United States Patent 11,459,587 (MATERIALS AND METHODS FOR TREATMENT OF PAIN RELATED DISORDERS) - sequence listing, part 5

SEQ ID NO: 57700 - DNA, 20 bp, Artificial Sequence
  Description of Artificial Sequence: Synthetic oligonucleotide
  Target: SCN9A; (-) strand; PAM type: YTN; PAM sequence: TTC
agttagaataaccataggtg

SEQ ID NO: 57701 - DNA, 20 bp, Artificial Sequence
  Description of Artificial Sequence: Synthetic oligonucleotide
  Target: SCN9A; (-) strand; PAM type: YTN; PAM sequence: TTT
cagttagaataaccataggt

SEQ ID NO: 57702 - DNA, 20 bp, Artificial Sequence
  Description of Artificial Sequence: Synthetic oligonucleotide
  Target: SCN9A; (-) strand; PAM type: YTN; PAM sequence: CTG
tttcagttagaataaccata

SEQ ID NO: 57703 - DNA, 20 bp, Artificial Sequence
  Description of Artificial Sequence: Synthetic oligonucleotide
  Target: SCN9A; (-) strand; PAM type: YTN; PAM sequence: TTC
tgtttcagttagaataacca

SEQ ID NO: 57704 - DNA, 20 bp, Artificial Sequence
  Description of Artificial Sequence: Synthetic oligonucleotide
  Target: SCN9A; (-) strand; PAM type: YTN; PAM sequence: TTT
ctgtttcagttagaataacc

SEQ ID NO: 57705 - DNA, 20 bp, Artificial Sequence
  Description of Artificial Sequence: Synthetic oligonucleotide
  Target: SCN9A; (-) strand; PAM type: YTN; PAM sequence: TTT
tctgtttcagttagaataac

SEQ ID NO: 57706 - DNA, 20 bp, Artificial Sequence
  Description of Artificial Sequence: Synthetic oligonucleotide
  Target: SCN9A; (-) strand; PAM type: YTN; PAM sequence: TTA
cacgtattttctgtttcagt

SEQ ID NO: 57707 - DNA, 20 bp, Artificial Sequence
  Description of Artificial Sequence: Synthetic oligonucleotide
  Target: SCN9A; (-) strand; PAM type: YTN; PAM sequence: TTT
acacgtattttctgtttcag

SEQ ID NO: 57708 - DNA, 20 bp, Artificial Sequence
  Description of Artificial Sequence: Synthetic oligonucleotide
  Target: SCN9A; (-) strand; PAM type: YTN; PAM sequence: TTA
tgtttacacgtattttctgt

SEQ ID NO: 57709 - DNA, 20 bp, Artificial Sequence
  Description of Artificial Sequence: Synthetic oligonucleotide
  Target: SCN9A; (-) strand; PAM type: YTN; PAM sequence: TTA
tacaaaataaaattatgttt

SEQ ID NO: 57710 - DNA, 20 bp, Artificial Sequence
  Description of Artificial Sequence: Synthetic oligonucleotide
  Target: SCN9A; (-) strand; PAM type: YTN; PAM sequence: CTA
agaataaaagttatacaaaa

SEQ ID NO: 57711 - DNA, 20 bp, Artificial Sequence
  Description of Artificial Sequence: Synthetic oligonucleotide
  Target: SCN9A; (-) strand; PAM type: YTN; PAM sequence: TTG
taatataatctaagaataaa

SEQ ID NO: 57712 - DNA, 20 bp, Artificial Sequence
  Description of Artificial Sequence: Synthetic oligonucleotide
  Target: SCN9A; (-) strand; PAM type: YTN; PAM sequence: CTG
acacattgtaatataatcta

SEQ ID NO: 57713 - DNA, 20 bp, Artificial Sequence
  Description of Artificial Sequence: Synthetic oligonucleotide
  Target: SCN9A; (-) strand; PAM type: YTN; PAM sequence: TTG
agactgacacattgtaatat

SEQ ID NO: 57714 - DNA, 20 bp, Artificial Sequence
  Description of Artificial Sequence: Synthetic oligonucleotide
  Target: SCN9A; (-) strand; PAM type: YTN; PAM sequence: CTT
gagactgacacattgtaata

SEQ ID NO: 57715 - DNA, 20 bp, Artificial Sequence
  Description of Artificial Sequence: Synthetic oligonucleotide
  Target: SCN9A; (-) strand; PAM type: YTN; PAM sequence: TTA
tacttgagactgacacattg

SEQ ID NO: 57716 - DNA, 20 bp, Artificial Sequence
  Description of Artificial Sequence: Synthetic oligonucleotide
  Target: SCN9A; (-) strand; PAM type: YTN; PAM sequence: TTG
tagttatacttgagactgac

SEQ ID NO: 57717 - DNA, 20 bp, Artificial Sequence
  Description of Artificial Sequence: Synthetic oligonucleotide
  Target: SCN9A; (-) strand; PAM type: YTN; PAM sequence: TTA
tattgtagttatacttgaga

SEQ ID NO: 57718 - DNA, 20 bp, Artificial Sequence
  Description of Artificial Sequence: Synthetic oligonucleotide
  Target: SCN9A; (-) strand; PAM type: YTN; PAM sequence: TTG
tagttatattgtagttatac

SEQ ID NO: 57719 - DNA, 20 bp, Artificial Sequence
  Description of Artificial Sequence: Synthetic oligonucleotide
  Target: SCN9A; (-) strand; PAM type: YTN; PAM sequence: TTA
tattgtagttatattgtagt

SEQ ID NO: 57720 - DNA, 20 bp, Artificial Sequence
  Description of Artificial Sequence: Synthetic oligonucleotide
  Target: SCN9A; (-) strand; PAM type: YTN; PAM sequence: TTG
ccataaattatattgtagtt

SEQ ID NO: 57721 - DNA, 20 bp, Artificial Sequence
  Description of Artificial Sequence: Synthetic oligonucleotide
  Target: SCN9A; (-) strand; PAM type: YTN; PAM sequence: TTT
gccataaattatattgtagt

SEQ ID NO: 57722 - DNA, 20 bp, Artificial Sequence
  Description of Artificial Sequence: Synthetic oligonucleotide
  Target: SCN9A; (-) strand; PAM type: YTN; PAM sequence: TTG
agtttgccataaattatatt

SEQ ID NO: 57723 - DNA, 20 bp, Artificial Sequence
  Description of Artificial Sequence: Synthetic oligonucleotide
  Target: SCN9A; (-) strand; PAM type: YTN; PAM sequence: TTT
gagtttgccataaattatat

SEQ ID NO: 57724 - DNA, 20 bp, Artificial Sequence
  Description of Artificial Sequence: Synthetic oligonucleotide
  Target: SCN9A; (-) strand; PAM type: YTN; PAM sequence: CTC
aaaatgtttgagtttgccat

SEQ ID NO: 57725 - DNA, 20 bp, Artificial Sequence
  Description of Artificial Sequence: Synthetic oligonucleotide
  Target: SCN9A; (-) strand; PAM type: YTN; PAM sequence: CTA
tgaatgctcaaaatgtttga

SEQ ID NO: 57726 - DNA, 20 bp, Artificial Sequence
  Description of Artificial Sequence: Synthetic oligonucleotide
  Target: SCN9A; (-) strand; PAM type: YTN; PAM sequence: TTC
atagatctatgaatgctcaa

SEQ ID NO: 57727 - DNA, 20 bp, Artificial Sequence
  Description of Artificial Sequence: Synthetic oligonucleotide
  Target: SCN9A; (-) strand; PAM type: YTN; PAM sequence: TTT
catagatctatgaatgctca

SEQ ID NO: 57728 - DNA, 20 bp, Artificial Sequence
  Description of Artificial Sequence: Synthetic oligonucleotide
  Target: SCN9A; (-) strand; PAM type: YTN; PAM sequence: TTA
caaatttcatagatctatga

SEQ ID NO: 57729 - DNA, 20 bp, Artificial Sequence
  Description of Artificial Sequence: Synthetic oligonucleotide
  Target: SCN9A; (-) strand; PAM type: YTN; PAM sequence: TTT
acaaatttcatagatctatg

SEQ ID NO: 57730 - DNA, 20 bp, Artificial Sequence
  Description of Artificial Sequence: Synthetic oligonucleotide
  Target: SCN9A; (-) strand; PAM type: YTN; PAM sequence: CTT
tacaaatttcatagatctat

SEQ ID NO: 57731 - DNA, 20 bp, Artificial Sequence
  Description of Artificial Sequence: Synthetic oligonucleotide
  Target: SCN9A; (-) strand; PAM type: YTN; PAM sequence: TTC
tttacaaatttcatagatct

SEQ ID NO: 57732 - DNA, 20 bp, Artificial Sequence
  Description of Artificial Sequence: Synthetic oligonucleotide
  Target: SCN9A; (-) strand; PAM type: YTN; PAM sequence: TTA
cataggattctttacaaatt

SEQ ID NO: 57733 - DNA, 20 bp, Artificial Sequence
  Description of Artificial Sequence: Synthetic oligonucleotide
  Target: SCN9A; (-) strand; PAM type: YTN; PAM sequence: TTT
acataggattctttacaaat

SEQ ID NO: 57734 - DNA, 20 bp, Artificial Sequence
  Description of Artificial Sequence: Synthetic oligonucleotide
  Target: SCN9A; (-) strand; PAM type: YTN; PAM sequence: CTG
tttacataggattctttaca

SEQ ID NO: 57735 - DNA, 20 bp, Artificial Sequence
  Description of Artificial Sequence: Synthetic oligonucleotide
  Target: SCN9A; (-) strand; PAM type: YTN; PAM sequence: TTC
atgaaaataaataaatagcc

SEQ ID NO: 57736 - DNA, 20 bp, Artificial Sequence
  Description of Artificial Sequence: Synthetic oligonucleotide
  Target: SCN9A; (-) strand; PAM type: YTN; PAM sequence: CTT
catgaaaataaataaatagc

SEQ ID NO: 57737 - DNA, 20 bp, Artificial Sequence
  Description of Artificial Sequence: Synthetic oligonucleotide
  Target: SCN9A; (-) strand; PAM type: YTN; PAM sequence: TTG
cttcatgaaaataaataaat

SEQ ID NO: 57738 - DNA, 20 bp, Artificial Sequence
  Description of Artificial Sequence: Synthetic oligonucleotide
  Target: SCN9A; (-) strand; PAM type: YTN; PAM sequence: TTG
aggaaaacaatcaagaattg

SEQ ID NO: 57739 - DNA, 20 bp, Artificial Sequence
  Description of Artificial Sequence: Synthetic oligonucleotide
  Target: SCN9A; (-) strand; PAM type: YTN; PAM sequence: CTT
gaggaaaacaatcaagaatt

SEQ ID NO: 57740 - DNA, 20 bp, Artificial Sequence
  Description of Artificial Sequence: Synthetic oligonucleotide
  Target: SCN9A; (-) strand; PAM type: YTN; PAM sequence: TTC
ttgaggaaaacaatcaagaa

SEQ ID NO: 57741 - DNA, 20 bp, Artificial Sequence
  Description of Artificial Sequence: Synthetic oligonucleotide
  Target: SCN9A; (-) strand; PAM type: YTN; PAM sequence: CTT
cttgaggaaaacaatcaaga

SEQ ID NO: 57742 - DNA, 20 bp, Artificial Sequence
  Description of Artificial Sequence: Synthetic oligonucleotide
  Target: SCN9A; (-) strand; PAM type: YTN; PAM sequence: TTA
tcttcttgaggaaaacaatc

SEQ ID NO: 57743 - DNA, 20 bp, Artificial Sequence
  Description of Artificial Sequence: Synthetic oligonucleotide
  Target: SCN9A; (-) strand; PAM type: YTN; PAM sequence: TTA
ttatcttcttgaggaaaaca

SEQ ID NO: 57744 - DNA, 20 bp, Artificial Sequence
  Description of Artificial Sequence: Synthetic oligonucleotide
  Target: SCN9A; (-) strand; PAM type: YTN; PAM sequence: TTA
tgttattatcttcttgagga

SEQ ID NO: 57745 - DNA, 20 bp, Artificial Sequence
  Description of Artificial Sequence: Synthetic oligonucleotide
  Target: SCN9A; (-) strand; PAM type: YTN; PAM sequence: TTA
ttatgttattatcttcttga

SEQ ID NO: 57746 - DNA, 20 bp, Artificial Sequence
  Description of Artificial Sequence: Synthetic oligonucleotide
  Target: SCN9A; (-) strand; PAM type: YTN; PAM sequence: TTT
attatgttattatcttcttg

SEQ ID NO: 57747 - DNA, 20 bp, Artificial Sequence
  Description of Artificial Sequence: Synthetic oligonucleotide
  Target: SCN9A; (-) strand; PAM type: YTN; PAM sequence: CTG
tggtttattatgttattatc

SEQ ID NO: 57748 - DNA, 20 bp, Artificial Sequence
  Description of Artificial Sequence: Synthetic oligonucleotide
  Target: SCN9A; (-) strand; PAM type: YTN; PAM sequence: TTA
aaaatatctgtggtttatta

SEQ ID NO: 57749 - DNA, 20 bp, Artificial Sequence
  Description of Artificial Sequence: Synthetic oligonucleotide
  Target: SCN9A; (-) strand; PAM type: YTN; PAM sequence: TTT
aaaaatatctgtggtttatt

SEQ ID NO: 57750 - DNA, 20 bp, Artificial Sequence
  Description of Artificial Sequence: Synthetic oligonucleotide
  Target: SCN9A; (-) strand; PAM type: YTN; PAM sequence: TTT
taaaaatatctgtggtttat

SEQ ID NO: 57751 - DNA, 20 bp, Artificial Sequence
  Description of Artificial Sequence: Synthetic oligonucleotide
  Target: SCN9A; (-) strand; PAM type: YTN; PAM sequence: TTT
ttaaaaatatctgtggttta

SEQ ID NO: 57752 - DNA, 20 bp, Artificial Sequence
  Description of Artificial Sequence: Synthetic oligonucleotide
  Target: SCN9A; (-) strand; PAM type: YTN; PAM sequence: TTT
tttaaaaatatctgtggttt

SEQ ID NO: 57753 - DNA, 20 bp, Artificial Sequence
  Description of Artificial Sequence: Synthetic oligonucleotide
  Target: SCN9A; (-) strand; PAM type: YTN; PAM sequence: CTA
tgtatgaaggccaccaattt

SEQ ID NO: 57754 - DNA, 20 bp, Artificial Sequence
  Description of Artificial Sequence: Synthetic oligonucleotide
  Target: SCN9A; (-) strand; PAM type: YTN; PAM sequence: TTA
ggacctatgtatgaaggcca

SEQ ID NO: 57755 - DNA, 20 bp, Artificial Sequence
  Description of Artificial Sequence: Synthetic oligonucleotide
  Target: SCN9A; (-) strand; PAM type: YTN; PAM sequence: TTT
aggacctatgtatgaaggcc

SEQ ID NO: 57756 - DNA, 20 bp, Artificial Sequence
  Description of Artificial Sequence: Synthetic oligonucleotide
  Target: SCN9A; (-) strand; PAM type: YTN; PAM sequence: CTG
ggtttaggacctatgtatga

SEQ ID NO: 57757 - DNA, 20 bp, Artificial Sequence
  Description of Artificial Sequence: Synthetic oligonucleotide
  Target: SCN9A; (-) strand; PAM type: YTN; PAM sequence: TTG
gcctgggtttaggacctatg

SEQ ID NO: 57758 - DNA, 20 bp, Artificial Sequence
  Description of Artificial Sequence: Synthetic oligonucleotide
  Target: SCN9A; (-) strand; PAM type: YTN; PAM sequence: TTA
ggatggccagggaattggcc

SEQ ID NO: 57759 - DNA, 20 bp, Artificial Sequence
  Description of Artificial Sequence: Synthetic oligonucleotide
  Target: SCN9A; (-) strand; PAM type: YTN; PAM sequence: CTA
aattaggatggccagggaat

SEQ ID NO: 57760 - DNA, 20 bp, Artificial Sequence
  Description of Artificial Sequence: Synthetic oligonucleotide
  Target: SCN9A; (-) strand; PAM type: YTN; PAM sequence: CTG
aaagaagggccaactaaatt

SEQ ID NO: 57761 - DNA, 20 bp, Artificial Sequence
  Description of Artificial Sequence: Synthetic oligonucleotide
  Target: SCN9A; (-) strand; PAM type: YTN; PAM sequence: TTA
atagaagtgctgaaagaagg

SEQ ID NO: 57762 - DNA, 20 bp, Artificial Sequence
  Description of Artificial Sequence: Synthetic oligonucleotide
  Target: SCN9A; (-) strand; PAM type: YTN; PAM sequence: TTC
agagaaatgttaatagaagt

SEQ ID NO: 57763 - DNA, 20 bp, Artificial Sequence
  Description of Artificial Sequence: Synthetic oligonucleotide
  Target: SCN9A; (-) strand; PAM type: YTN; PAM sequence: TTT
cagagaaatgttaatagaag

SEQ ID NO: 57764 - DNA, 20 bp, Artificial Sequence
  Description of Artificial Sequence: Synthetic oligonucleotide
  Target: SCN9A; (-) strand; PAM type: YTN; PAM sequence: CTA
tttcagagaaatgttaatag

SEQ ID NO: 57765 - DNA, 20 bp, Artificial Sequence
  Description of Artificial Sequence: Synthetic oligonucleotide
  Target: SCN9A; (-) strand; PAM type: YTN; PAM sequence: CTA
aatagctatttcagagaaat

SEQ ID NO: 57766 - DNA, 20 bp, Artificial Sequence
  Description of Artificial Sequence: Synthetic oligonucleotide
  Target: SCN9A; (-) strand; PAM type: YTN; PAM sequence: TTC
taaatagctatttcagagaa

SEQ ID NO: 57767 - DNA, 20 bp, Artificial Sequence
  Description of Artificial Sequence: Synthetic oligonucleotide
  Target: SCN9A; (-) strand; PAM type: YTN; PAM sequence: TTA
aaaagagtgaaaataaaatg

SEQ ID NO: 57768 - DNA, 20 bp, Artificial Sequence
  Description of Artificial Sequence: Synthetic oligonucleotide
  Target: SCN9A; (-) strand; PAM type: YTN; PAM sequence: TTA
ttaaaaagagtgaaaataaa

SEQ ID NO: 57769 - DNA, 20 bp, Artificial Sequence
  Description of Artificial Sequence: Synthetic oligonucleotide
  Target: SCN9A; (-) strand; PAM type: YTN; PAM sequence: TTT
attaaaaagagtgaaaataa

SEQ ID NO: 57770 - DNA, 20 bp, Artificial Sequence
  Description of Artificial Sequence: Synthetic oligonucleotide
  Target: SCN9A; (-) strand; PAM type: YTN; PAM sequence: CTT
tattaaaaagagtgaaaata

SEQ ID NO: 57771 - DNA, 20 bp, Artificial Sequence
  Description of Artificial Sequence: Synthetic oligonucleotide
  Target: SCN9A; (-) strand; PAM type: YTN; PAM sequence: TTG
atagctttattaaaaagagt

SEQ ID NO: 57772 - DNA, 20 bp, Artificial Sequence
  Description of Artificial Sequence: Synthetic oligonucleotide
  Target: SCN9A; (-) strand; PAM type: YTN; PAM sequence: TTT
gatagctttattaaaaagag

SEQ ID NO: 57773 - DNA, 20 bp, Artificial Sequence
  Description of Artificial Sequence: Synthetic oligonucleotide
  Target: SCN9A; (-) strand; PAM type: YTN; PAM sequence: TTT
tgatagctttattaaaaaga

SEQ ID NO: 57774 - DNA, 20 bp, Artificial Sequence
  Description of Artificial Sequence: Synthetic oligonucleotide
  Target: SCN9A; (-) strand; PAM type: YTN; PAM sequence: TTA
tagagttttgatagctttat

SEQ ID NO: 57775 - DNA, 20 bp, Artificial Sequence
  Description of Artificial Sequence: Synthetic oligonucleotide
  Target: SCN9A; (-) strand; PAM type: YTN; PAM sequence: TTT
atagagttttgatagcttta

SEQ ID NO: 57776 - DNA, 20 bp, Artificial Sequence
  Description of Artificial Sequence: Synthetic oligonucleotide
  Target: SCN9A; (-) strand; PAM type: YTN; PAM sequence: TTT
tatagagttttgatagcttt

SEQ ID NO: 57777 - DNA, 20 bp, Artificial Sequence
  Description of Artificial Sequence: Synthetic oligonucleotide
  Target: SCN9A; (-) strand; PAM type: YTN; PAM sequence: TTA
gcatgattttatagagtttt

SEQ ID NO: 57778 - DNA, 20 bp, Artificial Sequence
  Description of Artificial Sequence: Synthetic oligonucleotide
  Target: SCN9A; (-) strand; PAM type: YTN; PAM sequence: CTT
agcatgattttatagagttt

SEQ ID NO: 57779 - DNA, 20 bp, Artificial Sequence
  Description of Artificial Sequence: Synthetic oligonucleotide
  Target: SCN9A; (-) strand; PAM type: YTN; PAM sequence: TTG
aacatcacaacccaaaatac

SEQ ID NO: 57780 - DNA, 20 bp, Artificial Sequence
  Description of Artificial Sequence: Synthetic oligonucleotide
  Target: SCN9A; (-) strand; PAM type: YTN; PAM sequence: TTG
ttgaacatcacaacccaaaa

SEQ ID NO: 57781 - DNA, 20 bp, Artificial Sequence
  Description of Artificial Sequence: Synthetic oligonucleotide
  Target: SCN9A; (-) strand; PAM type: YTN; PAM sequence: CTG
attgttgaacatcacaaccc

SEQ ID NO: 57782 - DNA, 20 bp, Artificial Sequence
  Description of Artificial Sequence: Synthetic oligonucleotide
  Target: SCN9A; (-) strand; PAM type: YTN; PAM sequence: TTA
aatgctgattgttgaacatc

SEQ ID NO: 57783 - DNA, 20 bp, Artificial Sequence
  Description of Artificial Sequence: Synthetic oligonucleotide
  Target: SCN9A; (-) strand; PAM type: YTN; PAM sequence: TTT
aaatgctgattgttgaacat

SEQ ID NO: 57784 - DNA, 20 bp, Artificial Sequence
  Description of Artificial Sequence: Synthetic oligonucleotide
  Target: SCN9A; (-) strand; PAM type: YTN; PAM sequence: TTT
taaatgctgattgttgaaca

SEQ ID NO: 57785 - DNA, 20 bp, Artificial Sequence
  Description of Artificial Sequence: Synthetic oligonucleotide
  Target: SCN9A; (-) strand; PAM type: YTN; PAM sequence: TTT
ttaaatgctgattgttgaac

SEQ ID NO: 57786 - DNA, 20 bp, Artificial Sequence
  Description of Artificial Sequence: Synthetic oligonucleotide
  Target: SCN9A; (-) strand; PAM type: YTN; PAM sequence: CTG
tttttaaatgctgattgttg

SEQ ID NO: 57787 - DNA, 20 bp, Artificial Sequence
  Description of Artificial Sequence: Synthetic oligonucleotide
  Target: SCN9A; (-) strand; PAM type: YTN; PAM sequence: TTG
tgagctgtttttaaatgctg

SEQ ID NO: 57788 - DNA, 20 bp, Artificial Sequence
  Description of Artificial Sequence: Synthetic oligonucleotide
  Target: SCN9A; (-) strand; PAM type: YTN; PAM sequence: CTT
gtgagctgtttttaaatgct

SEQ ID NO: 57789 - DNA, 20 bp, Artificial Sequence
  Description of Artificial Sequence: Synthetic oligonucleotide
  Target: SCN9A; (-) strand; PAM type: YTN; PAM sequence: TTG
ggtgacttgtgagctgtttt

SEQ ID NO: 57790 - DNA, 20 bp, Artificial Sequence
  Description of Artificial Sequence: Synthetic oligonucleotide
  Target: SCN9A; (-) strand; PAM type: YTN; PAM sequence: TTT
gggtgacttgtgagctgttt

SEQ ID NO: 57791 - DNA, 20 bp, Artificial Sequence
  Description of Artificial Sequence: Synthetic oligonucleotide
  Target: SCN9A; (-) strand; PAM type: YTN; PAM sequence: TTG
caaaagatttgggtgacttg

SEQ ID NO: 57792 - DNA, 20 bp, Artificial Sequence
  Description of Artificial Sequence: Synthetic oligonucleotide
  Target: SCN9A; (-) strand; PAM type: YTN; PAM sequence: TTT
gcaaaagatttgggtgactt

SEQ ID NO: 57793 - DNA, 20 bp, Artificial Sequence
  Description of Artificial Sequence: Synthetic oligonucleotide
  Target: SCN9A; (-) strand; PAM type: YTN; PAM sequence: CTA
gtttgcaaaagatttgggtg

SEQ ID NO: 57794 - DNA, 20 bp, Artificial Sequence
  Description of Artificial Sequence: Synthetic oligonucleotide
  Target: SCN9A; (-) strand; PAM type: YTN; PAM sequence: TTA
cctagtttgcaaaagatttg

SEQ ID NO: 57795 - DNA, 20 bp, Artificial Sequence
  Description of Artificial Sequence: Synthetic oligonucleotide
  Target: SCN9A; (-) strand; PAM type: YTN; PAM sequence: TTG
atagttacctagtttgcaaa

SEQ ID NO: 57796 - DNA, 20 bp, Artificial Sequence
  Description of Artificial Sequence: Synthetic oligonucleotide
  Target: SCN9A; (-) strand; PAM type: YTN; PAM sequence: TTT
gatagttacctagtttgcaa

SEQ ID NO: 57797 - DNA, 20 bp, Artificial Sequence
  Description of Artificial Sequence: Synthetic oligonucleotide
  Target: SCN9A; (-) strand; PAM type: YTN; PAM sequence: TTT
tgatagttacctagtttgca

SEQ ID NO: 57798 - DNA, 20 bp, Artificial Sequence
  Description of Artificial Sequence: Synthetic oligonucleotide
  Target: SCN9A; (-) strand; PAM type: YTN; PAM sequence: TTT
ttgatagttacctagtttgc

SEQ ID NO: 57799 - DNA, 20 bp, Artificial Sequence
  Description of Artificial Sequence: Synthetic oligonucleotide
  Target: SCN9A; (-) strand; PAM type: YTN; PAM sequence: CTT
tttgatagttacctagtttg

SEQ ID NO: 57800 - DNA, 20 bp, Artificial Sequence
  Description of Artificial Sequence: Synthetic oligonucleotide
  Target: SCN9A; (-) strand; PAM type: YTN; PAM sequence: TTA
gctttttgatagttacctag

SEQ ID NO: 57801 - DNA, 20 bp, Artificial Sequence
  Description of Artificial Sequence: Synthetic oligonucleotide
  Target: SCN9A; (-) strand; PAM type: YTN; PAM sequence: TTT
agctttttgatagttaccta

SEQ ID NO: 57802 - DNA, 20 bp, Artificial Sequence
  Description of Artificial Sequence: Synthetic oligonucleotide
  Target: SCN9A; (-) strand; PAM type: YTN; PAM sequence: TTT
tagctttttgatagttacct

SEQ ID NO: 57803 - DNA, 20 bp, Artificial Sequence
  Description of Artificial Sequence: Synthetic oligonucleotide
  Target: SCN9A; (-) strand; PAM type: YTN; PAM sequence: CTA
attttagctttttgatagtt

SEQ ID NO: 57804 - DNA, 20 bp, Artificial Sequence
  Description of Artificial Sequence: Synthetic oligonucleotide
  Target: SCN9A; (-) strand; PAM type: YTN; PAM sequence: TTA
gagaacctaattttagcttt

SEQ ID NO: 57805 - DNA, 20 bp, Artificial Sequence
  Description of Artificial Sequence: Synthetic oligonucleotide
  Target: SCN9A; (-) strand; PAM type: YTN; PAM sequence: TTC
ggatgaaaattagagaacct

SEQ ID NO: 57806 - DNA, 20 bp, Artificial Sequence
  Description of Artificial Sequence: Synthetic oligonucleotide
  Target: SCN9A; (-) strand; PAM type: YTN; PAM sequence: TTT
cggatgaaaattagagaacc

SEQ ID NO: 57807 - DNA, 20 bp, Artificial Sequence
  Description of Artificial Sequence: Synthetic oligonucleotide
  Target: SCN9A; (-) strand; PAM type: YTN; PAM sequence: CTT
tcggatgaaaattagagaac

SEQ ID NO: 57808 - DNA, 20 bp, Artificial Sequence
  Description of Artificial Sequence: Synthetic oligonucleotide
  Target: SCN9A; (-) strand; PAM type: YTN; PAM sequence: TTG
aacacaaatctttcggatga

SEQ ID NO: 57809 - DNA, 20 bp, Artificial Sequence
  Description of Artificial Sequence: Synthetic oligonucleotide
  Target: SCN9A; (-) strand; PAM type: YTN; PAM sequence: TTT
gaacacaaatctttcggatg

SEQ ID NO: 57810 - DNA, 20 bp, Artificial Sequence
  Description of Artificial Sequence: Synthetic oligonucleotide
  Target: SCN9A; (-) strand; PAM type: YTN; PAM sequence: TTA
caggcatgagccaccatgcc

SEQ ID NO: 57811 - DNA, 20 bp, Artificial Sequence
  Description of Artificial Sequence: Synthetic oligonucleotide
  Target: SCN9A; (-) strand; PAM type: YTN; PAM sequence: CTG
gggttacaggcatgagccac

SEQ ID NO: 57812 - DNA, 20 bp, Artificial Sequence
  Description of Artificial Sequence: Synthetic oligonucleotide
  Target: SCN9A; (-) strand; PAM type: YTN; PAM sequence: CTG
ccaacatgctggggttacag

SEQ ID NO: 57813 - DNA, 20 bp, Artificial Sequence
  Description of Artificial Sequence: Synthetic oligonucleotide
  Target: SCN9A; (-) strand; PAM type: YTN; PAM sequence: CTG
tcatgacctgccaacatgct

SEQ ID NO: 57814 - DNA, 20 bp, Artificial Sequence
  Description of Artificial Sequence: Synthetic oligonucleotide
  Target: SCN9A; (-) strand; PAM type: YTN; PAM sequence: CTA
ctgtcatgacctgccaacat

SEQ ID NO: 57815 - DNA, 20 bp, Artificial Sequence
  Description of Artificial Sequence: Synthetic oligonucleotide
  Target: SCN9A; (-) strand; PAM type: YTN; PAM sequence: TTC
ctactgtcatgacctgccaa

SEQ ID NO: 57816 - DNA, 20 bp, Artificial Sequence
  Description of Artificial Sequence: Synthetic oligonucleotide
  Target: SCN9A; (-) strand; PAM type: YTN; PAM sequence: TTC
aagtgttcctactgtcatga

SEQ ID NO: 57817 - DNA, 20 bp, Artificial Sequence
  Description of Artificial Sequence: Synthetic oligonucleotide
  Target: SCN9A; (-) strand; PAM type: YTN; PAM sequence: CTT
caagtgttcctactgtcatg

SEQ ID NO: 57818 - DNA, 20 bp, Artificial Sequence
  Description of Artificial Sequence: Synthetic oligonucleotide
  Target: SCN9A; (-) strand; PAM type: YTN; PAM sequence: CTG
gcttcaagtgttcctactgt

SEQ ID NO: 57819 - DNA, 20 bp, Artificial Sequence
  Description of Artificial Sequence: Synthetic oligonucleotide
  Target: SCN9A; (-) strand; PAM type: YTN; PAM sequence: CTC
ctggcttcaagtgttcctac

SEQ ID NO: 57820 - DNA, 20 bp, Artificial Sequence
  Description of Artificial Sequence: Synthetic oligonucleotide
  Target: SCN9A; (-) strand; PAM type: YTN; PAM sequence: CTC
aaactcctggcttcaagtgt

SEQ ID NO: 57821 - DNA, 20 bp, Artificial Sequence
  Description of Artificial Sequence: Synthetic oligonucleotide
  Target: SCN9A; (-) strand; PAM type: YTN; PAM sequence: CTA
gtctcaaactcctggcttca

SEQ ID NO: 57822 - DNA, 20 bp, Artificial Sequence
  Description of Artificial Sequence: Synthetic oligonucleotide
  Target: SCN9A; (-) strand; PAM type: YTN; PAM sequence: TTG
cccaggctagtctcaaactc

SEQ ID NO: 57823 - DNA, 20 bp, Artificial Sequence
  Description of Artificial Sequence: Synthetic oligonucleotide
  Target: SCN9A; (-) strand; PAM type: YTN; PAM sequence: CTA
tgttgcccaggctagtctca

SEQ ID NO: 57824 - DNA, 20 bp, Artificial Sequence
  Description of Artificial Sequence: Synthetic oligonucleotide
  Target: SCN9A; (-) strand; PAM type: YTN; PAM sequence: TTG
ctatgttgcccaggctagtc

SEQ ID NO: 57825 - DNA, 20 bp, Artificial Sequence
  Description of Artificial Sequence: Synthetic oligonucleotide
  Target: SCN9A; (-) strand; PAM type: YTN; PAM sequence: CTT
gctatgttgcccaggctagt

SEQ ID NO: 57826 - DNA, 20 bp, Artificial Sequence
  Description of Artificial Sequence: Synthetic oligonucleotide
  Target: SCN9A; (-) strand; PAM type: YTN; PAM sequence: TTG
tagataaggggtcttgctat

SEQ ID NO: 57827 - DNA, 20 bp, Artificial Sequence
  Description of Artificial Sequence: Synthetic oligonucleotide
  Target: SCN9A; (-) strand; PAM type: YTN; PAM sequence: TTT
gtagataaggggtcttgcta

SEQ ID NO: 57828 - DNA, 20 bp, Artificial Sequence
  Description of Artificial Sequence: Synthetic oligonucleotide
  Target: SCN9A; (-) strand; PAM type: YTN; PAM sequence: TTT
tgtagataaggggtcttgct

SEQ ID NO: 57829 - DNA, 20 bp, Artificial Sequence
  Description of Artificial Sequence: Synthetic oligonucleotide
  Target: SCN9A; (-) strand; PAM type: YTN; PAM sequence: TTT
ttgtagataaggggtcttgc

SEQ ID NO: 57830 - DNA, 20 bp, Artificial Sequence
  Description of Artificial Sequence: Synthetic oligonucleotide
  Target: SCN9A; (-) strand; PAM type: YTN; PAM sequence: TTA
aatttttgtagataaggggt

SEQ ID NO: 57831 - DNA, 20 bp, Artificial Sequence
  Description of Artificial Sequence: Synthetic oligonucleotide
  Target: SCN9A; (-) strand; PAM type: YTN; PAM sequence: TTT
aaatttttgtagataagggg

SEQ ID NO: 57832 - DNA, 20 bp, Artificial Sequence
  Description of Artificial Sequence: Synthetic oligonucleotide
  Target: SCN9A; (-) strand; PAM type: YTN; PAM sequence: CTA
atatttaaatttttgtagat

SEQ ID NO: 57833 - DNA, 20 bp, Artificial Sequence
  Description of Artificial Sequence: Synthetic oligonucleotide
  Target: SCN9A; (-) strand; PAM type: YTN; PAM sequence: CTG
gctaatatttaaatttttgt

SEQ ID NO: 57834 - DNA, 20 bp, Artificial Sequence
  Description of Artificial Sequence: Synthetic oligonucleotide
  Target: SCN9A; (-) strand; PAM type: YTN; PAM sequence: CTA
caggtacatgccaccatgcc

SEQ ID NO: 57835 - DNA, 20 bp, Artificial Sequence
  Description of Artificial Sequence: Synthetic oligonucleotide
  Target: SCN9A; (-) strand; PAM type: YTN; PAM sequence: CTA
agactacaggtacatgccac

SEQ ID NO: 57836 - DNA, 20 bp, Artificial Sequence
  Description of Artificial Sequence: Synthetic oligonucleotide
  Target: SCN9A; (-) strand; PAM type: YTN; PAM sequence: CTC
ccaagtagctaagactacag

SEQ ID NO: 57837 - DNA, 20 bp, Artificial Sequence
  Description of Artificial Sequence: Synthetic oligonucleotide
  Target: SCN9A; (-) strand; PAM type: YTN; PAM sequence: CTC
agcctcccaagtagctaaga

SEQ ID NO: 57838 - DNA, 20 bp, Artificial Sequence
  Description of Artificial Sequence: Synthetic oligonucleotide
  Target: SCN9A; (-) strand; PAM type: YTN; PAM sequence: CTG
cctcagcctcccaagtagct

SEQ ID NO: 57839 - DNA, 20 bp, Artificial Sequence
  Description of Artificial Sequence: Synthetic oligonucleotide
  Target: SCN9A; (-) strand; PAM type: YTN; PAM sequence: CTC
ctgcctcagcctcccaagta

SEQ ID NO: 57840 - DNA, 20 bp, Artificial Sequence
  Description of Artificial Sequence: Synthetic oligonucleotide
  Target: SCN9A; (-) strand; PAM type: YTN; PAM sequence: CTC
aagcaaccctcctgcctcag

SEQ ID NO: 57841 - DNA, 20 bp, Artificial Sequence
  Description of Artificial Sequence: Synthetic oligonucleotide
  Target: SCN9A; (-) strand; PAM type: YTN; PAM sequence: CTG
ggctcaagcaaccctcctgc

SEQ ID NO: 57842 - DNA, 20 bp, Artificial Sequence
  Description of Artificial Sequence: Synthetic oligonucleotide
  Target: SCN9A; (-) strand; PAM type: YTN; PAM sequence: CTC
tgggctcaagcaaccctcct

SEQ ID NO: 57843 - DNA, 20 bp, Artificial Sequence
  Description of Artificial Sequence: Synthetic oligonucleotide
  Target: SCN9A; (-) strand; PAM type: YTN; PAM sequence: CTC
aactctgggctcaagcaacc

SEQ ID NO: 57844 - DNA, 20 bp, Artificial Sequence
  Description of Artificial Sequence: Synthetic oligonucleotide
  Target: SCN9A; (-) strand; PAM type: YTN; PAM sequence: CTG
cagcctcaactctgggctca

SEQ ID NO: 57845 - DNA, 20 bp, Artificial Sequence
  Description of Artificial Sequence: Synthetic oligonucleotide
  Target: SCN9A; (-) strand; PAM type: YTN; PAM sequence: CTC
tgcagcctcaactctgggct

SEQ ID NO: 57846 - DNA, 20 bp, Artificial Sequence
  Description of Artificial Sequence: Synthetic oligonucleotide
  Target: SCN9A; (-) strand; PAM type: YTN; PAM sequence: CTC
tctgcagcctcaactctggg

SEQ ID NO: 57847 - DNA, 20 bp, Artificial Sequence
  Description of Artificial Sequence: Synthetic oligonucleotide
  Target: SCN9A; (-) strand; PAM type: YTN; PAM sequence: CTA
gagtgcaatggcatgatcat

SEQ ID NO: 57848 - DNA, 20 bp, Artificial Sequence
  Description of Artificial Sequence: Synthetic oligonucleotide
  Target: SCN9A; (-) strand; PAM type: YTN; PAM sequence: CTG
tcacccaggctagagtgcaa

SEQ ID NO: 57849 - DNA, 20 bp, Artificial Sequence
  Description of Artificial Sequence: Synthetic oligonucleotide
  Target: SCN9A; (-) strand; PAM type: YTN; PAM sequence: CTC
tgtcacccaggctagagtgc

SEQ ID NO: 57850 - DNA, 20 bp, Artificial Sequence
  Description of Artificial Sequence: Synthetic oligonucleotide
  Target: SCN9A; (-) strand; PAM type: YTN; PAM sequence: CTC
gctctgtcacccaggctaga

SEQ ID NO: 57851 - DNA, 20 bp, Artificial Sequence
  Description of Artificial Sequence: Synthetic oligonucleotide
  Target: SCN9A; (-) strand; PAM type: YTN; PAM sequence: TTA
agtgaccaggtctcgctctg

SEQ ID NO: 57852 - DNA, 20 bp, Artificial Sequence
  Description of Artificial Sequence: Synthetic oligonucleotide
  Target: SCN9A; (-) strand; PAM type: YTN; PAM sequence: TTT
aagtgaccaggtctcgctct

SEQ ID NO: 57853 - DNA, 20 bp, Artificial Sequence
  Description of Artificial Sequence: Synthetic oligonucleotide
  Target: SCN9A; (-) strand; PAM type: YTN; PAM sequence: TTT
taagtgaccaggtctcgctc

SEQ ID NO: 57854 - DNA, 20 bp, Artificial Sequence
  Description of Artificial Sequence: Synthetic oligonucleotide
  Target: SCN9A; (-) strand; PAM type: YTN; PAM sequence: TTT
ttaagtgaccaggtctcgct

SEQ ID NO: 57855 - DNA, 20 bp, Artificial Sequence
  Description of Artificial Sequence: Synthetic oligonucleotide
  Target: SCN9A; (-) strand; PAM type: YTN; PAM sequence: TTT
tttaagtgaccaggtctcgc

SEQ ID NO: 57856 - DNA, 20 bp, Artificial Sequence
  Description of Artificial Sequence: Synthetic oligonucleotide
  Target: SCN9A; (-) strand; PAM type: YTN; PAM sequence: CTT
ttttaagtgaccaggtctcg

SEQ ID NO: 57857 - DNA, 20 bp, Artificial Sequence
  Description of Artificial Sequence: Synthetic oligonucleotide
  Target: SCN9A; (-) strand; PAM type: YTN; PAM sequence: CTA
aaaacttttttaagtgacca

SEQ ID NO: 57858 - DNA, 20 bp, Artificial Sequence
  Description of Artificial Sequence: Synthetic oligonucleotide
  Target: SCN9A; (-) strand; PAM type: YTN; PAM sequence: TTC
taaaaacttttttaagtgac

SEQ ID NO: 57859 - DNA, 20 bp, Artificial Sequence
  Description of Artificial Sequence: Synthetic oligonucleotide
  Target: SCN9A; (-) strand; PAM type: YTN; PAM sequence: TTT
ctaaaaacttttttaagtga

SEQ ID NO: 57860 - DNA, 20 bp, Artificial Sequence
  Description of Artificial Sequence: Synthetic oligonucleotide
  Target: SCN9A; (-) strand; PAM type: YTN; PAM sequence: TTT
tctaaaaacttttttaagtg

SEQ ID NO: 57861 - DNA, 20 bp, Artificial Sequence
  Description of Artificial Sequence: Synthetic oligonucleotide
  Target: SCN9A; (-) strand; PAM type: YTN; PAM sequence: TTA
gaataaaatggaagcaaaca

SEQ ID NO: 57862 - DNA, 20 bp, Artificial Sequence
  Description of Artificial Sequence: Synthetic oligonucleotide
  Target: SCN9A; (-) strand; PAM type: YTN; PAM sequence: CTT
agaataaaatggaagcaaac

SEQ ID NO: 57863 - DNA, 20 bp, Artificial Sequence
  Description of Artificial Sequence: Synthetic oligonucleotide
  Target: SCN9A; (-) strand; PAM type: YTN; PAM sequence: TTA
acttagaataaaatggaagc

SEQ ID NO: 57864 - DNA, 20 bp, Artificial Sequence
  Description of Artificial Sequence: Synthetic oligonucleotide
  Target: SCN9A; (-) strand; PAM type: YTN; PAM sequence: CTT
aacttagaataaaatggaag

SEQ ID NO: 57865 - DNA, 20 bp, Artificial Sequence
  Description of Artificial Sequence: Synthetic oligonucleotide
  Target: SCN9A; (-) strand; PAM type: YTN; PAM sequence: CTG
aagaacttaacttagaataa

SEQ ID NO: 57866 - DNA, 20 bp, Artificial Sequence
  Description of Artificial Sequence: Synthetic oligonucleotide
  Target: SCN9A; (-) strand; PAM type: YTN; PAM sequence: TTA
cactgaagaacttaacttag

SEQ ID NO: 57867 - DNA, 20 bp, Artificial Sequence
  Description of Artificial Sequence: Synthetic oligonucleotide
  Target: SCN9A; (-) strand; PAM type: YTN; PAM sequence: TTA
cacccaacaatacagaaagg

SEQ ID NO: 57868 - DNA, 20 bp, Artificial Sequence
  Description of Artificial Sequence: Synthetic oligonucleotide
  Target: SCN9A; (-) strand; PAM type: YTN; PAM sequence: TTA
ttacacccaacaatacagaa

SEQ ID NO: 57869 - DNA, 20 bp, Artificial Sequence
  Description of Artificial Sequence: Synthetic oligonucleotide
  Target: SCN9A; (-) strand; PAM type: YTN; PAM sequence: CTT
attacacccaacaatacaga

SEQ ID NO: 57870 - DNA, 20 bp, Artificial Sequence
  Description of Artificial Sequence: Synthetic oligonucleotide
  Target: SCN9A; (-) strand; PAM type: YTN; PAM sequence: CTG
aacttattacacccaacaat

SEQ ID NO: 57871 - DNA, 20 bp, Artificial Sequence
  Description of Artificial Sequence: Synthetic oligonucleotide
  Target: SCN9A; (-) strand; PAM type: YTN; PAM sequence: TTA
taatcgctgaacttattaca

SEQ ID NO: 57872 - DNA, 20 bp, Artificial Sequence
  Description of Artificial Sequence: Synthetic oligonucleotide
  Target: SCN9A; (-) strand; PAM type: YTN; PAM sequence: TTT
ataatcgctgaacttattac

SEQ ID NO: 57873 - DNA, 20 bp, Artificial Sequence
  Description of Artificial Sequence: Synthetic oligonucleotide
  Target: SCN9A; (-) strand; PAM type: YTN; PAM sequence: TTT
tataatcgctgaacttatta

SEQ ID NO: 57874 - DNA, 20 bp, Artificial Sequence
  Description of Artificial Sequence: Synthetic oligonucleotide
  Target: SCN9A; (-) strand; PAM type: YTN; PAM sequence: TTA
aattttataatcgctgaact

SEQ ID NO: 57875 - DNA, 20 bp, Artificial Sequence
  Description of Artificial Sequence: Synthetic oligonucleotide
  Target: SCN9A; (-) strand; PAM type: YTN; PAM sequence: TTT
aaattttataatcgctgaac

SEQ ID NO: 57876 - DNA, 20 bp, Artificial Sequence
  Description of Artificial Sequence: Synthetic oligonucleotide
  Target: SCN9A; (-) strand; PAM type: YTN; PAM sequence: TTA
atatttaaattttataatcg

SEQ ID NO: 57877 - DNA, 20 bp, Artificial Sequence
  Description of Artificial Sequence: Synthetic oligonucleotide
  Target: SCN9A; (-) strand; PAM type: YTN; PAM sequence: CTG
tcatattaatatttaaattt

SEQ ID NO: 57878 - DNA, 20 bp, Artificial Sequence
  Description of Artificial Sequence: Synthetic oligonucleotide
  Target: SCN9A; (-) strand; PAM type: YTN; PAM sequence: TTC
agaaggcactgtcatattaa

SEQ ID NO: 57879 - DNA, 20 bp, Artificial Sequence
  Description of Artificial Sequence: Synthetic oligonucleotide
  Target: SCN9A; (-) strand; PAM type: YTN; PAM sequence: CTT
cagaaggcactgtcatatta

SEQ ID NO: 57880 - DNA, 20 bp, Artificial Sequence
  Description of Artificial Sequence: Synthetic oligonucleotide
  Target: SCN9A; (-) strand; PAM type: YTN; PAM sequence: TTC
acccttcagaaggcactgtc

SEQ ID NO: 57881 - DNA, 20 bp, Artificial Sequence
  Description of Artificial Sequence: Synthetic oligonucleotide
  Target: SCN9A; (-) strand; PAM type: YTN; PAM sequence: TTT
cacccttcagaaggcactgt

SEQ ID NO: 57882 - DNA, 20 bp, Artificial Sequence
  Description of Artificial Sequence: Synthetic oligonucleotide
  Target: SCN9A; (-) strand; PAM type: YTN; PAM sequence: CTG
atggtttcacccttcagaag

SEQ ID NO: 57883 - DNA, 20 bp, Artificial Sequence
  Description of Artificial Sequence: Synthetic oligonucleotide
  Target: SCN9A; (-) strand; PAM type: YTN; PAM sequence: TTG
tactgatggtttcacccttc

SEQ ID NO: 57884 - DNA, 20 bp, Artificial Sequence
  Description of Artificial Sequence: Synthetic oligonucleotide
  Target: SCN9A; (-) strand; PAM type: YTN; PAM sequence: TTT
gtactgatggtttcaccctt

SEQ ID NO: 57885 - DNA, 20 bp, Artificial Sequence
  Description of Artificial Sequence: Synthetic oligonucleotide
  Target: SCN9A; (-) strand; PAM type: YTN; PAM sequence: CTG
tttgtactgatggtttcacc

SEQ ID NO: 57886 - DNA, 20 bp, Artificial Sequence
  Description of Artificial Sequence: Synthetic oligonucleotide
  Target: SCN9A; (-) strand; PAM type: YTN; PAM sequence: TTA
ctgtttgtactgatggtttc

SEQ ID NO: 57887 - DNA, 20 bp, Artificial Sequence
  Description of Artificial Sequence: Synthetic oligonucleotide
  Target: SCN9A; (-) strand; PAM type: YTN; PAM sequence: TTC
catgtagattactgtttgta

SEQ ID NO: 57888 - DNA, 20 bp, Artificial Sequence
  Description of Artificial Sequence: Synthetic oligonucleotide
  Target: SCN9A; (-) strand; PAM type: YTN; PAM sequence: TTT
ccatgtagattactgtttgt

SEQ ID NO: 57889 - DNA, 20 bp, Artificial Sequence
  Description of Artificial Sequence: Synthetic oligonucleotide
  Target: SCN9A; (-) strand; PAM type: YTN; PAM sequence: CTT
tccatgtagattactgtttg

SEQ ID NO: 57890 - DNA, 20 bp, Artificial Sequence
  Description of Artificial Sequence: Synthetic oligonucleotide
  Target: SCN9A; (-) strand; PAM type: YTN; PAM sequence: CTC
tttccatgtagattactgtt

SEQ ID NO: 57891 - DNA, 20 bp, Artificial Sequence
  Description of Artificial Sequence: Synthetic oligonucleotide
  Target: SCN9A; (-) strand; PAM type: YTN; PAM sequence: CTC
tctttccatgtagattactg

SEQ ID NO: 57892 - DNA, 20 bp, Artificial Sequence
  Description of Artificial Sequence: Synthetic oligonucleotide
  Target: SCN9A; (-) strand; PAM type: YTN; PAM sequence: TTA
gacctctctttccatgtaga

SEQ ID NO: 57893 - DNA, 20 bp, Artificial Sequence
  Description of Artificial Sequence: Synthetic oligonucleotide
  Target: SCN9A; (-) strand; PAM type: YTN; PAM sequence: TTG
aagtaaaattagacctctct

SEQ ID NO: 57894 - DNA, 20 bp, Artificial Sequence
  Description of Artificial Sequence: Synthetic oligonucleotide
  Target: SCN9A; (-) strand; PAM type: YTN; PAM sequence: CTT
gaagtaaaattagacctctc

SEQ ID NO: 57895 - DNA, 20 bp, Artificial Sequence
  Description of Artificial Sequence: Synthetic oligonucleotide
  Target: SCN9A; (-) strand; PAM type: YTN; PAM sequence: TTA
agtataagcttgaagtaaaa

SEQ ID NO: 57896 - DNA, 20 bp, Artificial Sequence
  Description of Artificial Sequence: Synthetic oligonucleotide
  Target: SCN9A; (-) strand; PAM type: YTN; PAM sequence: TTA
ttaagtataagcttgaagta

SEQ ID NO: 57897 - DNA, 20 bp, Artificial Sequence
  Description of Artificial Sequence: Synthetic oligonucleotide
  Target: SCN9A; (-) strand; PAM type: YTN; PAM sequence: CTT
attaagtataagcttgaagt

SEQ ID NO: 57898 - DNA, 20 bp, Artificial Sequence
  Description of Artificial Sequence: Synthetic oligonucleotide
  Target: SCN9A; (-) strand; PAM type: YTN; PAM sequence: TTG
gaagaaagagcttattaagt

SEQ ID NO: 57899 - DNA, 20 bp, Artificial Sequence
  Description of Artificial Sequence: Synthetic oligonucleotide
  Target: SCN9A; (-) strand; PAM type: YTN; PAM sequence: TTT
ggaagaaagagcttattaag

SEQ ID NO: 57900 - DNA, 20 bp, Artificial Sequence
  Description of Artificial Sequence: Synthetic oligonucleotide
  Target: SCN9A; (-) strand; PAM type: YTN; PAM sequence: TTA
aaaataatatttggaagaaa

SEQ ID NO: 57901 - DNA, 20 bp, Artificial Sequence
  Description of Artificial Sequence: Synthetic oligonucleotide
  Target: SCN9A; (-) strand; PAM type: YTN; PAM sequence: TTA
tcaattaaaaataatatttg

SEQ ID NO: 57902 - DNA, 20 bp, Artificial Sequence
  Description of Artificial Sequence: Synthetic oligonucleotide
  Target: SCN9A; (-) strand; PAM type: YTN; PAM sequence: TTT
atcaattaaaaataatattt

SEQ ID NO: 57903 - DNA, 20 bp, Artificial Sequence
  Description of Artificial Sequence: Synthetic oligonucleotide
  Target: SCN9A; (-) strand; PAM type: YTN; PAM sequence: TTT
tatcaattaaaaataatatt

SEQ ID NO: 57904 - DNA, 20 bp, Artificial Sequence
  Description of Artificial Sequence: Synthetic oligonucleotide
  Target: SCN9A; (-) strand; PAM type: YTN; PAM sequence: TTT
ttatcaattaaaaataatat

SEQ ID NO: 57905 - DNA, 20 bp, Artificial Sequence
  Description of Artificial Sequence: Synthetic oligonucleotide
  Target: SCN9A; (-) strand; PAM type: YTN; PAM sequence: CTT
tttatcaattaaaaataata

SEQ ID NO: 57906 - DNA, 20 bp, Artificial Sequence
  Description of Artificial Sequence: Synthetic oligonucleotide
  Target: SCN9A; (-) strand; PAM type: YTN; PAM sequence: TTG
tgactttttatcaattaaaa

SEQ ID NO: 57907 - DNA, 20 bp, Artificial Sequence
  Description of Artificial Sequence: Synthetic oligonucleotide
  Target: SCN9A; (-) strand; PAM type: YTN; PAM sequence: CTT
gtgactttttatcaattaaa

SEQ ID NO: 57908 - DNA, 20 bp, Artificial Sequence
  Description of Artificial Sequence: Synthetic oligonucleotide
  Target: SCN9A; (-) strand; PAM type: YTN; PAM sequence: CTA
cttgtgactttttatcaatt

SEQ ID NO: 57909 - DNA, 20 bp, Artificial Sequence
  Description of Artificial Sequence: Synthetic oligonucleotide
  Target: SCN9A; (-) strand; PAM type: YTN; PAM sequence: TTC
aggaatgtctacttgtgact

SEQ ID NO: 57910 - DNA, 20 bp, Artificial Sequence
  Description of Artificial Sequence: Synthetic oligonucleotide
  Target: SCN9A; (-) strand; PAM type: YTN; PAM sequence: TTT
caggaatgtctacttgtgac

SEQ ID NO: 57911 - DNA, 20 bp, Artificial Sequence
  Description of Artificial Sequence: Synthetic oligonucleotide
  Target: SCN9A; (-) strand; PAM type: YTN; PAM sequence: TTG
tttcaggaatgtctacttgt

SEQ ID NO: 57912 - DNA, 20 bp, Artificial Sequence
  Description of Artificial Sequence: Synthetic oligonucleotide
  Target: SCN9A; (-) strand; PAM type: YTN; PAM sequence: TTT
gtttcaggaatgtctacttg

SEQ ID NO: 57913 - DNA, 20 bp, Artificial Sequence
  Description of Artificial Sequence: Synthetic oligonucleotide
  Target: SCN9A; (-) strand; PAM type: YTN; PAM sequence: TTA
cgtttgtttcaggaatgtct

SEQ ID NO: 57914 - DNA, 20 bp, Artificial Sequence
  Description of Artificial Sequence: Synthetic oligonucleotide
  Target: SCN9A; (-) strand; PAM type: YTN; PAM sequence: TTT
acgtttgtttcaggaatgtc

SEQ ID NO: 57915 - DNA, 20 bp, Artificial Sequence
  Description of Artificial Sequence: Synthetic oligonucleotide
  Target: SCN9A; (-) strand; PAM type: YTN; PAM sequence: TTA
tatatatttacgtttgtttc

SEQ ID NO: 57916 - DNA, 20 bp, Artificial Sequence
  Description of Artificial Sequence: Synthetic oligonucleotide
  Target: SCN9A; (-) strand; PAM type: YTN; PAM sequence: TTT
atatatatttacgtttgttt

SEQ ID NO: 57917 - DNA, 20 bp, Artificial Sequence
  Description of Artificial Sequence: Synthetic oligonucleotide
  Target: SCN9A; (-) strand; PAM type: YTN; PAM sequence: TTT
tatatatatttacgtttgtt

SEQ ID NO: 57918 - DNA, 20 bp, Artificial Sequence
  Description of Artificial Sequence: Synthetic oligonucleotide
  Target: SCN9A; (-) strand; PAM type: YTN; PAM sequence: TTA
agttttatatatatttacgt

SEQ ID NO: 57919 - DNA, 20 bp, Artificial Sequence
  Description of Artificial Sequence: Synthetic oligonucleotide
  Target: SCN9A; (-) strand; PAM type: YTN; PAM sequence: TTA
aaataacatggttaagtttt

SEQ ID NO: 57920 - DNA, 20 bp, Artificial Sequence
  Description of Artificial Sequence: Synthetic oligonucleotide
  Target: SCN9A; (-) strand; PAM type: YTN; PAM sequence: TTT
aaaataacatggttaagttt

SEQ ID NO: 57921 - DNA, 20 bp, Artificial Sequence
  Description of Artificial Sequence: Synthetic oligonucleotide
  Target: SCN9A; (-) strand; PAM type: YTN; PAM sequence: TTT
taaaataacatggttaagtt

SEQ ID NO: 57922 - DNA, 20 bp, Artificial Sequence
  Description of Artificial Sequence: Synthetic oligonucleotide
  Target: SCN9A; (-) strand; PAM type: YTN; PAM sequence: TTT
ttaaaataacatggttaagt

SEQ ID NO: 57923 - DNA, 20 bp, Artificial Sequence
  Description of Artificial Sequence: Synthetic oligonucleotide
  Target: SCN9A; (-) strand; PAM type: YTN; PAM sequence: TTT
tttaaaataacatggttaag

SEQ ID NO: 57924 - DNA, 20 bp, Artificial Sequence
  Description of Artificial Sequence: Synthetic oligonucleotide
  Target: SCN9A; (-) strand; PAM type: YTN; PAM sequence: TTT
ttttaaaataacatggttaa

SEQ ID NO: 57925 - DNA, 20 bp, Artificial Sequence
  Description of Artificial Sequence: Synthetic oligonucleotide
  Target: SCN9A; (-) strand; PAM type: YTN; PAM sequence: TTT
tttttaaaataacatggtta

SEQ ID NO: 57926 - DNA, 20 bp, Artificial Sequence
  Description of Artificial Sequence: Synthetic oligonucleotide
  Target: SCN9A; (-) strand; PAM type: YTN; PAM sequence: TTT
ttttttaaaataacatggtt

SEQ ID NO: 57927 - DNA, 20 bp, Artificial Sequence
  Description of Artificial Sequence: Synthetic oligonucleotide
  Target: SCN9A; (-) strand; PAM type: YTN; PAM sequence: CTA
tgtttttttttaaaataaca

SEQ ID NO: 57928 - DNA, 20 bp, Artificial Sequence
  Description of Artificial Sequence: Synthetic oligonucleotide
  Target: SCN9A; (-) strand; PAM type: YTN; PAM sequence: TTC
atgaactatgttttttttta

SEQ ID NO: 57929 - DNA, 20 bp, Artificial Sequence
  Description of Artificial Sequence: Synthetic oligonucleotide
  Target: SCN9A; (-) strand; PAM type: YTN; PAM sequence: TTT
catgaactatgttttttttt

SEQ ID NO: 57930 - DNA, 20 bp, Artificial Sequence
  Description of Artificial Sequence: Synthetic oligonucleotide
  Target: SCN9A; (-) strand; PAM type: YTN; PAM sequence: CTA
tttcatgaactatgtttttt

SEQ ID NO: 57931 - DNA, 20 bp, Artificial Sequence
  Description of Artificial Sequence: Synthetic oligonucleotide
  Target: SCN9A; (-) strand; PAM type: YTN; PAM sequence: TTC
ctatttcatgaactatgttt

SEQ ID NO: 57932 - DNA, 20 bp, Artificial Sequence
  Description of Artificial Sequence: Synthetic oligonucleotide
  Target: SCN9A; (-) strand; PAM type: YTN; PAM sequence: TTT
cctatttcatgaactatgtt

SEQ ID NO: 57933 - DNA, 20 bp, Artificial Sequence
  Description of Artificial Sequence: Synthetic oligonucleotide
  Target: SCN9A; (-) strand; PAM type: YTN; PAM sequence: TTT
tcctatttcatgaactatgt

SEQ ID NO: 57934 - DNA, 20 bp, Artificial Sequence
  Description of Artificial Sequence: Synthetic oligonucleotide
  Target: SCN9A; (-) strand; PAM type: YTN; PAM sequence: TTT
ttcctatttcatgaactatg

SEQ ID NO: 57935 - DNA, 20 bp, Artificial Sequence
  Description of Artificial Sequence: Synthetic oligonucleotide
  Target: SCN9A; (-) strand; PAM type: YTN; PAM sequence: CTT
tttcctatttcatgaactat

SEQ ID NO: 57936 - DNA, 20 bp, Artificial Sequence
  Description of Artificial Sequence: Synthetic oligonucleotide
  Target: SCN9A; (-) strand; PAM type: YTN; PAM sequence: TTC
tttttcctatttcatgaact

SEQ ID NO: 57937 - DNA, 20 bp, Artificial Sequence
  Description of Artificial Sequence: Synthetic oligonucleotide
  Target: SCN9A; (-) strand; PAM type: YTN; PAM sequence: TTG
ttctttttcctatttcatga

SEQ ID NO: 57938 - DNA, 20 bp, Artificial Sequence
  Description of Artificial Sequence: Synthetic oligonucleotide
  Target: SCN9A; (-) strand; PAM type: YTN; PAM sequence: TTC
aaaaatatatataaagttgt

SEQ ID NO: 57939 - DNA, 20 bp, Artificial Sequence
  Description of Artificial Sequence: Synthetic oligonucleotide
  Target: SCN9A; (-) strand; PAM type: YTN; PAM sequence: TTT
caaaaatatatataaagttg

SEQ ID NO: 57940 - DNA, 20 bp, Artificial Sequence
  Description of Artificial Sequence: Synthetic oligonucleotide
  Target: SCN9A; (-) strand; PAM type: YTN; PAM sequence: TTA
gcatttcaaaaatatatata

SEQ ID NO: 57941 - DNA, 20 bp, Artificial Sequence
  Description of Artificial Sequence: Synthetic oligonucleotide
  Target: SCN9A; (-) strand; PAM type: YTN; PAM sequence: CTT
agcatttcaaaaatatatat

SEQ ID NO: 57942 - DNA, 20 bp, Artificial Sequence
  Description of Artificial Sequence: Synthetic oligonucleotide
  Target: SCN9A; (-) strand; PAM type: YTN; PAM sequence: TTC
ttagcatttcaaaaatatat

SEQ ID NO: 57943 - DNA, 20 bp, Artificial Sequence
  Description of Artificial Sequence: Synthetic oligonucleotide
  Target: SCN9A; (-) strand; PAM type: YTN; PAM sequence: CTT
cttagcatttcaaaaatata

SEQ ID NO: 57944 - DNA, 20 bp, Artificial Sequence
  Description of Artificial Sequence: Synthetic oligonucleotide
  Target: SCN9A; (-) strand; PAM type: YTN; PAM sequence: TTC
ttcttagcatttcaaaaata

SEQ ID NO: 57945 - DNA, 20 bp, Artificial Sequence
  Description of Artificial Sequence: Synthetic oligonucleotide
  Target: SCN9A; (-) strand; PAM type: YTN; PAM sequence: TTT
cttcttagcatttcaaaaat

SEQ ID NO: 57946 - DNA, 20 bp, Artificial Sequence
  Description of Artificial Sequence: Synthetic oligonucleotide
  Target: SCN9A; (-) strand; PAM type: YTN; PAM sequence: TTA
acaacacaatttcttcttag

SEQ ID NO: 57947 - DNA, 20 bp, Artificial Sequence
  Description of Artificial Sequence: Synthetic oligonucleotide
  Target: SCN9A; (-) strand; PAM type: YTN; PAM sequence: TTG
ttaacaacacaatttcttct

SEQ ID NO: 57948 - DNA, 20 bp, Artificial Sequence
  Description of Artificial Sequence: Synthetic oligonucleotide
  Target: SCN9A; (-) strand; PAM type: YTN; PAM sequence: TTT
gttaacaacacaatttcttc

SEQ ID NO: 57949 - DNA, 20 bp, Artificial Sequence
  Description of Artificial Sequence: Synthetic oligonucleotide
  Target: SCN9A; (-) strand; PAM type: YTN; PAM sequence: CTG
gtttgttaacaacacaattt

SEQ ID NO: 57950 - DNA, 20 bp, Artificial Sequence
  Description of Artificial Sequence: Synthetic oligonucleotide
  Target: SCN9A; (-) strand; PAM type: YTN; PAM sequence: TTA
tgtaaaataaaaaatatggg

SEQ ID NO: 57951 - DNA, 20 bp, Artificial Sequence
  Description of Artificial Sequence: Synthetic oligonucleotide
  Target: SCN9A; (-) strand; PAM type: YTN; PAM sequence: TTT
atgtaaaataaaaaatatgg

SEQ ID NO: 57952 - DNA, 20 bp, Artificial Sequence
  Description of Artificial Sequence: Synthetic oligonucleotide
  Target: SCN9A; (-) strand; PAM type: YTN; PAM sequence: TTT
tatgtaaaataaaaaatatg

SEQ ID NO: 57953 - DNA, 20 bp, Artificial Sequence
  Description of Artificial Sequence: Synthetic oligonucleotide
  Target: SCN9A; (-) strand; PAM type: YTN; PAM sequence: TTT
ttatgtaaaataaaaaatat

SEQ ID NO: 57954 - DNA, 20 bp, Artificial Sequence
  Description of Artificial Sequence: Synthetic oligonucleotide
  Target: SCN9A; (-) strand; PAM type: YTN; PAM sequence: TTG
tttttatgtaaaataaaaaa

SEQ ID NO: 57955 - DNA, 20 bp, Artificial Sequence
  Description of Artificial Sequence: Synthetic oligonucleotide
  Target: SCN9A; (-) strand; PAM type: YTN; PAM sequence: CTT
gtttttatgtaaaataaaaa

SEQ ID NO: 57956 - DNA, 20 bp, Artificial Sequence
  Description of Artificial Sequence: Synthetic oligonucleotide
  Target: SCN9A; (-) strand; PAM type: YTN; PAM sequence: TTG
ccttgtttttatgtaaaata

SEQ ID NO: 57957 - DNA, 20 bp, Artificial Sequence
  Description of Artificial Sequence: Synthetic oligonucleotide
  Target: SCN9A; (-) strand; PAM type: YTN; PAM sequence: TTA
cattgccttgtttttatgta

SEQ ID NO: 57958 - DNA, 20 bp, Artificial Sequence
  Description of Artificial Sequence: Synthetic oligonucleotide
  Target: SCN9A; (-) strand; PAM type: YTN; PAM sequence: TTT
acattgccttgtttttatgt

SEQ ID NO: 57959 - DNA, 20 bp, Artificial Sequence
  Description of Artificial Sequence: Synthetic oligonucleotide
  Target: SCN9A; (-) strand; PAM type: YTN; PAM sequence: TTT
tacattgccttgtttttatg

SEQ ID NO: 57960 - DNA, 20 bp, Artificial Sequence
  Description of Artificial Sequence: Synthetic oligonucleotide
  Target: SCN9A; (-) strand; PAM type: YTN; PAM sequence: TTT
ttacattgccttgtttttat

SEQ ID NO: 57961 - DNA, 20 bp, Artificial Sequence
  Description of Artificial Sequence: Synthetic oligonucleotide
  Target: SCN9A; (-) strand; PAM type: YTN; PAM sequence: TTA
atgtttttacattgccttgt

SEQ ID NO: 57962 - DNA, 20 bp, Artificial Sequence
  Description of Artificial Sequence: Synthetic oligonucleotide
  Target: SCN9A; (-) strand; PAM type: YTN; PAM sequence: CTA
ttaatgtttttacattgcct

SEQ ID NO: 57963 - DNA, 20 bp, Artificial Sequence
  Description of Artificial Sequence: Synthetic oligonucleotide
  Target: SCN9A; (-) strand; PAM type: YTN; PAM sequence: TTC
tattaatgtttttacattgc

SEQ ID NO: 57964 - DNA, 20 bp, Artificial Sequence
  Description of Artificial Sequence: Synthetic oligonucleotide
  Target: SCN9A; (-) strand; PAM type: YTN; PAM sequence: TTT
ctattaatgtttttacattg

SEQ ID NO: 57965 - DNA, 20 bp, Artificial Sequence
  Description of Artificial Sequence: Synthetic oligonucleotide
  Target: SCN9A; (-) strand; PAM type: YTN; PAM sequence: TTT
tctattaatgtttttacatt

SEQ ID NO: 57966 - DNA, 20 bp, Artificial Sequence
  Description of Artificial Sequence: Synthetic oligonucleotide
  Target: SCN9A; (-) strand; PAM type: YTN; PAM sequence: TTC
gtgtgtaattttctattaat

SEQ ID NO: 57967 - DNA, 20 bp, Artificial Sequence
  Description of Artificial Sequence: Synthetic oligonucleotide
  Target: SCN9A; (-) strand; PAM type: YTN; PAM sequence: TTG
acaggttcgtgtgtaatttt

SEQ ID NO: 57968 - DNA, 20 bp, Artificial Sequence
  Description of Artificial Sequence: Synthetic oligonucleotide
  Target: SCN9A; (-) strand; PAM type: YTN; PAM sequence: TTT
gacaggttcgtgtgtaattt

SEQ ID NO: 57969 - DNA, 20 bp, Artificial Sequence
  Description of Artificial Sequence: Synthetic oligonucleotide
  Target: SCN9A; (-) strand; PAM type: YTN; PAM sequence: TTA
cataatgtagtaagacaaga

SEQ ID NO: 57970 - DNA, 20 bp, Artificial Sequence
  Description of Artificial Sequence: Synthetic oligonucleotide
  Target: SCN9A; (-) strand; PAM type: YTN; PAM sequence: CTT
acataatgtagtaagacaag

SEQ ID NO: 57971 - DNA, 20 bp, Artificial Sequence
  Description of Artificial Sequence: Synthetic oligonucleotide
  Target: SCN9A; (-) strand; PAM type: YTN; PAM sequence: TTA
tgaatacttacataatgtag

SEQ ID NO: 57972 - DNA, 20 bp, Artificial Sequence
  Description of Artificial Sequence: Synthetic oligonucleotide
  Target: SCN9A; (-) strand; PAM type: YTN; PAM sequence: CTG
cattatgaatacttacataa

SEQ ID NO: 57973 - DNA, 20 bp, Artificial Sequence
  Description of Artificial Sequence: Synthetic oligonucleotide
  Target: SCN9A; (-) strand; PAM type: YTN; PAM sequence: CTC
acaaatataactgcattatg

SEQ ID NO: 57974 - DNA, 20 bp, Artificial Sequence
  Description of Artificial Sequence: Synthetic oligonucleotide
  Target: SCN9A; (-) strand; PAM type: YTN; PAM sequence: TTC
aaactcacaaatataactgc

SEQ ID NO: 57975 - DNA, 20 bp, Artificial Sequence
  Description of Artificial Sequence: Synthetic oligonucleotide
  Target: SCN9A; (-) strand; PAM type: YTN; PAM sequence: TTT
caaactcacaaatataactg

SEQ ID NO: 57976 - DNA, 20 bp, Artificial Sequence
  Description of Artificial Sequence: Synthetic oligonucleotide
  Target: SCN9A; (-) strand; PAM type: YTN; PAM sequence: TTA
tttcaaactcacaaatataa

SEQ ID NO: 57977 - DNA, 20 bp, Artificial Sequence
  Description of Artificial Sequence: Synthetic oligonucleotide
  Target: SCN9A; (-) strand; PAM type: YTN; PAM sequence: CTA
ccgttatttcaaactcacaa

SEQ ID NO: 57978 - DNA, 20 bp, Artificial Sequence
  Description of Artificial Sequence: Synthetic oligonucleotide
  Target: SCN9A; (-) strand; PAM type: YTN; PAM sequence: TTC
aatctaccgttatttcaaac

SEQ ID NO: 57979 - DNA, 20 bp, Artificial Sequence
  Description of Artificial Sequence: Synthetic oligonucleotide
  Target: SCN9A; (-) strand; PAM type: YTN; PAM sequence: TTG
aattcaatctaccgttattt

SEQ ID NO: 57980 - DNA, 20 bp, Artificial Sequence
  Description of Artificial Sequence: Synthetic oligonucleotide
  Target: SCN9A; (-) strand; PAM type: YTN; PAM sequence: TTT
gaattcaatctaccgttatt

SEQ ID NO: 57981 - DNA, 20 bp, Artificial Sequence
  Description of Artificial Sequence: Synthetic oligonucleotide
  Target: SCN9A; (-) strand; PAM type: YTN; PAM sequence: TTA
aatttgaattcaatctaccg

SEQ ID NO: 57982 - DNA, 20 bp, Artificial Sequence
  Description of Artificial Sequence: Synthetic oligonucleotide
  Target: SCN9A; (-) strand; PAM type: YTN; PAM sequence: CTT
aaatttgaattcaatctacc

SEQ ID NO: 57983 - DNA, 20 bp, Artificial Sequence
  Description of Artificial Sequence: Synthetic oligonucleotide
  Target: SCN9A; (-) strand; PAM type: YTN; PAM sequence: TTA
acatcaccttaaatttgaat

SEQ ID NO: 57984 - DNA, 20 bp, Artificial Sequence
  Description of Artificial Sequence: Synthetic oligonucleotide
  Target: SCN9A; (-) strand; PAM type: YTN; PAM sequence: TTT
aacatcaccttaaatttgaa

SEQ ID NO: 57985 - DNA, 20 bp, Artificial Sequence
  Description of Artificial Sequence: Synthetic oligonucleotide
  Target: SCN9A; (-) strand; PAM type: YTN; PAM sequence: TTA
agaatttaacatcaccttaa

SEQ ID NO: 57986 - DNA, 20 bp, Artificial Sequence
  Description of Artificial Sequence: Synthetic oligonucleotide
  Target: SCN9A; (-) strand; PAM type: YTN; PAM sequence: TTC
aattaagaatttaacatcac

SEQ ID NO: 57987 - DNA, 20 bp, Artificial Sequence
  Description of Artificial Sequence: Synthetic oligonucleotide
  Target: SCN9A; (-) strand; PAM type: YTN; PAM sequence: TTA
aatacattcaattaagaatt

SEQ ID NO: 57988 - DNA, 20 bp, Artificial Sequence
  Description of Artificial Sequence: Synthetic oligonucleotide
  Target: SCN9A; (-) strand; PAM type: YTN; PAM sequence: TTT
aaatacattcaattaagaat

SEQ ID NO: 57989 - DNA, 20 bp, Artificial Sequence
  Description of Artificial Sequence: Synthetic oligonucleotide
  Target: SCN9A; (-) strand; PAM type: YTN; PAM sequence: TTT
taaatacattcaattaagaa

SEQ ID NO: 57990 - DNA, 20 bp, Artificial Sequence
  Description of Artificial Sequence: Synthetic oligonucleotide
  Target: SCN9A; (-) strand; PAM type: YTN; PAM sequence: TTT
ttaaatacattcaattaaga

SEQ ID NO: 57991 - DNA, 20 bp, Artificial Sequence
  Description of Artificial Sequence: Synthetic oligonucleotide
  Target: SCN9A; (-) strand; PAM type: YTN; PAM sequence: TTA
tcagatttttaaatacattc

SEQ ID NO: 57992 - DNA, 20 bp, Artificial Sequence
  Description of Artificial Sequence: Synthetic oligonucleotide
  Target: SCN9A; (-) strand; PAM type: YTN; PAM sequence: TTT
atcagatttttaaatacatt

SEQ ID NO: 57993 - DNA, 20 bp, Artificial Sequence
  Description of Artificial Sequence: Synthetic oligonucleotide
  Target: SCN9A; (-) strand; PAM type: YTN; PAM sequence: TTA
catttatcagatttttaaat

SEQ ID NO: 57994 - DNA, 20 bp, Artificial Sequence
  Description of Artificial Sequence: Synthetic oligonucleotide
  Target: SCN9A; (-) strand; PAM type: YTN; PAM sequence: CTA
tacaaaatatattacattta

SEQ ID NO: 57995 - DNA, 20 bp, Artificial Sequence
  Description of Artificial Sequence: Synthetic oligonucleotide
  Target: SCN9A; (-) strand; PAM type: YTN; PAM sequence: TTA
agtagggacctatacaaaat

SEQ ID NO: 57996 - DNA, 20 bp, Artificial Sequence
  Description of Artificial Sequence: Synthetic oligonucleotide
  Target: SCN9A; (-) strand; PAM type: YTN; PAM sequence: TTT
aagtagggacctatacaaaa

SEQ ID NO: 57997 - DNA, 20 bp, Artificial Sequence
  Description of Artificial Sequence: Synthetic oligonucleotide
  Target: SCN9A; (-) strand; PAM type: YTN; PAM sequence: TTG
ataatttaagtagggaccta

SEQ ID NO: 57998 - DNA, 20 bp, Artificial Sequence
  Description of Artificial Sequence: Synthetic oligonucleotide
  Target: SCN9A; (-) strand; PAM type: YTN; PAM sequence: TTT
gataatttaagtagggacct

SEQ ID NO: 57999 - DNA, 20 bp, Artificial Sequence
  Description of Artificial Sequence: Synthetic oligonucleotide
  Target: SCN9A; (-) strand; PAM type: YTN; PAM sequence: TTT
tgataatttaagtagggacc

SEQ ID NO: 58000 - DNA, 20 bp, Artificial Sequence
  Description of Artificial Sequence: Synthetic oligonucleotide
  Target: SCN9A; (-) strand; PAM type: YTN; PAM sequence: TTG
gaaataggttttgataattt

SEQ ID NO: 58001 - DNA, 20 bp, Artificial Sequence
  Description of Artificial Sequence: Synthetic oligonucleotide
  Target: SCN9A; (-) strand; PAM type: YTN; PAM sequence: CTG
ttggaaataggttttgataa

SEQ ID NO: 58002 - DNA, 20 bp, Artificial Sequence
  Description of Artificial Sequence: Synthetic oligonucleotide
  Target: SCN9A; (-) strand; PAM type: YTN; PAM sequence: CTA
ccaagcctgttggaaatagg

SEQ ID NO: 58003 - DNA, 20 bp, Artificial Sequence
  Description of Artificial Sequence: Synthetic oligonucleotide
  Target: SCN9A; (-) strand; PAM type: YTN; PAM sequence: TTA
tcacatacctaccaagcctg

SEQ ID NO: 58004 - DNA, 20 bp, Artificial Sequence
  Description of Artificial Sequence: Synthetic oligonucleotide
  Target: SCN9A; (-) strand; PAM type: YTN; PAM sequence: TTT
atcacatacctaccaagcct

SEQ ID NO: 58005 - DNA, 20 bp, Artificial Sequence
  Description of Artificial Sequence: Synthetic oligonucleotide
  Target: SCN9A; (-) strand; PAM type: YTN; PAM sequence: TTT
tatcacatacctaccaagcc

SEQ ID NO: 58006 - DNA, 20 bp, Artificial Sequence
  Description of Artificial Sequence: Synthetic oligonucleotide
  Target: SCN9A; (-) strand; PAM type: YTN; PAM sequence: CTA
catagatcattttatcacat

SEQ ID NO: 58007 - DNA, 20 bp, Artificial Sequence
  Description of Artificial Sequence: Synthetic oligonucleotide
  Target: SCN9A; (-) strand; PAM type: YTN; PAM sequence: TTC
cgagactacatagatcattt

SEQ ID NO: 58008 - DNA, 20 bp, Artificial Sequence
  Description of Artificial Sequence: Synthetic oligonucleotide
  Target: SCN9A; (-) strand; PAM type: YTN; PAM sequence: TTT
ccgagactacatagatcatt

SEQ ID NO: 58009 - DNA, 20 bp, Artificial Sequence
  Description of Artificial Sequence: Synthetic oligonucleotide
  Target: SCN9A; (-) strand; PAM type: YTN; PAM sequence: TTT
tccgagactacatagatcat

SEQ ID NO: 58010 - DNA, 20 bp, Artificial Sequence
  Description of Artificial Sequence: Synthetic oligonucleotide
  Target: SCN9A; (-) strand; PAM type: YTN; PAM sequence: TTA
atatgaaagacaccatgcag

SEQ ID NO: 58011 - DNA, 20 bp, Artificial Sequence
  Description of Artificial Sequence: Synthetic oligonucleotide
  Target: SCN9A; (-) strand; PAM type: YTN; PAM sequence: TTT
aatatgaaagacaccatgca

SEQ ID NO: 58012 - DNA, 20 bp, Artificial Sequence
  Description of Artificial Sequence: Synthetic oligonucleotide
  Target: SCN9A; (-) strand; PAM type: YTN; PAM sequence: TTA
atttaatatgaaagacacca

SEQ ID NO: 58013 - DNA, 20 bp, Artificial Sequence
  Description of Artificial Sequence: Synthetic oligonucleotide
  Target: SCN9A; (-) strand; PAM type: YTN; PAM sequence: TTT
aatttaatatgaaagacacc

SEQ ID NO: 58014 - DNA, 20 bp, Artificial Sequence
  Description of Artificial Sequence: Synthetic oligonucleotide
  Target: SCN9A; (-) strand; PAM type: YTN; PAM sequence: TTT
taatttaatatgaaagacac

SEQ ID NO: 58015 - DNA, 20 bp, Artificial Sequence
  Description of Artificial Sequence: Synthetic oligonucleotide
  Target: SCN9A; (-) strand; PAM type: YTN; PAM sequence: TTT
ttaatttaatatgaaagaca

SEQ ID NO: 58016 - DNA, 20 bp, Artificial Sequence
  Description of Artificial Sequence: Synthetic oligonucleotide
  Target: SCN9A; (-) strand; PAM type: YTN; PAM sequence: CTT
tttaatttaatatgaaagac

SEQ ID NO: 58017 - DNA, 20 bp, Artificial Sequence
  Description of Artificial Sequence: Synthetic oligonucleotide
  Target: SCN9A; (-) strand; PAM type: YTN; PAM sequence: TTG
aaccactttttaatttaata

SEQ ID NO: 58018 - DNA, 20 bp, Artificial Sequence
  Description of Artificial Sequence: Synthetic oligonucleotide
  Target: SCN9A; (-) strand; PAM type: YTN; PAM sequence: TTT
gaaccactttttaatttaat

SEQ ID NO: 58019 - DNA, 20 bp, Artificial Sequence
  Description of Artificial Sequence: Synthetic oligonucleotide
  Target: SCN9A; (-) strand; PAM type: YTN; PAM sequence: CTA
tttgaaccactttttaattt

SEQ ID NO: 58020 - DNA, 20 bp, Artificial Sequence
  Description of Artificial Sequence: Synthetic oligonucleotide
  Target: SCN9A; (-) strand; PAM type: YTN; PAM sequence: TTA
ggctatttgaaccacttttt

SEQ ID NO: 58021 - DNA, 20 bp, Artificial Sequence
  Description of Artificial Sequence: Synthetic oligonucleotide
  Target: SCN9A; (-) strand; PAM type: YTN; PAM sequence: CTT
aggctatttgaaccactttt

SEQ ID NO: 58022 - DNA, 20 bp, Artificial Sequence
  Description of Artificial Sequence: Synthetic oligonucleotide
  Target: SCN9A; (-) strand; PAM type: YTN; PAM sequence: TTC
atcttaggctatttgaacca

SEQ ID NO: 58023 - DNA, 20 bp, Artificial Sequence
  Description of Artificial Sequence: Synthetic oligonucleotide
  Target: SCN9A; (-) strand; PAM type: YTN; PAM sequence: TTC
attcatcttaggctatttga

SEQ ID NO: 58024 - DNA, 20 bp, Artificial Sequence
  Description of Artificial Sequence: Synthetic oligonucleotide
  Target: SCN9A; (-) strand; PAM type: YTN; PAM sequence: TTA
ggttcattcatcttaggcta

SEQ ID NO: 58025 - DNA, 20 bp, Artificial Sequence
  Description of Artificial Sequence: Synthetic oligonucleotide
  Target: SCN9A; (-) strand; PAM type: YTN; PAM sequence: CTT
aggttcattcatcttaggct

SEQ ID NO: 58026 - DNA, 20 bp, Artificial Sequence
  Description of Artificial Sequence: Synthetic oligonucleotide
  Target: SCN9A; (-) strand; PAM type: YTN; PAM sequence: TTA
taccatcttaggttcattca

SEQ ID NO: 58027 - DNA, 20 bp, Artificial Sequence
  Description of Artificial Sequence: Synthetic oligonucleotide
  Target: SCN9A; (-) strand; PAM type: YTN; PAM sequence: TTT
ataccatcttaggttcattc

SEQ ID NO: 58028 - DNA, 20 bp, Artificial Sequence
  Description of Artificial Sequence: Synthetic oligonucleotide
  Target: SCN9A; (-) strand; PAM type: YTN; PAM sequence: CTT
tataccatcttaggttcatt

SEQ ID NO: 58029 - DNA, 20 bp, Artificial Sequence
  Description of Artificial Sequence: Synthetic oligonucleotide
  Target: SCN9A; (-) strand; PAM type: YTN; PAM sequence: TTC
tttataccatcttaggttca

SEQ ID NO: 58030 - DNA, 20 bp, Artificial Sequence
  Description of Artificial Sequence: Synthetic oligonucleotide
  Target: SCN9A; (-) strand; PAM type: YTN; PAM sequence: CTA
aagattctttataccatctt

SEQ ID NO: 58031 - DNA, 20 bp, Artificial Sequence
  Description of Artificial Sequence: Synthetic oligonucleotide
  Target: SCN9A; (-) strand; PAM type: YTN; PAM sequence: CTA
gggctaaagattctttatac

SEQ ID NO: 58032 - DNA, 20 bp, Artificial Sequence
  Description of Artificial Sequence: Synthetic oligonucleotide
  Target: SCN9A; (-) strand; PAM type: YTN; PAM sequence: CTC
aatctagggctaaagattct

SEQ ID NO: 58033 - DNA, 20 bp, Artificial Sequence
  Description of Artificial Sequence: Synthetic oligonucleotide
  Target: SCN9A; (-) strand; PAM type: YTN; PAM sequence: CTA
cgtataaaactcaatctagg

SEQ ID NO: 58034 - DNA, 20 bp, Artificial Sequence
  Description of Artificial Sequence: Synthetic oligonucleotide
  Target: SCN9A; (-) strand; PAM type: YTN; PAM sequence: CTA
atctacgtataaaactcaat

SEQ ID NO: 58035 - DNA, 20 bp, Artificial Sequence
  Description of Artificial Sequence: Synthetic oligonucleotide
  Target: SCN9A; (-) strand; PAM type: YTN; PAM sequence: TTG
tcctaatctacgtataaaac

SEQ ID NO: 58036 - DNA, 20 bp, Artificial Sequence
  Description of Artificial Sequence: Synthetic oligonucleotide
  Target: SCN9A; (-) strand; PAM type: YTN; PAM sequence: TTT
gtcctaatctacgtataaaa

SEQ ID NO: 58037 - DNA, 20 bp, Artificial Sequence
  Description of Artificial Sequence: Synthetic oligonucleotide
  Target: SCN9A; (-) strand; PAM type: YTN; PAM sequence: TTG
agacatttgtcctaatctac

SEQ ID NO: 58038 - DNA, 20 bp, Artificial Sequence
  Description of Artificial Sequence: Synthetic oligonucleotide
  Target: SCN9A; (-) strand; PAM type: YTN; PAM sequence: TTT
gagacatttgtcctaatcta

SEQ ID NO: 58039 - DNA, 20 bp, Artificial Sequence
  Description of Artificial Sequence: Synthetic oligonucleotide
  Target: SCN9A; (-) strand; PAM type: YTN; PAM sequence: CTT
tgagacatttgtcctaatct

SEQ ID NO: 58040 - DNA, 20 bp, Artificial Sequence
  Description of Artificial Sequence: Synthetic oligonucleotide
  Target: SCN9A; (-) strand; PAM type: YTN; PAM sequence: TTA
ctttgagacatttgtcctaa

SEQ ID NO: 58041 - DNA, 20 bp, Artificial Sequence
  Description of Artificial Sequence: Synthetic oligonucleotide
  Target: SCN9A; (-) strand; PAM type: YTN; PAM sequence: TTA
ttactttgagacatttgtcc

SEQ ID NO: 58042 - DNA, 20 bp, Artificial Sequence
  Description of Artificial Sequence: Synthetic oligonucleotide
  Target: SCN9A; (-) strand; PAM type: YTN; PAM sequence: TTA
caacatccgttattactttg

SEQ ID NO: 58043 - DNA, 20 bp, Artificial Sequence
  Description of Artificial Sequence: Synthetic oligonucleotide
  Target: SCN9A; (-) strand; PAM type: YTN; PAM sequence: TTT
acaacatccgttattacttt

SEQ ID NO: 58044 - DNA, 20 bp, Artificial Sequence
  Description of Artificial Sequence: Synthetic oligonucleotide
  Target: SCN9A; (-) strand; PAM type: YTN; PAM sequence: TTT
tacaacatccgttattactt

SEQ ID NO: 58045 - DNA, 20 bp, Artificial Sequence
  Description of Artificial Sequence: Synthetic oligonucleotide
  Target: SCN9A; (-) strand; PAM type: YTN; PAM sequence: TTG
tgatatattttacaacatcc

SEQ ID NO: 58046 - DNA, 20 bp, Artificial Sequence
  Description of Artificial Sequence: Synthetic oligonucleotide
  Target: SCN9A; (-) strand; PAM type: YTN; PAM sequence: TTA
aattgtgatatattttacaa

SEQ ID NO: 58047 - DNA, 20 bp, Artificial Sequence
  Description of Artificial Sequence: Synthetic oligonucleotide
  Target: SCN9A; (-) strand; PAM type: YTN; PAM sequence: TTT
aaattgtgatatattttaca

SEQ ID NO: 58048 - DNA, 20 bp, Artificial Sequence
  Description of Artificial Sequence: Synthetic oligonucleotide
  Target: SCN9A; (-) strand; PAM type: YTN; PAM sequence: TTT
taaattgtgatatattttac

SEQ ID NO: 58049 - DNA, 20 bp, Artificial Sequence
  Description of Artificial Sequence: Synthetic oligonucleotide
  Target: SCN9A; (-) strand; PAM type: YTN; PAM sequence: TTT
ttaaattgtgatatatttta

SEQ ID NO: 58050 - DNA, 20 bp, Artificial Sequence
  Description of Artificial Sequence: Synthetic oligonucleotide
  Target: SCN9A; (-) strand; PAM type: YTN; PAM sequence: CTA
gaatgtttttaaattgtgat

SEQ ID NO: 58051 - DNA, 20 bp, Artificial Sequence
  Description of Artificial Sequence: Synthetic oligonucleotide
  Target: SCN9A; (-) strand; PAM type: YTN; PAM sequence: TTA
aagaatgagatcagaagtct

SEQ ID NO: 58052 - DNA, 20 bp, Artificial Sequence
  Description of Artificial Sequence: Synthetic oligonucleotide
  Target: SCN9A; (-) strand; PAM type: YTN; PAM sequence: TTA
tggttaaagaatgagatcag

SEQ ID NO: 58053 - DNA, 20 bp, Artificial Sequence
  Description of Artificial Sequence: Synthetic oligonucleotide
  Target: SCN9A; (-) strand; PAM type: YTN; PAM sequence: TTT
atggttaaagaatgagatca

SEQ ID NO: 58054 - DNA, 20 bp, Artificial Sequence
  Description of Artificial Sequence: Synthetic oligonucleotide
  Target: SCN9A; (-) strand; PAM type: YTN; PAM sequence: CTA
tagaaacaaagatttatggt

SEQ ID NO: 58055 - DNA, 20 bp, Artificial Sequence
  Description of Artificial Sequence: Synthetic oligonucleotide
  Target: SCN9A; (-) strand; PAM type: YTN; PAM sequence: TTA
aacgtacctatagaaacaaa

SEQ ID NO: 58056 - DNA, 20 bp, Artificial Sequence
  Description of Artificial Sequence: Synthetic oligonucleotide
  Target: SCN9A; (-) strand; PAM type: YTN; PAM sequence: TTT
aaacgtacctatagaaacaa

SEQ ID NO: 58057 - DNA, 20 bp, Artificial Sequence
  Description of Artificial Sequence: Synthetic oligonucleotide
  Target: SCN9A; (-) strand; PAM type: YTN; PAM sequence: TTA
aaaagaaagaggatttaaac

SEQ ID NO: 58058 - DNA, 20 bp, Artificial Sequence
  Description of Artificial Sequence: Synthetic oligonucleotide
  Target: SCN9A; (-) strand; PAM type: YTN; PAM sequence: TTT
aaaaagaaagaggatttaaa

SEQ ID NO: 58059 - DNA, 20 bp, Artificial Sequence
  Description of Artificial Sequence: Synthetic oligonucleotide
  Target: SCN9A; (-) strand; PAM type: YTN; PAM sequence: CTG
gcaatttaaaaagaaagagg

SEQ ID NO: 58060 - DNA, 20 bp, Artificial Sequence
  Description of Artificial Sequence: Synthetic oligonucleotide
  Target: SCN9A; (-) strand; PAM type: YTN; PAM sequence: TTC
tggcaatttaaaaagaaaga

SEQ ID NO: 58061 - DNA, 20 bp, Artificial Sequence
  Description of Artificial Sequence: Synthetic oligonucleotide
  Target: SCN9A; (-) strand; PAM type: YTN; PAM sequence: TTG
ttctggcaatttaaaaagaa

SEQ ID NO: 58062 - DNA, 20 bp, Artificial Sequence
  Description of Artificial Sequence: Synthetic oligonucleotide
  Target: SCN9A; (-) strand; PAM type: YTN; PAM sequence: TTG
ttgttctggcaatttaaaaa

SEQ ID NO: 58063 - DNA, 20 bp, Artificial Sequence
  Description of Artificial Sequence: Synthetic oligonucleotide
  Target: SCN9A; (-) strand; PAM type: YTN; PAM sequence: TTT
gttgttctggcaatttaaaa

SEQ ID NO: 58064 - DNA, 20 bp, Artificial Sequence
  Description of Artificial Sequence: Synthetic oligonucleotide
  Target: SCN9A; (-) strand; PAM type: YTN; PAM sequence: TTT
tgttgttctggcaatttaaa

SEQ ID NO: 58065 - DNA, 20 bp, Artificial Sequence
  Description of Artificial Sequence: Synthetic oligonucleotide
  Target: SCN9A; (-) strand; PAM type: YTN; PAM sequence: TTT
ttgttgttctggcaatttaa

SEQ ID NO: 58066 - DNA, 20 bp, Artificial Sequence
  Description of Artificial Sequence: Synthetic oligonucleotide
  Target: SCN9A; (-) strand; PAM type: YTN; PAM sequence: TTT
tttgttgttctggcaattta

SEQ ID NO: 58067 - DNA, 20 bp, Artificial Sequence
  Description of Artificial Sequence: Synthetic oligonucleotide
  Target: SCN9A; (-) strand; PAM type: YTN; PAM sequence: TTA
aagcacatattttttgttgt

SEQ ID NO: 58068 - DNA, 20 bp, Artificial Sequence
  Description of Artificial Sequence: Synthetic oligonucleotide
  Target: SCN9A; (-) strand; PAM type: YTN; PAM sequence: TTT
aaagcacatattttttgttg

SEQ ID NO: 58069 - DNA, 20 bp, Artificial Sequence
  Description of Artificial Sequence: Synthetic oligonucleotide
  Target: SCN9A; (-) strand; PAM type: YTN; PAM sequence: TTA
tataataaatgtttaaagca

SEQ ID NO: 58070 - DNA, 20 bp, Artificial Sequence
  Description of Artificial Sequence: Synthetic oligonucleotide
  Target: SCN9A; (-) strand; PAM type: YTN; PAM sequence: TTT
atataataaatgtttaaagc

SEQ ID NO: 58071 - DNA, 20 bp, Artificial Sequence
  Description of Artificial Sequence: Synthetic oligonucleotide
  Target: SCN9A; (-) strand; PAM type: YTN; PAM sequence: TTA
catttatataataaatgttt

SEQ ID NO: 58072 - DNA, 20 bp, Artificial Sequence
  Description of Artificial Sequence: Synthetic oligonucleotide
  Target: SCN9A; (-) strand; PAM type: YTN; PAM sequence: TTA
aaaaataataaattacattt

SEQ ID NO: 58073 - DNA, 20 bp, Artificial Sequence
  Description of Artificial Sequence: Synthetic oligonucleotide
  Target: SCN9A; (-) strand; PAM type: YTN; PAM sequence: TTT
aaaaaataataaattacatt

SEQ ID NO: 58074 - DNA, 20 bp, Artificial Sequence
  Description of Artificial Sequence: Synthetic oligonucleotide
  Target: SCN9A; (-) strand; PAM type: YTN; PAM sequence: TTC
catatttaaaaaataataaa

SEQ ID NO: 58075 - DNA, 20 bp, Artificial Sequence
  Description of Artificial Sequence: Synthetic oligonucleotide
  Target: SCN9A; (-) strand; PAM type: YTN; PAM sequence: TTT
ccatatttaaaaaataataa

SEQ ID NO: 58076 - DNA, 20 bp, Artificial Sequence
  Description of Artificial Sequence: Synthetic oligonucleotide
  Target: SCN9A; (-) strand; PAM type: YTN; PAM sequence: CTT
tccatatttaaaaaataata

SEQ ID NO: 58077 - DNA, 20 bp, Artificial Sequence
  Description of Artificial Sequence: Synthetic oligonucleotide
  Target: SCN9A; (-) strand; PAM type: YTN; PAM sequence: TTG
ctttccatatttaaaaaata

SEQ ID NO: 58078 - DNA, 20 bp, Artificial Sequence
  Description of Artificial Sequence: Synthetic oligonucleotide
  Target: SCN9A; (-) strand; PAM type: YTN; PAM sequence: TTT
gctttccatatttaaaaaat

SEQ ID NO: 58079 - DNA, 20 bp, Artificial Sequence
  Description of Artificial Sequence: Synthetic oligonucleotide
  Target: SCN9A; (-) strand; PAM type: YTN; PAM sequence: CTA
atttgctttccatatttaaa

SEQ ID NO: 58080 - DNA, 20 bp, Artificial Sequence
  Description of Artificial Sequence: Synthetic oligonucleotide
  Target: SCN9A; (-) strand; PAM type: YTN; PAM sequence: TTC
actaatttgctttccatatt

SEQ ID NO: 58081 - DNA, 20 bp, Artificial Sequence
  Description of Artificial Sequence: Synthetic oligonucleotide
  Target: SCN9A; (-) strand; PAM type: YTN; PAM sequence: TTT
cactaatttgctttccatat

SEQ ID NO: 58082 - DNA, 20 bp, Artificial Sequence
  Description of Artificial Sequence: Synthetic oligonucleotide
  Target: SCN9A; (-) strand; PAM type: YTN; PAM sequence: CTT
tcactaatttgctttccata

SEQ ID NO: 58083 - DNA, 20 bp, Artificial Sequence
  Description of Artificial Sequence: Synthetic oligonucleotide
  Target: SCN9A; (-) strand; PAM type: YTN; PAM sequence: TTG
aagcaaatatataaaacaac

SEQ ID NO: 58084 - DNA, 20 bp, Artificial Sequence
  Description of Artificial Sequence: Synthetic oligonucleotide
  Target: SCN9A; (-) strand; PAM type: YTN; PAM sequence: TTT
gaagcaaatatataaaacaa

SEQ ID NO: 58085 - DNA, 20 bp, Artificial Sequence
  Description of Artificial Sequence: Synthetic oligonucleotide
  Target: SCN9A; (-) strand; PAM type: YTN; PAM sequence: TTT
tgaagcaaatatataaaaca

SEQ ID NO: 58086 - DNA, 20 bp, Artificial Sequence
  Description of Artificial Sequence: Synthetic oligonucleotide
  Target: SCN9A; (-) strand; PAM type: YTN; PAM sequence: TTG
tgggaggttttgaagcaaat

SEQ ID NO: 58087 - DNA, 20 bp, Artificial Sequence
  Description of Artificial Sequence: Synthetic oligonucleotide
  Target: SCN9A; (-) strand; PAM type: YTN; PAM sequence: TTT
gtgggaggttttgaagcaaa

SEQ ID NO: 58088 - DNA, 20 bp, Artificial Sequence
  Description of Artificial Sequence: Synthetic oligonucleotide
  Target: SCN9A; (-) strand; PAM type: YTN; PAM sequence: TTT
tgtgggaggttttgaagcaa

SEQ ID NO: 58089 - DNA, 20 bp, Artificial Sequence
  Description of Artificial Sequence: Synthetic oligonucleotide
  Target: SCN9A; (-) strand; PAM type: YTN; PAM sequence: TTT
ttgtgggaggttttgaagca

SEQ ID NO: 58090 - DNA, 20 bp, Artificial Sequence
  Description of Artificial Sequence: Synthetic oligonucleotide
  Target: SCN9A; (-) strand; PAM type: YTN; PAM sequence: TTA
gaagatttttgtgggaggtt

SEQ ID NO: 58091 - DNA, 20 bp, Artificial Sequence
  Description of Artificial Sequence: Synthetic oligonucleotide
  Target: SCN9A; (-) strand; PAM type: YTN; PAM sequence: CTT
agaagatttttgtgggaggt

SEQ ID NO: 58092 - DNA, 20 bp, Artificial Sequence
  Description of Artificial Sequence: Synthetic oligonucleotide
  Target: SCN9A; (-) strand; PAM type: YTN; PAM sequence: TTA
cttagaagatttttgtggga

SEQ ID NO: 58093 - DNA, 20 bp, Artificial Sequence
  Description of Artificial Sequence: Synthetic oligonucleotide
  Target: SCN9A; (-) strand; PAM type: YTN; PAM sequence: TTT
acttagaagatttttgtggg

SEQ ID NO: 58094 - DNA, 20 bp, Artificial Sequence
  Description of Artificial Sequence: Synthetic oligonucleotide
  Target: SCN9A; (-) strand; PAM type: YTN; PAM sequence: TTT
tacttagaagatttttgtgg

SEQ ID NO: 58095 - DNA, 20 bp, Artificial Sequence
  Description of Artificial Sequence: Synthetic oligonucleotide
  Target: SCN9A; (-) strand; PAM type: YTN; PAM sequence: CTA
cacaggtagaatgtagtttt

SEQ ID NO: 58096 - DNA, 20 bp, Artificial Sequence
  Description of Artificial Sequence: Synthetic oligonucleotide
  Target: SCN9A; (-) strand; PAM type: YTN; PAM sequence: TTG
agctacacaggtagaatgta

SEQ ID NO: 58097 - DNA, 20 bp, Artificial Sequence
  Description of Artificial Sequence: Synthetic oligonucleotide
  Target: SCN9A; (-) strand; PAM type: YTN; PAM sequence: TTC
atgcacaggcaaaaattgag

SEQ ID NO: 58098 - DNA, 20 bp, Artificial Sequence
  Description of Artificial Sequence: Synthetic oligonucleotide
  Target: SCN9A; (-) strand; PAM type: YTN; PAM sequence: TTA
ttcatgcacaggcaaaaatt

SEQ ID NO: 58099 - DNA, 20 bp, Artificial Sequence
  Description of Artificial Sequence: Synthetic oligonucleotide
  Target: SCN9A; (-) strand; PAM type: YTN; PAM sequence: CTA
taaagttattcatgcacagg

SEQ ID NO: 58100 - DNA, 20 bp, Artificial Sequence
  Description of Artificial Sequence: Synthetic oligonucleotide
  Target: SCN9A; (-) strand; PAM type: YTN; PAM sequence: TTC
tataaagttattcatgcaca

SEQ ID NO: 58101 - DNA, 20 bp, Artificial Sequence
  Description of Artificial Sequence: Synthetic oligonucleotide
  Target: SCN9A; (-) strand; PAM type: YTN; PAM sequence: CTT
ctataaagttattcatgcac

SEQ ID NO: 58102 - DNA, 20 bp, Artificial Sequence
  Description of Artificial Sequence: Synthetic oligonucleotide
  Target: SCN9A; (-) strand; PAM type: YTN; PAM sequence: TTC
ttctataaagttattcatgc

SEQ ID NO: 58103 - DNA, 20 bp, Artificial Sequence
  Description of Artificial Sequence: Synthetic oligonucleotide
  Target: SCN9A; (-) strand; PAM type: YTN; PAM sequence: TTT
cttctataaagttattcatg

SEQ ID NO: 58104 - DNA, 20 bp, Artificial Sequence
  Description of Artificial Sequence: Synthetic oligonucleotide
  Target: SCN9A; (-) strand; PAM type: YTN; PAM sequence: CTT
tcttctataaagttattcat

SEQ ID NO: 58105 - DNA, 20 bp, Artificial Sequence
  Description of Artificial Sequence: Synthetic oligonucleotide
  Target: SCN9A; (-) strand; PAM type: YTN; PAM sequence: TTC
aggaatatgagatctttctt

SEQ ID NO: 58106 - DNA, 20 bp, Artificial Sequence
  Description of Artificial Sequence: Synthetic oligonucleotide
  Target: SCN9A; (-) strand; PAM type: YTN; PAM sequence: TTT
caggaatatgagatctttct

SEQ ID NO: 58107 - DNA, 20 bp, Artificial Sequence
  Description of Artificial Sequence: Synthetic oligonucleotide
  Target: SCN9A; (-) strand; PAM type: YTN; PAM sequence: TTA
tttcaggaatatgagatctt

SEQ ID NO: 58108 - DNA, 20 bp, Artificial Sequence
  Description of Artificial Sequence: Synthetic oligonucleotide
  Target: SCN9A; (-) strand; PAM type: YTN; PAM sequence: TTT
atttcaggaatatgagatct

SEQ ID NO: 58109 - DNA, 20 bp, Artificial Sequence
  Description of Artificial Sequence: Synthetic oligonucleotide
  Target: SCN9A; (-) strand; PAM type: YTN; PAM sequence: TTC
gtgagtttatttcaggaata

SEQ ID NO: 58110 - DNA, 20 bp, Artificial Sequence
  Description of Artificial Sequence: Synthetic oligonucleotide
  Target: SCN9A; (-) strand; PAM type: YTN; PAM sequence: TTT
cgtgagtttatttcaggaat

SEQ ID NO: 58111 - DNA, 20 bp, Artificial Sequence
  Description of Artificial Sequence: Synthetic oligonucleotide
  Target: SCN9A; (-) strand; PAM type: YTN; PAM sequence: TTT
tcgtgagtttatttcaggaa

SEQ ID NO: 58112 - DNA, 20 bp, Artificial Sequence
  Description of Artificial Sequence: Synthetic oligonucleotide
  Target: SCN9A; (-) strand; PAM type: YTN; PAM sequence: TTT
ttcgtgagtttatttcagga

SEQ ID NO: 58113 - DNA, 20 bp, Artificial Sequence
  Description of Artificial Sequence: Synthetic oligonucleotide
  Target: SCN9A; (-) strand; PAM type: YTN; PAM sequence: TTT
tttcgtgagtttatttcagg

SEQ ID NO: 58114 - DNA, 20 bp, Artificial Sequence
  Description of Artificial Sequence: Synthetic oligonucleotide
  Target: SCN9A; (-) strand; PAM type: YTN; PAM sequence: TTT
ttttcgtgagtttatttcag

SEQ ID NO: 58115 - DNA, 20 bp, Artificial Sequence
  Description of Artificial Sequence: Synthetic oligonucleotide
  Target: SCN9A; (-) strand; PAM type: YTN; PAM sequence: CTT
tttttcgtgagtttatttca

SEQ ID NO: 58116 - DNA, 20 bp, Artificial Sequence
  Description of Artificial Sequence: Synthetic oligonucleotide
  Target: SCN9A; (-) strand; PAM type: YTN; PAM sequence: TTG
aaaagaaataaccataatgc

SEQ ID NO: 58117 - DNA, 20 bp, Artificial Sequence
  Description of Artificial Sequence: Synthetic oligonucleotide
  Target: SCN9A; (-) strand; PAM type: YTN; PAM sequence: TTT
gaaaagaaataaccataatg

SEQ ID NO: 58118 - DNA, 20 bp, Artificial Sequence
  Description of Artificial Sequence: Synthetic oligonucleotide
  Target: SCN9A; (-) strand; PAM type: YTN; PAM sequence: TTA
atagtaatttgaaaagaaat

SEQ ID NO: 58119 - DNA, 20 bp, Artificial Sequence
  Description of Artificial Sequence: Synthetic oligonucleotide
  Target: SCN9A; (-) strand; PAM type: YTN; PAM sequence: CTA
ttaatagtaatttgaaaaga

SEQ ID NO: 58120 - DNA, 20 bp, Artificial Sequence
  Description of Artificial Sequence: Synthetic oligonucleotide
  Target: SCN9A; (-) strand; PAM type: YTN; PAM sequence: TTG
aaaacacctattaatagtaa

SEQ ID NO: 58121 - DNA, 20 bp, Artificial Sequence
  Description of Artificial Sequence: Synthetic oligonucleotide
  Target: SCN9A; (-) strand; PAM type: YTN; PAM sequence: TTT
gaaaacacctattaatagta

SEQ ID NO: 58122 - DNA, 20 bp, Artificial Sequence
  Description of Artificial Sequence: Synthetic oligonucleotide
  Target: SCN9A; (-) strand; PAM type: YTN; PAM sequence: TTT
tgaaaacacctattaatagt

SEQ ID NO: 58123 - DNA, 20 bp, Artificial Sequence
  Description of Artificial Sequence: Synthetic oligonucleotide
  Target: SCN9A; (-) strand; PAM type: YTN; PAM sequence: TTT
ttgaaaacacctattaatag

SEQ ID NO: 58124 - DNA, 20 bp, Artificial Sequence
  Description of Artificial Sequence: Synthetic oligonucleotide
  Target: SCN9A; (-) strand; PAM type: YTN; PAM sequence: TTT
tttgaaaacacctattaata

SEQ ID NO: 58125 - DNA, 20 bp, Artificial Sequence
  Description of Artificial Sequence: Synthetic oligonucleotide
  Target: SCN9A; (-) strand; PAM type: YTN; PAM sequence: CTA
gttttttgaaaacacctatt

SEQ ID NO: 58126 - DNA, 20 bp, Artificial Sequence
  Description of Artificial Sequence: Synthetic oligonucleotide
  Target: SCN9A; (-) strand; PAM type: YTN; PAM sequence: CTG
tagacatctagttttttgaa

SEQ ID NO: 58127 - DNA, 20 bp, Artificial Sequence
  Description of Artificial Sequence: Synthetic oligonucleotide
  Target: SCN9A; (-) strand; PAM type: YTN; PAM sequence: TTA
gctgtagacatctagttttt

SEQ ID NO: 58128 - DNA, 20 bp, Artificial Sequence
  Description of Artificial Sequence: Synthetic oligonucleotide
  Target: SCN9A; (-) strand; PAM type: YTN; PAM sequence: TTG
cattagctgtagacatctag

SEQ ID NO: 58129 - DNA, 20 bp, Artificial Sequence
  Description of Artificial Sequence: Synthetic oligonucleotide
  Target: SCN9A; (-) strand; PAM type: YTN; PAM sequence: TTT
gcattagctgtagacatcta

SEQ ID NO: 58130 - DNA, 20 bp, Artificial Sequence
  Description of Artificial Sequence: Synthetic oligonucleotide
  Target: SCN9A; (-) strand; PAM type: YTN; PAM sequence: TTT
tgcattagctgtagacatct

SEQ ID NO: 58131 - DNA, 20 bp, Artificial Sequence
  Description of Artificial Sequence: Synthetic oligonucleotide
  Target: SCN9A; (-) strand; PAM type: YTN; PAM sequence: TTC
attttgcattagctgtagac

SEQ ID NO: 58132 - DNA, 20 bp, Artificial Sequence
  Description of Artificial Sequence: Synthetic oligonucleotide
  Target: SCN9A; (-) strand; PAM type: YTN; PAM sequence: TTA
tcaagcacatattcattttg

SEQ ID NO: 58133 - DNA, 20 bp, Artificial Sequence
  Description of Artificial Sequence: Synthetic oligonucleotide
  Target: SCN9A; (-) strand; PAM type: YTN; PAM sequence: TTT
atcaagcacatattcatttt

SEQ ID NO: 58134 - DNA, 20 bp, Artificial Sequence
  Description of Artificial Sequence: Synthetic oligonucleotide
  Target: SCN9A; (-) strand; PAM type: YTN; PAM sequence: CTA
atttatcaagcacatattca

SEQ ID NO: 58135 - DNA, 20 bp, Artificial Sequence
  Description of Artificial Sequence: Synthetic oligonucleotide
  Target: SCN9A; (-) strand; PAM type: YTN; PAM sequence: TTC
taatttatcaagcacatatt

SEQ ID NO: 58136 - DNA, 20 bp, Artificial Sequence
  Description of Artificial Sequence: Synthetic oligonucleotide
  Target: SCN9A; (-) strand; PAM type: YTN; PAM sequence: CTT
ctaatttatcaagcacatat

SEQ ID NO: 58137 - DNA, 20 bp, Artificial Sequence
  Description of Artificial Sequence: Synthetic oligonucleotide
  Target: SCN9A; (-) strand; PAM type: YTN; PAM sequence: CTC
aatcaacacagtaccatggg

SEQ ID NO: 58138 - DNA, 20 bp, Artificial Sequence
  Description of Artificial Sequence: Synthetic oligonucleotide
  Target: SCN9A; (-) strand; PAM type: YTN; PAM sequence: TTG
cctcaatcaacacagtacca

SEQ ID NO: 58139 - DNA, 20 bp, Artificial Sequence
  Description of Artificial Sequence: Synthetic oligonucleotide
  Target: SCN9A; (-) strand; PAM type: YTN; PAM sequence: TTT
gcctcaatcaacacagtacc

SEQ ID NO: 58140 - DNA, 20 bp, Artificial Sequence
  Description of Artificial Sequence: Synthetic oligonucleotide
  Target: SCN9A; (-) strand; PAM type: YTN; PAM sequence: TTT
tgcctcaatcaacacagtac

SEQ ID NO: 58141 - DNA, 20 bp, Artificial Sequence
  Description of Artificial Sequence: Synthetic oligonucleotide
  Target: SCN9A; (-) strand; PAM type: YTN; PAM sequence: CTA
tgatgtgaaatatattttgc

SEQ ID NO: 58142 - DNA, 20 bp, Artificial Sequence
  Description of Artificial Sequence: Synthetic oligonucleotide
  Target: SCN9A; (-) strand; PAM type: YTN; PAM sequence: TTC
tatgatgtgaaatatatttt

SEQ ID NO: 58143 - DNA, 20 bp, Artificial Sequence
  Description of Artificial Sequence: Synthetic oligonucleotide
  Target: SCN9A; (-) strand; PAM type: YTN; PAM sequence: TTA
aaattctatgatgtgaaata

SEQ ID NO: 58144 - DNA, 20 bp, Artificial Sequence
  Description of Artificial Sequence: Synthetic oligonucleotide
  Target: SCN9A; (-) strand; PAM type: YTN; PAM sequence: CTT
aaaattctatgatgtgaaat

SEQ ID NO: 58145 - DNA, 20 bp, Artificial Sequence
  Description of Artificial Sequence: Synthetic oligonucleotide
  Target: SCN9A; (-) strand; PAM type: YTN; PAM sequence: CTC
cttaaaattctatgatgtga

SEQ ID NO: 58146 - DNA, 20 bp, Artificial Sequence
  Description of Artificial Sequence: Synthetic oligonucleotide
  Target: SCN9A; (-) strand; PAM type: YTN; PAM sequence: TTC
tccttaaaattctatgatgt

SEQ ID NO: 58147 - DNA, 20 bp, Artificial Sequence
  Description of Artificial Sequence: Synthetic oligonucleotide
  Target: SCN9A; (-) strand; PAM type: YTN; PAM sequence: CTT
ctccttaaaattctatgatg

SEQ ID NO: 58148 - DNA, 20 bp, Artificial Sequence
  Description of Artificial Sequence: Synthetic oligonucleotide
  Target: SCN9A; (-) strand; PAM type: YTN; PAM sequence: TTC
aatgtatacaatgaggaaga

SEQ ID NO: 58149 - DNA, 20 bp, Artificial Sequence
  Description of Artificial Sequence: Synthetic oligonucleotide
  Target: SCN9A; (-) strand; PAM type: YTN; PAM sequence: CTT
caatgtatacaatgaggaag

SEQ ID NO: 58150 - DNA, 20 bp, Artificial Sequence
  Description of Artificial Sequence: Synthetic oligonucleotide
  Target: SCN9A; (-) strand; PAM type: YTN; PAM sequence: TTG
gatatacttcaatgtataca

SEQ ID NO: 58151 - DNA, 20 bp, Artificial Sequence
  Description of Artificial Sequence: Synthetic oligonucleotide
  Target: SCN9A; (-) strand; PAM type: YTN; PAM sequence: TTT
ggatatacttcaatgtatac

SEQ ID NO: 58152 - DNA, 20 bp, Artificial Sequence
  Description of Artificial Sequence: Synthetic oligonucleotide
  Target: SCN9A; (-) strand; PAM type: YTN; PAM sequence: TTT
tggatatacttcaatgtata

SEQ ID NO: 58153 - DNA, 20 bp, Artificial Sequence
  Description of Artificial Sequence: Synthetic oligonucleotide
  Target: SCN9A; (-) strand; PAM type: YTN; PAM sequence: TTT
ttggatatacttcaatgtat

SEQ ID NO: 58154 - DNA, 20 bp, Artificial Sequence
  Description of Artificial Sequence: Synthetic oligonucleotide
  Target: SCN9A; (-) strand; PAM type: YTN; PAM sequence: TTT
tttggatatacttcaatgta

SEQ ID NO: 58155 - DNA, 20 bp, Artificial Sequence
  Description of Artificial Sequence: Synthetic oligonucleotide
  Target: SCN9A; (-) strand; PAM type: YTN; PAM sequence: CTT
ttttggatatacttcaatgt

SEQ ID NO: 58156 - DNA, 20 bp, Artificial Sequence
  Description of Artificial Sequence: Synthetic oligonucleotide
  Target: SCN9A; (-) strand; PAM type: YTN; PAM sequence: TTA
tggaagtaatcttttttgga

SEQ ID NO: 58157 - DNA, 20 bp, Artificial Sequence
  Description of Artificial Sequence: Synthetic oligonucleotide
  Target: SCN9A; (-) strand; PAM type: YTN; PAM sequence: CTA
aattatggaagtaatctttt

SEQ ID NO: 58158 - DNA, 20 bp, Artificial Sequence
  Description of Artificial Sequence: Synthetic oligonucleotide
  Target: SCN9A; (-) strand; PAM type: YTN; PAM sequence: TTC
ctaaattatggaagtaatct

SEQ ID NO: 58159 - DNA, 20 bp, Artificial Sequence
  Description of Artificial Sequence: Synthetic oligonucleotide
  Target: SCN9A; (-) strand; PAM type: YTN; PAM sequence: TTT
cctaaattatggaagtaatc

SEQ ID NO: 58160 - DNA, 20 bp, Artificial Sequence
  Description of Artificial Sequence: Synthetic oligonucleotide
  Target: SCN9A; (-) strand; PAM type: YTN; PAM sequence: CTT
tcctaaattatggaagtaat

SEQ ID NO: 58161 - DNA, 20 bp, Artificial Sequence
  Description of Artificial Sequence: Synthetic oligonucleotide
  Target: SCN9A; (-) strand; PAM type: YTN; PAM sequence: TTA
ctttcctaaattatggaagt

SEQ ID NO: 58162 - DNA, 20 bp, Artificial Sequence
  Description of Artificial Sequence: Synthetic oligonucleotide
  Target: SCN9A; (-) strand; PAM type: YTN; PAM sequence: CTT
actttcctaaattatggaag

SEQ ID NO: 58163 - DNA, 20 bp, Artificial Sequence
  Description of Artificial Sequence: Synthetic oligonucleotide
  Target: SCN9A; (-) strand; PAM type: YTN; PAM sequence: TTG
ccaccaacttactttcctaa

SEQ ID NO: 58164 - DNA, 20 bp, Artificial Sequence
  Description of Artificial Sequence: Synthetic oligonucleotide
  Target: SCN9A; (-) strand; PAM type: YTN; PAM sequence: CTT
gccaccaacttactttccta

SEQ ID NO: 58165 - DNA, 20 bp, Artificial Sequence
  Description of Artificial Sequence: Synthetic oligonucleotide
  Target: SCN9A; (-) strand; PAM type: YTN; PAM sequence: CTC
ttgccaccaacttactttcc

SEQ ID NO: 58166 - DNA, 20 bp, Artificial Sequence
  Description of Artificial Sequence: Synthetic oligonucleotide
  Target: SCN9A; (-) strand; PAM type: YTN; PAM sequence: CTC
tcttgccaccaacttacttt

SEQ ID NO: 58167 - DNA, 20 bp, Artificial Sequence
  Description of Artificial Sequence: Synthetic oligonucleotide
  Target: SCN9A; (-) strand; PAM type: YTN; PAM sequence: TTG
ctctcttgccaccaacttac

SEQ ID NO: 58168 - DNA, 20 bp, Artificial Sequence
  Description of Artificial Sequence: Synthetic oligonucleotide
  Target: SCN9A; (-) strand; PAM type: YTN; PAM sequence: CTT
gctctcttgccaccaactta

SEQ ID NO: 58169 - DNA, 20 bp, Artificial Sequence
  Description of Artificial Sequence: Synthetic oligonucleotide
  Target: SCN9A; (-) strand; PAM type: YTN; PAM sequence: TTG
ccaacttgctctcttgccac

SEQ ID NO: 58170 - DNA, 20 bp, Artificial Sequence
  Description of Artificial Sequence: Synthetic oligonucleotide
  Target: SCN9A; (-) strand; PAM type: YTN; PAM sequence: CTT
gccaacttgctctcttgcca

SEQ ID NO: 58171 - DNA, 20 bp, Artificial Sequence
  Description of Artificial Sequence: Synthetic oligonucleotide
  Target: SCN9A; (-) strand; PAM type: YTN; PAM sequence: TTC
ttgccaacttgctctcttgc

SEQ ID NO: 58172 - DNA, 20 bp, Artificial Sequence
  Description of Artificial Sequence: Synthetic oligonucleotide
  Target: SCN9A; (-) strand; PAM type: YTN; PAM sequence: TTG
aaatagggattcttgccaac

SEQ ID NO: 58173 - DNA, 20 bp, Artificial Sequence
  Description of Artificial Sequence: Synthetic oligonucleotide
  Target: SCN9A; (-) strand; PAM type: YTN; PAM sequence: TTA
gtatgaataaaaaagcattg

SEQ ID NO: 58174 - DNA, 20 bp, Artificial Sequence
  Description of Artificial Sequence: Synthetic oligonucleotide
  Target: SCN9A; (-) strand; PAM type: YTN; PAM sequence: TTT
agtatgaataaaaaagcatt

SEQ ID NO: 58175 - DNA, 20 bp, Artificial Sequence
  Description of Artificial Sequence: Synthetic oligonucleotide
  Target: SCN9A; (-) strand; PAM type: YTN; PAM sequence: TTA
cacagatatgtgtttagtat

SEQ ID NO: 58176 - DNA, 20 bp, Artificial Sequence
  Description of Artificial Sequence: Synthetic oligonucleotide
  Target: SCN9A; (-) strand; PAM type: YTN; PAM sequence: TTT
acacagatatgtgtttagta

SEQ ID NO: 58177 - DNA, 20 bp, Artificial Sequence
  Description of Artificial Sequence: Synthetic oligonucleotide
  Target: SCN9A; (-) strand; PAM type: YTN; PAM sequence: CTT
tacacagatatgtgtttagt

SEQ ID NO: 58178 - DNA, 20 bp, Artificial Sequence
  Description of Artificial Sequence: Synthetic oligonucleotide
  Target: SCN9A; (-) strand; PAM type: YTN; PAM sequence: TTC
aaatcatgtaatatgacaga

SEQ ID NO: 58179 - DNA, 20 bp, Artificial Sequence
  Description of Artificial Sequence: Synthetic oligonucleotide
  Target: SCN9A; (-) strand; PAM type: YTN; PAM sequence: TTT
caaatcatgtaatatgacag

SEQ ID NO: 58180 - DNA, 20 bp, Artificial Sequence
  Description of Artificial Sequence: Synthetic oligonucleotide
  Target: SCN9A; (-) strand; PAM type: YTN; PAM sequence: CTT
tcaaatcatgtaatatgaca

SEQ ID NO: 58181 - DNA, 20 bp, Artificial Sequence
  Description of Artificial Sequence: Synthetic oligonucleotide
  Target: SCN9A; (-) strand; PAM type: YTN; PAM sequence: TTG
gcaagctttcaaatcatgta

SEQ ID NO: 58182 - DNA, 20 bp, Artificial Sequence
  Description of Artificial Sequence: Synthetic oligonucleotide
  Target: SCN9A; (-) strand; PAM type: YTN; PAM sequence: TTT
ggcaagctttcaaatcatgt

SEQ ID NO: 58183 - DNA, 20 bp, Artificial Sequence
  Description of Artificial Sequence: Synthetic oligonucleotide
  Target: SCN9A; (-) strand; PAM type: YTN; PAM sequence: TTG
tatacaatcccgtgtttggc

SEQ ID NO: 58184 - DNA, 20 bp, Artificial Sequence
  Description of Artificial Sequence: Synthetic oligonucleotide
  Target: SCN9A; (-) strand; PAM type: YTN; PAM sequence: CTT
gtatacaatcccgtgtttgg

SEQ ID NO: 58185 - DNA, 20 bp, Artificial Sequence
  Description of Artificial Sequence: Synthetic oligonucleotide
  Target: SCN9A; (-) strand; PAM type: YTN; PAM sequence: TTG
catcacttgtatacaatccc

SEQ ID NO: 58186 - DNA, 20 bp, Artificial Sequence
  Description of Artificial Sequence: Synthetic oligonucleotide
  Target: SCN9A; (-) strand; PAM type: YTN; PAM sequence: TTA
ttgcatcacttgtatacaat

SEQ ID NO: 58187 - DNA, 20 bp, Artificial Sequence
  Description of Artificial Sequence: Synthetic oligonucleotide
  Target: SCN9A; (-) strand; PAM type: YTN; PAM sequence: TTT
attgcatcacttgtatacaa

SEQ ID NO: 58188 - DNA, 20 bp, Artificial Sequence
  Description of Artificial Sequence: Synthetic oligonucleotide
  Target: SCN9A; (-) strand; PAM type: YTN; PAM sequence: TTG
ggcacagtatttattgcatc

SEQ ID NO: 58189 - DNA, 20 bp, Artificial Sequence
  Description of Artificial Sequence: Synthetic oligonucleotide
  Target: SCN9A; (-) strand; PAM type: YTN; PAM sequence: CTT
gggcacagtatttattgcat

SEQ ID NO: 58190 - DNA, 20 bp, Artificial Sequence
  Description of Artificial Sequence: Synthetic oligonucleotide
  Target: SCN9A; (-) strand; PAM type: YTN; PAM sequence: TTG
agcagataataacttgggca

SEQ ID NO: 58191 - DNA, 20 bp, Artificial Sequence
  Description of Artificial Sequence: Synthetic oligonucleotide
  Target: SCN9A; (-) strand; PAM type: YTN; PAM sequence: CTT
gagcagataataacttgggc

SEQ ID NO: 58192 - DNA, 20 bp, Artificial Sequence
  Description of Artificial Sequence: Synthetic oligonucleotide
  Target: SCN9A; (-) strand; PAM type: YTN; PAM sequence: TTG
accacggtacatacttgagc

SEQ ID NO: 58193 - DNA, 20 bp, Artificial Sequence
  Description of Artificial Sequence: Synthetic oligonucleotide
  Target: SCN9A; (-) strand; PAM type: YTN; PAM sequence: TTT
gaccacggtacatacttgag

SEQ ID NO: 58194 - DNA, 20 bp, Artificial Sequence
  Description of Artificial Sequence: Synthetic oligonucleotide
  Target: SCN9A; (-) strand; PAM type: YTN; PAM sequence: TTG
tttgaccacggtacatactt

SEQ ID NO: 58195 - DNA, 20 bp, Artificial Sequence
  Description of Artificial Sequence: Synthetic oligonucleotide
  Target: SCN9A; (-) strand; PAM type: YTN; PAM sequence: TTA
gttgtttgaccacggtacat

SEQ ID NO: 58196 - DNA, 20 bp, Artificial Sequence
  Description of Artificial Sequence: Synthetic oligonucleotide
  Target: SCN9A; (-) strand; PAM type: YTN; PAM sequence: CTG
atatgcagttagttgtttga

SEQ ID NO: 58197 - DNA, 20 bp, Artificial Sequence
  Description of Artificial Sequence: Synthetic oligonucleotide
  Target: SCN9A; (-) strand; PAM type: YTN; PAM sequence: TTC
ctgatatgcagttagttgtt

SEQ ID NO: 58198 - DNA, 20 bp, Artificial Sequence
  Description of Artificial Sequence: Synthetic oligonucleotide
  Target: SCN9A; (-) strand; PAM type: YTN; PAM sequence: CTT
cctgatatgcagttagttgt

SEQ ID NO: 58199 - DNA, 20 bp, Artificial Sequence
  Description of Artificial Sequence: Synthetic oligonucleotide
  Target: SCN9A; (-) strand; PAM type: YTN; PAM sequence: TTG
atgaaatccttcctgatatg

SEQ ID NO: 58200 - DNA, 20 bp, Artificial Sequence
  Description of Artificial Sequence: Synthetic oligonucleotide
  Target: SCN9A; (-) strand; PAM type: YTN; PAM sequence: CTG
taagcaaagttgatgaaatc

SEQ ID NO: 58201 - DNA, 20 bp, Artificial Sequence
  Description of Artificial Sequence: Synthetic oligonucleotide
  Target: SCN9A; (-) strand; PAM type: YTN; PAM sequence: TTC
gctgtaagcaaagttgatga

SEQ ID NO: 58202 - DNA, 20 bp, Artificial Sequence
  Description of Artificial Sequence: Synthetic oligonucleotide
  Target: SCN9A; (-) strand; PAM type: YTN; PAM sequence: TTT
cgctgtaagcaaagttgatg

SEQ ID NO: 58203 - DNA, 20 bp, Artificial Sequence
  Description of Artificial Sequence: Synthetic oligonucleotide
  Target: SCN9A; (-) strand; PAM type: YTN; PAM sequence: CTT
tcgctgtaagcaaagttgat

SEQ ID NO: 58204 - DNA, 20 bp, Artificial Sequence
  Description of Artificial Sequence: Synthetic oligonucleotide
  Target: SCN9A; (-) strand; PAM type: YTN; PAM sequence: TTA
gtcatcctttcgctgtaagc

SEQ ID NO: 58205 - DNA, 20 bp, Artificial Sequence
  Description of Artificial Sequence: Synthetic oligonucleotide
  Target: SCN9A; (-) strand; PAM type: YTN; PAM sequence: TTT
agtcatcctttcgctgtaag

SEQ ID NO: 58206 - DNA, 20 bp, Artificial Sequence
  Description of Artificial Sequence: Synthetic oligonucleotide
  Target: SCN9A; (-) strand; PAM type: YTN; PAM sequence: TTG
tttagtcatcctttcgctgt

SEQ ID NO: 58207 - DNA, 20 bp, Artificial Sequence
  Description of Artificial Sequence: Synthetic oligonucleotide
  Target: SCN9A; (-) strand; PAM type: YTN; PAM sequence: TTA
tgcagtattgtttagtcatc

SEQ ID NO: 58208 - DNA, 20 bp, Artificial Sequence
  Description of Artificial Sequence: Synthetic oligonucleotide
  Target: SCN9A; (-) strand; PAM type: YTN; PAM sequence: CTT
atgcagtattgtttagtcat

SEQ ID NO: 58209 - DNA, 20 bp, Artificial Sequence
  Description of Artificial Sequence: Synthetic oligonucleotide
  Target: SCN9A; (-) strand; PAM type: YTN; PAM sequence: TTC
ttatgcagtattgtttagtc

SEQ ID NO: 58210 - DNA, 20 bp, Artificial Sequence
  Description of Artificial Sequence: Synthetic oligonucleotide
  Target: SCN9A; (-) strand; PAM type: YTN; PAM sequence: TTT
cttatgcagtattgtttagt

SEQ ID NO: 58211 - DNA, 20 bp, Artificial Sequence
  Description of Artificial Sequence: Synthetic oligonucleotide
  Target: SCN9A; (-) strand; PAM type: YTN; PAM sequence: CTT
tcttatgcagtattgtttag

SEQ ID NO: 58212 - DNA, 20 bp, Artificial Sequence
  Description of Artificial Sequence: Synthetic oligonucleotide
  Target: SCN9A; (-) strand; PAM type: YTN; PAM sequence: CTG
ctttcttatgcagtattgtt

SEQ ID NO: 58213 - DNA, 20 bp, Artificial Sequence
  Description of Artificial Sequence: Synthetic oligonucleotide
  Target: SCN9A; (-) strand; PAM type: YTN; PAM sequence: TTC
ctgctttcttatgcagtatt

SEQ ID NO: 58214 - DNA, 20 bp, Artificial Sequence
  Description of Artificial Sequence: Synthetic oligonucleotide
  Target: SCN9A; (-) strand; PAM type: YTN; PAM sequence: TTT
cctgctttcttatgcagtat

SEQ ID NO: 58215 - DNA, 20 bp, Artificial Sequence
  Description of Artificial Sequence: Synthetic oligonucleotide
  Target: SCN9A; (-) strand; PAM type: YTN; PAM sequence: TTT
tcctgctttcttatgcagta

SEQ ID NO: 58216 - DNA, 20 bp, Artificial Sequence
  Description of Artificial Sequence: Synthetic oligonucleotide
  Target: SCN9A; (-) strand; PAM type: YTN; PAM sequence: TTG
tcaaattttcctgctttctt

SEQ ID NO: 58217 - DNA, 20 bp, Artificial Sequence
  Description of Artificial Sequence: Synthetic oligonucleotide
  Target: SCN9A; (-) strand; PAM type: YTN; PAM sequence: TTT
gtcaaattttcctgctttct

SEQ ID NO: 58218 - DNA, 20 bp, Artificial Sequence
  Description of Artificial Sequence: Synthetic oligonucleotide
  Target: SCN9A; (-) strand; PAM type: YTN; PAM sequence: TTT
tgtcaaattttcctgctttc

SEQ ID NO: 58219 - DNA, 20 bp, Artificial Sequence
  Description of Artificial Sequence: Synthetic oligonucleotide
  Target: SCN9A; (-) strand; PAM type: YTN; PAM sequence: CTT
ttgtcaaattttcctgcttt

SEQ ID NO: 58220 - DNA, 20 bp, Artificial Sequence
  Description of Artificial Sequence: Synthetic oligonucleotide
  Target: SCN9A; (-) strand; PAM type: YTN; PAM sequence: CTC
ttttgtcaaattttcctgct

SEQ ID NO: 58221 - DNA, 20 bp, Artificial Sequence
  Description of Artificial Sequence: Synthetic oligonucleotide
  Target: SCN9A; (-) strand; PAM type: YTN; PAM sequence: TTA
aactcttttgtcaaattttc

SEQ ID NO: 58222 - DNA, 20 bp, Artificial Sequence
  Description of Artificial Sequence: Synthetic oligonucleotide
  Target: SCN9A; (-) strand; PAM type: YTN; PAM sequence: CTT
aaactcttttgtcaaatttt

SEQ ID NO: 58223 - DNA, 20 bp, Artificial Sequence
  Description of Artificial Sequence: Synthetic oligonucleotide
  Target: SCN9A; (-) strand; PAM type: YTN; PAM sequence: CTC
ttaaactcttttgtcaaatt

SEQ ID NO: 58224 - DNA, 20 bp, Artificial Sequence
  Description of Artificial Sequence: Synthetic oligonucleotide
  Target: SCN9A; (-) strand; PAM type: YTN; PAM sequence: CTG
ataatagtctcttaaactct

SEQ ID NO: 58225 - DNA, 20 bp, Artificial Sequence
  Description of Artificial Sequence: Synthetic oligonucleotide
  Target: SCN9A; (-) strand; PAM type: YTN; PAM sequence: CTG
cccaaaatactgataatagt

SEQ ID NO: 58226 - DNA, 20 bp, Artificial Sequence
  Description of Artificial Sequence: Synthetic oligonucleotide
  Target: SCN9A; (-) strand; PAM type: YTN; PAM sequence: CTG
tgctgcccaaaatactgata

SEQ ID NO: 58227 - DNA, 20 bp, Artificial Sequence
  Description of Artificial Sequence: Synthetic oligonucleotide
  Target: SCN9A; (-) strand; PAM type: YTN; PAM sequence: TTG
actgtgctgcccaaaatact

SEQ ID NO: 58228 - DNA, 20 bp, Artificial Sequence
  Description of Artificial Sequence: Synthetic oligonucleotide
  Target: SCN9A; (-) strand; PAM type: YTN; PAM sequence: TTT
gactgtgctgcccaaaatac

SEQ ID NO: 58229 - DNA, 20 bp, Artificial Sequence
  Description of Artificial Sequence: Synthetic oligonucleotide
  Target: SCN9A; (-) strand; PAM type: YTN; PAM sequence: CTA
acatttgactgtgctgccca

SEQ ID NO: 58230 - DNA, 20 bp, Artificial Sequence
  Description of Artificial Sequence: Synthetic oligonucleotide
  Target: SCN9A; (-) strand; PAM type: YTN; PAM sequence: TTA
catagcctaacatttgactg

SEQ ID NO: 58231 - DNA, 20 bp, Artificial Sequence
  Description of Artificial Sequence: Synthetic oligonucleotide
  Target: SCN9A; (-) strand; PAM type: YTN; PAM sequence: TTT
acatagcctaacatttgact

SEQ ID NO: 58232 - DNA, 20 bp, Artificial Sequence
  Description of Artificial Sequence: Synthetic oligonucleotide
  Target: SCN9A; (-) strand; PAM type: YTN; PAM sequence: TTA
tttacatagcctaacatttg

SEQ ID NO: 58233 - DNA, 20 bp, Artificial Sequence
  Description of Artificial Sequence: Synthetic oligonucleotide
  Target: SCN9A; (-) strand; PAM type: YTN; PAM sequence: CTA
ttatttacatagcctaacat

SEQ ID NO: 58234 - DNA, 20 bp, Artificial Sequence
  Description of Artificial Sequence: Synthetic oligonucleotide
  Target: SCN9A; (-) strand; PAM type: YTN; PAM sequence: TTG
ctattatttacatagcctaa

SEQ ID NO: 58235 - DNA, 20 bp, Artificial Sequence
  Description of Artificial Sequence: Synthetic oligonucleotide
  Target: SCN9A; (-) strand; PAM type: YTN; PAM sequence: TTT
gctattatttacatagccta

SEQ ID NO: 58236 - DNA, 20 bp, Artificial Sequence
  Description of Artificial Sequence: Synthetic oligonucleotide
  Target: SCN9A; (-) strand; PAM type: YTN; PAM sequence: CTA
tttgctattatttacatagc

SEQ ID NO: 58237 - DNA, 20 bp, Artificial Sequence
  Description of Artificial Sequence: Synthetic oligonucleotide
  Target: SCN9A; (-) strand; PAM type: YTN; PAM sequence: TTC
tatttgctattatttacata

SEQ ID NO: 58238 - DNA, 20 bp, Artificial Sequence
  Description of Artificial Sequence: Synthetic oligonucleotide
  Target: SCN9A; (-) strand; PAM type: YTN; PAM sequence: TTG
acagaagttctatttgctat

SEQ ID NO: 58239 - DNA, 20 bp, Artificial Sequence
  Description of Artificial Sequence: Synthetic oligonucleotide
  Target: SCN9A; (-) strand; PAM type: YTN; PAM sequence: TTA
ttgacagaagttctatttgc

SEQ ID NO: 58240 - DNA, 20 bp, Artificial Sequence
  Description of Artificial Sequence: Synthetic oligonucleotide
  Target: SCN9A; (-) strand; PAM type: YTN; PAM sequence: CTG
agaaaaaagttattgacaga

SEQ ID NO: 58241 - DNA, 20 bp, Artificial Sequence
  Description of Artificial Sequence: Synthetic oligonucleotide
  Target: SCN9A; (-) strand; PAM type: YTN; PAM sequence: CTC
aaaaaaaacaaagataactg

SEQ ID NO: 58242 - DNA, 20 bp, Artificial Sequence
  Description of Artificial Sequence: Synthetic oligonucleotide
  Target: SCN9A; (-) strand; PAM type: YTN; PAM sequence: CTC
ctcaaaaaaaacaaagataa

SEQ ID NO: 58243 - DNA, 20 bp, Artificial Sequence
  Description of Artificial Sequence: Synthetic oligonucleotide
  Target: SCN9A; (-) strand; PAM type: YTN; PAM sequence: TTA
cactcctcaaaaaaaacaaa

SEQ ID NO: 58244 - DNA, 20 bp, Artificial Sequence
  Description of Artificial Sequence: Synthetic oligonucleotide
  Target: SCN9A; (-) strand; PAM type: YTN; PAM sequence: CTA
agtacatattacactcctca

SEQ ID NO: 58245 - DNA, 20 bp, Artificial Sequence
  Description of Artificial Sequence: Synthetic oligonucleotide
  Target: SCN9A; (-) strand; PAM type: YTN; PAM sequence: TTC
taagtacatattacactcct

SEQ ID NO: 58246 - DNA, 20 bp, Artificial Sequence
  Description of Artificial Sequence: Synthetic oligonucleotide
  Target: SCN9A; (-) strand; PAM type: YTN; PAM sequence: TTA
ttctaagtacatattacact

SEQ ID NO: 58247 - DNA, 20 bp, Artificial Sequence
  Description of Artificial Sequence: Synthetic oligonucleotide
  Target: SCN9A; (-) strand; PAM type: YTN; PAM sequence: TTG
aaaaattattctaagtacat

SEQ ID NO: 58248 - DNA, 20 bp, Artificial Sequence
  Description of Artificial Sequence: Synthetic oligonucleotide
  Target: SCN9A; (-) strand; PAM type: YTN; PAM sequence: CTT
gaaaaattattctaagtaca

SEQ ID NO: 58249 - DNA, 20 bp, Artificial Sequence
  Description of Artificial Sequence: Synthetic oligonucleotide
  Target: SCN9A; (-) strand; PAM type: YTN; PAM sequence: TTC
atagaataaccacagaactt

SEQ ID NO: 58250 - DNA, 20 bp, Artificial Sequence
  Description of Artificial Sequence: Synthetic oligonucleotide
  Target: SCN9A; (-) strand; PAM type: YTN; PAM sequence: TTG
ttcatagaataaccacagaa

SEQ ID NO: 58251 - DNA, 20 bp, Artificial Sequence
  Description of Artificial Sequence: Synthetic oligonucleotide
  Target: SCN9A; (-) strand; PAM type: YTN; PAM sequence: TTT
gttcatagaataaccacaga

SEQ ID NO: 58252 - DNA, 20 bp, Artificial Sequence
  Description of Artificial Sequence: Synthetic oligonucleotide
  Target: SCN9A; (-) strand; PAM type: YTN; PAM sequence: TTT
tgttcatagaataaccacag

SEQ ID NO: 58253 - DNA, 20 bp, Artificial Sequence
  Description of Artificial Sequence: Synthetic oligonucleotide
  Target: SCN9A; (-) strand; PAM type: YTN; PAM sequence: TTT
ttgttcatagaataaccaca

SEQ ID NO: 58254 - DNA, 20 bp, Artificial Sequence
  Description of Artificial Sequence: Synthetic oligonucleotide
  Target: SCN9A; (-) strand; PAM type: YTN; PAM sequence: CTT
tttgttcatagaataaccac

SEQ ID NO: 58255 - DNA, 20 bp, Artificial Sequence
  Description of Artificial Sequence: Synthetic oligonucleotide
  Target: SCN9A; (-) strand; PAM type: YTN; PAM sequence: TTC
atatccctttttgttcatag

SEQ ID NO: 58256 - DNA, 20 bp, Artificial Sequence
  Description of Artificial Sequence: Synthetic oligonucleotide
  Target: SCN9A; (-) strand; PAM type: YTN; PAM sequence: TTT
catatccctttttgttcata

SEQ ID NO: 58257 - DNA, 20 bp, Artificial Sequence
  Description of Artificial Sequence: Synthetic oligonucleotide
  Target: SCN9A; (-) strand; PAM type: YTN; PAM sequence: CTT
tcatatccctttttgttcat

SEQ ID NO: 58258 - DNA, 20 bp, Artificial Sequence
  Description of Artificial Sequence: Synthetic oligonucleotide
  Target: SCN9A; (-) strand; PAM type: YTN; PAM sequence: TTC
tttcatatccctttttgttc

SEQ ID NO: 58259 - DNA, 20 bp, Artificial Sequence
  Description of Artificial Sequence: Synthetic oligonucleotide
  Target: SCN9A; (-) strand; PAM type: YTN; PAM sequence: CTT
ctttcatatccctttttgtt

SEQ ID NO: 58260 - DNA, 20 bp, Artificial Sequence
  Description of Artificial Sequence: Synthetic oligonucleotide
  Target: SCN9A; (-) strand; PAM type: YTN; PAM sequence: TTC
ttctttcatatccctttttg

SEQ ID NO: 58261 - DNA, 20 bp, Artificial Sequence
  Description of Artificial Sequence: Synthetic oligonucleotide
  Target: SCN9A; (-) strand; PAM type: YTN; PAM sequence: TTT
cttctttcatatcccttttt

SEQ ID NO: 58262 - DNA, 20 bp, Artificial Sequence
  Description of Artificial Sequence: Synthetic oligonucleotide
  Target: SCN9A; (-) strand; PAM type: YTN; PAM sequence: CTT
tcttctttcatatccctttt

SEQ ID NO: 58263 - DNA, 20 bp, Artificial Sequence
  Description of Artificial Sequence: Synthetic oligonucleotide
  Target: SCN9A; (-) strand; PAM type: YTN; PAM sequence: TTC
atagcctttcttctttcata

SEQ ID NO: 58264 - DNA, 20 bp, Artificial Sequence
  Description of Artificial Sequence: Synthetic oligonucleotide
  Target: SCN9A; (-) strand; PAM type: YTN; PAM sequence: TTT
catagcctttcttctttcat

SEQ ID NO: 58265 - DNA, 20 bp, Artificial Sequence
  Description of Artificial Sequence: Synthetic oligonucleotide
  Target: SCN9A; (-) strand; PAM type: YTN; PAM sequence: TTG
tgtttcatagcctttcttct

SEQ ID NO: 58266 - DNA, 20 bp, Artificial Sequence
  Description of Artificial Sequence: Synthetic oligonucleotide
  Target: SCN9A; (-) strand; PAM type: YTN; PAM sequence: TTA
gagtattgtgtttcatagcc

SEQ ID NO: 58267 - DNA, 20 bp, Artificial Sequence
  Description of Artificial Sequence: Synthetic oligonucleotide
  Target: SCN9A; (-) strand; PAM type: YTN; PAM sequence: TTT
agagtattgtgtttcatagc

SEQ ID NO: 58268 - DNA, 20 bp, Artificial Sequence
  Description of Artificial Sequence: Synthetic oligonucleotide
  Target: SCN9A; (-) strand; PAM type: YTN; PAM sequence: CTT
tagagtattgtgtttcatag

SEQ ID NO: 58269 - DNA, 20 bp, Artificial Sequence
  Description of Artificial Sequence: Synthetic oligonucleotide
  Target: SCN9A; (-) strand; PAM type: YTN; PAM sequence: TTA
cctttagagtattgtgtttc

SEQ ID NO: 58270 - DNA, 20 bp, Artificial Sequence
  Description of Artificial Sequence: Synthetic oligonucleotide
  Target: SCN9A; (-) strand; PAM type: YTN; PAM sequence: CTT
acctttagagtattgtgttt

SEQ ID NO: 58271 - DNA, 20 bp, Artificial Sequence
  Description of Artificial Sequence: Synthetic oligonucleotide
  Target: SCN9A; (-) strand; PAM type: YTN; PAM sequence: CTC
acatgccaacaaggataaga

SEQ ID NO: 58272 - DNA, 20 bp, Artificial Sequence
  Description of Artificial Sequence: Synthetic oligonucleotide
  Target: SCN9A; (-) strand; PAM type: YTN; PAM sequence: TTG
actcacatgccaacaaggat

SEQ ID NO: 58273 - DNA, 20 bp, Artificial Sequence
  Description of Artificial Sequence: Synthetic oligonucleotide
  Target: SCN9A; (-) strand; PAM type: YTN; PAM sequence: CTT
gactcacatgccaacaagga

SEQ ID NO: 58274 - DNA, 20 bp, Artificial Sequence
  Description of Artificial Sequence: Synthetic oligonucleotide
  Target: SCN9A; (-) strand; PAM type: YTN; PAM sequence: TTC
atcttgactcacatgccaac

SEQ ID NO: 58275 - DNA, 20 bp, Artificial Sequence
  Description of Artificial Sequence: Synthetic oligonucleotide
  Target: SCN9A; (-) strand; PAM type: YTN; PAM sequence: TTC
attcatcttgactcacatgc

SEQ ID NO: 58276 - DNA, 20 bp, Artificial Sequence
  Description of Artificial Sequence: Synthetic oligonucleotide
  Target: SCN9A; (-) strand; PAM type: YTN; PAM sequence: TTT
cattcatcttgactcacatg

SEQ ID NO: 58277 - DNA, 20 bp, Artificial Sequence
  Description of Artificial Sequence: Synthetic oligonucleotide
  Target: SCN9A; (-) strand; PAM type: YTN; PAM sequence: TTT
tcattcatcttgactcacat

SEQ ID NO: 58278 - DNA, 20 bp, Artificial Sequence
  Description of Artificial Sequence: Synthetic oligonucleotide
  Target: SCN9A; (-) strand; PAM type: YTN; PAM sequence: TTT
ttcattcatcttgactcaca

SEQ ID NO: 58279 - DNA, 20 bp, Artificial Sequence
  Description of Artificial Sequence: Synthetic oligonucleotide
  Target: SCN9A; (-) strand; PAM type: YTN; PAM sequence: CTA
caaatgtttttcattcatct

SEQ ID NO: 58280 - DNA, 20 bp, Artificial Sequence
  Description of Artificial Sequence: Synthetic oligonucleotide
  Target: SCN9A; (-) strand; PAM type: YTN; PAM sequence: TTC
tacaaatgtttttcattcat

SEQ ID NO: 58281 - DNA, 20 bp, Artificial Sequence
  Description of Artificial Sequence: Synthetic oligonucleotide
  Target: SCN9A; (-) strand; PAM type: YTN; PAM sequence: TTT
ctacaaatgtttttcattca

SEQ ID NO: 58282 - DNA, 20 bp, Artificial Sequence
  Description of Artificial Sequence: Synthetic oligonucleotide
  Target: SCN9A; (-) strand; PAM type: YTN; PAM sequence: TTC
atttctacaaatgtttttca

SEQ ID NO: 58283 - DNA, 20 bp, Artificial Sequence
  Description of Artificial Sequence: Synthetic oligonucleotide
  Target: SCN9A; (-) strand; PAM type: YTN; PAM sequence: CTA
ttcatttctacaaatgtttt

SEQ ID NO: 58284 - DNA, 20 bp, Artificial Sequence
  Description of Artificial Sequence: Synthetic oligonucleotide
  Target: SCN9A; (-) strand; PAM type: YTN; PAM sequence: TTA
aaaatatatgtaggctattc

SEQ ID NO: 58285 - DNA, 20 bp, Artificial Sequence
  Description of Artificial Sequence: Synthetic oligonucleotide
  Target: SCN9A; (-) strand; PAM type: YTN; PAM sequence: CTA
taaaatgccatgggattaaa

SEQ ID NO: 58286 - DNA, 20 bp, Artificial Sequence
  Description of Artificial Sequence: Synthetic oligonucleotide
  Target: SCN9A; (-) strand; PAM type: YTN; PAM sequence: TTA
tatgtgcctataaaatgcca

SEQ ID NO: 58287 - DNA, 20 bp, Artificial Sequence
  Description of Artificial Sequence: Synthetic oligonucleotide
  Target: SCN9A; (-) strand; PAM type: YTN; PAM sequence: TTT
atatgtgcctataaaatgcc

SEQ ID NO: 58288 - DNA, 20 bp, Artificial Sequence
  Description of Artificial Sequence: Synthetic oligonucleotide
  Target: SCN9A; (-) strand; PAM type: YTN; PAM sequence: TTG
catcagaaccaatttatatg

SEQ ID NO: 58289 - DNA, 20 bp, Artificial Sequence
  Description of Artificial Sequence: Synthetic oligonucleotide
  Target: SCN9A; (-) strand; PAM type: YTN; PAM sequence: CTA
cattgcatcagaaccaattt

SEQ ID NO: 58290 - DNA, 20 bp, Artificial Sequence
  Description of Artificial Sequence: Synthetic oligonucleotide
  Target: SCN9A; (-) strand; PAM type: YTN; PAM sequence: TTC
tacattgcatcagaaccaat

SEQ ID NO: 58291 - DNA, 20 bp, Artificial Sequence
  Description of Artificial Sequence: Synthetic oligonucleotide
  Target: SCN9A; (-) strand; PAM type: YTN; PAM sequence: TTA
ttctacattgcatcagaacc

SEQ ID NO: 58292 - DNA, 20 bp, Artificial Sequence
  Description of Artificial Sequence: Synthetic oligonucleotide
  Target: SCN9A; (-) strand; PAM type: YTN; PAM sequence: TTT
attctacattgcatcagaac

SEQ ID NO: 58293 - DNA, 20 bp, Artificial Sequence
  Description of Artificial Sequence: Synthetic oligonucleotide
  Target: SCN9A; (-) strand; PAM type: YTN; PAM sequence: TTA
aatttattctacattgcatc

SEQ ID NO: 58294 - DNA, 20 bp, Artificial Sequence
  Description of Artificial Sequence: Synthetic oligonucleotide
  Target: SCN9A; (-) strand; PAM type: YTN; PAM sequence: CTT
aaatttattctacattgcat

SEQ ID NO: 58295 - DNA, 20 bp, Artificial Sequence
  Description of Artificial Sequence: Synthetic oligonucleotide
  Target: SCN9A; (-) strand; PAM type: YTN; PAM sequence: TTG
aggtgcttaaatttattcta

SEQ ID NO: 58296 - DNA, 20 bp, Artificial Sequence
  Description of Artificial Sequence: Synthetic oligonucleotide
  Target: SCN9A; (-) strand; PAM type: YTN; PAM sequence: TTT
gaggtgcttaaatttattct

SEQ ID NO: 58297 - DNA, 20 bp, Artificial Sequence
  Description of Artificial Sequence: Synthetic oligonucleotide
  Target: SCN9A; (-) strand; PAM type: YTN; PAM sequence: TTT
tgaggtgcttaaatttattc

SEQ ID NO: 58298 - DNA, 20 bp, Artificial Sequence
  Description of Artificial Sequence: Synthetic oligonucleotide
  Target: SCN9A; (-) strand; PAM type: YTN; PAM sequence: CTA
tattttgaggtgcttaaatt

SEQ ID NO: 58299 - DNA, 20 bp, Artificial Sequence
  Description of Artificial Sequence: Synthetic oligonucleotide
  Target: SCN9A; (-) strand; PAM type: YTN; PAM sequence: TTC
tatattttgaggtgcttaaa

SEQ ID NO: 58300 - DNA, 20 bp, Artificial Sequence
  Description of Artificial Sequence: Synthetic oligonucleotide
  Target: SCN9A; (-) strand; PAM type: YTN; PAM sequence: TTA
ttctatattttgaggtgctt

SEQ ID NO: 58301 - DNA, 20 bp, Artificial Sequence
  Description of Artificial Sequence: Synthetic oligonucleotide
  Target: SCN9A; (-) strand; PAM type: YTN; PAM sequence: TTA
tcaatgtacagaggttattc

SEQ ID NO: 58302 - DNA, 20 bp, Artificial Sequence
  Description of Artificial Sequence: Synthetic oligonucleotide
  Target: SCN9A; (-) strand; PAM type: YTN; PAM sequence: TTT
atcaatgtacagaggttatt

SEQ ID NO: 58303 - DNA, 20 bp, Artificial Sequence
  Description of Artificial Sequence: Synthetic oligonucleotide
  Target: SCN9A; (-) strand; PAM type: YTN; PAM sequence: TTT
tatcaatgtacagaggttat

SEQ ID NO: 58304 - DNA, 20 bp, Artificial Sequence
  Description of Artificial Sequence: Synthetic oligonucleotide
  Target: SCN9A; (-) strand; PAM type: YTN; PAM sequence: TTT
ttatcaatgtacagaggtta

SEQ ID NO: 58305 - DNA, 20 bp, Artificial Sequence
  Description of Artificial Sequence: Synthetic oligonucleotide
  Target: SCN9A; (-) strand; PAM type: YTN; PAM sequence: CTT
tttatcaatgtacagaggtt

SEQ ID NO: 58306 - DNA, 20 bp, Artificial Sequence
  Description of Artificial Sequence: Synthetic oligonucleotide
  Target: SCN9A; (-) strand; PAM type: YTN; PAM sequence: TTG
actttttatcaatgtacaga

SEQ ID NO: 58307 - DNA, 20 bp, Artificial Sequence
  Description of Artificial Sequence: Synthetic oligonucleotide
  Target: SCN9A; (-) strand; PAM type: YTN; PAM sequence: CTT
gactttttatcaatgtacag

SEQ ID NO: 58308 - DNA, 20 bp, Artificial Sequence
  Description of Artificial Sequence: Synthetic oligonucleotide
  Target: SCN9A; (-) strand; PAM type: YTN; PAM sequence: TTA
gggagcttgactttttatca

SEQ ID NO: 58309 - DNA, 20 bp, Artificial Sequence
  Description of Artificial Sequence: Synthetic oligonucleotide
  Target: SCN9A; (-) strand; PAM type: YTN; PAM sequence: TTA
ttagggagcttgacttttta

SEQ ID NO: 58310 - DNA, 20 bp, Artificial Sequence
  Description of Artificial Sequence: Synthetic oligonucleotide
  Target: SCN9A; (-) strand; PAM type: YTN; PAM sequence: TTA
aaatgcattattagggagct

SEQ ID NO: 58311 - DNA, 20 bp, Artificial Sequence
  Description of Artificial Sequence: Synthetic oligonucleotide
  Target: SCN9A; (-) strand; PAM type: YTN; PAM sequence: TTA
gttaaaatgcattattaggg

SEQ ID NO: 58312 - DNA, 20 bp, Artificial Sequence
  Description of Artificial Sequence: Synthetic oligonucleotide
  Target: SCN9A; (-) strand; PAM type: YTN; PAM sequence: TTT
agttaaaatgcattattagg

SEQ ID NO: 58313 - DNA, 20 bp, Artificial Sequence
  Description of Artificial Sequence: Synthetic oligonucleotide
  Target: SCN9A; (-) strand; PAM type: YTN; PAM sequence: TTA
tgaatgtttagttaaaatgc

SEQ ID NO: 58314 - DNA, 20 bp, Artificial Sequence
  Description of Artificial Sequence: Synthetic oligonucleotide
  Target: SCN9A; (-) strand; PAM type: YTN; PAM sequence: TTA
gttatgaatgtttagttaaa

SEQ ID NO: 58315 - DNA, 20 bp, Artificial Sequence
  Description of Artificial Sequence: Synthetic oligonucleotide
  Target: SCN9A; (-) strand; PAM type: YTN; PAM sequence: TTG
atagaagtaatggacattag

SEQ ID NO: 58316 - DNA, 20 bp, Artificial Sequence
  Description of Artificial Sequence: Synthetic oligonucleotide
  Target: SCN9A; (-) strand; PAM type: YTN; PAM sequence: CTT
gatagaagtaatggacatta

SEQ ID NO: 58317 - DNA, 20 bp, Artificial Sequence
  Description of Artificial Sequence: Synthetic oligonucleotide
  Target: SCN9A; (-) strand; PAM type: YTN; PAM sequence: TTG
caatgaaatgcttgatagaa

SEQ ID NO: 58318 - DNA, 20 bp, Artificial Sequence
  Description of Artificial Sequence: Synthetic oligonucleotide
  Target: SCN9A; (-) strand; PAM type: YTN; PAM sequence: TTT
gcaatgaaatgcttgataga

SEQ ID NO: 58319 - DNA, 20 bp, Artificial Sequence
  Description of Artificial Sequence: Synthetic oligonucleotide
  Target: SCN9A; (-) strand; PAM type: YTN; PAM sequence: CTT
tgcaatgaaatgcttgatag

SEQ ID NO: 58320 - DNA, 20 bp, Artificial Sequence
  Description of Artificial Sequence: Synthetic oligonucleotide
  Target: SCN9A; (-) strand; PAM type: YTN; PAM sequence: TTG
gctttgcaatgaaatgcttg

SEQ ID NO: 58321 - DNA, 20 bp, Artificial Sequence
  Description of Artificial Sequence: Synthetic oligonucleotide
  Target: SCN9A; (-) strand; PAM type: YTN; PAM sequence: CTT
ggctttgcaatgaaatgctt

SEQ ID NO: 58322 - DNA, 20 bp, Artificial Sequence
  Description of Artificial Sequence: Synthetic oligonucleotide
  Target: SCN9A; (-) strand; PAM type: YTN; PAM sequence: TTG
ccttggctttgcaatgaaat

SEQ ID NO: 58323 - DNA, 20 bp, Artificial Sequence
  Description of Artificial Sequence: Synthetic oligonucleotide
  Target: SCN9A; (-) strand; PAM type: YTN; PAM sequence: TTT
gccttggctttgcaatgaaa

SEQ ID NO: 58324 - DNA, 20 bp, Artificial Sequence
  Description of Artificial Sequence: Synthetic oligonucleotide
  Target: SCN9A; (-) strand; PAM type: YTN; PAM sequence: TTG
gaaatcaacaaaagtatttg

SEQ ID NO: 58325 - DNA, 20 bp, Artificial Sequence
  Description of Artificial Sequence: Synthetic oligonucleotide
  Target: SCN9A; (-) strand; PAM type: YTN; PAM sequence: TTT
ggaaatcaacaaaagtattt

SEQ ID NO: 58326 - DNA, 20 bp, Artificial Sequence
  Description of Artificial Sequence: Synthetic oligonucleotide
  Target: SCN9A; (-) strand; PAM type: YTN; PAM sequence: TTA
tttggaaatcaacaaaagta

SEQ ID NO: 58327 - DNA, 20 bp, Artificial Sequence
  Description of Artificial Sequence: Synthetic oligonucleotide
  Target: SCN9A; (-) strand; PAM type: YTN; PAM sequence: CTA
ttatttggaaatcaacaaaa

SEQ ID NO: 58328 - DNA, 20 bp, Artificial Sequence
  Description of Artificial Sequence: Synthetic oligonucleotide
  Target: SCN9A; (-) strand; PAM type: YTN; PAM sequence: TTA
tctattatttggaaatcaac

SEQ ID NO: 58329 - DNA, 20 bp, Artificial Sequence
  Description of Artificial Sequence: Synthetic oligonucleotide
  Target: SCN9A; (-) strand; PAM type: YTN; PAM sequence: TTT
atctattatttggaaatcaa

SEQ ID NO: 58330 - DNA, 20 bp, Artificial Sequence
  Description of Artificial Sequence: Synthetic oligonucleotide
  Target: SCN9A; (-) strand; PAM type: YTN; PAM sequence: TTA
tttatctattatttggaaat

SEQ ID NO: 58331 - DNA, 20 bp, Artificial Sequence
  Description of Artificial Sequence: Synthetic oligonucleotide
  Target: SCN9A; (-) strand; PAM type: YTN; PAM sequence: CTA
ttatttatctattatttgga

SEQ ID NO: 58332 - DNA, 20 bp, Artificial Sequence
  Description of Artificial Sequence: Synthetic oligonucleotide
  Target: SCN9A; (-) strand; PAM type: YTN; PAM sequence: TTC
ccatgtaaataaacaacaca

SEQ ID NO: 58333 - DNA, 20 bp, Artificial Sequence
  Description of Artificial Sequence: Synthetic oligonucleotide
  Target: SCN9A; (-) strand; PAM type: YTN; PAM sequence: TTT
cccatgtaaataaacaacac

SEQ ID NO: 58334 - DNA, 20 bp, Artificial Sequence
  Description of Artificial Sequence: Synthetic oligonucleotide
  Target: SCN9A; (-) strand; PAM type: YTN; PAM sequence: TTG
tttcccatgtaaataaacaa

SEQ ID NO: 58335 - DNA, 20 bp, Artificial Sequence
  Description of Artificial Sequence: Synthetic oligonucleotide
  Target: SCN9A; (-) strand; PAM type: YTN; PAM sequence: CTT
gtttcccatgtaaataaaca

SEQ ID NO: 58336 - DNA, 20 bp, Artificial Sequence
  Description of Artificial Sequence: Synthetic oligonucleotide
  Target: SCN9A; (-) strand; PAM type: YTN; PAM sequence: TTA
gtcttgtttcccatgtaaat

SEQ ID NO: 58337 - DNA, 20 bp, Artificial Sequence
  Description of Artificial Sequence: Synthetic oligonucleotide
  Target: SCN9A; (-) strand; PAM type: YTN; PAM sequence: TTG
taattagtcttgtttcccat

SEQ ID NO: 58338 - DNA, 20 bp, Artificial Sequence
  Description of Artificial Sequence: Synthetic oligonucleotide
  Target: SCN9A; (-) strand; PAM type: YTN; PAM sequence: TTC
acaggattgtaattagtctt

SEQ ID NO: 58339 - DNA, 20 bp, Artificial Sequence
  Description of Artificial Sequence: Synthetic oligonucleotide
  Target: SCN9A; (-) strand; PAM type: YTN; PAM sequence: TTT
cacaggattgtaattagtct

SEQ ID NO: 58340 - DNA, 20 bp, Artificial Sequence
  Description of Artificial Sequence: Synthetic oligonucleotide
  Target: SCN9A; (-) strand; PAM type: YTN; PAM sequence: TTT
tcacaggattgtaattagtc

SEQ ID NO: 58341 - DNA, 20 bp, Artificial Sequence
  Description of Artificial Sequence: Synthetic oligonucleotide
  Target: SCN9A; (-) strand; PAM type: YTN; PAM sequence: CTT
ttcacaggattgtaattagt

SEQ ID NO: 58342 - DNA, 20 bp, Artificial Sequence
  Description of Artificial Sequence: Synthetic oligonucleotide
  Target: SCN9A; (-) strand; PAM type: YTN; PAM sequence: TTG
tcatcttttcacaggattgt

SEQ ID NO: 58343 - DNA, 20 bp, Artificial Sequence
  Description of Artificial Sequence: Synthetic oligonucleotide
  Target: SCN9A; (-) strand; PAM type: YTN; PAM sequence: CTT
gtcatcttttcacaggattg

SEQ ID NO: 58344 - DNA, 20 bp, Artificial Sequence
  Description of Artificial Sequence: Synthetic oligonucleotide
  Target: SCN9A; (-) strand; PAM type: YTN; PAM sequence: CTG
ccttgtcatcttttcacagg

SEQ ID NO: 58345 - DNA, 20 bp, Artificial Sequence
  Description of Artificial Sequence: Synthetic oligonucleotide
  Target: SCN9A; (-) strand; PAM type: YTN; PAM sequence: TTA
catctgccttgtcatctttt

SEQ ID NO: 58346 - DNA, 20 bp, Artificial Sequence
  Description of Artificial Sequence: Synthetic oligonucleotide
  Target: SCN9A; (-) strand; PAM type: YTN; PAM sequence: TTT
acatctgccttgtcatcttt

SEQ ID NO: 58347 - DNA, 20 bp, Artificial Sequence
  Description of Artificial Sequence: Synthetic oligonucleotide
  Target: SCN9A; (-) strand; PAM type: YTN; PAM sequence: TTT
tacatctgccttgtcatctt

SEQ ID NO: 58348 - DNA, 20 bp, Artificial Sequence
  Description of Artificial Sequence: Synthetic oligonucleotide
  Target: SCN9A; (-) strand; PAM type: YTN; PAM sequence: CTT
ttacatctgccttgtcatct

SEQ ID NO: 58349 - DNA, 20 bp, Artificial Sequence
  Description of Artificial Sequence: Synthetic oligonucleotide
  Target: SCN9A; (-) strand; PAM type: YTN; PAM sequence: TTA
ataaatcagaagaccatgta

SEQ ID NO: 58350 - DNA, 20 bp, Artificial Sequence
  Description of Artificial Sequence: Synthetic oligonucleotide
  Target: SCN9A; (-) strand; PAM type: YTN; PAM sequence: TTT
aataaatcagaagaccatgt

SEQ ID NO: 58351 - DNA, 20 bp, Artificial Sequence
  Description of Artificial Sequence: Synthetic oligonucleotide
  Target: SCN9A; (-) strand; PAM type: YTN; PAM sequence: TTT
taataaatcagaagaccatg

SEQ ID NO: 58352 - DNA, 20 bp, Artificial Sequence
  Description of Artificial Sequence: Synthetic oligonucleotide
  Target: SCN9A; (-) strand; PAM type: YTN; PAM sequence: TTT
ttaataaatcagaagaccat

SEQ ID NO: 58353 - DNA, 20 bp, Artificial Sequence
  Description of Artificial Sequence: Synthetic oligonucleotide
  Target: SCN9A; (-) strand; PAM type: YTN; PAM sequence: TTG
gtttttaataaatcagaaga

SEQ ID NO: 58354 - DNA, 20 bp, Artificial Sequence
  Description of Artificial Sequence: Synthetic oligonucleotide
  Target: SCN9A; (-) strand; PAM type: YTN; PAM sequence: TTT
ggtttttaataaatcagaag

SEQ ID NO: 58355 - DNA, 20 bp, Artificial Sequence
  Description of Artificial Sequence: Synthetic oligonucleotide
  Target: SCN9A; (-) strand; PAM type: YTN; PAM sequence: TTT
tggtttttaataaatcagaa

SEQ ID NO: 58356 - DNA, 20 bp, Artificial Sequence
  Description of Artificial Sequence: Synthetic oligonucleotide
  Target: SCN9A; (-) strand; PAM type: YTN; PAM sequence: TTT
ttggtttttaataaatcaga

SEQ ID NO: 58357 - DNA, 20 bp, Artificial Sequence
  Description of Artificial Sequence: Synthetic oligonucleotide
  Target: SCN9A; (-) strand; PAM type: YTN; PAM sequence: TTT
tttggtttttaataaatcag

SEQ ID NO: 58358 - DNA, 20 bp, Artificial Sequence
  Description of Artificial Sequence: Synthetic oligonucleotide
  Target: SCN9A; (-) strand; PAM type: YTN; PAM sequence: TTC
agttttttggtttttaataa

SEQ ID NO: 58359 - DNA, 20 bp, Artificial Sequence
  Description of Artificial Sequence: Synthetic oligonucleotide
  Target: SCN9A; (-) strand; PAM type: YTN; PAM sequence: TTA
tagcatacaaaagtgattca

SEQ ID NO: 58360 - DNA, 20 bp, Artificial Sequence
  Description of Artificial Sequence: Synthetic oligonucleotide
  Target: SCN9A; (-) strand; PAM type: YTN; PAM sequence: TTG
attatagcatacaaaagtga

SEQ ID NO: 58361 - DNA, 20 bp, Artificial Sequence
  Description of Artificial Sequence: Synthetic oligonucleotide
  Target: SCN9A; (-) strand; PAM type: YTN; PAM sequence: TTA
ttgattatagcatacaaaag

SEQ ID NO: 58362 - DNA, 20 bp, Artificial Sequence
  Description of Artificial Sequence: Synthetic oligonucleotide
  Target: SCN9A; (-) strand; PAM type: YTN; PAM sequence: CTG
taggaattattgattatagc

SEQ ID NO: 58363 - DNA, 20 bp, Artificial Sequence
  Description of Artificial Sequence: Synthetic oligonucleotide
  Target: SCN9A; (-) strand; PAM type: YTN; PAM sequence: CTC
tgtaggaattattgattata

SEQ ID NO: 58364 - DNA, 20 bp, Artificial Sequence
  Description of Artificial Sequence: Synthetic oligonucleotide
  Target: SCN9A; (-) strand; PAM type: YTN; PAM sequence: TTA
agaatcgtaagagaactctg

SEQ ID NO: 58365 - DNA, 20 bp, Artificial Sequence
  Description of Artificial Sequence: Synthetic oligonucleotide
  Target: SCN9A; (-) strand; PAM type: YTN; PAM sequence: TTT
aagaatcgtaagagaactct

SEQ ID NO: 58366 - DNA, 20 bp, Artificial Sequence
  Description of Artificial Sequence: Synthetic oligonucleotide
  Target: SCN9A; (-) strand; PAM type: YTN; PAM sequence: CTT
taagaatcgtaagagaactc

SEQ ID NO: 58367 - DNA, 20 bp, Artificial Sequence
  Description of Artificial Sequence: Synthetic oligonucleotide
  Target: SCN9A; (-) strand; PAM type: YTN; PAM sequence: TTC
tttaagaatcgtaagagaac

SEQ ID NO: 58368 - DNA, 20 bp, Artificial Sequence
  Description of Artificial Sequence: Synthetic oligonucleotide
  Target: SCN9A; (-) strand; PAM type: YTN; PAM sequence: CTG
atgattctttaagaatcgta

SEQ ID NO: 58369 - DNA, 20 bp, Artificial Sequence
  Description of Artificial Sequence: Synthetic oligonucleotide
  Target: SCN9A; (-) strand; PAM type: YTN; PAM sequence: TTG
cactgatgattctttaagaa

SEQ ID NO: 58370 - DNA, 20 bp, Artificial Sequence
  Description of Artificial Sequence: Synthetic oligonucleotide
  Target: SCN9A; (-) strand; PAM type: YTN; PAM sequence: TTT
gcactgatgattctttaaga

SEQ ID NO: 58371 - DNA, 20 bp, Artificial Sequence
  Description of Artificial Sequence: Synthetic oligonucleotide
  Target: SCN9A; (-) strand; PAM type: YTN; PAM sequence: TTT
tgcactgatgattctttaag

SEQ ID NO: 58372 - DNA, 20 bp, Artificial Sequence
  Description of Artificial Sequence: Synthetic oligonucleotide
  Target: SCN9A; (-) strand; PAM type: YTN; PAM sequence: TTT
ttgcactgatgattctttaa

SEQ ID NO: 58373 - DNA, 20 bp, Artificial Sequence
  Description of Artificial Sequence: Synthetic oligonucleotide
  Target: SCN9A; (-) strand; PAM type: YTN; PAM sequence: TTA
tttttgcactgatgattctt

SEQ ID NO: 58374 - DNA, 20 bp, Artificial Sequence
  Description of Artificial Sequence: Synthetic oligonucleotide
  Target: SCN9A; (-) strand; PAM type: YTN; PAM sequence: TTA
gcagatggttatttttgcac

SEQ ID NO: 58375 - DNA, 20 bp, Artificial Sequence
  Description of Artificial Sequence: Synthetic oligonucleotide
  Target: SCN9A; (-) strand; PAM type: YTN; PAM sequence: CTA
agaaaggtgggcagcattag

SEQ ID NO: 58376 - DNA, 20 bp, Artificial Sequence
  Description of Artificial Sequence: Synthetic oligonucleotide
  Target: SCN9A; (-) strand; PAM type: YTN; PAM sequence: TTC
ctaagaaaggtgggcagcat

SEQ ID NO: 58377 - DNA, 20 bp, Artificial Sequence
  Description of Artificial Sequence: Synthetic oligonucleotide
  Target: SCN9A; (-) strand; PAM type: YTN; PAM sequence: TTT
cctaagaaaggtgggcagca

SEQ ID NO: 58378 - DNA, 20 bp, Artificial Sequence
  Description of Artificial Sequence: Synthetic oligonucleotide
  Target: SCN9A; (-) strand; PAM type: YTN; PAM sequence: CTG
atttcctaagaaaggtgggc

SEQ ID NO: 58379 - DNA, 20 bp, Artificial Sequence
  Description of Artificial Sequence: Synthetic oligonucleotide
  Target: SCN9A; (-) strand; PAM type: YTN; PAM sequence: CTC
tgatttcctaagaaaggtgg

SEQ ID NO: 58380 - DNA, 20 bp, Artificial Sequence
  Description of Artificial Sequence: Synthetic oligonucleotide
  Target: SCN9A; (-) strand; PAM type: YTN; PAM sequence: CTA
actctgatttcctaagaaag

SEQ ID NO: 58381 - DNA, 20 bp, Artificial Sequence
  Description of Artificial Sequence: Synthetic oligonucleotide
  Target: SCN9A; (-) strand; PAM type: YTN; PAM sequence: CTC
gaaggcagtgcagtcactaa

SEQ ID NO: 58382 - DNA, 20 bp, Artificial Sequence
  Description of Artificial Sequence: Synthetic oligonucleotide
  Target: SCN9A; (-) strand; PAM type: YTN; PAM sequence: TTC
tcgaaggcagtgcagtcact

SEQ ID NO: 58383 - DNA, 20 bp, Artificial Sequence
  Description of Artificial Sequence: Synthetic oligonucleotide
  Target: SCN9A; (-) strand; PAM type: YTN; PAM sequence: TTA
tcaaaatattctcgaaggca

SEQ ID NO: 58384 - DNA, 20 bp, Artificial Sequence
  Description of Artificial Sequence: Synthetic oligonucleotide
  Target: SCN9A; (-) strand; PAM type: YTN; PAM sequence: TTT
atcaaaatattctcgaaggc

SEQ ID NO: 58385 - DNA, 20 bp, Artificial Sequence
  Description of Artificial Sequence: Synthetic oligonucleotide
  Target: SCN9A; (-) strand; PAM type: YTN; PAM sequence: TTT
tatcaaaatattctcgaagg

SEQ ID NO: 58386 - DNA, 20 bp, Artificial Sequence
  Description of Artificial Sequence: Synthetic oligonucleotide
  Target: SCN9A; (-) strand; PAM type: YTN; PAM sequence: TTT
ttatcaaaatattctcgaag

SEQ ID NO: 58387 - DNA, 20 bp, Artificial Sequence
  Description of Artificial Sequence: Synthetic oligonucleotide
  Target: SCN9A; (-) strand; PAM type: YTN; PAM sequence: CTT
tttatcaaaatattctcgaa

SEQ ID NO: 58388 - DNA, 20 bp, Artificial Sequence
  Description of Artificial Sequence: Synthetic oligonucleotide
  Target: SCN9A; (-) strand; PAM type: YTN; PAM sequence: CTA
tgccaaaatcctttttatca

SEQ ID NO: 58389 - DNA, 20 bp, Artificial Sequence
  Description of Artificial Sequence: Synthetic oligonucleotide
  Target: SCN9A; (-) strand; PAM type: YTN; PAM sequence: TTG
aggaagtctatgccaaaatc

SEQ ID NO: 58390 - DNA, 20 bp, Artificial Sequence
  Description of Artificial Sequence: Synthetic oligonucleotide
  Target: SCN9A; (-) strand; PAM type: YTN; PAM sequence: TTT
gaggaagtctatgccaaaat

SEQ ID NO: 58391 - DNA, 20 bp, Artificial Sequence
  Description of Artificial Sequence: Synthetic oligonucleotide
  Target: SCN9A; (-) strand; PAM type: YTN; PAM sequence: TTT
tgaggaagtctatgccaaaa

SEQ ID NO: 58392 - DNA, 20 bp, Artificial Sequence
  Description of Artificial Sequence: Synthetic oligonucleotide
  Target: SCN9A; (-) strand; PAM type: YTN; PAM sequence: CTT
ttgaggaagtctatgccaaa

SEQ ID NO: 58393 - DNA, 20 bp, Artificial Sequence
  Description of Artificial Sequence: Synthetic oligonucleotide
  Target: SCN9A; (-) strand; PAM type: YTN; PAM sequence: CTC
ttttgaggaagtctatgcca

SEQ ID NO: 58394 - DNA, 20 bp, Artificial Sequence
  Description of Artificial Sequence: Synthetic oligonucleotide
  Target: SCN9A; (-) strand; PAM type: YTN; PAM sequence: TTA
ataaaactcttttgaggaag

SEQ ID NO: 58395 - DNA, 20 bp, Artificial Sequence
  Description of Artificial Sequence: Synthetic oligonucleotide
  Target: SCN9A; (-) strand; PAM type: YTN; PAM sequence: TTG
tgttaataaaactcttttga

SEQ ID NO: 58396 - DNA, 20 bp, Artificial Sequence
  Description of Artificial Sequence: Synthetic oligonucleotide
  Target: SCN9A; (-) strand; PAM type: YTN; PAM sequence: TTT
gtgttaataaaactcttttg

SEQ ID NO: 58397 - DNA, 20 bp, Artificial Sequence
  Description of Artificial Sequence: Synthetic oligonucleotide
  Target: SCN9A; (-) strand; PAM type: YTN; PAM sequence: TTA
tttgtgttaataaaactctt

SEQ ID NO: 58398 - DNA, 20 bp, Artificial Sequence
  Description of Artificial Sequence: Synthetic oligonucleotide
  Target: SCN9A; (-) strand; PAM type: YTN; PAM sequence: TTT
atttgtgttaataaaactct

SEQ ID NO: 58399 - DNA, 20 bp, Artificial Sequence
  Description of Artificial Sequence: Synthetic oligonucleotide
  Target: SCN9A; (-) strand; PAM type: YTN; PAM sequence: CTG
tgaaagtgatttatttgtgt

SEQ ID NO: 58400 - DNA, 20 bp, Artificial Sequence
  Description of Artificial Sequence: Synthetic oligonucleotide
  Target: SCN9A; (-) strand; PAM type: YTN; PAM sequence: TTA
cagcctgtgaaagtgattta

SEQ ID NO: 58401 - DNA, 20 bp, Artificial Sequence
  Description of Artificial Sequence: Synthetic oligonucleotide
  Target: SCN9A; (-) strand; PAM type: YTN; PAM sequence: TTT
acagcctgtgaaagtgattt

SEQ ID NO: 58402 - DNA, 20 bp, Artificial Sequence
  Description of Artificial Sequence: Synthetic oligonucleotide
  Target: SCN9A; (-) strand; PAM type: YTN; PAM sequence: TTG
tttacagcctgtgaaagtga

SEQ ID NO: 58403 - DNA, 20 bp, Artificial Sequence
  Description of Artificial Sequence: Synthetic oligonucleotide
  Target: SCN9A; (-) strand; PAM type: YTN; PAM sequence: TTG
atatattgtttacagcctgt

SEQ ID NO: 58404 - DNA, 20 bp, Artificial Sequence
  Description of Artificial Sequence: Synthetic oligonucleotide
  Target: SCN9A; (-) strand; PAM type: YTN; PAM sequence: TTT
gatatattgtttacagcctg

SEQ ID NO: 58405 - DNA, 20 bp, Artificial Sequence
  Description of Artificial Sequence: Synthetic oligonucleotide
  Target: SCN9A; (-) strand; PAM type: YTN; PAM sequence: TTT
tgatatattgtttacagcct

SEQ ID NO: 58406 - DNA, 20 bp, Artificial Sequence
  Description of Artificial Sequence: Synthetic oligonucleotide
  Target: SCN9A; (-) strand; PAM type: YTN; PAM sequence: TTT
ttgatatattgtttacagcc

SEQ ID NO: 58407 - DNA, 20 bp, Artificial Sequence
  Description of Artificial Sequence: Synthetic oligonucleotide
  Target: SCN9A; (-) strand; PAM type: YTN; PAM sequence: TTC
atttttgatatattgtttac

SEQ ID NO: 58408 - DNA, 20 bp, Artificial Sequence
  Description of Artificial Sequence: Synthetic oligonucleotide
  Target: SCN9A; (-) strand; PAM type: YTN; PAM sequence: CTT
catttttgatatattgttta

SEQ ID NO: 58409 - DNA, 20 bp, Artificial Sequence
  Description of Artificial Sequence: Synthetic oligonucleotide
  Target: SCN9A; (-) strand; PAM type: YTN; PAM sequence: TTC
atatgatagtgtaacaaagc

SEQ ID NO: 58410 - DNA, 20 bp, Artificial Sequence
  Description of Artificial Sequence: Synthetic oligonucleotide
  Target: SCN9A; (-) strand; PAM type: YTN; PAM sequence: CTT
catatgatagtgtaacaaag

SEQ ID NO: 58411 - DNA, 20 bp, Artificial Sequence
  Description of Artificial Sequence: Synthetic oligonucleotide
  Target: SCN9A; (-) strand; PAM type: YTN; PAM sequence: CTC
caccttcatatgatagtgta

SEQ ID NO: 58412 - DNA, 20 bp, Artificial Sequence
  Description of Artificial Sequence: Synthetic oligonucleotide
  Target: SCN9A; (-) strand; PAM type: YTN; PAM sequence: CTC
tccaccttcatatgatagtg

SEQ ID NO: 58413 - DNA, 20 bp, Artificial Sequence
  Description of Artificial Sequence: Synthetic oligonucleotide
  Target: SCN9A; (-) strand; PAM type: YTN; PAM sequence: TTC
atccaccacctctccacctt

SEQ ID NO: 58414 - DNA, 20 bp, Artificial Sequence
  Description of Artificial Sequence: Synthetic oligonucleotide
  Target: SCN9A; (-) strand; PAM type: YTN; PAM sequence: CTT
catccaccacctctccacct

SEQ ID NO: 58415 - DNA, 20 bp, Artificial Sequence
  Description of Artificial Sequence: Synthetic oligonucleotide
  Target: SCN9A; (-) strand; PAM type: YTN; PAM sequence: CTC
aagtccagaaaaaacagatg

SEQ ID NO: 58416 - DNA, 20 bp, Artificial Sequence
  Description of Artificial Sequence: Synthetic oligonucleotide
  Target: SCN9A; (-) strand; PAM type: YTN; PAM sequence: TTA
atgagaactcaagtccagaa

SEQ ID NO: 58417 - DNA, 20 bp, Artificial Sequence
  Description of Artificial Sequence: Synthetic oligonucleotide
  Target: SCN9A; (-) strand; PAM type: YTN; PAM sequence: TTG
ataatgttaatgagaactca

SEQ ID NO: 58418 - DNA, 20 bp, Artificial Sequence
  Description of Artificial Sequence: Synthetic oligonucleotide
  Target: SCN9A; (-) strand; PAM type: YTN; PAM sequence: TTT
gataatgttaatgagaactc

SEQ ID NO: 58419 - DNA, 20 bp, Artificial Sequence
  Description of Artificial Sequence: Synthetic oligonucleotide
  Target: SCN9A; (-) strand; PAM type: YTN; PAM sequence: TTT
tgataatgttaatgagaact

SEQ ID NO: 58420 - DNA, 20 bp, Artificial Sequence
  Description of Artificial Sequence: Synthetic oligonucleotide
  Target: SCN9A; (-) strand; PAM type: YTN; PAM sequence: CTT
ttgataatgttaatgagaac

SEQ ID NO: 58421 - DNA, 20 bp, Artificial Sequence
  Description of Artificial Sequence: Synthetic oligonucleotide
  Target: SCN9A; (-) strand; PAM type: YTN; PAM sequence: CTC
aataaaaaagatatggcttt

SEQ ID NO: 58422 - DNA, 20 bp, Artificial Sequence
  Description of Artificial Sequence: Synthetic oligonucleotide
  Target: SCN9A; (-) strand; PAM type: YTN; PAM sequence: TTA
ctcaataaaaaagatatggc

SEQ ID NO: 58423 - DNA, 20 bp, Artificial Sequence
  Description of Artificial Sequence: Synthetic oligonucleotide
  Target: SCN9A; (-) strand; PAM type: YTN; PAM sequence: TTT
actcaataaaaaagatatgg

SEQ ID NO: 58424 - DNA, 20 bp, Artificial Sequence
  Description of Artificial Sequence: Synthetic oligonucleotide
  Target: SCN9A; (-) strand; PAM type: YTN; PAM sequence: TTA
aggcaaaatgtcaaaaatat

SEQ ID NO: 58425 - DNA, 20 bp, Artificial Sequence
  Description of Artificial Sequence: Synthetic oligonucleotide
  Target: SCN9A; (-) strand; PAM type: YTN; PAM sequence: CTT
aaggcaaaatgtcaaaaata

SEQ ID NO: 58426 - DNA, 20 bp, Artificial Sequence
  Description of Artificial Sequence: Synthetic oligonucleotide
  Target: SCN9A; (-) strand; PAM type: YTN; PAM sequence: TTA
ccgcttaaggcaaaatgtca

SEQ ID NO: 58427 - DNA, 20 bp, Artificial Sequence
  Description of Artificial Sequence: Synthetic oligonucleotide
  Target: SCN9A; (-) strand; PAM type: YTN; PAM sequence: TTA
tagacgttaccgcttaaggc

SEQ ID NO: 58428 - DNA, 20 bp, Artificial Sequence
  Description of Artificial Sequence: Synthetic oligonucleotide
  Target: SCN9A; (-) strand; PAM type: YTN; PAM sequence: CTT
atagacgttaccgcttaagg

SEQ ID NO: 58429 - DNA, 20 bp, Artificial Sequence
  Description of Artificial Sequence: Synthetic oligonucleotide
  Target: SCN9A; (-) strand; PAM type: YTN; PAM sequence: TTC
agcgtgcttatagacgttac

SEQ ID NO: 58430 - DNA, 20 bp, Artificial Sequence
  Description of Artificial Sequence: Synthetic oligonucleotide
  Target: SCN9A; (-) strand; PAM type: YTN; PAM sequence: CTG
tcattcagcgtgcttataga

SEQ ID NO: 58431 - DNA, 20 bp, Artificial Sequence
  Description of Artificial Sequence: Synthetic oligonucleotide
  Target: SCN9A; (-) strand; PAM type: YTN; PAM sequence: CTA
ctgtcattcagcgtgcttat

SEQ ID NO: 58432 - DNA, 20 bp, Artificial Sequence
  Description of Artificial Sequence: Synthetic oligonucleotide
  Target: SCN9A; (-) strand; PAM type: YTN; PAM sequence: CTG
ctactgtcattcagcgtgct

SEQ ID NO: 58433 - DNA, 20 bp, Artificial Sequence
  Description of Artificial Sequence: Synthetic oligonucleotide
  Target: SCN9A; (-) strand; PAM type: YTN; PAM sequence: CTA
aaacggaaacaagaggatgt

SEQ ID NO: 58434 - DNA, 20 bp, Artificial Sequence
  Description of Artificial Sequence: Synthetic oligonucleotide
  Target: SCN9A; (-) strand; PAM type: YTN; PAM sequence: CTA
tgaacccatcacaaccacac

SEQ ID NO: 58435 - DNA, 20 bp, Artificial Sequence
  Description of Artificial Sequence: Synthetic oligonucleotide
  Target: SCN9A; (-) strand; PAM type: YTN; PAM sequence: TTC
caaagtgtcctatgaaccca

SEQ ID NO: 58436 - DNA, 20 bp, Artificial Sequence
  Description of Artificial Sequence: Synthetic oligonucleotide
  Target: SCN9A; (-) strand; PAM type: YTN; PAM sequence: CTT
ccaaagtgtcctatgaaccc

SEQ ID NO: 58437 - DNA, 20 bp, Artificial Sequence
  Description of Artificial Sequence: Synthetic oligonucleotide
  Target: SCN9A; (-) strand; PAM type: YTN; PAM sequence: CTG
caaatccttccaaagtgtcc

SEQ ID NO: 58438 - DNA, 20 bp, Artificial Sequence
  Description of Artificial Sequence: Synthetic oligonucleotide
  Target: SCN9A; (-) strand; PAM type: YTN; PAM sequence: TTC
atgtctgcaaatccttccaa

SEQ ID NO: 58439 - DNA, 20 bp, Artificial Sequence
  Description of Artificial Sequence: Synthetic oligonucleotide
  Target: SCN9A; (-) strand; PAM type: YTN; PAM sequence: TTC
acagatggaagaaaggttca

SEQ ID NO: 58440 - DNA, 20 bp, Artificial Sequence
  Description of Artificial Sequence: Synthetic oligonucleotide
  Target: SCN9A; (-) strand; PAM type: YTN; PAM sequence: TTC
gttcacagatggaagaaagg

SEQ ID NO: 58441 - DNA, 20 bp, Artificial Sequence
  Description of Artificial Sequence: Synthetic oligonucleotide
  Target: SCN9A; (-) strand; PAM type: YTN; PAM sequence: CTT
cgttcacagatggaagaaag

SEQ ID NO: 58442 - DNA, 20 bp, Artificial Sequence
  Description of Artificial Sequence: Synthetic oligonucleotide
  Target: SCN9A; (-) strand; PAM type: YTN; PAM sequence: CTC
ttcgttcacagatggaagaa

SEQ ID NO: 58443 - DNA, 20 bp, Artificial Sequence
  Description of Artificial Sequence: Synthetic oligonucleotide
  Target: SCN9A; (-) strand; PAM type: YTN; PAM sequence: TTC
tcttcgttcacagatggaag

SEQ ID NO: 58444 - DNA, 20 bp, Artificial Sequence
  Description of Artificial Sequence: Synthetic oligonucleotide
  Target: SCN9A; (-) strand; PAM type: YTN; PAM sequence: TTG
ggtgagagtggggagatgga

SEQ ID NO: 58445 - DNA, 20 bp, Artificial Sequence
  Description of Artificial Sequence: Synthetic oligonucleotide
  Target: SCN9A; (-) strand; PAM type: YTN; PAM sequence: TTT
gggtgagagtggggagatgg

SEQ ID NO: 58446 - DNA, 20 bp, Artificial Sequence
  Description of Artificial Sequence: Synthetic oligonucleotide
  Target: SCN9A; (-) strand; PAM type: YTN; PAM sequence: TTT
tgggtgagagtggggagatg

SEQ ID NO: 58447 - DNA, 20 bp, Artificial Sequence
  Description of Artificial Sequence: Synthetic oligonucleotide
  Target: SCN9A; (-) strand; PAM type: YTN; PAM sequence: TTA
caaagcgtgttttgggtgag

SEQ ID NO: 58448 - DNA, 20 bp, Artificial Sequence
  Description of Artificial Sequence: Synthetic oligonucleotide
  Target: SCN9A; (-) strand; PAM type: YTN; PAM sequence: TTT
acaaagcgtgttttgggtga

SEQ ID NO: 58449 - DNA, 20 bp, Artificial Sequence
  Description of Artificial Sequence: Synthetic oligonucleotide
  Target: SCN9A; (-) strand; PAM type: YTN; PAM sequence: TTT
tacaaagcgtgttttgggtg

SEQ ID NO: 58450 - DNA, 20 bp, Artificial Sequence
  Description of Artificial Sequence: Synthetic oligonucleotide
  Target: SCN9A; (-) strand; PAM type: YTN; PAM sequence: CTT
ttacaaagcgtgttttgggt

SEQ ID NO: 58451 - DNA, 20 bp, Artificial Sequence
  Description of Artificial Sequence: Synthetic oligonucleotide
  Target: SCN9A; (-) strand; PAM type: YTN; PAM sequence: TTG
cttttacaaagcgtgttttg

SEQ ID NO: 58452 - DNA, 20 bp, Artificial Sequence
  Description of Artificial Sequence: Synthetic oligonucleotide
  Target: SCN9A; (-) strand; PAM type: YTN; PAM sequence: TTT
gcttttacaaagcgtgtttt

SEQ ID NO: 58453 - DNA, 20 bp, Artificial Sequence
  Description of Artificial Sequence: Synthetic oligonucleotide
  Target: SCN9A; (-) strand; PAM type: YTN; PAM sequence: TTA
tttgcttttacaaagcgtgt

SEQ ID NO: 58454 - DNA, 20 bp, Artificial Sequence
  Description of Artificial Sequence: Synthetic oligonucleotide
  Target: SCN9A; (-) strand; PAM type: YTN; PAM sequence: CTT
atttgcttttacaaagcgtg

SEQ ID NO: 58455 - DNA, 20 bp, Artificial Sequence
  Description of Artificial Sequence: Synthetic oligonucleotide
  Target: SCN9A; (-) strand; PAM type: YTN; PAM sequence: TTG
acatcttatttgcttttaca

SEQ ID NO: 58456 - DNA, 20 bp, Artificial Sequence
  Description of Artificial Sequence: Synthetic oligonucleotide
  Target: SCN9A; (-) strand; PAM type: YTN; PAM sequence: CTT
gacatcttatttgcttttac

SEQ ID NO: 58457 - DNA, 20 bp, Artificial Sequence
  Description of Artificial Sequence: Synthetic oligonucleotide
  Target: SCN9A; (-) strand; PAM type: YTN; PAM sequence: TTG
tcttgacatcttatttgctt

SEQ ID NO: 58458 - DNA, 20 bp, Artificial Sequence
  Description of Artificial Sequence: Synthetic oligonucleotide
  Target: SCN9A; (-) strand; PAM type: YTN; PAM sequence: TTA
gtggtgaccggatccattgt

SEQ ID NO: 58459 - DNA, 20 bp, Artificial Sequence
  Description of Artificial Sequence: Synthetic oligonucleotide
  Target: SCN9A; (-) strand; PAM type: YTN; PAM sequence: CTG
cccatggttagtggtgaccg

SEQ ID NO: 58460 - DNA, 20 bp, Artificial Sequence
  Description of Artificial Sequence: Synthetic oligonucleotide
  Target: SCN9A; (-) strand; PAM type: YTN; PAM sequence: TTG
ccatggatctgcccatggtt

SEQ ID NO: 58461 - DNA, 20 bp, Artificial Sequence
  Description of Artificial Sequence: Synthetic oligonucleotide
  Target: SCN9A; (-) strand; PAM type: YTN; PAM sequence: CTC
attgccatggatctgcccat

SEQ ID NO: 58462 - DNA, 20 bp, Artificial Sequence
  Description of Artificial Sequence: Synthetic oligonucleotide
  Target: SCN9A; (-) strand; PAM type: YTN; PAM sequence: CTC
atagcaaaacccaacaaagt

SEQ ID NO: 58463 - DNA, 20 bp, Artificial Sequence
  Description of Artificial Sequence: Synthetic oligonucleotide
  Target: SCN9A; (-) strand; PAM type: YTN; PAM sequence: TTC
tcatagcaaaacccaacaaa

SEQ ID NO: 58464 - DNA, 20 bp, Artificial Sequence
  Description of Artificial Sequence: Synthetic oligonucleotide
  Target: SCN9A; (-) strand; PAM type: YTN; PAM sequence: CTT
ctcatagcaaaacccaacaa

SEQ ID NO: 58465 - DNA, 20 bp, Artificial Sequence
  Description of Artificial Sequence: Synthetic oligonucleotide
  Target: SCN9A; (-) strand; PAM type: YTN; PAM sequence: CTC
ttctcatagcaaaacccaac

SEQ ID NO: 58466 - DNA, 20 bp, Artificial Sequence
  Description of Artificial Sequence: Synthetic oligonucleotide
  Target: SCN9A; (-) strand; PAM type: YTN; PAM sequence: CTC
ctcttctcatagcaaaaccc

SEQ ID NO: 58467 - DNA, 20 bp, Artificial Sequence
  Description of Artificial Sequence: Synthetic oligonucleotide
  Target: SCN9A; (-) strand; PAM type: YTN; PAM sequence: CTG
gatcctcctcttctcatagc

SEQ ID NO: 58468 - DNA, 20 bp, Artificial Sequence
  Description of Artificial Sequence: Synthetic oligonucleotide
  Target: SCN9A; (-) strand; PAM type: YTN; PAM sequence: CTG
ccctggatcctcctcttctc

SEQ ID NO: 58469 - DNA, 20 bp, Artificial Sequence
  Description of Artificial Sequence: Synthetic oligonucleotide
  Target: SCN9A; (-) strand; PAM type: YTN; PAM sequence: TTG
cagctgccctggatcctcct

SEQ ID NO: 58470 - DNA, 20 bp, Artificial Sequence
  Description of Artificial Sequence: Synthetic oligonucleotide
  Target: SCN9A; (-) strand; PAM type: YTN; PAM sequence: TTT
gcagctgccctggatcctcc

SEQ ID NO: 58471 - DNA, 20 bp, Artificial Sequence
  Description of Artificial Sequence: Synthetic oligonucleotide
  Target: SCN9A; (-) strand; PAM type: YTN; PAM sequence: TTT
tgcagctgccctggatcctc

SEQ ID NO: 58472 - DNA, 20 bp, Artificial Sequence
  Description of Artificial Sequence: Synthetic oligonucleotide
  Target: SCN9A; (-) strand; PAM type: YTN; PAM sequence: CTG
attttgcagctgccctggat

SEQ ID NO: 58473 - DNA, 20 bp, Artificial Sequence
  Description of Artificial Sequence: Synthetic oligonucleotide
  Target: SCN9A; (-) strand; PAM type: YTN; PAM sequence: CTC
tgattttgcagctgccctgg

SEQ ID NO: 58474 - DNA, 20 bp, Artificial Sequence
  Description of Artificial Sequence: Synthetic oligonucleotide
  Target: SCN9A; (-) strand; PAM type: YTN; PAM sequence: CTC
tctgattttgcagctgccct

SEQ ID NO: 58475 - DNA, 20 bp, Artificial Sequence
  Description of Artificial Sequence: Synthetic oligonucleotide
  Target: SCN9A; (-) strand; PAM type: YTN; PAM sequence: CTA
aactctctgattttgcagct

SEQ ID NO: 58476 - DNA, 20 bp, Artificial Sequence
  Description of Artificial Sequence: Synthetic oligonucleotide
  Target: SCN9A; (-) strand; PAM type: YTN; PAM sequence: CTC
taaactctctgattttgcag

SEQ ID NO: 58477 - DNA, 20 bp, Artificial Sequence
  Description of Artificial Sequence: Synthetic oligonucleotide
  Target: SCN9A; (-) strand; PAM type: YTN; PAM sequence: TTC
tctaaactctctgattttgc

SEQ ID NO: 58478 - DNA, 20 bp, Artificial Sequence
  Description of Artificial Sequence: Synthetic oligonucleotide
  Target: SCN9A; (-) strand; PAM type: YTN; PAM sequence: TTA
tagagttctctaaactctct

SEQ ID NO: 58479 - DNA, 20 bp, Artificial Sequence
  Description of Artificial Sequence: Synthetic oligonucleotide
  Target: SCN9A; (-) strand; PAM type: YTN; PAM sequence: TTT
atagagttctctaaactctc

SEQ ID NO: 58480 - DNA, 20 bp, Artificial Sequence
  Description of Artificial Sequence: Synthetic oligonucleotide
  Target: SCN9A; (-) strand; PAM type: YTN; PAM sequence: TTG
atcccgatgcgacccagttt

SEQ ID NO: 58481 - DNA, 20 bp, Artificial Sequence
  Description of Artificial Sequence: Synthetic oligonucleotide
  Target: SCN9A; (-) strand; PAM type: YTN; PAM sequence: TTT
gatcccgatgcgacccagtt

SEQ ID NO: 58482 - DNA, 20 bp, Artificial Sequence
  Description of Artificial Sequence: Synthetic oligonucleotide
  Target: SCN9A; (-) strand; PAM type: YTN; PAM sequence: TTG
ggagaagtttgatcccgatg

SEQ ID NO: 58483 - DNA, 20 bp, Artificial Sequence
  Description of Artificial Sequence: Synthetic oligonucleotide
  Target: SCN9A; (-) strand; PAM type: YTN; PAM sequence: TTT
gggagaagtttgatcccgat

SEQ ID NO: 58484 - DNA, 20 bp, Artificial Sequence
  Description of Artificial Sequence: Synthetic oligonucleotide
  Target: SCN9A; (-) strand; PAM type: YTN; PAM sequence: CTA
tgaggtttgggagaagtttg

SEQ ID NO: 58485 - DNA, 20 bp, Artificial Sequence
  Description of Artificial Sequence: Synthetic oligonucleotide
  Target: SCN9A; (-) strand; PAM type: YTN; PAM sequence: TTC
tatgaggtttgggagaagtt

SEQ ID NO: 58486 - DNA, 20 bp, Artificial Sequence
  Description of Artificial Sequence: Synthetic oligonucleotide
  Target: SCN9A; (-) strand; PAM type: YTN; PAM sequence: TTG
agatgttctatgaggtttgg

SEQ ID NO: 58487 - DNA, 20 bp, Artificial Sequence
  Description of Artificial Sequence: Synthetic oligonucleotide
  Target: SCN9A; (-) strand; PAM type: YTN; PAM sequence: TTT
gagatgttctatgaggtttg

SEQ ID NO: 58488 - DNA, 20 bp, Artificial Sequence
  Description of Artificial Sequence: Synthetic oligonucleotide
  Target: SCN9A; (-) strand; PAM type: YTN; PAM sequence: CTT
tgagatgttctatgaggttt

SEQ ID NO: 58489 - DNA, 20 bp, Artificial Sequence
  Description of Artificial Sequence: Synthetic oligonucleotide
  Target: SCN9A; (-) strand; PAM type: YTN; PAM sequence: CTG
agtgaggatgactttgagat

SEQ ID NO: 58490 - DNA, 20 bp, Artificial Sequence
  Description of Artificial Sequence: Synthetic oligonucleotide
  Target: SCN9A; (-) strand; PAM type: YTN; PAM sequence: CTC
tgagtgaggatgactttgag

SEQ ID NO: 58491 - DNA, 20 bp, Artificial Sequence
  Description of Artificial Sequence: Synthetic oligonucleotide
  Target: SCN9A; (-) strand; PAM type: YTN; PAM sequence: CTG
aacctctgagtgaggatgac

SEQ ID NO: 58492 - DNA, 20 bp, Artificial Sequence
  Description of Artificial Sequence: Synthetic oligonucleotide
  Target: SCN9A; (-) strand; PAM type: YTN; PAM sequence: CTG
aagaaagtactgaacctctg

SEQ ID NO: 58493 - DNA, 20 bp, Artificial Sequence
  Description of Artificial Sequence: Synthetic oligonucleotide
  Target: SCN9A; (-) strand; PAM type: YTN; PAM sequence: TTG
ccactgaagaaagtactgaa

SEQ ID NO: 58494 - DNA, 20 bp, Artificial Sequence
  Description of Artificial Sequence: Synthetic oligonucleotide
  Target: SCN9A; (-) strand; PAM type: YTN; PAM sequence: TTA
gtgttgccactgaagaaagt

SEQ ID NO: 58495 - DNA, 20 bp, Artificial Sequence
  Description of Artificial Sequence: Synthetic oligonucleotide
  Target: SCN9A; (-) strand; PAM type: YTN; PAM sequence: TTT
agtgttgccactgaagaaag

SEQ ID NO: 58496 - DNA, 20 bp, Artificial Sequence
  Description of Artificial Sequence: Synthetic oligonucleotide
  Target: SCN9A; (-) strand; PAM type: YTN; PAM sequence: TTT
tagtgttgccactgaagaaa

SEQ ID NO: 58497 - DNA, 20 bp, Artificial Sequence
  Description of Artificial Sequence: Synthetic oligonucleotide
  Target: SCN9A; (-) strand; PAM type: YTN; PAM sequence: CTG
gagaattttagtgttgccac

SEQ ID NO: 58498 - DNA, 20 bp, Artificial Sequence
  Description of Artificial Sequence: Synthetic oligonucleotide
  Target: SCN9A; (-) strand; PAM type: YTN; PAM sequence: TTG
cagtcatactggagaatttt

SEQ ID NO: 58499 - DNA, 20 bp, Artificial Sequence
  Description of Artificial Sequence: Synthetic oligonucleotide
  Target: SCN9A; (-) strand; PAM type: YTN; PAM sequence: TTG
tggtgaacatgtacattgca

SEQ ID NO: 58500 - DNA, 20 bp, Artificial Sequence
  Description of Artificial Sequence: Synthetic oligonucleotide
  Target: SCN9A; (-) strand; PAM type: YTN; PAM sequence: CTG
gttgtggtgaacatgtacat

SEQ ID NO: 58501 - DNA, 20 bp, Artificial Sequence
  Description of Artificial Sequence: Synthetic oligonucleotide
  Target: SCN9A; (-) strand; PAM type: YTN; PAM sequence: TTC
ctggttgtggtgaacatgta

SEQ ID NO: 58502 - DNA, 20 bp, Artificial Sequence
  Description of Artificial Sequence: Synthetic oligonucleotide
  Target: SCN9A; (-) strand; PAM type: YTN; PAM sequence: CTT
cctggttgtggtgaacatgt

SEQ ID NO: 58503 - DNA, 20 bp, Artificial Sequence
  Description of Artificial Sequence: Synthetic oligonucleotide
  Target: SCN9A; (-) strand; PAM type: YTN; PAM sequence: TTA
tatcatcatatccttcctgg

SEQ ID NO: 58504 - DNA, 20 bp, Artificial Sequence
  Description of Artificial Sequence: Synthetic oligonucleotide
  Target: SCN9A; (-) strand; PAM type: YTN; PAM sequence: TTA
gttatatcatcatatccttc

SEQ ID NO: 58505 - DNA, 20 bp, Artificial Sequence
  Description of Artificial Sequence: Synthetic oligonucleotide
  Target: SCN9A; (-) strand; PAM type: YTN; PAM sequence: TTG
ttagttatatcatcatatcc

SEQ ID NO: 58506 - DNA, 20 bp, Artificial Sequence
  Description of Artificial Sequence: Synthetic oligonucleotide
  Target: SCN9A; (-) strand; PAM type: YTN; PAM sequence: TTT
gttagttatatcatcatatc

SEQ ID NO: 58507 - DNA, 20 bp, Artificial Sequence
  Description of Artificial Sequence: Synthetic oligonucleotide
  Target: SCN9A; (-) strand; PAM type: YTN; PAM sequence: CTT
tgttagttatatcatcatat

SEQ ID NO: 58508 - DNA, 20 bp, Artificial Sequence
  Description of Artificial Sequence: Synthetic oligonucleotide
  Target: SCN9A; (-) strand; PAM type: YTN; PAM sequence: CTA
ctttgttagttatatcatca

SEQ ID NO: 58509 - DNA, 20 bp, Artificial Sequence
  Description of Artificial Sequence: Synthetic oligonucleotide
  Target: SCN9A; (-) strand; PAM type: YTN; PAM sequence: TTC
tactttgttagttatatcat

SEQ ID NO: 58510 - DNA, 20 bp, Artificial Sequence
  Description of Artificial Sequence: Synthetic oligonucleotide
  Target: SCN9A; (-) strand; PAM type: YTN; PAM sequence: TTG
gaatattctactttgttagt

SEQ ID NO: 58511 - DNA, 20 bp, Artificial Sequence
  Description of Artificial Sequence: Synthetic oligonucleotide
  Target: SCN9A; (-) strand; PAM type: YTN; PAM sequence: CTG
ttggaatattctactttgtt

SEQ ID NO: 58512 - DNA, 20 bp, Artificial Sequence
  Description of Artificial Sequence: Synthetic oligonucleotide
  Target: SCN9A; (-) strand; PAM type: YTN; PAM sequence: CTG
tggtaacccatctgttggaa

SEQ ID NO: 58513 - DNA, 20 bp, Artificial Sequence
  Description of Artificial Sequence: Synthetic oligonucleotide
  Target: SCN9A; (-) strand; PAM type: YTN; PAM sequence: TTG
aaggagactgtggtaaccca

SEQ ID NO: 58514 - DNA, 20 bp, Artificial Sequence
  Description of Artificial Sequence: Synthetic oligonucleotide
  Target: SCN9A; (-) strand; PAM type: YTN; PAM sequence: TTC
agttgaaggagactgtggta

SEQ ID NO: 58515 - DNA, 20 bp, Artificial Sequence
  Description of Artificial Sequence: Synthetic oligonucleotide
  Target: SCN9A; (-) strand; PAM type: YTN; PAM sequence: CTG
gaagttcagttgaaggagac

SEQ ID NO: 58516 - DNA, 20 bp, Artificial Sequence
  Description of Artificial Sequence: Synthetic oligonucleotide
  Target: SCN9A; (-) strand; PAM type: YTN; PAM sequence: TTC
atcctggaagttcagttgaa

SEQ ID NO: 58517 - DNA, 20 bp, Artificial Sequence
  Description of Artificial Sequence: Synthetic oligonucleotide
  Target: SCN9A; (-) strand; PAM type: YTN; PAM sequence: CTG
tgacccaaaaaaagttcatc

SEQ ID NO: 58518 - DNA, 20 bp, Artificial Sequence
  Description of Artificial Sequence: Synthetic oligonucleotide
  Target: SCN9A; (-) strand; PAM type: YTN; PAM sequence: TTA
acagtaagccacccgactgt

SEQ ID NO: 58519 - DNA, 20 bp, Artificial Sequence
  Description of Artificial Sequence: Synthetic oligonucleotide
  Target: SCN9A; (-) strand; PAM type: YTN; PAM sequence: CTT
aacagtaagccacccgactg

SEQ ID NO: 58520 - DNA, 20 bp, Artificial Sequence
  Description of Artificial Sequence: Synthetic oligonucleotide
  Target: SCN9A; (-) strand; PAM type: YTN; PAM sequence: TTC
ttaacagtaagccacccgac

SEQ ID NO: 58521 - DNA, 20 bp, Artificial Sequence
  Description of Artificial Sequence: Synthetic oligonucleotide
  Target: SCN9A; (-) strand; PAM type: YTN; PAM sequence: CTA
ttcttaacagtaagccaccc

SEQ ID NO: 58522 - DNA, 20 bp, Artificial Sequence
  Description of Artificial Sequence: Synthetic oligonucleotide
  Target: SCN9A; (-) strand; PAM type: YTN; PAM sequence: CTA
gcacctattcttaacagtaa

SEQ ID NO: 58523 - DNA, 20 bp, Artificial Sequence
  Description of Artificial Sequence: Synthetic oligonucleotide
  Target: SCN9A; (-) strand; PAM type: YTN; PAM sequence: TTG
ctagcacctattcttaacag

SEQ ID NO: 58524 - DNA, 20 bp, Artificial Sequence
  Description of Artificial Sequence: Synthetic oligonucleotide
  Target: SCN9A; (-) strand; PAM type: YTN; PAM sequence: CTG
ggatggattgctagcaccta

SEQ ID NO: 58525 - DNA, 20 bp, Artificial Sequence
  Description of Artificial Sequence: Synthetic oligonucleotide
  Target: SCN9A; (-) strand; PAM type: YTN; PAM sequence: CTG
gctgggatggattgctagca

SEQ ID NO: 58526 - DNA, 20 bp, Artificial Sequence
  Description of Artificial Sequence: Synthetic oligonucleotide
  Target: SCN9A; (-) strand; PAM type: YTN; PAM sequence: CTG
ctggctgggatggattgcta

SEQ ID NO: 58527 - DNA, 20 bp, Artificial Sequence
  Description of Artificial Sequence: Synthetic oligonucleotide
  Target: SCN9A; (-) strand; PAM type: YTN; PAM sequence: CTC
tgctggctgggatggattgc

SEQ ID NO: 58528 - DNA, 20 bp, Artificial Sequence
  Description of Artificial Sequence: Synthetic oligonucleotide
  Target: SCN9A; (-) strand; PAM type: YTN; PAM sequence: TTA
caacctctgctggctgggat

SEQ ID NO: 58529 - DNA, 20 bp, Artificial Sequence
  Description of Artificial Sequence: Synthetic oligonucleotide
  Target: SCN9A; (-) strand; PAM type: YTN; PAM sequence: TTC
caaattacaacctctgctgg

SEQ ID NO: 58530 - DNA, 20 bp, Artificial Sequence
  Description of Artificial Sequence: Synthetic oligonucleotide
  Target: SCN9A; (-) strand; PAM type: YTN; PAM sequence: CTG
ttccaaattacaacctctgc

SEQ ID NO: 58531 - DNA, 20 bp, Artificial Sequence
  Description of Artificial Sequence: Synthetic oligonucleotide
  Target: SCN9A; (-) strand; PAM type: YTN; PAM sequence: TTG
cctgttccaaattacaacct

SEQ ID NO: 58532 - DNA, 20 bp, Artificial Sequence
  Description of Artificial Sequence: Synthetic oligonucleotide
  Target: SCN9A; (-) strand; PAM type: YTN; PAM sequence: TTT
gcctgttccaaattacaacc

SEQ ID NO: 58533 - DNA, 20 bp, Artificial Sequence
  Description of Artificial Sequence: Synthetic oligonucleotide
  Target: SCN9A; (-) strand; PAM type: YTN; PAM sequence: TTG
gcaacagtatgatttgcctg

SEQ ID NO: 58534 - DNA, 20 bp, Artificial Sequence
  Description of Artificial Sequence: Synthetic oligonucleotide
  Target: SCN9A; (-) strand; PAM type: YTN; PAM sequence: TTT
ggcaacagtatgatttgcct

SEQ ID NO: 58535 - DNA, 20 bp, Artificial Sequence
  Description of Artificial Sequence: Synthetic oligonucleotide
  Target: SCN9A; (-) strand; PAM type: YTN; PAM sequence: CTT
tggcaacagtatgatttgcc

SEQ ID NO: 58536 - DNA, 20 bp, Artificial Sequence
  Description of Artificial Sequence: Synthetic oligonucleotide
  Target: SCN9A; (-) strand; PAM type: YTN; PAM sequence: TTG
agacctttggcaacagtatg

SEQ ID NO: 58537 - DNA, 20 bp, Artificial Sequence
  Description of Artificial Sequence: Synthetic oligonucleotide
  Target: SCN9A; (-) strand; PAM type: YTN; PAM sequence: TTT
gagacctttggcaacagtat

SEQ ID NO: 58538 - DNA, 20 bp, Artificial Sequence
  Description of Artificial Sequence: Synthetic oligonucleotide
  Target: SCN9A; (-) strand; PAM type: YTN; PAM sequence: TTT
tgagacctttggcaacagta

SEQ ID NO: 58539 - DNA, 20 bp, Artificial Sequence
  Description of Artificial Sequence: Synthetic oligonucleotide
  Target: SCN9A; (-) strand; PAM type: YTN; PAM sequence: TTC
aattttgagacctttggcaa

SEQ ID NO: 58540 - DNA, 20 bp, Artificial Sequence
  Description of Artificial Sequence: Synthetic oligonucleotide
  Target: SCN9A; (-) strand; PAM type: YTN; PAM sequence: TTA
atgacatgttcaattttgag

SEQ ID NO: 58541 - DNA, 20 bp, Artificial Sequence
  Description of Artificial Sequence: Synthetic oligonucleotide
  Target: SCN9A; (-) strand; PAM type: YTN; PAM sequence: TTA
aaaaggaagatggaattaat

SEQ ID NO: 58542 - DNA, 20 bp, Artificial Sequence
  Description of Artificial Sequence: Synthetic oligonucleotide
  Target: SCN9A; (-) strand; PAM type: YTN; PAM sequence: CTA
tgttaaaaaggaagatggaa

SEQ ID NO: 58543 - DNA, 20 bp, Artificial Sequence
  Description of Artificial Sequence: Synthetic oligonucleotide
  Target: SCN9A; (-) strand; PAM type: YTN; PAM sequence: TTG
cctatgttaaaaaggaagat

SEQ ID NO: 58544 - DNA, 20 bp, Artificial Sequence
  Description of Artificial Sequence: Synthetic oligonucleotide
  Target: SCN9A; (-) strand; PAM type: YTN; PAM sequence: TTT
gcctatgttaaaaaggaaga

SEQ ID NO: 58545 - DNA, 20 bp, Artificial Sequence
  Description of Artificial Sequence: Synthetic oligonucleotide
  Target: SCN9A; (-) strand; PAM type: YTN; PAM sequence: CTT
tgcctatgttaaaaaggaag

SEQ ID NO: 58546 - DNA, 20 bp, Artificial Sequence
  Description of Artificial Sequence: Synthetic oligonucleotide
  Target: SCN9A; (-) strand; PAM type: YTN; PAM sequence: TTG
gaatgtccaactttgcctat

SEQ ID NO: 58547 - DNA, 20 bp, Artificial Sequence
  Description of Artificial Sequence: Synthetic oligonucleotide
  Target: SCN9A; (-) strand; PAM type: YTN; PAM sequence: TTT
ggaatgtccaactttgccta

SEQ ID NO: 58548 - DNA, 20 bp, Artificial Sequence
  Description of Artificial Sequence: Synthetic oligonucleotide
  Target: SCN9A; (-) strand; PAM type: YTN; PAM sequence: CTT
tggaatgtccaactttgcct

SEQ ID NO: 58549 - DNA, 20 bp, Artificial Sequence
  Description of Artificial Sequence: Synthetic oligonucleotide
  Target: SCN9A; (-) strand; PAM type: YTN; PAM sequence: CTA
cgccatctttggaatgtcca

SEQ ID NO: 58550 - DNA, 20 bp, Artificial Sequence
  Description of Artificial Sequence: Synthetic oligonucleotide
  Target: SCN9A; (-) strand; PAM type: YTN; PAM sequence: TTC
atctacgccatctttggaat

SEQ ID NO: 58551 - DNA, 20 bp, Artificial Sequence
  Description of Artificial Sequence: Synthetic oligonucleotide
  Target: SCN9A; (-) strand; PAM type: YTN; PAM sequence: CTG
gtcatgttcatctacgccat

SEQ ID NO: 58552 - DNA, 20 bp, Artificial Sequence
  Description of Artificial Sequence: Synthetic oligonucleotide
  Target: SCN9A; (-) strand; PAM type: YTN; PAM sequence: TTC
ctggtcatgttcatctacgc

SEQ ID NO: 58553 - DNA, 20 bp, Artificial Sequence
  Description of Artificial Sequence: Synthetic oligonucleotide
  Target: SCN9A; (-) strand; PAM type: YTN; PAM sequence: CTT
cctggtcatgttcatctacg

SEQ ID NO: 58554 - DNA, 20 bp, Artificial Sequence
  Description of Artificial Sequence: Synthetic oligonucleotide
  Target: SCN9A; (-) strand; PAM type: YTN; PAM sequence: CTC
ttcctggtcatgttcatcta

SEQ ID NO: 58555 - DNA, 20 bp, Artificial Sequence
  Description of Artificial Sequence: Synthetic oligonucleotide
  Target: SCN9A; (-) strand; PAM type: YTN; PAM sequence: CTG
ctcttcctggtcatgttcat

SEQ ID NO: 58556 - DNA, 20 bp, Artificial Sequence
  Description of Artificial Sequence: Synthetic oligonucleotide
  Target: SCN9A; (-) strand; PAM type: YTN; PAM sequence: CTC
ctgctcttcctggtcatgtt

SEQ ID NO: 58557 - DNA, 20 bp, Artificial Sequence
  Description of Artificial Sequence: Synthetic oligonucleotide
  Target: SCN9A; (-) strand; PAM type: YTN; PAM sequence: TTA
acatcggcctcctgctcttc

SEQ ID NO: 58558 - DNA, 20 bp, Artificial Sequence
  Description of Artificial Sequence: Synthetic oligonucleotide
  Target: SCN9A; (-) strand; PAM type: YTN; PAM sequence: TTT
aacatcggcctcctgctctt

SEQ ID NO: 58559 - DNA, 20 bp, Artificial Sequence
  Description of Artificial Sequence: Synthetic oligonucleotide
  Target: SCN9A; (-) strand; PAM type: YTN; PAM sequence: TTG
tttaacatcggcctcctgct

SEQ ID NO: 58560 - DNA, 20 bp, Artificial Sequence
  Description of Artificial Sequence: Synthetic oligonucleotide
  Target: SCN9A; (-) strand; PAM type: YTN; PAM sequence: CTG
cgttgtttaacatcggcctc

SEQ ID NO: 58561 - DNA, 20 bp, Artificial Sequence
  Description of Artificial Sequence: Synthetic oligonucleotide
  Target: SCN9A; (-) strand; PAM type: YTN; PAM sequence: TTC
ctgcgttgtttaacatcggc

SEQ ID NO: 58562 - DNA, 20 bp, Artificial Sequence
  Description of Artificial Sequence: Synthetic oligonucleotide
  Target: SCN9A; (-) strand; PAM type: YTN; PAM sequence: CTT
cctgcgttgtttaacatcgg

SEQ ID NO: 58563 - DNA, 20 bp, Artificial Sequence
  Description of Artificial Sequence: Synthetic oligonucleotide
  Target: SCN9A; (-) strand; PAM type: YTN; PAM sequence: TTG
atgatgtcccttcctgcgtt

SEQ ID NO: 58564 - DNA, 20 bp, Artificial Sequence
  Description of Artificial Sequence: Synthetic oligonucleotide
  Target: SCN9A; (-) strand; PAM type: YTN; PAM sequence: TTT
gatgatgtcccttcctgcgt

SEQ ID NO: 58565 - DNA, 20 bp, Artificial Sequence
  Description of Artificial Sequence: Synthetic oligonucleotide
  Target: SCN9A; (-) strand; PAM type: YTN; PAM sequence: CTT
tgatgatgtcccttcctgcg

SEQ ID NO: 58566 - DNA, 20 bp, Artificial Sequence
  Description of Artificial Sequence: Synthetic oligonucleotide
  Target: SCN9A; (-) strand; PAM type: YTN; PAM sequence: TTG
ctttgatgatgtcccttcct

SEQ ID NO: 58567 - DNA, 20 bp, Artificial Sequence
  Description of Artificial Sequence: Synthetic oligonucleotide
  Target: SCN9A; (-) strand; PAM type: YTN; PAM sequence: TTT
gctttgatgatgtcccttcc

SEQ ID NO: 58568 - DNA, 20 bp, Artificial Sequence
  Description of Artificial Sequence: Synthetic oligonucleotide
  Target: SCN9A; (-) strand; PAM type: YTN; PAM sequence: CTT
tgctttgatgatgtcccttc

SEQ ID NO: 58569 - DNA, 20 bp, Artificial Sequence
  Description of Artificial Sequence: Synthetic oligonucleotide
  Target: SCN9A; (-) strand; PAM type: YTN; PAM sequence: CTC
tttgctttgatgatgtccct

SEQ ID NO: 58570 - DNA, 20 bp, Artificial Sequence
  Description of Artificial Sequence: Synthetic oligonucleotide
  Target: SCN9A; (-) strand; PAM type: YTN; PAM sequence: CTG
ctctttgctttgatgatgtc

SEQ ID NO: 58571 - DNA, 20 bp, Artificial Sequence
  Description of Artificial Sequence: Synthetic oligonucleotide
  Target: SCN9A; (-) strand; PAM type: YTN; PAM sequence: CTA
gtcaaaggagcaaaggggat

SEQ ID NO: 58572 - DNA, 20 bp, Artificial Sequence
  Description of Artificial Sequence: Synthetic oligonucleotide
  Target: SCN9A; (-) strand; PAM type: YTN; PAM sequence: CTA
cgtctagtcaaaggagcaaa

SEQ ID NO: 58573 - DNA, 20 bp, Artificial Sequence
  Description of Artificial Sequence: Synthetic oligonucleotide
  Target: SCN9A; (-) strand; PAM type: YTN; PAM sequence: TTG
gccgaatcctacgtctagtc

SEQ ID NO: 58574 - DNA, 20 bp, Artificial Sequence
  Description of Artificial Sequence: Synthetic oligonucleotide
  Target: SCN9A; (-) strand; PAM type: YTN; PAM sequence: TTG
ccaggattggccgaatccta

SEQ ID NO: 58575 - DNA, 20 bp, Artificial Sequence
  Description of Artificial Sequence: Synthetic oligonucleotide
  Target: SCN9A; (-) strand; PAM type: YTN; PAM sequence: CTT
gccaggattggccgaatcct

SEQ ID NO: 58576 - DNA, 20 bp, Artificial Sequence
  Description of Artificial Sequence: Synthetic oligonucleotide
  Target: SCN9A; (-) strand; PAM type: YTN; PAM sequence: TTC
cgagtgatccgtcttgccag

SEQ ID NO: 58577 - DNA, 20 bp, Artificial Sequence
  Description of Artificial Sequence: Synthetic oligonucleotide
  Target: SCN9A; (-) strand; PAM type: YTN; PAM sequence: CTG
ttccgagtgatccgtcttgc

SEQ ID NO: 58578 - DNA, 20 bp, Artificial Sequence
  Description of Artificial Sequence: Synthetic oligonucleotide
  Target: SCN9A; (-) strand; PAM type: YTN; PAM sequence: CTA
ccctgttccgagtgatccgt

SEQ ID NO: 58579 - DNA, 20 bp, Artificial Sequence
  Description of Artificial Sequence: Synthetic oligonucleotide
  Target: SCN9A; (-) strand; PAM type: YTN; PAM sequence: TTG
tgtcccctaccctgttccga

SEQ ID NO: 58580 - DNA, 20 bp, Artificial Sequence
  Description of Artificial Sequence: Synthetic oligonucleotide
  Target: SCN9A; (-) strand; PAM type: YTN; PAM sequence: TTT
gtgtcccctaccctgttccg

SEQ ID NO: 58581 - DNA, 20 bp, Artificial Sequence
  Description of Artificial Sequence: Synthetic oligonucleotide
  Target: SCN9A; (-) strand; PAM type: YTN; PAM sequence: TTT
tgtgtcccctaccctgttcc

SEQ ID NO: 58582 - DNA, 20 bp, Artificial Sequence
  Description of Artificial Sequence: Synthetic oligonucleotide
  Target: SCN9A; (-) strand; PAM type: YTN; PAM sequence: TTG
aaacgtattttgtgtcccct

SEQ ID NO: 58583 - DNA, 20 bp, Artificial Sequence
  Description of Artificial Sequence: Synthetic oligonucleotide
  Target: SCN9A; (-) strand; PAM type: YTN; PAM sequence: TTG
attgaaacgtattttgtgtc

SEQ ID NO: 58584 - DNA, 20 bp, Artificial Sequence
  Description of Artificial Sequence: Synthetic oligonucleotide
  Target: SCN9A; (-) strand; PAM type: YTN; PAM sequence: TTT
gattgaaacgtattttgtgt

SEQ ID NO: 58585 - DNA, 20 bp, Artificial Sequence
  Description of Artificial Sequence: Synthetic oligonucleotide
  Target: SCN9A; (-) strand; PAM type: YTN; PAM sequence: CTG
atttgattgaaacgtatttt

SEQ ID NO: 58586 - DNA, 20 bp, Artificial Sequence
  Description of Artificial Sequence: Synthetic oligonucleotide
  Target: SCN9A; (-) strand; PAM type: YTN; PAM sequence: CTA
gctgatttgattgaaacgta

SEQ ID NO: 58587 - DNA, 20 bp, Artificial Sequence
  Description of Artificial Sequence: Synthetic oligonucleotide
  Target: SCN9A; (-) strand; PAM type: YTN; PAM sequence: TTC
tagctgatttgattgaaacg

SEQ ID NO: 58588 - DNA, 20 bp, Artificial Sequence
  Description of Artificial Sequence: Synthetic oligonucleotide
  Target: SCN9A; (-) strand; PAM type: YTN; PAM sequence: TTT
ctagctgatttgattgaaac

SEQ ID NO: 58589 - DNA, 20 bp, Artificial Sequence
  Description of Artificial Sequence: Synthetic oligonucleotide
  Target: SCN9A; (-) strand; PAM type: YTN; PAM sequence: CTC
cacatacaggtatgtttcta

SEQ ID NO: 58590 - DNA, 20 bp, Artificial Sequence
  Description of Artificial Sequence: Synthetic oligonucleotide
  Target: SCN9A; (-) strand; PAM type: YTN; PAM sequence: TTC
ctccacatacaggtatgttt

SEQ ID NO: 58591 - DNA, 20 bp, Artificial Sequence
  Description of Artificial Sequence: Synthetic oligonucleotide
  Target: SCN9A; (-) strand; PAM type: YTN; PAM sequence: TTT
cctccacatacaggtatgtt

SEQ ID NO: 58592 - DNA, 20 bp, Artificial Sequence
  Description of Artificial Sequence: Synthetic oligonucleotide
  Target: SCN9A; (-) strand; PAM type: YTN; PAM sequence: TTT
tcctccacatacaggtatgt

SEQ ID NO: 58593 - DNA, 20 bp, Artificial Sequence
  Description of Artificial Sequence: Synthetic oligonucleotide
  Target: SCN9A; (-) strand; PAM type: YTN; PAM sequence: TTA
ttttcctccacatacaggta

SEQ ID NO: 58594 - DNA, 20 bp, Artificial Sequence
  Description of Artificial Sequence: Synthetic oligonucleotide
  Target: SCN9A; (-) strand; PAM type: YTN; PAM sequence: CTA
ttattttcctccacatacag

SEQ ID NO: 58595 - DNA, 20 bp, Artificial Sequence
  Description of Artificial Sequence: Synthetic oligonucleotide
  Target: SCN9A; (-) strand; PAM type: YTN; PAM sequence: TTC
tattattttcctccacatac

SEQ ID NO: 58596 - DNA, 20 bp, Artificial Sequence
  Description of Artificial Sequence: Synthetic oligonucleotide
  Target: SCN9A; (-) strand; PAM type: YTN; PAM sequence: TTT
ctattattttcctccacata

SEQ ID NO: 58597 - DNA, 20 bp, Artificial Sequence
  Description of Artificial Sequence: Synthetic oligonucleotide
  Target: SCN9A; (-) strand; PAM type: YTN; PAM sequence: TTA
tttctattattttcctccac

SEQ ID NO: 58598 - DNA, 20 bp, Artificial Sequence
  Description of Artificial Sequence: Synthetic oligonucleotide
  Target: SCN9A; (-) strand; PAM type: YTN; PAM sequence: TTT
atttctattattttcctcca

SEQ ID NO: 58599 - DNA, 20 bp, Artificial Sequence
  Description of Artificial Sequence: Synthetic oligonucleotide
  Target: SCN9A; (-) strand; PAM type: YTN; PAM sequence: TTT
tatttctattattttcctcc

SEQ ID NO: 58600 - DNA, 20 bp, Artificial Sequence
  Description of Artificial Sequence: Synthetic oligonucleotide
  Target: SCN9A; (-) strand; PAM type: YTN; PAM sequence: TTA
aatattttatttctattatt

SEQ ID NO: 58601 - DNA, 20 bp, Artificial Sequence
  Description of Artificial Sequence: Synthetic oligonucleotide
  Target: SCN9A; (-) strand; PAM type: YTN; PAM sequence: TTT
aaatattttatttctattat

SEQ ID NO: 58602 - DNA, 20 bp, Artificial Sequence
  Description of Artificial Sequence: Synthetic oligonucleotide
  Target: SCN9A; (-) strand; PAM type: YTN; PAM sequence: CTT
taaatattttatttctatta

SEQ ID NO: 58603 - DNA, 20 bp, Artificial Sequence
  Description of Artificial Sequence: Synthetic oligonucleotide
  Target: SCN9A; (-) strand; PAM type: YTN; PAM sequence: TTC
aggtagcatacatctttaaa

SEQ ID NO: 58604 - DNA, 20 bp, Artificial Sequence
  Description of Artificial Sequence: Synthetic oligonucleotide
  Target: SCN9A; (-) strand; PAM type: YTN; PAM sequence: TTT
caggtagcatacatctttaa

SEQ ID NO: 58605 - DNA, 20 bp, Artificial Sequence
  Description of Artificial Sequence: Synthetic oligonucleotide
  Target: SCN9A; (-) strand; PAM type: YTN; PAM sequence: TTA
gagtcatcatttcaggtagc

SEQ ID NO: 58606 - DNA, 20 bp, Artificial Sequence
  Description of Artificial Sequence: Synthetic oligonucleotide
  Target: SCN9A; (-) strand; PAM type: YTN; PAM sequence: TTT
agagtcatcatttcaggtag

SEQ ID NO: 58607 - DNA, 20 bp, Artificial Sequence
  Description of Artificial Sequence: Synthetic oligonucleotide
  Target: SCN9A; (-) strand; PAM type: YTN; PAM sequence: CTG
tttagagtcatcatttcagg

SEQ ID NO: 58608 - DNA, 20 bp, Artificial Sequence
  Description of Artificial Sequence: Synthetic oligonucleotide
  Target: SCN9A; (-) strand; PAM type: YTN; PAM sequence: TTG
acagataaaactgtttagag

SEQ ID NO: 58609 - DNA, 20 bp, Artificial Sequence
  Description of Artificial Sequence: Synthetic oligonucleotide
  Target: SCN9A; (-) strand; PAM type: YTN; PAM sequence: TTC
ataagaaatgagttgacaga

SEQ ID NO: 58610 - DNA, 20 bp, Artificial Sequence
  Description of Artificial Sequence: Synthetic oligonucleotide
  Target: SCN9A; (-) strand; PAM type: YTN; PAM sequence: TTG
aattcataagaaatgagttg

SEQ ID NO: 58611 - DNA, 20 bp, Artificial Sequence
  Description of Artificial Sequence: Synthetic oligonucleotide
  Target: SCN9A; (-) strand; PAM type: YTN; PAM sequence: CTT
gaattcataagaaatgagtt

SEQ ID NO: 58612 - DNA, 20 bp, Artificial Sequence
  Description of Artificial Sequence: Synthetic oligonucleotide
  Target: SCN9A; (-) strand; PAM type: YTN; PAM sequence: CTG
tcttgaattcataagaaatg

SEQ ID NO: 58613 - DNA, 20 bp, Artificial Sequence
  Description of Artificial Sequence: Synthetic oligonucleotide
  Target: SCN9A; (-) strand; PAM type: YTN; PAM sequence: CTC
aaaaaaaaaaaaaaaaaaaa

SEQ ID NO: 58614 - DNA, 20 bp, Artificial Sequence
  Description of Artificial Sequence: Synthetic oligonucleotide
  Target: SCN9A; (-) strand; PAM type: YTN; PAM sequence: CTC
cgtctcaaaaaaaaaaaaaa

SEQ ID NO: 58615 - DNA, 20 bp, Artificial Sequence
  Description of Artificial Sequence: Synthetic oligonucleotide
  Target: SCN9A; (-) strand; PAM type: YTN; PAM sequence: CTG
ggcgacagagcgagactccg

SEQ ID NO: 58616 - DNA, 20 bp, Artificial Sequence
  Description of Artificial Sequence: Synthetic oligonucleotide
  Target: SCN9A; (-) strand; PAM type: YTN; PAM sequence: CTC
cagcctgggcgacagagcga

SEQ ID NO: 58617 - DNA, 20 bp, Artificial Sequence
  Description of Artificial Sequence: Synthetic oligonucleotide
  Target: SCN9A; (-) strand; PAM type: YTN; PAM sequence: CTG
cactccagcctgggcgacag

SEQ ID NO: 58618 - DNA, 20 bp, Artificial Sequence
  Description of Artificial Sequence: Synthetic oligonucleotide
  Target: SCN9A; (-) strand; PAM type: YTN; PAM sequence: TTG
cagtgagccgagatcgcgcc

SEQ ID NO: 58619 - DNA, 20 bp, Artificial Sequence
  Description of Artificial Sequence: Synthetic oligonucleotide
  Target: SCN9A; (-) strand; PAM type: YTN; PAM sequence: CTT
gcagtgagccgagatcgcgc

SEQ ID NO: 58620 - DNA, 20 bp, Artificial Sequence
  Description of Artificial Sequence: Synthetic oligonucleotide
  Target: SCN9A; (-) strand; PAM type: YTN; PAM sequence: CTG
aggcaggagaatggcgtgaa

SEQ ID NO: 58621 - DNA, 20 bp, Artificial Sequence
  Description of Artificial Sequence: Synthetic oligonucleotide
  Target: SCN9A; (-) strand; PAM type: YTN; PAM sequence: CTC
gggaggctgaggcaggagaa

SEQ ID NO: 58622 - DNA, 20 bp, Artificial Sequence
  Description of Artificial Sequence: Synthetic oligonucleotide
  Target: SCN9A; (-) strand; PAM type: YTN; PAM sequence: CTA
ctcgggaggctgaggcagga

SEQ ID NO: 58623 - DNA, 20 bp, Artificial Sequence
  Description of Artificial Sequence: Synthetic oligonucleotide
  Target: SCN9A; (-) strand; PAM type: YTN; PAM sequence: CTG
tagtcccagctactcgggag

SEQ ID NO: 58624 - DNA, 20 bp, Artificial Sequence
  Description of Artificial Sequence: Synthetic oligonucleotide
  Target: SCN9A; (-) strand; PAM type: YTN; PAM sequence: TTA
gccgggcgtggtagcgggcg

SEQ ID NO: 58625 - DNA, 20 bp, Artificial Sequence
  Description of Artificial Sequence: Synthetic oligonucleotide
  Target: SCN9A; (-) strand; PAM type: YTN; PAM sequence: CTA
aaaatacaaaaaattagccg

SEQ ID NO: 58626 - DNA, 20 bp, Artificial Sequence
  Description of Artificial Sequence: Synthetic oligonucleotide
  Target: SCN9A; (-) strand; PAM type: YTN; PAM sequence: CTA
ctaaaaatacaaaaaattag

SEQ ID NO: 58627 - DNA, 20 bp, Artificial Sequence
  Description of Artificial Sequence: Synthetic oligonucleotide
  Target: SCN9A; (-) strand; PAM type: YTN; PAM sequence: CTC
tactaaaaatacaaaaaatt

SEQ ID NO: 58628 - DNA, 20 bp, Artificial Sequence
  Description of Artificial Sequence: Synthetic oligonucleotide
  Target: SCN9A; (-) strand; PAM type: YTN; PAM sequence: CTA
acaaggtgaaaccccgtctc

SEQ ID NO: 58629 - DNA, 20 bp, Artificial Sequence
  Description of Artificial Sequence: Synthetic oligonucleotide
  Target: SCN9A; (-) strand; PAM type: YTN; PAM sequence: CTG
gctaacaaggtgaaaccccg

SEQ ID NO: 58630 - DNA, 20 bp, Artificial Sequence
  Description of Artificial Sequence: Synthetic oligonucleotide
  Target: SCN9A; (-) strand; PAM type: YTN; PAM sequence: TTG
ggaggccgaggcgggcggat

SEQ ID NO: 58631 - DNA, 20 bp, Artificial Sequence
  Description of Artificial Sequence: Synthetic oligonucleotide
  Target: SCN9A; (-) strand; PAM type: YTN; PAM sequence: TTT
gggaggccgaggcgggcgga

SEQ ID NO: 58632 - DNA, 20 bp, Artificial Sequence
  Description of Artificial Sequence: Synthetic oligonucleotide
  Target: SCN9A; (-) strand; PAM type: YTN; PAM sequence: CTT
tgggaggccgaggcgggcgg

SEQ ID NO: 58633 - DNA, 20 bp, Artificial Sequence
  Description of Artificial Sequence: Synthetic oligonucleotide
  Target: SCN9A; (-) strand; PAM type: YTN; PAM sequence: CTG
taatcccagcactttgggag

SEQ ID NO: 58634 - DNA, 20 bp, Artificial Sequence
  Description of Artificial Sequence: Synthetic oligonucleotide
  Target: SCN9A; (-) strand; PAM type: YTN; PAM sequence: CTC
acgcctgtaatcccagcact

SEQ ID NO: 58635 - DNA, 20 bp, Artificial Sequence
  Description of Artificial Sequence: Synthetic oligonucleotide
  Target: SCN9A; (-) strand; PAM type: YTN; PAM sequence: TTG
gccgggcacggtggctcacg

SEQ ID NO: 58636 - DNA, 20 bp, Artificial Sequence
  Description of Artificial Sequence: Synthetic oligonucleotide
  Target: SCN9A; (-) strand; PAM type: YTN; PAM sequence: CTT
ggccgggcacggtggctcac

SEQ ID NO: 58637 - DNA, 20 bp, Artificial Sequence
  Description of Artificial Sequence: Synthetic oligonucleotide
  Target: SCN9A; (-) strand; PAM type: YTN; PAM sequence: CTG
tcttggccgggcacggtggc

SEQ ID NO: 58638 - DNA, 20 bp, Artificial Sequence
  Description of Artificial Sequence: Synthetic oligonucleotide
  Target: SCN9A; (-) strand; PAM type: YTN; PAM sequence: TTC
agtataaaataactgtcttg

SEQ ID NO: 58639 - DNA, 20 bp, Artificial Sequence
  Description of Artificial Sequence: Synthetic oligonucleotide
  Target: SCN9A; (-) strand; PAM type: YTN; PAM sequence: TTG
cattcagtataaaataactg

SEQ ID NO: 58640 - DNA, 20 bp, Artificial Sequence
  Description of Artificial Sequence: Synthetic oligonucleotide
  Target: SCN9A; (-) strand; PAM type: YTN; PAM sequence: TTA
agtaattgcattcagtataa

SEQ ID NO: 58641 - DNA, 20 bp, Artificial Sequence
  Description of Artificial Sequence: Synthetic oligonucleotide
  Target: SCN9A; (-) strand; PAM type: YTN; PAM sequence: TTT
aagtaattgcattcagtata

SEQ ID NO: 58642 - DNA, 20 bp, Artificial Sequence
  Description of Artificial Sequence: Synthetic oligonucleotide
  Target: SCN9A; (-) strand; PAM type: YTN; PAM sequence: TTT
taagtaattgcattcagtat

SEQ ID NO: 58643 - DNA, 20 bp, Artificial Sequence
  Description of Artificial Sequence: Synthetic oligonucleotide
  Target: SCN9A; (-) strand; PAM type: YTN; PAM sequence: TTT
ttaagtaattgcattcagta

SEQ ID NO: 58644 - DNA, 20 bp, Artificial Sequence
  Description of Artificial Sequence: Synthetic oligonucleotide
  Target: SCN9A; (-) strand; PAM type: YTN; PAM sequence: TTT
tttaagtaattgcattcagt

SEQ ID NO: 58645 - DNA, 20 bp, Artificial Sequence
  Description of Artificial Sequence: Synthetic oligonucleotide
  Target: SCN9A; (-) strand; PAM type: YTN; PAM sequence: CTT
ttttaagtaattgcattcag

SEQ ID NO: 58646 - DNA, 20 bp, Artificial Sequence
  Description of Artificial Sequence: Synthetic oligonucleotide
  Target: SCN9A; (-) strand; PAM type: YTN; PAM sequence: TTA
atccttttttaagtaattgc

SEQ ID NO: 58647 - DNA, 20 bp, Artificial Sequence
  Description of Artificial Sequence: Synthetic oligonucleotide
  Target: SCN9A; (-) strand; PAM type: YTN; PAM sequence: CTT
aatccttttttaagtaattg

SEQ ID NO: 58648 - DNA, 20 bp, Artificial Sequence
  Description of Artificial Sequence: Synthetic oligonucleotide
  Target: SCN9A; (-) strand; PAM type: YTN; PAM sequence: TTC
ttaatccttttttaagtaat

SEQ ID NO: 58649 - DNA, 20 bp, Artificial Sequence
  Description of Artificial Sequence: Synthetic oligonucleotide
  Target: SCN9A; (-) strand; PAM type: YTN; PAM sequence: TTT
cttaatccttttttaagtaa

SEQ ID NO: 58650 - DNA, 20 bp, Artificial Sequence
  Description of Artificial Sequence: Synthetic oligonucleotide
  Target: SCN9A; (-) strand; PAM type: YTN; PAM sequence: TTG
gaatttcttaatcctttttt

SEQ ID NO: 58651 - DNA, 20 bp, Artificial Sequence
  Description of Artificial Sequence: Synthetic oligonucleotide
  Target: SCN9A; (-) strand; PAM type: YTN; PAM sequence: TTT
ggaatttcttaatccttttt

SEQ ID NO: 58652 - DNA, 20 bp, Artificial Sequence
  Description of Artificial Sequence: Synthetic oligonucleotide
  Target: SCN9A; (-) strand; PAM type: YTN; PAM sequence: CTT
tggaatttcttaatcctttt

SEQ ID NO: 58653 - DNA, 20 bp, Artificial Sequence
  Description of Artificial Sequence: Synthetic oligonucleotide
  Target: SCN9A; (-) strand; PAM type: YTN; PAM sequence: CTC
tttggaatttcttaatcctt

SEQ ID NO: 58654 - DNA, 20 bp, Artificial Sequence
  Description of Artificial Sequence: Synthetic oligonucleotide
  Target: SCN9A; (-) strand; PAM type: YTN; PAM sequence: TTC
tctttggaatttcttaatcc

SEQ ID NO: 58655 - DNA, 20 bp, Artificial Sequence
  Description of Artificial Sequence: Synthetic oligonucleotide
  Target: SCN9A; (-) strand; PAM type: YTN; PAM sequence: TTT
ctctttggaatttcttaatc

SEQ ID NO: 58656 - DNA, 20 bp, Artificial Sequence
  Description of Artificial Sequence: Synthetic oligonucleotide
  Target: SCN9A; (-) strand; PAM type: YTN; PAM sequence: TTA
gtcatttctctttggaattt

SEQ ID NO: 58657 - DNA, 20 bp, Artificial Sequence
  Description of Artificial Sequence: Synthetic oligonucleotide
  Target: SCN9A; (-) strand; PAM type: YTN; PAM sequence: TTA
gtaaaaaggagaaaatgtca

SEQ ID NO: 58658 - DNA, 20 bp, Artificial Sequence
  Description of Artificial Sequence: Synthetic oligonucleotide
  Target: SCN9A; (-) strand; PAM type: YTN; PAM sequence: CTT
agtaaaaaggagaaaatgtc

SEQ ID NO: 58659 - DNA, 20 bp, Artificial Sequence
  Description of Artificial Sequence: Synthetic oligonucleotide
  Target: SCN9A; (-) strand; PAM type: YTN; PAM sequence: TTA
tggagggaaaaaatggccca

SEQ ID NO: 58660 - DNA, 20 bp, Artificial Sequence
  Description of Artificial Sequence: Synthetic oligonucleotide
  Target: SCN9A; (-) strand; PAM type: YTN; PAM sequence: CTA
ttatggagggaaaaaatggc

SEQ ID NO: 58661 - DNA, 20 bp, Artificial Sequence
  Description of Artificial Sequence: Synthetic oligonucleotide
  Target: SCN9A; (-) strand; PAM type: YTN; PAM sequence: TTA
aaatgtaaaacactattatg

SEQ ID NO: 58662 - DNA, 20 bp, Artificial Sequence
  Description of Artificial Sequence: Synthetic oligonucleotide
  Target: SCN9A; (-) strand; PAM type: YTN; PAM sequence: CTT
aaaatgtaaaacactattat

SEQ ID NO: 58663 - DNA, 20 bp, Artificial Sequence
  Description of Artificial Sequence: Synthetic oligonucleotide
  Target: SCN9A; (-) strand; PAM type: YTN; PAM sequence: TTC
ttaaaatgtaaaacactatt

SEQ ID NO: 58664 - DNA, 20 bp, Artificial Sequence
  Description of Artificial Sequence: Synthetic oligonucleotide
  Target: SCN9A; (-) strand; PAM type: YTN; PAM sequence: CTA
tgtgagtaggtatcattctt

SEQ ID NO: 58665 - DNA, 20 bp, Artificial Sequence
  Description of Artificial Sequence: Synthetic oligonucleotide
  Target: SCN9A; (-) strand; PAM type: YTN; PAM sequence: TTC
tatgtgagtaggtatcattc

SEQ ID NO: 58666 - DNA, 20 bp, Artificial Sequence
  Description of Artificial Sequence: Synthetic oligonucleotide
  Target: SCN9A; (-) strand; PAM type: YTN; PAM sequence: TTT
ctatgtgagtaggtatcatt

SEQ ID NO: 58667 - DNA, 20 bp, Artificial Sequence
  Description of Artificial Sequence: Synthetic oligonucleotide
  Target: SCN9A; (-) strand; PAM type: YTN; PAM sequence: TTT
tctatgtgagtaggtatcat

SEQ ID NO: 58668 - DNA, 20 bp, Artificial Sequence
  Description of Artificial Sequence: Synthetic oligonucleotide
  Target: SCN9A; (-) strand; PAM type: YTN; PAM sequence: TTG
aattttctatgtgagtaggt

SEQ ID NO: 58669 - DNA, 20 bp, Artificial Sequence
  Description of Artificial Sequence: Synthetic oligonucleotide
  Target: SCN9A; (-) strand; PAM type: YTN; PAM sequence: CTT
gaattttctatgtgagtagg

SEQ ID NO: 58670 - DNA, 20 bp, Artificial Sequence
  Description of Artificial Sequence: Synthetic oligonucleotide
  Target: SCN9A; (-) strand; PAM type: YTN; PAM sequence: TTG
cttgaattttctatgtgagt

SEQ ID NO: 58671 - DNA, 20 bp, Artificial Sequence
  Description of Artificial Sequence: Synthetic oligonucleotide
  Target: SCN9A; (-) strand; PAM type: YTN; PAM sequence: TTA
acggtattgcttgaattttc

SEQ ID NO: 58672 - DNA, 20 bp, Artificial Sequence
  Description of Artificial Sequence: Synthetic oligonucleotide
  Target: SCN9A; (-) strand; PAM type: YTN; PAM sequence: TTT
aacggtattgcttgaatttt

SEQ ID NO: 58673 - DNA, 20 bp, Artificial Sequence
  Description of Artificial Sequence: Synthetic oligonucleotide
  Target: SCN9A; (-) strand; PAM type: YTN; PAM sequence: TTA
gcatttaacggtattgcttg

SEQ ID NO: 58674 - DNA, 20 bp, Artificial Sequence
  Description of Artificial Sequence: Synthetic oligonucleotide
  Target: SCN9A; (-) strand; PAM type: YTN; PAM sequence: TTT
agcatttaacggtattgctt

SEQ ID NO: 58675 - DNA, 20 bp, Artificial Sequence
  Description of Artificial Sequence: Synthetic oligonucleotide
  Target: SCN9A; (-) strand; PAM type: YTN; PAM sequence: TTT
tagcatttaacggtattgct

SEQ ID NO: 58676 - DNA, 20 bp, Artificial Sequence
  Description of Artificial Sequence: Synthetic oligonucleotide
  Target: SCN9A; (-) strand; PAM type: YTN; PAM sequence: TTT
ttagcatttaacggtattgc

SEQ ID NO: 58677 - DNA, 20 bp, Artificial Sequence
  Description of Artificial Sequence: Synthetic oligonucleotide
  Target: SCN9A; (-) strand; PAM type: YTN; PAM sequence: CTT
tttagcatttaacggtattg

SEQ ID NO: 58678 - DNA, 20 bp, Artificial Sequence
  Description of Artificial Sequence: Synthetic oligonucleotide
  Target: SCN9A; (-) strand; PAM type: YTN; PAM sequence: TTC
tttttagcatttaacggtat

SEQ ID NO: 58679 - DNA, 20 bp, Artificial Sequence
  Description of Artificial Sequence: Synthetic oligonucleotide
  Target: SCN9A; (-) strand; PAM type: YTN; PAM sequence: TTT
ctttttagcatttaacggta

SEQ ID NO: 58680 - DNA, 20 bp, Artificial Sequence
  Description of Artificial Sequence: Synthetic oligonucleotide
  Target: SCN9A; (-) strand; PAM type: YTN; PAM sequence: TTT
tctttttagcatttaacggt

SEQ ID NO: 58681 - DNA, 20 bp, Artificial Sequence
  Description of Artificial Sequence: Synthetic oligonucleotide
  Target: SCN9A; (-) strand; PAM type: YTN; PAM sequence: TTA
tattttctttttagcattta

SEQ ID NO: 58682 - DNA, 20 bp, Artificial Sequence
  Description of Artificial Sequence: Synthetic oligonucleotide
  Target: SCN9A; (-) strand; PAM type: YTN; PAM sequence: TTT
atattttctttttagcattt

SEQ ID NO: 58683 - DNA, 20 bp, Artificial Sequence
  Description of Artificial Sequence: Synthetic oligonucleotide
  Target: SCN9A; (-) strand; PAM type: YTN; PAM sequence: TTC
aggtgatttatattttcttt

SEQ ID NO: 58684 - DNA, 20 bp, Artificial Sequence
  Description of Artificial Sequence: Synthetic oligonucleotide
  Target: SCN9A; (-) strand; PAM type: YTN; PAM sequence: TTT
caggtgatttatattttctt

SEQ ID NO: 58685 - DNA, 20 bp, Artificial Sequence
  Description of Artificial Sequence: Synthetic oligonucleotide
  Target: SCN9A; (-) strand; PAM type: YTN; PAM sequence: TTG
acatttcaggtgatttatat

SEQ ID NO: 58686 - DNA, 20 bp, Artificial Sequence
  Description of Artificial Sequence: Synthetic oligonucleotide
  Target: SCN9A; (-) strand; PAM type: YTN; PAM sequence: TTG
ttgacatttcaggtgattta

SEQ ID NO: 58687 - DNA, 20 bp, Artificial Sequence
  Description of Artificial Sequence: Synthetic oligonucleotide
  Target: SCN9A; (-) strand; PAM type: YTN; PAM sequence: TTA
ttgttgacatttcaggtgat

SEQ ID NO: 58688 - DNA, 20 bp, Artificial Sequence
  Description of Artificial Sequence: Synthetic oligonucleotide
  Target: SCN9A; (-) strand; PAM type: YTN; PAM sequence: TTG
ataatagttattgttgacat

SEQ ID NO: 58689 - DNA, 20 bp, Artificial Sequence
  Description of Artificial Sequence: Synthetic oligonucleotide
  Target: SCN9A; (-) strand; PAM type: YTN; PAM sequence: CTC
aaaaaaatattgataatagt

SEQ ID NO: 58690 - DNA, 20 bp, Artificial Sequence
  Description of Artificial Sequence: Synthetic oligonucleotide
  Target: SCN9A; (-) strand; PAM type: YTN; PAM sequence: CTG
aagtgatactcaaaaaaata

SEQ ID NO: 58691 - DNA, 20 bp, Artificial Sequence
  Description of Artificial Sequence: Synthetic oligonucleotide
  Target: SCN9A; (-) strand; PAM type: YTN; PAM sequence: TTG
cacagaaaaatgtctgaagt

SEQ ID NO: 58692 - DNA, 20 bp, Artificial Sequence
  Description of Artificial Sequence: Synthetic oligonucleotide
  Target: SCN9A; (-) strand; PAM type: YTN; PAM sequence: CTT
gcacagaaaaatgtctgaag

SEQ ID NO: 58693 - DNA, 20 bp, Artificial Sequence
  Description of Artificial Sequence: Synthetic oligonucleotide
  Target: SCN9A; (-) strand; PAM type: YTN; PAM sequence: TTG
tgtgtgtacatgtgcttgca

SEQ ID NO: 58694 - DNA, 20 bp, Artificial Sequence
  Description of Artificial Sequence: Synthetic oligonucleotide
  Target: SCN9A; (-) strand; PAM type: YTN; PAM sequence: TTT
gtgtgtgtacatgtgcttgc

SEQ ID NO: 58695 - DNA, 20 bp, Artificial Sequence
  Description of Artificial Sequence: Synthetic oligonucleotide
  Target: SCN9A; (-) strand; PAM type: YTN; PAM sequence: TTG
tttgtgtgtgtacatgtgct

SEQ ID NO: 58696 - DNA, 20 bp, Artificial Sequence
  Description of Artificial Sequence: Synthetic oligonucleotide
  Target: SCN9A; (-) strand; PAM type: YTN; PAM sequence: TTT
gtttgtgtgtgtacatgtgc

SEQ ID NO: 58697 - DNA, 20 bp, Artificial Sequence
  Description of Artificial Sequence: Synthetic oligonucleotide
  Target: SCN9A; (-) strand; PAM type: YTN; PAM sequence: TTA
tataacatgaatacatttgt

SEQ ID NO: 58698 - DNA, 20 bp, Artificial Sequence
  Description of Artificial Sequence: Synthetic oligonucleotide
  Target: SCN9A; (-) strand; PAM type: YTN; PAM sequence: CTT
atataacatgaatacatttg

SEQ ID NO: 58699 - DNA, 20 bp, Artificial Sequence
  Description of Artificial Sequence: Synthetic oligonucleotide
  Target: SCN9A; (-) strand; PAM type: YTN; PAM sequence: TTA
caaaaaaagcttatataaca

SEQ ID NO: 58700 - DNA, 20 bp, Artificial Sequence
  Description of Artificial Sequence: Synthetic oligonucleotide
  Target: SCN9A; (-) strand; PAM type: YTN; PAM sequence: TTG
aaaaataaataaataggtta

SEQ ID NO: 58701 - DNA, 20 bp, Artificial Sequence
  Description of Artificial Sequence: Synthetic oligonucleotide
  Target: SCN9A; (-) strand; PAM type: YTN; PAM sequence: CTT
gaaaaataaataaataggtt

SEQ ID NO: 58702 - DNA, 20 bp, Artificial Sequence
  Description of Artificial Sequence: Synthetic oligonucleotide
  Target: SCN9A; (-) strand; PAM type: YTN; PAM sequence: CTG
tcttgaaaaataaataaata

SEQ ID NO: 58703 - DNA, 20 bp, Artificial Sequence
  Description of Artificial Sequence: Synthetic oligonucleotide
  Target: SCN9A; (-) strand; PAM type: YTN; PAM sequence: CTC
tgtcttgaaaaataaataaa

SEQ ID NO: 58704 - DNA, 20 bp, Artificial Sequence
  Description of Artificial Sequence: Synthetic oligonucleotide
  Target: SCN9A; (-) strand; PAM type: YTN; PAM sequence: TTG
gcgacagagcaagactctgt

SEQ ID NO: 58705 - DNA, 20 bp, Artificial Sequence
  Description of Artificial Sequence: Synthetic oligonucleotide
  Target: SCN9A; (-) strand; PAM type: YTN; PAM sequence: TTT
ggcgacagagcaagactctg

SEQ ID NO: 58706 - DNA, 20 bp, Artificial Sequence
  Description of Artificial Sequence: Synthetic oligonucleotide
  Target: SCN9A; (-) strand; PAM type: YTN; PAM sequence: CTT
tggcgacagagcaagactct

SEQ ID NO: 58707 - DNA, 20 bp, Artificial Sequence
  Description of Artificial Sequence: Synthetic oligonucleotide
  Target: SCN9A; (-) strand; PAM type: YTN; PAM sequence: CTC
cagctttggcgacagagcaa

SEQ ID NO: 58708 - DNA, 20 bp, Artificial Sequence
  Description of Artificial Sequence: Synthetic oligonucleotide
  Target: SCN9A; (-) strand; PAM type: YTN; PAM sequence: TTG
cagtaggccaagatcacacc

SEQ ID NO: 58709 - DNA, 20 bp, Artificial Sequence
  Description of Artificial Sequence: Synthetic oligonucleotide
  Target: SCN9A; (-) strand; PAM type: YTN; PAM sequence: TTG
atcccgggatgcagagattg

SEQ ID NO: 58710 - DNA, 20 bp, Artificial Sequence
  Description of Artificial Sequence: Synthetic oligonucleotide
  Target: SCN9A; (-) strand; PAM type: YTN; PAM sequence: TTT
gatcccgggatgcagagatt

SEQ ID NO: 58711 - DNA, 20 bp, Artificial Sequence
  Description of Artificial Sequence: Synthetic oligonucleotide
  Target: SCN9A; (-) strand; PAM type: YTN; PAM sequence: CTG
gagaatcatttgatcccggg

SEQ ID NO: 58712 - DNA, 20 bp, Artificial Sequence
  Description of Artificial Sequence: Synthetic oligonucleotide
  Target: SCN9A; (-) strand; PAM type: YTN; PAM sequence: CTG
aggctggagaatcatttgat

SEQ ID NO: 58713 - DNA, 20 bp, Artificial Sequence
  Description of Artificial Sequence: Synthetic oligonucleotide
  Target: SCN9A; (-) strand; PAM type: YTN; PAM sequence: CTG
gaggctgaggctggagaatc

SEQ ID NO: 58714 - DNA, 20 bp, Artificial Sequence
  Description of Artificial Sequence: Synthetic oligonucleotide
  Target: SCN9A; (-) strand; PAM type: YTN; PAM sequence: CTC
tggaggctgaggctggagaa

SEQ ID NO: 58715 - DNA, 20 bp, Artificial Sequence
  Description of Artificial Sequence: Synthetic oligonucleotide
  Target: SCN9A; (-) strand; PAM type: YTN; PAM sequence: CTA
ctctggaggctgaggctgga

SEQ ID NO: 58716 - DNA, 20 bp, Artificial Sequence
  Description of Artificial Sequence: Synthetic oligonucleotide
  Target: SCN9A; (-) strand; PAM type: YTN; PAM sequence: CTG
tagtcccagctactctggag

SEQ ID NO: 58717 - DNA, 20 bp, Artificial Sequence
  Description of Artificial Sequence: Synthetic oligonucleotide
  Target: SCN9A; (-) strand; PAM type: YTN; PAM sequence: TTA
accaggtgtggtggcgcatg

SEQ ID NO: 58718 - DNA, 20 bp, Artificial Sequence
  Description of Artificial Sequence: Synthetic oligonucleotide
  Target: SCN9A; (-) strand; PAM type: YTN; PAM sequence: CTA
ccaaaaacacaaaaattaac

SEQ ID NO: 58719 - DNA, 20 bp, Artificial Sequence
  Description of Artificial Sequence: Synthetic oligonucleotide
  Target: SCN9A; (-) strand; PAM type: YTN; PAM sequence: CTG
gccaacaaggtgaaaaccgt

SEQ ID NO: 58720 - DNA, 20 bp, Artificial Sequence
  Description of Artificial Sequence: Synthetic oligonucleotide
  Target: SCN9A; (-) strand; PAM type: YTN; PAM sequence: TTG
agaccagcctggccaacaag

SEQ ID NO: 58721 - DNA, 20 bp, Artificial Sequence
  Description of Artificial Sequence: Synthetic oligonucleotide
  Target: SCN9A; (-) strand; PAM type: YTN; PAM sequence: TTT
gagaccagcctggccaacaa

SEQ ID NO: 58722 - DNA, 20 bp, Artificial Sequence
  Description of Artificial Sequence: Synthetic oligonucleotide
  Target: SCN9A; (-) strand; PAM type: YTN; PAM sequence: TTG
aagtcagaagtttgagacca

SEQ ID NO: 58723 - DNA, 20 bp, Artificial Sequence
  Description of Artificial Sequence: Synthetic oligonucleotide
  Target: SCN9A; (-) strand; PAM type: YTN; PAM sequence: CTT
gaagtcagaagtttgagacc

SEQ ID NO: 58724 - DNA, 20 bp, Artificial Sequence
  Description of Artificial Sequence: Synthetic oligonucleotide
  Target: SCN9A; (-) strand; PAM type: YTN; PAM sequence: TTG
ggaggccgaggtgggcgaaa

SEQ ID NO: 58725 - DNA, 20 bp, Artificial Sequence
  Description of Artificial Sequence: Synthetic oligonucleotide
  Target: SCN9A; (-) strand; PAM type: YTN; PAM sequence: CTA
taatcccagcacattgggag

SEQ ID NO: 58726 - DNA, 20 bp, Artificial Sequence
  Description of Artificial Sequence: Synthetic oligonucleotide
  Target: SCN9A; (-) strand; PAM type: YTN; PAM sequence: CTC
acgcctataatcccagcaca

SEQ ID NO: 58727 - DNA, 20 bp, Artificial Sequence
  Description of Artificial Sequence: Synthetic oligonucleotide
  Target: SCN9A; (-) strand; PAM type: YTN; PAM sequence: CTG
tggctcacgcctataatccc

SEQ ID NO: 58728 - DNA, 20 bp, Artificial Sequence
  Description of Artificial Sequence: Synthetic oligonucleotide
  Target: SCN9A; (-) strand; PAM type: YTN; PAM sequence: CTG
ggcactgtggctcacgccta

SEQ ID NO: 58729 - DNA, 20 bp, Artificial Sequence
  Description of Artificial Sequence: Synthetic oligonucleotide
  Target: SCN9A; (-) strand; PAM type: YTN; PAM sequence: TTA
caggctgggcactgtggctc

SEQ ID NO: 58730 - DNA, 20 bp, Artificial Sequence
  Description of Artificial Sequence: Synthetic oligonucleotide
  Target: SCN9A; (-) strand; PAM type: YTN; PAM sequence: CTC
catgacatataaagtaaata

SEQ ID NO: 58731 - DNA, 20 bp, Artificial Sequence
  Description of Artificial Sequence: Synthetic oligonucleotide
  Target: SCN9A; (-) strand; PAM type: YTN; PAM sequence: CTA
tctccatgacatataaagta

SEQ ID NO: 58732 - DNA, 20 bp, Artificial Sequence
  Description of Artificial Sequence: Synthetic oligonucleotide
  Target: SCN9A; (-) strand; PAM type: YTN; PAM sequence: TTA
tgaaactatctccatgacat

SEQ ID NO: 58733 - DNA, 20 bp, Artificial Sequence
  Description of Artificial Sequence: Synthetic oligonucleotide
  Target: SCN9A; (-) strand; PAM type: YTN; PAM sequence: TTT
atgaaactatctccatgaca

SEQ ID NO: 58734 - DNA, 20 bp, Artificial Sequence
  Description of Artificial Sequence: Synthetic oligonucleotide
  Target: SCN9A; (-) strand; PAM type: YTN; PAM sequence: TTT
tatgaaactatctccatgac

SEQ ID NO: 58735 - DNA, 20 bp, Artificial Sequence
  Description of Artificial Sequence: Synthetic oligonucleotide
  Target: SCN9A; (-) strand; PAM type: YTN; PAM sequence: TTT
ttatgaaactatctccatga

SEQ ID NO: 58736 - DNA, 20 bp, Artificial Sequence
  Description of Artificial Sequence: Synthetic oligonucleotide
  Target: SCN9A; (-) strand; PAM type: YTN; PAM sequence: TTG
tcatttttatgaaactatct

SEQ ID NO: 58737 - DNA, 20 bp, Artificial Sequence
  Description of Artificial Sequence: Synthetic oligonucleotide
  Target: SCN9A; (-) strand; PAM type: YTN; PAM sequence: TTC
gttgtcatttttatgaaact

SEQ ID NO: 58738 - DNA, 20 bp, Artificial Sequence
  Description of Artificial Sequence: Synthetic oligonucleotide
  Target: SCN9A; (-) strand; PAM type: YTN; PAM sequence: TTT
cgttgtcatttttatgaaac

SEQ ID NO: 58739 - DNA, 20 bp, Artificial Sequence
  Description of Artificial Sequence: Synthetic oligonucleotide
  Target: SCN9A; (-) strand; PAM type: YTN; PAM sequence: TTA
tttcgttgtcatttttatga

SEQ ID NO: 58740 - DNA, 20 bp, Artificial Sequence
  Description of Artificial Sequence: Synthetic oligonucleotide
  Target: SCN9A; (-) strand; PAM type: YTN; PAM sequence: CTA
taataaattatttcgttgtc

SEQ ID NO: 58741 - DNA, 20 bp, Artificial Sequence
  Description of Artificial Sequence: Synthetic oligonucleotide
  Target: SCN9A; (-) strand; PAM type: YTN; PAM sequence: TTA
taccactataataaattatt

SEQ ID NO: 58742 - DNA, 20 bp, Artificial Sequence
  Description of Artificial Sequence: Synthetic oligonucleotide
  Target: SCN9A; (-) strand; PAM type: YTN; PAM sequence: TTG
agagaacattataccactat

SEQ ID NO: 58743 - DNA, 20 bp, Artificial Sequence
  Description of Artificial Sequence: Synthetic oligonucleotide
  Target: SCN9A; (-) strand; PAM type: YTN; PAM sequence: TTT
gagagaacattataccacta

SEQ ID NO: 58744 - DNA, 20 bp, Artificial Sequence
  Description of Artificial Sequence: Synthetic oligonucleotide
  Target: SCN9A; (-) strand; PAM type: YTN; PAM sequence: TTT
tgagagaacattataccact

SEQ ID NO: 58745 - DNA, 20 bp, Artificial Sequence
  Description of Artificial Sequence: Synthetic oligonucleotide
  Target: SCN9A; (-) strand; PAM type: YTN; PAM sequence: TTA
ttttgagagaacattatacc

SEQ ID NO: 58746 - DNA, 20 bp, Artificial Sequence
  Description of Artificial Sequence: Synthetic oligonucleotide
  Target: SCN9A; (-) strand; PAM type: YTN; PAM sequence: TTG
tggttattttgagagaacat

SEQ ID NO: 58747 - DNA, 20 bp, Artificial Sequence
  Description of Artificial Sequence: Synthetic oligonucleotide
  Target: SCN9A; (-) strand; PAM type: YTN; PAM sequence: TTT
gtggttattttgagagaaca

SEQ ID NO: 58748 - DNA, 20 bp, Artificial Sequence
  Description of Artificial Sequence: Synthetic oligonucleotide
  Target: SCN9A; (-) strand; PAM type: YTN; PAM sequence: TTC
aatttgtggttattttgaga

SEQ ID NO: 58749 - DNA, 20 bp, Artificial Sequence
  Description of Artificial Sequence: Synthetic oligonucleotide
  Target: SCN9A; (-) strand; PAM type: YTN; PAM sequence: CTT
caatttgtggttattttgag

SEQ ID NO: 58750 - DNA, 20 bp, Artificial Sequence
  Description of Artificial Sequence: Synthetic oligonucleotide
  Target: SCN9A; (-) strand; PAM type: YTN; PAM sequence: CTA
gtcttcaatttgtggttatt

SEQ ID NO: 58751 - DNA, 20 bp, Artificial Sequence
  Description of Artificial Sequence: Synthetic oligonucleotide
  Target: SCN9A; (-) strand; PAM type: YTN; PAM sequence: TTC
agtaacaaaaatggaaacag

SEQ ID NO: 58752 - DNA, 20 bp, Artificial Sequence
  Description of Artificial Sequence: Synthetic oligonucleotide
  Target: SCN9A; (-) strand; PAM type: YTN; PAM sequence: TTT
cagtaacaaaaatggaaaca

SEQ ID NO: 58753 - DNA, 20 bp, Artificial Sequence
  Description of Artificial Sequence: Synthetic oligonucleotide
  Target: SCN9A; (-) strand; PAM type: YTN; PAM sequence: TTC
atttcagtaacaaaaatgga

SEQ ID NO: 58754 - DNA, 20 bp, Artificial Sequence
  Description of Artificial Sequence: Synthetic oligonucleotide
  Target: SCN9A; (-) strand; PAM type: YTN; PAM sequence: TTA
gatattcatttcagtaacaa

SEQ ID NO: 58755 - DNA, 20 bp, Artificial Sequence
  Description of Artificial Sequence: Synthetic oligonucleotide
  Target: SCN9A; (-) strand; PAM type: YTN; PAM sequence: TTT
agatattcatttcagtaaca

SEQ ID NO: 58756 - DNA, 20 bp, Artificial Sequence
  Description of Artificial Sequence: Synthetic oligonucleotide
  Target: SCN9A; (-) strand; PAM type: YTN; PAM sequence: CTA
tttagatattcatttcagta

SEQ ID NO: 58757 - DNA, 20 bp, Artificial Sequence
  Description of Artificial Sequence: Synthetic oligonucleotide
  Target: SCN9A; (-) strand; PAM type: YTN; PAM sequence: TTA
ggagaacatagctatttaga

SEQ ID NO: 58758 - DNA, 20 bp, Artificial Sequence
  Description of Artificial Sequence: Synthetic oligonucleotide
  Target: SCN9A; (-) strand; PAM type: YTN; PAM sequence: CTC
atgcaattaggagaacatag

SEQ ID NO: 58759 - DNA, 20 bp, Artificial Sequence
  Description of Artificial Sequence: Synthetic oligonucleotide
  Target: SCN9A; (-) strand; PAM type: YTN; PAM sequence: TTA
aaaagtactcatgcaattag

SEQ ID NO: 58760 - DNA, 20 bp, Artificial Sequence
  Description of Artificial Sequence: Synthetic oligonucleotide
  Target: SCN9A; (-) strand; PAM type: YTN; PAM sequence: TTA
ttaaaaagtactcatgcaat

SEQ ID NO: 58761 - DNA, 20 bp, Artificial Sequence
  Description of Artificial Sequence: Synthetic oligonucleotide
  Target: SCN9A; (-) strand; PAM type: YTN; PAM sequence: TTA
acatattattaaaaagtact

SEQ ID NO: 58762 - DNA, 20 bp, Artificial Sequence
  Description of Artificial Sequence: Synthetic oligonucleotide
  Target: SCN9A; (-) strand; PAM type: YTN; PAM sequence: CTA
ttaacatattattaaaaagt

SEQ ID NO: 58763 - DNA, 20 bp, Artificial Sequence
  Description of Artificial Sequence: Synthetic oligonucleotide
  Target: SCN9A; (-) strand; PAM type: YTN; PAM sequence: TTC
tattaacatattattaaaaa

SEQ ID NO: 58764 - DNA, 20 bp, Artificial Sequence
  Description of Artificial Sequence: Synthetic oligonucleotide
  Target: SCN9A; (-) strand; PAM type: YTN; PAM sequence: TTG
acccaagttctattaacata

SEQ ID NO: 58765 - DNA, 20 bp, Artificial Sequence
  Description of Artificial Sequence: Synthetic oligonucleotide
  Target: SCN9A; (-) strand; PAM type: YTN; PAM sequence: CTG
ttgacccaagttctattaac

SEQ ID NO: 58766 - DNA, 20 bp, Artificial Sequence
  Description of Artificial Sequence: Synthetic oligonucleotide
  Target: SCN9A; (-) strand; PAM type: YTN; PAM sequence: CTG
tatatagtatatatagtatg

SEQ ID NO: 58767 - DNA, 20 bp, Artificial Sequence
  Description of Artificial Sequence: Synthetic oligonucleotide
  Target: SCN9A; (-) strand; PAM type: YTN; PAM sequence: CTA
tatactgtatatagtatata

SEQ ID NO: 58768 - DNA, 20 bp, Artificial Sequence
  Description of Artificial Sequence: Synthetic oligonucleotide
  Target: SCN9A; (-) strand; PAM type: YTN; PAM sequence: TTA
gtatatgtatatgtatatgt

SEQ ID NO: 58769 - DNA, 20 bp, Artificial Sequence
  Description of Artificial Sequence: Synthetic oligonucleotide
  Target: SCN9A; (-) strand; PAM type: YTN; PAM sequence: CTT
agtatatgtatatgtatatg

SEQ ID NO: 58770 - DNA, 20 bp, Artificial Sequence
  Description of Artificial Sequence: Synthetic oligonucleotide
  Target: SCN9A; (-) strand; PAM type: YTN; PAM sequence: CTG
tatatacgtatacttagtat

SEQ ID NO: 58771 - DNA, 20 bp, Artificial Sequence
  Description of Artificial Sequence: Synthetic oligonucleotide
  Target: SCN9A; (-) strand; PAM type: YTN; PAM sequence: CTA
tgtactgtatatacgtatac

SEQ ID NO: 58772 - DNA, 20 bp, Artificial Sequence
  Description of Artificial Sequence: Synthetic oligonucleotide
  Target: SCN9A; (-) strand; PAM type: YTN; PAM sequence: CTA
tatagtatacatatactatg

SEQ ID NO: 58773 - DNA, 20 bp, Artificial Sequence
  Description of Artificial Sequence: Synthetic oligonucleotide
  Target: SCN9A; (-) strand; PAM type: YTN; PAM sequence: CTA
tatatacatactatatagta

SEQ ID NO: 58774 - DNA, 20 bp, Artificial Sequence
  Description of Artificial Sequence: Synthetic oligonucleotide
  Target: SCN9A; (-) strand; PAM type: YTN; PAM sequence: CTA
tatgctatatatacatacta

SEQ ID NO: 58775 - DNA, 20 bp, Artificial Sequence
  Description of Artificial Sequence: Synthetic oligonucleotide
  Target: SCN9A; (-) strand; PAM type: YTN; PAM sequence: CTA
tatagagtatacgcatacta

SEQ ID NO: 58776 - DNA, 20 bp, Artificial Sequence
  Description of Artificial Sequence: Synthetic oligonucleotide
  Target: SCN9A; (-) strand; PAM type: YTN; PAM sequence: CTA
tatgctatatagagtatacg

SEQ ID NO: 58777 - DNA, 20 bp, Artificial Sequence
  Description of Artificial Sequence: Synthetic oligonucleotide
  Target: SCN9A; (-) strand; PAM type: YTN; PAM sequence: CTA
tatagcgtatatgcatacta

SEQ ID NO: 58778 - DNA, 20 bp, Artificial Sequence
  Description of Artificial Sequence: Synthetic oligonucleotide
  Target: SCN9A; (-) strand; PAM type: YTN; PAM sequence: CTA
tatgctatatagcgtatatg

SEQ ID NO: 58779 - DNA, 20 bp, Artificial Sequence
  Description of Artificial Sequence: Synthetic oligonucleotide
  Target: SCN9A; (-) strand; PAM type: YTN; PAM sequence: CTA
tatatagtatatgcatacta

SEQ ID NO: 58780 - DNA, 20 bp, Artificial Sequence
  Description of Artificial Sequence: Synthetic oligonucleotide
  Target: SCN9A; (-) strand; PAM type: YTN; PAM sequence: CTA
tactatatatagtatatgca

SEQ ID NO: 58781 - DNA, 20 bp, Artificial Sequence
  Description of Artificial Sequence: Synthetic oligonucleotide
  Target: SCN9A; (-) strand; PAM type: YTN; PAM sequence: CTC
tatactatatatagtatatg

SEQ ID NO: 58782 - DNA, 20 bp, Artificial Sequence
  Description of Artificial Sequence: Synthetic oligonucleotide
  Target: SCN9A; (-) strand; PAM type: YTN; PAM sequence: CTA
tatatatagtatacgcatac

SEQ ID NO: 58783 - DNA, 20 bp, Artificial Sequence
  Description of Artificial Sequence: Synthetic oligonucleotide
  Target: SCN9A; (-) strand; PAM type: YTN; PAM sequence: CTA
tactatatatatagtatacg

SEQ ID NO: 58784 - DNA, 20 bp, Artificial Sequence
  Description of Artificial Sequence: Synthetic oligonucleotide
  Target: SCN9A; (-) strand; PAM type: YTN; PAM sequence: CTC
tatactatatatatagtata

SEQ ID NO: 58785 - DNA, 20 bp, Artificial Sequence
  Description of Artificial Sequence: Synthetic oligonucleotide
  Target: SCN9A; (-) strand; PAM type: YTN; PAM sequence: CTA
tatatatagtatacgcatac

SEQ ID NO: 58786 - DNA, 20 bp, Artificial Sequence
  Description of Artificial Sequence: Synthetic oligonucleotide
  Target: SCN9A; (-) strand; PAM type: YTN; PAM sequence: CTA
tactatatatatagtatacg

SEQ ID NO: 58787 - DNA, 20 bp, Artificial Sequence
  Description of Artificial Sequence: Synthetic oligonucleotide
  Target: SCN9A; (-) strand; PAM type: YTN; PAM sequence: CTC
tatactatatatatagtata

SEQ ID NO: 58788 - DNA, 20 bp, Artificial Sequence
  Description of Artificial Sequence: Synthetic oligonucleotide
  Target: SCN9A; (-) strand; PAM type: YTN; PAM sequence: CTA
tatatatagtatacgcatac

SEQ ID NO: 58789 - DNA, 20 bp, Artificial Sequence
  Description of Artificial Sequence: Synthetic oligonucleotide
  Target: SCN9A; (-) strand; PAM type: YTN; PAM sequence: CTA
tactatatatatagtatacg

SEQ ID NO: 58790 - DNA, 20 bp, Artificial Sequence
  Description of Artificial Sequence: Synthetic oligonucleotide
  Target: SCN9A; (-) strand; PAM type: YTN; PAM sequence: CTC
tatactatatatatagtata

SEQ ID NO: 58791 - DNA, 20 bp, Artificial Sequence
  Description of Artificial Sequence: Synthetic oligonucleotide
  Target: SCN9A; (-) strand; PAM type: YTN; PAM sequence: CTA
tatatatagtatacgcatac

SEQ ID NO: 58792 - DNA, 20 bp, Artificial Sequence
  Description of Artificial Sequence: Synthetic oligonucleotide
  Target: SCN9A; (-) strand; PAM type: YTN; PAM sequence: CTA
tactatatatatagtatacg

SEQ ID NO: 58793 - DNA, 20 bp, Artificial Sequence
  Description of Artificial Sequence: Synthetic oligonucleotide
  Target: SCN9A; (-) strand; PAM type: YTN; PAM sequence: CTC
tatactatatatatagtata

SEQ ID NO: 58794 - DNA, 20 bp, Artificial Sequence
  Description of Artificial Sequence: Synthetic oligonucleotide
  Target: SCN9A; (-) strand; PAM type: YTN; PAM sequence: CTA
tatatatagtatacgcatac

SEQ ID NO: 58795 - DNA, 20 bp, Artificial Sequence
  Description of Artificial Sequence: Synthetic oligonucleotide
  Target: SCN9A; (-) strand; PAM type: YTN; PAM sequence: CTA
tactatatatatagtatacg

SEQ ID NO: 58796 - DNA, 20 bp, Artificial Sequence
  Description of Artificial Sequence: Synthetic oligonucleotide
  Target: SCN9A; (-) strand; PAM type: YTN; PAM sequence: CTC
tatactatatatatagtata

SEQ ID NO: 58797 - DNA, 20 bp, Artificial Sequence
  Description of Artificial Sequence: Synthetic oligonucleotide
  Target: SCN9A; (-) strand; PAM type: YTN; PAM sequence: CTA
tatatatagtatacgcatac

SEQ ID NO: 58798 - DNA, 20 bp, Artificial Sequence
  Description of Artificial Sequence: Synthetic oligonucleotide
  Target: SCN9A; (-) strand; PAM type: YTN; PAM sequence: CTA
tactatatatatagtatacg

SEQ ID NO: 58799 - DNA, 20 bp, Artificial Sequence
  Description of Artificial Sequence: Synthetic oligonucleotide
  Target: SCN9A; (-) strand; PAM type: YTN; PAM sequence: CTC
tatactatatatatagtata

SEQ ID NO: 58800 - DNA, 20 bp, Artificial Sequence
  Description of Artificial Sequence: Synthetic oligonucleotide
  Target: SCN9A; (-) strand; PAM type: YTN; PAM sequence: CTA
tatatatagtatacgcatac

SEQ ID NO: 58801 - DNA, 20 bp, Artificial Sequence
  Description of Artificial Sequence: Synthetic oligonucleotide
  Target: SCN9A; (-) strand; PAM type: YTN; PAM sequence: CTA
tactatatatatagtatacg

SEQ ID NO: 58802 - DNA, 20 bp, Artificial Sequence
  Description of Artificial Sequence: Synthetic oligonucleotide
  Target: SCN9A; (-) strand; PAM type: YTN; PAM sequence: CTC
tatactatatatatagtata

SEQ ID NO: 58803 - DNA, 20 bp, Artificial Sequence
  Description of Artificial Sequence: Synthetic oligonucleotide
  Target: SCN9A; (-) strand; PAM type: YTN; PAM sequence: CTA
tatatatacatactctatac

SEQ ID NO: 58804 - DNA, 20 bp, Artificial Sequence
  Description of Artificial Sequence: Synthetic oligonucleotide
  Target: SCN9A; (-) strand; PAM type: YTN; PAM sequence: CTA
tgtatatagtatagagtatg

SEQ ID NO: 58805 - DNA, 20 bp, Artificial Sequence
  Description of Artificial Sequence: Synthetic oligonucleotide
  Target: SCN9A; (-) strand; PAM type: YTN; PAM sequence: TTG
tgtgtatatatatacacata

SEQ ID NO: 58806 - DNA, 20 bp, Artificial Sequence
  Description of Artificial Sequence: Synthetic oligonucleotide
  Target: SCN9A; (-) strand; PAM type: YTN; PAM sequence: CTA
tatattgtgtgtatatatat

SEQ ID NO: 58807 - DNA, 20 bp, Artificial Sequence
  Description of Artificial Sequence: Synthetic oligonucleotide
  Target: SCN9A; (-) strand; PAM type: YTN; PAM sequence: TTC
agctatatattgtgtgtata

SEQ ID NO: 58808 - DNA, 20 bp, Artificial Sequence
  Description of Artificial Sequence: Synthetic oligonucleotide
  Target: SCN9A; (-) strand; PAM type: YTN; PAM sequence: CTG
gagataggttcagctatata

SEQ ID NO: 58809 - DNA, 20 bp, Artificial Sequence
  Description of Artificial Sequence: Synthetic oligonucleotide
  Target: SCN9A; (-) strand; PAM type: YTN; PAM sequence: TTC
tggagataggttcagctata

SEQ ID NO: 58810 - DNA, 20 bp, Artificial Sequence
  Description of Artificial Sequence: Synthetic oligonucleotide
  Target: SCN9A; (-) strand; PAM type: YTN; PAM sequence: TTT
ctggagataggttcagctat

SEQ ID NO: 58811 - DNA, 20 bp, Artificial Sequence
  Description of Artificial Sequence: Synthetic oligonucleotide
  Target: SCN9A; (-) strand; PAM type: YTN; PAM sequence: CTT
tctggagataggttcagcta

SEQ ID NO: 58812 - DNA, 20 bp, Artificial Sequence
  Description of Artificial Sequence: Synthetic oligonucleotide
  Target: SCN9A; (-) strand; PAM type: YTN; PAM sequence: TTA
gtacaggctttctggagata

SEQ ID NO: 58813 - DNA, 20 bp, Artificial Sequence
  Description of Artificial Sequence: Synthetic oligonucleotide
  Target: SCN9A; (-) strand; PAM type: YTN; PAM sequence: TTA
attagtacaggctttctgga

SEQ ID NO: 58814 - DNA, 20 bp, Artificial Sequence
  Description of Artificial Sequence: Synthetic oligonucleotide
  Target: SCN9A; (-) strand; PAM type: YTN; PAM sequence: TTA
gaaatgttaattagtacagg

SEQ ID NO: 58815 - DNA, 20 bp, Artificial Sequence
  Description of Artificial Sequence: Synthetic oligonucleotide
  Target: SCN9A; (-) strand; PAM type: YTN; PAM sequence: CTG
ccattagaaatgttaattag

SEQ ID NO: 58816 - DNA, 20 bp, Artificial Sequence
  Description of Artificial Sequence: Synthetic oligonucleotide
  Target: SCN9A; (-) strand; PAM type: YTN; PAM sequence: CTA
tcatatactgccattagaaa

SEQ ID NO: 58817 - DNA, 20 bp, Artificial Sequence
  Description of Artificial Sequence: Synthetic oligonucleotide
  Target: SCN9A; (-) strand; PAM type: YTN; PAM sequence: TTG
aatgtgtaaagtatgagcac

SEQ ID NO: 58818 - DNA, 20 bp, Artificial Sequence
  Description of Artificial Sequence: Synthetic oligonucleotide
  Target: SCN9A; (-) strand; PAM type: YTN; PAM sequence: CTG
ttgaatgtgtaaagtatgag

SEQ ID NO: 58819 - DNA, 20 bp, Artificial Sequence
  Description of Artificial Sequence: Synthetic oligonucleotide
  Target: SCN9A; (-) strand; PAM type: YTN; PAM sequence: CTC
aatactgttgaatgtgtaaa

SEQ ID NO: 58820 - DNA, 20 bp, Artificial Sequence
  Description of Artificial Sequence: Synthetic oligonucleotide
  Target: SCN9A; (-) strand; PAM type: YTN; PAM sequence: CTA
taaagaagaatggtagcact

SEQ ID NO: 58821 - DNA, 20 bp, Artificial Sequence
  Description of Artificial Sequence: Synthetic oligonucleotide
  Target: SCN9A; (-) strand; PAM type: YTN; PAM sequence: TTG
gtaaaaaactataaagaaga

SEQ ID NO: 58822 - DNA, 20 bp, Artificial Sequence
  Description of Artificial Sequence: Synthetic oligonucleotide
  Target: SCN9A; (-) strand; PAM type: YTN; PAM sequence: TTT
ggtaaaaaactataaagaag

SEQ ID NO: 58823 - DNA, 20 bp, Artificial Sequence
  Description of Artificial Sequence: Synthetic oligonucleotide
  Target: SCN9A; (-) strand; PAM type: YTN; PAM sequence: TTT
tggtaaaaaactataaagaa

SEQ ID NO: 58824 - DNA, 20 bp, Artificial Sequence
  Description of Artificial Sequence: Synthetic oligonucleotide
  Target: SCN9A; (-) strand; PAM type: YTN; PAM sequence: TTT
ttggtaaaaaactataaaga

SEQ ID NO: 58825 - DNA, 20 bp, Artificial Sequence
  Description of Artificial Sequence: Synthetic oligonucleotide
  Target: SCN9A; (-) strand; PAM type: YTN; PAM sequence: TTT
tttggtaaaaaactataaag

SEQ ID NO: 58826 - DNA, 20 bp, Artificial Sequence
  Description of Artificial Sequence: Synthetic oligonucleotide
  Target: SCN9A; (-) strand; PAM type: YTN; PAM sequence: TTC
aaatgtcatgaaaatttttt

SEQ ID NO: 58827 - DNA, 20 bp, Artificial Sequence
  Description of Artificial Sequence: Synthetic oligonucleotide
  Target: SCN9A; (-) strand; PAM type: YTN; PAM sequence: TTT
caaatgtcatgaaaattttt

SEQ ID NO: 58828 - DNA, 20 bp, Artificial Sequence
  Description of Artificial Sequence: Synthetic oligonucleotide
  Target: SCN9A; (-) strand; PAM type: YTN; PAM sequence: TTT
tcaaatgtcatgaaaatttt

SEQ ID NO: 58829 - DNA, 20 bp, Artificial Sequence
  Description of Artificial Sequence: Synthetic oligonucleotide
  Target: SCN9A; (-) strand; PAM type: YTN; PAM sequence: TTA
caatagtagatgttttcaaa

SEQ ID NO: 58830 - DNA, 20 bp, Artificial Sequence
  Description of Artificial Sequence: Synthetic oligonucleotide
  Target: SCN9A; (-) strand; PAM type: YTN; PAM sequence: TTC
acaaaaaatgcaaataaatt

SEQ ID NO: 58831 - DNA, 20 bp, Artificial Sequence
  Description of Artificial Sequence: Synthetic oligonucleotide
  Target: SCN9A; (-) strand; PAM type: YTN; PAM sequence: TTT
cacaaaaaatgcaaataaat

SEQ ID NO: 58832 - DNA, 20 bp, Artificial Sequence
  Description of Artificial Sequence: Synthetic oligonucleotide
  Target: SCN9A; (-) strand; PAM type: YTN; PAM sequence: TTT
tcacaaaaaatgcaaataaa

SEQ ID NO: 58833 - DNA, 20 bp, Artificial Sequence
  Description of Artificial Sequence: Synthetic oligonucleotide
  Target: SCN9A; (-) strand; PAM type: YTN; PAM sequence: TTA
ttttcacaaaaaatgcaaat

SEQ ID NO: 58834 - DNA, 20 bp, Artificial Sequence
  Description of Artificial Sequence: Synthetic oligonucleotide
  Target: SCN9A; (-) strand; PAM type: YTN; PAM sequence: TTG
tggattattttcacaaaaaa

SEQ ID NO: 58835 - DNA, 20 bp, Artificial Sequence
  Description of Artificial Sequence: Synthetic oligonucleotide
  Target: SCN9A; (-) strand; PAM type: YTN; PAM sequence: TTA
aaaacaaccaataaggatac

SEQ ID NO: 58836 - DNA, 20 bp, Artificial Sequence
  Description of Artificial Sequence: Synthetic oligonucleotide
  Target: SCN9A; (-) strand; PAM type: YTN; PAM sequence: CTA
agccaaaaacagaagttaaa

SEQ ID NO: 58837 - DNA, 20 bp, Artificial Sequence
  Description of Artificial Sequence: Synthetic oligonucleotide
  Target: SCN9A; (-) strand; PAM type: YTN; PAM sequence: TTA
ataagaatatagtaaaaatc

SEQ ID NO: 58838 - DNA, 20 bp, Artificial Sequence
  Description of Artificial Sequence: Synthetic oligonucleotide
  Target: SCN9A; (-) strand; PAM type: YTN; PAM sequence: TTA
taaattaataagaatatagt

SEQ ID NO: 58839 - DNA, 20 bp, Artificial Sequence
  Description of Artificial Sequence: Synthetic oligonucleotide
  Target: SCN9A; (-) strand; PAM type: YTN; PAM sequence: CTT
ataaattaataagaatatag

SEQ ID NO: 58840 - DNA, 20 bp, Artificial Sequence
  Description of Artificial Sequence: Synthetic oligonucleotide
  Target: SCN9A; (-) strand; PAM type: YTN; PAM sequence: TTC
ttataaattaataagaatat

SEQ ID NO: 58841 - DNA, 20 bp, Artificial Sequence
  Description of Artificial Sequence: Synthetic oligonucleotide
  Target: SCN9A; (-) strand; PAM type: YTN; PAM sequence: TTG
ttcttataaattaataagaa

SEQ ID NO: 58842 - DNA, 20 bp, Artificial Sequence
  Description of Artificial Sequence: Synthetic oligonucleotide
  Target: SCN9A; (-) strand; PAM type: YTN; PAM sequence: TTA
aatagaaaattgttcttata

SEQ ID NO: 58843 - DNA, 20 bp, Artificial Sequence
  Description of Artificial Sequence: Synthetic oligonucleotide
  Target: SCN9A; (-) strand; PAM type: YTN; PAM sequence: TTT
aaatagaaaattgttcttat

SEQ ID NO: 58844 - DNA, 20 bp, Artificial Sequence
  Description of Artificial Sequence: Synthetic oligonucleotide
  Target: SCN9A; (-) strand; PAM type: YTN; PAM sequence: CTT
taaatagaaaattgttctta

SEQ ID NO: 58845 - DNA, 20 bp, Artificial Sequence
  Description of Artificial Sequence: Synthetic oligonucleotide
  Target: SCN9A; (-) strand; PAM type: YTN; PAM sequence: TTA
aggccgagaaaggatcaata

SEQ ID NO: 58846 - DNA, 20 bp, Artificial Sequence
  Description of Artificial Sequence: Synthetic oligonucleotide
  Target: SCN9A; (-) strand; PAM type: YTN; PAM sequence: TTA
cataacagttaaggccgaga

SEQ ID NO: 58847 - DNA, 20 bp, Artificial Sequence
  Description of Artificial Sequence: Synthetic oligonucleotide
  Target: SCN9A; (-) strand; PAM type: YTN; PAM sequence: TTT
acataacagttaaggccgag

SEQ ID NO: 58848 - DNA, 20 bp, Artificial Sequence
  Description of Artificial Sequence: Synthetic oligonucleotide
  Target: SCN9A; (-) strand; PAM type: YTN; PAM sequence: TTG
aaagacaaaaaataggtgaa

SEQ ID NO: 58849 - DNA, 20 bp, Artificial Sequence
  Description of Artificial Sequence: Synthetic oligonucleotide
  Target: SCN9A; (-) strand; PAM type: YTN; PAM sequence: TTG
gggaaaaaatcatcataaat

SEQ ID NO: 58850 - DNA, 20 bp, Artificial Sequence
  Description of Artificial Sequence: Synthetic oligonucleotide
  Target: SCN9A; (-) strand; PAM type: YTN; PAM sequence: TTT
ggggaaaaaatcatcataaa

SEQ ID NO: 58851 - DNA, 20 bp, Artificial Sequence
  Description of Artificial Sequence: Synthetic oligonucleotide
  Target: SCN9A; (-) strand; PAM type: YTN; PAM sequence: CTT
tggggaaaaaatcatcataa

SEQ ID NO: 58852 - DNA, 20 bp, Artificial Sequence
  Description of Artificial Sequence: Synthetic oligonucleotide
  Target: SCN9A; (-) strand; PAM type: YTN; PAM sequence: TTC
tttggggaaaaaatcatcat

SEQ ID NO: 58853 - DNA, 20 bp, Artificial Sequence
  Description of Artificial Sequence: Synthetic oligonucleotide
  Target: SCN9A; (-) strand; PAM type: YTN; PAM sequence: CTG
cacaaaaaaacaaaatattc

SEQ ID NO: 58854 - DNA, 20 bp, Artificial Sequence
  Description of Artificial Sequence: Synthetic oligonucleotide
  Target: SCN9A; (-) strand; PAM type: YTN; PAM sequence: TTG
taaagccaaaaaaaaaaatg

SEQ ID NO: 58855 - DNA, 20 bp, Artificial Sequence
  Description of Artificial Sequence: Synthetic oligonucleotide
  Target: SCN9A; (-) strand; PAM type: YTN; PAM sequence: TTT
gtaaagccaaaaaaaaaaat

SEQ ID NO: 58856 - DNA, 20 bp, Artificial Sequence
  Description of Artificial Sequence: Synthetic oligonucleotide
  Target: SCN9A; (-) strand; PAM type: YTN; PAM sequence: CTA
tgcaaaacacaaatttgtaa

SEQ ID NO: 58857 - DNA, 20 bp, Artificial Sequence
  Description of Artificial Sequence: Synthetic oligonucleotide
  Target: SCN9A; (-) strand; PAM type: YTN; PAM sequence: TTC
tatgcaaaacacaaatttgt

SEQ ID NO: 58858 - DNA, 20 bp, Artificial Sequence
  Description of Artificial Sequence: Synthetic oligonucleotide
  Target: SCN9A; (-) strand; PAM type: YTN; PAM sequence: TTT
ctatgcaaaacacaaatttg

SEQ ID NO: 58859 - DNA, 20 bp, Artificial Sequence
  Description of Artificial Sequence: Synthetic oligonucleotide
  Target: SCN9A; (-) strand; PAM type: YTN; PAM sequence: CTT
tctatgcaaaacacaaattt

SEQ ID NO: 58860 - DNA, 20 bp, Artificial Sequence
  Description of Artificial Sequence: Synthetic oligonucleotide
  Target: SCN9A; (-) strand; PAM type: YTN; PAM sequence: TTA
tagtcctttctatgcaaaac

SEQ ID NO: 58861 - DNA, 20 bp, Artificial Sequence
  Description of Artificial Sequence: Synthetic oligonucleotide
  Target: SCN9A; (-) strand; PAM type: YTN; PAM sequence: CTT
atagtcctttctatgcaaaa

SEQ ID NO: 58862 - DNA, 20 bp, Artificial Sequence
  Description of Artificial Sequence: Synthetic oligonucleotide
  Target: SCN9A; (-) strand; PAM type: YTN; PAM sequence: CTC
ttatagtcctttctatgcaa

SEQ ID NO: 58863 - DNA, 20 bp, Artificial Sequence
  Description of Artificial Sequence: Synthetic oligonucleotide
  Target: SCN9A; (-) strand; PAM type: YTN; PAM sequence: CTA
gtaggaaatatgtggaaata

SEQ ID NO: 58864 - DNA, 20 bp, Artificial Sequence
  Description of Artificial Sequence: Synthetic oligonucleotide
  Target: SCN9A; (-) strand; PAM type: YTN; PAM sequence: TTC
tagtaggaaatatgtggaaa

SEQ ID NO: 58865 - DNA, 20 bp, Artificial Sequence
  Description of Artificial Sequence: Synthetic oligonucleotide
  Target: SCN9A; (-) strand; PAM type: YTN; PAM sequence: TTA
aaaaaaaagattctagtagg

SEQ ID NO: 58866 - DNA, 20 bp, Artificial Sequence
  Description of Artificial Sequence: Synthetic oligonucleotide
  Target: SCN9A; (-) strand; PAM type: YTN; PAM sequence: CTA
aagttaaaaaaaaagattct

SEQ ID NO: 58867 - DNA, 20 bp, Artificial Sequence
  Description of Artificial Sequence: Synthetic oligonucleotide
  Target: SCN9A; (-) strand; PAM type: YTN; PAM sequence: CTG
tgtgaaaagatcacatgaat

SEQ ID NO: 58868 - DNA, 20 bp, Artificial Sequence
  Description of Artificial Sequence: Synthetic oligonucleotide
  Target: SCN9A; (-) strand; PAM type: YTN; PAM sequence: TTA
ctgtgtgaaaagatcacatg

SEQ ID NO: 58869 - DNA, 20 bp, Artificial Sequence
  Description of Artificial Sequence: Synthetic oligonucleotide
  Target: SCN9A; (-) strand; PAM type: YTN; PAM sequence: TTT
actgtgtgaaaagatcacat

SEQ ID NO: 58870 - DNA, 20 bp, Artificial Sequence
  Description of Artificial Sequence: Synthetic oligonucleotide
  Target: SCN9A; (-) strand; PAM type: YTN; PAM sequence: TTA
ccaatttactgtgtgaaaag

SEQ ID NO: 58871 - DNA, 20 bp, Artificial Sequence
  Description of Artificial Sequence: Synthetic oligonucleotide
  Target: SCN9A; (-) strand; PAM type: YTN; PAM sequence: TTA
atgtataattaccaatttac

SEQ ID NO: 58872 - DNA, 20 bp, Artificial Sequence
  Description of Artificial Sequence: Synthetic oligonucleotide
  Target: SCN9A; (-) strand; PAM type: YTN; PAM sequence: TTT
aatgtataattaccaattta

SEQ ID NO: 58873 - DNA, 20 bp, Artificial Sequence
  Description of Artificial Sequence: Synthetic oligonucleotide
  Target: SCN9A; (-) strand; PAM type: YTN; PAM sequence: CTT
taatgtataattaccaattt

SEQ ID NO: 58874 - DNA, 20 bp, Artificial Sequence
  Description of Artificial Sequence: Synthetic oligonucleotide
  Target: SCN9A; (-) strand; PAM type: YTN; PAM sequence: TTA
aactttaatgtataattacc

SEQ ID NO: 58875 - DNA, 20 bp, Artificial Sequence
  Description of Artificial Sequence: Synthetic oligonucleotide
  Target: SCN9A; (-) strand; PAM type: YTN; PAM sequence: TTG
aagagagtccaaattaaact

SEQ ID NO: 58876 - DNA, 20 bp, Artificial Sequence
  Description of Artificial Sequence: Synthetic oligonucleotide
  Target: SCN9A; (-) strand; PAM type: YTN; PAM sequence: TTT
gaagagagtccaaattaaac

SEQ ID NO: 58877 - DNA, 20 bp, Artificial Sequence
  Description of Artificial Sequence: Synthetic oligonucleotide
  Target: SCN9A; (-) strand; PAM type: YTN; PAM sequence: CTC
agtgggtttgaagagagtcc

SEQ ID NO: 58878 - DNA, 20 bp, Artificial Sequence
  Description of Artificial Sequence: Synthetic oligonucleotide
  Target: SCN9A; (-) strand; PAM type: YTN; PAM sequence: TTC
aaatataaaagctcagtggg

SEQ ID NO: 58879 - DNA, 20 bp, Artificial Sequence
  Description of Artificial Sequence: Synthetic oligonucleotide
  Target: SCN9A; (-) strand; PAM type: YTN; PAM sequence: CTG
ttcaaatataaaagctcagt

SEQ ID NO: 58880 - DNA, 20 bp, Artificial Sequence
  Description of Artificial Sequence: Synthetic oligonucleotide
  Target: SCN9A; (-) strand; PAM type: YTN; PAM sequence: TTA
aataaaactgttcaaatata

SEQ ID NO: 58881 - DNA, 20 bp, Artificial Sequence
  Description of Artificial Sequence: Synthetic oligonucleotide
  Target: SCN9A; (-) strand; PAM type: YTN; PAM sequence: TTA
agacatatagatgttaaata

SEQ ID NO: 58882 - DNA, 20 bp, Artificial Sequence
  Description of Artificial Sequence: Synthetic oligonucleotide
  Target: SCN9A; (-) strand; PAM type: YTN; PAM sequence: CTG
caaaatattaagacatatag

SEQ ID NO: 58883 - DNA, 20 bp, Artificial Sequence
  Description of Artificial Sequence: Synthetic oligonucleotide
  Target: SCN9A; (-) strand; PAM type: YTN; PAM sequence: TTC
tgcaaaatattaagacatat

SEQ ID NO: 58884 - DNA, 20 bp, Artificial Sequence
  Description of Artificial Sequence: Synthetic oligonucleotide
  Target: SCN9A; (-) strand; PAM type: YTN; PAM sequence: TTA
ttctgcaaaatattaagaca

SEQ ID NO: 58885 - DNA, 20 bp, Artificial Sequence
  Description of Artificial Sequence: Synthetic oligonucleotide
  Target: SCN9A; (-) strand; PAM type: YTN; PAM sequence: CTT
attctgcaaaatattaagac

SEQ ID NO: 58886 - DNA, 20 bp, Artificial Sequence
  Description of Artificial Sequence: Synthetic oligonucleotide
  Target: SCN9A; (-) strand; PAM type: YTN; PAM sequence: TTA
gggtgacaagaggtggctta

SEQ ID NO: 58887 - DNA, 20 bp, Artificial Sequence
  Description of Artificial Sequence: Synthetic oligonucleotide
  Target: SCN9A; (-) strand; PAM type: YTN; PAM sequence: CTG
gaagaaaattagggtgacaa

SEQ ID NO: 58888 - DNA, 20 bp, Artificial Sequence
  Description of Artificial Sequence: Synthetic oligonucleotide
  Target: SCN9A; (-) strand; PAM type: YTN; PAM sequence: TTC
atctggaagaaaattagggt

SEQ ID NO: 58889 - DNA, 20 bp, Artificial Sequence
  Description of Artificial Sequence: Synthetic oligonucleotide
  Target: SCN9A; (-) strand; PAM type: YTN; PAM sequence: CTA
aattcatctggaagaaaatt

SEQ ID NO: 58890 - DNA, 20 bp, Artificial Sequence
  Description of Artificial Sequence: Synthetic oligonucleotide
  Target: SCN9A; (-) strand; PAM type: YTN; PAM sequence: TTC
taaattcatctggaagaaaa

SEQ ID NO: 58891 - DNA, 20 bp, Artificial Sequence
  Description of Artificial Sequence: Synthetic oligonucleotide
  Target: SCN9A; (-) strand; PAM type: YTN; PAM sequence: CTA
aatgattctaaattcatctg

SEQ ID NO: 58892 - DNA, 20 bp, Artificial Sequence
  Description of Artificial Sequence: Synthetic oligonucleotide
  Target: SCN9A; (-) strand; PAM type: YTN; PAM sequence: TTA
tgtagtgtgggtaataaata

SEQ ID NO: 58893 - DNA, 20 bp, Artificial Sequence
  Description of Artificial Sequence: Synthetic oligonucleotide
  Target: SCN9A; (-) strand; PAM type: YTN; PAM sequence: TTT
atgtagtgtgggtaataaat

SEQ ID NO: 58894 - DNA, 20 bp, Artificial Sequence
  Description of Artificial Sequence: Synthetic oligonucleotide
  Target: SCN9A; (-) strand; PAM type: YTN; PAM sequence: TTT
tatgtagtgtgggtaataaa

SEQ ID NO: 58895 - DNA, 20 bp, Artificial Sequence
  Description of Artificial Sequence: Synthetic oligonucleotide
  Target: SCN9A; (-) strand; PAM type: YTN; PAM sequence: TTT
ttatgtagtgtgggtaataa

SEQ ID NO: 58896 - DNA, 20 bp, Artificial Sequence
  Description of Artificial Sequence: Synthetic oligonucleotide
  Target: SCN9A; (-) strand; PAM type: YTN; PAM sequence: CTT
tttatgtagtgtgggtaata

SEQ ID NO: 58897 - DNA, 20 bp, Artificial Sequence
  Description of Artificial Sequence: Synthetic oligonucleotide
  Target: SCN9A; (-) strand; PAM type: YTN; PAM sequence: TTC
aaggaaaatatcaatgagtc

SEQ ID NO: 58898 - DNA, 20 bp, Artificial Sequence
  Description of Artificial Sequence: Synthetic oligonucleotide
  Target: SCN9A; (-) strand; PAM type: YTN; PAM sequence: CTA
taaattcaaggaaaatatca

SEQ ID NO: 58899 - DNA, 20 bp, Artificial Sequence
  Description of Artificial Sequence: Synthetic oligonucleotide
  Target: SCN9A; (-) strand; PAM type: YTN; PAM sequence: TTA
atctataaattcaaggaaaa

SEQ ID NO: 58900 - DNA, 20 bp, Artificial Sequence
  Description of Artificial Sequence: Synthetic oligonucleotide
  Target: SCN9A; (-) strand; PAM type: YTN; PAM sequence: TTA
ttaatctataaattcaagga

SEQ ID NO: 58901 - DNA, 20 bp, Artificial Sequence
  Description of Artificial Sequence: Synthetic oligonucleotide
  Target: SCN9A; (-) strand; PAM type: YTN; PAM sequence: TTT
attaatctataaattcaagg

SEQ ID NO: 58902 - DNA, 20 bp, Artificial Sequence
  Description of Artificial Sequence: Synthetic oligonucleotide
  Target: SCN9A; (-) strand; PAM type: YTN; PAM sequence: TTC
aaatttattaatctataaat

SEQ ID NO: 58903 - DNA, 20 bp, Artificial Sequence
  Description of Artificial Sequence: Synthetic oligonucleotide
  Target: SCN9A; (-) strand; PAM type: YTN; PAM sequence: TTT
caaatttattaatctataaa

SEQ ID NO: 58904 - DNA, 20 bp, Artificial Sequence
  Description of Artificial Sequence: Synthetic oligonucleotide
  Target: SCN9A; (-) strand; PAM type: YTN; PAM sequence: CTT
tcaaatttattaatctataa

SEQ ID NO: 58905 - DNA, 20 bp, Artificial Sequence
  Description of Artificial Sequence: Synthetic oligonucleotide
  Target: SCN9A; (-) strand; PAM type: YTN; PAM sequence: TTA
agactttcaaatttattaat

SEQ ID NO: 58906 - DNA, 20 bp, Artificial Sequence
  Description of Artificial Sequence: Synthetic oligonucleotide
  Target: SCN9A; (-) strand; PAM type: YTN; PAM sequence: TTG
taattaagactttcaaattt

SEQ ID NO: 58907 - DNA, 20 bp, Artificial Sequence
  Description of Artificial Sequence: Synthetic oligonucleotide
  Target: SCN9A; (-) strand; PAM type: YTN; PAM sequence: CTC
attgtaattaagactttcaa

SEQ ID NO: 58908 - DNA, 20 bp, Artificial Sequence
  Description of Artificial Sequence: Synthetic oligonucleotide
  Target: SCN9A; (-) strand; PAM type: YTN; PAM sequence: CTC
tcattgtaattaagactttc

SEQ ID NO: 58909 - DNA, 20 bp, Artificial Sequence
  Description of Artificial Sequence: Synthetic oligonucleotide
  Target: SCN9A; (-) strand; PAM type: YTN; PAM sequence: TTC
tctcattgtaattaagactt

SEQ ID NO: 58910 - DNA, 20 bp, Artificial Sequence
  Description of Artificial Sequence: Synthetic oligonucleotide
  Target: SCN9A; (-) strand; PAM type: YTN; PAM sequence: CTT
ctctcattgtaattaagact

SEQ ID NO: 58911 - DNA, 20 bp, Artificial Sequence
  Description of Artificial Sequence: Synthetic oligonucleotide
  Target: SCN9A; (-) strand; PAM type: YTN; PAM sequence: TTA
gataagcttctctcattgta

SEQ ID NO: 58912 - DNA, 20 bp, Artificial Sequence
  Description of Artificial Sequence: Synthetic oligonucleotide
  Target: SCN9A; (-) strand; PAM type: YTN; PAM sequence: CTT
agataagcttctctcattgt

SEQ ID NO: 58913 - DNA, 20 bp, Artificial Sequence
  Description of Artificial Sequence: Synthetic oligonucleotide
  Target: SCN9A; (-) strand; PAM type: YTN; PAM sequence: TTG
tcatgtacttagataagctt

SEQ ID NO: 58914 - DNA, 20 bp, Artificial Sequence
  Description of Artificial Sequence: Synthetic oligonucleotide
  Target: SCN9A; (-) strand; PAM type: YTN; PAM sequence: TTG
aaaggattgtcatgtactta

SEQ ID NO: 58915 - DNA, 20 bp, Artificial Sequence
  Description of Artificial Sequence: Synthetic oligonucleotide
  Target: SCN9A; (-) strand; PAM type: YTN; PAM sequence: CTA
aaataattgaaaggattgtc

SEQ ID NO: 58916 - DNA, 20 bp, Artificial Sequence
  Description of Artificial Sequence: Synthetic oligonucleotide
  Target: SCN9A; (-) strand; PAM type: YTN; PAM sequence: TTA
ggatataaaagaaagctaaa

SEQ ID NO: 58917 - DNA, 20 bp, Artificial Sequence
  Description of Artificial Sequence: Synthetic oligonucleotide
  Target: SCN9A; (-) strand; PAM type: YTN; PAM sequence: TTT
aggatataaaagaaagctaa

SEQ ID NO: 58918 - DNA, 20 bp, Artificial Sequence
  Description of Artificial Sequence: Synthetic oligonucleotide
  Target: SCN9A; (-) strand; PAM type: YTN; PAM sequence: CTT
taggatataaaagaaagcta

SEQ ID NO: 58919 - DNA, 20 bp, Artificial Sequence
  Description of Artificial Sequence: Synthetic oligonucleotide
  Target: SCN9A; (-) strand; PAM type: YTN; PAM sequence: CTG
aagaaaactttaggatataa

SEQ ID NO: 58920 - DNA, 20 bp, Artificial Sequence
  Description of Artificial Sequence: Synthetic oligonucleotide
  Target: SCN9A; (-) strand; PAM type: YTN; PAM sequence: TTC
tgaagaaaactttaggatat

SEQ ID NO: 58921 - DNA, 20 bp, Artificial Sequence
  Description of Artificial Sequence: Synthetic oligonucleotide
  Target: SCN9A; (-) strand; PAM type: YTN; PAM sequence: CTT
ctgaagaaaactttaggata

SEQ ID NO: 58922 - DNA, 20 bp, Artificial Sequence
  Description of Artificial Sequence: Synthetic oligonucleotide
  Target: SCN9A; (-) strand; PAM type: YTN; PAM sequence: TTA
tcatatgagacttctgaaga

SEQ ID NO: 58923 - DNA, 20 bp, Artificial Sequence
  Description of Artificial Sequence: Synthetic oligonucleotide
  Target: SCN9A; (-) strand; PAM type: YTN; PAM sequence: TTT
atcatatgagacttctgaag

SEQ ID NO: 58924 - DNA, 20 bp, Artificial Sequence
  Description of Artificial Sequence: Synthetic oligonucleotide
  Target: SCN9A; (-) strand; PAM type: YTN; PAM sequence: CTT
tatcatatgagacttctgaa

SEQ ID NO: 58925 - DNA, 20 bp, Artificial Sequence
  Description of Artificial Sequence: Synthetic oligonucleotide
  Target: SCN9A; (-) strand; PAM type: YTN; PAM sequence: CTA
ataataactttatcatatga

SEQ ID NO: 58926 - DNA, 20 bp, Artificial Sequence
  Description of Artificial Sequence: Synthetic oligonucleotide
  Target: SCN9A; (-) strand; PAM type: YTN; PAM sequence: TTA
tctaataataactttatcat

SEQ ID NO: 58927 - DNA, 20 bp, Artificial Sequence
  Description of Artificial Sequence: Synthetic oligonucleotide
  Target: SCN9A; (-) strand; PAM type: YTN; PAM sequence: TTG
caataaaaataaagtaaatt

SEQ ID NO: 58928 - DNA, 20 bp, Artificial Sequence
  Description of Artificial Sequence: Synthetic oligonucleotide
  Target: SCN9A; (-) strand; PAM type: YTN; PAM sequence: TTC
acaattgcaataaaaataaa

SEQ ID NO: 58929 - DNA, 20 bp, Artificial Sequence
  Description of Artificial Sequence: Synthetic oligonucleotide
  Target: SCN9A; (-) strand; PAM type: YTN; PAM sequence: CTG
attcacaattgcaataaaaa

SEQ ID NO: 58930 - DNA, 20 bp, Artificial Sequence
  Description of Artificial Sequence: Synthetic oligonucleotide
  Target: SCN9A; (-) strand; PAM type: YTN; PAM sequence: TTA
gaaaatctgattcacaattg

SEQ ID NO: 58931 - DNA, 20 bp, Artificial Sequence
  Description of Artificial Sequence: Synthetic oligonucleotide
  Target: SCN9A; (-) strand; PAM type: YTN; PAM sequence: TTA
tacatgaaaaaaattagaaa

SEQ ID NO: 58932 - DNA, 20 bp, Artificial Sequence
  Description of Artificial Sequence: Synthetic oligonucleotide
  Target: SCN9A; (-) strand; PAM type: YTN; PAM sequence: CTT
atacatgaaaaaaattagaa

SEQ ID NO: 58933 - DNA, 20 bp, Artificial Sequence
  Description of Artificial Sequence: Synthetic oligonucleotide
  Target: SCN9A; (-) strand; PAM type: YTN; PAM sequence: TTA
tcttatacatgaaaaaaatt

SEQ ID NO: 58934 - DNA, 20 bp, Artificial Sequence
  Description of Artificial Sequence: Synthetic oligonucleotide
  Target: SCN9A; (-) strand; PAM type: YTN; PAM sequence: CTA
ataattatcttatacatgaa

SEQ ID NO: 58935 - DNA, 20 bp, Artificial Sequence
  Description of Artificial Sequence: Synthetic oligonucleotide
  Target: SCN9A; (-) strand; PAM type: YTN; PAM sequence: TTA
catgtgccaacactaataat

SEQ ID NO: 58936 - DNA, 20 bp, Artificial Sequence
  Description of Artificial Sequence: Synthetic oligonucleotide
  Target: SCN9A; (-) strand; PAM type: YTN; PAM sequence: TTA
aattacatgtgccaacacta

SEQ ID NO: 58937 - DNA, 20 bp, Artificial Sequence
  Description of Artificial Sequence: Synthetic oligonucleotide
  Target: SCN9A; (-) strand; PAM type: YTN; PAM sequence: TTT
aaattacatgtgccaacact

SEQ ID NO: 58938 - DNA, 20 bp, Artificial Sequence
  Description of Artificial Sequence: Synthetic oligonucleotide
  Target: SCN9A; (-) strand; PAM type: YTN; PAM sequence: TTT
taaattacatgtgccaacac

SEQ ID NO: 58939 - DNA, 20 bp, Artificial Sequence
  Description of Artificial Sequence: Synthetic oligonucleotide
  Target: SCN9A; (-) strand; PAM type: YTN; PAM sequence: TTC
aaaaggtacaaattttaaat

SEQ ID NO: 58940 - DNA, 20 bp, Artificial Sequence
  Description of Artificial Sequence: Synthetic oligonucleotide
  Target: SCN9A; (-) strand; PAM type: YTN; PAM sequence: TTA
gagttcaaaaggtacaaatt

SEQ ID NO: 58941 - DNA, 20 bp, Artificial Sequence
  Description of Artificial Sequence: Synthetic oligonucleotide
  Target: SCN9A; (-) strand; PAM type: YTN; PAM sequence: TTC
aattagagttcaaaaggtac

SEQ ID NO: 58942 - DNA, 20 bp, Artificial Sequence
  Description of Artificial Sequence: Synthetic oligonucleotide
  Target: SCN9A; (-) strand; PAM type: YTN; PAM sequence: CTA
aaaataaattcaattagagt

SEQ ID NO: 58943 - DNA, 20 bp, Artificial Sequence
  Description of Artificial Sequence: Synthetic oligonucleotide
  Target: SCN9A; (-) strand; PAM type: YTN; PAM sequence: TTG
aaagagaatcaactaaaaat

SEQ ID NO: 58944 - DNA, 20 bp, Artificial Sequence
  Description of Artificial Sequence: Synthetic oligonucleotide
  Target: SCN9A; (-) strand; PAM type: YTN; PAM sequence: TTC
atatattgaaagagaatcaa

SEQ ID NO: 58945 - DNA, 20 bp, Artificial Sequence
  Description of Artificial Sequence: Synthetic oligonucleotide
  Target: SCN9A; (-) strand; PAM type: YTN; PAM sequence: TTG
ttcatatattgaaagagaat

SEQ ID NO: 58946 - DNA, 20 bp, Artificial Sequence
  Description of Artificial Sequence: Synthetic oligonucleotide
  Target: SCN9A; (-) strand; PAM type: YTN; PAM sequence: CTT
gttcatatattgaaagagaa

SEQ ID NO: 58947 - DNA, 20 bp, Artificial Sequence
  Description of Artificial Sequence: Synthetic oligonucleotide
  Target: SCN9A; (-) strand; PAM type: YTN; PAM sequence: TTC
atataatgaaagaacttgtt

SEQ ID NO: 58948 - DNA, 20 bp, Artificial Sequence
  Description of Artificial Sequence: Synthetic oligonucleotide
  Target: SCN9A; (-) strand; PAM type: YTN; PAM sequence: CTT
catataatgaaagaacttgt

SEQ ID NO: 58949 - DNA, 20 bp, Artificial Sequence
  Description of Artificial Sequence: Synthetic oligonucleotide
  Target: SCN9A; (-) strand; PAM type: YTN; PAM sequence: TTC
ttcatataatgaaagaactt

SEQ ID NO: 58950 - DNA, 20 bp, Artificial Sequence
  Description of Artificial Sequence: Synthetic oligonucleotide
  Target: SCN9A; (-) strand; PAM type: YTN; PAM sequence: CTT
cttcatataatgaaagaact

SEQ ID NO: 58951 - DNA, 20 bp, Artificial Sequence
  Description of Artificial Sequence: Synthetic oligonucleotide
  Target: SCN9A; (-) strand; PAM type: YTN; PAM sequence: TTA
atataatgaccttcttcata

SEQ ID NO: 58952 - DNA, 20 bp, Artificial Sequence
  Description of Artificial Sequence: Synthetic oligonucleotide
  Target: SCN9A; (-) strand; PAM type: YTN; PAM sequence: CTT
aatataatgaccttcttcat

SEQ ID NO: 58953 - DNA, 20 bp, Artificial Sequence
  Description of Artificial Sequence: Synthetic oligonucleotide
  Target: SCN9A; (-) strand; PAM type: YTN; PAM sequence: TTA
gataagaaaacagagaggta

SEQ ID NO: 58954 - DNA, 20 bp, Artificial Sequence
  Description of Artificial Sequence: Synthetic oligonucleotide
  Target: SCN9A; (-) strand; PAM type: YTN; PAM sequence: TTG
gccaatgcaattagataaga

SEQ ID NO: 58955 - DNA, 20 bp, Artificial Sequence
  Description of Artificial Sequence: Synthetic oligonucleotide
  Target: SCN9A; (-) strand; PAM type: YTN; PAM sequence: TTG
ttggccaatgcaattagata

SEQ ID NO: 58956 - DNA, 20 bp, Artificial Sequence
  Description of Artificial Sequence: Synthetic oligonucleotide
  Target: SCN9A; (-) strand; PAM type: YTN; PAM sequence: TTA
gtgttgttggccaatgcaat

SEQ ID NO: 58957 - DNA, 20 bp, Artificial Sequence
  Description of Artificial Sequence: Synthetic oligonucleotide
  Target: SCN9A; (-) strand; PAM type: YTN; PAM sequence: TTT
agtgttgttggccaatgcaa

SEQ ID NO: 58958 - DNA, 20 bp, Artificial Sequence
  Description of Artificial Sequence: Synthetic oligonucleotide
  Target: SCN9A; (-) strand; PAM type: YTN; PAM sequence: TTT
tagtgttgttggccaatgca

SEQ ID NO: 58959 - DNA, 20 bp, Artificial Sequence
  Description of Artificial Sequence: Synthetic oligonucleotide
  Target: SCN9A; (-) strand; PAM type: YTN; PAM sequence: TTT
ttagtgttgttggccaatgc

SEQ ID NO: 58960 - DNA, 20 bp, Artificial Sequence
  Description of Artificial Sequence: Synthetic oligonucleotide
  Target: SCN9A; (-) strand; PAM type: YTN; PAM sequence: CTG
tttttagtgttgttggccaa

SEQ ID NO: 58961 - DNA, 20 bp, Artificial Sequence
  Description of Artificial Sequence: Synthetic oligonucleotide
  Target: SCN9A; (-) strand; PAM type: YTN; PAM sequence: CTG
tatcatccctgtttttagtg

SEQ ID NO: 58962 - DNA, 20 bp, Artificial Sequence
  Description of Artificial Sequence: Synthetic oligonucleotide
  Target: SCN9A; (-) strand; PAM type: YTN; PAM sequence: TTA
agtcaggaaaaaaaaaagag

SEQ ID NO: 58963 - DNA, 20 bp, Artificial Sequence
  Description of Artificial Sequence: Synthetic oligonucleotide
  Target: SCN9A; (-) strand; PAM type: YTN; PAM sequence: CTA
ttaagtcaggaaaaaaaaaa

SEQ ID NO: 58964 - DNA, 20 bp, Artificial Sequence
  Description of Artificial Sequence: Synthetic oligonucleotide
  Target: SCN9A; (-) strand; PAM type: YTN; PAM sequence: TTC
ctattaagtcaggaaaaaaa

SEQ ID NO: 58965 - DNA, 20 bp, Artificial Sequence
  Description of Artificial Sequence: Synthetic oligonucleotide
  Target: SCN9A; (-) strand; PAM type: YTN; PAM sequence: CTG
aaagcattcctattaagtca

SEQ ID NO: 58966 - DNA, 20 bp, Artificial Sequence
  Description of Artificial Sequence: Synthetic oligonucleotide
  Target: SCN9A; (-) strand; PAM type: YTN; PAM sequence: TTC
tgaaagcattcctattaagt

SEQ ID NO: 58967 - DNA, 20 bp, Artificial Sequence
  Description of Artificial Sequence: Synthetic oligonucleotide
  Target: SCN9A; (-) strand; PAM type: YTN; PAM sequence: CTA
acaaaaatgattctgaaagc

SEQ ID NO: 58968 - DNA, 20 bp, Artificial Sequence
  Description of Artificial Sequence: Synthetic oligonucleotide
  Target: SCN9A; (-) strand; PAM type: YTN; PAM sequence: TTC
acactaacaaaaatgattct

SEQ ID NO: 58969 - DNA, 20 bp, Artificial Sequence
  Description of Artificial Sequence: Synthetic oligonucleotide
  Target: SCN9A; (-) strand; PAM type: YTN; PAM sequence: TTT
cacactaacaaaaatgattc

SEQ ID NO: 58970 - DNA, 20 bp, Artificial Sequence
  Description of Artificial Sequence: Synthetic oligonucleotide
  Target: SCN9A; (-) strand; PAM type: YTN; PAM sequence: TTA
ggtgagaatttcacactaac

SEQ ID NO: 58971 - DNA, 20 bp, Artificial Sequence
  Description of Artificial Sequence: Synthetic oligonucleotide
  Target: SCN9A; (-) strand; PAM type: YTN; PAM sequence: TTT
aggtgagaatttcacactaa

SEQ ID NO: 58972 - DNA, 20 bp, Artificial Sequence
  Description of Artificial Sequence: Synthetic oligonucleotide
  Target: SCN9A; (-) strand; PAM type: YTN; PAM sequence: TTA
aaatttaggtgagaatttca

SEQ ID NO: 58973 - DNA, 20 bp, Artificial Sequence
  Description of Artificial Sequence: Synthetic oligonucleotide
  Target: SCN9A; (-) strand; PAM type: YTN; PAM sequence: TTG
atataagaaaatgtattaaa

SEQ ID NO: 58974 - DNA, 20 bp, Artificial Sequence
  Description of Artificial Sequence: Synthetic oligonucleotide
  Target: SCN9A; (-) strand; PAM type: YTN; PAM sequence: TTA
tcaccagaagtcataccaaa

SEQ ID NO: 58975 - DNA, 20 bp, Artificial Sequence
  Description of Artificial Sequence: Synthetic oligonucleotide
  Target: SCN9A; (-) strand; PAM type: YTN; PAM sequence: TTG
gaaaagcatattatcaccag

SEQ ID NO: 58976 - DNA, 20 bp, Artificial Sequence
  Description of Artificial Sequence: Synthetic oligonucleotide
  Target: SCN9A; (-) strand; PAM type: YTN; PAM sequence: TTT
ggaaaagcatattatcacca

SEQ ID NO: 58977 - DNA, 20 bp, Artificial Sequence
  Description of Artificial Sequence: Synthetic oligonucleotide
  Target: SCN9A; (-) strand; PAM type: YTN; PAM sequence: TTT
tggaaaagcatattatcacc

SEQ ID NO: 58978 - DNA, 20 bp, Artificial Sequence
  Description of Artificial Sequence: Synthetic oligonucleotide
  Target: SCN9A; (-) strand; PAM type: YTN; PAM sequence: TTA
aaatcaataattttggaaaa

SEQ ID NO: 58979 - DNA, 20 bp, Artificial Sequence
  Description of Artificial Sequence: Synthetic oligonucleotide
  Target: SCN9A; (-) strand; PAM type: YTN; PAM sequence: TTT
aaaatcaataattttggaaa

SEQ ID NO: 58980 - DNA, 20 bp, Artificial Sequence
  Description of Artificial Sequence: Synthetic oligonucleotide
  Target: SCN9A; (-) strand; PAM type: YTN; PAM sequence: TTG
agtgccacataacagagtaa

SEQ ID NO: 58981 - DNA, 20 bp, Artificial Sequence
  Description of Artificial Sequence: Synthetic oligonucleotide
  Target: SCN9A; (-) strand; PAM type: YTN; PAM sequence: TTA
gaatcataaaattgagtgcc

SEQ ID NO: 58982 - DNA, 20 bp, Artificial Sequence
  Description of Artificial Sequence: Synthetic oligonucleotide
  Target: SCN9A; (-) strand; PAM type: YTN; PAM sequence: CTT
agaatcataaaattgagtgc

SEQ ID NO: 58983 - DNA, 20 bp, Artificial Sequence
  Description of Artificial Sequence: Synthetic oligonucleotide
  Target: SCN9A; (-) strand; PAM type: YTN; PAM sequence: TTG
catgacttagaatcataaaa

SEQ ID NO: 58984 - DNA, 20 bp, Artificial Sequence
  Description of Artificial Sequence: Synthetic oligonucleotide
  Target: SCN9A; (-) strand; PAM type: YTN; PAM sequence: TTC
aaggttgcatgacttagaat

SEQ ID NO: 58985 - DNA, 20 bp, Artificial Sequence
  Description of Artificial Sequence: Synthetic oligonucleotide
  Target: SCN9A; (-) strand; PAM type: YTN; PAM sequence: CTG
aaaaggttcaaggttgcatg

SEQ ID NO: 58986 - DNA, 20 bp, Artificial Sequence
  Description of Artificial Sequence: Synthetic oligonucleotide
  Target: SCN9A; (-) strand; PAM type: YTN; PAM sequence: TTA
tcaatctgaaaaggttcaag

SEQ ID NO: 58987 - DNA, 20 bp, Artificial Sequence
  Description of Artificial Sequence: Synthetic oligonucleotide
  Target: SCN9A; (-) strand; PAM type: YTN; PAM sequence: TTA
atcaacaggttatcaatctg

SEQ ID NO: 58988 - DNA, 20 bp, Artificial Sequence
  Description of Artificial Sequence: Synthetic oligonucleotide
  Target: SCN9A; (-) strand; PAM type: YTN; PAM sequence: TTT
aatcaacaggttatcaatct

SEQ ID NO: 58989 - DNA, 20 bp, Artificial Sequence
  Description of Artificial Sequence: Synthetic oligonucleotide
  Target: SCN9A; (-) strand; PAM type: YTN; PAM sequence: CTA
caagtttaatcaacaggtta

SEQ ID NO: 58990 - DNA, 20 bp, Artificial Sequence
  Description of Artificial Sequence: Synthetic oligonucleotide
  Target: SCN9A; (-) strand; PAM type: YTN; PAM sequence: TTA
ctacaagtttaatcaacagg

SEQ ID NO: 58991 - DNA, 20 bp, Artificial Sequence
  Description of Artificial Sequence: Synthetic oligonucleotide
  Target: SCN9A; (-) strand; PAM type: YTN; PAM sequence: TTA
tagagattactacaagttta

SEQ ID NO: 58992 - DNA, 20 bp, Artificial Sequence
  Description of Artificial Sequence: Synthetic oligonucleotide
  Target: SCN9A; (-) strand; PAM type: YTN; PAM sequence: TTA
agagagagagattatagaga

SEQ ID NO: 58993 - DNA, 20 bp, Artificial Sequence
  Description of Artificial Sequence: Synthetic oligonucleotide
  Target: SCN9A; (-) strand; PAM type: YTN; PAM sequence: TTT
aagagagagagattatagag

SEQ ID NO: 58994 - DNA, 20 bp, Artificial Sequence
  Description of Artificial Sequence: Synthetic oligonucleotide
  Target: SCN9A; (-) strand; PAM type: YTN; PAM sequence: TTT
taagagagagagattataga

SEQ ID NO: 58995 - DNA, 20 bp, Artificial Sequence
  Description of Artificial Sequence: Synthetic oligonucleotide
  Target: SCN9A; (-) strand; PAM type: YTN; PAM sequence: CTT
ttaagagagagagattatag

SEQ ID NO: 58996 - DNA, 20 bp, Artificial Sequence
  Description of Artificial Sequence: Synthetic oligonucleotide
  Target: SCN9A; (-) strand; PAM type: YTN; PAM sequence: TTA
taaacttttaagagagagag

SEQ ID NO: 58997 - DNA, 20 bp, Artificial Sequence
  Description of Artificial Sequence: Synthetic oligonucleotide
  Target: SCN9A; (-) strand; PAM type: YTN; PAM sequence: TTA
gaattataaacttttaagag

SEQ ID NO: 58998 - DNA, 20 bp, Artificial Sequence
  Description of Artificial Sequence: Synthetic oligonucleotide
  Target: SCN9A; (-) strand; PAM type: YTN; PAM sequence: TTT
agaattataaacttttaaga

SEQ ID NO: 58999 - DNA, 20 bp, Artificial Sequence
  Description of Artificial Sequence: Synthetic oligonucleotide
  Target: SCN9A; (-) strand; PAM type: YTN; PAM sequence: TTT
tagaattataaacttttaag

SEQ ID NO: 59000 - DNA, 20 bp, Artificial Sequence
  Description of Artificial Sequence: Synthetic oligonucleotide
  Target: SCN9A; (-) strand; PAM type: YTN; PAM sequence: TTT
ttagaattataaacttttaa

SEQ ID NO: 59001 - DNA, 20 bp, Artificial Sequence
  Description of Artificial Sequence: Synthetic oligonucleotide
  Target: SCN9A; (-) strand; PAM type: YTN; PAM sequence: CTT
tttagaattataaactttta

SEQ ID NO: 59002 - DNA, 20 bp, Artificial Sequence
  Description of Artificial Sequence: Synthetic oligonucleotide
  Target: SCN9A; (-) strand; PAM type: YTN; PAM sequence: TTC
tttttagaattataaacttt

SEQ ID NO: 59003 - DNA, 20 bp, Artificial Sequence
  Description of Artificial Sequence: Synthetic oligonucleotide
  Target: SCN9A; (-) strand; PAM type: YTN; PAM sequence: TTT
ctttttagaattataaactt

SEQ ID NO: 59004 - DNA, 20 bp, Artificial Sequence
  Description of Artificial Sequence: Synthetic oligonucleotide
  Target: SCN9A; (-) strand; PAM type: YTN; PAM sequence: TTG
tatttctttttagaattata

SEQ ID NO: 59005 - DNA, 20 bp, Artificial Sequence
  Description of Artificial Sequence: Synthetic oligonucleotide
  Target: SCN9A; (-) strand; PAM type: YTN; PAM sequence: TTA
ggattgtatttctttttaga

SEQ ID NO: 59006 - DNA, 20 bp, Artificial Sequence
  Description of Artificial Sequence: Synthetic oligonucleotide
  Target: SCN9A; (-) strand; PAM type: YTN; PAM sequence: TTT
aggattgtatttctttttag

SEQ ID NO: 59007 - DNA, 20 bp, Artificial Sequence
  Description of Artificial Sequence: Synthetic oligonucleotide
  Target: SCN9A; (-) strand; PAM type: YTN; PAM sequence: TTT
taggattgtatttcttttta

SEQ ID NO: 59008 - DNA, 20 bp, Artificial Sequence
  Description of Artificial Sequence: Synthetic oligonucleotide
  Target: SCN9A; (-) strand; PAM type: YTN; PAM sequence: TTG
caaagtattttaggattgta

SEQ ID NO: 59009 - DNA, 20 bp, Artificial Sequence
  Description of Artificial Sequence: Synthetic oligonucleotide
  Target: SCN9A; (-) strand; PAM type: YTN; PAM sequence: CTT
gcaaagtattttaggattgt

SEQ ID NO: 59010 - DNA, 20 bp, Artificial Sequence
  Description of Artificial Sequence: Synthetic oligonucleotide
  Target: SCN9A; (-) strand; PAM type: YTN; PAM sequence: TTC
acatatcttgcaaagtattt

SEQ ID NO: 59011 - DNA, 20 bp, Artificial Sequence
  Description of Artificial Sequence: Synthetic oligonucleotide
  Target: SCN9A; (-) strand; PAM type: YTN; PAM sequence: TTT
cacatatcttgcaaagtatt

SEQ ID NO: 59012 - DNA, 20 bp, Artificial Sequence
  Description of Artificial Sequence: Synthetic oligonucleotide
  Target: SCN9A; (-) strand; PAM type: YTN; PAM sequence: TTT
tcacatatcttgcaaagtat

SEQ ID NO: 59013 - DNA, 20 bp, Artificial Sequence
  Description of Artificial Sequence: Synthetic oligonucleotide
  Target: SCN9A; (-) strand; PAM type: YTN; PAM sequence: TTA
ttttcacatatcttgcaaag

SEQ ID NO: 59014 - DNA, 20 bp, Artificial Sequence
  Description of Artificial Sequence: Synthetic oligonucleotide
  Target: SCN9A; (-) strand; PAM type: YTN; PAM sequence: TTG
ttattttcacatatcttgca

SEQ ID NO: 59015 - DNA, 20 bp, Artificial Sequence
  Description of Artificial Sequence: Synthetic oligonucleotide
  Target: SCN9A; (-) strand; PAM type: YTN; PAM sequence: TTG
ttgttattttcacatatctt

SEQ ID NO: 59016 - DNA, 20 bp, Artificial Sequence
  Description of Artificial Sequence: Synthetic oligonucleotide
  Target: SCN9A; (-) strand; PAM type: YTN; PAM sequence: TTG
ttgttgttattttcacatat

SEQ ID NO: 59017 - DNA, 20 bp, Artificial Sequence
  Description of Artificial Sequence: Synthetic oligonucleotide
  Target: SCN9A; (-) strand; PAM type: YTN; PAM sequence: TTG
ttgttgttgttattttcaca

SEQ ID NO: 59018 - DNA, 20 bp, Artificial Sequence
  Description of Artificial Sequence: Synthetic oligonucleotide
  Target: SCN9A; (-) strand; PAM type: YTN; PAM sequence: TTT
gttgttgttgttattttcac

SEQ ID NO: 59019 - DNA, 20 bp, Artificial Sequence
  Description of Artificial Sequence: Synthetic oligonucleotide
  Target: SCN9A; (-) strand; PAM type: YTN; PAM sequence: TTT
tgttgttgttgttattttca

SEQ ID NO: 59020 - DNA, 20 bp, Artificial Sequence
  Description of Artificial Sequence: Synthetic oligonucleotide
  Target: SCN9A; (-) strand; PAM type: YTN; PAM sequence: TTT
ttgttgttgttgttattttc

SEQ ID NO: 59021 - DNA, 20 bp, Artificial Sequence
  Description of Artificial Sequence: Synthetic oligonucleotide
  Target: SCN9A; (-) strand; PAM type: YTN; PAM sequence: TTG
tttttgttgttgttgttatt

SEQ ID NO: 59022 - DNA, 20 bp, Artificial Sequence
  Description of Artificial Sequence: Synthetic oligonucleotide
  Target: SCN9A; (-) strand; PAM type: YTN; PAM sequence: CTT
gtttttgttgttgttgttat

SEQ ID NO: 59023 - DNA, 20 bp, Artificial Sequence
  Description of Artificial Sequence: Synthetic oligonucleotide
  Target: SCN9A; (-) strand; PAM type: YTN; PAM sequence: TTC
ttgtttttgttgttgttgtt

SEQ ID NO: 59024 - DNA, 20 bp, Artificial Sequence
  Description of Artificial Sequence: Synthetic oligonucleotide
  Target: SCN9A; (-) strand; PAM type: YTN; PAM sequence: CTT
cttgtttttgttgttgttgt

SEQ ID NO: 59025 - DNA, 20 bp, Artificial Sequence
  Description of Artificial Sequence: Synthetic oligonucleotide
  Target: SCN9A; (-) strand; PAM type: YTN; PAM sequence: CTA
tcttcttgtttttgttgttg

SEQ ID NO: 59026 - DNA, 20 bp, Artificial Sequence
  Description of Artificial Sequence: Synthetic oligonucleotide
  Target: SCN9A; (-) strand; PAM type: YTN; PAM sequence: TTC
tatcttcttgtttttgttgt

SEQ ID NO: 59027 - DNA, 20 bp, Artificial Sequence
  Description of Artificial Sequence: Synthetic oligonucleotide
  Target: SCN9A; (-) strand; PAM type: YTN; PAM sequence: TTT
ctatcttcttgtttttgttg

SEQ ID NO: 59028 - DNA, 20 bp, Artificial Sequence
  Description of Artificial Sequence: Synthetic oligonucleotide
  Target: SCN9A; (-) strand; PAM type: YTN; PAM sequence: TTT
tctatcttcttgtttttgtt

SEQ ID NO: 59029 - DNA, 20 bp, Artificial Sequence
  Description of Artificial Sequence: Synthetic oligonucleotide
  Target: SCN9A; (-) strand; PAM type: YTN; PAM sequence: TTT
ttctatcttcttgtttttgt

SEQ ID NO: 59030 - DNA, 20 bp, Artificial Sequence
  Description of Artificial Sequence: Synthetic oligonucleotide
  Target: SCN9A; (-) strand; PAM type: YTN; PAM sequence: TTG
tttttctatcttcttgtttt

SEQ ID NO: 59031 - DNA, 20 bp, Artificial Sequence
  Description of Artificial Sequence: Synthetic oligonucleotide
  Target: SCN9A; (-) strand; PAM type: YTN; PAM sequence: TTG
ccatggttgtttttctatct

SEQ ID NO: 59032 - DNA, 20 bp, Artificial Sequence
  Description of Artificial Sequence: Synthetic oligonucleotide
  Target: SCN9A; (-) strand; PAM type: YTN; PAM sequence: TTC
attgccatggttgtttttct

SEQ ID NO: 59033 - DNA, 20 bp, Artificial Sequence
  Description of Artificial Sequence: Synthetic oligonucleotide
  Target: SCN9A; (-) strand; PAM type: YTN; PAM sequence: CTA
tacattcattgccatggttg

SEQ ID NO: 59034 - DNA, 20 bp, Artificial Sequence
  Description of Artificial Sequence: Synthetic oligonucleotide
  Target: SCN9A; (-) strand; PAM type: YTN; PAM sequence: TTC
ctatacattcattgccatgg

SEQ ID NO: 59035 - DNA, 20 bp, Artificial Sequence
  Description of Artificial Sequence: Synthetic oligonucleotide
  Target: SCN9A; (-) strand; PAM type: YTN; PAM sequence: CTT
cctatacattcattgccatg

SEQ ID NO: 59036 - DNA, 20 bp, Artificial Sequence
  Description of Artificial Sequence: Synthetic oligonucleotide
  Target: SCN9A; (-) strand; PAM type: YTN; PAM sequence: TTA
tacttcctatacattcattg

SEQ ID NO: 59037 - DNA, 20 bp, Artificial Sequence
  Description of Artificial Sequence: Synthetic oligonucleotide
  Target: SCN9A; (-) strand; PAM type: YTN; PAM sequence: TTT
atacttcctatacattcatt

SEQ ID NO: 59038 - DNA, 20 bp, Artificial Sequence
  Description of Artificial Sequence: Synthetic oligonucleotide
  Target: SCN9A; (-) strand; PAM type: YTN; PAM sequence: TTT
tatacttcctatacattcat

SEQ ID NO: 59039 - DNA, 20 bp, Artificial Sequence
  Description of Artificial Sequence: Synthetic oligonucleotide
  Target: SCN9A; (-) strand; PAM type: YTN; PAM sequence: CTG
tgaataacagcacatgattt

SEQ ID NO: 59040 - DNA, 20 bp, Artificial Sequence
  Description of Artificial Sequence: Synthetic oligonucleotide
  Target: SCN9A; (-) strand; PAM type: YTN; PAM sequence: TTC
atgtctgtgaataacagcac

SEQ ID NO: 59041 - DNA, 20 bp, Artificial Sequence
  Description of Artificial Sequence: Synthetic oligonucleotide
  Target: SCN9A; (-) strand; PAM type: YTN; PAM sequence: CTC
aaccagccatggtgttcatg

SEQ ID NO: 59042 - DNA, 20 bp, Artificial Sequence
  Description of Artificial Sequence: Synthetic oligonucleotide
  Target: SCN9A; (-) strand; PAM type: YTN; PAM sequence: TTC
ctcaaccagccatggtgttc

SEQ ID NO: 59043 - DNA, 20 bp, Artificial Sequence
  Description of Artificial Sequence: Synthetic oligonucleotide
  Target: SCN9A; (-) strand; PAM type: YTN; PAM sequence: TTC
acaagtgtataaaatgccaa

SEQ ID NO: 59044 - DNA, 20 bp, Artificial Sequence
  Description of Artificial Sequence: Synthetic oligonucleotide
  Target: SCN9A; (-) strand; PAM type: YTN; PAM sequence: CTT
cacaagtgtataaaatgcca

SEQ ID NO: 59045 - DNA, 20 bp, Artificial Sequence
  Description of Artificial Sequence: Synthetic oligonucleotide
  Target: SCN9A; (-) strand; PAM type: YTN; PAM sequence: TTA
atacttcacaagtgtataaa

SEQ ID NO: 59046 - DNA, 20 bp, Artificial Sequence
  Description of Artificial Sequence: Synthetic oligonucleotide
  Target: SCN9A; (-) strand; PAM type: YTN; PAM sequence: CTT
aatacttcacaagtgtataa

SEQ ID NO: 59047 - DNA, 20 bp, Artificial Sequence
  Description of Artificial Sequence: Synthetic oligonucleotide
  Target: SCN9A; (-) strand; PAM type: YTN; PAM sequence: TTA
cagcttaatacttcacaagt

SEQ ID NO: 59048 - DNA, 20 bp, Artificial Sequence
  Description of Artificial Sequence: Synthetic oligonucleotide
  Target: SCN9A; (-) strand; PAM type: YTN; PAM sequence: TTT
acagcttaatacttcacaag

SEQ ID NO: 59049 - DNA, 20 bp, Artificial Sequence
  Description of Artificial Sequence: Synthetic oligonucleotide
  Target: SCN9A; (-) strand; PAM type: YTN; PAM sequence: TTT
tacagcttaatacttcacaa

SEQ ID NO: 59050 - DNA, 20 bp, Artificial Sequence
  Description of Artificial Sequence: Synthetic oligonucleotide
  Target: SCN9A; (-) strand; PAM type: YTN; PAM sequence: TTT
ttacagcttaatacttcaca

SEQ ID NO: 59051 - DNA, 20 bp, Artificial Sequence
  Description of Artificial Sequence: Synthetic oligonucleotide
  Target: SCN9A; (-) strand; PAM type: YTN; PAM sequence: TTT
tttacagcttaatacttcac

SEQ ID NO: 59052 - DNA, 20 bp, Artificial Sequence
  Description of Artificial Sequence: Synthetic oligonucleotide
  Target: SCN9A; (-) strand; PAM type: YTN; PAM sequence: TTA
ttttttacagcttaatactt

SEQ ID NO: 59053 - DNA, 20 bp, Artificial Sequence
  Description of Artificial Sequence: Synthetic oligonucleotide
  Target: SCN9A; (-) strand; PAM type: YTN; PAM sequence: TTT
attttttacagcttaatact

SEQ ID NO: 59054 - DNA, 20 bp, Artificial Sequence
  Description of Artificial Sequence: Synthetic oligonucleotide
  Target: SCN9A; (-) strand; PAM type: YTN; PAM sequence: TTT
tattttttacagcttaatac

SEQ ID NO: 59055 - DNA, 20 bp, Artificial Sequence
  Description of Artificial Sequence: Synthetic oligonucleotide
  Target: SCN9A; (-) strand; PAM type: YTN; PAM sequence: CTA
gaaatgccagttttattttt

SEQ ID NO: 59056 - DNA, 20 bp, Artificial Sequence
  Description of Artificial Sequence: Synthetic oligonucleotide
  Target: SCN9A; (-) strand; PAM type: YTN; PAM sequence: CTC
tagaaatgccagttttattt

SEQ ID NO: 59057 - DNA, 20 bp, Artificial Sequence
  Description of Artificial Sequence: Synthetic oligonucleotide
  Target: SCN9A; (-) strand; PAM type: YTN; PAM sequence: TTA
agatctctagaaatgccagt

SEQ ID NO: 59058 - DNA, 20 bp, Artificial Sequence
  Description of Artificial Sequence: Synthetic oligonucleotide
  Target: SCN9A; (-) strand; PAM type: YTN; PAM sequence: TTA
aagtgaagttaagatctcta

SEQ ID NO: 59059 - DNA, 20 bp, Artificial Sequence
  Description of Artificial Sequence: Synthetic oligonucleotide
  Target: SCN9A; (-) strand; PAM type: YTN; PAM sequence: TTT
aaagtgaagttaagatctct

SEQ ID NO: 59060 - DNA, 20 bp, Artificial Sequence
  Description of Artificial Sequence: Synthetic oligonucleotide
  Target: SCN9A; (-) strand; PAM type: YTN; PAM sequence: TTC
cagaatttaaagtgaagtta

SEQ ID NO: 59061 - DNA, 20 bp, Artificial Sequence
  Description of Artificial Sequence: Synthetic oligonucleotide
  Target: SCN9A; (-) strand; PAM type: YTN; PAM sequence: CTT
ccagaatttaaagtgaagtt

SEQ ID NO: 59062 - DNA, 20 bp, Artificial Sequence
  Description of Artificial Sequence: Synthetic oligonucleotide
  Target: SCN9A; (-) strand; PAM type: YTN; PAM sequence: TTC
ttccagaatttaaagtgaag

SEQ ID NO: 59063 - DNA, 20 bp, Artificial Sequence
  Description of Artificial Sequence: Synthetic oligonucleotide
  Target: SCN9A; (-) strand; PAM type: YTN; PAM sequence: TTG
tgaaaattcttccagaattt

SEQ ID NO: 59064 - DNA, 20 bp, Artificial Sequence
  Description of Artificial Sequence: Synthetic oligonucleotide
  Target: SCN9A; (-) strand; PAM type: YTN; PAM sequence: TTT
gtgaaaattcttccagaatt

SEQ ID NO: 59065 - DNA, 20 bp, Artificial Sequence
  Description of Artificial Sequence: Synthetic oligonucleotide
  Target: SCN9A; (-) strand; PAM type: YTN; PAM sequence: CTG
tgaatttgtgaaaattcttc

SEQ ID NO: 59066 - DNA, 20 bp, Artificial Sequence
  Description of Artificial Sequence: Synthetic oligonucleotide
  Target: SCN9A; (-) strand; PAM type: YTN; PAM sequence: TTA
atagccagaatatctgtgaa

SEQ ID NO: 59067 - DNA, 20 bp, Artificial Sequence
  Description of Artificial Sequence: Synthetic oligonucleotide
  Target: SCN9A; (-) strand; PAM type: YTN; PAM sequence: TTA
atgataatattaatagccag

SEQ ID NO: 59068 - DNA, 20 bp, Artificial Sequence
  Description of Artificial Sequence: Synthetic oligonucleotide
  Target: SCN9A; (-) strand; PAM type: YTN; PAM sequence: TTG
attaatgataatattaatag

SEQ ID NO: 59069 - DNA, 20 bp, Artificial Sequence
  Description of Artificial Sequence: Synthetic oligonucleotide
  Target: SCN9A; (-) strand; PAM type: YTN; PAM sequence: TTT
gattaatgataatattaata

SEQ ID NO: 59070 - DNA, 20 bp, Artificial Sequence
  Description of Artificial Sequence: Synthetic oligonucleotide
  Target: SCN9A; (-) strand; PAM type: YTN; PAM sequence: TTG
tcatttgattaatgataata

SEQ ID NO: 59071 - DNA, 20 bp, Artificial Sequence
  Description of Artificial Sequence: Synthetic oligonucleotide
  Target: SCN9A; (-) strand; PAM type: YTN; PAM sequence: CTT
gtcatttgattaatgataat

SEQ ID NO: 59072 - DNA, 20 bp, Artificial Sequence
  Description of Artificial Sequence: Synthetic oligonucleotide
  Target: SCN9A; (-) strand; PAM type: YTN; PAM sequence: TTA
gcacatgtgagacttgtcat

SEQ ID NO: 59073 - DNA, 20 bp, Artificial Sequence
  Description of Artificial Sequence: Synthetic oligonucleotide
  Target: SCN9A; (-) strand; PAM type: YTN; PAM sequence: TTT
agcacatgtgagacttgtca

SEQ ID NO: 59074 - DNA, 20 bp, Artificial Sequence
  Description of Artificial Sequence: Synthetic oligonucleotide
  Target: SCN9A; (-) strand; PAM type: YTN; PAM sequence: TTT
tagcacatgtgagacttgtc

SEQ ID NO: 59075 - DNA, 20 bp, Artificial Sequence
  Description of Artificial Sequence: Synthetic oligonucleotide
  Target: SCN9A; (-) strand; PAM type: YTN; PAM sequence: CTG
gttttagcacatgtgagact

SEQ ID NO: 59076 - DNA, 20 bp, Artificial Sequence
  Description of Artificial Sequence: Synthetic oligonucleotide
  Target: SCN9A; (-) strand; PAM type: YTN; PAM sequence: TTC
tggttttagcacatgtgaga

SEQ ID NO: 59077 - DNA, 20 bp, Artificial Sequence
  Description of Artificial Sequence: Synthetic oligonucleotide
  Target: SCN9A; (-) strand; PAM type: YTN; PAM sequence: CTT
ctggttttagcacatgtgag

SEQ ID NO: 59078 - DNA, 20 bp, Artificial Sequence
  Description of Artificial Sequence: Synthetic oligonucleotide
  Target: SCN9A; (-) strand; PAM type: YTN; PAM sequence: CTG
aaataacttctggttttagc

SEQ ID NO: 59079 - DNA, 20 bp, Artificial Sequence
  Description of Artificial Sequence: Synthetic oligonucleotide
  Target: SCN9A; (-) strand; PAM type: YTN; PAM sequence: TTG
aatctgaaataacttctggt

SEQ ID NO: 59080 - DNA, 20 bp, Artificial Sequence
  Description of Artificial Sequence: Synthetic oligonucleotide
  Target: SCN9A; (-) strand; PAM type: YTN; PAM sequence: TTG
gaaaaccaatgttgaatctg

SEQ ID NO: 59081 - DNA, 20 bp, Artificial Sequence
  Description of Artificial Sequence: Synthetic oligonucleotide
  Target: SCN9A; (-) strand; PAM type: YTN; PAM sequence: CTT
ggaaaaccaatgttgaatct

SEQ ID NO: 59082 - DNA, 20 bp, Artificial Sequence
  Description of Artificial Sequence: Synthetic oligonucleotide
  Target: SCN9A; (-) strand; PAM type: YTN; PAM sequence: CTG
tgtcttggaaaaccaatgtt

SEQ ID NO: 59083 - DNA, 20 bp, Artificial Sequence
  Description of Artificial Sequence: Synthetic oligonucleotide
  Target: SCN9A; (-) strand; PAM type: YTN; PAM sequence: TTA
tatatagctgtgtcttggaa

SEQ ID NO: 59084 - DNA, 20 bp, Artificial Sequence
  Description of Artificial Sequence: Synthetic oligonucleotide
  Target: SCN9A; (-) strand; PAM type: YTN; PAM sequence: TTT
atatatagctgtgtcttgga

SEQ ID NO: 59085 - DNA, 20 bp, Artificial Sequence
  Description of Artificial Sequence: Synthetic oligonucleotide
  Target: SCN9A; (-) strand; PAM type: YTN; PAM sequence: TTA
ccatgtttatatatagctgt

SEQ ID NO: 59086 - DNA, 20 bp, Artificial Sequence
  Description of Artificial Sequence: Synthetic oligonucleotide
  Target: SCN9A; (-) strand; PAM type: YTN; PAM sequence: CTA
gttaccatgtttatatatag

SEQ ID NO: 59087 - DNA, 20 bp, Artificial Sequence
  Description of Artificial Sequence: Synthetic oligonucleotide
  Target: SCN9A; (-) strand; PAM type: YTN; PAM sequence: TTG
caaaactagttaccatgttt

SEQ ID NO: 59088 - DNA, 20 bp, Artificial Sequence
  Description of Artificial Sequence: Synthetic oligonucleotide
  Target: SCN9A; (-) strand; PAM type: YTN; PAM sequence: TTT
gcaaaactagttaccatgtt

SEQ ID NO: 59089 - DNA, 20 bp, Artificial Sequence
  Description of Artificial Sequence: Synthetic oligonucleotide
  Target: SCN9A; (-) strand; PAM type: YTN; PAM sequence: CTT
tgcaaaactagttaccatgt

SEQ ID NO: 59090 - DNA, 20 bp, Artificial Sequence
  Description of Artificial Sequence: Synthetic oligonucleotide
  Target: SCN9A; (-) strand; PAM type: YTN; PAM sequence: TTA
cctttgcaaaactagttacc

SEQ ID NO: 59091 - DNA, 20 bp, Artificial Sequence
  Description of Artificial Sequence: Synthetic oligonucleotide
  Target: SCN9A; (-) strand; PAM type: YTN; PAM sequence: TTC
caatattacctttgcaaaac

SEQ ID NO: 59092 - DNA, 20 bp, Artificial Sequence
  Description of Artificial Sequence: Synthetic oligonucleotide
  Target: SCN9A; (-) strand; PAM type: YTN; PAM sequence: TTT
ccaatattacctttgcaaaa

SEQ ID NO: 59093 - DNA, 20 bp, Artificial Sequence
  Description of Artificial Sequence: Synthetic oligonucleotide
  Target: SCN9A; (-) strand; PAM type: YTN; PAM sequence: TTA
gtttccaatattacctttgc

SEQ ID NO: 59094 - DNA, 20 bp, Artificial Sequence
  Description of Artificial Sequence: Synthetic oligonucleotide
  Target: SCN9A; (-) strand; PAM type: YTN; PAM sequence: TTT
agtttccaatattacctttg

SEQ ID NO: 59095 - DNA, 20 bp, Artificial Sequence
  Description of Artificial Sequence: Synthetic oligonucleotide
  Target: SCN9A; (-) strand; PAM type: YTN; PAM sequence: TTG
atatttagtttccaatatta

SEQ ID NO: 59096 - DNA, 20 bp, Artificial Sequence
  Description of Artificial Sequence: Synthetic oligonucleotide
  Target: SCN9A; (-) strand; PAM type: YTN; PAM sequence: TTG
ttgatatttagtttccaata

SEQ ID NO: 59097 - DNA, 20 bp, Artificial Sequence
  Description of Artificial Sequence: Synthetic oligonucleotide
  Target: SCN9A; (-) strand; PAM type: YTN; PAM sequence: CTT
gttgatatttagtttccaat

SEQ ID NO: 59098 - DNA, 20 bp, Artificial Sequence
  Description of Artificial Sequence: Synthetic oligonucleotide
  Target: SCN9A; (-) strand; PAM type: YTN; PAM sequence: TTA
tacttgttgatatttagttt

SEQ ID NO: 59099 - DNA, 20 bp, Artificial Sequence
  Description of Artificial Sequence: Synthetic oligonucleotide
  Target: SCN9A; (-) strand; PAM type: YTN; PAM sequence: TTA
gaaggaaattatacttgttg

SEQ ID NO: 59100 - DNA, 20 bp, Artificial Sequence
  Description of Artificial Sequence: Synthetic oligonucleotide
  Target: SCN9A; (-) strand; PAM type: YTN; PAM sequence: CTA
ttagaaggaaattatacttg

SEQ ID NO: 59101 - DNA, 20 bp, Artificial Sequence
  Description of Artificial Sequence: Synthetic oligonucleotide
  Target: SCN9A; (-) strand; PAM type: YTN; PAM sequence: CTA
tctattagaaggaaattata

SEQ ID NO: 59102 - DNA, 20 bp, Artificial Sequence
  Description of Artificial Sequence: Synthetic oligonucleotide
  Target: SCN9A; (-) strand; PAM type: YTN; PAM sequence: TTC
tatctattagaaggaaatta

SEQ ID NO: 59103 - DNA, 20 bp, Artificial Sequence
  Description of Artificial Sequence: Synthetic oligonucleotide
  Target: SCN9A; (-) strand; PAM type: YTN; PAM sequence: TTT
ctatctattagaaggaaatt

SEQ ID NO: 59104 - DNA, 20 bp, Artificial Sequence
  Description of Artificial Sequence: Synthetic oligonucleotide
  Target: SCN9A; (-) strand; PAM type: YTN; PAM sequence: CTA
caggccccaaagccaaatat

SEQ ID NO: 59105 - DNA, 20 bp, Artificial Sequence
  Description of Artificial Sequence: Synthetic oligonucleotide
  Target: SCN9A; (-) strand; PAM type: YTN; PAM sequence: TTA
cactacaggccccaaagcca

SEQ ID NO: 59106 - DNA, 20 bp, Artificial Sequence
  Description of Artificial Sequence: Synthetic oligonucleotide
  Target: SCN9A; (-) strand; PAM type: YTN; PAM sequence: TTT
acactacaggccccaaagcc

SEQ ID NO: 59107 - DNA, 20 bp, Artificial Sequence
  Description of Artificial Sequence: Synthetic oligonucleotide
  Target: SCN9A; (-) strand; PAM type: YTN; PAM sequence: CTG
ggtttacactacaggcccca

SEQ ID NO: 59108 - DNA, 20 bp, Artificial Sequence
  Description of Artificial Sequence: Synthetic oligonucleotide
  Target: SCN9A; (-) strand; PAM type: YTN; PAM sequence: TTC
tgggtttacactacaggccc

SEQ ID NO: 59109 - DNA, 20 bp, Artificial Sequence
  Description of Artificial Sequence: Synthetic oligonucleotide
  Target: SCN9A; (-) strand; PAM type: YTN; PAM sequence: TTT
ctgggtttacactacaggcc

SEQ ID NO: 59110 - DNA, 20 bp, Artificial Sequence
  Description of Artificial Sequence: Synthetic oligonucleotide
  Target: SCN9A; (-) strand; PAM type: YTN; PAM sequence: CTA
cagtgtttctgggtttacac

SEQ ID NO: 59111 - DNA, 20 bp, Artificial Sequence
  Description of Artificial Sequence: Synthetic oligonucleotide
  Target: SCN9A; (-) strand; PAM type: YTN; PAM sequence: CTC
atactacagtgtttctgggt

SEQ ID NO: 59112 - DNA, 20 bp, Artificial Sequence
  Description of Artificial Sequence: Synthetic oligonucleotide
  Target: SCN9A; (-) strand; PAM type: YTN; PAM sequence: CTC
tcatactacagtgtttctgg

SEQ ID NO: 59113 - DNA, 20 bp, Artificial Sequence
  Description of Artificial Sequence: Synthetic oligonucleotide
  Target: SCN9A; (-) strand; PAM type: YTN; PAM sequence: CTG
tctctcatactacagtgttt

SEQ ID NO: 59114 - DNA, 20 bp, Artificial Sequence
  Description of Artificial Sequence: Synthetic oligonucleotide
  Target: SCN9A; (-) strand; PAM type: YTN; PAM sequence: CTA
aaaagcaaaacaaatatctg

SEQ ID NO: 59115 - DNA, 20 bp, Artificial Sequence
  Description of Artificial Sequence: Synthetic oligonucleotide
  Target: SCN9A; (-) strand; PAM type: YTN; PAM sequence: TTG
agtaagtcagtacaatgaaa

SEQ ID NO: 59116 - DNA, 20 bp, Artificial Sequence
  Description of Artificial Sequence: Synthetic oligonucleotide
  Target: SCN9A; (-) strand; PAM type: YTN; PAM sequence: CTT
gagtaagtcagtacaatgaa

SEQ ID NO: 59117 - DNA, 20 bp, Artificial Sequence
  Description of Artificial Sequence: Synthetic oligonucleotide
  Target: SCN9A; (-) strand; PAM type: YTN; PAM sequence: CTC
ttgagtaagtcagtacaatg

SEQ ID NO: 59118 - DNA, 20 bp, Artificial Sequence
  Description of Artificial Sequence: Synthetic oligonucleotide
  Target: SCN9A; (-) strand; PAM type: YTN; PAM sequence: TTA
ctcttgagtaagtcagtaca

SEQ ID NO: 59119 - DNA, 20 bp, Artificial Sequence
  Description of Artificial Sequence: Synthetic oligonucleotide
  Target: SCN9A; (-) strand; PAM type: YTN; PAM sequence: TTT
actcttgagtaagtcagtac

SEQ ID NO: 59120 - DNA, 20 bp, Artificial Sequence
  Description of Artificial Sequence: Synthetic oligonucleotide
  Target: SCN9A; (-) strand; PAM type: YTN; PAM sequence: TTG
aacacaaatttactcttgag

SEQ ID NO: 59121 - DNA, 20 bp, Artificial Sequence
  Description of Artificial Sequence: Synthetic oligonucleotide
  Target: SCN9A; (-) strand; PAM type: YTN; PAM sequence: CTT
gaacacaaatttactcttga

SEQ ID NO: 59122 - DNA, 20 bp, Artificial Sequence
  Description of Artificial Sequence: Synthetic oligonucleotide
  Target: SCN9A; (-) strand; PAM type: YTN; PAM sequence: TTC
ttgaacacaaatttactctt

SEQ ID NO: 59123 - DNA, 20 bp, Artificial Sequence
  Description of Artificial Sequence: Synthetic oligonucleotide
  Target: SCN9A; (-) strand; PAM type: YTN; PAM sequence: CTG
aattcttgaacacaaattta

SEQ ID NO: 59124 - DNA, 20 bp, Artificial Sequence
  Description of Artificial Sequence: Synthetic oligonucleotide
  Target: SCN9A; (-) strand; PAM type: YTN; PAM sequence: CTC
aaggaagtatatgctgaatt

SEQ ID NO: 59125 - DNA, 20 bp, Artificial Sequence
  Description of Artificial Sequence: Synthetic oligonucleotide
  Target: SCN9A; (-) strand; PAM type: YTN; PAM sequence: TTA
tgctcaaggaagtatatgct

SEQ ID NO: 59126 - DNA, 20 bp, Artificial Sequence
  Description of Artificial Sequence: Synthetic oligonucleotide
  Target: SCN9A; (-) strand; PAM type: YTN; PAM sequence: CTT
atgctcaaggaagtatatgc

SEQ ID NO: 59127 - DNA, 20 bp, Artificial Sequence
  Description of Artificial Sequence: Synthetic oligonucleotide
  Target: SCN9A; (-) strand; PAM type: YTN; PAM sequence: TTC
acttatgctcaaggaagtat

SEQ ID NO: 59128 - DNA, 20 bp, Artificial Sequence
  Description of Artificial Sequence: Synthetic oligonucleotide
  Target: SCN9A; (-) strand; PAM type: YTN; PAM sequence: CTT
cacttatgctcaaggaagta

SEQ ID NO: 59129 - DNA, 20 bp, Artificial Sequence
  Description of Artificial Sequence: Synthetic oligonucleotide
  Target: SCN9A; (-) strand; PAM type: YTN; PAM sequence: CTA
aacttcacttatgctcaagg

SEQ ID NO: 59130 - DNA, 20 bp, Artificial Sequence
  Description of Artificial Sequence: Synthetic oligonucleotide
  Target: SCN9A; (-) strand; PAM type: YTN; PAM sequence: TTG
agtaaagctaaacttcactt

SEQ ID NO: 59131 - DNA, 20 bp, Artificial Sequence
  Description of Artificial Sequence: Synthetic oligonucleotide
  Target: SCN9A; (-) strand; PAM type: YTN; PAM sequence: TTT
gagtaaagctaaacttcact

SEQ ID NO: 59132 - DNA, 20 bp, Artificial Sequence
  Description of Artificial Sequence: Synthetic oligonucleotide
  Target: SCN9A; (-) strand; PAM type: YTN; PAM sequence: TTT
tgagtaaagctaaacttcac

SEQ ID NO: 59133 - DNA, 20 bp, Artificial Sequence
  Description of Artificial Sequence: Synthetic oligonucleotide
  Target: SCN9A; (-) strand; PAM type: YTN; PAM sequence: TTT
ttgagtaaagctaaacttca

SEQ ID NO: 59134 - DNA, 20 bp, Artificial Sequence
  Description of Artificial Sequence: Synthetic oligonucleotide
  Target: SCN9A; (-) strand; PAM type: YTN; PAM sequence: TTT
tttgagtaaagctaaacttc

SEQ ID NO: 59135 - DNA, 20 bp, Artificial Sequence
  Description of Artificial Sequence: Synthetic oligonucleotide
  Target: SCN9A; (-) strand; PAM type: YTN; PAM sequence: TTA
ttttttgagtaaagctaaac

SEQ ID NO: 59136 - DNA, 20 bp, Artificial Sequence
  Description of Artificial Sequence: Synthetic oligonucleotide
  Target: SCN9A; (-) strand; PAM type: YTN; PAM sequence: TTT
attttttgagtaaagctaaa

SEQ ID NO: 59137 - DNA, 20 bp, Artificial Sequence
  Description of Artificial Sequence: Synthetic oligonucleotide
  Target: SCN9A; (-) strand; PAM type: YTN; PAM sequence: TTT
tattttttgagtaaagctaa

SEQ ID NO: 59138 - DNA, 20 bp, Artificial Sequence
  Description of Artificial Sequence: Synthetic oligonucleotide
  Target: SCN9A; (-) strand; PAM type: YTN; PAM sequence: TTC
agattttattttttgagtaa

SEQ ID NO: 59139 - DNA, 20 bp, Artificial Sequence
  Description of Artificial Sequence: Synthetic oligonucleotide
  Target: SCN9A; (-) strand; PAM type: YTN; PAM sequence: TTT
cagattttattttttgagta

SEQ ID NO: 59140 - DNA, 20 bp, Artificial Sequence
  Description of Artificial Sequence: Synthetic oligonucleotide
  Target: SCN9A; (-) strand; PAM type: YTN; PAM sequence: TTT
tcagattttattttttgagt

SEQ ID NO: 59141 - DNA, 20 bp, Artificial Sequence
  Description of Artificial Sequence: Synthetic oligonucleotide
  Target: SCN9A; (-) strand; PAM type: YTN; PAM sequence: TTT
ttcagattttattttttgag

SEQ ID NO: 59142 - DNA, 20 bp, Artificial Sequence
  Description of Artificial Sequence: Synthetic oligonucleotide
  Target: SCN9A; (-) strand; PAM type: YTN; PAM sequence: TTA
tttttcagattttatttttt

SEQ ID NO: 59143 - DNA, 20 bp, Artificial Sequence
  Description of Artificial Sequence: Synthetic oligonucleotide
  Target: SCN9A; (-) strand; PAM type: YTN; PAM sequence: TTT
atttttcagattttattttt

SEQ ID NO: 59144 - DNA, 20 bp, Artificial Sequence
  Description of Artificial Sequence: Synthetic oligonucleotide
  Target: SCN9A; (-) strand; PAM type: YTN; PAM sequence: TTG
taggtaagaatatttatttt

SEQ ID NO: 59145 - DNA, 20 bp, Artificial Sequence
  Description of Artificial Sequence: Synthetic oligonucleotide
  Target: SCN9A; (-) strand; PAM type: YTN; PAM sequence: CTC
cattgtaggtaagaatattt

SEQ ID NO: 59146 - DNA, 20 bp, Artificial Sequence
  Description of Artificial Sequence: Synthetic oligonucleotide
  Target: SCN9A; (-) strand; PAM type: YTN; PAM sequence: TTA
tctccattgtaggtaagaat

SEQ ID NO: 59147 - DNA, 20 bp, Artificial Sequence
  Description of Artificial Sequence: Synthetic oligonucleotide
  Target: SCN9A; (-) strand; PAM type: YTN; PAM sequence: TTG
tgattatctccattgtaggt

SEQ ID NO: 59148 - DNA, 20 bp, Artificial Sequence
  Description of Artificial Sequence: Synthetic oligonucleotide
  Target: SCN9A; (-) strand; PAM type: YTN; PAM sequence: TTG
tggttgtgattatctccatt

SEQ ID NO: 59149 - DNA, 20 bp, Artificial Sequence
  Description of Artificial Sequence: Synthetic oligonucleotide
  Target: SCN9A; (-) strand; PAM type: YTN; PAM sequence: TTT
gtggttgtgattatctccat

SEQ ID NO: 59150 - DNA, 20 bp, Artificial Sequence
  Description of Artificial Sequence: Synthetic oligonucleotide
  Target: SCN9A; (-) strand; PAM type: YTN; PAM sequence: TTT
tgtggttgtgattatctcca

SEQ ID NO: 59151 - DNA, 20 bp, Artificial Sequence
  Description of Artificial Sequence: Synthetic oligonucleotide
  Target: SCN9A; (-) strand; PAM type: YTN; PAM sequence: TTG
attttgtggttgtgattatc

SEQ ID NO: 59152 - DNA, 20 bp, Artificial Sequence
  Description of Artificial Sequence: Synthetic oligonucleotide
  Target: SCN9A; (-) strand; PAM type: YTN; PAM sequence: TTT
gattttgtggttgtgattat

SEQ ID NO: 59153 - DNA, 20 bp, Artificial Sequence
  Description of Artificial Sequence: Synthetic oligonucleotide
  Target: SCN9A; (-) strand; PAM type: YTN; PAM sequence: TTT
tgattttgtggttgtgatta

SEQ ID NO: 59154 - DNA, 20 bp, Artificial Sequence
  Description of Artificial Sequence: Synthetic oligonucleotide
  Target: SCN9A; (-) strand; PAM type: YTN; PAM sequence: TTT
ttgattttgtggttgtgatt

SEQ ID NO: 59155 - DNA, 20 bp, Artificial Sequence
  Description of Artificial Sequence: Synthetic oligonucleotide
  Target: SCN9A; (-) strand; PAM type: YTN; PAM sequence: CTG
taggatggaatatttttgat

SEQ ID NO: 59156 - DNA, 20 bp, Artificial Sequence
  Description of Artificial Sequence: Synthetic oligonucleotide
  Target: SCN9A; (-) strand; PAM type: YTN; PAM sequence: TTC
actgtaggatggaatatttt

SEQ ID NO: 59157 - DNA, 20 bp, Artificial Sequence
  Description of Artificial Sequence: Synthetic oligonucleotide
  Target: SCN9A; (-) strand; PAM type: YTN; PAM sequence: CTT
cactgtaggatggaatattt

SEQ ID NO: 59158 - DNA, 20 bp, Artificial Sequence
  Description of Artificial Sequence: Synthetic oligonucleotide
  Target: SCN9A; (-) strand; PAM type: YTN; PAM sequence: CTA
cttcactgtaggatggaata

SEQ ID NO: 59159 - DNA, 20 bp, Artificial Sequence
  Description of Artificial Sequence: Synthetic oligonucleotide
  Target: SCN9A; (-) strand; PAM type: YTN; PAM sequence: CTA
ctacttcactgtaggatgga

SEQ ID NO: 59160 - DNA, 20 bp, Artificial Sequence
  Description of Artificial Sequence: Synthetic oligonucleotide
  Target: SCN9A; (-) strand; PAM type: YTN; PAM sequence: CTC
agacactactacttcactgt

SEQ ID NO: 59161 - DNA, 20 bp, Artificial Sequence
  Description of Artificial Sequence: Synthetic oligonucleotide
  Target: SCN9A; (-) strand; PAM type: YTN; PAM sequence: CTC
cctcagacactactacttca

SEQ ID NO: 59162 - DNA, 20 bp, Artificial Sequence
  Description of Artificial Sequence: Synthetic oligonucleotide
  Target: SCN9A; (-) strand; PAM type: YTN; PAM sequence: CTG
atctccctcagacactacta

SEQ ID NO: 59163 - DNA, 20 bp, Artificial Sequence
  Description of Artificial Sequence: Synthetic oligonucleotide
  Target: SCN9A; (-) strand; PAM type: YTN; PAM sequence: CTA
aaactgatctccctcagaca

SEQ ID NO: 59164 - DNA, 20 bp, Artificial Sequence
  Description of Artificial Sequence: Synthetic oligonucleotide
  Target: SCN9A; (-) strand; PAM type: YTN; PAM sequence: CTG
gagaatgtgtgctaaaactg

SEQ ID NO: 59165 - DNA, 20 bp, Artificial Sequence
  Description of Artificial Sequence: Synthetic oligonucleotide
  Target: SCN9A; (-) strand; PAM type: YTN; PAM sequence: TTC
actggagaatgtgtgctaaa

SEQ ID NO: 59166 - DNA, 20 bp, Artificial Sequence
  Description of Artificial Sequence: Synthetic oligonucleotide
  Target: SCN9A; (-) strand; PAM type: YTN; PAM sequence: TTT
cactggagaatgtgtgctaa

SEQ ID NO: 59167 - DNA, 20 bp, Artificial Sequence
  Description of Artificial Sequence: Synthetic oligonucleotide
  Target: SCN9A; (-) strand; PAM type: YTN; PAM sequence: TTT
tcactggagaatgtgtgcta

SEQ ID NO: 59168 - DNA, 20 bp, Artificial Sequence
  Description of Artificial Sequence: Synthetic oligonucleotide
  Target: SCN9A; (-) strand; PAM type: YTN; PAM sequence: CTT
ttcactggagaatgtgtgct

SEQ ID NO: 59169 - DNA, 20 bp, Artificial Sequence
  Description of Artificial Sequence: Synthetic oligonucleotide
  Target: SCN9A; (-) strand; PAM type: YTN; PAM sequence: TTA
taatccttttcactggagaa

SEQ ID NO: 59170 - DNA, 20 bp, Artificial Sequence
  Description of Artificial Sequence: Synthetic oligonucleotide
  Target: SCN9A; (-) strand; PAM type: YTN; PAM sequence: TTT
ataatccttttcactggaga

SEQ ID NO: 59171 - DNA, 20 bp, Artificial Sequence
  Description of Artificial Sequence: Synthetic oligonucleotide
  Target: SCN9A; (-) strand; PAM type: YTN; PAM sequence: TTT
tataatccttttcactggag

SEQ ID NO: 59172 - DNA, 20 bp, Artificial Sequence
  Description of Artificial Sequence: Synthetic oligonucleotide
  Target: SCN9A; (-) strand; PAM type: YTN; PAM sequence: TTT
ttataatccttttcactgga

SEQ ID NO: 59173 - DNA, 20 bp, Artificial Sequence
  Description of Artificial Sequence: Synthetic oligonucleotide
  Target: SCN9A; (-) strand; PAM type: YTN; PAM sequence: TTG
gataaatgtggtttttataa

SEQ ID NO: 59174 - DNA, 20 bp, Artificial Sequence
  Description of Artificial Sequence: Synthetic oligonucleotide
  Target: SCN9A; (-) strand; PAM type: YTN; PAM sequence: TTA
tattggataaatgtggtttt

SEQ ID NO: 59175 - DNA, 20 bp, Artificial Sequence
  Description of Artificial Sequence: Synthetic oligonucleotide
  Target: SCN9A; (-) strand; PAM type: YTN; PAM sequence: TTT
atattggataaatgtggttt

SEQ ID NO: 59176 - DNA, 20 bp, Artificial Sequence
  Description of Artificial Sequence: Synthetic oligonucleotide
  Target: SCN9A; (-) strand; PAM type: YTN; PAM sequence: TTT
tatattggataaatgtggtt

SEQ ID NO: 59177 - DNA, 20 bp, Artificial Sequence
  Description of Artificial Sequence: Synthetic oligonucleotide
  Target: SCN9A; (-) strand; PAM type: YTN; PAM sequence: CTG
aagttttatattggataaat

SEQ ID NO: 59178 - DNA, 20 bp, Artificial Sequence
  Description of Artificial Sequence: Synthetic oligonucleotide
  Target: SCN9A; (-) strand; PAM type: YTN; PAM sequence: CTC
aacatggtaaccatgatggt

SEQ ID NO: 59179 - DNA, 20 bp, Artificial Sequence
  Description of Artificial Sequence: Synthetic oligonucleotide
  Target: SCN9A; (-) strand; PAM type: YTN; PAM sequence: CTG
tctcaacatggtaaccatga

SEQ ID NO: 59180 - DNA, 20 bp, Artificial Sequence
  Description of Artificial Sequence: Synthetic oligonucleotide
  Target: SCN9A; (-) strand; PAM type: YTN; PAM sequence: TTA
tctgtctcaacatggtaacc

SEQ ID NO: 59181 - DNA, 20 bp, Artificial Sequence
  Description of Artificial Sequence: Synthetic oligonucleotide
  Target: SCN9A; (-) strand; PAM type: YTN; PAM sequence: CTT
atctgtctcaacatggtaac

SEQ ID NO: 59182 - DNA, 20 bp, Artificial Sequence
  Description of Artificial Sequence: Synthetic oligonucleotide
  Target: SCN9A; (-) strand; PAM type: YTN; PAM sequence: TTC
ttatctgtctcaacatggta

SEQ ID NO: 59183 - DNA, 20 bp, Artificial Sequence
  Description of Artificial Sequence: Synthetic oligonucleotide
  Target: SCN9A; (-) strand; PAM type: YTN; PAM sequence: TTA
gtatcatggttcttatctgt

SEQ ID NO: 59184 - DNA, 20 bp, Artificial Sequence
  Description of Artificial Sequence: Synthetic oligonucleotide
  Target: SCN9A; (-) strand; PAM type: YTN; PAM sequence: TTG
atattagtatcatggttctt

SEQ ID NO: 59185 - DNA, 20 bp, Artificial Sequence
  Description of Artificial Sequence: Synthetic oligonucleotide
  Target: SCN9A; (-) strand; PAM type: YTN; PAM sequence: TTT
gatattagtatcatggttct

SEQ ID NO: 59186 - DNA, 20 bp, Artificial Sequence
  Description of Artificial Sequence: Synthetic oligonucleotide
  Target: SCN9A; (-) strand; PAM type: YTN; PAM sequence: CTT
tgatattagtatcatggttc

SEQ ID NO: 59187 - DNA, 20 bp, Artificial Sequence
  Description of Artificial Sequence: Synthetic oligonucleotide
  Target: SCN9A; (-) strand; PAM type: YTN; PAM sequence: CTA
gtgacaaatcaagcctttga

SEQ ID NO: 59188 - DNA, 20 bp, Artificial Sequence
  Description of Artificial Sequence: Synthetic oligonucleotide
  Target: SCN9A; (-) strand; PAM type: YTN; PAM sequence: TTG
acctagtgacaaatcaagcc

SEQ ID NO: 59189 - DNA, 20 bp, Artificial Sequence
  Description of Artificial Sequence: Synthetic oligonucleotide
  Target: SCN9A; (-) strand; PAM type: YTN; PAM sequence: TTT
gacctagtgacaaatcaagc

SEQ ID NO: 59190 - DNA, 20 bp, Artificial Sequence
  Description of Artificial Sequence: Synthetic oligonucleotide
  Target: SCN9A; (-) strand; PAM type: YTN; PAM sequence: TTG
cagaacaaaatccaaggatg

SEQ ID NO: 59191 - DNA, 20 bp, Artificial Sequence
  Description of Artificial Sequence: Synthetic oligonucleotide
  Target: SCN9A; (-) strand; PAM type: YTN; PAM sequence: TTT
gcagaacaaaatccaaggat

SEQ ID NO: 59192 - DNA, 20 bp, Artificial Sequence
  Description of Artificial Sequence: Synthetic oligonucleotide
  Target: SCN9A; (-) strand; PAM type: YTN; PAM sequence: CTT
tgcagaacaaaatccaagga

SEQ ID NO: 59193 - DNA, 20 bp, Artificial Sequence
  Description of Artificial Sequence: Synthetic oligonucleotide
  Target: SCN9A; (-) strand; PAM type: YTN; PAM sequence: TTC
tttgcagaacaaaatccaag

SEQ ID NO: 59194 - DNA, 20 bp, Artificial Sequence
  Description of Artificial Sequence: Synthetic oligonucleotide
  Target: SCN9A; (-) strand; PAM type: YTN; PAM sequence: TTT
ctttgcagaacaaaatccaa

SEQ ID NO: 59195 - DNA, 20 bp, Artificial Sequence
  Description of Artificial Sequence: Synthetic oligonucleotide
  Target: SCN9A; (-) strand; PAM type: YTN; PAM sequence: TTA
tttctttgcagaacaaaatc

SEQ ID NO: 59196 - DNA, 20 bp, Artificial Sequence
  Description of Artificial Sequence: Synthetic oligonucleotide
  Target: SCN9A; (-) strand; PAM type: YTN; PAM sequence: CTT
atttctttgcagaacaaaat

SEQ ID NO: 59197 - DNA, 20 bp, Artificial Sequence
  Description of Artificial Sequence: Synthetic oligonucleotide
  Target: SCN9A; (-) strand; PAM type: YTN; PAM sequence: TTC
ttatttctttgcagaacaaa

SEQ ID NO: 59198 - DNA, 20 bp, Artificial Sequence
  Description of Artificial Sequence: Synthetic oligonucleotide
  Target: SCN9A; (-) strand; PAM type: YTN; PAM sequence: TTA
ttcttatttctttgcagaac

SEQ ID NO: 59199 - DNA, 20 bp, Artificial Sequence
  Description of Artificial Sequence: Synthetic oligonucleotide
  Target: SCN9A; (-) strand; PAM type: YTN; PAM sequence: TTC
gatattattcttatttcttt

SEQ ID NO: 59200 - DNA, 20 bp, Artificial Sequence
  Description of Artificial Sequence: Synthetic oligonucleotide
  Target: SCN9A; (-) strand; PAM type: YTN; PAM sequence: CTG
cattcgatattattcttatt

SEQ ID NO: 59201 - DNA, 20 bp, Artificial Sequence
  Description of Artificial Sequence: Synthetic oligonucleotide
  Target: SCN9A; (-) strand; PAM type: YTN; PAM sequence: CTC
tgcattcgatattattctta

SEQ ID NO: 59202 - DNA, 20 bp, Artificial Sequence
  Description of Artificial Sequence: Synthetic oligonucleotide
  Target: SCN9A; (-) strand; PAM type: YTN; PAM sequence: TTA
ctctgcattcgatattattc

SEQ ID NO: 59203 - DNA, 20 bp, Artificial Sequence
  Description of Artificial Sequence: Synthetic oligonucleotide
  Target: SCN9A; (-) strand; PAM type: YTN; PAM sequence: TTT
actctgcattcgatattatt

SEQ ID NO: 59204 - DNA, 20 bp, Artificial Sequence
  Description of Artificial Sequence: Synthetic oligonucleotide
  Target: SCN9A; (-) strand; PAM type: YTN; PAM sequence: TTG
aaaagtttactctgcattcg

SEQ ID NO: 59205 - DNA, 20 bp, Artificial Sequence
  Description of Artificial Sequence: Synthetic oligonucleotide
  Target: SCN9A; (-) strand; PAM type: YTN; PAM sequence: CTT
gaaaagtttactctgcattc

SEQ ID NO: 59206 - DNA, 20 bp, Artificial Sequence
  Description of Artificial Sequence: Synthetic oligonucleotide
  Target: SCN9A; (-) strand; PAM type: YTN; PAM sequence: CTG
gataatacttgaaaagttta

SEQ ID NO: 59207 - DNA, 20 bp, Artificial Sequence
  Description of Artificial Sequence: Synthetic oligonucleotide
  Target: SCN9A; (-) strand; PAM type: YTN; PAM sequence: TTC
tggataatacttgaaaagtt

SEQ ID NO: 59208 - DNA, 20 bp, Artificial Sequence
  Description of Artificial Sequence: Synthetic oligonucleotide
  Target: SCN9A; (-) strand; PAM type: YTN; PAM sequence: TTT
ctggataatacttgaaaagt

SEQ ID NO: 59209 - DNA, 20 bp, Artificial Sequence
  Description of Artificial Sequence: Synthetic oligonucleotide
  Target: SCN9A; (-) strand; PAM type: YTN; PAM sequence: TTA
atttctggataatacttgaa

SEQ ID NO: 59210 - DNA, 20 bp, Artificial Sequence
  Description of Artificial Sequence: Synthetic oligonucleotide
  Target: SCN9A; (-) strand; PAM type: YTN; PAM sequence: TTT
aatttctggataatacttga

SEQ ID NO: 59211 - DNA, 20 bp, Artificial Sequence
  Description of Artificial Sequence: Synthetic oligonucleotide
  Target: SCN9A; (-) strand; PAM type: YTN; PAM sequence: CTT
taatttctggataatacttg

SEQ ID NO: 59212 - DNA, 20 bp, Artificial Sequence
  Description of Artificial Sequence: Synthetic oligonucleotide
  Target: SCN9A; (-) strand; PAM type: YTN; PAM sequence: TTA
atgcacatctttaatttctg

SEQ ID NO: 59213 - DNA, 20 bp, Artificial Sequence
  Description of Artificial Sequence: Synthetic oligonucleotide
  Target: SCN9A; (-) strand; PAM type: YTN; PAM sequence: TTT
aatgcacatctttaatttct

SEQ ID NO: 59214 - DNA, 20 bp, Artificial Sequence
  Description of Artificial Sequence: Synthetic oligonucleotide
  Target: SCN9A; (-) strand; PAM type: YTN; PAM sequence: TTT
taatgcacatctttaatttc

SEQ ID NO: 59215 - DNA, 20 bp, Artificial Sequence
  Description of Artificial Sequence: Synthetic oligonucleotide
  Target: SCN9A; (-) strand; PAM type: YTN; PAM sequence: TTT
ttaatgcacatctttaattt

SEQ ID NO: 59216 - DNA, 20 bp, Artificial Sequence
  Description of Artificial Sequence: Synthetic oligonucleotide
  Target: SCN9A; (-) strand; PAM type: YTN; PAM sequence: TTC
atttttaatgcacatcttta

SEQ ID NO: 59217 - DNA, 20 bp, Artificial Sequence
  Description of Artificial Sequence: Synthetic oligonucleotide
  Target: SCN9A; (-) strand; PAM type: YTN; PAM sequence: CTA
attcatttttaatgcacatc

SEQ ID NO: 59218 - DNA, 20 bp, Artificial Sequence
  Description of Artificial Sequence: Synthetic oligonucleotide
  Target: SCN9A; (-) strand; PAM type: YTN; PAM sequence: TTC
taattcatttttaatgcaca

SEQ ID NO: 59219 - DNA, 20 bp, Artificial Sequence
  Description of Artificial Sequence: Synthetic oligonucleotide
  Target: SCN9A; (-) strand; PAM type: YTN; PAM sequence: TTT
ctaattcatttttaatgcac

SEQ ID NO: 59220 - DNA, 20 bp, Artificial Sequence
  Description of Artificial Sequence: Synthetic oligonucleotide
  Target: SCN9A; (-) strand; PAM type: YTN; PAM sequence: TTA
tttctaattcatttttaatg

SEQ ID NO: 59221 - DNA, 20 bp, Artificial Sequence
  Description of Artificial Sequence: Synthetic oligonucleotide
  Target: SCN9A; (-) strand; PAM type: YTN; PAM sequence: TTC
aaattatttctaattcattt

SEQ ID NO: 59222 - DNA, 20 bp, Artificial Sequence
  Description of Artificial Sequence: Synthetic oligonucleotide
  Target: SCN9A; (-) strand; PAM type: YTN; PAM sequence: TTT
caaattatttctaattcatt

SEQ ID NO: 59223 - DNA, 20 bp, Artificial Sequence
  Description of Artificial Sequence: Synthetic oligonucleotide
  Target: SCN9A; (-) strand; PAM type: YTN; PAM sequence: TTT
tcaaattatttctaattcat

SEQ ID NO: 59224 - DNA, 20 bp, Artificial Sequence
  Description of Artificial Sequence: Synthetic oligonucleotide
  Target: SCN9A; (-) strand; PAM type: YTN; PAM sequence: TTA
gcatatagattttcaaatta

SEQ ID NO: 59225 - DNA, 20 bp, Artificial Sequence
  Description of Artificial Sequence: Synthetic oligonucleotide
  Target: SCN9A; (-) strand; PAM type: YTN; PAM sequence: TTT
agcatatagattttcaaatt

SEQ ID NO: 59226 - DNA, 20 bp, Artificial Sequence
  Description of Artificial Sequence: Synthetic oligonucleotide
  Target: SCN9A; (-) strand; PAM type: YTN; PAM sequence: CTT
tagcatatagattttcaaat

SEQ ID NO: 59227 - DNA, 20 bp, Artificial Sequence
  Description of Artificial Sequence: Synthetic oligonucleotide
  Target: SCN9A; (-) strand; PAM type: YTN; PAM sequence: CTC
gaccaggggtaaaaaaatat

SEQ ID NO: 59228 - DNA, 20 bp, Artificial Sequence
  Description of Artificial Sequence: Synthetic oligonucleotide
  Target: SCN9A; (-) strand; PAM type: YTN; PAM sequence: TTC
ctcgaccaggggtaaaaaaa

SEQ ID NO: 59229 - DNA, 20 bp, Artificial Sequence
  Description of Artificial Sequence: Synthetic oligonucleotide
  Target: SCN9A; (-) strand; PAM type: YTN; PAM sequence: CTG
gggtccaagaagccacaaaa

SEQ ID NO: 59230 - DNA, 20 bp, Artificial Sequence
  Description of Artificial Sequence: Synthetic oligonucleotide
  Target: SCN9A; (-) strand; PAM type: YTN; PAM sequence: CTA
taatgcaatgaaaaagctgg

SEQ ID NO: 59231 - DNA, 20 bp, Artificial Sequence
  Description of Artificial Sequence: Synthetic oligonucleotide
  Target: SCN9A; (-) strand; PAM type: YTN; PAM sequence: TTA
tgacagaagaacagaagaaa

SEQ ID NO: 59232 - DNA, 20 bp, Artificial Sequence
  Description of Artificial Sequence: Synthetic oligonucleotide
  Target: SCN9A; (-) strand; PAM type: YTN; PAM sequence: TTT
atgacagaagaacagaagaa

SEQ ID NO: 59233 - DNA, 20 bp, Artificial Sequence
  Description of Artificial Sequence: Synthetic oligonucleotide
  Target: SCN9A; (-) strand; PAM type: YTN; PAM sequence: CTT
tatgacagaagaacagaaga

SEQ ID NO: 59234 - DNA, 20 bp, Artificial Sequence
  Description of Artificial Sequence: Synthetic oligonucleotide
  Target: SCN9A; (-) strand; PAM type: YTN; PAM sequence: TTG
gaggtcaagacatctttatg

SEQ ID NO: 59235 - DNA, 20 bp, Artificial Sequence
  Description of Artificial Sequence: Synthetic oligonucleotide
  Target: SCN9A; (-) strand; PAM type: YTN; PAM sequence: CTT
ggaggtcaagacatctttat

SEQ ID NO: 59236 - DNA, 20 bp, Artificial Sequence
  Description of Artificial Sequence: Synthetic oligonucleotide
  Target: SCN9A; (-) strand; PAM type: YTN; PAM sequence: TTA
ccttggaggtcaagacatct

SEQ ID NO: 59237 - DNA, 20 bp, Artificial Sequence
  Description of Artificial Sequence: Synthetic oligonucleotide
  Target: SCN9A; (-) strand; PAM type: YTN; PAM sequence: TTT
accttggaggtcaagacatc

SEQ ID NO: 59238 - DNA, 20 bp, Artificial Sequence
  Description of Artificial Sequence: Synthetic oligonucleotide
  Target: SCN9A; (-) strand; PAM type: YTN; PAM sequence: CTT
taccttggaggtcaagacat

SEQ ID NO: 59239 - DNA, 20 bp, Artificial Sequence
  Description of Artificial Sequence: Synthetic oligonucleotide
  Target: SCN9A; (-) strand; PAM type: YTN; PAM sequence: TTC
tttaccttggaggtcaagac

SEQ ID NO: 59240 - DNA, 20 bp, Artificial Sequence
  Description of Artificial Sequence: Synthetic oligonucleotide
  Target: SCN9A; (-) strand; PAM type: YTN; PAM sequence: TTT
ctttaccttggaggtcaaga

SEQ ID NO: 59241 - DNA, 20 bp, Artificial Sequence
  Description of Artificial Sequence: Synthetic oligonucleotide
  Target: SCN9A; (-) strand; PAM type: YTN; PAM sequence: TTG
tttctttaccttggaggtca

SEQ ID NO: 59242 - DNA, 20 bp, Artificial Sequence
  Description of Artificial Sequence: Synthetic oligonucleotide
  Target: SCN9A; (-) strand; PAM type: YTN; PAM sequence: TTT
gtttctttaccttggaggtc

SEQ ID NO: 59243 - DNA, 20 bp, Artificial Sequence
  Description of Artificial Sequence: Synthetic oligonucleotide
  Target: SCN9A; (-) strand; PAM type: YTN; PAM sequence: TTG
tttgtttctttaccttggag

SEQ ID NO: 59244 - DNA, 20 bp, Artificial Sequence
  Description of Artificial Sequence: Synthetic oligonucleotide
  Target: SCN9A; (-) strand; PAM type: YTN; PAM sequence: TTT
gtttgtttctttaccttgga

SEQ ID NO: 59245 - DNA, 20 bp, Artificial Sequence
  Description of Artificial Sequence: Synthetic oligonucleotide
  Target: SCN9A; (-) strand; PAM type: YTN; PAM sequence: TTT
tgtttgtttctttaccttgg

SEQ ID NO: 59246 - DNA, 20 bp, Artificial Sequence
  Description of Artificial Sequence: Synthetic oligonucleotide
  Target: SCN9A; (-) strand; PAM type: YTN; PAM sequence: TTT
ttgtttgtttctttaccttg

SEQ ID NO: 59247 - DNA, 20 bp, Artificial Sequence
  Description of Artificial Sequence: Synthetic oligonucleotide
  Target: SCN9A; (-) strand; PAM type: YTN; PAM sequence: TTT
tttgtttgtttctttacctt

SEQ ID NO: 59248 - DNA, 20 bp, Artificial Sequence
  Description of Artificial Sequence: Synthetic oligonucleotide
  Target: SCN9A; (-) strand; PAM type: YTN; PAM sequence: TTA
ttttttgtttgtttctttac

SEQ ID NO: 59249 - DNA, 20 bp, Artificial Sequence
  Description of Artificial Sequence: Synthetic oligonucleotide
  Target: SCN9A; (-) strand; PAM type: YTN; PAM sequence: TTT
attttttgtttgtttcttta

SEQ ID NO: 59250 - DNA, 20 bp, Artificial Sequence
  Description of Artificial Sequence: Synthetic oligonucleotide
  Target: SCN9A; (-) strand; PAM type: YTN; PAM sequence: CTA
catttattttttgtttgttt

SEQ ID NO: 59251 - DNA, 20 bp, Artificial Sequence
  Description of Artificial Sequence: Synthetic oligonucleotide
  Target: SCN9A; (-) strand; PAM type: YTN; PAM sequence: TTA
actacatttattttttgttt

SEQ ID NO: 59252 - DNA, 20 bp, Artificial Sequence
  Description of Artificial Sequence: Synthetic oligonucleotide
  Target: SCN9A; (-) strand; PAM type: YTN; PAM sequence: TTT
aactacatttattttttgtt

SEQ ID NO: 59253 - DNA, 20 bp, Artificial Sequence
  Description of Artificial Sequence: Synthetic oligonucleotide
  Target: SCN9A; (-) strand; PAM type: YTN; PAM sequence: TTT
taactacatttattttttgt

SEQ ID NO: 59254 - DNA, 20 bp, Artificial Sequence
  Description of Artificial Sequence: Synthetic oligonucleotide
  Target: SCN9A; (-) strand; PAM type: YTN; PAM sequence: CTG
gttttaactacatttatttt

SEQ ID NO: 59255 - DNA, 20 bp, Artificial Sequence
  Description of Artificial Sequence: Synthetic oligonucleotide
  Target: SCN9A; (-) strand; PAM type: YTN; PAM sequence: TTC
tggttttaactacatttatt

SEQ ID NO: 59256 - DNA, 20 bp, Artificial Sequence
  Description of Artificial Sequence: Synthetic oligonucleotide
  Target: SCN9A; (-) strand; PAM type: YTN; PAM sequence: CTA
tagaaagatgtagacaatga

SEQ ID NO: 59257 - DNA, 20 bp, Artificial Sequence
  Description of Artificial Sequence: Synthetic oligonucleotide
  Target: SCN9A; (-) strand; PAM type: YTN; PAM sequence: TTA
gtaatctatagaaagatgta

SEQ ID NO: 59258 - DNA, 20 bp, Artificial Sequence
  Description of Artificial Sequence: Synthetic oligonucleotide
  Target: SCN9A; (-) strand; PAM type: YTN; PAM sequence: TTT
agtaatctatagaaagatgt

SEQ ID NO: 59259 - DNA, 20 bp, Artificial Sequence
  Description of Artificial Sequence: Synthetic oligonucleotide
  Target: SCN9A; (-) strand; PAM type: YTN; PAM sequence: TTT
tagtaatctatagaaagatg

SEQ ID NO: 59260 - DNA, 20 bp, Artificial Sequence
  Description of Artificial Sequence: Synthetic oligonucleotide
  Target: SCN9A; (-) strand; PAM type: YTN; PAM sequence: CTA
ttttagtaatctatagaaag

SEQ ID NO: 59261 - DNA, 20 bp, Artificial Sequence
  Description of Artificial Sequence: Synthetic oligonucleotide
  Target: SCN9A; (-) strand; PAM type: YTN; PAM sequence: TTA
acctattttagtaatctata

SEQ ID NO: 59262 - DNA, 20 bp, Artificial Sequence
  Description of Artificial Sequence: Synthetic oligonucleotide
  Target: SCN9A; (-) strand; PAM type: YTN; PAM sequence: TTT
aacctattttagtaatctat

SEQ ID NO: 59263 - DNA, 20 bp, Artificial Sequence
  Description of Artificial Sequence: Synthetic oligonucleotide
  Target: SCN9A; (-) strand; PAM type: YTN; PAM sequence: TTT
taacctattttagtaatcta

SEQ ID NO: 59264 - DNA, 20 bp, Artificial Sequence
  Description of Artificial Sequence: Synthetic oligonucleotide
  Target: SCN9A; (-) strand; PAM type: YTN; PAM sequence: TTA
acacattttaacctatttta

SEQ ID NO: 59265 - DNA, 20 bp, Artificial Sequence
  Description of Artificial Sequence: Synthetic oligonucleotide
  Target: SCN9A; (-) strand; PAM type: YTN; PAM sequence: CTA
tattaacacattttaaccta

SEQ ID NO: 59266 - DNA, 20 bp, Artificial Sequence
  Description of Artificial Sequence: Synthetic oligonucleotide
  Target: SCN9A; (-) strand; PAM type: YTN; PAM sequence: TTC
tatattaacacattttaacc

SEQ ID NO: 59267 - DNA, 20 bp, Artificial Sequence
  Description of Artificial Sequence: Synthetic oligonucleotide
  Target: SCN9A; (-) strand; PAM type: YTN; PAM sequence: TTT
ctatattaacacattttaac

SEQ ID NO: 59268 - DNA, 20 bp, Artificial Sequence
  Description of Artificial Sequence: Synthetic oligonucleotide
  Target: SCN9A; (-) strand; PAM type: YTN; PAM sequence: TTA
tttctatattaacacatttt

SEQ ID NO: 59269 - DNA, 20 bp, Artificial Sequence
  Description of Artificial Sequence: Synthetic oligonucleotide
  Target: SCN9A; (-) strand; PAM type: YTN; PAM sequence: TTT
atttctatattaacacattt

SEQ ID NO: 59270 - DNA, 20 bp, Artificial Sequence
  Description of Artificial Sequence: Synthetic oligonucleotide
  Target: SCN9A; (-) strand; PAM type: YTN; PAM sequence: TTT
tatttctatattaacacatt

SEQ ID NO: 59271 - DNA, 20 bp, Artificial Sequence
  Description of Artificial Sequence: Synthetic oligonucleotide
  Target: SCN9A; (-) strand; PAM type: YTN; PAM sequence: CTA
tcatgaacataataaaatac

SEQ ID NO: 59272 - DNA, 20 bp, Artificial Sequence
  Description of Artificial Sequence: Synthetic oligonucleotide
  Target: SCN9A; (-) strand; PAM type: YTN; PAM sequence: TTA
tgtatagctatcatgaacat

SEQ ID NO: 59273 - DNA, 20 bp, Artificial Sequence
  Description of Artificial Sequence: Synthetic oligonucleotide
  Target: SCN9A; (-) strand; PAM type: YTN; PAM sequence: TTT
atgtatagctatcatgaaca

SEQ ID NO: 59274 - DNA, 20 bp, Artificial Sequence
  Description of Artificial Sequence: Synthetic oligonucleotide
  Target: SCN9A; (-) strand; PAM type: YTN; PAM sequence: TTT
tatgtatagctatcatgaac

SEQ ID NO: 59275 - DNA, 20 bp, Artificial Sequence
  Description of Artificial Sequence: Synthetic oligonucleotide
  Target: SCN9A; (-) strand; PAM type: YTN; PAM sequence: TTA
agatatattttatgtatagc

SEQ ID NO: 59276 - DNA, 20 bp, Artificial Sequence
  Description of Artificial Sequence: Synthetic oligonucleotide
  Target: SCN9A; (-) strand; PAM type: YTN; PAM sequence: TTT
aagatatattttatgtatag

SEQ ID NO: 59277 - DNA, 20 bp, Artificial Sequence
  Description of Artificial Sequence: Synthetic oligonucleotide
  Target: SCN9A; (-) strand; PAM type: YTN; PAM sequence: TTA
tttaagatatattttatgta

SEQ ID NO: 59278 - DNA, 20 bp, Artificial Sequence
  Description of Artificial Sequence: Synthetic oligonucleotide
  Target: SCN9A; (-) strand; PAM type: YTN; PAM sequence: CTA
cacatatgtaattatttaag

SEQ ID NO: 59279 - DNA, 20 bp, Artificial Sequence
  Description of Artificial Sequence: Synthetic oligonucleotide
  Target: SCN9A; (-) strand; PAM type: YTN; PAM sequence: TTC
tacacatatgtaattattta

SEQ ID NO: 59280 - DNA, 20 bp, Artificial Sequence
  Description of Artificial Sequence: Synthetic oligonucleotide
  Target: SCN9A; (-) strand; PAM type: YTN; PAM sequence: TTT
ctacacatatgtaattattt

SEQ ID NO: 59281 - DNA, 20 bp, Artificial Sequence
  Description of Artificial Sequence: Synthetic oligonucleotide
  Target: SCN9A; (-) strand; PAM type: YTN; PAM sequence: TTG
gagacccatgtttctacaca

SEQ ID NO: 59282 - DNA, 20 bp, Artificial Sequence
  Description of Artificial Sequence: Synthetic oligonucleotide
  Target: SCN9A; (-) strand; PAM type: YTN; PAM sequence: TTT
ggagacccatgtttctacac

SEQ ID NO: 59283 - DNA, 20 bp, Artificial Sequence
  Description of Artificial Sequence: Synthetic oligonucleotide
  Target: SCN9A; (-) strand; PAM type: YTN; PAM sequence: CTG
tgtttggagacccatgtttc

SEQ ID NO: 59284 - DNA, 20 bp, Artificial Sequence
  Description of Artificial Sequence: Synthetic oligonucleotide
  Target: SCN9A; (-) strand; PAM type: YTN; PAM sequence: TTA
actgtgtttggagacccatg

SEQ ID NO: 59285 - DNA, 20 bp, Artificial Sequence
  Description of Artificial Sequence: Synthetic oligonucleotide
  Target: SCN9A; (-) strand; PAM type: YTN; PAM sequence: TTT
aactgtgtttggagacccat

SEQ ID NO: 59286 - DNA, 20 bp, Artificial Sequence
  Description of Artificial Sequence: Synthetic oligonucleotide
  Target: SCN9A; (-) strand; PAM type: YTN; PAM sequence: TTA
tatatgcacatttaactgtg

SEQ ID NO: 59287 - DNA, 20 bp, Artificial Sequence
  Description of Artificial Sequence: Synthetic oligonucleotide
  Target: SCN9A; (-) strand; PAM type: YTN; PAM sequence: TTT
atatatgcacatttaactgt

SEQ ID NO: 59288 - DNA, 20 bp, Artificial Sequence
  Description of Artificial Sequence: Synthetic oligonucleotide
  Target: SCN9A; (-) strand; PAM type: YTN; PAM sequence: TTA
tatgtaatacaaatatttat

SEQ ID NO: 59289 - DNA, 20 bp, Artificial Sequence
  Description of Artificial Sequence: Synthetic oligonucleotide
  Target: SCN9A; (-) strand; PAM type: YTN; PAM sequence: TTA
ttatatgtaatacaaatatt

SEQ ID NO: 59290 - DNA, 20 bp, Artificial Sequence
  Description of Artificial Sequence: Synthetic oligonucleotide
  Target: SCN9A; (-) strand; PAM type: YTN; PAM sequence: CTT
attatatgtaatacaaatat

SEQ ID NO: 59291 - DNA, 20 bp, Artificial Sequence
  Description of Artificial Sequence: Synthetic oligonucleotide
  Target: SCN9A; (-) strand; PAM type: YTN; PAM sequence: TTG
agccaatccttattatatgt

SEQ ID NO: 59292 - DNA, 20 bp, Artificial Sequence
  Description of Artificial Sequence: Synthetic oligonucleotide
  Target: SCN9A; (-) strand; PAM type: YTN; PAM sequence: TTA
gcacaccaaaagaatattga

SEQ ID NO: 59293 - DNA, 20 bp, Artificial Sequence
  Description of Artificial Sequence: Synthetic oligonucleotide
  Target: SCN9A; (-) strand; PAM type: YTN; PAM sequence: CTG
attagcacaccaaaagaata

SEQ ID NO: 59294 - DNA, 20 bp, Artificial Sequence
  Description of Artificial Sequence: Synthetic oligonucleotide
  Target: SCN9A; (-) strand; PAM type: YTN; PAM sequence: TTA
aaacaacactgattagcaca

SEQ ID NO: 59295 - DNA, 20 bp, Artificial Sequence
  Description of Artificial Sequence: Synthetic oligonucleotide
  Target: SCN9A; (-) strand; PAM type: YTN; PAM sequence: TTT
aaaacaacactgattagcac

SEQ ID NO: 59296 - DNA, 20 bp, Artificial Sequence
  Description of Artificial Sequence: Synthetic oligonucleotide
  Target: SCN9A; (-) strand; PAM type: YTN; PAM sequence: CTA
gcagataaaaaagataaaag

SEQ ID NO: 59297 - DNA, 20 bp, Artificial Sequence
  Description of Artificial Sequence: Synthetic oligonucleotide
  Target: SCN9A; (-) strand; PAM type: YTN; PAM sequence: TTA
gcaataaaagtcacagtaag

SEQ ID NO: 59298 - DNA, 20 bp, Artificial Sequence
  Description of Artificial Sequence: Synthetic oligonucleotide
  Target: SCN9A; (-) strand; PAM type: YTN; PAM sequence: CTT
agcaataaaagtcacagtaa

SEQ ID NO: 59299 - DNA, 20 bp, Artificial Sequence
  Description of Artificial Sequence: Synthetic oligonucleotide
  Target: SCN9A; (-) strand; PAM type: YTN; PAM sequence: TTC
ttagcaataaaagtcacagt

SEQ ID NO: 59300 - DNA, 20 bp, Artificial Sequence
  Description of Artificial Sequence: Synthetic oligonucleotide
  Target: SCN9A; (-) strand; PAM type: YTN; PAM sequence: TTT
cttagcaataaaagtcacag

SEQ ID NO: 59301 - DNA, 20 bp, Artificial Sequence
  Description of Artificial Sequence: Synthetic oligonucleotide
  Target: SCN9A; (-) strand; PAM type: YTN; PAM sequence: TTT
tcttagcaataaaagtcaca

SEQ ID NO: 59302 - DNA, 20 bp, Artificial Sequence
  Description of Artificial Sequence: Synthetic oligonucleotide
  Target: SCN9A; (-) strand; PAM type: YTN; PAM sequence: TTA
caaattttcttagcaataaa

SEQ ID NO: 59303 - DNA, 20 bp, Artificial Sequence
  Description of Artificial Sequence: Synthetic oligonucleotide
  Target: SCN9A; (-) strand; PAM type: YTN; PAM sequence: CTT
acaaattttcttagcaataa

SEQ ID NO: 59304 - DNA, 20 bp, Artificial Sequence
  Description of Artificial Sequence: Synthetic oligonucleotide
  Target: SCN9A; (-) strand; PAM type: YTN; PAM sequence: TTC
ttacaaattttcttagcaat

SEQ ID NO: 59305 - DNA, 20 bp, Artificial Sequence
  Description of Artificial Sequence: Synthetic oligonucleotide
  Target: SCN9A; (-) strand; PAM type: YTN; PAM sequence: TTA
attcttacaaattttcttag

SEQ ID NO: 59306 - DNA, 20 bp, Artificial Sequence
  Description of Artificial Sequence: Synthetic oligonucleotide
  Target: SCN9A; (-) strand; PAM type: YTN; PAM sequence: TTT
aattcttacaaattttctta

SEQ ID NO: 59307 - DNA, 20 bp, Artificial Sequence
  Description of Artificial Sequence: Synthetic oligonucleotide
  Target: SCN9A; (-) strand; PAM type: YTN; PAM sequence: TTT
taattcttacaaattttctt

SEQ ID NO: 59308 - DNA, 20 bp, Artificial Sequence
  Description of Artificial Sequence: Synthetic oligonucleotide
  Target: SCN9A; (-) strand; PAM type: YTN; PAM sequence: CTT
ttaattcttacaaattttct

SEQ ID NO: 59309 - DNA, 20 bp, Artificial Sequence
  Description of Artificial Sequence: Synthetic oligonucleotide
  Target: SCN9A; (-) strand; PAM type: YTN; PAM sequence: TTA
cttttaattcttacaaattt

SEQ ID NO: 59310 - DNA, 20 bp, Artificial Sequence
  Description of Artificial Sequence: Synthetic oligonucleotide
  Target: SCN9A; (-) strand; PAM type: YTN; PAM sequence: TTC
attacttttaattcttacaa

SEQ ID NO: 59311 - DNA, 20 bp, Artificial Sequence
  Description of Artificial Sequence: Synthetic oligonucleotide
  Target: SCN9A; (-) strand; PAM type: YTN; PAM sequence: TTG
ccaaatcatcaaagaagata

SEQ ID NO: 59312 - DNA, 20 bp, Artificial Sequence
  Description of Artificial Sequence: Synthetic oligonucleotide
  Target: SCN9A; (-) strand; PAM type: YTN; PAM sequence: TTT
gccaaatcatcaaagaagat

SEQ ID NO: 59313 - DNA, 20 bp, Artificial Sequence
  Description of Artificial Sequence: Synthetic oligonucleotide
  Target: SCN9A; (-) strand; PAM type: YTN; PAM sequence: CTA
aatatttgccaaatcatcaa

SEQ ID NO: 59314 - DNA, 20 bp, Artificial Sequence
  Description of Artificial Sequence: Synthetic oligonucleotide
  Target: SCN9A; (-) strand; PAM type: YTN; PAM sequence: TTC
taaatatttgccaaatcatc

SEQ ID NO: 59315 - DNA, 20 bp, Artificial Sequence
  Description of Artificial Sequence: Synthetic oligonucleotide
  Target: SCN9A; (-) strand; PAM type: YTN; PAM sequence: TTA
taaaagttctaaatatttgc

SEQ ID NO: 59316 - DNA, 20 bp, Artificial Sequence
  Description of Artificial Sequence: Synthetic oligonucleotide
  Target: SCN9A; (-) strand; PAM type: YTN; PAM sequence: TTT
ataaaagttctaaatatttg

SEQ ID NO: 59317 - DNA, 20 bp, Artificial Sequence
  Description of Artificial Sequence: Synthetic oligonucleotide
  Target: SCN9A; (-) strand; PAM type: YTN; PAM sequence: CTT
tataaaagttctaaatattt

SEQ ID NO: 59318 - DNA, 20 bp, Artificial Sequence
  Description of Artificial Sequence: Synthetic oligonucleotide
  Target: SCN9A; (-) strand; PAM type: YTN; PAM sequence: TTC
tttataaaagttctaaatat

SEQ ID NO: 59319 - DNA, 20 bp, Artificial Sequence
  Description of Artificial Sequence: Synthetic oligonucleotide
  Target: SCN9A; (-) strand; PAM type: YTN; PAM sequence: CTA
ttctttataaaagttctaaa

SEQ ID NO: 59320 - DNA, 20 bp, Artificial Sequence
  Description of Artificial Sequence: Synthetic oligonucleotide
  Target: SCN9A; (-) strand; PAM type: YTN; PAM sequence: CTC
cctattctttataaaagttc

SEQ ID NO: 59321 - DNA, 20 bp, Artificial Sequence
  Description of Artificial Sequence: Synthetic oligonucleotide
  Target: SCN9A; (-) strand; PAM type: YTN; PAM sequence: TTG
gctccctattctttataaaa

SEQ ID NO: 59322 - DNA, 20 bp, Artificial Sequence
  Description of Artificial Sequence: Synthetic oligonucleotide
  Target: SCN9A; (-) strand; PAM type: YTN; PAM sequence: TTT
ggctccctattctttataaa

SEQ ID NO: 59323 - DNA, 20 bp, Artificial Sequence
  Description of Artificial Sequence: Synthetic oligonucleotide
  Target: SCN9A; (-) strand; PAM type: YTN; PAM sequence: CTC
atgatttggctccctattct

SEQ ID NO: 59324 - DNA, 20 bp, Artificial Sequence
  Description of Artificial Sequence: Synthetic oligonucleotide
  Target: SCN9A; (-) strand; PAM type: YTN; PAM sequence: TTC
actcatgatttggctcccta

SEQ ID NO: 59325 - DNA, 20 bp, Artificial Sequence
  Description of Artificial Sequence: Synthetic oligonucleotide
  Target: SCN9A; (-) strand; PAM type: YTN; PAM sequence: TTG
tgaatgggagttcactcatg

SEQ ID NO: 59326 - DNA, 20 bp, Artificial Sequence
  Description of Artificial Sequence: Synthetic oligonucleotide
  Target: SCN9A; (-) strand; PAM type: YTN; PAM sequence: TTG
tagtaattgtgaatgggagt

SEQ ID NO: 59327 - DNA, 20 bp, Artificial Sequence
  Description of Artificial Sequence: Synthetic oligonucleotide
  Target: SCN9A; (-) strand; PAM type: YTN; PAM sequence: TTT
gtagtaattgtgaatgggag

SEQ ID NO: 59328 - DNA, 20 bp, Artificial Sequence
  Description of Artificial Sequence: Synthetic oligonucleotide
  Target: SCN9A; (-) strand; PAM type: YTN; PAM sequence: CTT
tgtagtaattgtgaatggga

SEQ ID NO: 59329 - DNA, 20 bp, Artificial Sequence
  Description of Artificial Sequence: Synthetic oligonucleotide
  Target: SCN9A; (-) strand; PAM type: YTN; PAM sequence: CTC
tttgtagtaattgtgaatgg

SEQ ID NO: 59330 - DNA, 20 bp, Artificial Sequence
  Description of Artificial Sequence: Synthetic oligonucleotide
  Target: SCN9A; (-) strand; PAM type: YTN; PAM sequence: TTC
tctttgtagtaattgtgaat

SEQ ID NO: 59331 - DNA, 20 bp, Artificial Sequence
  Description of Artificial Sequence: Synthetic oligonucleotide
  Target: SCN9A; (-) strand; PAM type: YTN; PAM sequence: TTA
ttctctttgtagtaattgtg

SEQ ID NO: 59332 - DNA, 20 bp, Artificial Sequence
  Description of Artificial Sequence: Synthetic oligonucleotide
  Target: SCN9A; (-) strand; PAM type: YTN; PAM sequence: TTT
attctctttgtagtaattgt

SEQ ID NO: 59333 - DNA, 20 bp, Artificial Sequence
  Description of Artificial Sequence: Synthetic oligonucleotide
  Target: SCN9A; (-) strand; PAM type: YTN; PAM sequence: TTT
tattctctttgtagtaattg

SEQ ID NO: 59334 - DNA, 20 bp, Artificial Sequence
  Description of Artificial Sequence: Synthetic oligonucleotide
  Target: SCN9A; (-) strand; PAM type: YTN; PAM sequence: CTA
ggtattttattctctttgta

SEQ ID NO: 59335 - DNA, 20 bp, Artificial Sequence
  Description of Artificial Sequence: Synthetic oligonucleotide
  Target: SCN9A; (-) strand; PAM type: YTN; PAM sequence: TTC
ctaggtattttattctcttt

SEQ ID NO: 59336 - DNA, 20 bp, Artificial Sequence
  Description of Artificial Sequence: Synthetic oligonucleotide
  Target: SCN9A; (-) strand; PAM type: YTN; PAM sequence: TTG
gattcctaggtattttattc

SEQ ID NO: 59337 - DNA, 20 bp, Artificial Sequence
  Description of Artificial Sequence: Synthetic oligonucleotide
  Target: SCN9A; (-) strand; PAM type: YTN; PAM sequence: TTG
taagttggattcctaggtat

SEQ ID NO: 59338 - DNA, 20 bp, Artificial Sequence
  Description of Artificial Sequence: Synthetic oligonucleotide
  Target: SCN9A; (-) strand; PAM type: YTN; PAM sequence: CTT
gtaagttggattcctaggta

SEQ ID NO: 59339 - DNA, 20 bp, Artificial Sequence
  Description of Artificial Sequence: Synthetic oligonucleotide
  Target: SCN9A; (-) strand; PAM type: YTN; PAM sequence: TTC
acatcccttgtaagttggat

SEQ ID NO: 59340 - DNA, 20 bp, Artificial Sequence
  Description of Artificial Sequence: Synthetic oligonucleotide
  Target: SCN9A; (-) strand; PAM type: YTN; PAM sequence: CTT
cacatcccttgtaagttgga

SEQ ID NO: 59341 - DNA, 20 bp, Artificial Sequence
  Description of Artificial Sequence: Synthetic oligonucleotide
  Target: SCN9A; (-) strand; PAM type: YTN; PAM sequence: TTG
aagaggtccttcacatccct

SEQ ID NO: 59342 - DNA, 20 bp, Artificial Sequence
  Description of Artificial Sequence: Synthetic oligonucleotide
  Target: SCN9A; (-) strand; PAM type: YTN; PAM sequence: CTT
gaagaggtccttcacatccc

SEQ ID NO: 59343 - DNA, 20 bp, Artificial Sequence
  Description of Artificial Sequence: Synthetic oligonucleotide
  Target: SCN9A; (-) strand; PAM type: YTN; PAM sequence: CTC
cttgaagaggtccttcacat

SEQ ID NO: 59344 - DNA, 20 bp, Artificial Sequence
  Description of Artificial Sequence: Synthetic oligonucleotide
  Target: SCN9A; (-) strand; PAM type: YTN; PAM sequence: TTC
tccttgaagaggtccttcac

SEQ ID NO: 59345 - DNA, 20 bp, Artificial Sequence
  Description of Artificial Sequence: Synthetic oligonucleotide
  Target: SCN9A; (-) strand; PAM type: YTN; PAM sequence: TTG
tagttctccttgaagaggtc

SEQ ID NO: 59346 - DNA, 20 bp, Artificial Sequence
  Description of Artificial Sequence: Synthetic oligonucleotide
  Target: SCN9A; (-) strand; PAM type: YTN; PAM sequence: TTT
gtagttctccttgaagaggt

SEQ ID NO: 59347 - DNA, 20 bp, Artificial Sequence
  Description of Artificial Sequence: Synthetic oligonucleotide
  Target: SCN9A; (-) strand; PAM type: YTN; PAM sequence: CTG
agcagtggtttgtagttctc

SEQ ID NO: 59348 - DNA, 20 bp, Artificial Sequence
  Description of Artificial Sequence: Synthetic oligonucleotide
  Target: SCN9A; (-) strand; PAM type: YTN; PAM sequence: TTC
gctgagcagtggtttgtagt

SEQ ID NO: 59349 - DNA, 20 bp, Artificial Sequence
  Description of Artificial Sequence: Synthetic oligonucleotide
  Target: SCN9A; (-) strand; PAM type: YTN; PAM sequence: TTT
cgctgagcagtggtttgtag

SEQ ID NO: 59350 - DNA, 20 bp, Artificial Sequence
  Description of Artificial Sequence: Synthetic oligonucleotide
  Target: SCN9A; (-) strand; PAM type: YTN; PAM sequence: TTA
tttcgctgagcagtggtttg

SEQ ID NO: 59351 - DNA, 20 bp, Artificial Sequence
  Description of Artificial Sequence: Synthetic oligonucleotide
  Target: SCN9A; (-) strand; PAM type: YTN; PAM sequence: TTT
atttcgctgagcagtggttt

SEQ ID NO: 59352 - DNA, 20 bp, Artificial Sequence
  Description of Artificial Sequence: Synthetic oligonucleotide
  Target: SCN9A; (-) strand; PAM type: YTN; PAM sequence: TTT
tatttcgctgagcagtggtt

SEQ ID NO: 59353 - DNA, 20 bp, Artificial Sequence
  Description of Artificial Sequence: Synthetic oligonucleotide
  Target: SCN9A; (-) strand; PAM type: YTN; PAM sequence: CTT
ttatttcgctgagcagtggt

SEQ ID NO: 59354 - DNA, 20 bp, Artificial Sequence
  Description of Artificial Sequence: Synthetic oligonucleotide
  Target: SCN9A; (-) strand; PAM type: YTN; PAM sequence: CTC
ttttatttcgctgagcagtg

SEQ ID NO: 59355 - DNA, 20 bp, Artificial Sequence
  Description of Artificial Sequence: Synthetic oligonucleotide
  Target: SCN9A; (-) strand; PAM type: YTN; PAM sequence: TTG
tgtcctcttttatttcgctg

SEQ ID NO: 59356 - DNA, 20 bp, Artificial Sequence
  Description of Artificial Sequence: Synthetic oligonucleotide
  Target: SCN9A; (-) strand; PAM type: YTN; PAM sequence: TTT
gtgtcctcttttatttcgct

SEQ ID NO: 59357 - DNA, 20 bp, Artificial Sequence
  Description of Artificial Sequence: Synthetic oligonucleotide
  Target: SCN9A; (-) strand; PAM type: YTN; PAM sequence: TTG
tttgtgtcctcttttatttc

SEQ ID NO: 59358 - DNA, 20 bp, Artificial Sequence
  Description of Artificial Sequence: Synthetic oligonucleotide
  Target: SCN9A; (-) strand; PAM type: YTN; PAM sequence: TTT
gtttgtgtcctcttttattt

SEQ ID NO: 59359 - DNA, 20 bp, Artificial Sequence
  Description of Artificial Sequence: Synthetic oligonucleotide
  Target: SCN9A; (-) strand; PAM type: YTN; PAM sequence: TTC
catttgtttgtgtcctcttt

SEQ ID NO: 59360 - DNA, 20 bp, Artificial Sequence
  Description of Artificial Sequence: Synthetic oligonucleotide
  Target: SCN9A; (-) strand; PAM type: YTN; PAM sequence: CTT
ccatttgtttgtgtcctctt

SEQ ID NO: 59361 - DNA, 20 bp, Artificial Sequence
  Description of Artificial Sequence: Synthetic oligonucleotide
  Target: SCN9A; (-) strand; PAM type: YTN; PAM sequence: TTC
ttccatttgtttgtgtcctc

SEQ ID NO: 59362 - DNA, 20 bp, Artificial Sequence
  Description of Artificial Sequence: Synthetic oligonucleotide
  Target: SCN9A; (-) strand; PAM type: YTN; PAM sequence: CTA
tccatgagcatggaatattc

SEQ ID NO: 59363 - DNA, 20 bp, Artificial Sequence
  Description of Artificial Sequence: Synthetic oligonucleotide
  Target: SCN9A; (-) strand; PAM type: YTN; PAM sequence: TTC
ctatccatgagcatggaata

SEQ ID NO: 59364 - DNA, 20 bp, Artificial Sequence
  Description of Artificial Sequence: Synthetic oligonucleotide
  Target: SCN9A; (-) strand; PAM type: YTN; PAM sequence: CTT
cctatccatgagcatggaat

SEQ ID NO: 59365 - DNA, 20 bp, Artificial Sequence
  Description of Artificial Sequence: Synthetic oligonucleotide
  Target: SCN9A; (-) strand; PAM type: YTN; PAM sequence: TTG
agtcttcctatccatgagca

SEQ ID NO: 59366 - DNA, 20 bp, Artificial Sequence
  Description of Artificial Sequence: Synthetic oligonucleotide
  Target: SCN9A; (-) strand; PAM type: YTN; PAM sequence: TTC
atgatattgagtcttcctat

SEQ ID NO: 59367 - DNA, 20 bp, Artificial Sequence
  Description of Artificial Sequence: Synthetic oligonucleotide
  Target: SCN9A; (-) strand; PAM type: YTN; PAM sequence: TTT
catgatattgagtcttccta

SEQ ID NO: 59368 - DNA, 20 bp, Artificial Sequence
  Description of Artificial Sequence: Synthetic oligonucleotide
  Target: SCN9A; (-) strand; PAM type: YTN; PAM sequence: TTT
tcatgatattgagtcttcct

SEQ ID NO: 59369 - DNA, 20 bp, Artificial Sequence
  Description of Artificial Sequence: Synthetic oligonucleotide
  Target: SCN9A; (-) strand; PAM type: YTN; PAM sequence: TTG
ggcagtaatgccattttcat

SEQ ID NO: 59370 - DNA, 20 bp, Artificial Sequence
  Description of Artificial Sequence: Synthetic oligonucleotide
  Target: SCN9A; (-) strand; PAM type: YTN; PAM sequence: CTT
gggcagtaatgccattttca

SEQ ID NO: 59371 - DNA, 20 bp, Artificial Sequence
  Description of Artificial Sequence: Synthetic oligonucleotide
  Target: SCN9A; (-) strand; PAM type: YTN; PAM sequence: TTA
ccttgggcagtaatgccatt

SEQ ID NO: 59372 - DNA, 20 bp, Artificial Sequence
  Description of Artificial Sequence: Synthetic oligonucleotide
  Target: SCN9A; (-) strand; PAM type: YTN; PAM sequence: TTA
taaattaccttgggcagtaa

SEQ ID NO: 59373 - DNA, 20 bp, Artificial Sequence
  Description of Artificial Sequence: Synthetic oligonucleotide
  Target: SCN9A; (-) strand; PAM type: YTN; PAM sequence: TTT
ataaattaccttgggcagta

SEQ ID NO: 59374 - DNA, 20 bp, Artificial Sequence
  Description of Artificial Sequence: Synthetic oligonucleotide
  Target: SCN9A; (-) strand; PAM type: YTN; PAM sequence: TTG
aatttataaattaccttggg

SEQ ID NO: 59375 - DNA, 20 bp, Artificial Sequence
  Description of Artificial Sequence: Synthetic oligonucleotide
  Target: SCN9A; (-) strand; PAM type: YTN; PAM sequence: TTG
atggggatagcattgaattt

SEQ ID NO: 59376 - DNA, 20 bp, Artificial Sequence
  Description of Artificial Sequence: Synthetic oligonucleotide
  Target: SCN9A; (-) strand; PAM type: YTN; PAM sequence: CTT
gatggggatagcattgaatt

SEQ ID NO: 59377 - DNA, 20 bp, Artificial Sequence
  Description of Artificial Sequence: Synthetic oligonucleotide
  Target: SCN9A; (-) strand; PAM type: YTN; PAM sequence: TTG
tgaagaaagtcagtggtagc

SEQ ID NO: 59378 - DNA, 20 bp, Artificial Sequence
  Description of Artificial Sequence: Synthetic oligonucleotide
  Target: SCN9A; (-) strand; PAM type: YTN; PAM sequence: TTT
gtgaagaaagtcagtggtag

SEQ ID NO: 59379 - DNA, 20 bp, Artificial Sequence
  Description of Artificial Sequence: Synthetic oligonucleotide
  Target: SCN9A; (-) strand; PAM type: YTN; PAM sequence: TTT
tgtgaagaaagtcagtggta

SEQ ID NO: 59380 - DNA, 20 bp, Artificial Sequence
  Description of Artificial Sequence: Synthetic oligonucleotide
  Target: SCN9A; (-) strand; PAM type: YTN; PAM sequence: TTC
caattttgtgaagaaagtca

SEQ ID NO: 59381 - DNA, 20 bp, Artificial Sequence
  Description of Artificial Sequence: Synthetic oligonucleotide
  Target: SCN9A; (-) strand; PAM type: YTN; PAM sequence: TTT
ccaattttgtgaagaaagtc

SEQ ID NO: 59382 - DNA, 20 bp, Artificial Sequence
  Description of Artificial Sequence: Synthetic oligonucleotide
  Target: SCN9A; (-) strand; PAM type: YTN; PAM sequence: TTT
tccaattttgtgaagaaagt

SEQ ID NO: 59383 - DNA, 20 bp, Artificial Sequence
  Description of Artificial Sequence: Synthetic oligonucleotide
  Target: SCN9A; (-) strand; PAM type: YTN; PAM sequence: TTT
ttccaattttgtgaagaaag

SEQ ID NO: 59384 - DNA, 20 bp, Artificial Sequence
  Description of Artificial Sequence: Synthetic oligonucleotide
  Target: SCN9A; (-) strand; PAM type: YTN; PAM sequence: TTT
tttccaattttgtgaagaaa

SEQ ID NO: 59385 - DNA, 20 bp, Artificial Sequence
  Description of Artificial Sequence: Synthetic oligonucleotide
  Target: SCN9A; (-) strand; PAM type: YTN; PAM sequence: TTT
ttttccaattttgtgaagaa

SEQ ID NO: 59386 - DNA, 20 bp, Artificial Sequence
  Description of Artificial Sequence: Synthetic oligonucleotide
  Target: SCN9A; (-) strand; PAM type: YTN; PAM sequence: TTA
aagtagtttttttccaattt

SEQ ID NO: 59387 - DNA, 20 bp, Artificial Sequence
  Description of Artificial Sequence: Synthetic oligonucleotide
  Target: SCN9A; (-) strand; PAM type: YTN; PAM sequence: TTT
aaagtagtttttttccaatt

SEQ ID NO: 59388 - DNA, 20 bp, Artificial Sequence
  Description of Artificial Sequence: Synthetic oligonucleotide
  Target: SCN9A; (-) strand; PAM type: YTN; PAM sequence: CTT
taaagtagtttttttccaat

SEQ ID NO: 59389 - DNA, 20 bp, Artificial Sequence
  Description of Artificial Sequence: Synthetic oligonucleotide
  Target: SCN9A; (-) strand; PAM type: YTN; PAM sequence: TTC
catatgaactttaaagtagt

SEQ ID NO: 59390 - DNA, 20 bp, Artificial Sequence
  Description of Artificial Sequence: Synthetic oligonucleotide
  Target: SCN9A; (-) strand; PAM type: YTN; PAM sequence: TTG
gttccatatgaactttaaag

SEQ ID NO: 59391 - DNA, 20 bp, Artificial Sequence
  Description of Artificial Sequence: Synthetic oligonucleotide
  Target: SCN9A; (-) strand; PAM type: YTN; PAM sequence: TTT
ggttccatatgaactttaaa

SEQ ID NO: 59392 - DNA, 20 bp, Artificial Sequence
  Description of Artificial Sequence: Synthetic oligonucleotide
  Target: SCN9A; (-) strand; PAM type: YTN; PAM sequence: TTT
tggttccatatgaactttaa

SEQ ID NO: 59393 - DNA, 20 bp, Artificial Sequence
  Description of Artificial Sequence: Synthetic oligonucleotide
  Target: SCN9A; (-) strand; PAM type: YTN; PAM sequence: TTT
ttggttccatatgaacttta

SEQ ID NO: 59394 - DNA, 20 bp, Artificial Sequence
  Description of Artificial Sequence: Synthetic oligonucleotide
  Target: SCN9A; (-) strand; PAM type: YTN; PAM sequence: TTT
tttggttccatatgaacttt

SEQ ID NO: 59395 - DNA, 20 bp, Artificial Sequence
  Description of Artificial Sequence: Synthetic oligonucleotide
  Target: SCN9A; (-) strand; PAM type: YTN; PAM sequence: CTT
ttttggttccatatgaactt

SEQ ID NO: 59396 - DNA, 20 bp, Artificial Sequence
  Description of Artificial Sequence: Synthetic oligonucleotide
  Target: SCN9A; (-) strand; PAM type: YTN; PAM sequence: CTC
ttttttggttccatatgaac

SEQ ID NO: 59397 - DNA, 20 bp, Artificial Sequence
  Description of Artificial Sequence: Synthetic oligonucleotide
  Target: SCN9A; (-) strand; PAM type: YTN; PAM sequence: CTA
tgcaggctcttttttggttc

SEQ ID NO: 59398 - DNA, 20 bp, Artificial Sequence
  Description of Artificial Sequence: Synthetic oligonucleotide
  Target: SCN9A; (-) strand; PAM type: YTN; PAM sequence: TTG
gctatgcaggctcttttttg

SEQ ID NO: 59399 - DNA, 20 bp, Artificial Sequence
  Description of Artificial Sequence: Synthetic oligonucleotide
  Target: SCN9A; (-) strand; PAM type: YTN; PAM sequence: CTT
ggctatgcaggctctttttt

SEQ ID NO: 59400 - DNA, 20 bp, Artificial Sequence
  Description of Artificial Sequence: Synthetic oligonucleotide
  Target: SCN9A; (-) strand; PAM type: YTN; PAM sequence: TTA
tcttggctatgcaggctctt

SEQ ID NO: 59401 - DNA, 20 bp, Artificial Sequence
  Description of Artificial Sequence: Synthetic oligonucleotide
  Target: SCN9A; (-) strand; PAM type: YTN; PAM sequence: TTA
ggattatcttggctatgcag

SEQ ID NO: 59402 - DNA, 20 bp, Artificial Sequence
  Description of Artificial Sequence: Synthetic oligonucleotide
  Target: SCN9A; (-) strand; PAM type: YTN; PAM sequence: CTT
aggattatcttggctatgca

SEQ ID NO: 59403 - DNA, 20 bp, Artificial Sequence
  Description of Artificial Sequence: Synthetic oligonucleotide
  Target: SCN9A; (-) strand; PAM type: YTN; PAM sequence: TTG
cttaggattatcttggctat

SEQ ID NO: 59404 - DNA, 20 bp, Artificial Sequence
  Description of Artificial Sequence: Synthetic oligonucleotide
  Target: SCN9A; (-) strand; PAM type: YTN; PAM sequence: TTT
gcttaggattatcttggcta

SEQ ID NO: 59405 - DNA, 20 bp, Artificial Sequence
  Description of Artificial Sequence: Synthetic oligonucleotide
  Target: SCN9A; (-) strand; PAM type: YTN; PAM sequence: TTT
tgcttaggattatcttggct

SEQ ID NO: 59406 - DNA, 20 bp, Artificial Sequence
  Description of Artificial Sequence: Synthetic oligonucleotide
  Target: SCN9A; (-) strand; PAM type: YTN; PAM sequence: TTT
ttgcttaggattatcttggc

SEQ ID NO: 59407 - DNA, 20 bp, Artificial Sequence
  Description of Artificial Sequence: Synthetic oligonucleotide
  Target: SCN9A; (-) strand; PAM type: YTN; PAM sequence: CTT
tttgcttaggattatcttgg

SEQ ID NO: 59408 - DNA, 20 bp, Artificial Sequence
  Description of Artificial Sequence: Synthetic oligonucleotide
  Target: SCN9A; (-) strand; PAM type: YTN; PAM sequence: TTC
tttttgcttaggattatctt

SEQ ID NO: 59409 - DNA, 20 bp, Artificial Sequence
  Description of Artificial Sequence: Synthetic oligonucleotide
  Target: SCN9A; (-) strand; PAM type: YTN; PAM sequence: TTG
ttctttttgcttaggattat

SEQ ID NO: 59410 - DNA, 20 bp, Artificial Sequence
  Description of Artificial Sequence: Synthetic oligonucleotide
  Target: SCN9A; (-) strand; PAM type: YTN; PAM sequence: TTT
gttctttttgcttaggatta

SEQ ID NO: 59411 - DNA, 20 bp, Artificial Sequence
  Description of Artificial Sequence: Synthetic oligonucleotide
  Target: SCN9A; (-) strand; PAM type: YTN; PAM sequence: CTT
tgttctttttgcttaggatt

SEQ ID NO: 59412 - DNA, 20 bp, Artificial Sequence
  Description of Artificial Sequence: Synthetic oligonucleotide
  Target: SCN9A; (-) strand; PAM type: YTN; PAM sequence: CTC
cagctttgttctttttgctt

SEQ ID NO: 59413 - DNA, 20 bp, Artificial Sequence
  Description of Artificial Sequence: Synthetic oligonucleotide
  Target: SCN9A; (-) strand; PAM type: YTN; PAM sequence: TTG
aagtcaggtagtgtgacgcc

SEQ ID NO: 59414 - DNA, 20 bp, Artificial Sequence
  Description of Artificial Sequence: Synthetic oligonucleotide
  Target: SCN9A; (-) strand; PAM type: YTN; PAM sequence: TTT
gaagtcaggtagtgtgacgc

SEQ ID NO: 59415 - DNA, 20 bp, Artificial Sequence
  Description of Artificial Sequence: Synthetic oligonucleotide
  Target: SCN9A; (-) strand; PAM type: YTN; PAM sequence: TTG
tagtatagtttgaagtcagg

SEQ ID NO: 59416 - DNA, 20 bp, Artificial Sequence
  Description of Artificial Sequence: Synthetic oligonucleotide
  Target: SCN9A; (-) strand; PAM type: YTN; PAM sequence: CTT
gtagtatagtttgaagtcag

SEQ ID NO: 59417 - DNA, 20 bp, Artificial Sequence
  Description of Artificial Sequence: Synthetic oligonucleotide
  Target: SCN9A; (-) strand; PAM type: YTN; PAM sequence: CTG
tagccttgtagtatagtttg

SEQ ID NO: 59418 - DNA, 20 bp, Artificial Sequence
  Description of Artificial Sequence: Synthetic oligonucleotide
  Target: SCN9A; (-) strand; PAM type: YTN; PAM sequence: TTA
ctgtagccttgtagtatagt

SEQ ID NO: 59419 - DNA, 20 bp, Artificial Sequence
  Description of Artificial Sequence: Synthetic oligonucleotide
  Target: SCN9A; (-) strand; PAM type: YTN; PAM sequence: TTG
gttactgtagccttgtagta

SEQ ID NO: 59420 - DNA, 20 bp, Artificial Sequence
  Description of Artificial Sequence: Synthetic oligonucleotide
  Target: SCN9A; (-) strand; PAM type: YTN; PAM sequence: TTT
ggttactgtagccttgtagt

SEQ ID NO: 59421 - DNA, 20 bp, Artificial Sequence
  Description of Artificial Sequence: Synthetic oligonucleotide
  Target: SCN9A; (-) strand; PAM type: YTN; PAM sequence: TTT
tggttactgtagccttgtag

SEQ ID NO: 59422 - DNA, 20 bp, Artificial Sequence
  Description of Artificial Sequence: Synthetic oligonucleotide
  Target: SCN9A; (-) strand; PAM type: YTN; PAM sequence: CTG
ttttggttactgtagccttg

SEQ ID NO: 59423 - DNA, 20 bp, Artificial Sequence
  Description of Artificial Sequence: Synthetic oligonucleotide
  Target: SCN9A; (-) strand; PAM type: YTN; PAM sequence: TTG
gtaccagtaccatgctgttt

SEQ ID NO: 59424 - DNA, 20 bp, Artificial Sequence
  Description of Artificial Sequence: Synthetic oligonucleotide
  Target: SCN9A; (-) strand; PAM type: YTN; PAM sequence: TTT
ggtaccagtaccatgctgtt

SEQ ID NO: 59425 - DNA, 20 bp, Artificial Sequence
  Description of Artificial Sequence: Synthetic oligonucleotide
  Target: SCN9A; (-) strand; PAM type: YTN; PAM sequence: TTT
tggtaccagtaccatgctgt

SEQ ID NO: 59426 - DNA, 20 bp, Artificial Sequence
  Description of Artificial Sequence: Synthetic oligonucleotide
  Target: SCN9A; (-) strand; PAM type: YTN; PAM sequence: CTG
ttttggtaccagtaccatgc

SEQ ID NO: 59427 - DNA, 20 bp, Artificial Sequence
  Description of Artificial Sequence: Synthetic oligonucleotide
  Target: SCN9A; (-) strand; PAM type: YTN; PAM sequence: TTG
gtgtatgtatctgttttggt

SEQ ID NO: 59428 - DNA, 20 bp, Artificial Sequence
  Description of Artificial Sequence: Synthetic oligonucleotide
  Target: SCN9A; (-) strand; PAM type: YTN; PAM sequence: CTG
ttggtgtatgtatctgtttt

SEQ ID NO: 59429 - DNA, 20 bp, Artificial Sequence
  Description of Artificial Sequence: Synthetic oligonucleotide
  Target: SCN9A; (-) strand; PAM type: YTN; PAM sequence: TTC
tgttggtgtatgtatctgtt

SEQ ID NO: 59430 - DNA, 20 bp, Artificial Sequence
  Description of Artificial Sequence: Synthetic oligonucleotide
  Target: SCN9A; (-) strand; PAM type: YTN; PAM sequence: CTG
ttctgttggtgtatgtatct

SEQ ID NO: 59431 - DNA, 20 bp, Artificial Sequence
  Description of Artificial Sequence: Synthetic oligonucleotide
  Target: SCN9A; (-) strand; PAM type: YTN; PAM sequence: TTC
tgttctgttggtgtatgtat

SEQ ID NO: 59432 - DNA, 20 bp, Artificial Sequence
  Description of Artificial Sequence: Synthetic oligonucleotide
  Target: SCN9A; (-) strand; PAM type: YTN; PAM sequence: CTG
ttctgttctgttggtgtatg

SEQ ID NO: 59433 - DNA, 20 bp, Artificial Sequence
  Description of Artificial Sequence: Synthetic oligonucleotide
  Target: SCN9A; (-) strand; PAM type: YTN; PAM sequence: CTC
tgttctgttctgttggtgta

SEQ ID NO: 59434 - DNA, 20 bp, Artificial Sequence
  Description of Artificial Sequence: Synthetic oligonucleotide
  Target: SCN9A; (-) strand; PAM type: YTN; PAM sequence: CTG
aggcctctgttctgttctgt

SEQ ID NO: 59435 - DNA, 20 bp, Artificial Sequence
  Description of Artificial Sequence: Synthetic oligonucleotide
  Target: SCN9A; (-) strand; PAM type: YTN; PAM sequence: TTC
tgaggcctctgttctgttct

SEQ ID NO: 59436 - DNA, 20 bp, Artificial Sequence
  Description of Artificial Sequence: Synthetic oligonucleotide
  Target: SCN9A; (-) strand; PAM type: YTN; PAM sequence: TTT
ctgaggcctctgttctgttc

SEQ ID NO: 59437 - DNA, 20 bp, Artificial Sequence
  Description of Artificial Sequence: Synthetic oligonucleotide
  Target: SCN9A; (-) strand; PAM type: YTN; PAM sequence: TTA
tttctgaggcctctgttctg

SEQ ID NO: 59438 - DNA, 20 bp, Artificial Sequence
  Description of Artificial Sequence: Synthetic oligonucleotide
  Target: SCN9A; (-) strand; PAM type: YTN; PAM sequence: TTG
tagatgtgtagtgttatttc

SEQ ID NO: 59439 - DNA, 20 bp, Artificial Sequence
  Description of Artificial Sequence: Synthetic oligonucleotide
  Target: SCN9A; (-) strand; PAM type: YTN; PAM sequence: TTG
tcaaggatcagatggttgta

SEQ ID NO: 59440 - DNA, 20 bp, Artificial Sequence
  Description of Artificial Sequence: Synthetic oligonucleotide
  Target: SCN9A; (-) strand; PAM type: YTN; PAM sequence: TTT
gtcaaggatcagatggttgt

SEQ ID NO: 59441 - DNA, 20 bp, Artificial Sequence
  Description of Artificial Sequence: Synthetic oligonucleotide
  Target: SCN9A; (-) strand; PAM type: YTN; PAM sequence: TTG
tgaggtttgtcaaggatcag

SEQ ID NO: 59442 - DNA, 20 bp, Artificial Sequence
  Description of Artificial Sequence: Synthetic oligonucleotide
  Target: SCN9A; (-) strand; PAM type: YTN; PAM sequence: TTT
gtgaggtttgtcaaggatca

SEQ ID NO: 59443 - DNA, 20 bp, Artificial Sequence
  Description of Artificial Sequence: Synthetic oligonucleotide
  Target: SCN9A; (-) strand; PAM type: YTN; PAM sequence: TTT
tgtgaggtttgtcaaggatc

SEQ ID NO: 59444 - DNA, 20 bp, Artificial Sequence
  Description of Artificial Sequence: Synthetic oligonucleotide
  Target: SCN9A; (-) strand; PAM type: YTN; PAM sequence: TTT
ttgtgaggtttgtcaaggat

SEQ ID NO: 59445 - DNA, 20 bp, Artificial Sequence
  Description of Artificial Sequence: Synthetic oligonucleotide
  Target: SCN9A; (-) strand; PAM type: YTN; PAM sequence: TTG
tttttgtgaggtttgtcaag

SEQ ID NO: 59446 - DNA, 20 bp, Artificial Sequence
  Description of Artificial Sequence: Synthetic oligonucleotide
  Target: SCN9A; (-) strand; PAM type: YTN; PAM sequence: CTT
gtttttgtgaggtttgtcaa

SEQ ID NO: 59447 - DNA, 20 bp, Artificial Sequence
  Description of Artificial Sequence: Synthetic oligonucleotide
  Target: SCN9A; (-) strand; PAM type: YTN; PAM sequence: TTG
cttgtttttgtgaggtttgt

SEQ ID NO: 59448 - DNA, 20 bp, Artificial Sequence
  Description of Artificial Sequence: Synthetic oligonucleotide
  Target: SCN9A; (-) strand; PAM type: YTN; PAM sequence: TTC
cccgttgcttgtttttgtga

SEQ ID NO: 59449 - DNA, 20 bp, Artificial Sequence
  Description of Artificial Sequence: Synthetic oligonucleotide
  Target: SCN9A; (-) strand; PAM type: YTN; PAM sequence: TTT
ccccgttgcttgtttttgtg

SEQ ID NO: 59450 - DNA, 20 bp, Artificial Sequence
  Description of Artificial Sequence: Synthetic oligonucleotide
  Target: SCN9A; (-) strand; PAM type: YTN; PAM sequence: CTT
tccccgttgcttgtttttgt

SEQ ID NO: 59451 - DNA, 20 bp, Artificial Sequence
  Description of Artificial Sequence: Synthetic oligonucleotide
  Target: SCN9A; (-) strand; PAM type: YTN; PAM sequence: TTA
aatagggaagcctttccccg

SEQ ID NO: 59452 - DNA, 20 bp, Artificial Sequence
  Description of Artificial Sequence: Synthetic oligonucleotide
  Target: SCN9A; (-) strand; PAM type: YTN; PAM sequence: TTA
ttaaatagggaagcctttcc

SEQ ID NO: 59453 - DNA, 20 bp, Artificial Sequence
  Description of Artificial Sequence: Synthetic oligonucleotide
  Target: SCN9A; (-) strand; PAM type: YTN; PAM sequence: TTT
attaaatagggaagcctttc

SEQ ID NO: 59454 - DNA, 20 bp, Artificial Sequence
  Description of Artificial Sequence: Synthetic oligonucleotide
  Target: SCN9A; (-) strand; PAM type: YTN; PAM sequence: TTC
ccagcatcatttattaaata

SEQ ID NO: 59455 - DNA, 20 bp, Artificial Sequence
  Description of Artificial Sequence: Synthetic oligonucleotide
  Target: SCN9A; (-) strand; PAM type: YTN; PAM sequence: TTT
cccagcatcatttattaaat

SEQ ID NO: 59456 - DNA, 20 bp, Artificial Sequence
  Description of Artificial Sequence: Synthetic oligonucleotide
  Target: SCN9A; (-) strand; PAM type: YTN; PAM sequence: TTT
tcccagcatcatttattaaa

SEQ ID NO: 59457 - DNA, 20 bp, Artificial Sequence
  Description of Artificial Sequence: Synthetic oligonucleotide
  Target: SCN9A; (-) strand; PAM type: YTN; PAM sequence: CTA
gccagttttcccagcatcat

SEQ ID NO: 59458 - DNA, 20 bp, Artificial Sequence
  Description of Artificial Sequence: Synthetic oligonucleotide
  Target: SCN9A; (-) strand; PAM type: YTN; PAM sequence: CTA
catatggctagccagttttc

SEQ ID NO: 59459 - DNA, 20 bp, Artificial Sequence
  Description of Artificial Sequence: Synthetic oligonucleotide
  Target: SCN9A; (-) strand; PAM type: YTN; PAM sequence: TTC
tacatatggctagccagttt

SEQ ID NO: 59460 - DNA, 20 bp, Artificial Sequence
  Description of Artificial Sequence: Synthetic oligonucleotide
  Target: SCN9A; (-) strand; PAM type: YTN; PAM sequence: TTT
ctacatatggctagccagtt

SEQ ID NO: 59461 - DNA, 20 bp, Artificial Sequence
  Description of Artificial Sequence: Synthetic oligonucleotide
  Target: SCN9A; (-) strand; PAM type: YTN; PAM sequence: CTT
tctacatatggctagccagt

SEQ ID NO: 59462 - DNA, 20 bp, Artificial Sequence
  Description of Artificial Sequence: Synthetic oligonucleotide
  Target: SCN9A; (-) strand; PAM type: YTN; PAM sequence: TTC
aactttctacatatggctag

SEQ ID NO: 59463 - DNA, 20 bp, Artificial Sequence
  Description of Artificial Sequence: Synthetic oligonucleotide
  Target: SCN9A; (-) strand; PAM type: YTN; PAM sequence: TTT
caactttctacatatggcta

SEQ ID NO: 59464 - DNA, 20 bp, Artificial Sequence
  Description of Artificial Sequence: Synthetic oligonucleotide
  Target: SCN9A; (-) strand; PAM type: YTN; PAM sequence: TTG
tacaaggtgtaaggaaggga

SEQ ID NO: 59465 - DNA, 20 bp, Artificial Sequence
  Description of Artificial Sequence: Synthetic oligonucleotide
  Target: SCN9A; (-) strand; PAM type: YTN; PAM sequence: TTT
gtacaaggtgtaaggaaggg

SEQ ID NO: 59466 - DNA, 20 bp, Artificial Sequence
  Description of Artificial Sequence: Synthetic oligonucleotide
  Target: SCN9A; (-) strand; PAM type: YTN; PAM sequence: TTT
tgtacaaggtgtaaggaagg

SEQ ID NO: 59467 - DNA, 20 bp, Artificial Sequence
  Description of Artificial Sequence: Synthetic oligonucleotide
  Target: SCN9A; (-) strand; PAM type: YTN; PAM sequence: TTT
ttgtacaaggtgtaaggaag

SEQ ID NO: 59468 - DNA, 20 bp, Artificial Sequence
  Description of Artificial Sequence: Synthetic oligonucleotide
  Target: SCN9A; (-) strand; PAM type: YTN; PAM sequence: TTA
atttttgtacaaggtgtaag

SEQ ID NO: 59469 - DNA, 20 bp, Artificial Sequence
  Description of Artificial Sequence: Synthetic oligonucleotide
  Target: SCN9A; (-) strand; PAM type: YTN; PAM sequence: TTG
agttaatttttgtacaaggt

SEQ ID NO: 59470 - DNA, 20 bp, Artificial Sequence
  Description of Artificial Sequence: Synthetic oligonucleotide
  Target: SCN9A; (-) strand; PAM type: YTN; PAM sequence: CTT
gagttaatttttgtacaagg

SEQ ID NO: 59471 - DNA, 20 bp, Artificial Sequence
  Description of Artificial Sequence: Synthetic oligonucleotide
  Target: SCN9A; (-) strand; PAM type: YTN; PAM sequence: TTA
atccatcttgagttaatttt

SEQ ID NO: 59472 - DNA, 20 bp, Artificial Sequence
  Description of Artificial Sequence: Synthetic oligonucleotide
  Target: SCN9A; (-) strand; PAM type: YTN; PAM sequence: TTT
aatccatcttgagttaattt

SEQ ID NO: 59473 - DNA, 20 bp, Artificial Sequence
  Description of Artificial Sequence: Synthetic oligonucleotide
  Target: SCN9A; (-) strand; PAM type: YTN; PAM sequence: CTT
taatccatcttgagttaatt

SEQ ID NO: 59474 - DNA, 20 bp, Artificial Sequence
  Description of Artificial Sequence: Synthetic oligonucleotide
  Target: SCN9A; (-) strand; PAM type: YTN; PAM sequence: TTA
agtctttaatccatcttgag

SEQ ID NO: 59475 - DNA, 20 bp, Artificial Sequence
  Description of Artificial Sequence: Synthetic oligonucleotide
  Target: SCN9A; (-) strand; PAM type: YTN; PAM sequence: TTT
aagtctttaatccatcttga

SEQ ID NO: 59476 - DNA, 20 bp, Artificial Sequence
  Description of Artificial Sequence: Synthetic oligonucleotide
  Target: SCN9A; (-) strand; PAM type: YTN; PAM sequence: TTA
catttaagtctttaatccat

SEQ ID NO: 59477 - DNA, 20 bp, Artificial Sequence
  Description of Artificial Sequence: Synthetic oligonucleotide
  Target: SCN9A; (-) strand; PAM type: YTN; PAM sequence: CTT
acatttaagtctttaatcca

SEQ ID NO: 59478 - DNA, 20 bp, Artificial Sequence
  Description of Artificial Sequence: Synthetic oligonucleotide
  Target: SCN9A; (-) strand; PAM type: YTN; PAM sequence: TTA
ggtcttacatttaagtcttt

SEQ ID NO: 59479 - DNA, 20 bp, Artificial Sequence
  Description of Artificial Sequence: Synthetic oligonucleotide
  Target: SCN9A; (-) strand; PAM type: YTN; PAM sequence: TTT
aggtcttacatttaagtctt

SEQ ID NO: 59480 - DNA, 20 bp, Artificial Sequence
  Description of Artificial Sequence: Synthetic oligonucleotide
  Target: SCN9A; (-) strand; PAM type: YTN; PAM sequence: TTT
taggtcttacatttaagtct

SEQ ID NO: 59481 - DNA, 20 bp, Artificial Sequence
  Description of Artificial Sequence: Synthetic oligonucleotide
  Target: SCN9A; (-) strand; PAM type: YTN; PAM sequence: TTA
tggttttaggtcttacattt

SEQ ID NO: 59482 - DNA, 20 bp, Artificial Sequence
  Description of Artificial Sequence: Synthetic oligonucleotide
  Target: SCN9A; (-) strand; PAM type: YTN; PAM sequence: TTT
atggttttaggtcttacatt

SEQ ID NO: 59483 - DNA, 20 bp, Artificial Sequence
  Description of Artificial Sequence: Synthetic oligonucleotide
  Target: SCN9A; (-) strand; PAM type: YTN; PAM sequence: TTT
tatggttttaggtcttacat

SEQ ID NO: 59484 - DNA, 20 bp, Artificial Sequence
  Description of Artificial Sequence: Synthetic oligonucleotide
  Target: SCN9A; (-) strand; PAM type: YTN; PAM sequence: TTT
ttatggttttaggtcttaca

SEQ ID NO: 59485 - DNA, 20 bp, Artificial Sequence
  Description of Artificial Sequence: Synthetic oligonucleotide
  Target: SCN9A; (-) strand; PAM type: YTN; PAM sequence: CTA
gggtttttatggttttaggt

SEQ ID NO: 59486 - DNA, 20 bp, Artificial Sequence
  Description of Artificial Sequence: Synthetic oligonucleotide
  Target: SCN9A; (-) strand; PAM type: YTN; PAM sequence: TTC
tagggtttttatggttttag

SEQ ID NO: 59487 - DNA, 20 bp, Artificial Sequence
  Description of Artificial Sequence: Synthetic oligonucleotide
  Target: SCN9A; (-) strand; PAM type: YTN; PAM sequence: CTT
ctagggtttttatggtttta

SEQ ID NO: 59488 - DNA, 20 bp, Artificial Sequence
  Description of Artificial Sequence: Synthetic oligonucleotide
  Target: SCN9A; (-) strand; PAM type: YTN; PAM sequence: TTC
ttctagggtttttatggttt

SEQ ID NO: 59489 - DNA, 20 bp, Artificial Sequence
  Description of Artificial Sequence: Synthetic oligonucleotide
  Target: SCN9A; (-) strand; PAM type: YTN; PAM sequence: TTT
cttctagggtttttatggtt

SEQ ID NO: 59490 - DNA, 20 bp, Artificial Sequence
  Description of Artificial Sequence: Synthetic oligonucleotide
  Target: SCN9A; (-) strand; PAM type: YTN; PAM sequence: CTA
gagtttcttctagggttttt

SEQ ID NO: 59491 - DNA, 20 bp, Artificial Sequence
  Description of Artificial Sequence: Synthetic oligonucleotide
  Target: SCN9A; (-) strand; PAM type: YTN; PAM sequence: TTG
cctagagtttcttctagggt

SEQ ID NO: 59492 - DNA, 20 bp, Artificial Sequence
  Description of Artificial Sequence: Synthetic oligonucleotide
  Target: SCN9A; (-) strand; PAM type: YTN; PAM sequence: CTG
aatgatattgcctagagttt

SEQ ID NO: 59493 - DNA, 20 bp, Artificial Sequence
  Description of Artificial Sequence: Synthetic oligonucleotide
  Target: SCN9A; (-) strand; PAM type: YTN; PAM sequence: CTA
tgtcctgaatgatattgcct

SEQ ID NO: 59494 - DNA, 20 bp, Artificial Sequence
  Description of Artificial Sequence: Synthetic oligonucleotide
  Target: SCN9A; (-) strand; PAM type: YTN; PAM sequence: TTG
cccatgcctatgtcctgaat

SEQ ID NO: 59495 - DNA, 20 bp, Artificial Sequence
  Description of Artificial Sequence: Synthetic oligonucleotide
  Target: SCN9A; (-) strand; PAM type: YTN; PAM sequence: TTT
gcccatgcctatgtcctgaa

SEQ ID NO: 59496 - DNA, 20 bp, Artificial Sequence
  Description of Artificial Sequence: Synthetic oligonucleotide
  Target: SCN9A; (-) strand; PAM type: YTN; PAM sequence: CTT
tgcccatgcctatgtcctga

SEQ ID NO: 59497 - DNA, 20 bp, Artificial Sequence
  Description of Artificial Sequence: Synthetic oligonucleotide
  Target: SCN9A; (-) strand; PAM type: YTN; PAM sequence: TTA
gtcatgaagtctttgcccat

SEQ ID NO: 59498 - DNA, 20 bp, Artificial Sequence
  Description of Artificial Sequence: Synthetic oligonucleotide
  Target: SCN9A; (-) strand; PAM type: YTN; PAM sequence: TTT
agtcatgaagtctttgccca

SEQ ID NO: 59499 - DNA, 20 bp, Artificial Sequence
  Description of Artificial Sequence: Synthetic oligonucleotide
  Target: SCN9A; (-) strand; PAM type: YTN; PAM sequence: TTT
tagtcatgaagtctttgccc

SEQ ID NO: 59500 - DNA, 20 bp, Artificial Sequence
  Description of Artificial Sequence: Synthetic oligonucleotide
  Target: SCN9A; (-) strand; PAM type: YTN; PAM sequence: TTG
gtgttttagtcatgaagtct

SEQ ID NO: 59501 - DNA, 20 bp, Artificial Sequence
  Description of Artificial Sequence: Synthetic oligonucleotide
  Target: SCN9A; (-) strand; PAM type: YTN; PAM sequence: TTT
ggtgttttagtcatgaagtc

SEQ ID NO: 59502 - DNA, 20 bp, Artificial Sequence
  Description of Artificial Sequence: Synthetic oligonucleotide
  Target: SCN9A; (-) strand; PAM type: YTN; PAM sequence: TTT
tggtgttttagtcatgaagt

SEQ ID NO: 59503 - DNA, 20 bp, Artificial Sequence
  Description of Artificial Sequence: Synthetic oligonucleotide
  Target: SCN9A; (-) strand; PAM type: YTN; PAM sequence: CTT
ttggtgttttagtcatgaag

SEQ ID NO: 59504 - DNA, 20 bp, Artificial Sequence
  Description of Artificial Sequence: Synthetic oligonucleotide
  Target: SCN9A; (-) strand; PAM type: YTN; PAM sequence: TTG
cttttggtgttttagtcatg

SEQ ID NO: 59505 - DNA, 20 bp, Artificial Sequence
  Description of Artificial Sequence: Synthetic oligonucleotide
  Target: SCN9A; (-) strand; PAM type: YTN; PAM sequence: TTG
ccattgcttttggtgtttta

SEQ ID NO: 59506 - DNA, 20 bp, Artificial Sequence
  Description of Artificial Sequence: Synthetic oligonucleotide
  Target: SCN9A; (-) strand; PAM type: YTN; PAM sequence: TTG
ttgccattgcttttggtgtt

SEQ ID NO: 59507 - DNA, 20 bp, Artificial Sequence
  Description of Artificial Sequence: Synthetic oligonucleotide
  Target: SCN9A; (-) strand; PAM type: YTN; PAM sequence: TTT
gttgccattgcttttggtgt

SEQ ID NO: 59508 - DNA, 20 bp, Artificial Sequence
  Description of Artificial Sequence: Synthetic oligonucleotide
  Target: SCN9A; (-) strand; PAM type: YTN; PAM sequence: TTT
tgttgccattgcttttggtg

SEQ ID NO: 59509 - DNA, 20 bp, Artificial Sequence
  Description of Artificial Sequence: Synthetic oligonucleotide
  Target: SCN9A; (-) strand; PAM type: YTN; PAM sequence: CTT
ttgttgccattgcttttggt

SEQ ID NO: 59510 - DNA, 20 bp, Artificial Sequence
  Description of Artificial Sequence: Synthetic oligonucleotide
  Target: SCN9A; (-) strand; PAM type: YTN; PAM sequence: TTG
gcttttgttgccattgcttt

SEQ ID NO: 59511 - DNA, 20 bp, Artificial Sequence
  Description of Artificial Sequence: Synthetic oligonucleotide
  Target: SCN9A; (-) strand; PAM type: YTN; PAM sequence: TTT
ggcttttgttgccattgctt

SEQ ID NO: 59512 - DNA, 20 bp, Artificial Sequence
  Description of Artificial Sequence: Synthetic oligonucleotide
  Target: SCN9A; (-) strand; PAM type: YTN; PAM sequence: TTT
tggcttttgttgccattgct

SEQ ID NO: 59513 - DNA, 20 bp, Artificial Sequence
  Description of Artificial Sequence: Synthetic oligonucleotide
  Target: SCN9A; (-) strand; PAM type: YTN; PAM sequence: CTG
ttttggcttttgttgccatt

SEQ ID NO: 59514 - DNA, 20 bp, Artificial Sequence
  Description of Artificial Sequence: Synthetic oligonucleotide
  Target: SCN9A; (-) strand; PAM type: YTN; PAM sequence: TTG
tctgttttggcttttgttgc

SEQ ID NO: 59515 - DNA, 20 bp, Artificial Sequence
  Description of Artificial Sequence: Synthetic oligonucleotide
  Target: SCN9A; (-) strand; PAM type: YTN; PAM sequence: TTT
gtctgttttggcttttgttg

SEQ ID NO: 59516 - DNA, 20 bp, Artificial Sequence
  Description of Artificial Sequence: Synthetic oligonucleotide
  Target: SCN9A; (-) strand; PAM type: YTN; PAM sequence: TTA
gatcccatttgtctgttttg

SEQ ID NO: 59517 - DNA, 20 bp, Artificial Sequence
  Description of Artificial Sequence: Synthetic oligonucleotide
  Target: SCN9A; (-) strand; PAM type: YTN; PAM sequence: TTA
attagatcccatttgtctgt

SEQ ID NO: 59518 - DNA, 20 bp, Artificial Sequence
  Description of Artificial Sequence: Synthetic oligonucleotide
  Target: SCN9A; (-) strand; PAM type: YTN; PAM sequence: TTT
aattagatcccatttgtctg

SEQ ID NO: 59519 - DNA, 20 bp, Artificial Sequence
  Description of Artificial Sequence: Synthetic oligonucleotide
  Target: SCN9A; (-) strand; PAM type: YTN; PAM sequence: TTA
gtttaattagatcccatttg

SEQ ID NO: 59520 - DNA, 20 bp, Artificial Sequence
  Description of Artificial Sequence: Synthetic oligonucleotide
  Target: SCN9A; (-) strand; PAM type: YTN; PAM sequence: TTT
agtttaattagatcccattt

SEQ ID NO: 59521 - DNA, 20 bp, Artificial Sequence
  Description of Artificial Sequence: Synthetic oligonucleotide
  Target: SCN9A; (-) strand; PAM type: YTN; PAM sequence: CTT
tagtttaattagatcccatt

SEQ ID NO: 59522 - DNA, 20 bp, Artificial Sequence
  Description of Artificial Sequence: Synthetic oligonucleotide
  Target: SCN9A; (-) strand; PAM type: YTN; PAM sequence: CTC
tttagtttaattagatccca

SEQ ID NO: 59523 - DNA, 20 bp, Artificial Sequence
  Description of Artificial Sequence: Synthetic oligonucleotide
  Target: SCN9A; (-) strand; PAM type: YTN; PAM sequence: TTG
cagaagctctttagtttaat

SEQ ID NO: 59524 - DNA, 20 bp, Artificial Sequence
  Description of Artificial Sequence: Synthetic oligonucleotide
  Target: SCN9A; (-) strand; PAM type: YTN; PAM sequence: TTT
gcagaagctctttagtttaa

SEQ ID NO: 59525 - DNA, 20 bp, Artificial Sequence
  Description of Artificial Sequence: Synthetic oligonucleotide
  Target: SCN9A; (-) strand; PAM type: YTN; PAM sequence: CTT
tgcagaagctctttagttta

SEQ ID NO: 59526 - DNA, 20 bp, Artificial Sequence
  Description of Artificial Sequence: Synthetic oligonucleotide
  Target: SCN9A; (-) strand; PAM type: YTN; PAM sequence: TTG
ctttgcagaagctctttagt

SEQ ID NO: 59527 - DNA, 20 bp, Artificial Sequence
  Description of Artificial Sequence: Synthetic oligonucleotide
  Target: SCN9A; (-) strand; PAM type: YTN; PAM sequence: TTT
gctttgcagaagctctttag

SEQ ID NO: 59528 - DNA, 20 bp, Artificial Sequence
  Description of Artificial Sequence: Synthetic oligonucleotide
  Target: SCN9A; (-) strand; PAM type: YTN; PAM sequence: TTT
tgctttgcagaagctcttta

SEQ ID NO: 59529 - DNA, 20 bp, Artificial Sequence
  Description of Artificial Sequence: Synthetic oligonucleotide
  Target: SCN9A; (-) strand; PAM type: YTN; PAM sequence: CTT
ttgctttgcagaagctcttt

SEQ ID NO: 59530 - DNA, 20 bp, Artificial Sequence
  Description of Artificial Sequence: Synthetic oligonucleotide
  Target: SCN9A; (-) strand; PAM type: YTN; PAM sequence: TTC
ttttgctttgcagaagctct

SEQ ID NO: 59531 - DNA, 20 bp, Artificial Sequence
  Description of Artificial Sequence: Synthetic oligonucleotide
  Target: SCN9A; (-) strand; PAM type: YTN; PAM sequence: TTT
cttttgctttgcagaagctc

SEQ ID NO: 59532 - DNA, 20 bp, Artificial Sequence
  Description of Artificial Sequence: Synthetic oligonucleotide
  Target: SCN9A; (-) strand; PAM type: YTN; PAM sequence: CTG
atgatagtttcttttgcttt

SEQ ID NO: 59533 - DNA, 20 bp, Artificial Sequence
  Description of Artificial Sequence: Synthetic oligonucleotide
  Target: SCN9A; (-) strand; PAM type: YTN; PAM sequence: CTC
tgatgatagtttcttttgct

SEQ ID NO: 59534 - DNA, 20 bp, Artificial Sequence
  Description of Artificial Sequence: Synthetic oligonucleotide
  Target: SCN9A; (-) strand; PAM type: YTN; PAM sequence: TTC
actctgatgatagtttcttt

SEQ ID NO: 59535 - DNA, 20 bp, Artificial Sequence
  Description of Artificial Sequence: Synthetic oligonucleotide
  Target: SCN9A; (-) strand; PAM type: YTN; PAM sequence: CTG
ttcactctgatgatagtttc

SEQ ID NO: 59536 - DNA, 20 bp, Artificial Sequence
  Description of Artificial Sequence: Synthetic oligonucleotide
  Target: SCN9A; (-) strand; PAM type: YTN; PAM sequence: TTG
cctgttcactctgatgatag

SEQ ID NO: 59537 - DNA, 20 bp, Artificial Sequence
  Description of Artificial Sequence: Synthetic oligonucleotide
  Target: SCN9A; (-) strand; PAM type: YTN; PAM sequence: CTG
taggttgcctgttcactctg

SEQ ID NO: 59538 - DNA, 20 bp, Artificial Sequence
  Description of Artificial Sequence: Synthetic oligonucleotide
  Target: SCN9A; (-) strand; PAM type: YTN; PAM sequence: TTC
tgtaggttgcctgttcactc

SEQ ID NO: 59539 - DNA, 20 bp, Artificial Sequence
  Description of Artificial Sequence: Synthetic oligonucleotide
  Target: SCN9A; (-) strand; PAM type: YTN; PAM sequence: CTC
ccattctgtaggttgcctgt

SEQ ID NO: 59540 - DNA, 20 bp, Artificial Sequence
  Description of Artificial Sequence: Synthetic oligonucleotide
  Target: SCN9A; (-) strand; PAM type: YTN; PAM sequence: TTC
tcccattctgtaggttgcct

SEQ ID NO: 59541 - DNA, 20 bp, Artificial Sequence
  Description of Artificial Sequence: Synthetic oligonucleotide
  Target: SCN9A; (-) strand; PAM type: YTN; PAM sequence: TTT
ctcccattctgtaggttgcc

SEQ ID NO: 59542 - DNA, 20 bp, Artificial Sequence
  Description of Artificial Sequence: Synthetic oligonucleotide
  Target: SCN9A; (-) strand; PAM type: YTN; PAM sequence: TTT
tctcccattctgtaggttgc

SEQ ID NO: 59543 - DNA, 20 bp, Artificial Sequence
  Description of Artificial Sequence: Synthetic oligonucleotide
  Target: SCN9A; (-) strand; PAM type: YTN; PAM sequence: TTG
caaaaattttctcccattct

SEQ ID NO: 59544 - DNA, 20 bp, Artificial Sequence
  Description of Artificial Sequence: Synthetic oligonucleotide
  Target: SCN9A; (-) strand; PAM type: YTN; PAM sequence: TTG
tcagatggataaattgcaaa

SEQ ID NO: 59545 - DNA, 20 bp, Artificial Sequence
  Description of Artificial Sequence: Synthetic oligonucleotide
  Target: SCN9A; (-) strand; PAM type: YTN; PAM sequence: TTT
gtcagatggataaattgcaa

SEQ ID NO: 59546 - DNA, 20 bp, Artificial Sequence
  Description of Artificial Sequence: Synthetic oligonucleotide
  Target: SCN9A; (-) strand; PAM type: YTN; PAM sequence: TTT
tgtcagatggataaattgca

SEQ ID NO: 59547 - DNA, 20 bp, Artificial Sequence
  Description of Artificial Sequence: Synthetic oligonucleotide
  Target: SCN9A; (-) strand; PAM type: YTN; PAM sequence: CTT
ttgtcagatggataaattgc

SEQ ID NO: 59548 - DNA, 20 bp, Artificial Sequence
  Description of Artificial Sequence: Synthetic oligonucleotide
  Target: SCN9A; (-) strand; PAM type: YTN; PAM sequence: TTA
gcccttttgtcagatggata

SEQ ID NO: 59549 - DNA, 20 bp, Artificial Sequence
  Description of Artificial Sequence: Synthetic oligonucleotide
  Target: SCN9A; (-) strand; PAM type: YTN; PAM sequence: CTG
gatattagcccttttgtcag

SEQ ID NO: 59550 - DNA, 20 bp, Artificial Sequence
  Description of Artificial Sequence: Synthetic oligonucleotide
  Target: SCN9A; (-) strand; PAM type: YTN; PAM sequence: TTC
tggatattagcccttttgtc

SEQ ID NO: 59551 - DNA, 20 bp, Artificial Sequence
  Description of Artificial Sequence: Synthetic oligonucleotide
  Target: SCN9A; (-) strand; PAM type: YTN; PAM sequence: TTG
tagattctggatattagccc

SEQ ID NO: 59552 - DNA, 20 bp, Artificial Sequence
  Description of Artificial Sequence: Synthetic oligonucleotide
  Target: SCN9A; (-) strand; PAM type: YTN; PAM sequence: TTT
gtagattctggatattagcc

SEQ ID NO: 59553 - DNA, 20 bp, Artificial Sequence
  Description of Artificial Sequence: Synthetic oligonucleotide
  Target: SCN9A; (-) strand; PAM type: YTN; PAM sequence: CTT
tgtagattctggatattagc

SEQ ID NO: 59554 - DNA, 20 bp, Artificial Sequence
  Description of Artificial Sequence: Synthetic oligonucleotide
  Target: SCN9A; (-) strand; PAM type: YTN; PAM sequence: TTC
tttgtagattctggatatta

SEQ ID NO: 59555 - DNA, 20 bp, Artificial Sequence
  Description of Artificial Sequence: Synthetic oligonucleotide
  Target: SCN9A; (-) strand; PAM type: YTN; PAM sequence: TTA
agttctttgtagattctgga

SEQ ID NO: 59556 - DNA, 20 bp, Artificial Sequence
  Description of Artificial Sequence: Synthetic oligonucleotide
  Target: SCN9A; (-) strand; PAM type: YTN; PAM sequence: TTT
aagttctttgtagattctgg

SEQ ID NO: 59557 - DNA, 20 bp, Artificial Sequence
  Description of Artificial Sequence: Synthetic oligonucleotide
  Target: SCN9A; (-) strand; PAM type: YTN; PAM sequence: TTG
tttaagttctttgtagattc

SEQ ID NO: 59558 - DNA, 20 bp, Artificial Sequence
  Description of Artificial Sequence: Synthetic oligonucleotide
  Target: SCN9A; (-) strand; PAM type: YTN; PAM sequence: TTT
gtttaagttctttgtagatt

SEQ ID NO: 59559 - DNA, 20 bp, Artificial Sequence
  Description of Artificial Sequence: Synthetic oligonucleotide
  Target: SCN9A; (-) strand; PAM type: YTN; PAM sequence: TTG
taaatttgtttaagttcttt

SEQ ID NO: 59560 - DNA, 20 bp, Artificial Sequence
  Description of Artificial Sequence: Synthetic oligonucleotide
  Target: SCN9A; (-) strand; PAM type: YTN; PAM sequence: CTT
gtaaatttgtttaagttctt

SEQ ID NO: 59561 - DNA, 20 bp, Artificial Sequence
  Description of Artificial Sequence: Synthetic oligonucleotide
  Target: SCN9A; (-) strand; PAM type: YTN; PAM sequence: TTC
ttgtaaatttgtttaagttc

SEQ ID NO: 59562 - DNA, 20 bp, Artificial Sequence
  Description of Artificial Sequence: Synthetic oligonucleotide
  Target: SCN9A; (-) strand; PAM type: YTN; PAM sequence: TTT
cttgtaaatttgtttaagtt

SEQ ID NO: 59563 - DNA, 20 bp, Artificial Sequence
  Description of Artificial Sequence: Synthetic oligonucleotide
  Target: SCN9A; (-) strand; PAM type: YTN; PAM sequence: TTT
tcttgtaaatttgtttaagt

SEQ ID NO: 59564 - DNA, 20 bp, Artificial Sequence
  Description of Artificial Sequence: Synthetic oligonucleotide
  Target: SCN9A; (-) strand; PAM type: YTN; PAM sequence: TTT
ttcttgtaaatttgtttaag

SEQ ID NO: 59565 - DNA, 20 bp, Artificial Sequence
  Description of Artificial Sequence: Synthetic oligonucleotide
  Target: SCN9A; (-) strand; PAM type: YTN; PAM sequence: TTT
tttcttgtaaatttgtttaa

SEQ ID NO: 59566 - DNA, 20 bp, Artificial Sequence
  Description of Artificial Sequence: Synthetic oligonucleotide
  Target: SCN9A; (-) strand; PAM type: YTN; PAM sequence: TTT
ttttcttgtaaatttgttta

SEQ ID NO: 59567 - DNA, 20 bp, Artificial Sequence
  Description of Artificial Sequence: Synthetic oligonucleotide
  Target: SCN9A; (-) strand; PAM type: YTN; PAM sequence: TTG
tttttttcttgtaaatttgt

SEQ ID NO: 59568 - DNA, 20 bp, Artificial Sequence
  Description of Artificial Sequence: Synthetic oligonucleotide
  Target: SCN9A; (-) strand; PAM type: YTN; PAM sequence: TTT
gtttttttcttgtaaatttg

SEQ ID NO: 59569 - DNA, 20 bp, Artificial Sequence
  Description of Artificial Sequence: Synthetic oligonucleotide
  Target: SCN9A; (-) strand; PAM type: YTN; PAM sequence: TTG
tttgtttttttcttgtaaat

SEQ ID NO: 59570 - DNA, 20 bp, Artificial Sequence
  Description of Artificial Sequence: Synthetic oligonucleotide
  Target: SCN9A; (-) strand; PAM type: YTN; PAM sequence: TTG
atggagttgtttgttttttt

SEQ ID NO: 59571 - DNA, 20 bp, Artificial Sequence
  Description of Artificial Sequence: Synthetic oligonucleotide
  Target: SCN9A; (-) strand; PAM type: YTN; PAM sequence: TTT
gatggagttgtttgtttttt

SEQ ID NO: 59572 - DNA, 20 bp, Artificial Sequence
  Description of Artificial Sequence: Synthetic oligonucleotide
  Target: SCN9A; (-) strand; PAM type: YTN; PAM sequence: TTT
tgatggagttgtttgttttt

SEQ ID NO: 59573 - DNA, 20 bp, Artificial Sequence
  Description of Artificial Sequence: Synthetic oligonucleotide
  Target: SCN9A; (-) strand; PAM type: YTN; PAM sequence: TTT
ttgatggagttgtttgtttt

SEQ ID NO: 59574 - DNA, 20 bp, Artificial Sequence
  Description of Artificial Sequence: Synthetic oligonucleotide
  Target: SCN9A; (-) strand; PAM type: YTN; PAM sequence: CTT
tttgatggagttgtttgttt

SEQ ID NO: 59575 - DNA, 20 bp, Artificial Sequence
  Description of Artificial Sequence: Synthetic oligonucleotide
  Target: SCN9A; (-) strand; PAM type: YTN; PAM sequence: TTG
cccactttttgatggagttg

SEQ ID NO: 59576 - DNA, 20 bp, Artificial Sequence
  Description of Artificial Sequence: Synthetic oligonucleotide
  Target: SCN9A; (-) strand; PAM type: YTN; PAM sequence: TTT
gcccactttttgatggagtt

SEQ ID NO: 59577 - DNA, 20 bp, Artificial Sequence
  Description of Artificial Sequence: Synthetic oligonucleotide
  Target: SCN9A; (-) strand; PAM type: YTN; PAM sequence: CTT
tgcccactttttgatggagt

SEQ ID NO: 59578 - DNA, 20 bp, Artificial Sequence
  Description of Artificial Sequence: Synthetic oligonucleotide
  Target: SCN9A; (-) strand; PAM type: YTN; PAM sequence: TTC
atatcctttgcccacttttt

SEQ ID NO: 59579 - DNA, 20 bp, Artificial Sequence
  Description of Artificial Sequence: Synthetic oligonucleotide
  Target: SCN9A; (-) strand; PAM type: YTN; PAM sequence: CTG
ttcatatcctttgcccactt

SEQ ID NO: 59580 - DNA, 20 bp, Artificial Sequence
  Description of Artificial Sequence: Synthetic oligonucleotide
  Target: SCN9A; (-) strand; PAM type: YTN; PAM sequence: TTG
agaagtacctgttcatatcc

SEQ ID NO: 59581 - DNA, 20 bp, Artificial Sequence
  Description of Artificial Sequence: Synthetic oligonucleotide
  Target: SCN9A; (-) strand; PAM type: YTN; PAM sequence: TTT
gagaagtacctgttcatatc

SEQ ID NO: 59582 - DNA, 20 bp, Artificial Sequence
  Description of Artificial Sequence: Synthetic oligonucleotide
  Target: SCN9A; (-) strand; PAM type: YTN; PAM sequence: TTT
tgagaagtacctgttcatat

SEQ ID NO: 59583 - DNA, 20 bp, Artificial Sequence
  Description of Artificial Sequence: Synthetic oligonucleotide
  Target: SCN9A; (-) strand; PAM type: YTN; PAM sequence: CTT
ttgagaagtacctgttcata

SEQ ID NO: 59584 - DNA, 20 bp, Artificial Sequence
  Description of Artificial Sequence: Synthetic oligonucleotide
  Target: SCN9A; (-) strand; PAM type: YTN; PAM sequence: TTC
ttttgagaagtacctgttca

SEQ ID NO: 59585 - DNA, 20 bp, Artificial Sequence
  Description of Artificial Sequence: Synthetic oligonucleotide
  Target: SCN9A; (-) strand; PAM type: YTN; PAM sequence: CTT
cttttgagaagtacctgttc

SEQ ID NO: 59586 - DNA, 20 bp, Artificial Sequence
  Description of Artificial Sequence: Synthetic oligonucleotide
  Target: SCN9A; (-) strand; PAM type: YTN; PAM sequence: CTG
cataaatgtcttcttttgag

SEQ ID NO: 59587 - DNA, 20 bp, Artificial Sequence
  Description of Artificial Sequence: Synthetic oligonucleotide
  Target: SCN9A; (-) strand; PAM type: YTN; PAM sequence: TTG
gctgcataaatgtcttcttt

SEQ ID NO: 59588 - DNA, 20 bp, Artificial Sequence
  Description of Artificial Sequence: Synthetic oligonucleotide
  Target: SCN9A; (-) strand; PAM type: YTN; PAM sequence: CTG
ttggctgcataaatgtcttc

SEQ ID NO: 59589 - DNA, 20 bp, Artificial Sequence
  Description of Artificial Sequence: Synthetic oligonucleotide
  Target: SCN9A; (-) strand; PAM type: YTN; PAM sequence: TTC
atatgtctgttggctgcata

SEQ ID NO: 59590 - DNA, 20 bp, Artificial Sequence
  Description of Artificial Sequence: Synthetic oligonucleotide
  Target: SCN9A; (-) strand; PAM type: YTN; PAM sequence: TTT
catatgtctgttggctgcat

SEQ ID NO: 59591 - DNA, 20 bp, Artificial Sequence
  Description of Artificial Sequence: Synthetic oligonucleotide
  Target: SCN9A; (-) strand; PAM type: YTN; PAM sequence: TTT
tcatatgtctgttggctgca

SEQ ID NO: 59592 - DNA, 20 bp, Artificial Sequence
  Description of Artificial Sequence: Synthetic oligonucleotide
  Target: SCN9A; (-) strand; PAM type: YTN; PAM sequence: TTT
ttcatatgtctgttggctgc

SEQ ID NO: 59593 - DNA, 20 bp, Artificial Sequence
  Description of Artificial Sequence: Synthetic oligonucleotide
  Target: SCN9A; (-) strand; PAM type: YTN; PAM sequence: TTT
tttcatatgtctgttggctg

SEQ ID NO: 59594 - DNA, 20 bp, Artificial Sequence
  Description of Artificial Sequence: Synthetic oligonucleotide
  Target: SCN9A; (-) strand; PAM type: YTN; PAM sequence: CTG
atgaccagtgatgatgagca

SEQ ID NO: 59595 - DNA, 20 bp, Artificial Sequence
  Description of Artificial Sequence: Synthetic oligonucleotide
  Target: SCN9A; (-) strand; PAM type: YTN; PAM sequence: CTC
tgatgaccagtgatgatgag

SEQ ID NO: 59596 - DNA, 20 bp, Artificial Sequence
  Description of Artificial Sequence: Synthetic oligonucleotide
  Target: SCN9A; (-) strand; PAM type: YTN; PAM sequence: TTC
tctgatgaccagtgatgatg

SEQ ID NO: 59597 - DNA, 20 bp, Artificial Sequence
  Description of Artificial Sequence: Synthetic oligonucleotide
  Target: SCN9A; (-) strand; PAM type: YTN; PAM sequence: TTT
ctctgatgaccagtgatgat

SEQ ID NO: 59598 - DNA, 20 bp, Artificial Sequence
  Description of Artificial Sequence: Synthetic oligonucleotide
  Target: SCN9A; (-) strand; PAM type: YTN; PAM sequence: TTG
tgtttctctgatgaccagtg

SEQ ID NO: 59599 - DNA, 20 bp, Artificial Sequence
  Description of Artificial Sequence: Synthetic oligonucleotide
  Target: SCN9A; (-) strand; PAM type: YTN; PAM sequence: TTT
gtgtttctctgatgaccagt

SEQ ID NO: 59600 - DNA, 20 bp, Artificial Sequence
  Description of Artificial Sequence: Synthetic oligonucleotide
  Target: SCN9A; (-) strand; PAM type: YTN; PAM sequence: TTG
atttgtgtttctctgatgac

SEQ ID NO: 59601 - DNA, 20 bp, Artificial Sequence
  Description of Artificial Sequence: Synthetic oligonucleotide
  Target: SCN9A; (-) strand; PAM type: YTN; PAM sequence: TTT
gatttgtgtttctctgatga

SEQ ID NO: 59602 - DNA, 20 bp, Artificial Sequence
  Description of Artificial Sequence: Synthetic oligonucleotide
  Target: SCN9A; (-) strand; PAM type: YTN; PAM sequence: TTT
tgatttgtgtttctctgatg

SEQ ID NO: 59603 - DNA, 20 bp, Artificial Sequence
  Description of Artificial Sequence: Synthetic oligonucleotide
  Target: SCN9A; (-) strand; PAM type: YTN; PAM sequence: TTG
tggttttgatttgtgtttct

SEQ ID NO: 59604 - DNA, 20 bp, Artificial Sequence
  Description of Artificial Sequence: Synthetic oligonucleotide
  Target: SCN9A; (-) strand; PAM type: YTN; PAM sequence: CTC
attgtggttttgatttgtgt

SEQ ID NO: 59605 - DNA, 20 bp, Artificial Sequence
  Description of Artificial Sequence: Synthetic oligonucleotide
  Target: SCN9A; (-) strand; PAM type: YTN; PAM sequence: TTG
gcatgaggtggtatctcatt

SEQ ID NO: 59606 - DNA, 20 bp, Artificial Sequence
  Description of Artificial Sequence: Synthetic oligonucleotide
  Target: SCN9A; (-) strand; PAM type: YTN; PAM sequence: CTA
attggcatgaggtggtatct

SEQ ID NO: 59607 - DNA, 20 bp, Artificial Sequence
  Description of Artificial Sequence: Synthetic oligonucleotide
  Target: SCN9A; (-) strand; PAM type: YTN; PAM sequence: TTC
taattggcatgaggtggtat

SEQ ID NO: 59608 - DNA, 20 bp, Artificial Sequence
  Description of Artificial Sequence: Synthetic oligonucleotide
  Target: SCN9A; (-) strand; PAM type: YTN; PAM sequence: TTG
ccattctaattggcatgagg

SEQ ID NO: 59609 - DNA, 20 bp, Artificial Sequence
  Description of Artificial Sequence: Synthetic oligonucleotide
  Target: SCN9A; (-) strand; PAM type: YTN; PAM sequence: TTA
gtgattgccattctaattgg

SEQ ID NO: 59610 - DNA, 20 bp, Artificial Sequence
  Description of Artificial Sequence: Synthetic oligonucleotide
  Target: SCN9A; (-) strand; PAM type: YTN; PAM sequence: TTT
agtgattgccattctaattg

SEQ ID NO: 59611 - DNA, 20 bp, Artificial Sequence
  Description of Artificial Sequence: Synthetic oligonucleotide
  Target: SCN9A; (-) strand; PAM type: YTN; PAM sequence: TTT
tagtgattgccattctaatt

SEQ ID NO: 59612 - DNA, 20 bp, Artificial Sequence
  Description of Artificial Sequence: Synthetic oligonucleotide
  Target: SCN9A; (-) strand; PAM type: YTN; PAM sequence: TTT
ttagtgattgccattctaat

SEQ ID NO: 59613 - DNA, 20 bp, Artificial Sequence
  Description of Artificial Sequence: Synthetic oligonucleotide
  Target: SCN9A; (-) strand; PAM type: YTN; PAM sequence: CTT
tttagtgattgccattctaa

SEQ ID NO: 59614 - DNA, 20 bp, Artificial Sequence
  Description of Artificial Sequence: Synthetic oligonucleotide
  Target: SCN9A; (-) strand; PAM type: YTN; PAM sequence: CTG
actttttagtgattgccatt

SEQ ID NO: 59615 - DNA, 20 bp, Artificial Sequence
  Description of Artificial Sequence: Synthetic oligonucleotide
  Target: SCN9A; (-) strand; PAM type: YTN; PAM sequence: TTC
ctgactttttagtgattgcc

SEQ ID NO: 59616 - DNA, 20 bp, Artificial Sequence
  Description of Artificial Sequence: Synthetic oligonucleotide
  Target: SCN9A; (-) strand; PAM type: YTN; PAM sequence: TTT
cctgactttttagtgattgc

SEQ ID NO: 59617 - DNA, 20 bp, Artificial Sequence
  Description of Artificial Sequence: Synthetic oligonucleotide
  Target: SCN9A; (-) strand; PAM type: YTN; PAM sequence: TTG
tttcctgactttttagtgat

SEQ ID NO: 59618 - DNA, 20 bp, Artificial Sequence
  Description of Artificial Sequence: Synthetic oligonucleotide
  Target: SCN9A; (-) strand; PAM type: YTN; PAM sequence: CTG
ttgtttcctgactttttagt

SEQ ID NO: 59619 - DNA, 20 bp, Artificial Sequence
  Description of Artificial Sequence: Synthetic oligonucleotide
  Target: SCN9A; (-) strand; PAM type: YTN; PAM sequence: CTC
caacatctgttgtttcctga

SEQ ID NO: 59620 - DNA, 20 bp, Artificial Sequence
  Description of Artificial Sequence: Synthetic oligonucleotide
  Target: SCN9A; (-) strand; PAM type: YTN; PAM sequence: CTC
tccaacatctgttgtttcct

SEQ ID NO: 59621 - DNA, 20 bp, Artificial Sequence
  Description of Artificial Sequence: Synthetic oligonucleotide
  Target: SCN9A; (-) strand; PAM type: YTN; PAM sequence: CTC
cacatcctctccaacatctg

SEQ ID NO: 59622 - DNA, 20 bp, Artificial Sequence
  Description of Artificial Sequence: Synthetic oligonucleotide
  Target: SCN9A; (-) strand; PAM type: YTN; PAM sequence: TTC
tccacatcctctccaacatc

SEQ ID NO: 59623 - DNA, 20 bp, Artificial Sequence
  Description of Artificial Sequence: Synthetic oligonucleotide
  Target: SCN9A; (-) strand; PAM type: YTN; PAM sequence: TTT
ctccacatcctctccaacat

SEQ ID NO: 59624 - DNA, 20 bp, Artificial Sequence
  Description of Artificial Sequence: Synthetic oligonucleotide
  Target: SCN9A; (-) strand; PAM type: YTN; PAM sequence: CTA
tttctccacatcctctccaa

SEQ ID NO: 59625 - DNA, 20 bp, Artificial Sequence
  Description of Artificial Sequence: Synthetic oligonucleotide
  Target: SCN9A; (-) strand; PAM type: YTN; PAM sequence: TTG
ctatttctccacatcctctc

SEQ ID NO: 59626 - DNA, 20 bp, Artificial Sequence
  Description of Artificial Sequence: Synthetic oligonucleotide
  Target: SCN9A; (-) strand; PAM type: YTN; PAM sequence: CTC
accaacagtgtaaaagcgtt

SEQ ID NO: 59627 - DNA, 20 bp, Artificial Sequence
  Description of Artificial Sequence: Synthetic oligonucleotide
  Target: SCN9A; (-) strand; PAM type: YTN; PAM sequence: CTC
tcaccaacagtgtaaaagcg

SEQ ID NO: 59628 - DNA, 20 bp, Artificial Sequence
  Description of Artificial Sequence: Synthetic oligonucleotide
  Target: SCN9A; (-) strand; PAM type: YTN; PAM sequence: TTA
cactctcaccaacagtgtaa

SEQ ID NO: 59629 - DNA, 20 bp, Artificial Sequence
  Description of Artificial Sequence: Synthetic oligonucleotide
  Target: SCN9A; (-) strand; PAM type: YTN; PAM sequence: TTT
acactctcaccaacagtgta

SEQ ID NO: 59630 - DNA, 20 bp, Artificial Sequence
  Description of Artificial Sequence: Synthetic oligonucleotide
  Target: SCN9A; (-) strand; PAM type: YTN; PAM sequence: TTT
tacactctcaccaacagtgt

SEQ ID NO: 59631 - DNA, 20 bp, Artificial Sequence
  Description of Artificial Sequence: Synthetic oligonucleotide
  Target: SCN9A; (-) strand; PAM type: YTN; PAM sequence: CTA
ttttacactctcaccaacag

SEQ ID NO: 59632 - DNA, 20 bp, Artificial Sequence
  Description of Artificial Sequence: Synthetic oligonucleotide
  Target: SCN9A; (-) strand; PAM type: YTN; PAM sequence: TTG
aactattttacactctcacc

SEQ ID NO: 59633 - DNA, 20 bp, Artificial Sequence
  Description of Artificial Sequence: Synthetic oligonucleotide
  Target: SCN9A; (-) strand; PAM type: YTN; PAM sequence: TTC
cacaatggttgaactatttt

SEQ ID NO: 59634 - DNA, 20 bp, Artificial Sequence
  Description of Artificial Sequence: Synthetic oligonucleotide
  Target: SCN9A; (-) strand; PAM type: YTN; PAM sequence: CTT
ccacaatggttgaactattt

SEQ ID NO: 59635 - DNA, 20 bp, Artificial Sequence
  Description of Artificial Sequence: Synthetic oligonucleotide
  Target: SCN9A; (-) strand; PAM type: YTN; PAM sequence: CTG
tcttccacaatggttgaact

SEQ ID NO: 59636 - DNA, 20 bp, Artificial Sequence
  Description of Artificial Sequence: Synthetic oligonucleotide
  Target: SCN9A; (-) strand; PAM type: YTN; PAM sequence: TTG
aggaatcatcacactgtctt

SEQ ID NO: 59637 - DNA, 20 bp, Artificial Sequence
  Description of Artificial Sequence: Synthetic oligonucleotide
  Target: SCN9A; (-) strand; PAM type: YTN; PAM sequence: CTT
gaggaatcatcacactgtct

SEQ ID NO: 59638 - DNA, 20 bp, Artificial Sequence
  Description of Artificial Sequence: Synthetic oligonucleotide
  Target: SCN9A; (-) strand; PAM type: YTN; PAM sequence: TTC
ttgaggaatcatcacactgt

SEQ ID NO: 59639 - DNA, 20 bp, Artificial Sequence
  Description of Artificial Sequence: Synthetic oligonucleotide
  Target: SCN9A; (-) strand; PAM type: YTN; PAM sequence: TTA
gattcttgaggaatcatcac

SEQ ID NO: 59640 - DNA, 20 bp, Artificial Sequence
  Description of Artificial Sequence: Synthetic oligonucleotide
  Target: SCN9A; (-) strand; PAM type: YTN; PAM sequence: TTT
agattcttgaggaatcatca

SEQ ID NO: 59641 - DNA, 20 bp, Artificial Sequence
  Description of Artificial Sequence: Synthetic oligonucleotide
  Target: SCN9A; (-) strand; PAM type: YTN; PAM sequence: TTT
tagattcttgaggaatcatc

SEQ ID NO: 59642 - DNA, 20 bp, Artificial Sequence
  Description of Artificial Sequence: Synthetic oligonucleotide
  Target: SCN9A; (-) strand; PAM type: YTN; PAM sequence: CTA
gttttagattcttgaggaat

SEQ ID NO: 59643 - DNA, 20 bp, Artificial Sequence
  Description of Artificial Sequence: Synthetic oligonucleotide
  Target: SCN9A; (-) strand; PAM type: YTN; PAM sequence: TTC
tagttttagattcttgagga

SEQ ID NO: 59644 - DNA, 20 bp, Artificial Sequence
  Description of Artificial Sequence: Synthetic oligonucleotide
  Target: SCN9A; (-) strand; PAM type: YTN; PAM sequence: TTT
ctagttttagattcttgagg

SEQ ID NO: 59645 - DNA, 20 bp, Artificial Sequence
  Description of Artificial Sequence: Synthetic oligonucleotide
  Target: SCN9A; (-) strand; PAM type: YTN; PAM sequence: CTG
ggtcaaatggtatttctagt

SEQ ID NO: 59646 - DNA, 20 bp, Artificial Sequence
  Description of Artificial Sequence: Synthetic oligonucleotide
  Target: SCN9A; (-) strand; PAM type: YTN; PAM sequence: TTG
ctgggtcaaatggtatttct

SEQ ID NO: 59647 - DNA, 20 bp, Artificial Sequence
  Description of Artificial Sequence: Synthetic oligonucleotide
  Target: SCN9A; (-) strand; PAM type: YTN; PAM sequence: TTG
agtatatacccagtaatgag

SEQ ID NO: 59648 - DNA, 20 bp, Artificial Sequence
  Description of Artificial Sequence: Synthetic oligonucleotide
  Target: SCN9A; (-) strand; PAM type: YTN; PAM sequence: CTT
gagtatatacccagtaatga

SEQ ID NO: 59649 - DNA, 20 bp, Artificial Sequence
  Description of Artificial Sequence: Synthetic oligonucleotide
  Target: SCN9A; (-) strand; PAM type: YTN; PAM sequence: TTA
caatcccttgagtatatacc

SEQ ID NO: 59650 - DNA, 20 bp, Artificial Sequence
  Description of Artificial Sequence: Synthetic oligonucleotide
  Target: SCN9A; (-) strand; PAM type: YTN; PAM sequence: TTT
acaatcccttgagtatatac

SEQ ID NO: 59651 - DNA, 20 bp, Artificial Sequence
  Description of Artificial Sequence: Synthetic oligonucleotide
  Target: SCN9A; (-) strand; PAM type: YTN; PAM sequence: TTA
tagtagcatgatttacaatc

SEQ ID NO: 59652 - DNA, 20 bp, Artificial Sequence
  Description of Artificial Sequence: Synthetic oligonucleotide
  Target: SCN9A; (-) strand; PAM type: YTN; PAM sequence: TTT
atagtagcatgatttacaat

SEQ ID NO: 59653 - DNA, 20 bp, Artificial Sequence
  Description of Artificial Sequence: Synthetic oligonucleotide
  Target: SCN9A; (-) strand; PAM type: YTN; PAM sequence: CTT
tatagtagcatgatttacaa

SEQ ID NO: 59654 - DNA, 20 bp, Artificial Sequence
  Description of Artificial Sequence: Synthetic oligonucleotide
  Target: SCN9A; (-) strand; PAM type: YTN; PAM sequence: CTG
caataaatatacatatgcat

SEQ ID NO: 59655 - DNA, 20 bp, Artificial Sequence
  Description of Artificial Sequence: Synthetic oligonucleotide
  Target: SCN9A; (-) strand; PAM type: YTN; PAM sequence: TTG
tgaatagtgctgcaataaat

SEQ ID NO: 59656 - DNA, 20 bp, Artificial Sequence
  Description of Artificial Sequence: Synthetic oligonucleotide
  Target: SCN9A; (-) strand; PAM type: YTN; PAM sequence: CTA
ttgtgaatagtgctgcaata

SEQ ID NO: 59657 - DNA, 20 bp, Artificial Sequence
  Description of Artificial Sequence: Synthetic oligonucleotide
  Target: SCN9A; (-) strand; PAM type: YTN; PAM sequence: TTG
ctattgtgaatagtgctgca

SEQ ID NO: 59658 - DNA, 20 bp, Artificial Sequence
  Description of Artificial Sequence: Synthetic oligonucleotide
  Target: SCN9A; (-) strand; PAM type: YTN; PAM sequence: TTT
gctattgtgaatagtgctgc

SEQ ID NO: 59659 - DNA, 20 bp, Artificial Sequence
  Description of Artificial Sequence: Synthetic oligonucleotide
  Target: SCN9A; (-) strand; PAM type: YTN; PAM sequence: CTT
tgctattgtgaatagtgctg

SEQ ID NO: 59660 - DNA, 20 bp, Artificial Sequence
  Description of Artificial Sequence: Synthetic oligonucleotide
  Target: SCN9A; (-) strand; PAM type: YTN; PAM sequence: TTC
caagtctttgctattgtgaa

SEQ ID NO: 59661 - DNA, 20 bp, Artificial Sequence
  Description of Artificial Sequence: Synthetic oligonucleotide
  Target: SCN9A; (-) strand; PAM type: YTN; PAM sequence: TTG
gttccaagtctttgctattg

SEQ ID NO: 59662 - DNA, 20 bp, Artificial Sequence
  Description of Artificial Sequence: Synthetic oligonucleotide
  Target: SCN9A; (-) strand; PAM type: YTN; PAM sequence: TTG
ggttggttccaagtctttgc

SEQ ID NO: 59663 - DNA, 20 bp, Artificial Sequence
  Description of Artificial Sequence: Synthetic oligonucleotide
  Target: SCN9A; (-) strand; PAM type: YTN; PAM sequence: TTT
gggttggttccaagtctttg

SEQ ID NO: 59664 - DNA, 20 bp, Artificial Sequence
  Description of Artificial Sequence: Synthetic oligonucleotide
  Target: SCN9A; (-) strand; PAM type: YTN; PAM sequence: TTG
atggacatttgggttggttc

SEQ ID NO: 59665 - DNA, 20 bp, Artificial Sequence
  Description of Artificial Sequence: Synthetic oligonucleotide
  Target: SCN9A; (-) strand; PAM type: YTN; PAM sequence: TTA
ttgatggacatttgggttgg

SEQ ID NO: 59666 - DNA, 20 bp, Artificial Sequence
  Description of Artificial Sequence: Synthetic oligonucleotide
  Target: SCN9A; (-) strand; PAM type: YTN; PAM sequence: CTA
ttattgatggacatttgggt

SEQ ID NO: 59667 - DNA, 20 bp, Artificial Sequence
  Description of Artificial Sequence: Synthetic oligonucleotide
  Target: SCN9A; (-) strand; PAM type: YTN; PAM sequence: TTA
tccagtctattattgatgga

SEQ ID NO: 59668 - DNA, 20 bp, Artificial Sequence
  Description of Artificial Sequence: Synthetic oligonucleotide
  Target: SCN9A; (-) strand; PAM type: YTN; PAM sequence: TTT
atccagtctattattgatgg

SEQ ID NO: 59669 - DNA, 20 bp, Artificial Sequence
  Description of Artificial Sequence: Synthetic oligonucleotide
  Target: SCN9A; (-) strand; PAM type: YTN; PAM sequence: CTT
tatccagtctattattgatg

SEQ ID NO: 59670 - DNA, 20 bp, Artificial Sequence
  Description of Artificial Sequence: Synthetic oligonucleotide
  Target: SCN9A; (-) strand; PAM type: YTN; PAM sequence: TTC
tttatccagtctattattga

SEQ ID NO: 59671 - DNA, 20 bp, Artificial Sequence
  Description of Artificial Sequence: Synthetic oligonucleotide
  Target: SCN9A; (-) strand; PAM type: YTN; PAM sequence: TTT
ctttatccagtctattattg

SEQ ID NO: 59672 - DNA, 20 bp, Artificial Sequence
  Description of Artificial Sequence: Synthetic oligonucleotide
  Target: SCN9A; (-) strand; PAM type: YTN; PAM sequence: TTT
tctttatccagtctattatt

SEQ ID NO: 59673 - DNA, 20 bp, Artificial Sequence
  Description of Artificial Sequence: Synthetic oligonucleotide
  Target: SCN9A; (-) strand; PAM type: YTN; PAM sequence: TTC
catggtgtatatatgccaca

SEQ ID NO: 59674 - DNA, 20 bp, Artificial Sequence
  Description of Artificial Sequence: Synthetic oligonucleotide
  Target: SCN9A; (-) strand; PAM type: YTN; PAM sequence: CTG
catagtattccatggtgtat

SEQ ID NO: 59675 - DNA, 20 bp, Artificial Sequence
  Description of Artificial Sequence: Synthetic oligonucleotide
  Target: SCN9A; (-) strand; PAM type: YTN; PAM sequence: TTA
tggctgcatagtattccatg

SEQ ID NO: 59676 - DNA, 20 bp, Artificial Sequence
  Description of Artificial Sequence: Synthetic oligonucleotide
  Target: SCN9A; (-) strand; PAM type: YTN; PAM sequence: TTT
atggctgcatagtattccat

SEQ ID NO: 59677 - DNA, 20 bp, Artificial Sequence
  Description of Artificial Sequence: Synthetic oligonucleotide
  Target: SCN9A; (-) strand; PAM type: YTN; PAM sequence: TTT
tatggctgcatagtattcca

SEQ ID NO: 59678 - DNA, 20 bp, Artificial Sequence
  Description of Artificial Sequence: Synthetic oligonucleotide
  Target: SCN9A; (-) strand; PAM type: YTN; PAM sequence: TTT
ttatggctgcatagtattcc

SEQ ID NO: 59679 - DNA, 20 bp, Artificial Sequence
  Description of Artificial Sequence: Synthetic oligonucleotide
  Target: SCN9A; (-) strand; PAM type: YTN; PAM sequence: TTT
tttatggctgcatagtattc

SEQ ID NO: 59680 - DNA, 20 bp, Artificial Sequence
  Description of Artificial Sequence: Synthetic oligonucleotide
  Target: SCN9A; (-) strand; PAM type: YTN; PAM sequence: CTT
ttttatggctgcatagtatt

SEQ ID NO: 59681 - DNA, 20 bp, Artificial Sequence
  Description of Artificial Sequence: Synthetic oligonucleotide
  Target: SCN9A; (-) strand; PAM type: YTN; PAM sequence: CTC
atccttttttatggctgcat

SEQ ID NO: 59682 - DNA, 20 bp, Artificial Sequence
  Description of Artificial Sequence: Synthetic oligonucleotide
  Target: SCN9A; (-) strand; PAM type: YTN; PAM sequence: CTA
caaaggacatgaactcatcc

SEQ ID NO: 59683 - DNA, 20 bp, Artificial Sequence
  Description of Artificial Sequence: Synthetic oligonucleotide
  Target: SCN9A; (-) strand; PAM type: YTN; PAM sequence: TTC
atgcatgtccctacaaagga

SEQ ID NO: 59684 - DNA, 20 bp, Artificial Sequence
  Description of Artificial Sequence: Synthetic oligonucleotide
  Target: SCN9A; (-) strand; PAM type: YTN; PAM sequence: CTT
catgcatgtccctacaaagg

SEQ ID NO: 59685 - DNA, 20 bp, Artificial Sequence
  Description of Artificial Sequence: Synthetic oligonucleotide
  Target: SCN9A; (-) strand; PAM type: YTN; PAM sequence: TTC
cagcttcatgcatgtcccta

SEQ ID NO: 59686 - DNA, 20 bp, Artificial Sequence
  Description of Artificial Sequence: Synthetic oligonucleotide
  Target: SCN9A; (-) strand; PAM type: YTN; PAM sequence: TTT
ccagcttcatgcatgtccct

SEQ ID NO: 59687 - DNA, 20 bp, Artificial Sequence
  Description of Artificial Sequence: Synthetic oligonucleotide
  Target: SCN9A; (-) strand; PAM type: YTN; PAM sequence: CTG
agaatgatggtttccagctt

SEQ ID NO: 59688 - DNA, 20 bp, Artificial Sequence
  Description of Artificial Sequence: Synthetic oligonucleotide
  Target: SCN9A; (-) strand; PAM type: YTN; PAM sequence: TTG
ctgagaatgatggtttccag

SEQ ID NO: 59689 - DNA, 20 bp, Artificial Sequence
  Description of Artificial Sequence: Synthetic oligonucleotide
  Target: SCN9A; (-) strand; PAM type: YTN; PAM sequence: TTT
gctgagaatgatggtttcca

SEQ ID NO: 59690 - DNA, 20 bp, Artificial Sequence
  Description of Artificial Sequence: Synthetic oligonucleotide
  Target: SCN9A; (-) strand; PAM type: YTN; PAM sequence: TTT
tgctgagaatgatggtttcc

SEQ ID NO: 59691 - DNA, 20 bp, Artificial Sequence
  Description of Artificial Sequence: Synthetic oligonucleotide
  Target: SCN9A; (-) strand; PAM type: YTN; PAM sequence: TTG
tgatattttgctgagaatga

SEQ ID NO: 59692 - DNA, 20 bp, Artificial Sequence
  Description of Artificial Sequence: Synthetic oligonucleotide
  Target: SCN9A; (-) strand; PAM type: YTN; PAM sequence: CTT
gtgatattttgctgagaatg

SEQ ID NO: 59693 - DNA, 20 bp, Artificial Sequence
  Description of Artificial Sequence: Synthetic oligonucleotide
  Target: SCN9A; (-) strand; PAM type: YTN; PAM sequence: TTC
cgtccttgtgatattttgct

SEQ ID NO: 59694 - DNA, 20 bp, Artificial Sequence
  Description of Artificial Sequence: Synthetic oligonucleotide
  Target: SCN9A; (-) strand; PAM type: YTN; PAM sequence: TTT
ccgtccttgtgatattttgc

SEQ ID NO: 59695 - DNA, 20 bp, Artificial Sequence
  Description of Artificial Sequence: Synthetic oligonucleotide
  Target: SCN9A; (-) strand; PAM type: YTN; PAM sequence: TTT
tccgtccttgtgatattttg

SEQ ID NO: 59696 - DNA, 20 bp, Artificial Sequence
  Description of Artificial Sequence: Synthetic oligonucleotide
  Target: SCN9A; (-) strand; PAM type: YTN; PAM sequence: TTG
gttttccgtccttgtgatat

SEQ ID NO: 59697 - DNA, 20 bp, Artificial Sequence
  Description of Artificial Sequence: Synthetic oligonucleotide
  Target: SCN9A; (-) strand; PAM type: YTN; PAM sequence: TTT
ggttttccgtccttgtgata

SEQ ID NO: 59698 - DNA, 20 bp, Artificial Sequence
  Description of Artificial Sequence: Synthetic oligonucleotide
  Target: SCN9A; (-) strand; PAM type: YTN; PAM sequence: TTA
tgagtgagaacatgcagagt

SEQ ID NO: 59699 - DNA, 20 bp, Artificial Sequence
  Description of Artificial Sequence: Synthetic oligonucleotide
  Target: SCN9A; (-) strand; PAM type: YTN; PAM sequence: CTT
atgagtgagaacatgcagag

SEQ ID NO: 59700 - DNA, 20 bp, Artificial Sequence
  Description of Artificial Sequence: Synthetic oligonucleotide
  Target: SCN9A; (-) strand; PAM type: YTN; PAM sequence: CTC
ccacttatgagtgagaacat

SEQ ID NO: 59701 - DNA, 20 bp, Artificial Sequence
  Description of Artificial Sequence: Synthetic oligonucleotide
  Target: SCN9A; (-) strand; PAM type: YTN; PAM sequence: TTC
aactcccacttatgagtgag

SEQ ID NO: 59702 - DNA, 20 bp, Artificial Sequence
  Description of Artificial Sequence: Synthetic oligonucleotide
  Target: SCN9A; (-) strand; PAM type: YTN; PAM sequence: TTG
ttcaactcccacttatgagt

SEQ ID NO: 59703 - DNA, 20 bp, Artificial Sequence
  Description of Artificial Sequence: Synthetic oligonucleotide
  Target: SCN9A; (-) strand; PAM type: YTN; PAM sequence: CTC
attgttcaactcccacttat

SEQ ID NO: 59704 - DNA, 20 bp, Artificial Sequence
  Description of Artificial Sequence: Synthetic oligonucleotide
  Target: SCN9A; (-) strand; PAM type: YTN; PAM sequence: TTC
tcattgttcaactcccactt

SEQ ID NO: 59705 - DNA, 20 bp, Artificial Sequence
  Description of Artificial Sequence: Synthetic oligonucleotide
  Target: SCN9A; (-) strand; PAM type: YTN; PAM sequence: CTG
tgtccatgtgttctcattgt

SEQ ID NO: 59706 - DNA, 20 bp, Artificial Sequence
  Description of Artificial Sequence: Synthetic oligonucleotide
  Target: SCN9A; (-) strand; PAM type: YTN; PAM sequence: CTC
cctgtgtccatgtgttctca

SEQ ID NO: 59707 - DNA, 20 bp, Artificial Sequence
  Description of Artificial Sequence: Synthetic oligonucleotide
  Target: SCN9A; (-) strand; PAM type: YTN; PAM sequence: TTC
ccctccctgtgtccatgtgt

SEQ ID NO: 59708 - DNA, 20 bp, Artificial Sequence
  Description of Artificial Sequence: Synthetic oligonucleotide
  Target: SCN9A; (-) strand; PAM type: YTN; PAM sequence: CTG
gtgtgtgatgttcccctccc

SEQ ID NO: 59709 - DNA, 20 bp, Artificial Sequence
  Description of Artificial Sequence: Synthetic oligonucleotide
  Target: SCN9A; (-) strand; PAM type: YTN; PAM sequence: CTG
cccctggtgtgtgatgttcc

SEQ ID NO: 59710 - DNA, 20 bp, Artificial Sequence
  Description of Artificial Sequence: Synthetic oligonucleotide
  Target: SCN9A; (-) strand; PAM type: YTN; PAM sequence: CTA
actgcccctggtgtgtgatg

SEQ ID NO: 59711 - DNA, 20 bp, Artificial Sequence
  Description of Artificial Sequence: Synthetic oligonucleotide
  Target: SCN9A; (-) strand; PAM type: YTN; PAM sequence: CTC
ccaaccccctaactgcccct

SEQ ID NO: 59712 - DNA, 20 bp, Artificial Sequence
  Description of Artificial Sequence: Synthetic oligonucleotide
  Target: SCN9A; (-) strand; PAM type: YTN; PAM sequence: CTC
ccaaagctcccaacccccta

SEQ ID NO: 59713 - DNA, 20 bp, Artificial Sequence
  Description of Artificial Sequence: Synthetic oligonucleotide
  Target: SCN9A; (-) strand; PAM type: YTN; PAM sequence: CTA
agtaatccctcccaaagctc

SEQ ID NO: 59714 - DNA, 20 bp, Artificial Sequence
  Description of Artificial Sequence: Synthetic oligonucleotide
  Target: SCN9A; (-) strand; PAM type: YTN; PAM sequence: CTC
ctaagtaatccctcccaaag

SEQ ID NO: 59715 - DNA, 20 bp, Artificial Sequence
  Description of Artificial Sequence: Synthetic oligonucleotide
  Target: SCN9A; (-) strand; PAM type: YTN; PAM sequence: TTC
tcctaagtaatccctcccaa

SEQ ID NO: 59716 - DNA, 20 bp, Artificial Sequence
  Description of Artificial Sequence: Synthetic oligonucleotide
  Target: SCN9A; (-) strand; PAM type: YTN; PAM sequence: TTT
ctcctaagtaatccctccca

SEQ ID NO: 59717 - DNA, 20 bp, Artificial Sequence
  Description of Artificial Sequence: Synthetic oligonucleotide
  Target: SCN9A; (-) strand; PAM type: YTN; PAM sequence: TTA
ggtatttctcctaagtaatc

SEQ ID NO: 59718 - DNA, 20 bp, Artificial Sequence
  Description of Artificial Sequence: Synthetic oligonucleotide
  Target: SCN9A; (-) strand; PAM type: YTN; PAM sequence: TTA
cattaggtatttctcctaag

SEQ ID NO: 59719 - DNA, 20 bp, Artificial Sequence
  Description of Artificial Sequence: Synthetic oligonucleotide
  Target: SCN9A; (-) strand; PAM type: YTN; PAM sequence: TTT
acattaggtatttctcctaa

SEQ ID NO: 59720 - DNA, 20 bp, Artificial Sequence
  Description of Artificial Sequence: Synthetic oligonucleotide
  Target: SCN9A; (-) strand; PAM type: YTN; PAM sequence: CTC
atcatttacattaggtattt

SEQ ID NO: 59721 - DNA, 20 bp, Artificial Sequence
  Description of Artificial Sequence: Synthetic oligonucleotide
  Target: SCN9A; (-) strand; PAM type: YTN; PAM sequence: CTG
caccaatcaactcatcattt

SEQ ID NO: 59722 - DNA, 20 bp, Artificial Sequence
  Description of Artificial Sequence: Synthetic oligonucleotide
  Target: SCN9A; (-) strand; PAM type: YTN; PAM sequence: TTG
ctgcaccaatcaactcatca

SEQ ID NO: 59723 - DNA, 20 bp, Artificial Sequence
  Description of Artificial Sequence: Synthetic oligonucleotide
  Target: SCN9A; (-) strand; PAM type: YTN; PAM sequence: TTT
gctgcaccaatcaactcatc

SEQ ID NO: 59724 - DNA, 20 bp, Artificial Sequence
  Description of Artificial Sequence: Synthetic oligonucleotide
  Target: SCN9A; (-) strand; PAM type: YTN; PAM sequence: TTG
gtttgctgcaccaatcaact

SEQ ID NO: 59725 - DNA, 20 bp, Artificial Sequence
  Description of Artificial Sequence: Synthetic oligonucleotide
  Target: SCN9A; (-) strand; PAM type: YTN; PAM sequence: TTA
cataggtatacatgtaccat

SEQ ID NO: 59726 - DNA, 20 bp, Artificial Sequence
  Description of Artificial Sequence: Synthetic oligonucleotide
  Target: SCN9A; (-) strand; PAM type: YTN; PAM sequence: TTG
ttacataggtatacatgtac

SEQ ID NO: 59727 - DNA, 20 bp, Artificial Sequence
  Description of Artificial Sequence: Synthetic oligonucleotide
  Target: SCN9A; (-) strand; PAM type: YTN; PAM sequence: TTT
gttacataggtatacatgta

SEQ ID NO: 59728 - DNA, 20 bp, Artificial Sequence
  Description of Artificial Sequence: Synthetic oligonucleotide
  Target: SCN9A; (-) strand; PAM type: YTN; PAM sequence: CTA
gggtacatgtgcaaaacatg

SEQ ID NO: 59729 - DNA, 20 bp, Artificial Sequence
  Description of Artificial Sequence: Synthetic oligonucleotide
  Target: SCN9A; (-) strand; PAM type: YTN; PAM sequence: TTC
tagggtacatgtgcaaaaca

SEQ ID NO: 59730 - DNA, 20 bp, Artificial Sequence
  Description of Artificial Sequence: Synthetic oligonucleotide
  Target: SCN9A; (-) strand; PAM type: YTN; PAM sequence: TTA
agttctagggtacatgtgca

SEQ ID NO: 59731 - DNA, 20 bp, Artificial Sequence
  Description of Artificial Sequence: Synthetic oligonucleotide
  Target: SCN9A; (-) strand; PAM type: YTN; PAM sequence: TTT
aagttctagggtacatgtgc

SEQ ID NO: 59732 - DNA, 20 bp, Artificial Sequence
  Description of Artificial Sequence: Synthetic oligonucleotide
  Target: SCN9A; (-) strand; PAM type: YTN; PAM sequence: CTT
taagttctagggtacatgtg

SEQ ID NO: 59733 - DNA, 20 bp, Artificial Sequence
  Description of Artificial Sequence: Synthetic oligonucleotide
  Target: SCN9A; (-) strand; PAM type: YTN; PAM sequence: TTA
tactttaagttctagggtac

SEQ ID NO: 59734 - DNA, 20 bp, Artificial Sequence
  Description of Artificial Sequence: Synthetic oligonucleotide
  Target: SCN9A; (-) strand; PAM type: YTN; PAM sequence: TTA
ttatactttaagttctaggg

SEQ ID NO: 59735 - DNA, 20 bp, Artificial Sequence
  Description of Artificial Sequence: Synthetic oligonucleotide
  Target: SCN9A; (-) strand; PAM type: YTN; PAM sequence: TTA
ttattatactttaagttcta

SEQ ID NO: 59736 - DNA, 20 bp, Artificial Sequence
  Description of Artificial Sequence: Synthetic oligonucleotide
  Target: SCN9A; (-) strand; PAM type: YTN; PAM sequence: TTT
attattatactttaagttct

SEQ ID NO: 59737 - DNA, 20 bp, Artificial Sequence
  Description of Artificial Sequence: Synthetic oligonucleotide
  Target: SCN9A; (-) strand; PAM type: YTN; PAM sequence: TTT
tattattatactttaagttc

SEQ ID NO: 59738 - DNA, 20 bp, Artificial Sequence
  Description of Artificial Sequence: Synthetic oligonucleotide
  Target: SCN9A; (-) strand; PAM type: YTN; PAM sequence: TTT
ttattattatactttaagtt

SEQ ID NO: 59739 - DNA, 20 bp, Artificial Sequence
  Description of Artificial Sequence: Synthetic oligonucleotide
  Target: SCN9A; (-) strand; PAM type: YTN; PAM sequence: TTT
tttattattatactttaagt

SEQ ID NO: 59740 - DNA, 20 bp, Artificial Sequence
  Description of Artificial Sequence: Synthetic oligonucleotide
  Target: SCN9A; (-) strand; PAM type: YTN; PAM sequence: TTT
ttttattattatactttaag

SEQ ID NO: 59741 - DNA, 20 bp, Artificial Sequence
  Description of Artificial Sequence: Synthetic oligonucleotide
  Target: SCN9A; (-) strand; PAM type: YTN; PAM sequence: CTT
tttttattattatactttaa

SEQ ID NO: 59742 - DNA, 20 bp, Artificial Sequence
  Description of Artificial Sequence: Synthetic oligonucleotide
  Target: SCN9A; (-) strand; PAM type: YTN; PAM sequence: TTC
tttttttattattatacttt

SEQ ID NO: 59743 - DNA, 20 bp, Artificial Sequence
  Description of Artificial Sequence: Synthetic oligonucleotide
  Target: SCN9A; (-) strand; PAM type: YTN; PAM sequence: CTA
ttctttttttattattatac

SEQ ID NO: 59744 - DNA, 20 bp, Artificial Sequence
  Description of Artificial Sequence: Synthetic oligonucleotide
  Target: SCN9A; (-) strand; PAM type: YTN; PAM sequence: TTG
tatgtagcccctattctttt

SEQ ID NO: 59745 - DNA, 20 bp, Artificial Sequence
  Description of Artificial Sequence: Synthetic oligonucleotide
  Target: SCN9A; (-) strand; PAM type: YTN; PAM sequence: TTA
ttgtatgtagcccctattct

SEQ ID NO: 59746 - DNA, 20 bp, Artificial Sequence
  Description of Artificial Sequence: Synthetic oligonucleotide
  Target: SCN9A; (-) strand; PAM type: YTN; PAM sequence: TTG
gttattgtatgtagccccta

SEQ ID NO: 59747 - DNA, 20 bp, Artificial Sequence
  Description of Artificial Sequence: Synthetic oligonucleotide
  Target: SCN9A; (-) strand; PAM type: YTN; PAM sequence: TTT
ggttattgtatgtagcccct

SEQ ID NO: 59748 - DNA, 20 bp, Artificial Sequence
  Description of Artificial Sequence: Synthetic oligonucleotide
  Target: SCN9A; (-) strand; PAM type: YTN; PAM sequence: TTT
tggttattgtatgtagcccc

SEQ ID NO: 59749 - DNA, 20 bp, Artificial Sequence
  Description of Artificial Sequence: Synthetic oligonucleotide
  Target: SCN9A; (-) strand; PAM type: YTN; PAM sequence: TTA
atacaattttggttattgta

SEQ ID NO: 59750 - DNA, 20 bp, Artificial Sequence
  Description of Artificial Sequence: Synthetic oligonucleotide
  Target: SCN9A; (-) strand; PAM type: YTN; PAM sequence: TTA
aaatgaatataaaattaata

SEQ ID NO: 59751 - DNA, 20 bp, Artificial Sequence
  Description of Artificial Sequence: Synthetic oligonucleotide
  Target: SCN9A; (-) strand; PAM type: YTN; PAM sequence: TTA
tgtaaaggaataatggtata

SEQ ID NO: 59752 - DNA, 20 bp, Artificial Sequence
  Description of Artificial Sequence: Synthetic oligonucleotide
  Target: SCN9A; (-) strand; PAM type: YTN; PAM sequence: TTT
atgtaaaggaataatggtat

SEQ ID NO: 59753 - DNA, 20 bp, Artificial Sequence
  Description of Artificial Sequence: Synthetic oligonucleotide
  Target: SCN9A; (-) strand; PAM type: YTN; PAM sequence: TTT
tatgtaaaggaataatggta

SEQ ID NO: 59754 - DNA, 20 bp, Artificial Sequence
  Description of Artificial Sequence: Synthetic oligonucleotide
  Target: SCN9A; (-) strand; PAM type: YTN; PAM sequence: TTT
ttatgtaaaggaataatggt

SEQ ID NO: 59755 - DNA, 20 bp, Artificial Sequence
  Description of Artificial Sequence: Synthetic oligonucleotide
  Target: SCN9A; (-) strand; PAM type: YTN; PAM sequence: TTT
tttatgtaaaggaataatgg

SEQ ID NO: 59756 - DNA, 20 bp, Artificial Sequence
  Description of Artificial Sequence: Synthetic oligonucleotide
  Target: SCN9A; (-) strand; PAM type: YTN; PAM sequence: TTC
attttttatgtaaaggaata

SEQ ID NO: 59757 - DNA, 20 bp, Artificial Sequence
  Description of Artificial Sequence: Synthetic oligonucleotide
  Target: SCN9A; (-) strand; PAM type: YTN; PAM sequence: TTA
tattcattttttatgtaaag

SEQ ID NO: 59758 - DNA, 20 bp, Artificial Sequence
  Description of Artificial Sequence: Synthetic oligonucleotide
  Target: SCN9A; (-) strand; PAM type: YTN; PAM sequence: TTT
atattcattttttatgtaaa

SEQ ID NO: 59759 - DNA, 20 bp, Artificial Sequence
  Description of Artificial Sequence: Synthetic oligonucleotide
  Target: SCN9A; (-) strand; PAM type: YTN; PAM sequence: TTA
gtttatattcattttttatg

SEQ ID NO: 59760 - DNA, 20 bp, Artificial Sequence
  Description of Artificial Sequence: Synthetic oligonucleotide
  Target: SCN9A; (-) strand; PAM type: YTN; PAM sequence: TTT
agtttatattcattttttat

SEQ ID NO: 59761 - DNA, 20 bp, Artificial Sequence
  Description of Artificial Sequence: Synthetic oligonucleotide
  Target: SCN9A; (-) strand; PAM type: YTN; PAM sequence: TTT
tagtttatattcatttttta

SEQ ID NO: 59762 - DNA, 20 bp, Artificial Sequence
  Description of Artificial Sequence: Synthetic oligonucleotide
  Target: SCN9A; (-) strand; PAM type: YTN; PAM sequence: TTA
tcattttagtttatattcat

SEQ ID NO: 59763 - DNA, 20 bp, Artificial Sequence
  Description of Artificial Sequence: Synthetic oligonucleotide
  Target: SCN9A; (-) strand; PAM type: YTN; PAM sequence: TTG
aaatagagatatagaaatgt

SEQ ID NO: 59764 - DNA, 20 bp, Artificial Sequence
  Description of Artificial Sequence: Synthetic oligonucleotide
  Target: SCN9A; (-) strand; PAM type: YTN; PAM sequence: CTT
gaaatagagatatagaaatg

SEQ ID NO: 59765 - DNA, 20 bp, Artificial Sequence
  Description of Artificial Sequence: Synthetic oligonucleotide
  Target: SCN9A; (-) strand; PAM type: YTN; PAM sequence: TTC
ttgaaatagagatatagaaa

SEQ ID NO: 59766 - DNA, 20 bp, Artificial Sequence
  Description of Artificial Sequence: Synthetic oligonucleotide
  Target: SCN9A; (-) strand; PAM type: YTN; PAM sequence: TTT
cttgaaatagagatatagaa

SEQ ID NO: 59767 - DNA, 20 bp, Artificial Sequence
  Description of Artificial Sequence: Synthetic oligonucleotide
  Target: SCN9A; (-) strand; PAM type: YTN; PAM sequence: TTA
aaaaggtagtcaaagagttt

SEQ ID NO: 59768 - DNA, 20 bp, Artificial Sequence
  Description of Artificial Sequence: Synthetic oligonucleotide
  Target: SCN9A; (-) strand; PAM type: YTN; PAM sequence: TTA
gaattaaaaaggtagtcaaa

SEQ ID NO: 59769 - DNA, 20 bp, Artificial Sequence
  Description of Artificial Sequence: Synthetic oligonucleotide
  Target: SCN9A; (-) strand; PAM type: YTN; PAM sequence: TTT
agaattaaaaaggtagtcaa

SEQ ID NO: 59770 - DNA, 20 bp, Artificial Sequence
  Description of Artificial Sequence: Synthetic oligonucleotide
  Target: SCN9A; (-) strand; PAM type: YTN; PAM sequence: TTA
tttagaattaaaaaggtagt

SEQ ID NO: 59771 - DNA, 20 bp, Artificial Sequence
  Description of Artificial Sequence: Synthetic oligonucleotide
  Target: SCN9A; (-) strand; PAM type: YTN; PAM sequence: TTT
atttagaattaaaaaggtag

SEQ ID NO: 59772 - DNA, 20 bp, Artificial Sequence
  Description of Artificial Sequence: Synthetic oligonucleotide
  Target: SCN9A; (-) strand; PAM type: YTN; PAM sequence: CTT
tatttagaattaaaaaggta

SEQ ID NO: 59773 - DNA, 20 bp, Artificial Sequence
  Description of Artificial Sequence: Synthetic oligonucleotide
  Target: SCN9A; (-) strand; PAM type: YTN; PAM sequence: TTG
aaatcctttatttagaatta

SEQ ID NO: 59774 - DNA, 20 bp, Artificial Sequence
  Description of Artificial Sequence: Synthetic oligonucleotide
  Target: SCN9A; (-) strand; PAM type: YTN; PAM sequence: TTA
tgttgaaatcctttatttag

SEQ ID NO: 59775 - DNA, 20 bp, Artificial Sequence
  Description of Artificial Sequence: Synthetic oligonucleotide
  Target: SCN9A; (-) strand; PAM type: YTN; PAM sequence: TTT
atgttgaaatcctttattta

SEQ ID NO: 59776 - DNA, 20 bp, Artificial Sequence
  Description of Artificial Sequence: Synthetic oligonucleotide
  Target: SCN9A; (-) strand; PAM type: YTN; PAM sequence: TTG
acatccaataaagtgtttat

SEQ ID NO: 59777 - DNA, 20 bp, Artificial Sequence
  Description of Artificial Sequence: Synthetic oligonucleotide
  Target: SCN9A; (-) strand; PAM type: YTN; PAM sequence: CTA
tcaaggataatgttgacatc

SEQ ID NO: 59778 - DNA, 20 bp, Artificial Sequence
  Description of Artificial Sequence: Synthetic oligonucleotide
  Target: SCN9A; (-) strand; PAM type: YTN; PAM sequence: CTA
gaaatctatcaaggataatg

SEQ ID NO: 59779 - DNA, 20 bp, Artificial Sequence
  Description of Artificial Sequence: Synthetic oligonucleotide
  Target: SCN9A; (-) strand; PAM type: YTN; PAM sequence: CTC
agtacctagaaatctatcaa

SEQ ID NO: 59780 - DNA, 20 bp, Artificial Sequence
  Description of Artificial Sequence: Synthetic oligonucleotide
  Target: SCN9A; (-) strand; PAM type: YTN; PAM sequence: TTC
ctcagtacctagaaatctat

SEQ ID NO: 59781 - DNA, 20 bp, Artificial Sequence
  Description of Artificial Sequence: Synthetic oligonucleotide
  Target: SCN9A; (-) strand; PAM type: YTN; PAM sequence: CTT
cctcagtacctagaaatcta

SEQ ID NO: 59782 - DNA, 20 bp, Artificial Sequence
  Description of Artificial Sequence: Synthetic oligonucleotide
  Target: SCN9A; (-) strand; PAM type: YTN; PAM sequence: TTG
ataacttcctcagtacctag

SEQ ID NO: 59783 - DNA, 20 bp, Artificial Sequence
  Description of Artificial Sequence: Synthetic oligonucleotide
  Target: SCN9A; (-) strand; PAM type: YTN; PAM sequence: TTG
ggtatgataattgataactt

SEQ ID NO: 59784 - DNA, 20 bp, Artificial Sequence
  Description of Artificial Sequence: Synthetic oligonucleotide
  Target: SCN9A; (-) strand; PAM type: YTN; PAM sequence: TTT
gggtatgataattgataact

SEQ ID NO: 59785 - DNA, 20 bp, Artificial Sequence
  Description of Artificial Sequence: Synthetic oligonucleotide
  Target: SCN9A; (-) strand; PAM type: YTN; PAM sequence: TTC
agtttgggtatgataattga

SEQ ID NO: 59786 - DNA, 20 bp, Artificial Sequence
  Description of Artificial Sequence: Synthetic oligonucleotide
  Target: SCN9A; (-) strand; PAM type: YTN; PAM sequence: CTT
cagtttgggtatgataattg

SEQ ID NO: 59787 - DNA, 20 bp, Artificial Sequence
  Description of Artificial Sequence: Synthetic oligonucleotide
  Target: SCN9A; (-) strand; PAM type: YTN; PAM sequence: TTG
gaaagtccttcagtttgggt

SEQ ID NO: 59788 - DNA, 20 bp, Artificial Sequence
  Description of Artificial Sequence: Synthetic oligonucleotide
  Target: SCN9A; (-) strand; PAM type: YTN; PAM sequence: TTA
tgtaatcaattggaaagtcc

SEQ ID NO: 59789 - DNA, 20 bp, Artificial Sequence
  Description of Artificial Sequence: Synthetic oligonucleotide
  Target: SCN9A; (-) strand; PAM type: YTN; PAM sequence: TTT
atgtaatcaattggaaagtc

SEQ ID NO: 59790 - DNA, 20 bp, Artificial Sequence
  Description of Artificial Sequence: Synthetic oligonucleotide
  Target: SCN9A; (-) strand; PAM type: YTN; PAM sequence: TTT
tatgtaatcaattggaaagt

SEQ ID NO: 59791 - DNA, 20 bp, Artificial Sequence
  Description of Artificial Sequence: Synthetic oligonucleotide
  Target: SCN9A; (-) strand; PAM type: YTN; PAM sequence: CTT
ttatgtaatcaattggaaag

SEQ ID NO: 59792 - DNA, 20 bp, Artificial Sequence
  Description of Artificial Sequence: Synthetic oligonucleotide
  Target: SCN9A; (-) strand; PAM type: YTN; PAM sequence: TTC
ttttatgtaatcaattggaa

SEQ ID NO: 59793 - DNA, 20 bp, Artificial Sequence
  Description of Artificial Sequence: Synthetic oligonucleotide
  Target: SCN9A; (-) strand; PAM type: YTN; PAM sequence: TTT
cttttatgtaatcaattgga

SEQ ID NO: 59794 - DNA, 20 bp, Artificial Sequence
  Description of Artificial Sequence: Synthetic oligonucleotide
  Target: SCN9A; (-) strand; PAM type: YTN; PAM sequence: TTT
tcttttatgtaatcaattgg

SEQ ID NO: 59795 - DNA, 20 bp, Artificial Sequence
  Description of Artificial Sequence: Synthetic oligonucleotide
  Target: SCN9A; (-) strand; PAM type: YTN; PAM sequence: TTA
tattttcttttatgtaatca

SEQ ID NO: 59796 - DNA, 20 bp, Artificial Sequence
  Description of Artificial Sequence: Synthetic oligonucleotide
  Target: SCN9A; (-) strand; PAM type: YTN; PAM sequence: TTA
aaagttatattttcttttat

SEQ ID NO: 59797 - DNA, 20 bp, Artificial Sequence
  Description of Artificial Sequence: Synthetic oligonucleotide
  Target: SCN9A; (-) strand; PAM type: YTN; PAM sequence: TTT
aaaagttatattttctttta

SEQ ID NO: 59798 - DNA, 20 bp, Artificial Sequence
  Description of Artificial Sequence: Synthetic oligonucleotide
  Target: SCN9A; (-) strand; PAM type: YTN; PAM sequence: TTT
taaaagttatattttctttt

SEQ ID NO: 59799 - DNA, 20 bp, Artificial Sequence
  Description of Artificial Sequence: Synthetic oligonucleotide
  Target: SCN9A; (-) strand; PAM type: YTN; PAM sequence: TTG
aattttaaaagttatatttt

SEQ ID NO: 59800 - DNA, 20 bp, Artificial Sequence
  Description of Artificial Sequence: Synthetic oligonucleotide
  Target: SCN9A; (-) strand; PAM type: YTN; PAM sequence: CTG
ttgaattttaaaagttatat

SEQ ID NO: 59801 - DNA, 20 bp, Artificial Sequence
  Description of Artificial Sequence: Synthetic oligonucleotide
  Target: SCN9A; (-) strand; PAM type: YTN; PAM sequence: TTA
ctgttgaattttaaaagtta

SEQ ID NO: 59802 - DNA, 20 bp, Artificial Sequence
  Description of Artificial Sequence: Synthetic oligonucleotide
  Target: SCN9A; (-) strand; PAM type: YTN; PAM sequence: TTT
actgttgaattttaaaagtt

SEQ ID NO: 59803 - DNA, 20 bp, Artificial Sequence
  Description of Artificial Sequence: Synthetic oligonucleotide
  Target: SCN9A; (-) strand; PAM type: YTN; PAM sequence: TTA
tttactgttgaattttaaaa

SEQ ID NO: 59804 - DNA, 20 bp, Artificial Sequence
  Description of Artificial Sequence: Synthetic oligonucleotide
  Target: SCN9A; (-) strand; PAM type: YTN; PAM sequence: TTA
tgttatttactgttgaattt

SEQ ID NO: 59805 - DNA, 20 bp, Artificial Sequence
  Description of Artificial Sequence: Synthetic oligonucleotide
  Target: SCN9A; (-) strand; PAM type: YTN; PAM sequence: TTA
gatgttatgttatttactgt

SEQ ID NO: 59806 - DNA, 20 bp, Artificial Sequence
  Description of Artificial Sequence: Synthetic oligonucleotide
  Target: SCN9A; (-) strand; PAM type: YTN; PAM sequence: TTT
agatgttatgttatttactg

SEQ ID NO: 59807 - DNA, 20 bp, Artificial Sequence
  Description of Artificial Sequence: Synthetic oligonucleotide
  Target: SCN9A; (-) strand; PAM type: YTN; PAM sequence: CTC
atttagatgttatgttattt

SEQ ID NO: 59808 - DNA, 20 bp, Artificial Sequence
  Description of Artificial Sequence: Synthetic oligonucleotide
  Target: SCN9A; (-) strand; PAM type: YTN; PAM sequence: TTC
cagtcaaaaacctcatttag

SEQ ID NO: 59809 - DNA, 20 bp, Artificial Sequence
  Description of Artificial Sequence: Synthetic oligonucleotide
  Target: SCN9A; (-) strand; PAM type: YTN; PAM sequence: TTT
ccagtcaaaaacctcattta

SEQ ID NO: 59810 - DNA, 20 bp, Artificial Sequence
  Description of Artificial Sequence: Synthetic oligonucleotide
  Target: SCN9A; (-) strand; PAM type: YTN; PAM sequence: TTT
tccagtcaaaaacctcattt

SEQ ID NO: 59811 - DNA, 20 bp, Artificial Sequence
  Description of Artificial Sequence: Synthetic oligonucleotide
  Target: SCN9A; (-) strand; PAM type: YTN; PAM sequence: CTT
ttccagtcaaaaacctcatt

SEQ ID NO: 59812 - DNA, 20 bp, Artificial Sequence
  Description of Artificial Sequence: Synthetic oligonucleotide
  Target: SCN9A; (-) strand; PAM type: YTN; PAM sequence: TTA
ggcttttccagtcaaaaacc

SEQ ID NO: 59813 - DNA, 20 bp, Artificial Sequence
  Description of Artificial Sequence: Synthetic oligonucleotide
  Target: SCN9A; (-) strand; PAM type: YTN; PAM sequence: TTT
aggcttttccagtcaaaaac

SEQ ID NO: 59814 - DNA, 20 bp, Artificial Sequence
  Description of Artificial Sequence: Synthetic oligonucleotide
  Target: SCN9A; (-) strand; PAM type: YTN; PAM sequence: TTG
taagatttaggcttttccag

SEQ ID NO: 59815 - DNA, 20 bp, Artificial Sequence
  Description of Artificial Sequence: Synthetic oligonucleotide
  Target: SCN9A; (-) strand; PAM type: YTN; PAM sequence: TTT
gtaagatttaggcttttcca

SEQ ID NO: 59816 - DNA, 20 bp, Artificial Sequence
  Description of Artificial Sequence: Synthetic oligonucleotide
  Target: SCN9A; (-) strand; PAM type: YTN; PAM sequence: CTT
tgtaagatttaggcttttcc

SEQ ID NO: 59817 - DNA, 20 bp, Artificial Sequence
  Description of Artificial Sequence: Synthetic oligonucleotide
  Target: SCN9A; (-) strand; PAM type: YTN; PAM sequence: CTA
gcccccctttgtaagattta

SEQ ID NO: 59818 - DNA, 20 bp, Artificial Sequence
  Description of Artificial Sequence: Synthetic oligonucleotide
  Target: SCN9A; (-) strand; PAM type: YTN; PAM sequence: TTC
tagcccccctttgtaagatt

SEQ ID NO: 59819 - DNA, 20 bp, Artificial Sequence
  Description of Artificial Sequence: Synthetic oligonucleotide
  Target: SCN9A; (-) strand; PAM type: YTN; PAM sequence: CTT
ctagcccccctttgtaagat

SEQ ID NO: 59820 - DNA, 20 bp, Artificial Sequence
  Description of Artificial Sequence: Synthetic oligonucleotide
  Target: SCN9A; (-) strand; PAM type: YTN; PAM sequence: CTG
aagcttctagcccccctttg

SEQ ID NO: 59821 - DNA, 20 bp, Artificial Sequence
  Description of Artificial Sequence: Synthetic oligonucleotide
  Target: SCN9A; (-) strand; PAM type: YTN; PAM sequence: TTA
gcagagaacaaagggagcaa

SEQ ID NO: 59822 - DNA, 20 bp, Artificial Sequence
  Description of Artificial Sequence: Synthetic oligonucleotide
  Target: SCN9A; (-) strand; PAM type: YTN; PAM sequence: TTA
agaaattagcagagaacaaa

SEQ ID NO: 59823 - DNA, 20 bp, Artificial Sequence
  Description of Artificial Sequence: Synthetic oligonucleotide
  Target: SCN9A; (-) strand; PAM type: YTN; PAM sequence: CTT
aagaaattagcagagaacaa

SEQ ID NO: 59824 - DNA, 20 bp, Artificial Sequence
  Description of Artificial Sequence: Synthetic oligonucleotide
  Target: SCN9A; (-) strand; PAM type: YTN; PAM sequence: CTA
acttaagaaattagcagaga

SEQ ID NO: 59825 - DNA, 20 bp, Artificial Sequence
  Description of Artificial Sequence: Synthetic oligonucleotide
  Target: SCN9A; (-) strand; PAM type: YTN; PAM sequence: TTA
cagctaacttaagaaattag

SEQ ID NO: 59826 - DNA, 20 bp, Artificial Sequence
  Description of Artificial Sequence: Synthetic oligonucleotide
  Target: SCN9A; (-) strand; PAM type: YTN; PAM sequence: CTT
acagctaacttaagaaatta

SEQ ID NO: 59827 - DNA, 20 bp, Artificial Sequence
  Description of Artificial Sequence: Synthetic oligonucleotide
  Target: SCN9A; (-) strand; PAM type: YTN; PAM sequence: CTG
taaaacttacagctaactta

SEQ ID NO: 59828 - DNA, 20 bp, Artificial Sequence
  Description of Artificial Sequence: Synthetic oligonucleotide
  Target: SCN9A; (-) strand; PAM type: YTN; PAM sequence: CTA
atgtagaatatacataaatc

SEQ ID NO: 59829 - DNA, 20 bp, Artificial Sequence
  Description of Artificial Sequence: Synthetic oligonucleotide
  Target: SCN9A; (-) strand; PAM type: YTN; PAM sequence: TTA
tagactaatgtagaatatac

SEQ ID NO: 59830 - DNA, 20 bp, Artificial Sequence
  Description of Artificial Sequence: Synthetic oligonucleotide
  Target: SCN9A; (-) strand; PAM type: YTN; PAM sequence: TTA
aaaaggtgaaattatagact

SEQ ID NO: 59831 - DNA, 20 bp, Artificial Sequence
  Description of Artificial Sequence: Synthetic oligonucleotide
  Target: SCN9A; (-) strand; PAM type: YTN; PAM sequence: CTT
aaaaaggtgaaattatagac

SEQ ID NO: 59832 - DNA, 20 bp, Artificial Sequence
  Description of Artificial Sequence: Synthetic oligonucleotide
  Target: SCN9A; (-) strand; PAM type: YTN; PAM sequence: CTG
tgacttaaaaaggtgaaatt

SEQ ID NO: 59833 - DNA, 20 bp, Artificial Sequence
  Description of Artificial Sequence: Synthetic oligonucleotide
  Target: SCN9A; (-) strand; PAM type: YTN; PAM sequence: TTA
tgctgtgacttaaaaaggtg

SEQ ID NO: 59834 - DNA, 20 bp, Artificial Sequence
  Description of Artificial Sequence: Synthetic oligonucleotide
  Target: SCN9A; (-) strand; PAM type: YTN; PAM sequence: TTT
atgctgtgacttaaaaaggt

SEQ ID NO: 59835 - DNA, 20 bp, Artificial Sequence
  Description of Artificial Sequence: Synthetic oligonucleotide
  Target: SCN9A; (-) strand; PAM type: YTN; PAM sequence: CTA
atttatgctgtgacttaaaa

SEQ ID NO: 59836 - DNA, 20 bp, Artificial Sequence
  Description of Artificial Sequence: Synthetic oligonucleotide
  Target: SCN9A; (-) strand; PAM type: YTN; PAM sequence: TTA
tactaatttatgctgtgact

SEQ ID NO: 59837 - DNA, 20 bp, Artificial Sequence
  Description of Artificial Sequence: Synthetic oligonucleotide
  Target: SCN9A; (-) strand; PAM type: YTN; PAM sequence: TTA
tatggattatactaatttat

SEQ ID NO: 59838 - DNA, 20 bp, Artificial Sequence
  Description of Artificial Sequence: Synthetic oligonucleotide
  Target: SCN9A; (-) strand; PAM type: YTN; PAM sequence: TTA
attatatggattatactaat

SEQ ID NO: 59839 - DNA, 20 bp, Artificial Sequence
  Description of Artificial Sequence: Synthetic oligonucleotide
  Target: SCN9A; (-) strand; PAM type: YTN; PAM sequence: CTT
aattatatggattatactaa

SEQ ID NO: 59840 - DNA, 20 bp, Artificial Sequence
  Description of Artificial Sequence: Synthetic oligonucleotide
  Target: SCN9A; (-) strand; PAM type: YTN; PAM sequence: TTC
ttaattatatggattatact

SEQ ID NO: 59841 - DNA, 20 bp, Artificial Sequence
  Description of Artificial Sequence: Synthetic oligonucleotide
  Target: SCN9A; (-) strand; PAM type: YTN; PAM sequence: TTG
aaaataaattcttaattata

SEQ ID NO: 59842 - DNA, 20 bp, Artificial Sequence
  Description of Artificial Sequence: Synthetic oligonucleotide
  Target: SCN9A; (-) strand; PAM type: YTN; PAM sequence: CTT
gaaaataaattcttaattat

SEQ ID NO: 59843 - DNA, 20 bp, Artificial Sequence
  Description of Artificial Sequence: Synthetic oligonucleotide
  Target: SCN9A; (-) strand; PAM type: YTN; PAM sequence: CTA
taaatccttgaaaataaatt

SEQ ID NO: 59844 - DNA, 20 bp, Artificial Sequence
  Description of Artificial Sequence: Synthetic oligonucleotide
  Target: SCN9A; (-) strand; PAM type: YTN; PAM sequence: CTC
agaactataaatccttgaaa

SEQ ID NO: 59845 - DNA, 20 bp, Artificial Sequence
  Description of Artificial Sequence: Synthetic oligonucleotide
  Target: SCN9A; (-) strand; PAM type: YTN; PAM sequence: TTA
agtaatgatctcagaactat

SEQ ID NO: 59846 - DNA, 20 bp, Artificial Sequence
  Description of Artificial Sequence: Synthetic oligonucleotide
  Target: SCN9A; (-) strand; PAM type: YTN; PAM sequence: CTA
caagttaagtaatgatctca

SEQ ID NO: 59847 - DNA, 20 bp, Artificial Sequence
  Description of Artificial Sequence: Synthetic oligonucleotide
  Target: SCN9A; (-) strand; PAM type: YTN; PAM sequence: TTC
cagcaccctacaagttaagt

SEQ ID NO: 59848 - DNA, 20 bp, Artificial Sequence
  Description of Artificial Sequence: Synthetic oligonucleotide
  Target: SCN9A; (-) strand; PAM type: YTN; PAM sequence: TTA
attccagcaccctacaagtt

SEQ ID NO: 59849 - DNA, 20 bp, Artificial Sequence
  Description of Artificial Sequence: Synthetic oligonucleotide
  Target: SCN9A; (-) strand; PAM type: YTN; PAM sequence: TTT
aattccagcaccctacaagt

SEQ ID NO: 59850 - DNA, 20 bp, Artificial Sequence
  Description of Artificial Sequence: Synthetic oligonucleotide
  Target: SCN9A; (-) strand; PAM type: YTN; PAM sequence: CTT
taattccagcaccctacaag

SEQ ID NO: 59851 - DNA, 20 bp, Artificial Sequence
  Description of Artificial Sequence: Synthetic oligonucleotide
  Target: SCN9A; (-) strand; PAM type: YTN; PAM sequence: TTA
ccaaatccaagagaataaag

SEQ ID NO: 59852 - DNA, 20 bp, Artificial Sequence
  Description of Artificial Sequence: Synthetic oligonucleotide
  Target: SCN9A; (-) strand; PAM type: YTN; PAM sequence: CTG
aatattaccaaatccaagag

SEQ ID NO: 59853 - DNA, 20 bp, Artificial Sequence
  Description of Artificial Sequence: Synthetic oligonucleotide
  Target: SCN9A; (-) strand; PAM type: YTN; PAM sequence: TTA
aaaaaataagtaaataagag

SEQ ID NO: 59854 - DNA, 20 bp, Artificial Sequence
  Description of Artificial Sequence: Synthetic oligonucleotide
  Target: SCN9A; (-) strand; PAM type: YTN; PAM sequence: TTC
aatagcaaacaattaaaaaa

SEQ ID NO: 59855 - DNA, 20 bp, Artificial Sequence
  Description of Artificial Sequence: Synthetic oligonucleotide
  Target: SCN9A; (-) strand; PAM type: YTN; PAM sequence: TTC
ccattcaatagcaaacaatt

SEQ ID NO: 59856 - DNA, 20 bp, Artificial Sequence
  Description of Artificial Sequence: Synthetic oligonucleotide
  Target: SCN9A; (-) strand; PAM type: YTN; PAM sequence: CTT
cccattcaatagcaaacaat

SEQ ID NO: 59857 - DNA, 20 bp, Artificial Sequence
  Description of Artificial Sequence: Synthetic oligonucleotide
  Target: SCN9A; (-) strand; PAM type: YTN; PAM sequence: TTC
aatataatgggaagcttccc

SEQ ID NO: 59858 - DNA, 20 bp, Artificial Sequence
  Description of Artificial Sequence: Synthetic oligonucleotide
  Target: SCN9A; (-) strand; PAM type: YTN; PAM sequence: TTG
atgaataagaaaattcaata

SEQ ID NO: 59859 - DNA, 20 bp, Artificial Sequence
  Description of Artificial Sequence: Synthetic oligonucleotide
  Target: SCN9A; (-) strand; PAM type: YTN; PAM sequence: TTT
gatgaataagaaaattcaat

SEQ ID NO: 59860 - DNA, 20 bp, Artificial Sequence
  Description of Artificial Sequence: Synthetic oligonucleotide
  Target: SCN9A; (-) strand; PAM type: YTN; PAM sequence: TTA
ggtgtttgatgaataagaaa

SEQ ID NO: 59861 - DNA, 20 bp, Artificial Sequence
  Description of Artificial Sequence: Synthetic oligonucleotide
  Target: SCN9A; (-) strand; PAM type: YTN; PAM sequence: TTA
ccattaggtgtttgatgaat

SEQ ID NO: 59862 - DNA, 20 bp, Artificial Sequence
  Description of Artificial Sequence: Synthetic oligonucleotide
  Target: SCN9A; (-) strand; PAM type: YTN; PAM sequence: CTG
gttaccattaggtgtttgat

SEQ ID NO: 59863 - DNA, 20 bp, Artificial Sequence
  Description of Artificial Sequence: Synthetic oligonucleotide
  Target: SCN9A; (-) strand; PAM type: YTN; PAM sequence: CTA
aggcagaaagggaagtctgg

SEQ ID NO: 59864 - DNA, 20 bp, Artificial Sequence
  Description of Artificial Sequence: Synthetic oligonucleotide
  Target: SCN9A; (-) strand; PAM type: YTN; PAM sequence: CTC
taaggcagaaagggaagtct

SEQ ID NO: 59865 - DNA, 20 bp, Artificial Sequence
  Description of Artificial Sequence: Synthetic oligonucleotide
  Target: SCN9A; (-) strand; PAM type: YTN; PAM sequence: CTC
catcaaaaacaacaacaaca

SEQ ID NO: 59866 - DNA, 20 bp, Artificial Sequence
  Description of Artificial Sequence: Synthetic oligonucleotide
  Target: SCN9A; (-) strand; PAM type: YTN; PAM sequence: CTC
agagcaagactccatcaaaa

SEQ ID NO: 59867 - DNA, 20 bp, Artificial Sequence
  Description of Artificial Sequence: Synthetic oligonucleotide
  Target: SCN9A; (-) strand; PAM type: YTN; PAM sequence: CTG
tgcctcagagcaagactcca

SEQ ID NO: 59868 - DNA, 20 bp, Artificial Sequence
  Description of Artificial Sequence: Synthetic oligonucleotide
  Target: SCN9A; (-) strand; PAM type: YTN; PAM sequence: CTC
cagcctgtgcctcagagcaa

SEQ ID NO: 59869 - DNA, 20 bp, Artificial Sequence
  Description of Artificial Sequence: Synthetic oligonucleotide
  Target: SCN9A; (-) strand; PAM type: YTN; PAM sequence: CTG
cactccagcctgtgcctcag

SEQ ID NO: 59870 - DNA, 20 bp, Artificial Sequence
  Description of Artificial Sequence: Synthetic oligonucleotide
  Target: SCN9A; (-) strand; PAM type: YTN; PAM sequence: TTG
cagtgagccaagatggtggc

SEQ ID NO: 59871 - DNA, 20 bp, Artificial Sequence
  Description of Artificial Sequence: Synthetic oligonucleotide
  Target: SCN9A; (-) strand; PAM type: YTN; PAM sequence: TTG
aacccaggaggtggaggttg

SEQ ID NO: 59872 - DNA, 20 bp, Artificial Sequence
  Description of Artificial Sequence: Synthetic oligonucleotide
  Target: SCN9A; (-) strand; PAM type: YTN; PAM sequence: CTT
gaacccaggaggtggaggtt

SEQ ID NO: 59873 - DNA, 20 bp, Artificial Sequence
  Description of Artificial Sequence: Synthetic oligonucleotide
  Target: SCN9A; (-) strand; PAM type: YTN; PAM sequence: TTA
cttgaacccaggaggtggag

SEQ ID NO: 59874 - DNA, 20 bp, Artificial Sequence
  Description of Artificial Sequence: Synthetic oligonucleotide
  Target: SCN9A; (-) strand; PAM type: YTN; PAM sequence: CTG
agacatgagaattacttgaa

SEQ ID NO: 59875 - DNA, 20 bp, Artificial Sequence
  Description of Artificial Sequence: Synthetic oligonucleotide
  Target: SCN9A; (-) strand; PAM type: YTN; PAM sequence: TTG
ggaggctgagacatgagaat

SEQ ID NO: 59876 - DNA, 20 bp, Artificial Sequence
  Description of Artificial Sequence: Synthetic oligonucleotide
  Target: SCN9A; (-) strand; PAM type: YTN; PAM sequence: CTT
gggaggctgagacatgagaa

SEQ ID NO: 59877 - DNA, 20 bp, Artificial Sequence
  Description of Artificial Sequence: Synthetic oligonucleotide
  Target: SCN9A; (-) strand; PAM type: YTN; PAM sequence: CTA
cttgggaggctgagacatga

SEQ ID NO: 59878 - DNA, 20 bp, Artificial Sequence
  Description of Artificial Sequence: Synthetic oligonucleotide
  Target: SCN9A; (-) strand; PAM type: YTN; PAM sequence: CTG
taatcccagctacttgggag

SEQ ID NO: 59879 - DNA, 20 bp, Artificial Sequence
  Description of Artificial Sequence: Synthetic oligonucleotide
  Target: SCN9A; (-) strand; PAM type: YTN; PAM sequence: CTG
atgtggtggcatgcacctgt

SEQ ID NO: 59880 - DNA, 20 bp, Artificial Sequence
  Description of Artificial Sequence: Synthetic oligonucleotide
  Target: SCN9A; (-) strand; PAM type: YTN; PAM sequence: TTA
gcctgatgtggtggcatgca

SEQ ID NO: 59881 - DNA, 20 bp, Artificial Sequence
  Description of Artificial Sequence: Synthetic oligonucleotide
  Target: SCN9A; (-) strand; PAM type: YTN; PAM sequence: CTA
aaaatacaaaaattagcctg

SEQ ID NO: 59882 - DNA, 20 bp, Artificial Sequence
  Description of Artificial Sequence: Synthetic oligonucleotide
  Target: SCN9A; (-) strand; PAM type: YTN; PAM sequence: CTA
ctaaaaatacaaaaattagc

SEQ ID NO: 59883 - DNA, 20 bp, Artificial Sequence
  Description of Artificial Sequence: Synthetic oligonucleotide
  Target: SCN9A; (-) strand; PAM type: YTN; PAM sequence: CTC
tactaaaaatacaaaaatta

SEQ ID NO: 59884 - DNA, 20 bp, Artificial Sequence
  Description of Artificial Sequence: Synthetic oligonucleotide
  Target: SCN9A; (-) strand; PAM type: YTN; PAM sequence: CTG
tctctactaaaaatacaaaa

SEQ ID NO: 59885 - DNA, 20 bp, Artificial Sequence
  Description of Artificial Sequence: Synthetic oligonucleotide
  Target: SCN9A; (-) strand; PAM type: YTN; PAM sequence: TTC
aaaaccagaccagccaacat

SEQ ID NO: 59886 - DNA, 20 bp, Artificial Sequence
  Description of Artificial Sequence: Synthetic oligonucleotide
  Target: SCN9A; (-) strand; PAM type: YTN; PAM sequence: TTG
aggccaggagttcaaaacca

SEQ ID NO: 59887 - DNA, 20 bp, Artificial Sequence
  Description of Artificial Sequence: Synthetic oligonucleotide
  Target: SCN9A; (-) strand; PAM type: YTN; PAM sequence: CTT
gaggccaggagttcaaaacc

SEQ ID NO: 59888 - DNA, 20 bp, Artificial Sequence
  Description of Artificial Sequence: Synthetic oligonucleotide
  Target: SCN9A; (-) strand; PAM type: YTN; PAM sequence: CTG
gcagatcacttgaggccagg

SEQ ID NO: 59889 - DNA, 20 bp, Artificial Sequence
  Description of Artificial Sequence: Synthetic oligonucleotide
  Target: SCN9A; (-) strand; PAM type: YTN; PAM sequence: TTG
ggaggccaaggctggcagat

SEQ ID NO: 59890 - DNA, 20 bp, Artificial Sequence
  Description of Artificial Sequence: Synthetic oligonucleotide
  Target: SCN9A; (-) strand; PAM type: YTN; PAM sequence: TTT
gggaggccaaggctggcaga

SEQ ID NO: 59891 - DNA, 20 bp, Artificial Sequence
  Description of Artificial Sequence: Synthetic oligonucleotide
  Target: SCN9A; (-) strand; PAM type: YTN; PAM sequence: CTT
tgggaggccaaggctggcag

SEQ ID NO: 59892 - DNA, 20 bp, Artificial Sequence
  Description of Artificial Sequence: Synthetic oligonucleotide
  Target: SCN9A; (-) strand; PAM type: YTN; PAM sequence: CTG
taatcccagcactttgggag

SEQ ID NO: 59893 - DNA, 20 bp, Artificial Sequence
  Description of Artificial Sequence: Synthetic oligonucleotide
  Target: SCN9A; (-) strand; PAM type: YTN; PAM sequence: CTC
acgcctgtaatcccagcact

SEQ ID NO: 59894 - DNA, 20 bp, Artificial Sequence
  Description of Artificial Sequence: Synthetic oligonucleotide
  Target: SCN9A; (-) strand; PAM type: YTN; PAM sequence: CTA
aggtggccggatatggtggc

SEQ ID NO: 59895 - DNA, 20 bp, Artificial Sequence
  Description of Artificial Sequence: Synthetic oligonucleotide
  Target: SCN9A; (-) strand; PAM type: YTN; PAM sequence: CTC
taaggtggccggatatggtg

SEQ ID NO: 59896 - DNA, 20 bp, Artificial Sequence
  Description of Artificial Sequence: Synthetic oligonucleotide
  Target: SCN9A; (-) strand; PAM type: YTN; PAM sequence: TTA
aaacactctaaggtggccgg

SEQ ID NO: 59897 - DNA, 20 bp, Artificial Sequence
  Description of Artificial Sequence: Synthetic oligonucleotide
  Target: SCN9A; (-) strand; PAM type: YTN; PAM sequence: CTG
aattaaaacactctaaggtg

SEQ ID NO: 59898 - DNA, 20 bp, Artificial Sequence
  Description of Artificial Sequence: Synthetic oligonucleotide
  Target: SCN9A; (-) strand; PAM type: YTN; PAM sequence: TTA
aatagaggaaagctgaatta

SEQ ID NO: 59899 - DNA, 20 bp, Artificial Sequence
  Description of Artificial Sequence: Synthetic oligonucleotide
  Target: SCN9A; (-) strand; PAM type: YTN; PAM sequence: CTG
catattaaatagaggaaagc

SEQ ID NO: 59900 - DNA, 20 bp, Artificial Sequence
  Description of Artificial Sequence: Synthetic oligonucleotide
  Target: SCN9A; (-) strand; PAM type: YTN; PAM sequence: TTA
cataaagactgcatattaaa

SEQ ID NO: 59901 - DNA, 20 bp, Artificial Sequence
  Description of Artificial Sequence: Synthetic oligonucleotide
  Target: SCN9A; (-) strand; PAM type: YTN; PAM sequence: TTG
ccagtaggtgagatgaatat

SEQ ID NO: 59902 - DNA, 20 bp, Artificial Sequence
  Description of Artificial Sequence: Synthetic oligonucleotide
  Target: SCN9A; (-) strand; PAM type: YTN; PAM sequence: CTT
gccagtaggtgagatgaata

SEQ ID NO: 59903 - DNA, 20 bp, Artificial Sequence
  Description of Artificial Sequence: Synthetic oligonucleotide
  Target: SCN9A; (-) strand; PAM type: YTN; PAM sequence: CTC
atgccttgccagtaggtgag

SEQ ID NO: 59904 - DNA, 20 bp, Artificial Sequence
  Description of Artificial Sequence: Synthetic oligonucleotide
  Target: SCN9A; (-) strand; PAM type: YTN; PAM sequence: CTC
tcatgccttgccagtaggtg

SEQ ID NO: 59905 - DNA, 20 bp, Artificial Sequence
  Description of Artificial Sequence: Synthetic oligonucleotide
  Target: SCN9A; (-) strand; PAM type: YTN; PAM sequence: CTC
tctcatgccttgccagtagg

SEQ ID NO: 59906 - DNA, 20 bp, Artificial Sequence
  Description of Artificial Sequence: Synthetic oligonucleotide
  Target: SCN9A; (-) strand; PAM type: YTN; PAM sequence: CTG
tctctctcatgccttgccag

SEQ ID NO: 59907 - DNA, 20 bp, Artificial Sequence
  Description of Artificial Sequence: Synthetic oligonucleotide
  Target: SCN9A; (-) strand; PAM type: YTN; PAM sequence: TTG
acatgaagtctgtctctctc

SEQ ID NO: 59908 - DNA, 20 bp, Artificial Sequence
  Description of Artificial Sequence: Synthetic oligonucleotide
  Target: SCN9A; (-) strand; PAM type: YTN; PAM sequence: TTG
acattgacatgaagtctgtc

SEQ ID NO: 59909 - DNA, 20 bp, Artificial Sequence
  Description of Artificial Sequence: Synthetic oligonucleotide
  Target: SCN9A; (-) strand; PAM type: YTN; PAM sequence: CTT
gacattgacatgaagtctgt

SEQ ID NO: 59910 - DNA, 20 bp, Artificial Sequence
  Description of Artificial Sequence: Synthetic oligonucleotide
  Target: SCN9A; (-) strand; PAM type: YTN; PAM sequence: CTC
ttgacattgacatgaagtct

SEQ ID NO: 59911 - DNA, 20 bp, Artificial Sequence
  Description of Artificial Sequence: Synthetic oligonucleotide
  Target: SCN9A; (-) strand; PAM type: YTN; PAM sequence: TTC
tcttgacattgacatgaagt

SEQ ID NO: 59912 - DNA, 20 bp, Artificial Sequence
  Description of Artificial Sequence: Synthetic oligonucleotide
  Target: SCN9A; (-) strand; PAM type: YTN; PAM sequence: TTT
ctcttgacattgacatgaag

SEQ ID NO: 59913 - DNA, 20 bp, Artificial Sequence
  Description of Artificial Sequence: Synthetic oligonucleotide
  Target: SCN9A; (-) strand; PAM type: YTN; PAM sequence: CTG
ggtttctcttgacattgaca

SEQ ID NO: 59914 - DNA, 20 bp, Artificial Sequence
  Description of Artificial Sequence: Synthetic oligonucleotide
  Target: SCN9A; (-) strand; PAM type: YTN; PAM sequence: TTA
atgaacagtaaaggatctgg

SEQ ID NO: 59915 - DNA, 20 bp, Artificial Sequence
  Description of Artificial Sequence: Synthetic oligonucleotide
  Target: SCN9A; (-) strand; PAM type: YTN; PAM sequence: TTC
agtccccattaatgaacagt

SEQ ID NO: 59916 - DNA, 20 bp, Artificial Sequence
  Description of Artificial Sequence: Synthetic oligonucleotide
  Target: SCN9A; (-) strand; PAM type: YTN; PAM sequence: TTT
cagtccccattaatgaacag

SEQ ID NO: 59917 - DNA, 20 bp, Artificial Sequence
  Description of Artificial Sequence: Synthetic oligonucleotide
  Target: SCN9A; (-) strand; PAM type: YTN; PAM sequence: TTT
tcagtccccattaatgaaca

SEQ ID NO: 59918 - DNA, 20 bp, Artificial Sequence
  Description of Artificial Sequence: Synthetic oligonucleotide
  Target: SCN9A; (-) strand; PAM type: YTN; PAM sequence: CTG
taattttcagtccccattaa

SEQ ID NO: 59919 - DNA, 20 bp, Artificial Sequence
  Description of Artificial Sequence: Synthetic oligonucleotide
  Target: SCN9A; (-) strand; PAM type: YTN; PAM sequence: TTG
gcatgctgtaattttcagtc

SEQ ID NO: 59920 - DNA, 20 bp, Artificial Sequence
  Description of Artificial Sequence: Synthetic oligonucleotide
  Target: SCN9A; (-) strand; PAM type: YTN; PAM sequence: CTT
ggcatgctgtaattttcagt

SEQ ID NO: 59921 - DNA, 20 bp, Artificial Sequence
  Description of Artificial Sequence: Synthetic oligonucleotide
  Target: SCN9A; (-) strand; PAM type: YTN; PAM sequence: TTC
ttggcatgctgtaattttca

SEQ ID NO: 59922 - DNA, 20 bp, Artificial Sequence
  Description of Artificial Sequence: Synthetic oligonucleotide
  Target: SCN9A; (-) strand; PAM type: YTN; PAM sequence: CTG
tcaagttcttggcatgctgt

SEQ ID NO: 59923 - DNA, 20 bp, Artificial Sequence
  Description of Artificial Sequence: Synthetic oligonucleotide
  Target: SCN9A; (-) strand; PAM type: YTN; PAM sequence: TTC
tgtcaagttcttggcatgct

SEQ ID NO: 59924 - DNA, 20 bp, Artificial Sequence
  Description of Artificial Sequence: Synthetic oligonucleotide
  Target: SCN9A; (-) strand; PAM type: YTN; PAM sequence: CTT
ctgtcaagttcttggcatgc

SEQ ID NO: 59925 - DNA, 20 bp, Artificial Sequence
  Description of Artificial Sequence: Synthetic oligonucleotide
  Target: SCN9A; (-) strand; PAM type: YTN; PAM sequence: TTC
ttctgtcaagttcttggcat

SEQ ID NO: 59926 - DNA, 20 bp, Artificial Sequence
  Description of Artificial Sequence: Synthetic oligonucleotide
  Target: SCN9A; (-) strand; PAM type: YTN; PAM sequence: CTT
cttctgtcaagttcttggca

SEQ ID NO: 59927 - DNA, 20 bp, Artificial Sequence
  Description of Artificial Sequence: Synthetic oligonucleotide
  Target: SCN9A; (-) strand; PAM type: YTN; PAM sequence: CTC
cagcttcttctgtcaagttc

SEQ ID NO: 59928 - DNA, 20 bp, Artificial Sequence
  Description of Artificial Sequence: Synthetic oligonucleotide
  Target: SCN9A; (-) strand; PAM type: YTN; PAM sequence: TTC
tccagcttcttctgtcaagt

SEQ ID NO: 59929 - DNA, 20 bp, Artificial Sequence
  Description of Artificial Sequence: Synthetic oligonucleotide
  Target: SCN9A; (-) strand; PAM type: YTN; PAM sequence: TTT
ctccagcttcttctgtcaag

SEQ ID NO: 59930 - DNA, 20 bp, Artificial Sequence
  Description of Artificial Sequence: Synthetic oligonucleotide
  Target: SCN9A; (-) strand; PAM type: YTN; PAM sequence: TTT
tctccagcttcttctgtcaa

SEQ ID NO: 59931 - DNA, 20 bp, Artificial Sequence
  Description of Artificial Sequence: Synthetic oligonucleotide
  Target: SCN9A; (-) strand; PAM type: YTN; PAM sequence: TTT
ttctccagcttcttctgtca

SEQ ID NO: 59932 - DNA, 20 bp, Artificial Sequence
  Description of Artificial Sequence: Synthetic oligonucleotide
  Target: SCN9A; (-) strand; PAM type: YTN; PAM sequence: CTC
agtttttctccagcttcttc

SEQ ID NO: 59933 - DNA, 20 bp, Artificial Sequence
  Description of Artificial Sequence: Synthetic oligonucleotide
  Target: SCN9A; (-) strand; PAM type: YTN; PAM sequence: CTC
ctcagtttttctccagcttc

SEQ ID NO: 59934 - DNA, 20 bp, Artificial Sequence
  Description of Artificial Sequence: Synthetic oligonucleotide
  Target: SCN9A; (-) strand; PAM type: YTN; PAM sequence: TTC
tcctcagtttttctccagct

SEQ ID NO: 59935 - DNA, 20 bp, Artificial Sequence
  Description of Artificial Sequence: Synthetic oligonucleotide
  Target: SCN9A; (-) strand; PAM type: YTN; PAM sequence: TTT
ctcctcagtttttctccagc

SEQ ID NO: 59936 - DNA, 20 bp, Artificial Sequence
  Description of Artificial Sequence: Synthetic oligonucleotide
  Target: SCN9A; (-) strand; PAM type: YTN; PAM sequence: TTT
tctcctcagtttttctccag

SEQ ID NO: 59937 - DNA, 20 bp, Artificial Sequence
  Description of Artificial Sequence: Synthetic oligonucleotide
  Target: SCN9A; (-) strand; PAM type: YTN; PAM sequence: TTG
gagttttctcctcagttttt

SEQ ID NO: 59938 - DNA, 20 bp, Artificial Sequence
  Description of Artificial Sequence: Synthetic oligonucleotide
  Target: SCN9A; (-) strand; PAM type: YTN; PAM sequence: TTC
aaagttggagttttctcctc

SEQ ID NO: 59939 - DNA, 20 bp, Artificial Sequence
  Description of Artificial Sequence: Synthetic oligonucleotide
  Target: SCN9A; (-) strand; PAM type: YTN; PAM sequence: CTT
caaagttggagttttctcct

SEQ ID NO: 59940 - DNA, 20 bp, Artificial Sequence
  Description of Artificial Sequence: Synthetic oligonucleotide
  Target: SCN9A; (-) strand; PAM type: YTN; PAM sequence: CTC
ttcaaagttggagttttctc

SEQ ID NO: 59941 - DNA, 20 bp, Artificial Sequence
  Description of Artificial Sequence: Synthetic oligonucleotide
  Target: SCN9A; (-) strand; PAM type: YTN; PAM sequence: TTC
tcttcaaagttggagttttc

SEQ ID NO: 59942 - DNA, 20 bp, Artificial Sequence
  Description of Artificial Sequence: Synthetic oligonucleotide
  Target: SCN9A; (-) strand; PAM type: YTN; PAM sequence: TTT
ctcttcaaagttggagtttt

SEQ ID NO: 59943 - DNA, 20 bp, Artificial Sequence
  Description of Artificial Sequence: Synthetic oligonucleotide
  Target: SCN9A; (-) strand; PAM type: YTN; PAM sequence: TTT
tctcttcaaagttggagttt

SEQ ID NO: 59944 - DNA, 20 bp, Artificial Sequence
  Description of Artificial Sequence: Synthetic oligonucleotide
  Target: SCN9A; (-) strand; PAM type: YTN; PAM sequence: TTG
attttctcttcaaagttgga

SEQ ID NO: 59945 - DNA, 20 bp, Artificial Sequence
  Description of Artificial Sequence: Synthetic oligonucleotide
  Target: SCN9A; (-) strand; PAM type: YTN; PAM sequence: TTT
gattttctcttcaaagttgg

SEQ ID NO: 59946 - DNA, 20 bp, Artificial Sequence
  Description of Artificial Sequence: Synthetic oligonucleotide
  Target: SCN9A; (-) strand; PAM type: YTN; PAM sequence: CTT
tgattttctcttcaaagttg

SEQ ID NO: 59947 - DNA, 20 bp, Artificial Sequence
  Description of Artificial Sequence: Synthetic oligonucleotide
  Target: SCN9A; (-) strand; PAM type: YTN; PAM sequence: TTA
ctttgattttctcttcaaag

SEQ ID NO: 59948 - DNA, 20 bp, Artificial Sequence
  Description of Artificial Sequence: Synthetic oligonucleotide
  Target: SCN9A; (-) strand; PAM type: YTN; PAM sequence: CTA
ttactttgattttctcttca

SEQ ID NO: 59949 - DNA, 20 bp, Artificial Sequence
  Description of Artificial Sequence: Synthetic oligonucleotide
  Target: SCN9A; (-) strand; PAM type: YTN; PAM sequence: TTA
ggggaaaacaaaatctatta

SEQ ID NO: 59950 - DNA, 20 bp, Artificial Sequence
  Description of Artificial Sequence: Synthetic oligonucleotide
  Target: SCN9A; (-) strand; PAM type: YTN; PAM sequence: TTG
acaaccaggatatcattagg

SEQ ID NO: 59951 - DNA, 20 bp, Artificial Sequence
  Description of Artificial Sequence: Synthetic oligonucleotide
  Target: SCN9A; (-) strand; PAM type: YTN; PAM sequence: TTC
atcatattgacaaccaggat

SEQ ID NO: 59952 - DNA, 20 bp, Artificial Sequence
  Description of Artificial Sequence: Synthetic oligonucleotide
  Target: SCN9A; (-) strand; PAM type: YTN; PAM sequence: CTT
catcatattgacaaccagga

SEQ ID NO: 59953 - DNA, 20 bp, Artificial Sequence
  Description of Artificial Sequence: Synthetic oligonucleotide
  Target: SCN9A; (-) strand; PAM type: YTN; PAM sequence: TTC
ttcatcatattgacaaccag

SEQ ID NO: 59954 - DNA, 20 bp, Artificial Sequence
  Description of Artificial Sequence: Synthetic oligonucleotide
  Target: SCN9A; (-) strand; PAM type: YTN; PAM sequence: TTA
tcccattcttcatcatattg

SEQ ID NO: 59955 - DNA, 20 bp, Artificial Sequence
  Description of Artificial Sequence: Synthetic oligonucleotide
  Target: SCN9A; (-) strand; PAM type: YTN; PAM sequence: TTT
atcccattcttcatcatatt

SEQ ID NO: 59956 - DNA, 20 bp, Artificial Sequence
  Description of Artificial Sequence: Synthetic oligonucleotide
  Target: SCN9A; (-) strand; PAM type: YTN; PAM sequence: TTT
tatcccattcttcatcatat

SEQ ID NO: 59957 - DNA, 20 bp, Artificial Sequence
  Description of Artificial Sequence: Synthetic oligonucleotide
  Target: SCN9A; (-) strand; PAM type: YTN; PAM sequence: TTA
gttttatcccattcttcatc

SEQ ID NO: 59958 - DNA, 20 bp, Artificial Sequence
  Description of Artificial Sequence: Synthetic oligonucleotide
  Target: SCN9A; (-) strand; PAM type: YTN; PAM sequence: CTA
ttagttttatcccattcttc

SEQ ID NO: 59959 - DNA, 20 bp, Artificial Sequence
  Description of Artificial Sequence: Synthetic oligonucleotide
  Target: SCN9A; (-) strand; PAM type: YTN; PAM sequence: CTC
ctattagttttatcccattc

SEQ ID NO: 59960 - DNA, 20 bp, Artificial Sequence
  Description of Artificial Sequence: Synthetic oligonucleotide
  Target: SCN9A; (-) strand; PAM type: YTN; PAM sequence: TTC
ataatctcctattagtttta

SEQ ID NO: 59961 - DNA, 20 bp, Artificial Sequence
  Description of Artificial Sequence: Synthetic oligonucleotide
  Target: SCN9A; (-) strand; PAM type: YTN; PAM sequence: TTA
attcataatctcctattagt

SEQ ID NO: 59962 - DNA, 20 bp, Artificial Sequence
  Description of Artificial Sequence: Synthetic oligonucleotide
  Target: SCN9A; (-) strand; PAM type: YTN; PAM sequence: TTG
aattaattcataatctccta

SEQ ID NO: 59963 - DNA, 20 bp, Artificial Sequence
  Description of Artificial Sequence: Synthetic oligonucleotide
  Target: SCN9A; (-) strand; PAM type: YTN; PAM sequence: CTA
ttgaattaattcataatctc

SEQ ID NO: 59964 - DNA, 20 bp, Artificial Sequence
  Description of Artificial Sequence: Synthetic oligonucleotide
  Target: SCN9A; (-) strand; PAM type: YTN; PAM sequence: CTC
tattgaattaattcataatc

SEQ ID NO: 59965 - DNA, 20 bp, Artificial Sequence
  Description of Artificial Sequence: Synthetic oligonucleotide
  Target: SCN9A; (-) strand; PAM type: YTN; PAM sequence: TTC
tctattgaattaattcataa

SEQ ID NO: 59966 - DNA, 20 bp, Artificial Sequence
  Description of Artificial Sequence: Synthetic oligonucleotide
  Target: SCN9A; (-) strand; PAM type: YTN; PAM sequence: TTT
ctctattgaattaattcata

SEQ ID NO: 59967 - DNA, 20 bp, Artificial Sequence
  Description of Artificial Sequence: Synthetic oligonucleotide
  Target: SCN9A; (-) strand; PAM type: YTN; PAM sequence: CTA
taggaaaacaaaacacccac

SEQ ID NO: 59968 - DNA, 20 bp, Artificial Sequence
  Description of Artificial Sequence: Synthetic oligonucleotide
  Target: SCN9A; (-) strand; PAM type: YTN; PAM sequence: CTA
aataagctataggaaaacaa

SEQ ID NO: 59969 - DNA, 20 bp, Artificial Sequence
  Description of Artificial Sequence: Synthetic oligonucleotide
  Target: SCN9A; (-) strand; PAM type: YTN; PAM sequence: TTG
cacaaggcctaaataagcta

SEQ ID NO: 59970 - DNA, 20 bp, Artificial Sequence
  Description of Artificial Sequence: Synthetic oligonucleotide
  Target: SCN9A; (-) strand; PAM type: YTN; PAM sequence: TTT
gcacaaggcctaaataagct

SEQ ID NO: 59971 - DNA, 20 bp, Artificial Sequence
  Description of Artificial Sequence: Synthetic oligonucleotide
  Target: SCN9A; (-) strand; PAM type: YTN; PAM sequence: TTT
tgcacaaggcctaaataagc

SEQ ID NO: 59972 - DNA, 20 bp, Artificial Sequence
  Description of Artificial Sequence: Synthetic oligonucleotide
  Target: SCN9A; (-) strand; PAM type: YTN; PAM sequence: TTA
aagggatacattttgcacaa

SEQ ID NO: 59973 - DNA, 20 bp, Artificial Sequence
  Description of Artificial Sequence: Synthetic oligonucleotide
  Target: SCN9A; (-) strand; PAM type: YTN; PAM sequence: TTT
aaagggatacattttgcaca

SEQ ID NO: 59974 - DNA, 20 bp, Artificial Sequence
  Description of Artificial Sequence: Synthetic oligonucleotide
  Target: SCN9A; (-) strand; PAM type: YTN; PAM sequence: TTT
taaagggatacattttgcac

SEQ ID NO: 59975 - DNA, 20 bp, Artificial Sequence
  Description of Artificial Sequence: Synthetic oligonucleotide
  Target: SCN9A; (-) strand; PAM type: YTN; PAM sequence: CTA
ggttttaaagggatacattt

SEQ ID NO: 59976 - DNA, 20 bp, Artificial Sequence
  Description of Artificial Sequence: Synthetic oligonucleotide
  Target: SCN9A; (-) strand; PAM type: YTN; PAM sequence: TTC
cacctaggttttaaagggat

SEQ ID NO: 59977 - DNA, 20 bp, Artificial Sequence
  Description of Artificial Sequence: Synthetic oligonucleotide
  Target: SCN9A; (-) strand; PAM type: YTN; PAM sequence: CTT
ccacctaggttttaaaggga

SEQ ID NO: 59978 - DNA, 20 bp, Artificial Sequence
  Description of Artificial Sequence: Synthetic oligonucleotide
  Target: SCN9A; (-) strand; PAM type: YTN; PAM sequence: TTC
cttccacctaggttttaaag

SEQ ID NO: 59979 - DNA, 20 bp, Artificial Sequence
  Description of Artificial Sequence: Synthetic oligonucleotide
  Target: SCN9A; (-) strand; PAM type: YTN; PAM sequence: TTA
cagaattccttccacctagg

SEQ ID NO: 59980 - DNA, 20 bp, Artificial Sequence
  Description of Artificial Sequence: Synthetic oligonucleotide
  Target: SCN9A; (-) strand; PAM type: YTN; PAM sequence: CTT
acagaattccttccacctag

SEQ ID NO: 59981 - DNA, 20 bp, Artificial Sequence
  Description of Artificial Sequence: Synthetic oligonucleotide
  Target: SCN9A; (-) strand; PAM type: YTN; PAM sequence: CTG
acttacagaattccttccac

SEQ ID NO: 59982 - DNA, 20 bp, Artificial Sequence
  Description of Artificial Sequence: Synthetic oligonucleotide
  Target: SCN9A; (-) strand; PAM type: YTN; PAM sequence: CTA
gcctgacttacagaattcct

SEQ ID NO: 59983 - DNA, 20 bp, Artificial Sequence
  Description of Artificial Sequence: Synthetic oligonucleotide
  Target: SCN9A; (-) strand; PAM type: YTN; PAM sequence: TTG
taacacagaaaaaaactagc

SEQ ID NO: 59984 - DNA, 20 bp, Artificial Sequence
  Description of Artificial Sequence: Synthetic oligonucleotide
  Target: SCN9A; (-) strand; PAM type: YTN; PAM sequence: CTC
aatgtagattgtaacacaga

SEQ ID NO: 59985 - DNA, 20 bp, Artificial Sequence
  Description of Artificial Sequence: Synthetic oligonucleotide
  Target: SCN9A; (-) strand; PAM type: YTN; PAM sequence: CTA
tgtaatacagcctcaatgta

SEQ ID NO: 59986 - DNA, 20 bp, Artificial Sequence
  Description of Artificial Sequence: Synthetic oligonucleotide
  Target: SCN9A; (-) strand; PAM type: YTN; PAM sequence: TTA
ctatgtaatacagcctcaat

SEQ ID NO: 59987 - DNA, 20 bp, Artificial Sequence
  Description of Artificial Sequence: Synthetic oligonucleotide
  Target: SCN9A; (-) strand; PAM type: YTN; PAM sequence: TTA
ttactatgtaatacagcctc

SEQ ID NO: 59988 - DNA, 20 bp, Artificial Sequence
  Description of Artificial Sequence: Synthetic oligonucleotide
  Target: SCN9A; (-) strand; PAM type: YTN; PAM sequence: TTT
attactatgtaatacagcct

SEQ ID NO: 59989 - DNA, 20 bp, Artificial Sequence
  Description of Artificial Sequence: Synthetic oligonucleotide
  Target: SCN9A; (-) strand; PAM type: YTN; PAM sequence: CTT
tattactatgtaatacagcc

SEQ ID NO: 59990 - DNA, 20 bp, Artificial Sequence
  Description of Artificial Sequence: Synthetic oligonucleotide
  Target: SCN9A; (-) strand; PAM type: YTN; PAM sequence: CTG
acaccagaagtgaagaagtc

SEQ ID NO: 59991 - DNA, 20 bp, Artificial Sequence
  Description of Artificial Sequence: Synthetic oligonucleotide
  Target: SCN9A; (-) strand; PAM type: YTN; PAM sequence: TTG
aacaaagatgatctgacacc

SEQ ID NO: 59992 - DNA, 20 bp, Artificial Sequence
  Description of Artificial Sequence: Synthetic oligonucleotide
  Target: SCN9A; (-) strand; PAM type: YTN; PAM sequence: CTT
gaacaaagatgatctgacac

SEQ ID NO: 59993 - DNA, 20 bp, Artificial Sequence
  Description of Artificial Sequence: Synthetic oligonucleotide
  Target: SCN9A; (-) strand; PAM type: YTN; PAM sequence: TTA
cccaaggacaaaagaaagga

SEQ ID NO: 59994 - DNA, 20 bp, Artificial Sequence
  Description of Artificial Sequence: Synthetic oligonucleotide
  Target: SCN9A; (-) strand; PAM type: YTN; PAM sequence: CTT
acccaaggacaaaagaaagg

SEQ ID NO: 59995 - DNA, 20 bp, Artificial Sequence
  Description of Artificial Sequence: Synthetic oligonucleotide
  Target: SCN9A; (-) strand; PAM type: YTN; PAM sequence: TTA
agaaacttacccaaggacaa

SEQ ID NO: 59996 - DNA, 20 bp, Artificial Sequence
  Description of Artificial Sequence: Synthetic oligonucleotide
  Target: SCN9A; (-) strand; PAM type: YTN; PAM sequence: TTA
aagaattaagaaacttaccc

SEQ ID NO: 59997 - DNA, 20 bp, Artificial Sequence
  Description of Artificial Sequence: Synthetic oligonucleotide
  Target: SCN9A; (-) strand; PAM type: YTN; PAM sequence: CTT
aaagaattaagaaacttacc

SEQ ID NO: 59998 - DNA, 20 bp, Artificial Sequence
  Description of Artificial Sequence: Synthetic oligonucleotide
  Target: SCN9A; (-) strand; PAM type: YTN; PAM sequence: TTA
cttaaagaattaagaaactt

SEQ ID NO: 59999 - DNA, 20 bp, Artificial Sequence
  Description of Artificial Sequence: Synthetic oligonucleotide
  Target: SCN9A; (-) strand; PAM type: YTN; PAM sequence: TTT
acttaaagaattaagaaact

SEQ ID NO: 60000 - DNA, 20 bp, Artificial Sequence
  Description of Artificial Sequence: Synthetic oligonucleotide
  Target: SCN9A; (-) strand; PAM type: YTN; PAM sequence: TTT
tacttaaagaattaagaaac

SEQ ID NO: 60001 - DNA, 20 bp, Artificial Sequence
  Description of Artificial Sequence: Synthetic oligonucleotide
  Target: SCN9A; (-) strand; PAM type: YTN; PAM sequence: TTA
taatgatgaggtggttttac

SEQ ID NO: 60002 - DNA, 20 bp, Artificial Sequence
  Description of Artificial Sequence: Synthetic oligonucleotide
  Target: SCN9A; (-) strand; PAM type: YTN; PAM sequence: CTT
ataatgatgaggtggtttta

SEQ ID NO: 60003 - DNA, 20 bp, Artificial Sequence
  Description of Artificial Sequence: Synthetic oligonucleotide
  Target: SCN9A; (-) strand; PAM type: YTN; PAM sequence: CTC
ttataatgatgaggtggttt

SEQ ID NO: 60004 - DNA, 20 bp, Artificial Sequence
  Description of Artificial Sequence: Synthetic oligonucleotide
  Target: SCN9A; (-) strand; PAM type: YTN; PAM sequence: CTA
ctcttataatgatgaggtgg

SEQ ID NO: 60005 - DNA, 20 bp, Artificial Sequence
  Description of Artificial Sequence: Synthetic oligonucleotide
  Target: SCN9A; (-) strand; PAM type: YTN; PAM sequence: CTC
agcaaacacaaatgcagtga

SEQ ID NO: 60006 - DNA, 20 bp, Artificial Sequence
  Description of Artificial Sequence: Synthetic oligonucleotide
  Target: SCN9A; (-) strand; PAM type: YTN; PAM sequence: TTC
tcagcaaacacaaatgcagt

SEQ ID NO: 60007 - DNA, 20 bp, Artificial Sequence
  Description of Artificial Sequence: Synthetic oligonucleotide
  Target: SCN9A; (-) strand; PAM type: YTN; PAM sequence: CTT
ctcagcaaacacaaatgcag

SEQ ID NO: 60008 - DNA, 20 bp, Artificial Sequence
  Description of Artificial Sequence: Synthetic oligonucleotide
  Target: SCN9A; (-) strand; PAM type: YTN; PAM sequence: TTA
tcttctcagcaaacacaaat

SEQ ID NO: 60009 - DNA, 20 bp, Artificial Sequence
  Description of Artificial Sequence: Synthetic oligonucleotide
  Target: SCN9A; (-) strand; PAM type: YTN; PAM sequence: TTT
atcttctcagcaaacacaaa

SEQ ID NO: 60010 - DNA, 20 bp, Artificial Sequence
  Description of Artificial Sequence: Synthetic oligonucleotide
  Target: SCN9A; (-) strand; PAM type: YTN; PAM sequence: CTC
aatttatcttctcagcaaac

SEQ ID NO: 60011 - DNA, 20 bp, Artificial Sequence
  Description of Artificial Sequence: Synthetic oligonucleotide
  Target: SCN9A; (-) strand; PAM type: YTN; PAM sequence: TTA
cctcaatttatcttctcagc

SEQ ID NO: 60012 - DNA, 20 bp, Artificial Sequence
  Description of Artificial Sequence: Synthetic oligonucleotide
  Target: SCN9A; (-) strand; PAM type: YTN; PAM sequence: TTC
atgcattacctcaatttatc

SEQ ID NO: 60013 - DNA, 20 bp, Artificial Sequence
  Description of Artificial Sequence: Synthetic oligonucleotide
  Target: SCN9A; (-) strand; PAM type: YTN; PAM sequence: CTT
catgcattacctcaatttat

SEQ ID NO: 60014 - DNA, 20 bp, Artificial Sequence
  Description of Artificial Sequence: Synthetic oligonucleotide
  Target: SCN9A; (-) strand; PAM type: YTN; PAM sequence: TTC
ttcatgcattacctcaattt

SEQ ID NO: 60015 - DNA, 20 bp, Artificial Sequence
  Description of Artificial Sequence: Synthetic oligonucleotide
  Target: SCN9A; (-) strand; PAM type: YTN; PAM sequence: CTA
agtattcttcatgcattacc

SEQ ID NO: 60016 - DNA, 20 bp, Artificial Sequence
  Description of Artificial Sequence: Synthetic oligonucleotide
  Target: SCN9A; (-) strand; PAM type: YTN; PAM sequence: TTA
tgctaagtattcttcatgca

SEQ ID NO: 60017 - DNA, 20 bp, Artificial Sequence
  Description of Artificial Sequence: Synthetic oligonucleotide
  Target: SCN9A; (-) strand; PAM type: YTN; PAM sequence: TTA
ccatgtgccagatattatgc

SEQ ID NO: 60018 - DNA, 20 bp, Artificial Sequence
  Description of Artificial Sequence: Synthetic oligonucleotide
  Target: SCN9A; (-) strand; PAM type: YTN; PAM sequence: CTT
accatgtgccagatattatg

SEQ ID NO: 60019 - DNA, 20 bp, Artificial Sequence
  Description of Artificial Sequence: Synthetic oligonucleotide
  Target: SCN9A; (-) strand; PAM type: YTN; PAM sequence: TTA
atgaagacttaccatgtgcc

SEQ ID NO: 60020 - DNA, 20 bp, Artificial Sequence
  Description of Artificial Sequence: Synthetic oligonucleotide
  Target: SCN9A; (-) strand; PAM type: YTN; PAM sequence: TTT
aatgaagacttaccatgtgc

SEQ ID NO: 60021 - DNA, 20 bp, Artificial Sequence
  Description of Artificial Sequence: Synthetic oligonucleotide
  Target: SCN9A; (-) strand; PAM type: YTN; PAM sequence: CTA
aaatttaatgaagacttacc

SEQ ID NO: 60022 - DNA, 20 bp, Artificial Sequence
  Description of Artificial Sequence: Synthetic oligonucleotide
  Target: SCN9A; (-) strand; PAM type: YTN; PAM sequence: TTA
atagcaccaacagtaatagt

SEQ ID NO: 60023 - DNA, 20 bp, Artificial Sequence
  Description of Artificial Sequence: Synthetic oligonucleotide
  Target: SCN9A; (-) strand; PAM type: YTN; PAM sequence: TTT
aatagcaccaacagtaatag

SEQ ID NO: 60024 - DNA, 20 bp, Artificial Sequence
  Description of Artificial Sequence: Synthetic oligonucleotide
  Target: SCN9A; (-) strand; PAM type: YTN; PAM sequence: TTA
tcaggaagtttaatagcacc

SEQ ID NO: 60025 - DNA, 20 bp, Artificial Sequence
  Description of Artificial Sequence: Synthetic oligonucleotide
  Target: SCN9A; (-) strand; PAM type: YTN; PAM sequence: CTT
atcaggaagtttaatagcac

SEQ ID NO: 60026 - DNA, 20 bp, Artificial Sequence
  Description of Artificial Sequence: Synthetic oligonucleotide
  Target: SCN9A; (-) strand; PAM type: YTN; PAM sequence: CTC
atcttatcaggaagtttaat

SEQ ID NO: 60027 - DNA, 20 bp, Artificial Sequence
  Description of Artificial Sequence: Synthetic oligonucleotide
  Target: SCN9A; (-) strand; PAM type: YTN; PAM sequence: CTC
tcatcttatcaggaagttta

SEQ ID NO: 60028 - DNA, 20 bp, Artificial Sequence
  Description of Artificial Sequence: Synthetic oligonucleotide
  Target: SCN9A; (-) strand; PAM type: YTN; PAM sequence: TTA
actctcatcttatcaggaag

SEQ ID NO: 60029 - DNA, 20 bp, Artificial Sequence
  Description of Artificial Sequence: Synthetic oligonucleotide
  Target: SCN9A; (-) strand; PAM type: YTN; PAM sequence: TTC
attaactctcatcttatcag

SEQ ID NO: 60030 - DNA, 20 bp, Artificial Sequence
  Description of Artificial Sequence: Synthetic oligonucleotide
  Target: SCN9A; (-) strand; PAM type: YTN; PAM sequence: TTT
cattaactctcatcttatca

SEQ ID NO: 60031 - DNA, 20 bp, Artificial Sequence
  Description of Artificial Sequence: Synthetic oligonucleotide
  Target: SCN9A; (-) strand; PAM type: YTN; PAM sequence: CTC
atttcattaactctcatctt

SEQ ID NO: 60032 - DNA, 20 bp, Artificial Sequence
  Description of Artificial Sequence: Synthetic oligonucleotide
  Target: SCN9A; (-) strand; PAM type: YTN; PAM sequence: TTA
acaataacctcatttcatta

SEQ ID NO: 60033 - DNA, 20 bp, Artificial Sequence
  Description of Artificial Sequence: Synthetic oligonucleotide
  Target: SCN9A; (-) strand; PAM type: YTN; PAM sequence: CTA
tggagtaaatgttaacaata

SEQ ID NO: 60034 - DNA, 20 bp, Artificial Sequence
  Description of Artificial Sequence: Synthetic oligonucleotide
  Target: SCN9A; (-) strand; PAM type: YTN; PAM sequence: TTG
agcaactatggagtaaatgt

SEQ ID NO: 60035 - DNA, 20 bp, Artificial Sequence
  Description of Artificial Sequence: Synthetic oligonucleotide
  Target: SCN9A; (-) strand; PAM type: YTN; PAM sequence: TTT
gagcaactatggagtaaatg

SEQ ID NO: 60036 - DNA, 20 bp, Artificial Sequence
  Description of Artificial Sequence: Synthetic oligonucleotide
  Target: SCN9A; (-) strand; PAM type: YTN; PAM sequence: TTA
caaatttgagcaactatgga

SEQ ID NO: 60037 - DNA, 20 bp, Artificial Sequence
  Description of Artificial Sequence: Synthetic oligonucleotide
  Target: SCN9A; (-) strand; PAM type: YTN; PAM sequence: TTA
catgatatacaaatatataa

SEQ ID NO: 60038 - DNA, 20 bp, Artificial Sequence
  Description of Artificial Sequence: Synthetic oligonucleotide
  Target: SCN9A; (-) strand; PAM type: YTN; PAM sequence: TTA
taaaaaggaagattacatga

SEQ ID NO: 60039 - DNA, 20 bp, Artificial Sequence
  Description of Artificial Sequence: Synthetic oligonucleotide
  Target: SCN9A; (-) strand; PAM type: YTN; PAM sequence: TTC
aagttataaaaaggaagatt

SEQ ID NO: 60040 - DNA, 20 bp, Artificial Sequence
  Description of Artificial Sequence: Synthetic oligonucleotide
  Target: SCN9A; (-) strand; PAM type: YTN; PAM sequence: TTA
atgagttcaagttataaaaa

SEQ ID NO: 60041 - DNA, 20 bp, Artificial Sequence
  Description of Artificial Sequence: Synthetic oligonucleotide
  Target: SCN9A; (-) strand; PAM type: YTN; PAM sequence: TTA
gaacaaaagtcattaatgag

SEQ ID NO: 60042 - DNA, 20 bp, Artificial Sequence
  Description of Artificial Sequence: Synthetic oligonucleotide
  Target: SCN9A; (-) strand; PAM type: YTN; PAM sequence: CTA
ttagaacaaaagtcattaat

SEQ ID NO: 60043 - DNA, 20 bp, Artificial Sequence
  Description of Artificial Sequence: Synthetic oligonucleotide
  Target: SCN9A; (-) strand; PAM type: YTN; PAM sequence: CTA
ctattagaacaaaagtcatt

SEQ ID NO: 60044 - DNA, 20 bp, Artificial Sequence
  Description of Artificial Sequence: Synthetic oligonucleotide
  Target: SCN9A; (-) strand; PAM type: YTN; PAM sequence: TTA
ataatcataaaacatactac

SEQ ID NO: 60045 - DNA, 20 bp, Artificial Sequence
  Description of Artificial Sequence: Synthetic oligonucleotide
  Target: SCN9A; (-) strand; PAM type: YTN; PAM sequence: TTT
aataatcataaaacatacta

SEQ ID NO: 60046 - DNA, 20 bp, Artificial Sequence
  Description of Artificial Sequence: Synthetic oligonucleotide
  Target: SCN9A; (-) strand; PAM type: YTN; PAM sequence: TTT
taataatcataaaacatact

SEQ ID NO: 60047 - DNA, 20 bp, Artificial Sequence
  Description of Artificial Sequence: Synthetic oligonucleotide
  Target: SCN9A; (-) strand; PAM type: YTN; PAM sequence: TTT
ttaataatcataaaacatac

SEQ ID NO: 60048 - DNA, 20 bp, Artificial Sequence
  Description of Artificial Sequence: Synthetic oligonucleotide
  Target: SCN9A; (-) strand; PAM type: YTN; PAM sequence: TTA
gtttttaataatcataaaac

SEQ ID NO: 60049 - DNA, 20 bp, Artificial Sequence
  Description of Artificial Sequence: Synthetic oligonucleotide
  Target: SCN9A; (-) strand; PAM type: YTN; PAM sequence: TTC
atgtgaaattagtttttaat

SEQ ID NO: 60050 - DNA, 20 bp, Artificial Sequence
  Description of Artificial Sequence: Synthetic oligonucleotide
  Target: SCN9A; (-) strand; PAM type: YTN; PAM sequence: TTT
catgtgaaattagtttttaa

SEQ ID NO: 60051 - DNA, 20 bp, Artificial Sequence
  Description of Artificial Sequence: Synthetic oligonucleotide
  Target: SCN9A; (-) strand; PAM type: YTN; PAM sequence: CTA
atgatttcatgtgaaattag

SEQ ID NO: 60052 - DNA, 20 bp, Artificial Sequence
  Description of Artificial Sequence: Synthetic oligonucleotide
  Target: SCN9A; (-) strand; PAM type: YTN; PAM sequence: CTC
taatgatttcatgtgaaatt

SEQ ID NO: 60053 - DNA, 20 bp, Artificial Sequence
  Description of Artificial Sequence: Synthetic oligonucleotide
  Target: SCN9A; (-) strand; PAM type: YTN; PAM sequence: TTC
acctctaatgatttcatgtg

SEQ ID NO: 60054 - DNA, 20 bp, Artificial Sequence
  Description of Artificial Sequence: Synthetic oligonucleotide
  Target: SCN9A; (-) strand; PAM type: YTN; PAM sequence: TTT
cacctctaatgatttcatgt

SEQ ID NO: 60055 - DNA, 20 bp, Artificial Sequence
  Description of Artificial Sequence: Synthetic oligonucleotide
  Target: SCN9A; (-) strand; PAM type: YTN; PAM sequence: TTT
tcacctctaatgatttcatg

SEQ ID NO: 60056 - DNA, 20 bp, Artificial Sequence
  Description of Artificial Sequence: Synthetic oligonucleotide
  Target: SCN9A; (-) strand; PAM type: YTN; PAM sequence: TTT
ttcacctctaatgatttcat

SEQ ID NO: 60057 - DNA, 20 bp, Artificial Sequence
  Description of Artificial Sequence: Synthetic oligonucleotide
  Target: SCN9A; (-) strand; PAM type: YTN; PAM sequence: TTT
tttcacctctaatgatttca

SEQ ID NO: 60058 - DNA, 20 bp, Artificial Sequence
  Description of Artificial Sequence: Synthetic oligonucleotide
  Target: SCN9A; (-) strand; PAM type: YTN; PAM sequence: CTT
ttttcacctctaatgatttc

SEQ ID NO: 60059 - DNA, 20 bp, Artificial Sequence
  Description of Artificial Sequence: Synthetic oligonucleotide
  Target: SCN9A; (-) strand; PAM type: YTN; PAM sequence: CTC
ataagtacttttttcacctc

SEQ ID NO: 60060 - DNA, 20 bp, Artificial Sequence
  Description of Artificial Sequence: Synthetic oligonucleotide
  Target: SCN9A; (-) strand; PAM type: YTN; PAM sequence: TTC
atcatcctcataagtacttt

SEQ ID NO: 60061 - DNA, 20 bp, Artificial Sequence
  Description of Artificial Sequence: Synthetic oligonucleotide
  Target: SCN9A; (-) strand; PAM type: YTN; PAM sequence: CTA
ttcatcatcctcataagtac

SEQ ID NO: 60062 - DNA, 20 bp, Artificial Sequence
  Description of Artificial Sequence: Synthetic oligonucleotide
  Target: SCN9A; (-) strand; PAM type: YTN; PAM sequence: TTC
caactattcatcatcctcat

SEQ ID NO: 60063 - DNA, 20 bp, Artificial Sequence
  Description of Artificial Sequence: Synthetic oligonucleotide
  Target: SCN9A; (-) strand; PAM type: YTN; PAM sequence: TTT
ccaactattcatcatcctca

SEQ ID NO: 60064 - DNA, 20 bp, Artificial Sequence
  Description of Artificial Sequence: Synthetic oligonucleotide
  Target: SCN9A; (-) strand; PAM type: YTN; PAM sequence: TTT
tccaactattcatcatcctc

SEQ ID NO: 60065 - DNA, 20 bp, Artificial Sequence
  Description of Artificial Sequence: Synthetic oligonucleotide
  Target: SCN9A; (-) strand; PAM type: YTN; PAM sequence: TTT
ttccaactattcatcatcct

SEQ ID NO: 60066 - DNA, 20 bp, Artificial Sequence
  Description of Artificial Sequence: Synthetic oligonucleotide
  Target: SCN9A; (-) strand; PAM type: YTN; PAM sequence: CTA
gtttttccaactattcatca

SEQ ID NO: 60067 - DNA, 20 bp, Artificial Sequence
  Description of Artificial Sequence: Synthetic oligonucleotide
  Target: SCN9A; (-) strand; PAM type: YTN; PAM sequence: TTA
ctagtttttccaactattca

SEQ ID NO: 60068 - DNA, 20 bp, Artificial Sequence
  Description of Artificial Sequence: Synthetic oligonucleotide
  Target: SCN9A; (-) strand; PAM type: YTN; PAM sequence: TTT
actagtttttccaactattc

SEQ ID NO: 60069 - DNA, 20 bp, Artificial Sequence
  Description of Artificial Sequence: Synthetic oligonucleotide
  Target: SCN9A; (-) strand; PAM type: YTN; PAM sequence: TTT
tactagtttttccaactatt

SEQ ID NO: 60070 - DNA, 20 bp, Artificial Sequence
  Description of Artificial Sequence: Synthetic oligonucleotide
  Target: SCN9A; (-) strand; PAM type: YTN; PAM sequence: CTA
ttttactagtttttccaact

SEQ ID NO: 60071 - DNA, 20 bp, Artificial Sequence
  Description of Artificial Sequence: Synthetic oligonucleotide
  Target: SCN9A; (-) strand; PAM type: YTN; PAM sequence: CTA
ataaccaaccctattttact

SEQ ID NO: 60072 - DNA, 20 bp, Artificial Sequence
  Description of Artificial Sequence: Synthetic oligonucleotide
  Target: SCN9A; (-) strand; PAM type: YTN; PAM sequence: TTC
taataaccaaccctatttta

SEQ ID NO: 60073 - DNA, 20 bp, Artificial Sequence
  Description of Artificial Sequence: Synthetic oligonucleotide
  Target: SCN9A; (-) strand; PAM type: YTN; PAM sequence: TTT
ctaataaccaaccctatttt

SEQ ID NO: 60074 - DNA, 20 bp, Artificial Sequence
  Description of Artificial Sequence: Synthetic oligonucleotide
  Target: SCN9A; (-) strand; PAM type: YTN; PAM sequence: CTT
tctaataaccaaccctattt

SEQ ID NO: 60075 - DNA, 20 bp, Artificial Sequence
  Description of Artificial Sequence: Synthetic oligonucleotide
  Target: SCN9A; (-) strand; PAM type: YTN; PAM sequence: CTC
tttctaataaccaaccctat

SEQ ID NO: 60076 - DNA, 20 bp, Artificial Sequence
  Description of Artificial Sequence: Synthetic oligonucleotide
  Target: SCN9A; (-) strand; PAM type: YTN; PAM sequence: CTA
cccatgcctctttctaataa

SEQ ID NO: 60077 - DNA, 20 bp, Artificial Sequence
  Description of Artificial Sequence: Synthetic oligonucleotide
  Target: SCN9A; (-) strand; PAM type: YTN; PAM sequence: CTA
tcaactacccatgcctcttt

SEQ ID NO: 60078 - DNA, 20 bp, Artificial Sequence
  Description of Artificial Sequence: Synthetic oligonucleotide
  Target: SCN9A; (-) strand; PAM type: YTN; PAM sequence: CTC
tatcaactacccatgcctct

SEQ ID NO: 60079 - DNA, 20 bp, Artificial Sequence
  Description of Artificial Sequence: Synthetic oligonucleotide
  Target: SCN9A; (-) strand; PAM type: YTN; PAM sequence: TTA
tggctctatcaactacccat

SEQ ID NO: 60080 - DNA, 20 bp, Artificial Sequence
  Description of Artificial Sequence: Synthetic oligonucleotide
  Target: SCN9A; (-) strand; PAM type: YTN; PAM sequence: CTT
atggctctatcaactaccca

SEQ ID NO: 60081 - DNA, 20 bp, Artificial Sequence
  Description of Artificial Sequence: Synthetic oligonucleotide
  Target: SCN9A; (-) strand; PAM type: YTN; PAM sequence: TTG
atcaaagcttatggctctat

SEQ ID NO: 60082 - DNA, 20 bp, Artificial Sequence
  Description of Artificial Sequence: Synthetic oligonucleotide
  Target: SCN9A; (-) strand; PAM type: YTN; PAM sequence: TTT
gatcaaagcttatggctcta

SEQ ID NO: 60083 - DNA, 20 bp, Artificial Sequence
  Description of Artificial Sequence: Synthetic oligonucleotide
  Target: SCN9A; (-) strand; PAM type: YTN; PAM sequence: TTC
aataatttgatcaaagctta

SEQ ID NO: 60084 - DNA, 20 bp, Artificial Sequence
  Description of Artificial Sequence: Synthetic oligonucleotide
  Target: SCN9A; (-) strand; PAM type: YTN; PAM sequence: CTT
caataatttgatcaaagctt

SEQ ID NO: 60085 - DNA, 20 bp, Artificial Sequence
  Description of Artificial Sequence: Synthetic oligonucleotide
  Target: SCN9A; (-) strand; PAM type: YTN; PAM sequence: TTA
acttcaataatttgatcaaa

SEQ ID NO: 60086 - DNA, 20 bp, Artificial Sequence
  Description of Artificial Sequence: Synthetic oligonucleotide
  Target: SCN9A; (-) strand; PAM type: YTN; PAM sequence: TTT
aacttcaataatttgatcaa

SEQ ID NO: 60087 - DNA, 20 bp, Artificial Sequence
  Description of Artificial Sequence: Synthetic oligonucleotide
  Target: SCN9A; (-) strand; PAM type: YTN; PAM sequence: TTT
taacttcaataatttgatca

SEQ ID NO: 60088 - DNA, 20 bp, Artificial Sequence
  Description of Artificial Sequence: Synthetic oligonucleotide
  Target: SCN9A; (-) strand; PAM type: YTN; PAM sequence: TTT
ttaacttcaataatttgatc

SEQ ID NO: 60089 - DNA, 20 bp, Artificial Sequence
  Description of Artificial Sequence: Synthetic oligonucleotide
  Target: SCN9A; (-) strand; PAM type: YTN; PAM sequence: CTT
tttaacttcaataatttgat

SEQ ID NO: 60090 - DNA, 20 bp, Artificial Sequence
  Description of Artificial Sequence: Synthetic oligonucleotide
  Target: SCN9A; (-) strand; PAM type: YTN; PAM sequence: CTG
ctttttaacttcaataattt

SEQ ID NO: 60091 - DNA, 20 bp, Artificial Sequence
  Description of Artificial Sequence: Synthetic oligonucleotide
  Target: SCN9A; (-) strand; PAM type: YTN; PAM sequence: TTA
ctgctttttaacttcaataa

SEQ ID NO: 60092 - DNA, 20 bp, Artificial Sequence
  Description of Artificial Sequence: Synthetic oligonucleotide
  Target: SCN9A; (-) strand; PAM type: YTN; PAM sequence: CTT
actgctttttaacttcaata

SEQ ID NO: 60093 - DNA, 20 bp, Artificial Sequence
  Description of Artificial Sequence: Synthetic oligonucleotide
  Target: SCN9A; (-) strand; PAM type: YTN; PAM sequence: TTG
ccacttactgctttttaact

SEQ ID NO: 60094 - DNA, 20 bp, Artificial Sequence
  Description of Artificial Sequence: Synthetic oligonucleotide
  Target: SCN9A; (-) strand; PAM type: YTN; PAM sequence: TTC
cacaatgcaatgttgccact

SEQ ID NO: 60095 - DNA, 20 bp, Artificial Sequence
  Description of Artificial Sequence: Synthetic oligonucleotide
  Target: SCN9A; (-) strand; PAM type: YTN; PAM sequence: TTT
ccacaatgcaatgttgccac

SEQ ID NO: 60096 - DNA, 20 bp, Artificial Sequence
  Description of Artificial Sequence: Synthetic oligonucleotide
  Target: SCN9A; (-) strand; PAM type: YTN; PAM sequence: TTT
tccacaatgcaatgttgcca

SEQ ID NO: 60097 - DNA, 20 bp, Artificial Sequence
  Description of Artificial Sequence: Synthetic oligonucleotide
  Target: SCN9A; (-) strand; PAM type: YTN; PAM sequence: CTT
ttccacaatgcaatgttgcc

SEQ ID NO: 60098 - DNA, 20 bp, Artificial Sequence
  Description of Artificial Sequence: Synthetic oligonucleotide
  Target: SCN9A; (-) strand; PAM type: YTN; PAM sequence: TTG
aaaacccatatcttttccac

SEQ ID NO: 60099 - DNA, 20 bp, Artificial Sequence
  Description of Artificial Sequence: Synthetic oligonucleotide
  Target: SCN9A; (-) strand; PAM type: YTN; PAM sequence: TTT
gaaaacccatatcttttcca

SEQ ID NO: 60100 - DNA, 20 bp, Artificial Sequence
  Description of Artificial Sequence: Synthetic oligonucleotide
  Target: SCN9A; (-) strand; PAM type: YTN; PAM sequence: TTG
atttgaaaacccatatcttt

SEQ ID NO: 60101 - DNA, 20 bp, Artificial Sequence
  Description of Artificial Sequence: Synthetic oligonucleotide
  Target: SCN9A; (-) strand; PAM type: YTN; PAM sequence: TTT
gatttgaaaacccatatctt

SEQ ID NO: 60102 - DNA, 20 bp, Artificial Sequence
  Description of Artificial Sequence: Synthetic oligonucleotide
  Target: SCN9A; (-) strand; PAM type: YTN; PAM sequence: CTG
tttgatttgaaaacccatat

SEQ ID NO: 60103 - DNA, 20 bp, Artificial Sequence
  Description of Artificial Sequence: Synthetic oligonucleotide
  Target: SCN9A; (-) strand; PAM type: YTN; PAM sequence: TTG
aaatgcctgtttgatttgaa

SEQ ID NO: 60104 - DNA, 20 bp, Artificial Sequence
  Description of Artificial Sequence: Synthetic oligonucleotide
  Target: SCN9A; (-) strand; PAM type: YTN; PAM sequence: TTA
tgattgaaatgcctgtttga

SEQ ID NO: 60105 - DNA, 20 bp, Artificial Sequence
  Description of Artificial Sequence: Synthetic oligonucleotide
  Target: SCN9A; (-) strand; PAM type: YTN; PAM sequence: TTC
aaaccaagtaacaggatacc

SEQ ID NO: 60106 - DNA, 20 bp, Artificial Sequence
  Description of Artificial Sequence: Synthetic oligonucleotide
  Target: SCN9A; (-) strand; PAM type: YTN; PAM sequence: TTT
caaaccaagtaacaggatac

SEQ ID NO: 60107 - DNA, 20 bp, Artificial Sequence
  Description of Artificial Sequence: Synthetic oligonucleotide
  Target: SCN9A; (-) strand; PAM type: YTN; PAM sequence: TTG
tttcaaaccaagtaacagga

SEQ ID NO: 60108 - DNA, 20 bp, Artificial Sequence
  Description of Artificial Sequence: Synthetic oligonucleotide
  Target: SCN9A; (-) strand; PAM type: YTN; PAM sequence: CTA
gaaaggatggataaattgtt

SEQ ID NO: 60109 - DNA, 20 bp, Artificial Sequence
  Description of Artificial Sequence: Synthetic oligonucleotide
  Target: SCN9A; (-) strand; PAM type: YTN; PAM sequence: TTA
gcccctagaaaggatggata

SEQ ID NO: 60110 - DNA, 20 bp, Artificial Sequence
  Description of Artificial Sequence: Synthetic oligonucleotide
  Target: SCN9A; (-) strand; PAM type: YTN; PAM sequence: TTG
atgaaaatgaataaattagc

SEQ ID NO: 60111 - DNA, 20 bp, Artificial Sequence
  Description of Artificial Sequence: Synthetic oligonucleotide
  Target: SCN9A; (-) strand; PAM type: YTN; PAM sequence: CTT
gatgaaaatgaataaattag

SEQ ID NO: 60112 - DNA, 20 bp, Artificial Sequence
  Description of Artificial Sequence: Synthetic oligonucleotide
  Target: SCN9A; (-) strand; PAM type: YTN; PAM sequence: TTG
aaagtggtatcttgatgaaa

SEQ ID NO: 60113 - DNA, 20 bp, Artificial Sequence
  Description of Artificial Sequence: Synthetic oligonucleotide
  Target: SCN9A; (-) strand; PAM type: YTN; PAM sequence: CTT
gaaagtggtatcttgatgaa

SEQ ID NO: 60114 - DNA, 20 bp, Artificial Sequence
  Description of Artificial Sequence: Synthetic oligonucleotide
  Target: SCN9A; (-) strand; PAM type: YTN; PAM sequence: CTC
ccttgaaagtggtatcttga

SEQ ID NO: 60115 - DNA, 20 bp, Artificial Sequence
  Description of Artificial Sequence: Synthetic oligonucleotide
  Target: SCN9A; (-) strand; PAM type: YTN; PAM sequence: CTC
cctcccttgaaagtggtatc

SEQ ID NO: 60116 - DNA, 20 bp, Artificial Sequence
  Description of Artificial Sequence: Synthetic oligonucleotide
  Target: SCN9A; (-) strand; PAM type: YTN; PAM sequence: CTC
tccctcccttgaaagtggta

SEQ ID NO: 60117 - DNA, 20 bp, Artificial Sequence
  Description of Artificial Sequence: Synthetic oligonucleotide
  Target: SCN9A; (-) strand; PAM type: YTN; PAM sequence: CTC
ctctccctcccttgaaagtg

SEQ ID NO: 60118 - DNA, 20 bp, Artificial Sequence
  Description of Artificial Sequence: Synthetic oligonucleotide
  Target: SCN9A; (-) strand; PAM type: YTN; PAM sequence: CTC
cactcctctccctcccttga

SEQ ID NO: 60119 - DNA, 20 bp, Artificial Sequence
  Description of Artificial Sequence: Synthetic oligonucleotide
  Target: SCN9A; (-) strand; PAM type: YTN; PAM sequence: TTG
atgtgctccactcctctccc

SEQ ID NO: 60120 - DNA, 20 bp, Artificial Sequence
  Description of Artificial Sequence: Synthetic oligonucleotide
  Target: SCN9A; (-) strand; PAM type: YTN; PAM sequence: TTT
gatgtgctccactcctctcc

SEQ ID NO: 60121 - DNA, 20 bp, Artificial Sequence
  Description of Artificial Sequence: Synthetic oligonucleotide
  Target: SCN9A; (-) strand; PAM type: YTN; PAM sequence: CTG
aatggcaaggacatttgatg

SEQ ID NO: 60122 - DNA, 20 bp, Artificial Sequence
  Description of Artificial Sequence: Synthetic oligonucleotide
  Target: SCN9A; (-) strand; PAM type: YTN; PAM sequence: CTA
gtgcagcacactgaatggca

SEQ ID NO: 60123 - DNA, 20 bp, Artificial Sequence
  Description of Artificial Sequence: Synthetic oligonucleotide
  Target: SCN9A; (-) strand; PAM type: YTN; PAM sequence: CTG
gaccctagtgcagcacactg

SEQ ID NO: 60124 - DNA, 20 bp, Artificial Sequence
  Description of Artificial Sequence: Synthetic oligonucleotide
  Target: SCN9A; (-) strand; PAM type: YTN; PAM sequence: CTC
catatgaggcaagagtgaaa

SEQ ID NO: 60125 - DNA, 20 bp, Artificial Sequence
  Description of Artificial Sequence: Synthetic oligonucleotide
  Target: SCN9A; (-) strand; PAM type: YTN; PAM sequence: TTC
agtgctccatatgaggcaag

SEQ ID NO: 60126 - DNA, 20 bp, Artificial Sequence
  Description of Artificial Sequence: Synthetic oligonucleotide
  Target: SCN9A; (-) strand; PAM type: YTN; PAM sequence: TTT
cagtgctccatatgaggcaa

SEQ ID NO: 60127 - DNA, 20 bp, Artificial Sequence
  Description of Artificial Sequence: Synthetic oligonucleotide
  Target: SCN9A; (-) strand; PAM type: YTN; PAM sequence: CTT
tcagtgctccatatgaggca

SEQ ID NO: 60128 - DNA, 20 bp, Artificial Sequence
  Description of Artificial Sequence: Synthetic oligonucleotide
  Target: SCN9A; (-) strand; PAM type: YTN; PAM sequence: TTC
tttcagtgctccatatgagg

SEQ ID NO: 60129 - DNA, 20 bp, Artificial Sequence
  Description of Artificial Sequence: Synthetic oligonucleotide
  Target: SCN9A; (-) strand; PAM type: YTN; PAM sequence: CTG
gttctttcagtgctccatat

SEQ ID NO: 60130 - DNA, 20 bp, Artificial Sequence
  Description of Artificial Sequence: Synthetic oligonucleotide
  Target: SCN9A; (-) strand; PAM type: YTN; PAM sequence: CTA
atcatactggttctttcagt

SEQ ID NO: 60131 - DNA, 20 bp, Artificial Sequence
  Description of Artificial Sequence: Synthetic oligonucleotide
  Target: SCN9A; (-) strand; PAM type: YTN; PAM sequence: TTC
taatcatactggttctttca

SEQ ID NO: 60132 - DNA, 20 bp, Artificial Sequence
  Description of Artificial Sequence: Synthetic oligonucleotide
  Target: SCN9A; (-) strand; PAM type: YTN; PAM sequence: TTG
ttctaatcatactggttctt

SEQ ID NO: 60133 - DNA, 20 bp, Artificial Sequence
  Description of Artificial Sequence: Synthetic oligonucleotide
  Target: SCN9A; (-) strand; PAM type: YTN; PAM sequence: CTG
tatcaattgttctaatcata

SEQ ID NO: 60134 - DNA, 20 bp, Artificial Sequence
  Description of Artificial Sequence: Synthetic oligonucleotide
  Target: SCN9A; (-) strand; PAM type: YTN; PAM sequence: TTG
tagctgtatcaattgttcta

SEQ ID NO: 60135 - DNA, 20 bp, Artificial Sequence
  Description of Artificial Sequence: Synthetic oligonucleotide
  Target: SCN9A; (-) strand; PAM type: YTN; PAM sequence: TTT
gtagctgtatcaattgttct

SEQ ID NO: 60136 - DNA, 20 bp, Artificial Sequence
  Description of Artificial Sequence: Synthetic oligonucleotide
  Target: SCN9A; (-) strand; PAM type: YTN; PAM sequence: CTA
tgtttgtagctgtatcaatt

SEQ ID NO: 60137 - DNA, 20 bp, Artificial Sequence
  Description of Artificial Sequence: Synthetic oligonucleotide
  Target: SCN9A; (-) strand; PAM type: YTN; PAM sequence: TTC
ctatgtttgtagctgtatca

SEQ ID NO: 60138 - DNA, 20 bp, Artificial Sequence
  Description of Artificial Sequence: Synthetic oligonucleotide
  Target: SCN9A; (-) strand; PAM type: YTN; PAM sequence: TTT
cctatgtttgtagctgtatc

SEQ ID NO: 60139 - DNA, 20 bp, Artificial Sequence
  Description of Artificial Sequence: Synthetic oligonucleotide
  Target: SCN9A; (-) strand; PAM type: YTN; PAM sequence: TTT
tcctatgtttgtagctgtat

SEQ ID NO: 60140 - DNA, 20 bp, Artificial Sequence
  Description of Artificial Sequence: Synthetic oligonucleotide
  Target: SCN9A; (-) strand; PAM type: YTN; PAM sequence: CTT
ttcctatgtttgtagctgta

SEQ ID NO: 60141 - DNA, 20 bp, Artificial Sequence
  Description of Artificial Sequence: Synthetic oligonucleotide
  Target: SCN9A; (-) strand; PAM type: YTN; PAM sequence: CTA
ccgtccccttttcctatgtt

SEQ ID NO: 60142 - DNA, 20 bp, Artificial Sequence
  Description of Artificial Sequence: Synthetic oligonucleotide
  Target: SCN9A; (-) strand; PAM type: YTN; PAM sequence: CTA
atctaccgtccccttttcct

SEQ ID NO: 60143 - DNA, 20 bp, Artificial Sequence
  Description of Artificial Sequence: Synthetic oligonucleotide
  Target: SCN9A; (-) strand; PAM type: YTN; PAM sequence: CTC
aaacagctaatctaccgtcc

SEQ ID NO: 60144 - DNA, 20 bp, Artificial Sequence
  Description of Artificial Sequence: Synthetic oligonucleotide
  Target: SCN9A; (-) strand; PAM type: YTN; PAM sequence: CTC
tcaaacagctaatctaccgt

SEQ ID NO: 60145 - DNA, 20 bp, Artificial Sequence
  Description of Artificial Sequence: Synthetic oligonucleotide
  Target: SCN9A; (-) strand; PAM type: YTN; PAM sequence: CTG
agagtctctcaaacagctaa

SEQ ID NO: 60146 - DNA, 20 bp, Artificial Sequence
  Description of Artificial Sequence: Synthetic oligonucleotide
  Target: SCN9A; (-) strand; PAM type: YTN; PAM sequence: CTA
gagatactgagagtctctca

SEQ ID NO: 60147 - DNA, 20 bp, Artificial Sequence
  Description of Artificial Sequence: Synthetic oligonucleotide
  Target: SCN9A; (-) strand; PAM type: YTN; PAM sequence: CTG
gctagagatactgagagtct

SEQ ID NO: 60148 - DNA, 20 bp, Artificial Sequence
  Description of Artificial Sequence: Synthetic oligonucleotide
  Target: SCN9A; (-) strand; PAM type: YTN; PAM sequence: TTG
ccagtcagcctggctagaga

SEQ ID NO: 60149 - DNA, 20 bp, Artificial Sequence
  Description of Artificial Sequence: Synthetic oligonucleotide
  Target: SCN9A; (-) strand; PAM type: YTN; PAM sequence: TTT
gccagtcagcctggctagag

SEQ ID NO: 60150 - DNA, 20 bp, Artificial Sequence
  Description of Artificial Sequence: Synthetic oligonucleotide
  Target: SCN9A; (-) strand; PAM type: YTN; PAM sequence: CTT
tgccagtcagcctggctaga

SEQ ID NO: 60151 - DNA, 20 bp, Artificial Sequence
  Description of Artificial Sequence: Synthetic oligonucleotide
  Target: SCN9A; (-) strand; PAM type: YTN; PAM sequence: TTG
acagggcaagacctttgcca

SEQ ID NO: 60152 - DNA, 20 bp, Artificial Sequence
  Description of Artificial Sequence: Synthetic oligonucleotide
  Target: SCN9A; (-) strand; PAM type: YTN; PAM sequence: TTT
gacagggcaagacctttgcc

SEQ ID NO: 60153 - DNA, 20 bp, Artificial Sequence
  Description of Artificial Sequence: Synthetic oligonucleotide
  Target: SCN9A; (-) strand; PAM type: YTN; PAM sequence: CTT
tgacagggcaagacctttgc

SEQ ID NO: 60154 - DNA, 20 bp, Artificial Sequence
  Description of Artificial Sequence: Synthetic oligonucleotide
  Target: SCN9A; (-) strand; PAM type: YTN; PAM sequence: CTG
actttgacagggcaagacct

SEQ ID NO: 60155 - DNA, 20 bp, Artificial Sequence
  Description of Artificial Sequence: Synthetic oligonucleotide
  Target: SCN9A; (-) strand; PAM type: YTN; PAM sequence: TTA
tggactgactttgacagggc

SEQ ID NO: 60156 - DNA, 20 bp, Artificial Sequence
  Description of Artificial Sequence: Synthetic oligonucleotide
  Target: SCN9A; (-) strand; PAM type: YTN; PAM sequence: TTT
atggactgactttgacaggg

SEQ ID NO: 60157 - DNA, 20 bp, Artificial Sequence
  Description of Artificial Sequence: Synthetic oligonucleotide
  Target: SCN9A; (-) strand; PAM type: YTN; PAM sequence: CTG
tcagccatccgacacaatgt

SEQ ID NO: 60158 - DNA, 20 bp, Artificial Sequence
  Description of Artificial Sequence: Synthetic oligonucleotide
  Target: SCN9A; (-) strand; PAM type: YTN; PAM sequence: TTG
gaagaatagccacctgtcag

SEQ ID NO: 60159 - DNA, 20 bp, Artificial Sequence
  Description of Artificial Sequence: Synthetic oligonucleotide
  Target: SCN9A; (-) strand; PAM type: YTN; PAM sequence: CTG
tgcattggaagaatagccac

SEQ ID NO: 60160 - DNA, 20 bp, Artificial Sequence
  Description of Artificial Sequence: Synthetic oligonucleotide
  Target: SCN9A; (-) strand; PAM type: YTN; PAM sequence: TTG
gtgtctgtgcattggaagaa

SEQ ID NO: 60161 - DNA, 20 bp, Artificial Sequence
  Description of Artificial Sequence: Synthetic oligonucleotide
  Target: SCN9A; (-) strand; PAM type: YTN; PAM sequence: TTG
cattggtgtctgtgcattgg

SEQ ID NO: 60162 - DNA, 20 bp, Artificial Sequence
  Description of Artificial Sequence: Synthetic oligonucleotide
  Target: SCN9A; (-) strand; PAM type: YTN; PAM sequence: TTT
gcattggtgtctgtgcattg

SEQ ID NO: 60163 - DNA, 20 bp, Artificial Sequence
  Description of Artificial Sequence: Synthetic oligonucleotide
  Target: SCN9A; (-) strand; PAM type: YTN; PAM sequence: CTT
tgcattggtgtctgtgcatt

SEQ ID NO: 60164 - DNA, 20 bp, Artificial Sequence
  Description of Artificial Sequence: Synthetic oligonucleotide
  Target: SCN9A; (-) strand; PAM type: YTN; PAM sequence: TTG
tgctttgcattggtgtctgt

SEQ ID NO: 60165 - DNA, 20 bp, Artificial Sequence
  Description of Artificial Sequence: Synthetic oligonucleotide
  Target: SCN9A; (-) strand; PAM type: YTN; PAM sequence: CTT
gtgctttgcattggtgtctg

SEQ ID NO: 60166 - DNA, 20 bp, Artificial Sequence
  Description of Artificial Sequence: Synthetic oligonucleotide
  Target: SCN9A; (-) strand; PAM type: YTN; PAM sequence: TTC
cttgtgctttgcattggtgt

SEQ ID NO: 60167 - DNA, 20 bp, Artificial Sequence
  Description of Artificial Sequence: Synthetic oligonucleotide
  Target: SCN9A; (-) strand; PAM type: YTN; PAM sequence: TTG
tgttccttgtgctttgcatt

SEQ ID NO: 60168 - DNA, 20 bp, Artificial Sequence
  Description of Artificial Sequence: Synthetic oligonucleotide
  Target: SCN9A; (-) strand; PAM type: YTN; PAM sequence: TTT
gtgttccttgtgctttgcat

SEQ ID NO: 60169 - DNA, 20 bp, Artificial Sequence
  Description of Artificial Sequence: Synthetic oligonucleotide
  Target: SCN9A; (-) strand; PAM type: YTN; PAM sequence: CTT
tgtgttccttgtgctttgca

SEQ ID NO: 60170 - DNA, 20 bp, Artificial Sequence
  Description of Artificial Sequence: Synthetic oligonucleotide
  Target: SCN9A; (-) strand; PAM type: YTN; PAM sequence: TTC
tttgtgttccttgtgctttg

SEQ ID NO: 60171 - DNA, 20 bp, Artificial Sequence
  Description of Artificial Sequence: Synthetic oligonucleotide
  Target: SCN9A; (-) strand; PAM type: YTN; PAM sequence: CTA
attctttgtgttccttgtgc

SEQ ID NO: 60172 - DNA, 20 bp, Artificial Sequence
  Description of Artificial Sequence: Synthetic oligonucleotide
  Target: SCN9A; (-) strand; PAM type: YTN; PAM sequence: TTC
cctaattctttgtgttcctt

SEQ ID NO: 60173 - DNA, 20 bp, Artificial Sequence
  Description of Artificial Sequence: Synthetic oligonucleotide
  Target: SCN9A; (-) strand; PAM type: YTN; PAM sequence: TTT
ccctaattctttgtgttcct

SEQ ID NO: 60174 - DNA, 20 bp, Artificial Sequence
  Description of Artificial Sequence: Synthetic oligonucleotide
  Target: SCN9A; (-) strand; PAM type: YTN; PAM sequence: TTG
tttccctaattctttgtgtt

SEQ ID NO: 60175 - DNA, 20 bp, Artificial Sequence
  Description of Artificial Sequence: Synthetic oligonucleotide
  Target: SCN9A; (-) strand; PAM type: YTN; PAM sequence: TTG
ttgtttccctaattctttgt

SEQ ID NO: 60176 - DNA, 20 bp, Artificial Sequence
  Description of Artificial Sequence: Synthetic oligonucleotide
  Target: SCN9A; (-) strand; PAM type: YTN; PAM sequence: TTT
gttgtttccctaattctttg

SEQ ID NO: 60177 - DNA, 20 bp, Artificial Sequence
  Description of Artificial Sequence: Synthetic oligonucleotide
  Target: SCN9A; (-) strand; PAM type: YTN; PAM sequence: TTT
tgttgtttccctaattcttt

SEQ ID NO: 60178 - DNA, 20 bp, Artificial Sequence
  Description of Artificial Sequence: Synthetic oligonucleotide
  Target: SCN9A; (-) strand; PAM type: YTN; PAM sequence: TTT
ttgttgtttccctaattctt

SEQ ID NO: 60179 - DNA, 20 bp, Artificial Sequence
  Description of Artificial Sequence: Synthetic oligonucleotide
  Target: SCN9A; (-) strand; PAM type: YTN; PAM sequence: CTT
tttgttgtttccctaattct

SEQ ID NO: 60180 - DNA, 20 bp, Artificial Sequence
  Description of Artificial Sequence: Synthetic oligonucleotide
  Target: SCN9A; (-) strand; PAM type: YTN; PAM sequence: TTA
tccctttttgttgtttccct

SEQ ID NO: 60181 - DNA, 20 bp, Artificial Sequence
  Description of Artificial Sequence: Synthetic oligonucleotide
  Target: SCN9A; (-) strand; PAM type: YTN; PAM sequence: TTT
atccctttttgttgtttccc

SEQ ID NO: 60182 - DNA, 20 bp, Artificial Sequence
  Description of Artificial Sequence: Synthetic oligonucleotide
  Target: SCN9A; (-) strand; PAM type: YTN; PAM sequence: TTT
tatccctttttgttgtttcc

SEQ ID NO: 60183 - DNA, 20 bp, Artificial Sequence
  Description of Artificial Sequence: Synthetic oligonucleotide
  Target: SCN9A; (-) strand; PAM type: YTN; PAM sequence: CTT
ttatccctttttgttgtttc

SEQ ID NO: 60184 - DNA, 20 bp, Artificial Sequence
  Description of Artificial Sequence: Synthetic oligonucleotide
  Target: SCN9A; (-) strand; PAM type: YTN; PAM sequence: TTC
ttttatccctttttgttgtt

SEQ ID NO: 60185 - DNA, 20 bp, Artificial Sequence
  Description of Artificial Sequence: Synthetic oligonucleotide
  Target: SCN9A; (-) strand; PAM type: YTN; PAM sequence: TTT
cttttatccctttttgttgt

SEQ ID NO: 60186 - DNA, 20 bp, Artificial Sequence
  Description of Artificial Sequence: Synthetic oligonucleotide
  Target: SCN9A; (-) strand; PAM type: YTN; PAM sequence: CTG
cggatttcttttatcccttt

SEQ ID NO: 60187 - DNA, 20 bp, Artificial Sequence
  Description of Artificial Sequence: Synthetic oligonucleotide
  Target: SCN9A; (-) strand; PAM type: YTN; PAM sequence: TTA
gggtcagtaactgcggattt

SEQ ID NO: 60188 - DNA, 20 bp, Artificial Sequence
  Description of Artificial Sequence: Synthetic oligonucleotide
  Target: SCN9A; (-) strand; PAM type: YTN; PAM sequence: TTT
agggtcagtaactgcggatt

SEQ ID NO: 60189 - DNA, 20 bp, Artificial Sequence
  Description of Artificial Sequence: Synthetic oligonucleotide
  Target: SCN9A; (-) strand; PAM type: YTN; PAM sequence: CTT
tagggtcagtaactgcggat

SEQ ID NO: 60190 - DNA, 20 bp, Artificial Sequence
  Description of Artificial Sequence: Synthetic oligonucleotide
  Target: SCN9A; (-) strand; PAM type: YTN; PAM sequence: TTC
tttagggtcagtaactgcgg

SEQ ID NO: 60191 - DNA, 20 bp, Artificial Sequence
  Description of Artificial Sequence: Synthetic oligonucleotide
  Target: SCN9A; (-) strand; PAM type: YTN; PAM sequence: TTT
ctttagggtcagtaactgcg

SEQ ID NO: 60192 - DNA, 20 bp, Artificial Sequence
  Description of Artificial Sequence: Synthetic oligonucleotide
  Target: SCN9A; (-) strand; PAM type: YTN; PAM sequence: CTA
tttctttagggtcagtaact

SEQ ID NO: 60193 - DNA, 20 bp, Artificial Sequence
  Description of Artificial Sequence: Synthetic oligonucleotide
  Target: SCN9A; (-) strand; PAM type: YTN; PAM sequence: CTC
tatttctttagggtcagtaa

SEQ ID NO: 60194 - DNA, 20 bp, Artificial Sequence
  Description of Artificial Sequence: Synthetic oligonucleotide
  Target: SCN9A; (-) strand; PAM type: YTN; PAM sequence: TTA
taaatctctatttctttagg

SEQ ID NO: 60195 - DNA, 20 bp, Artificial Sequence
  Description of Artificial Sequence: Synthetic oligonucleotide
  Target: SCN9A; (-) strand; PAM type: YTN; PAM sequence: TTT
ataaatctctatttctttag

SEQ ID NO: 60196 - DNA, 20 bp, Artificial Sequence
  Description of Artificial Sequence: Synthetic oligonucleotide
  Target: SCN9A; (-) strand; PAM type: YTN; PAM sequence: TTA
ggcaatttataaatctctat

SEQ ID NO: 60197 - DNA, 20 bp, Artificial Sequence
  Description of Artificial Sequence: Synthetic oligonucleotide
  Target: SCN9A; (-) strand; PAM type: YTN; PAM sequence: TTT
aggcaatttataaatctcta

SEQ ID NO: 60198 - DNA, 20 bp, Artificial Sequence
  Description of Artificial Sequence: Synthetic oligonucleotide
  Target: SCN9A; (-) strand; PAM type: YTN; PAM sequence: TTT
taggcaatttataaatctct

SEQ ID NO: 60199 - DNA, 20 bp, Artificial Sequence
  Description of Artificial Sequence: Synthetic oligonucleotide
  Target: SCN9A; (-) strand; PAM type: YTN; PAM sequence: TTT
ttaggcaatttataaatctc

SEQ ID NO: 60200 - DNA, 20 bp, Artificial Sequence
  Description of Artificial Sequence: Synthetic oligonucleotide
  Target: SCN9A; (-) strand; PAM type: YTN; PAM sequence: TTT
tttaggcaatttataaatct

SEQ ID NO: 60201 - DNA, 20 bp, Artificial Sequence
  Description of Artificial Sequence: Synthetic oligonucleotide
  Target: SCN9A; (-) strand; PAM type: YTN; PAM sequence: CTT
ttttaggcaatttataaatc

SEQ ID NO: 60202 - DNA, 20 bp, Artificial Sequence
  Description of Artificial Sequence: Synthetic oligonucleotide
  Target: SCN9A; (-) strand; PAM type: YTN; PAM sequence: TTC
ttttttaggcaatttataaa

SEQ ID NO: 60203 - DNA, 20 bp, Artificial Sequence
  Description of Artificial Sequence: Synthetic oligonucleotide
  Target: SCN9A; (-) strand; PAM type: YTN; PAM sequence: TTG
aattcttttttaggcaattt

SEQ ID NO: 60204 - DNA, 20 bp, Artificial Sequence
  Description of Artificial Sequence: Synthetic oligonucleotide
  Target: SCN9A; (-) strand; PAM type: YTN; PAM sequence: TTT
gaattcttttttaggcaatt

SEQ ID NO: 60205 - DNA, 20 bp, Artificial Sequence
  Description of Artificial Sequence: Synthetic oligonucleotide
  Target: SCN9A; (-) strand; PAM type: YTN; PAM sequence: TTT
tgaattcttttttaggcaat

SEQ ID NO: 60206 - DNA, 20 bp, Artificial Sequence
  Description of Artificial Sequence: Synthetic oligonucleotide
  Target: SCN9A; (-) strand; PAM type: YTN; PAM sequence: TTA
ttttgaattcttttttaggc

SEQ ID NO: 60207 - DNA, 20 bp, Artificial Sequence
  Description of Artificial Sequence: Synthetic oligonucleotide
  Target: SCN9A; (-) strand; PAM type: YTN; PAM sequence: TTA
ggataattattttgaattct

SEQ ID NO: 60208 - DNA, 20 bp, Artificial Sequence
  Description of Artificial Sequence: Synthetic oligonucleotide
  Target: SCN9A; (-) strand; PAM type: YTN; PAM sequence: TTC
attaggataattattttgaa

SEQ ID NO: 60209 - DNA, 20 bp, Artificial Sequence
  Description of Artificial Sequence: Synthetic oligonucleotide
  Target: SCN9A; (-) strand; PAM type: YTN; PAM sequence: CTT
cattaggataattattttga

SEQ ID NO: 60210 - DNA, 20 bp, Artificial Sequence
  Description of Artificial Sequence: Synthetic oligonucleotide
  Target: SCN9A; (-) strand; PAM type: YTN; PAM sequence: CTA
aacttcattaggataattat

SEQ ID NO: 60211 - DNA, 20 bp, Artificial Sequence
  Description of Artificial Sequence: Synthetic oligonucleotide
  Target: SCN9A; (-) strand; PAM type: YTN; PAM sequence: TTG
ctaaacttcattaggataat

SEQ ID NO: 60212 - DNA, 20 bp, Artificial Sequence
  Description of Artificial Sequence: Synthetic oligonucleotide
  Target: SCN9A; (-) strand; PAM type: YTN; PAM sequence: TTT
gctaaacttcattaggataa

SEQ ID NO: 60213 - DNA, 20 bp, Artificial Sequence
  Description of Artificial Sequence: Synthetic oligonucleotide
  Target: SCN9A; (-) strand; PAM type: YTN; PAM sequence: CTT
tgctaaacttcattaggata

SEQ ID NO: 60214 - DNA, 20 bp, Artificial Sequence
  Description of Artificial Sequence: Synthetic oligonucleotide
  Target: SCN9A; (-) strand; PAM type: YTN; PAM sequence: CTG
gtactttgctaaacttcatt

SEQ ID NO: 60215 - DNA, 20 bp, Artificial Sequence
  Description of Artificial Sequence: Synthetic oligonucleotide
  Target: SCN9A; (-) strand; PAM type: YTN; PAM sequence: CTC
tggtactttgctaaacttca

SEQ ID NO: 60216 - DNA, 20 bp, Artificial Sequence
  Description of Artificial Sequence: Synthetic oligonucleotide
  Target: SCN9A; (-) strand; PAM type: YTN; PAM sequence: TTC
tctggtactttgctaaactt

SEQ ID NO: 60217 - DNA, 20 bp, Artificial Sequence
  Description of Artificial Sequence: Synthetic oligonucleotide
  Target: SCN9A; (-) strand; PAM type: YTN; PAM sequence: CTG
ttctctggtactttgctaaa

SEQ ID NO: 60218 - DNA, 20 bp, Artificial Sequence
  Description of Artificial Sequence: Synthetic oligonucleotide
  Target: SCN9A; (-) strand; PAM type: YTN; PAM sequence: CTC
tgttctctggtactttgcta

SEQ ID NO: 60219 - DNA, 20 bp, Artificial Sequence
  Description of Artificial Sequence: Synthetic oligonucleotide
  Target: SCN9A; (-) strand; PAM type: YTN; PAM sequence: CTA
tctctgttctctggtacttt

SEQ ID NO: 60220 - DNA, 20 bp, Artificial Sequence
  Description of Artificial Sequence: Synthetic oligonucleotide
  Target: SCN9A; (-) strand; PAM type: YTN; PAM sequence: TTG
tctatctctgttctctggta

SEQ ID NO: 60221 - DNA, 20 bp, Artificial Sequence
  Description of Artificial Sequence: Synthetic oligonucleotide
  Target: SCN9A; (-) strand; PAM type: YTN; PAM sequence: TTA
gttgtctatctctgttctct

SEQ ID NO: 60222 - DNA, 20 bp, Artificial Sequence
  Description of Artificial Sequence: Synthetic oligonucleotide
  Target: SCN9A; (-) strand; PAM type: YTN; PAM sequence: TTT
agttgtctatctctgttctc

SEQ ID NO: 60223 - DNA, 20 bp, Artificial Sequence
  Description of Artificial Sequence: Synthetic oligonucleotide
  Target: SCN9A; (-) strand; PAM type: YTN; PAM sequence: TTG
tttagttgtctatctctgtt

SEQ ID NO: 60224 - DNA, 20 bp, Artificial Sequence
  Description of Artificial Sequence: Synthetic oligonucleotide
  Target: SCN9A; (-) strand; PAM type: YTN; PAM sequence: TTT
gtttagttgtctatctctgt

SEQ ID NO: 60225 - DNA, 20 bp, Artificial Sequence
  Description of Artificial Sequence: Synthetic oligonucleotide
  Target: SCN9A; (-) strand; PAM type: YTN; PAM sequence: TTT
tgtttagttgtctatctctg

SEQ ID NO: 60226 - DNA, 20 bp, Artificial Sequence
  Description of Artificial Sequence: Synthetic oligonucleotide
  Target: SCN9A; (-) strand; PAM type: YTN; PAM sequence: CTG
attttgtttagttgtctatc

SEQ ID NO: 60227 - DNA, 20 bp, Artificial Sequence
  Description of Artificial Sequence: Synthetic oligonucleotide
  Target: SCN9A; (-) strand; PAM type: YTN; PAM sequence: TTC
ctgattttgtttagttgtct

SEQ ID NO: 60228 - DNA, 20 bp, Artificial Sequence
  Description of Artificial Sequence: Synthetic oligonucleotide
  Target: SCN9A; (-) strand; PAM type: YTN; PAM sequence: CTT
cctgattttgtttagttgtc

SEQ ID NO: 60229 - DNA, 20 bp, Artificial Sequence
  Description of Artificial Sequence: Synthetic oligonucleotide
  Target: SCN9A; (-) strand; PAM type: YTN; PAM sequence: TTC
atgtatcatcttcctgattt

SEQ ID NO: 60230 - DNA, 20 bp, Artificial Sequence
  Description of Artificial Sequence: Synthetic oligonucleotide
  Target: SCN9A; (-) strand; PAM type: YTN; PAM sequence: TTG
tgttcatgtatcatcttcct

SEQ ID NO: 60231 - DNA, 20 bp, Artificial Sequence
  Description of Artificial Sequence: Synthetic oligonucleotide
  Target: SCN9A; (-) strand; PAM type: YTN; PAM sequence: CTC
attgtgttcatgtatcatct

SEQ ID NO: 60232 - DNA, 20 bp, Artificial Sequence
  Description of Artificial Sequence: Synthetic oligonucleotide
  Target: SCN9A; (-) strand; PAM type: YTN; PAM sequence: TTG
atatcctcattgtgttcatg

SEQ ID NO: 60233 - DNA, 20 bp, Artificial Sequence
  Description of Artificial Sequence: Synthetic oligonucleotide
  Target: SCN9A; (-) strand; PAM type: YTN; PAM sequence: TTC
attgatatcctcattgtgtt

SEQ ID NO: 60234 - DNA, 20 bp, Artificial Sequence
  Description of Artificial Sequence: Synthetic oligonucleotide
  Target: SCN9A; (-) strand; PAM type: YTN; PAM sequence: CTT
cattgatatcctcattgtgt

SEQ ID NO: 60235 - DNA, 20 bp, Artificial Sequence
  Description of Artificial Sequence: Synthetic oligonucleotide
  Target: SCN9A; (-) strand; PAM type: YTN; PAM sequence: TTC
ccttcattgatatcctcatt

SEQ ID NO: 60236 - DNA, 20 bp, Artificial Sequence
  Description of Artificial Sequence: Synthetic oligonucleotide
  Target: SCN9A; (-) strand; PAM type: YTN; PAM sequence: TTT
cccttcattgatatcctcat

SEQ ID NO: 60237 - DNA, 20 bp, Artificial Sequence
  Description of Artificial Sequence: Synthetic oligonucleotide
  Target: SCN9A; (-) strand; PAM type: YTN; PAM sequence: CTT
tcccttcattgatatcctca

SEQ ID NO: 60238 - DNA, 20 bp, Artificial Sequence
  Description of Artificial Sequence: Synthetic oligonucleotide
  Target: SCN9A; (-) strand; PAM type: YTN; PAM sequence: TTC
tttcccttcattgatatcct

SEQ ID NO: 60239 - DNA, 20 bp, Artificial Sequence
  Description of Artificial Sequence: Synthetic oligonucleotide
  Target: SCN9A; (-) strand; PAM type: YTN; PAM sequence: TTT
ctttcccttcattgatatcc

SEQ ID NO: 60240 - DNA, 20 bp, Artificial Sequence
  Description of Artificial Sequence: Synthetic oligonucleotide
  Target: SCN9A; (-) strand; PAM type: YTN; PAM sequence: TTG
tgtgtgtgtgtatagtttct

SEQ ID NO: 60241 - DNA, 20 bp, Artificial Sequence
  Description of Artificial Sequence: Synthetic oligonucleotide
  Target: SCN9A; (-) strand; PAM type: YTN; PAM sequence: TTT
gtgtgtgtgtgtatagtttc

SEQ ID NO: 60242 - DNA, 20 bp, Artificial Sequence
  Description of Artificial Sequence: Synthetic oligonucleotide
  Target: SCN9A; (-) strand; PAM type: YTN; PAM sequence: TTT
tgtgtgtgtgtgtatagttt

SEQ ID NO: 60243 - DNA, 20 bp, Artificial Sequence
  Description of Artificial Sequence: Synthetic oligonucleotide
  Target: SCN9A; (-) strand; PAM type: YTN; PAM sequence: TTT
ttgtgtgtgtgtgtatagtt

SEQ ID NO: 60244 - DNA, 20 bp, Artificial Sequence
  Description of Artificial Sequence: Synthetic oligonucleotide
  Target: SCN9A; (-) strand; PAM type: YTN; PAM sequence: CTT
tttgtgtgtgtgtgtatagt

SEQ ID NO: 60245 - DNA, 20 bp, Artificial Sequence
  Description of Artificial Sequence: Synthetic oligonucleotide
  Target: SCN9A; (-) strand; PAM type: YTN; PAM sequence: TTG
actttttgtgtgtgtgtgta

SEQ ID NO: 60246 - DNA, 20 bp, Artificial Sequence
  Description of Artificial Sequence: Synthetic oligonucleotide
  Target: SCN9A; (-) strand; PAM type: YTN; PAM sequence: TTT
gactttttgtgtgtgtgtgt

SEQ ID NO: 60247 - DNA, 20 bp, Artificial Sequence
  Description of Artificial Sequence: Synthetic oligonucleotide
  Target: SCN9A; (-) strand; PAM type: YTN; PAM sequence: CTG
atatttgactttttgtgtgt

SEQ ID NO: 60248 - DNA, 20 bp, Artificial Sequence
  Description of Artificial Sequence: Synthetic oligonucleotide
  Target: SCN9A; (-) strand; PAM type: YTN; PAM sequence: TTA
ctgatatttgactttttgtg

SEQ ID NO: 60249 - DNA, 20 bp, Artificial Sequence
  Description of Artificial Sequence: Synthetic oligonucleotide
  Target: SCN9A; (-) strand; PAM type: YTN; PAM sequence: TTT
actgatatttgactttttgt

SEQ ID NO: 60250 - DNA, 20 bp, Artificial Sequence
  Description of Artificial Sequence: Synthetic oligonucleotide
  Target: SCN9A; (-) strand; PAM type: YTN; PAM sequence: TTT
tactgatatttgactttttg

SEQ ID NO: 60251 - DNA, 20 bp, Artificial Sequence
  Description of Artificial Sequence: Synthetic oligonucleotide
  Target: SCN9A; (-) strand; PAM type: YTN; PAM sequence: TTT
ttactgatatttgacttttt

SEQ ID NO: 60252 - DNA, 20 bp, Artificial Sequence
  Description of Artificial Sequence: Synthetic oligonucleotide
  Target: SCN9A; (-) strand; PAM type: YTN; PAM sequence: TTC
cagagtttttactgatattt

SEQ ID NO: 60253 - DNA, 20 bp, Artificial Sequence
  Description of Artificial Sequence: Synthetic oligonucleotide
  Target: SCN9A; (-) strand; PAM type: YTN; PAM sequence: TTC
aattccagagtttttactga

SEQ ID NO: 60254 - DNA, 20 bp, Artificial Sequence
  Description of Artificial Sequence: Synthetic oligonucleotide
  Target: SCN9A; (-) strand; PAM type: YTN; PAM sequence: CTT
caattccagagtttttactg

SEQ ID NO: 60255 - DNA, 20 bp, Artificial Sequence
  Description of Artificial Sequence: Synthetic oligonucleotide
  Target: SCN9A; (-) strand; PAM type: YTN; PAM sequence: TTC
ttcaattccagagtttttac

SEQ ID NO: 60256 - DNA, 20 bp, Artificial Sequence
  Description of Artificial Sequence: Synthetic oligonucleotide
  Target: SCN9A; (-) strand; PAM type: YTN; PAM sequence: TTG
tattcttcaattccagagtt

SEQ ID NO: 60257 - DNA, 20 bp, Artificial Sequence
  Description of Artificial Sequence: Synthetic oligonucleotide
  Target: SCN9A; (-) strand; PAM type: YTN; PAM sequence: TTA
ttgtattcttcaattccaga

SEQ ID NO: 60258 - DNA, 20 bp, Artificial Sequence
  Description of Artificial Sequence: Synthetic oligonucleotide
  Target: SCN9A; (-) strand; PAM type: YTN; PAM sequence: TTC
aattattgtattcttcaatt

SEQ ID NO: 60259 - DNA, 20 bp, Artificial Sequence
  Description of Artificial Sequence: Synthetic oligonucleotide
  Target: SCN9A; (-) strand; PAM type: YTN; PAM sequence: TTA
gttcaattattgtattcttc

SEQ ID NO: 60260 - DNA, 20 bp, Artificial Sequence
  Description of Artificial Sequence: Synthetic oligonucleotide
  Target: SCN9A; (-) strand; PAM type: YTN; PAM sequence: TTT
agttcaattattgtattctt

SEQ ID NO: 60261 - DNA, 20 bp, Artificial Sequence
  Description of Artificial Sequence: Synthetic oligonucleotide
  Target: SCN9A; (-) strand; PAM type: YTN; PAM sequence: TTT
tagttcaattattgtattct

SEQ ID NO: 60262 - DNA, 20 bp, Artificial Sequence
  Description of Artificial Sequence: Synthetic oligonucleotide
  Target: SCN9A; (-) strand; PAM type: YTN; PAM sequence: TTT
ttagttcaattattgtattc

SEQ ID NO: 60263 - DNA, 20 bp, Artificial Sequence
  Description of Artificial Sequence: Synthetic oligonucleotide
  Target: SCN9A; (-) strand; PAM type: YTN; PAM sequence: TTT
tttagttcaattattgtatt

SEQ ID NO: 60264 - DNA, 20 bp, Artificial Sequence
  Description of Artificial Sequence: Synthetic oligonucleotide
  Target: SCN9A; (-) strand; PAM type: YTN; PAM sequence: CTA
gggagttttttagttcaatt

SEQ ID NO: 60265 - DNA, 20 bp, Artificial Sequence
  Description of Artificial Sequence: Synthetic oligonucleotide
  Target: SCN9A; (-) strand; PAM type: YTN; PAM sequence: CTC
tagggagttttttagttcaa

SEQ ID NO: 60266 - DNA, 20 bp, Artificial Sequence
  Description of Artificial Sequence: Synthetic oligonucleotide
  Target: SCN9A; (-) strand; PAM type: YTN; PAM sequence: TTG
aatcctctagggagtttttt

SEQ ID NO: 60267 - DNA, 20 bp, Artificial Sequence
  Description of Artificial Sequence: Synthetic oligonucleotide
  Target: SCN9A; (-) strand; PAM type: YTN; PAM sequence: CTA
ttgaatcctctagggagttt

SEQ ID NO: 60268 - DNA, 20 bp, Artificial Sequence
  Description of Artificial Sequence: Synthetic oligonucleotide
  Target: SCN9A; (-) strand; PAM type: YTN; PAM sequence: CTG
ctattgaatcctctagggag

SEQ ID NO: 60269 - DNA, 20 bp, Artificial Sequence
  Description of Artificial Sequence: Synthetic oligonucleotide
  Target: SCN9A; (-) strand; PAM type: YTN; PAM sequence: TTG
atcaagtctgctattgaatc

SEQ ID NO: 60270 - DNA, 20 bp, Artificial Sequence
  Description of Artificial Sequence: Synthetic oligonucleotide
  Target: SCN9A; (-) strand; PAM type: YTN; PAM sequence: TTT
gatcaagtctgctattgaat

SEQ ID NO: 60271 - DNA, 20 bp, Artificial Sequence
  Description of Artificial Sequence: Synthetic oligonucleotide
  Target: SCN9A; (-) strand; PAM type: YTN; PAM sequence: CTC
cagtttgatcaagtctgcta

SEQ ID NO: 60272 - DNA, 20 bp, Artificial Sequence
  Description of Artificial Sequence: Synthetic oligonucleotide
  Target: SCN9A; (-) strand; PAM type: YTN; PAM sequence: TTC
tccagtttgatcaagtctgc

SEQ ID NO: 60273 - DNA, 20 bp, Artificial Sequence
  Description of Artificial Sequence: Synthetic oligonucleotide
  Target: SCN9A; (-) strand; PAM type: YTN; PAM sequence: TTT
ctccagtttgatcaagtctg

SEQ ID NO: 60274 - DNA, 20 bp, Artificial Sequence
  Description of Artificial Sequence: Synthetic oligonucleotide
  Target: SCN9A; (-) strand; PAM type: YTN; PAM sequence: CTT
tctccagtttgatcaagtct

SEQ ID NO: 60275 - DNA, 20 bp, Artificial Sequence
  Description of Artificial Sequence: Synthetic oligonucleotide
  Target: SCN9A; (-) strand; PAM type: YTN; PAM sequence: TTC
tttctccagtttgatcaagt

SEQ ID NO: 60276 - DNA, 20 bp, Artificial Sequence
  Description of Artificial Sequence: Synthetic oligonucleotide
  Target: SCN9A; (-) strand; PAM type: YTN; PAM sequence: TTG
attctttctccagtttgatc

SEQ ID NO: 60277 - DNA, 20 bp, Artificial Sequence
  Description of Artificial Sequence: Synthetic oligonucleotide
  Target: SCN9A; (-) strand; PAM type: YTN; PAM sequence: TTG
ttgattctttctccagtttg

SEQ ID NO: 60278 - DNA, 20 bp, Artificial Sequence
  Description of Artificial Sequence: Synthetic oligonucleotide
  Target: SCN9A; (-) strand; PAM type: YTN; PAM sequence: TTT
gttgattctttctccagttt

SEQ ID NO: 60279 - DNA, 20 bp, Artificial Sequence
  Description of Artificial Sequence: Synthetic oligonucleotide
  Target: SCN9A; (-) strand; PAM type: YTN; PAM sequence: TTG
gtttgttgattctttctcca

SEQ ID NO: 60280 - DNA, 20 bp, Artificial Sequence
  Description of Artificial Sequence: Synthetic oligonucleotide
  Target: SCN9A; (-) strand; PAM type: YTN; PAM sequence: CTT
ggtttgttgattctttctcc

SEQ ID NO: 60281 - DNA, 20 bp, Artificial Sequence
  Description of Artificial Sequence: Synthetic oligonucleotide
  Target: SCN9A; (-) strand; PAM type: YTN; PAM sequence: TTC
ttggtttgttgattctttct

SEQ ID NO: 60282 - DNA, 20 bp, Artificial Sequence
  Description of Artificial Sequence: Synthetic oligonucleotide
  Target: SCN9A; (-) strand; PAM type: YTN; PAM sequence: TTT
cttggtttgttgattctttc

SEQ ID NO: 60283 - DNA, 20 bp, Artificial Sequence
  Description of Artificial Sequence: Synthetic oligonucleotide
  Target: SCN9A; (-) strand; PAM type: YTN; PAM sequence: TTT
tcttggtttgttgattcttt

SEQ ID NO: 60284 - DNA, 20 bp, Artificial Sequence
  Description of Artificial Sequence: Synthetic oligonucleotide
  Target: SCN9A; (-) strand; PAM type: YTN; PAM sequence: TTT
ttcttggtttgttgattctt

SEQ ID NO: 60285 - DNA, 20 bp, Artificial Sequence
  Description of Artificial Sequence: Synthetic oligonucleotide
  Target: SCN9A; (-) strand; PAM type: YTN; PAM sequence: TTT
tttcttggtttgttgattct

SEQ ID NO: 60286 - DNA, 20 bp, Artificial Sequence
  Description of Artificial Sequence: Synthetic oligonucleotide
  Target: SCN9A; (-) strand; PAM type: YTN; PAM sequence: TTT
ttttcttggtttgttgattc

SEQ ID NO: 60287 - DNA, 20 bp, Artificial Sequence
  Description of Artificial Sequence: Synthetic oligonucleotide
  Target: SCN9A; (-) strand; PAM type: YTN; PAM sequence: TTG
tttttttcttggtttgttga

SEQ ID NO: 60288 - DNA, 20 bp, Artificial Sequence
  Description of Artificial Sequence: Synthetic oligonucleotide
  Target: SCN9A; (-) strand; PAM type: YTN; PAM sequence: TTG
atggggttgtttttttcttg

SEQ ID NO: 60289 - DNA, 20 bp, Artificial Sequence
  Description of Artificial Sequence: Synthetic oligonucleotide
  Target: SCN9A; (-) strand; PAM type: YTN; PAM sequence: TTT
gatggggttgtttttttctt

SEQ ID NO: 60290 - DNA, 20 bp, Artificial Sequence
  Description of Artificial Sequence: Synthetic oligonucleotide
  Target: SCN9A; (-) strand; PAM type: YTN; PAM sequence: TTT
tgatggggttgtttttttct

SEQ ID NO: 60291 - DNA, 20 bp, Artificial Sequence
  Description of Artificial Sequence: Synthetic oligonucleotide
  Target: SCN9A; (-) strand; PAM type: YTN; PAM sequence: TTT
ttgatggggttgtttttttc

SEQ ID NO: 60292 - DNA, 20 bp, Artificial Sequence
  Description of Artificial Sequence: Synthetic oligonucleotide
  Target: SCN9A; (-) strand; PAM type: YTN; PAM sequence: TTA
cccagtttttgatggggttg

SEQ ID NO: 60293 - DNA, 20 bp, Artificial Sequence
  Description of Artificial Sequence: Synthetic oligonucleotide
  Target: SCN9A; (-) strand; PAM type: YTN; PAM sequence: TTT
acccagtttttgatggggtt

SEQ ID NO: 60294 - DNA, 20 bp, Artificial Sequence
  Description of Artificial Sequence: Synthetic oligonucleotide
  Target: SCN9A; (-) strand; PAM type: YTN; PAM sequence: CTT
tacccagtttttgatggggt

SEQ ID NO: 60295 - DNA, 20 bp, Artificial Sequence
  Description of Artificial Sequence: Synthetic oligonucleotide
  Target: SCN9A; (-) strand; PAM type: YTN; PAM sequence: TTC
atatcctttacccagttttt

SEQ ID NO: 60296 - DNA, 20 bp, Artificial Sequence
  Description of Artificial Sequence: Synthetic oligonucleotide
  Target: SCN9A; (-) strand; PAM type: YTN; PAM sequence: CTG
ttcatatcctttacccagtt

SEQ ID NO: 60297 - DNA, 20 bp, Artificial Sequence
  Description of Artificial Sequence: Synthetic oligonucleotide
  Target: SCN9A; (-) strand; PAM type: YTN; PAM sequence: TTG
agaagtgtctgttcatatcc

SEQ ID NO: 60298 - DNA, 20 bp, Artificial Sequence
  Description of Artificial Sequence: Synthetic oligonucleotide
  Target: SCN9A; (-) strand; PAM type: YTN; PAM sequence: TTT
gagaagtgtctgttcatatc

SEQ ID NO: 60299 - DNA, 20 bp, Artificial Sequence
  Description of Artificial Sequence: Synthetic oligonucleotide
  Target: SCN9A; (-) strand; PAM type: YTN; PAM sequence: TTT
tgagaagtgtctgttcatat

SEQ ID NO: 60300 - DNA, 20 bp, Artificial Sequence
  Description of Artificial Sequence: Synthetic oligonucleotide
  Target: SCN9A; (-) strand; PAM type: YTN; PAM sequence: CTT
ttgagaagtgtctgttcata

SEQ ID NO: 60301 - DNA, 20 bp, Artificial Sequence
  Description of Artificial Sequence: Synthetic oligonucleotide
  Target: SCN9A; (-) strand; PAM type: YTN; PAM sequence: TTC
ttttgagaagtgtctgttca

SEQ ID NO: 60302 - DNA, 20 bp, Artificial Sequence
  Description of Artificial Sequence: Synthetic oligonucleotide
  Target: SCN9A; (-) strand; PAM type: YTN; PAM sequence: CTT
cttttgagaagtgtctgttc

SEQ ID NO: 60303 - DNA, 20 bp, Artificial Sequence
  Description of Artificial Sequence: Synthetic oligonucleotide
  Target: SCN9A; (-) strand; PAM type: YTN; PAM sequence: CTG
cataaatgtcttcttttgag

SEQ ID NO: 60304 - DNA, 20 bp, Artificial Sequence
  Description of Artificial Sequence: Synthetic oligonucleotide
  Target: SCN9A; (-) strand; PAM type: YTN; PAM sequence: TTG
gctgcataaatgtcttcttt

SEQ ID NO: 60305 - DNA, 20 bp, Artificial Sequence
  Description of Artificial Sequence: Synthetic oligonucleotide
  Target: SCN9A; (-) strand; PAM type: YTN; PAM sequence: TTT
ggctgcataaatgtcttctt

SEQ ID NO: 60306 - DNA, 20 bp, Artificial Sequence
  Description of Artificial Sequence: Synthetic oligonucleotide
  Target: SCN9A; (-) strand; PAM type: YTN; PAM sequence: TTT
tggctgcataaatgtcttct

SEQ ID NO: 60307 - DNA, 20 bp, Artificial Sequence
  Description of Artificial Sequence: Synthetic oligonucleotide
  Target: SCN9A; (-) strand; PAM type: YTN; PAM sequence: TTT
ttggctgcataaatgtcttc

SEQ ID NO: 60308 - DNA, 20 bp, Artificial Sequence
  Description of Artificial Sequence: Synthetic oligonucleotide
  Target: SCN9A; (-) strand; PAM type: YTN; PAM sequence: TTT
tttggctgcataaatgtctt

SEQ ID NO: 60309 - DNA, 20 bp, Artificial Sequence
  Description of Artificial Sequence: Synthetic oligonucleotide
  Target: SCN9A; (-) strand; PAM type: YTN; PAM sequence: TTC
atgtgttttttggctgcata

SEQ ID NO: 60310 - DNA, 20 bp, Artificial Sequence
  Description of Artificial Sequence: Synthetic oligonucleotide
  Target: SCN9A; (-) strand; PAM type: YTN; PAM sequence: TTT
catgtgttttttggctgcat

SEQ ID NO: 60311 - DNA, 20 bp, Artificial Sequence
  Description of Artificial Sequence: Synthetic oligonucleotide
  Target: SCN9A; (-) strand; PAM type: YTN; PAM sequence: TTT
tcatgtgttttttggctgca

SEQ ID NO: 60312 - DNA, 20 bp, Artificial Sequence
  Description of Artificial Sequence: Synthetic oligonucleotide
  Target: SCN9A; (-) strand; PAM type: YTN; PAM sequence: TTT
ttcatgtgttttttggctgc

SEQ ID NO: 60313 - DNA, 20 bp, Artificial Sequence
  Description of Artificial Sequence: Synthetic oligonucleotide
  Target: SCN9A; (-) strand; PAM type: YTN; PAM sequence: TTT
tttcatgtgttttttggctg

SEQ ID NO: 60314 - DNA, 20 bp, Artificial Sequence
  Description of Artificial Sequence: Synthetic oligonucleotide
  Target: SCN9A; (-) strand; PAM type: YTN; PAM sequence: CTG
atggccagtgatgatgagca

SEQ ID NO: 60315 - DNA, 20 bp, Artificial Sequence
  Description of Artificial Sequence: Synthetic oligonucleotide
  Target: SCN9A; (-) strand; PAM type: YTN; PAM sequence: CTC
tgatggccagtgatgatgag

SEQ ID NO: 60316 - DNA, 20 bp, Artificial Sequence
  Description of Artificial Sequence: Synthetic oligonucleotide
  Target: SCN9A; (-) strand; PAM type: YTN; PAM sequence: TTC
tctgatggccagtgatgatg

SEQ ID NO: 60317 - DNA, 20 bp, Artificial Sequence
  Description of Artificial Sequence: Synthetic oligonucleotide
  Target: SCN9A; (-) strand; PAM type: YTN; PAM sequence: TTT
ctctgatggccagtgatgat

SEQ ID NO: 60318 - DNA, 20 bp, Artificial Sequence
  Description of Artificial Sequence: Synthetic oligonucleotide
  Target: SCN9A; (-) strand; PAM type: YTN; PAM sequence: TTG
catttctctgatggccagtg

SEQ ID NO: 60319 - DNA, 20 bp, Artificial Sequence
  Description of Artificial Sequence: Synthetic oligonucleotide
  Target: SCN9A; (-) strand; PAM type: YTN; PAM sequence: TTT
gcatttctctgatggccagt

SEQ ID NO: 60320 - DNA, 20 bp, Artificial Sequence
  Description of Artificial Sequence: Synthetic oligonucleotide
  Target: SCN9A; (-) strand; PAM type: YTN; PAM sequence: TTG
atttgcatttctctgatggc

SEQ ID NO: 60321 - DNA, 20 bp, Artificial Sequence
  Description of Artificial Sequence: Synthetic oligonucleotide
  Target: SCN9A; (-) strand; PAM type: YTN; PAM sequence: TTT
gatttgcatttctctgatgg

SEQ ID NO: 60322 - DNA, 20 bp, Artificial Sequence
  Description of Artificial Sequence: Synthetic oligonucleotide
  Target: SCN9A; (-) strand; PAM type: YTN; PAM sequence: TTT
tgatttgcatttctctgatg

SEQ ID NO: 60323 - DNA, 20 bp, Artificial Sequence
  Description of Artificial Sequence: Synthetic oligonucleotide
  Target: SCN9A; (-) strand; PAM type: YTN; PAM sequence: TTG
cggttttgatttgcatttct

SEQ ID NO: 60324 - DNA, 20 bp, Artificial Sequence
  Description of Artificial Sequence: Synthetic oligonucleotide
  Target: SCN9A; (-) strand; PAM type: YTN; PAM sequence: CTC
attgcggttttgatttgcat

SEQ ID NO: 60325 - DNA, 20 bp, Artificial Sequence
  Description of Artificial Sequence: Synthetic oligonucleotide
  Target: SCN9A; (-) strand; PAM type: YTN; PAM sequence: CTG
gtatgagatggtatctcatt

SEQ ID NO: 60326 - DNA, 20 bp, Artificial Sequence
  Description of Artificial Sequence: Synthetic oligonucleotide
  Target: SCN9A; (-) strand; PAM type: YTN; PAM sequence: CTA
actggtatgagatggtatct

SEQ ID NO: 60327 - DNA, 20 bp, Artificial Sequence
  Description of Artificial Sequence: Synthetic oligonucleotide
  Target: SCN9A; (-) strand; PAM type: YTN; PAM sequence: TTC
taactggtatgagatggtat

SEQ ID NO: 60328 - DNA, 20 bp, Artificial Sequence
  Description of Artificial Sequence: Synthetic oligonucleotide
  Target: SCN9A; (-) strand; PAM type: YTN; PAM sequence: TTA
atgatcaccattctaactgg

SEQ ID NO: 60329 - DNA, 20 bp, Artificial Sequence
  Description of Artificial Sequence: Synthetic oligonucleotide
  Target: SCN9A; (-) strand; PAM type: YTN; PAM sequence: TTT
aatgatcaccattctaactg

SEQ ID NO: 60330 - DNA, 20 bp, Artificial Sequence
  Description of Artificial Sequence: Synthetic oligonucleotide
  Target: SCN9A; (-) strand; PAM type: YTN; PAM sequence: TTT
taatgatcaccattctaact

SEQ ID NO: 60331 - DNA, 20 bp, Artificial Sequence
  Description of Artificial Sequence: Synthetic oligonucleotide
  Target: SCN9A; (-) strand; PAM type: YTN; PAM sequence: TTT
ttaatgatcaccattctaac

SEQ ID NO: 60332 - DNA, 20 bp, Artificial Sequence
  Description of Artificial Sequence: Synthetic oligonucleotide
  Target: SCN9A; (-) strand; PAM type: YTN; PAM sequence: CTT
tttaatgatcaccattctaa

SEQ ID NO: 60333 - DNA, 20 bp, Artificial Sequence
  Description of Artificial Sequence: Synthetic oligonucleotide
  Target: SCN9A; (-) strand; PAM type: YTN; PAM sequence: CTG
actttttaatgatcaccatt

SEQ ID NO: 60334 - DNA, 20 bp, Artificial Sequence
  Description of Artificial Sequence: Synthetic oligonucleotide
  Target: SCN9A; (-) strand; PAM type: YTN; PAM sequence: TTC
ctgactttttaatgatcacc

SEQ ID NO: 60335 - DNA, 20 bp, Artificial Sequence
  Description of Artificial Sequence: Synthetic oligonucleotide
  Target: SCN9A; (-) strand; PAM type: YTN; PAM sequence: TTT
cctgactttttaatgatcac

SEQ ID NO: 60336 - DNA, 20 bp, Artificial Sequence
  Description of Artificial Sequence: Synthetic oligonucleotide
  Target: SCN9A; (-) strand; PAM type: YTN; PAM sequence: TTG
tttcctgactttttaatgat

SEQ ID NO: 60337 - DNA, 20 bp, Artificial Sequence
  Description of Artificial Sequence: Synthetic oligonucleotide
  Target: SCN9A; (-) strand; PAM type: YTN; PAM sequence: CTG
ttgtttcctgactttttaat

SEQ ID NO: 60338 - DNA, 20 bp, Artificial Sequence
  Description of Artificial Sequence: Synthetic oligonucleotide
  Target: SCN9A; (-) strand; PAM type: YTN; PAM sequence: CTC
cagcacctgttgtttcctga

SEQ ID NO: 60339 - DNA, 20 bp, Artificial Sequence
  Description of Artificial Sequence: Synthetic oligonucleotide
  Target: SCN9A; (-) strand; PAM type: YTN; PAM sequence: CTC
tccagcacctgttgtttcct

SEQ ID NO: 60340 - DNA, 20 bp, Artificial Sequence
  Description of Artificial Sequence: Synthetic oligonucleotide
  Target: SCN9A; (-) strand; PAM type: YTN; PAM sequence: CTC
cacatcctctccagcacctg

SEQ ID NO: 60341 - DNA, 20 bp, Artificial Sequence
  Description of Artificial Sequence: Synthetic oligonucleotide
  Target: SCN9A; (-) strand; PAM type: YTN; PAM sequence: TTC
tccacatcctctccagcacc

SEQ ID NO: 60342 - DNA, 20 bp, Artificial Sequence
  Description of Artificial Sequence: Synthetic oligonucleotide
  Target: SCN9A; (-) strand; PAM type: YTN; PAM sequence: TTT
ctccacatcctctccagcac

SEQ ID NO: 60343 - DNA, 20 bp, Artificial Sequence
  Description of Artificial Sequence: Synthetic oligonucleotide
  Target: SCN9A; (-) strand; PAM type: YTN; PAM sequence: CTA
tttctccacatcctctccag

SEQ ID NO: 60344 - DNA, 20 bp, Artificial Sequence
  Description of Artificial Sequence: Synthetic oligonucleotide
  Target: SCN9A; (-) strand; PAM type: YTN; PAM sequence: TTC
ctatttctccacatcctctc

SEQ ID NO: 60345 - DNA, 20 bp, Artificial Sequence
  Description of Artificial Sequence: Synthetic oligonucleotide
  Target: SCN9A; (-) strand; PAM type: YTN; PAM sequence: TTA
cagtcccaccaacagtgtaa

SEQ ID NO: 60346 - DNA, 20 bp, Artificial Sequence
  Description of Artificial Sequence: Synthetic oligonucleotide
  Target: SCN9A; (-) strand; PAM type: YTN; PAM sequence: TTT
acagtcccaccaacagtgta

SEQ ID NO: 60347 - DNA, 20 bp, Artificial Sequence
  Description of Artificial Sequence: Synthetic oligonucleotide
  Target: SCN9A; (-) strand; PAM type: YTN; PAM sequence: CTA
gtttacagtcccaccaacag

SEQ ID NO: 60348 - DNA, 20 bp, Artificial Sequence
  Description of Artificial Sequence: Synthetic oligonucleotide
  Target: SCN9A; (-) strand; PAM type: YTN; PAM sequence: TTG
aactagtttacagtcccacc

SEQ ID NO: 60349 - DNA, 20 bp, Artificial Sequence
  Description of Artificial Sequence: Synthetic oligonucleotide
  Target: SCN9A; (-) strand; PAM type: YTN; PAM sequence: TTC
cacagtggttgaactagttt

SEQ ID NO: 60350 - DNA, 20 bp, Artificial Sequence
  Description of Artificial Sequence: Synthetic oligonucleotide
  Target: SCN9A; (-) strand; PAM type: YTN; PAM sequence: CTT
ccacagtggttgaactagtt

SEQ ID NO: 60351 - DNA, 20 bp, Artificial Sequence
  Description of Artificial Sequence: Synthetic oligonucleotide
  Target: SCN9A; (-) strand; PAM type: YTN; PAM sequence: TTG
aggaatcgccacacggactt

SEQ ID NO: 60352 - DNA, 20 bp, Artificial Sequence
  Description of Artificial Sequence: Synthetic oligonucleotide
  Target: SCN9A; (-) strand; PAM type: YTN; PAM sequence: CTT
gaggaatcgccacacggact

SEQ ID NO: 60353 - DNA, 20 bp, Artificial Sequence
  Description of Artificial Sequence: Synthetic oligonucleotide
  Target: SCN9A; (-) strand; PAM type: YTN; PAM sequence: CTA
gatccttgaggaatcgccac

SEQ ID NO: 60354 - DNA, 20 bp, Artificial Sequence
  Description of Artificial Sequence: Synthetic oligonucleotide
  Target: SCN9A; (-) strand; PAM type: YTN; PAM sequence: TTC
tagatccttgaggaatcgcc

SEQ ID NO: 60355 - DNA, 20 bp, Artificial Sequence
  Description of Artificial Sequence: Synthetic oligonucleotide
  Target: SCN9A; (-) strand; PAM type: YTN; PAM sequence: CTA
gttctagatccttgaggaat

SEQ ID NO: 60356 - DNA, 20 bp, Artificial Sequence
  Description of Artificial Sequence: Synthetic oligonucleotide
  Target: SCN9A; (-) strand; PAM type: YTN; PAM sequence: TTC
tagttctagatccttgagga

SEQ ID NO: 60357 - DNA, 20 bp, Artificial Sequence
  Description of Artificial Sequence: Synthetic oligonucleotide
  Target: SCN9A; (-) strand; PAM type: YTN; PAM sequence: TTT
ctagttctagatccttgagg

SEQ ID NO: 60358 - DNA, 20 bp, Artificial Sequence
  Description of Artificial Sequence: Synthetic oligonucleotide
  Target: SCN9A; (-) strand; PAM type: YTN; PAM sequence: CTG
ggtcaaatggtatttctagt

SEQ ID NO: 60359 - DNA, 20 bp, Artificial Sequence
  Description of Artificial Sequence: Synthetic oligonucleotide
  Target: SCN9A; (-) strand; PAM type: YTN; PAM sequence: TTG
ggtatatacccagtcatggg

SEQ ID NO: 60360 - DNA, 20 bp, Artificial Sequence
  Description of Artificial Sequence: Synthetic oligonucleotide
  Target: SCN9A; (-) strand; PAM type: YTN; PAM sequence: TTT
gggtatatacccagtcatgg

SEQ ID NO: 60361 - DNA, 20 bp, Artificial Sequence
  Description of Artificial Sequence: Synthetic oligonucleotide
  Target: SCN9A; (-) strand; PAM type: YTN; PAM sequence: CTT
tgggtatatacccagtcatg

SEQ ID NO: 60362 - DNA, 20 bp, Artificial Sequence
  Description of Artificial Sequence: Synthetic oligonucleotide
  Target: SCN9A; (-) strand; PAM type: YTN; PAM sequence: TTA
taatcctttgggtatatacc

SEQ ID NO: 60363 - DNA, 20 bp, Artificial Sequence
  Description of Artificial Sequence: Synthetic oligonucleotide
  Target: SCN9A; (-) strand; PAM type: YTN; PAM sequence: TTT
ataatcctttgggtatatac

SEQ ID NO: 60364 - DNA, 20 bp, Artificial Sequence
  Description of Artificial Sequence: Synthetic oligonucleotide
  Target: SCN9A; (-) strand; PAM type: YTN; PAM sequence: TTA
tagcagcatgatttataatc

SEQ ID NO: 60365 - DNA, 20 bp, Artificial Sequence
  Description of Artificial Sequence: Synthetic oligonucleotide
  Target: SCN9A; (-) strand; PAM type: YTN; PAM sequence: TTT
atagcagcatgatttataat

SEQ ID NO: 60366 - DNA, 20 bp, Artificial Sequence
  Description of Artificial Sequence: Synthetic oligonucleotide
  Target: SCN9A; (-) strand; PAM type: YTN; PAM sequence: CTT
tatagcagcatgatttataa

SEQ ID NO: 60367 - DNA, 20 bp, Artificial Sequence
  Description of Artificial Sequence: Synthetic oligonucleotide
  Target: SCN9A; (-) strand; PAM type: YTN; PAM sequence: TTG
tgaatagtgccgcaataaac

SEQ ID NO: 60368 - DNA, 20 bp, Artificial Sequence
  Description of Artificial Sequence: Synthetic oligonucleotide
  Target: SCN9A; (-) strand; PAM type: YTN; PAM sequence: CTA
ttgtgaatagtgccgcaata

SEQ ID NO: 60369 - DNA, 20 bp, Artificial Sequence
  Description of Artificial Sequence: Synthetic oligonucleotide
  Target: SCN9A; (-) strand; PAM type: YTN; PAM sequence: TTG
ctattgtgaatagtgccgca

SEQ ID NO: 60370 - DNA, 20 bp, Artificial Sequence
  Description of Artificial Sequence: Synthetic oligonucleotide
  Target: SCN9A; (-) strand; PAM type: YTN; PAM sequence: TTT
gctattgtgaatagtgccgc

SEQ ID NO: 60371 - DNA, 20 bp, Artificial Sequence
  Description of Artificial Sequence: Synthetic oligonucleotide
  Target: SCN9A; (-) strand; PAM type: YTN; PAM sequence: CTT
tgctattgtgaatagtgccg

SEQ ID NO: 60372 - DNA, 20 bp, Artificial Sequence
  Description of Artificial Sequence: Synthetic oligonucleotide
  Target: SCN9A; (-) strand; PAM type: YTN; PAM sequence: TTC
caagtctttgctattgtgaa

SEQ ID NO: 60373 - DNA, 20 bp, Artificial Sequence
  Description of Artificial Sequence: Synthetic oligonucleotide
  Target: SCN9A; (-) strand; PAM type: YTN; PAM sequence: TTG
gttccaagtctttgctattg

SEQ ID NO: 60374 - DNA, 20 bp, Artificial Sequence
  Description of Artificial Sequence: Synthetic oligonucleotide
  Target: SCN9A; (-) strand; PAM type: YTN; PAM sequence: CTT
ggttccaagtctttgctatt

SEQ ID NO: 60375 - DNA, 20 bp, Artificial Sequence
  Description of Artificial Sequence: Synthetic oligonucleotide
  Target: SCN9A; (-) strand; PAM type: YTN; PAM sequence: TTG
gcttggttccaagtctttgc

SEQ ID NO: 60376 - DNA, 20 bp, Artificial Sequence
  Description of Artificial Sequence: Synthetic oligonucleotide
  Target: SCN9A; (-) strand; PAM type: YTN; PAM sequence: TTT
ggcttggttccaagtctttg

SEQ ID NO: 60377 - DNA, 20 bp, Artificial Sequence
  Description of Artificial Sequence: Synthetic oligonucleotide
  Target: SCN9A; (-) strand; PAM type: YTN; PAM sequence: TTG
gacatttggcttggttccaa

SEQ ID NO: 60378 - DNA, 20 bp, Artificial Sequence
  Description of Artificial Sequence: Synthetic oligonucleotide
  Target: SCN9A; (-) strand; PAM type: YTN; PAM sequence: TTG
ttggacatttggcttggttc

SEQ ID NO: 60379 - DNA, 20 bp, Artificial Sequence
  Description of Artificial Sequence: Synthetic oligonucleotide
  Target: SCN9A; (-) strand; PAM type: YTN; PAM sequence: CTA
tcattgttggacatttggct

SEQ ID NO: 60380 - DNA, 20 bp, Artificial Sequence
  Description of Artificial Sequence: Synthetic oligonucleotide
  Target: SCN9A; (-) strand; PAM type: YTN; PAM sequence: TTA
atccagtctatcattgttgg

SEQ ID NO: 60381 - DNA, 20 bp, Artificial Sequence
  Description of Artificial Sequence: Synthetic oligonucleotide
  Target: SCN9A; (-) strand; PAM type: YTN; PAM sequence: CTT
aatccagtctatcattgttg

SEQ ID NO: 60382 - DNA, 20 bp, Artificial Sequence
  Description of Artificial Sequence: Synthetic oligonucleotide
  Target: SCN9A; (-) strand; PAM type: YTN; PAM sequence: TTC
ttaatccagtctatcattgt

SEQ ID NO: 60383 - DNA, 20 bp, Artificial Sequence
  Description of Artificial Sequence: Synthetic oligonucleotide
  Target: SCN9A; (-) strand; PAM type: YTN; PAM sequence: TTT
cttaatccagtctatcattg

SEQ ID NO: 60384 - DNA, 20 bp, Artificial Sequence
  Description of Artificial Sequence: Synthetic oligonucleotide
  Target: SCN9A; (-) strand; PAM type: YTN; PAM sequence: TTT
tcttaatccagtctatcatt

SEQ ID NO: 60385 - DNA, 20 bp, Artificial Sequence
  Description of Artificial Sequence: Synthetic oligonucleotide
  Target: SCN9A; (-) strand; PAM type: YTN; PAM sequence: TTC
catggtgtatatgtgccata

SEQ ID NO: 60386 - DNA, 20 bp, Artificial Sequence
  Description of Artificial Sequence: Synthetic oligonucleotide
  Target: SCN9A; (-) strand; PAM type: YTN; PAM sequence: CTG
catagtattccatggtgtat

SEQ ID NO: 60387 - DNA, 20 bp, Artificial Sequence
  Description of Artificial Sequence: Synthetic oligonucleotide
  Target: SCN9A; (-) strand; PAM type: YTN; PAM sequence: TTA
tggctgcatagtattccatg

SEQ ID NO: 60388 - DNA, 20 bp, Artificial Sequence
  Description of Artificial Sequence: Synthetic oligonucleotide
  Target: SCN9A; (-) strand; PAM type: YTN; PAM sequence: TTT
atggctgcatagtattccat

SEQ ID NO: 60389 - DNA, 20 bp, Artificial Sequence
  Description of Artificial Sequence: Synthetic oligonucleotide
  Target: SCN9A; (-) strand; PAM type: YTN; PAM sequence: TTT
tatggctgcatagtattcca

SEQ ID NO: 60390 - DNA, 20 bp, Artificial Sequence
  Description of Artificial Sequence: Synthetic oligonucleotide
  Target: SCN9A; (-) strand; PAM type: YTN; PAM sequence: TTT
ttatggctgcatagtattcc

SEQ ID NO: 60391 - DNA, 20 bp, Artificial Sequence
  Description of Artificial Sequence: Synthetic oligonucleotide
  Target: SCN9A; (-) strand; PAM type: YTN; PAM sequence: TTT
tttatggctgcatagtattc

SEQ ID NO: 60392 - DNA, 20 bp, Artificial Sequence
  Description of Artificial Sequence: Synthetic oligonucleotide
  Target: SCN9A; (-) strand; PAM type: YTN; PAM sequence: CTT
ttttatggctgcatagtatt

SEQ ID NO: 60393 - DNA, 20 bp, Artificial Sequence
  Description of Artificial Sequence: Synthetic oligonucleotide
  Target: SCN9A; (-) strand; PAM type: YTN; PAM sequence: CTC
atccttttttatggctgcat

SEQ ID NO: 60394 - DNA, 20 bp, Artificial Sequence
  Description of Artificial Sequence: Synthetic oligonucleotide
  Target: SCN9A; (-) strand; PAM type: YTN; PAM sequence: TTG
agctcatccttttttatggc

SEQ ID NO: 60395 - DNA, 20 bp, Artificial Sequence
  Description of Artificial Sequence: Synthetic oligonucleotide
  Target: SCN9A; (-) strand; PAM type: YTN; PAM sequence: CTT
gagctcatccttttttatgg

SEQ ID NO: 60396 - DNA, 20 bp, Artificial Sequence
  Description of Artificial Sequence: Synthetic oligonucleotide
  Target: SCN9A; (-) strand; PAM type: YTN; PAM sequence: CTG
caaaggacttgagctcatcc

SEQ ID NO: 60397 - DNA, 20 bp, Artificial Sequence
  Description of Artificial Sequence: Synthetic oligonucleotide
  Target: SCN9A; (-) strand; PAM type: YTN; PAM sequence: TTC
atgcatgtccctgcaaagga

SEQ ID NO: 60398 - DNA, 20 bp, Artificial Sequence
  Description of Artificial Sequence: Synthetic oligonucleotide
  Target: SCN9A; (-) strand; PAM type: YTN; PAM sequence: CTT
catgcatgtccctgcaaagg

SEQ ID NO: 60399 - DNA, 20 bp, Artificial Sequence
  Description of Artificial Sequence: Synthetic oligonucleotide
  Target: SCN9A; (-) strand; PAM type: YTN; PAM sequence: TTC
cagcttcatgcatgtccctg

SEQ ID NO: 60400 - DNA, 20 bp, Artificial Sequence
  Description of Artificial Sequence: Synthetic oligonucleotide
  Target: SCN9A; (-) strand; PAM type: YTN; PAM sequence: TTT
ccagcttcatgcatgtccct

SEQ ID NO: 60401 - DNA, 20 bp, Artificial Sequence
  Description of Artificial Sequence: Synthetic oligonucleotide
  Target: SCN9A; (-) strand; PAM type: YTN; PAM sequence: CTG
agaatgatggtttccagctt

SEQ ID NO: 60402 - DNA, 20 bp, Artificial Sequence
  Description of Artificial Sequence: Synthetic oligonucleotide
  Target: SCN9A; (-) strand; PAM type: YTN; PAM sequence: TTG
ctgagaatgatggtttccag

SEQ ID NO: 60403 - DNA, 20 bp, Artificial Sequence
  Description of Artificial Sequence: Synthetic oligonucleotide
  Target: SCN9A; (-) strand; PAM type: YTN; PAM sequence: TTT
gctgagaatgatggtttcca

SEQ ID NO: 60404 - DNA, 20 bp, Artificial Sequence
  Description of Artificial Sequence: Synthetic oligonucleotide
  Target: SCN9A; (-) strand; PAM type: YTN; PAM sequence: TTG
cgatagtttgctgagaatga

SEQ ID NO: 60405 - DNA, 20 bp, Artificial Sequence
  Description of Artificial Sequence: Synthetic oligonucleotide
  Target: SCN9A; (-) strand; PAM type: YTN; PAM sequence: CTT
gcgatagtttgctgagaatg

SEQ ID NO: 60406 - DNA, 20 bp, Artificial Sequence
  Description of Artificial Sequence: Synthetic oligonucleotide
  Target: SCN9A; (-) strand; PAM type: YTN; PAM sequence: TTC
cttgcgatagtttgctgaga

SEQ ID NO: 60407 - DNA, 20 bp, Artificial Sequence
  Description of Artificial Sequence: Synthetic oligonucleotide
  Target: SCN9A; (-) strand; PAM type: YTN; PAM sequence: TTT
ccttgcgatagtttgctgag

SEQ ID NO: 60408 - DNA, 20 bp, Artificial Sequence
  Description of Artificial Sequence: Synthetic oligonucleotide
  Target: SCN9A; (-) strand; PAM type: YTN; PAM sequence: TTT
tccttgcgatagtttgctga

SEQ ID NO: 60409 - DNA, 20 bp, Artificial Sequence
  Description of Artificial Sequence: Synthetic oligonucleotide
  Target: SCN9A; (-) strand; PAM type: YTN; PAM sequence: TTT
ttccttgcgatagtttgctg

SEQ ID NO: 60410 - DNA, 20 bp, Artificial Sequence
  Description of Artificial Sequence: Synthetic oligonucleotide
  Target: SCN9A; (-) strand; PAM type: YTN; PAM sequence: TTT
tttccttgcgatagtttgct

SEQ ID NO: 60411 - DNA, 20 bp, Artificial Sequence
  Description of Artificial Sequence: Synthetic oligonucleotide
  Target: SCN9A; (-) strand; PAM type: YTN; PAM sequence: TTT
ttttccttgcgatagtttgc

SEQ ID NO: 60412 - DNA, 20 bp, Artificial Sequence
  Description of Artificial Sequence: Synthetic oligonucleotide
  Target: SCN9A; (-) strand; PAM type: YTN; PAM sequence: TTG
gtttttttccttgcgatagt

SEQ ID NO: 60413 - DNA, 20 bp, Artificial Sequence
  Description of Artificial Sequence: Synthetic oligonucleotide
  Target: SCN9A; (-) strand; PAM type: YTN; PAM sequence: TTT
ggtttttttccttgcgatag

SEQ ID NO: 60414 - DNA, 20 bp, Artificial Sequence
  Description of Artificial Sequence: Synthetic oligonucleotide
  Target: SCN9A; (-) strand; PAM type: YTN; PAM sequence: CTA
tgagtgagaaagtgcagtgt

SEQ ID NO: 60415 - DNA, 20 bp, Artificial Sequence
  Description of Artificial Sequence: Synthetic oligonucleotide
  Target: SCN9A; (-) strand; PAM type: YTN; PAM sequence: TTC
ccacctatgagtgagaaagt

SEQ ID NO: 60416 - DNA, 20 bp, Artificial Sequence
  Description of Artificial Sequence: Synthetic oligonucleotide
  Target: SCN9A; (-) strand; PAM type: YTN; PAM sequence: TTC
aattcccacctatgagtgag

SEQ ID NO: 60417 - DNA, 20 bp, Artificial Sequence
  Description of Artificial Sequence: Synthetic oligonucleotide
  Target: SCN9A; (-) strand; PAM type: YTN; PAM sequence: TTG
ttcaattcccacctatgagt

SEQ ID NO: 60418 - DNA, 20 bp, Artificial Sequence
  Description of Artificial Sequence: Synthetic oligonucleotide
  Target: SCN9A; (-) strand; PAM type: YTN; PAM sequence: CTC
attgttcaattcccacctat

SEQ ID NO: 60419 - DNA, 20 bp, Artificial Sequence
  Description of Artificial Sequence: Synthetic oligonucleotide
  Target: SCN9A; (-) strand; PAM type: YTN; PAM sequence: TTC
tcattgttcaattcccacct

SEQ ID NO: 60420 - DNA, 20 bp, Artificial Sequence
  Description of Artificial Sequence: Synthetic oligonucleotide
  Target: SCN9A; (-) strand; PAM type: YTN; PAM sequence: CTG
tgtccatgtgttctcattgt

SEQ ID NO: 60421 - DNA, 20 bp, Artificial Sequence
  Description of Artificial Sequence: Synthetic oligonucleotide
  Target: SCN9A; (-) strand; PAM type: YTN; PAM sequence: TTC
ctgtgtccatgtgttctcat

SEQ ID NO: 60422 - DNA, 20 bp, Artificial Sequence
  Description of Artificial Sequence: Synthetic oligonucleotide
  Target: SCN9A; (-) strand; PAM type: YTN; PAM sequence: CTT
cctgtgtccatgtgttctca

SEQ ID NO: 60423 - DNA, 20 bp, Artificial Sequence
  Description of Artificial Sequence: Synthetic oligonucleotide
  Target: SCN9A; (-) strand; PAM type: YTN; PAM sequence: CTG
gtgtgtgatggtccccttcc

SEQ ID NO: 60424 - DNA, 20 bp, Artificial Sequence
  Description of Artificial Sequence: Synthetic oligonucleotide
  Target: SCN9A; (-) strand; PAM type: YTN; PAM sequence: CTC
cccccaccccacaacaggcc

SEQ ID NO: 60425 - DNA, 20 bp, Artificial Sequence
  Description of Artificial Sequence: Synthetic oligonucleotide
  Target: SCN9A; (-) strand; PAM type: YTN; PAM sequence: CTC
ctccccccaccccacaacag

SEQ ID NO: 60426 - DNA, 20 bp, Artificial Sequence
  Description of Artificial Sequence: Synthetic oligonucleotide
  Target: SCN9A; (-) strand; PAM type: YTN; PAM sequence: TTA
ggtatatccccctcctcccc

SEQ ID NO: 60427 - DNA, 20 bp, Artificial Sequence
  Description of Artificial Sequence: Synthetic oligonucleotide
  Target: SCN9A; (-) strand; PAM type: YTN; PAM sequence: CTA
atgttaggtatatccccctc

SEQ ID NO: 60428 - DNA, 20 bp, Artificial Sequence
  Description of Artificial Sequence: Synthetic oligonucleotide
  Target: SCN9A; (-) strand; PAM type: YTN; PAM sequence: CTC
ctaatgttaggtatatcccc

SEQ ID NO: 60429 - DNA, 20 bp, Artificial Sequence
  Description of Artificial Sequence: Synthetic oligonucleotide
  Target: SCN9A; (-) strand; PAM type: YTN; PAM sequence: TTA
ggtatatctcctaatgttag

SEQ ID NO: 60430 - DNA, 20 bp, Artificial Sequence
  Description of Artificial Sequence: Synthetic oligonucleotide
  Target: SCN9A; (-) strand; PAM type: YTN; PAM sequence: TTA
acattaggtatatctcctaa

SEQ ID NO: 60431 - DNA, 20 bp, Artificial Sequence
  Description of Artificial Sequence: Synthetic oligonucleotide
  Target: SCN9A; (-) strand; PAM type: YTN; PAM sequence: TTT
aacattaggtatatctccta

SEQ ID NO: 60432 - DNA, 20 bp, Artificial Sequence
  Description of Artificial Sequence: Synthetic oligonucleotide
  Target: SCN9A; (-) strand; PAM type: YTN; PAM sequence: CTC
atcatttaacattaggtata

SEQ ID NO: 60433 - DNA, 20 bp, Artificial Sequence
  Description of Artificial Sequence: Synthetic oligonucleotide
  Target: SCN9A; (-) strand; PAM type: YTN; PAM sequence: TTA
actcatcatttaacattagg

SEQ ID NO: 60434 - DNA, 20 bp, Artificial Sequence
  Description of Artificial Sequence: Synthetic oligonucleotide
  Target: SCN9A; (-) strand; PAM type: YTN; PAM sequence: CTA
cacccattaactcatcattt

SEQ ID NO: 60435 - DNA, 20 bp, Artificial Sequence
  Description of Artificial Sequence: Synthetic oligonucleotide
  Target: SCN9A; (-) strand; PAM type: YTN; PAM sequence: TTG
gtgtgctacacccattaact

SEQ ID NO: 60436 - DNA, 20 bp, Artificial Sequence
  Description of Artificial Sequence: Synthetic oligonucleotide
  Target: SCN9A; (-) strand; PAM type: YTN; PAM sequence: TTA
catatgtatacatgtgccat

SEQ ID NO: 60437 - DNA, 20 bp, Artificial Sequence
  Description of Artificial Sequence: Synthetic oligonucleotide
  Target: SCN9A; (-) strand; PAM type: YTN; PAM sequence: TTA
gttacatatgtatacatgtg

SEQ ID NO: 60438 - DNA, 20 bp, Artificial Sequence
  Description of Artificial Sequence: Synthetic oligonucleotide
  Target: SCN9A; (-) strand; PAM type: YTN; PAM sequence: TTA
gggtacatgtgcacaacgtg

SEQ ID NO: 60439 - DNA, 20 bp, Artificial Sequence
  Description of Artificial Sequence: Synthetic oligonucleotide
  Target: SCN9A; (-) strand; PAM type: YTN; PAM sequence: TTT
agggtacatgtgcacaacgt

SEQ ID NO: 60440 - DNA, 20 bp, Artificial Sequence
  Description of Artificial Sequence: Synthetic oligonucleotide
  Target: SCN9A; (-) strand; PAM type: YTN; PAM sequence: TTT
tagggtacatgtgcacaacg

SEQ ID NO: 60441 - DNA, 20 bp, Artificial Sequence
  Description of Artificial Sequence: Synthetic oligonucleotide
  Target: SCN9A; (-) strand; PAM type: YTN; PAM sequence: TTA
agttttagggtacatgtgca

SEQ ID NO: 60442 - DNA, 20 bp, Artificial Sequence
  Description of Artificial Sequence: Synthetic oligonucleotide
  Target: SCN9A; (-) strand; PAM type: YTN; PAM sequence: TTT
aagttttagggtacatgtgc

SEQ ID NO: 60443 - DNA, 20 bp, Artificial Sequence
  Description of Artificial Sequence: Synthetic oligonucleotide
  Target: SCN9A; (-) strand; PAM type: YTN; PAM sequence: CTT
taagttttagggtacatgtg

SEQ ID NO: 60444 - DNA, 20 bp, Artificial Sequence
  Description of Artificial Sequence: Synthetic oligonucleotide
  Target: SCN9A; (-) strand; PAM type: YTN; PAM sequence: TTA
tactttaagttttagggtac

SEQ ID NO: 60445 - DNA, 20 bp, Artificial Sequence
  Description of Artificial Sequence: Synthetic oligonucleotide
  Target: SCN9A; (-) strand; PAM type: YTN; PAM sequence: TTA
ttatactttaagttttaggg

SEQ ID NO: 60446 - DNA, 20 bp, Artificial Sequence
  Description of Artificial Sequence: Synthetic oligonucleotide
  Target: SCN9A; (-) strand; PAM type: YTN; PAM sequence: TTT
attatactttaagttttagg

SEQ ID NO: 60447 - DNA, 20 bp, Artificial Sequence
  Description of Artificial Sequence: Synthetic oligonucleotide
  Target: SCN9A; (-) strand; PAM type: YTN; PAM sequence: TTT
tattatactttaagttttag

SEQ ID NO: 60448 - DNA, 20 bp, Artificial Sequence
  Description of Artificial Sequence: Synthetic oligonucleotide
  Target: SCN9A; (-) strand; PAM type: YTN; PAM sequence: TTT
ttattatactttaagtttta

SEQ ID NO: 60449 - DNA, 20 bp, Artificial Sequence
  Description of Artificial Sequence: Synthetic oligonucleotide
  Target: SCN9A; (-) strand; PAM type: YTN; PAM sequence: TTT
tttattatactttaagtttt

SEQ ID NO: 60450 - DNA, 20 bp, Artificial Sequence
  Description of Artificial Sequence: Synthetic oligonucleotide
  Target: SCN9A; (-) strand; PAM type: YTN; PAM sequence: TTA
ttttttattatactttaagt

SEQ ID NO: 60451 - DNA, 20 bp, Artificial Sequence
  Description of Artificial Sequence: Synthetic oligonucleotide
  Target: SCN9A; (-) strand; PAM type: YTN; PAM sequence: TTT
attttttattatactttaag

SEQ ID NO: 60452 - DNA, 20 bp, Artificial Sequence
  Description of Artificial Sequence: Synthetic oligonucleotide
  Target: SCN9A; (-) strand; PAM type: YTN; PAM sequence: TTT
tattttttattatactttaa

SEQ ID NO: 60453 - DNA, 20 bp, Artificial Sequence
  Description of Artificial Sequence: Synthetic oligonucleotide
  Target: SCN9A; (-) strand; PAM type: YTN; PAM sequence: TTT
ttattttttattatacttta

SEQ ID NO: 60454 - DNA, 20 bp, Artificial Sequence
  Description of Artificial Sequence: Synthetic oligonucleotide
  Target: SCN9A; (-) strand; PAM type: YTN; PAM sequence: TTA
tttttattttttattatact

SEQ ID NO: 60455 - DNA, 20 bp, Artificial Sequence
  Description of Artificial Sequence: Synthetic oligonucleotide
  Target: SCN9A; (-) strand; PAM type: YTN; PAM sequence: TTT
atttttattttttattatac

SEQ ID NO: 60456 - DNA, 20 bp, Artificial Sequence
  Description of Artificial Sequence: Synthetic oligonucleotide
  Target: SCN9A; (-) strand; PAM type: YTN; PAM sequence: TTT
tatttttattttttattata

SEQ ID NO: 60457 - DNA, 20 bp, Artificial Sequence
  Description of Artificial Sequence: Synthetic oligonucleotide
  Target: SCN9A; (-) strand; PAM type: YTN; PAM sequence: TTT
ttatttttattttttattat

SEQ ID NO: 60458 - DNA, 20 bp, Artificial Sequence
  Description of Artificial Sequence: Synthetic oligonucleotide
  Target: SCN9A; (-) strand; PAM type: YTN; PAM sequence: TTT
tttatttttattttttatta

SEQ ID NO: 60459 - DNA, 20 bp, Artificial Sequence
  Description of Artificial Sequence: Synthetic oligonucleotide
  Target: SCN9A; (-) strand; PAM type: YTN; PAM sequence: TTT
ttttatttttattttttatt

SEQ ID NO: 60460 - DNA, 20 bp, Artificial Sequence
  Description of Artificial Sequence: Synthetic oligonucleotide
  Target: SCN9A; (-) strand; PAM type: YTN; PAM sequence: TTA
tttttttatttttatttttt

SEQ ID NO: 60461 - DNA, 20 bp, Artificial Sequence
  Description of Artificial Sequence: Synthetic oligonucleotide
  Target: SCN9A; (-) strand; PAM type: YTN; PAM sequence: TTT
atttttttatttttattttt

SEQ ID NO: 60462 - DNA, 20 bp, Artificial Sequence
  Description of Artificial Sequence: Synthetic oligonucleotide
  Target: SCN9A; (-) strand; PAM type: YTN; PAM sequence: TTT
tatttttttatttttatttt

SEQ ID NO: 60463 - DNA, 20 bp, Artificial Sequence
  Description of Artificial Sequence: Synthetic oligonucleotide
  Target: SCN9A; (-) strand; PAM type: YTN; PAM sequence: TTT
ttatttttttatttttattt

SEQ ID NO: 60464 - DNA, 20 bp, Artificial Sequence
  Description of Artificial Sequence: Synthetic oligonucleotide
  Target: SCN9A; (-) strand; PAM type: YTN; PAM sequence: TTT
tttatttttttatttttatt

SEQ ID NO: 60465 - DNA, 20 bp, Artificial Sequence
  Description of Artificial Sequence: Synthetic oligonucleotide
  Target: SCN9A; (-) strand; PAM type: YTN; PAM sequence: TTA
ttttttatttttttattttt

SEQ ID NO: 60466 - DNA, 20 bp, Artificial Sequence
  Description of Artificial Sequence: Synthetic oligonucleotide
  Target: SCN9A; (-) strand; PAM type: YTN; PAM sequence: TTT
attttttatttttttatttt

SEQ ID NO: 60467 - DNA, 20 bp, Artificial Sequence
  Description of Artificial Sequence: Synthetic oligonucleotide
  Target: SCN9A; (-) strand; PAM type: YTN; PAM sequence: TTT
tattttttatttttttattt

SEQ ID NO: 60468 - DNA, 20 bp, Artificial Sequence
  Description of Artificial Sequence: Synthetic oligonucleotide
  Target: SCN9A; (-) strand; PAM type: YTN; PAM sequence: TTA
attttattttttattttttt

SEQ ID NO: 60469 - DNA, 20 bp, Artificial Sequence
  Description of Artificial Sequence: Synthetic oligonucleotide
  Target: SCN9A; (-) strand; PAM type: YTN; PAM sequence: TTT
aattttattttttatttttt

SEQ ID NO: 60470 - DNA, 20 bp, Artificial Sequence
  Description of Artificial Sequence: Synthetic oligonucleotide
  Target: SCN9A; (-) strand; PAM type: YTN; PAM sequence: TTT
taattttattttttattttt

SEQ ID NO: 60471 - DNA, 20 bp, Artificial Sequence
  Description of Artificial Sequence: Synthetic oligonucleotide
  Target: SCN9A; (-) strand; PAM type: YTN; PAM sequence: TTT
ttaattttattttttatttt

SEQ ID NO: 60472 - DNA, 20 bp, Artificial Sequence
  Description of Artificial Sequence: Synthetic oligonucleotide
  Target: SCN9A; (-) strand; PAM type: YTN; PAM sequence: TTT
tttaattttattttttattt

SEQ ID NO: 60473 - DNA, 20 bp, Artificial Sequence
  Description of Artificial Sequence: Synthetic oligonucleotide
  Target: SCN9A; (-) strand; PAM type: YTN; PAM sequence: TTG
agggttttttaattttattt

SEQ ID NO: 60474 - DNA, 20 bp, Artificial Sequence
  Description of Artificial Sequence: Synthetic oligonucleotide
  Target: SCN9A; (-) strand; PAM type: YTN; PAM sequence: TTT
gagggttttttaattttatt

SEQ ID NO: 60475 - DNA, 20 bp, Artificial Sequence
  Description of Artificial Sequence: Synthetic oligonucleotide
  Target: SCN9A; (-) strand; PAM type: YTN; PAM sequence: TTT
tgagggttttttaattttat

SEQ ID NO: 60476 - DNA, 20 bp, Artificial Sequence
  Description of Artificial Sequence: Synthetic oligonucleotide
  Target: SCN9A; (-) strand; PAM type: YTN; PAM sequence: CTT
ttgagggttttttaatttta

SEQ ID NO: 60477 - DNA, 20 bp, Artificial Sequence
  Description of Artificial Sequence: Synthetic oligonucleotide
  Target: SCN9A; (-) strand; PAM type: YTN; PAM sequence: TTG
gtgtccatcttttgagggtt

SEQ ID NO: 60478 - DNA, 20 bp, Artificial Sequence
  Description of Artificial Sequence: Synthetic oligonucleotide
  Target: SCN9A; (-) strand; PAM type: YTN; PAM sequence: TTT
ggtgtccatcttttgagggt

SEQ ID NO: 60479 - DNA, 20 bp, Artificial Sequence
  Description of Artificial Sequence: Synthetic oligonucleotide
  Target: SCN9A; (-) strand; PAM type: YTN; PAM sequence: TTT
tggtgtccatcttttgaggg

SEQ ID NO: 60480 - DNA, 20 bp, Artificial Sequence
  Description of Artificial Sequence: Synthetic oligonucleotide
  Target: SCN9A; (-) strand; PAM type: YTN; PAM sequence: TTT
ttggtgtccatcttttgagg

SEQ ID NO: 60481 - DNA, 20 bp, Artificial Sequence
  Description of Artificial Sequence: Synthetic oligonucleotide
  Target: SCN9A; (-) strand; PAM type: YTN; PAM sequence: TTT
tttggtgtccatcttttgag

SEQ ID NO: 60482 - DNA, 20 bp, Artificial Sequence
  Description of Artificial Sequence: Synthetic oligonucleotide
  Target: SCN9A; (-) strand; PAM type: YTN; PAM sequence: TTT
ttttggtgtccatcttttga

SEQ ID NO: 60483 - DNA, 20 bp, Artificial Sequence
  Description of Artificial Sequence: Synthetic oligonucleotide
  Target: SCN9A; (-) strand; PAM type: YTN; PAM sequence: TTT
tttttggtgtccatcttttg

SEQ ID NO: 60484 - DNA, 20 bp, Artificial Sequence
  Description of Artificial Sequence: Synthetic oligonucleotide
  Target: SCN9A; (-) strand; PAM type: YTN; PAM sequence: TTT
ttttttggtgtccatctttt

SEQ ID NO: 60485 - DNA, 20 bp, Artificial Sequence
  Description of Artificial Sequence: Synthetic oligonucleotide
  Target: SCN9A; (-) strand; PAM type: YTN; PAM sequence: TTT
tttttttggtgtccatcttt

SEQ ID NO: 60486 - DNA, 20 bp, Artificial Sequence
  Description of Artificial Sequence: Synthetic oligonucleotide
  Target: SCN9A; (-) strand; PAM type: YTN; PAM sequence: TTT
ttttttttggtgtccatctt

SEQ ID NO: 60487 - DNA, 20 bp, Artificial Sequence
  Description of Artificial Sequence: Synthetic oligonucleotide
  Target: SCN9A; (-) strand; PAM type: YTN; PAM sequence: TTT
tttttttttggtgtccatct

SEQ ID NO: 60488 - DNA, 20 bp, Artificial Sequence
  Description of Artificial Sequence: Synthetic oligonucleotide
  Target: SCN9A; (-) strand; PAM type: YTN; PAM sequence: TTT
ttttttttttggtgtccatc

SEQ ID NO: 60489 - DNA, 20 bp, Artificial Sequence
  Description of Artificial Sequence: Synthetic oligonucleotide
  Target: SCN9A; (-) strand; PAM type: YTN; PAM sequence: TTT
tttttttttttggtgtccat

SEQ ID NO: 60490 - DNA, 20 bp, Artificial Sequence
  Description of Artificial Sequence: Synthetic oligonucleotide
  Target: SCN9A; (-) strand; PAM type: YTN; PAM sequence: TTT
ttttttttttttggtgtcca

SEQ ID NO: 60491 - DNA, 20 bp, Artificial Sequence
  Description of Artificial Sequence: Synthetic oligonucleotide
  Target: SCN9A; (-) strand; PAM type: YTN; PAM sequence: CTT
tttttttttttttggtgtcc

SEQ ID NO: 60492 - DNA, 20 bp, Artificial Sequence
  Description of Artificial Sequence: Synthetic oligonucleotide
  Target: SCN9A; (-) strand; PAM type: YTN; PAM sequence: CTA
cctttttttttttttttggt

SEQ ID NO: 60493 - DNA, 20 bp, Artificial Sequence
  Description of Artificial Sequence: Synthetic oligonucleotide
  Target: SCN9A; (-) strand; PAM type: YTN; PAM sequence: TTA
aatgatctaccttttttttt

SEQ ID NO: 60494 - DNA, 20 bp, Artificial Sequence
  Description of Artificial Sequence: Synthetic oligonucleotide
  Target: SCN9A; (-) strand; PAM type: YTN; PAM sequence: TTT
aaatgatctacctttttttt

SEQ ID NO: 60495 - DNA, 20 bp, Artificial Sequence
  Description of Artificial Sequence: Synthetic oligonucleotide
  Target: SCN9A; (-) strand; PAM type: YTN; PAM sequence: TTT
taaatgatctaccttttttt

SEQ ID NO: 60496 - DNA, 20 bp, Artificial Sequence
  Description of Artificial Sequence: Synthetic oligonucleotide
  Target: SCN9A; (-) strand; PAM type: YTN; PAM sequence: CTG
gataattttaaatgatctac

SEQ ID NO: 60497 - DNA, 20 bp, Artificial Sequence
  Description of Artificial Sequence: Synthetic oligonucleotide
  Target: SCN9A; (-) strand; PAM type: YTN; PAM sequence: CTG
actggataattttaaatgat

SEQ ID NO: 60498 - DNA, 20 bp, Artificial Sequence
  Description of Artificial Sequence: Synthetic oligonucleotide
  Target: SCN9A; (-) strand; PAM type: YTN; PAM sequence: CTC
cactgactggataattttaa

SEQ ID NO: 60499 - DNA, 20 bp, Artificial Sequence
  Description of Artificial Sequence: Synthetic oligonucleotide
  Target: SCN9A; (-) strand; PAM type: YTN; PAM sequence: TTG
ctccactgactggataattt

SEQ ID NO: 60500 - DNA, 20 bp, Artificial Sequence
  Description of Artificial Sequence: Synthetic oligonucleotide
  Target: SCN9A; (-) strand; PAM type: YTN; PAM sequence: CTT
gctccactgactggataatt

SEQ ID NO: 60501 - DNA, 20 bp, Artificial Sequence
  Description of Artificial Sequence: Synthetic oligonucleotide
  Target: SCN9A; (-) strand; PAM type: YTN; PAM sequence: TTC
ttgctccactgactggataa

SEQ ID NO: 60502 - DNA, 20 bp, Artificial Sequence
  Description of Artificial Sequence: Synthetic oligonucleotide
  Target: SCN9A; (-) strand; PAM type: YTN; PAM sequence: CTT
cttgctccactgactggata

SEQ ID NO: 60503 - DNA, 20 bp, Artificial Sequence
  Description of Artificial Sequence: Synthetic oligonucleotide
  Target: SCN9A; (-) strand; PAM type: YTN; PAM sequence: TTC
ttcttgctccactgactgga

SEQ ID NO: 60504 - DNA, 20 bp, Artificial Sequence
  Description of Artificial Sequence: Synthetic oligonucleotide
  Target: SCN9A; (-) strand; PAM type: YTN; PAM sequence: TTT
cttcttgctccactgactgg

SEQ ID NO: 60505 - DNA, 20 bp, Artificial Sequence
  Description of Artificial Sequence: Synthetic oligonucleotide
  Target: SCN9A; (-) strand; PAM type: YTN; PAM sequence: TTA
tttcttcttgctccactgac

SEQ ID NO: 60506 - DNA, 20 bp, Artificial Sequence
  Description of Artificial Sequence: Synthetic oligonucleotide
  Target: SCN9A; (-) strand; PAM type: YTN; PAM sequence: TTT
atttcttcttgctccactga

SEQ ID NO: 60507 - DNA, 20 bp, Artificial Sequence
  Description of Artificial Sequence: Synthetic oligonucleotide
  Target: SCN9A; (-) strand; PAM type: YTN; PAM sequence: TTT
tatttcttcttgctccactg

SEQ ID NO: 60508 - DNA, 20 bp, Artificial Sequence
  Description of Artificial Sequence: Synthetic oligonucleotide
  Target: SCN9A; (-) strand; PAM type: YTN; PAM sequence: TTT
ttatttcttcttgctccact

SEQ ID NO: 60509 - DNA, 20 bp, Artificial Sequence
  Description of Artificial Sequence: Synthetic oligonucleotide
  Target: SCN9A; (-) strand; PAM type: YTN; PAM sequence: TTT
tttatttcttcttgctccac

SEQ ID NO: 60510 - DNA, 20 bp, Artificial Sequence
  Description of Artificial Sequence: Synthetic oligonucleotide
  Target: SCN9A; (-) strand; PAM type: YTN; PAM sequence: TTT
ttttatttcttcttgctcca

SEQ ID NO: 60511 - DNA, 20 bp, Artificial Sequence
  Description of Artificial Sequence: Synthetic oligonucleotide
  Target: SCN9A; (-) strand; PAM type: YTN; PAM sequence: TTT
tttttatttcttcttgctcc

SEQ ID NO: 60512 - DNA, 20 bp, Artificial Sequence
  Description of Artificial Sequence: Synthetic oligonucleotide
  Target: SCN9A; (-) strand; PAM type: YTN; PAM sequence: TTT
ttttttatttcttcttgctc

SEQ ID NO: 60513 - DNA, 20 bp, Artificial Sequence
  Description of Artificial Sequence: Synthetic oligonucleotide
  Target: SCN9A; (-) strand; PAM type: YTN; PAM sequence: TTT
tttttttatttcttcttgct

SEQ ID NO: 60514 - DNA, 20 bp, Artificial Sequence
  Description of Artificial Sequence: Synthetic oligonucleotide
  Target: SCN9A; (-) strand; PAM type: YTN; PAM sequence: TTT
ttttttttatttcttcttgc

SEQ ID NO: 60515 - DNA, 20 bp, Artificial Sequence
  Description of Artificial Sequence: Synthetic oligonucleotide
  Target: SCN9A; (-) strand; PAM type: YTN; PAM sequence: CTC
atttttttttttatttcttc

SEQ ID NO: 60516 - DNA, 20 bp, Artificial Sequence
  Description of Artificial Sequence: Synthetic oligonucleotide
  Target: SCN9A; (-) strand; PAM type: YTN; PAM sequence: TTC
actcatttttttttttattt

SEQ ID NO: 60517 - DNA, 20 bp, Artificial Sequence
  Description of Artificial Sequence: Synthetic oligonucleotide
  Target: SCN9A; (-) strand; PAM type: YTN; PAM sequence: CTT
cactcatttttttttttatt

SEQ ID NO: 60518 - DNA, 20 bp, Artificial Sequence
  Description of Artificial Sequence: Synthetic oligonucleotide
  Target: SCN9A; (-) strand; PAM type: YTN; PAM sequence: TTA
atgatgtcccatgaaccttc

SEQ ID NO: 60519 - DNA, 20 bp, Artificial Sequence
  Description of Artificial Sequence: Synthetic oligonucleotide
  Target: SCN9A; (-) strand; PAM type: YTN; PAM sequence: CTT
aatgatgtcccatgaacctt

SEQ ID NO: 60520 - DNA, 20 bp, Artificial Sequence
  Description of Artificial Sequence: Synthetic oligonucleotide
  Target: SCN9A; (-) strand; PAM type: YTN; PAM sequence: TTC
cacttaatgatgtcccatga

SEQ ID NO: 60521 - DNA, 20 bp, Artificial Sequence
  Description of Artificial Sequence: Synthetic oligonucleotide
  Target: SCN9A; (-) strand; PAM type: YTN; PAM sequence: TTG
ttccacttaatgatgtccca

SEQ ID NO: 60522 - DNA, 20 bp, Artificial Sequence
  Description of Artificial Sequence: Synthetic oligonucleotide
  Target: SCN9A; (-) strand; PAM type: YTN; PAM sequence: TTC
ataatgcatatattgttcca

SEQ ID NO: 60523 - DNA, 20 bp, Artificial Sequence
  Description of Artificial Sequence: Synthetic oligonucleotide
  Target: SCN9A; (-) strand; PAM type: YTN; PAM sequence: TTT
cataatgcatatattgttcc

SEQ ID NO: 60524 - DNA, 20 bp, Artificial Sequence
  Description of Artificial Sequence: Synthetic oligonucleotide
  Target: SCN9A; (-) strand; PAM type: YTN; PAM sequence: CTG
tgatttcataatgcatatat

SEQ ID NO: 60525 - DNA, 20 bp, Artificial Sequence
  Description of Artificial Sequence: Synthetic oligonucleotide
  Target: SCN9A; (-) strand; PAM type: YTN; PAM sequence: CTC
tgtgatttcataatgcatat

SEQ ID NO: 60526 - DNA, 20 bp, Artificial Sequence
  Description of Artificial Sequence: Synthetic oligonucleotide
  Target: SCN9A; (-) strand; PAM type: YTN; PAM sequence: TTC
tctgtgatttcataatgcat

SEQ ID NO: 60527 - DNA, 20 bp, Artificial Sequence
  Description of Artificial Sequence: Synthetic oligonucleotide
  Target: SCN9A; (-) strand; PAM type: YTN; PAM sequence: CTT
ctctgtgatttcataatgca

SEQ ID NO: 60528 - DNA, 20 bp, Artificial Sequence
  Description of Artificial Sequence: Synthetic oligonucleotide
  Target: SCN9A; (-) strand; PAM type: YTN; PAM sequence: CTG
tcttctctgtgatttcataa

SEQ ID NO: 60529 - DNA, 20 bp, Artificial Sequence
  Description of Artificial Sequence: Synthetic oligonucleotide
  Target: SCN9A; (-) strand; PAM type: YTN; PAM sequence: TTC
tgtcttctctgtgatttcat

SEQ ID NO: 60530 - DNA, 20 bp, Artificial Sequence
  Description of Artificial Sequence: Synthetic oligonucleotide
  Target: SCN9A; (-) strand; PAM type: YTN; PAM sequence: TTT
ctgtcttctctgtgatttca

SEQ ID NO: 60531 - DNA, 20 bp, Artificial Sequence
  Description of Artificial Sequence: Synthetic oligonucleotide
  Target: SCN9A; (-) strand; PAM type: YTN; PAM sequence: CTT
tctgtcttctctgtgatttc

SEQ ID NO: 60532 - DNA, 20 bp, Artificial Sequence
  Description of Artificial Sequence: Synthetic oligonucleotide
  Target: SCN9A; (-) strand; PAM type: YTN; PAM sequence: TTA
cacccctttctgtcttctct

SEQ ID NO: 60533 - DNA, 20 bp, Artificial Sequence
  Description of Artificial Sequence: Synthetic oligonucleotide
  Target: SCN9A; (-) strand; PAM type: YTN; PAM sequence: TTT
acacccctttctgtcttctc

SEQ ID NO: 60534 - DNA, 20 bp, Artificial Sequence
  Description of Artificial Sequence: Synthetic oligonucleotide
  Target: SCN9A; (-) strand; PAM type: YTN; PAM sequence: TTT
tacacccctttctgtcttct

SEQ ID NO: 60535 - DNA, 20 bp, Artificial Sequence
  Description of Artificial Sequence: Synthetic oligonucleotide
  Target: SCN9A; (-) strand; PAM type: YTN; PAM sequence: TTT
ttacacccctttctgtcttc

SEQ ID NO: 60536 - DNA, 20 bp, Artificial Sequence
  Description of Artificial Sequence: Synthetic oligonucleotide
  Target: SCN9A; (-) strand; PAM type: YTN; PAM sequence: TTA
aaaaatatttttacacccct

SEQ ID NO: 60537 - DNA, 20 bp, Artificial Sequence
  Description of Artificial Sequence: Synthetic oligonucleotide
  Target: SCN9A; (-) strand; PAM type: YTN; PAM sequence: TTT
aaaaaatatttttacacccc

SEQ ID NO: 60538 - DNA, 20 bp, Artificial Sequence
  Description of Artificial Sequence: Synthetic oligonucleotide
  Target: SCN9A; (-) strand; PAM type: YTN; PAM sequence: TTA
gtcatttaaaaaatattttt

SEQ ID NO: 60539 - DNA, 20 bp, Artificial Sequence
  Description of Artificial Sequence: Synthetic oligonucleotide
  Target: SCN9A; (-) strand; PAM type: YTN; PAM sequence: TTT
agtcatttaaaaaatatttt

SEQ ID NO: 60540 - DNA, 20 bp, Artificial Sequence
  Description of Artificial Sequence: Synthetic oligonucleotide
  Target: SCN9A; (-) strand; PAM type: YTN; PAM sequence: TTT
tagtcatttaaaaaatattt

SEQ ID NO: 60541 - DNA, 20 bp, Artificial Sequence
  Description of Artificial Sequence: Synthetic oligonucleotide
  Target: SCN9A; (-) strand; PAM type: YTN; PAM sequence: TTG
aacatattttagtcatttaa

SEQ ID NO: 60542 - DNA, 20 bp, Artificial Sequence
  Description of Artificial Sequence: Synthetic oligonucleotide
  Target: SCN9A; (-) strand; PAM type: YTN; PAM sequence: TTT
gaacatattttagtcattta

SEQ ID NO: 60543 - DNA, 20 bp, Artificial Sequence
  Description of Artificial Sequence: Synthetic oligonucleotide
  Target: SCN9A; (-) strand; PAM type: YTN; PAM sequence: CTC
cccaaatttgaacatatttt

SEQ ID NO: 60544 - DNA, 20 bp, Artificial Sequence
  Description of Artificial Sequence: Synthetic oligonucleotide
  Target: SCN9A; (-) strand; PAM type: YTN; PAM sequence: CTC
tccccaaatttgaacatatt

SEQ ID NO: 60545 - DNA, 20 bp, Artificial Sequence
  Description of Artificial Sequence: Synthetic oligonucleotide
  Target: SCN9A; (-) strand; PAM type: YTN; PAM sequence: TTC
atatctctccccaaatttga

SEQ ID NO: 60546 - DNA, 20 bp, Artificial Sequence
  Description of Artificial Sequence: Synthetic oligonucleotide
  Target: SCN9A; (-) strand; PAM type: YTN; PAM sequence: TTA
gatgttcatatctctcccca

SEQ ID NO: 60547 - DNA, 20 bp, Artificial Sequence
  Description of Artificial Sequence: Synthetic oligonucleotide
  Target: SCN9A; (-) strand; PAM type: YTN; PAM sequence: TTT
agatgttcatatctctcccc

SEQ ID NO: 60548 - DNA, 20 bp, Artificial Sequence
  Description of Artificial Sequence: Synthetic oligonucleotide
  Target: SCN9A; (-) strand; PAM type: YTN; PAM sequence: CTG
aatttagatgttcatatctc

SEQ ID NO: 60549 - DNA, 20 bp, Artificial Sequence
  Description of Artificial Sequence: Synthetic oligonucleotide
  Target: SCN9A; (-) strand; PAM type: YTN; PAM sequence: TTC
ctgaatttagatgttcatat

SEQ ID NO: 60550 - DNA, 20 bp, Artificial Sequence
  Description of Artificial Sequence: Synthetic oligonucleotide
  Target: SCN9A; (-) strand; PAM type: YTN; PAM sequence: TTT
cctgaatttagatgttcata

SEQ ID NO: 60551 - DNA, 20 bp, Artificial Sequence
  Description of Artificial Sequence: Synthetic oligonucleotide
  Target: SCN9A; (-) strand; PAM type: YTN; PAM sequence: TTG
agtttcctgaatttagatgt

SEQ ID NO: 60552 - DNA, 20 bp, Artificial Sequence
  Description of Artificial Sequence: Synthetic oligonucleotide
  Target: SCN9A; (-) strand; PAM type: YTN; PAM sequence: TTT
gagtttcctgaatttagatg

SEQ ID NO: 60553 - DNA, 20 bp, Artificial Sequence
  Description of Artificial Sequence: Synthetic oligonucleotide
  Target: SCN9A; (-) strand; PAM type: YTN; PAM sequence: CTT
tgagtttcctgaatttagat

SEQ ID NO: 60554 - DNA, 20 bp, Artificial Sequence
  Description of Artificial Sequence: Synthetic oligonucleotide
  Target: SCN9A; (-) strand; PAM type: YTN; PAM sequence: TTC
tttgagtttcctgaatttag

SEQ ID NO: 60555 - DNA, 20 bp, Artificial Sequence
  Description of Artificial Sequence: Synthetic oligonucleotide
  Target: SCN9A; (-) strand; PAM type: YTN; PAM sequence: TTG
ggattctttgagtttcctga

SEQ ID NO: 60556 - DNA, 20 bp, Artificial Sequence
  Description of Artificial Sequence: Synthetic oligonucleotide
  Target: SCN9A; (-) strand; PAM type: YTN; PAM sequence: TTT
gggattctttgagtttcctg

SEQ ID NO: 60557 - DNA, 20 bp, Artificial Sequence
  Description of Artificial Sequence: Synthetic oligonucleotide
  Target: SCN9A; (-) strand; PAM type: YTN; PAM sequence: CTA
tttgggattctttgagtttc

SEQ ID NO: 60558 - DNA, 20 bp, Artificial Sequence
  Description of Artificial Sequence: Synthetic oligonucleotide
  Target: SCN9A; (-) strand; PAM type: YTN; PAM sequence: TTG
tcctatttgggattctttga

SEQ ID NO: 60559 - DNA, 20 bp, Artificial Sequence
  Description of Artificial Sequence: Synthetic oligonucleotide
  Target: SCN9A; (-) strand; PAM type: YTN; PAM sequence: TTT
gtcctatttgggattctttg

SEQ ID NO: 60560 - DNA, 20 bp, Artificial Sequence
  Description of Artificial Sequence: Synthetic oligonucleotide
  Target: SCN9A; (-) strand; PAM type: YTN; PAM sequence: TTA
gatttgtcctatttgggatt

SEQ ID NO: 60561 - DNA, 20 bp, Artificial Sequence
  Description of Artificial Sequence: Synthetic oligonucleotide
  Target: SCN9A; (-) strand; PAM type: YTN; PAM sequence: TTT
agatttgtcctatttgggat

SEQ ID NO: 60562 - DNA, 20 bp, Artificial Sequence
  Description of Artificial Sequence: Synthetic oligonucleotide
  Target: SCN9A; (-) strand; PAM type: YTN; PAM sequence: CTT
tagatttgtcctatttggga

SEQ ID NO: 60563 - DNA, 20 bp, Artificial Sequence
  Description of Artificial Sequence: Synthetic oligonucleotide
  Target: SCN9A; (-) strand; PAM type: YTN; PAM sequence: TTC
tttagatttgtcctatttgg

SEQ ID NO: 60564 - DNA, 20 bp, Artificial Sequence
  Description of Artificial Sequence: Synthetic oligonucleotide
  Target: SCN9A; (-) strand; PAM type: YTN; PAM sequence: CTT
ctttagatttgtcctatttg

SEQ ID NO: 60565 - DNA, 20 bp, Artificial Sequence
  Description of Artificial Sequence: Synthetic oligonucleotide
  Target: SCN9A; (-) strand; PAM type: YTN; PAM sequence: TTA
caggtgtgagccaccatgcc

SEQ ID NO: 60566 - DNA, 20 bp, Artificial Sequence
  Description of Artificial Sequence: Synthetic oligonucleotide
  Target: SCN9A; (-) strand; PAM type: YTN; PAM sequence: CTG
ggattacaggtgtgagccac

SEQ ID NO: 60567 - DNA, 20 bp, Artificial Sequence
  Description of Artificial Sequence: Synthetic oligonucleotide
  Target: SCN9A; (-) strand; PAM type: YTN; PAM sequence: CTC
aaagtgctgggattacaggt

SEQ ID NO: 60568 - DNA, 20 bp, Artificial Sequence
  Description of Artificial Sequence: Synthetic oligonucleotide
  Target: SCN9A; (-) strand; PAM type: YTN; PAM sequence: CTC
agcccctcaaagtgctggga

SEQ ID NO: 60569 - DNA, 20 bp, Artificial Sequence
  Description of Artificial Sequence: Synthetic oligonucleotide
  Target: SCN9A; (-) strand; PAM type: YTN; PAM sequence: CTC
ccgctcagcccctcaaagtg

SEQ ID NO: 60570 - DNA, 20 bp, Artificial Sequence
  Description of Artificial Sequence: Synthetic oligonucleotide
  Target: SCN9A; (-) strand; PAM type: YTN; PAM sequence: CTC
aggtgatccactcccgctca

SEQ ID NO: 60571 - DNA, 20 bp, Artificial Sequence
  Description of Artificial Sequence: Synthetic oligonucleotide
  Target: SCN9A; (-) strand; PAM type: YTN; PAM sequence: CTG
acctcaggtgatccactccc

SEQ ID NO: 60572 - DNA, 20 bp, Artificial Sequence
  Description of Artificial Sequence: Synthetic oligonucleotide
  Target: SCN9A; (-) strand; PAM type: YTN; PAM sequence: CTC
ctgacctcaggtgatccact

SEQ ID NO: 60573 - DNA, 20 bp, Artificial Sequence
  Description of Artificial Sequence: Synthetic oligonucleotide
  Target: SCN9A; (-) strand; PAM type: YTN; PAM sequence: TTG
aactcctgacctcaggtgat

SEQ ID NO: 60574 - DNA, 20 bp, Artificial Sequence
  Description of Artificial Sequence: Synthetic oligonucleotide
  Target: SCN9A; (-) strand; PAM type: YTN; PAM sequence: CTT
gaactcctgacctcaggtga

SEQ ID NO: 60575 - DNA, 20 bp, Artificial Sequence
  Description of Artificial Sequence: Synthetic oligonucleotide
  Target: SCN9A; (-) strand; PAM type: YTN; PAM sequence: CTG
gtcttgaactcctgacctca

SEQ ID NO: 60576 - DNA, 20 bp, Artificial Sequence
  Description of Artificial Sequence: Synthetic oligonucleotide
  Target: SCN9A; (-) strand; PAM type: YTN; PAM sequence: TTG
gccaggctggtcttgaactc

SEQ ID NO: 60577 - DNA, 20 bp, Artificial Sequence
  Description of Artificial Sequence: Synthetic oligonucleotide
  Target: SCN9A; (-) strand; PAM type: YTN; PAM sequence: TTG
ccatgttggccaggctggtc

SEQ ID NO: 60578 - DNA, 20 bp, Artificial Sequence
  Description of Artificial Sequence: Synthetic oligonucleotide
  Target: SCN9A; (-) strand; PAM type: YTN; PAM sequence: TTT
gccatgttggccaggctggt

SEQ ID NO: 60579 - DNA, 20 bp, Artificial Sequence
  Description of Artificial Sequence: Synthetic oligonucleotide
  Target: SCN9A; (-) strand; PAM type: YTN; PAM sequence: TTT
tgccatgttggccaggctgg

SEQ ID NO: 60580 - DNA, 20 bp, Artificial Sequence
  Description of Artificial Sequence: Synthetic oligonucleotide
  Target: SCN9A; (-) strand; PAM type: YTN; PAM sequence: TTG
gtagagatgtggttttgcca

SEQ ID NO: 60581 - DNA, 20 bp, Artificial Sequence
  Description of Artificial Sequence: Synthetic oligonucleotide
  Target: SCN9A; (-) strand; PAM type: YTN; PAM sequence: TTT
ggtagagatgtggttttgcc

SEQ ID NO: 60582 - DNA, 20 bp, Artificial Sequence
  Description of Artificial Sequence: Synthetic oligonucleotide
  Target: SCN9A; (-) strand; PAM type: YTN; PAM sequence: TTT
tggtagagatgtggttttgc

SEQ ID NO: 60583 - DNA, 20 bp, Artificial Sequence
  Description of Artificial Sequence: Synthetic oligonucleotide
  Target: SCN9A; (-) strand; PAM type: YTN; PAM sequence: TTT
ttggtagagatgtggttttg

SEQ ID NO: 60584 - DNA, 20 bp, Artificial Sequence
  Description of Artificial Sequence: Synthetic oligonucleotide
  Target: SCN9A; (-) strand; PAM type: YTN; PAM sequence: TTG
taatttttggtagagatgtg

SEQ ID NO: 60585 - DNA, 20 bp, Artificial Sequence
  Description of Artificial Sequence: Synthetic oligonucleotide
  Target: SCN9A; (-) strand; PAM type: YTN; PAM sequence: TTT
gtaatttttggtagagatgt

SEQ ID NO: 60586 - DNA, 20 bp, Artificial Sequence
  Description of Artificial Sequence: Synthetic oligonucleotide
  Target: SCN9A; (-) strand; PAM type: YTN; PAM sequence: TTT
tgtaatttttggtagagatg

SEQ ID NO: 60587 - DNA, 20 bp, Artificial Sequence
  Description of Artificial Sequence: Synthetic oligonucleotide
  Target: SCN9A; (-) strand; PAM type: YTN; PAM sequence: TTT
ttgtaatttttggtagagat

SEQ ID NO: 60588 - DNA, 20 bp, Artificial Sequence
  Description of Artificial Sequence: Synthetic oligonucleotide
  Target: SCN9A; (-) strand; PAM type: YTN; PAM sequence: CTG
atttttgtaatttttggtag

SEQ ID NO: 60589 - DNA, 20 bp, Artificial Sequence
  Description of Artificial Sequence: Synthetic oligonucleotide
  Target: SCN9A; (-) strand; PAM type: YTN; PAM sequence: TTA
taggcacccaccaccacacc

SEQ ID NO: 60590 - DNA, 20 bp, Artificial Sequence
  Description of Artificial Sequence: Synthetic oligonucleotide
  Target: SCN9A; (-) strand; PAM type: YTN; PAM sequence: CTG
ggattataggcacccaccac

SEQ ID NO: 60591 - DNA, 20 bp, Artificial Sequence
  Description of Artificial Sequence: Synthetic oligonucleotide
  Target: SCN9A; (-) strand; PAM type: YTN; PAM sequence: CTC
ccgagtagctgggattatag

SEQ ID NO: 60592 - DNA, 20 bp, Artificial Sequence
  Description of Artificial Sequence: Synthetic oligonucleotide
  Target: SCN9A; (-) strand; PAM type: YTN; PAM sequence: CTC
agcctcccgagtagctggga

SEQ ID NO: 60593 - DNA, 20 bp, Artificial Sequence
  Description of Artificial Sequence: Synthetic oligonucleotide
  Target: SCN9A; (-) strand; PAM type: YTN; PAM sequence: CTG
cctcagcctcccgagtagct

SEQ ID NO: 60594 - DNA, 20 bp, Artificial Sequence
  Description of Artificial Sequence: Synthetic oligonucleotide
  Target: SCN9A; (-) strand; PAM type: YTN; PAM sequence: CTC
tgcctcagcctcccgagtag

SEQ ID NO: 60595 - DNA, 20 bp, Artificial Sequence
  Description of Artificial Sequence: Synthetic oligonucleotide
  Target: SCN9A; (-) strand; PAM type: YTN; PAM sequence: CTC
tctgcctcagcctcccgagt

SEQ ID NO: 60596 - DNA, 20 bp, Artificial Sequence
  Description of Artificial Sequence: Synthetic oligonucleotide
  Target: SCN9A; (-) strand; PAM type: YTN; PAM sequence: TTC
tctctgcctcagcctcccga

SEQ ID NO: 60597 - DNA, 20 bp, Artificial Sequence
  Description of Artificial Sequence: Synthetic oligonucleotide
  Target: SCN9A; (-) strand; PAM type: YTN; PAM sequence: TTC
aagcaattctctctgcctca

SEQ ID NO: 60598 - DNA, 20 bp, Artificial Sequence
  Description of Artificial Sequence: Synthetic oligonucleotide
  Target: SCN9A; (-) strand; PAM type: YTN; PAM sequence: CTC
gtgggttcaagcaattctct

SEQ ID NO: 60599 - DNA, 20 bp, Artificial Sequence
  Description of Artificial Sequence: Synthetic oligonucleotide
  Target: SCN9A; (-) strand; PAM type: YTN; PAM sequence: TTC
cacctcgtgggttcaagcaa

SEQ ID NO: 60600 - DNA, 20 bp, Artificial Sequence
  Description of Artificial Sequence: Synthetic oligonucleotide
  Target: SCN9A; (-) strand; PAM type: YTN; PAM sequence: CTT
ccacctcgtgggttcaagca

SEQ ID NO: 60601 - DNA, 20 bp, Artificial Sequence
  Description of Artificial Sequence: Synthetic oligonucleotide
  Target: SCN9A; (-) strand; PAM type: YTN; PAM sequence: CTG
caacttccacctcgtgggtt

SEQ ID NO: 60602 - DNA, 20 bp, Artificial Sequence
  Description of Artificial Sequence: Synthetic oligonucleotide
  Target: SCN9A; (-) strand; PAM type: YTN; PAM sequence: CTC
actgcaacttccacctcgtg

SEQ ID NO: 60603 - DNA, 20 bp, Artificial Sequence
  Description of Artificial Sequence: Synthetic oligonucleotide
  Target: SCN9A; (-) strand; PAM type: YTN; PAM sequence: TTG
gctcactgcaacttccacct

SEQ ID NO: 60604 - DNA, 20 bp, Artificial Sequence
  Description of Artificial Sequence: Synthetic oligonucleotide
  Target: SCN9A; (-) strand; PAM type: YTN; PAM sequence: CTT
ggctcactgcaacttccacc

SEQ ID NO: 60605 - DNA, 20 bp, Artificial Sequence
  Description of Artificial Sequence: Synthetic oligonucleotide
  Target: SCN9A; (-) strand; PAM type: YTN; PAM sequence: CTG
gagtgcagtagcatgatctt

SEQ ID NO: 60606 - DNA, 20 bp, Artificial Sequence
  Description of Artificial Sequence: Synthetic oligonucleotide
  Target: SCN9A; (-) strand; PAM type: YTN; PAM sequence: TTG
cccaggctggagtgcagtag

SEQ ID NO: 60607 - DNA, 20 bp, Artificial Sequence
  Description of Artificial Sequence: Synthetic oligonucleotide
  Target: SCN9A; (-) strand; PAM type: YTN; PAM sequence: TTC
accgtgttgcccaggctgga

SEQ ID NO: 60608 - DNA, 20 bp, Artificial Sequence
  Description of Artificial Sequence: Synthetic oligonucleotide
  Target: SCN9A; (-) strand; PAM type: YTN; PAM sequence: TTT
caccgtgttgcccaggctgg

SEQ ID NO: 60609 - DNA, 20 bp, Artificial Sequence
  Description of Artificial Sequence: Synthetic oligonucleotide
  Target: SCN9A; (-) strand; PAM type: YTN; PAM sequence: TTC
cgagatagagtttcaccgtg

SEQ ID NO: 60610 - DNA, 20 bp, Artificial Sequence
  Description of Artificial Sequence: Synthetic oligonucleotide
  Target: SCN9A; (-) strand; PAM type: YTN; PAM sequence: TTT
ccgagatagagtttcaccgt

SEQ ID NO: 60611 - DNA, 20 bp, Artificial Sequence
  Description of Artificial Sequence: Synthetic oligonucleotide
  Target: SCN9A; (-) strand; PAM type: YTN; PAM sequence: TTT
tccgagatagagtttcaccg

SEQ ID NO: 60612 - DNA, 20 bp, Artificial Sequence
  Description of Artificial Sequence: Synthetic oligonucleotide
  Target: SCN9A; (-) strand; PAM type: YTN; PAM sequence: TTT
ttccgagatagagtttcacc

SEQ ID NO: 60613 - DNA, 20 bp, Artificial Sequence
  Description of Artificial Sequence: Synthetic oligonucleotide
  Target: SCN9A; (-) strand; PAM type: YTN; PAM sequence: TTT
tttccgagatagagtttcac

SEQ ID NO: 60614 - DNA, 20 bp, Artificial Sequence
  Description of Artificial Sequence: Synthetic oligonucleotide
  Target: SCN9A; (-) strand; PAM type: YTN; PAM sequence: TTT
ttttccgagatagagtttca

SEQ ID NO: 60615 - DNA, 20 bp, Artificial Sequence
  Description of Artificial Sequence: Synthetic oligonucleotide
  Target: SCN9A; (-) strand; PAM type: YTN; PAM sequence: TTT
tttttccgagatagagtttc

SEQ ID NO: 60616 - DNA, 20 bp, Artificial Sequence
  Description of Artificial Sequence: Synthetic oligonucleotide
  Target: SCN9A; (-) strand; PAM type: YTN; PAM sequence: CTT
ttttttccgagatagagttt

SEQ ID NO: 60617 - DNA, 20 bp, Artificial Sequence
  Description of Artificial Sequence: Synthetic oligonucleotide
  Target: SCN9A; (-) strand; PAM type: YTN; PAM sequence: TTC
ttttttttccgagatagagt

SEQ ID NO: 60618 - DNA, 20 bp, Artificial Sequence
  Description of Artificial Sequence: Synthetic oligonucleotide
  Target: SCN9A; (-) strand; PAM type: YTN; PAM sequence: TTT
cttttttttccgagatagag

SEQ ID NO: 60619 - DNA, 20 bp, Artificial Sequence
  Description of Artificial Sequence: Synthetic oligonucleotide
  Target: SCN9A; (-) strand; PAM type: YTN; PAM sequence: CTT
tcttttttttccgagataga

SEQ ID NO: 60620 - DNA, 20 bp, Artificial Sequence
  Description of Artificial Sequence: Synthetic oligonucleotide
  Target: SCN9A; (-) strand; PAM type: YTN; PAM sequence: TTC
tttcttttttttccgagata

SEQ ID NO: 60621 - DNA, 20 bp, Artificial Sequence
  Description of Artificial Sequence: Synthetic oligonucleotide
  Target: SCN9A; (-) strand; PAM type: YTN; PAM sequence: TTT
ctttcttttttttccgagat

SEQ ID NO: 60622 - DNA, 20 bp, Artificial Sequence
  Description of Artificial Sequence: Synthetic oligonucleotide
  Target: SCN9A; (-) strand; PAM type: YTN; PAM sequence: CTT
tctttcttttttttccgaga

SEQ ID NO: 60623 - DNA, 20 bp, Artificial Sequence
  Description of Artificial Sequence: Synthetic oligonucleotide
  Target: SCN9A; (-) strand; PAM type: YTN; PAM sequence: CTA
gtggagactttctttctttt

SEQ ID NO: 60624 - DNA, 20 bp, Artificial Sequence
  Description of Artificial Sequence: Synthetic oligonucleotide
  Target: SCN9A; (-) strand; PAM type: YTN; PAM sequence: CTC
tagtggagactttctttctt

SEQ ID NO: 60625 - DNA, 20 bp, Artificial Sequence
  Description of Artificial Sequence: Synthetic oligonucleotide
  Target: SCN9A; (-) strand; PAM type: YTN; PAM sequence: TTA
tgtctctagtggagactttc

SEQ ID NO: 60626 - DNA, 20 bp, Artificial Sequence
  Description of Artificial Sequence: Synthetic oligonucleotide
  Target: SCN9A; (-) strand; PAM type: YTN; PAM sequence: TTG
atgatattatgtctctagtg

SEQ ID NO: 60627 - DNA, 20 bp, Artificial Sequence
  Description of Artificial Sequence: Synthetic oligonucleotide
  Target: SCN9A; (-) strand; PAM type: YTN; PAM sequence: TTT
gatgatattatgtctctagt

SEQ ID NO: 60628 - DNA, 20 bp, Artificial Sequence
  Description of Artificial Sequence: Synthetic oligonucleotide
  Target: SCN9A; (-) strand; PAM type: YTN; PAM sequence: TTG
gcaatttgatgatattatgt

SEQ ID NO: 60629 - DNA, 20 bp, Artificial Sequence
  Description of Artificial Sequence: Synthetic oligonucleotide
  Target: SCN9A; (-) strand; PAM type: YTN; PAM sequence: TTT
ggcaatttgatgatattatg

SEQ ID NO: 60630 - DNA, 20 bp, Artificial Sequence
  Description of Artificial Sequence: Synthetic oligonucleotide
  Target: SCN9A; (-) strand; PAM type: YTN; PAM sequence: TTT
tggcaatttgatgatattat

SEQ ID NO: 60631 - DNA, 20 bp, Artificial Sequence
  Description of Artificial Sequence: Synthetic oligonucleotide
  Target: SCN9A; (-) strand; PAM type: YTN; PAM sequence: CTT
ttggcaatttgatgatatta

SEQ ID NO: 60632 - DNA, 20 bp, Artificial Sequence
  Description of Artificial Sequence: Synthetic oligonucleotide
  Target: SCN9A; (-) strand; PAM type: YTN; PAM sequence: TTC
acttttggcaatttgatgat

SEQ ID NO: 60633 - DNA, 20 bp, Artificial Sequence
  Description of Artificial Sequence: Synthetic oligonucleotide
  Target: SCN9A; (-) strand; PAM type: YTN; PAM sequence: TTT
cacttttggcaatttgatga

SEQ ID NO: 60634 - DNA, 20 bp, Artificial Sequence
  Description of Artificial Sequence: Synthetic oligonucleotide
  Target: SCN9A; (-) strand; PAM type: YTN; PAM sequence: CTT
tcacttttggcaatttgatg

SEQ ID NO: 60635 - DNA, 20 bp, Artificial Sequence
  Description of Artificial Sequence: Synthetic oligonucleotide
  Target: SCN9A; (-) strand; PAM type: YTN; PAM sequence: TTC
cctttcacttttggcaattt

SEQ ID NO: 60636 - DNA, 20 bp, Artificial Sequence
  Description of Artificial Sequence: Synthetic oligonucleotide
  Target: SCN9A; (-) strand; PAM type: YTN; PAM sequence: CTT
ccctttcacttttggcaatt

SEQ ID NO: 60637 - DNA, 20 bp, Artificial Sequence
  Description of Artificial Sequence: Synthetic oligonucleotide
  Target: SCN9A; (-) strand; PAM type: YTN; PAM sequence: TTC
aaacttccctttcacttttg

SEQ ID NO: 60638 - DNA, 20 bp, Artificial Sequence
  Description of Artificial Sequence: Synthetic oligonucleotide
  Target: SCN9A; (-) strand; PAM type: YTN; PAM sequence: TTT
caaacttccctttcactttt

SEQ ID NO: 60639 - DNA, 20 bp, Artificial Sequence
  Description of Artificial Sequence: Synthetic oligonucleotide
  Target: SCN9A; (-) strand; PAM type: YTN; PAM sequence: CTT
tcaaacttccctttcacttt

SEQ ID NO: 60640 - DNA, 20 bp, Artificial Sequence
  Description of Artificial Sequence: Synthetic oligonucleotide
  Target: SCN9A; (-) strand; PAM type: YTN; PAM sequence: CTG
ctttcaaacttccctttcac

SEQ ID NO: 60641 - DNA, 20 bp, Artificial Sequence
  Description of Artificial Sequence: Synthetic oligonucleotide
  Target: SCN9A; (-) strand; PAM type: YTN; PAM sequence: TTG
ctgctttcaaacttcccttt

SEQ ID NO: 60642 - DNA, 20 bp, Artificial Sequence
  Description of Artificial Sequence: Synthetic oligonucleotide
  Target: SCN9A; (-) strand; PAM type: YTN; PAM sequence: CTT
gctgctttcaaacttccctt

SEQ ID NO: 60643 - DNA, 20 bp, Artificial Sequence
  Description of Artificial Sequence: Synthetic oligonucleotide
  Target: SCN9A; (-) strand; PAM type: YTN; PAM sequence: TTC
ttgctgctttcaaacttccc

SEQ ID NO: 60644 - DNA, 20 bp, Artificial Sequence
  Description of Artificial Sequence: Synthetic oligonucleotide
  Target: SCN9A; (-) strand; PAM type: YTN; PAM sequence: TTT
cttgctgctttcaaacttcc

SEQ ID NO: 60645 - DNA, 20 bp, Artificial Sequence
  Description of Artificial Sequence: Synthetic oligonucleotide
  Target: SCN9A; (-) strand; PAM type: YTN; PAM sequence: TTT
tcttgctgctttcaaacttc

SEQ ID NO: 60646 - DNA, 20 bp, Artificial Sequence
  Description of Artificial Sequence: Synthetic oligonucleotide
  Target: SCN9A; (-) strand; PAM type: YTN; PAM sequence: TTT
ttcttgctgctttcaaactt

SEQ ID NO: 60647 - DNA, 20 bp, Artificial Sequence
  Description of Artificial Sequence: Synthetic oligonucleotide
  Target: SCN9A; (-) strand; PAM type: YTN; PAM sequence: TTT
tttcttgctgctttcaaact

SEQ ID NO: 60648 - DNA, 20 bp, Artificial Sequence
  Description of Artificial Sequence: Synthetic oligonucleotide
  Target: SCN9A; (-) strand; PAM type: YTN; PAM sequence: TTT
ttttcttgctgctttcaaac

SEQ ID NO: 60649 - DNA, 20 bp, Artificial Sequence
  Description of Artificial Sequence: Synthetic oligonucleotide
  Target: SCN9A; (-) strand; PAM type: YTN; PAM sequence: TTC
agtttttttcttgctgcttt

SEQ ID NO: 60650 - DNA, 20 bp, Artificial Sequence
  Description of Artificial Sequence: Synthetic oligonucleotide
  Target: SCN9A; (-) strand; PAM type: YTN; PAM sequence: TTG
gacatgacaattcagttttt

SEQ ID NO: 60651 - DNA, 20 bp, Artificial Sequence
  Description of Artificial Sequence: Synthetic oligonucleotide
  Target: SCN9A; (-) strand; PAM type: YTN; PAM sequence: TTT
ggacatgacaattcagtttt

SEQ ID NO: 60652 - DNA, 20 bp, Artificial Sequence
  Description of Artificial Sequence: Synthetic oligonucleotide
  Target: SCN9A; (-) strand; PAM type: YTN; PAM sequence: TTT
tggacatgacaattcagttt

SEQ ID NO: 60653 - DNA, 20 bp, Artificial Sequence
  Description of Artificial Sequence: Synthetic oligonucleotide
  Target: SCN9A; (-) strand; PAM type: YTN; PAM sequence: CTT
ttggacatgacaattcagtt

SEQ ID NO: 60654 - DNA, 20 bp, Artificial Sequence
  Description of Artificial Sequence: Synthetic oligonucleotide
  Target: SCN9A; (-) strand; PAM type: YTN; PAM sequence: CTC
ttttggacatgacaattcag

SEQ ID NO: 60655 - DNA, 20 bp, Artificial Sequence
  Description of Artificial Sequence: Synthetic oligonucleotide
  Target: SCN9A; (-) strand; PAM type: YTN; PAM sequence: TTA
agagagctcttttggacatg

SEQ ID NO: 60656 - DNA, 20 bp, Artificial Sequence
  Description of Artificial Sequence: Synthetic oligonucleotide
  Target: SCN9A; (-) strand; PAM type: YTN; PAM sequence: CTT
aagagagctcttttggacat

SEQ ID NO: 60657 - DNA, 20 bp, Artificial Sequence
  Description of Artificial Sequence: Synthetic oligonucleotide
  Target: SCN9A; (-) strand; PAM type: YTN; PAM sequence: TTC
atcttaagagagctcttttg

SEQ ID NO: 60658 - DNA, 20 bp, Artificial Sequence
  Description of Artificial Sequence: Synthetic oligonucleotide
  Target: SCN9A; (-) strand; PAM type: YTN; PAM sequence: CTG
ttcatcttaagagagctctt

SEQ ID NO: 60659 - DNA, 20 bp, Artificial Sequence
  Description of Artificial Sequence: Synthetic oligonucleotide
  Target: SCN9A; (-) strand; PAM type: YTN; PAM sequence: CTG
ctgttcatcttaagagagct

SEQ ID NO: 60660 - DNA, 20 bp, Artificial Sequence
  Description of Artificial Sequence: Synthetic oligonucleotide
  Target: SCN9A; (-) strand; PAM type: YTN; PAM sequence: CTG
agaaatctgctgttcatctt

SEQ ID NO: 60661 - DNA, 20 bp, Artificial Sequence
  Description of Artificial Sequence: Synthetic oligonucleotide
  Target: SCN9A; (-) strand; PAM type: YTN; PAM sequence: TTC
cactgagaaatctgctgttc

SEQ ID NO: 60662 - DNA, 20 bp, Artificial Sequence
  Description of Artificial Sequence: Synthetic oligonucleotide
  Target: SCN9A; (-) strand; PAM type: YTN; PAM sequence: TTT
ccactgagaaatctgctgtt

SEQ ID NO: 60663 - DNA, 20 bp, Artificial Sequence
  Description of Artificial Sequence: Synthetic oligonucleotide
  Target: SCN9A; (-) strand; PAM type: YTN; PAM sequence: TTA
aagtttccactgagaaatct

SEQ ID NO: 60664 - DNA, 20 bp, Artificial Sequence
  Description of Artificial Sequence: Synthetic oligonucleotide
  Target: SCN9A; (-) strand; PAM type: YTN; PAM sequence: TTT
aaagtttccactgagaaatc

SEQ ID NO: 60665 - DNA, 20 bp, Artificial Sequence
  Description of Artificial Sequence: Synthetic oligonucleotide
  Target: SCN9A; (-) strand; PAM type: YTN; PAM sequence: TTT
taaagtttccactgagaaat

SEQ ID NO: 60666 - DNA, 20 bp, Artificial Sequence
  Description of Artificial Sequence: Synthetic oligonucleotide
  Target: SCN9A; (-) strand; PAM type: YTN; PAM sequence: CTT
ttaaagtttccactgagaaa

SEQ ID NO: 60667 - DNA, 20 bp, Artificial Sequence
  Description of Artificial Sequence: Synthetic oligonucleotide
  Target: SCN9A; (-) strand; PAM type: YTN; PAM sequence: CTC
ttttaaagtttccactgaga

SEQ ID NO: 60668 - DNA, 20 bp, Artificial Sequence
  Description of Artificial Sequence: Synthetic oligonucleotide
  Target: SCN9A; (-) strand; PAM type: YTN; PAM sequence: TTG
ctcttttaaagtttccactg

SEQ ID NO: 60669 - DNA, 20 bp, Artificial Sequence
  Description of Artificial Sequence: Synthetic oligonucleotide
  Target: SCN9A; (-) strand; PAM type: YTN; PAM sequence: TTT
gctcttttaaagtttccact

SEQ ID NO: 60670 - DNA, 20 bp, Artificial Sequence
  Description of Artificial Sequence: Synthetic oligonucleotide
  Target: SCN9A; (-) strand; PAM type: YTN; PAM sequence: TTA
tttgctcttttaaagtttcc

SEQ ID NO: 60671 - DNA, 20 bp, Artificial Sequence
  Description of Artificial Sequence: Synthetic oligonucleotide
  Target: SCN9A; (-) strand; PAM type: YTN; PAM sequence: TTT
atttgctcttttaaagtttc

SEQ ID NO: 60672 - DNA, 20 bp, Artificial Sequence
  Description of Artificial Sequence: Synthetic oligonucleotide
  Target: SCN9A; (-) strand; PAM type: YTN; PAM sequence: CTT
tatttgctcttttaaagttt

SEQ ID NO: 60673 - DNA, 20 bp, Artificial Sequence
  Description of Artificial Sequence: Synthetic oligonucleotide
  Target: SCN9A; (-) strand; PAM type: YTN; PAM sequence: TTC
actttatttgctcttttaaa

SEQ ID NO: 60674 - DNA, 20 bp, Artificial Sequence
  Description of Artificial Sequence: Synthetic oligonucleotide
  Target: SCN9A; (-) strand; PAM type: YTN; PAM sequence: TTT
cactttatttgctcttttaa

SEQ ID NO: 60675 - DNA, 20 bp, Artificial Sequence
  Description of Artificial Sequence: Synthetic oligonucleotide
  Target: SCN9A; (-) strand; PAM type: YTN; PAM sequence: CTT
tcactttatttgctctttta

SEQ ID NO: 60676 - DNA, 20 bp, Artificial Sequence
  Description of Artificial Sequence: Synthetic oligonucleotide
  Target: SCN9A; (-) strand; PAM type: YTN; PAM sequence: TTG
aatatatactttcactttat

SEQ ID NO: 60677 - DNA, 20 bp, Artificial Sequence
  Description of Artificial Sequence: Synthetic oligonucleotide
  Target: SCN9A; (-) strand; PAM type: YTN; PAM sequence: TTT
gaatatatactttcacttta

SEQ ID NO: 60678 - DNA, 20 bp, Artificial Sequence
  Description of Artificial Sequence: Synthetic oligonucleotide
  Target: SCN9A; (-) strand; PAM type: YTN; PAM sequence: TTT
tgaatatatactttcacttt

SEQ ID NO: 60679 - DNA, 20 bp, Artificial Sequence
  Description of Artificial Sequence: Synthetic oligonucleotide
  Target: SCN9A; (-) strand; PAM type: YTN; PAM sequence: TTA
agtattttgaatatatactt

SEQ ID NO: 60680 - DNA, 20 bp, Artificial Sequence
  Description of Artificial Sequence: Synthetic oligonucleotide
  Target: SCN9A; (-) strand; PAM type: YTN; PAM sequence: TTT
aagtattttgaatatatact

SEQ ID NO: 60681 - DNA, 20 bp, Artificial Sequence
  Description of Artificial Sequence: Synthetic oligonucleotide
  Target: SCN9A; (-) strand; PAM type: YTN; PAM sequence: CTT
taagtattttgaatatatac

SEQ ID NO: 60682 - DNA, 20 bp, Artificial Sequence
  Description of Artificial Sequence: Synthetic oligonucleotide
  Target: SCN9A; (-) strand; PAM type: YTN; PAM sequence: TTC
tttaagtattttgaatatat

SEQ ID NO: 60683 - DNA, 20 bp, Artificial Sequence
  Description of Artificial Sequence: Synthetic oligonucleotide
  Target: SCN9A; (-) strand; PAM type: YTN; PAM sequence: TTT
ctttaagtattttgaatata

SEQ ID NO: 60684 - DNA, 20 bp, Artificial Sequence
  Description of Artificial Sequence: Synthetic oligonucleotide
  Target: SCN9A; (-) strand; PAM type: YTN; PAM sequence: TTT
tctttaagtattttgaatat

SEQ ID NO: 60685 - DNA, 20 bp, Artificial Sequence
  Description of Artificial Sequence: Synthetic oligonucleotide
  Target: SCN9A; (-) strand; PAM type: YTN; PAM sequence: TTT
ttctttaagtattttgaata

SEQ ID NO: 60686 - DNA, 20 bp, Artificial Sequence
  Description of Artificial Sequence: Synthetic oligonucleotide
  Target: SCN9A; (-) strand; PAM type: YTN; PAM sequence: TTT
tttctttaagtattttgaat

SEQ ID NO: 60687 - DNA, 20 bp, Artificial Sequence
  Description of Artificial Sequence: Synthetic oligonucleotide
  Target: SCN9A; (-) strand; PAM type: YTN; PAM sequence: TTT
ttttctttaagtattttgaa

SEQ ID NO: 60688 - DNA, 20 bp, Artificial Sequence
  Description of Artificial Sequence: Synthetic oligonucleotide
  Target: SCN9A; (-) strand; PAM type: YTN; PAM sequence: TTG
gtcagcagtttttttcttta

SEQ ID NO: 60689 - DNA, 20 bp, Artificial Sequence
  Description of Artificial Sequence: Synthetic oligonucleotide
  Target: SCN9A; (-) strand; PAM type: YTN; PAM sequence: CTT
ggtcagcagtttttttcttt

SEQ ID NO: 60690 - DNA, 20 bp, Artificial Sequence
  Description of Artificial Sequence: Synthetic oligonucleotide
  Target: SCN9A; (-) strand; PAM type: YTN; PAM sequence: TTC
ttggtcagcagtttttttct

SEQ ID NO: 60691 - DNA, 20 bp, Artificial Sequence
  Description of Artificial Sequence: Synthetic oligonucleotide
  Target: SCN9A; (-) strand; PAM type: YTN; PAM sequence: TTA
ttcttggtcagcagtttttt

SEQ ID NO: 60692 - DNA, 20 bp, Artificial Sequence
  Description of Artificial Sequence: Synthetic oligonucleotide
  Target: SCN9A; (-) strand; PAM type: YTN; PAM sequence: TTC
caggtatattattcttggtc

SEQ ID NO: 60693 - DNA, 20 bp, Artificial Sequence
  Description of Artificial Sequence: Synthetic oligonucleotide
  Target: SCN9A; (-) strand; PAM type: YTN; PAM sequence: TTT
ccaggtatattattcttggt

SEQ ID NO: 60694 - DNA, 20 bp, Artificial Sequence
  Description of Artificial Sequence: Synthetic oligonucleotide
  Target: SCN9A; (-) strand; PAM type: YTN; PAM sequence: TTT
tccaggtatattattcttgg

SEQ ID NO: 60695 - DNA, 20 bp, Artificial Sequence
  Description of Artificial Sequence: Synthetic oligonucleotide
  Target: SCN9A; (-) strand; PAM type: YTN; PAM sequence: TTT
ttccaggtatattattcttg

SEQ ID NO: 60696 - DNA, 20 bp, Artificial Sequence
  Description of Artificial Sequence: Synthetic oligonucleotide
  Target: SCN9A; (-) strand; PAM type: YTN; PAM sequence: TTA
aaggacagtttttccaggta

SEQ ID NO: 60697 - DNA, 20 bp, Artificial Sequence
  Description of Artificial Sequence: Synthetic oligonucleotide
  Target: SCN9A; (-) strand; PAM type: YTN; PAM sequence: TTT
aaaggacagtttttccaggt

SEQ ID NO: 60698 - DNA, 20 bp, Artificial Sequence
  Description of Artificial Sequence: Synthetic oligonucleotide
  Target: SCN9A; (-) strand; PAM type: YTN; PAM sequence: TTT
taaaggacagtttttccagg

SEQ ID NO: 60699 - DNA, 20 bp, Artificial Sequence
  Description of Artificial Sequence: Synthetic oligonucleotide
  Target: SCN9A; (-) strand; PAM type: YTN; PAM sequence: TTA
attttaaaggacagtttttc

SEQ ID NO: 60700 - DNA, 20 bp, Artificial Sequence
  Description of Artificial Sequence: Synthetic oligonucleotide
  Target: SCN9A; (-) strand; PAM type: YTN; PAM sequence: CTT
aattttaaaggacagttttt

SEQ ID NO: 60701 - DNA, 20 bp, Artificial Sequence
  Description of Artificial Sequence: Synthetic oligonucleotide
  Target: SCN9A; (-) strand; PAM type: YTN; PAM sequence: TTC
cttaattttaaaggacagtt

SEQ ID NO: 60702 - DNA, 20 bp, Artificial Sequence
  Description of Artificial Sequence: Synthetic oligonucleotide
  Target: SCN9A; (-) strand; PAM type: YTN; PAM sequence: CTT
ccttaattttaaaggacagt

SEQ ID NO: 60703 - DNA, 20 bp, Artificial Sequence
  Description of Artificial Sequence: Synthetic oligonucleotide
  Target: SCN9A; (-) strand; PAM type: YTN; PAM sequence: TTA
tccttccttaattttaaagg

SEQ ID NO: 60704 - DNA, 20 bp, Artificial Sequence
  Description of Artificial Sequence: Synthetic oligonucleotide
  Target: SCN9A; (-) strand; PAM type: YTN; PAM sequence: TTT
atccttccttaattttaaag

SEQ ID NO: 60705 - DNA, 20 bp, Artificial Sequence
  Description of Artificial Sequence: Synthetic oligonucleotide
  Target: SCN9A; (-) strand; PAM type: YTN; PAM sequence: TTT
tatccttccttaattttaaa

SEQ ID NO: 60706 - DNA, 20 bp, Artificial Sequence
  Description of Artificial Sequence: Synthetic oligonucleotide
  Target: SCN9A; (-) strand; PAM type: YTN; PAM sequence: TTT
ttatccttccttaattttaa

SEQ ID NO: 60707 - DNA, 20 bp, Artificial Sequence
  Description of Artificial Sequence: Synthetic oligonucleotide
  Target: SCN9A; (-) strand; PAM type: YTN; PAM sequence: TTG
tatgagaaagtttttatcct

SEQ ID NO: 60708 - DNA, 20 bp, Artificial Sequence
  Description of Artificial Sequence: Synthetic oligonucleotide
  Target: SCN9A; (-) strand; PAM type: YTN; PAM sequence: CTT
gtatgagaaagtttttatcc

SEQ ID NO: 60709 - DNA, 20 bp, Artificial Sequence
  Description of Artificial Sequence: Synthetic oligonucleotide
  Target: SCN9A; (-) strand; PAM type: YTN; PAM sequence: TTG
cttgtatgagaaagttttta

SEQ ID NO: 60710 - DNA, 20 bp, Artificial Sequence
  Description of Artificial Sequence: Synthetic oligonucleotide
  Target: SCN9A; (-) strand; PAM type: YTN; PAM sequence: TTT
gcttgtatgagaaagttttt

SEQ ID NO: 60711 - DNA, 20 bp, Artificial Sequence
  Description of Artificial Sequence: Synthetic oligonucleotide
  Target: SCN9A; (-) strand; PAM type: YTN; PAM sequence: CTC
agcatttgcttgtatgagaa

SEQ ID NO: 60712 - DNA, 20 bp, Artificial Sequence
  Description of Artificial Sequence: Synthetic oligonucleotide
  Target: SCN9A; (-) strand; PAM type: YTN; PAM sequence: CTC
cctcagcatttgcttgtatg

SEQ ID NO: 60713 - DNA, 20 bp, Artificial Sequence
  Description of Artificial Sequence: Synthetic oligonucleotide
  Target: SCN9A; (-) strand; PAM type: YTN; PAM sequence: CTA
gtggtgatgaactccctcag

SEQ ID NO: 60714 - DNA, 20 bp, Artificial Sequence
  Description of Artificial Sequence: Synthetic oligonucleotide
  Target: SCN9A; (-) strand; PAM type: YTN; PAM sequence: CTA
taagataaatctagtggtga

SEQ ID NO: 60715 - DNA, 20 bp, Artificial Sequence
  Description of Artificial Sequence: Synthetic oligonucleotide
  Target: SCN9A; (-) strand; PAM type: YTN; PAM sequence: TTC
ctataagataaatctagtgg

SEQ ID NO: 60716 - DNA, 20 bp, Artificial Sequence
  Description of Artificial Sequence: Synthetic oligonucleotide
  Target: SCN9A; (-) strand; PAM type: YTN; PAM sequence: TTT
cctataagataaatctagtg

SEQ ID NO: 60717 - DNA, 20 bp, Artificial Sequence
  Description of Artificial Sequence: Synthetic oligonucleotide
  Target: SCN9A; (-) strand; PAM type: YTN; PAM sequence: TTA
gcatttcctataagataaat

SEQ ID NO: 60718 - DNA, 20 bp, Artificial Sequence
  Description of Artificial Sequence: Synthetic oligonucleotide
  Target: SCN9A; (-) strand; PAM type: YTN; PAM sequence: TTT
agcatttcctataagataaa

SEQ ID NO: 60719 - DNA, 20 bp, Artificial Sequence
  Description of Artificial Sequence: Synthetic oligonucleotide
  Target: SCN9A; (-) strand; PAM type: YTN; PAM sequence: CTT
tagcatttcctataagataa

SEQ ID NO: 60720 - DNA, 20 bp, Artificial Sequence
  Description of Artificial Sequence: Synthetic oligonucleotide
  Target: SCN9A; (-) strand; PAM type: YTN; PAM sequence: CTC
actttagcatttcctataag

SEQ ID NO: 60721 - DNA, 20 bp, Artificial Sequence
  Description of Artificial Sequence: Synthetic oligonucleotide
  Target: SCN9A; (-) strand; PAM type: YTN; PAM sequence: TTG
aagaactcactttagcattt

SEQ ID NO: 60722 - DNA, 20 bp, Artificial Sequence
  Description of Artificial Sequence: Synthetic oligonucleotide
  Target: SCN9A; (-) strand; PAM type: YTN; PAM sequence: CTT
gaagaactcactttagcatt

SEQ ID NO: 60723 - DNA, 20 bp, Artificial Sequence
  Description of Artificial Sequence: Synthetic oligonucleotide
  Target: SCN9A; (-) strand; PAM type: YTN; PAM sequence: TTC
aacttgaagaactcacttta

SEQ ID NO: 60724 - DNA, 20 bp, Artificial Sequence
  Description of Artificial Sequence: Synthetic oligonucleotide
  Target: SCN9A; (-) strand; PAM type: YTN; PAM sequence: TTT
caacttgaagaactcacttt

SEQ ID NO: 60725 - DNA, 20 bp, Artificial Sequence
  Description of Artificial Sequence: Synthetic oligonucleotide
  Target: SCN9A; (-) strand; PAM type: YTN; PAM sequence: TTC
gtttcaacttgaagaactca

SEQ ID NO: 60726 - DNA, 20 bp, Artificial Sequence
  Description of Artificial Sequence: Synthetic oligonucleotide
  Target: SCN9A; (-) strand; PAM type: YTN; PAM sequence: TTT
cgtttcaacttgaagaactc

SEQ ID NO: 60727 - DNA, 20 bp, Artificial Sequence
  Description of Artificial Sequence: Synthetic oligonucleotide
  Target: SCN9A; (-) strand; PAM type: YTN; PAM sequence: CTT
tcgtttcaacttgaagaact

SEQ ID NO: 60728 - DNA, 20 bp, Artificial Sequence
  Description of Artificial Sequence: Synthetic oligonucleotide
  Target: SCN9A; (-) strand; PAM type: YTN; PAM sequence: TTA
ccatgctttcgtttcaactt

SEQ ID NO: 60729 - DNA, 20 bp, Artificial Sequence
  Description of Artificial Sequence: Synthetic oligonucleotide
  Target: SCN9A; (-) strand; PAM type: YTN; PAM sequence: TTT
accatgctttcgtttcaact

SEQ ID NO: 60730 - DNA, 20 bp, Artificial Sequence
  Description of Artificial Sequence: Synthetic oligonucleotide
  Target: SCN9A; (-) strand; PAM type: YTN; PAM sequence: CTT
taccatgctttcgtttcaac

SEQ ID NO: 60731 - DNA, 20 bp, Artificial Sequence
  Description of Artificial Sequence: Synthetic oligonucleotide
  Target: SCN9A; (-) strand; PAM type: YTN; PAM sequence: CTC
tttaccatgctttcgtttca

SEQ ID NO: 60732 - DNA, 20 bp, Artificial Sequence
  Description of Artificial Sequence: Synthetic oligonucleotide
  Target: SCN9A; (-) strand; PAM type: YTN; PAM sequence: TTG
ctctttaccatgctttcgtt

SEQ ID NO: 60733 - DNA, 20 bp, Artificial Sequence
  Description of Artificial Sequence: Synthetic oligonucleotide
  Target: SCN9A; (-) strand; PAM type: YTN; PAM sequence: TTG
tgttgctctttaccatgctt

SEQ ID NO: 60734 - DNA, 20 bp, Artificial Sequence
  Description of Artificial Sequence: Synthetic oligonucleotide
  Target: SCN9A; (-) strand; PAM type: YTN; PAM sequence: CTT
gtgttgctctttaccatgct

SEQ ID NO: 60735 - DNA, 20 bp, Artificial Sequence
  Description of Artificial Sequence: Synthetic oligonucleotide
  Target: SCN9A; (-) strand; PAM type: YTN; PAM sequence: CTC
ttgtgttgctctttaccatg

SEQ ID NO: 60736 - DNA, 20 bp, Artificial Sequence
  Description of Artificial Sequence: Synthetic oligonucleotide
  Target: SCN9A; (-) strand; PAM type: YTN; PAM sequence: TTC
atatgctcttgtgttgctct

SEQ ID NO: 60737 - DNA, 20 bp, Artificial Sequence
  Description of Artificial Sequence: Synthetic oligonucleotide
  Target: SCN9A; (-) strand; PAM type: YTN; PAM sequence: TTT
catatgctcttgtgttgctc

SEQ ID NO: 60738 - DNA, 20 bp, Artificial Sequence
  Description of Artificial Sequence: Synthetic oligonucleotide
  Target: SCN9A; (-) strand; PAM type: YTN; PAM sequence: CTT
tcatatgctcttgtgttgct

SEQ ID NO: 60739 - DNA, 20 bp, Artificial Sequence
  Description of Artificial Sequence: Synthetic oligonucleotide
  Target: SCN9A; (-) strand; PAM type: YTN; PAM sequence: TTG
tgctttcatatgctcttgtg

SEQ ID NO: 60740 - DNA, 20 bp, Artificial Sequence
  Description of Artificial Sequence: Synthetic oligonucleotide
  Target: SCN9A; (-) strand; PAM type: YTN; PAM sequence: TTT
gtgctttcatatgctcttgt

SEQ ID NO: 60741 - DNA, 20 bp, Artificial Sequence
  Description of Artificial Sequence: Synthetic oligonucleotide
  Target: SCN9A; (-) strand; PAM type: YTN; PAM sequence: CTA
gtgagatttgtgctttcata

SEQ ID NO: 60742 - DNA, 20 bp, Artificial Sequence
  Description of Artificial Sequence: Synthetic oligonucleotide
  Target: SCN9A; (-) strand; PAM type: YTN; PAM sequence: TTA
ctagtgagatttgtgctttc

SEQ ID NO: 60743 - DNA, 20 bp, Artificial Sequence
  Description of Artificial Sequence: Synthetic oligonucleotide
  Target: SCN9A; (-) strand; PAM type: YTN; PAM sequence: TTT
actagtgagatttgtgcttt

SEQ ID NO: 60744 - DNA, 20 bp, Artificial Sequence
  Description of Artificial Sequence: Synthetic oligonucleotide
  Target: SCN9A; (-) strand; PAM type: YTN; PAM sequence: CTT
tactagtgagatttgtgctt

SEQ ID NO: 60745 - DNA, 20 bp, Artificial Sequence
  Description of Artificial Sequence: Synthetic oligonucleotide
  Target: SCN9A; (-) strand; PAM type: YTN; PAM sequence: TTA
cctttactagtgagatttgt

SEQ ID NO: 60746 - DNA, 20 bp, Artificial Sequence
  Description of Artificial Sequence: Synthetic oligonucleotide
  Target: SCN9A; (-) strand; PAM type: YTN; PAM sequence: TTT
acctttactagtgagatttg

SEQ ID NO: 60747 - DNA, 20 bp, Artificial Sequence
  Description of Artificial Sequence: Synthetic oligonucleotide
  Target: SCN9A; (-) strand; PAM type: YTN; PAM sequence: TTG
tccatgtatttacctttact

SEQ ID NO: 60748 - DNA, 20 bp, Artificial Sequence
  Description of Artificial Sequence: Synthetic oligonucleotide
  Target: SCN9A; (-) strand; PAM type: YTN; PAM sequence: TTT
gtccatgtatttacctttac

SEQ ID NO: 60749 - DNA, 20 bp, Artificial Sequence
  Description of Artificial Sequence: Synthetic oligonucleotide
  Target: SCN9A; (-) strand; PAM type: YTN; PAM sequence: CTA
tttgtccatgtatttacctt

SEQ ID NO: 60750 - DNA, 20 bp, Artificial Sequence
  Description of Artificial Sequence: Synthetic oligonucleotide
  Target: SCN9A; (-) strand; PAM type: YTN; PAM sequence: CTC
tatttgtccatgtatttacc

SEQ ID NO: 60751 - DNA, 20 bp, Artificial Sequence
  Description of Artificial Sequence: Synthetic oligonucleotide
  Target: SCN9A; (-) strand; PAM type: YTN; PAM sequence: TTC
tctatttgtccatgtattta

SEQ ID NO: 60752 - DNA, 20 bp, Artificial Sequence
  Description of Artificial Sequence: Synthetic oligonucleotide
  Target: SCN9A; (-) strand; PAM type: YTN; PAM sequence: TTA
cagtattctctatttgtcca

SEQ ID NO: 60753 - DNA, 20 bp, Artificial Sequence
  Description of Artificial Sequence: Synthetic oligonucleotide
  Target: SCN9A; (-) strand; PAM type: YTN; PAM sequence: TTA
gagtattacagtattctcta

SEQ ID NO: 60754 - DNA, 20 bp, Artificial Sequence
  Description of Artificial Sequence: Synthetic oligonucleotide
  Target: SCN9A; (-) strand; PAM type: YTN; PAM sequence: CTA
ttagagtattacagtattct

SEQ ID NO: 60755 - DNA, 20 bp, Artificial Sequence
  Description of Artificial Sequence: Synthetic oligonucleotide
  Target: SCN9A; (-) strand; PAM type: YTN; PAM sequence: TTA
tataatactattagagtatt

SEQ ID NO: 60756 - DNA, 20 bp, Artificial Sequence
  Description of Artificial Sequence: Synthetic oligonucleotide
  Target: SCN9A; (-) strand; PAM type: YTN; PAM sequence: TTT
atataatactattagagtat

SEQ ID NO: 60757 - DNA, 20 bp, Artificial Sequence
  Description of Artificial Sequence: Synthetic oligonucleotide
  Target: SCN9A; (-) strand; PAM type: YTN; PAM sequence: TTA
taaatgatttatataatact

SEQ ID NO: 60758 - DNA, 20 bp, Artificial Sequence
  Description of Artificial Sequence: Synthetic oligonucleotide
  Target: SCN9A; (-) strand; PAM type: YTN; PAM sequence: TTA
gaattataaatgatttatat

SEQ ID NO: 60759 - DNA, 20 bp, Artificial Sequence
  Description of Artificial Sequence: Synthetic oligonucleotide
  Target: SCN9A; (-) strand; PAM type: YTN; PAM sequence: TTA
tattagaattataaatgatt

SEQ ID NO: 60760 - DNA, 20 bp, Artificial Sequence
  Description of Artificial Sequence: Synthetic oligonucleotide
  Target: SCN9A; (-) strand; PAM type: YTN; PAM sequence: TTT
atattagaattataaatgat

SEQ ID NO: 60761 - DNA, 20 bp, Artificial Sequence
  Description of Artificial Sequence: Synthetic oligonucleotide
  Target: SCN9A; (-) strand; PAM type: YTN; PAM sequence: TTT
tatattagaattataaatga

SEQ ID NO: 60762 - DNA, 20 bp, Artificial Sequence
  Description of Artificial Sequence: Synthetic oligonucleotide
  Target: SCN9A; (-) strand; PAM type: YTN; PAM sequence: CTT
ttatattagaattataaatg

SEQ ID NO: 60763 - DNA, 20 bp, Artificial Sequence
  Description of Artificial Sequence: Synthetic oligonucleotide
  Target: SCN9A; (-) strand; PAM type: YTN; PAM sequence: TTA
acttttatattagaattata

SEQ ID NO: 60764 - DNA, 20 bp, Artificial Sequence
  Description of Artificial Sequence: Synthetic oligonucleotide
  Target: SCN9A; (-) strand; PAM type: YTN; PAM sequence: TTT
aacttttatattagaattat

SEQ ID NO: 60765 - DNA, 20 bp, Artificial Sequence
  Description of Artificial Sequence: Synthetic oligonucleotide
  Target: SCN9A; (-) strand; PAM type: YTN; PAM sequence: TTG
acatttaacttttatattag

SEQ ID NO: 60766 - DNA, 20 bp, Artificial Sequence
  Description of Artificial Sequence: Synthetic oligonucleotide
  Target: SCN9A; (-) strand; PAM type: YTN; PAM sequence: TTT
gacatttaacttttatatta

SEQ ID NO: 60767 - DNA, 20 bp, Artificial Sequence
  Description of Artificial Sequence: Synthetic oligonucleotide
  Target: SCN9A; (-) strand; PAM type: YTN; PAM sequence: TTT
tgacatttaacttttatatt

SEQ ID NO: 60768 - DNA, 20 bp, Artificial Sequence
  Description of Artificial Sequence: Synthetic oligonucleotide
  Target: SCN9A; (-) strand; PAM type: YTN; PAM sequence: TTA
ttttgacatttaacttttat

SEQ ID NO: 60769 - DNA, 20 bp, Artificial Sequence
  Description of Artificial Sequence: Synthetic oligonucleotide
  Target: SCN9A; (-) strand; PAM type: YTN; PAM sequence: TTA
attattttgacatttaactt

SEQ ID NO: 60770 - DNA, 20 bp, Artificial Sequence
  Description of Artificial Sequence: Synthetic oligonucleotide
  Target: SCN9A; (-) strand; PAM type: YTN; PAM sequence: CTT
aattattttgacatttaact

SEQ ID NO: 60771 - DNA, 20 bp, Artificial Sequence
  Description of Artificial Sequence: Synthetic oligonucleotide
  Target: SCN9A; (-) strand; PAM type: YTN; PAM sequence: TTC
ttaattattttgacatttaa

SEQ ID NO: 60772 - DNA, 20 bp, Artificial Sequence
  Description of Artificial Sequence: Synthetic oligonucleotide
  Target: SCN9A; (-) strand; PAM type: YTN; PAM sequence: TTA
ttcttaattattttgacatt

SEQ ID NO: 60773 - DNA, 20 bp, Artificial Sequence
  Description of Artificial Sequence: Synthetic oligonucleotide
  Target: SCN9A; (-) strand; PAM type: YTN; PAM sequence: TTA
gttattcttaattattttga

SEQ ID NO: 60774 - DNA, 20 bp, Artificial Sequence
  Description of Artificial Sequence: Synthetic oligonucleotide
  Target: SCN9A; (-) strand; PAM type: YTN; PAM sequence: TTT
agttattcttaattattttg

SEQ ID NO: 60775 - DNA, 20 bp, Artificial Sequence
  Description of Artificial Sequence: Synthetic oligonucleotide
  Target: SCN9A; (-) strand; PAM type: YTN; PAM sequence: TTT
tagttattcttaattatttt

SEQ ID NO: 60776 - DNA, 20 bp, Artificial Sequence
  Description of Artificial Sequence: Synthetic oligonucleotide
  Target: SCN9A; (-) strand; PAM type: YTN; PAM sequence: TTG
taattttagttattcttaat

SEQ ID NO: 60777 - DNA, 20 bp, Artificial Sequence
  Description of Artificial Sequence: Synthetic oligonucleotide
  Target: SCN9A; (-) strand; PAM type: YTN; PAM sequence: TTT
gtaattttagttattcttaa

SEQ ID NO: 60778 - DNA, 20 bp, Artificial Sequence
  Description of Artificial Sequence: Synthetic oligonucleotide
  Target: SCN9A; (-) strand; PAM type: YTN; PAM sequence: TTT
tgtaattttagttattctta

SEQ ID NO: 60779 - DNA, 20 bp, Artificial Sequence
  Description of Artificial Sequence: Synthetic oligonucleotide
  Target: SCN9A; (-) strand; PAM type: YTN; PAM sequence: TTT
ttgtaattttagttattctt

SEQ ID NO: 60780 - DNA, 20 bp, Artificial Sequence
  Description of Artificial Sequence: Synthetic oligonucleotide
  Target: SCN9A; (-) strand; PAM type: YTN; PAM sequence: CTA
caaacacatttttgtaattt

SEQ ID NO: 60781 - DNA, 20 bp, Artificial Sequence
  Description of Artificial Sequence: Synthetic oligonucleotide
  Target: SCN9A; (-) strand; PAM type: YTN; PAM sequence: TTC
tacaaacacatttttgtaat

SEQ ID NO: 60782 - DNA, 20 bp, Artificial Sequence
  Description of Artificial Sequence: Synthetic oligonucleotide
  Target: SCN9A; (-) strand; PAM type: YTN; PAM sequence: TTT
ctacaaacacatttttgtaa

SEQ ID NO: 60783 - DNA, 20 bp, Artificial Sequence
  Description of Artificial Sequence: Synthetic oligonucleotide
  Target: SCN9A; (-) strand; PAM type: YTN; PAM sequence: TTA
taatgtgtttctacaaacac

SEQ ID NO: 60784 - DNA, 20 bp, Artificial Sequence
  Description of Artificial Sequence: Synthetic oligonucleotide
  Target: SCN9A; (-) strand; PAM type: YTN; PAM sequence: TTT
ataatgtgtttctacaaaca

SEQ ID NO: 60785 - DNA, 20 bp, Artificial Sequence
  Description of Artificial Sequence: Synthetic oligonucleotide
  Target: SCN9A; (-) strand; PAM type: YTN; PAM sequence: TTT
tataatgtgtttctacaaac

SEQ ID NO: 60786 - DNA, 20 bp, Artificial Sequence
  Description of Artificial Sequence: Synthetic oligonucleotide
  Target: SCN9A; (-) strand; PAM type: YTN; PAM sequence: TTT
ttataatgtgtttctacaaa

SEQ ID NO: 60787 - DNA, 20 bp, Artificial Sequence
  Description of Artificial Sequence: Synthetic oligonucleotide
  Target: SCN9A; (-) strand; PAM type: YTN; PAM sequence: CTT
tttataatgtgtttctacaa

SEQ ID NO: 60788 - DNA, 20 bp, Artificial Sequence
  Description of Artificial Sequence: Synthetic oligonucleotide
  Target: SCN9A; (-) strand; PAM type: YTN; PAM sequence: TTA
catctttttataatgtgttt

SEQ ID NO: 60789 - DNA, 20 bp, Artificial Sequence
  Description of Artificial Sequence: Synthetic oligonucleotide
  Target: SCN9A; (-) strand; PAM type: YTN; PAM sequence: TTT
acatctttttataatgtgtt

SEQ ID NO: 60790 - DNA, 20 bp, Artificial Sequence
  Description of Artificial Sequence: Synthetic oligonucleotide
  Target: SCN9A; (-) strand; PAM type: YTN; PAM sequence: TTA
tgtcacaatttacatctttt

SEQ ID NO: 60791 - DNA, 20 bp, Artificial Sequence
  Description of Artificial Sequence: Synthetic oligonucleotide
  Target: SCN9A; (-) strand; PAM type: YTN; PAM sequence: TTG
ttatgtcacaatttacatct

SEQ ID NO: 60792 - DNA, 20 bp, Artificial Sequence
  Description of Artificial Sequence: Synthetic oligonucleotide
  Target: SCN9A; (-) strand; PAM type: YTN; PAM sequence: TTT
gttatgtcacaatttacatc

SEQ ID NO: 60793 - DNA, 20 bp, Artificial Sequence
  Description of Artificial Sequence: Synthetic oligonucleotide
  Target: SCN9A; (-) strand; PAM type: YTN; PAM sequence: TTT
tgttatgtcacaatttacat

SEQ ID NO: 60794 - DNA, 20 bp, Artificial Sequence
  Description of Artificial Sequence: Synthetic oligonucleotide
  Target: SCN9A; (-) strand; PAM type: YTN; PAM sequence: TTT
ttgttatgtcacaatttaca

SEQ ID NO: 60795 - DNA, 20 bp, Artificial Sequence
  Description of Artificial Sequence: Synthetic oligonucleotide
  Target: SCN9A; (-) strand; PAM type: YTN; PAM sequence: CTT
tttgttatgtcacaatttac

SEQ ID NO: 60796 - DNA, 20 bp, Artificial Sequence
  Description of Artificial Sequence: Synthetic oligonucleotide
  Target: SCN9A; (-) strand; PAM type: YTN; PAM sequence: CTC
acactttttgttatgtcaca

SEQ ID NO: 60797 - DNA, 20 bp, Artificial Sequence
  Description of Artificial Sequence: Synthetic oligonucleotide
  Target: SCN9A; (-) strand; PAM type: YTN; PAM sequence: CTC
cctcacactttttgttatgt

SEQ ID NO: 60798 - DNA, 20 bp, Artificial Sequence
  Description of Artificial Sequence: Synthetic oligonucleotide
  Target: SCN9A; (-) strand; PAM type: YTN; PAM sequence: TTA
atacctccctcacacttttt

SEQ ID NO: 60799 - DNA, 20 bp, Artificial Sequence
  Description of Artificial Sequence: Synthetic oligonucleotide
  Target: SCN9A; (-) strand; PAM type: YTN; PAM sequence: TTT
aatacctccctcacactttt

SEQ ID NO: 60800 - DNA, 20 bp, Artificial Sequence
  Description of Artificial Sequence: Synthetic oligonucleotide
  Target: SCN9A; (-) strand; PAM type: YTN; PAM sequence: TTT
taatacctccctcacacttt

SEQ ID NO: 60801 - DNA, 20 bp, Artificial Sequence
  Description of Artificial Sequence: Synthetic oligonucleotide
  Target: SCN9A; (-) strand; PAM type: YTN; PAM sequence: CTT
ttaatacctccctcacactt

SEQ ID NO: 60802 - DNA, 20 bp, Artificial Sequence
  Description of Artificial Sequence: Synthetic oligonucleotide
  Target: SCN9A; (-) strand; PAM type: YTN; PAM sequence: TTC
acttttaatacctccctcac

SEQ ID NO: 60803 - DNA, 20 bp, Artificial Sequence
  Description of Artificial Sequence: Synthetic oligonucleotide
  Target: SCN9A; (-) strand; PAM type: YTN; PAM sequence: CTT
cacttttaatacctccctca

SEQ ID NO: 60804 - DNA, 20 bp, Artificial Sequence
  Description of Artificial Sequence: Synthetic oligonucleotide
  Target: SCN9A; (-) strand; PAM type: YTN; PAM sequence: TTC
aatcatatatcaaaaatctt

SEQ ID NO: 60805 - DNA, 20 bp, Artificial Sequence
  Description of Artificial Sequence: Synthetic oligonucleotide
  Target: SCN9A; (-) strand; PAM type: YTN; PAM sequence: CTT
caatcatatatcaaaaatct

SEQ ID NO: 60806 - DNA, 20 bp, Artificial Sequence
  Description of Artificial Sequence: Synthetic oligonucleotide
  Target: SCN9A; (-) strand; PAM type: YTN; PAM sequence: TTA
acttcaatcatatatcaaaa

SEQ ID NO: 60807 - DNA, 20 bp, Artificial Sequence
  Description of Artificial Sequence: Synthetic oligonucleotide
  Target: SCN9A; (-) strand; PAM type: YTN; PAM sequence: CTT
aacttcaatcatatatcaaa

SEQ ID NO: 60808 - DNA, 20 bp, Artificial Sequence
  Description of Artificial Sequence: Synthetic oligonucleotide
  Target: SCN9A; (-) strand; PAM type: YTN; PAM sequence: CTG
ataacaacttaacttcaatc

SEQ ID NO: 60809 - DNA, 20 bp, Artificial Sequence
  Description of Artificial Sequence: Synthetic oligonucleotide
  Target: SCN9A; (-) strand; PAM type: YTN; PAM sequence: TTA
agctgataacaacttaactt

SEQ ID NO: 60810 - DNA, 20 bp, Artificial Sequence
  Description of Artificial Sequence: Synthetic oligonucleotide
  Target: SCN9A; (-) strand; PAM type: YTN; PAM sequence: TTT
aagctgataacaacttaact

SEQ ID NO: 60811 - DNA, 20 bp, Artificial Sequence
  Description of Artificial Sequence: Synthetic oligonucleotide
  Target: SCN9A; (-) strand; PAM type: YTN; PAM sequence: CTT
taagctgataacaacttaac

SEQ ID NO: 60812 - DNA, 20 bp, Artificial Sequence
  Description of Artificial Sequence: Synthetic oligonucleotide
  Target: SCN9A; (-) strand; PAM type: YTN; PAM sequence: CTA
ctttaagctgataacaactt

SEQ ID NO: 60813 - DNA, 20 bp, Artificial Sequence
  Description of Artificial Sequence: Synthetic oligonucleotide
  Target: SCN9A; (-) strand; PAM type: YTN; PAM sequence: TTA
taatagtctactttaagctg

SEQ ID NO: 60814 - DNA, 20 bp, Artificial Sequence
  Description of Artificial Sequence: Synthetic oligonucleotide
  Target: SCN9A; (-) strand; PAM type: YTN; PAM sequence: CTT
ataatagtctactttaagct

SEQ ID NO: 60815 - DNA, 20 bp, Artificial Sequence
  Description of Artificial Sequence: Synthetic oligonucleotide
  Target: SCN9A; (-) strand; PAM type: YTN; PAM sequence: TTA
tcatgaggcaatcacaaata

SEQ ID NO: 60816 - DNA, 20 bp, Artificial Sequence
  Description of Artificial Sequence: Synthetic oligonucleotide
  Target: SCN9A; (-) strand; PAM type: YTN; PAM sequence: TTG
tggttatcatgaggcaatca

SEQ ID NO: 60817 - DNA, 20 bp, Artificial Sequence
  Description of Artificial Sequence: Synthetic oligonucleotide
  Target: SCN9A; (-) strand; PAM type: YTN; PAM sequence: CTT
gtggttatcatgaggcaatc

SEQ ID NO: 60818 - DNA, 20 bp, Artificial Sequence
  Description of Artificial Sequence: Synthetic oligonucleotide
  Target: SCN9A; (-) strand; PAM type: YTN; PAM sequence: TTC
cttgtggttatcatgaggca

SEQ ID NO: 60819 - DNA, 20 bp, Artificial Sequence
  Description of Artificial Sequence: Synthetic oligonucleotide
  Target: SCN9A; (-) strand; PAM type: YTN; PAM sequence: TTT
ccttgtggttatcatgaggc

SEQ ID NO: 60820 - DNA, 20 bp, Artificial Sequence
  Description of Artificial Sequence: Synthetic oligonucleotide
  Target: SCN9A; (-) strand; PAM type: YTN; PAM sequence: TTT
tccttgtggttatcatgagg

SEQ ID NO: 60821 - DNA, 20 bp, Artificial Sequence
  Description of Artificial Sequence: Synthetic oligonucleotide
  Target: SCN9A; (-) strand; PAM type: YTN; PAM sequence: TTA
cgtggattttccttgtggtt

SEQ ID NO: 60822 - DNA, 20 bp, Artificial Sequence
  Description of Artificial Sequence: Synthetic oligonucleotide
  Target: SCN9A; (-) strand; PAM type: YTN; PAM sequence: TTT
acgtggattttccttgtggt

SEQ ID NO: 60823 - DNA, 20 bp, Artificial Sequence
  Description of Artificial Sequence: Synthetic oligonucleotide
  Target: SCN9A; (-) strand; PAM type: YTN; PAM sequence: TTT
tacgtggattttccttgtgg

SEQ ID NO: 60824 - DNA, 20 bp, Artificial Sequence
  Description of Artificial Sequence: Synthetic oligonucleotide
  Target: SCN9A; (-) strand; PAM type: YTN; PAM sequence: TTT
ttacgtggattttccttgtg

SEQ ID NO: 60825 - DNA, 20 bp, Artificial Sequence
  Description of Artificial Sequence: Synthetic oligonucleotide
  Target: SCN9A; (-) strand; PAM type: YTN; PAM sequence: CTG
tatttttacgtggattttcc

SEQ ID NO: 60826 - DNA, 20 bp, Artificial Sequence
  Description of Artificial Sequence: Synthetic oligonucleotide
  Target: SCN9A; (-) strand; PAM type: YTN; PAM sequence: TTC
tgtatttttacgtggatttt

SEQ ID NO: 60827 - DNA, 20 bp, Artificial Sequence
  Description of Artificial Sequence: Synthetic oligonucleotide
  Target: SCN9A; (-) strand; PAM type: YTN; PAM sequence: TTT
ctgtatttttacgtggattt

SEQ ID NO: 60828 - DNA, 20 bp, Artificial Sequence
  Description of Artificial Sequence: Synthetic oligonucleotide
  Target: SCN9A; (-) strand; PAM type: YTN; PAM sequence: TTA
tttctgtatttttacgtgga

SEQ ID NO: 60829 - DNA, 20 bp, Artificial Sequence
  Description of Artificial Sequence: Synthetic oligonucleotide
  Target: SCN9A; (-) strand; PAM type: YTN; PAM sequence: TTT
atttctgtatttttacgtgg

SEQ ID NO: 60830 - DNA, 20 bp, Artificial Sequence
  Description of Artificial Sequence: Synthetic oligonucleotide
  Target: SCN9A; (-) strand; PAM type: YTN; PAM sequence: TTT
tatttctgtatttttacgtg

SEQ ID NO: 60831 - DNA, 20 bp, Artificial Sequence
  Description of Artificial Sequence: Synthetic oligonucleotide
  Target: SCN9A; (-) strand; PAM type: YTN; PAM sequence: TTT
ttatttctgtatttttacgt

SEQ ID NO: 60832 - DNA, 20 bp, Artificial Sequence
  Description of Artificial Sequence: Synthetic oligonucleotide
  Target: SCN9A; (-) strand; PAM type: YTN; PAM sequence: TTT
tttatttctgtatttttacg

SEQ ID NO: 60833 - DNA, 20 bp, Artificial Sequence
  Description of Artificial Sequence: Synthetic oligonucleotide
  Target: SCN9A; (-) strand; PAM type: YTN; PAM sequence: CTT
ttttatttctgtatttttac

SEQ ID NO: 60834 - DNA, 20 bp, Artificial Sequence
  Description of Artificial Sequence: Synthetic oligonucleotide
  Target: SCN9A; (-) strand; PAM type: YTN; PAM sequence: CTC
ttttttatttctgtattttt

SEQ ID NO: 60835 - DNA, 20 bp, Artificial Sequence
  Description of Artificial Sequence: Synthetic oligonucleotide
  Target: SCN9A; (-) strand; PAM type: YTN; PAM sequence: TTC
tcttttttatttctgtattt

SEQ ID NO: 60836 - DNA, 20 bp, Artificial Sequence
  Description of Artificial Sequence: Synthetic oligonucleotide
  Target: SCN9A; (-) strand; PAM type: YTN; PAM sequence: TTT
ctcttttttatttctgtatt

SEQ ID NO: 60837 - DNA, 20 bp, Artificial Sequence
  Description of Artificial Sequence: Synthetic oligonucleotide
  Target: SCN9A; (-) strand; PAM type: YTN; PAM sequence: CTA
tgatttctcttttttatttc

SEQ ID NO: 60838 - DNA, 20 bp, Artificial Sequence
  Description of Artificial Sequence: Synthetic oligonucleotide
  Target: SCN9A; (-) strand; PAM type: YTN; PAM sequence: TTG
tgatatgctatgatttctct

SEQ ID NO: 60839 - DNA, 20 bp, Artificial Sequence
  Description of Artificial Sequence: Synthetic oligonucleotide
  Target: SCN9A; (-) strand; PAM type: YTN; PAM sequence: TTA
ttgtgatatgctatgatttc

SEQ ID NO: 60840 - DNA, 20 bp, Artificial Sequence
  Description of Artificial Sequence: Synthetic oligonucleotide
  Target: SCN9A; (-) strand; PAM type: YTN; PAM sequence: TTT
attgtgatatgctatgattt

SEQ ID NO: 60841 - DNA, 20 bp, Artificial Sequence
  Description of Artificial Sequence: Synthetic oligonucleotide
  Target: SCN9A; (-) strand; PAM type: YTN; PAM sequence: TTT
tattgtgatatgctatgatt

SEQ ID NO: 60842 - DNA, 20 bp, Artificial Sequence
  Description of Artificial Sequence: Synthetic oligonucleotide
  Target: SCN9A; (-) strand; PAM type: YTN; PAM sequence: TTG
gatgatattttattgtgata

SEQ ID NO: 60843 - DNA, 20 bp, Artificial Sequence
  Description of Artificial Sequence: Synthetic oligonucleotide
  Target: SCN9A; (-) strand; PAM type: YTN; PAM sequence: TTG
tgattggatgatattttatt

SEQ ID NO: 60844 - DNA, 20 bp, Artificial Sequence
  Description of Artificial Sequence: Synthetic oligonucleotide
  Target: SCN9A; (-) strand; PAM type: YTN; PAM sequence: TTT
gtgattggatgatattttat

SEQ ID NO: 60845 - DNA, 20 bp, Artificial Sequence
  Description of Artificial Sequence: Synthetic oligonucleotide
  Target: SCN9A; (-) strand; PAM type: YTN; PAM sequence: TTT
tgtgattggatgatatttta

SEQ ID NO: 60846 - DNA, 20 bp, Artificial Sequence
  Description of Artificial Sequence: Synthetic oligonucleotide
  Target: SCN9A; (-) strand; PAM type: YTN; PAM sequence: CTT
ttgtgattggatgatatttt

SEQ ID NO: 60847 - DNA, 20 bp, Artificial Sequence
  Description of Artificial Sequence: Synthetic oligonucleotide
  Target: SCN9A; (-) strand; PAM type: YTN; PAM sequence: TTC
ttttgtgattggatgatatt

SEQ ID NO: 60848 - DNA, 20 bp, Artificial Sequence
  Description of Artificial Sequence: Synthetic oligonucleotide
  Target: SCN9A; (-) strand; PAM type: YTN; PAM sequence: CTT
cttttgtgattggatgatat

SEQ ID NO: 60849 - DNA, 20 bp, Artificial Sequence
  Description of Artificial Sequence: Synthetic oligonucleotide
  Target: SCN9A; (-) strand; PAM type: YTN; PAM sequence: CTG
tcttcttttgtgattggatg

SEQ ID NO: 60850 - DNA, 20 bp, Artificial Sequence
  Description of Artificial Sequence: Synthetic oligonucleotide
  Target: SCN9A; (-) strand; PAM type: YTN; PAM sequence: TTA
actgtcttcttttgtgattg

SEQ ID NO: 60851 - DNA, 20 bp, Artificial Sequence
  Description of Artificial Sequence: Synthetic oligonucleotide
  Target: SCN9A; (-) strand; PAM type: YTN; PAM sequence: CTT
aactgtcttcttttgtgatt

SEQ ID NO: 60852 - DNA, 20 bp, Artificial Sequence
  Description of Artificial Sequence: Synthetic oligonucleotide
  Target: SCN9A; (-) strand; PAM type: YTN; PAM sequence: CTC
ttaactgtcttcttttgtga

SEQ ID NO: 60853 - DNA, 20 bp, Artificial Sequence
  Description of Artificial Sequence: Synthetic oligonucleotide
  Target: SCN9A; (-) strand; PAM type: YTN; PAM sequence: CTC
tcttaactgtcttcttttgt

SEQ ID NO: 60854 - DNA, 20 bp, Artificial Sequence
  Description of Artificial Sequence: Synthetic oligonucleotide
  Target: SCN9A; (-) strand; PAM type: YTN; PAM sequence: TTC
tctcttaactgtcttctttt

SEQ ID NO: 60855 - DNA, 20 bp, Artificial Sequence
  Description of Artificial Sequence: Synthetic oligonucleotide
  Target: SCN9A; (-) strand; PAM type: YTN; PAM sequence: TTT
ctctcttaactgtcttcttt

SEQ ID NO: 60856 - DNA, 20 bp, Artificial Sequence
  Description of Artificial Sequence: Synthetic oligonucleotide
  Target: SCN9A; (-) strand; PAM type: YTN; PAM sequence: TTT
tctctcttaactgtcttctt

SEQ ID NO: 60857 - DNA, 20 bp, Artificial Sequence
  Description of Artificial Sequence: Synthetic oligonucleotide
  Target: SCN9A; (-) strand; PAM type: YTN; PAM sequence: TTT
ttctctcttaactgtcttct

SEQ ID NO: 60858 - DNA, 20 bp, Artificial Sequence
  Description of Artificial Sequence: Synthetic oligonucleotide
  Target: SCN9A; (-) strand; PAM type: YTN; PAM sequence: CTT
tttctctcttaactgtcttc

SEQ ID NO: 60859 - DNA, 20 bp, Artificial Sequence
  Description of Artificial Sequence: Synthetic oligonucleotide
  Target: SCN9A; (-) strand; PAM type: YTN; PAM sequence: CTG
tctttttctctcttaactgt

SEQ ID NO: 60860 - DNA, 20 bp, Artificial Sequence
  Description of Artificial Sequence: Synthetic oligonucleotide
  Target: SCN9A; (-) strand; PAM type: YTN; PAM sequence: TTC
tgtctttttctctcttaact

SEQ ID NO: 60861 - DNA, 20 bp, Artificial Sequence
  Description of Artificial Sequence: Synthetic oligonucleotide
  Target: SCN9A; (-) strand; PAM type: YTN; PAM sequence: TTT
ctgtctttttctctcttaac

SEQ ID NO: 60862 - DNA, 20 bp, Artificial Sequence
  Description of Artificial Sequence: Synthetic oligonucleotide
  Target: SCN9A; (-) strand; PAM type: YTN; PAM sequence: TTT
tctgtctttttctctcttaa

SEQ ID NO: 60863 - DNA, 20 bp, Artificial Sequence
  Description of Artificial Sequence: Synthetic oligonucleotide
  Target: SCN9A; (-) strand; PAM type: YTN; PAM sequence: TTT
ttctgtctttttctctctta

SEQ ID NO: 60864 - DNA, 20 bp, Artificial Sequence
  Description of Artificial Sequence: Synthetic oligonucleotide
  Target: SCN9A; (-) strand; PAM type: YTN; PAM sequence: TTT
tttctgtctttttctctctt

SEQ ID NO: 60865 - DNA, 20 bp, Artificial Sequence
  Description of Artificial Sequence: Synthetic oligonucleotide
  Target: SCN9A; (-) strand; PAM type: YTN; PAM sequence: TTT
ttttctgtctttttctctct

SEQ ID NO: 60866 - DNA, 20 bp, Artificial Sequence
  Description of Artificial Sequence: Synthetic oligonucleotide
  Target: SCN9A; (-) strand; PAM type: YTN; PAM sequence: CTT
tttttctgtctttttctctc

SEQ ID NO: 60867 - DNA, 20 bp, Artificial Sequence
  Description of Artificial Sequence: Synthetic oligonucleotide
  Target: SCN9A; (-) strand; PAM type: YTN; PAM sequence: TTC
tttttttctgtctttttctc

SEQ ID NO: 60868 - DNA, 20 bp, Artificial Sequence
  Description of Artificial Sequence: Synthetic oligonucleotide
  Target: SCN9A; (-) strand; PAM type: YTN; PAM sequence: TTG
taattctttttttctgtctt

SEQ ID NO: 60869 - DNA, 20 bp, Artificial Sequence
  Description of Artificial Sequence: Synthetic oligonucleotide
  Target: SCN9A; (-) strand; PAM type: YTN; PAM sequence: TTT
gtaattctttttttctgtct

SEQ ID NO: 60870 - DNA, 20 bp, Artificial Sequence
  Description of Artificial Sequence: Synthetic oligonucleotide
  Target: SCN9A; (-) strand; PAM type: YTN; PAM sequence: TTT
tgtaattctttttttctgtc

SEQ ID NO: 60871 - DNA, 20 bp, Artificial Sequence
  Description of Artificial Sequence: Synthetic oligonucleotide
  Target: SCN9A; (-) strand; PAM type: YTN; PAM sequence: CTG
ttttgtaattctttttttct

SEQ ID NO: 60872 - DNA, 20 bp, Artificial Sequence
  Description of Artificial Sequence: Synthetic oligonucleotide
  Target: SCN9A; (-) strand; PAM type: YTN; PAM sequence: TTC
tgttttgtaattcttttttt

SEQ ID NO: 60873 - DNA, 20 bp, Artificial Sequence
  Description of Artificial Sequence: Synthetic oligonucleotide
  Target: SCN9A; (-) strand; PAM type: YTN; PAM sequence: TTT
ctgttttgtaattctttttt

SEQ ID NO: 60874 - DNA, 20 bp, Artificial Sequence
  Description of Artificial Sequence: Synthetic oligonucleotide
  Target: SCN9A; (-) strand; PAM type: YTN; PAM sequence: TTT
tctgttttgtaattcttttt

SEQ ID NO: 60875 - DNA, 20 bp, Artificial Sequence
  Description of Artificial Sequence: Synthetic oligonucleotide
  Target: SCN9A; (-) strand; PAM type: YTN; PAM sequence: TTT
ttctgttttgtaattctttt

SEQ ID NO: 60876 - DNA, 20 bp, Artificial Sequence
  Description of Artificial Sequence: Synthetic oligonucleotide
  Target: SCN9A; (-) strand; PAM type: YTN; PAM sequence: TTA
aatttttctgttttgtaatt

SEQ ID NO: 60877 - DNA, 20 bp, Artificial Sequence
  Description of Artificial Sequence: Synthetic oligonucleotide
  Target: SCN9A; (-) strand; PAM type: YTN; PAM sequence: TTG
ttaaatttttctgttttgta

SEQ ID NO: 60878 - DNA, 20 bp, Artificial Sequence
  Description of Artificial Sequence: Synthetic oligonucleotide
  Target: SCN9A; (-) strand; PAM type: YTN; PAM sequence: TTT
gttaaatttttctgttttgt

SEQ ID NO: 60879 - DNA, 20 bp, Artificial Sequence
  Description of Artificial Sequence: Synthetic oligonucleotide
  Target: SCN9A; (-) strand; PAM type: YTN; PAM sequence: TTT
tgttaaatttttctgttttg

SEQ ID NO: 60880 - DNA, 20 bp, Artificial Sequence
  Description of Artificial Sequence: Synthetic oligonucleotide
  Target: SCN9A; (-) strand; PAM type: YTN; PAM sequence: TTT
ttgttaaatttttctgtttt

SEQ ID NO: 60881 - DNA, 20 bp, Artificial Sequence
  Description of Artificial Sequence: Synthetic oligonucleotide
  Target: SCN9A; (-) strand; PAM type: YTN; PAM sequence: CTT
tttgttaaatttttctgttt

SEQ ID NO: 60882 - DNA, 20 bp, Artificial Sequence
  Description of Artificial Sequence: Synthetic oligonucleotide
  Target: SCN9A; (-) strand; PAM type: YTN; PAM sequence: TTG
cctttttgttaaatttttct

SEQ ID NO: 60883 - DNA, 20 bp, Artificial Sequence
  Description of Artificial Sequence: Synthetic oligonucleotide
  Target: SCN9A; (-) strand; PAM type: YTN; PAM sequence: CTA
ttgcctttttgttaaatttt

SEQ ID NO: 60884 - DNA, 20 bp, Artificial Sequence
  Description of Artificial Sequence: Synthetic oligonucleotide
  Target: SCN9A; (-) strand; PAM type: YTN; PAM sequence: TTA
ctattgcctttttgttaaat

SEQ ID NO: 60885 - DNA, 20 bp, Artificial Sequence
  Description of Artificial Sequence: Synthetic oligonucleotide
  Target: SCN9A; (-) strand; PAM type: YTN; PAM sequence: CTT
actattgcctttttgttaaa

SEQ ID NO: 60886 - DNA, 20 bp, Artificial Sequence
  Description of Artificial Sequence: Synthetic oligonucleotide
  Target: SCN9A; (-) strand; PAM type: YTN; PAM sequence: TTG
gtaggtaatgacttactatt

SEQ ID NO: 60887 - DNA, 20 bp, Artificial Sequence
  Description of Artificial Sequence: Synthetic oligonucleotide
  Target: SCN9A; (-) strand; PAM type: YTN; PAM sequence: TTG
aaataatcattggtaggtaa

SEQ ID NO: 60888 - DNA, 20 bp, Artificial Sequence
  Description of Artificial Sequence: Synthetic oligonucleotide
  Target: SCN9A; (-) strand; PAM type: YTN; PAM sequence: TTT
gaaataatcattggtaggta

SEQ ID NO: 60889 - DNA, 20 bp, Artificial Sequence
  Description of Artificial Sequence: Synthetic oligonucleotide
  Target: SCN9A; (-) strand; PAM type: YTN; PAM sequence: TTG
tatttgaaataatcattggt

SEQ ID NO: 60890 - DNA, 20 bp, Artificial Sequence
  Description of Artificial Sequence: Synthetic oligonucleotide
  Target: SCN9A; (-) strand; PAM type: YTN; PAM sequence: TTT
gtatttgaaataatcattgg

SEQ ID NO: 60891 - DNA, 20 bp, Artificial Sequence
  Description of Artificial Sequence: Synthetic oligonucleotide
  Target: SCN9A; (-) strand; PAM type: YTN; PAM sequence: TTA
atccatttgtatttgaaata

SEQ ID NO: 60892 - DNA, 20 bp, Artificial Sequence
  Description of Artificial Sequence: Synthetic oligonucleotide
  Target: SCN9A; (-) strand; PAM type: YTN; PAM sequence: TTT
aatccatttgtatttgaaat

SEQ ID NO: 60893 - DNA, 20 bp, Artificial Sequence
  Description of Artificial Sequence: Synthetic oligonucleotide
  Target: SCN9A; (-) strand; PAM type: YTN; PAM sequence: TTG
ggaagtttaatccatttgta

SEQ ID NO: 60894 - DNA, 20 bp, Artificial Sequence
  Description of Artificial Sequence: Synthetic oligonucleotide
  Target: SCN9A; (-) strand; PAM type: YTN; PAM sequence: TTG
attgggaagtttaatccatt

SEQ ID NO: 60895 - DNA, 20 bp, Artificial Sequence
  Description of Artificial Sequence: Synthetic oligonucleotide
  Target: SCN9A; (-) strand; PAM type: YTN; PAM sequence: TTT
gattgggaagtttaatccat

SEQ ID NO: 60896 - DNA, 20 bp, Artificial Sequence
  Description of Artificial Sequence: Synthetic oligonucleotide
  Target: SCN9A; (-) strand; PAM type: YTN; PAM sequence: TTT
tgattgggaagtttaatcca

SEQ ID NO: 60897 - DNA, 20 bp, Artificial Sequence
  Description of Artificial Sequence: Synthetic oligonucleotide
  Target: SCN9A; (-) strand; PAM type: YTN; PAM sequence: CTT
ttgattgggaagtttaatcc

SEQ ID NO: 60898 - DNA, 20 bp, Artificial Sequence
  Description of Artificial Sequence: Synthetic oligonucleotide
  Target: SCN9A; (-) strand; PAM type: YTN; PAM sequence: TTG
taggtcttttgattgggaag

SEQ ID NO: 60899 - DNA, 20 bp, Artificial Sequence
  Description of Artificial Sequence: Synthetic oligonucleotide
  Target: SCN9A; (-) strand; PAM type: YTN; PAM sequence: CTA
tgcagccattgtaggtcttt

SEQ ID NO: 60900 - DNA, 20 bp, Artificial Sequence
  Description of Artificial Sequence: Synthetic oligonucleotide
  Target: SCN9A; (-) strand; PAM type: YTN; PAM sequence: TTC
ataaatctatgcagccattg

SEQ ID NO: 60901 - DNA, 20 bp, Artificial Sequence
  Description of Artificial Sequence: Synthetic oligonucleotide
  Target: SCN9A; (-) strand; PAM type: YTN; PAM sequence: TTT
cataaatctatgcagccatt

SEQ ID NO: 60902 - DNA, 20 bp, Artificial Sequence
  Description of Artificial Sequence: Synthetic oligonucleotide
  Target: SCN9A; (-) strand; PAM type: YTN; PAM sequence: TTT
tcataaatctatgcagccat

SEQ ID NO: 60903 - DNA, 20 bp, Artificial Sequence
  Description of Artificial Sequence: Synthetic oligonucleotide
  Target: SCN9A; (-) strand; PAM type: YTN; PAM sequence: TTG
ttttcataaatctatgcagc

SEQ ID NO: 60904 - DNA, 20 bp, Artificial Sequence
  Description of Artificial Sequence: Synthetic oligonucleotide
  Target: SCN9A; (-) strand; PAM type: YTN; PAM sequence: CTT
gttttcataaatctatgcag

SEQ ID NO: 60905 - DNA, 20 bp, Artificial Sequence
  Description of Artificial Sequence: Synthetic oligonucleotide
  Target: SCN9A; (-) strand; PAM type: YTN; PAM sequence: CTG
gatcttgttttcataaatct

SEQ ID NO: 60906 - DNA, 20 bp, Artificial Sequence
  Description of Artificial Sequence: Synthetic oligonucleotide
  Target: SCN9A; (-) strand; PAM type: YTN; PAM sequence: CTG
gagacagcatataactggat

SEQ ID NO: 60907 - DNA, 20 bp, Artificial Sequence
  Description of Artificial Sequence: Synthetic oligonucleotide
  Target: SCN9A; (-) strand; PAM type: YTN; PAM sequence: CTG
aaacgagtatctggagacag

SEQ ID NO: 60908 - DNA, 20 bp, Artificial Sequence
  Description of Artificial Sequence: Synthetic oligonucleotide
  Target: SCN9A; (-) strand; PAM type: YTN; PAM sequence: TTA
aatctgaaacgagtatctgg

SEQ ID NO: 60909 - DNA, 20 bp, Artificial Sequence
  Description of Artificial Sequence: Synthetic oligonucleotide
  Target: SCN9A; (-) strand; PAM type: YTN; PAM sequence: CTT
aaatctgaaacgagtatctg

SEQ ID NO: 60910 - DNA, 20 bp, Artificial Sequence
  Description of Artificial Sequence: Synthetic oligonucleotide
  Target: SCN9A; (-) strand; PAM type: YTN; PAM sequence: TTC
ttaaatctgaaacgagtatc

SEQ ID NO: 60911 - DNA, 20 bp, Artificial Sequence
  Description of Artificial Sequence: Synthetic oligonucleotide
  Target: SCN9A; (-) strand; PAM type: YTN; PAM sequence: TTT
cttaaatctgaaacgagtat

SEQ ID NO: 60912 - DNA, 20 bp, Artificial Sequence
  Description of Artificial Sequence: Synthetic oligonucleotide
  Target: SCN9A; (-) strand; PAM type: YTN; PAM sequence: TTT
tcttaaatctgaaacgagta

SEQ ID NO: 60913 - DNA, 20 bp, Artificial Sequence
  Description of Artificial Sequence: Synthetic oligonucleotide
  Target: SCN9A; (-) strand; PAM type: YTN; PAM sequence: CTA
tgttttcttaaatctgaaac

SEQ ID NO: 60914 - DNA, 20 bp, Artificial Sequence
  Description of Artificial Sequence: Synthetic oligonucleotide
  Target: SCN9A; (-) strand; PAM type: YTN; PAM sequence: TTC
aaactatgttttcttaaatc

SEQ ID NO: 60915 - DNA, 20 bp, Artificial Sequence
  Description of Artificial Sequence: Synthetic oligonucleotide
  Target: SCN9A; (-) strand; PAM type: YTN; PAM sequence: TTT
caaactatgttttcttaaat

SEQ ID NO: 60916 - DNA, 20 bp, Artificial Sequence
  Description of Artificial Sequence: Synthetic oligonucleotide
  Target: SCN9A; (-) strand; PAM type: YTN; PAM sequence: CTT
tcaaactatgttttcttaaa

SEQ ID NO: 60917 - DNA, 20 bp, Artificial Sequence
  Description of Artificial Sequence: Synthetic oligonucleotide
  Target: SCN9A; (-) strand; PAM type: YTN; PAM sequence: TTA
actttcaaactatgttttct

SEQ ID NO: 60918 - DNA, 20 bp, Artificial Sequence
  Description of Artificial Sequence: Synthetic oligonucleotide
  Target: SCN9A; (-) strand; PAM type: YTN; PAM sequence: TTA
tcaattaactttcaaactat

SEQ ID NO: 60919 - DNA, 20 bp, Artificial Sequence
  Description of Artificial Sequence: Synthetic oligonucleotide
  Target: SCN9A; (-) strand; PAM type: YTN; PAM sequence: TTT
atcaattaactttcaaacta

SEQ ID NO: 60920 - DNA, 20 bp, Artificial Sequence
  Description of Artificial Sequence: Synthetic oligonucleotide
  Target: SCN9A; (-) strand; PAM type: YTN; PAM sequence: TTT
tatcaattaactttcaaact

SEQ ID NO: 60921 - DNA, 20 bp, Artificial Sequence
  Description of Artificial Sequence: Synthetic oligonucleotide
  Target: SCN9A; (-) strand; PAM type: YTN; PAM sequence: TTT
ttatcaattaactttcaaac

SEQ ID NO: 60922 - DNA, 20 bp, Artificial Sequence
  Description of Artificial Sequence: Synthetic oligonucleotide
  Target: SCN9A; (-) strand; PAM type: YTN; PAM sequence: TTT
tttatcaattaactttcaaa

SEQ ID NO: 60923 - DNA, 20 bp, Artificial Sequence
  Description of Artificial Sequence: Synthetic oligonucleotide
  Target: SCN9A; (-) strand; PAM type: YTN; PAM sequence: CTT
ttttatcaattaactttcaa

SEQ ID NO: 60924 - DNA, 20 bp, Artificial Sequence
  Description of Artificial Sequence: Synthetic oligonucleotide
  Target: SCN9A; (-) strand; PAM type: YTN; PAM sequence: CTA
caaaatgtatcttttttatc

SEQ ID NO: 60925 - DNA, 20 bp, Artificial Sequence
  Description of Artificial Sequence: Synthetic oligonucleotide
  Target: SCN9A; (-) strand; PAM type: YTN; PAM sequence: TTC
tacaaaatgtatctttttta

SEQ ID NO: 60926 - DNA, 20 bp, Artificial Sequence
  Description of Artificial Sequence: Synthetic oligonucleotide
  Target: SCN9A; (-) strand; PAM type: YTN; PAM sequence: TTT
ctacaaaatgtatctttttt

SEQ ID NO: 60927 - DNA, 20 bp, Artificial Sequence
  Description of Artificial Sequence: Synthetic oligonucleotide
  Target: SCN9A; (-) strand; PAM type: YTN; PAM sequence: TTA
ccatttctacaaaatgtatc

SEQ ID NO: 60928 - DNA, 20 bp, Artificial Sequence
  Description of Artificial Sequence: Synthetic oligonucleotide
  Target: SCN9A; (-) strand; PAM type: YTN; PAM sequence: TTG
gttaccatttctacaaaatg

SEQ ID NO: 60929 - DNA, 20 bp, Artificial Sequence
  Description of Artificial Sequence: Synthetic oligonucleotide
  Target: SCN9A; (-) strand; PAM type: YTN; PAM sequence: TTT
ggttaccatttctacaaaat

SEQ ID NO: 60930 - DNA, 20 bp, Artificial Sequence
  Description of Artificial Sequence: Synthetic oligonucleotide
  Target: SCN9A; (-) strand; PAM type: YTN; PAM sequence: TTT
tggttaccatttctacaaaa

SEQ ID NO: 60931 - DNA, 20 bp, Artificial Sequence
  Description of Artificial Sequence: Synthetic oligonucleotide
  Target: SCN9A; (-) strand; PAM type: YTN; PAM sequence: CTT
ttggttaccatttctacaaa

SEQ ID NO: 60932 - DNA, 20 bp, Artificial Sequence
  Description of Artificial Sequence: Synthetic oligonucleotide
  Target: SCN9A; (-) strand; PAM type: YTN; PAM sequence: CTC
ttttggttaccatttctaca

SEQ ID NO: 60933 - DNA, 20 bp, Artificial Sequence
  Description of Artificial Sequence: Synthetic oligonucleotide
  Target: SCN9A; (-) strand; PAM type: YTN; PAM sequence: CTC
tcttttggttaccatttcta

SEQ ID NO: 60934 - DNA, 20 bp, Artificial Sequence
  Description of Artificial Sequence: Synthetic oligonucleotide
  Target: SCN9A; (-) strand; PAM type: YTN; PAM sequence: TTG
ctctcttttggttaccattt

SEQ ID NO: 60935 - DNA, 20 bp, Artificial Sequence
  Description of Artificial Sequence: Synthetic oligonucleotide
  Target: SCN9A; (-) strand; PAM type: YTN; PAM sequence: CTG
tatagccccattgctctctt

SEQ ID NO: 60936 - DNA, 20 bp, Artificial Sequence
  Description of Artificial Sequence: Synthetic oligonucleotide
  Target: SCN9A; (-) strand; PAM type: YTN; PAM sequence: CTG
aaggacgactgtatagcccc

SEQ ID NO: 60937 - DNA, 20 bp, Artificial Sequence
  Description of Artificial Sequence: Synthetic oligonucleotide
  Target: SCN9A; (-) strand; PAM type: YTN; PAM sequence: CTG
tagatactgaaggacgactg

SEQ ID NO: 60938 - DNA, 20 bp, Artificial Sequence
  Description of Artificial Sequence: Synthetic oligonucleotide
  Target: SCN9A; (-) strand; PAM type: YTN; PAM sequence: CTG
aaaccatgaccctgtagata

SEQ ID NO: 60939 - DNA, 20 bp, Artificial Sequence
  Description of Artificial Sequence: Synthetic oligonucleotide
  Target: SCN9A; (-) strand; PAM type: YTN; PAM sequence: TTC
tgaaaccatgaccctgtaga

SEQ ID NO: 60940 - DNA, 20 bp, Artificial Sequence
  Description of Artificial Sequence: Synthetic oligonucleotide
  Target: SCN9A; (-) strand; PAM type: YTN; PAM sequence: TTG
gggttctgaaaccatgaccc

SEQ ID NO: 60941 - DNA, 20 bp, Artificial Sequence
  Description of Artificial Sequence: Synthetic oligonucleotide
  Target: SCN9A; (-) strand; PAM type: YTN; PAM sequence: CTT
ggggttctgaaaccatgacc

SEQ ID NO: 60942 - DNA, 20 bp, Artificial Sequence
  Description of Artificial Sequence: Synthetic oligonucleotide
  Target: SCN9A; (-) strand; PAM type: YTN; PAM sequence: TTG
gtatcccttggggttctgaa

SEQ ID NO: 60943 - DNA, 20 bp, Artificial Sequence
  Description of Artificial Sequence: Synthetic oligonucleotide
  Target: SCN9A; (-) strand; PAM type: YTN; PAM sequence: TTT
ggtatcccttggggttctga

SEQ ID NO: 60944 - DNA, 20 bp, Artificial Sequence
  Description of Artificial Sequence: Synthetic oligonucleotide
  Target: SCN9A; (-) strand; PAM type: YTN; PAM sequence: TTT
tggtatcccttggggttctg

SEQ ID NO: 60945 - DNA, 20 bp, Artificial Sequence
  Description of Artificial Sequence: Synthetic oligonucleotide
  Target: SCN9A; (-) strand; PAM type: YTN; PAM sequence: CTC
aattttggtatcccttgggg

SEQ ID NO: 60946 - DNA, 20 bp, Artificial Sequence
  Description of Artificial Sequence: Synthetic oligonucleotide
  Target: SCN9A; (-) strand; PAM type: YTN; PAM sequence: TTA
agcatcctcaattttggtat

SEQ ID NO: 60947 - DNA, 20 bp, Artificial Sequence
  Description of Artificial Sequence: Synthetic oligonucleotide
  Target: SCN9A; (-) strand; PAM type: YTN; PAM sequence: CTT
aagcatcctcaattttggta

SEQ ID NO: 60948 - DNA, 20 bp, Artificial Sequence
  Description of Artificial Sequence: Synthetic oligonucleotide
  Target: SCN9A; (-) strand; PAM type: YTN; PAM sequence: CTG
tgggacttaagcatcctcaa

SEQ ID NO: 60949 - DNA, 20 bp, Artificial Sequence
  Description of Artificial Sequence: Synthetic oligonucleotide
  Target: SCN9A; (-) strand; PAM type: YTN; PAM sequence: CTG
actgtgggacttaagcatcc

SEQ ID NO: 60950 - DNA, 20 bp, Artificial Sequence
  Description of Artificial Sequence: Synthetic oligonucleotide
  Target: SCN9A; (-) strand; PAM type: YTN; PAM sequence: CTG
caagactgactgtgggactt

SEQ ID NO: 60951 - DNA, 20 bp, Artificial Sequence
  Description of Artificial Sequence: Synthetic oligonucleotide
  Target: SCN9A; (-) strand; PAM type: YTN; PAM sequence: TTA
tccacaggtcctgcaagact

SEQ ID NO: 60952 - DNA, 20 bp, Artificial Sequence
  Description of Artificial Sequence: Synthetic oligonucleotide
  Target: SCN9A; (-) strand; PAM type: YTN; PAM sequence: TTT
atccacaggtcctgcaagac

SEQ ID NO: 60953 - DNA, 20 bp, Artificial Sequence
  Description of Artificial Sequence: Synthetic oligonucleotide
  Target: SCN9A; (-) strand; PAM type: YTN; PAM sequence: TTT
tatccacaggtcctgcaaga

SEQ ID NO: 60954 - DNA, 20 bp, Artificial Sequence
  Description of Artificial Sequence: Synthetic oligonucleotide
  Target: SCN9A; (-) strand; PAM type: YTN; PAM sequence: TTT
ttatccacaggtcctgcaag

SEQ ID NO: 60955 - DNA, 20 bp, Artificial Sequence
  Description of Artificial Sequence: Synthetic oligonucleotide
  Target: SCN9A; (-) strand; PAM type: YTN; PAM sequence: TTT
tttatccacaggtcctgcaa

SEQ ID NO: 60956 - DNA, 20 bp, Artificial Sequence
  Description of Artificial Sequence: Synthetic oligonucleotide
  Target: SCN9A; (-) strand; PAM type: YTN; PAM sequence: TTT
ttttatccacaggtcctgca

SEQ ID NO: 60957 - DNA, 20 bp, Artificial Sequence
  Description of Artificial Sequence: Synthetic oligonucleotide
  Target: SCN9A; (-) strand; PAM type: YTN; PAM sequence: TTC
atggaatgtgaaatccacag

SEQ ID NO: 60958 - DNA, 20 bp, Artificial Sequence
  Description of Artificial Sequence: Synthetic oligonucleotide
  Target: SCN9A; (-) strand; PAM type: YTN; PAM sequence: CTG
tattcatggaatgtgaaatc

SEQ ID NO: 60959 - DNA, 20 bp, Artificial Sequence
  Description of Artificial Sequence: Synthetic oligonucleotide
  Target: SCN9A; (-) strand; PAM type: YTN; PAM sequence: TTG
aaaacactgtattcatggaa

SEQ ID NO: 60960 - DNA, 20 bp, Artificial Sequence
  Description of Artificial Sequence: Synthetic oligonucleotide
  Target: SCN9A; (-) strand; PAM type: YTN; PAM sequence: CTG
attgaaaacactgtattcat

SEQ ID NO: 60961 - DNA, 20 bp, Artificial Sequence
  Description of Artificial Sequence: Synthetic oligonucleotide
  Target: SCN9A; (-) strand; PAM type: YTN; PAM sequence: TTC
agccaatgctgattgaaaac

SEQ ID NO: 60962 - DNA, 20 bp, Artificial Sequence
  Description of Artificial Sequence: Synthetic oligonucleotide
  Target: SCN9A; (-) strand; PAM type: YTN; PAM sequence: CTG
tagattcagccaatgctgat

SEQ ID NO: 60963 - DNA, 20 bp, Artificial Sequence
  Description of Artificial Sequence: Synthetic oligonucleotide
  Target: SCN9A; (-) strand; PAM type: YTN; PAM sequence: TTA
catctgtagattcagccaat

SEQ ID NO: 60964 - DNA, 20 bp, Artificial Sequence
  Description of Artificial Sequence: Synthetic oligonucleotide
  Target: SCN9A; (-) strand; PAM type: YTN; PAM sequence: TTT
acatctgtagattcagccaa

SEQ ID NO: 60965 - DNA, 20 bp, Artificial Sequence
  Description of Artificial Sequence: Synthetic oligonucleotide
  Target: SCN9A; (-) strand; PAM type: YTN; PAM sequence: TTT
tacatctgtagattcagcca

SEQ ID NO: 60966 - DNA, 20 bp, Artificial Sequence
  Description of Artificial Sequence: Synthetic oligonucleotide
  Target: SCN9A; (-) strand; PAM type: YTN; PAM sequence: CTG
tgggttttacatctgtagat

SEQ ID NO: 60967 - DNA, 20 bp, Artificial Sequence
  Description of Artificial Sequence: Synthetic oligonucleotide
  Target: SCN9A; (-) strand; PAM type: YTN; PAM sequence: CTG
tgtctgtgggttttacatct

SEQ ID NO: 60968 - DNA, 20 bp, Artificial Sequence
  Description of Artificial Sequence: Synthetic oligonucleotide
  Target: SCN9A; (-) strand; PAM type: YTN; PAM sequence: CTC
tgtgtctgtgggttttacat

SEQ ID NO: 60969 - DNA, 20 bp, Artificial Sequence
  Description of Artificial Sequence: Synthetic oligonucleotide
  Target: SCN9A; (-) strand; PAM type: YTN; PAM sequence: TTA
cagggtgtcctctgtgtctg

SEQ ID NO: 60970 - DNA, 20 bp, Artificial Sequence
  Description of Artificial Sequence: Synthetic oligonucleotide
  Target: SCN9A; (-) strand; PAM type: YTN; PAM sequence: CTG
atataattacagggtgtcct

SEQ ID NO: 60971 - DNA, 20 bp, Artificial Sequence
  Description of Artificial Sequence: Synthetic oligonucleotide
  Target: SCN9A; (-) strand; PAM type: YTN; PAM sequence: TTG
gctgatataattacagggtg

SEQ ID NO: 60972 - DNA, 20 bp, Artificial Sequence
  Description of Artificial Sequence: Synthetic oligonucleotide
  Target: SCN9A; (-) strand; PAM type: YTN; PAM sequence: TTT
ggctgatataattacagggt

SEQ ID NO: 60973 - DNA, 20 bp, Artificial Sequence
  Description of Artificial Sequence: Synthetic oligonucleotide
  Target: SCN9A; (-) strand; PAM type: YTN; PAM sequence: TTT
tggctgatataattacaggg

SEQ ID NO: 60974 - DNA, 20 bp, Artificial Sequence
  Description of Artificial Sequence: Synthetic oligonucleotide
  Target: SCN9A; (-) strand; PAM type: YTN; PAM sequence: CTA
ttttggctgatataattaca

SEQ ID NO: 60975 - DNA, 20 bp, Artificial Sequence
  Description of Artificial Sequence: Synthetic oligonucleotide
  Target: SCN9A; (-) strand; PAM type: YTN; PAM sequence: TTA
aaatctattttggctgatat

SEQ ID NO: 60976 - DNA, 20 bp, Artificial Sequence
  Description of Artificial Sequence: Synthetic oligonucleotide
  Target: SCN9A; (-) strand; PAM type: YTN; PAM sequence: TTT
aaaatctattttggctgata

SEQ ID NO: 60977 - DNA, 20 bp, Artificial Sequence
  Description of Artificial Sequence: Synthetic oligonucleotide
  Target: SCN9A; (-) strand; PAM type: YTN; PAM sequence: TTA
tttaaaatctattttggctg

SEQ ID NO: 60978 - DNA, 20 bp, Artificial Sequence
  Description of Artificial Sequence: Synthetic oligonucleotide
  Target: SCN9A; (-) strand; PAM type: YTN; PAM sequence: TTT
atttaaaatctattttggct

SEQ ID NO: 60979 - DNA, 20 bp, Artificial Sequence
  Description of Artificial Sequence: Synthetic oligonucleotide
  Target: SCN9A; (-) strand; PAM type: YTN; PAM sequence: TTT
tatttaaaatctattttggc

SEQ ID NO: 60980 - DNA, 20 bp, Artificial Sequence
  Description of Artificial Sequence: Synthetic oligonucleotide
  Target: SCN9A; (-) strand; PAM type: YTN; PAM sequence: TTT
ttatttaaaatctattttgg

SEQ ID NO: 60981 - DNA, 20 bp, Artificial Sequence
  Description of Artificial Sequence: Synthetic oligonucleotide
  Target: SCN9A; (-) strand; PAM type: YTN; PAM sequence: TTT
tttatttaaaatctattttg

SEQ ID NO: 60982 - DNA, 20 bp, Artificial Sequence
  Description of Artificial Sequence: Synthetic oligonucleotide
  Target: SCN9A; (-) strand; PAM type: YTN; PAM sequence: TTG
tgacagttttttatttaaaa

SEQ ID NO: 60983 - DNA, 20 bp, Artificial Sequence
  Description of Artificial Sequence: Synthetic oligonucleotide
  Target: SCN9A; (-) strand; PAM type: YTN; PAM sequence: CTT
gtgacagttttttatttaaa

SEQ ID NO: 60984 - DNA, 20 bp, Artificial Sequence
  Description of Artificial Sequence: Synthetic oligonucleotide
  Target: SCN9A; (-) strand; PAM type: YTN; PAM sequence: CTC
ttgtgacagttttttattta

SEQ ID NO: 60985 - DNA, 20 bp, Artificial Sequence
  Description of Artificial Sequence: Synthetic oligonucleotide
  Target: SCN9A; (-) strand; PAM type: YTN; PAM sequence: TTG
tctcttgtgacagtttttta

SEQ ID NO: 60986 - DNA, 20 bp, Artificial Sequence
  Description of Artificial Sequence: Synthetic oligonucleotide
  Target: SCN9A; (-) strand; PAM type: YTN; PAM sequence: TTT
gtctcttgtgacagtttttt

SEQ ID NO: 60987 - DNA, 20 bp, Artificial Sequence
  Description of Artificial Sequence: Synthetic oligonucleotide
  Target: SCN9A; (-) strand; PAM type: YTN; PAM sequence: CTT
tgtctcttgtgacagttttt

SEQ ID NO: 60988 - DNA, 20 bp, Artificial Sequence
  Description of Artificial Sequence: Synthetic oligonucleotide
  Target: SCN9A; (-) strand; PAM type: YTN; PAM sequence: CTA
ctttgtctcttgtgacagtt

SEQ ID NO: 60989 - DNA, 20 bp, Artificial Sequence
  Description of Artificial Sequence: Synthetic oligonucleotide
  Target: SCN9A; (-) strand; PAM type: YTN; PAM sequence: TTA
tgacctactttgtctcttgt

SEQ ID NO: 60990 - DNA, 20 bp, Artificial Sequence
  Description of Artificial Sequence: Synthetic oligonucleotide
  Target: SCN9A; (-) strand; PAM type: YTN; PAM sequence: TTT
atgacctactttgtctcttg

SEQ ID NO: 60991 - DNA, 20 bp, Artificial Sequence
  Description of Artificial Sequence: Synthetic oligonucleotide
  Target: SCN9A; (-) strand; PAM type: YTN; PAM sequence: TTT
tatgacctactttgtctctt

SEQ ID NO: 60992 - DNA, 20 bp, Artificial Sequence
  Description of Artificial Sequence: Synthetic oligonucleotide
  Target: SCN9A; (-) strand; PAM type: YTN; PAM sequence: TTA
ttttatgacctactttgtct

SEQ ID NO: 60993 - DNA, 20 bp, Artificial Sequence
  Description of Artificial Sequence: Synthetic oligonucleotide
  Target: SCN9A; (-) strand; PAM type: YTN; PAM sequence: CTT
attttatgacctactttgtc

SEQ ID NO: 60994 - DNA, 20 bp, Artificial Sequence
  Description of Artificial Sequence: Synthetic oligonucleotide
  Target: SCN9A; (-) strand; PAM type: YTN; PAM sequence: TTA
tcttattttatgacctactt

SEQ ID NO: 60995 - DNA, 20 bp, Artificial Sequence
  Description of Artificial Sequence: Synthetic oligonucleotide
  Target: SCN9A; (-) strand; PAM type: YTN; PAM sequence: TTT
atcttattttatgacctact

SEQ ID NO: 60996 - DNA, 20 bp, Artificial Sequence
  Description of Artificial Sequence: Synthetic oligonucleotide
  Target: SCN9A; (-) strand; PAM type: YTN; PAM sequence: TTT
tatcttattttatgacctac

SEQ ID NO: 60997 - DNA, 20 bp, Artificial Sequence
  Description of Artificial Sequence: Synthetic oligonucleotide
  Target: SCN9A; (-) strand; PAM type: YTN; PAM sequence: CTT
ttatcttattttatgaccta

SEQ ID NO: 60998 - DNA, 20 bp, Artificial Sequence
  Description of Artificial Sequence: Synthetic oligonucleotide
  Target: SCN9A; (-) strand; PAM type: YTN; PAM sequence: CTC
ttttatcttattttatgacc

SEQ ID NO: 60999 - DNA, 20 bp, Artificial Sequence
  Description of Artificial Sequence: Synthetic oligonucleotide
  Target: SCN9A; (-) strand; PAM type: YTN; PAM sequence: TTA
actcttttatcttattttat

SEQ ID NO: 61000 - DNA, 20 bp, Artificial Sequence
  Description of Artificial Sequence: Synthetic oligonucleotide
  Target: SCN9A; (-) strand; PAM type: YTN; PAM sequence: TTG
atgaattaactcttttatct

SEQ ID NO: 61001 - DNA, 20 bp, Artificial Sequence
  Description of Artificial Sequence: Synthetic oligonucleotide
  Target: SCN9A; (-) strand; PAM type: YTN; PAM sequence: CTT
gatgaattaactcttttatc

SEQ ID NO: 61002 - DNA, 20 bp, Artificial Sequence
  Description of Artificial Sequence: Synthetic oligonucleotide
  Target: SCN9A; (-) strand; PAM type: YTN; PAM sequence: TTC
ttgatgaattaactctttta

SEQ ID NO: 61003 - DNA, 20 bp, Artificial Sequence
  Description of Artificial Sequence: Synthetic oligonucleotide
  Target: SCN9A; (-) strand; PAM type: YTN; PAM sequence: CTT
cttgatgaattaactctttt

SEQ ID NO: 61004 - DNA, 20 bp, Artificial Sequence
  Description of Artificial Sequence: Synthetic oligonucleotide
  Target: SCN9A; (-) strand; PAM type: YTN; PAM sequence: TTA
tatcttcttgatgaattaac

SEQ ID NO: 61005 - DNA, 20 bp, Artificial Sequence
  Description of Artificial Sequence: Synthetic oligonucleotide
  Target: SCN9A; (-) strand; PAM type: YTN; PAM sequence: TTG
ttatatcttcttgatgaatt

SEQ ID NO: 61006 - DNA, 20 bp, Artificial Sequence
  Description of Artificial Sequence: Synthetic oligonucleotide
  Target: SCN9A; (-) strand; PAM type: YTN; PAM sequence: TTA
taattgttatatcttcttga

SEQ ID NO: 61007 - DNA, 20 bp, Artificial Sequence
  Description of Artificial Sequence: Synthetic oligonucleotide
  Target: SCN9A; (-) strand; PAM type: YTN; PAM sequence: TTT
ataattgttatatcttcttg

SEQ ID NO: 61008 - DNA, 20 bp, Artificial Sequence
  Description of Artificial Sequence: Synthetic oligonucleotide
  Target: SCN9A; (-) strand; PAM type: YTN; PAM sequence: TTC
acatatatttataattgtta

SEQ ID NO: 61009 - DNA, 20 bp, Artificial Sequence
  Description of Artificial Sequence: Synthetic oligonucleotide
  Target: SCN9A; (-) strand; PAM type: YTN; PAM sequence: TTG
atgatggattcacatatatt

SEQ ID NO: 61010 - DNA, 20 bp, Artificial Sequence
  Description of Artificial Sequence: Synthetic oligonucleotide
  Target: SCN9A; (-) strand; PAM type: YTN; PAM sequence: TTT
gatgatggattcacatatat

SEQ ID NO: 61011 - DNA, 20 bp, Artificial Sequence
  Description of Artificial Sequence: Synthetic oligonucleotide
  Target: SCN9A; (-) strand; PAM type: YTN; PAM sequence: CTT
tgatgatggattcacatata

SEQ ID NO: 61012 - DNA, 20 bp, Artificial Sequence
  Description of Artificial Sequence: Synthetic oligonucleotide
  Target: SCN9A; (-) strand; PAM type: YTN; PAM sequence: TTA
catgctttgatgatggattc

SEQ ID NO: 61013 - DNA, 20 bp, Artificial Sequence
  Description of Artificial Sequence: Synthetic oligonucleotide
  Target: SCN9A; (-) strand; PAM type: YTN; PAM sequence: TTT
acatgctttgatgatggatt

SEQ ID NO: 61014 - DNA, 20 bp, Artificial Sequence
  Description of Artificial Sequence: Synthetic oligonucleotide
  Target: SCN9A; (-) strand; PAM type: YTN; PAM sequence: TTA
cgtatttacatgctttgatg

SEQ ID NO: 61015 - DNA, 20 bp, Artificial Sequence
  Description of Artificial Sequence: Synthetic oligonucleotide
  Target: SCN9A; (-) strand; PAM type: YTN; PAM sequence: TTT
acgtatttacatgctttgat

SEQ ID NO: 61016 - DNA, 20 bp, Artificial Sequence
  Description of Artificial Sequence: Synthetic oligonucleotide
  Target: SCN9A; (-) strand; PAM type: YTN; PAM sequence: CTT
tacgtatttacatgctttga

SEQ ID NO: 61017 - DNA, 20 bp, Artificial Sequence
  Description of Artificial Sequence: Synthetic oligonucleotide
  Target: SCN9A; (-) strand; PAM type: YTN; PAM sequence: TTG
ctttacgtatttacatgctt

SEQ ID NO: 61018 - DNA, 20 bp, Artificial Sequence
  Description of Artificial Sequence: Synthetic oligonucleotide
  Target: SCN9A; (-) strand; PAM type: YTN; PAM sequence: CTG
tcaatgattgctttacgtat

SEQ ID NO: 61019 - DNA, 20 bp, Artificial Sequence
  Description of Artificial Sequence: Synthetic oligonucleotide
  Target: SCN9A; (-) strand; PAM type: YTN; PAM sequence: TTC
agatctgtcaatgattgctt

SEQ ID NO: 61020 - DNA, 20 bp, Artificial Sequence
  Description of Artificial Sequence: Synthetic oligonucleotide
  Target: SCN9A; (-) strand; PAM type: YTN; PAM sequence: CTT
cagatctgtcaatgattgct

SEQ ID NO: 61021 - DNA, 20 bp, Artificial Sequence
  Description of Artificial Sequence: Synthetic oligonucleotide
  Target: SCN9A; (-) strand; PAM type: YTN; PAM sequence: TTA
tcccttcagatctgtcaatg

SEQ ID NO: 61022 - DNA, 20 bp, Artificial Sequence
  Description of Artificial Sequence: Synthetic oligonucleotide
  Target: SCN9A; (-) strand; PAM type: YTN; PAM sequence: TTT
atcccttcagatctgtcaat

SEQ ID NO: 61023 - DNA, 20 bp, Artificial Sequence
  Description of Artificial Sequence: Synthetic oligonucleotide
  Target: SCN9A; (-) strand; PAM type: YTN; PAM sequence: CTG
catgtttatcccttcagatc

SEQ ID NO: 61024 - DNA, 20 bp, Artificial Sequence
  Description of Artificial Sequence: Synthetic oligonucleotide
  Target: SCN9A; (-) strand; PAM type: YTN; PAM sequence: TTG
ctgcatgtttatcccttcag

SEQ ID NO: 61025 - DNA, 20 bp, Artificial Sequence
  Description of Artificial Sequence: Synthetic oligonucleotide
  Target: SCN9A; (-) strand; PAM type: YTN; PAM sequence: TTA
tggtgttgctgcatgtttat

SEQ ID NO: 61026 - DNA, 20 bp, Artificial Sequence
  Description of Artificial Sequence: Synthetic oligonucleotide
  Target: SCN9A; (-) strand; PAM type: YTN; PAM sequence: CTG
ttatggtgttgctgcatgtt

SEQ ID NO: 61027 - DNA, 20 bp, Artificial Sequence
  Description of Artificial Sequence: Synthetic oligonucleotide
  Target: SCN9A; (-) strand; PAM type: YTN; PAM sequence: CTA
ctgttatggtgttgctgcat

SEQ ID NO: 61028 - DNA, 20 bp, Artificial Sequence
  Description of Artificial Sequence: Synthetic oligonucleotide
  Target: SCN9A; (-) strand; PAM type: YTN; PAM sequence: TTG
atgtatcctactgttatggt

SEQ ID NO: 61029 - DNA, 20 bp, Artificial Sequence
  Description of Artificial Sequence: Synthetic oligonucleotide
  Target: SCN9A; (-) strand; PAM type: YTN; PAM sequence: TTG
caagtcgggtattgatgtat

SEQ ID NO: 61030 - DNA, 20 bp, Artificial Sequence
  Description of Artificial Sequence: Synthetic oligonucleotide
  Target: SCN9A; (-) strand; PAM type: YTN; PAM sequence: TTA
ttgcaagtcgggtattgatg

SEQ ID NO: 61031 - DNA, 20 bp, Artificial Sequence
  Description of Artificial Sequence: Synthetic oligonucleotide
  Target: SCN9A; (-) strand; PAM type: YTN; PAM sequence: TTC
attattgcaagtcgggtatt

SEQ ID NO: 61032 - DNA, 20 bp, Artificial Sequence
  Description of Artificial Sequence: Synthetic oligonucleotide
  Target: SCN9A; (-) strand; PAM type: YTN; PAM sequence: CTG
ttcattattgcaagtcgggt

SEQ ID NO: 61033 - DNA, 20 bp, Artificial Sequence
  Description of Artificial Sequence: Synthetic oligonucleotide
  Target: SCN9A; (-) strand; PAM type: YTN; PAM sequence: TTC
tgttcattattgcaagtcgg

SEQ ID NO: 61034 - DNA, 20 bp, Artificial Sequence
  Description of Artificial Sequence: Synthetic oligonucleotide
  Target: SCN9A; (-) strand; PAM type: YTN; PAM sequence: CTG
ttctgttcattattgcaagt

SEQ ID NO: 61035 - DNA, 20 bp, Artificial Sequence
  Description of Artificial Sequence: Synthetic oligonucleotide
  Target: SCN9A; (-) strand; PAM type: YTN; PAM sequence: CTG
gctgttctgttcattattgc

SEQ ID NO: 61036 - DNA, 20 bp, Artificial Sequence
  Description of Artificial Sequence: Synthetic oligonucleotide
  Target: SCN9A; (-) strand; PAM type: YTN; PAM sequence: TTC
catatctggctgttctgttc

SEQ ID NO: 61037 - DNA, 20 bp, Artificial Sequence
  Description of Artificial Sequence: Synthetic oligonucleotide
  Target: SCN9A; (-) strand; PAM type: YTN; PAM sequence: TTA
tagattccatatctggctgt

SEQ ID NO: 61038 - DNA, 20 bp, Artificial Sequence
  Description of Artificial Sequence: Synthetic oligonucleotide
  Target: SCN9A; (-) strand; PAM type: YTN; PAM sequence: TTT
atagattccatatctggctg

SEQ ID NO: 61039 - DNA, 20 bp, Artificial Sequence
  Description of Artificial Sequence: Synthetic oligonucleotide
  Target: SCN9A; (-) strand; PAM type: YTN; PAM sequence: TTG
tttatagattccatatctgg

SEQ ID NO: 61040 - DNA, 20 bp, Artificial Sequence
  Description of Artificial Sequence: Synthetic oligonucleotide
  Target: SCN9A; (-) strand; PAM type: YTN; PAM sequence: TTT
gtttatagattccatatctg

SEQ ID NO: 61041 - DNA, 20 bp, Artificial Sequence
  Description of Artificial Sequence: Synthetic oligonucleotide
  Target: SCN9A; (-) strand; PAM type: YTN; PAM sequence: TTC
aaatccacagtttgtttata

SEQ ID NO: 61042 - DNA, 20 bp, Artificial Sequence
  Description of Artificial Sequence: Synthetic oligonucleotide
  Target: SCN9A; (-) strand; PAM type: YTN; PAM sequence: TTG
ttcaaatccacagtttgttt

SEQ ID NO: 61043 - DNA, 20 bp, Artificial Sequence
  Description of Artificial Sequence: Synthetic oligonucleotide
  Target: SCN9A; (-) strand; PAM type: YTN; PAM sequence: CTA
tagcgttgttcaaatccaca

SEQ ID NO: 61044 - DNA, 20 bp, Artificial Sequence
  Description of Artificial Sequence: Synthetic oligonucleotide
  Target: SCN9A; (-) strand; PAM type: YTN; PAM sequence: TTG
gtctatagcgttgttcaaat

SEQ ID NO: 61045 - DNA, 20 bp, Artificial Sequence
  Description of Artificial Sequence: Synthetic oligonucleotide
  Target: SCN9A; (-) strand; PAM type: YTN; PAM sequence: TTT
ggtctatagcgttgttcaaa

SEQ ID NO: 61046 - DNA, 20 bp, Artificial Sequence
  Description of Artificial Sequence: Synthetic oligonucleotide
  Target: SCN9A; (-) strand; PAM type: YTN; PAM sequence: TTG
tgatccatttggtctatagc

SEQ ID NO: 61047 - DNA, 20 bp, Artificial Sequence
  Description of Artificial Sequence: Synthetic oligonucleotide
  Target: SCN9A; (-) strand; PAM type: YTN; PAM sequence: TTT
gtgatccatttggtctatag

SEQ ID NO: 61048 - DNA, 20 bp, Artificial Sequence
  Description of Artificial Sequence: Synthetic oligonucleotide
  Target: SCN9A; (-) strand; PAM type: YTN; PAM sequence: CTG
tgtgtttgtgatccatttgg

SEQ ID NO: 61049 - DNA, 20 bp, Artificial Sequence
  Description of Artificial Sequence: Synthetic oligonucleotide
  Target: SCN9A; (-) strand; PAM type: YTN; PAM sequence: TTC
tgtgtgtttgtgatccattt

SEQ ID NO: 61050 - DNA, 20 bp, Artificial Sequence
  Description of Artificial Sequence: Synthetic oligonucleotide
  Target: SCN9A; (-) strand; PAM type: YTN; PAM sequence: TTG
ggtagcatattctgtgtgtt

SEQ ID NO: 61051 - DNA, 20 bp, Artificial Sequence
  Description of Artificial Sequence: Synthetic oligonucleotide
  Target: SCN9A; (-) strand; PAM type: YTN; PAM sequence: CTG
ttgggtagcatattctgtgt

SEQ ID NO: 61052 - DNA, 20 bp, Artificial Sequence
  Description of Artificial Sequence: Synthetic oligonucleotide
  Target: SCN9A; (-) strand; PAM type: YTN; PAM sequence: TTA
agatgctgttgggtagcata

SEQ ID NO: 61053 - DNA, 20 bp, Artificial Sequence
  Description of Artificial Sequence: Synthetic oligonucleotide
  Target: SCN9A; (-) strand; PAM type: YTN; PAM sequence: TTG
aaaagatggtatattaagat

SEQ ID NO: 61054 - DNA, 20 bp, Artificial Sequence
  Description of Artificial Sequence: Synthetic oligonucleotide
  Target: SCN9A; (-) strand; PAM type: YTN; PAM sequence: CTT
gaaaagatggtatattaaga

SEQ ID NO: 61055 - DNA, 20 bp, Artificial Sequence
  Description of Artificial Sequence: Synthetic oligonucleotide
  Target: SCN9A; (-) strand; PAM type: YTN; PAM sequence: CTG
tgcgcacttgaaaagatggt

SEQ ID NO: 61056 - DNA, 20 bp, Artificial Sequence
  Description of Artificial Sequence: Synthetic oligonucleotide
  Target: SCN9A; (-) strand; PAM type: YTN; PAM sequence: TTC
tgtgcgcacttgaaaagatg

SEQ ID NO: 61057 - DNA, 20 bp, Artificial Sequence
  Description of Artificial Sequence: Synthetic oligonucleotide
  Target: SCN9A; (-) strand; PAM type: YTN; PAM sequence: CTG
agaatattctgtgcgcactt

SEQ ID NO: 61058 - DNA, 20 bp, Artificial Sequence
  Description of Artificial Sequence: Synthetic oligonucleotide
  Target: SCN9A; (-) strand; PAM type: YTN; PAM sequence: CTA
tcctgagaatattctgtgcg

SEQ ID NO: 61059 - DNA, 20 bp, Artificial Sequence
  Description of Artificial Sequence: Synthetic oligonucleotide
  Target: SCN9A; (-) strand; PAM type: YTN; PAM sequence: CTG
atatgtgatctatcctgaga

SEQ ID NO: 61060 - DNA, 20 bp, Artificial Sequence
  Description of Artificial Sequence: Synthetic oligonucleotide
  Target: SCN9A; (-) strand; PAM type: YTN; PAM sequence: TTC
atgacctgatatgtgatcta

SEQ ID NO: 61061 - DNA, 20 bp, Artificial Sequence
  Description of Artificial Sequence: Synthetic oligonucleotide
  Target: SCN9A; (-) strand; PAM type: YTN; PAM sequence: CTT
catgacctgatatgtgatct

SEQ ID NO: 61062 - DNA, 20 bp, Artificial Sequence
  Description of Artificial Sequence: Synthetic oligonucleotide
  Target: SCN9A; (-) strand; PAM type: YTN; PAM sequence: TTG
tcaaaacaaacttcatgacc

SEQ ID NO: 61063 - DNA, 20 bp, Artificial Sequence
  Description of Artificial Sequence: Synthetic oligonucleotide
  Target: SCN9A; (-) strand; PAM type: YTN; PAM sequence: TTA
acagttgtcaaaacaaactt

SEQ ID NO: 61064 - DNA, 20 bp, Artificial Sequence
  Description of Artificial Sequence: Synthetic oligonucleotide
  Target: SCN9A; (-) strand; PAM type: YTN; PAM sequence: CTT
aacagttgtcaaaacaaact

SEQ ID NO: 61065 - DNA, 20 bp, Artificial Sequence
  Description of Artificial Sequence: Synthetic oligonucleotide
  Target: SCN9A; (-) strand; PAM type: YTN; PAM sequence: TTC
ttaacagttgtcaaaacaaa

SEQ ID NO: 61066 - DNA, 20 bp, Artificial Sequence
  Description of Artificial Sequence: Synthetic oligonucleotide
  Target: SCN9A; (-) strand; PAM type: YTN; PAM sequence: CTT
cttaacagttgtcaaaacaa

SEQ ID NO: 61067 - DNA, 20 bp, Artificial Sequence
  Description of Artificial Sequence: Synthetic oligonucleotide
  Target: SCN9A; (-) strand; PAM type: YTN; PAM sequence: TTC
aacttcttaacagttgtcaa

SEQ ID NO: 61068 - DNA, 20 bp, Artificial Sequence
  Description of Artificial Sequence: Synthetic oligonucleotide
  Target: SCN9A; (-) strand; PAM type: YTN; PAM sequence: TTT
caacttcttaacagttgtca

SEQ ID NO: 61069 - DNA, 20 bp, Artificial Sequence
  Description of Artificial Sequence: Synthetic oligonucleotide
  Target: SCN9A; (-) strand; PAM type: YTN; PAM sequence: CTG
gtatgatttcaacttcttaa

SEQ ID NO: 61070 - DNA, 20 bp, Artificial Sequence
  Description of Artificial Sequence: Synthetic oligonucleotide
  Target: SCN9A; (-) strand; PAM type: YTN; PAM sequence: TTG
tggtcataaaagatatctgg

SEQ ID NO: 61071 - DNA, 20 bp, Artificial Sequence
  Description of Artificial Sequence: Synthetic oligonucleotide
  Target: SCN9A; (-) strand; PAM type: YTN; PAM sequence: TTC
cattgtggtcataaaagata

SEQ ID NO: 61072 - DNA, 20 bp, Artificial Sequence
  Description of Artificial Sequence: Synthetic oligonucleotide
  Target: SCN9A; (-) strand; PAM type: YTN; PAM sequence: CTT
ccattgtggtcataaaagat

SEQ ID NO: 61073 - DNA, 20 bp, Artificial Sequence
  Description of Artificial Sequence: Synthetic oligonucleotide
  Target: SCN9A; (-) strand; PAM type: YTN; PAM sequence: TTC
cttccattgtggtcataaaa

SEQ ID NO: 61074 - DNA, 20 bp, Artificial Sequence
  Description of Artificial Sequence: Synthetic oligonucleotide
  Target: SCN9A; (-) strand; PAM type: YTN; PAM sequence: TTT
ccttccattgtggtcataaa

SEQ ID NO: 61075 - DNA, 20 bp, Artificial Sequence
  Description of Artificial Sequence: Synthetic oligonucleotide
  Target: SCN9A; (-) strand; PAM type: YTN; PAM sequence: TTC
cagtttccttccattgtggt

SEQ ID NO: 61076 - DNA, 20 bp, Artificial Sequence
  Description of Artificial Sequence: Synthetic oligonucleotide
  Target: SCN9A; (-) strand; PAM type: YTN; PAM sequence: CTT
ccagtttccttccattgtgg

SEQ ID NO: 61077 - DNA, 20 bp, Artificial Sequence
  Description of Artificial Sequence: Synthetic oligonucleotide
  Target: SCN9A; (-) strand; PAM type: YTN; PAM sequence: CTG
acttccagtttccttccatt

SEQ ID NO: 61078 - DNA, 20 bp, Artificial Sequence
  Description of Artificial Sequence: Synthetic oligonucleotide
  Target: SCN9A; (-) strand; PAM type: YTN; PAM sequence: TTA
ctgacttccagtttccttcc

SEQ ID NO: 61079 - DNA, 20 bp, Artificial Sequence
  Description of Artificial Sequence: Synthetic oligonucleotide
  Target: SCN9A; (-) strand; PAM type: YTN; PAM sequence: CTA
ttactgacttccagtttcct

SEQ ID NO: 61080 - DNA, 20 bp, Artificial Sequence
  Description of Artificial Sequence: Synthetic oligonucleotide
  Target: SCN9A; (-) strand; PAM type: YTN; PAM sequence: TTC
tattactgacttccagtttc

SEQ ID NO: 61081 - DNA, 20 bp, Artificial Sequence
  Description of Artificial Sequence: Synthetic oligonucleotide
  Target: SCN9A; (-) strand; PAM type: YTN; PAM sequence: CTT
ctattactgacttccagttt

SEQ ID NO: 61082 - DNA, 20 bp, Artificial Sequence
  Description of Artificial Sequence: Synthetic oligonucleotide
  Target: SCN9A; (-) strand; PAM type: YTN; PAM sequence: TTC
cttctattactgacttccag

SEQ ID NO: 61083 - DNA, 20 bp, Artificial Sequence
  Description of Artificial Sequence: Synthetic oligonucleotide
  Target: SCN9A; (-) strand; PAM type: YTN; PAM sequence: TTT
ccttctattactgacttcca

SEQ ID NO: 61084 - DNA, 20 bp, Artificial Sequence
  Description of Artificial Sequence: Synthetic oligonucleotide
  Target: SCN9A; (-) strand; PAM type: YTN; PAM sequence: TTT
tccttctattactgacttcc

SEQ ID NO: 61085 - DNA, 20 bp, Artificial Sequence
  Description of Artificial Sequence: Synthetic oligonucleotide
  Target: SCN9A; (-) strand; PAM type: YTN; PAM sequence: TTC
agttttccttctattactga

SEQ ID NO: 61086 - DNA, 20 bp, Artificial Sequence
  Description of Artificial Sequence: Synthetic oligonucleotide
  Target: SCN9A; (-) strand; PAM type: YTN; PAM sequence: TTT
cagttttccttctattactg

SEQ ID NO: 61087 - DNA, 20 bp, Artificial Sequence
  Description of Artificial Sequence: Synthetic oligonucleotide
  Target: SCN9A; (-) strand; PAM type: YTN; PAM sequence: TTT
tcagttttccttctattact

SEQ ID NO: 61088 - DNA, 20 bp, Artificial Sequence
  Description of Artificial Sequence: Synthetic oligonucleotide
  Target: SCN9A; (-) strand; PAM type: YTN; PAM sequence: TTT
ttcagttttccttctattac

SEQ ID NO: 61089 - DNA, 20 bp, Artificial Sequence
  Description of Artificial Sequence: Synthetic oligonucleotide
  Target: SCN9A; (-) strand; PAM type: YTN; PAM sequence: TTG
tgaatttttcagttttcctt

SEQ ID NO: 61090 - DNA, 20 bp, Artificial Sequence
  Description of Artificial Sequence: Synthetic oligonucleotide
  Target: SCN9A; (-) strand; PAM type: YTN; PAM sequence: TTT
gtgaatttttcagttttcct

SEQ ID NO: 61091 - DNA, 20 bp, Artificial Sequence
  Description of Artificial Sequence: Synthetic oligonucleotide
  Target: SCN9A; (-) strand; PAM type: YTN; PAM sequence: TTC
cacatatttgtgaatttttc

SEQ ID NO: 61092 - DNA, 20 bp, Artificial Sequence
  Description of Artificial Sequence: Synthetic oligonucleotide
  Target: SCN9A; (-) strand; PAM type: YTN; PAM sequence: TTT
ccacatatttgtgaattttt

SEQ ID NO: 61093 - DNA, 20 bp, Artificial Sequence
  Description of Artificial Sequence: Synthetic oligonucleotide
  Target: SCN9A; (-) strand; PAM type: YTN; PAM sequence: TTA
atttccacatatttgtgaat

SEQ ID NO: 61094 - DNA, 20 bp, Artificial Sequence
  Description of Artificial Sequence: Synthetic oligonucleotide
  Target: SCN9A; (-) strand; PAM type: YTN; PAM sequence: TTT
aatttccacatatttgtgaa

SEQ ID NO: 61095 - DNA, 20 bp, Artificial Sequence
  Description of Artificial Sequence: Synthetic oligonucleotide
  Target: SCN9A; (-) strand; PAM type: YTN; PAM sequence: TTG
tttaatttccacatatttgt

SEQ ID NO: 61096 - DNA, 20 bp, Artificial Sequence
  Description of Artificial Sequence: Synthetic oligonucleotide
  Target: SCN9A; (-) strand; PAM type: YTN; PAM sequence: TTC
aagagagtgttgtttaattt

SEQ ID NO: 61097 - DNA, 20 bp, Artificial Sequence
  Description of Artificial Sequence: Synthetic oligonucleotide
  Target: SCN9A; (-) strand; PAM type: YTN; PAM sequence: TTT
caagagagtgttgtttaatt

SEQ ID NO: 61098 - DNA, 20 bp, Artificial Sequence
  Description of Artificial Sequence: Synthetic oligonucleotide
  Target: SCN9A; (-) strand; PAM type: YTN; PAM sequence: TTT
tcaagagagtgttgtttaat

SEQ ID NO: 61099 - DNA, 20 bp, Artificial Sequence
  Description of Artificial Sequence: Synthetic oligonucleotide
  Target: SCN9A; (-) strand; PAM type: YTN; PAM sequence: TTT
ttcaagagagtgttgtttaa

SEQ ID NO: 61100 - DNA, 20 bp, Artificial Sequence
  Description of Artificial Sequence: Synthetic oligonucleotide
  Target: SCN9A; (-) strand; PAM type: YTN; PAM sequence: CTT
tttcaagagagtgttgttta

SEQ ID NO: 61101 - DNA, 20 bp, Artificial Sequence
  Description of Artificial Sequence: Synthetic oligonucleotide
  Target: SCN9A; (-) strand; PAM type: YTN; PAM sequence: TTG
ctttttcaagagagtgttgt

SEQ ID NO: 61102 - DNA, 20 bp, Artificial Sequence
  Description of Artificial Sequence: Synthetic oligonucleotide
  Target: SCN9A; (-) strand; PAM type: YTN; PAM sequence: TTG
acccattgctttttcaagag

SEQ ID NO: 61103 - DNA, 20 bp, Artificial Sequence
  Description of Artificial Sequence: Synthetic oligonucleotide
  Target: SCN9A; (-) strand; PAM type: YTN; PAM sequence: TTT
gacccattgctttttcaaga

SEQ ID NO: 61104 - DNA, 20 bp, Artificial Sequence
  Description of Artificial Sequence: Synthetic oligonucleotide
  Target: SCN9A; (-) strand; PAM type: YTN; PAM sequence: CTT
tgacccattgctttttcaag

SEQ ID NO: 61105 - DNA, 20 bp, Artificial Sequence
  Description of Artificial Sequence: Synthetic oligonucleotide
  Target: SCN9A; (-) strand; PAM type: YTN; PAM sequence: TTC
tttgacccattgctttttca

SEQ ID NO: 61106 - DNA, 20 bp, Artificial Sequence
  Description of Artificial Sequence: Synthetic oligonucleotide
  Target: SCN9A; (-) strand; PAM type: YTN; PAM sequence: TTT
ctttgacccattgctttttc

SEQ ID NO: 61107 - DNA, 20 bp, Artificial Sequence
  Description of Artificial Sequence: Synthetic oligonucleotide
  Target: SCN9A; (-) strand; PAM type: YTN; PAM sequence: TTT
tctttgacccattgcttttt

SEQ ID NO: 61108 - DNA, 20 bp, Artificial Sequence
  Description of Artificial Sequence: Synthetic oligonucleotide
  Target: SCN9A; (-) strand; PAM type: YTN; PAM sequence: TTT
ttctttgacccattgctttt

SEQ ID NO: 61109 - DNA, 20 bp, Artificial Sequence
  Description of Artificial Sequence: Synthetic oligonucleotide
  Target: SCN9A; (-) strand; PAM type: YTN; PAM sequence: TTT
tttctttgacccattgcttt

SEQ ID NO: 61110 - DNA, 20 bp, Artificial Sequence
  Description of Artificial Sequence: Synthetic oligonucleotide
  Target: SCN9A; (-) strand; PAM type: YTN; PAM sequence: TTT
ttttctttgacccattgctt

SEQ ID NO: 61111 - DNA, 20 bp, Artificial Sequence
  Description of Artificial Sequence: Synthetic oligonucleotide
  Target: SCN9A; (-) strand; PAM type: YTN; PAM sequence: TTT
tttttctttgacccattgct

SEQ ID NO: 61112 - DNA, 20 bp, Artificial Sequence
  Description of Artificial Sequence: Synthetic oligonucleotide
  Target: SCN9A; (-) strand; PAM type: YTN; PAM sequence: TTG
attttttttctttgacccat

SEQ ID NO: 61113 - DNA, 20 bp, Artificial Sequence
  Description of Artificial Sequence: Synthetic oligonucleotide
  Target: SCN9A; (-) strand; PAM type: YTN; PAM sequence: CTA
ttgattttttttctttgacc

SEQ ID NO: 61114 - DNA, 20 bp, Artificial Sequence
  Description of Artificial Sequence: Synthetic oligonucleotide
  Target: SCN9A; (-) strand; PAM type: YTN; PAM sequence: TTC
ctattgattttttttctttg

SEQ ID NO: 61115 - DNA, 20 bp, Artificial Sequence
  Description of Artificial Sequence: Synthetic oligonucleotide
  Target: SCN9A; (-) strand; PAM type: YTN; PAM sequence: TTT
cctattgattttttttcttt

SEQ ID NO: 61116 - DNA, 20 bp, Artificial Sequence
  Description of Artificial Sequence: Synthetic oligonucleotide
  Target: SCN9A; (-) strand; PAM type: YTN; PAM sequence: TTT
tcctattgattttttttctt

SEQ ID NO: 61117 - DNA, 20 bp, Artificial Sequence
  Description of Artificial Sequence: Synthetic oligonucleotide
  Target: SCN9A; (-) strand; PAM type: YTN; PAM sequence: TTA
aattttcctattgatttttt

SEQ ID NO: 61118 - DNA, 20 bp, Artificial Sequence
  Description of Artificial Sequence: Synthetic oligonucleotide
  Target: SCN9A; (-) strand; PAM type: YTN; PAM sequence: TTT
aaattttcctattgattttt

SEQ ID NO: 61119 - DNA, 20 bp, Artificial Sequence
  Description of Artificial Sequence: Synthetic oligonucleotide
  Target: SCN9A; (-) strand; PAM type: YTN; PAM sequence: TTT
taaattttcctattgatttt

SEQ ID NO: 61120 - DNA, 20 bp, Artificial Sequence
  Description of Artificial Sequence: Synthetic oligonucleotide
  Target: SCN9A; (-) strand; PAM type: YTN; PAM sequence: CTT
ttaaattttcctattgattt

SEQ ID NO: 61121 - DNA, 20 bp, Artificial Sequence
  Description of Artificial Sequence: Synthetic oligonucleotide
  Target: SCN9A; (-) strand; PAM type: YTN; PAM sequence: TTC
aagatacttttaaattttcc

SEQ ID NO: 61122 - DNA, 20 bp, Artificial Sequence
  Description of Artificial Sequence: Synthetic oligonucleotide
  Target: SCN9A; (-) strand; PAM type: YTN; PAM sequence: TTT
caagatacttttaaattttc

SEQ ID NO: 61123 - DNA, 20 bp, Artificial Sequence
  Description of Artificial Sequence: Synthetic oligonucleotide
  Target: SCN9A; (-) strand; PAM type: YTN; PAM sequence: TTG
tttcaagatacttttaaatt

SEQ ID NO: 61124 - DNA, 20 bp, Artificial Sequence
  Description of Artificial Sequence: Synthetic oligonucleotide
  Target: SCN9A; (-) strand; PAM type: YTN; PAM sequence: TTT
gtttcaagatacttttaaat

SEQ ID NO: 61125 - DNA, 20 bp, Artificial Sequence
  Description of Artificial Sequence: Synthetic oligonucleotide
  Target: SCN9A; (-) strand; PAM type: YTN; PAM sequence: TTG
tttgtttcaagatactttta

SEQ ID NO: 61126 - DNA, 20 bp, Artificial Sequence
  Description of Artificial Sequence: Synthetic oligonucleotide
  Target: SCN9A; (-) strand; PAM type: YTN; PAM sequence: TTT
gtttgtttcaagatactttt

SEQ ID NO: 61127 - DNA, 20 bp, Artificial Sequence
  Description of Artificial Sequence: Synthetic oligonucleotide
  Target: SCN9A; (-) strand; PAM type: YTN; PAM sequence: TTT
tgtttgtttcaagatacttt

SEQ ID NO: 61128 - DNA, 20 bp, Artificial Sequence
  Description of Artificial Sequence: Synthetic oligonucleotide
  Target: SCN9A; (-) strand; PAM type: YTN; PAM sequence: TTT
ttgtttgtttcaagatactt

SEQ ID NO: 61129 - DNA, 20 bp, Artificial Sequence
  Description of Artificial Sequence: Synthetic oligonucleotide
  Target: SCN9A; (-) strand; PAM type: YTN; PAM sequence: TTC
atttttgtttgtttcaagat

SEQ ID NO: 61130 - DNA, 20 bp, Artificial Sequence
  Description of Artificial Sequence: Synthetic oligonucleotide
  Target: SCN9A; (-) strand; PAM type: YTN; PAM sequence: TTT
catttttgtttgtttcaaga

SEQ ID NO: 61131 - DNA, 20 bp, Artificial Sequence
  Description of Artificial Sequence: Synthetic oligonucleotide
  Target: SCN9A; (-) strand; PAM type: YTN; PAM sequence: CTT
tcatttttgtttgtttcaag

SEQ ID NO: 61132 - DNA, 20 bp, Artificial Sequence
  Description of Artificial Sequence: Synthetic oligonucleotide
  Target: SCN9A; (-) strand; PAM type: YTN; PAM sequence: TTG
tgctttcatttttgtttgtt

SEQ ID NO: 61133 - DNA, 20 bp, Artificial Sequence
  Description of Artificial Sequence: Synthetic oligonucleotide
  Target: SCN9A; (-) strand; PAM type: YTN; PAM sequence: TTG
gaaattgtgctttcattttt

SEQ ID NO: 61134 - DNA, 20 bp, Artificial Sequence
  Description of Artificial Sequence: Synthetic oligonucleotide
  Target: SCN9A; (-) strand; PAM type: YTN; PAM sequence: TTT
ggaaattgtgctttcatttt

SEQ ID NO: 61135 - DNA, 20 bp, Artificial Sequence
  Description of Artificial Sequence: Synthetic oligonucleotide
  Target: SCN9A; (-) strand; PAM type: YTN; PAM sequence: TTT
tggaaattgtgctttcattt

SEQ ID NO: 61136 - DNA, 20 bp, Artificial Sequence
  Description of Artificial Sequence: Synthetic oligonucleotide
  Target: SCN9A; (-) strand; PAM type: YTN; PAM sequence: CTC
ataaattttggaaattgtgc

SEQ ID NO: 61137 - DNA, 20 bp, Artificial Sequence
  Description of Artificial Sequence: Synthetic oligonucleotide
  Target: SCN9A; (-) strand; PAM type: YTN; PAM sequence: CTG
catctcataaattttggaaa

SEQ ID NO: 61138 - DNA, 20 bp, Artificial Sequence
  Description of Artificial Sequence: Synthetic oligonucleotide
  Target: SCN9A; (-) strand; PAM type: YTN; PAM sequence: TTG
ctgcatctcataaattttgg

SEQ ID NO: 61139 - DNA, 20 bp, Artificial Sequence
  Description of Artificial Sequence: Synthetic oligonucleotide
  Target: SCN9A; (-) strand; PAM type: YTN; PAM sequence: TTT
gctgcatctcataaattttg

SEQ ID NO: 61140 - DNA, 20 bp, Artificial Sequence
  Description of Artificial Sequence: Synthetic oligonucleotide
  Target: SCN9A; (-) strand; PAM type: YTN; PAM sequence: TTT
tgctgcatctcataaatttt

SEQ ID NO: 61141 - DNA, 20 bp, Artificial Sequence
  Description of Artificial Sequence: Synthetic oligonucleotide
  Target: SCN9A; (-) strand; PAM type: YTN; PAM sequence: CTT
ttgctgcatctcataaattt

SEQ ID NO: 61142 - DNA, 20 bp, Artificial Sequence
  Description of Artificial Sequence: Synthetic oligonucleotide
  Target: SCN9A; (-) strand; PAM type: YTN; PAM sequence: CTG
cttttgctgcatctcataaa

SEQ ID NO: 61143 - DNA, 20 bp, Artificial Sequence
  Description of Artificial Sequence: Synthetic oligonucleotide
  Target: SCN9A; (-) strand; PAM type: YTN; PAM sequence: TTA
ctgcttttgctgcatctcat

SEQ ID NO: 61144 - DNA, 20 bp, Artificial Sequence
  Description of Artificial Sequence: Synthetic oligonucleotide
  Target: SCN9A; (-) strand; PAM type: YTN; PAM sequence: TTA
ttactgcttttgctgcatct

SEQ ID NO: 61145 - DNA, 20 bp, Artificial Sequence
  Description of Artificial Sequence: Synthetic oligonucleotide
  Target: SCN9A; (-) strand; PAM type: YTN; PAM sequence: TTT
attactgcttttgctgcatc

SEQ ID NO: 61146 - DNA, 20 bp, Artificial Sequence
  Description of Artificial Sequence: Synthetic oligonucleotide
  Target: SCN9A; (-) strand; PAM type: YTN; PAM sequence: TTT
tattactgcttttgctgcat

SEQ ID NO: 61147 - DNA, 20 bp, Artificial Sequence
  Description of Artificial Sequence: Synthetic oligonucleotide
  Target: SCN9A; (-) strand; PAM type: YTN; PAM sequence: CTT
ttattactgcttttgctgca

SEQ ID NO: 61148 - DNA, 20 bp, Artificial Sequence
  Description of Artificial Sequence: Synthetic oligonucleotide
  Target: SCN9A; (-) strand; PAM type: YTN; PAM sequence: TTG
cttttattactgcttttgct

SEQ ID NO: 61149 - DNA, 20 bp, Artificial Sequence
  Description of Artificial Sequence: Synthetic oligonucleotide
  Target: SCN9A; (-) strand; PAM type: YTN; PAM sequence: TTT
gcttttattactgcttttgc

SEQ ID NO: 61150 - DNA, 20 bp, Artificial Sequence
  Description of Artificial Sequence: Synthetic oligonucleotide
  Target: SCN9A; (-) strand; PAM type: YTN; PAM sequence: CTC
aataagatttgcttttatta

SEQ ID NO: 61151 - DNA, 20 bp, Artificial Sequence
  Description of Artificial Sequence: Synthetic oligonucleotide
  Target: SCN9A; (-) strand; PAM type: YTN; PAM sequence: TTA
taatgtagacatgtatctca

SEQ ID NO: 61152 - DNA, 20 bp, Artificial Sequence
  Description of Artificial Sequence: Synthetic oligonucleotide
  Target: SCN9A; (-) strand; PAM type: YTN; PAM sequence: TTT
ataatgtagacatgtatctc

SEQ ID NO: 61153 - DNA, 20 bp, Artificial Sequence
  Description of Artificial Sequence: Synthetic oligonucleotide
  Target: SCN9A; (-) strand; PAM type: YTN; PAM sequence: TTT
tataatgtagacatgtatct

SEQ ID NO: 61154 - DNA, 20 bp, Artificial Sequence
  Description of Artificial Sequence: Synthetic oligonucleotide
  Target: SCN9A; (-) strand; PAM type: YTN; PAM sequence: TTT
ttataatgtagacatgtatc

SEQ ID NO: 61155 - DNA, 20 bp, Artificial Sequence
  Description of Artificial Sequence: Synthetic oligonucleotide
  Target: SCN9A; (-) strand; PAM type: YTN; PAM sequence: CTT
tttataatgtagacatgtat

SEQ ID NO: 61156 - DNA, 20 bp, Artificial Sequence
  Description of Artificial Sequence: Synthetic oligonucleotide
  Target: SCN9A; (-) strand; PAM type: YTN; PAM sequence: TTC
tttttataatgtagacatgt

SEQ ID NO: 61157 - DNA, 20 bp, Artificial Sequence
  Description of Artificial Sequence: Synthetic oligonucleotide
  Target: SCN9A; (-) strand; PAM type: YTN; PAM sequence: TTT
ctttttataatgtagacatg

SEQ ID NO: 61158 - DNA, 20 bp, Artificial Sequence
  Description of Artificial Sequence: Synthetic oligonucleotide
  Target: SCN9A; (-) strand; PAM type: YTN; PAM sequence: TTA
tatgagatatttctttttat

SEQ ID NO: 61159 - DNA, 20 bp, Artificial Sequence
  Description of Artificial Sequence: Synthetic oligonucleotide
  Target: SCN9A; (-) strand; PAM type: YTN; PAM sequence: TTT
atatgagatatttcttttta

SEQ ID NO: 61160 - DNA, 20 bp, Artificial Sequence
  Description of Artificial Sequence: Synthetic oligonucleotide
  Target: SCN9A; (-) strand; PAM type: YTN; PAM sequence: TTG
tttatatgagatatttcttt

SEQ ID NO: 61161 - DNA, 20 bp, Artificial Sequence
  Description of Artificial Sequence: Synthetic oligonucleotide
  Target: SCN9A; (-) strand; PAM type: YTN; PAM sequence: CTA
tattgtttatatgagatatt

SEQ ID NO: 61162 - DNA, 20 bp, Artificial Sequence
  Description of Artificial Sequence: Synthetic oligonucleotide
  Target: SCN9A; (-) strand; PAM type: YTN; PAM sequence: CTA
gacatgtaaatctatattgt

SEQ ID NO: 61163 - DNA, 20 bp, Artificial Sequence
  Description of Artificial Sequence: Synthetic oligonucleotide
  Target: SCN9A; (-) strand; PAM type: YTN; PAM sequence: TTC
ctagacatgtaaatctatat

SEQ ID NO: 61164 - DNA, 20 bp, Artificial Sequence
  Description of Artificial Sequence: Synthetic oligonucleotide
  Target: SCN9A; (-) strand; PAM type: YTN; PAM sequence: CTA
gttcctagacatgtaaatct

SEQ ID NO: 61165 - DNA, 20 bp, Artificial Sequence
  Description of Artificial Sequence: Synthetic oligonucleotide
  Target: SCN9A; (-) strand; PAM type: YTN; PAM sequence: TTC
tagttcctagacatgtaaat

SEQ ID NO: 61166 - DNA, 20 bp, Artificial Sequence
  Description of Artificial Sequence: Synthetic oligonucleotide
  Target: SCN9A; (-) strand; PAM type: YTN; PAM sequence: TTT
ctagttcctagacatgtaaa

SEQ ID NO: 61167 - DNA, 20 bp, Artificial Sequence
  Description of Artificial Sequence: Synthetic oligonucleotide
  Target: SCN9A; (-) strand; PAM type: YTN; PAM sequence: TTT
tctagttcctagacatgtaa

SEQ ID NO: 61168 - DNA, 20 bp, Artificial Sequence
  Description of Artificial Sequence: Synthetic oligonucleotide
  Target: SCN9A; (-) strand; PAM type: YTN; PAM sequence: TTT
ttctagttcctagacatgta

SEQ ID NO: 61169 - DNA, 20 bp, Artificial Sequence
  Description of Artificial Sequence: Synthetic oligonucleotide
  Target: SCN9A; (-) strand; PAM type: YTN; PAM sequence: CTT
tttctagttcctagacatgt

SEQ ID NO: 61170 - DNA, 20 bp, Artificial Sequence
  Description of Artificial Sequence: Synthetic oligonucleotide
  Target: SCN9A; (-) strand; PAM type: YTN; PAM sequence: TTC
tttttctagttcctagacat

SEQ ID NO: 61171 - DNA, 20 bp, Artificial Sequence
  Description of Artificial Sequence: Synthetic oligonucleotide
  Target: SCN9A; (-) strand; PAM type: YTN; PAM sequence: TTG
ttctttttctagttcctaga

SEQ ID NO: 61172 - DNA, 20 bp, Artificial Sequence
  Description of Artificial Sequence: Synthetic oligonucleotide
  Target: SCN9A; (-) strand; PAM type: YTN; PAM sequence: TTT
gttctttttctagttcctag

SEQ ID NO: 61173 - DNA, 20 bp, Artificial Sequence
  Description of Artificial Sequence: Synthetic oligonucleotide
  Target: SCN9A; (-) strand; PAM type: YTN; PAM sequence: TTA
gtttgttctttttctagttc

SEQ ID NO: 61174 - DNA, 20 bp, Artificial Sequence
  Description of Artificial Sequence: Synthetic oligonucleotide
  Target: SCN9A; (-) strand; PAM type: YTN; PAM sequence: CTT
agtttgttctttttctagtt

SEQ ID NO: 61175 - DNA, 20 bp, Artificial Sequence
  Description of Artificial Sequence: Synthetic oligonucleotide
  Target: SCN9A; (-) strand; PAM type: YTN; PAM sequence: TTG
ggcttagtttgttctttttc

SEQ ID NO: 61176 - DNA, 20 bp, Artificial Sequence
  Description of Artificial Sequence: Synthetic oligonucleotide
  Target: SCN9A; (-) strand; PAM type: YTN; PAM sequence: CTG
atgttgggcttagtttgttc

SEQ ID NO: 61177 - DNA, 20 bp, Artificial Sequence
  Description of Artificial Sequence: Synthetic oligonucleotide
  Target: SCN9A; (-) strand; PAM type: YTN; PAM sequence: TTG
ctgatgttgggcttagtttg

SEQ ID NO: 61178 - DNA, 20 bp, Artificial Sequence
  Description of Artificial Sequence: Synthetic oligonucleotide
  Target: SCN9A; (-) strand; PAM type: YTN; PAM sequence: TTT
gctgatgttgggcttagttt

SEQ ID NO: 61179 - DNA, 20 bp, Artificial Sequence
  Description of Artificial Sequence: Synthetic oligonucleotide
  Target: SCN9A; (-) strand; PAM type: YTN; PAM sequence: TTT
tgctgatgttgggcttagtt

SEQ ID NO: 61180 - DNA, 20 bp, Artificial Sequence
  Description of Artificial Sequence: Synthetic oligonucleotide
  Target: SCN9A; (-) strand; PAM type: YTN; PAM sequence: CTT
ttgctgatgttgggcttagt

SEQ ID NO: 61181 - DNA, 20 bp, Artificial Sequence
  Description of Artificial Sequence: Synthetic oligonucleotide
  Target: SCN9A; (-) strand; PAM type: YTN; PAM sequence: TTC
cttttgctgatgttgggctt

SEQ ID NO: 61182 - DNA, 20 bp, Artificial Sequence
  Description of Artificial Sequence: Synthetic oligonucleotide
  Target: SCN9A; (-) strand; PAM type: YTN; PAM sequence: CTT
ccttttgctgatgttgggct

SEQ ID NO: 61183 - DNA, 20 bp, Artificial Sequence
  Description of Artificial Sequence: Synthetic oligonucleotide
  Target: SCN9A; (-) strand; PAM type: YTN; PAM sequence: TTC
cttccttttgctgatgttgg

SEQ ID NO: 61184 - DNA, 20 bp, Artificial Sequence
  Description of Artificial Sequence: Synthetic oligonucleotide
  Target: SCN9A; (-) strand; PAM type: YTN; PAM sequence: TTT
ccttccttttgctgatgttg

SEQ ID NO: 61185 - DNA, 20 bp, Artificial Sequence
  Description of Artificial Sequence: Synthetic oligonucleotide
  Target: SCN9A; (-) strand; PAM type: YTN; PAM sequence: TTA
tttccttccttttgctgatg

SEQ ID NO: 61186 - DNA, 20 bp, Artificial Sequence
  Description of Artificial Sequence: Synthetic oligonucleotide
  Target: SCN9A; (-) strand; PAM type: YTN; PAM sequence: TTA
ttatttccttccttttgctg

SEQ ID NO: 61187 - DNA, 20 bp, Artificial Sequence
  Description of Artificial Sequence: Synthetic oligonucleotide
  Target: SCN9A; (-) strand; PAM type: YTN; PAM sequence: CTT
attatttccttccttttgct

SEQ ID NO: 61188 - DNA, 20 bp, Artificial Sequence
  Description of Artificial Sequence: Synthetic oligonucleotide
  Target: SCN9A; (-) strand; PAM type: YTN; PAM sequence: CTA
atacttattatttccttcct

SEQ ID NO: 61189 - DNA, 20 bp, Artificial Sequence
  Description of Artificial Sequence: Synthetic oligonucleotide
  Target: SCN9A; (-) strand; PAM type: YTN; PAM sequence: CTC
taatacttattatttccttc

SEQ ID NO: 61190 - DNA, 20 bp, Artificial Sequence
  Description of Artificial Sequence: Synthetic oligonucleotide
  Target: SCN9A; (-) strand; PAM type: YTN; PAM sequence: TTA
gctctaatacttattatttc

SEQ ID NO: 61191 - DNA, 20 bp, Artificial Sequence
  Description of Artificial Sequence: Synthetic oligonucleotide
  Target: SCN9A; (-) strand; PAM type: YTN; PAM sequence: CTT
agctctaatacttattattt

SEQ ID NO: 61192 - DNA, 20 bp, Artificial Sequence
  Description of Artificial Sequence: Synthetic oligonucleotide
  Target: SCN9A; (-) strand; PAM type: YTN; PAM sequence: TTA
cttagctctaatacttatta

SEQ ID NO: 61193 - DNA, 20 bp, Artificial Sequence
  Description of Artificial Sequence: Synthetic oligonucleotide
  Target: SCN9A; (-) strand; PAM type: YTN; PAM sequence: CTT
acttagctctaatacttatt

SEQ ID NO: 61194 - DNA, 20 bp, Artificial Sequence
  Description of Artificial Sequence: Synthetic oligonucleotide
  Target: SCN9A; (-) strand; PAM type: YTN; PAM sequence: TTC
acttacttagctctaatact

SEQ ID NO: 61195 - DNA, 20 bp, Artificial Sequence
  Description of Artificial Sequence: Synthetic oligonucleotide
  Target: SCN9A; (-) strand; PAM type: YTN; PAM sequence: TTT
cacttacttagctctaatac

SEQ ID NO: 61196 - DNA, 20 bp, Artificial Sequence
  Description of Artificial Sequence: Synthetic oligonucleotide
  Target: SCN9A; (-) strand; PAM type: YTN; PAM sequence: CTA
tttcacttacttagctctaa

SEQ ID NO: 61197 - DNA, 20 bp, Artificial Sequence
  Description of Artificial Sequence: Synthetic oligonucleotide
  Target: SCN9A; (-) strand; PAM type: YTN; PAM sequence: CTC
tatttcacttacttagctct

SEQ ID NO: 61198 - DNA, 20 bp, Artificial Sequence
  Description of Artificial Sequence: Synthetic oligonucleotide
  Target: SCN9A; (-) strand; PAM type: YTN; PAM sequence: TTC
tctatttcacttacttagct

SEQ ID NO: 61199 - DNA, 20 bp, Artificial Sequence
  Description of Artificial Sequence: Synthetic oligonucleotide
  Target: SCN9A; (-) strand; PAM type: YTN; PAM sequence: TTA
ttctctatttcacttactta

SEQ ID NO: 61200 - DNA, 20 bp, Artificial Sequence
  Description of Artificial Sequence: Synthetic oligonucleotide
  Target: SCN9A; (-) strand; PAM type: YTN; PAM sequence: TTT
attctctatttcacttactt

SEQ ID NO: 61201 - DNA, 20 bp, Artificial Sequence
  Description of Artificial Sequence: Synthetic oligonucleotide
  Target: SCN9A; (-) strand; PAM type: YTN; PAM sequence: TTT
tattctctatttcacttact

SEQ ID NO: 61202 - DNA, 20 bp, Artificial Sequence
  Description of Artificial Sequence: Synthetic oligonucleotide
  Target: SCN9A; (-) strand; PAM type: YTN; PAM sequence: TTT
ttattctctatttcacttac

SEQ ID NO: 61203 - DNA, 20 bp, Artificial Sequence
  Description of Artificial Sequence: Synthetic oligonucleotide
  Target: SCN9A; (-) strand; PAM type: YTN; PAM sequence: TTT
tttattctctatttcactta

SEQ ID NO: 61204 - DNA, 20 bp, Artificial Sequence
  Description of Artificial Sequence: Synthetic oligonucleotide
  Target: SCN9A; (-) strand; PAM type: YTN; PAM sequence: CTT
ttttattctctatttcactt

SEQ ID NO: 61205 - DNA, 20 bp, Artificial Sequence
  Description of Artificial Sequence: Synthetic oligonucleotide
  Target: SCN9A; (-) strand; PAM type: YTN; PAM sequence: TTG
cttttttattctctatttca

SEQ ID NO: 61206 - DNA, 20 bp, Artificial Sequence
  Description of Artificial Sequence: Synthetic oligonucleotide
  Target: SCN9A; (-) strand; PAM type: YTN; PAM sequence: CTA
ttgcttttttattctctatt

SEQ ID NO: 61207 - DNA, 20 bp, Artificial Sequence
  Description of Artificial Sequence: Synthetic oligonucleotide
  Target: SCN9A; (-) strand; PAM type: YTN; PAM sequence: TTC
tattgcttttttattctcta

SEQ ID NO: 61208 - DNA, 20 bp, Artificial Sequence
  Description of Artificial Sequence: Synthetic oligonucleotide
  Target: SCN9A; (-) strand; PAM type: YTN; PAM sequence: TTT
ctattgcttttttattctct

SEQ ID NO: 61209 - DNA, 20 bp, Artificial Sequence
  Description of Artificial Sequence: Synthetic oligonucleotide
  Target: SCN9A; (-) strand; PAM type: YTN; PAM sequence: TTT
tctattgcttttttattctc

SEQ ID NO: 61210 - DNA, 20 bp, Artificial Sequence
  Description of Artificial Sequence: Synthetic oligonucleotide
  Target: SCN9A; (-) strand; PAM type: YTN; PAM sequence: TTT
ttctattgcttttttattct

SEQ ID NO: 61211 - DNA, 20 bp, Artificial Sequence
  Description of Artificial Sequence: Synthetic oligonucleotide
  Target: SCN9A; (-) strand; PAM type: YTN; PAM sequence: CTT
tttctattgcttttttattc

SEQ ID NO: 61212 - DNA, 20 bp, Artificial Sequence
  Description of Artificial Sequence: Synthetic oligonucleotide
  Target: SCN9A; (-) strand; PAM type: YTN; PAM sequence: TTG
actttttctattgctttttt

SEQ ID NO: 61213 - DNA, 20 bp, Artificial Sequence
  Description of Artificial Sequence: Synthetic oligonucleotide
  Target: SCN9A; (-) strand; PAM type: YTN; PAM sequence: TTG
ttgactttttctattgcttt

SEQ ID NO: 61214 - DNA, 20 bp, Artificial Sequence
  Description of Artificial Sequence: Synthetic oligonucleotide
  Target: SCN9A; (-) strand; PAM type: YTN; PAM sequence: TTT
gttgactttttctattgctt

SEQ ID NO: 61215 - DNA, 20 bp, Artificial Sequence
  Description of Artificial Sequence: Synthetic oligonucleotide
  Target: SCN9A; (-) strand; PAM type: YTN; PAM sequence: TTT
tgttgactttttctattgct

SEQ ID NO: 61216 - DNA, 20 bp, Artificial Sequence
  Description of Artificial Sequence: Synthetic oligonucleotide
  Target: SCN9A; (-) strand; PAM type: YTN; PAM sequence: TTA
gttttgttgactttttctat

SEQ ID NO: 61217 - DNA, 20 bp, Artificial Sequence
  Description of Artificial Sequence: Synthetic oligonucleotide
  Target: SCN9A; (-) strand; PAM type: YTN; PAM sequence: CTT
agttttgttgactttttcta

SEQ ID NO: 61218 - DNA, 20 bp, Artificial Sequence
  Description of Artificial Sequence: Synthetic oligonucleotide
  Target: SCN9A; (-) strand; PAM type: YTN; PAM sequence: TTC
ttagttttgttgactttttc

SEQ ID NO: 61219 - DNA, 20 bp, Artificial Sequence
  Description of Artificial Sequence: Synthetic oligonucleotide
  Target: SCN9A; (-) strand; PAM type: YTN; PAM sequence: TTC
gaaaaaaccaattcttagtt

SEQ ID NO: 61220 - DNA, 20 bp, Artificial Sequence
  Description of Artificial Sequence: Synthetic oligonucleotide
  Target: SCN9A; (-) strand; PAM type: YTN; PAM sequence: TTT
cgaaaaaaccaattcttagt

SEQ ID NO: 61221 - DNA, 20 bp, Artificial Sequence
  Description of Artificial Sequence: Synthetic oligonucleotide
  Target: SCN9A; (-) strand; PAM type: YTN; PAM sequence: CTT
tcgaaaaaaccaattcttag

SEQ ID NO: 61222 - DNA, 20 bp, Artificial Sequence
  Description of Artificial Sequence: Synthetic oligonucleotide
  Target: SCN9A; (-) strand; PAM type: YTN; PAM sequence: TTA
tctttcgaaaaaaccaattc

SEQ ID NO: 61223 - DNA, 20 bp, Artificial Sequence
  Description of Artificial Sequence: Synthetic oligonucleotide
  Target: SCN9A; (-) strand; PAM type: YTN; PAM sequence: TTT
atctttcgaaaaaaccaatt

SEQ ID NO: 61224 - DNA, 20 bp, Artificial Sequence
  Description of Artificial Sequence: Synthetic oligonucleotide
  Target: SCN9A; (-) strand; PAM type: YTN; PAM sequence: TTT
tatctttcgaaaaaaccaat

SEQ ID NO: 61225 - DNA, 20 bp, Artificial Sequence
  Description of Artificial Sequence: Synthetic oligonucleotide
  Target: SCN9A; (-) strand; PAM type: YTN; PAM sequence: CTA
ttttatctttcgaaaaaacc

SEQ ID NO: 61226 - DNA, 20 bp, Artificial Sequence
  Description of Artificial Sequence: Synthetic oligonucleotide
  Target: SCN9A; (-) strand; PAM type: YTN; PAM sequence: TTG
tctattttatctttcgaaaa

SEQ ID NO: 61227 - DNA, 20 bp, Artificial Sequence
  Description of Artificial Sequence: Synthetic oligonucleotide
  Target: SCN9A; (-) strand; PAM type: YTN; PAM sequence: TTT
gtctattttatctttcgaaa

SEQ ID NO: 61228 - DNA, 20 bp, Artificial Sequence
  Description of Artificial Sequence: Synthetic oligonucleotide
  Target: SCN9A; (-) strand; PAM type: YTN; PAM sequence: CTA
aggatttgtctattttatct

SEQ ID NO: 61229 - DNA, 20 bp, Artificial Sequence
  Description of Artificial Sequence: Synthetic oligonucleotide
  Target: SCN9A; (-) strand; PAM type: YTN; PAM sequence: TTG
ctaaggatttgtctatttta

SEQ ID NO: 61230 - DNA, 20 bp, Artificial Sequence
  Description of Artificial Sequence: Synthetic oligonucleotide
  Target: SCN9A; (-) strand; PAM type: YTN; PAM sequence: CTT
gctaaggatttgtctatttt

SEQ ID NO: 61231 - DNA, 20 bp, Artificial Sequence
  Description of Artificial Sequence: Synthetic oligonucleotide
  Target: SCN9A; (-) strand; PAM type: YTN; PAM sequence: TTA
tgcttgctaaggatttgtct

SEQ ID NO: 61232 - DNA, 20 bp, Artificial Sequence
  Description of Artificial Sequence: Synthetic oligonucleotide
  Target: SCN9A; (-) strand; PAM type: YTN; PAM sequence: TTA
gttatgcttgctaaggattt

SEQ ID NO: 61233 - DNA, 20 bp, Artificial Sequence
  Description of Artificial Sequence: Synthetic oligonucleotide
  Target: SCN9A; (-) strand; PAM type: YTN; PAM sequence: CTT
agttatgcttgctaaggatt

SEQ ID NO: 61234 - DNA, 20 bp, Artificial Sequence
  Description of Artificial Sequence: Synthetic oligonucleotide
  Target: SCN9A; (-) strand; PAM type: YTN; PAM sequence: TTC
ttagttatgcttgctaagga

SEQ ID NO: 61235 - DNA, 20 bp, Artificial Sequence
  Description of Artificial Sequence: Synthetic oligonucleotide
  Target: SCN9A; (-) strand; PAM type: YTN; PAM sequence: TTT
cttagttatgcttgctaagg

SEQ ID NO: 61236 - DNA, 20 bp, Artificial Sequence
  Description of Artificial Sequence: Synthetic oligonucleotide
  Target: SCN9A; (-) strand; PAM type: YTN; PAM sequence: TTT
tcttagttatgcttgctaag

SEQ ID NO: 61237 - DNA, 20 bp, Artificial Sequence
  Description of Artificial Sequence: Synthetic oligonucleotide
  Target: SCN9A; (-) strand; PAM type: YTN; PAM sequence: TTT
ttcttagttatgcttgctaa

SEQ ID NO: 61238 - DNA, 20 bp, Artificial Sequence
  Description of Artificial Sequence: Synthetic oligonucleotide
  Target: SCN9A; (-) strand; PAM type: YTN; PAM sequence: TTT
tttcttagttatgcttgcta

SEQ ID NO: 61239 - DNA, 20 bp, Artificial Sequence
  Description of Artificial Sequence: Synthetic oligonucleotide
  Target: SCN9A; (-) strand; PAM type: YTN; PAM sequence: CTT
ttttcttagttatgcttgct

SEQ ID NO: 61240 - DNA, 20 bp, Artificial Sequence
  Description of Artificial Sequence: Synthetic oligonucleotide
  Target: SCN9A; (-) strand; PAM type: YTN; PAM sequence: CTA
tcttttttcttagttatgct

SEQ ID NO: 61241 - DNA, 20 bp, Artificial Sequence
  Description of Artificial Sequence: Synthetic oligonucleotide
  Target: SCN9A; (-) strand; PAM type: YTN; PAM sequence: CTC
tatcttttttcttagttatg

SEQ ID NO: 61242 - DNA, 20 bp, Artificial Sequence
  Description of Artificial Sequence: Synthetic oligonucleotide
  Target: SCN9A; (-) strand; PAM type: YTN; PAM sequence: TTG
agtcctctatcttttttctt

SEQ ID NO: 61243 - DNA, 20 bp, Artificial Sequence
  Description of Artificial Sequence: Synthetic oligonucleotide
  Target: SCN9A; (-) strand; PAM type: YTN; PAM sequence: TTT
gagtcctctatcttttttct

SEQ ID NO: 61244 - DNA, 20 bp, Artificial Sequence
  Description of Artificial Sequence: Synthetic oligonucleotide
  Target: SCN9A; (-) strand; PAM type: YTN; PAM sequence: TTA
catatttgagtcctctatct

SEQ ID NO: 61245 - DNA, 20 bp, Artificial Sequence
  Description of Artificial Sequence: Synthetic oligonucleotide
  Target: SCN9A; (-) strand; PAM type: YTN; PAM sequence: TTT
acatatttgagtcctctatc

SEQ ID NO: 61246 - DNA, 20 bp, Artificial Sequence
  Description of Artificial Sequence: Synthetic oligonucleotide
  Target: SCN9A; (-) strand; PAM type: YTN; PAM sequence: TTT
tacatatttgagtcctctat

SEQ ID NO: 61247 - DNA, 20 bp, Artificial Sequence
  Description of Artificial Sequence: Synthetic oligonucleotide
  Target: SCN9A; (-) strand; PAM type: YTN; PAM sequence: CTG
gttttacatatttgagtcct

SEQ ID NO: 61248 - DNA, 20 bp, Artificial Sequence
  Description of Artificial Sequence: Synthetic oligonucleotide
  Target: SCN9A; (-) strand; PAM type: YTN; PAM sequence: TTC
tggttttacatatttgagtc

SEQ ID NO: 61249 - DNA, 20 bp, Artificial Sequence
  Description of Artificial Sequence: Synthetic oligonucleotide
  Target: SCN9A; (-) strand; PAM type: YTN; PAM sequence: TTT
ctggttttacatatttgagt

SEQ ID NO: 61250 - DNA, 20 bp, Artificial Sequence
  Description of Artificial Sequence: Synthetic oligonucleotide
  Target: SCN9A; (-) strand; PAM type: YTN; PAM sequence: TTC
atttctggttttacatattt

SEQ ID NO: 61251 - DNA, 20 bp, Artificial Sequence
  Description of Artificial Sequence: Synthetic oligonucleotide
  Target: SCN9A; (-) strand; PAM type: YTN; PAM sequence: TTT
catttctggttttacatatt

SEQ ID NO: 61252 - DNA, 20 bp, Artificial Sequence
  Description of Artificial Sequence: Synthetic oligonucleotide
  Target: SCN9A; (-) strand; PAM type: YTN; PAM sequence: CTT
tcatttctggttttacatat

SEQ ID NO: 61253 - DNA, 20 bp, Artificial Sequence
  Description of Artificial Sequence: Synthetic oligonucleotide
  Target: SCN9A; (-) strand; PAM type: YTN; PAM sequence: CTC
tttcatttctggttttacat

SEQ ID NO: 61254 - DNA, 20 bp, Artificial Sequence
  Description of Artificial Sequence: Synthetic oligonucleotide
  Target: SCN9A; (-) strand; PAM type: YTN; PAM sequence: CTC
ctctttcatttctggtttta

SEQ ID NO: 61255 - DNA, 20 bp, Artificial Sequence
  Description of Artificial Sequence: Synthetic oligonucleotide
  Target: SCN9A; (-) strand; PAM type: YTN; PAM sequence: TTC
tcctctttcatttctggttt

SEQ ID NO: 61256 - DNA, 20 bp, Artificial Sequence
  Description of Artificial Sequence: Synthetic oligonucleotide
  Target: SCN9A; (-) strand; PAM type: YTN; PAM sequence: TTG
taaattctcctctttcattt

SEQ ID NO: 61257 - DNA, 20 bp, Artificial Sequence
  Description of Artificial Sequence: Synthetic oligonucleotide
  Target: SCN9A; (-) strand; PAM type: YTN; PAM sequence: TTC
ccataaaatcagttgtaaat

SEQ ID NO: 61258 - DNA, 20 bp, Artificial Sequence
  Description of Artificial Sequence: Synthetic oligonucleotide
  Target: SCN9A; (-) strand; PAM type: YTN; PAM sequence: TTA
ttcccataaaatcagttgta

SEQ ID NO: 61259 - DNA, 20 bp, Artificial Sequence
  Description of Artificial Sequence: Synthetic oligonucleotide
  Target: SCN9A; (-) strand; PAM type: YTN; PAM sequence: CTT
attcccataaaatcagttgt

SEQ ID NO: 61260 - DNA, 20 bp, Artificial Sequence
  Description of Artificial Sequence: Synthetic oligonucleotide
  Target: SCN9A; (-) strand; PAM type: YTN; PAM sequence: TTC
ttattcccataaaatcagtt

SEQ ID NO: 61261 - DNA, 20 bp, Artificial Sequence
  Description of Artificial Sequence: Synthetic oligonucleotide
  Target: SCN9A; (-) strand; PAM type: YTN; PAM sequence: CTT
cttattcccataaaatcagt

SEQ ID NO: 61262 - DNA, 20 bp, Artificial Sequence
  Description of Artificial Sequence: Synthetic oligonucleotide
  Target: SCN9A; (-) strand; PAM type: YTN; PAM sequence: TTG
atccttcttattcccataaa

SEQ ID NO: 61263 - DNA, 20 bp, Artificial Sequence
  Description of Artificial Sequence: Synthetic oligonucleotide
  Target: SCN9A; (-) strand; PAM type: YTN; PAM sequence: TTT
gatccttcttattcccataa

SEQ ID NO: 61264 - DNA, 20 bp, Artificial Sequence
  Description of Artificial Sequence: Synthetic oligonucleotide
  Target: SCN9A; (-) strand; PAM type: YTN; PAM sequence: CTT
tgatccttcttattcccata

SEQ ID NO: 61265 - DNA, 20 bp, Artificial Sequence
  Description of Artificial Sequence: Synthetic oligonucleotide
  Target: SCN9A; (-) strand; PAM type: YTN; PAM sequence: CTC
tttgatccttcttattccca

SEQ ID NO: 61266 - DNA, 20 bp, Artificial Sequence
  Description of Artificial Sequence: Synthetic oligonucleotide
  Target: SCN9A; (-) strand; PAM type: YTN; PAM sequence: TTC
atggtagtctctttgatcct

SEQ ID NO: 61267 - DNA, 20 bp, Artificial Sequence
  Description of Artificial Sequence: Synthetic oligonucleotide
  Target: SCN9A; (-) strand; PAM type: YTN; PAM sequence: TTG
ttcatggtagtctctttgat

SEQ ID NO: 61268 - DNA, 20 bp, Artificial Sequence
  Description of Artificial Sequence: Synthetic oligonucleotide
  Target: SCN9A; (-) strand; PAM type: YTN; PAM sequence: TTG
gtgtataattgttcatggta

SEQ ID NO: 61269 - DNA, 20 bp, Artificial Sequence
  Description of Artificial Sequence: Synthetic oligonucleotide
  Target: SCN9A; (-) strand; PAM type: YTN; PAM sequence: TTG
ttggtgtataattgttcatg

SEQ ID NO: 61270 - DNA, 20 bp, Artificial Sequence
  Description of Artificial Sequence: Synthetic oligonucleotide
  Target: SCN9A; (-) strand; PAM type: YTN; PAM sequence: TTT
gttggtgtataattgttcat

SEQ ID NO: 61271 - DNA, 20 bp, Artificial Sequence
  Description of Artificial Sequence: Synthetic oligonucleotide
  Target: SCN9A; (-) strand; PAM type: YTN; PAM sequence: TTA
tccaatttgttggtgtataa

SEQ ID NO: 61272 - DNA, 20 bp, Artificial Sequence
  Description of Artificial Sequence: Synthetic oligonucleotide
  Target: SCN9A; (-) strand; PAM type: YTN; PAM sequence: CTA
agttatccaatttgttggtg

SEQ ID NO: 61273 - DNA, 20 bp, Artificial Sequence
  Description of Artificial Sequence: Synthetic oligonucleotide
  Target: SCN9A; (-) strand; PAM type: YTN; PAM sequence: TTC
taagttatccaatttgttgg

SEQ ID NO: 61274 - DNA, 20 bp, Artificial Sequence
  Description of Artificial Sequence: Synthetic oligonucleotide
  Target: SCN9A; (-) strand; PAM type: YTN; PAM sequence: CTT
ctaagttatccaatttgttg

SEQ ID NO: 61275 - DNA, 20 bp, Artificial Sequence
  Description of Artificial Sequence: Synthetic oligonucleotide
  Target: SCN9A; (-) strand; PAM type: YTN; PAM sequence: TTC
cttctaagttatccaatttg

SEQ ID NO: 61276 - DNA, 20 bp, Artificial Sequence
  Description of Artificial Sequence: Synthetic oligonucleotide
  Target: SCN9A; (-) strand; PAM type: YTN; PAM sequence: CTA
ttccttctaagttatccaat

SEQ ID NO: 61277 - DNA, 20 bp, Artificial Sequence
  Description of Artificial Sequence: Synthetic oligonucleotide
  Target: SCN9A; (-) strand; PAM type: YTN; PAM sequence: TTA
cctattccttctaagttatc

SEQ ID NO: 61278 - DNA, 20 bp, Artificial Sequence
  Description of Artificial Sequence: Synthetic oligonucleotide
  Target: SCN9A; (-) strand; PAM type: YTN; PAM sequence: TTT
acctattccttctaagttat

SEQ ID NO: 61279 - DNA, 20 bp, Artificial Sequence
  Description of Artificial Sequence: Synthetic oligonucleotide
  Target: SCN9A; (-) strand; PAM type: YTN; PAM sequence: TTG
gaatttacctattccttcta

SEQ ID NO: 61280 - DNA, 20 bp, Artificial Sequence
  Description of Artificial Sequence: Synthetic oligonucleotide
  Target: SCN9A; (-) strand; PAM type: YTN; PAM sequence: TTT
ggaatttacctattccttct

SEQ ID NO: 61281 - DNA, 20 bp, Artificial Sequence
  Description of Artificial Sequence: Synthetic oligonucleotide
  Target: SCN9A; (-) strand; PAM type: YTN; PAM sequence: TTT
tggaatttacctattccttc

SEQ ID NO: 61282 - DNA, 20 bp, Artificial Sequence
  Description of Artificial Sequence: Synthetic oligonucleotide
  Target: SCN9A; (-) strand; PAM type: YTN; PAM sequence: TTT
ttggaatttacctattcctt

SEQ ID NO: 61283 - DNA, 20 bp, Artificial Sequence
  Description of Artificial Sequence: Synthetic oligonucleotide
  Target: SCN9A; (-) strand; PAM type: YTN; PAM sequence: TTG
tatatttttggaatttacct

SEQ ID NO: 61284 - DNA, 20 bp, Artificial Sequence
  Description of Artificial Sequence: Synthetic oligonucleotide
  Target: SCN9A; (-) strand; PAM type: YTN; PAM sequence: TTG
gtaggttgtatatttttgga

SEQ ID NO: 61285 - DNA, 20 bp, Artificial Sequence
  Description of Artificial Sequence: Synthetic oligonucleotide
  Target: SCN9A; (-) strand; PAM type: YTN; PAM sequence: CTT
ggtaggttgtatatttttgg

SEQ ID NO: 61286 - DNA, 20 bp, Artificial Sequence
  Description of Artificial Sequence: Synthetic oligonucleotide
  Target: SCN9A; (-) strand; PAM type: YTN; PAM sequence: TTC
agtcttggtaggttgtatat

SEQ ID NO: 61287 - DNA, 20 bp, Artificial Sequence
  Description of Artificial Sequence: Synthetic oligonucleotide
  Target: SCN9A; (-) strand; PAM type: YTN; PAM sequence: CTC
atgattcagtcttggtaggt

SEQ ID NO: 61288 - DNA, 20 bp, Artificial Sequence
  Description of Artificial Sequence: Synthetic oligonucleotide
  Target: SCN9A; (-) strand; PAM type: YTN; PAM sequence: TTC
ctcatgattcagtcttggta

SEQ ID NO: 61289 - DNA, 20 bp, Artificial Sequence
  Description of Artificial Sequence: Synthetic oligonucleotide
  Target: SCN9A; (-) strand; PAM type: YTN; PAM sequence: TTT
cctcatgattcagtcttggt

SEQ ID NO: 61290 - DNA, 20 bp, Artificial Sequence
  Description of Artificial Sequence: Synthetic oligonucleotide
  Target: SCN9A; (-) strand; PAM type: YTN; PAM sequence: CTA
tttcctcatgattcagtctt

SEQ ID NO: 61291 - DNA, 20 bp, Artificial Sequence
  Description of Artificial Sequence: Synthetic oligonucleotide
  Target: SCN9A; (-) strand; PAM type: YTN; PAM sequence: TTC
tatttcctcatgattcagtc

SEQ ID NO: 61292 - DNA, 20 bp, Artificial Sequence
  Description of Artificial Sequence: Synthetic oligonucleotide
  Target: SCN9A; (-) strand; PAM type: YTN; PAM sequence: TTA
ttctatttcctcatgattca

SEQ ID NO: 61293 - DNA, 20 bp, Artificial Sequence
  Description of Artificial Sequence: Synthetic oligonucleotide
  Target: SCN9A; (-) strand; PAM type: YTN; PAM sequence: TTC
agttattctatttcctcatg

SEQ ID NO: 61294 - DNA, 20 bp, Artificial Sequence
  Description of Artificial Sequence: Synthetic oligonucleotide
  Target: SCN9A; (-) strand; PAM type: YTN; PAM sequence: CTA
ttcagttattctatttcctc

SEQ ID NO: 61295 - DNA, 20 bp, Artificial Sequence
  Description of Artificial Sequence: Synthetic oligonucleotide
  Target: SCN9A; (-) strand; PAM type: YTN; PAM sequence: TTG
tctattcagttattctattt

SEQ ID NO: 61296 - DNA, 20 bp, Artificial Sequence
  Description of Artificial Sequence: Synthetic oligonucleotide
  Target: SCN9A; (-) strand; PAM type: YTN; PAM sequence: TTT
gtctattcagttattctatt

SEQ ID NO: 61297 - DNA, 20 bp, Artificial Sequence
  Description of Artificial Sequence: Synthetic oligonucleotide
  Target: SCN9A; (-) strand; PAM type: YTN; PAM sequence: TTC
aatttgtctattcagttatt

SEQ ID NO: 61298 - DNA, 20 bp, Artificial Sequence
  Description of Artificial Sequence: Synthetic oligonucleotide
  Target: SCN9A; (-) strand; PAM type: YTN; PAM sequence: TTG
gttcaatttgtctattcagt

SEQ ID NO: 61299 - DNA, 20 bp, Artificial Sequence
  Description of Artificial Sequence: Synthetic oligonucleotide
  Target: SCN9A; (-) strand; PAM type: YTN; PAM sequence: TTA
ttggttcaatttgtctattc

SEQ ID NO: 61300 - DNA, 20 bp, Artificial Sequence
  Description of Artificial Sequence: Synthetic oligonucleotide
  Target: SCN9A; (-) strand; PAM type: YTN; PAM sequence: TTA
ttattggttcaatttgtcta

SEQ ID NO: 61301 - DNA, 20 bp, Artificial Sequence
  Description of Artificial Sequence: Synthetic oligonucleotide
  Target: SCN9A; (-) strand; PAM type: YTN; PAM sequence: TTA
ttattattggttcaatttgt

SEQ ID NO: 61302 - DNA, 20 bp, Artificial Sequence
  Description of Artificial Sequence: Synthetic oligonucleotide
  Target: SCN9A; (-) strand; PAM type: YTN; PAM sequence: TTA
ttattattattggttcaatt

SEQ ID NO: 61303 - DNA, 20 bp, Artificial Sequence
  Description of Artificial Sequence: Synthetic oligonucleotide
  Target: SCN9A; (-) strand; PAM type: YTN; PAM sequence: TTA
ttattattattattggttca

SEQ ID NO: 61304 - DNA, 20 bp, Artificial Sequence
  Description of Artificial Sequence: Synthetic oligonucleotide
  Target: SCN9A; (-) strand; PAM type: YTN; PAM sequence: TTA
ttattattattattattggt

SEQ ID NO: 61305 - DNA, 20 bp, Artificial Sequence
  Description of Artificial Sequence: Synthetic oligonucleotide
  Target: SCN9A; (-) strand; PAM type: YTN; PAM sequence: TTA
ttattattattattattatt

SEQ ID NO: 61306 - DNA, 20 bp, Artificial Sequence
  Description of Artificial Sequence: Synthetic oligonucleotide
  Target: SCN9A; (-) strand; PAM type: YTN; PAM sequence: TTA
ttattattattattattatt

SEQ ID NO: 61307 - DNA, 20 bp, Artificial Sequence
  Description of Artificial Sequence: Synthetic oligonucleotide
  Target: SCN9A; (-) strand; PAM type: YTN; PAM sequence: TTA
ttattattattattattatt

SEQ ID NO: 61308 - DNA, 20 bp, Artificial Sequence
  Description of Artificial Sequence: Synthetic oligonucleotide
  Target: SCN9A; (-) strand; PAM type: YTN; PAM sequence: TTA
ttattattattattattatt

SEQ ID NO: 61309 - DNA, 20 bp, Artificial Sequence
  Description of Artificial Sequence: Synthetic oligonucleotide
  Target: SCN9A; (-) strand; PAM type: YTN; PAM sequence: TTA
ttattattattattattatt

SEQ ID NO: 61310 - DNA, 20 bp, Artificial Sequence
  Description of Artificial Sequence: Synthetic oligonucleotide
  Target: SCN9A; (-) strand; PAM type: YTN; PAM sequence: TTA
tcattattattattattatt

SEQ ID NO: 61311 - DNA, 20 bp, Artificial Sequence
  Description of Artificial Sequence: Synthetic oligonucleotide
  Target: SCN9A; (-) strand; PAM type: YTN; PAM sequence: CTA
tcattatcattattattatt

SEQ ID NO: 61312 - DNA, 20 bp, Artificial Sequence
  Description of Artificial Sequence: Synthetic oligonucleotide
  Target: SCN9A; (-) strand; PAM type: YTN; PAM sequence: TTA
ctatcattatcattattatt

SEQ ID NO: 61313 - DNA, 20 bp, Artificial Sequence
  Description of Artificial Sequence: Synthetic oligonucleotide
  Target: SCN9A; (-) strand; PAM type: YTN; PAM sequence: TTG
ggagttactatcattatcat

SEQ ID NO: 61314 - DNA, 20 bp, Artificial Sequence
  Description of Artificial Sequence: Synthetic oligonucleotide
  Target: SCN9A; (-) strand; PAM type: YTN; PAM sequence: TTT
gggagttactatcattatca

SEQ ID NO: 61315 - DNA, 20 bp, Artificial Sequence
  Description of Artificial Sequence: Synthetic oligonucleotide
  Target: SCN9A; (-) strand; PAM type: YTN; PAM sequence: TTT
tgggagttactatcattatc

SEQ ID NO: 61316 - DNA, 20 bp, Artificial Sequence
  Description of Artificial Sequence: Synthetic oligonucleotide
  Target: SCN9A; (-) strand; PAM type: YTN; PAM sequence: TTT
ttgggagttactatcattat

SEQ ID NO: 61317 - DNA, 20 bp, Artificial Sequence
  Description of Artificial Sequence: Synthetic oligonucleotide
  Target: SCN9A; (-) strand; PAM type: YTN; PAM sequence: TTT
tttgggagttactatcatta

SEQ ID NO: 61318 - DNA, 20 bp, Artificial Sequence
  Description of Artificial Sequence: Synthetic oligonucleotide
  Target: SCN9A; (-) strand; PAM type: YTN; PAM sequence: CTT
ttttgggagttactatcatt

SEQ ID NO: 61319 - DNA, 20 bp, Artificial Sequence
  Description of Artificial Sequence: Synthetic oligonucleotide
  Target: SCN9A; (-) strand; PAM type: YTN; PAM sequence: TTC
ttttttgggagttactatca

SEQ ID NO: 61320 - DNA, 20 bp, Artificial Sequence
  Description of Artificial Sequence: Synthetic oligonucleotide
  Target: SCN9A; (-) strand; PAM type: YTN; PAM sequence: TTT
cttttttgggagttactatc

SEQ ID NO: 61321 - DNA, 20 bp, Artificial Sequence
  Description of Artificial Sequence: Synthetic oligonucleotide
  Target: SCN9A; (-) strand; PAM type: YTN; PAM sequence: CTG
tacatttcttttttgggagt

SEQ ID NO: 61322 - DNA, 20 bp, Artificial Sequence
  Description of Artificial Sequence: Synthetic oligonucleotide
  Target: SCN9A; (-) strand; PAM type: YTN; PAM sequence: CTG
gtcctgtacatttctttttt

SEQ ID NO: 61323 - DNA, 20 bp, Artificial Sequence
  Description of Artificial Sequence: Synthetic oligonucleotide
  Target: SCN9A; (-) strand; PAM type: YTN; PAM sequence: CTC
cagagaagccgtctggtcct

SEQ ID NO: 61324 - DNA, 20 bp, Artificial Sequence
  Description of Artificial Sequence: Synthetic oligonucleotide
  Target: SCN9A; (-) strand; PAM type: YTN; PAM sequence: TTC
tccagagaagccgtctggtc

SEQ ID NO: 61325 - DNA, 20 bp, Artificial Sequence
  Description of Artificial Sequence: Synthetic oligonucleotide
  Target: SCN9A; (-) strand; PAM type: YTN; PAM sequence: CTT
ctccagagaagccgtctggt

SEQ ID NO: 61326 - DNA, 20 bp, Artificial Sequence
  Description of Artificial Sequence: Synthetic oligonucleotide
  Target: SCN9A; (-) strand; PAM type: YTN; PAM sequence: TTG
gacttctccagagaagccgt

SEQ ID NO: 61327 - DNA, 20 bp, Artificial Sequence
  Description of Artificial Sequence: Synthetic oligonucleotide
  Target: SCN9A; (-) strand; PAM type: YTN; PAM sequence: TTG
gttggacttctccagagaag

SEQ ID NO: 61328 - DNA, 20 bp, Artificial Sequence
  Description of Artificial Sequence: Synthetic oligonucleotide
  Target: SCN9A; (-) strand; PAM type: YTN; PAM sequence: TTT
ggttggacttctccagagaa

SEQ ID NO: 61329 - DNA, 20 bp, Artificial Sequence
  Description of Artificial Sequence: Synthetic oligonucleotide
  Target: SCN9A; (-) strand; PAM type: YTN; PAM sequence: TTA
aatgtttggttggacttctc

SEQ ID NO: 61330 - DNA, 20 bp, Artificial Sequence
  Description of Artificial Sequence: Synthetic oligonucleotide
  Target: SCN9A; (-) strand; PAM type: YTN; PAM sequence: TTT
aaatgtttggttggacttct

SEQ ID NO: 61331 - DNA, 20 bp, Artificial Sequence
  Description of Artificial Sequence: Synthetic oligonucleotide
  Target: SCN9A; (-) strand; PAM type: YTN; PAM sequence: CTT
taaatgtttggttggacttc

SEQ ID NO: 61332 - DNA, 20 bp, Artificial Sequence
  Description of Artificial Sequence: Synthetic oligonucleotide
  Target: SCN9A; (-) strand; PAM type: YTN; PAM sequence: TTC
tttaaatgtttggttggact

SEQ ID NO: 61333 - DNA, 20 bp, Artificial Sequence
  Description of Artificial Sequence: Synthetic oligonucleotide
  Target: SCN9A; (-) strand; PAM type: YTN; PAM sequence: CTT
ctttaaatgtttggttggac

SEQ ID NO: 61334 - DNA, 20 bp, Artificial Sequence
  Description of Artificial Sequence: Synthetic oligonucleotide
  Target: SCN9A; (-) strand; PAM type: YTN; PAM sequence: TTC
ttctttaaatgtttggttgg

SEQ ID NO: 61335 - DNA, 20 bp, Artificial Sequence
  Description of Artificial Sequence: Synthetic oligonucleotide
  Target: SCN9A; (-) strand; PAM type: YTN; PAM sequence: TTT
cttctttaaatgtttggttg

SEQ ID NO: 61336 - DNA, 20 bp, Artificial Sequence
  Description of Artificial Sequence: Synthetic oligonucleotide
  Target: SCN9A; (-) strand; PAM type: YTN; PAM sequence: TTG
tttcttctttaaatgtttgg

SEQ ID NO: 61337 - DNA, 20 bp, Artificial Sequence
  Description of Artificial Sequence: Synthetic oligonucleotide
  Target: SCN9A; (-) strand; PAM type: YTN; PAM sequence: TTA
atgttgtttcttctttaaat

SEQ ID NO: 61338 - DNA, 20 bp, Artificial Sequence
  Description of Artificial Sequence: Synthetic oligonucleotide
  Target: SCN9A; (-) strand; PAM type: YTN; PAM sequence: TTG
agaagaattaatgttgtttc

SEQ ID NO: 61339 - DNA, 20 bp, Artificial Sequence
  Description of Artificial Sequence: Synthetic oligonucleotide
  Target: SCN9A; (-) strand; PAM type: YTN; PAM sequence: TTT
gagaagaattaatgttgttt

SEQ ID NO: 61340 - DNA, 20 bp, Artificial Sequence
  Description of Artificial Sequence: Synthetic oligonucleotide
  Target: SCN9A; (-) strand; PAM type: YTN; PAM sequence: TTA
agagagtttgagaagaatta

SEQ ID NO: 61341 - DNA, 20 bp, Artificial Sequence
  Description of Artificial Sequence: Synthetic oligonucleotide
  Target: SCN9A; (-) strand; PAM type: YTN; PAM sequence: TTT
aagagagtttgagaagaatt

SEQ ID NO: 61342 - DNA, 20 bp, Artificial Sequence
  Description of Artificial Sequence: Synthetic oligonucleotide
  Target: SCN9A; (-) strand; PAM type: YTN; PAM sequence: TTT
taagagagtttgagaagaat

SEQ ID NO: 61343 - DNA, 20 bp, Artificial Sequence
  Description of Artificial Sequence: Synthetic oligonucleotide
  Target: SCN9A; (-) strand; PAM type: YTN; PAM sequence: TTC
aaagttttaagagagtttga

SEQ ID NO: 61344 - DNA, 20 bp, Artificial Sequence
  Description of Artificial Sequence: Synthetic oligonucleotide
  Target: SCN9A; (-) strand; PAM type: YTN; PAM sequence: CTT
caaagttttaagagagtttg

SEQ ID NO: 61345 - DNA, 20 bp, Artificial Sequence
  Description of Artificial Sequence: Synthetic oligonucleotide
  Target: SCN9A; (-) strand; PAM type: YTN; PAM sequence: CTC
ttcaaagttttaagagagtt

SEQ ID NO: 61346 - DNA, 20 bp, Artificial Sequence
  Description of Artificial Sequence: Synthetic oligonucleotide
  Target: SCN9A; (-) strand; PAM type: YTN; PAM sequence: TTC
ctcttcaaagttttaagaga

SEQ ID NO: 61347 - DNA, 20 bp, Artificial Sequence
  Description of Artificial Sequence: Synthetic oligonucleotide
  Target: SCN9A; (-) strand; PAM type: YTN; PAM sequence: TTT
cctcttcaaagttttaagag

SEQ ID NO: 61348 - DNA, 20 bp, Artificial Sequence
  Description of Artificial Sequence: Synthetic oligonucleotide
  Target: SCN9A; (-) strand; PAM type: YTN; PAM sequence: CTT
tcctcttcaaagttttaaga

SEQ ID NO: 61349 - DNA, 20 bp, Artificial Sequence
  Description of Artificial Sequence: Synthetic oligonucleotide
  Target: SCN9A; (-) strand; PAM type: YTN; PAM sequence: TTC
tttcctcttcaaagttttaa

SEQ ID NO: 61350 - DNA, 20 bp, Artificial Sequence
  Description of Artificial Sequence: Synthetic oligonucleotide
  Target: SCN9A; (-) strand; PAM type: YTN; PAM sequence: TTC
gaagtgttctttcctcttca

SEQ ID NO: 61351 - DNA, 20 bp, Artificial Sequence
  Description of Artificial Sequence: Synthetic oligonucleotide
  Target: SCN9A; (-) strand; PAM type: YTN; PAM sequence: TTT
cgaagtgttctttcctcttc

SEQ ID NO: 61352 - DNA, 20 bp, Artificial Sequence
  Description of Artificial Sequence: Synthetic oligonucleotide
  Target: SCN9A; (-) strand; PAM type: YTN; PAM sequence: CTT
tcgaagtgttctttcctctt

SEQ ID NO: 61353 - DNA, 20 bp, Artificial Sequence
  Description of Artificial Sequence: Synthetic oligonucleotide
  Target: SCN9A; (-) strand; PAM type: YTN; PAM sequence: CTG
gccccataaaatgactttcg

SEQ ID NO: 61354 - DNA, 20 bp, Artificial Sequence
  Description of Artificial Sequence: Synthetic oligonucleotide
  Target: SCN9A; (-) strand; PAM type: YTN; PAM sequence: TTC
tggccccataaaatgacttt

SEQ ID NO: 61355 - DNA, 20 bp, Artificial Sequence
  Description of Artificial Sequence: Synthetic oligonucleotide
  Target: SCN9A; (-) strand; PAM type: YTN; PAM sequence: TTG
atatgagaataattctggcc

SEQ ID NO: 61356 - DNA, 20 bp, Artificial Sequence
  Description of Artificial Sequence: Synthetic oligonucleotide
  Target: SCN9A; (-) strand; PAM type: YTN; PAM sequence: TTT
gatatgagaataattctggc

SEQ ID NO: 61357 - DNA, 20 bp, Artificial Sequence
  Description of Artificial Sequence: Synthetic oligonucleotide
  Target: SCN9A; (-) strand; PAM type: YTN; PAM sequence: CTT
tgatatgagaataattctgg

SEQ ID NO: 61358 - DNA, 20 bp, Artificial Sequence
  Description of Artificial Sequence: Synthetic oligonucleotide
  Target: SCN9A; (-) strand; PAM type: YTN; PAM sequence: CTG
gctttgatatgagaataatt

SEQ ID NO: 61359 - DNA, 20 bp, Artificial Sequence
  Description of Artificial Sequence: Synthetic oligonucleotide
  Target: SCN9A; (-) strand; PAM type: YTN; PAM sequence: TTG
tctggctttgatatgagaat

SEQ ID NO: 61360 - DNA, 20 bp, Artificial Sequence
  Description of Artificial Sequence: Synthetic oligonucleotide
  Target: SCN9A; (-) strand; PAM type: YTN; PAM sequence: TTT
gtctggctttgatatgagaa

SEQ ID NO: 61361 - DNA, 20 bp, Artificial Sequence
  Description of Artificial Sequence: Synthetic oligonucleotide
  Target: SCN9A; (-) strand; PAM type: YTN; PAM sequence: CTT
tgtctggctttgatatgaga

SEQ ID NO: 61362 - DNA, 20 bp, Artificial Sequence
  Description of Artificial Sequence: Synthetic oligonucleotide
  Target: SCN9A; (-) strand; PAM type: YTN; PAM sequence: TTA
cagtgtctttgtctggcttt

SEQ ID NO: 61363 - DNA, 20 bp, Artificial Sequence
  Description of Artificial Sequence: Synthetic oligonucleotide
  Target: SCN9A; (-) strand; PAM type: YTN; PAM sequence: CTT
acagtgtctttgtctggctt

SEQ ID NO: 61364 - DNA, 20 bp, Artificial Sequence
  Description of Artificial Sequence: Synthetic oligonucleotide
  Target: SCN9A; (-) strand; PAM type: YTN; PAM sequence: TTC
ttacagtgtctttgtctggc

SEQ ID NO: 61365 - DNA, 20 bp, Artificial Sequence
  Description of Artificial Sequence: Synthetic oligonucleotide
  Target: SCN9A; (-) strand; PAM type: YTN; PAM sequence: TTT
cttacagtgtctttgtctgg

SEQ ID NO: 61366 - DNA, 20 bp, Artificial Sequence
  Description of Artificial Sequence: Synthetic oligonucleotide
  Target: SCN9A; (-) strand; PAM type: YTN; PAM sequence: TTT
tcttacagtgtctttgtctg

SEQ ID NO: 61367 - DNA, 20 bp, Artificial Sequence
  Description of Artificial Sequence: Synthetic oligonucleotide
  Target: SCN9A; (-) strand; PAM type: YTN; PAM sequence: CTT
ttcttacagtgtctttgtct

SEQ ID NO: 61368 - DNA, 20 bp, Artificial Sequence
  Description of Artificial Sequence: Synthetic oligonucleotide
  Target: SCN9A; (-) strand; PAM type: YTN; PAM sequence: TTC
ttttcttacagtgtctttgt

SEQ ID NO: 61369 - DNA, 20 bp, Artificial Sequence
  Description of Artificial Sequence: Synthetic oligonucleotide
  Target: SCN9A; (-) strand; PAM type: YTN; PAM sequence: TTT
cttttcttacagtgtctttg

SEQ ID NO: 61370 - DNA, 20 bp, Artificial Sequence
  Description of Artificial Sequence: Synthetic oligonucleotide
  Target: SCN9A; (-) strand; PAM type: YTN; PAM sequence: TTT
tcttttcttacagtgtcttt

SEQ ID NO: 61371 - DNA, 20 bp, Artificial Sequence
  Description of Artificial Sequence: Synthetic oligonucleotide
  Target: SCN9A; (-) strand; PAM type: YTN; PAM sequence: CTG
taattttcttttcttacagt

SEQ ID NO: 61372 - DNA, 20 bp, Artificial Sequence
  Description of Artificial Sequence: Synthetic oligonucleotide
  Target: SCN9A; (-) strand; PAM type: YTN; PAM sequence: TTC
aaaagctgtaattttctttt

SEQ ID NO: 61373 - DNA, 20 bp, Artificial Sequence
  Description of Artificial Sequence: Synthetic oligonucleotide
  Target: SCN9A; (-) strand; PAM type: YTN; PAM sequence: CTT
caaaagctgtaattttcttt

SEQ ID NO: 61374 - DNA, 20 bp, Artificial Sequence
  Description of Artificial Sequence: Synthetic oligonucleotide
  Target: SCN9A; (-) strand; PAM type: YTN; PAM sequence: TTC
cttcaaaagctgtaattttc

SEQ ID NO: 61375 - DNA, 20 bp, Artificial Sequence
  Description of Artificial Sequence: Synthetic oligonucleotide
  Target: SCN9A; (-) strand; PAM type: YTN; PAM sequence: CTT
ccttcaaaagctgtaatttt

SEQ ID NO: 61376 - DNA, 20 bp, Artificial Sequence
  Description of Artificial Sequence: Synthetic oligonucleotide
  Target: SCN9A; (-) strand; PAM type: YTN; PAM sequence: CTG
aagtcacttccttcaaaagc

SEQ ID NO: 61377 - DNA, 20 bp, Artificial Sequence
  Description of Artificial Sequence: Synthetic oligonucleotide
  Target: SCN9A; (-) strand; PAM type: YTN; PAM sequence: TTG
ctgaagtcacttccttcaaa

SEQ ID NO: 61378 - DNA, 20 bp, Artificial Sequence
  Description of Artificial Sequence: Synthetic oligonucleotide
  Target: SCN9A; (-) strand; PAM type: YTN; PAM sequence: TTC
cacaatgttgctgaagtcac

SEQ ID NO: 61379 - DNA, 20 bp, Artificial Sequence
  Description of Artificial Sequence: Synthetic oligonucleotide
  Target: SCN9A; (-) strand; PAM type: YTN; PAM sequence: CTA
ttccacaatgttgctgaagt

SEQ ID NO: 61380 - DNA, 20 bp, Artificial Sequence
  Description of Artificial Sequence: Synthetic oligonucleotide
  Target: SCN9A; (-) strand; PAM type: YTN; PAM sequence: CTC
ctattccacaatgttgctga

SEQ ID NO: 61381 - DNA, 20 bp, Artificial Sequence
  Description of Artificial Sequence: Synthetic oligonucleotide
  Target: SCN9A; (-) strand; PAM type: YTN; PAM sequence: TTG
gtacgtccatgagagaaaaa

SEQ ID NO: 61382 - DNA, 20 bp, Artificial Sequence
  Description of Artificial Sequence: Synthetic oligonucleotide
  Target: SCN9A; (-) strand; PAM type: YTN; PAM sequence: CTT
ggtacgtccatgagagaaaa

SEQ ID NO: 61383 - DNA, 20 bp, Artificial Sequence
  Description of Artificial Sequence: Synthetic oligonucleotide
  Target: SCN9A; (-) strand; PAM type: YTN; PAM sequence: TTA
cttggtacgtccatgagaga

SEQ ID NO: 61384 - DNA, 20 bp, Artificial Sequence
  Description of Artificial Sequence: Synthetic oligonucleotide
  Target: SCN9A; (-) strand; PAM type: YTN; PAM sequence: TTT
acttggtacgtccatgagag

SEQ ID NO: 61385 - DNA, 20 bp, Artificial Sequence
  Description of Artificial Sequence: Synthetic oligonucleotide
  Target: SCN9A; (-) strand; PAM type: YTN; PAM sequence: CTG
atccatgtgtatgtagatgt

SEQ ID NO: 61386 - DNA, 20 bp, Artificial Sequence
  Description of Artificial Sequence: Synthetic oligonucleotide
  Target: SCN9A; (-) strand; PAM type: YTN; PAM sequence: CTG
gagagaactgatccatgtgt

SEQ ID NO: 61387 - DNA, 20 bp, Artificial Sequence
  Description of Artificial Sequence: Synthetic oligonucleotide
  Target: SCN9A; (-) strand; PAM type: YTN; PAM sequence: CTC
tggagagaactgatccatgt

SEQ ID NO: 61388 - DNA, 20 bp, Artificial Sequence
  Description of Artificial Sequence: Synthetic oligonucleotide
  Target: SCN9A; (-) strand; PAM type: YTN; PAM sequence: TTC
tctggagagaactgatccat

SEQ ID NO: 61389 - DNA, 20 bp, Artificial Sequence
  Description of Artificial Sequence: Synthetic oligonucleotide
  Target: SCN9A; (-) strand; PAM type: YTN; PAM sequence: TTT
ctctggagagaactgatcca

SEQ ID NO: 61390 - DNA, 20 bp, Artificial Sequence
  Description of Artificial Sequence: Synthetic oligonucleotide
  Target: SCN9A; (-) strand; PAM type: YTN; PAM sequence: CTG
ggtttctctggagagaactg

SEQ ID NO: 61391 - DNA, 20 bp, Artificial Sequence
  Description of Artificial Sequence: Synthetic oligonucleotide
  Target: SCN9A; (-) strand; PAM type: YTN; PAM sequence: TTC
tgggtttctctggagagaac

SEQ ID NO: 61392 - DNA, 20 bp, Artificial Sequence
  Description of Artificial Sequence: Synthetic oligonucleotide
  Target: SCN9A; (-) strand; PAM type: YTN; PAM sequence: CTG
gattctgggtttctctggag

SEQ ID NO: 61393 - DNA, 20 bp, Artificial Sequence
  Description of Artificial Sequence: Synthetic oligonucleotide
  Target: SCN9A; (-) strand; PAM type: YTN; PAM sequence: CTA
ctggattctgggtttctctg

SEQ ID NO: 61394 - DNA, 20 bp, Artificial Sequence
  Description of Artificial Sequence: Synthetic oligonucleotide
  Target: SCN9A; (-) strand; PAM type: YTN; PAM sequence: TTC
tactggattctgggtttctc

SEQ ID NO: 61395 - DNA, 20 bp, Artificial Sequence
  Description of Artificial Sequence: Synthetic oligonucleotide
  Target: SCN9A; (-) strand; PAM type: YTN; PAM sequence: TTT
ctactggattctgggtttct

SEQ ID NO: 61396 - DNA, 20 bp, Artificial Sequence
  Description of Artificial Sequence: Synthetic oligonucleotide
  Target: SCN9A; (-) strand; PAM type: YTN; PAM sequence: TTT
tctactggattctgggtttc

SEQ ID NO: 61397 - DNA, 20 bp, Artificial Sequence
  Description of Artificial Sequence: Synthetic oligonucleotide
  Target: SCN9A; (-) strand; PAM type: YTN; PAM sequence: TTT
ttctactggattctgggttt

SEQ ID NO: 61398 - DNA, 20 bp, Artificial Sequence
  Description of Artificial Sequence: Synthetic oligonucleotide
  Target: SCN9A; (-) strand; PAM type: YTN; PAM sequence: CTG
gtgtgcatgagtttttctac

SEQ ID NO: 61399 - DNA, 20 bp, Artificial Sequence
  Description of Artificial Sequence: Synthetic oligonucleotide
  Target: SCN9A; (-) strand; PAM type: YTN; PAM sequence: CTC
tggtgtgcatgagtttttct

SEQ ID NO: 61400 - DNA, 20 bp, Artificial Sequence
  Description of Artificial Sequence: Synthetic oligonucleotide
  Target: SCN9A; (-) strand; PAM type: YTN; PAM sequence: CTG
tcctctggtgtgcatgagtt

SEQ ID NO: 61401 - DNA, 20 bp, Artificial Sequence
  Description of Artificial Sequence: Synthetic oligonucleotide
  Target: SCN9A; (-) strand; PAM type: YTN; PAM sequence: TTC
tgtcctctggtgtgcatgag

SEQ ID NO: 61402 - DNA, 20 bp, Artificial Sequence
  Description of Artificial Sequence: Synthetic oligonucleotide
  Target: SCN9A; (-) strand; PAM type: YTN; PAM sequence: TTT
ctgtcctctggtgtgcatga

SEQ ID NO: 61403 - DNA, 20 bp, Artificial Sequence
  Description of Artificial Sequence: Synthetic oligonucleotide
  Target: SCN9A; (-) strand; PAM type: YTN; PAM sequence: TTT
tctgtcctctggtgtgcatg

SEQ ID NO: 61404 - DNA, 20 bp, Artificial Sequence
  Description of Artificial Sequence: Synthetic oligonucleotide
  Target: SCN9A; (-) strand; PAM type: YTN; PAM sequence: TTG
atatgggtattttctgtcct

SEQ ID NO: 61405 - DNA, 20 bp, Artificial Sequence
  Description of Artificial Sequence: Synthetic oligonucleotide
  Target: SCN9A; (-) strand; PAM type: YTN; PAM sequence: TTT
gatatgggtattttctgtcc

SEQ ID NO: 61406 - DNA, 20 bp, Artificial Sequence
  Description of Artificial Sequence: Synthetic oligonucleotide
  Target: SCN9A; (-) strand; PAM type: YTN; PAM sequence: TTT
tgatatgggtattttctgtc

SEQ ID NO: 61407 - DNA, 20 bp, Artificial Sequence
  Description of Artificial Sequence: Synthetic oligonucleotide
  Target: SCN9A; (-) strand; PAM type: YTN; PAM sequence: CTA
cccattttgatatgggtatt

SEQ ID NO: 61408 - DNA, 20 bp, Artificial Sequence
  Description of Artificial Sequence: Synthetic oligonucleotide
  Target: SCN9A; (-) strand; PAM type: YTN; PAM sequence: TTC
tacccattttgatatgggta

SEQ ID NO: 61409 - DNA, 20 bp, Artificial Sequence
  Description of Artificial Sequence: Synthetic oligonucleotide
  Target: SCN9A; (-) strand; PAM type: YTN; PAM sequence: TTT
ctacccattttgatatgggt

SEQ ID NO: 61410 - DNA, 20 bp, Artificial Sequence
  Description of Artificial Sequence: Synthetic oligonucleotide
  Target: SCN9A; (-) strand; PAM type: YTN; PAM sequence: TTT
tctacccattttgatatggg

SEQ ID NO: 61411 - DNA, 20 bp, Artificial Sequence
  Description of Artificial Sequence: Synthetic oligonucleotide
  Target: SCN9A; (-) strand; PAM type: YTN; PAM sequence: TTT
ttctacccattttgatatgg

SEQ ID NO: 61412 - DNA, 20 bp, Artificial Sequence
  Description of Artificial Sequence: Synthetic oligonucleotide
  Target: SCN9A; (-) strand; PAM type: YTN; PAM sequence: CTT
tttctacccattttgatatg

SEQ ID NO: 61413 - DNA, 20 bp, Artificial Sequence
  Description of Artificial Sequence: Synthetic oligonucleotide
  Target: SCN9A; (-) strand; PAM type: YTN; PAM sequence: TTC
cactttttctacccattttg

SEQ ID NO: 61414 - DNA, 20 bp, Artificial Sequence
  Description of Artificial Sequence: Synthetic oligonucleotide
  Target: SCN9A; (-) strand; PAM type: YTN; PAM sequence: TTT
ccactttttctacccatttt

SEQ ID NO: 61415 - DNA, 20 bp, Artificial Sequence
  Description of Artificial Sequence: Synthetic oligonucleotide
  Target: SCN9A; (-) strand; PAM type: YTN; PAM sequence: CTT
tccactttttctacccattt

SEQ ID NO: 61416 - DNA, 20 bp, Artificial Sequence
  Description of Artificial Sequence: Synthetic oligonucleotide
  Target: SCN9A; (-) strand; PAM type: YTN; PAM sequence: TTA
gtgcatgagtgtctttccac

SEQ ID NO: 61417 - DNA, 20 bp, Artificial Sequence
  Description of Artificial Sequence: Synthetic oligonucleotide
  Target: SCN9A; (-) strand; PAM type: YTN; PAM sequence: CTC
agggtggggttagtgcatga

SEQ ID NO: 61418 - DNA, 20 bp, Artificial Sequence
  Description of Artificial Sequence: Synthetic oligonucleotide
  Target: SCN9A; (-) strand; PAM type: YTN; PAM sequence: CTG
tgctcagggtggggttagtg

SEQ ID NO: 61419 - DNA, 20 bp, Artificial Sequence
  Description of Artificial Sequence: Synthetic oligonucleotide
  Target: SCN9A; (-) strand; PAM type: YTN; PAM sequence: TTC
ccaaatgtaaggcactgtgc

SEQ ID NO: 61420 - DNA, 20 bp, Artificial Sequence
  Description of Artificial Sequence: Synthetic oligonucleotide
  Target: SCN9A; (-) strand; PAM type: YTN; PAM sequence: CTT
cccaaatgtaaggcactgtg

SEQ ID NO: 61421 - DNA, 20 bp, Artificial Sequence
  Description of Artificial Sequence: Synthetic oligonucleotide
  Target: SCN9A; (-) strand; PAM type: YTN; PAM sequence: TTC
ttcccaaatgtaaggcactg

SEQ ID NO: 61422 - DNA, 20 bp, Artificial Sequence
  Description of Artificial Sequence: Synthetic oligonucleotide
  Target: SCN9A; (-) strand; PAM type: YTN; PAM sequence: TTT
cttcccaaatgtaaggcact

SEQ ID NO: 61423 - DNA, 20 bp, Artificial Sequence
  Description of Artificial Sequence: Synthetic oligonucleotide
  Target: SCN9A; (-) strand; PAM type: YTN; PAM sequence: TTT
tcttcccaaatgtaaggcac

SEQ ID NO: 61424 - DNA, 20 bp, Artificial Sequence
  Description of Artificial Sequence: Synthetic oligonucleotide
  Target: SCN9A; (-) strand; PAM type: YTN; PAM sequence: TTG
gttttcttcccaaatgtaag

SEQ ID NO: 61425 - DNA, 20 bp, Artificial Sequence
  Description of Artificial Sequence: Synthetic oligonucleotide
  Target: SCN9A; (-) strand; PAM type: YTN; PAM sequence: TTT
ggttttcttcccaaatgtaa

SEQ ID NO: 61426 - DNA, 20 bp, Artificial Sequence
  Description of Artificial Sequence: Synthetic oligonucleotide
  Target: SCN9A; (-) strand; PAM type: YTN; PAM sequence: CTG
caaatttggttttcttccca

SEQ ID NO: 61427 - DNA, 20 bp, Artificial Sequence
  Description of Artificial Sequence: Synthetic oligonucleotide
  Target: SCN9A; (-) strand; PAM type: YTN; PAM sequence: TTG
ggaagtagctgcaaatttgg

SEQ ID NO: 61428 - DNA, 20 bp, Artificial Sequence
  Description of Artificial Sequence: Synthetic oligonucleotide
  Target: SCN9A; (-) strand; PAM type: YTN; PAM sequence: CTT
gggaagtagctgcaaatttg

SEQ ID NO: 61429 - DNA, 20 bp, Artificial Sequence
  Description of Artificial Sequence: Synthetic oligonucleotide
  Target: SCN9A; (-) strand; PAM type: YTN; PAM sequence: CTC
aacccttgggaagtagctgc

SEQ ID NO: 61430 - DNA, 20 bp, Artificial Sequence
  Description of Artificial Sequence: Synthetic oligonucleotide
  Target: SCN9A; (-) strand; PAM type: YTN; PAM sequence: TTC
tcaacccttgggaagtagct

SEQ ID NO: 61431 - DNA, 20 bp, Artificial Sequence
  Description of Artificial Sequence: Synthetic oligonucleotide
  Target: SCN9A; (-) strand; PAM type: YTN; PAM sequence: TTT
ctcaacccttgggaagtagc

SEQ ID NO: 61432 - DNA, 20 bp, Artificial Sequence
  Description of Artificial Sequence: Synthetic oligonucleotide
  Target: SCN9A; (-) strand; PAM type: YTN; PAM sequence: CTA
tagtttctcaacccttggga

SEQ ID NO: 61433 - DNA, 20 bp, Artificial Sequence
  Description of Artificial Sequence: Synthetic oligonucleotide
  Target: SCN9A; (-) strand; PAM type: YTN; PAM sequence: CTA
tatgtgtgctatagtttctc

SEQ ID NO: 61434 - DNA, 20 bp, Artificial Sequence
  Description of Artificial Sequence: Synthetic oligonucleotide
  Target: SCN9A; (-) strand; PAM type: YTN; PAM sequence: TTC
tatatgtgtgctatagtttc

SEQ ID NO: 61435 - DNA, 20 bp, Artificial Sequence
  Description of Artificial Sequence: Synthetic oligonucleotide
  Target: SCN9A; (-) strand; PAM type: YTN; PAM sequence: TTG
ggttctatatgtgtgctata

SEQ ID NO: 61436 - DNA, 20 bp, Artificial Sequence
  Description of Artificial Sequence: Synthetic oligonucleotide
  Target: SCN9A; (-) strand; PAM type: YTN; PAM sequence: TTA
aaaaaaagttgggttctata

SEQ ID NO: 61437 - DNA, 20 bp, Artificial Sequence
  Description of Artificial Sequence: Synthetic oligonucleotide
  Target: SCN9A; (-) strand; PAM type: YTN; PAM sequence: TTA
aattaaaaaaaagttgggtt

SEQ ID NO: 61438 - DNA, 20 bp, Artificial Sequence
  Description of Artificial Sequence: Synthetic oligonucleotide
  Target: SCN9A; (-) strand; PAM type: YTN; PAM sequence: CTT
aaattaaaaaaaagttgggt

SEQ ID NO: 61439 - DNA, 20 bp, Artificial Sequence
  Description of Artificial Sequence: Synthetic oligonucleotide
  Target: SCN9A; (-) strand; PAM type: YTN; PAM sequence: TTC
cttaaattaaaaaaaagttg

SEQ ID NO: 61440 - DNA, 20 bp, Artificial Sequence
  Description of Artificial Sequence: Synthetic oligonucleotide
  Target: SCN9A; (-) strand; PAM type: YTN; PAM sequence: TTT
ccttaaattaaaaaaaagtt

SEQ ID NO: 61441 - DNA, 20 bp, Artificial Sequence
  Description of Artificial Sequence: Synthetic oligonucleotide
  Target: SCN9A; (-) strand; PAM type: YTN; PAM sequence: CTA
gaaataaatacatttcctta

SEQ ID NO: 61442 - DNA, 20 bp, Artificial Sequence
  Description of Artificial Sequence: Synthetic oligonucleotide
  Target: SCN9A; (-) strand; PAM type: YTN; PAM sequence: TTC
tagaaataaatacatttcct

SEQ ID NO: 61443 - DNA, 20 bp, Artificial Sequence
  Description of Artificial Sequence: Synthetic oligonucleotide
  Target: SCN9A; (-) strand; PAM type: YTN; PAM sequence: TTT
ctagaaataaatacatttcc

SEQ ID NO: 61444 - DNA, 20 bp, Artificial Sequence
  Description of Artificial Sequence: Synthetic oligonucleotide
  Target: SCN9A; (-) strand; PAM type: YTN; PAM sequence: TTT
tctagaaataaatacatttc

SEQ ID NO: 61445 - DNA, 20 bp, Artificial Sequence
  Description of Artificial Sequence: Synthetic oligonucleotide
  Target: SCN9A; (-) strand; PAM type: YTN; PAM sequence: CTA
gaaaaagcattttctagaaa

SEQ ID NO: 61446 - DNA, 20 bp, Artificial Sequence
  Description of Artificial Sequence: Synthetic oligonucleotide
  Target: SCN9A; (-) strand; PAM type: YTN; PAM sequence: CTC
tagaaaaagcattttctaga

SEQ ID NO: 61447 - DNA, 20 bp, Artificial Sequence
  Description of Artificial Sequence: Synthetic oligonucleotide
  Target: SCN9A; (-) strand; PAM type: YTN; PAM sequence: TTA
cactctagaaaaagcatttt

SEQ ID NO: 61448 - DNA, 20 bp, Artificial Sequence
  Description of Artificial Sequence: Synthetic oligonucleotide
  Target: SCN9A; (-) strand; PAM type: YTN; PAM sequence: TTT
acactctagaaaaagcattt

SEQ ID NO: 61449 - DNA, 20 bp, Artificial Sequence
  Description of Artificial Sequence: Synthetic oligonucleotide
  Target: SCN9A; (-) strand; PAM type: YTN; PAM sequence: CTT
tacactctagaaaaagcatt

SEQ ID NO: 61450 - DNA, 20 bp, Artificial Sequence
  Description of Artificial Sequence: Synthetic oligonucleotide
  Target: SCN9A; (-) strand; PAM type: YTN; PAM sequence: CTC
tttacactctagaaaaagca

SEQ ID NO: 61451 - DNA, 20 bp, Artificial Sequence
  Description of Artificial Sequence: Synthetic oligonucleotide
  Target: SCN9A; (-) strand; PAM type: YTN; PAM sequence: CTC
tctttacactctagaaaaag

SEQ ID NO: 61452 - DNA, 20 bp, Artificial Sequence
  Description of Artificial Sequence: Synthetic oligonucleotide
  Target: SCN9A; (-) strand; PAM type: YTN; PAM sequence: TTC
tctctttacactctagaaaa

SEQ ID NO: 61453 - DNA, 20 bp, Artificial Sequence
  Description of Artificial Sequence: Synthetic oligonucleotide
  Target: SCN9A; (-) strand; PAM type: YTN; PAM sequence: CTT
ctctctttacactctagaaa

SEQ ID NO: 61454 - DNA, 20 bp, Artificial Sequence
  Description of Artificial Sequence: Synthetic oligonucleotide
  Target: SCN9A; (-) strand; PAM type: YTN; PAM sequence: CTC
ttctctctttacactctaga

SEQ ID NO: 61455 - DNA, 20 bp, Artificial Sequence
  Description of Artificial Sequence: Synthetic oligonucleotide
  Target: SCN9A; (-) strand; PAM type: YTN; PAM sequence: TTC
atctcttctctctttacact

SEQ ID NO: 61456 - DNA, 20 bp, Artificial Sequence
  Description of Artificial Sequence: Synthetic oligonucleotide
  Target: SCN9A; (-) strand; PAM type: YTN; PAM sequence: TTA
taatatagttcatctcttct

SEQ ID NO: 61457 - DNA, 20 bp, Artificial Sequence
  Description of Artificial Sequence: Synthetic oligonucleotide
  Target: SCN9A; (-) strand; PAM type: YTN; PAM sequence: TTT
ataatatagttcatctcttc

SEQ ID NO: 61458 - DNA, 20 bp, Artificial Sequence
  Description of Artificial Sequence: Synthetic oligonucleotide
  Target: SCN9A; (-) strand; PAM type: YTN; PAM sequence: TTT
tataatatagttcatctctt

SEQ ID NO: 61459 - DNA, 20 bp, Artificial Sequence
  Description of Artificial Sequence: Synthetic oligonucleotide
  Target: SCN9A; (-) strand; PAM type: YTN; PAM sequence: TTA
tgaagatgattttataatat

SEQ ID NO: 61460 - DNA, 20 bp, Artificial Sequence
  Description of Artificial Sequence: Synthetic oligonucleotide
  Target: SCN9A; (-) strand; PAM type: YTN; PAM sequence: CTA
caaaatggaaaaccaaggca

SEQ ID NO: 61461 - DNA, 20 bp, Artificial Sequence
  Description of Artificial Sequence: Synthetic oligonucleotide
  Target: SCN9A; (-) strand; PAM type: YTN; PAM sequence: TTC
tacaaaatggaaaaccaagg

SEQ ID NO: 61462 - DNA, 20 bp, Artificial Sequence
  Description of Artificial Sequence: Synthetic oligonucleotide
  Target: SCN9A; (-) strand; PAM type: YTN; PAM sequence: TTG
ggttctacaaaatggaaaac

SEQ ID NO: 61463 - DNA, 20 bp, Artificial Sequence
  Description of Artificial Sequence: Synthetic oligonucleotide
  Target: SCN9A; (-) strand; PAM type: YTN; PAM sequence: CTA
taaaagttgggttctacaaa

SEQ ID NO: 61464 - DNA, 20 bp, Artificial Sequence
  Description of Artificial Sequence: Synthetic oligonucleotide
  Target: SCN9A; (-) strand; PAM type: YTN; PAM sequence: CTG
tgtcagggcctataaaagtt

SEQ ID NO: 61465 - DNA, 20 bp, Artificial Sequence
  Description of Artificial Sequence: Synthetic oligonucleotide
  Target: SCN9A; (-) strand; PAM type: YTN; PAM sequence: CTC
tgtgtcagggcctataaaag

SEQ ID NO: 61466 - DNA, 20 bp, Artificial Sequence
  Description of Artificial Sequence: Synthetic oligonucleotide
  Target: SCN9A; (-) strand; PAM type: YTN; PAM sequence: CTA
aaagccaagctctgtgtcag

SEQ ID NO: 61467 - DNA, 20 bp, Artificial Sequence
  Description of Artificial Sequence: Synthetic oligonucleotide
  Target: SCN9A; (-) strand; PAM type: YTN; PAM sequence: CTC
aagcatggtgatctaaaagc

SEQ ID NO: 61468 - DNA, 20 bp, Artificial Sequence
  Description of Artificial Sequence: Synthetic oligonucleotide
  Target: SCN9A; (-) strand; PAM type: YTN; PAM sequence: TTC
ctcaagcatggtgatctaaa

SEQ ID NO: 61469 - DNA, 20 bp, Artificial Sequence
  Description of Artificial Sequence: Synthetic oligonucleotide
  Target: SCN9A; (-) strand; PAM type: YTN; PAM sequence: CTG
ccattcctcaagcatggtga

SEQ ID NO: 61470 - DNA, 20 bp, Artificial Sequence
  Description of Artificial Sequence: Synthetic oligonucleotide
  Target: SCN9A; (-) strand; PAM type: YTN; PAM sequence: CTC
tgccattcctcaagcatggt

SEQ ID NO: 61471 - DNA, 20 bp, Artificial Sequence
  Description of Artificial Sequence: Synthetic oligonucleotide
  Target: SCN9A; (-) strand; PAM type: YTN; PAM sequence: TTA
tctctgccattcctcaagca

SEQ ID NO: 61472 - DNA, 20 bp, Artificial Sequence
  Description of Artificial Sequence: Synthetic oligonucleotide
  Target: SCN9A; (-) strand; PAM type: YTN; PAM sequence: CTT
atctctgccattcctcaagc

SEQ ID NO: 61473 - DNA, 20 bp, Artificial Sequence
  Description of Artificial Sequence: Synthetic oligonucleotide
  Target: SCN9A; (-) strand; PAM type: YTN; PAM sequence: CTC
caatggcttatctctgccat

SEQ ID NO: 61474 - DNA, 20 bp, Artificial Sequence
  Description of Artificial Sequence: Synthetic oligonucleotide
  Target: SCN9A; (-) strand; PAM type: YTN; PAM sequence: TTG
agagaaaactccaatggctt

SEQ ID NO: 61475 - DNA, 20 bp, Artificial Sequence
  Description of Artificial Sequence: Synthetic oligonucleotide
  Target: SCN9A; (-) strand; PAM type: YTN; PAM sequence: CTT
gagagaaaactccaatggct

SEQ ID NO: 61476 - DNA, 20 bp, Artificial Sequence
  Description of Artificial Sequence: Synthetic oligonucleotide
  Target: SCN9A; (-) strand; PAM type: YTN; PAM sequence: TTG
tacttgagagaaaactccaa

SEQ ID NO: 61477 - DNA, 20 bp, Artificial Sequence
  Description of Artificial Sequence: Synthetic oligonucleotide
  Target: SCN9A; (-) strand; PAM type: YTN; PAM sequence: TTT
gtacttgagagaaaactcca

SEQ ID NO: 61478 - DNA, 20 bp, Artificial Sequence
  Description of Artificial Sequence: Synthetic oligonucleotide
  Target: SCN9A; (-) strand; PAM type: YTN; PAM sequence: TTT
tgtacttgagagaaaactcc

SEQ ID NO: 61479 - DNA, 20 bp, Artificial Sequence
  Description of Artificial Sequence: Synthetic oligonucleotide
  Target: SCN9A; (-) strand; PAM type: YTN; PAM sequence: TTT
ttgtacttgagagaaaactc

SEQ ID NO: 61480 - DNA, 20 bp, Artificial Sequence
  Description of Artificial Sequence: Synthetic oligonucleotide
  Target: SCN9A; (-) strand; PAM type: YTN; PAM sequence: TTT
tttgtacttgagagaaaact

SEQ ID NO: 61481 - DNA, 20 bp, Artificial Sequence
  Description of Artificial Sequence: Synthetic oligonucleotide
  Target: SCN9A; (-) strand; PAM type: YTN; PAM sequence: TTC
aaaaccccccatcgtttttt

SEQ ID NO: 61482 - DNA, 20 bp, Artificial Sequence
  Description of Artificial Sequence: Synthetic oligonucleotide
  Target: SCN9A; (-) strand; PAM type: YTN; PAM sequence: CTC
aggcagttcaaaacccccca

SEQ ID NO: 61483 - DNA, 20 bp, Artificial Sequence
  Description of Artificial Sequence: Synthetic oligonucleotide
  Target: SCN9A; (-) strand; PAM type: YTN; PAM sequence: CTG
agagtgctcaggcagttcaa

SEQ ID NO: 61484 - DNA, 20 bp, Artificial Sequence
  Description of Artificial Sequence: Synthetic oligonucleotide
  Target: SCN9A; (-) strand; PAM type: YTN; PAM sequence: TTC
tgagagtgctcaggcagttc

SEQ ID NO: 61485 - DNA, 20 bp, Artificial Sequence
  Description of Artificial Sequence: Synthetic oligonucleotide
  Target: SCN9A; (-) strand; PAM type: YTN; PAM sequence: CTT
ctgagagtgctcaggcagtt

SEQ ID NO: 61486 - DNA, 20 bp, Artificial Sequence
  Description of Artificial Sequence: Synthetic oligonucleotide
  Target: SCN9A; (-) strand; PAM type: YTN; PAM sequence: TTA
aagcttctgagagtgctcag

SEQ ID NO: 61487 - DNA, 20 bp, Artificial Sequence
  Description of Artificial Sequence: Synthetic oligonucleotide
  Target: SCN9A; (-) strand; PAM type: YTN; PAM sequence: CTG
atcccaggaattaaagcttc

SEQ ID NO: 61488 - DNA, 20 bp, Artificial Sequence
  Description of Artificial Sequence: Synthetic oligonucleotide
  Target: SCN9A; (-) strand; PAM type: YTN; PAM sequence: TTG
gaagatggtctgatcccagg

SEQ ID NO: 61489 - DNA, 20 bp, Artificial Sequence
  Description of Artificial Sequence: Synthetic oligonucleotide
  Target: SCN9A; (-) strand; PAM type: YTN; PAM sequence: TTC
catggggaagttggaagatg

SEQ ID NO: 61490 - DNA, 20 bp, Artificial Sequence
  Description of Artificial Sequence: Synthetic oligonucleotide
  Target: SCN9A; (-) strand; PAM type: YTN; PAM sequence: TTT
ccatggggaagttggaagat

SEQ ID NO: 61491 - DNA, 20 bp, Artificial Sequence
  Description of Artificial Sequence: Synthetic oligonucleotide
  Target: SCN9A; (-) strand; PAM type: YTN; PAM sequence: CTA
atggtttccatggggaagtt

SEQ ID NO: 61492 - DNA, 20 bp, Artificial Sequence
  Description of Artificial Sequence: Synthetic oligonucleotide
  Target: SCN9A; (-) strand; PAM type: YTN; PAM sequence: CTG
gaaaacgtgtagcctaatgg

SEQ ID NO: 61493 - DNA, 20 bp, Artificial Sequence
  Description of Artificial Sequence: Synthetic oligonucleotide
  Target: SCN9A; (-) strand; PAM type: YTN; PAM sequence: CTG
gaagaggccagaaccacagg

SEQ ID NO: 61494 - DNA, 20 bp, Artificial Sequence
  Description of Artificial Sequence: Synthetic oligonucleotide
  Target: SCN9A; (-) strand; PAM type: YTN; PAM sequence: TTC
caagtactggaagaggccag

SEQ ID NO: 61495 - DNA, 20 bp, Artificial Sequence
  Description of Artificial Sequence: Synthetic oligonucleotide
  Target: SCN9A; (-) strand; PAM type: YTN; PAM sequence: TTT
ccaagtactggaagaggcca

SEQ ID NO: 61496 - DNA, 20 bp, Artificial Sequence
  Description of Artificial Sequence: Synthetic oligonucleotide
  Target: SCN9A; (-) strand; PAM type: YTN; PAM sequence: CTA
tgtagatttccaagtactgg

SEQ ID NO: 61497 - DNA, 20 bp, Artificial Sequence
  Description of Artificial Sequence: Synthetic oligonucleotide
  Target: SCN9A; (-) strand; PAM type: YTN; PAM sequence: TTG
ctatgtagatttccaagtac

SEQ ID NO: 61498 - DNA, 20 bp, Artificial Sequence
  Description of Artificial Sequence: Synthetic oligonucleotide
  Target: SCN9A; (-) strand; PAM type: YTN; PAM sequence: TTT
gctatgtagatttccaagta

SEQ ID NO: 61499 - DNA, 20 bp, Artificial Sequence
  Description of Artificial Sequence: Synthetic oligonucleotide
  Target: SCN9A; (-) strand; PAM type: YTN; PAM sequence: TTC
atttgctatgtagatttcca

SEQ ID NO: 61500 - DNA, 20 bp, Artificial Sequence
  Description of Artificial Sequence: Synthetic oligonucleotide
  Target: SCN9A; (-) strand; PAM type: YTN; PAM sequence: CTT
catttgctatgtagatttcc

SEQ ID NO: 61501 - DNA, 20 bp, Artificial Sequence
  Description of Artificial Sequence: Synthetic oligonucleotide
  Target: SCN9A; (-) strand; PAM type: YTN; PAM sequence: TTC
ttcatttgctatgtagattt

SEQ ID NO: 61502 - DNA, 20 bp, Artificial Sequence
  Description of Artificial Sequence: Synthetic oligonucleotide
  Target: SCN9A; (-) strand; PAM type: YTN; PAM sequence: TTA
ttcttcatttgctatgtaga

SEQ ID NO: 61503 - DNA, 20 bp, Artificial Sequence
  Description of Artificial Sequence: Synthetic oligonucleotide
  Target: SCN9A; (-) strand; PAM type: YTN; PAM sequence: TTT
attcttcatttgctatgtag

SEQ ID NO: 61504 - DNA, 20 bp, Artificial Sequence
  Description of Artificial Sequence: Synthetic oligonucleotide
  Target: SCN9A; (-) strand; PAM type: YTN; PAM sequence: CTG
aagaaggtttattcttcatt

SEQ ID NO: 61505 - DNA, 20 bp, Artificial Sequence
  Description of Artificial Sequence: Synthetic oligonucleotide
  Target: SCN9A; (-) strand; PAM type: YTN; PAM sequence: TTA
ggctgaagaaggtttattct

SEQ ID NO: 61506 - DNA, 20 bp, Artificial Sequence
  Description of Artificial Sequence: Synthetic oligonucleotide
  Target: SCN9A; (-) strand; PAM type: YTN; PAM sequence: TTT
aggctgaagaaggtttattc

SEQ ID NO: 61507 - DNA, 20 bp, Artificial Sequence
  Description of Artificial Sequence: Synthetic oligonucleotide
  Target: SCN9A; (-) strand; PAM type: YTN; PAM sequence: TTG
tttaggctgaagaaggttta

SEQ ID NO: 61508 - DNA, 20 bp, Artificial Sequence
  Description of Artificial Sequence: Synthetic oligonucleotide
  Target: SCN9A; (-) strand; PAM type: YTN; PAM sequence: CTT
gtttaggctgaagaaggttt

SEQ ID NO: 61509 - DNA, 20 bp, Artificial Sequence
  Description of Artificial Sequence: Synthetic oligonucleotide
  Target: SCN9A; (-) strand; PAM type: YTN; PAM sequence: CTC
ttgtttaggctgaagaaggt

SEQ ID NO: 61510 - DNA, 20 bp, Artificial Sequence
  Description of Artificial Sequence: Synthetic oligonucleotide
  Target: SCN9A; (-) strand; PAM type: YTN; PAM sequence: TTC
ctcttgtttaggctgaagaa

SEQ ID NO: 61511 - DNA, 20 bp, Artificial Sequence
  Description of Artificial Sequence: Synthetic oligonucleotide
  Target: SCN9A; (-) strand; PAM type: YTN; PAM sequence: TTA
ttcctcttgtttaggctgaa

SEQ ID NO: 61512 - DNA, 20 bp, Artificial Sequence
  Description of Artificial Sequence: Synthetic oligonucleotide
  Target: SCN9A; (-) strand; PAM type: YTN; PAM sequence: CTG
gaggaagccagggaagaagg

SEQ ID NO: 61513 - DNA, 20 bp, Artificial Sequence
  Description of Artificial Sequence: Synthetic oligonucleotide
  Target: SCN9A; (-) strand; PAM type: YTN; PAM sequence: CTC
tggaggaagccagggaagaa

SEQ ID NO: 61514 - DNA, 20 bp, Artificial Sequence
  Description of Artificial Sequence: Synthetic oligonucleotide
  Target: SCN9A; (-) strand; PAM type: YTN; PAM sequence: TTG
tctctggaggaagccaggga

SEQ ID NO: 61515 - DNA, 20 bp, Artificial Sequence
  Description of Artificial Sequence: Synthetic oligonucleotide
  Target: SCN9A; (-) strand; PAM type: YTN; PAM sequence: TTG
ggattgtctctggaggaagc

SEQ ID NO: 61516 - DNA, 20 bp, Artificial Sequence
  Description of Artificial Sequence: Synthetic oligonucleotide
  Target: SCN9A; (-) strand; PAM type: YTN; PAM sequence: TTG
tagagttgggattgtctctg

SEQ ID NO: 61517 - DNA, 20 bp, Artificial Sequence
  Description of Artificial Sequence: Synthetic oligonucleotide
  Target: SCN9A; (-) strand; PAM type: YTN; PAM sequence: CTC
aaaaaaaaaaaaaaaaaaaa

SEQ ID NO: 61518 - DNA, 20 bp, Artificial Sequence
  Description of Artificial Sequence: Synthetic oligonucleotide
  Target: SCN9A; (-) strand; PAM type: YTN; PAM sequence: CTC
catctcaaaaaaaaaaaaaa

SEQ ID NO: 61519 - DNA, 20 bp, Artificial Sequence
  Description of Artificial Sequence: Synthetic oligonucleotide
  Target: SCN9A; (-) strand; PAM type: YTN; PAM sequence: CTG
ggcgacagagcgagacagcg

SEQ ID NO: 61520 - DNA, 20 bp, Artificial Sequence
  Description of Artificial Sequence: Synthetic oligonucleotide
  Target: SCN9A; (-) strand; PAM type: YTN; PAM sequence: CTC
cagcctgggcgacagagcga

SEQ ID NO: 61521 - DNA, 20 bp, Artificial Sequence
  Description of Artificial Sequence: Synthetic oligonucleotide
  Target: SCN9A; (-) strand; PAM type: YTN; PAM sequence: CTG
cactccagcctgggcgacag

SEQ ID NO: 61522 - DNA, 20 bp, Artificial Sequence
  Description of Artificial Sequence: Synthetic oligonucleotide
  Target: SCN9A; (-) strand; PAM type: YTN; PAM sequence: TTG
cgccactgcactccagcctg

SEQ ID NO: 61523 - DNA, 20 bp, Artificial Sequence
  Description of Artificial Sequence: Synthetic oligonucleotide
  Target: SCN9A; (-) strand; PAM type: YTN; PAM sequence: TTG
cagtgagccgagattgcgcc

SEQ ID NO: 61524 - DNA, 20 bp, Artificial Sequence
  Description of Artificial Sequence: Synthetic oligonucleotide
  Target: SCN9A; (-) strand; PAM type: YTN; PAM sequence: CTT
gcagtgagccgagattgcgc

SEQ ID NO: 61525 - DNA, 20 bp, Artificial Sequence
  Description of Artificial Sequence: Synthetic oligonucleotide
  Target: SCN9A; (-) strand; PAM type: YTN; PAM sequence: CTG
aggcaggagaatggcatgaa

SEQ ID NO: 61526 - DNA, 20 bp, Artificial Sequence
  Description of Artificial Sequence: Synthetic oligonucleotide
  Target: SCN9A; (-) strand; PAM type: YTN; PAM sequence: CTC
gggaggctgaggcaggagaa

SEQ ID NO: 61527 - DNA, 20 bp, Artificial Sequence
  Description of Artificial Sequence: Synthetic oligonucleotide
  Target: SCN9A; (-) strand; PAM type: YTN; PAM sequence: CTA
ctcgggaggctgaggcagga

SEQ ID NO: 61528 - DNA, 20 bp, Artificial Sequence
  Description of Artificial Sequence: Synthetic oligonucleotide
  Target: SCN9A; (-) strand; PAM type: YTN; PAM sequence: CTG
tagtcccagctactcgggag

SEQ ID NO: 61529 - DNA, 20 bp, Artificial Sequence
  Description of Artificial Sequence: Synthetic oligonucleotide
  Target: SCN9A; (-) strand; PAM type: YTN; PAM sequence: TTA
gccgggcgtggtagcgggcg

SEQ ID NO: 61530 - DNA, 20 bp, Artificial Sequence
  Description of Artificial Sequence: Synthetic oligonucleotide
  Target: SCN9A; (-) strand; PAM type: YTN; PAM sequence: CTA
aaaatacaaaaaattagccg

SEQ ID NO: 61531 - DNA, 20 bp, Artificial Sequence
  Description of Artificial Sequence: Synthetic oligonucleotide
  Target: SCN9A; (-) strand; PAM type: YTN; PAM sequence: CTA
ctaaaaatacaaaaaattag

SEQ ID NO: 61532 - DNA, 20 bp, Artificial Sequence
  Description of Artificial Sequence: Synthetic oligonucleotide
  Target: SCN9A; (-) strand; PAM type: YTN; PAM sequence: CTC
tactaaaaatacaaaaaatt

SEQ ID NO: 61533 - DNA, 20 bp, Artificial Sequence
  Description of Artificial Sequence: Synthetic oligonucleotide
  Target: SCN9A; (-) strand; PAM type: YTN; PAM sequence: CTA
acacggtgaaaccccgtctc

SEQ ID NO: 61534 - DNA, 20 bp, Artificial Sequence
  Description of Artificial Sequence: Synthetic oligonucleotide
  Target: SCN9A; (-) strand; PAM type: YTN; PAM sequence: CTG
gctaacacggtgaaaccccg

SEQ ID NO: 61535 - DNA, 20 bp, Artificial Sequence
  Description of Artificial Sequence: Synthetic oligonucleotide
  Target: SCN9A; (-) strand; PAM type: YTN; PAM sequence: TTG
ggaggccgaggcgggcggat

SEQ ID NO: 61536 - DNA, 20 bp, Artificial Sequence
  Description of Artificial Sequence: Synthetic oligonucleotide
  Target: SCN9A; (-) strand; PAM type: YTN; PAM sequence: TTT
gggaggccgaggcgggcgga

SEQ ID NO: 61537 - DNA, 20 bp, Artificial Sequence
  Description of Artificial Sequence: Synthetic oligonucleotide
  Target: SCN9A; (-) strand; PAM type: YTN; PAM sequence: CTT
tgggaggccgaggcgggcgg

SEQ ID NO: 61538 - DNA, 20 bp, Artificial Sequence
  Description of Artificial Sequence: Synthetic oligonucleotide
  Target: SCN9A; (-) strand; PAM type: YTN; PAM sequence: CTG
taatcccagcactttgggag

SEQ ID NO: 61539 - DNA, 20 bp, Artificial Sequence
  Description of Artificial Sequence: Synthetic oligonucleotide
  Target: SCN9A; (-) strand; PAM type: YTN; PAM sequence: CTC
acgcctgtaatcccagcact

SEQ ID NO: 61540 - DNA, 20 bp, Artificial Sequence
  Description of Artificial Sequence: Synthetic oligonucleotide
  Target: SCN9A; (-) strand; PAM type: YTN; PAM sequence: TTG
tggccgggcgcggtggctca

SEQ ID NO: 61541 - DNA, 20 bp, Artificial Sequence
  Description of Artificial Sequence: Synthetic oligonucleotide
  Target: SCN9A; (-) strand; PAM type: YTN; PAM sequence: TTA
aaagaaagattgtggccggg

SEQ ID NO: 61542 - DNA, 20 bp, Artificial Sequence
  Description of Artificial Sequence: Synthetic oligonucleotide
  Target: SCN9A; (-) strand; PAM type: YTN; PAM sequence: TTT
aaaagaaagattgtggccgg

SEQ ID NO: 61543 - DNA, 20 bp, Artificial Sequence
  Description of Artificial Sequence: Synthetic oligonucleotide
  Target: SCN9A; (-) strand; PAM type: YTN; PAM sequence: TTT
taaaagaaagattgtggccg

SEQ ID NO: 61544 - DNA, 20 bp, Artificial Sequence
  Description of Artificial Sequence: Synthetic oligonucleotide
  Target: SCN9A; (-) strand; PAM type: YTN; PAM sequence: CTT
ttaaaagaaagattgtggcc

SEQ ID NO: 61545 - DNA, 20 bp, Artificial Sequence
  Description of Artificial Sequence: Synthetic oligonucleotide
  Target: SCN9A; (-) strand; PAM type: YTN; PAM sequence: TTC
cacatcttttaaaagaaaga

SEQ ID NO: 61546 - DNA, 20 bp, Artificial Sequence
  Description of Artificial Sequence: Synthetic oligonucleotide
  Target: SCN9A; (-) strand; PAM type: YTN; PAM sequence: CTT
ccacatcttttaaaagaaag

SEQ ID NO: 61547 - DNA, 20 bp, Artificial Sequence
  Description of Artificial Sequence: Synthetic oligonucleotide
  Target: SCN9A; (-) strand; PAM type: YTN; PAM sequence: TTG
gtggtagagaccttccacat

SEQ ID NO: 61548 - DNA, 20 bp, Artificial Sequence
  Description of Artificial Sequence: Synthetic oligonucleotide
  Target: SCN9A; (-) strand; PAM type: YTN; PAM sequence: CTT
ggtggtagagaccttccaca

SEQ ID NO: 61549 - DNA, 20 bp, Artificial Sequence
  Description of Artificial Sequence: Synthetic oligonucleotide
  Target: SCN9A; (-) strand; PAM type: YTN; PAM sequence: TTC
ttggtggtagagaccttcca

SEQ ID NO: 61550 - DNA, 20 bp, Artificial Sequence
  Description of Artificial Sequence: Synthetic oligonucleotide
  Target: SCN9A; (-) strand; PAM type: YTN; PAM sequence: CTG
ttcttggtggtagagacctt

SEQ ID NO: 61551 - DNA, 20 bp, Artificial Sequence
  Description of Artificial Sequence: Synthetic oligonucleotide
  Target: SCN9A; (-) strand; PAM type: YTN; PAM sequence: TTC
ctgttcttggtggtagagac

SEQ ID NO: 61552 - DNA, 20 bp, Artificial Sequence
  Description of Artificial Sequence: Synthetic oligonucleotide
  Target: SCN9A; (-) strand; PAM type: YTN; PAM sequence: CTT
cctgttcttggtggtagaga

SEQ ID NO: 61553 - DNA, 20 bp, Artificial Sequence
  Description of Artificial Sequence: Synthetic oligonucleotide
  Target: SCN9A; (-) strand; PAM type: YTN; PAM sequence: TTA
tgtcaggagcaagccaggga

SEQ ID NO: 61554 - DNA, 20 bp, Artificial Sequence
  Description of Artificial Sequence: Synthetic oligonucleotide
  Target: SCN9A; (-) strand; PAM type: YTN; PAM sequence: CTG
cataaattatgtcaggagca

SEQ ID NO: 61555 - DNA, 20 bp, Artificial Sequence
  Description of Artificial Sequence: Synthetic oligonucleotide
  Target: SCN9A; (-) strand; PAM type: YTN; PAM sequence: CTA
ataagaaactgcataaatta

SEQ ID NO: 61556 - DNA, 20 bp, Artificial Sequence
  Description of Artificial Sequence: Synthetic oligonucleotide
  Target: SCN9A; (-) strand; PAM type: YTN; PAM sequence: CTC
taataagaaactgcataaat

SEQ ID NO: 61557 - DNA, 20 bp, Artificial Sequence
  Description of Artificial Sequence: Synthetic oligonucleotide
  Target: SCN9A; (-) strand; PAM type: YTN; PAM sequence: TTC
ctctaataagaaactgcata

SEQ ID NO: 61558 - DNA, 20 bp, Artificial Sequence
  Description of Artificial Sequence: Synthetic oligonucleotide
  Target: SCN9A; (-) strand; PAM type: YTN; PAM sequence: CTT
cctctaataagaaactgcat

SEQ ID NO: 61559 - DNA, 20 bp, Artificial Sequence
  Description of Artificial Sequence: Synthetic oligonucleotide
  Target: SCN9A; (-) strand; PAM type: YTN; PAM sequence: TTC
aagccttcctctaataagaa

SEQ ID NO: 61560 - DNA, 20 bp, Artificial Sequence
  Description of Artificial Sequence: Synthetic oligonucleotide
  Target: SCN9A; (-) strand; PAM type: YTN; PAM sequence: TTA
aagtgtagttcaagccttcc

SEQ ID NO: 61561 - DNA, 20 bp, Artificial Sequence
  Description of Artificial Sequence: Synthetic oligonucleotide
  Target: SCN9A; (-) strand; PAM type: YTN; PAM sequence: TTG
gattaaagtgtagttcaagc

SEQ ID NO: 61562 - DNA, 20 bp, Artificial Sequence
  Description of Artificial Sequence: Synthetic oligonucleotide
  Target: SCN9A; (-) strand; PAM type: YTN; PAM sequence: CTA
ttggattaaagtgtagttca

SEQ ID NO: 61563 - DNA, 20 bp, Artificial Sequence
  Description of Artificial Sequence: Synthetic oligonucleotide
  Target: SCN9A; (-) strand; PAM type: YTN; PAM sequence: TTA
gatctattggattaaagtgt

SEQ ID NO: 61564 - DNA, 20 bp, Artificial Sequence
  Description of Artificial Sequence: Synthetic oligonucleotide
  Target: SCN9A; (-) strand; PAM type: YTN; PAM sequence: CTG
ttagatctattggattaaag

SEQ ID NO: 61565 - DNA, 20 bp, Artificial Sequence
  Description of Artificial Sequence: Synthetic oligonucleotide
  Target: SCN9A; (-) strand; PAM type: YTN; PAM sequence: CTA
taaatatctgttagatctat

SEQ ID NO: 61566 - DNA, 20 bp, Artificial Sequence
  Description of Artificial Sequence: Synthetic oligonucleotide
  Target: SCN9A; (-) strand; PAM type: YTN; PAM sequence: TTC
tataaatatctgttagatct

SEQ ID NO: 61567 - DNA, 20 bp, Artificial Sequence
  Description of Artificial Sequence: Synthetic oligonucleotide
  Target: SCN9A; (-) strand; PAM type: YTN; PAM sequence: CTG
ttctataaatatctgttaga

SEQ ID NO: 61568 - DNA, 20 bp, Artificial Sequence
  Description of Artificial Sequence: Synthetic oligonucleotide
  Target: SCN9A; (-) strand; PAM type: YTN; PAM sequence: TTG
gatgaactgttctataaata

SEQ ID NO: 61569 - DNA, 20 bp, Artificial Sequence
  Description of Artificial Sequence: Synthetic oligonucleotide
  Target: SCN9A; (-) strand; PAM type: YTN; PAM sequence: CTG
ttggatgaactgttctataa

SEQ ID NO: 61570 - DNA, 20 bp, Artificial Sequence
  Description of Artificial Sequence: Synthetic oligonucleotide
  Target: SCN9A; (-) strand; PAM type: YTN; PAM sequence: TTG
ctgttggatgaactgttcta

SEQ ID NO: 61571 - DNA, 20 bp, Artificial Sequence
  Description of Artificial Sequence: Synthetic oligonucleotide
  Target: SCN9A; (-) strand; PAM type: YTN; PAM sequence: TTG
ttgctgttggatgaactgtt

SEQ ID NO: 61572 - DNA, 20 bp, Artificial Sequence
  Description of Artificial Sequence: Synthetic oligonucleotide
  Target: SCN9A; (-) strand; PAM type: YTN; PAM sequence: TTT
gttgctgttggatgaactgt

SEQ ID NO: 61573 - DNA, 20 bp, Artificial Sequence
  Description of Artificial Sequence: Synthetic oligonucleotide
  Target: SCN9A; (-) strand; PAM type: YTN; PAM sequence: TTT
tgttgctgttggatgaactg

SEQ ID NO: 61574 - DNA, 20 bp, Artificial Sequence
  Description of Artificial Sequence: Synthetic oligonucleotide
  Target: SCN9A; (-) strand; PAM type: YTN; PAM sequence: TTG
agaagaatatgtattttgtt

SEQ ID NO: 61575 - DNA, 20 bp, Artificial Sequence
  Description of Artificial Sequence: Synthetic oligonucleotide
  Target: SCN9A; (-) strand; PAM type: YTN; PAM sequence: TTT
gagaagaatatgtattttgt

SEQ ID NO: 61576 - DNA, 20 bp, Artificial Sequence
  Description of Artificial Sequence: Synthetic oligonucleotide
  Target: SCN9A; (-) strand; PAM type: YTN; PAM sequence: TTC
atgtgatttgagaagaatat

SEQ ID NO: 61577 - DNA, 20 bp, Artificial Sequence
  Description of Artificial Sequence: Synthetic oligonucleotide
  Target: SCN9A; (-) strand; PAM type: YTN; PAM sequence: TTT
catgtgatttgagaagaata

SEQ ID NO: 61578 - DNA, 20 bp, Artificial Sequence
  Description of Artificial Sequence: Synthetic oligonucleotide
  Target: SCN9A; (-) strand; PAM type: YTN; PAM sequence: CTG
gagagtgtttcatgtgattt

SEQ ID NO: 61579 - DNA, 20 bp, Artificial Sequence
  Description of Artificial Sequence: Synthetic oligonucleotide
  Target: SCN9A; (-) strand; PAM type: YTN; PAM sequence: CTA
tcctggagagtgtttcatgt

SEQ ID NO: 61580 - DNA, 20 bp, Artificial Sequence
  Description of Artificial Sequence: Synthetic oligonucleotide
  Target: SCN9A; (-) strand; PAM type: YTN; PAM sequence: CTA
acatgtgatctatcctggag

SEQ ID NO: 61581 - DNA, 20 bp, Artificial Sequence
  Description of Artificial Sequence: Synthetic oligonucleotide
  Target: SCN9A; (-) strand; PAM type: YTN; PAM sequence: TTG
gtggcctaacatgtgatcta

SEQ ID NO: 61582 - DNA, 20 bp, Artificial Sequence
  Description of Artificial Sequence: Synthetic oligonucleotide
  Target: SCN9A; (-) strand; PAM type: YTN; PAM sequence: TTT
ggtggcctaacatgtgatct

SEQ ID NO: 61583 - DNA, 20 bp, Artificial Sequence
  Description of Artificial Sequence: Synthetic oligonucleotide
  Target: SCN9A; (-) strand; PAM type: YTN; PAM sequence: TTG
tttggtggcctaacatgtga

SEQ ID NO: 61584 - DNA, 20 bp, Artificial Sequence
  Description of Artificial Sequence: Synthetic oligonucleotide
  Target: SCN9A; (-) strand; PAM type: YTN; PAM sequence: CTT
gtttggtggcctaacatgtg

SEQ ID NO: 61585 - DNA, 20 bp, Artificial Sequence
  Description of Artificial Sequence: Synthetic oligonucleotide
  Target: SCN9A; (-) strand; PAM type: YTN; PAM sequence: TTA
aaacttgtttggtggcctaa

SEQ ID NO: 61586 - DNA, 20 bp, Artificial Sequence
  Description of Artificial Sequence: Synthetic oligonucleotide
  Target: SCN9A; (-) strand; PAM type: YTN; PAM sequence: TTG
ttaaaacttgtttggtggcc

SEQ ID NO: 61587 - DNA, 20 bp, Artificial Sequence
  Description of Artificial Sequence: Synthetic oligonucleotide
  Target: SCN9A; (-) strand; PAM type: YTN; PAM sequence: TTT
gttaaaacttgtttggtggc

SEQ ID NO: 61588 - DNA, 20 bp, Artificial Sequence
  Description of Artificial Sequence: Synthetic oligonucleotide
  Target: SCN9A; (-) strand; PAM type: YTN; PAM sequence: TTA
aatttgttaaaacttgtttg

SEQ ID NO: 61589 - DNA, 20 bp, Artificial Sequence
  Description of Artificial Sequence: Synthetic oligonucleotide
  Target: SCN9A; (-) strand; PAM type: YTN; PAM sequence: CTT
aaatttgttaaaacttgttt

SEQ ID NO: 61590 - DNA, 20 bp, Artificial Sequence
  Description of Artificial Sequence: Synthetic oligonucleotide
  Target: SCN9A; (-) strand; PAM type: YTN; PAM sequence: TTC
ttaaatttgttaaaacttgt

SEQ ID NO: 61591 - DNA, 20 bp, Artificial Sequence
  Description of Artificial Sequence: Synthetic oligonucleotide
  Target: SCN9A; (-) strand; PAM type: YTN; PAM sequence: CTT
cttaaatttgttaaaacttg

SEQ ID NO: 61592 - DNA, 20 bp, Artificial Sequence
  Description of Artificial Sequence: Synthetic oligonucleotide
  Target: SCN9A; (-) strand; PAM type: YTN; PAM sequence: TTA
atcttcttaaatttgttaaa

SEQ ID NO: 61593 - DNA, 20 bp, Artificial Sequence
  Description of Artificial Sequence: Synthetic oligonucleotide
  Target: SCN9A; (-) strand; PAM type: YTN; PAM sequence: TTT
aatcttcttaaatttgttaa

SEQ ID NO: 61594 - DNA, 20 bp, Artificial Sequence
  Description of Artificial Sequence: Synthetic oligonucleotide
  Target: SCN9A; (-) strand; PAM type: YTN; PAM sequence: TTT
taatcttcttaaatttgtta

SEQ ID NO: 61595 - DNA, 20 bp, Artificial Sequence
  Description of Artificial Sequence: Synthetic oligonucleotide
  Target: SCN9A; (-) strand; PAM type: YTN; PAM sequence: CTC
gatatgattttaatcttctt

SEQ ID NO: 61596 - DNA, 20 bp, Artificial Sequence
  Description of Artificial Sequence: Synthetic oligonucleotide
  Target: SCN9A; (-) strand; PAM type: YTN; PAM sequence: TTC
atgtcatcatgaacagaaaa

SEQ ID NO: 61597 - DNA, 20 bp, Artificial Sequence
  Description of Artificial Sequence: Synthetic oligonucleotide
  Target: SCN9A; (-) strand; PAM type: YTN; PAM sequence: TTT
catgtcatcatgaacagaaa

SEQ ID NO: 61598 - DNA, 20 bp, Artificial Sequence
  Description of Artificial Sequence: Synthetic oligonucleotide
  Target: SCN9A; (-) strand; PAM type: YTN; PAM sequence: CTA
gtttcatgtcatcatgaaca

SEQ ID NO: 61599 - DNA, 20 bp, Artificial Sequence
  Description of Artificial Sequence: Synthetic oligonucleotide
  Target: SCN9A; (-) strand; PAM type: YTN; PAM sequence: TTC
tagtttcatgtcatcatgaa

SEQ ID NO: 61600 - DNA, 20 bp, Artificial Sequence
  Description of Artificial Sequence: Synthetic oligonucleotide
  Target: SCN9A; (-) strand; PAM type: YTN; PAM sequence: CTT
ctagtttcatgtcatcatga

SEQ ID NO: 61601 - DNA, 20 bp, Artificial Sequence
  Description of Artificial Sequence: Synthetic oligonucleotide
  Target: SCN9A; (-) strand; PAM type: YTN; PAM sequence: TTG
acttctagtttcatgtcatc

SEQ ID NO: 61602 - DNA, 20 bp, Artificial Sequence
  Description of Artificial Sequence: Synthetic oligonucleotide
  Target: SCN9A; (-) strand; PAM type: YTN; PAM sequence: TTA
ttgacttctagtttcatgtc

SEQ ID NO: 61603 - DNA, 20 bp, Artificial Sequence
  Description of Artificial Sequence: Synthetic oligonucleotide
  Target: SCN9A; (-) strand; PAM type: YTN; PAM sequence: CTT
attgacttctagtttcatgt

SEQ ID NO: 61604 - DNA, 20 bp, Artificial Sequence
  Description of Artificial Sequence: Synthetic oligonucleotide
  Target: SCN9A; (-) strand; PAM type: YTN; PAM sequence: TTC
ttattgacttctagtttcat

SEQ ID NO: 61605 - DNA, 20 bp, Artificial Sequence
  Description of Artificial Sequence: Synthetic oligonucleotide
  Target: SCN9A; (-) strand; PAM type: YTN; PAM sequence: TTA
ttcttattgacttctagttt

SEQ ID NO: 61606 - DNA, 20 bp, Artificial Sequence
  Description of Artificial Sequence: Synthetic oligonucleotide
  Target: SCN9A; (-) strand; PAM type: YTN; PAM sequence: TTC
aaggttattcttattgactt

SEQ ID NO: 61607 - DNA, 20 bp, Artificial Sequence
  Description of Artificial Sequence: Synthetic oligonucleotide
  Target: SCN9A; (-) strand; PAM type: YTN; PAM sequence: TTG
ttcaaggttattcttattga

SEQ ID NO: 61608 - DNA, 20 bp, Artificial Sequence
  Description of Artificial Sequence: Synthetic oligonucleotide
  Target: SCN9A; (-) strand; PAM type: YTN; PAM sequence: TTA
tgagttgttcaaggttattc

SEQ ID NO: 61609 - DNA, 20 bp, Artificial Sequence
  Description of Artificial Sequence: Synthetic oligonucleotide
  Target: SCN9A; (-) strand; PAM type: YTN; PAM sequence: TTC
cacgtaattatgagttgttc

SEQ ID NO: 61610 - DNA, 20 bp, Artificial Sequence
  Description of Artificial Sequence: Synthetic oligonucleotide
  Target: SCN9A; (-) strand; PAM type: YTN; PAM sequence: TTT
ccacgtaattatgagttgtt

SEQ ID NO: 61611 - DNA, 20 bp, Artificial Sequence
  Description of Artificial Sequence: Synthetic oligonucleotide
  Target: SCN9A; (-) strand; PAM type: YTN; PAM sequence: TTA
atttccacgtaattatgagt

SEQ ID NO: 61612 - DNA, 20 bp, Artificial Sequence
  Description of Artificial Sequence: Synthetic oligonucleotide
  Target: SCN9A; (-) strand; PAM type: YTN; PAM sequence: TTT
aatttccacgtaattatgag

SEQ ID NO: 61613 - DNA, 20 bp, Artificial Sequence
  Description of Artificial Sequence: Synthetic oligonucleotide
  Target: SCN9A; (-) strand; PAM type: YTN; PAM sequence: TTG
tttaatttccacgtaattat

SEQ ID NO: 61614 - DNA, 20 bp, Artificial Sequence
  Description of Artificial Sequence: Synthetic oligonucleotide
  Target: SCN9A; (-) strand; PAM type: YTN; PAM sequence: TTC
aggagcatgttgtttaattt

SEQ ID NO: 61615 - DNA, 20 bp, Artificial Sequence
  Description of Artificial Sequence: Synthetic oligonucleotide
  Target: SCN9A; (-) strand; PAM type: YTN; PAM sequence: CTG
ttcaggagcatgttgtttaa

SEQ ID NO: 61616 - DNA, 20 bp, Artificial Sequence
  Description of Artificial Sequence: Synthetic oligonucleotide
  Target: SCN9A; (-) strand; PAM type: YTN; PAM sequence: TTG
cctgttcaggagcatgttgt

SEQ ID NO: 61617 - DNA, 20 bp, Artificial Sequence
  Description of Artificial Sequence: Synthetic oligonucleotide
  Target: SCN9A; (-) strand; PAM type: YTN; PAM sequence: TTG
acccattgcctgttcaggag

SEQ ID NO: 61618 - DNA, 20 bp, Artificial Sequence
  Description of Artificial Sequence: Synthetic oligonucleotide
  Target: SCN9A; (-) strand; PAM type: YTN; PAM sequence: TTT
gacccattgcctgttcagga

SEQ ID NO: 61619 - DNA, 20 bp, Artificial Sequence
  Description of Artificial Sequence: Synthetic oligonucleotide
  Target: SCN9A; (-) strand; PAM type: YTN; PAM sequence: CTT
tgacccattgcctgttcagg

SEQ ID NO: 61620 - DNA, 20 bp, Artificial Sequence
  Description of Artificial Sequence: Synthetic oligonucleotide
  Target: SCN9A; (-) strand; PAM type: YTN; PAM sequence: TTC
tttgacccattgcctgttca

SEQ ID NO: 61621 - DNA, 20 bp, Artificial Sequence
  Description of Artificial Sequence: Synthetic oligonucleotide
  Target: SCN9A; (-) strand; PAM type: YTN; PAM sequence: CTT
ctttgacccattgcctgttc

SEQ ID NO: 61622 - DNA, 20 bp, Artificial Sequence
  Description of Artificial Sequence: Synthetic oligonucleotide
  Target: SCN9A; (-) strand; PAM type: YTN; PAM sequence: TTC
ttctttgacccattgcctgt

SEQ ID NO: 61623 - DNA, 20 bp, Artificial Sequence
  Description of Artificial Sequence: Synthetic oligonucleotide
  Target: SCN9A; (-) strand; PAM type: YTN; PAM sequence: TTT
cttctttgacccattgcctg

SEQ ID NO: 61624 - DNA, 20 bp, Artificial Sequence
  Description of Artificial Sequence: Synthetic oligonucleotide
  Target: SCN9A; (-) strand; PAM type: YTN; PAM sequence: TTC
cgtataatttcttctttgac

SEQ ID NO: 61625 - DNA, 20 bp, Artificial Sequence
  Description of Artificial Sequence: Synthetic oligonucleotide
  Target: SCN9A; (-) strand; PAM type: YTN; PAM sequence: TTT
ccgtataatttcttctttga

SEQ ID NO: 61626 - DNA, 20 bp, Artificial Sequence
  Description of Artificial Sequence: Synthetic oligonucleotide
  Target: SCN9A; (-) strand; PAM type: YTN; PAM sequence: TTT
tccgtataatttcttctttg

SEQ ID NO: 61627 - DNA, 20 bp, Artificial Sequence
  Description of Artificial Sequence: Synthetic oligonucleotide
  Target: SCN9A; (-) strand; PAM type: YTN; PAM sequence: TTT
ttccgtataatttcttcttt

SEQ ID NO: 61628 - DNA, 20 bp, Artificial Sequence
  Description of Artificial Sequence: Synthetic oligonucleotide
  Target: SCN9A; (-) strand; PAM type: YTN; PAM sequence: CTG
tttttccgtataatttcttc

SEQ ID NO: 61629 - DNA, 20 bp, Artificial Sequence
  Description of Artificial Sequence: Synthetic oligonucleotide
  Target: SCN9A; (-) strand; PAM type: YTN; PAM sequence: TTC
tgtttttccgtataatttct

SEQ ID NO: 61630 - DNA, 20 bp, Artificial Sequence
  Description of Artificial Sequence: Synthetic oligonucleotide
  Target: SCN9A; (-) strand; PAM type: YTN; PAM sequence: TTT
ctgtttttccgtataatttc

SEQ ID NO: 61631 - DNA, 20 bp, Artificial Sequence
  Description of Artificial Sequence: Synthetic oligonucleotide
  Target: SCN9A; (-) strand; PAM type: YTN; PAM sequence: TTT
tctgtttttccgtataattt

SEQ ID NO: 61632 - DNA, 20 bp, Artificial Sequence
  Description of Artificial Sequence: Synthetic oligonucleotide
  Target: SCN9A; (-) strand; PAM type: YTN; PAM sequence: TTG
atcccaaaatattttctgtt

SEQ ID NO: 61633 - DNA, 20 bp, Artificial Sequence
  Description of Artificial Sequence: Synthetic oligonucleotide
  Target: SCN9A; (-) strand; PAM type: YTN; PAM sequence: TTG
tcattgatcccaaaatattt

SEQ ID NO: 61634 - DNA, 20 bp, Artificial Sequence
  Description of Artificial Sequence: Synthetic oligonucleotide
  Target: SCN9A; (-) strand; PAM type: YTN; PAM sequence: TTC
cattgtcattgatcccaaaa

SEQ ID NO: 61635 - DNA, 20 bp, Artificial Sequence
  Description of Artificial Sequence: Synthetic oligonucleotide
  Target: SCN9A; (-) strand; PAM type: YTN; PAM sequence: TTT
ccattgtcattgatcccaaa

SEQ ID NO: 61636 - DNA, 20 bp, Artificial Sequence
  Description of Artificial Sequence: Synthetic oligonucleotide
  Target: SCN9A; (-) strand; PAM type: YTN; PAM sequence: TTG
tgtttccattgtcattgatc

SEQ ID NO: 61637 - DNA, 20 bp, Artificial Sequence
  Description of Artificial Sequence: Synthetic oligonucleotide
  Target: SCN9A; (-) strand; PAM type: YTN; PAM sequence: CTT
gtgtttccattgtcattgat

SEQ ID NO: 61638 - DNA, 20 bp, Artificial Sequence
  Description of Artificial Sequence: Synthetic oligonucleotide
  Target: SCN9A; (-) strand; PAM type: YTN; PAM sequence: TTA
tcttgtgtttccattgtcat

SEQ ID NO: 61639 - DNA, 20 bp, Artificial Sequence
  Description of Artificial Sequence: Synthetic oligonucleotide
  Target: SCN9A; (-) strand; PAM type: YTN; PAM sequence: TTG
ttatcttgtgtttccattgt

SEQ ID NO: 61640 - DNA, 20 bp, Artificial Sequence
  Description of Artificial Sequence: Synthetic oligonucleotide
  Target: SCN9A; (-) strand; PAM type: YTN; PAM sequence: TTT
gttatcttgtgtttccattg

SEQ ID NO: 61641 - DNA, 20 bp, Artificial Sequence
  Description of Artificial Sequence: Synthetic oligonucleotide
  Target: SCN9A; (-) strand; PAM type: YTN; PAM sequence: CTA
tttgttatcttgtgtttcca

SEQ ID NO: 61642 - DNA, 20 bp, Artificial Sequence
  Description of Artificial Sequence: Synthetic oligonucleotide
  Target: SCN9A; (-) strand; PAM type: YTN; PAM sequence: TTC
catactatttgttatcttgt

SEQ ID NO: 61643 - DNA, 20 bp, Artificial Sequence
  Description of Artificial Sequence: Synthetic oligonucleotide
  Target: SCN9A; (-) strand; PAM type: YTN; PAM sequence: CTA
cattccatactatttgttat

SEQ ID NO: 61644 - DNA, 20 bp, Artificial Sequence
  Description of Artificial Sequence: Synthetic oligonucleotide
  Target: SCN9A; (-) strand; PAM type: YTN; PAM sequence: TTC
tacattccatactatttgtt

SEQ ID NO: 61645 - DNA, 20 bp, Artificial Sequence
  Description of Artificial Sequence: Synthetic oligonucleotide
  Target: SCN9A; (-) strand; PAM type: YTN; PAM sequence: TTT
ctacattccatactatttgt

SEQ ID NO: 61646 - DNA, 20 bp, Artificial Sequence
  Description of Artificial Sequence: Synthetic oligonucleotide
  Target: SCN9A; (-) strand; PAM type: YTN; PAM sequence: TTT
tctacattccatactatttg

SEQ ID NO: 61647 - DNA, 20 bp, Artificial Sequence
  Description of Artificial Sequence: Synthetic oligonucleotide
  Target: SCN9A; (-) strand; PAM type: YTN; PAM sequence: TTT
ttctacattccatactattt

SEQ ID NO: 61648 - DNA, 20 bp, Artificial Sequence
  Description of Artificial Sequence: Synthetic oligonucleotide
  Target: SCN9A; (-) strand; PAM type: YTN; PAM sequence: CTT
tttctacattccatactatt

SEQ ID NO: 61649 - DNA, 20 bp, Artificial Sequence
  Description of Artificial Sequence: Synthetic oligonucleotide
  Target: SCN9A; (-) strand; PAM type: YTN; PAM sequence: TTC
tttttctacattccatacta

SEQ ID NO: 61650 - DNA, 20 bp, Artificial Sequence
  Description of Artificial Sequence: Synthetic oligonucleotide
  Target: SCN9A; (-) strand; PAM type: YTN; PAM sequence: CTT
ctttttctacattccatact

SEQ ID NO: 61651 - DNA, 20 bp, Artificial Sequence
  Description of Artificial Sequence: Synthetic oligonucleotide
  Target: SCN9A; (-) strand; PAM type: YTN; PAM sequence: CTC
agggcttctttttctacatt

SEQ ID NO: 61652 - DNA, 20 bp, Artificial Sequence
  Description of Artificial Sequence: Synthetic oligonucleotide
  Target: SCN9A; (-) strand; PAM type: YTN; PAM sequence: CTC
tcagggcttctttttctaca

SEQ ID NO: 61653 - DNA, 20 bp, Artificial Sequence
  Description of Artificial Sequence: Synthetic oligonucleotide
  Target: SCN9A; (-) strand; PAM type: YTN; PAM sequence: TTC
tctcagggcttctttttcta

SEQ ID NO: 61654 - DNA, 20 bp, Artificial Sequence
  Description of Artificial Sequence: Synthetic oligonucleotide
  Target: SCN9A; (-) strand; PAM type: YTN; PAM sequence: TTT
ctctcagggcttctttttct

SEQ ID NO: 61655 - DNA, 20 bp, Artificial Sequence
  Description of Artificial Sequence: Synthetic oligonucleotide
  Target: SCN9A; (-) strand; PAM type: YTN; PAM sequence: TTT
tctctcagggcttctttttc

SEQ ID NO: 61656 - DNA, 20 bp, Artificial Sequence
  Description of Artificial Sequence: Synthetic oligonucleotide
  Target: SCN9A; (-) strand; PAM type: YTN; PAM sequence: TTT
ttctctcagggcttcttttt

SEQ ID NO: 61657 - DNA, 20 bp, Artificial Sequence
  Description of Artificial Sequence: Synthetic oligonucleotide
  Target: SCN9A; (-) strand; PAM type: YTN; PAM sequence: CTA
taaatttttctctcagggct

SEQ ID NO: 61658 - DNA, 20 bp, Artificial Sequence
  Description of Artificial Sequence: Synthetic oligonucleotide
  Target: SCN9A; (-) strand; PAM type: YTN; PAM sequence: TTA
ctataaatttttctctcagg

SEQ ID NO: 61659 - DNA, 20 bp, Artificial Sequence
  Description of Artificial Sequence: Synthetic oligonucleotide
  Target: SCN9A; (-) strand; PAM type: YTN; PAM sequence: TTA
ttactataaatttttctctc

SEQ ID NO: 61660 - DNA, 20 bp, Artificial Sequence
  Description of Artificial Sequence: Synthetic oligonucleotide
  Target: SCN9A; (-) strand; PAM type: YTN; PAM sequence: TTT
attactataaatttttctct

SEQ ID NO: 61661 - DNA, 20 bp, Artificial Sequence
  Description of Artificial Sequence: Synthetic oligonucleotide
  Target: SCN9A; (-) strand; PAM type: YTN; PAM sequence: TTA
atgtaggcatttattactat

SEQ ID NO: 61662 - DNA, 20 bp, Artificial Sequence
  Description of Artificial Sequence: Synthetic oligonucleotide
  Target: SCN9A; (-) strand; PAM type: YTN; PAM sequence: TTT
aatgtaggcatttattacta

SEQ ID NO: 61663 - DNA, 20 bp, Artificial Sequence
  Description of Artificial Sequence: Synthetic oligonucleotide
  Target: SCN9A; (-) strand; PAM type: YTN; PAM sequence: CTT
taatgtaggcatttattact

SEQ ID NO: 61664 - DNA, 20 bp, Artificial Sequence
  Description of Artificial Sequence: Synthetic oligonucleotide
  Target: SCN9A; (-) strand; PAM type: YTN; PAM sequence: TTC
tttaatgtaggcatttatta

SEQ ID NO: 61665 - DNA, 20 bp, Artificial Sequence
  Description of Artificial Sequence: Synthetic oligonucleotide
  Target: SCN9A; (-) strand; PAM type: YTN; PAM sequence: TTT
ctttaatgtaggcatttatt

SEQ ID NO: 61666 - DNA, 20 bp, Artificial Sequence
  Description of Artificial Sequence: Synthetic oligonucleotide
  Target: SCN9A; (-) strand; PAM type: YTN; PAM sequence: CTT
tctttaatgtaggcatttat

SEQ ID NO: 61667 - DNA, 20 bp, Artificial Sequence
  Description of Artificial Sequence: Synthetic oligonucleotide
  Target: SCN9A; (-) strand; PAM type: YTN; PAM sequence: TTC
tttctttaatgtaggcattt

SEQ ID NO: 61668 - DNA, 20 bp, Artificial Sequence
  Description of Artificial Sequence: Synthetic oligonucleotide
  Target: SCN9A; (-) strand; PAM type: YTN; PAM sequence: CTT
ctttctttaatgtaggcatt

SEQ ID NO: 61669 - DNA, 20 bp, Artificial Sequence
  Description of Artificial Sequence: Synthetic oligonucleotide
  Target: SCN9A; (-) strand; PAM type: YTN; PAM sequence: TTC
cttctttctttaatgtaggc

SEQ ID NO: 61670 - DNA, 20 bp, Artificial Sequence
  Description of Artificial Sequence: Synthetic oligonucleotide
  Target: SCN9A; (-) strand; PAM type: YTN; PAM sequence: TTT
ccttctttctttaatgtagg

SEQ ID NO: 61671 - DNA, 20 bp, Artificial Sequence
  Description of Artificial Sequence: Synthetic oligonucleotide
  Target: SCN9A; (-) strand; PAM type: YTN; PAM sequence: TTT
tccttctttctttaatgtag

SEQ ID NO: 61672 - DNA, 20 bp, Artificial Sequence
  Description of Artificial Sequence: Synthetic oligonucleotide
  Target: SCN9A; (-) strand; PAM type: YTN; PAM sequence: TTG
agattttccttctttcttta

SEQ ID NO: 61673 - DNA, 20 bp, Artificial Sequence
  Description of Artificial Sequence: Synthetic oligonucleotide
  Target: SCN9A; (-) strand; PAM type: YTN; PAM sequence: TTT
gagattttccttctttcttt

SEQ ID NO: 61674 - DNA, 20 bp, Artificial Sequence
  Description of Artificial Sequence: Synthetic oligonucleotide
  Target: SCN9A; (-) strand; PAM type: YTN; PAM sequence: TTA
tttgagattttccttctttc

SEQ ID NO: 61675 - DNA, 20 bp, Artificial Sequence
  Description of Artificial Sequence: Synthetic oligonucleotide
  Target: SCN9A; (-) strand; PAM type: YTN; PAM sequence: TTT
atttgagattttccttcttt

SEQ ID NO: 61676 - DNA, 20 bp, Artificial Sequence
  Description of Artificial Sequence: Synthetic oligonucleotide
  Target: SCN9A; (-) strand; PAM type: YTN; PAM sequence: TTG
tttatttgagattttccttc

SEQ ID NO: 61677 - DNA, 20 bp, Artificial Sequence
  Description of Artificial Sequence: Synthetic oligonucleotide
  Target: SCN9A; (-) strand; PAM type: YTN; PAM sequence: TTA
ggttgtttatttgagatttt

SEQ ID NO: 61678 - DNA, 20 bp, Artificial Sequence
  Description of Artificial Sequence: Synthetic oligonucleotide
  Target: SCN9A; (-) strand; PAM type: YTN; PAM sequence: CTA
agatgtaatattaggttgtt

SEQ ID NO: 61679 - DNA, 20 bp, Artificial Sequence
  Description of Artificial Sequence: Synthetic oligonucleotide
  Target: SCN9A; (-) strand; PAM type: YTN; PAM sequence: CTC
taagatgtaatattaggttg

SEQ ID NO: 61680 - DNA, 20 bp, Artificial Sequence
  Description of Artificial Sequence: Synthetic oligonucleotide
  Target: SCN9A; (-) strand; PAM type: YTN; PAM sequence: CTA
atctctaagatgtaatatta

SEQ ID NO: 61681 - DNA, 20 bp, Artificial Sequence
  Description of Artificial Sequence: Synthetic oligonucleotide
  Target: SCN9A; (-) strand; PAM type: YTN; PAM sequence: TTC
taatctctaagatgtaatat

SEQ ID NO: 61682 - DNA, 20 bp, Artificial Sequence
  Description of Artificial Sequence: Synthetic oligonucleotide
  Target: SCN9A; (-) strand; PAM type: YTN; PAM sequence: TTT
ctaatctctaagatgtaata

SEQ ID NO: 61683 - DNA, 20 bp, Artificial Sequence
  Description of Artificial Sequence: Synthetic oligonucleotide
  Target: SCN9A; (-) strand; PAM type: YTN; PAM sequence: TTT
tctaatctctaagatgtaat

SEQ ID NO: 61684 - DNA, 20 bp, Artificial Sequence
  Description of Artificial Sequence: Synthetic oligonucleotide
  Target: SCN9A; (-) strand; PAM type: YTN; PAM sequence: TTT
ttctaatctctaagatgtaa

SEQ ID NO: 61685 - DNA, 20 bp, Artificial Sequence
  Description of Artificial Sequence: Synthetic oligonucleotide
  Target: SCN9A; (-) strand; PAM type: YTN; PAM sequence: CTT
tttctaatctctaagatgta

SEQ ID NO: 61686 - DNA, 20 bp, Artificial Sequence
  Description of Artificial Sequence: Synthetic oligonucleotide
  Target: SCN9A; (-) strand; PAM type: YTN; PAM sequence: TTC
tttttctaatctctaagatg

SEQ ID NO: 61687 - DNA, 20 bp, Artificial Sequence
  Description of Artificial Sequence: Synthetic oligonucleotide
  Target: SCN9A; (-) strand; PAM type: YTN; PAM sequence: CTT
ctttttctaatctctaagat

SEQ ID NO: 61688 - DNA, 20 bp, Artificial Sequence
  Description of Artificial Sequence: Synthetic oligonucleotide
  Target: SCN9A; (-) strand; PAM type: YTN; PAM sequence: TTC
ttctttttctaatctctaag

SEQ ID NO: 61689 - DNA, 20 bp, Artificial Sequence
  Description of Artificial Sequence: Synthetic oligonucleotide
  Target: SCN9A; (-) strand; PAM type: YTN; PAM sequence: CTG
ttcttctttttctaatctct

SEQ ID NO: 61690 - DNA, 20 bp, Artificial Sequence
  Description of Artificial Sequence: Synthetic oligonucleotide
  Target: SCN9A; (-) strand; PAM type: YTN; PAM sequence: TTC
tgttcttctttttctaatct

SEQ ID NO: 61691 - DNA, 20 bp, Artificial Sequence
  Description of Artificial Sequence: Synthetic oligonucleotide
  Target: SCN9A; (-) strand; PAM type: YTN; PAM sequence: TTG
gggatattctgttcttcttt

SEQ ID NO: 61692 - DNA, 20 bp, Artificial Sequence
  Description of Artificial Sequence: Synthetic oligonucleotide
  Target: SCN9A; (-) strand; PAM type: YTN; PAM sequence: TTT
ggggatattctgttcttctt

SEQ ID NO: 61693 - DNA, 20 bp, Artificial Sequence
  Description of Artificial Sequence: Synthetic oligonucleotide
  Target: SCN9A; (-) strand; PAM type: YTN; PAM sequence: CTG
caaagtttggggatattctg

SEQ ID NO: 61694 - DNA, 20 bp, Artificial Sequence
  Description of Artificial Sequence: Synthetic oligonucleotide
  Target: SCN9A; (-) strand; PAM type: YTN; PAM sequence: TTC
tgcaaagtttggggatattc

SEQ ID NO: 61695 - DNA, 20 bp, Artificial Sequence
  Description of Artificial Sequence: Synthetic oligonucleotide
  Target: SCN9A; (-) strand; PAM type: YTN; PAM sequence: CTT
ctgcaaagtttggggatatt

SEQ ID NO: 61696 - DNA, 20 bp, Artificial Sequence
  Description of Artificial Sequence: Synthetic oligonucleotide
  Target: SCN9A; (-) strand; PAM type: YTN; PAM sequence: TTC
cttctgcaaagtttggggat

SEQ ID NO: 61697 - DNA, 20 bp, Artificial Sequence
  Description of Artificial Sequence: Synthetic oligonucleotide
  Target: SCN9A; (-) strand; PAM type: YTN; PAM sequence: CTT
ccttctgcaaagtttgggga

SEQ ID NO: 61698 - DNA, 20 bp, Artificial Sequence
  Description of Artificial Sequence: Synthetic oligonucleotide
  Target: SCN9A; (-) strand; PAM type: YTN; PAM sequence: TTC
ttccttctgcaaagtttggg

SEQ ID NO: 61699 - DNA, 20 bp, Artificial Sequence
  Description of Artificial Sequence: Synthetic oligonucleotide
  Target: SCN9A; (-) strand; PAM type: YTN; PAM sequence: TTT
cttccttctgcaaagtttgg

SEQ ID NO: 61700 - DNA, 20 bp, Artificial Sequence
  Description of Artificial Sequence: Synthetic oligonucleotide
  Target: SCN9A; (-) strand; PAM type: YTN; PAM sequence: TTT
tcttccttctgcaaagtttg

SEQ ID NO: 61701 - DNA, 20 bp, Artificial Sequence
  Description of Artificial Sequence: Synthetic oligonucleotide
  Target: SCN9A; (-) strand; PAM type: YTN; PAM sequence: TTA
ttttcttccttctgcaaagt

SEQ ID NO: 61702 - DNA, 20 bp, Artificial Sequence
  Description of Artificial Sequence: Synthetic oligonucleotide
  Target: SCN9A; (-) strand; PAM type: YTN; PAM sequence: TTG
ttattttcttccttctgcaa

SEQ ID NO: 61703 - DNA, 20 bp, Artificial Sequence
  Description of Artificial Sequence: Synthetic oligonucleotide
  Target: SCN9A; (-) strand; PAM type: YTN; PAM sequence: TTT
gttattttcttccttctgca

SEQ ID NO: 61704 - DNA, 20 bp, Artificial Sequence
  Description of Artificial Sequence: Synthetic oligonucleotide
  Target: SCN9A; (-) strand; PAM type: YTN; PAM sequence: CTT
tgttattttcttccttctgc

SEQ ID NO: 61705 - DNA, 20 bp, Artificial Sequence
  Description of Artificial Sequence: Synthetic oligonucleotide
  Target: SCN9A; (-) strand; PAM type: YTN; PAM sequence: TTA
tctttgttattttcttcctt

SEQ ID NO: 61706 - DNA, 20 bp, Artificial Sequence
  Description of Artificial Sequence: Synthetic oligonucleotide
  Target: SCN9A; (-) strand; PAM type: YTN; PAM sequence: CTA
tcattatctttgttattttc

SEQ ID NO: 61707 - DNA, 20 bp, Artificial Sequence
  Description of Artificial Sequence: Synthetic oligonucleotide
  Target: SCN9A; (-) strand; PAM type: YTN; PAM sequence: TTC
tatcattatctttgttattt

SEQ ID NO: 61708 - DNA, 20 bp, Artificial Sequence
  Description of Artificial Sequence: Synthetic oligonucleotide
  Target: SCN9A; (-) strand; PAM type: YTN; PAM sequence: TTT
ctatcattatctttgttatt

SEQ ID NO: 61709 - DNA, 20 bp, Artificial Sequence
  Description of Artificial Sequence: Synthetic oligonucleotide
  Target: SCN9A; (-) strand; PAM type: YTN; PAM sequence: TTA
tttctatcattatctttgtt

SEQ ID NO: 61710 - DNA, 20 bp, Artificial Sequence
  Description of Artificial Sequence: Synthetic oligonucleotide
  Target: SCN9A; (-) strand; PAM type: YTN; PAM sequence: TTT
atttctatcattatctttgt

SEQ ID NO: 61711 - DNA, 20 bp, Artificial Sequence
  Description of Artificial Sequence: Synthetic oligonucleotide
  Target: SCN9A; (-) strand; PAM type: YTN; PAM sequence: TTG
tttatttctatcattatctt

SEQ ID NO: 61712 - DNA, 20 bp, Artificial Sequence
  Description of Artificial Sequence: Synthetic oligonucleotide
  Target: SCN9A; (-) strand; PAM type: YTN; PAM sequence: TTT
gtttatttctatcattatct

SEQ ID NO: 61713 - DNA, 20 bp, Artificial Sequence
  Description of Artificial Sequence: Synthetic oligonucleotide
  Target: SCN9A; (-) strand; PAM type: YTN; PAM sequence: CTT
tgtttatttctatcattatc

SEQ ID NO: 61714 - DNA, 20 bp, Artificial Sequence
  Description of Artificial Sequence: Synthetic oligonucleotide
  Target: SCN9A; (-) strand; PAM type: YTN; PAM sequence: TTG
ctttgtttatttctatcatt

SEQ ID NO: 61715 - DNA, 20 bp, Artificial Sequence
  Description of Artificial Sequence: Synthetic oligonucleotide
  Target: SCN9A; (-) strand; PAM type: YTN; PAM sequence: TTT
gctttgtttatttctatcat

SEQ ID NO: 61716 - DNA, 20 bp, Artificial Sequence
  Description of Artificial Sequence: Synthetic oligonucleotide
  Target: SCN9A; (-) strand; PAM type: YTN; PAM sequence: TTA
gtatttgctttgtttatttc

SEQ ID NO: 61717 - DNA, 20 bp, Artificial Sequence
  Description of Artificial Sequence: Synthetic oligonucleotide
  Target: SCN9A; (-) strand; PAM type: YTN; PAM sequence: TTT
agtatttgctttgtttattt

SEQ ID NO: 61718 - DNA, 20 bp, Artificial Sequence
  Description of Artificial Sequence: Synthetic oligonucleotide
  Target: SCN9A; (-) strand; PAM type: YTN; PAM sequence: TTT
tagtatttgctttgtttatt

SEQ ID NO: 61719 - DNA, 20 bp, Artificial Sequence
  Description of Artificial Sequence: Synthetic oligonucleotide
  Target: SCN9A; (-) strand; PAM type: YTN; PAM sequence: TTT
ttagtatttgctttgtttat

SEQ ID NO: 61720 - DNA, 20 bp, Artificial Sequence
  Description of Artificial Sequence: Synthetic oligonucleotide
  Target: SCN9A; (-) strand; PAM type: YTN; PAM sequence: CTT
tttagtatttgctttgttta

SEQ ID NO: 61721 - DNA, 20 bp, Artificial Sequence
  Description of Artificial Sequence: Synthetic oligonucleotide
  Target: SCN9A; (-) strand; PAM type: YTN; PAM sequence: TTC
aaaaaaacaactttttagta

SEQ ID NO: 61722 - DNA, 20 bp, Artificial Sequence
  Description of Artificial Sequence: Synthetic oligonucleotide
  Target: SCN9A; (-) strand; PAM type: YTN; PAM sequence: TTT
caaaaaaacaactttttagt

SEQ ID NO: 61723 - DNA, 20 bp, Artificial Sequence
  Description of Artificial Sequence: Synthetic oligonucleotide
  Target: SCN9A; (-) strand; PAM type: YTN; PAM sequence: TTT
tcaaaaaaacaactttttag

SEQ ID NO: 61724 - DNA, 20 bp, Artificial Sequence
  Description of Artificial Sequence: Synthetic oligonucleotide
  Target: SCN9A; (-) strand; PAM type: YTN; PAM sequence: CTT
ttcaaaaaaacaacttttta

SEQ ID NO: 61725 - DNA, 20 bp, Artificial Sequence
  Description of Artificial Sequence: Synthetic oligonucleotide
  Target: SCN9A; (-) strand; PAM type: YTN; PAM sequence: TTA
tcttttcaaaaaaacaactt

SEQ ID NO: 61726 - DNA, 20 bp, Artificial Sequence
  Description of Artificial Sequence: Synthetic oligonucleotide
  Target: SCN9A; (-) strand; PAM type: YTN; PAM sequence: TTT
atcttttcaaaaaaacaact

SEQ ID NO: 61727 - DNA, 20 bp, Artificial Sequence
  Description of Artificial Sequence: Synthetic oligonucleotide
  Target: SCN9A; (-) strand; PAM type: YTN; PAM sequence: TTT
tatcttttcaaaaaaacaac

SEQ ID NO: 61728 - DNA, 20 bp, Artificial Sequence
  Description of Artificial Sequence: Synthetic oligonucleotide
  Target: SCN9A; (-) strand; PAM type: YTN; PAM sequence: TTC
gattttatcttttcaaaaaa

SEQ ID NO: 61729 - DNA, 20 bp, Artificial Sequence
  Description of Artificial Sequence: Synthetic oligonucleotide
  Target: SCN9A; (-) strand; PAM type: YTN; PAM sequence: TTT
cgattttatcttttcaaaaa

SEQ ID NO: 61730 - DNA, 20 bp, Artificial Sequence
  Description of Artificial Sequence: Synthetic oligonucleotide
  Target: SCN9A; (-) strand; PAM type: YTN; PAM sequence: TTT
tcgattttatcttttcaaaa

SEQ ID NO: 61731 - DNA, 20 bp, Artificial Sequence
  Description of Artificial Sequence: Synthetic oligonucleotide
  Target: SCN9A; (-) strand; PAM type: YTN; PAM sequence: TTT
ttcgattttatcttttcaaa

SEQ ID NO: 61732 - DNA, 20 bp, Artificial Sequence
  Description of Artificial Sequence: Synthetic oligonucleotide
  Target: SCN9A; (-) strand; PAM type: YTN; PAM sequence: TTA
aaggtttttcgattttatct

SEQ ID NO: 61733 - DNA, 20 bp, Artificial Sequence
  Description of Artificial Sequence: Synthetic oligonucleotide
  Target: SCN9A; (-) strand; PAM type: YTN; PAM sequence: CTA
gttaaaggtttttcgatttt

SEQ ID NO: 61734 - DNA, 20 bp, Artificial Sequence
  Description of Artificial Sequence: Synthetic oligonucleotide
  Target: SCN9A; (-) strand; PAM type: YTN; PAM sequence: TTA
gtctagttaaaggtttttcg

SEQ ID NO: 61735 - DNA, 20 bp, Artificial Sequence
  Description of Artificial Sequence: Synthetic oligonucleotide
  Target: SCN9A; (-) strand; PAM type: YTN; PAM sequence: TTG
gttagtctagttaaaggttt

SEQ ID NO: 61736 - DNA, 20 bp, Artificial Sequence
  Description of Artificial Sequence: Synthetic oligonucleotide
  Target: SCN9A; (-) strand; PAM type: YTN; PAM sequence: CTT
ggttagtctagttaaaggtt

SEQ ID NO: 61737 - DNA, 20 bp, Artificial Sequence
  Description of Artificial Sequence: Synthetic oligonucleotide
  Target: SCN9A; (-) strand; PAM type: YTN; PAM sequence: TTC
ccttggttagtctagttaaa

SEQ ID NO: 61738 - DNA, 20 bp, Artificial Sequence
  Description of Artificial Sequence: Synthetic oligonucleotide
  Target: SCN9A; (-) strand; PAM type: YTN; PAM sequence: TTT
cccttggttagtctagttaa

SEQ ID NO: 61739 - DNA, 20 bp, Artificial Sequence
  Description of Artificial Sequence: Synthetic oligonucleotide
  Target: SCN9A; (-) strand; PAM type: YTN; PAM sequence: TTT
tcccttggttagtctagtta

SEQ ID NO: 61740 - DNA, 20 bp, Artificial Sequence
  Description of Artificial Sequence: Synthetic oligonucleotide
  Target: SCN9A; (-) strand; PAM type: YTN; PAM sequence: TTT
ttcccttggttagtctagtt

SEQ ID NO: 61741 - DNA, 20 bp, Artificial Sequence
  Description of Artificial Sequence: Synthetic oligonucleotide
  Target: SCN9A; (-) strand; PAM type: YTN; PAM sequence: TTT
tttcccttggttagtctagt

SEQ ID NO: 61742 - DNA, 20 bp, Artificial Sequence
  Description of Artificial Sequence: Synthetic oligonucleotide
  Target: SCN9A; (-) strand; PAM type: YTN; PAM sequence: CTT
ttttcccttggttagtctag

SEQ ID NO: 61743 - DNA, 20 bp, Artificial Sequence
  Description of Artificial Sequence: Synthetic oligonucleotide
  Target: SCN9A; (-) strand; PAM type: YTN; PAM sequence: TTG
tcttttttcccttggttagt

SEQ ID NO: 61744 - DNA, 20 bp, Artificial Sequence
  Description of Artificial Sequence: Synthetic oligonucleotide
  Target: SCN9A; (-) strand; PAM type: YTN; PAM sequence: TTG
agttgtcttttttcccttgg

SEQ ID NO: 61745 - DNA, 20 bp, Artificial Sequence
  Description of Artificial Sequence: Synthetic oligonucleotide
  Target: SCN9A; (-) strand; PAM type: YTN; PAM sequence: TTT
gagttgtcttttttcccttg

SEQ ID NO: 61746 - DNA, 20 bp, Artificial Sequence
  Description of Artificial Sequence: Synthetic oligonucleotide
  Target: SCN9A; (-) strand; PAM type: YTN; PAM sequence: TTG
tttgagttgtcttttttccc

SEQ ID NO: 61747 - DNA, 20 bp, Artificial Sequence
  Description of Artificial Sequence: Synthetic oligonucleotide
  Target: SCN9A; (-) strand; PAM type: YTN; PAM sequence: TTC
agatattgtttgagttgtct

SEQ ID NO: 61748 - DNA, 20 bp, Artificial Sequence
  Description of Artificial Sequence: Synthetic oligonucleotide
  Target: SCN9A; (-) strand; PAM type: YTN; PAM sequence: TTT
cagatattgtttgagttgtc

SEQ ID NO: 61749 - DNA, 20 bp, Artificial Sequence
  Description of Artificial Sequence: Synthetic oligonucleotide
  Target: SCN9A; (-) strand; PAM type: YTN; PAM sequence: TTC
atttcagatattgtttgagt

SEQ ID NO: 61750 - DNA, 20 bp, Artificial Sequence
  Description of Artificial Sequence: Synthetic oligonucleotide
  Target: SCN9A; (-) strand; PAM type: YTN; PAM sequence: TTT
catttcagatattgtttgag

SEQ ID NO: 61751 - DNA, 20 bp, Artificial Sequence
  Description of Artificial Sequence: Synthetic oligonucleotide
  Target: SCN9A; (-) strand; PAM type: YTN; PAM sequence: CTT
tcatttcagatattgtttga

SEQ ID NO: 61752 - DNA, 20 bp, Artificial Sequence
  Description of Artificial Sequence: Synthetic oligonucleotide
  Target: SCN9A; (-) strand; PAM type: YTN; PAM sequence: TTC
tttcatttcagatattgttt

SEQ ID NO: 61753 - DNA, 20 bp, Artificial Sequence
  Description of Artificial Sequence: Synthetic oligonucleotide
  Target: SCN9A; (-) strand; PAM type: YTN; PAM sequence: CTT
ctttcatttcagatattgtt

SEQ ID NO: 61754 - DNA, 20 bp, Artificial Sequence
  Description of Artificial Sequence: Synthetic oligonucleotide
  Target: SCN9A; (-) strand; PAM type: YTN; PAM sequence: CTC
ccttctttcatttcagatat

SEQ ID NO: 61755 - DNA, 20 bp, Artificial Sequence
  Description of Artificial Sequence: Synthetic oligonucleotide
  Target: SCN9A; (-) strand; PAM type: YTN; PAM sequence: TTA
gtctcccttctttcatttca

SEQ ID NO: 61756 - DNA, 20 bp, Artificial Sequence
  Description of Artificial Sequence: Synthetic oligonucleotide
  Target: SCN9A; (-) strand; PAM type: YTN; PAM sequence: TTA
tcagtgttagtctcccttct

SEQ ID NO: 61757 - DNA, 20 bp, Artificial Sequence
  Description of Artificial Sequence: Synthetic oligonucleotide
  Target: SCN9A; (-) strand; PAM type: YTN; PAM sequence: TTA
tgtgttatcagtgttagtct

SEQ ID NO: 61758 - DNA, 20 bp, Artificial Sequence
  Description of Artificial Sequence: Synthetic oligonucleotide
  Target: SCN9A; (-) strand; PAM type: YTN; PAM sequence: TTT
atgtgttatcagtgttagtc

SEQ ID NO: 61759 - DNA, 20 bp, Artificial Sequence
  Description of Artificial Sequence: Synthetic oligonucleotide
  Target: SCN9A; (-) strand; PAM type: YTN; PAM sequence: TTG
tatttatgtgttatcagtgt

SEQ ID NO: 61760 - DNA, 20 bp, Artificial Sequence
  Description of Artificial Sequence: Synthetic oligonucleotide
  Target: SCN9A; (-) strand; PAM type: YTN; PAM sequence: CTT
gtatttatgtgttatcagtg

SEQ ID NO: 61761 - DNA, 20 bp, Artificial Sequence
  Description of Artificial Sequence: Synthetic oligonucleotide
  Target: SCN9A; (-) strand; PAM type: YTN; PAM sequence: TTC
cttgtatttatgtgttatca

SEQ ID NO: 61762 - DNA, 20 bp, Artificial Sequence
  Description of Artificial Sequence: Synthetic oligonucleotide
  Target: SCN9A; (-) strand; PAM type: YTN; PAM sequence: TTA
tgattccttgtatttatgtg

SEQ ID NO: 61763 - DNA, 20 bp, Artificial Sequence
  Description of Artificial Sequence: Synthetic oligonucleotide
  Target: SCN9A; (-) strand; PAM type: YTN; PAM sequence: TTT
atgattccttgtatttatgt

SEQ ID NO: 61764 - DNA, 20 bp, Artificial Sequence
  Description of Artificial Sequence: Synthetic oligonucleotide
  Target: SCN9A; (-) strand; PAM type: YTN; PAM sequence: TTA
atagtttatgattccttgta

SEQ ID NO: 61765 - DNA, 20 bp, Artificial Sequence
  Description of Artificial Sequence: Synthetic oligonucleotide
  Target: SCN9A; (-) strand; PAM type: YTN; PAM sequence: TTC
acattaatagtttatgattc

SEQ ID NO: 61766 - DNA, 20 bp, Artificial Sequence
  Description of Artificial Sequence: Synthetic oligonucleotide
  Target: SCN9A; (-) strand; PAM type: YTN; PAM sequence: TTG
ttcacattaatagtttatga

SEQ ID NO: 61767 - DNA, 20 bp, Artificial Sequence
  Description of Artificial Sequence: Synthetic oligonucleotide
  Target: SCN9A; (-) strand; PAM type: YTN; PAM sequence: TTG
atggtgtatggttgttcaca

SEQ ID NO: 61768 - DNA, 20 bp, Artificial Sequence
  Description of Artificial Sequence: Synthetic oligonucleotide
  Target: SCN9A; (-) strand; PAM type: YTN; PAM sequence: TTT
gatggtgtatggttgttcac

SEQ ID NO: 61769 - DNA, 20 bp, Artificial Sequence
  Description of Artificial Sequence: Synthetic oligonucleotide
  Target: SCN9A; (-) strand; PAM type: YTN; PAM sequence: TTC
aatttgatggtgtatggttg

SEQ ID NO: 61770 - DNA, 20 bp, Artificial Sequence
  Description of Artificial Sequence: Synthetic oligonucleotide
  Target: SCN9A; (-) strand; PAM type: YTN; PAM sequence: TTA
ttcaatttgatggtgtatgg

SEQ ID NO: 61771 - DNA, 20 bp, Artificial Sequence
  Description of Artificial Sequence: Synthetic oligonucleotide
  Target: SCN9A; (-) strand; PAM type: YTN; PAM sequence: CTA
ggttattcaatttgatggtg

SEQ ID NO: 61772 - DNA, 20 bp, Artificial Sequence
  Description of Artificial Sequence: Synthetic oligonucleotide
  Target: SCN9A; (-) strand; PAM type: YTN; PAM sequence: TTC
taggttattcaatttgatgg

SEQ ID NO: 61773 - DNA, 20 bp, Artificial Sequence
  Description of Artificial Sequence: Synthetic oligonucleotide
  Target: SCN9A; (-) strand; PAM type: YTN; PAM sequence: CTT
ctaggttattcaatttgatg

SEQ ID NO: 61774 - DNA, 20 bp, Artificial Sequence
  Description of Artificial Sequence: Synthetic oligonucleotide
  Target: SCN9A; (-) strand; PAM type: YTN; PAM sequence: TTC
cttctaggttattcaatttg

SEQ ID NO: 61775 - DNA, 20 bp, Artificial Sequence
  Description of Artificial Sequence: Synthetic oligonucleotide
  Target: SCN9A; (-) strand; PAM type: YTN; PAM sequence: TTC
attccttctaggttattcaa

SEQ ID NO: 61776 - DNA, 20 bp, Artificial Sequence
  Description of Artificial Sequence: Synthetic oligonucleotide
  Target: SCN9A; (-) strand; PAM type: YTN; PAM sequence: TTA
gttcattccttctaggttat

SEQ ID NO: 61777 - DNA, 20 bp, Artificial Sequence
  Description of Artificial Sequence: Synthetic oligonucleotide
  Target: SCN9A; (-) strand; PAM type: YTN; PAM sequence: CTA
aagattagttcattccttct

SEQ ID NO: 61778 - DNA, 20 bp, Artificial Sequence
  Description of Artificial Sequence: Synthetic oligonucleotide
  Target: SCN9A; (-) strand; PAM type: YTN; PAM sequence: TTC
taaagattagttcattcctt

SEQ ID NO: 61779 - DNA, 20 bp, Artificial Sequence
  Description of Artificial Sequence: Synthetic oligonucleotide
  Target: SCN9A; (-) strand; PAM type: YTN; PAM sequence: TTT
ctaaagattagttcattcct

SEQ ID NO: 61780 - DNA, 20 bp, Artificial Sequence
  Description of Artificial Sequence: Synthetic oligonucleotide
  Target: SCN9A; (-) strand; PAM type: YTN; PAM sequence: TTG
catgtttctaaagattagtt

SEQ ID NO: 61781 - DNA, 20 bp, Artificial Sequence
  Description of Artificial Sequence: Synthetic oligonucleotide
  Target: SCN9A; (-) strand; PAM type: YTN; PAM sequence: TTG
gtaggttgcatgtttctaaa

SEQ ID NO: 61782 - DNA, 20 bp, Artificial Sequence
  Description of Artificial Sequence: Synthetic oligonucleotide
  Target: SCN9A; (-) strand; PAM type: YTN; PAM sequence: CTT
ggtaggttgcatgtttctaa

SEQ ID NO: 61783 - DNA, 20 bp, Artificial Sequence
  Description of Artificial Sequence: Synthetic oligonucleotide
  Target: SCN9A; (-) strand; PAM type: YTN; PAM sequence: TTA
gtcttggtaggttgcatgtt

SEQ ID NO: 61784 - DNA, 20 bp, Artificial Sequence
  Description of Artificial Sequence: Synthetic oligonucleotide
  Target: SCN9A; (-) strand; PAM type: YTN; PAM sequence: TTT
agtcttggtaggttgcatgt

SEQ ID NO: 61785 - DNA, 20 bp, Artificial Sequence
  Description of Artificial Sequence: Synthetic oligonucleotide
  Target: SCN9A; (-) strand; PAM type: YTN; PAM sequence: TTG
atttagtcttggtaggttgc

SEQ ID NO: 61786 - DNA, 20 bp, Artificial Sequence
  Description of Artificial Sequence: Synthetic oligonucleotide
  Target: SCN9A; (-) strand; PAM type: YTN; PAM sequence: CTT
gatttagtcttggtaggttg

SEQ ID NO: 61787 - DNA, 20 bp, Artificial Sequence
  Description of Artificial Sequence: Synthetic oligonucleotide
  Target: SCN9A; (-) strand; PAM type: YTN; PAM sequence: TTC
ttgatttagtcttggtaggt

SEQ ID NO: 61788 - DNA, 20 bp, Artificial Sequence
  Description of Artificial Sequence: Synthetic oligonucleotide
  Target: SCN9A; (-) strand; PAM type: YTN; PAM sequence: TTT
cttgatttagtcttggtagg

SEQ ID NO: 61789 - DNA, 20 bp, Artificial Sequence
  Description of Artificial Sequence: Synthetic oligonucleotide
  Target: SCN9A; (-) strand; PAM type: YTN; PAM sequence: TTC
agatgtaatatttcttgatt

SEQ ID NO: 61790 - DNA, 20 bp, Artificial Sequence
  Description of Artificial Sequence: Synthetic oligonucleotide
  Target: SCN9A; (-) strand; PAM type: YTN; PAM sequence: TTG
ttcagatgtaatatttcttg

SEQ ID NO: 61791 - DNA, 20 bp, Artificial Sequence
  Description of Artificial Sequence: Synthetic oligonucleotide
  Target: SCN9A; (-) strand; PAM type: YTN; PAM sequence: TTT
gttcagatgtaatatttctt

SEQ ID NO: 61792 - DNA, 20 bp, Artificial Sequence
  Description of Artificial Sequence: Synthetic oligonucleotide
  Target: SCN9A; (-) strand; PAM type: YTN; PAM sequence: TTG
gtttgttcagatgtaatatt

SEQ ID NO: 61793 - DNA, 20 bp, Artificial Sequence
  Description of Artificial Sequence: Synthetic oligonucleotide
  Target: SCN9A; (-) strand; PAM type: YTN; PAM sequence: TTA
tccagtattggtttgttcag

SEQ ID NO: 61794 - DNA, 20 bp, Artificial Sequence
  Description of Artificial Sequence: Synthetic oligonucleotide
  Target: SCN9A; (-) strand; PAM type: YTN; PAM sequence: TTT
atccagtattggtttgttca

SEQ ID NO: 61795 - DNA, 20 bp, Artificial Sequence
  Description of Artificial Sequence: Synthetic oligonucleotide
  Target: SCN9A; (-) strand; PAM type: YTN; PAM sequence: CTT
tatccagtattggtttgttc

SEQ ID NO: 61796 - DNA, 20 bp, Artificial Sequence
  Description of Artificial Sequence: Synthetic oligonucleotide
  Target: SCN9A; (-) strand; PAM type: YTN; PAM sequence: TTC
tttatccagtattggtttgt

SEQ ID NO: 61797 - DNA, 20 bp, Artificial Sequence
  Description of Artificial Sequence: Synthetic oligonucleotide
  Target: SCN9A; (-) strand; PAM type: YTN; PAM sequence: TTT
ctttatccagtattggtttg

SEQ ID NO: 61798 - DNA, 20 bp, Artificial Sequence
  Description of Artificial Sequence: Synthetic oligonucleotide
  Target: SCN9A; (-) strand; PAM type: YTN; PAM sequence: TTT
tctttatccagtattggttt

SEQ ID NO: 61799 - DNA, 20 bp, Artificial Sequence
  Description of Artificial Sequence: Synthetic oligonucleotide
  Target: SCN9A; (-) strand; PAM type: YTN; PAM sequence: CTA
ttttctttatccagtattgg

SEQ ID NO: 61800 - DNA, 20 bp, Artificial Sequence
  Description of Artificial Sequence: Synthetic oligonucleotide
  Target: SCN9A; (-) strand; PAM type: YTN; PAM sequence: CTG
atctattttctttatccagt

SEQ ID NO: 61801 - DNA, 20 bp, Artificial Sequence
  Description of Artificial Sequence: Synthetic oligonucleotide
  Target: SCN9A; (-) strand; PAM type: YTN; PAM sequence: TTA
ctgatctattttctttatcc

SEQ ID NO: 61802 - DNA, 20 bp, Artificial Sequence
  Description of Artificial Sequence: Synthetic oligonucleotide
  Target: SCN9A; (-) strand; PAM type: YTN; PAM sequence: TTA
ttactgatctattttcttta

SEQ ID NO: 61803 - DNA, 20 bp, Artificial Sequence
  Description of Artificial Sequence: Synthetic oligonucleotide
  Target: SCN9A; (-) strand; PAM type: YTN; PAM sequence: TTT
attactgatctattttcttt

SEQ ID NO: 61804 - DNA, 20 bp, Artificial Sequence
  Description of Artificial Sequence: Synthetic oligonucleotide
  Target: SCN9A; (-) strand; PAM type: YTN; PAM sequence: TTA
atttattactgatctatttt

SEQ ID NO: 61805 - DNA, 20 bp, Artificial Sequence
  Description of Artificial Sequence: Synthetic oligonucleotide
  Target: SCN9A; (-) strand; PAM type: YTN; PAM sequence: CTT
aatttattactgatctattt

SEQ ID NO: 61806 - DNA, 20 bp, Artificial Sequence
  Description of Artificial Sequence: Synthetic oligonucleotide
  Target: SCN9A; (-) strand; PAM type: YTN; PAM sequence: TTA
ggagacttaatttattactg

SEQ ID NO: 61807 - DNA, 20 bp, Artificial Sequence
  Description of Artificial Sequence: Synthetic oligonucleotide
  Target: SCN9A; (-) strand; PAM type: YTN; PAM sequence: TTG
gttaggagacttaatttatt

SEQ ID NO: 61808 - DNA, 20 bp, Artificial Sequence
  Description of Artificial Sequence: Synthetic oligonucleotide
  Target: SCN9A; (-) strand; PAM type: YTN; PAM sequence: TTT
ggttaggagacttaatttat

SEQ ID NO: 61809 - DNA, 20 bp, Artificial Sequence
  Description of Artificial Sequence: Synthetic oligonucleotide
  Target: SCN9A; (-) strand; PAM type: YTN; PAM sequence: TTT
tggttaggagacttaattta

SEQ ID NO: 61810 - DNA, 20 bp, Artificial Sequence
  Description of Artificial Sequence: Synthetic oligonucleotide
  Target: SCN9A; (-) strand; PAM type: YTN; PAM sequence: TTT
ttggttaggagacttaattt

SEQ ID NO: 61811 - DNA, 20 bp, Artificial Sequence
  Description of Artificial Sequence: Synthetic oligonucleotide
  Target: SCN9A; (-) strand; PAM type: YTN; PAM sequence: TTT
tttggttaggagacttaatt

SEQ ID NO: 61812 - DNA, 20 bp, Artificial Sequence
  Description of Artificial Sequence: Synthetic oligonucleotide
  Target: SCN9A; (-) strand; PAM type: YTN; PAM sequence: TTT
ttttggttaggagacttaat

SEQ ID NO: 61813 - DNA, 20 bp, Artificial Sequence
  Description of Artificial Sequence: Synthetic oligonucleotide
  Target: SCN9A; (-) strand; PAM type: YTN; PAM sequence: TTT
tttttggttaggagacttaa

SEQ ID NO: 61814 - DNA, 20 bp, Artificial Sequence
  Description of Artificial Sequence: Synthetic oligonucleotide
  Target: SCN9A; (-) strand; PAM type: YTN; PAM sequence: TTT
ttttttggttaggagactta

SEQ ID NO: 61815 - DNA, 20 bp, Artificial Sequence
  Description of Artificial Sequence: Synthetic oligonucleotide
  Target: SCN9A; (-) strand; PAM type: YTN; PAM sequence: TTT
tttttttggttaggagactt

SEQ ID NO: 61816 - DNA, 20 bp, Artificial Sequence
  Description of Artificial Sequence: Synthetic oligonucleotide
  Target: SCN9A; (-) strand; PAM type: YTN; PAM sequence: TTT
ttttttttggttaggagact

SEQ ID NO: 61817 - DNA, 20 bp, Artificial Sequence
  Description of Artificial Sequence: Synthetic oligonucleotide
  Target: SCN9A; (-) strand; PAM type: YTN; PAM sequence: TTT
tttttttttggttaggagac

SEQ ID NO: 61818 - DNA, 20 bp, Artificial Sequence
  Description of Artificial Sequence: Synthetic oligonucleotide
  Target: SCN9A; (-) strand; PAM type: YTN; PAM sequence: TTT
ttttttttttggttaggaga

SEQ ID NO: 61819 - DNA, 20 bp, Artificial Sequence
  Description of Artificial Sequence: Synthetic oligonucleotide
  Target: SCN9A; (-) strand; PAM type: YTN; PAM sequence: TTT
tttttttttttggttaggag

SEQ ID NO: 61820 - DNA, 20 bp, Artificial Sequence
  Description of Artificial Sequence: Synthetic oligonucleotide
  Target: SCN9A; (-) strand; PAM type: YTN; PAM sequence: CTT
ttttttttttttggttagga

SEQ ID NO: 61821 - DNA, 20 bp, Artificial Sequence
  Description of Artificial Sequence: Synthetic oligonucleotide
  Target: SCN9A; (-) strand; PAM type: YTN; PAM sequence: TTC
cttttttttttttttggtta

SEQ ID NO: 61822 - DNA, 20 bp, Artificial Sequence
  Description of Artificial Sequence: Synthetic oligonucleotide
  Target: SCN9A; (-) strand; PAM type: YTN; PAM sequence: TTT
ccttttttttttttttggtt

SEQ ID NO: 61823 - DNA, 20 bp, Artificial Sequence
  Description of Artificial Sequence: Synthetic oligonucleotide
  Target: SCN9A; (-) strand; PAM type: YTN; PAM sequence: TTT
tccttttttttttttttggt

SEQ ID NO: 61824 - DNA, 20 bp, Artificial Sequence
  Description of Artificial Sequence: Synthetic oligonucleotide
  Target: SCN9A; (-) strand; PAM type: YTN; PAM sequence: CTT
ttccttttttttttttttgg

SEQ ID NO: 61825 - DNA, 20 bp, Artificial Sequence
  Description of Artificial Sequence: Synthetic oligonucleotide
  Target: SCN9A; (-) strand; PAM type: YTN; PAM sequence: TTC
accagtgaccttttcctttt

SEQ ID NO: 61826 - DNA, 20 bp, Artificial Sequence
  Description of Artificial Sequence: Synthetic oligonucleotide
  Target: SCN9A; (-) strand; PAM type: YTN; PAM sequence: TTA
aatagaattcaccagtgacc

SEQ ID NO: 61827 - DNA, 20 bp, Artificial Sequence
  Description of Artificial Sequence: Synthetic oligonucleotide
  Target: SCN9A; (-) strand; PAM type: YTN; PAM sequence: TTT
aaatagaattcaccagtgac

SEQ ID NO: 61828 - DNA, 20 bp, Artificial Sequence
  Description of Artificial Sequence: Synthetic oligonucleotide
  Target: SCN9A; (-) strand; PAM type: YTN; PAM sequence: CTT
taaatagaattcaccagtga

SEQ ID NO: 61829 - DNA, 20 bp, Artificial Sequence
  Description of Artificial Sequence: Synthetic oligonucleotide
  Target: SCN9A; (-) strand; PAM type: YTN; PAM sequence: TTC
tttaaatagaattcaccagt

SEQ ID NO: 61830 - DNA, 20 bp, Artificial Sequence
  Description of Artificial Sequence: Synthetic oligonucleotide
  Target: SCN9A; (-) strand; PAM type: YTN; PAM sequence: CTT
ctttaaatagaattcaccag

SEQ ID NO: 61831 - DNA, 20 bp, Artificial Sequence
  Description of Artificial Sequence: Synthetic oligonucleotide
  Target: SCN9A; (-) strand; PAM type: YTN; PAM sequence: TTA
cttctttaaatagaattcac

SEQ ID NO: 61832 - DNA, 20 bp, Artificial Sequence
  Description of Artificial Sequence: Synthetic oligonucleotide
  Target: SCN9A; (-) strand; PAM type: YTN; PAM sequence: TTC
atattacttctttaaataga

SEQ ID NO: 61833 - DNA, 20 bp, Artificial Sequence
  Description of Artificial Sequence: Synthetic oligonucleotide
  Target: SCN9A; (-) strand; PAM type: YTN; PAM sequence: TTG
agaagaattcatattacttc

SEQ ID NO: 61834 - DNA, 20 bp, Artificial Sequence
  Description of Artificial Sequence: Synthetic oligonucleotide
  Target: SCN9A; (-) strand; PAM type: YTN; PAM sequence: TTT
gagaagaattcatattactt

SEQ ID NO: 61835 - DNA, 20 bp, Artificial Sequence
  Description of Artificial Sequence: Synthetic oligonucleotide
  Target: SCN9A; (-) strand; PAM type: YTN; PAM sequence: TTG
gaagaatttgagaagaattc

SEQ ID NO: 61836 - DNA, 20 bp, Artificial Sequence
  Description of Artificial Sequence: Synthetic oligonucleotide
  Target: SCN9A; (-) strand; PAM type: YTN; PAM sequence: TTT
ggaagaatttgagaagaatt

SEQ ID NO: 61837 - DNA, 20 bp, Artificial Sequence
  Description of Artificial Sequence: Synthetic oligonucleotide
  Target: SCN9A; (-) strand; PAM type: YTN; PAM sequence: TTT
tggaagaatttgagaagaat

SEQ ID NO: 61838 - DNA, 20 bp, Artificial Sequence
  Description of Artificial Sequence: Synthetic oligonucleotide
  Target: SCN9A; (-) strand; PAM type: YTN; PAM sequence: TTT
ttggaagaatttgagaagaa

SEQ ID NO: 61839 - DNA, 20 bp, Artificial Sequence
  Description of Artificial Sequence: Synthetic oligonucleotide
  Target: SCN9A; (-) strand; PAM type: YTN; PAM sequence: TTT
tttggaagaatttgagaaga

SEQ ID NO: 61840 - DNA, 20 bp, Artificial Sequence
  Description of Artificial Sequence: Synthetic oligonucleotide
  Target: SCN9A; (-) strand; PAM type: YTN; PAM sequence: TTC
aattttttggaagaatttga

SEQ ID NO: 61841 - DNA, 20 bp, Artificial Sequence
  Description of Artificial Sequence: Synthetic oligonucleotide
  Target: SCN9A; (-) strand; PAM type: YTN; PAM sequence: TTT
caattttttggaagaatttg

SEQ ID NO: 61842 - DNA, 20 bp, Artificial Sequence
  Description of Artificial Sequence: Synthetic oligonucleotide
  Target: SCN9A; (-) strand; PAM type: YTN; PAM sequence: TTT
tcaattttttggaagaattt

SEQ ID NO: 61843 - DNA, 20 bp, Artificial Sequence
  Description of Artificial Sequence: Synthetic oligonucleotide
  Target: SCN9A; (-) strand; PAM type: YTN; PAM sequence: CTT
ttcaattttttggaagaatt

SEQ ID NO: 61844 - DNA, 20 bp, Artificial Sequence
  Description of Artificial Sequence: Synthetic oligonucleotide
  Target: SCN9A; (-) strand; PAM type: YTN; PAM sequence: CTC
cttttcaattttttggaaga

SEQ ID NO: 61845 - DNA, 20 bp, Artificial Sequence
  Description of Artificial Sequence: Synthetic oligonucleotide
  Target: SCN9A; (-) strand; PAM type: YTN; PAM sequence: TTG
acctccttttcaattttttg

SEQ ID NO: 61846 - DNA, 20 bp, Artificial Sequence
  Description of Artificial Sequence: Synthetic oligonucleotide
  Target: SCN9A; (-) strand; PAM type: YTN; PAM sequence: TTT
gacctccttttcaatttttt

SEQ ID NO: 61847 - DNA, 20 bp, Artificial Sequence
  Description of Artificial Sequence: Synthetic oligonucleotide
  Target: SCN9A; (-) strand; PAM type: YTN; PAM sequence: CTC
ataaaatgaatttgacctcc

SEQ ID NO: 61848 - DNA, 20 bp, Artificial Sequence
  Description of Artificial Sequence: Synthetic oligonucleotide
  Target: SCN9A; (-) strand; PAM type: YTN; PAM sequence: CTG
gcctcataaaatgaatttga

SEQ ID NO: 61849 - DNA, 20 bp, Artificial Sequence
  Description of Artificial Sequence: Synthetic oligonucleotide
  Target: SCN9A; (-) strand; PAM type: YTN; PAM sequence: TTC
atatcagtataatactggcc

SEQ ID NO: 61850 - DNA, 20 bp, Artificial Sequence
  Description of Artificial Sequence: Synthetic oligonucleotide
  Target: SCN9A; (-) strand; PAM type: YTN; PAM sequence: TTT
catatcagtataatactggc

SEQ ID NO: 61851 - DNA, 20 bp, Artificial Sequence
  Description of Artificial Sequence: Synthetic oligonucleotide
  Target: SCN9A; (-) strand; PAM type: YTN; PAM sequence: TTT
tcatatcagtataatactgg

SEQ ID NO: 61852 - DNA, 20 bp, Artificial Sequence
  Description of Artificial Sequence: Synthetic oligonucleotide
  Target: SCN9A; (-) strand; PAM type: YTN; PAM sequence: TTA
gggttttcatatcagtataa

SEQ ID NO: 61853 - DNA, 20 bp, Artificial Sequence
  Description of Artificial Sequence: Synthetic oligonucleotide
  Target: SCN9A; (-) strand; PAM type: YTN; PAM sequence: CTT
agggttttcatatcagtata

SEQ ID NO: 61854 - DNA, 20 bp, Artificial Sequence
  Description of Artificial Sequence: Synthetic oligonucleotide
  Target: SCN9A; (-) strand; PAM type: YTN; PAM sequence: CTC
ttagggttttcatatcagta

SEQ ID NO: 61855 - DNA, 20 bp, Artificial Sequence
  Description of Artificial Sequence: Synthetic oligonucleotide
  Target: SCN9A; (-) strand; PAM type: YTN; PAM sequence: CTG
gtagcatactcttagggttt

SEQ ID NO: 61856 - DNA, 20 bp, Artificial Sequence
  Description of Artificial Sequence: Synthetic oligonucleotide
  Target: SCN9A; (-) strand; PAM type: YTN; PAM sequence: TTC
tggtagcatactcttagggt

SEQ ID NO: 61857 - DNA, 20 bp, Artificial Sequence
  Description of Artificial Sequence: Synthetic oligonucleotide
  Target: SCN9A; (-) strand; PAM type: YTN; PAM sequence: TTT
ctggtagcatactcttaggg

SEQ ID NO: 61858 - DNA, 20 bp, Artificial Sequence
  Description of Artificial Sequence: Synthetic oligonucleotide
  Target: SCN9A; (-) strand; PAM type: YTN; PAM sequence: TTT
tctggtagcatactcttagg

SEQ ID NO: 61859 - DNA, 20 bp, Artificial Sequence
  Description of Artificial Sequence: Synthetic oligonucleotide
  Target: SCN9A; (-) strand; PAM type: YTN; PAM sequence: CTT
ttctggtagcatactcttag

SEQ ID NO: 61860 - DNA, 20 bp, Artificial Sequence
  Description of Artificial Sequence: Synthetic oligonucleotide
  Target: SCN9A; (-) strand; PAM type: YTN; PAM sequence: TTC
ttttctggtagcatactctt

SEQ ID NO: 61861 - DNA, 20 bp, Artificial Sequence
  Description of Artificial Sequence: Synthetic oligonucleotide
  Target: SCN9A; (-) strand; PAM type: YTN; PAM sequence: TTT
cttttctggtagcatactct

SEQ ID NO: 61862 - DNA, 20 bp, Artificial Sequence
  Description of Artificial Sequence: Synthetic oligonucleotide
  Target: SCN9A; (-) strand; PAM type: YTN; PAM sequence: TTT
tcttttctggtagcatactc

SEQ ID NO: 61863 - DNA, 20 bp, Artificial Sequence
  Description of Artificial Sequence: Synthetic oligonucleotide
  Target: SCN9A; (-) strand; PAM type: YTN; PAM sequence: CTG
cagttttcttttctggtagc

SEQ ID NO: 61864 - DNA, 20 bp, Artificial Sequence
  Description of Artificial Sequence: Synthetic oligonucleotide
  Target: SCN9A; (-) strand; PAM type: YTN; PAM sequence: TTG
gcctgcagttttcttttctg

SEQ ID NO: 61865 - DNA, 20 bp, Artificial Sequence
  Description of Artificial Sequence: Synthetic oligonucleotide
  Target: SCN9A; (-) strand; PAM type: YTN; PAM sequence: TTC
atcaagaatattggcctgca

SEQ ID NO: 61866 - DNA, 20 bp, Artificial Sequence
  Description of Artificial Sequence: Synthetic oligonucleotide
  Target: SCN9A; (-) strand; PAM type: YTN; PAM sequence: CTA
tgttcatcaagaatattggc

SEQ ID NO: 61867 - DNA, 20 bp, Artificial Sequence
  Description of Artificial Sequence: Synthetic oligonucleotide
  Target: SCN9A; (-) strand; PAM type: YTN; PAM sequence: TTG
gatctatgttcatcaagaat

SEQ ID NO: 61868 - DNA, 20 bp, Artificial Sequence
  Description of Artificial Sequence: Synthetic oligonucleotide
  Target: SCN9A; (-) strand; PAM type: YTN; PAM sequence: TTT
ggatctatgttcatcaagaa

SEQ ID NO: 61869 - DNA, 20 bp, Artificial Sequence
  Description of Artificial Sequence: Synthetic oligonucleotide
  Target: SCN9A; (-) strand; PAM type: YTN; PAM sequence: TTT
tggatctatgttcatcaaga

SEQ ID NO: 61870 - DNA, 20 bp, Artificial Sequence
  Description of Artificial Sequence: Synthetic oligonucleotide
  Target: SCN9A; (-) strand; PAM type: YTN; PAM sequence: TTT
ttggatctatgttcatcaag

SEQ ID NO: 61871 - DNA, 20 bp, Artificial Sequence
  Description of Artificial Sequence: Synthetic oligonucleotide
  Target: SCN9A; (-) strand; PAM type: YTN; PAM sequence: TTG
tgaatttttggatctatgtt

SEQ ID NO: 61872 - DNA, 20 bp, Artificial Sequence
  Description of Artificial Sequence: Synthetic oligonucleotide
  Target: SCN9A; (-) strand; PAM type: YTN; PAM sequence: TTG
ttgtgaatttttggatctat

SEQ ID NO: 61873 - DNA, 20 bp, Artificial Sequence
  Description of Artificial Sequence: Synthetic oligonucleotide
  Target: SCN9A; (-) strand; PAM type: YTN; PAM sequence: CTA
atatattgttgtgaattttt

SEQ ID NO: 61874 - DNA, 20 bp, Artificial Sequence
  Description of Artificial Sequence: Synthetic oligonucleotide
  Target: SCN9A; (-) strand; PAM type: YTN; PAM sequence: TTG
ctaatatattgttgtgaatt

SEQ ID NO: 61875 - DNA, 20 bp, Artificial Sequence
  Description of Artificial Sequence: Synthetic oligonucleotide
  Target: SCN9A; (-) strand; PAM type: YTN; PAM sequence: TTT
gctaatatattgttgtgaat

SEQ ID NO: 61876 - DNA, 20 bp, Artificial Sequence
  Description of Artificial Sequence: Synthetic oligonucleotide
  Target: SCN9A; (-) strand; PAM type: YTN; PAM sequence: TTC
agtttgctaatatattgttg

SEQ ID NO: 61877 - DNA, 20 bp, Artificial Sequence
  Description of Artificial Sequence: Synthetic oligonucleotide
  Target: SCN9A; (-) strand; PAM type: YTN; PAM sequence: CTA
gggaattcagtttgctaata

SEQ ID NO: 61878 - DNA, 20 bp, Artificial Sequence
  Description of Artificial Sequence: Synthetic oligonucleotide
  Target: SCN9A; (-) strand; PAM type: YTN; PAM sequence: TTA
aatgtgctagggaattcagt

SEQ ID NO: 61879 - DNA, 20 bp, Artificial Sequence
  Description of Artificial Sequence: Synthetic oligonucleotide
  Target: SCN9A; (-) strand; PAM type: YTN; PAM sequence: TTT
aaatgtgctagggaattcag

SEQ ID NO: 61880 - DNA, 20 bp, Artificial Sequence
  Description of Artificial Sequence: Synthetic oligonucleotide
  Target: SCN9A; (-) strand; PAM type: YTN; PAM sequence: TTT
taaatgtgctagggaattca

SEQ ID NO: 61881 - DNA, 20 bp, Artificial Sequence
  Description of Artificial Sequence: Synthetic oligonucleotide
  Target: SCN9A; (-) strand; PAM type: YTN; PAM sequence: CTC
agataaatcccaagtaatca

SEQ ID NO: 61882 - DNA, 20 bp, Artificial Sequence
  Description of Artificial Sequence: Synthetic oligonucleotide
  Target: SCN9A; (-) strand; PAM type: YTN; PAM sequence: TTG
catccctcagataaatccca

SEQ ID NO: 61883 - DNA, 20 bp, Artificial Sequence
  Description of Artificial Sequence: Synthetic oligonucleotide
  Target: SCN9A; (-) strand; PAM type: YTN; PAM sequence: TTT
gcatccctcagataaatccc

SEQ ID NO: 61884 - DNA, 20 bp, Artificial Sequence
  Description of Artificial Sequence: Synthetic oligonucleotide
  Target: SCN9A; (-) strand; PAM type: YTN; PAM sequence: TTT
tgcatccctcagataaatcc

SEQ ID NO: 61885 - DNA, 20 bp, Artificial Sequence
  Description of Artificial Sequence: Synthetic oligonucleotide
  Target: SCN9A; (-) strand; PAM type: YTN; PAM sequence: TTT
ttgcatccctcagataaatc

SEQ ID NO: 61886 - DNA, 20 bp, Artificial Sequence
  Description of Artificial Sequence: Synthetic oligonucleotide
  Target: SCN9A; (-) strand; PAM type: YTN; PAM sequence: TTA
accatttttgcatccctcag

SEQ ID NO: 61887 - DNA, 20 bp, Artificial Sequence
  Description of Artificial Sequence: Synthetic oligonucleotide
  Target: SCN9A; (-) strand; PAM type: YTN; PAM sequence: TTT
aaccatttttgcatccctca

SEQ ID NO: 61888 - DNA, 20 bp, Artificial Sequence
  Description of Artificial Sequence: Synthetic oligonucleotide
  Target: SCN9A; (-) strand; PAM type: YTN; PAM sequence: TTA
tgtatgtttaaccatttttg

SEQ ID NO: 61889 - DNA, 20 bp, Artificial Sequence
  Description of Artificial Sequence: Synthetic oligonucleotide
  Target: SCN9A; (-) strand; PAM type: YTN; PAM sequence: TTT
atgtatgtttaaccattttt

SEQ ID NO: 61890 - DNA, 20 bp, Artificial Sequence
  Description of Artificial Sequence: Synthetic oligonucleotide
  Target: SCN9A; (-) strand; PAM type: YTN; PAM sequence: TTG
atttatgtatgtttaaccat

SEQ ID NO: 61891 - DNA, 20 bp, Artificial Sequence
  Description of Artificial Sequence: Synthetic oligonucleotide
  Target: SCN9A; (-) strand; PAM type: YTN; PAM sequence: TTA
ttgatttatgtatgtttaac

SEQ ID NO: 61892 - DNA, 20 bp, Artificial Sequence
  Description of Artificial Sequence: Synthetic oligonucleotide
  Target: SCN9A; (-) strand; PAM type: YTN; PAM sequence: TTT
attgatttatgtatgtttaa

SEQ ID NO: 61893 - DNA, 20 bp, Artificial Sequence
  Description of Artificial Sequence: Synthetic oligonucleotide
  Target: SCN9A; (-) strand; PAM type: YTN; PAM sequence: TTA
atgtagcatatcacatttat

SEQ ID NO: 61894 - DNA, 20 bp, Artificial Sequence
  Description of Artificial Sequence: Synthetic oligonucleotide
  Target: SCN9A; (-) strand; PAM type: YTN; PAM sequence: TTG
ttaatgtagcatatcacatt

SEQ ID NO: 61895 - DNA, 20 bp, Artificial Sequence
  Description of Artificial Sequence: Synthetic oligonucleotide
  Target: SCN9A; (-) strand; PAM type: YTN; PAM sequence: TTT
gttaatgtagcatatcacat

SEQ ID NO: 61896 - DNA, 20 bp, Artificial Sequence
  Description of Artificial Sequence: Synthetic oligonucleotide
  Target: SCN9A; (-) strand; PAM type: YTN; PAM sequence: TTT
tgttaatgtagcatatcaca

SEQ ID NO: 61897 - DNA, 20 bp, Artificial Sequence
  Description of Artificial Sequence: Synthetic oligonucleotide
  Target: SCN9A; (-) strand; PAM type: YTN; PAM sequence: TTA
ttttgttaatgtagcatatc

SEQ ID NO: 61898 - DNA, 20 bp, Artificial Sequence
  Description of Artificial Sequence: Synthetic oligonucleotide
  Target: SCN9A; (-) strand; PAM type: YTN; PAM sequence: CTT
attttgttaatgtagcatat

SEQ ID NO: 61899 - DNA, 20 bp, Artificial Sequence
  Description of Artificial Sequence: Synthetic oligonucleotide
  Target: SCN9A; (-) strand; PAM type: YTN; PAM sequence: TTC
ttattttgttaatgtagcat

SEQ ID NO: 61900 - DNA, 20 bp, Artificial Sequence
  Description of Artificial Sequence: Synthetic oligonucleotide
  Target: SCN9A; (-) strand; PAM type: YTN; PAM sequence: TTG
ttcttattttgttaatgtag

SEQ ID NO: 61901 - DNA, 20 bp, Artificial Sequence
  Description of Artificial Sequence: Synthetic oligonucleotide
  Target: SCN9A; (-) strand; PAM type: YTN; PAM sequence: TTT
gttcttattttgttaatgta

SEQ ID NO: 61902 - DNA, 20 bp, Artificial Sequence
  Description of Artificial Sequence: Synthetic oligonucleotide
  Target: SCN9A; (-) strand; PAM type: YTN; PAM sequence: TTT
tgttcttattttgttaatgt

SEQ ID NO: 61903 - DNA, 20 bp, Artificial Sequence
  Description of Artificial Sequence: Synthetic oligonucleotide
  Target: SCN9A; (-) strand; PAM type: YTN; PAM sequence: TTT
ttgttcttattttgttaatg

SEQ ID NO: 61904 - DNA, 20 bp, Artificial Sequence
  Description of Artificial Sequence: Synthetic oligonucleotide
  Target: SCN9A; (-) strand; PAM type: YTN; PAM sequence: CTA
gtaagatgatcatatgattt

SEQ ID NO: 61905 - DNA, 20 bp, Artificial Sequence
  Description of Artificial Sequence: Synthetic oligonucleotide
  Target: SCN9A; (-) strand; PAM type: YTN; PAM sequence: CTG
catctagtaagatgatcata

SEQ ID NO: 61906 - DNA, 20 bp, Artificial Sequence
  Description of Artificial Sequence: Synthetic oligonucleotide
  Target: SCN9A; (-) strand; PAM type: YTN; PAM sequence: TTG
tctgcatctagtaagatgat

SEQ ID NO: 61907 - DNA, 20 bp, Artificial Sequence
  Description of Artificial Sequence: Synthetic oligonucleotide
  Target: SCN9A; (-) strand; PAM type: YTN; PAM sequence: TTT
gtctgcatctagtaagatga

SEQ ID NO: 61908 - DNA, 20 bp, Artificial Sequence
  Description of Artificial Sequence: Synthetic oligonucleotide
  Target: SCN9A; (-) strand; PAM type: YTN; PAM sequence: CTT
tgtctgcatctagtaagatg

SEQ ID NO: 61909 - DNA, 20 bp, Artificial Sequence
  Description of Artificial Sequence: Synthetic oligonucleotide
  Target: SCN9A; (-) strand; PAM type: YTN; PAM sequence: TTA
tcaaatgctttgtctgcatc

SEQ ID NO: 61910 - DNA, 20 bp, Artificial Sequence
  Description of Artificial Sequence: Synthetic oligonucleotide
  Target: SCN9A; (-) strand; PAM type: YTN; PAM sequence: TTT
atcaaatgctttgtctgcat

SEQ ID NO: 61911 - DNA, 20 bp, Artificial Sequence
  Description of Artificial Sequence: Synthetic oligonucleotide
  Target: SCN9A; (-) strand; PAM type: YTN; PAM sequence: TTT
tatcaaatgctttgtctgca

SEQ ID NO: 61912 - DNA, 20 bp, Artificial Sequence
  Description of Artificial Sequence: Synthetic oligonucleotide
  Target: SCN9A; (-) strand; PAM type: YTN; PAM sequence: CTG
gattttatcaaatgctttgt

SEQ ID NO: 61913 - DNA, 20 bp, Artificial Sequence
  Description of Artificial Sequence: Synthetic oligonucleotide
  Target: SCN9A; (-) strand; PAM type: YTN; PAM sequence: TTA
tgaacatatgctggatttta

SEQ ID NO: 61914 - DNA, 20 bp, Artificial Sequence
  Description of Artificial Sequence: Synthetic oligonucleotide
  Target: SCN9A; (-) strand; PAM type: YTN; PAM sequence: TTA
ttatgaacatatgctggatt

SEQ ID NO: 61915 - DNA, 20 bp, Artificial Sequence
  Description of Artificial Sequence: Synthetic oligonucleotide
  Target: SCN9A; (-) strand; PAM type: YTN; PAM sequence: TTT
attatgaacatatgctggat

SEQ ID NO: 61916 - DNA, 20 bp, Artificial Sequence
  Description of Artificial Sequence: Synthetic oligonucleotide
  Target: SCN9A; (-) strand; PAM type: YTN; PAM sequence: TTT
tattatgaacatatgctgga

SEQ ID NO: 61917 - DNA, 20 bp, Artificial Sequence
  Description of Artificial Sequence: Synthetic oligonucleotide
  Target: SCN9A; (-) strand; PAM type: YTN; PAM sequence: TTG
agattttattatgaacatat

SEQ ID NO: 61918 - DNA, 20 bp, Artificial Sequence
  Description of Artificial Sequence: Synthetic oligonucleotide
  Target: SCN9A; (-) strand; PAM type: YTN; PAM sequence: TTG
ttgagattttattatgaaca

SEQ ID NO: 61919 - DNA, 20 bp, Artificial Sequence
  Description of Artificial Sequence: Synthetic oligonucleotide
  Target: SCN9A; (-) strand; PAM type: YTN; PAM sequence: TTT
gttgagattttattatgaac

SEQ ID NO: 61920 - DNA, 20 bp, Artificial Sequence
  Description of Artificial Sequence: Synthetic oligonucleotide
  Target: SCN9A; (-) strand; PAM type: YTN; PAM sequence: CTT
tgttgagattttattatgaa

SEQ ID NO: 61921 - DNA, 20 bp, Artificial Sequence
  Description of Artificial Sequence: Synthetic oligonucleotide
  Target: SCN9A; (-) strand; PAM type: YTN; PAM sequence: CTG
ctttgttgagattttattat

SEQ ID NO: 61922 - DNA, 20 bp, Artificial Sequence
  Description of Artificial Sequence: Synthetic oligonucleotide
  Target: SCN9A; (-) strand; PAM type: YTN; PAM sequence: TTC
catatctgctttgttgagat

SEQ ID NO: 61923 - DNA, 20 bp, Artificial Sequence
  Description of Artificial Sequence: Synthetic oligonucleotide
  Target: SCN9A; (-) strand; PAM type: YTN; PAM sequence: CTT
ccatatctgctttgttgaga

SEQ ID NO: 61924 - DNA, 20 bp, Artificial Sequence
  Description of Artificial Sequence: Synthetic oligonucleotide
  Target: SCN9A; (-) strand; PAM type: YTN; PAM sequence: TTC
cttccatatctgctttgttg

SEQ ID NO: 61925 - DNA, 20 bp, Artificial Sequence
  Description of Artificial Sequence: Synthetic oligonucleotide
  Target: SCN9A; (-) strand; PAM type: YTN; PAM sequence: TTA
aggtacattccttccatatc

SEQ ID NO: 61926 - DNA, 20 bp, Artificial Sequence
  Description of Artificial Sequence: Synthetic oligonucleotide
  Target: SCN9A; (-) strand; PAM type: YTN; PAM sequence: TTG
ttaaggtacattccttccat

SEQ ID NO: 61927 - DNA, 20 bp, Artificial Sequence
  Description of Artificial Sequence: Synthetic oligonucleotide
  Target: SCN9A; (-) strand; PAM type: YTN; PAM sequence: TTT
gttaaggtacattccttcca

SEQ ID NO: 61928 - DNA, 20 bp, Artificial Sequence
  Description of Artificial Sequence: Synthetic oligonucleotide
  Target: SCN9A; (-) strand; PAM type: YTN; PAM sequence: TTT
tgttaaggtacattccttcc

SEQ ID NO: 61929 - DNA, 20 bp, Artificial Sequence
  Description of Artificial Sequence: Synthetic oligonucleotide
  Target: SCN9A; (-) strand; PAM type: YTN; PAM sequence: TTA
ttttgttaaggtacattcct

SEQ ID NO: 61930 - DNA, 20 bp, Artificial Sequence
  Description of Artificial Sequence: Synthetic oligonucleotide
  Target: SCN9A; (-) strand; PAM type: YTN; PAM sequence: TTT
attttgttaaggtacattcc

SEQ ID NO: 61931 - DNA, 20 bp, Artificial Sequence
  Description of Artificial Sequence: Synthetic oligonucleotide
  Target: SCN9A; (-) strand; PAM type: YTN; PAM sequence: CTT
tattttgttaaggtacattc

SEQ ID NO: 61932 - DNA, 20 bp, Artificial Sequence
  Description of Artificial Sequence: Synthetic oligonucleotide
  Target: SCN9A; (-) strand; PAM type: YTN; PAM sequence: TTG
tcatatatggctttattttg

SEQ ID NO: 61933 - DNA, 20 bp, Artificial Sequence
  Description of Artificial Sequence: Synthetic oligonucleotide
  Target: SCN9A; (-) strand; PAM type: YTN; PAM sequence: CTT
gtcatatatggctttatttt

SEQ ID NO: 61934 - DNA, 20 bp, Artificial Sequence
  Description of Artificial Sequence: Synthetic oligonucleotide
  Target: SCN9A; (-) strand; PAM type: YTN; PAM sequence: TTA
gccgtgggcttgtcatatat

SEQ ID NO: 61935 - DNA, 20 bp, Artificial Sequence
  Description of Artificial Sequence: Synthetic oligonucleotide
  Target: SCN9A; (-) strand; PAM type: YTN; PAM sequence: TTG
cataatgttagccgtgggct

SEQ ID NO: 61936 - DNA, 20 bp, Artificial Sequence
  Description of Artificial Sequence: Synthetic oligonucleotide
  Target: SCN9A; (-) strand; PAM type: YTN; PAM sequence: TTT
gcataatgttagccgtgggc

SEQ ID NO: 61937 - DNA, 20 bp, Artificial Sequence
  Description of Artificial Sequence: Synthetic oligonucleotide
  Target: SCN9A; (-) strand; PAM type: YTN; PAM sequence: TTT
tgcataatgttagccgtggg

SEQ ID NO: 61938 - DNA, 20 bp, Artificial Sequence
  Description of Artificial Sequence: Synthetic oligonucleotide
  Target: SCN9A; (-) strand; PAM type: YTN; PAM sequence: TTT
ttgcataatgttagccgtgg

SEQ ID NO: 61939 - DNA, 20 bp, Artificial Sequence
  Description of Artificial Sequence: Synthetic oligonucleotide
  Target: SCN9A; (-) strand; PAM type: YTN; PAM sequence: TTC
agtttttgcataatgttagc

SEQ ID NO: 61940 - DNA, 20 bp, Artificial Sequence
  Description of Artificial Sequence: Synthetic oligonucleotide
  Target: SCN9A; (-) strand; PAM type: YTN; PAM sequence: TTT
cagtttttgcataatgttag

SEQ ID NO: 61941 - DNA, 20 bp, Artificial Sequence
  Description of Artificial Sequence: Synthetic oligonucleotide
  Target: SCN9A; (-) strand; PAM type: YTN; PAM sequence: TTT
tcagtttttgcataatgtta

SEQ ID NO: 61942 - DNA, 20 bp, Artificial Sequence
  Description of Artificial Sequence: Synthetic oligonucleotide
  Target: SCN9A; (-) strand; PAM type: YTN; PAM sequence: CTT
ttcagtttttgcataatgtt

SEQ ID NO: 61943 - DNA, 20 bp, Artificial Sequence
  Description of Artificial Sequence: Synthetic oligonucleotide
  Target: SCN9A; (-) strand; PAM type: YTN; PAM sequence: CTC
ccaacttttcagtttttgca

SEQ ID NO: 61944 - DNA, 20 bp, Artificial Sequence
  Description of Artificial Sequence: Synthetic oligonucleotide
  Target: SCN9A; (-) strand; PAM type: YTN; PAM sequence: TTA
gaagaaaagctcccaacttt

SEQ ID NO: 61945 - DNA, 20 bp, Artificial Sequence
  Description of Artificial Sequence: Synthetic oligonucleotide
  Target: SCN9A; (-) strand; PAM type: YTN; PAM sequence: CTT
agaagaaaagctcccaactt

SEQ ID NO: 61946 - DNA, 20 bp, Artificial Sequence
  Description of Artificial Sequence: Synthetic oligonucleotide
  Target: SCN9A; (-) strand; PAM type: YTN; PAM sequence: CTG
atcttagaagaaaagctccc

SEQ ID NO: 61947 - DNA, 20 bp, Artificial Sequence
  Description of Artificial Sequence: Synthetic oligonucleotide
  Target: SCN9A; (-) strand; PAM type: YTN; PAM sequence: TTC
ctgatcttagaagaaaagct

SEQ ID NO: 61948 - DNA, 20 bp, Artificial Sequence
  Description of Artificial Sequence: Synthetic oligonucleotide
  Target: SCN9A; (-) strand; PAM type: YTN; PAM sequence: TTG
ttcctgatcttagaagaaaa

SEQ ID NO: 61949 - DNA, 20 bp, Artificial Sequence
  Description of Artificial Sequence: Synthetic oligonucleotide
  Target: SCN9A; (-) strand; PAM type: YTN; PAM sequence: CTT
gttcctgatcttagaagaaa

SEQ ID NO: 61950 - DNA, 20 bp, Artificial Sequence
  Description of Artificial Sequence: Synthetic oligonucleotide
  Target: SCN9A; (-) strand; PAM type: YTN; PAM sequence: TTG
tcttgttcctgatcttagaa

SEQ ID NO: 61951 - DNA, 20 bp, Artificial Sequence
  Description of Artificial Sequence: Synthetic oligonucleotide
  Target: SCN9A; (-) strand; PAM type: YTN; PAM sequence: CTT
gtcttgttcctgatcttaga

SEQ ID NO: 61952 - DNA, 20 bp, Artificial Sequence
  Description of Artificial Sequence: Synthetic oligonucleotide
  Target: SCN9A; (-) strand; PAM type: YTN; PAM sequence: CTA
tgtcaaaaagaagtggtaat

SEQ ID NO: 61953 - DNA, 20 bp, Artificial Sequence
  Description of Artificial Sequence: Synthetic oligonucleotide
  Target: SCN9A; (-) strand; PAM type: YTN; PAM sequence: CTA
gtactatgtcaaaaagaagt

SEQ ID NO: 61954 - DNA, 20 bp, Artificial Sequence
  Description of Artificial Sequence: Synthetic oligonucleotide
  Target: SCN9A; (-) strand; PAM type: YTN; PAM sequence: TTC
tagtactatgtcaaaaagaa

SEQ ID NO: 61955 - DNA, 20 bp, Artificial Sequence
  Description of Artificial Sequence: Synthetic oligonucleotide
  Target: SCN9A; (-) strand; PAM type: YTN; PAM sequence: TTT
ctagtactatgtcaaaaaga

SEQ ID NO: 61956 - DNA, 20 bp, Artificial Sequence
  Description of Artificial Sequence: Synthetic oligonucleotide
  Target: SCN9A; (-) strand; PAM type: YTN; PAM sequence: CTA
tggatgggatttctagtact

SEQ ID NO: 61957 - DNA, 20 bp, Artificial Sequence
  Description of Artificial Sequence: Synthetic oligonucleotide
  Target: SCN9A; (-) strand; PAM type: YTN; PAM sequence: TTG
ctatggatgggatttctagt

SEQ ID NO: 61958 - DNA, 20 bp, Artificial Sequence
  Description of Artificial Sequence: Synthetic oligonucleotide
  Target: SCN9A; (-) strand; PAM type: YTN; PAM sequence: CTA
attgctatggatgggatttc

SEQ ID NO: 61959 - DNA, 20 bp, Artificial Sequence
  Description of Artificial Sequence: Synthetic oligonucleotide
  Target: SCN9A; (-) strand; PAM type: YTN; PAM sequence: CTG
cctaattgctatggatggga

SEQ ID NO: 61960 - DNA, 20 bp, Artificial Sequence
  Description of Artificial Sequence: Synthetic oligonucleotide
  Target: SCN9A; (-) strand; PAM type: YTN; PAM sequence: TTC
ctgcctaattgctatggatg

SEQ ID NO: 61961 - DNA, 20 bp, Artificial Sequence
  Description of Artificial Sequence: Synthetic oligonucleotide
  Target: SCN9A; (-) strand; PAM type: YTN; PAM sequence: TTT
cctgcctaattgctatggat

SEQ ID NO: 61962 - DNA, 20 bp, Artificial Sequence
  Description of Artificial Sequence: Synthetic oligonucleotide
  Target: SCN9A; (-) strand; PAM type: YTN; PAM sequence: TTT
tcctgcctaattgctatgga

SEQ ID NO: 61963 - DNA, 20 bp, Artificial Sequence
  Description of Artificial Sequence: Synthetic oligonucleotide
  Target: SCN9A; (-) strand; PAM type: YTN; PAM sequence: TTT
ttcctgcctaattgctatgg

SEQ ID NO: 61964 - DNA, 20 bp, Artificial Sequence
  Description of Artificial Sequence: Synthetic oligonucleotide
  Target: SCN9A; (-) strand; PAM type: YTN; PAM sequence: CTT
tttcctgcctaattgctatg

SEQ ID NO: 61965 - DNA, 20 bp, Artificial Sequence
  Description of Artificial Sequence: Synthetic oligonucleotide
  Target: SCN9A; (-) strand; PAM type: YTN; PAM sequence: TTC
tttttcctgcctaattgcta

SEQ ID NO: 61966 - DNA, 20 bp, Artificial Sequence
  Description of Artificial Sequence: Synthetic oligonucleotide
  Target: SCN9A; (-) strand; PAM type: YTN; PAM sequence: TTT
ctttttcctgcctaattgct

SEQ ID NO: 61967 - DNA, 20 bp, Artificial Sequence
  Description of Artificial Sequence: Synthetic oligonucleotide
  Target: SCN9A; (-) strand; PAM type: YTN; PAM sequence: TTA
tttctttttcctgcctaatt

SEQ ID NO: 61968 - DNA, 20 bp, Artificial Sequence
  Description of Artificial Sequence: Synthetic oligonucleotide
  Target: SCN9A; (-) strand; PAM type: YTN; PAM sequence: TTT
atttctttttcctgcctaat

SEQ ID NO: 61969 - DNA, 20 bp, Artificial Sequence
  Description of Artificial Sequence: Synthetic oligonucleotide
  Target: SCN9A; (-) strand; PAM type: YTN; PAM sequence: TTT
tatttctttttcctgcctaa

SEQ ID NO: 61970 - DNA, 20 bp, Artificial Sequence
  Description of Artificial Sequence: Synthetic oligonucleotide
  Target: SCN9A; (-) strand; PAM type: YTN; PAM sequence: TTA
catggatgtattttatttct

SEQ ID NO: 61971 - DNA, 20 bp, Artificial Sequence
  Description of Artificial Sequence: Synthetic oligonucleotide
  Target: SCN9A; (-) strand; PAM type: YTN; PAM sequence: CTT
acatggatgtattttatttc

SEQ ID NO: 61972 - DNA, 20 bp, Artificial Sequence
  Description of Artificial Sequence: Synthetic oligonucleotide
  Target: SCN9A; (-) strand; PAM type: YTN; PAM sequence: TTC
ttacatggatgtattttatt

SEQ ID NO: 61973 - DNA, 20 bp, Artificial Sequence
  Description of Artificial Sequence: Synthetic oligonucleotide
  Target: SCN9A; (-) strand; PAM type: YTN; PAM sequence: TTT
cttacatggatgtattttat

SEQ ID NO: 61974 - DNA, 20 bp, Artificial Sequence
  Description of Artificial Sequence: Synthetic oligonucleotide
  Target: SCN9A; (-) strand; PAM type: YTN; PAM sequence: CTT
tcttacatggatgtatttta

SEQ ID NO: 61975 - DNA, 20 bp, Artificial Sequence
  Description of Artificial Sequence: Synthetic oligonucleotide
  Target: SCN9A; (-) strand; PAM type: YTN; PAM sequence: TTG
ctttcttacatggatgtatt

SEQ ID NO: 61976 - DNA, 20 bp, Artificial Sequence
  Description of Artificial Sequence: Synthetic oligonucleotide
  Target: SCN9A; (-) strand; PAM type: YTN; PAM sequence: CTT
gctttcttacatggatgtat

SEQ ID NO: 61977 - DNA, 20 bp, Artificial Sequence
  Description of Artificial Sequence: Synthetic oligonucleotide
  Target: SCN9A; (-) strand; PAM type: YTN; PAM sequence: TTC
ttgctttcttacatggatgt

SEQ ID NO: 61978 - DNA, 20 bp, Artificial Sequence
  Description of Artificial Sequence: Synthetic oligonucleotide
  Target: SCN9A; (-) strand; PAM type: YTN; PAM sequence: TTT
cttgctttcttacatggatg

SEQ ID NO: 61979 - DNA, 20 bp, Artificial Sequence
  Description of Artificial Sequence: Synthetic oligonucleotide
  Target: SCN9A; (-) strand; PAM type: YTN; PAM sequence: TTA
tttcttgctttcttacatgg

SEQ ID NO: 61980 - DNA, 20 bp, Artificial Sequence
  Description of Artificial Sequence: Synthetic oligonucleotide
  Target: SCN9A; (-) strand; PAM type: YTN; PAM sequence: TTT
atttcttgctttcttacatg

SEQ ID NO: 61981 - DNA, 20 bp, Artificial Sequence
  Description of Artificial Sequence: Synthetic oligonucleotide
  Target: SCN9A; (-) strand; PAM type: YTN; PAM sequence: TTT
tatttcttgctttcttacat

SEQ ID NO: 61982 - DNA, 20 bp, Artificial Sequence
  Description of Artificial Sequence: Synthetic oligonucleotide
  Target: SCN9A; (-) strand; PAM type: YTN; PAM sequence: TTA
gcaaacagagataattttat

SEQ ID NO: 61983 - DNA, 20 bp, Artificial Sequence
  Description of Artificial Sequence: Synthetic oligonucleotide
  Target: SCN9A; (-) strand; PAM type: YTN; PAM sequence: CTA
catataaagatcatgtcatt

SEQ ID NO: 61984 - DNA, 20 bp, Artificial Sequence
  Description of Artificial Sequence: Synthetic oligonucleotide
  Target: SCN9A; (-) strand; PAM type: YTN; PAM sequence: TTC
tacatataaagatcatgtca

SEQ ID NO: 61985 - DNA, 20 bp, Artificial Sequence
  Description of Artificial Sequence: Synthetic oligonucleotide
  Target: SCN9A; (-) strand; PAM type: YTN; PAM sequence: TTT
ctacatataaagatcatgtc

SEQ ID NO: 61986 - DNA, 20 bp, Artificial Sequence
  Description of Artificial Sequence: Synthetic oligonucleotide
  Target: SCN9A; (-) strand; PAM type: YTN; PAM sequence: TTT
tctacatataaagatcatgt

SEQ ID NO: 61987 - DNA, 20 bp, Artificial Sequence
  Description of Artificial Sequence: Synthetic oligonucleotide
  Target: SCN9A; (-) strand; PAM type: YTN; PAM sequence: TTC
agggttttctacatataaag

SEQ ID NO: 61988 - DNA, 20 bp, Artificial Sequence
  Description of Artificial Sequence: Synthetic oligonucleotide
  Target: SCN9A; (-) strand; PAM type: YTN; PAM sequence: CTC
agtagagtgttcagggtttt

SEQ ID NO: 61989 - DNA, 20 bp, Artificial Sequence
  Description of Artificial Sequence: Synthetic oligonucleotide
  Target: SCN9A; (-) strand; PAM type: YTN; PAM sequence: TTC
tcagtagagtgttcagggtt

SEQ ID NO: 61990 - DNA, 20 bp, Artificial Sequence
  Description of Artificial Sequence: Synthetic oligonucleotide
  Target: SCN9A; (-) strand; PAM type: YTN; PAM sequence: TTA
acagttctcagtagagtgtt

SEQ ID NO: 61991 - DNA, 20 bp, Artificial Sequence
  Description of Artificial Sequence: Synthetic oligonucleotide
  Target: SCN9A; (-) strand; PAM type: YTN; PAM sequence: TTT
aacagttctcagtagagtgt

SEQ ID NO: 61992 - DNA, 20 bp, Artificial Sequence
  Description of Artificial Sequence: Synthetic oligonucleotide
  Target: SCN9A; (-) strand; PAM type: YTN; PAM sequence: TTT
taacagttctcagtagagtg

SEQ ID NO: 61993 - DNA, 20 bp, Artificial Sequence
  Description of Artificial Sequence: Synthetic oligonucleotide
  Target: SCN9A; (-) strand; PAM type: YTN; PAM sequence: TTA
tgtatcagttttaacagttc

SEQ ID NO: 61994 - DNA, 20 bp, Artificial Sequence
  Description of Artificial Sequence: Synthetic oligonucleotide
  Target: SCN9A; (-) strand; PAM type: YTN; PAM sequence: TTT
atgtatcagttttaacagtt

SEQ ID NO: 61995 - DNA, 20 bp, Artificial Sequence
  Description of Artificial Sequence: Synthetic oligonucleotide
  Target: SCN9A; (-) strand; PAM type: YTN; PAM sequence: CTG
aatttatgtatcagttttaa

SEQ ID NO: 61996 - DNA, 20 bp, Artificial Sequence
  Description of Artificial Sequence: Synthetic oligonucleotide
  Target: SCN9A; (-) strand; PAM type: YTN; PAM sequence: TTA
ctgaatttatgtatcagttt

SEQ ID NO: 61997 - DNA, 20 bp, Artificial Sequence
  Description of Artificial Sequence: Synthetic oligonucleotide
  Target: SCN9A; (-) strand; PAM type: YTN; PAM sequence: TTT
actgaatttatgtatcagtt

SEQ ID NO: 61998 - DNA, 20 bp, Artificial Sequence
  Description of Artificial Sequence: Synthetic oligonucleotide
  Target: SCN9A; (-) strand; PAM type: YTN; PAM sequence: CTT
tactgaatttatgtatcagt

SEQ ID NO: 61999 - DNA, 20 bp, Artificial Sequence
  Description of Artificial Sequence: Synthetic oligonucleotide
  Target: SCN9A; (-) strand; PAM type: YTN; PAM sequence: CTG
caactttactgaatttatgt

SEQ ID NO: 62000 - DNA, 20 bp, Artificial Sequence
  Description of Artificial Sequence: Synthetic oligonucleotide
  Target: SCN9A; (-) strand; PAM type: YTN; PAM sequence: TTG
caaactgcaactttactgaa

SEQ ID NO: 62001 - DNA, 20 bp, Artificial Sequence
  Description of Artificial Sequence: Synthetic oligonucleotide
  Target: SCN9A; (-) strand; PAM type: YTN; PAM sequence: TTT
gcaaactgcaactttactga

SEQ ID NO: 62002 - DNA, 20 bp, Artificial Sequence
  Description of Artificial Sequence: Synthetic oligonucleotide
  Target: SCN9A; (-) strand; PAM type: YTN; PAM sequence: TTT
tgcaaactgcaactttactg

SEQ ID NO: 62003 - DNA, 20 bp, Artificial Sequence
  Description of Artificial Sequence: Synthetic oligonucleotide
  Target: SCN9A; (-) strand; PAM type: YTN; PAM sequence: TTG
attttgcaaactgcaacttt

SEQ ID NO: 62004 - DNA, 20 bp, Artificial Sequence
  Description of Artificial Sequence: Synthetic oligonucleotide
  Target: SCN9A; (-) strand; PAM type: YTN; PAM sequence: CTA
tgttgattttgcaaactgca

SEQ ID NO: 62005 - DNA, 20 bp, Artificial Sequence
  Description of Artificial Sequence: Synthetic oligonucleotide
  Target: SCN9A; (-) strand; PAM type: YTN; PAM sequence: TTC
tatgttgattttgcaaactg

SEQ ID NO: 62006 - DNA, 20 bp, Artificial Sequence
  Description of Artificial Sequence: Synthetic oligonucleotide
  Target: SCN9A; (-) strand; PAM type: YTN; PAM sequence: TTT
ctatgttgattttgcaaact

SEQ ID NO: 62007 - DNA, 20 bp, Artificial Sequence
  Description of Artificial Sequence: Synthetic oligonucleotide
  Target: SCN9A; (-) strand; PAM type: YTN; PAM sequence: TTT
tctatgttgattttgcaaac

SEQ ID NO: 62008 - DNA, 20 bp, Artificial Sequence
  Description of Artificial Sequence: Synthetic oligonucleotide
  Target: SCN9A; (-) strand; PAM type: YTN; PAM sequence: TTT
ttctatgttgattttgcaaa

SEQ ID NO: 62009 - DNA, 20 bp, Artificial Sequence
  Description of Artificial Sequence: Synthetic oligonucleotide
  Target: SCN9A; (-) strand; PAM type: YTN; PAM sequence: CTG
atttttctatgttgattttg

SEQ ID NO: 62010 - DNA, 20 bp, Artificial Sequence
  Description of Artificial Sequence: Synthetic oligonucleotide
  Target: SCN9A; (-) strand; PAM type: YTN; PAM sequence: CTA
ctgatttttctatgttgatt

SEQ ID NO: 62011 - DNA, 20 bp, Artificial Sequence
  Description of Artificial Sequence: Synthetic oligonucleotide
  Target: SCN9A; (-) strand; PAM type: YTN; PAM sequence: TTA
atgtatagaaatgctactga

SEQ ID NO: 62012 - DNA, 20 bp, Artificial Sequence
  Description of Artificial Sequence: Synthetic oligonucleotide
  Target: SCN9A; (-) strand; PAM type: YTN; PAM sequence: TTG
ttaatgtatagaaatgctac

SEQ ID NO: 62013 - DNA, 20 bp, Artificial Sequence
  Description of Artificial Sequence: Synthetic oligonucleotide
  Target: SCN9A; (-) strand; PAM type: YTN; PAM sequence: CTC
attgttaatgtatagaaatg

SEQ ID NO: 62014 - DNA, 20 bp, Artificial Sequence
  Description of Artificial Sequence: Synthetic oligonucleotide
  Target: SCN9A; (-) strand; PAM type: YTN; PAM sequence: TTG
gatacctcattgttaatgta

SEQ ID NO: 62015 - DNA, 20 bp, Artificial Sequence
  Description of Artificial Sequence: Synthetic oligonucleotide
  Target: SCN9A; (-) strand; PAM type: YTN; PAM sequence: TTG
ttggatacctcattgttaat

SEQ ID NO: 62016 - DNA, 20 bp, Artificial Sequence
  Description of Artificial Sequence: Synthetic oligonucleotide
  Target: SCN9A; (-) strand; PAM type: YTN; PAM sequence: TTT
gttggatacctcattgttaa

SEQ ID NO: 62017 - DNA, 20 bp, Artificial Sequence
  Description of Artificial Sequence: Synthetic oligonucleotide
  Target: SCN9A; (-) strand; PAM type: YTN; PAM sequence: CTT
tgttggatacctcattgtta

SEQ ID NO: 62018 - DNA, 20 bp, Artificial Sequence
  Description of Artificial Sequence: Synthetic oligonucleotide
  Target: SCN9A; (-) strand; PAM type: YTN; PAM sequence: TTC
tttgttggatacctcattgt

SEQ ID NO: 62019 - DNA, 20 bp, Artificial Sequence
  Description of Artificial Sequence: Synthetic oligonucleotide
  Target: SCN9A; (-) strand; PAM type: YTN; PAM sequence: TTT
ctttgttggatacctcattg

SEQ ID NO: 62020 - DNA, 20 bp, Artificial Sequence
  Description of Artificial Sequence: Synthetic oligonucleotide
  Target: SCN9A; (-) strand; PAM type: YTN; PAM sequence: TTA
atttctttgttggatacctc

SEQ ID NO: 62021 - DNA, 20 bp, Artificial Sequence
  Description of Artificial Sequence: Synthetic oligonucleotide
  Target: SCN9A; (-) strand; PAM type: YTN; PAM sequence: CTT
aatttctttgttggatacct

SEQ ID NO: 62022 - DNA, 20 bp, Artificial Sequence
  Description of Artificial Sequence: Synthetic oligonucleotide
  Target: SCN9A; (-) strand; PAM type: YTN; PAM sequence: TTC
ttaatttctttgttggatac

SEQ ID NO: 62023 - DNA, 20 bp, Artificial Sequence
  Description of Artificial Sequence: Synthetic oligonucleotide
  Target: SCN9A; (-) strand; PAM type: YTN; PAM sequence: TTT
cttaatttctttgttggata

SEQ ID NO: 62024 - DNA, 20 bp, Artificial Sequence
  Description of Artificial Sequence: Synthetic oligonucleotide
  Target: SCN9A; (-) strand; PAM type: YTN; PAM sequence: TTA
atttcttaatttctttgttg

SEQ ID NO: 62025 - DNA, 20 bp, Artificial Sequence
  Description of Artificial Sequence: Synthetic oligonucleotide
  Target: SCN9A; (-) strand; PAM type: YTN; PAM sequence: TTA
aataggattaatttcttaat

SEQ ID NO: 62026 - DNA, 20 bp, Artificial Sequence
  Description of Artificial Sequence: Synthetic oligonucleotide
  Target: SCN9A; (-) strand; PAM type: YTN; PAM sequence: TTT
aaataggattaatttcttaa

SEQ ID NO: 62027 - DNA, 20 bp, Artificial Sequence
  Description of Artificial Sequence: Synthetic oligonucleotide
  Target: SCN9A; (-) strand; PAM type: YTN; PAM sequence: TTT
taaataggattaatttctta

SEQ ID NO: 62028 - DNA, 20 bp, Artificial Sequence
  Description of Artificial Sequence: Synthetic oligonucleotide
  Target: SCN9A; (-) strand; PAM type: YTN; PAM sequence: CTG
ttttaaataggattaatttc

SEQ ID NO: 62029 - DNA, 20 bp, Artificial Sequence
  Description of Artificial Sequence: Synthetic oligonucleotide
  Target: SCN9A; (-) strand; PAM type: YTN; PAM sequence: TTG
atgctgttttaaataggatt

SEQ ID NO: 62030 - DNA, 20 bp, Artificial Sequence
  Description of Artificial Sequence: Synthetic oligonucleotide
  Target: SCN9A; (-) strand; PAM type: YTN; PAM sequence: TTT
gatgctgttttaaataggat

SEQ ID NO: 62031 - DNA, 20 bp, Artificial Sequence
  Description of Artificial Sequence: Synthetic oligonucleotide
  Target: SCN9A; (-) strand; PAM type: YTN; PAM sequence: TTT
tgatgctgttttaaatagga

SEQ ID NO: 62032 - DNA, 20 bp, Artificial Sequence
  Description of Artificial Sequence: Synthetic oligonucleotide
  Target: SCN9A; (-) strand; PAM type: YTN; PAM sequence: TTA
ttttgatgctgttttaaata

SEQ ID NO: 62033 - DNA, 20 bp, Artificial Sequence
  Description of Artificial Sequence: Synthetic oligonucleotide
  Target: SCN9A; (-) strand; PAM type: YTN; PAM sequence: TTT
attttgatgctgttttaaat

SEQ ID NO: 62034 - DNA, 20 bp, Artificial Sequence
  Description of Artificial Sequence: Synthetic oligonucleotide
  Target: SCN9A; (-) strand; PAM type: YTN; PAM sequence: TTA
tttattttgatgctgtttta

SEQ ID NO: 62035 - DNA, 20 bp, Artificial Sequence
  Description of Artificial Sequence: Synthetic oligonucleotide
  Target: SCN9A; (-) strand; PAM type: YTN; PAM sequence: TTT
atttattttgatgctgtttt

SEQ ID NO: 62036 - DNA, 20 bp, Artificial Sequence
  Description of Artificial Sequence: Synthetic oligonucleotide
  Target: SCN9A; (-) strand; PAM type: YTN; PAM sequence: TTA
tttatttattttgatgctgt

SEQ ID NO: 62037 - DNA, 20 bp, Artificial Sequence
  Description of Artificial Sequence: Synthetic oligonucleotide
  Target: SCN9A; (-) strand; PAM type: YTN; PAM sequence: TTT
atttatttattttgatgctg

SEQ ID NO: 62038 - DNA, 20 bp, Artificial Sequence
  Description of Artificial Sequence: Synthetic oligonucleotide
  Target: SCN9A; (-) strand; PAM type: YTN; PAM sequence: TTT
tatttatttattttgatgct

SEQ ID NO: 62039 - DNA, 20 bp, Artificial Sequence
  Description of Artificial Sequence: Synthetic oligonucleotide
  Target: SCN9A; (-) strand; PAM type: YTN; PAM sequence: TTC
aaagtattttatttatttat

SEQ ID NO: 62040 - DNA, 20 bp, Artificial Sequence
  Description of Artificial Sequence: Synthetic oligonucleotide
  Target: SCN9A; (-) strand; PAM type: YTN; PAM sequence: CTT
caaagtattttatttattta

SEQ ID NO: 62041 - DNA, 20 bp, Artificial Sequence
  Description of Artificial Sequence: Synthetic oligonucleotide
  Target: SCN9A; (-) strand; PAM type: YTN; PAM sequence: TTA
cttcaaagtattttatttat

SEQ ID NO: 62042 - DNA, 20 bp, Artificial Sequence
  Description of Artificial Sequence: Synthetic oligonucleotide
  Target: SCN9A; (-) strand; PAM type: YTN; PAM sequence: TTT
acttcaaagtattttattta

SEQ ID NO: 62043 - DNA, 20 bp, Artificial Sequence
  Description of Artificial Sequence: Synthetic oligonucleotide
  Target: SCN9A; (-) strand; PAM type: YTN; PAM sequence: TTA
aatttacttcaaagtatttt

SEQ ID NO: 62044 - DNA, 20 bp, Artificial Sequence
  Description of Artificial Sequence: Synthetic oligonucleotide
  Target: SCN9A; (-) strand; PAM type: YTN; PAM sequence: CTG
gttaaatttacttcaaagta

SEQ ID NO: 62045 - DNA, 20 bp, Artificial Sequence
  Description of Artificial Sequence: Synthetic oligonucleotide
  Target: SCN9A; (-) strand; PAM type: YTN; PAM sequence: TTC
ctggttaaatttacttcaaa

SEQ ID NO: 62046 - DNA, 20 bp, Artificial Sequence
  Description of Artificial Sequence: Synthetic oligonucleotide
  Target: SCN9A; (-) strand; PAM type: YTN; PAM sequence: TTT
cctggttaaatttacttcaa

SEQ ID NO: 62047 - DNA, 20 bp, Artificial Sequence
  Description of Artificial Sequence: Synthetic oligonucleotide
  Target: SCN9A; (-) strand; PAM type: YTN; PAM sequence: CTT
tcctggttaaatttacttca

SEQ ID NO: 62048 - DNA, 20 bp, Artificial Sequence
  Description of Artificial Sequence: Synthetic oligonucleotide
  Target: SCN9A; (-) strand; PAM type: YTN; PAM sequence: TTC
aactttcctggttaaattta

SEQ ID NO: 62049 - DNA, 20 bp, Artificial Sequence
  Description of Artificial Sequence: Synthetic oligonucleotide
  Target: SCN9A; (-) strand; PAM type: YTN; PAM sequence: CTT
caactttcctggttaaattt

SEQ ID NO: 62050 - DNA, 20 bp, Artificial Sequence
  Description of Artificial Sequence: Synthetic oligonucleotide
  Target: SCN9A; (-) strand; PAM type: YTN; PAM sequence: TTC
agtgtacagatcttcaactt

SEQ ID NO: 62051 - DNA, 20 bp, Artificial Sequence
  Description of Artificial Sequence: Synthetic oligonucleotide
  Target: SCN9A; (-) strand; PAM type: YTN; PAM sequence: TTT
cagtgtacagatcttcaact

SEQ ID NO: 62052 - DNA, 20 bp, Artificial Sequence
  Description of Artificial Sequence: Synthetic oligonucleotide
  Target: SCN9A; (-) strand; PAM type: YTN; PAM sequence: TTT
tcagtgtacagatcttcaac

SEQ ID NO: 62053 - DNA, 20 bp, Artificial Sequence
  Description of Artificial Sequence: Synthetic oligonucleotide
  Target: SCN9A; (-) strand; PAM type: YTN; PAM sequence: TTA
tagttttcagtgtacagatc

SEQ ID NO: 62054 - DNA, 20 bp, Artificial Sequence
  Description of Artificial Sequence: Synthetic oligonucleotide
  Target: SCN9A; (-) strand; PAM type: YTN; PAM sequence: CTT
atagttttcagtgtacagat

SEQ ID NO: 62055 - DNA, 20 bp, Artificial Sequence
  Description of Artificial Sequence: Synthetic oligonucleotide
  Target: SCN9A; (-) strand; PAM type: YTN; PAM sequence: TTA
aatcaacttatagttttcag

SEQ ID NO: 62056 - DNA, 20 bp, Artificial Sequence
  Description of Artificial Sequence: Synthetic oligonucleotide
  Target: SCN9A; (-) strand; PAM type: YTN; PAM sequence: TTT
aaatcaacttatagttttca

SEQ ID NO: 62057 - DNA, 20 bp, Artificial Sequence
  Description of Artificial Sequence: Synthetic oligonucleotide
  Target: SCN9A; (-) strand; PAM type: YTN; PAM sequence: TTT
taaatcaacttatagttttc

SEQ ID NO: 62058 - DNA, 20 bp, Artificial Sequence
  Description of Artificial Sequence: Synthetic oligonucleotide
  Target: SCN9A; (-) strand; PAM type: YTN; PAM sequence: TTT
ttaaatcaacttatagtttt

SEQ ID NO: 62059 - DNA, 20 bp, Artificial Sequence
  Description of Artificial Sequence: Synthetic oligonucleotide
  Target: SCN9A; (-) strand; PAM type: YTN; PAM sequence: TTT
tttaaatcaacttatagttt

SEQ ID NO: 62060 - DNA, 20 bp, Artificial Sequence
  Description of Artificial Sequence: Synthetic oligonucleotide
  Target: SCN9A; (-) strand; PAM type: YTN; PAM sequence: TTT
ttttaaatcaacttatagtt

SEQ ID NO: 62061 - DNA, 20 bp, Artificial Sequence
  Description of Artificial Sequence: Synthetic oligonucleotide
  Target: SCN9A; (-) strand; PAM type: YTN; PAM sequence: CTC
agtttttttaaatcaactta

SEQ ID NO: 62062 - DNA, 20 bp, Artificial Sequence
  Description of Artificial Sequence: Synthetic oligonucleotide
  Target: SCN9A; (-) strand; PAM type: YTN; PAM sequence: TTC
ctcagtttttttaaatcaac

SEQ ID NO: 62063 - DNA, 20 bp, Artificial Sequence
  Description of Artificial Sequence: Synthetic oligonucleotide
  Target: SCN9A; (-) strand; PAM type: YTN; PAM sequence: CTT
cctcagtttttttaaatcaa

SEQ ID NO: 62064 - DNA, 20 bp, Artificial Sequence
  Description of Artificial Sequence: Synthetic oligonucleotide
  Target: SCN9A; (-) strand; PAM type: YTN; PAM sequence: TTG
tgtcttcctcagttttttta

SEQ ID NO: 62065 - DNA, 20 bp, Artificial Sequence
  Description of Artificial Sequence: Synthetic oligonucleotide
  Target: SCN9A; (-) strand; PAM type: YTN; PAM sequence: TTT
gtgtcttcctcagttttttt

SEQ ID NO: 62066 - DNA, 20 bp, Artificial Sequence
  Description of Artificial Sequence: Synthetic oligonucleotide
  Target: SCN9A; (-) strand; PAM type: YTN; PAM sequence: TTA
tttgtgtcttcctcagtttt

SEQ ID NO: 62067 - DNA, 20 bp, Artificial Sequence
  Description of Artificial Sequence: Synthetic oligonucleotide
  Target: SCN9A; (-) strand; PAM type: YTN; PAM sequence: TTT
atttgtgtcttcctcagttt

SEQ ID NO: 62068 - DNA, 20 bp, Artificial Sequence
  Description of Artificial Sequence: Synthetic oligonucleotide
  Target: SCN9A; (-) strand; PAM type: YTN; PAM sequence: TTA
caatttatttgtgtcttcct

SEQ ID NO: 62069 - DNA, 20 bp, Artificial Sequence
  Description of Artificial Sequence: Synthetic oligonucleotide
  Target: SCN9A; (-) strand; PAM type: YTN; PAM sequence: TTC
caacacatgaacatgaaata

SEQ ID NO: 62070 - DNA, 20 bp, Artificial Sequence
  Description of Artificial Sequence: Synthetic oligonucleotide
  Target: SCN9A; (-) strand; PAM type: YTN; PAM sequence: CTT
ccaacacatgaacatgaaat

SEQ ID NO: 62071 - DNA, 20 bp, Artificial Sequence
  Description of Artificial Sequence: Synthetic oligonucleotide
  Target: SCN9A; (-) strand; PAM type: YTN; PAM sequence: TTC
ttccaacacatgaacatgaa

SEQ ID NO: 62072 - DNA, 20 bp, Artificial Sequence
  Description of Artificial Sequence: Synthetic oligonucleotide
  Target: SCN9A; (-) strand; PAM type: YTN; PAM sequence: TTA
attcttccaacacatgaaca

SEQ ID NO: 62073 - DNA, 20 bp, Artificial Sequence
  Description of Artificial Sequence: Synthetic oligonucleotide
  Target: SCN9A; (-) strand; PAM type: YTN; PAM sequence: TTA
acaatattaattcttccaac

SEQ ID NO: 62074 - DNA, 20 bp, Artificial Sequence
  Description of Artificial Sequence: Synthetic oligonucleotide
  Target: SCN9A; (-) strand; PAM type: YTN; PAM sequence: TTT
aacaatattaattcttccaa

SEQ ID NO: 62075 - DNA, 20 bp, Artificial Sequence
  Description of Artificial Sequence: Synthetic oligonucleotide
  Target: SCN9A; (-) strand; PAM type: YTN; PAM sequence: TTT
taacaatattaattcttcca

SEQ ID NO: 62076 - DNA, 20 bp, Artificial Sequence
  Description of Artificial Sequence: Synthetic oligonucleotide
  Target: SCN9A; (-) strand; PAM type: YTN; PAM sequence: TTG
ggtagtatggacattttaac

SEQ ID NO: 62077 - DNA, 20 bp, Artificial Sequence
  Description of Artificial Sequence: Synthetic oligonucleotide
  Target: SCN9A; (-) strand; PAM type: YTN; PAM sequence: TTT
gggtagtatggacattttaa

SEQ ID NO: 62078 - DNA, 20 bp, Artificial Sequence
  Description of Artificial Sequence: Synthetic oligonucleotide
  Target: SCN9A; (-) strand; PAM type: YTN; PAM sequence: TTT
tgggtagtatggacatttta

SEQ ID NO: 62079 - DNA, 20 bp, Artificial Sequence
  Description of Artificial Sequence: Synthetic oligonucleotide
  Target: SCN9A; (-) strand; PAM type: YTN; PAM sequence: TTA
ttttgggtagtatggacatt

SEQ ID NO: 62080 - DNA, 20 bp, Artificial Sequence
  Description of Artificial Sequence: Synthetic oligonucleotide
  Target: SCN9A; (-) strand; PAM type: YTN; PAM sequence: CTG
tagattattttgggtagtat

SEQ ID NO: 62081 - DNA, 20 bp, Artificial Sequence
  Description of Artificial Sequence: Synthetic oligonucleotide
  Target: SCN9A; (-) strand; PAM type: YTN; PAM sequence: TTG
aatctgtagattattttggg

SEQ ID NO: 62082 - DNA, 20 bp, Artificial Sequence
  Description of Artificial Sequence: Synthetic oligonucleotide
  Target: SCN9A; (-) strand; PAM type: YTN; PAM sequence: TTG
cattgaatctgtagattatt

SEQ ID NO: 62083 - DNA, 20 bp, Artificial Sequence
  Description of Artificial Sequence: Synthetic oligonucleotide
  Target: SCN9A; (-) strand; PAM type: YTN; PAM sequence: TTG
atagggattgcattgaatct

SEQ ID NO: 62084 - DNA, 20 bp, Artificial Sequence
  Description of Artificial Sequence: Synthetic oligonucleotide
  Target: SCN9A; (-) strand; PAM type: YTN; PAM sequence: TTT
gatagggattgcattgaatc

SEQ ID NO: 62085 - DNA, 20 bp, Artificial Sequence
  Description of Artificial Sequence: Synthetic oligonucleotide
  Target: SCN9A; (-) strand; PAM type: YTN; PAM sequence: TTT
tgatagggattgcattgaat

SEQ ID NO: 62086 - DNA, 20 bp, Artificial Sequence
  Description of Artificial Sequence: Synthetic oligonucleotide
  Target: SCN9A; (-) strand; PAM type: YTN; PAM sequence: TTA
gaattttgatagggattgca

SEQ ID NO: 62087 - DNA, 20 bp, Artificial Sequence
  Description of Artificial Sequence: Synthetic oligonucleotide
  Target: SCN9A; (-) strand; PAM type: YTN; PAM sequence: CTG
acattagaattttgataggg

SEQ ID NO: 62088 - DNA, 20 bp, Artificial Sequence
  Description of Artificial Sequence: Synthetic oligonucleotide
  Target: SCN9A; (-) strand; PAM type: YTN; PAM sequence: CTG
tgaaaactgacattagaatt

SEQ ID NO: 62089 - DNA, 20 bp, Artificial Sequence
  Description of Artificial Sequence: Synthetic oligonucleotide
  Target: SCN9A; (-) strand; PAM type: YTN; PAM sequence: TTC
tgtgaaaactgacattagaa

SEQ ID NO: 62090 - DNA, 20 bp, Artificial Sequence
  Description of Artificial Sequence: Synthetic oligonucleotide
  Target: SCN9A; (-) strand; PAM type: YTN; PAM sequence: TTT
ctgtgaaaactgacattaga

SEQ ID NO: 62091 - DNA, 20 bp, Artificial Sequence
  Description of Artificial Sequence: Synthetic oligonucleotide
  Target: SCN9A; (-) strand; PAM type: YTN; PAM sequence: CTA
tttctgtgaaaactgacatt

SEQ ID NO: 62092 - DNA, 20 bp, Artificial Sequence
  Description of Artificial Sequence: Synthetic oligonucleotide
  Target: SCN9A; (-) strand; PAM type: YTN; PAM sequence: TTA
ctatttctgtgaaaactgac

SEQ ID NO: 62093 - DNA, 20 bp, Artificial Sequence
  Description of Artificial Sequence: Synthetic oligonucleotide
  Target: SCN9A; (-) strand; PAM type: YTN; PAM sequence: TTT
actatttctgtgaaaactga

SEQ ID NO: 62094 - DNA, 20 bp, Artificial Sequence
  Description of Artificial Sequence: Synthetic oligonucleotide
  Target: SCN9A; (-) strand; PAM type: YTN; PAM sequence: TTT
tactatttctgtgaaaactg

SEQ ID NO: 62095 - DNA, 20 bp, Artificial Sequence
  Description of Artificial Sequence: Synthetic oligonucleotide
  Target: SCN9A; (-) strand; PAM type: YTN; PAM sequence: TTT
ttactatttctgtgaaaact

SEQ ID NO: 62096 - DNA, 20 bp, Artificial Sequence
  Description of Artificial Sequence: Synthetic oligonucleotide
  Target: SCN9A; (-) strand; PAM type: YTN; PAM sequence: TTT
tttactatttctgtgaaaac

SEQ ID NO: 62097 - DNA, 20 bp, Artificial Sequence
  Description of Artificial Sequence: Synthetic oligonucleotide
  Target: SCN9A; (-) strand; PAM type: YTN; PAM sequence: TTA
ggattttttactatttctgt

SEQ ID NO: 62098 - DNA, 20 bp, Artificial Sequence
  Description of Artificial Sequence: Synthetic oligonucleotide
  Target: SCN9A; (-) strand; PAM type: YTN; PAM sequence: TTC
aaatgttaggattttttact

SEQ ID NO: 62099 - DNA, 20 bp, Artificial Sequence
  Description of Artificial Sequence: Synthetic oligonucleotide
  Target: SCN9A; (-) strand; PAM type: YTN; PAM sequence: TTA
ttcaaatgttaggatttttt

SEQ ID NO: 62100 - DNA, 20 bp, Artificial Sequence
  Description of Artificial Sequence: Synthetic oligonucleotide
  Target: SCN9A; (-) strand; PAM type: YTN; PAM sequence: TTT
attcaaatgttaggattttt

SEQ ID NO: 62101 - DNA, 20 bp, Artificial Sequence
  Description of Artificial Sequence: Synthetic oligonucleotide
  Target: SCN9A; (-) strand; PAM type: YTN; PAM sequence: TTT
tattcaaatgttaggatttt

SEQ ID NO: 62102 - DNA, 20 bp, Artificial Sequence
  Description of Artificial Sequence: Synthetic oligonucleotide
  Target: SCN9A; (-) strand; PAM type: YTN; PAM sequence: TTA
ttttattcaaatgttaggat

SEQ ID NO: 62103 - DNA, 20 bp, Artificial Sequence
  Description of Artificial Sequence: Synthetic oligonucleotide
  Target: SCN9A; (-) strand; PAM type: YTN; PAM sequence: TTT
attttattcaaatgttagga

SEQ ID NO: 62104 - DNA, 20 bp, Artificial Sequence
  Description of Artificial Sequence: Synthetic oligonucleotide
  Target: SCN9A; (-) strand; PAM type: YTN; PAM sequence: TTT
tattttattcaaatgttagg

SEQ ID NO: 62105 - DNA, 20 bp, Artificial Sequence
  Description of Artificial Sequence: Synthetic oligonucleotide
  Target: SCN9A; (-) strand; PAM type: YTN; PAM sequence: TTT
ttattttattcaaatgttag

SEQ ID NO: 62106 - DNA, 20 bp, Artificial Sequence
  Description of Artificial Sequence: Synthetic oligonucleotide
  Target: SCN9A; (-) strand; PAM type: YTN; PAM sequence: TTT
tttattttattcaaatgtta

SEQ ID NO: 62107 - DNA, 20 bp, Artificial Sequence
  Description of Artificial Sequence: Synthetic oligonucleotide
  Target: SCN9A; (-) strand; PAM type: YTN; PAM sequence: CTT
ttttattttattcaaatgtt

SEQ ID NO: 62108 - DNA, 20 bp, Artificial Sequence
  Description of Artificial Sequence: Synthetic oligonucleotide
  Target: SCN9A; (-) strand; PAM type: YTN; PAM sequence: TTA
gcatcttttttattttattc

SEQ ID NO: 62109 - DNA, 20 bp, Artificial Sequence
  Description of Artificial Sequence: Synthetic oligonucleotide
  Target: SCN9A; (-) strand; PAM type: YTN; PAM sequence: TTT
agcatcttttttattttatt

SEQ ID NO: 62110 - DNA, 20 bp, Artificial Sequence
  Description of Artificial Sequence: Synthetic oligonucleotide
  Target: SCN9A; (-) strand; PAM type: YTN; PAM sequence: TTG
gccatttagcatctttttta

SEQ ID NO: 62111 - DNA, 20 bp, Artificial Sequence
  Description of Artificial Sequence: Synthetic oligonucleotide
  Target: SCN9A; (-) strand; PAM type: YTN; PAM sequence: TTT
ggccatttagcatctttttt

SEQ ID NO: 62112 - DNA, 20 bp, Artificial Sequence
  Description of Artificial Sequence: Synthetic oligonucleotide
  Target: SCN9A; (-) strand; PAM type: YTN; PAM sequence: CTT
tggccatttagcatcttttt

SEQ ID NO: 62113 - DNA, 20 bp, Artificial Sequence
  Description of Artificial Sequence: Synthetic oligonucleotide
  Target: SCN9A; (-) strand; PAM type: YTN; PAM sequence: TTG
ctttggccatttagcatctt

SEQ ID NO: 62114 - DNA, 20 bp, Artificial Sequence
  Description of Artificial Sequence: Synthetic oligonucleotide
  Target: SCN9A; (-) strand; PAM type: YTN; PAM sequence: CTC
agattgctttggccatttag

SEQ ID NO: 62115 - DNA, 20 bp, Artificial Sequence
  Description of Artificial Sequence: Synthetic oligonucleotide
  Target: SCN9A; (-) strand; PAM type: YTN; PAM sequence: TTG
ctcagattgctttggccatt

SEQ ID NO: 62116 - DNA, 20 bp, Artificial Sequence
  Description of Artificial Sequence: Synthetic oligonucleotide
  Target: SCN9A; (-) strand; PAM type: YTN; PAM sequence: TTT
gctcagattgctttggccat

SEQ ID NO: 62117 - DNA, 20 bp, Artificial Sequence
  Description of Artificial Sequence: Synthetic oligonucleotide
  Target: SCN9A; (-) strand; PAM type: YTN; PAM sequence: TTT
tgctcagattgctttggcca

SEQ ID NO: 62118 - DNA, 20 bp, Artificial Sequence
  Description of Artificial Sequence: Synthetic oligonucleotide
  Target: SCN9A; (-) strand; PAM type: YTN; PAM sequence: TTT
ttgctcagattgctttggcc

SEQ ID NO: 62119 - DNA, 20 bp, Artificial Sequence
  Description of Artificial Sequence: Synthetic oligonucleotide
  Target: SCN9A; (-) strand; PAM type: YTN; PAM sequence: CTT
tttgctcagattgctttggc

SEQ ID NO: 62120 - DNA, 20 bp, Artificial Sequence
  Description of Artificial Sequence: Synthetic oligonucleotide
  Target: SCN9A; (-) strand; PAM type: YTN; PAM sequence: TTC
tttttgctcagattgctttg

SEQ ID NO: 62121 - DNA, 20 bp, Artificial Sequence
  Description of Artificial Sequence: Synthetic oligonucleotide
  Target: SCN9A; (-) strand; PAM type: YTN; PAM sequence: TTG
ttctttttgctcagattgct

SEQ ID NO: 62122 - DNA, 20 bp, Artificial Sequence
  Description of Artificial Sequence: Synthetic oligonucleotide
  Target: SCN9A; (-) strand; PAM type: YTN; PAM sequence: TTT
gttctttttgctcagattgc

SEQ ID NO: 62123 - DNA, 20 bp, Artificial Sequence
  Description of Artificial Sequence: Synthetic oligonucleotide
  Target: SCN9A; (-) strand; PAM type: YTN; PAM sequence: CTT
tgttctttttgctcagattg

SEQ ID NO: 62124 - DNA, 20 bp, Artificial Sequence
  Description of Artificial Sequence: Synthetic oligonucleotide
  Target: SCN9A; (-) strand; PAM type: YTN; PAM sequence: CTA
gctttgttctttttgctcag

SEQ ID NO: 62125 - DNA, 20 bp, Artificial Sequence
  Description of Artificial Sequence: Synthetic oligonucleotide
  Target: SCN9A; (-) strand; PAM type: YTN; PAM sequence: CTC
tagctttgttctttttgctc

SEQ ID NO: 62126 - DNA, 20 bp, Artificial Sequence
  Description of Artificial Sequence: Synthetic oligonucleotide
  Target: SCN9A; (-) strand; PAM type: YTN; PAM sequence: TTG
cacctctagctttgttcttt

SEQ ID NO: 62127 - DNA, 20 bp, Artificial Sequence
  Description of Artificial Sequence: Synthetic oligonucleotide
  Target: SCN9A; (-) strand; PAM type: YTN; PAM sequence: TTG
aaatgacagagtattgcacc

SEQ ID NO: 62128 - DNA, 20 bp, Artificial Sequence
  Description of Artificial Sequence: Synthetic oligonucleotide
  Target: SCN9A; (-) strand; PAM type: YTN; PAM sequence: TTT
gaaatgacagagtattgcac

SEQ ID NO: 62129 - DNA, 20 bp, Artificial Sequence
  Description of Artificial Sequence: Synthetic oligonucleotide
  Target: SCN9A; (-) strand; PAM type: YTN; PAM sequence: TTT
tgaaatgacagagtattgca

SEQ ID NO: 62130 - DNA, 20 bp, Artificial Sequence
  Description of Artificial Sequence: Synthetic oligonucleotide
  Target: SCN9A; (-) strand; PAM type: YTN; PAM sequence: TTA
tattttgaaatgacagagta

SEQ ID NO: 62131 - DNA, 20 bp, Artificial Sequence
  Description of Artificial Sequence: Synthetic oligonucleotide
  Target: SCN9A; (-) strand; PAM type: YTN; PAM sequence: TTT
atattttgaaatgacagagt

SEQ ID NO: 62132 - DNA, 20 bp, Artificial Sequence
  Description of Artificial Sequence: Synthetic oligonucleotide
  Target: SCN9A; (-) strand; PAM type: YTN; PAM sequence: CTT
tatattttgaaatgacagag

SEQ ID NO: 62133 - DNA, 20 bp, Artificial Sequence
  Description of Artificial Sequence: Synthetic oligonucleotide
  Target: SCN9A; (-) strand; PAM type: YTN; PAM sequence: TTA
tgccaatagcatagctttat

SEQ ID NO: 62134 - DNA, 20 bp, Artificial Sequence
  Description of Artificial Sequence: Synthetic oligonucleotide
  Target: SCN9A; (-) strand; PAM type: YTN; PAM sequence: TTT
atgccaatagcatagcttta

SEQ ID NO: 62135 - DNA, 20 bp, Artificial Sequence
  Description of Artificial Sequence: Synthetic oligonucleotide
  Target: SCN9A; (-) strand; PAM type: YTN; PAM sequence: CTG
tgtttatgccaatagcatag

SEQ ID NO: 62136 - DNA, 20 bp, Artificial Sequence
  Description of Artificial Sequence: Synthetic oligonucleotide
  Target: SCN9A; (-) strand; PAM type: YTN; PAM sequence: TTA
gccaatatatctgtgtttat

SEQ ID NO: 62137 - DNA, 20 bp, Artificial Sequence
  Description of Artificial Sequence: Synthetic oligonucleotide
  Target: SCN9A; (-) strand; PAM type: YTN; PAM sequence: TTC
cattagccaatatatctgtg

SEQ ID NO: 62138 - DNA, 20 bp, Artificial Sequence
  Description of Artificial Sequence: Synthetic oligonucleotide
  Target: SCN9A; (-) strand; PAM type: YTN; PAM sequence: TTT
ccattagccaatatatctgt

SEQ ID NO: 62139 - DNA, 20 bp, Artificial Sequence
  Description of Artificial Sequence: Synthetic oligonucleotide
  Target: SCN9A; (-) strand; PAM type: YTN; PAM sequence: TTT
tccattagccaatatatctg

SEQ ID NO: 62140 - DNA, 20 bp, Artificial Sequence
  Description of Artificial Sequence: Synthetic oligonucleotide
  Target: SCN9A; (-) strand; PAM type: YTN; PAM sequence: CTT
ttccattagccaatatatct

SEQ ID NO: 62141 - DNA, 20 bp, Artificial Sequence
  Description of Artificial Sequence: Synthetic oligonucleotide
  Target: SCN9A; (-) strand; PAM type: YTN; PAM sequence: TTA
tccttttccattagccaata

SEQ ID NO: 62142 - DNA, 20 bp, Artificial Sequence
  Description of Artificial Sequence: Synthetic oligonucleotide
  Target: SCN9A; (-) strand; PAM type: YTN; PAM sequence: TTT
atccttttccattagccaat

SEQ ID NO: 62143 - DNA, 20 bp, Artificial Sequence
  Description of Artificial Sequence: Synthetic oligonucleotide
  Target: SCN9A; (-) strand; PAM type: YTN; PAM sequence: TTT
tatccttttccattagccaa

SEQ ID NO: 62144 - DNA, 20 bp, Artificial Sequence
  Description of Artificial Sequence: Synthetic oligonucleotide
  Target: SCN9A; (-) strand; PAM type: YTN; PAM sequence: TTT
ttatccttttccattagcca

SEQ ID NO: 62145 - DNA, 20 bp, Artificial Sequence
  Description of Artificial Sequence: Synthetic oligonucleotide
  Target: SCN9A; (-) strand; PAM type: YTN; PAM sequence: CTT
tttatccttttccattagcc

SEQ ID NO: 62146 - DNA, 20 bp, Artificial Sequence
  Description of Artificial Sequence: Synthetic oligonucleotide
  Target: SCN9A; (-) strand; PAM type: YTN; PAM sequence: CTG
ggctttttatccttttccat

SEQ ID NO: 62147 - DNA, 20 bp, Artificial Sequence
  Description of Artificial Sequence: Synthetic oligonucleotide
  Target: SCN9A; (-) strand; PAM type: YTN; PAM sequence: TTC
tgggctttttatccttttcc

SEQ ID NO: 62148 - DNA, 20 bp, Artificial Sequence
  Description of Artificial Sequence: Synthetic oligonucleotide
  Target: SCN9A; (-) strand; PAM type: YTN; PAM sequence: TTT
ctgggctttttatccttttc

SEQ ID NO: 62149 - DNA, 20 bp, Artificial Sequence
  Description of Artificial Sequence: Synthetic oligonucleotide
  Target: SCN9A; (-) strand; PAM type: YTN; PAM sequence: TTA
tttctgggctttttatcctt

SEQ ID NO: 62150 - DNA, 20 bp, Artificial Sequence
  Description of Artificial Sequence: Synthetic oligonucleotide
  Target: SCN9A; (-) strand; PAM type: YTN; PAM sequence: TTT
atttctgggctttttatcct

SEQ ID NO: 62151 - DNA, 20 bp, Artificial Sequence
  Description of Artificial Sequence: Synthetic oligonucleotide
  Target: SCN9A; (-) strand; PAM type: YTN; PAM sequence: TTG
ggtttatttctgggcttttt

SEQ ID NO: 62152 - DNA, 20 bp, Artificial Sequence
  Description of Artificial Sequence: Synthetic oligonucleotide
  Target: SCN9A; (-) strand; PAM type: YTN; PAM sequence: CTA
taaataattgggtttatttc

SEQ ID NO: 62153 - DNA, 20 bp, Artificial Sequence
  Description of Artificial Sequence: Synthetic oligonucleotide
  Target: SCN9A; (-) strand; PAM type: YTN; PAM sequence: TTG
actataaataattgggttta

SEQ ID NO: 62154 - DNA, 20 bp, Artificial Sequence
  Description of Artificial Sequence: Synthetic oligonucleotide
  Target: SCN9A; (-) strand; PAM type: YTN; PAM sequence: CTG
aaaatcaattgactataaat

SEQ ID NO: 62155 - DNA, 20 bp, Artificial Sequence
  Description of Artificial Sequence: Synthetic oligonucleotide
  Target: SCN9A; (-) strand; PAM type: YTN; PAM sequence: TTG
ctgaaaatcaattgactata

SEQ ID NO: 62156 - DNA, 20 bp, Artificial Sequence
  Description of Artificial Sequence: Synthetic oligonucleotide
  Target: SCN9A; (-) strand; PAM type: YTN; PAM sequence: TTT
gctgaaaatcaattgactat

SEQ ID NO: 62157 - DNA, 20 bp, Artificial Sequence
  Description of Artificial Sequence: Synthetic oligonucleotide
  Target: SCN9A; (-) strand; PAM type: YTN; PAM sequence: CTT
tgctgaaaatcaattgacta

SEQ ID NO: 62158 - DNA, 20 bp, Artificial Sequence
  Description of Artificial Sequence: Synthetic oligonucleotide
  Target: SCN9A; (-) strand; PAM type: YTN; PAM sequence: TTG
cacctttgctgaaaatcaat

SEQ ID NO: 62159 - DNA, 20 bp, Artificial Sequence
  Description of Artificial Sequence: Synthetic oligonucleotide
  Target: SCN9A; (-) strand; PAM type: YTN; PAM sequence: TTT
gcacctttgctgaaaatcaa

SEQ ID NO: 62160 - DNA, 20 bp, Artificial Sequence
  Description of Artificial Sequence: Synthetic oligonucleotide
  Target: SCN9A; (-) strand; PAM type: YTN; PAM sequence: CTT
tgcacctttgctgaaaatca

SEQ ID NO: 62161 - DNA, 20 bp, Artificial Sequence
  Description of Artificial Sequence: Synthetic oligonucleotide
  Target: SCN9A; (-) strand; PAM type: YTN; PAM sequence: TTC
tttgcacctttgctgaaaat

SEQ ID NO: 62162 - DNA, 20 bp, Artificial Sequence
  Description of Artificial Sequence: Synthetic oligonucleotide
  Target: SCN9A; (-) strand; PAM type: YTN; PAM sequence: TTA
ttctttgcacctttgctgaa

SEQ ID NO: 62163 - DNA, 20 bp, Artificial Sequence
  Description of Artificial Sequence: Synthetic oligonucleotide
  Target: SCN9A; (-) strand; PAM type: YTN; PAM sequence: TTT
attctttgcacctttgctga

SEQ ID NO: 62164 - DNA, 20 bp, Artificial Sequence
  Description of Artificial Sequence: Synthetic oligonucleotide
  Target: SCN9A; (-) strand; PAM type: YTN; PAM sequence: TTG
tttattctttgcacctttgc

SEQ ID NO: 62165 - DNA, 20 bp, Artificial Sequence
  Description of Artificial Sequence: Synthetic oligonucleotide
  Target: SCN9A; (-) strand; PAM type: YTN; PAM sequence: TTC
ccccattgtttattctttgc

SEQ ID NO: 62166 - DNA, 20 bp, Artificial Sequence
  Description of Artificial Sequence: Synthetic oligonucleotide
  Target: SCN9A; (-) strand; PAM type: YTN; PAM sequence: TTT
cccccattgtttattctttg

SEQ ID NO: 62167 - DNA, 20 bp, Artificial Sequence
  Description of Artificial Sequence: Synthetic oligonucleotide
  Target: SCN9A; (-) strand; PAM type: YTN; PAM sequence: CTT
tcccccattgtttattcttt

SEQ ID NO: 62168 - DNA, 20 bp, Artificial Sequence
  Description of Artificial Sequence: Synthetic oligonucleotide
  Target: SCN9A; (-) strand; PAM type: YTN; PAM sequence: TTG
aagagatcgtcctttccccc

SEQ ID NO: 62169 - DNA, 20 bp, Artificial Sequence
  Description of Artificial Sequence: Synthetic oligonucleotide
  Target: SCN9A; (-) strand; PAM type: YTN; PAM sequence: TTA
ttgaagagatcgtcctttcc

SEQ ID NO: 62170 - DNA, 20 bp, Artificial Sequence
  Description of Artificial Sequence: Synthetic oligonucleotide
  Target: SCN9A; (-) strand; PAM type: YTN; PAM sequence: TTT
attgaagagatcgtcctttc

SEQ ID NO: 62171 - DNA, 20 bp, Artificial Sequence
  Description of Artificial Sequence: Synthetic oligonucleotide
  Target: SCN9A; (-) strand; PAM type: YTN; PAM sequence: TTC
ccaacaccatttattgaaga

SEQ ID NO: 62172 - DNA, 20 bp, Artificial Sequence
  Description of Artificial Sequence: Synthetic oligonucleotide
  Target: SCN9A; (-) strand; PAM type: YTN; PAM sequence: TTT
cccaacaccatttattgaag

SEQ ID NO: 62173 - DNA, 20 bp, Artificial Sequence
  Description of Artificial Sequence: Synthetic oligonucleotide
  Target: SCN9A; (-) strand; PAM type: YTN; PAM sequence: TTT
tcccaacaccatttattgaa

SEQ ID NO: 62174 - DNA, 20 bp, Artificial Sequence
  Description of Artificial Sequence: Synthetic oligonucleotide
  Target: SCN9A; (-) strand; PAM type: YTN; PAM sequence: TTC
agttttcccaacaccattta

SEQ ID NO: 62175 - DNA, 20 bp, Artificial Sequence
  Description of Artificial Sequence: Synthetic oligonucleotide
  Target: SCN9A; (-) strand; PAM type: YTN; PAM sequence: TTG
cataaggaatattcagtttt

SEQ ID NO: 62176 - DNA, 20 bp, Artificial Sequence
  Description of Artificial Sequence: Synthetic oligonucleotide
  Target: SCN9A; (-) strand; PAM type: YTN; PAM sequence: TTT
gcataaggaatattcagttt

SEQ ID NO: 62177 - DNA, 20 bp, Artificial Sequence
  Description of Artificial Sequence: Synthetic oligonucleotide
  Target: SCN9A; (-) strand; PAM type: YTN; PAM sequence: TTT
tgcataaggaatattcagtt

SEQ ID NO: 62178 - DNA, 20 bp, Artificial Sequence
  Description of Artificial Sequence: Synthetic oligonucleotide
  Target: SCN9A; (-) strand; PAM type: YTN; PAM sequence: CTT
ttgcataaggaatattcagt

SEQ ID NO: 62179 - DNA, 20 bp, Artificial Sequence
  Description of Artificial Sequence: Synthetic oligonucleotide
  Target: SCN9A; (-) strand; PAM type: YTN; PAM sequence: TTC
ttttgcataaggaatattca

SEQ ID NO: 62180 - DNA, 20 bp, Artificial Sequence
  Description of Artificial Sequence: Synthetic oligonucleotide
  Target: SCN9A; (-) strand; PAM type: YTN; PAM sequence: TTC
attcttttgcataaggaata

SEQ ID NO: 62181 - DNA, 20 bp, Artificial Sequence
  Description of Artificial Sequence: Synthetic oligonucleotide
  Target: SCN9A; (-) strand; PAM type: YTN; PAM sequence: TTT
cattcttttgcataaggaat

SEQ ID NO: 62182 - DNA, 20 bp, Artificial Sequence
  Description of Artificial Sequence: Synthetic oligonucleotide
  Target: SCN9A; (-) strand; PAM type: YTN; PAM sequence: TTA
taaacatatggtatgagaaa

SEQ ID NO: 62183 - DNA, 20 bp, Artificial Sequence
  Description of Artificial Sequence: Synthetic oligonucleotide
  Target: SCN9A; (-) strand; PAM type: YTN; PAM sequence: TTT
ataaacatatggtatgagaa

SEQ ID NO: 62184 - DNA, 20 bp, Artificial Sequence
  Description of Artificial Sequence: Synthetic oligonucleotide
  Target: SCN9A; (-) strand; PAM type: YTN; PAM sequence: TTT
tataaacatatggtatgaga

SEQ ID NO: 62185 - DNA, 20 bp, Artificial Sequence
  Description of Artificial Sequence: Synthetic oligonucleotide
  Target: SCN9A; (-) strand; PAM type: YTN; PAM sequence: TTG
gttttataaacatatggtat

SEQ ID NO: 62186 - DNA, 20 bp, Artificial Sequence
  Description of Artificial Sequence: Synthetic oligonucleotide
  Target: SCN9A; (-) strand; PAM type: YTN; PAM sequence: TTT
ggttttataaacatatggta

SEQ ID NO: 62187 - DNA, 20 bp, Artificial Sequence
  Description of Artificial Sequence: Synthetic oligonucleotide
  Target: SCN9A; (-) strand; PAM type: YTN; PAM sequence: TTG
tttggttttataaacatatg

SEQ ID NO: 62188 - DNA, 20 bp, Artificial Sequence
  Description of Artificial Sequence: Synthetic oligonucleotide
  Target: SCN9A; (-) strand; PAM type: YTN; PAM sequence: CTT
gtttggttttataaacatat

SEQ ID NO: 62189 - DNA, 20 bp, Artificial Sequence
  Description of Artificial Sequence: Synthetic oligonucleotide
  Target: SCN9A; (-) strand; PAM type: YTN; PAM sequence: TTA
cttgtttggttttataaaca

SEQ ID NO: 62190 - DNA, 20 bp, Artificial Sequence
  Description of Artificial Sequence: Synthetic oligonucleotide
  Target: SCN9A; (-) strand; PAM type: YTN; PAM sequence: TTT
acttgtttggttttataaac

SEQ ID NO: 62191 - DNA, 20 bp, Artificial Sequence
  Description of Artificial Sequence: Synthetic oligonucleotide
  Target: SCN9A; (-) strand; PAM type: YTN; PAM sequence: TTT
tacttgtttggttttataaa

SEQ ID NO: 62192 - DNA, 20 bp, Artificial Sequence
  Description of Artificial Sequence: Synthetic oligonucleotide
  Target: SCN9A; (-) strand; PAM type: YTN; PAM sequence: CTT
ttacttgtttggttttataa

SEQ ID NO: 62193 - DNA, 20 bp, Artificial Sequence
  Description of Artificial Sequence: Synthetic oligonucleotide
  Target: SCN9A; (-) strand; PAM type: YTN; PAM sequence: TTA
agtcttttacttgtttggtt

SEQ ID NO: 62194 - DNA, 20 bp, Artificial Sequence
  Description of Artificial Sequence: Synthetic oligonucleotide
  Target: SCN9A; (-) strand; PAM type: YTN; PAM sequence: TTT
aagtcttttacttgtttggt

SEQ ID NO: 62195 - DNA, 20 bp, Artificial Sequence
  Description of Artificial Sequence: Synthetic oligonucleotide
  Target: SCN9A; (-) strand; PAM type: YTN; PAM sequence: TTA
tatttaagtcttttacttgt

SEQ ID NO: 62196 - DNA, 20 bp, Artificial Sequence
  Description of Artificial Sequence: Synthetic oligonucleotide
  Target: SCN9A; (-) strand; PAM type: YTN; PAM sequence: CTT
atatttaagtcttttacttg

SEQ ID NO: 62197 - DNA, 20 bp, Artificial Sequence
  Description of Artificial Sequence: Synthetic oligonucleotide
  Target: SCN9A; (-) strand; PAM type: YTN; PAM sequence: TTC
ttatatttaagtcttttact

SEQ ID NO: 62198 - DNA, 20 bp, Artificial Sequence
  Description of Artificial Sequence: Synthetic oligonucleotide
  Target: SCN9A; (-) strand; PAM type: YTN; PAM sequence: TTT
cttatatttaagtcttttac

SEQ ID NO: 62199 - DNA, 20 bp, Artificial Sequence
  Description of Artificial Sequence: Synthetic oligonucleotide
  Target: SCN9A; (-) strand; PAM type: YTN; PAM sequence: TTC
atttcttatatttaagtctt

SEQ ID NO: 62200 - DNA, 20 bp, Artificial Sequence
  Description of Artificial Sequence: Synthetic oligonucleotide
  Target: SCN9A; (-) strand; PAM type: YTN; PAM sequence: TTT
catttcttatatttaagtct

SEQ ID NO: 62201 - DNA, 20 bp, Artificial Sequence
  Description of Artificial Sequence: Synthetic oligonucleotide
  Target: SCN9A; (-) strand; PAM type: YTN; PAM sequence: TTA
tagtttcatttcttatattt

SEQ ID NO: 62202 - DNA, 20 bp, Artificial Sequence
  Description of Artificial Sequence: Synthetic oligonucleotide
  Target: SCN9A; (-) strand; PAM type: YTN; PAM sequence: TTT
atagtttcatttcttatatt

SEQ ID NO: 62203 - DNA, 20 bp, Artificial Sequence
  Description of Artificial Sequence: Synthetic oligonucleotide
  Target: SCN9A; (-) strand; PAM type: YTN; PAM sequence: CTT
tatagtttcatttcttatat

SEQ ID NO: 62204 - DNA, 20 bp, Artificial Sequence
  Description of Artificial Sequence: Synthetic oligonucleotide
  Target: SCN9A; (-) strand; PAM type: YTN; PAM sequence: CTA
gtagctttatagtttcattt

SEQ ID NO: 62205 - DNA, 20 bp, Artificial Sequence
  Description of Artificial Sequence: Synthetic oligonucleotide
  Target: SCN9A; (-) strand; PAM type: YTN; PAM sequence: TTC
tagtagctttatagtttcat

SEQ ID NO: 62206 - DNA, 20 bp, Artificial Sequence
  Description of Artificial Sequence: Synthetic oligonucleotide
  Target: SCN9A; (-) strand; PAM type: YTN; PAM sequence: CTT
ctagtagctttatagtttca

SEQ ID NO: 62207 - DNA, 20 bp, Artificial Sequence
  Description of Artificial Sequence: Synthetic oligonucleotide
  Target: SCN9A; (-) strand; PAM type: YTN; PAM sequence: TTC
ttctagtagctttatagttt

SEQ ID NO: 62208 - DNA, 20 bp, Artificial Sequence
  Description of Artificial Sequence: Synthetic oligonucleotide
  Target: SCN9A; (-) strand; PAM type: YTN; PAM sequence: TTT
cttctagtagctttatagtt

SEQ ID NO: 62209 - DNA, 20 bp, Artificial Sequence
  Description of Artificial Sequence: Synthetic oligonucleotide
  Target: SCN9A; (-) strand; PAM type: YTN; PAM sequence: TTT
tcttctagtagctttatagt

SEQ ID NO: 62210 - DNA, 20 bp, Artificial Sequence
  Description of Artificial Sequence: Synthetic oligonucleotide
  Target: SCN9A; (-) strand; PAM type: YTN; PAM sequence: TTA
tgttttcttctagtagcttt

SEQ ID NO: 62211 - DNA, 20 bp, Artificial Sequence
  Description of Artificial Sequence: Synthetic oligonucleotide
  Target: SCN9A; (-) strand; PAM type: YTN; PAM sequence: TTT
atgttttcttctagtagctt

SEQ ID NO: 62212 - DNA, 20 bp, Artificial Sequence
  Description of Artificial Sequence: Synthetic oligonucleotide
  Target: SCN9A; (-) strand; PAM type: YTN; PAM sequence: TTT
tatgttttcttctagtagct

SEQ ID NO: 62213 - DNA, 20 bp, Artificial Sequence
  Description of Artificial Sequence: Synthetic oligonucleotide
  Target: SCN9A; (-) strand; PAM type: YTN; PAM sequence: CTT
ttatgttttcttctagtagc

SEQ ID NO: 62214 - DNA, 20 bp, Artificial Sequence
  Description of Artificial Sequence: Synthetic oligonucleotide
  Target: SCN9A; (-) strand; PAM type: YTN; PAM sequence: TTC
ttttatgttttcttctagta

SEQ ID NO: 62215 - DNA, 20 bp, Artificial Sequence
  Description of Artificial Sequence: Synthetic oligonucleotide
  Target: SCN9A; (-) strand; PAM type: YTN; PAM sequence: TTT
cttttatgttttcttctagt

SEQ ID NO: 62216 - DNA, 20 bp, Artificial Sequence
  Description of Artificial Sequence: Synthetic oligonucleotide
  Target: SCN9A; (-) strand; PAM type: YTN; PAM sequence: TTT
tcttttatgttttcttctag

SEQ ID NO: 62217 - DNA, 20 bp, Artificial Sequence
  Description of Artificial Sequence: Synthetic oligonucleotide
  Target: SCN9A; (-) strand; PAM type: YTN; PAM sequence: CTT
ttcttttatgttttcttcta

SEQ ID NO: 62218 - DNA, 20 bp, Artificial Sequence
  Description of Artificial Sequence: Synthetic oligonucleotide
  Target: SCN9A; (-) strand; PAM type: YTN; PAM sequence: TTG
cccagataaatgtcatacag

SEQ ID NO: 62219 - DNA, 20 bp, Artificial Sequence
  Description of Artificial Sequence: Synthetic oligonucleotide
  Target: SCN9A; (-) strand; PAM type: YTN; PAM sequence: CTT
gcccagataaatgtcataca

SEQ ID NO: 62220 - DNA, 20 bp, Artificial Sequence
  Description of Artificial Sequence: Synthetic oligonucleotide
  Target: SCN9A; (-) strand; PAM type: YTN; PAM sequence: CTA
gccaagaaatccttgcccag

SEQ ID NO: 62221 - DNA, 20 bp, Artificial Sequence
  Description of Artificial Sequence: Synthetic oligonucleotide
  Target: SCN9A; (-) strand; PAM type: YTN; PAM sequence: TTA
gagtcctagccaagaaatcc

SEQ ID NO: 62222 - DNA, 20 bp, Artificial Sequence
  Description of Artificial Sequence: Synthetic oligonucleotide
  Target: SCN9A; (-) strand; PAM type: YTN; PAM sequence: TTT
agagtcctagccaagaaatc

SEQ ID NO: 62223 - DNA, 20 bp, Artificial Sequence
  Description of Artificial Sequence: Synthetic oligonucleotide
  Target: SCN9A; (-) strand; PAM type: YTN; PAM sequence: TTT
tagagtcctagccaagaaat

SEQ ID NO: 62224 - DNA, 20 bp, Artificial Sequence
  Description of Artificial Sequence: Synthetic oligonucleotide
  Target: SCN9A; (-) strand; PAM type: YTN; PAM sequence: CTT
ttagagtcctagccaagaaa

SEQ ID NO: 62225 - DNA, 20 bp, Artificial Sequence
  Description of Artificial Sequence: Synthetic oligonucleotide
  Target: SCN9A; (-) strand; PAM type: YTN; PAM sequence: CTG
tgcttttagagtcctagcca

SEQ ID NO: 62226 - DNA, 20 bp, Artificial Sequence
  Description of Artificial Sequence: Synthetic oligonucleotide
  Target: SCN9A; (-) strand; PAM type: YTN; PAM sequence: TTA
cctgtgcttttagagtccta

SEQ ID NO: 62227 - DNA, 20 bp, Artificial Sequence
  Description of Artificial Sequence: Synthetic oligonucleotide
  Target: SCN9A; (-) strand; PAM type: YTN; PAM sequence: TTG
ttacctgtgcttttagagtc

SEQ ID NO: 62228 - DNA, 20 bp, Artificial Sequence
  Description of Artificial Sequence: Synthetic oligonucleotide
  Target: SCN9A; (-) strand; PAM type: YTN; PAM sequence: TTT
gttacctgtgcttttagagt

SEQ ID NO: 62229 - DNA, 20 bp, Artificial Sequence
  Description of Artificial Sequence: Synthetic oligonucleotide
  Target: SCN9A; (-) strand; PAM type: YTN; PAM sequence: TTT
tgttacctgtgcttttagag

SEQ ID NO: 62230 - DNA, 20 bp, Artificial Sequence
  Description of Artificial Sequence: Synthetic oligonucleotide
  Target: SCN9A; (-) strand; PAM type: YTN; PAM sequence: CTT
ttgttacctgtgcttttaga

SEQ ID NO: 62231 - DNA, 20 bp, Artificial Sequence
  Description of Artificial Sequence: Synthetic oligonucleotide
  Target: SCN9A; (-) strand; PAM type: YTN; PAM sequence: TTG
tcttttgttacctgtgcttt

SEQ ID NO: 62232 - DNA, 20 bp, Artificial Sequence
  Description of Artificial Sequence: Synthetic oligonucleotide
  Target: SCN9A; (-) strand; PAM type: YTN; PAM sequence: TTA
ttgtcttttgttacctgtgc

SEQ ID NO: 62233 - DNA, 20 bp, Artificial Sequence
  Description of Artificial Sequence: Synthetic oligonucleotide
  Target: SCN9A; (-) strand; PAM type: YTN; PAM sequence: CTT
attgtcttttgttacctgtg

SEQ ID NO: 62234 - DNA, 20 bp, Artificial Sequence
  Description of Artificial Sequence: Synthetic oligonucleotide
  Target: SCN9A; (-) strand; PAM type: YTN; PAM sequence: CTC
ttattgtcttttgttacctg

SEQ ID NO: 62235 - DNA, 20 bp, Artificial Sequence
  Description of Artificial Sequence: Synthetic oligonucleotide
  Target: SCN9A; (-) strand; PAM type: YTN; PAM sequence: TTG
tctcttattgtcttttgtta

SEQ ID NO: 62236 - DNA, 20 bp, Artificial Sequence
  Description of Artificial Sequence: Synthetic oligonucleotide
  Target: SCN9A; (-) strand; PAM type: YTN; PAM sequence: CTT
gtctcttattgtcttttgtt

SEQ ID NO: 62237 - DNA, 20 bp, Artificial Sequence
  Description of Artificial Sequence: Synthetic oligonucleotide
  Target: SCN9A; (-) strand; PAM type: YTN; PAM sequence: CTA
atccaacttgtctcttattg

SEQ ID NO: 62238 - DNA, 20 bp, Artificial Sequence
  Description of Artificial Sequence: Synthetic oligonucleotide
  Target: SCN9A; (-) strand; PAM type: YTN; PAM sequence: TTG
atctaatccaacttgtctct

SEQ ID NO: 62239 - DNA, 20 bp, Artificial Sequence
  Description of Artificial Sequence: Synthetic oligonucleotide
  Target: SCN9A; (-) strand; PAM type: YTN; PAM sequence: TTT
gatctaatccaacttgtctc

SEQ ID NO: 62240 - DNA, 20 bp, Artificial Sequence
  Description of Artificial Sequence: Synthetic oligonucleotide
  Target: SCN9A; (-) strand; PAM type: YTN; PAM sequence: TTA
gtttgatctaatccaacttg

SEQ ID NO: 62241 - DNA, 20 bp, Artificial Sequence
  Description of Artificial Sequence: Synthetic oligonucleotide
  Target: SCN9A; (-) strand; PAM type: YTN; PAM sequence: TTT
agtttgatctaatccaactt

SEQ ID NO: 62242 - DNA, 20 bp, Artificial Sequence
  Description of Artificial Sequence: Synthetic oligonucleotide
  Target: SCN9A; (-) strand; PAM type: YTN; PAM sequence: TTT
tagtttgatctaatccaact

SEQ ID NO: 62243 - DNA, 20 bp, Artificial Sequence
  Description of Artificial Sequence: Synthetic oligonucleotide
  Target: SCN9A; (-) strand; PAM type: YTN; PAM sequence: TTT
ttagtttgatctaatccaac

SEQ ID NO: 62244 - DNA, 20 bp, Artificial Sequence
  Description of Artificial Sequence: Synthetic oligonucleotide
  Target: SCN9A; (-) strand; PAM type: YTN; PAM sequence: CTG
taaagaacatttttagtttg

SEQ ID NO: 62245 - DNA, 20 bp, Artificial Sequence
  Description of Artificial Sequence: Synthetic oligonucleotide
  Target: SCN9A; (-) strand; PAM type: YTN; PAM sequence: TTG
ctgtaaagaacatttttagt

SEQ ID NO: 62246 - DNA, 20 bp, Artificial Sequence
  Description of Artificial Sequence: Synthetic oligonucleotide
  Target: SCN9A; (-) strand; PAM type: YTN; PAM sequence: TTT
gctgtaaagaacatttttag

SEQ ID NO: 62247 - DNA, 20 bp, Artificial Sequence
  Description of Artificial Sequence: Synthetic oligonucleotide
  Target: SCN9A; (-) strand; PAM type: YTN; PAM sequence: TTC
gtttgctgtaaagaacattt

SEQ ID NO: 62248 - DNA, 20 bp, Artificial Sequence
  Description of Artificial Sequence: Synthetic oligonucleotide
  Target: SCN9A; (-) strand; PAM type: YTN; PAM sequence: CTT
cgtttgctgtaaagaacatt

SEQ ID NO: 62249 - DNA, 20 bp, Artificial Sequence
  Description of Artificial Sequence: Synthetic oligonucleotide
  Target: SCN9A; (-) strand; PAM type: YTN; PAM sequence: TTG
cttcgtttgctgtaaagaac

SEQ ID NO: 62250 - DNA, 20 bp, Artificial Sequence
  Description of Artificial Sequence: Synthetic oligonucleotide
  Target: SCN9A; (-) strand; PAM type: YTN; PAM sequence: TTA
ttgcttcgtttgctgtaaag

SEQ ID NO: 62251 - DNA, 20 bp, Artificial Sequence
  Description of Artificial Sequence: Synthetic oligonucleotide
  Target: SCN9A; (-) strand; PAM type: YTN; PAM sequence: CTG
ttattgcttcgtttgctgta

SEQ ID NO: 62252 - DNA, 20 bp, Artificial Sequence
  Description of Artificial Sequence: Synthetic oligonucleotide
  Target: SCN9A; (-) strand; PAM type: YTN; PAM sequence: CTC
tgttattgcttcgtttgctg

SEQ ID NO: 62253 - DNA, 20 bp, Artificial Sequence
  Description of Artificial Sequence: Synthetic oligonucleotide
  Target: SCN9A; (-) strand; PAM type: YTN; PAM sequence: CTC
cactctgttattgcttcgtt

SEQ ID NO: 62254 - DNA, 20 bp, Artificial Sequence
  Description of Artificial Sequence: Synthetic oligonucleotide
  Target: SCN9A; (-) strand; PAM type: YTN; PAM sequence: CTC
tccactctgttattgcttcg

SEQ ID NO: 62255 - DNA, 20 bp, Artificial Sequence
  Description of Artificial Sequence: Synthetic oligonucleotide
  Target: SCN9A; (-) strand; PAM type: YTN; PAM sequence: CTC
tctccactctgttattgctt

SEQ ID NO: 62256 - DNA, 20 bp, Artificial Sequence
  Description of Artificial Sequence: Synthetic oligonucleotide
  Target: SCN9A; (-) strand; PAM type: YTN; PAM sequence: CTC
tctctccactctgttattgc

SEQ ID NO: 62257 - DNA, 20 bp, Artificial Sequence
  Description of Artificial Sequence: Synthetic oligonucleotide
  Target: SCN9A; (-) strand; PAM type: YTN; PAM sequence: TTC
aatccatgatctctctctcc

SEQ ID NO: 62258 - DNA, 20 bp, Artificial Sequence
  Description of Artificial Sequence: Synthetic oligonucleotide
  Target: SCN9A; (-) strand; PAM type: YTN; PAM sequence: TTT
caatccatgatctctctctc

SEQ ID NO: 62259 - DNA, 20 bp, Artificial Sequence
  Description of Artificial Sequence: Synthetic oligonucleotide
  Target: SCN9A; (-) strand; PAM type: YTN; PAM sequence: TTA
tttcaatccatgatctctct

SEQ ID NO: 62260 - DNA, 20 bp, Artificial Sequence
  Description of Artificial Sequence: Synthetic oligonucleotide
  Target: SCN9A; (-) strand; PAM type: YTN; PAM sequence: TTT
atttcaatccatgatctctc

SEQ ID NO: 62261 - DNA, 20 bp, Artificial Sequence
  Description of Artificial Sequence: Synthetic oligonucleotide
  Target: SCN9A; (-) strand; PAM type: YTN; PAM sequence: TTT
tatttcaatccatgatctct

SEQ ID NO: 62262 - DNA, 20 bp, Artificial Sequence
  Description of Artificial Sequence: Synthetic oligonucleotide
  Target: SCN9A; (-) strand; PAM type: YTN; PAM sequence: TTG
cagatattttatttcaatcc

SEQ ID NO: 62263 - DNA, 20 bp, Artificial Sequence
  Description of Artificial Sequence: Synthetic oligonucleotide
  Target: SCN9A; (-) strand; PAM type: YTN; PAM sequence: TTT
gcagatattttatttcaatc

SEQ ID NO: 62264 - DNA, 20 bp, Artificial Sequence
  Description of Artificial Sequence: Synthetic oligonucleotide
  Target: SCN9A; (-) strand; PAM type: YTN; PAM sequence: TTA
tcagatgtatggtttgcaga

SEQ ID NO: 62265 - DNA, 20 bp, Artificial Sequence
  Description of Artificial Sequence: Synthetic oligonucleotide
  Target: SCN9A; (-) strand; PAM type: YTN; PAM sequence: TTT
atcagatgtatggtttgcag

SEQ ID NO: 62266 - DNA, 20 bp, Artificial Sequence
  Description of Artificial Sequence: Synthetic oligonucleotide
  Target: SCN9A; (-) strand; PAM type: YTN; PAM sequence: CTT
tatcagatgtatggtttgca

SEQ ID NO: 62267 - DNA, 20 bp, Artificial Sequence
  Description of Artificial Sequence: Synthetic oligonucleotide
  Target: SCN9A; (-) strand; PAM type: YTN; PAM sequence: TTA
gccctttatcagatgtatgg

SEQ ID NO: 62268 - DNA, 20 bp, Artificial Sequence
  Description of Artificial Sequence: Synthetic oligonucleotide
  Target: SCN9A; (-) strand; PAM type: YTN; PAM sequence: TTG
gatattagccctttatcaga

SEQ ID NO: 62269 - DNA, 20 bp, Artificial Sequence
  Description of Artificial Sequence: Synthetic oligonucleotide
  Target: SCN9A; (-) strand; PAM type: YTN; PAM sequence: TTA
tgtataatgttggatattag

SEQ ID NO: 62270 - DNA, 20 bp, Artificial Sequence
  Description of Artificial Sequence: Synthetic oligonucleotide
  Target: SCN9A; (-) strand; PAM type: YTN; PAM sequence: TTT
atgtataatgttggatatta

SEQ ID NO: 62271 - DNA, 20 bp, Artificial Sequence
  Description of Artificial Sequence: Synthetic oligonucleotide
  Target: SCN9A; (-) strand; PAM type: YTN; PAM sequence: TTT
tatgtataatgttggatatt

SEQ ID NO: 62272 - DNA, 20 bp, Artificial Sequence
  Description of Artificial Sequence: Synthetic oligonucleotide
  Target: SCN9A; (-) strand; PAM type: YTN; PAM sequence: TTT
ttatgtataatgttggatat

SEQ ID NO: 62273 - DNA, 20 bp, Artificial Sequence
  Description of Artificial Sequence: Synthetic oligonucleotide
  Target: SCN9A; (-) strand; PAM type: YTN; PAM sequence: CTT
tttatgtataatgttggata

SEQ ID NO: 62274 - DNA, 20 bp, Artificial Sequence
  Description of Artificial Sequence: Synthetic oligonucleotide
  Target: SCN9A; (-) strand; PAM type: YTN; PAM sequence: TTG
agctttttatgtataatgtt

SEQ ID NO: 62275 - DNA, 20 bp, Artificial Sequence
  Description of Artificial Sequence: Synthetic oligonucleotide
  Target: SCN9A; (-) strand; PAM type: YTN; PAM sequence: CTT
gagctttttatgtataatgt

SEQ ID NO: 62276 - DNA, 20 bp, Artificial Sequence
  Description of Artificial Sequence: Synthetic oligonucleotide
  Target: SCN9A; (-) strand; PAM type: YTN; PAM sequence: TTG
cttgagctttttatgtataa

SEQ ID NO: 62277 - DNA, 20 bp, Artificial Sequence
  Description of Artificial Sequence: Synthetic oligonucleotide
  Target: SCN9A; (-) strand; PAM type: YTN; PAM sequence: TTG
agttgcttgagctttttatg

SEQ ID NO: 62278 - DNA, 20 bp, Artificial Sequence
  Description of Artificial Sequence: Synthetic oligonucleotide
  Target: SCN9A; (-) strand; PAM type: YTN; PAM sequence: CTA
ggtgttgagttgcttgagct

SEQ ID NO: 62279 - DNA, 20 bp, Artificial Sequence
  Description of Artificial Sequence: Synthetic oligonucleotide
  Target: SCN9A; (-) strand; PAM type: YTN; PAM sequence: TTC
taggtgttgagttgcttgag

SEQ ID NO: 62280 - DNA, 20 bp, Artificial Sequence
  Description of Artificial Sequence: Synthetic oligonucleotide
  Target: SCN9A; (-) strand; PAM type: YTN; PAM sequence: TTT
ctaggtgttgagttgcttga

SEQ ID NO: 62281 - DNA, 20 bp, Artificial Sequence
  Description of Artificial Sequence: Synthetic oligonucleotide
  Target: SCN9A; (-) strand; PAM type: YTN; PAM sequence: TTT
tctaggtgttgagttgcttg

SEQ ID NO: 62282 - DNA, 20 bp, Artificial Sequence
  Description of Artificial Sequence: Synthetic oligonucleotide
  Target: SCN9A; (-) strand; PAM type: YTN; PAM sequence: TTG
attttctaggtgttgagttg

SEQ ID NO: 62283 - DNA, 20 bp, Artificial Sequence
  Description of Artificial Sequence: Synthetic oligonucleotide
  Target: SCN9A; (-) strand; PAM type: YTN; PAM sequence: TTA
ttgattttctaggtgttgag

SEQ ID NO: 62284 - DNA, 20 bp, Artificial Sequence
  Description of Artificial Sequence: Synthetic oligonucleotide
  Target: SCN9A; (-) strand; PAM type: YTN; PAM sequence: TTT
attgattttctaggtgttga

SEQ ID NO: 62285 - DNA, 20 bp, Artificial Sequence
  Description of Artificial Sequence: Synthetic oligonucleotide
  Target: SCN9A; (-) strand; PAM type: YTN; PAM sequence: TTG
gtttattgattttctaggtg

SEQ ID NO: 62286 - DNA, 20 bp, Artificial Sequence
  Description of Artificial Sequence: Synthetic oligonucleotide
  Target: SCN9A; (-) strand; PAM type: YTN; PAM sequence: CTA
caattggtttattgattttc

SEQ ID NO: 62287 - DNA, 20 bp, Artificial Sequence
  Description of Artificial Sequence: Synthetic oligonucleotide
  Target: SCN9A; (-) strand; PAM type: YTN; PAM sequence: TTC
tacaattggtttattgattt

SEQ ID NO: 62288 - DNA, 20 bp, Artificial Sequence
  Description of Artificial Sequence: Synthetic oligonucleotide
  Target: SCN9A; (-) strand; PAM type: YTN; PAM sequence: TTG
cccattctacaattggttta

SEQ ID NO: 62289 - DNA, 20 bp, Artificial Sequence
  Description of Artificial Sequence: Synthetic oligonucleotide
  Target: SCN9A; (-) strand; PAM type: YTN; PAM sequence: TTT
gcccattctacaattggttt

SEQ ID NO: 62290 - DNA, 20 bp, Artificial Sequence
  Description of Artificial Sequence: Synthetic oligonucleotide
  Target: SCN9A; (-) strand; PAM type: YTN; PAM sequence: TTA
tttgcccattctacaattgg

SEQ ID NO: 62291 - DNA, 20 bp, Artificial Sequence
  Description of Artificial Sequence: Synthetic oligonucleotide
  Target: SCN9A; (-) strand; PAM type: YTN; PAM sequence: TTC
agattatttgcccattctac

SEQ ID NO: 62292 - DNA, 20 bp, Artificial Sequence
  Description of Artificial Sequence: Synthetic oligonucleotide
  Target: SCN9A; (-) strand; PAM type: YTN; PAM sequence: CTG
ttcagattatttgcccattc

SEQ ID NO: 62293 - DNA, 20 bp, Artificial Sequence
  Description of Artificial Sequence: Synthetic oligonucleotide
  Target: SCN9A; (-) strand; PAM type: YTN; PAM sequence: TTG
agaaatgtctgttcagatta

SEQ ID NO: 62294 - DNA, 20 bp, Artificial Sequence
  Description of Artificial Sequence: Synthetic oligonucleotide
  Target: SCN9A; (-) strand; PAM type: YTN; PAM sequence: TTT
gagaaatgtctgttcagatt

SEQ ID NO: 62295 - DNA, 20 bp, Artificial Sequence
  Description of Artificial Sequence: Synthetic oligonucleotide
  Target: SCN9A; (-) strand; PAM type: YTN; PAM sequence: TTT
tgagaaatgtctgttcagat

SEQ ID NO: 62296 - DNA, 20 bp, Artificial Sequence
  Description of Artificial Sequence: Synthetic oligonucleotide
  Target: SCN9A; (-) strand; PAM type: YTN; PAM sequence: CTT
ttgagaaatgtctgttcaga

SEQ ID NO: 62297 - DNA, 20 bp, Artificial Sequence
  Description of Artificial Sequence: Synthetic oligonucleotide
  Target: SCN9A; (-) strand; PAM type: YTN; PAM sequence: TTC
ttttgagaaatgtctgttca

SEQ ID NO: 62298 - DNA, 20 bp, Artificial Sequence
  Description of Artificial Sequence: Synthetic oligonucleotide
  Target: SCN9A; (-) strand; PAM type: YTN; PAM sequence: CTT
cttttgagaaatgtctgttc

SEQ ID NO: 62299 - DNA, 20 bp, Artificial Sequence
  Description of Artificial Sequence: Synthetic oligonucleotide
  Target: SCN9A; (-) strand; PAM type: YTN; PAM sequence: CTC
ttcttttgagaaatgtctgt

SEQ ID NO: 62300 - DNA, 20 bp, Artificial Sequence
  Description of Artificial Sequence: Synthetic oligonucleotide
  Target: SCN9A; (-) strand; PAM type: YTN; PAM sequence: TTC
atatctcttcttttgagaaa

SEQ ID NO: 62301 - DNA, 20 bp, Artificial Sequence
  Description of Artificial Sequence: Synthetic oligonucleotide
  Target: SCN9A; (-) strand; PAM type: YTN; PAM sequence: TTG
gccattcatatctcttcttt

SEQ ID NO: 62302 - DNA, 20 bp, Artificial Sequence
  Description of Artificial Sequence: Synthetic oligonucleotide
  Target: SCN9A; (-) strand; PAM type: YTN; PAM sequence: CTA
ttggccattcatatctcttc

SEQ ID NO: 62303 - DNA, 20 bp, Artificial Sequence
  Description of Artificial Sequence: Synthetic oligonucleotide
  Target: SCN9A; (-) strand; PAM type: YTN; PAM sequence: TTA
atatatctattggccattca

SEQ ID NO: 62304 - DNA, 20 bp, Artificial Sequence
  Description of Artificial Sequence: Synthetic oligonucleotide
  Target: SCN9A; (-) strand; PAM type: YTN; PAM sequence: TTT
aatatatctattggccattc

SEQ ID NO: 62305 - DNA, 20 bp, Artificial Sequence
  Description of Artificial Sequence: Synthetic oligonucleotide
  Target: SCN9A; (-) strand; PAM type: YTN; PAM sequence: TTT
taatatatctattggccatt

SEQ ID NO: 62306 - DNA, 20 bp, Artificial Sequence
  Description of Artificial Sequence: Synthetic oligonucleotide
  Target: SCN9A; (-) strand; PAM type: YTN; PAM sequence: TTT
ttaatatatctattggccat

SEQ ID NO: 62307 - DNA, 20 bp, Artificial Sequence
  Description of Artificial Sequence: Synthetic oligonucleotide
  Target: SCN9A; (-) strand; PAM type: YTN; PAM sequence: TTT
tttaatatatctattggcca

SEQ ID NO: 62308 - DNA, 20 bp, Artificial Sequence
  Description of Artificial Sequence: Synthetic oligonucleotide
  Target: SCN9A; (-) strand; PAM type: YTN; PAM sequence: TTG
agcattttttaatatatcta

SEQ ID NO: 62309 - DNA, 20 bp, Artificial Sequence
  Description of Artificial Sequence: Synthetic oligonucleotide
  Target: SCN9A; (-) strand; PAM type: YTN; PAM sequence: TTA
gagatgttgagcatttttta

SEQ ID NO: 62310 - DNA, 20 bp, Artificial Sequence
  Description of Artificial Sequence: Synthetic oligonucleotide
  Target: SCN9A; (-) strand; PAM type: YTN; PAM sequence: CTG
atgattagagatgttgagca

SEQ ID NO: 62311 - DNA, 20 bp, Artificial Sequence
  Description of Artificial Sequence: Synthetic oligonucleotide
  Target: SCN9A; (-) strand; PAM type: YTN; PAM sequence: TTC
tgatgattagagatgttgag

SEQ ID NO: 62312 - DNA, 20 bp, Artificial Sequence
  Description of Artificial Sequence: Synthetic oligonucleotide
  Target: SCN9A; (-) strand; PAM type: YTN; PAM sequence: TTT
ctgatgattagagatgttga

SEQ ID NO: 62313 - DNA, 20 bp, Artificial Sequence
  Description of Artificial Sequence: Synthetic oligonucleotide
  Target: SCN9A; (-) strand; PAM type: YTN; PAM sequence: TTT
tctgatgattagagatgttg

SEQ ID NO: 62314 - DNA, 20 bp, Artificial Sequence
  Description of Artificial Sequence: Synthetic oligonucleotide
  Target: SCN9A; (-) strand; PAM type: YTN; PAM sequence: TTT
ttctgatgattagagatgtt

SEQ ID NO: 62315 - DNA, 20 bp, Artificial Sequence
  Description of Artificial Sequence: Synthetic oligonucleotide
  Target: SCN9A; (-) strand; PAM type: YTN; PAM sequence: TTG
catttttctgatgattagag

SEQ ID NO: 62316 - DNA, 20 bp, Artificial Sequence
  Description of Artificial Sequence: Synthetic oligonucleotide
  Target: SCN9A; (-) strand; PAM type: YTN; PAM sequence: TTT
gcatttttctgatgattaga

SEQ ID NO: 62317 - DNA, 20 bp, Artificial Sequence
  Description of Artificial Sequence: Synthetic oligonucleotide
  Target: SCN9A; (-) strand; PAM type: YTN; PAM sequence: TTA
atttgcatttttctgatgat

SEQ ID NO: 62318 - DNA, 20 bp, Artificial Sequence
  Description of Artificial Sequence: Synthetic oligonucleotide
  Target: SCN9A; (-) strand; PAM type: YTN; PAM sequence: TTT
aatttgcatttttctgatga

SEQ ID NO: 62319 - DNA, 20 bp, Artificial Sequence
  Description of Artificial Sequence: Synthetic oligonucleotide
  Target: SCN9A; (-) strand; PAM type: YTN; PAM sequence: TTT
taatttgcatttttctgatg

SEQ ID NO: 62320 - DNA, 20 bp, Artificial Sequence
  Description of Artificial Sequence: Synthetic oligonucleotide
  Target: SCN9A; (-) strand; PAM type: YTN; PAM sequence: TTG
ggattttaatttgcattttt

SEQ ID NO: 62321 - DNA, 20 bp, Artificial Sequence
  Description of Artificial Sequence: Synthetic oligonucleotide
  Target: SCN9A; (-) strand; PAM type: YTN; PAM sequence: TTC
attgggattttaatttgcat

SEQ ID NO: 62322 - DNA, 20 bp, Artificial Sequence
  Description of Artificial Sequence: Synthetic oligonucleotide
  Target: SCN9A; (-) strand; PAM type: YTN; PAM sequence: TTT
cattgggattttaatttgca

SEQ ID NO: 62323 - DNA, 20 bp, Artificial Sequence
  Description of Artificial Sequence: Synthetic oligonucleotide
  Target: SCN9A; (-) strand; PAM type: YTN; PAM sequence: CTA
ggaggtgtgaggtaatattt

SEQ ID NO: 62324 - DNA, 20 bp, Artificial Sequence
  Description of Artificial Sequence: Synthetic oligonucleotide
  Target: SCN9A; (-) strand; PAM type: YTN; PAM sequence: TTC
taggaggtgtgaggtaatat

SEQ ID NO: 62325 - DNA, 20 bp, Artificial Sequence
  Description of Artificial Sequence: Synthetic oligonucleotide
  Target: SCN9A; (-) strand; PAM type: YTN; PAM sequence: TTG
ataacagccattctaggagg

SEQ ID NO: 62326 - DNA, 20 bp, Artificial Sequence
  Description of Artificial Sequence: Synthetic oligonucleotide
  Target: SCN9A; (-) strand; PAM type: YTN; PAM sequence: TTT
gataacagccattctaggag

SEQ ID NO: 62327 - DNA, 20 bp, Artificial Sequence
  Description of Artificial Sequence: Synthetic oligonucleotide
  Target: SCN9A; (-) strand; PAM type: YTN; PAM sequence: TTT
tgataacagccattctagga

SEQ ID NO: 62328 - DNA, 20 bp, Artificial Sequence
  Description of Artificial Sequence: Synthetic oligonucleotide
  Target: SCN9A; (-) strand; PAM type: YTN; PAM sequence: TTT
ttgataacagccattctagg

SEQ ID NO: 62329 - DNA, 20 bp, Artificial Sequence
  Description of Artificial Sequence: Synthetic oligonucleotide
  Target: SCN9A; (-) strand; PAM type: YTN; PAM sequence: CTT
tttgataacagccattctag

SEQ ID NO: 62330 - DNA, 20 bp, Artificial Sequence
  Description of Artificial Sequence: Synthetic oligonucleotide
  Target: SCN9A; (-) strand; PAM type: YTN; PAM sequence: TTC
atctttttgataacagccat

SEQ ID NO: 62331 - DNA, 20 bp, Artificial Sequence
  Description of Artificial Sequence: Synthetic oligonucleotide
  Target: SCN9A; (-) strand; PAM type: YTN; PAM sequence: TTA
tcattcatctttttgataac

SEQ ID NO: 62332 - DNA, 20 bp, Artificial Sequence
  Description of Artificial Sequence: Synthetic oligonucleotide
  Target: SCN9A; (-) strand; PAM type: YTN; PAM sequence: TTG
ttatcattcatctttttgat

SEQ ID NO: 62333 - DNA, 20 bp, Artificial Sequence
  Description of Artificial Sequence: Synthetic oligonucleotide
  Target: SCN9A; (-) strand; PAM type: YTN; PAM sequence: CTT
gttatcattcatctttttga

SEQ ID NO: 62334 - DNA, 20 bp, Artificial Sequence
  Description of Artificial Sequence: Synthetic oligonucleotide
  Target: SCN9A; (-) strand; PAM type: YTN; PAM sequence: CTC
atcaacacttgttatcattc

SEQ ID NO: 62335 - DNA, 20 bp, Artificial Sequence
  Description of Artificial Sequence: Synthetic oligonucleotide
  Target: SCN9A; (-) strand; PAM type: YTN; PAM sequence: CTC
cacatcctcatcaacacttg

SEQ ID NO: 62336 - DNA, 20 bp, Artificial Sequence
  Description of Artificial Sequence: Synthetic oligonucleotide
  Target: SCN9A; (-) strand; PAM type: YTN; PAM sequence: TTC
tccacatcctcatcaacact

SEQ ID NO: 62337 - DNA, 20 bp, Artificial Sequence
  Description of Artificial Sequence: Synthetic oligonucleotide
  Target: SCN9A; (-) strand; PAM type: YTN; PAM sequence: TTT
ctccacatcctcatcaacac

SEQ ID NO: 62338 - DNA, 20 bp, Artificial Sequence
  Description of Artificial Sequence: Synthetic oligonucleotide
  Target: SCN9A; (-) strand; PAM type: YTN; PAM sequence: CTA
tttctccacatcctcatcaa

SEQ ID NO: 62339 - DNA, 20 bp, Artificial Sequence
  Description of Artificial Sequence: Synthetic oligonucleotide
  Target: SCN9A; (-) strand; PAM type: YTN; PAM sequence: TTC
ctatttctccacatcctcat

SEQ ID NO: 62340 - DNA, 20 bp, Artificial Sequence
  Description of Artificial Sequence: Synthetic oligonucleotide
  Target: SCN9A; (-) strand; PAM type: YTN; PAM sequence: CTA
acaatgtataagggttccta

SEQ ID NO: 62341 - DNA, 20 bp, Artificial Sequence
  Description of Artificial Sequence: Synthetic oligonucleotide
  Target: SCN9A; (-) strand; PAM type: YTN; PAM sequence: TTC
actaacaatgtataagggtt

SEQ ID NO: 62342 - DNA, 20 bp, Artificial Sequence
  Description of Artificial Sequence: Synthetic oligonucleotide
  Target: SCN9A; (-) strand; PAM type: YTN; PAM sequence: TTT
cactaacaatgtataagggt

SEQ ID NO: 62343 - DNA, 20 bp, Artificial Sequence
  Description of Artificial Sequence: Synthetic oligonucleotide
  Target: SCN9A; (-) strand; PAM type: YTN; PAM sequence: TTT
tcactaacaatgtataaggg

SEQ ID NO: 62344 - DNA, 20 bp, Artificial Sequence
  Description of Artificial Sequence: Synthetic oligonucleotide
  Target: SCN9A; (-) strand; PAM type: YTN; PAM sequence: TTA
cattttcactaacaatgtat

SEQ ID NO: 62345 - DNA, 20 bp, Artificial Sequence
  Description of Artificial Sequence: Synthetic oligonucleotide
  Target: SCN9A; (-) strand; PAM type: YTN; PAM sequence: TTT
acattttcactaacaatgta

SEQ ID NO: 62346 - DNA, 20 bp, Artificial Sequence
  Description of Artificial Sequence: Synthetic oligonucleotide
  Target: SCN9A; (-) strand; PAM type: YTN; PAM sequence: CTA
atttacattttcactaacaa

SEQ ID NO: 62347 - DNA, 20 bp, Artificial Sequence
  Description of Artificial Sequence: Synthetic oligonucleotide
  Target: SCN9A; (-) strand; PAM type: YTN; PAM sequence: CTG
tactaatttacattttcact

SEQ ID NO: 62348 - DNA, 20 bp, Artificial Sequence
  Description of Artificial Sequence: Synthetic oligonucleotide
  Target: SCN9A; (-) strand; PAM type: YTN; PAM sequence: CTC
aaacagctgtactaatttac

SEQ ID NO: 62349 - DNA, 20 bp, Artificial Sequence
  Description of Artificial Sequence: Synthetic oligonucleotide
  Target: SCN9A; (-) strand; PAM type: YTN; PAM sequence: TTC
tcaaacagctgtactaattt

SEQ ID NO: 62350 - DNA, 20 bp, Artificial Sequence
  Description of Artificial Sequence: Synthetic oligonucleotide
  Target: SCN9A; (-) strand; PAM type: YTN; PAM sequence: TTT
ctcaaacagctgtactaatt

SEQ ID NO: 62351 - DNA, 20 bp, Artificial Sequence
  Description of Artificial Sequence: Synthetic oligonucleotide
  Target: SCN9A; (-) strand; PAM type: YTN; PAM sequence: TTT
tctcaaacagctgtactaat

SEQ ID NO: 62352 - DNA, 20 bp, Artificial Sequence
  Description of Artificial Sequence: Synthetic oligonucleotide
  Target: SCN9A; (-) strand; PAM type: YTN; PAM sequence: TTT
ttctcaaacagctgtactaa

SEQ ID NO: 62353 - DNA, 20 bp, Artificial Sequence
  Description of Artificial Sequence: Synthetic oligonucleotide
  Target: SCN9A; (-) strand; PAM type: YTN; PAM sequence: CTA
tttttctcaaacagctgtac

SEQ ID NO: 62354 - DNA, 20 bp, Artificial Sequence
  Description of Artificial Sequence: Synthetic oligonucleotide
  Target: SCN9A; (-) strand; PAM type: YTN; PAM sequence: TTC
catgctatttttctcaaaca

SEQ ID NO: 62355 - DNA, 20 bp, Artificial Sequence
  Description of Artificial Sequence: Synthetic oligonucleotide
  Target: SCN9A; (-) strand; PAM type: YTN; PAM sequence: CTT
ccatgctatttttctcaaac

SEQ ID NO: 62356 - DNA, 20 bp, Artificial Sequence
  Description of Artificial Sequence: Synthetic oligonucleotide
  Target: SCN9A; (-) strand; PAM type: YTN; PAM sequence: TTG
ggaacttccatgctattttt

SEQ ID NO: 62357 - DNA, 20 bp, Artificial Sequence
  Description of Artificial Sequence: Synthetic oligonucleotide
  Target: SCN9A; (-) strand; PAM type: YTN; PAM sequence: TTT
gggaacttccatgctatttt

SEQ ID NO: 62358 - DNA, 20 bp, Artificial Sequence
  Description of Artificial Sequence: Synthetic oligonucleotide
  Target: SCN9A; (-) strand; PAM type: YTN; PAM sequence: TTT
tgggaacttccatgctattt

SEQ ID NO: 62359 - DNA, 20 bp, Artificial Sequence
  Description of Artificial Sequence: Synthetic oligonucleotide
  Target: SCN9A; (-) strand; PAM type: YTN; PAM sequence: TTG
ttttgggaacttccatgcta

SEQ ID NO: 62360 - DNA, 20 bp, Artificial Sequence
  Description of Artificial Sequence: Synthetic oligonucleotide
  Target: SCN9A; (-) strand; PAM type: YTN; PAM sequence: TTT
gttttgggaacttccatgct

SEQ ID NO: 62361 - DNA, 20 bp, Artificial Sequence
  Description of Artificial Sequence: Synthetic oligonucleotide
  Target: SCN9A; (-) strand; PAM type: YTN; PAM sequence: TTG
tatttgttttgggaacttcc

SEQ ID NO: 62362 - DNA, 20 bp, Artificial Sequence
  Description of Artificial Sequence: Synthetic oligonucleotide
  Target: SCN9A; (-) strand; PAM type: YTN; PAM sequence: TTA
tatggtaattgtatttgttt

SEQ ID NO: 62363 - DNA, 20 bp, Artificial Sequence
  Description of Artificial Sequence: Synthetic oligonucleotide
  Target: SCN9A; (-) strand; PAM type: YTN; PAM sequence: CTG
aattatatggtaattgtatt

SEQ ID NO: 62364 - DNA, 20 bp, Artificial Sequence
  Description of Artificial Sequence: Synthetic oligonucleotide
  Target: SCN9A; (-) strand; PAM type: YTN; PAM sequence: TTG
ctgaattatatggtaattgt

SEQ ID NO: 62365 - DNA, 20 bp, Artificial Sequence
  Description of Artificial Sequence: Synthetic oligonucleotide
  Target: SCN9A; (-) strand; PAM type: YTN; PAM sequence: CTA
gaagtggaattgctgaatta

SEQ ID NO: 62366 - DNA, 20 bp, Artificial Sequence
  Description of Artificial Sequence: Synthetic oligonucleotide
  Target: SCN9A; (-) strand; PAM type: YTN; PAM sequence: CTA
tatacctagaagtggaattg

SEQ ID NO: 62367 - DNA, 20 bp, Artificial Sequence
  Description of Artificial Sequence: Synthetic oligonucleotide
  Target: SCN9A; (-) strand; PAM type: YTN; PAM sequence: TTA
aatatataccactatatacc

SEQ ID NO: 62368 - DNA, 20 bp, Artificial Sequence
  Description of Artificial Sequence: Synthetic oligonucleotide
  Target: SCN9A; (-) strand; PAM type: YTN; PAM sequence: CTA
aaggaattaaatatatacca

SEQ ID NO: 62369 - DNA, 20 bp, Artificial Sequence
  Description of Artificial Sequence: Synthetic oligonucleotide
  Target: SCN9A; (-) strand; PAM type: YTN; PAM sequence: CTC
taaaggaattaaatatatac

SEQ ID NO: 62370 - DNA, 20 bp, Artificial Sequence
  Description of Artificial Sequence: Synthetic oligonucleotide
  Target: SCN9A; (-) strand; PAM type: YTN; PAM sequence: TTC
ctctaaaggaattaaatata

SEQ ID NO: 62371 - DNA, 20 bp, Artificial Sequence
  Description of Artificial Sequence: Synthetic oligonucleotide
  Target: SCN9A; (-) strand; PAM type: YTN; PAM sequence: TTA
attcctctaaaggaattaaa

SEQ ID NO: 62372 - DNA, 20 bp, Artificial Sequence
  Description of Artificial Sequence: Synthetic oligonucleotide
  Target: SCN9A; (-) strand; PAM type: YTN; PAM sequence: TTT
aattcctctaaaggaattaa

SEQ ID NO: 62373 - DNA, 20 bp, Artificial Sequence
  Description of Artificial Sequence: Synthetic oligonucleotide
  Target: SCN9A; (-) strand; PAM type: YTN; PAM sequence: TTT
taattcctctaaaggaatta

SEQ ID NO: 62374 - DNA, 20 bp, Artificial Sequence
  Description of Artificial Sequence: Synthetic oligonucleotide
  Target: SCN9A; (-) strand; PAM type: YTN; PAM sequence: TTG
acagaacgattttaattcct

SEQ ID NO: 62375 - DNA, 20 bp, Artificial Sequence
  Description of Artificial Sequence: Synthetic oligonucleotide
  Target: SCN9A; (-) strand; PAM type: YTN; PAM sequence: TTT
gacagaacgattttaattcc

SEQ ID NO: 62376 - DNA, 20 bp, Artificial Sequence
  Description of Artificial Sequence: Synthetic oligonucleotide
  Target: SCN9A; (-) strand; PAM type: YTN; PAM sequence: CTT
tgacagaacgattttaattc

SEQ ID NO: 62377 - DNA, 20 bp, Artificial Sequence
  Description of Artificial Sequence: Synthetic oligonucleotide
  Target: SCN9A; (-) strand; PAM type: YTN; PAM sequence: CTG
aaatgaacatgggagtgcag

SEQ ID NO: 62378 - DNA, 20 bp, Artificial Sequence
  Description of Artificial Sequence: Synthetic oligonucleotide
  Target: SCN9A; (-) strand; PAM type: YTN; PAM sequence: TTG
taaataatgctgaaatgaac

SEQ ID NO: 62379 - DNA, 20 bp, Artificial Sequence
  Description of Artificial Sequence: Synthetic oligonucleotide
  Target: SCN9A; (-) strand; PAM type: YTN; PAM sequence: CTT
gtaaataatgctgaaatgaa

SEQ ID NO: 62380 - DNA, 20 bp, Artificial Sequence
  Description of Artificial Sequence: Synthetic oligonucleotide
  Target: SCN9A; (-) strand; PAM type: YTN; PAM sequence: TTC
ttgtaaataatgctgaaatg

SEQ ID NO: 62381 - DNA, 20 bp, Artificial Sequence
  Description of Artificial Sequence: Synthetic oligonucleotide
  Target: SCN9A; (-) strand; PAM type: YTN; PAM sequence: TTG
gttcttgtaaataatgctga

SEQ ID NO: 62382 - DNA, 20 bp, Artificial Sequence
  Description of Artificial Sequence: Synthetic oligonucleotide
  Target: SCN9A; (-) strand; PAM type: YTN; PAM sequence: CTT
ggttcttgtaaataatgctg

SEQ ID NO: 62383 - DNA, 20 bp, Artificial Sequence
  Description of Artificial Sequence: Synthetic oligonucleotide
  Target: SCN9A; (-) strand; PAM type: YTN; PAM sequence: CTA
atatgtcttggttcttgtaa

SEQ ID NO: 62384 - DNA, 20 bp, Artificial Sequence
  Description of Artificial Sequence: Synthetic oligonucleotide
  Target: SCN9A; (-) strand; PAM type: YTN; PAM sequence: TTG
caccaacctaatatgtcttg

SEQ ID NO: 62385 - DNA, 20 bp, Artificial Sequence
  Description of Artificial Sequence: Synthetic oligonucleotide
  Target: SCN9A; (-) strand; PAM type: YTN; PAM sequence: TTT
gcaccaacctaatatgtctt

SEQ ID NO: 62386 - DNA, 20 bp, Artificial Sequence
  Description of Artificial Sequence: Synthetic oligonucleotide
  Target: SCN9A; (-) strand; PAM type: YTN; PAM sequence: TTA
catttgcaccaacctaatat

SEQ ID NO: 62387 - DNA, 20 bp, Artificial Sequence
  Description of Artificial Sequence: Synthetic oligonucleotide
  Target: SCN9A; (-) strand; PAM type: YTN; PAM sequence: CTG
caattacatttgcaccaacc

SEQ ID NO: 62388 - DNA, 20 bp, Artificial Sequence
  Description of Artificial Sequence: Synthetic oligonucleotide
  Target: SCN9A; (-) strand; PAM type: YTN; PAM sequence: TTG
cagcaaaagtaatggtaaaa

SEQ ID NO: 62389 - DNA, 20 bp, Artificial Sequence
  Description of Artificial Sequence: Synthetic oligonucleotide
  Target: SCN9A; (-) strand; PAM type: YTN; PAM sequence: TTA
attgcagcaaaagtaatggt

SEQ ID NO: 62390 - DNA, 20 bp, Artificial Sequence
  Description of Artificial Sequence: Synthetic oligonucleotide
  Target: SCN9A; (-) strand; PAM type: YTN; PAM sequence: TTT
aattgcagcaaaagtaatgg

SEQ ID NO: 62391 - DNA, 20 bp, Artificial Sequence
  Description of Artificial Sequence: Synthetic oligonucleotide
  Target: SCN9A; (-) strand; PAM type: YTN; PAM sequence: TTT
taattgcagcaaaagtaatg

SEQ ID NO: 62392 - DNA, 20 bp, Artificial Sequence
  Description of Artificial Sequence: Synthetic oligonucleotide
  Target: SCN9A; (-) strand; PAM type: YTN; PAM sequence: CTT
ttaattgcagcaaaagtaat

SEQ ID NO: 62393 - DNA, 20 bp, Artificial Sequence
  Description of Artificial Sequence: Synthetic oligonucleotide
  Target: SCN9A; (-) strand; PAM type: YTN; PAM sequence: TTA
cttttaattgcagcaaaagt

SEQ ID NO: 62394 - DNA, 20 bp, Artificial Sequence
  Description of Artificial Sequence: Synthetic oligonucleotide
  Target: SCN9A; (-) strand; PAM type: YTN; PAM sequence: TTG
gccattacttttaattgcag

SEQ ID NO: 62395 - DNA, 20 bp, Artificial Sequence
  Description of Artificial Sequence: Synthetic oligonucleotide
  Target: SCN9A; (-) strand; PAM type: YTN; PAM sequence: TTT
ggccattacttttaattgca

SEQ ID NO: 62396 - DNA, 20 bp, Artificial Sequence
  Description of Artificial Sequence: Synthetic oligonucleotide
  Target: SCN9A; (-) strand; PAM type: YTN; PAM sequence: TTT
tggccattacttttaattgc

SEQ ID NO: 62397 - DNA, 20 bp, Artificial Sequence
  Description of Artificial Sequence: Synthetic oligonucleotide
  Target: SCN9A; (-) strand; PAM type: YTN; PAM sequence: TTG
cggttttggccattactttt

SEQ ID NO: 62398 - DNA, 20 bp, Artificial Sequence
  Description of Artificial Sequence: Synthetic oligonucleotide
  Target: SCN9A; (-) strand; PAM type: YTN; PAM sequence: TTA
gtgcaaaagtaattgcggtt

SEQ ID NO: 62399 - DNA, 20 bp, Artificial Sequence
  Description of Artificial Sequence: Synthetic oligonucleotide
  Target: SCN9A; (-) strand; PAM type: YTN; PAM sequence: TTG
catgtatgggttagtgcaaa

SEQ ID NO: 62400 - DNA, 20 bp, Artificial Sequence
  Description of Artificial Sequence: Synthetic oligonucleotide
  Target: SCN9A; (-) strand; PAM type: YTN; PAM sequence: TTG
atgggtacaggttgcatgta

SEQ ID NO: 62401 - DNA, 20 bp, Artificial Sequence
  Description of Artificial Sequence: Synthetic oligonucleotide
  Target: SCN9A; (-) strand; PAM type: YTN; PAM sequence: CTG
ttgatgggtacaggttgcat

SEQ ID NO: 62402 - DNA, 20 bp, Artificial Sequence
  Description of Artificial Sequence: Synthetic oligonucleotide
  Target: SCN9A; (-) strand; PAM type: YTN; PAM sequence: TTC
acctgttgatgggtacaggt

SEQ ID NO: 62403 - DNA, 20 bp, Artificial Sequence
  Description of Artificial Sequence: Synthetic oligonucleotide
  Target: SCN9A; (-) strand; PAM type: YTN; PAM sequence: TTC
attcacctgttgatgggtac

SEQ ID NO: 62404 - DNA, 20 bp, Artificial Sequence
  Description of Artificial Sequence: Synthetic oligonucleotide
  Target: SCN9A; (-) strand; PAM type: YTN; PAM sequence: TTA
ttcattcacctgttgatggg

SEQ ID NO: 62405 - DNA, 20 bp, Artificial Sequence
  Description of Artificial Sequence: Synthetic oligonucleotide
  Target: SCN9A; (-) strand; PAM type: YTN; PAM sequence: TTT
attcattcacctgttgatgg

SEQ ID NO: 62406 - DNA, 20 bp, Artificial Sequence
  Description of Artificial Sequence: Synthetic oligonucleotide
  Target: SCN9A; (-) strand; PAM type: YTN; PAM sequence: CTT
tattcattcacctgttgatg

SEQ ID NO: 62407 - DNA, 20 bp, Artificial Sequence
  Description of Artificial Sequence: Synthetic oligonucleotide
  Target: SCN9A; (-) strand; PAM type: YTN; PAM sequence: TTC
tttattcattcacctgttga

SEQ ID NO: 62408 - DNA, 20 bp, Artificial Sequence
  Description of Artificial Sequence: Synthetic oligonucleotide
  Target: SCN9A; (-) strand; PAM type: YTN; PAM sequence: TTT
ctttattcattcacctgttg

SEQ ID NO: 62409 - DNA, 20 bp, Artificial Sequence
  Description of Artificial Sequence: Synthetic oligonucleotide
  Target: SCN9A; (-) strand; PAM type: YTN; PAM sequence: TTT
tctttattcattcacctgtt

SEQ ID NO: 62410 - DNA, 20 bp, Artificial Sequence
  Description of Artificial Sequence: Synthetic oligonucleotide
  Target: SCN9A; (-) strand; PAM type: YTN; PAM sequence: CTA
tcacattttctttattcatt

SEQ ID NO: 62411 - DNA, 20 bp, Artificial Sequence
  Description of Artificial Sequence: Synthetic oligonucleotide
  Target: SCN9A; (-) strand; PAM type: YTN; PAM sequence: CTG
tgcatacctatcacattttc

SEQ ID NO: 62412 - DNA, 20 bp, Artificial Sequence
  Description of Artificial Sequence: Synthetic oligonucleotide
  Target: SCN9A; (-) strand; PAM type: YTN; PAM sequence: TTG
tatagtagtgcactgtgcat

SEQ ID NO: 62413 - DNA, 20 bp, Artificial Sequence
  Description of Artificial Sequence: Synthetic oligonucleotide
  Target: SCN9A; (-) strand; PAM type: YTN; PAM sequence: TTT
gtatagtagtgcactgtgca

SEQ ID NO: 62414 - DNA, 20 bp, Artificial Sequence
  Description of Artificial Sequence: Synthetic oligonucleotide
  Target: SCN9A; (-) strand; PAM type: YTN; PAM sequence: TTT
tgtatagtagtgcactgtgc

SEQ ID NO: 62415 - DNA, 20 bp, Artificial Sequence
  Description of Artificial Sequence: Synthetic oligonucleotide
  Target: SCN9A; (-) strand; PAM type: YTN; PAM sequence: TTA
aagttttgtatagtagtgca

SEQ ID NO: 62416 - DNA, 20 bp, Artificial Sequence
  Description of Artificial Sequence: Synthetic oligonucleotide
  Target: SCN9A; (-) strand; PAM type: YTN; PAM sequence: TTT
aaagttttgtatagtagtgc

SEQ ID NO: 62417 - DNA, 20 bp, Artificial Sequence
  Description of Artificial Sequence: Synthetic oligonucleotide
  Target: SCN9A; (-) strand; PAM type: YTN; PAM sequence: TTT
taaagttttgtatagtagtg

SEQ ID NO: 62418 - DNA, 20 bp, Artificial Sequence
  Description of Artificial Sequence: Synthetic oligonucleotide
  Target: SCN9A; (-) strand; PAM type: YTN; PAM sequence: CTT
ttaaagttttgtatagtagt

SEQ ID NO: 62419 - DNA, 20 bp, Artificial Sequence
  Description of Artificial Sequence: Synthetic oligonucleotide
  Target: SCN9A; (-) strand; PAM type: YTN; PAM sequence: TTC
ttttaaagttttgtatagta

SEQ ID NO: 62420 - DNA, 20 bp, Artificial Sequence
  Description of Artificial Sequence: Synthetic oligonucleotide
  Target: SCN9A; (-) strand; PAM type: YTN; PAM sequence: TTG
ttcttttaaagttttgtata

SEQ ID NO: 62421 - DNA, 20 bp, Artificial Sequence
  Description of Artificial Sequence: Synthetic oligonucleotide
  Target: SCN9A; (-) strand; PAM type: YTN; PAM sequence: TTT
gttcttttaaagttttgtat

SEQ ID NO: 62422 - DNA, 20 bp, Artificial Sequence
  Description of Artificial Sequence: Synthetic oligonucleotide
  Target: SCN9A; (-) strand; PAM type: YTN; PAM sequence: TTG
ggatgaatgacaaaatttgt

SEQ ID NO: 62423 - DNA, 20 bp, Artificial Sequence
  Description of Artificial Sequence: Synthetic oligonucleotide
  Target: SCN9A; (-) strand; PAM type: YTN; PAM sequence: TTC
atgttgggatgaatgacaaa

SEQ ID NO: 62424 - DNA, 20 bp, Artificial Sequence
  Description of Artificial Sequence: Synthetic oligonucleotide
  Target: SCN9A; (-) strand; PAM type: YTN; PAM sequence: TTC
attcatgttgggatgaatga

SEQ ID NO: 62425 - DNA, 20 bp, Artificial Sequence
  Description of Artificial Sequence: Synthetic oligonucleotide
  Target: SCN9A; (-) strand; PAM type: YTN; PAM sequence: TTT
cattcatgttgggatgaatg

SEQ ID NO: 62426 - DNA, 20 bp, Artificial Sequence
  Description of Artificial Sequence: Synthetic oligonucleotide
  Target: SCN9A; (-) strand; PAM type: YTN; PAM sequence: TTA
gtttcattcatgttgggatg

SEQ ID NO: 62427 - DNA, 20 bp, Artificial Sequence
  Description of Artificial Sequence: Synthetic oligonucleotide
  Target: SCN9A; (-) strand; PAM type: YTN; PAM sequence: TTT
agtttcattcatgttgggat

SEQ ID NO: 62428 - DNA, 20 bp, Artificial Sequence
  Description of Artificial Sequence: Synthetic oligonucleotide
  Target: SCN9A; (-) strand; PAM type: YTN; PAM sequence: CTT
tagtttcattcatgttggga

SEQ ID NO: 62429 - DNA, 20 bp, Artificial Sequence
  Description of Artificial Sequence: Synthetic oligonucleotide
  Target: SCN9A; (-) strand; PAM type: YTN; PAM sequence: TTA
gcataacgtcctttagtttc

SEQ ID NO: 62430 - DNA, 20 bp, Artificial Sequence
  Description of Artificial Sequence: Synthetic oligonucleotide
  Target: SCN9A; (-) strand; PAM type: YTN; PAM sequence: CTT
agcataacgtcctttagttt

SEQ ID NO: 62431 - DNA, 20 bp, Artificial Sequence
  Description of Artificial Sequence: Synthetic oligonucleotide
  Target: SCN9A; (-) strand; PAM type: YTN; PAM sequence: TTG
cttagcataacgtcctttag

SEQ ID NO: 62432 - DNA, 20 bp, Artificial Sequence
  Description of Artificial Sequence: Synthetic oligonucleotide
  Target: SCN9A; (-) strand; PAM type: YTN; PAM sequence: TTT
gcttagcataacgtccttta

SEQ ID NO: 62433 - DNA, 20 bp, Artificial Sequence
  Description of Artificial Sequence: Synthetic oligonucleotide
  Target: SCN9A; (-) strand; PAM type: YTN; PAM sequence: TTT
tgcttagcataacgtccttt

SEQ ID NO: 62434 - DNA, 20 bp, Artificial Sequence
  Description of Artificial Sequence: Synthetic oligonucleotide
  Target: SCN9A; (-) strand; PAM type: YTN; PAM sequence: CTA
attttgcttagcataacgtc

SEQ ID NO: 62435 - DNA, 20 bp, Artificial Sequence
  Description of Artificial Sequence: Synthetic oligonucleotide
  Target: SCN9A; (-) strand; PAM type: YTN; PAM sequence: CTG
gctaattttgcttagcataa

SEQ ID NO: 62436 - DNA, 20 bp, Artificial Sequence
  Description of Artificial Sequence: Synthetic oligonucleotide
  Target: SCN9A; (-) strand; PAM type: YTN; PAM sequence: CTG
tacctggctaattttgctta

SEQ ID NO: 62437 - DNA, 20 bp, Artificial Sequence
  Description of Artificial Sequence: Synthetic oligonucleotide
  Target: SCN9A; (-) strand; PAM type: YTN; PAM sequence: TTC
tgtacctggctaattttgct

SEQ ID NO: 62438 - DNA, 20 bp, Artificial Sequence
  Description of Artificial Sequence: Synthetic oligonucleotide
  Target: SCN9A; (-) strand; PAM type: YTN; PAM sequence: TTT
ctgtacctggctaattttgc

SEQ ID NO: 62439 - DNA, 20 bp, Artificial Sequence
  Description of Artificial Sequence: Synthetic oligonucleotide
  Target: SCN9A; (-) strand; PAM type: YTN; PAM sequence: CTT
tctgtacctggctaattttg

SEQ ID NO: 62440 - DNA, 20 bp, Artificial Sequence
  Description of Artificial Sequence: Synthetic oligonucleotide
  Target: SCN9A; (-) strand; PAM type: YTN; PAM sequence: TTG
tctttctgtacctggctaat

SEQ ID NO: 62441 - DNA, 20 bp, Artificial Sequence
  Description of Artificial Sequence: Synthetic oligonucleotide
  Target: SCN9A; (-) strand; PAM type: YTN; PAM sequence: TTT
gtctttctgtacctggctaa

SEQ ID NO: 62442 - DNA, 20 bp, Artificial Sequence
  Description of Artificial Sequence: Synthetic oligonucleotide
  Target: SCN9A; (-) strand; PAM type: YTN; PAM sequence: TTA
catgtaagtgagatcatgtg

SEQ ID NO: 62443 - DNA, 20 bp, Artificial Sequence
  Description of Artificial Sequence: Synthetic oligonucleotide
  Target: SCN9A; (-) strand; PAM type: YTN; PAM sequence: TTT
acatgtaagtgagatcatgt

SEQ ID NO: 62444 - DNA, 20 bp, Artificial Sequence
  Description of Artificial Sequence: Synthetic oligonucleotide
  Target: SCN9A; (-) strand; PAM type: YTN; PAM sequence: TTT
tacatgtaagtgagatcatg

SEQ ID NO: 62445 - DNA, 20 bp, Artificial Sequence
  Description of Artificial Sequence: Synthetic oligonucleotide
  Target: SCN9A; (-) strand; PAM type: YTN; PAM sequence: CTC
cccccaccccattttacatg

SEQ ID NO: 62446 - DNA, 20 bp, Artificial Sequence
  Description of Artificial Sequence: Synthetic oligonucleotide
  Target: SCN9A; (-) strand; PAM type: YTN; PAM sequence: CTC
ccccctccccccaccccatt

SEQ ID NO: 62447 - DNA, 20 bp, Artificial Sequence
  Description of Artificial Sequence: Synthetic oligonucleotide
  Target: SCN9A; (-) strand; PAM type: YTN; PAM sequence: CTA
tccctcccccctccccccac

SEQ ID NO: 62448 - DNA, 20 bp, Artificial Sequence
  Description of Artificial Sequence: Synthetic oligonucleotide
  Target: SCN9A; (-) strand; PAM type: YTN; PAM sequence: CTA
atgctatccctcccccctcc

SEQ ID NO: 62449 - DNA, 20 bp, Artificial Sequence
  Description of Artificial Sequence: Synthetic oligonucleotide
  Target: SCN9A; (-) strand; PAM type: YTN; PAM sequence: CTC
ctaatgctatccctcccccc

SEQ ID NO: 62450 - DNA, 20 bp, Artificial Sequence
  Description of Artificial Sequence: Synthetic oligonucleotide
  Target: SCN9A; (-) strand; PAM type: YTN; PAM sequence: TTA
ggtatatctcctaatgctat

SEQ ID NO: 62451 - DNA, 20 bp, Artificial Sequence
  Description of Artificial Sequence: Synthetic oligonucleotide
  Target: SCN9A; (-) strand; PAM type: YTN; PAM sequence: TTA
cattaggtatatctcctaat

SEQ ID NO: 62452 - DNA, 20 bp, Artificial Sequence
  Description of Artificial Sequence: Synthetic oligonucleotide
  Target: SCN9A; (-) strand; PAM type: YTN; PAM sequence: TTT
acattaggtatatctcctaa

SEQ ID NO: 62453 - DNA, 20 bp, Artificial Sequence
  Description of Artificial Sequence: Synthetic oligonucleotide
  Target: SCN9A; (-) strand; PAM type: YTN; PAM sequence: CTC
gtcatttacattaggtatat

SEQ ID NO: 62454 - DNA, 20 bp, Artificial Sequence
  Description of Artificial Sequence: Synthetic oligonucleotide
  Target: SCN9A; (-) strand; PAM type: YTN; PAM sequence: TTA
actcgtcatttacattaggt

SEQ ID NO: 62455 - DNA, 20 bp, Artificial Sequence
  Description of Artificial Sequence: Synthetic oligonucleotide
  Target: SCN9A; (-) strand; PAM type: YTN; PAM sequence: TTG
gtgtgcggcacccattaact

SEQ ID NO: 62456 - DNA, 20 bp, Artificial Sequence
  Description of Artificial Sequence: Synthetic oligonucleotide
  Target: SCN9A; (-) strand; PAM type: YTN; PAM sequence: TTA
catatgtatacatgtgccat

SEQ ID NO: 62457 - DNA, 20 bp, Artificial Sequence
  Description of Artificial Sequence: Synthetic oligonucleotide
  Target: SCN9A; (-) strand; PAM type: YTN; PAM sequence: TTG
ttacatatgtatacatgtgc

SEQ ID NO: 62458 - DNA, 20 bp, Artificial Sequence
  Description of Artificial Sequence: Synthetic oligonucleotide
  Target: SCN9A; (-) strand; PAM type: YTN; PAM sequence: TTT
gttacatatgtatacatgtg

SEQ ID NO: 62459 - DNA, 20 bp, Artificial Sequence
  Description of Artificial Sequence: Synthetic oligonucleotide
  Target: SCN9A; (-) strand; PAM type: YTN; PAM sequence: CTA
gggtacatgtgcacaacgtg

SEQ ID NO: 62460 - DNA, 20 bp, Artificial Sequence
  Description of Artificial Sequence: Synthetic oligonucleotide
  Target: SCN9A; (-) strand; PAM type: YTN; PAM sequence: TTC
tagggtacatgtgcacaacg

SEQ ID NO: 62461 - DNA, 20 bp, Artificial Sequence
  Description of Artificial Sequence: Synthetic oligonucleotide
  Target: SCN9A; (-) strand; PAM type: YTN; PAM sequence: TTA
agttctagggtacatgtgca

SEQ ID NO: 62462 - DNA, 20 bp, Artificial Sequence
  Description of Artificial Sequence: Synthetic oligonucleotide
  Target: SCN9A; (-) strand; PAM type: YTN; PAM sequence: TTT
aagttctagggtacatgtgc

SEQ ID NO: 62463 - DNA, 20 bp, Artificial Sequence
  Description of Artificial Sequence: Synthetic oligonucleotide
  Target: SCN9A; (-) strand; PAM type: YTN; PAM sequence: CTT
taagttctagggtacatgtg

SEQ ID NO: 62464 - DNA, 20 bp, Artificial Sequence
  Description of Artificial Sequence: Synthetic oligonucleotide
  Target: SCN9A; (-) strand; PAM type: YTN; PAM sequence: TTA
ctttaagttctagggtacat

SEQ ID NO: 62465 - DNA, 20 bp, Artificial Sequence
  Description of Artificial Sequence: Synthetic oligonucleotide
  Target: SCN9A; (-) strand; PAM type: YTN; PAM sequence: TTT
actttaagttctagggtaca

SEQ ID NO: 62466 - DNA, 20 bp, Artificial Sequence
  Description of Artificial Sequence: Synthetic oligonucleotide
  Target: SCN9A; (-) strand; PAM type: YTN; PAM sequence: TTT
tactttaagttctagggtac

SEQ ID NO: 62467 - DNA, 20 bp, Artificial Sequence
  Description of Artificial Sequence: Synthetic oligonucleotide
  Target: SCN9A; (-) strand; PAM type: YTN; PAM sequence: TTA
ttttactttaagttctaggg

SEQ ID NO: 62468 - DNA, 20 bp, Artificial Sequence
  Description of Artificial Sequence: Synthetic oligonucleotide
  Target: SCN9A; (-) strand; PAM type: YTN; PAM sequence: TTT
attttactttaagttctagg

SEQ ID NO: 62469 - DNA, 20 bp, Artificial Sequence
  Description of Artificial Sequence: Synthetic oligonucleotide
  Target: SCN9A; (-) strand; PAM type: YTN; PAM sequence: TTT
tattttactttaagttctag

SEQ ID NO: 62470 - DNA, 20 bp, Artificial Sequence
  Description of Artificial Sequence: Synthetic oligonucleotide
  Target: SCN9A; (-) strand; PAM type: YTN; PAM sequence: TTT
ttattttactttaagttcta

SEQ ID NO: 62471 - DNA, 20 bp, Artificial Sequence
  Description of Artificial Sequence: Synthetic oligonucleotide
  Target: SCN9A; (-) strand; PAM type: YTN; PAM sequence: TTT
tttattttactttaagttct

SEQ ID NO: 62472 - DNA, 20 bp, Artificial Sequence
  Description of Artificial Sequence: Synthetic oligonucleotide
  Target: SCN9A; (-) strand; PAM type: YTN; PAM sequence: TTT
ttttattttactttaagttc

SEQ ID NO: 62473 - DNA, 20 bp, Artificial Sequence
  Description of Artificial Sequence: Synthetic oligonucleotide
  Target: SCN9A; (-) strand; PAM type: YTN; PAM sequence: TTA
tttttttattttactttaag

SEQ ID NO: 62474 - DNA, 20 bp, Artificial Sequence
  Description of Artificial Sequence: Synthetic oligonucleotide
  Target: SCN9A; (-) strand; PAM type: YTN; PAM sequence: TTT
atttttttattttactttaa

SEQ ID NO: 62475 - DNA, 20 bp, Artificial Sequence
  Description of Artificial Sequence: Synthetic oligonucleotide
  Target: SCN9A; (-) strand; PAM type: YTN; PAM sequence: TTA
tttatttttttattttactt

SEQ ID NO: 62476 - DNA, 20 bp, Artificial Sequence
  Description of Artificial Sequence: Synthetic oligonucleotide
  Target: SCN9A; (-) strand; PAM type: YTN; PAM sequence: TTT
atttatttttttattttact

SEQ ID NO: 62477 - DNA, 20 bp, Artificial Sequence
  Description of Artificial Sequence: Synthetic oligonucleotide
  Target: SCN9A; (-) strand; PAM type: YTN; PAM sequence: TTA
tttatttatttttttatttt

SEQ ID NO: 62478 - DNA, 20 bp, Artificial Sequence
  Description of Artificial Sequence: Synthetic oligonucleotide
  Target: SCN9A; (-) strand; PAM type: YTN; PAM sequence: TTT
atttatttatttttttattt

SEQ ID NO: 62479 - DNA, 20 bp, Artificial Sequence
  Description of Artificial Sequence: Synthetic oligonucleotide
  Target: SCN9A; (-) strand; PAM type: YTN; PAM sequence: TTT
tatttatttatttttttatt

SEQ ID NO: 62480 - DNA, 20 bp, Artificial Sequence
  Description of Artificial Sequence: Synthetic oligonucleotide
  Target: SCN9A; (-) strand; PAM type: YTN; PAM sequence: TTT
ttatttatttatttttttat

SEQ ID NO: 62481 - DNA, 20 bp, Artificial Sequence
  Description of Artificial Sequence: Synthetic oligonucleotide
  Target: SCN9A; (-) strand; PAM type: YTN; PAM sequence: TTT
tttatttatttattttttta

SEQ ID NO: 62482 - DNA, 20 bp, Artificial Sequence
  Description of Artificial Sequence: Synthetic oligonucleotide
  Target: SCN9A; (-) strand; PAM type: YTN; PAM sequence: TTA
ttttttatttatttattttt

SEQ ID NO: 62483 - DNA, 20 bp, Artificial Sequence
  Description of Artificial Sequence: Synthetic oligonucleotide
  Target: SCN9A; (-) strand; PAM type: YTN; PAM sequence: TTT
attttttatttatttatttt

SEQ ID NO: 62484 - DNA, 20 bp, Artificial Sequence
  Description of Artificial Sequence: Synthetic oligonucleotide
  Target: SCN9A; (-) strand; PAM type: YTN; PAM sequence: TTT
tattttttatttatttattt

SEQ ID NO: 62485 - DNA, 20 bp, Artificial Sequence
  Description of Artificial Sequence: Synthetic oligonucleotide
  Target: SCN9A; (-) strand; PAM type: YTN; PAM sequence: TTT
ttattttttatttatttatt

SEQ ID NO: 62486 - DNA, 20 bp, Artificial Sequence
  Description of Artificial Sequence: Synthetic oligonucleotide
  Target: SCN9A; (-) strand; PAM type: YTN; PAM sequence: TTT
tttattttttatttatttat

SEQ ID NO: 62487 - DNA, 20 bp, Artificial Sequence
  Description of Artificial Sequence: Synthetic oligonucleotide
  Target: SCN9A; (-) strand; PAM type: YTN; PAM sequence: CTT
ttttattttttatttattta

SEQ ID NO: 62488 - DNA, 20 bp, Artificial Sequence
  Description of Artificial Sequence: Synthetic oligonucleotide
  Target: SCN9A; (-) strand; PAM type: YTN; PAM sequence: CTC
acttttttattttttattta

SEQ ID NO: 62489 - DNA, 20 bp, Artificial Sequence
  Description of Artificial Sequence: Synthetic oligonucleotide
  Target: SCN9A; (-) strand; PAM type: YTN; PAM sequence: TTC
tcacttttttattttttatt

SEQ ID NO: 62490 - DNA, 20 bp, Artificial Sequence
  Description of Artificial Sequence: Synthetic oligonucleotide
  Target: SCN9A; (-) strand; PAM type: YTN; PAM sequence: CTT
ctcacttttttattttttat

SEQ ID NO: 62491 - DNA, 20 bp, Artificial Sequence
  Description of Artificial Sequence: Synthetic oligonucleotide
  Target: SCN9A; (-) strand; PAM type: YTN; PAM sequence: TTG
acttctcacttttttatttt

SEQ ID NO: 62492 - DNA, 20 bp, Artificial Sequence
  Description of Artificial Sequence: Synthetic oligonucleotide
  Target: SCN9A; (-) strand; PAM type: YTN; PAM sequence: CTG
taatgttgacttctcacttt

SEQ ID NO: 62493 - DNA, 20 bp, Artificial Sequence
  Description of Artificial Sequence: Synthetic oligonucleotide
  Target: SCN9A; (-) strand; PAM type: YTN; PAM sequence: TTC
tgtaatgttgacttctcact

SEQ ID NO: 62494 - DNA, 20 bp, Artificial Sequence
  Description of Artificial Sequence: Synthetic oligonucleotide
  Target: SCN9A; (-) strand; PAM type: YTN; PAM sequence: TTT
ctgtaatgttgacttctcac

SEQ ID NO: 62495 - DNA, 20 bp, Artificial Sequence
  Description of Artificial Sequence: Synthetic oligonucleotide
  Target: SCN9A; (-) strand; PAM type: YTN; PAM sequence: CTG
tttctgtaatgttgacttct

SEQ ID NO: 62496 - DNA, 20 bp, Artificial Sequence
  Description of Artificial Sequence: Synthetic oligonucleotide
  Target: SCN9A; (-) strand; PAM type: YTN; PAM sequence: TTA
tatgctgtttctgtaatgtt

SEQ ID NO: 62497 - DNA, 20 bp, Artificial Sequence
  Description of Artificial Sequence: Synthetic oligonucleotide
  Target: SCN9A; (-) strand; PAM type: YTN; PAM sequence: TTT
atatgctgtttctgtaatgt

SEQ ID NO: 62498 - DNA, 20 bp, Artificial Sequence
  Description of Artificial Sequence: Synthetic oligonucleotide
  Target: SCN9A; (-) strand; PAM type: YTN; PAM sequence: CTT
tatatgctgtttctgtaatg

SEQ ID NO: 62499 - DNA, 20 bp, Artificial Sequence
  Description of Artificial Sequence: Synthetic oligonucleotide
  Target: SCN9A; (-) strand; PAM type: YTN; PAM sequence: CTA
tggcaaccacctttatatgc

SEQ ID NO: 62500 - DNA, 20 bp, Artificial Sequence
  Description of Artificial Sequence: Synthetic oligonucleotide
  Target: SCN9A; (-) strand; PAM type: YTN; PAM sequence: TTC
ccccagtcctatggcaacca

SEQ ID NO: 62501 - DNA, 20 bp, Artificial Sequence
  Description of Artificial Sequence: Synthetic oligonucleotide
  Target: SCN9A; (-) strand; PAM type: YTN; PAM sequence: CTT
cccccagtcctatggcaacc

SEQ ID NO: 62502 - DNA, 20 bp, Artificial Sequence
  Description of Artificial Sequence: Synthetic oligonucleotide
  Target: SCN9A; (-) strand; PAM type: YTN; PAM sequence: CTC
cacatcgtcttcccccagtc

SEQ ID NO: 62503 - DNA, 20 bp, Artificial Sequence
  Description of Artificial Sequence: Synthetic oligonucleotide
  Target: SCN9A; (-) strand; PAM type: YTN; PAM sequence: TTC
tccacatcgtcttcccccag

SEQ ID NO: 62504 - DNA, 20 bp, Artificial Sequence
  Description of Artificial Sequence: Synthetic oligonucleotide
  Target: SCN9A; (-) strand; PAM type: YTN; PAM sequence: TTT
ctccacatcgtcttccccca

SEQ ID NO: 62505 - DNA, 20 bp, Artificial Sequence
  Description of Artificial Sequence: Synthetic oligonucleotide
  Target: SCN9A; (-) strand; PAM type: YTN; PAM sequence: CTT
tctccacatcgtcttccccc

SEQ ID NO: 62506 - DNA, 20 bp, Artificial Sequence
  Description of Artificial Sequence: Synthetic oligonucleotide
  Target: SCN9A; (-) strand; PAM type: YTN; PAM sequence: TTA
tactttctccacatcgtctt

SEQ ID NO: 62507 - DNA, 20 bp, Artificial Sequence
  Description of Artificial Sequence: Synthetic oligonucleotide
  Target: SCN9A; (-) strand; PAM type: YTN; PAM sequence: TTT
atactttctccacatcgtct

SEQ ID NO: 62508 - DNA, 20 bp, Artificial Sequence
  Description of Artificial Sequence: Synthetic oligonucleotide
  Target: SCN9A; (-) strand; PAM type: YTN; PAM sequence: TTG
atcaagatttatactttctc

SEQ ID NO: 62509 - DNA, 20 bp, Artificial Sequence
  Description of Artificial Sequence: Synthetic oligonucleotide
  Target: SCN9A; (-) strand; PAM type: YTN; PAM sequence: TTT
gatcaagatttatactttct

SEQ ID NO: 62510 - DNA, 20 bp, Artificial Sequence
  Description of Artificial Sequence: Synthetic oligonucleotide
  Target: SCN9A; (-) strand; PAM type: YTN; PAM sequence: CTT
tgatcaagatttatactttc

SEQ ID NO: 62511 - DNA, 20 bp, Artificial Sequence
  Description of Artificial Sequence: Synthetic oligonucleotide
  Target: SCN9A; (-) strand; PAM type: YTN; PAM sequence: CTA
aatgaaaaatgtacatcctt

SEQ ID NO: 62512 - DNA, 20 bp, Artificial Sequence
  Description of Artificial Sequence: Synthetic oligonucleotide
  Target: SCN9A; (-) strand; PAM type: YTN; PAM sequence: CTC
taaatgaaaaatgtacatcc

SEQ ID NO: 62513 - DNA, 20 bp, Artificial Sequence
  Description of Artificial Sequence: Synthetic oligonucleotide
  Target: SCN9A; (-) strand; PAM type: YTN; PAM sequence: CTA
ctctaaatgaaaaatgtaca

SEQ ID NO: 62514 - DNA, 20 bp, Artificial Sequence
  Description of Artificial Sequence: Synthetic oligonucleotide
  Target: SCN9A; (-) strand; PAM type: YTN; PAM sequence: CTC
tactctaaatgaaaaatgta

SEQ ID NO: 62515 - DNA, 20 bp, Artificial Sequence
  Description of Artificial Sequence: Synthetic oligonucleotide
  Target: SCN9A; (-) strand; PAM type: YTN; PAM sequence: TTC
ctctactctaaatgaaaaat

SEQ ID NO: 62516 - DNA, 20 bp, Artificial Sequence
  Description of Artificial Sequence: Synthetic oligonucleotide
  Target: SCN9A; (-) strand; PAM type: YTN; PAM sequence: TTA
ttcctctactctaaatgaaa

SEQ ID NO: 62517 - DNA, 20 bp, Artificial Sequence
  Description of Artificial Sequence: Synthetic oligonucleotide
  Target: SCN9A; (-) strand; PAM type: YTN; PAM sequence: TTT
attcctctactctaaatgaa

SEQ ID NO: 62518 - DNA, 20 bp, Artificial Sequence
  Description of Artificial Sequence: Synthetic oligonucleotide
  Target: SCN9A; (-) strand; PAM type: YTN; PAM sequence: TTA
agatttattcctctactcta

SEQ ID NO: 62519 - DNA, 20 bp, Artificial Sequence
  Description of Artificial Sequence: Synthetic oligonucleotide
  Target: SCN9A; (-) strand; PAM type: YTN; PAM sequence: CTT
aagatttattcctctactct

SEQ ID NO: 62520 - DNA, 20 bp, Artificial Sequence
  Description of Artificial Sequence: Synthetic oligonucleotide
  Target: SCN9A; (-) strand; PAM type: YTN; PAM sequence: TTA
atccatcttaagatttattc

SEQ ID NO: 62521 - DNA, 20 bp, Artificial Sequence
  Description of Artificial Sequence: Synthetic oligonucleotide
  Target: SCN9A; (-) strand; PAM type: YTN; PAM sequence: TTT
aatccatcttaagatttatt

SEQ ID NO: 62522 - DNA, 20 bp, Artificial Sequence
  Description of Artificial Sequence: Synthetic oligonucleotide
  Target: SCN9A; (-) strand; PAM type: YTN; PAM sequence: CTT
taatccatcttaagatttat

SEQ ID NO: 62523 - DNA, 20 bp, Artificial Sequence
  Description of Artificial Sequence: Synthetic oligonucleotide
  Target: SCN9A; (-) strand; PAM type: YTN; PAM sequence: TTA
agtctttaatccatcttaag

SEQ ID NO: 62524 - DNA, 20 bp, Artificial Sequence
  Description of Artificial Sequence: Synthetic oligonucleotide
  Target: SCN9A; (-) strand; PAM type: YTN; PAM sequence: TTT
aagtctttaatccatcttaa

SEQ ID NO: 62525 - DNA, 20 bp, Artificial Sequence
  Description of Artificial Sequence: Synthetic oligonucleotide
  Target: SCN9A; (-) strand; PAM type: YTN; PAM sequence: TTA
catttaagtctttaatccat

SEQ ID NO: 62526 - DNA, 20 bp, Artificial Sequence
  Description of Artificial Sequence: Synthetic oligonucleotide
  Target: SCN9A; (-) strand; PAM type: YTN; PAM sequence: TTT
acatttaagtctttaatcca

SEQ ID NO: 62527 - DNA, 20 bp, Artificial Sequence
  Description of Artificial Sequence: Synthetic oligonucleotide
  Target: SCN9A; (-) strand; PAM type: YTN; PAM sequence: TTT
tacatttaagtctttaatcc

SEQ ID NO: 62528 - DNA, 20 bp, Artificial Sequence
  Description of Artificial Sequence: Synthetic oligonucleotide
  Target: SCN9A; (-) strand; PAM type: YTN; PAM sequence: TTA
gattttacatttaagtcttt

SEQ ID NO: 62529 - DNA, 20 bp, Artificial Sequence
  Description of Artificial Sequence: Synthetic oligonucleotide
  Target: SCN9A; (-) strand; PAM type: YTN; PAM sequence: TTT
agattttacatttaagtctt

SEQ ID NO: 62530 - DNA, 20 bp, Artificial Sequence
  Description of Artificial Sequence: Synthetic oligonucleotide
  Target: SCN9A; (-) strand; PAM type: YTN; PAM sequence: TTT
tagattttacatttaagtct

SEQ ID NO: 62531 - DNA, 20 bp, Artificial Sequence
  Description of Artificial Sequence: Synthetic oligonucleotide
  Target: SCN9A; (-) strand; PAM type: YTN; PAM sequence: TTA
tagttttagattttacattt

SEQ ID NO: 62532 - DNA, 20 bp, Artificial Sequence
  Description of Artificial Sequence: Synthetic oligonucleotide
  Target: SCN9A; (-) strand; PAM type: YTN; PAM sequence: TTT
atagttttagattttacatt

SEQ ID NO: 62533 - DNA, 20 bp, Artificial Sequence
  Description of Artificial Sequence: Synthetic oligonucleotide
  Target: SCN9A; (-) strand; PAM type: YTN; PAM sequence: TTT
tatagttttagattttacat

SEQ ID NO: 62534 - DNA, 20 bp, Artificial Sequence
  Description of Artificial Sequence: Synthetic oligonucleotide
  Target: SCN9A; (-) strand; PAM type: YTN; PAM sequence: TTT
ttatagttttagattttaca

SEQ ID NO: 62535 - DNA, 20 bp, Artificial Sequence
  Description of Artificial Sequence: Synthetic oligonucleotide
  Target: SCN9A; (-) strand; PAM type: YTN; PAM sequence: TTC
cagggtttttatagttttag

SEQ ID NO: 62536 - DNA, 20 bp, Artificial Sequence
  Description of Artificial Sequence: Synthetic oligonucleotide
  Target: SCN9A; (-) strand; PAM type: YTN; PAM sequence: CTT
ccagggtttttatagtttta

SEQ ID NO: 62537 - DNA, 20 bp, Artificial Sequence
  Description of Artificial Sequence: Synthetic oligonucleotide
  Target: SCN9A; (-) strand; PAM type: YTN; PAM sequence: CTG
tcttccagggtttttatagt

SEQ ID NO: 62538 - DNA, 20 bp, Artificial Sequence
  Description of Artificial Sequence: Synthetic oligonucleotide
  Target: SCN9A; (-) strand; PAM type: YTN; PAM sequence: CTA
ggctgtcttccagggttttt

SEQ ID NO: 62539 - DNA, 20 bp, Artificial Sequence
  Description of Artificial Sequence: Synthetic oligonucleotide
  Target: SCN9A; (-) strand; PAM type: YTN; PAM sequence: TTG
cctaggctgtcttccagggt

SEQ ID NO: 62540 - DNA, 20 bp, Artificial Sequence
  Description of Artificial Sequence: Synthetic oligonucleotide
  Target: SCN9A; (-) strand; PAM type: YTN; PAM sequence: CTG
aatggtattgcctaggctgt

SEQ ID NO: 62541 - DNA, 20 bp, Artificial Sequence
  Description of Artificial Sequence: Synthetic oligonucleotide
  Target: SCN9A; (-) strand; PAM type: YTN; PAM sequence: CTA
tgtcctgaatggtattgcct

SEQ ID NO: 62542 - DNA, 20 bp, Artificial Sequence
  Description of Artificial Sequence: Synthetic oligonucleotide
  Target: SCN9A; (-) strand; PAM type: YTN; PAM sequence: TTG
cccatgcctatgtcctgaat

SEQ ID NO: 62543 - DNA, 20 bp, Artificial Sequence
  Description of Artificial Sequence: Synthetic oligonucleotide
  Target: SCN9A; (-) strand; PAM type: YTN; PAM sequence: TTT
gcccatgcctatgtcctgaa

SEQ ID NO: 62544 - DNA, 20 bp, Artificial Sequence
  Description of Artificial Sequence: Synthetic oligonucleotide
  Target: SCN9A; (-) strand; PAM type: YTN; PAM sequence: CTT
tgcccatgcctatgtcctga

SEQ ID NO: 62545 - DNA, 20 bp, Artificial Sequence
  Description of Artificial Sequence: Synthetic oligonucleotide
  Target: SCN9A; (-) strand; PAM type: YTN; PAM sequence: TTC
atcatgaaatctttgcccat

SEQ ID NO: 62546 - DNA, 20 bp, Artificial Sequence
  Description of Artificial Sequence: Synthetic oligonucleotide
  Target: SCN9A; (-) strand; PAM type: YTN; PAM sequence: CTT
catcatgaaatctttgccca

SEQ ID NO: 62547 - DNA, 20 bp, Artificial Sequence
  Description of Artificial Sequence: Synthetic oligonucleotide
  Target: SCN9A; (-) strand; PAM type: YTN; PAM sequence: TTG
gtgtcttcatcatgaaatct

SEQ ID NO: 62548 - DNA, 20 bp, Artificial Sequence
  Description of Artificial Sequence: Synthetic oligonucleotide
  Target: SCN9A; (-) strand; PAM type: YTN; PAM sequence: TTT
ggtgtcttcatcatgaaatc

SEQ ID NO: 62549 - DNA, 20 bp, Artificial Sequence
  Description of Artificial Sequence: Synthetic oligonucleotide
  Target: SCN9A; (-) strand; PAM type: YTN; PAM sequence: TTT
tggtgtcttcatcatgaaat

SEQ ID NO: 62550 - DNA, 20 bp, Artificial Sequence
  Description of Artificial Sequence: Synthetic oligonucleotide
  Target: SCN9A; (-) strand; PAM type: YTN; PAM sequence: CTT
ttggtgtcttcatcatgaaa

SEQ ID NO: 62551 - DNA, 20 bp, Artificial Sequence
  Description of Artificial Sequence: Synthetic oligonucleotide
  Target: SCN9A; (-) strand; PAM type: YTN; PAM sequence: TTG
cttttggtgtcttcatcatg

SEQ ID NO: 62552 - DNA, 20 bp, Artificial Sequence
  Description of Artificial Sequence: Synthetic oligonucleotide
  Target: SCN9A; (-) strand; PAM type: YTN; PAM sequence: TTG
cagttgcttttggtgtcttc

SEQ ID NO: 62553 - DNA, 20 bp, Artificial Sequence
  Description of Artificial Sequence: Synthetic oligonucleotide
  Target: SCN9A; (-) strand; PAM type: YTN; PAM sequence: TTG
ttgcagttgcttttggtgtc

SEQ ID NO: 62554 - DNA, 20 bp, Artificial Sequence
  Description of Artificial Sequence: Synthetic oligonucleotide
  Target: SCN9A; (-) strand; PAM type: YTN; PAM sequence: TTT
gttgcagttgcttttggtgt

SEQ ID NO: 62555 - DNA, 20 bp, Artificial Sequence
  Description of Artificial Sequence: Synthetic oligonucleotide
  Target: SCN9A; (-) strand; PAM type: YTN; PAM sequence: TTT
tgttgcagttgcttttggtg

SEQ ID NO: 62556 - DNA, 20 bp, Artificial Sequence
  Description of Artificial Sequence: Synthetic oligonucleotide
  Target: SCN9A; (-) strand; PAM type: YTN; PAM sequence: TTT
ttgttgcagttgcttttggt

SEQ ID NO: 62557 - DNA, 20 bp, Artificial Sequence
  Description of Artificial Sequence: Synthetic oligonucleotide
  Target: SCN9A; (-) strand; PAM type: YTN; PAM sequence: TTG
tttttgttgcagttgctttt

SEQ ID NO: 62558 - DNA, 20 bp, Artificial Sequence
  Description of Artificial Sequence: Synthetic oligonucleotide
  Target: SCN9A; (-) strand; PAM type: YTN; PAM sequence: TTT
gtttttgttgcagttgcttt

SEQ ID NO: 62559 - DNA, 20 bp, Artificial Sequence
  Description of Artificial Sequence: Synthetic oligonucleotide
  Target: SCN9A; (-) strand; PAM type: YTN; PAM sequence: TTT
tgtttttgttgcagttgctt

SEQ ID NO: 62560 - DNA, 20 bp, Artificial Sequence
  Description of Artificial Sequence: Synthetic oligonucleotide
  Target: SCN9A; (-) strand; PAM type: YTN; PAM sequence: TTT
ttgtttttgttgcagttgct

SEQ ID NO: 62561 - DNA, 20 bp, Artificial Sequence
  Description of Artificial Sequence: Synthetic oligonucleotide
  Target: SCN9A; (-) strand; PAM type: YTN; PAM sequence: TTA
atttttgtttttgttgcagt

SEQ ID NO: 62562 - DNA, 20 bp, Artificial Sequence
  Description of Artificial Sequence: Synthetic oligonucleotide
  Target: SCN9A; (-) strand; PAM type: YTN; PAM sequence: TTG
ttaatttttgtttttgttgc

SEQ ID NO: 62563 - DNA, 20 bp, Artificial Sequence
  Description of Artificial Sequence: Synthetic oligonucleotide
  Target: SCN9A; (-) strand; PAM type: YTN; PAM sequence: TTT
gttaatttttgtttttgttg

SEQ ID NO: 62564 - DNA, 20 bp, Artificial Sequence
  Description of Artificial Sequence: Synthetic oligonucleotide
  Target: SCN9A; (-) strand; PAM type: YTN; PAM sequence: TTA
gatcccatttgttaattttt

SEQ ID NO: 62565 - DNA, 20 bp, Artificial Sequence
  Description of Artificial Sequence: Synthetic oligonucleotide
  Target: SCN9A; (-) strand; PAM type: YTN; PAM sequence: TTA
attagatcccatttgttaat

SEQ ID NO: 62566 - DNA, 20 bp, Artificial Sequence
  Description of Artificial Sequence: Synthetic oligonucleotide
  Target: SCN9A; (-) strand; PAM type: YTN; PAM sequence: TTT
aattagatcccatttgttaa

SEQ ID NO: 62567 - DNA, 20 bp, Artificial Sequence
  Description of Artificial Sequence: Synthetic oligonucleotide
  Target: SCN9A; (-) strand; PAM type: YTN; PAM sequence: TTA
gtttaattagatcccatttg

SEQ ID NO: 62568 - DNA, 20 bp, Artificial Sequence
  Description of Artificial Sequence: Synthetic oligonucleotide
  Target: SCN9A; (-) strand; PAM type: YTN; PAM sequence: TTT
agtttaattagatcccattt

SEQ ID NO: 62569 - DNA, 20 bp, Artificial Sequence
  Description of Artificial Sequence: Synthetic oligonucleotide
  Target: SCN9A; (-) strand; PAM type: YTN; PAM sequence: CTT
tagtttaattagatcccatt

SEQ ID NO: 62570 - DNA, 20 bp, Artificial Sequence
  Description of Artificial Sequence: Synthetic oligonucleotide
  Target: SCN9A; (-) strand; PAM type: YTN; PAM sequence: CTC
tttagtttaattagatccca

SEQ ID NO: 62571 - DNA, 20 bp, Artificial Sequence
  Description of Artificial Sequence: Synthetic oligonucleotide
  Target: SCN9A; (-) strand; PAM type: YTN; PAM sequence: CTG
tgcagaagctctttagttta

SEQ ID NO: 62572 - DNA, 20 bp, Artificial Sequence
  Description of Artificial Sequence: Synthetic oligonucleotide
  Target: SCN9A; (-) strand; PAM type: YTN; PAM sequence: TTG
ctgtgcagaagctctttagt

SEQ ID NO: 62573 - DNA, 20 bp, Artificial Sequence
  Description of Artificial Sequence: Synthetic oligonucleotide
  Target: SCN9A; (-) strand; PAM type: YTN; PAM sequence: TTT
gctgtgcagaagctctttag

SEQ ID NO: 62574 - DNA, 20 bp, Artificial Sequence
  Description of Artificial Sequence: Synthetic oligonucleotide
  Target: SCN9A; (-) strand; PAM type: YTN; PAM sequence: TTT
tgctgtgcagaagctcttta

SEQ ID NO: 62575 - DNA, 20 bp, Artificial Sequence
  Description of Artificial Sequence: Synthetic oligonucleotide
  Target: SCN9A; (-) strand; PAM type: YTN; PAM sequence: CTT
ttgctgtgcagaagctcttt

SEQ ID NO: 62576 - DNA, 20 bp, Artificial Sequence
  Description of Artificial Sequence: Synthetic oligonucleotide
  Target: SCN9A; (-) strand; PAM type: YTN; PAM sequence: TTC
ttttgctgtgcagaagctct

SEQ ID NO: 62577 - DNA, 20 bp, Artificial Sequence
  Description of Artificial Sequence: Synthetic oligonucleotide
  Target: SCN9A; (-) strand; PAM type: YTN; PAM sequence: TTT
cttttgctgtgcagaagctc

SEQ ID NO: 62578 - DNA, 20 bp, Artificial Sequence
  Description of Artificial Sequence: Synthetic oligonucleotide
  Target: SCN9A; (-) strand; PAM type: YTN; PAM sequence: TTG
atagtttcttttgctgtgca

SEQ ID NO: 62579 - DNA, 20 bp, Artificial Sequence
  Description of Artificial Sequence: Synthetic oligonucleotide
  Target: SCN9A; (-) strand; PAM type: YTN; PAM sequence: CTG
ttgatagtttcttttgctgt

SEQ ID NO: 62580 - DNA, 20 bp, Artificial Sequence
  Description of Artificial Sequence: Synthetic oligonucleotide
  Target: SCN9A; (-) strand; PAM type: YTN; PAM sequence: CTC
tgttgatagtttcttttgct

SEQ ID NO: 62581 - DNA, 20 bp, Artificial Sequence
  Description of Artificial Sequence: Synthetic oligonucleotide
  Target: SCN9A; (-) strand; PAM type: YTN; PAM sequence: TTA
ctctgttgatagtttctttt

SEQ ID NO: 62582 - DNA, 20 bp, Artificial Sequence
  Description of Artificial Sequence: Synthetic oligonucleotide
  Target: SCN9A; (-) strand; PAM type: YTN; PAM sequence: CTT
actctgttgatagtttcttt

SEQ ID NO: 62583 - DNA, 20 bp, Artificial Sequence
  Description of Artificial Sequence: Synthetic oligonucleotide
  Target: SCN9A; (-) strand; PAM type: YTN; PAM sequence: CTG
cttactctgttgatagtttc

SEQ ID NO: 62584 - DNA, 20 bp, Artificial Sequence
  Description of Artificial Sequence: Synthetic oligonucleotide
  Target: SCN9A; (-) strand; PAM type: YTN; PAM sequence: CTG
tctgcttactctgttgatag

SEQ ID NO: 62585 - DNA, 20 bp, Artificial Sequence
  Description of Artificial Sequence: Synthetic oligonucleotide
  Target: SCN9A; (-) strand; PAM type: YTN; PAM sequence: CTG
tagactgtctgcttactctg

SEQ ID NO: 62586 - DNA, 20 bp, Artificial Sequence
  Description of Artificial Sequence: Synthetic oligonucleotide
  Target: SCN9A; (-) strand; PAM type: YTN; PAM sequence: TTC
tgtagactgtctgcttactc

SEQ ID NO: 62587 - DNA, 20 bp, Artificial Sequence
  Description of Artificial Sequence: Synthetic oligonucleotide
  Target: SCN9A; (-) strand; PAM type: YTN; PAM sequence: CTC
ccattctgtagactgtctgc

SEQ ID NO: 62588 - DNA, 20 bp, Artificial Sequence
  Description of Artificial Sequence: Synthetic oligonucleotide
  Target: SCN9A; (-) strand; PAM type: YTN; PAM sequence: TTC
tcccattctgtagactgtct

SEQ ID NO: 62589 - DNA, 20 bp, Artificial Sequence
  Description of Artificial Sequence: Synthetic oligonucleotide
  Target: SCN9A; (-) strand; PAM type: YTN; PAM sequence: TTT
ctcccattctgtagactgtc

SEQ ID NO: 62590 - DNA, 20 bp, Artificial Sequence
  Description of Artificial Sequence: Synthetic oligonucleotide
  Target: SCN9A; (-) strand; PAM type: YTN; PAM sequence: TTT
tctcccattctgtagactgt

SEQ ID NO: 62591 - DNA, 20 bp, Artificial Sequence
  Description of Artificial Sequence: Synthetic oligonucleotide
  Target: SCN9A; (-) strand; PAM type: YTN; PAM sequence: CTG
caaaaattttctcccattct

SEQ ID NO: 62592 - DNA, 20 bp, Artificial Sequence
  Description of Artificial Sequence: Synthetic oligonucleotide
  Target: SCN9A; (-) strand; PAM type: YTN; PAM sequence: TTG
tcagatgcatagtctgcaaa

SEQ ID NO: 62593 - DNA, 20 bp, Artificial Sequence
  Description of Artificial Sequence: Synthetic oligonucleotide
  Target: SCN9A; (-) strand; PAM type: YTN; PAM sequence: TTT
gtcagatgcatagtctgcaa

SEQ ID NO: 62594 - DNA, 20 bp, Artificial Sequence
  Description of Artificial Sequence: Synthetic oligonucleotide
  Target: SCN9A; (-) strand; PAM type: YTN; PAM sequence: CTT
tgtcagatgcatagtctgca

SEQ ID NO: 62595 - DNA, 20 bp, Artificial Sequence
  Description of Artificial Sequence: Synthetic oligonucleotide
  Target: SCN9A; (-) strand; PAM type: YTN; PAM sequence: TTA
gacctttgtcagatgcatag

SEQ ID NO: 62596 - DNA, 20 bp, Artificial Sequence
  Description of Artificial Sequence: Synthetic oligonucleotide
  Target: SCN9A; (-) strand; PAM type: YTN; PAM sequence: CTG
gatattagacctttgtcaga

SEQ ID NO: 62597 - DNA, 20 bp, Artificial Sequence
  Description of Artificial Sequence: Synthetic oligonucleotide
  Target: SCN9A; (-) strand; PAM type: YTN; PAM sequence: TTC
tggatattagacctttgtca

SEQ ID NO: 62598 - DNA, 20 bp, Artificial Sequence
  Description of Artificial Sequence: Synthetic oligonucleotide
  Target: SCN9A; (-) strand; PAM type: YTN; PAM sequence: TTA
tagattctggatattagacc

SEQ ID NO: 62599 - DNA, 20 bp, Artificial Sequence
  Description of Artificial Sequence: Synthetic oligonucleotide
  Target: SCN9A; (-) strand; PAM type: YTN; PAM sequence: CTT
atagattctggatattagac

SEQ ID NO: 62600 - DNA, 20 bp, Artificial Sequence
  Description of Artificial Sequence: Synthetic oligonucleotide
  Target: SCN9A; (-) strand; PAM type: YTN; PAM sequence: TTC
cttatagattctggatatta

SEQ ID NO: 62601 - DNA, 20 bp, Artificial Sequence
  Description of Artificial Sequence: Synthetic oligonucleotide
  Target: SCN9A; (-) strand; PAM type: YTN; PAM sequence: TTA
agttccttatagattctgga

SEQ ID NO: 62602 - DNA, 20 bp, Artificial Sequence
  Description of Artificial Sequence: Synthetic oligonucleotide
  Target: SCN9A; (-) strand; PAM type: YTN; PAM sequence: TTT
aagttccttatagattctgg

SEQ ID NO: 62603 - DNA, 20 bp, Artificial Sequence
  Description of Artificial Sequence: Synthetic oligonucleotide
  Target: SCN9A; (-) strand; PAM type: YTN; PAM sequence: CTC
atttaagttccttatagatt

SEQ ID NO: 62604 - DNA, 20 bp, Artificial Sequence
  Description of Artificial Sequence: Synthetic oligonucleotide
  Target: SCN9A; (-) strand; PAM type: YTN; PAM sequence: TTG
taaactcatttaagttcctt

SEQ ID NO: 62605 - DNA, 20 bp, Artificial Sequence
  Description of Artificial Sequence: Synthetic oligonucleotide
  Target: SCN9A; (-) strand; PAM type: YTN; PAM sequence: CTT
gtaaactcatttaagttcct

SEQ ID NO: 62606 - DNA, 20 bp, Artificial Sequence
  Description of Artificial Sequence: Synthetic oligonucleotide
  Target: SCN9A; (-) strand; PAM type: YTN; PAM sequence: TTC
ttgtaaactcatttaagttc

SEQ ID NO: 62607 - DNA, 20 bp, Artificial Sequence
  Description of Artificial Sequence: Synthetic oligonucleotide
  Target: SCN9A; (-) strand; PAM type: YTN; PAM sequence: TTT
cttgtaaactcatttaagtt

SEQ ID NO: 62608 - DNA, 20 bp, Artificial Sequence
  Description of Artificial Sequence: Synthetic oligonucleotide
  Target: SCN9A; (-) strand; PAM type: YTN; PAM sequence: TTA
tttcttgtaaactcatttaa

SEQ ID NO: 62609 - DNA, 20 bp, Artificial Sequence
  Description of Artificial Sequence: Synthetic oligonucleotide
  Target: SCN9A; (-) strand; PAM type: YTN; PAM sequence: TTT
atttcttgtaaactcattta

SEQ ID NO: 62610 - DNA, 20 bp, Artificial Sequence
  Description of Artificial Sequence: Synthetic oligonucleotide
  Target: SCN9A; (-) strand; PAM type: YTN; PAM sequence: TTG
tttatttcttgtaaactcat

SEQ ID NO: 62611 - DNA, 20 bp, Artificial Sequence
  Description of Artificial Sequence: Synthetic oligonucleotide
  Target: SCN9A; (-) strand; PAM type: YTN; PAM sequence: TTA
atggggttgtttatttcttg

SEQ ID NO: 62612 - DNA, 20 bp, Artificial Sequence
  Description of Artificial Sequence: Synthetic oligonucleotide
  Target: SCN9A; (-) strand; PAM type: YTN; PAM sequence: TTT
aatggggttgtttatttctt

SEQ ID NO: 62613 - DNA, 20 bp, Artificial Sequence
  Description of Artificial Sequence: Synthetic oligonucleotide
  Target: SCN9A; (-) strand; PAM type: YTN; PAM sequence: TTT
taatggggttgtttatttct

SEQ ID NO: 62614 - DNA, 20 bp, Artificial Sequence
  Description of Artificial Sequence: Synthetic oligonucleotide
  Target: SCN9A; (-) strand; PAM type: YTN; PAM sequence: TTT
ttaatggggttgtttatttc

SEQ ID NO: 62615 - DNA, 20 bp, Artificial Sequence
  Description of Artificial Sequence: Synthetic oligonucleotide
  Target: SCN9A; (-) strand; PAM type: YTN; PAM sequence: CTT
tttaatggggttgtttattt

SEQ ID NO: 62616 - DNA, 20 bp, Artificial Sequence
  Description of Artificial Sequence: Synthetic oligonucleotide
  Target: SCN9A; (-) strand; PAM type: YTN; PAM sequence: TTG
cccactttttaatggggttg

SEQ ID NO: 62617 - DNA, 20 bp, Artificial Sequence
  Description of Artificial Sequence: Synthetic oligonucleotide
  Target: SCN9A; (-) strand; PAM type: YTN; PAM sequence: TTT
gcccactttttaatggggtt

SEQ ID NO: 62618 - DNA, 20 bp, Artificial Sequence
  Description of Artificial Sequence: Synthetic oligonucleotide
  Target: SCN9A; (-) strand; PAM type: YTN; PAM sequence: CTT
tgcccactttttaatggggt

SEQ ID NO: 62619 - DNA, 20 bp, Artificial Sequence
  Description of Artificial Sequence: Synthetic oligonucleotide
  Target: SCN9A; (-) strand; PAM type: YTN; PAM sequence: TTC
atatcctttgcccacttttt

SEQ ID NO: 62620 - DNA, 20 bp, Artificial Sequence
  Description of Artificial Sequence: Synthetic oligonucleotide
  Target: SCN9A; (-) strand; PAM type: YTN; PAM sequence: CTG
ttcatatcctttgcccactt

SEQ ID NO: 62621 - DNA, 20 bp, Artificial Sequence
  Description of Artificial Sequence: Synthetic oligonucleotide
  Target: SCN9A; (-) strand; PAM type: YTN; PAM sequence: TTC
agaagtgtctgttcatatcc

SEQ ID NO: 62622 - DNA, 20 bp, Artificial Sequence
  Description of Artificial Sequence: Synthetic oligonucleotide
  Target: SCN9A; (-) strand; PAM type: YTN; PAM sequence: TTT
cagaagtgtctgttcatatc

SEQ ID NO: 62623 - DNA, 20 bp, Artificial Sequence
  Description of Artificial Sequence: Synthetic oligonucleotide
  Target: SCN9A; (-) strand; PAM type: YTN; PAM sequence: TTT
tcagaagtgtctgttcatat

SEQ ID NO: 62624 - DNA, 20 bp, Artificial Sequence
  Description of Artificial Sequence: Synthetic oligonucleotide
  Target: SCN9A; (-) strand; PAM type: YTN; PAM sequence: CTT
ttcagaagtgtctgttcata

SEQ ID NO: 62625 - DNA, 20 bp, Artificial Sequence
  Description of Artificial Sequence: Synthetic oligonucleotide
  Target: SCN9A; (-) strand; PAM type: YTN; PAM sequence: TTC
ttttcagaagtgtctgttca

SEQ ID NO: 62626 - DNA, 20 bp, Artificial Sequence
  Description of Artificial Sequence: Synthetic oligonucleotide
  Target: SCN9A; (-) strand; PAM type: YTN; PAM sequence: CTT
cttttcagaagtgtctgttc

SEQ ID NO: 62627 - DNA, 20 bp, Artificial Sequence
  Description of Artificial Sequence: Synthetic oligonucleotide
  Target: SCN9A; (-) strand; PAM type: YTN; PAM sequence: TTG
catgtgtgtcttcttttcag

SEQ ID NO: 62628 - DNA, 20 bp, Artificial Sequence
  Description of Artificial Sequence: Synthetic oligonucleotide
  Target: SCN9A; (-) strand; PAM type: YTN; PAM sequence: TTG
ttgcatgtgtgtcttctttt

SEQ ID NO: 62629 - DNA, 20 bp, Artificial Sequence
  Description of Artificial Sequence: Synthetic oligonucleotide
  Target: SCN9A; (-) strand; PAM type: YTN; PAM sequence: TTT
gttgcatgtgtgtcttcttt

SEQ ID NO: 62630 - DNA, 20 bp, Artificial Sequence
  Description of Artificial Sequence: Synthetic oligonucleotide
  Target: SCN9A; (-) strand; PAM type: YTN; PAM sequence: TTG
tttgttgcatgtgtgtcttc

SEQ ID NO: 62631 - DNA, 20 bp, Artificial Sequence
  Description of Artificial Sequence: Synthetic oligonucleotide
  Target: SCN9A; (-) strand; PAM type: YTN; PAM sequence: CTT
gtttgttgcatgtgtgtctt

SEQ ID NO: 62632 - DNA, 20 bp, Artificial Sequence
  Description of Artificial Sequence: Synthetic oligonucleotide
  Target: SCN9A; (-) strand; PAM type: YTN; PAM sequence: TTC
atatgcttgtttgttgcatg

SEQ ID NO: 62633 - DNA, 20 bp, Artificial Sequence
  Description of Artificial Sequence: Synthetic oligonucleotide
  Target: SCN9A; (-) strand; PAM type: YTN; PAM sequence: TTT
catatgcttgtttgttgcat

SEQ ID NO: 62634 - DNA, 20 bp, Artificial Sequence
  Description of Artificial Sequence: Synthetic oligonucleotide
  Target: SCN9A; (-) strand; PAM type: YTN; PAM sequence: TTT
tcatatgcttgtttgttgca

SEQ ID NO: 62635 - DNA, 20 bp, Artificial Sequence
  Description of Artificial Sequence: Synthetic oligonucleotide
  Target: SCN9A; (-) strand; PAM type: YTN; PAM sequence: TTT
ttcatatgcttgtttgttgc

SEQ ID NO: 62636 - DNA, 20 bp, Artificial Sequence
  Description of Artificial Sequence: Synthetic oligonucleotide
  Target: SCN9A; (-) strand; PAM type: YTN; PAM sequence: TTT
tttcatatgcttgtttgttg

SEQ ID NO: 62637 - DNA, 20 bp, Artificial Sequence
  Description of Artificial Sequence: Synthetic oligonucleotide
  Target: SCN9A; (-) strand; PAM type: YTN; PAM sequence: TTT
ttttcatatgcttgtttgtt

SEQ ID NO: 62638 - DNA, 20 bp, Artificial Sequence
  Description of Artificial Sequence: Synthetic oligonucleotide
  Target: SCN9A; (-) strand; PAM type: YTN; PAM sequence: CTT
tttttcatatgcttgtttgt

SEQ ID NO: 62639 - DNA, 20 bp, Artificial Sequence
  Description of Artificial Sequence: Synthetic oligonucleotide
  Target: SCN9A; (-) strand; PAM type: YTN; PAM sequence: TTG
agctttttttcatatgcttg

SEQ ID NO: 62640 - DNA, 20 bp, Artificial Sequence
  Description of Artificial Sequence: Synthetic oligonucleotide
  Target: SCN9A; (-) strand; PAM type: YTN; PAM sequence: CTA
atggtcagtgacattgagct

SEQ ID NO: 62641 - DNA, 20 bp, Artificial Sequence
  Description of Artificial Sequence: Synthetic oligonucleotide
  Target: SCN9A; (-) strand; PAM type: YTN; PAM sequence: CTC
taatggtcagtgacattgag

SEQ ID NO: 62642 - DNA, 20 bp, Artificial Sequence
  Description of Artificial Sequence: Synthetic oligonucleotide
  Target: SCN9A; (-) strand; PAM type: YTN; PAM sequence: TTC
tctaatggtcagtgacattg

SEQ ID NO: 62643 - DNA, 20 bp, Artificial Sequence
  Description of Artificial Sequence: Synthetic oligonucleotide
  Target: SCN9A; (-) strand; PAM type: YTN; PAM sequence: TTT
ctctaatggtcagtgacatt

SEQ ID NO: 62644 - DNA, 20 bp, Artificial Sequence
  Description of Artificial Sequence: Synthetic oligonucleotide
  Target: SCN9A; (-) strand; PAM type: YTN; PAM sequence: TTG
catttctctaatggtcagtg

SEQ ID NO: 62645 - DNA, 20 bp, Artificial Sequence
  Description of Artificial Sequence: Synthetic oligonucleotide
  Target: SCN9A; (-) strand; PAM type: YTN; PAM sequence: TTT
gcatttctctaatggtcagt

SEQ ID NO: 62646 - DNA, 20 bp, Artificial Sequence
  Description of Artificial Sequence: Synthetic oligonucleotide
  Target: SCN9A; (-) strand; PAM type: YTN; PAM sequence: TTG
atttgcatttctctaatggt

SEQ ID NO: 62647 - DNA, 20 bp, Artificial Sequence
  Description of Artificial Sequence: Synthetic oligonucleotide
  Target: SCN9A; (-) strand; PAM type: YTN; PAM sequence: TTT
gatttgcatttctctaatgg

SEQ ID NO: 62648 - DNA, 20 bp, Artificial Sequence
  Description of Artificial Sequence: Synthetic oligonucleotide
  Target: SCN9A; (-) strand; PAM type: YTN; PAM sequence: TTT
tgatttgcatttctctaatg

SEQ ID NO: 62649 - DNA, 20 bp, Artificial Sequence
  Description of Artificial Sequence: Synthetic oligonucleotide
  Target: SCN9A; (-) strand; PAM type: YTN; PAM sequence: TTG
tggttttgatttgcatttct

SEQ ID NO: 62650 - DNA, 20 bp, Artificial Sequence
  Description of Artificial Sequence: Synthetic oligonucleotide
  Target: SCN9A; (-) strand; PAM type: YTN; PAM sequence: CTC
attgtggttttgatttgcat

SEQ ID NO: 62651 - DNA, 20 bp, Artificial Sequence
  Description of Artificial Sequence: Synthetic oligonucleotide
  Target: SCN9A; (-) strand; PAM type: YTN; PAM sequence: CTG
gtgtgagatggtatctcatt

SEQ ID NO: 62652 - DNA, 20 bp, Artificial Sequence
  Description of Artificial Sequence: Synthetic oligonucleotide
  Target: SCN9A; (-) strand; PAM type: YTN; PAM sequence: CTG
actggtgtgagatggtatct

SEQ ID NO: 62653 - DNA, 20 bp, Artificial Sequence
  Description of Artificial Sequence: Synthetic oligonucleotide
  Target: SCN9A; (-) strand; PAM type: YTN; PAM sequence: TTC
tgactggtgtgagatggtat

SEQ ID NO: 62654 - DNA, 20 bp, Artificial Sequence
  Description of Artificial Sequence: Synthetic oligonucleotide
  Target: SCN9A; (-) strand; PAM type: YTN; PAM sequence: TTC
ataatagccattctgactgg

SEQ ID NO: 62655 - DNA, 20 bp, Artificial Sequence
  Description of Artificial Sequence: Synthetic oligonucleotide
  Target: SCN9A; (-) strand; PAM type: YTN; PAM sequence: TTT
cataatagccattctgactg

SEQ ID NO: 62656 - DNA, 20 bp, Artificial Sequence
  Description of Artificial Sequence: Synthetic oligonucleotide
  Target: SCN9A; (-) strand; PAM type: YTN; PAM sequence: TTT
tcataatagccattctgact

SEQ ID NO: 62657 - DNA, 20 bp, Artificial Sequence
  Description of Artificial Sequence: Synthetic oligonucleotide
  Target: SCN9A; (-) strand; PAM type: YTN; PAM sequence: TTT
ttcataatagccattctgac

SEQ ID NO: 62658 - DNA, 20 bp, Artificial Sequence
  Description of Artificial Sequence: Synthetic oligonucleotide
  Target: SCN9A; (-) strand; PAM type: YTN; PAM sequence: CTT
tttcataatagccattctga

SEQ ID NO: 62659 - DNA, 20 bp, Artificial Sequence
  Description of Artificial Sequence: Synthetic oligonucleotide
  Target: SCN9A; (-) strand; PAM type: YTN; PAM sequence: TTG
actttttcataatagccatt

SEQ ID NO: 62660 - DNA, 20 bp, Artificial Sequence
  Description of Artificial Sequence: Synthetic oligonucleotide
  Target: SCN9A; (-) strand; PAM type: YTN; PAM sequence: TTT
gactttttcataatagccat

SEQ ID NO: 62661 - DNA, 20 bp, Artificial Sequence
  Description of Artificial Sequence: Synthetic oligonucleotide
  Target: SCN9A; (-) strand; PAM type: YTN; PAM sequence: TTT
tgactttttcataatagcca

SEQ ID NO: 62662 - DNA, 20 bp, Artificial Sequence
  Description of Artificial Sequence: Synthetic oligonucleotide
  Target: SCN9A; (-) strand; PAM type: YTN; PAM sequence: TTT
ttgactttttcataatagcc

SEQ ID NO: 62663 - DNA, 20 bp, Artificial Sequence
  Description of Artificial Sequence: Synthetic oligonucleotide
  Target: SCN9A; (-) strand; PAM type: YTN; PAM sequence: TTT
tttgactttttcataatagc

SEQ ID NO: 62664 - DNA, 20 bp, Artificial Sequence
  Description of Artificial Sequence: Synthetic oligonucleotide
  Target: SCN9A; (-) strand; PAM type: YTN; PAM sequence: TTA
ttttttgactttttcataat

SEQ ID NO: 62665 - DNA, 20 bp, Artificial Sequence
  Description of Artificial Sequence: Synthetic oligonucleotide
  Target: SCN9A; (-) strand; PAM type: YTN; PAM sequence: CTG
ttattttttgactttttcat

SEQ ID NO: 62666 - DNA, 20 bp, Artificial Sequence
  Description of Artificial Sequence: Synthetic oligonucleotide
  Target: SCN9A; (-) strand; PAM type: YTN; PAM sequence: CTC
gccagcatctgttatttttt

SEQ ID NO: 62667 - DNA, 20 bp, Artificial Sequence
  Description of Artificial Sequence: Synthetic oligonucleotide
  Target: SCN9A; (-) strand; PAM type: YTN; PAM sequence: CTC
cacaccctcgccagcatctg

SEQ ID NO: 62668 - DNA, 20 bp, Artificial Sequence
  Description of Artificial Sequence: Synthetic oligonucleotide
  Target: SCN9A; (-) strand; PAM type: YTN; PAM sequence: TTC
tccacaccctcgccagcatc

SEQ ID NO: 62669 - DNA, 20 bp, Artificial Sequence
  Description of Artificial Sequence: Synthetic oligonucleotide
  Target: SCN9A; (-) strand; PAM type: YTN; PAM sequence: TTT
ctccacaccctcgccagcat

SEQ ID NO: 62670 - DNA, 20 bp, Artificial Sequence
  Description of Artificial Sequence: Synthetic oligonucleotide
  Target: SCN9A; (-) strand; PAM type: YTN; PAM sequence: TTT
tctccacaccctcgccagca

SEQ ID NO: 62671 - DNA, 20 bp, Artificial Sequence
  Description of Artificial Sequence: Synthetic oligonucleotide
  Target: SCN9A; (-) strand; PAM type: YTN; PAM sequence: TTT
ttctccacaccctcgccagc

SEQ ID NO: 62672 - DNA, 20 bp, Artificial Sequence
  Description of Artificial Sequence: Synthetic oligonucleotide
  Target: SCN9A; (-) strand; PAM type: YTN; PAM sequence: TTT
tttctccacaccctcgccag

SEQ ID NO: 62673 - DNA, 20 bp, Artificial Sequence
  Description of Artificial Sequence: Synthetic oligonucleotide
  Target: SCN9A; (-) strand; PAM type: YTN; PAM sequence: TTT
ttttctccacaccctcgcca

SEQ ID NO: 62674 - DNA, 20 bp, Artificial Sequence
  Description of Artificial Sequence: Synthetic oligonucleotide
  Target: SCN9A; (-) strand; PAM type: YTN; PAM sequence: CTT
tttttctccacaccctcgcc

SEQ ID NO: 62675 - DNA, 20 bp, Artificial Sequence
  Description of Artificial Sequence: Synthetic oligonucleotide
  Target: SCN9A; (-) strand; PAM type: YTN; PAM sequence: TTC
tttttttctccacaccctcg

SEQ ID NO: 62676 - DNA, 20 bp, Artificial Sequence
  Description of Artificial Sequence: Synthetic oligonucleotide
  Target: SCN9A; (-) strand; PAM type: YTN; PAM sequence: CTC
ccatcaacagtgtgtaggca

SEQ ID NO: 62677 - DNA, 20 bp, Artificial Sequence
  Description of Artificial Sequence: Synthetic oligonucleotide
  Target: SCN9A; (-) strand; PAM type: YTN; PAM sequence: TTA
cactcccatcaacagtgtgt

SEQ ID NO: 62678 - DNA, 20 bp, Artificial Sequence
  Description of Artificial Sequence: Synthetic oligonucleotide
  Target: SCN9A; (-) strand; PAM type: YTN; PAM sequence: TTT
acactcccatcaacagtgtg

SEQ ID NO: 62679 - DNA, 20 bp, Artificial Sequence
  Description of Artificial Sequence: Synthetic oligonucleotide
  Target: SCN9A; (-) strand; PAM type: YTN; PAM sequence: TTA
atttacactcccatcaacag

SEQ ID NO: 62680 - DNA, 20 bp, Artificial Sequence
  Description of Artificial Sequence: Synthetic oligonucleotide
  Target: SCN9A; (-) strand; PAM type: YTN; PAM sequence: TTG
aattaatttacactcccatc

SEQ ID NO: 62681 - DNA, 20 bp, Artificial Sequence
  Description of Artificial Sequence: Synthetic oligonucleotide
  Target: SCN9A; (-) strand; PAM type: YTN; PAM sequence: TTA
tggttgaattaatttacact

SEQ ID NO: 62682 - DNA, 20 bp, Artificial Sequence
  Description of Artificial Sequence: Synthetic oligonucleotide
  Target: SCN9A; (-) strand; PAM type: YTN; PAM sequence: TTC
cattatggttgaattaattt

SEQ ID NO: 62683 - DNA, 20 bp, Artificial Sequence
  Description of Artificial Sequence: Synthetic oligonucleotide
  Target: SCN9A; (-) strand; PAM type: YTN; PAM sequence: CTT
ccattatggttgaattaatt

SEQ ID NO: 62684 - DNA, 20 bp, Artificial Sequence
  Description of Artificial Sequence: Synthetic oligonucleotide
  Target: SCN9A; (-) strand; PAM type: YTN; PAM sequence: TTG
ccacacagtcttccattatg

SEQ ID NO: 62685 - DNA, 20 bp, Artificial Sequence
  Description of Artificial Sequence: Synthetic oligonucleotide
  Target: SCN9A; (-) strand; PAM type: YTN; PAM sequence: TTG
aggaattgccacacagtctt

SEQ ID NO: 62686 - DNA, 20 bp, Artificial Sequence
  Description of Artificial Sequence: Synthetic oligonucleotide
  Target: SCN9A; (-) strand; PAM type: YTN; PAM sequence: TTT
gaggaattgccacacagtct

SEQ ID NO: 62687 - DNA, 20 bp, Artificial Sequence
  Description of Artificial Sequence: Synthetic oligonucleotide
  Target: SCN9A; (-) strand; PAM type: YTN; PAM sequence: CTT
tgaggaattgccacacagtc

SEQ ID NO: 62688 - DNA, 20 bp, Artificial Sequence
  Description of Artificial Sequence: Synthetic oligonucleotide
  Target: SCN9A; (-) strand; PAM type: YTN; PAM sequence: TTA
ggtctttgaggaattgccac

SEQ ID NO: 62689 - DNA, 20 bp, Artificial Sequence
  Description of Artificial Sequence: Synthetic oligonucleotide
  Target: SCN9A; (-) strand; PAM type: YTN; PAM sequence: TTT
aggtctttgaggaattgcca

SEQ ID NO: 62690 - DNA, 20 bp, Artificial Sequence
  Description of Artificial Sequence: Synthetic oligonucleotide
  Target: SCN9A; (-) strand; PAM type: YTN; PAM sequence: CTT
taggtctttgaggaattgcc

SEQ ID NO: 62691 - DNA, 20 bp, Artificial Sequence
  Description of Artificial Sequence: Synthetic oligonucleotide
  Target: SCN9A; (-) strand; PAM type: YTN; PAM sequence: CTG
tctttaggtctttgaggaat

SEQ ID NO: 62692 - DNA, 20 bp, Artificial Sequence
  Description of Artificial Sequence: Synthetic oligonucleotide
  Target: SCN9A; (-) strand; PAM type: YTN; PAM sequence: TTC
tgtctttaggtctttgagga

SEQ ID NO: 62693 - DNA, 20 bp, Artificial Sequence
  Description of Artificial Sequence: Synthetic oligonucleotide
  Target: SCN9A; (-) strand; PAM type: YTN; PAM sequence: TTT
ctgtctttaggtctttgagg

SEQ ID NO: 62694 - DNA, 20 bp, Artificial Sequence
  Description of Artificial Sequence: Synthetic oligonucleotide
  Target: SCN9A; (-) strand; PAM type: YTN; PAM sequence: TTG
aatggcatttctgtctttag

SEQ ID NO: 62695 - DNA, 20 bp, Artificial Sequence
  Description of Artificial Sequence: Synthetic oligonucleotide
  Target: SCN9A; (-) strand; PAM type: YTN; PAM sequence: CTG
ggttgaatggcatttctgtc

SEQ ID NO: 62696 - DNA, 20 bp, Artificial Sequence
  Description of Artificial Sequence: Synthetic oligonucleotide
  Target: SCN9A; (-) strand; PAM type: YTN; PAM sequence: TTG
ctgggttgaatggcatttct

SEQ ID NO: 62697 - DNA, 20 bp, Artificial Sequence
  Description of Artificial Sequence: Synthetic oligonucleotide
  Target: SCN9A; (-) strand; PAM type: YTN; PAM sequence: TTA
ggtatatacccagtaatggg

SEQ ID NO: 62698 - DNA, 20 bp, Artificial Sequence
  Description of Artificial Sequence: Synthetic oligonucleotide
  Target: SCN9A; (-) strand; PAM type: YTN; PAM sequence: TTT
aggtatatacccagtaatgg

SEQ ID NO: 62699 - DNA, 20 bp, Artificial Sequence
  Description of Artificial Sequence: Synthetic oligonucleotide
  Target: SCN9A; (-) strand; PAM type: YTN; PAM sequence: CTT
taggtatatacccagtaatg

SEQ ID NO: 62700 - DNA, 20 bp, Artificial Sequence
  Description of Artificial Sequence: Synthetic oligonucleotide
  Target: SCN9A; (-) strand; PAM type: YTN; PAM sequence: TTC
cctttaggtatatacccagt

SEQ ID NO: 62701 - DNA, 20 bp, Artificial Sequence
  Description of Artificial Sequence: Synthetic oligonucleotide
  Target: SCN9A; (-) strand; PAM type: YTN; PAM sequence: TTT
ccctttaggtatatacccag

SEQ ID NO: 62702 - DNA, 20 bp, Artificial Sequence
  Description of Artificial Sequence: Synthetic oligonucleotide
  Target: SCN9A; (-) strand; PAM type: YTN; PAM sequence: TTA
taatagaaaaatgtatttcc

SEQ ID NO: 62703 - DNA, 20 bp, Artificial Sequence
  Description of Artificial Sequence: Synthetic oligonucleotide
  Target: SCN9A; (-) strand; PAM type: YTN; PAM sequence: TTT
ataatagaaaaatgtatttc

SEQ ID NO: 62704 - DNA, 20 bp, Artificial Sequence
  Description of Artificial Sequence: Synthetic oligonucleotide
  Target: SCN9A; (-) strand; PAM type: YTN; PAM sequence: CTT
tataatagaaaaatgtattt

SEQ ID NO: 62705 - DNA, 20 bp, Artificial Sequence
  Description of Artificial Sequence: Synthetic oligonucleotide
  Target: SCN9A; (-) strand; PAM type: YTN; PAM sequence: CTC
caataaacatatgtgtgcat

SEQ ID NO: 62706 - DNA, 20 bp, Artificial Sequence
  Description of Artificial Sequence: Synthetic oligonucleotide
  Target: SCN9A; (-) strand; PAM type: YTN; PAM sequence: TTG
tgaatagtgctccaataaac

SEQ ID NO: 62707 - DNA, 20 bp, Artificial Sequence
  Description of Artificial Sequence: Synthetic oligonucleotide
  Target: SCN9A; (-) strand; PAM type: YTN; PAM sequence: TTG
ccattgtgaatagtgctcca

SEQ ID NO: 62708 - DNA, 20 bp, Artificial Sequence
  Description of Artificial Sequence: Synthetic oligonucleotide
  Target: SCN9A; (-) strand; PAM type: YTN; PAM sequence: TTT
gccattgtgaatagtgctcc

SEQ ID NO: 62709 - DNA, 20 bp, Artificial Sequence
  Description of Artificial Sequence: Synthetic oligonucleotide
  Target: SCN9A; (-) strand; PAM type: YTN; PAM sequence: CTT
tgccattgtgaatagtgctc

SEQ ID NO: 62710 - DNA, 20 bp, Artificial Sequence
  Description of Artificial Sequence: Synthetic oligonucleotide
  Target: SCN9A; (-) strand; PAM type: YTN; PAM sequence: CTA
tgtctttgccattgtgaata

SEQ ID NO: 62711 - DNA, 20 bp, Artificial Sequence
  Description of Artificial Sequence: Synthetic oligonucleotide
  Target: SCN9A; (-) strand; PAM type: YTN; PAM sequence: TTC
tatgtctttgccattgtgaa

SEQ ID NO: 62712 - DNA, 20 bp, Artificial Sequence
  Description of Artificial Sequence: Synthetic oligonucleotide
  Target: SCN9A; (-) strand; PAM type: YTN; PAM sequence: TTG
attctatgtctttgccattg

SEQ ID NO: 62713 - DNA, 20 bp, Artificial Sequence
  Description of Artificial Sequence: Synthetic oligonucleotide
  Target: SCN9A; (-) strand; PAM type: YTN; PAM sequence: TTG
agttgattctatgtctttgc

SEQ ID NO: 62714 - DNA, 20 bp, Artificial Sequence
  Description of Artificial Sequence: Synthetic oligonucleotide
  Target: SCN9A; (-) strand; PAM type: YTN; PAM sequence: TTT
gagttgattctatgtctttg

SEQ ID NO: 62715 - DNA, 20 bp, Artificial Sequence
  Description of Artificial Sequence: Synthetic oligonucleotide
  Target: SCN9A; (-) strand; PAM type: YTN; PAM sequence: CTG
atggtcatttgagttgattc

SEQ ID NO: 62716 - DNA, 20 bp, Artificial Sequence
  Description of Artificial Sequence: Synthetic oligonucleotide
  Target: SCN9A; (-) strand; PAM type: YTN; PAM sequence: CTA
tcactgatggtcatttgagt

SEQ ID NO: 62717 - DNA, 20 bp, Artificial Sequence
  Description of Artificial Sequence: Synthetic oligonucleotide
  Target: SCN9A; (-) strand; PAM type: YTN; PAM sequence: TTA
tccagtctatcactgatggt

SEQ ID NO: 62718 - DNA, 20 bp, Artificial Sequence
  Description of Artificial Sequence: Synthetic oligonucleotide
  Target: SCN9A; (-) strand; PAM type: YTN; PAM sequence: TTT
atccagtctatcactgatgg

SEQ ID NO: 62719 - DNA, 20 bp, Artificial Sequence
  Description of Artificial Sequence: Synthetic oligonucleotide
  Target: SCN9A; (-) strand; PAM type: YTN; PAM sequence: CTT
tatccagtctatcactgatg

SEQ ID NO: 62720 - DNA, 20 bp, Artificial Sequence
  Description of Artificial Sequence: Synthetic oligonucleotide
  Target: SCN9A; (-) strand; PAM type: YTN; PAM sequence: TTA
tctttatccagtctatcact

SEQ ID NO: 62721 - DNA, 20 bp, Artificial Sequence
  Description of Artificial Sequence: Synthetic oligonucleotide
  Target: SCN9A; (-) strand; PAM type: YTN; PAM sequence: TTA
ccacattatctttatccagt

SEQ ID NO: 62722 - DNA, 20 bp, Artificial Sequence
  Description of Artificial Sequence: Synthetic oligonucleotide
  Target: SCN9A; (-) strand; PAM type: YTN; PAM sequence: TTT
accacattatctttatccag

SEQ ID NO: 62723 - DNA, 20 bp, Artificial Sequence
  Description of Artificial Sequence: Synthetic oligonucleotide
  Target: SCN9A; (-) strand; PAM type: YTN; PAM sequence: TTA
tatggtatatatttaccaca

SEQ ID NO: 62724 - DNA, 20 bp, Artificial Sequence
  Description of Artificial Sequence: Synthetic oligonucleotide
  Target: SCN9A; (-) strand; PAM type: YTN; PAM sequence: CTG
catagtattatatggtatat

SEQ ID NO: 62725 - DNA, 20 bp, Artificial Sequence
  Description of Artificial Sequence: Synthetic oligonucleotide
  Target: SCN9A; (-) strand; PAM type: YTN; PAM sequence: TTG
aatggctgcatagtattata

SEQ ID NO: 62726 - DNA, 20 bp, Artificial Sequence
  Description of Artificial Sequence: Synthetic oligonucleotide
  Target: SCN9A; (-) strand; PAM type: YTN; PAM sequence: TTT
gaatggctgcatagtattat

SEQ ID NO: 62727 - DNA, 20 bp, Artificial Sequence
  Description of Artificial Sequence: Synthetic oligonucleotide
  Target: SCN9A; (-) strand; PAM type: YTN; PAM sequence: TTT
tgaatggctgcatagtatta

SEQ ID NO: 62728 - DNA, 20 bp, Artificial Sequence
  Description of Artificial Sequence: Synthetic oligonucleotide
  Target: SCN9A; (-) strand; PAM type: YTN; PAM sequence: TTT
ttgaatggctgcatagtatt

SEQ ID NO: 62729 - DNA, 20 bp, Artificial Sequence
  Description of Artificial Sequence: Synthetic oligonucleotide
  Target: SCN9A; (-) strand; PAM type: YTN; PAM sequence: TTT
tttgaatggctgcatagtat

SEQ ID NO: 62730 - DNA, 20 bp, Artificial Sequence
  Description of Artificial Sequence: Synthetic oligonucleotide
  Target: SCN9A; (-) strand; PAM type: YTN; PAM sequence: TTT
ttttgaatggctgcatagta

SEQ ID NO: 62731 - DNA, 20 bp, Artificial Sequence
  Description of Artificial Sequence: Synthetic oligonucleotide
  Target: SCN9A; (-) strand; PAM type: YTN; PAM sequence: TTT
tttttgaatggctgcatagt

SEQ ID NO: 62732 - DNA, 20 bp, Artificial Sequence
  Description of Artificial Sequence: Synthetic oligonucleotide
  Target: SCN9A; (-) strand; PAM type: YTN; PAM sequence: TTT
ttttttgaatggctgcatag

SEQ ID NO: 62733 - DNA, 20 bp, Artificial Sequence
  Description of Artificial Sequence: Synthetic oligonucleotide
  Target: SCN9A; (-) strand; PAM type: YTN; PAM sequence: CTC
gtttttttttgaatggctgc

SEQ ID NO: 62734 - DNA, 20 bp, Artificial Sequence
  Description of Artificial Sequence: Synthetic oligonucleotide
  Target: SCN9A; (-) strand; PAM type: YTN; PAM sequence: CTG
caaaggatatgatctcgttt

SEQ ID NO: 62735 - DNA, 20 bp, Artificial Sequence
  Description of Artificial Sequence: Synthetic oligonucleotide
  Target: SCN9A; (-) strand; PAM type: YTN; PAM sequence: TTC
atgtccctgcaaaggatatg

SEQ ID NO: 62736 - DNA, 20 bp, Artificial Sequence
  Description of Artificial Sequence: Synthetic oligonucleotide
  Target: SCN9A; (-) strand; PAM type: YTN; PAM sequence: CTC
cattcatgtccctgcaaagg

SEQ ID NO: 62737 - DNA, 20 bp, Artificial Sequence
  Description of Artificial Sequence: Synthetic oligonucleotide
  Target: SCN9A; (-) strand; PAM type: YTN; PAM sequence: CTC
cagctccattcatgtccctg

SEQ ID NO: 62738 - DNA, 20 bp, Artificial Sequence
  Description of Artificial Sequence: Synthetic oligonucleotide
  Target: SCN9A; (-) strand; PAM type: YTN; PAM sequence: CTA
atgaaaatggcctccagctc

SEQ ID NO: 62739 - DNA, 20 bp, Artificial Sequence
  Description of Artificial Sequence: Synthetic oligonucleotide
  Target: SCN9A; (-) strand; PAM type: YTN; PAM sequence: TTA
ctaatgaaaatggcctccag

SEQ ID NO: 62740 - DNA, 20 bp, Artificial Sequence
  Description of Artificial Sequence: Synthetic oligonucleotide
  Target: SCN9A; (-) strand; PAM type: YTN; PAM sequence: TTT
actaatgaaaatggcctcca

SEQ ID NO: 62741 - DNA, 20 bp, Artificial Sequence
  Description of Artificial Sequence: Synthetic oligonucleotide
  Target: SCN9A; (-) strand; PAM type: YTN; PAM sequence: TTA
gtttactaatgaaaatggcc

SEQ ID NO: 62742 - DNA, 20 bp, Artificial Sequence
  Description of Artificial Sequence: Synthetic oligonucleotide
  Target: SCN9A; (-) strand; PAM type: YTN; PAM sequence: CTT
agtttactaatgaaaatggc

SEQ ID NO: 62743 - DNA, 20 bp, Artificial Sequence
  Description of Artificial Sequence: Synthetic oligonucleotide
  Target: SCN9A; (-) strand; PAM type: YTN; PAM sequence: CTG
ccttagtttactaatgaaaa

SEQ ID NO: 62744 - DNA, 20 bp, Artificial Sequence
  Description of Artificial Sequence: Synthetic oligonucleotide
  Target: SCN9A; (-) strand; PAM type: YTN; PAM sequence: TTC
ctgccttagtttactaatga

SEQ ID NO: 62745 - DNA, 20 bp, Artificial Sequence
  Description of Artificial Sequence: Synthetic oligonucleotide
  Target: SCN9A; (-) strand; PAM type: YTN; PAM sequence: CTG
ttcctgccttagtttactaa

SEQ ID NO: 62746 - DNA, 20 bp, Artificial Sequence
  Description of Artificial Sequence: Synthetic oligonucleotide
  Target: SCN9A; (-) strand; PAM type: YTN; PAM sequence: TTC
tgttcctgccttagtttact

SEQ ID NO: 62747 - DNA, 20 bp, Artificial Sequence
  Description of Artificial Sequence: Synthetic oligonucleotide
  Target: SCN9A; (-) strand; PAM type: YTN; PAM sequence: TTT
ctgttcctgccttagtttac

SEQ ID NO: 62748 - DNA, 20 bp, Artificial Sequence
  Description of Artificial Sequence: Synthetic oligonucleotide
  Target: SCN9A; (-) strand; PAM type: YTN; PAM sequence: TTT
tctgttcctgccttagttta

SEQ ID NO: 62749 - DNA, 20 bp, Artificial Sequence
  Description of Artificial Sequence: Synthetic oligonucleotide
  Target: SCN9A; (-) strand; PAM type: YTN; PAM sequence: TTG
gttttctgttcctgccttag

SEQ ID NO: 62750 - DNA, 20 bp, Artificial Sequence
  Description of Artificial Sequence: Synthetic oligonucleotide
  Target: SCN9A; (-) strand; PAM type: YTN; PAM sequence: TTT
ggttttctgttcctgcctta

SEQ ID NO: 62751 - DNA, 20 bp, Artificial Sequence
  Description of Artificial Sequence: Synthetic oligonucleotide
  Target: SCN9A; (-) strand; PAM type: YTN; PAM sequence: TTA
taagtgagaacatgtggtat

SEQ ID NO: 62752 - DNA, 20 bp, Artificial Sequence
  Description of Artificial Sequence: Synthetic oligonucleotide
  Target: SCN9A; (-) strand; PAM type: YTN; PAM sequence: CTT
ataagtgagaacatgtggta

SEQ ID NO: 62753 - DNA, 20 bp, Artificial Sequence
  Description of Artificial Sequence: Synthetic oligonucleotide
  Target: SCN9A; (-) strand; PAM type: YTN; PAM sequence: CTC
ccacttataagtgagaacat

SEQ ID NO: 62754 - DNA, 20 bp, Artificial Sequence
  Description of Artificial Sequence: Synthetic oligonucleotide
  Target: SCN9A; (-) strand; PAM type: YTN; PAM sequence: TTA
gctcccacttataagtgaga

SEQ ID NO: 62755 - DNA, 20 bp, Artificial Sequence
  Description of Artificial Sequence: Synthetic oligonucleotide
  Target: SCN9A; (-) strand; PAM type: YTN; PAM sequence: TTT
agctcccacttataagtgag

SEQ ID NO: 62756 - DNA, 20 bp, Artificial Sequence
  Description of Artificial Sequence: Synthetic oligonucleotide
  Target: SCN9A; (-) strand; PAM type: YTN; PAM sequence: CTC
atcatttagctcccacttat

SEQ ID NO: 62757 - DNA, 20 bp, Artificial Sequence
  Description of Artificial Sequence: Synthetic oligonucleotide
  Target: SCN9A; (-) strand; PAM type: YTN; PAM sequence: TTC
tcatcatttagctcccactt

SEQ ID NO: 62758 - DNA, 20 bp, Artificial Sequence
  Description of Artificial Sequence: Synthetic oligonucleotide
  Target: SCN9A; (-) strand; PAM type: YTN; PAM sequence: TTA
tgtgtccatgtgttctcatc

SEQ ID NO: 62759 - DNA, 20 bp, Artificial Sequence
  Description of Artificial Sequence: Synthetic oligonucleotide
  Target: SCN9A; (-) strand; PAM type: YTN; PAM sequence: TTT
atgtgtccatgtgttctcat

SEQ ID NO: 62760 - DNA, 20 bp, Artificial Sequence
  Description of Artificial Sequence: Synthetic oligonucleotide
  Target: SCN9A; (-) strand; PAM type: YTN; PAM sequence: CTT
tatgtgtccatgtgttctca

SEQ ID NO: 62761 - DNA, 20 bp, Artificial Sequence
  Description of Artificial Sequence: Synthetic oligonucleotide
  Target: SCN9A; (-) strand; PAM type: YTN; PAM sequence: TTA
ccctttatgtgtccatgtgt

SEQ ID NO: 62762 - DNA, 20 bp, Artificial Sequence
  Description of Artificial Sequence: Synthetic oligonucleotide
  Target: SCN9A; (-) strand; PAM type: YTN; PAM sequence: TTG
ttaccctttatgtgtccatg

SEQ ID NO: 62763 - DNA, 20 bp, Artificial Sequence
  Description of Artificial Sequence: Synthetic oligonucleotide
  Target: SCN9A; (-) strand; PAM type: YTN; PAM sequence: CTC
ccataggccccagtgtgtgt

SEQ ID NO: 62764 - DNA, 20 bp, Artificial Sequence
  Description of Artificial Sequence: Synthetic oligonucleotide
  Target: SCN9A; (-) strand; PAM type: YTN; PAM sequence: TTC
accctcccataggccccagt

SEQ ID NO: 62765 - DNA, 20 bp, Artificial Sequence
  Description of Artificial Sequence: Synthetic oligonucleotide
  Target: SCN9A; (-) strand; PAM type: YTN; PAM sequence: CTT
caccctcccataggccccag

SEQ ID NO: 62766 - DNA, 20 bp, Artificial Sequence
  Description of Artificial Sequence: Synthetic oligonucleotide
  Target: SCN9A; (-) strand; PAM type: YTN; PAM sequence: CTC
ccacccttcaccctcccata

SEQ ID NO: 62767 - DNA, 20 bp, Artificial Sequence
  Description of Artificial Sequence: Synthetic oligonucleotide
  Target: SCN9A; (-) strand; PAM type: YTN; PAM sequence: TTC
ctcccacccttcaccctccc

SEQ ID NO: 62768 - DNA, 20 bp, Artificial Sequence
  Description of Artificial Sequence: Synthetic oligonucleotide
  Target: SCN9A; (-) strand; PAM type: YTN; PAM sequence: CTT
cctcccacccttcaccctcc

SEQ ID NO: 62769 - DNA, 20 bp, Artificial Sequence
  Description of Artificial Sequence: Synthetic oligonucleotide
  Target: SCN9A; (-) strand; PAM type: YTN; PAM sequence: CTC
cttcctcccacccttcaccc

SEQ ID NO: 62770 - DNA, 20 bp, Artificial Sequence
  Description of Artificial Sequence: Synthetic oligonucleotide
  Target: SCN9A; (-) strand; PAM type: YTN; PAM sequence: CTC
tccttcctcccacccttcac

SEQ ID NO: 62771 - DNA, 20 bp, Artificial Sequence
  Description of Artificial Sequence: Synthetic oligonucleotide
  Target: SCN9A; (-) strand; PAM type: YTN; PAM sequence: CTG
accctctccttcctcccacc

SEQ ID NO: 62772 - DNA, 20 bp, Artificial Sequence
  Description of Artificial Sequence: Synthetic oligonucleotide
  Target: SCN9A; (-) strand; PAM type: YTN; PAM sequence: TTC
ctgaccctctccttcctccc

SEQ ID NO: 62773 - DNA, 20 bp, Artificial Sequence
  Description of Artificial Sequence: Synthetic oligonucleotide
  Target: SCN9A; (-) strand; PAM type: YTN; PAM sequence: TTT
cctgaccctctccttcctcc

SEQ ID NO: 62774 - DNA, 20 bp, Artificial Sequence
  Description of Artificial Sequence: Synthetic oligonucleotide
  Target: SCN9A; (-) strand; PAM type: YTN; PAM sequence: TTT
tcctgaccctctccttcctc

SEQ ID NO: 62775 - DNA, 20 bp, Artificial Sequence
  Description of Artificial Sequence: Synthetic oligonucleotide
  Target: SCN9A; (-) strand; PAM type: YTN; PAM sequence: TTT
ttcctgaccctctccttcct

SEQ ID NO: 62776 - DNA, 20 bp, Artificial Sequence
  Description of Artificial Sequence: Synthetic oligonucleotide
  Target: SCN9A; (-) strand; PAM type: YTN; PAM sequence: TTA
tttttcctgaccctctcctt

SEQ ID NO: 62777 - DNA, 20 bp, Artificial Sequence
  Description of Artificial Sequence: Synthetic oligonucleotide
  Target: SCN9A; (-) strand; PAM type: YTN; PAM sequence: TTG
gttatttttcctgaccctct

SEQ ID NO: 62778 - DNA, 20 bp, Artificial Sequence
  Description of Artificial Sequence: Synthetic oligonucleotide
  Target: SCN9A; (-) strand; PAM type: YTN; PAM sequence: TTA
atcccagtatgcattggtta

SEQ ID NO: 62779 - DNA, 20 bp, Artificial Sequence
  Description of Artificial Sequence: Synthetic oligonucleotide
  Target: SCN9A; (-) strand; PAM type: YTN; PAM sequence: CTG
aggtattaatcccagtatgc

SEQ ID NO: 62780 - DNA, 20 bp, Artificial Sequence
  Description of Artificial Sequence: Synthetic oligonucleotide
  Target: SCN9A; (-) strand; PAM type: YTN; PAM sequence: TTC
atccctgaggtattaatccc

SEQ ID NO: 62781 - DNA, 20 bp, Artificial Sequence
  Description of Artificial Sequence: Synthetic oligonucleotide
  Target: SCN9A; (-) strand; PAM type: YTN; PAM sequence: TTT
catccctgaggtattaatcc

SEQ ID NO: 62782 - DNA, 20 bp, Artificial Sequence
  Description of Artificial Sequence: Synthetic oligonucleotide
  Target: SCN9A; (-) strand; PAM type: YTN; PAM sequence: TTA
tttcatccctgaggtattaa

SEQ ID NO: 62783 - DNA, 20 bp, Artificial Sequence
  Description of Artificial Sequence: Synthetic oligonucleotide
  Target: SCN9A; (-) strand; PAM type: YTN; PAM sequence: TTG
tacagattatttcatccctg

SEQ ID NO: 62784 - DNA, 20 bp, Artificial Sequence
  Description of Artificial Sequence: Synthetic oligonucleotide
  Target: SCN9A; (-) strand; PAM type: YTN; PAM sequence: TTG
ttgtacagattatttcatcc

SEQ ID NO: 62785 - DNA, 20 bp, Artificial Sequence
  Description of Artificial Sequence: Synthetic oligonucleotide
  Target: SCN9A; (-) strand; PAM type: YTN; PAM sequence: TTT
gttgtacagattatttcatc

SEQ ID NO: 62786 - DNA, 20 bp, Artificial Sequence
  Description of Artificial Sequence: Synthetic oligonucleotide
  Target: SCN9A; (-) strand; PAM type: YTN; PAM sequence: TTA
cataggtaaacatgtcatag

SEQ ID NO: 62787 - DNA, 20 bp, Artificial Sequence
  Description of Artificial Sequence: Synthetic oligonucleotide
  Target: SCN9A; (-) strand; PAM type: YTN; PAM sequence: TTG
ttacataggtaaacatgtca

SEQ ID NO: 62788 - DNA, 20 bp, Artificial Sequence
  Description of Artificial Sequence: Synthetic oligonucleotide
  Target: SCN9A; (-) strand; PAM type: YTN; PAM sequence: CTT
gttacataggtaaacatgtc

SEQ ID NO: 62789 - DNA, 20 bp, Artificial Sequence
  Description of Artificial Sequence: Synthetic oligonucleotide
  Target: SCN9A; (-) strand; PAM type: YTN; PAM sequence: TTC
aggggtacatgtacaggatg

SEQ ID NO: 62790 - DNA, 20 bp, Artificial Sequence
  Description of Artificial Sequence: Synthetic oligonucleotide
  Target: SCN9A; (-) strand; PAM type: YTN; PAM sequence: TTA
agttcaggggtacatgtaca

SEQ ID NO: 62791 - DNA, 20 bp, Artificial Sequence
  Description of Artificial Sequence: Synthetic oligonucleotide
  Target: SCN9A; (-) strand; PAM type: YTN; PAM sequence: TTT
aagttcaggggtacatgtac

SEQ ID NO: 62792 - DNA, 20 bp, Artificial Sequence
  Description of Artificial Sequence: Synthetic oligonucleotide
  Target: SCN9A; (-) strand; PAM type: YTN; PAM sequence: TTT
taagttcaggggtacatgta

SEQ ID NO: 62793 - DNA, 20 bp, Artificial Sequence
  Description of Artificial Sequence: Synthetic oligonucleotide
  Target: SCN9A; (-) strand; PAM type: YTN; PAM sequence: TTA
ttttaagttcaggggtacat

SEQ ID NO: 62794 - DNA, 20 bp, Artificial Sequence
  Description of Artificial Sequence: Synthetic oligonucleotide
  Target: SCN9A; (-) strand; PAM type: YTN; PAM sequence: TTT
attttaagttcaggggtaca

SEQ ID NO: 62795 - DNA, 20 bp, Artificial Sequence
  Description of Artificial Sequence: Synthetic oligonucleotide
  Target: SCN9A; (-) strand; PAM type: YTN; PAM sequence: TTT
tattttaagttcaggggtac

SEQ ID NO: 62796 - DNA, 20 bp, Artificial Sequence
  Description of Artificial Sequence: Synthetic oligonucleotide
  Target: SCN9A; (-) strand; PAM type: YTN; PAM sequence: CTT
ttattttaagttcaggggta

SEQ ID NO: 62797 - DNA, 20 bp, Artificial Sequence
  Description of Artificial Sequence: Synthetic oligonucleotide
  Target: SCN9A; (-) strand; PAM type: YTN; PAM sequence: TTG
acttttattttaagttcagg

SEQ ID NO: 62798 - DNA, 20 bp, Artificial Sequence
  Description of Artificial Sequence: Synthetic oligonucleotide
  Target: SCN9A; (-) strand; PAM type: YTN; PAM sequence: TTT
gacttttattttaagttcag

SEQ ID NO: 62799 - DNA, 20 bp, Artificial Sequence
  Description of Artificial Sequence: Synthetic oligonucleotide
  Target: SCN9A; (-) strand; PAM type: YTN; PAM sequence: TTT
tgacttttattttaagttca

SEQ ID NO: 62800 - DNA, 20 bp, Artificial Sequence
  Description of Artificial Sequence: Synthetic oligonucleotide
  Target: SCN9A; (-) strand; PAM type: YTN; PAM sequence: TTT
ttgacttttattttaagttc

SEQ ID NO: 62801 - DNA, 20 bp, Artificial Sequence
  Description of Artificial Sequence: Synthetic oligonucleotide
  Target: SCN9A; (-) strand; PAM type: YTN; PAM sequence: TTT
tttgacttttattttaagtt

SEQ ID NO: 62802 - DNA, 20 bp, Artificial Sequence
  Description of Artificial Sequence: Synthetic oligonucleotide
  Target: SCN9A; (-) strand; PAM type: YTN; PAM sequence: CTT
ttttgacttttattttaagt

SEQ ID NO: 62803 - DNA, 20 bp, Artificial Sequence
  Description of Artificial Sequence: Synthetic oligonucleotide
  Target: SCN9A; (-) strand; PAM type: YTN; PAM sequence: TTG
tgtgacttttttgactttta

SEQ ID NO: 62804 - DNA, 20 bp, Artificial Sequence
  Description of Artificial Sequence: Synthetic oligonucleotide
  Target: SCN9A; (-) strand; PAM type: YTN; PAM sequence: CTA
ttgtgtgacttttttgactt

SEQ ID NO: 62805 - DNA, 20 bp, Artificial Sequence
  Description of Artificial Sequence: Synthetic oligonucleotide
  Target: SCN9A; (-) strand; PAM type: YTN; PAM sequence: TTC
ctattgtgtgacttttttga

SEQ ID NO: 62806 - DNA, 20 bp, Artificial Sequence
  Description of Artificial Sequence: Synthetic oligonucleotide
  Target: SCN9A; (-) strand; PAM type: YTN; PAM sequence: TTT
cctattgtgtgacttttttg

SEQ ID NO: 62807 - DNA, 20 bp, Artificial Sequence
  Description of Artificial Sequence: Synthetic oligonucleotide
  Target: SCN9A; (-) strand; PAM type: YTN; PAM sequence: TTC
atttcctattgtgtgacttt

SEQ ID NO: 62808 - DNA, 20 bp, Artificial Sequence
  Description of Artificial Sequence: Synthetic oligonucleotide
  Target: SCN9A; (-) strand; PAM type: YTN; PAM sequence: TTT
catttcctattgtgtgactt

SEQ ID NO: 62809 - DNA, 20 bp, Artificial Sequence
  Description of Artificial Sequence: Synthetic oligonucleotide
  Target: SCN9A; (-) strand; PAM type: YTN; PAM sequence: TTT
tcatttcctattgtgtgact

SEQ ID NO: 62810 - DNA, 20 bp, Artificial Sequence
  Description of Artificial Sequence: Synthetic oligonucleotide
  Target: SCN9A; (-) strand; PAM type: YTN; PAM sequence: TTT
ttcatttcctattgtgtgac

SEQ ID NO: 62811 - DNA, 20 bp, Artificial Sequence
  Description of Artificial Sequence: Synthetic oligonucleotide
  Target: SCN9A; (-) strand; PAM type: YTN; PAM sequence: TTT
tttcatttcctattgtgtga

SEQ ID NO: 62812 - DNA, 20 bp, Artificial Sequence
  Description of Artificial Sequence: Synthetic oligonucleotide
  Target: SCN9A; (-) strand; PAM type: YTN; PAM sequence: TTT
ttttcatttcctattgtgtg

SEQ ID NO: 62813 - DNA, 20 bp, Artificial Sequence
  Description of Artificial Sequence: Synthetic oligonucleotide
  Target: SCN9A; (-) strand; PAM type: YTN; PAM sequence: TTA
tttttttcatttcctattgt

SEQ ID NO: 62814 - DNA, 20 bp, Artificial Sequence
  Description of Artificial Sequence: Synthetic oligonucleotide
  Target: SCN9A; (-) strand; PAM type: YTN; PAM sequence: TTT
atttttttcatttcctattg

SEQ ID NO: 62815 - DNA, 20 bp, Artificial Sequence
  Description of Artificial Sequence: Synthetic oligonucleotide
  Target: SCN9A; (-) strand; PAM type: YTN; PAM sequence: TTG
aaatatacatttattttttt

SEQ ID NO: 62816 - DNA, 20 bp, Artificial Sequence
  Description of Artificial Sequence: Synthetic oligonucleotide
  Target: SCN9A; (-) strand; PAM type: YTN; PAM sequence: TTT
gaaatatacatttatttttt

SEQ ID NO: 62817 - DNA, 20 bp, Artificial Sequence
  Description of Artificial Sequence: Synthetic oligonucleotide
  Target: SCN9A; (-) strand; PAM type: YTN; PAM sequence: TTT
tgaaatatacatttattttt

SEQ ID NO: 62818 - DNA, 20 bp, Artificial Sequence
  Description of Artificial Sequence: Synthetic oligonucleotide
  Target: SCN9A; (-) strand; PAM type: YTN; PAM sequence: TTA
gcaattttgaaatatacatt

SEQ ID NO: 62819 - DNA, 20 bp, Artificial Sequence
  Description of Artificial Sequence: Synthetic oligonucleotide
  Target: SCN9A; (-) strand; PAM type: YTN; PAM sequence: TTT
agcaattttgaaatatacat

SEQ ID NO: 62820 - DNA, 20 bp, Artificial Sequence
  Description of Artificial Sequence: Synthetic oligonucleotide
  Target: SCN9A; (-) strand; PAM type: YTN; PAM sequence: TTT
tagcaattttgaaatataca

SEQ ID NO: 62821 - DNA, 20 bp, Artificial Sequence
  Description of Artificial Sequence: Synthetic oligonucleotide
  Target: SCN9A; (-) strand; PAM type: YTN; PAM sequence: CTT
ttagcaattttgaaatatac

SEQ ID NO: 62822 - DNA, 20 bp, Artificial Sequence
  Description of Artificial Sequence: Synthetic oligonucleotide
  Target: SCN9A; (-) strand; PAM type: YTN; PAM sequence: TTC
ttttagcaattttgaaatat

SEQ ID NO: 62823 - DNA, 20 bp, Artificial Sequence
  Description of Artificial Sequence: Synthetic oligonucleotide
  Target: SCN9A; (-) strand; PAM type: YTN; PAM sequence: CTA
ttcttttagcaattttgaaa

SEQ ID NO: 62824 - DNA, 20 bp, Artificial Sequence
  Description of Artificial Sequence: Synthetic oligonucleotide
  Target: SCN9A; (-) strand; PAM type: YTN; PAM sequence: TTA
aaaagctattcttttagcaa

SEQ ID NO: 62825 - DNA, 20 bp, Artificial Sequence
  Description of Artificial Sequence: Synthetic oligonucleotide
  Target: SCN9A; (-) strand; PAM type: YTN; PAM sequence: TTG
tggtaagaaagttaaaaagc

SEQ ID NO: 62826 - DNA, 20 bp, Artificial Sequence
  Description of Artificial Sequence: Synthetic oligonucleotide
  Target: SCN9A; (-) strand; PAM type: YTN; PAM sequence: TTT
gtggtaagaaagttaaaaag

SEQ ID NO: 62827 - DNA, 20 bp, Artificial Sequence
  Description of Artificial Sequence: Synthetic oligonucleotide
  Target: SCN9A; (-) strand; PAM type: YTN; PAM sequence: TTT
tgtggtaagaaagttaaaaa

SEQ ID NO: 62828 - DNA, 20 bp, Artificial Sequence
  Description of Artificial Sequence: Synthetic oligonucleotide
  Target: SCN9A; (-) strand; PAM type: YTN; PAM sequence: TTT
ttgtggtaagaaagttaaaa

SEQ ID NO: 62829 - DNA, 20 bp, Artificial Sequence
  Description of Artificial Sequence: Synthetic oligonucleotide
  Target: SCN9A; (-) strand; PAM type: YTN; PAM sequence: TTT
tttgtggtaagaaagttaaa

SEQ ID NO: 62830 - DNA, 20 bp, Artificial Sequence
  Description of Artificial Sequence: Synthetic oligonucleotide
  Target: SCN9A; (-) strand; PAM type: YTN; PAM sequence: TTT
ttttgtggtaagaaagttaa

SEQ ID NO: 62831 - DNA, 20 bp, Artificial Sequence
  Description of Artificial Sequence: Synthetic oligonucleotide
  Target: SCN9A; (-) strand; PAM type: YTN; PAM sequence: TTA
tcatttttttgtggtaagaa

SEQ ID NO: 62832 - DNA, 20 bp, Artificial Sequence
  Description of Artificial Sequence: Synthetic oligonucleotide
  Target: SCN9A; (-) strand; PAM type: YTN; PAM sequence: CTT
atcatttttttgtggtaaga

SEQ ID NO: 62833 - DNA, 20 bp, Artificial Sequence
  Description of Artificial Sequence: Synthetic oligonucleotide
  Target: SCN9A; (-) strand; PAM type: YTN; PAM sequence: TTC
acccacttatcatttttttg

SEQ ID NO: 62834 - DNA, 20 bp, Artificial Sequence
  Description of Artificial Sequence: Synthetic oligonucleotide
  Target: SCN9A; (-) strand; PAM type: YTN; PAM sequence: CTT
cacccacttatcattttttt

SEQ ID NO: 62835 - DNA, 20 bp, Artificial Sequence
  Description of Artificial Sequence: Synthetic oligonucleotide
  Target: SCN9A; (-) strand; PAM type: YTN; PAM sequence: TTA
acataaccatcacttcaccc

SEQ ID NO: 62836 - DNA, 20 bp, Artificial Sequence
  Description of Artificial Sequence: Synthetic oligonucleotide
  Target: SCN9A; (-) strand; PAM type: YTN; PAM sequence: CTA
attaacataaccatcacttc

SEQ ID NO: 62837 - DNA, 20 bp, Artificial Sequence
  Description of Artificial Sequence: Synthetic oligonucleotide
  Target: SCN9A; (-) strand; PAM type: YTN; PAM sequence: TTC
agtcacgctaattaacataa

SEQ ID NO: 62838 - DNA, 20 bp, Artificial Sequence
  Description of Artificial Sequence: Synthetic oligonucleotide
  Target: SCN9A; (-) strand; PAM type: YTN; PAM sequence: TTT
cagtcacgctaattaacata

SEQ ID NO: 62839 - DNA, 20 bp, Artificial Sequence
  Description of Artificial Sequence: Synthetic oligonucleotide
  Target: SCN9A; (-) strand; PAM type: YTN; PAM sequence: TTT
tcagtcacgctaattaacat

SEQ ID NO: 62840 - DNA, 20 bp, Artificial Sequence
  Description of Artificial Sequence: Synthetic oligonucleotide
  Target: SCN9A; (-) strand; PAM type: YTN; PAM sequence: TTG
tagaaattttcagtcacgct

SEQ ID NO: 62841 - DNA, 20 bp, Artificial Sequence
  Description of Artificial Sequence: Synthetic oligonucleotide
  Target: SCN9A; (-) strand; PAM type: YTN; PAM sequence: CTA
cataaacattgtagaaattt

SEQ ID NO: 62842 - DNA, 20 bp, Artificial Sequence
  Description of Artificial Sequence: Synthetic oligonucleotide
  Target: SCN9A; (-) strand; PAM type: YTN; PAM sequence: TTG
atctacataaacattgtaga

SEQ ID NO: 62843 - DNA, 20 bp, Artificial Sequence
  Description of Artificial Sequence: Synthetic oligonucleotide
  Target: SCN9A; (-) strand; PAM type: YTN; PAM sequence: TTT
gatctacataaacattgtag

SEQ ID NO: 62844 - DNA, 20 bp, Artificial Sequence
  Description of Artificial Sequence: Synthetic oligonucleotide
  Target: SCN9A; (-) strand; PAM type: YTN; PAM sequence: TTT
tgatctacataaacattgta

SEQ ID NO: 62845 - DNA, 20 bp, Artificial Sequence
  Description of Artificial Sequence: Synthetic oligonucleotide
  Target: SCN9A; (-) strand; PAM type: YTN; PAM sequence: TTA
tggggtacaaaacaatgttt

SEQ ID NO: 62846 - DNA, 20 bp, Artificial Sequence
  Description of Artificial Sequence: Synthetic oligonucleotide
  Target: SCN9A; (-) strand; PAM type: YTN; PAM sequence: TTT
atggggtacaaaacaatgtt

SEQ ID NO: 62847 - DNA, 20 bp, Artificial Sequence
  Description of Artificial Sequence: Synthetic oligonucleotide
  Target: SCN9A; (-) strand; PAM type: YTN; PAM sequence: TTA
tttatggggtacaaaacaat

SEQ ID NO: 62848 - DNA, 20 bp, Artificial Sequence
  Description of Artificial Sequence: Synthetic oligonucleotide
  Target: SCN9A; (-) strand; PAM type: YTN; PAM sequence: CTT
atttatggggtacaaaacaa

SEQ ID NO: 62849 - DNA, 20 bp, Artificial Sequence
  Description of Artificial Sequence: Synthetic oligonucleotide
  Target: SCN9A; (-) strand; PAM type: YTN; PAM sequence: TTG
tgcttatttatggggtacaa

SEQ ID NO: 62850 - DNA, 20 bp, Artificial Sequence
  Description of Artificial Sequence: Synthetic oligonucleotide
  Target: SCN9A; (-) strand; PAM type: YTN; PAM sequence: TTG
acaaaaattgtgcttattta

SEQ ID NO: 62851 - DNA, 20 bp, Artificial Sequence
  Description of Artificial Sequence: Synthetic oligonucleotide
  Target: SCN9A; (-) strand; PAM type: YTN; PAM sequence: TTA
attgacaaaaattgtgctta

SEQ ID NO: 62852 - DNA, 20 bp, Artificial Sequence
  Description of Artificial Sequence: Synthetic oligonucleotide
  Target: SCN9A; (-) strand; PAM type: YTN; PAM sequence: TTT
aattgacaaaaattgtgctt

SEQ ID NO: 62853 - DNA, 20 bp, Artificial Sequence
  Description of Artificial Sequence: Synthetic oligonucleotide
  Target: SCN9A; (-) strand; PAM type: YTN; PAM sequence: TTT
taattgacaaaaattgtgct

SEQ ID NO: 62854 - DNA, 20 bp, Artificial Sequence
  Description of Artificial Sequence: Synthetic oligonucleotide
  Target: SCN9A; (-) strand; PAM type: YTN; PAM sequence: TTT
ttaattgacaaaaattgtgc

SEQ ID NO: 62855 - DNA, 20 bp, Artificial Sequence
  Description of Artificial Sequence: Synthetic oligonucleotide
  Target: SCN9A; (-) strand; PAM type: YTN; PAM sequence: TTC
atttttaattgacaaaaatt

SEQ ID NO: 62856 - DNA, 20 bp, Artificial Sequence
  Description of Artificial Sequence: Synthetic oligonucleotide
  Target: SCN9A; (-) strand; PAM type: YTN; PAM sequence: TTG
ttcatttttaattgacaaaa

SEQ ID NO: 62857 - DNA, 20 bp, Artificial Sequence
  Description of Artificial Sequence: Synthetic oligonucleotide
  Target: SCN9A; (-) strand; PAM type: YTN; PAM sequence: TTT
gttcatttttaattgacaaa

SEQ ID NO: 62858 - DNA, 20 bp, Artificial Sequence
  Description of Artificial Sequence: Synthetic oligonucleotide
  Target: SCN9A; (-) strand; PAM type: YTN; PAM sequence: TTA
aatatttgttcatttttaat

SEQ ID NO: 62859 - DNA, 20 bp, Artificial Sequence
  Description of Artificial Sequence: Synthetic oligonucleotide
  Target: SCN9A; (-) strand; PAM type: YTN; PAM sequence: TTT
aaatatttgttcatttttaa

SEQ ID NO: 62860 - DNA, 20 bp, Artificial Sequence
  Description of Artificial Sequence: Synthetic oligonucleotide
  Target: SCN9A; (-) strand; PAM type: YTN; PAM sequence: CTG
tttaaatatttgttcatttt

SEQ ID NO: 62861 - DNA, 20 bp, Artificial Sequence
  Description of Artificial Sequence: Synthetic oligonucleotide
  Target: SCN9A; (-) strand; PAM type: YTN; PAM sequence: TTC
tgtttaaatatttgttcatt

SEQ ID NO: 62862 - DNA, 20 bp, Artificial Sequence
  Description of Artificial Sequence: Synthetic oligonucleotide
  Target: SCN9A; (-) strand; PAM type: YTN; PAM sequence: TTT
ctgtttaaatatttgttcat

SEQ ID NO: 62863 - DNA, 20 bp, Artificial Sequence
  Description of Artificial Sequence: Synthetic oligonucleotide
  Target: SCN9A; (-) strand; PAM type: YTN; PAM sequence: TTT
tctgtttaaatatttgttca

SEQ ID NO: 62864 - DNA, 20 bp, Artificial Sequence
  Description of Artificial Sequence: Synthetic oligonucleotide
  Target: SCN9A; (-) strand; PAM type: YTN; PAM sequence: TTT
ttctgtttaaatatttgttc

SEQ ID NO: 62865 - DNA, 20 bp, Artificial Sequence
  Description of Artificial Sequence: Synthetic oligonucleotide
  Target: SCN9A; (-) strand; PAM type: YTN; PAM sequence: TTT
tttctgtttaaatatttgtt

SEQ ID NO: 62866 - DNA, 20 bp, Artificial Sequence
  Description of Artificial Sequence: Synthetic oligonucleotide
  Target: SCN9A; (-) strand; PAM type: YTN; PAM sequence: TTT
ttttctgtttaaatatttgt

SEQ ID NO: 62867 - DNA, 20 bp, Artificial Sequence
  Description of Artificial Sequence: Synthetic oligonucleotide
  Target: SCN9A; (-) strand; PAM type: YTN; PAM sequence: CTG
tagtatgtttttttctgttt

SEQ ID NO: 62868 - DNA, 20 bp, Artificial Sequence
  Description of Artificial Sequence: Synthetic oligonucleotide
  Target: SCN9A; (-) strand; PAM type: YTN; PAM sequence: TTC
tgtagtatgtttttttctgt

SEQ ID NO: 62869 - DNA, 20 bp, Artificial Sequence
  Description of Artificial Sequence: Synthetic oligonucleotide
  Target: SCN9A; (-) strand; PAM type: YTN; PAM sequence: TTG
ttctgtagtatgtttttttc

SEQ ID NO: 62870 - DNA, 20 bp, Artificial Sequence
  Description of Artificial Sequence: Synthetic oligonucleotide
  Target: SCN9A; (-) strand; PAM type: YTN; PAM sequence: CTT
gttctgtagtatgttttttt

SEQ ID NO: 62871 - DNA, 20 bp, Artificial Sequence
  Description of Artificial Sequence: Synthetic oligonucleotide
  Target: SCN9A; (-) strand; PAM type: YTN; PAM sequence: TTC
atcagggatcttgttctgta

SEQ ID NO: 62872 - DNA, 20 bp, Artificial Sequence
  Description of Artificial Sequence: Synthetic oligonucleotide
  Target: SCN9A; (-) strand; PAM type: YTN; PAM sequence: CTA
tgttcatcagggatcttgtt

SEQ ID NO: 62873 - DNA, 20 bp, Artificial Sequence
  Description of Artificial Sequence: Synthetic oligonucleotide
  Target: SCN9A; (-) strand; PAM type: YTN; PAM sequence: TTG
catctatgttcatcagggat

SEQ ID NO: 62874 - DNA, 20 bp, Artificial Sequence
  Description of Artificial Sequence: Synthetic oligonucleotide
  Target: SCN9A; (-) strand; PAM type: YTN; PAM sequence: TTT
gcatctatgttcatcaggga

SEQ ID NO: 62875 - DNA, 20 bp, Artificial Sequence
  Description of Artificial Sequence: Synthetic oligonucleotide
  Target: SCN9A; (-) strand; PAM type: YTN; PAM sequence: TTA
tttgcatctatgttcatcag

SEQ ID NO: 62876 - DNA, 20 bp, Artificial Sequence
  Description of Artificial Sequence: Synthetic oligonucleotide
  Target: SCN9A; (-) strand; PAM type: YTN; PAM sequence: TTG
atgaagttatttgcatctat

SEQ ID NO: 62877 - DNA, 20 bp, Artificial Sequence
  Description of Artificial Sequence: Synthetic oligonucleotide
  Target: SCN9A; (-) strand; PAM type: YTN; PAM sequence: TTT
gatgaagttatttgcatcta

SEQ ID NO: 62878 - DNA, 20 bp, Artificial Sequence
  Description of Artificial Sequence: Synthetic oligonucleotide
  Target: SCN9A; (-) strand; PAM type: YTN; PAM sequence: TTT
tgatgaagttatttgcatct

SEQ ID NO: 62879 - DNA, 20 bp, Artificial Sequence
  Description of Artificial Sequence: Synthetic oligonucleotide
  Target: SCN9A; (-) strand; PAM type: YTN; PAM sequence: CTA
atattttgatgaagttattt

SEQ ID NO: 62880 - DNA, 20 bp, Artificial Sequence
  Description of Artificial Sequence: Synthetic oligonucleotide
  Target: SCN9A; (-) strand; PAM type: YTN; PAM sequence: TTG
ctaatattttgatgaagtta

SEQ ID NO: 62881 - DNA, 20 bp, Artificial Sequence
  Description of Artificial Sequence: Synthetic oligonucleotide
  Target: SCN9A; (-) strand; PAM type: YTN; PAM sequence: TTT
gctaatattttgatgaagtt

SEQ ID NO: 62882 - DNA, 20 bp, Artificial Sequence
  Description of Artificial Sequence: Synthetic oligonucleotide
  Target: SCN9A; (-) strand; PAM type: YTN; PAM sequence: TTC
agtttgctaatattttgatg

SEQ ID NO: 62883 - DNA, 20 bp, Artificial Sequence
  Description of Artificial Sequence: Synthetic oligonucleotide
  Target: SCN9A; (-) strand; PAM type: YTN; PAM sequence: TTG
cattcagtttgctaatattt

SEQ ID NO: 62884 - DNA, 20 bp, Artificial Sequence
  Description of Artificial Sequence: Synthetic oligonucleotide
  Target: SCN9A; (-) strand; PAM type: YTN; PAM sequence: CTG
ttgcattcagtttgctaata

SEQ ID NO: 62885 - DNA, 20 bp, Artificial Sequence
  Description of Artificial Sequence: Synthetic oligonucleotide
  Target: SCN9A; (-) strand; PAM type: YTN; PAM sequence: TTA
atgggctgttgcattcagtt

SEQ ID NO: 62886 - DNA, 20 bp, Artificial Sequence
  Description of Artificial Sequence: Synthetic oligonucleotide
  Target: SCN9A; (-) strand; PAM type: YTN; PAM sequence: TTT
aatgggctgttgcattcagt

SEQ ID NO: 62887 - DNA, 20 bp, Artificial Sequence
  Description of Artificial Sequence: Synthetic oligonucleotide
  Target: SCN9A; (-) strand; PAM type: YTN; PAM sequence: TTG
gtcgtagtacatgatcattt

SEQ ID NO: 62888 - DNA, 20 bp, Artificial Sequence
  Description of Artificial Sequence: Synthetic oligonucleotide
  Target: SCN9A; (-) strand; PAM type: YTN; PAM sequence: CTT
ggtcgtagtacatgatcatt

SEQ ID NO: 62889 - DNA, 20 bp, Artificial Sequence
  Description of Artificial Sequence: Synthetic oligonucleotide
  Target: SCN9A; (-) strand; PAM type: YTN; PAM sequence: CTC
ccacttggtcgtagtacatg

SEQ ID NO: 62890 - DNA, 20 bp, Artificial Sequence
  Description of Artificial Sequence: Synthetic oligonucleotide
  Target: SCN9A; (-) strand; PAM type: YTN; PAM sequence: CTA
gggacaactcccacttggtc

SEQ ID NO: 62891 - DNA, 20 bp, Artificial Sequence
  Description of Artificial Sequence: Synthetic oligonucleotide
  Target: SCN9A; (-) strand; PAM type: YTN; PAM sequence: TTG
catcctagggacaactccca

SEQ ID NO: 62892 - DNA, 20 bp, Artificial Sequence
  Description of Artificial Sequence: Synthetic oligonucleotide
  Target: SCN9A; (-) strand; PAM type: YTN; PAM sequence: CTT
gcatcctagggacaactccc

SEQ ID NO: 62893 - DNA, 20 bp, Artificial Sequence
  Description of Artificial Sequence: Synthetic oligonucleotide
  Target: SCN9A; (-) strand; PAM type: YTN; PAM sequence: TTG
aaccatccttgcatcctagg

SEQ ID NO: 62894 - DNA, 20 bp, Artificial Sequence
  Description of Artificial Sequence: Synthetic oligonucleotide
  Target: SCN9A; (-) strand; PAM type: YTN; PAM sequence: CTG
catatgttgaaccatccttg

SEQ ID NO: 62895 - DNA, 20 bp, Artificial Sequence
  Description of Artificial Sequence: Synthetic oligonucleotide
  Target: SCN9A; (-) strand; PAM type: YTN; PAM sequence: TTG
gtctgcatatgttgaaccat

SEQ ID NO: 62896 - DNA, 20 bp, Artificial Sequence
  Description of Artificial Sequence: Synthetic oligonucleotide
  Target: SCN9A; (-) strand; PAM type: YTN; PAM sequence: TTA
ttggtctgcatatgttgaac

SEQ ID NO: 62897 - DNA, 20 bp, Artificial Sequence
  Description of Artificial Sequence: Synthetic oligonucleotide
  Target: SCN9A; (-) strand; PAM type: YTN; PAM sequence: CTC
agatcatgtggtgtatcaca

SEQ ID NO: 62898 - DNA, 20 bp, Artificial Sequence
  Description of Artificial Sequence: Synthetic oligonucleotide
  Target: SCN9A; (-) strand; PAM type: YTN; PAM sequence: TTC
tcagatcatgtggtgtatca

SEQ ID NO: 62899 - DNA, 20 bp, Artificial Sequence
  Description of Artificial Sequence: Synthetic oligonucleotide
  Target: SCN9A; (-) strand; PAM type: YTN; PAM sequence: CTT
ctcagatcatgtggtgtatc

SEQ ID NO: 62900 - DNA, 20 bp, Artificial Sequence
  Description of Artificial Sequence: Synthetic oligonucleotide
  Target: SCN9A; (-) strand; PAM type: YTN; PAM sequence: TTA
tccttctcagatcatgtggt

SEQ ID NO: 62901 - DNA, 20 bp, Artificial Sequence
  Description of Artificial Sequence: Synthetic oligonucleotide
  Target: SCN9A; (-) strand; PAM type: YTN; PAM sequence: TTT
atccttctcagatcatgtgg

SEQ ID NO: 62902 - DNA, 20 bp, Artificial Sequence
  Description of Artificial Sequence: Synthetic oligonucleotide
  Target: SCN9A; (-) strand; PAM type: YTN; PAM sequence: TTT
tatccttctcagatcatgtg

SEQ ID NO: 62903 - DNA, 20 bp, Artificial Sequence
  Description of Artificial Sequence: Synthetic oligonucleotide
  Target: SCN9A; (-) strand; PAM type: YTN; PAM sequence: TTT
ttatccttctcagatcatgt

SEQ ID NO: 62904 - DNA, 20 bp, Artificial Sequence
  Description of Artificial Sequence: Synthetic oligonucleotide
  Target: SCN9A; (-) strand; PAM type: YTN; PAM sequence: CTG
atgatcatgtgatttttatc

SEQ ID NO: 62905 - DNA, 20 bp, Artificial Sequence
  Description of Artificial Sequence: Synthetic oligonucleotide
  Target: SCN9A; (-) strand; PAM type: YTN; PAM sequence: TTC
tgatgatcatgtgattttta

SEQ ID NO: 62906 - DNA, 20 bp, Artificial Sequence
  Description of Artificial Sequence: Synthetic oligonucleotide
  Target: SCN9A; (-) strand; PAM type: YTN; PAM sequence: CTT
ctgatgatcatgtgattttt

SEQ ID NO: 62907 - DNA, 20 bp, Artificial Sequence
  Description of Artificial Sequence: Synthetic oligonucleotide
  Target: SCN9A; (-) strand; PAM type: YTN; PAM sequence: CTC
ttctgatgatcatgtgattt

SEQ ID NO: 62908 - DNA, 20 bp, Artificial Sequence
  Description of Artificial Sequence: Synthetic oligonucleotide
  Target: SCN9A; (-) strand; PAM type: YTN; PAM sequence: CTG
aatctcttctgatgatcatg

SEQ ID NO: 62909 - DNA, 20 bp, Artificial Sequence
  Description of Artificial Sequence: Synthetic oligonucleotide
  Target: SCN9A; (-) strand; PAM type: YTN; PAM sequence: TTC
tgaatctcttctgatgatca

SEQ ID NO: 62910 - DNA, 20 bp, Artificial Sequence
  Description of Artificial Sequence: Synthetic oligonucleotide
  Target: SCN9A; (-) strand; PAM type: YTN; PAM sequence: CTT
ctgaatctcttctgatgatc

SEQ ID NO: 62911 - DNA, 20 bp, Artificial Sequence
  Description of Artificial Sequence: Synthetic oligonucleotide
  Target: SCN9A; (-) strand; PAM type: YTN; PAM sequence: TTC
ttctgaatctcttctgatga

SEQ ID NO: 62912 - DNA, 20 bp, Artificial Sequence
  Description of Artificial Sequence: Synthetic oligonucleotide
  Target: SCN9A; (-) strand; PAM type: YTN; PAM sequence: CTT
cttctgaatctcttctgatg

SEQ ID NO: 62913 - DNA, 20 bp, Artificial Sequence
  Description of Artificial Sequence: Synthetic oligonucleotide
  Target: SCN9A; (-) strand; PAM type: YTN; PAM sequence: TTG
tcaaatgcttcttctgaatc

SEQ ID NO: 62914 - DNA, 20 bp, Artificial Sequence
  Description of Artificial Sequence: Synthetic oligonucleotide
  Target: SCN9A; (-) strand; PAM type: YTN; PAM sequence: TTT
gtcaaatgcttcttctgaat

SEQ ID NO: 62915 - DNA, 20 bp, Artificial Sequence
  Description of Artificial Sequence: Synthetic oligonucleotide
  Target: SCN9A; (-) strand; PAM type: YTN; PAM sequence: TTG
aaatttgtcaaatgcttctt

SEQ ID NO: 62916 - DNA, 20 bp, Artificial Sequence
  Description of Artificial Sequence: Synthetic oligonucleotide
  Target: SCN9A; (-) strand; PAM type: YTN; PAM sequence: TTG
ttgaaatttgtcaaatgctt

SEQ ID NO: 62917 - DNA, 20 bp, Artificial Sequence
  Description of Artificial Sequence: Synthetic oligonucleotide
  Target: SCN9A; (-) strand; PAM type: YTN; PAM sequence: TTA
ccatgaaaggttgttgaaat

SEQ ID NO: 62918 - DNA, 20 bp, Artificial Sequence
  Description of Artificial Sequence: Synthetic oligonucleotide
  Target: SCN9A; (-) strand; PAM type: YTN; PAM sequence: TTT
accatgaaaggttgttgaaa

SEQ ID NO: 62919 - DNA, 20 bp, Artificial Sequence
  Description of Artificial Sequence: Synthetic oligonucleotide
  Target: SCN9A; (-) strand; PAM type: YTN; PAM sequence: TTT
taccatgaaaggttgttgaa

SEQ ID NO: 62920 - DNA, 20 bp, Artificial Sequence
  Description of Artificial Sequence: Synthetic oligonucleotide
  Target: SCN9A; (-) strand; PAM type: YTN; PAM sequence: TTT
ttaccatgaaaggttgttga

SEQ ID NO: 62921 - DNA, 20 bp, Artificial Sequence
  Description of Artificial Sequence: Synthetic oligonucleotide
  Target: SCN9A; (-) strand; PAM type: YTN; PAM sequence: TTA
gtttttaccatgaaaggttg

SEQ ID NO: 62922 - DNA, 20 bp, Artificial Sequence
  Description of Artificial Sequence: Synthetic oligonucleotide
  Target: SCN9A; (-) strand; PAM type: YTN; PAM sequence: TTT
agtttttaccatgaaaggtt

SEQ ID NO: 62923 - DNA, 20 bp, Artificial Sequence
  Description of Artificial Sequence: Synthetic oligonucleotide
  Target: SCN9A; (-) strand; PAM type: YTN; PAM sequence: TTT
tagtttttaccatgaaaggt

SEQ ID NO: 62924 - DNA, 20 bp, Artificial Sequence
  Description of Artificial Sequence: Synthetic oligonucleotide
  Target: SCN9A; (-) strand; PAM type: YTN; PAM sequence: TTT
ttagtttttaccatgaaagg

SEQ ID NO: 62925 - DNA, 20 bp, Artificial Sequence
  Description of Artificial Sequence: Synthetic oligonucleotide
  Target: SCN9A; (-) strand; PAM type: YTN; PAM sequence: TTT
tttagtttttaccatgaaag

SEQ ID NO: 62926 - DNA, 20 bp, Artificial Sequence
  Description of Artificial Sequence: Synthetic oligonucleotide
  Target: SCN9A; (-) strand; PAM type: YTN; PAM sequence: TTT
ttttagtttttaccatgaaa

SEQ ID NO: 62927 - DNA, 20 bp, Artificial Sequence
  Description of Artificial Sequence: Synthetic oligonucleotide
  Target: SCN9A; (-) strand; PAM type: YTN; PAM sequence: CTT
tttttagtttttaccatgaa

SEQ ID NO: 62928 - DNA, 20 bp, Artificial Sequence
  Description of Artificial Sequence: Synthetic oligonucleotide
  Target: SCN9A; (-) strand; PAM type: YTN; PAM sequence: TTC
tttttttagtttttaccatg

SEQ ID NO: 62929 - DNA, 20 bp, Artificial Sequence
  Description of Artificial Sequence: Synthetic oligonucleotide
  Target: SCN9A; (-) strand; PAM type: YTN; PAM sequence: TTT
ctttttttagtttttaccat

SEQ ID NO: 62930 - DNA, 20 bp, Artificial Sequence
  Description of Artificial Sequence: Synthetic oligonucleotide
  Target: SCN9A; (-) strand; PAM type: YTN; PAM sequence: TTT
tctttttttagtttttacca

SEQ ID NO: 62931 - DNA, 20 bp, Artificial Sequence
  Description of Artificial Sequence: Synthetic oligonucleotide
  Target: SCN9A; (-) strand; PAM type: YTN; PAM sequence: TTG
ttttctttttttagttttta

SEQ ID NO: 62932 - DNA, 20 bp, Artificial Sequence
  Description of Artificial Sequence: Synthetic oligonucleotide
  Target: SCN9A; (-) strand; PAM type: YTN; PAM sequence: TTT
gttttctttttttagttttt

SEQ ID NO: 62933 - DNA, 20 bp, Artificial Sequence
  Description of Artificial Sequence: Synthetic oligonucleotide
  Target: SCN9A; (-) strand; PAM type: YTN; PAM sequence: TTT
tgttttctttttttagtttt

SEQ ID NO: 62934 - DNA, 20 bp, Artificial Sequence
  Description of Artificial Sequence: Synthetic oligonucleotide
  Target: SCN9A; (-) strand; PAM type: YTN; PAM sequence: CTT
ttgttttctttttttagttt

SEQ ID NO: 62935 - DNA, 20 bp, Artificial Sequence
  Description of Artificial Sequence: Synthetic oligonucleotide
  Target: SCN9A; (-) strand; PAM type: YTN; PAM sequence: CTA
gcttttgttttcttttttta

SEQ ID NO: 62936 - DNA, 20 bp, Artificial Sequence
  Description of Artificial Sequence: Synthetic oligonucleotide
  Target: SCN9A; (-) strand; PAM type: YTN; PAM sequence: CTA
tacctagcttttgttttctt

SEQ ID NO: 62937 - DNA, 20 bp, Artificial Sequence
  Description of Artificial Sequence: Synthetic oligonucleotide
  Target: SCN9A; (-) strand; PAM type: YTN; PAM sequence: TTC
tatacctagcttttgttttc

SEQ ID NO: 62938 - DNA, 20 bp, Artificial Sequence
  Description of Artificial Sequence: Synthetic oligonucleotide
  Target: SCN9A; (-) strand; PAM type: YTN; PAM sequence: CTT
ctatacctagcttttgtttt

SEQ ID NO: 62939 - DNA, 20 bp, Artificial Sequence
  Description of Artificial Sequence: Synthetic oligonucleotide
  Target: SCN9A; (-) strand; PAM type: YTN; PAM sequence: TTA
tagcaacttctatacctagc

SEQ ID NO: 62940 - DNA, 20 bp, Artificial Sequence
  Description of Artificial Sequence: Synthetic oligonucleotide
  Target: SCN9A; (-) strand; PAM type: YTN; PAM sequence: TTC
aagttatagcaacttctata

SEQ ID NO: 62941 - DNA, 20 bp, Artificial Sequence
  Description of Artificial Sequence: Synthetic oligonucleotide
  Target: SCN9A; (-) strand; PAM type: YTN; PAM sequence: CTT
caagttatagcaacttctat

SEQ ID NO: 62942 - DNA, 20 bp, Artificial Sequence
  Description of Artificial Sequence: Synthetic oligonucleotide
  Target: SCN9A; (-) strand; PAM type: YTN; PAM sequence: TTG
gaggggacaaaccttcaagt

SEQ ID NO: 62943 - DNA, 20 bp, Artificial Sequence
  Description of Artificial Sequence: Synthetic oligonucleotide
  Target: SCN9A; (-) strand; PAM type: YTN; PAM sequence: TTT
ggaggggacaaaccttcaag

SEQ ID NO: 62944 - DNA, 20 bp, Artificial Sequence
  Description of Artificial Sequence: Synthetic oligonucleotide
  Target: SCN9A; (-) strand; PAM type: YTN; PAM sequence: CTT
tggaggggacaaaccttcaa

SEQ ID NO: 62945 - DNA, 20 bp, Artificial Sequence
  Description of Artificial Sequence: Synthetic oligonucleotide
  Target: SCN9A; (-) strand; PAM type: YTN; PAM sequence: TTG
caacatgagctttggagggg

SEQ ID NO: 62946 - DNA, 20 bp, Artificial Sequence
  Description of Artificial Sequence: Synthetic oligonucleotide
  Target: SCN9A; (-) strand; PAM type: YTN; PAM sequence: TTA
aattgcaacatgagctttgg

SEQ ID NO: 62947 - DNA, 20 bp, Artificial Sequence
  Description of Artificial Sequence: Synthetic oligonucleotide
  Target: SCN9A; (-) strand; PAM type: YTN; PAM sequence: TTG
caattaaattgcaacatgag

SEQ ID NO: 62948 - DNA, 20 bp, Artificial Sequence
  Description of Artificial Sequence: Synthetic oligonucleotide
  Target: SCN9A; (-) strand; PAM type: YTN; PAM sequence: CTG
tcacaattgcaattaaattg

SEQ ID NO: 62949 - DNA, 20 bp, Artificial Sequence
  Description of Artificial Sequence: Synthetic oligonucleotide
  Target: SCN9A; (-) strand; PAM type: YTN; PAM sequence: TTC
tgtcacaattgcaattaaat

SEQ ID NO: 62950 - DNA, 20 bp, Artificial Sequence
  Description of Artificial Sequence: Synthetic oligonucleotide
  Target: SCN9A; (-) strand; PAM type: YTN; PAM sequence: CTC
ccaattctgtcacaattgca

SEQ ID NO: 62951 - DNA, 20 bp, Artificial Sequence
  Description of Artificial Sequence: Synthetic oligonucleotide
  Target: SCN9A; (-) strand; PAM type: YTN; PAM sequence: CTC
acctcccaattctgtcacaa

SEQ ID NO: 62952 - DNA, 20 bp, Artificial Sequence
  Description of Artificial Sequence: Synthetic oligonucleotide
  Target: SCN9A; (-) strand; PAM type: YTN; PAM sequence: TTA
aaggtctcacctcccaattc

SEQ ID NO: 62953 - DNA, 20 bp, Artificial Sequence
  Description of Artificial Sequence: Synthetic oligonucleotide
  Target: SCN9A; (-) strand; PAM type: YTN; PAM sequence: CTT
aaaggtctcacctcccaatt

SEQ ID NO: 62954 - DNA, 20 bp, Artificial Sequence
  Description of Artificial Sequence: Synthetic oligonucleotide
  Target: SCN9A; (-) strand; PAM type: YTN; PAM sequence: CTC
ttaaaggtctcacctcccaa

SEQ ID NO: 62955 - DNA, 20 bp, Artificial Sequence
  Description of Artificial Sequence: Synthetic oligonucleotide
  Target: SCN9A; (-) strand; PAM type: YTN; PAM sequence: TTA
aacacctcttaaaggtctca

SEQ ID NO: 62956 - DNA, 20 bp, Artificial Sequence
  Description of Artificial Sequence: Synthetic oligonucleotide
  Target: SCN9A; (-) strand; PAM type: YTN; PAM sequence: CTT
aaacacctcttaaaggtctc

SEQ ID NO: 62957 - DNA, 20 bp, Artificial Sequence
  Description of Artificial Sequence: Synthetic oligonucleotide
  Target: SCN9A; (-) strand; PAM type: YTN; PAM sequence: CTC
ataacttaaacacctcttaa

SEQ ID NO: 62958 - DNA, 20 bp, Artificial Sequence
  Description of Artificial Sequence: Synthetic oligonucleotide
  Target: SCN9A; (-) strand; PAM type: YTN; PAM sequence: TTC
tcataacttaaacacctctt

SEQ ID NO: 62959 - DNA, 20 bp, Artificial Sequence
  Description of Artificial Sequence: Synthetic oligonucleotide
  Target: SCN9A; (-) strand; PAM type: YTN; PAM sequence: TTA
aaagggtaaaattctcataa

SEQ ID NO: 62960 - DNA, 20 bp, Artificial Sequence
  Description of Artificial Sequence: Synthetic oligonucleotide
  Target: SCN9A; (-) strand; PAM type: YTN; PAM sequence: TTT
aaaagggtaaaattctcata

SEQ ID NO: 62961 - DNA, 20 bp, Artificial Sequence
  Description of Artificial Sequence: Synthetic oligonucleotide
  Target: SCN9A; (-) strand; PAM type: YTN; PAM sequence: TTA
atgcatttaaaagggtaaaa

SEQ ID NO: 62962 - DNA, 20 bp, Artificial Sequence
  Description of Artificial Sequence: Synthetic oligonucleotide
  Target: SCN9A; (-) strand; PAM type: YTN; PAM sequence: CTG
agataacagcattaatgcat

SEQ ID NO: 62963 - DNA, 20 bp, Artificial Sequence
  Description of Artificial Sequence: Synthetic oligonucleotide
  Target: SCN9A; (-) strand; PAM type: YTN; PAM sequence: CTC
aatcctgagataacagcatt

SEQ ID NO: 62964 - DNA, 20 bp, Artificial Sequence
  Description of Artificial Sequence: Synthetic oligonucleotide
  Target: SCN9A; (-) strand; PAM type: YTN; PAM sequence: TTA
taatgaactcaatcctgaga

SEQ ID NO: 62965 - DNA, 20 bp, Artificial Sequence
  Description of Artificial Sequence: Synthetic oligonucleotide
  Target: SCN9A; (-) strand; PAM type: YTN; PAM sequence: TTT
ataatgaactcaatcctgag

SEQ ID NO: 62966 - DNA, 20 bp, Artificial Sequence
  Description of Artificial Sequence: Synthetic oligonucleotide
  Target: SCN9A; (-) strand; PAM type: YTN; PAM sequence: CTG
tttataatgaactcaatcct

SEQ ID NO: 62967 - DNA, 20 bp, Artificial Sequence
  Description of Artificial Sequence: Synthetic oligonucleotide
  Target: SCN9A; (-) strand; PAM type: YTN; PAM sequence: CTG
cctgtttataatgaactcaa

SEQ ID NO: 62968 - DNA, 20 bp, Artificial Sequence
  Description of Artificial Sequence: Synthetic oligonucleotide
  Target: SCN9A; (-) strand; PAM type: YTN; PAM sequence: TTA
tgatacacatggcacaaaga

SEQ ID NO: 62969 - DNA, 20 bp, Artificial Sequence
  Description of Artificial Sequence: Synthetic oligonucleotide
  Target: SCN9A; (-) strand; PAM type: YTN; PAM sequence: CTG
taaggtatcatgttatgata

SEQ ID NO: 62970 - DNA, 20 bp, Artificial Sequence
  Description of Artificial Sequence: Synthetic oligonucleotide
  Target: SCN9A; (-) strand; PAM type: YTN; PAM sequence: TTG
tgtcataacatgctgtaagg

SEQ ID NO: 62971 - DNA, 20 bp, Artificial Sequence
  Description of Artificial Sequence: Synthetic oligonucleotide
  Target: SCN9A; (-) strand; PAM type: YTN; PAM sequence: TTG
ttgtgtcataacatgctgta

SEQ ID NO: 62972 - DNA, 20 bp, Artificial Sequence
  Description of Artificial Sequence: Synthetic oligonucleotide
  Target: SCN9A; (-) strand; PAM type: YTN; PAM sequence: TTT
gttgtgtcataacatgctgt

SEQ ID NO: 62973 - DNA, 20 bp, Artificial Sequence
  Description of Artificial Sequence: Synthetic oligonucleotide
  Target: SCN9A; (-) strand; PAM type: YTN; PAM sequence: TTA
tttgttgtgtcataacatgc

SEQ ID NO: 62974 - DNA, 20 bp, Artificial Sequence
  Description of Artificial Sequence: Synthetic oligonucleotide
  Target: SCN9A; (-) strand; PAM type: YTN; PAM sequence: CTT
atttgttgtgtcataacatg

SEQ ID NO: 62975 - DNA, 20 bp, Artificial Sequence
  Description of Artificial Sequence: Synthetic oligonucleotide
  Target: SCN9A; (-) strand; PAM type: YTN; PAM sequence: CTG
gtgaggtcttatttgttgtg

SEQ ID NO: 62976 - DNA, 20 bp, Artificial Sequence
  Description of Artificial Sequence: Synthetic oligonucleotide
  Target: SCN9A; (-) strand; PAM type: YTN; PAM sequence: CTG
tctggtgaggtcttatttgt

SEQ ID NO: 62977 - DNA, 20 bp, Artificial Sequence
  Description of Artificial Sequence: Synthetic oligonucleotide
  Target: SCN9A; (-) strand; PAM type: YTN; PAM sequence: CTG
aggggctgtctggtgaggtc

SEQ ID NO: 62978 - DNA, 20 bp, Artificial Sequence
  Description of Artificial Sequence: Synthetic oligonucleotide
  Target: SCN9A; (-) strand; PAM type: YTN; PAM sequence: TTC
atgactgaggggctgtctgg

SEQ ID NO: 62979 - DNA, 20 bp, Artificial Sequence
  Description of Artificial Sequence: Synthetic oligonucleotide
  Target: SCN9A; (-) strand; PAM type: YTN; PAM sequence: CTG
gaggatggaaagttcatgac

SEQ ID NO: 62980 - DNA, 20 bp, Artificial Sequence
  Description of Artificial Sequence: Synthetic oligonucleotide
  Target: SCN9A; (-) strand; PAM type: YTN; PAM sequence: TTA
tgggatcacagtactggagg

SEQ ID NO: 62981 - DNA, 20 bp, Artificial Sequence
  Description of Artificial Sequence: Synthetic oligonucleotide
  Target: SCN9A; (-) strand; PAM type: YTN; PAM sequence: CTT
atgggatcacagtactggag

SEQ ID NO: 62982 - DNA, 20 bp, Artificial Sequence
  Description of Artificial Sequence: Synthetic oligonucleotide
  Target: SCN9A; (-) strand; PAM type: YTN; PAM sequence: TTA
taatgaacataaaccttatg

SEQ ID NO: 62983 - DNA, 20 bp, Artificial Sequence
  Description of Artificial Sequence: Synthetic oligonucleotide
  Target: SCN9A; (-) strand; PAM type: YTN; PAM sequence: TTT
ataatgaacataaaccttat

SEQ ID NO: 62984 - DNA, 20 bp, Artificial Sequence
  Description of Artificial Sequence: Synthetic oligonucleotide
  Target: SCN9A; (-) strand; PAM type: YTN; PAM sequence: CTG
ggtaatttataatgaacata

SEQ ID NO: 62985 - DNA, 20 bp, Artificial Sequence
  Description of Artificial Sequence: Synthetic oligonucleotide
  Target: SCN9A; (-) strand; PAM type: YTN; PAM sequence: CTA
taacagaataccacagactg

SEQ ID NO: 62986 - DNA, 20 bp, Artificial Sequence
  Description of Artificial Sequence: Synthetic oligonucleotide
  Target: SCN9A; (-) strand; PAM type: YTN; PAM sequence: CTA
ctataacagaataccacaga

SEQ ID NO: 62987 - DNA, 20 bp, Artificial Sequence
  Description of Artificial Sequence: Synthetic oligonucleotide
  Target: SCN9A; (-) strand; PAM type: YTN; PAM sequence: TTG
tgctactataacagaatacc

SEQ ID NO: 62988 - DNA, 20 bp, Artificial Sequence
  Description of Artificial Sequence: Synthetic oligonucleotide
  Target: SCN9A; (-) strand; PAM type: YTN; PAM sequence: TTT
gtgctactataacagaatac

SEQ ID NO: 62989 - DNA, 20 bp, Artificial Sequence
  Description of Artificial Sequence: Synthetic oligonucleotide
  Target: SCN9A; (-) strand; PAM type: YTN; PAM sequence: CTC
atccatttgtgctactataa

SEQ ID NO: 62990 - DNA, 20 bp, Artificial Sequence
  Description of Artificial Sequence: Synthetic oligonucleotide
  Target: SCN9A; (-) strand; PAM type: YTN; PAM sequence: TTC
tcatccatttgtgctactat

SEQ ID NO: 62991 - DNA, 20 bp, Artificial Sequence
  Description of Artificial Sequence: Synthetic oligonucleotide
  Target: SCN9A; (-) strand; PAM type: YTN; PAM sequence: CTG
ttctcatccatttgtgctac

SEQ ID NO: 62992 - DNA, 20 bp, Artificial Sequence
  Description of Artificial Sequence: Synthetic oligonucleotide
  Target: SCN9A; (-) strand; PAM type: YTN; PAM sequence: CTC
tgttctcatccatttgtgct

SEQ ID NO: 62993 - DNA, 20 bp, Artificial Sequence
  Description of Artificial Sequence: Synthetic oligonucleotide
  Target: SCN9A; (-) strand; PAM type: YTN; PAM sequence: TTC
ctctgttctcatccatttgt

SEQ ID NO: 62994 - DNA, 20 bp, Artificial Sequence
  Description of Artificial Sequence: Synthetic oligonucleotide
  Target: SCN9A; (-) strand; PAM type: YTN; PAM sequence: TTT
cctctgttctcatccatttg

SEQ ID NO: 62995 - DNA, 20 bp, Artificial Sequence
  Description of Artificial Sequence: Synthetic oligonucleotide
  Target: SCN9A; (-) strand; PAM type: YTN; PAM sequence: TTA
tcatgaagtatatttcctct

SEQ ID NO: 62996 - DNA, 20 bp, Artificial Sequence
  Description of Artificial Sequence: Synthetic oligonucleotide
  Target: SCN9A; (-) strand; PAM type: YTN; PAM sequence: TTG
ttatcatgaagtatatttcc

SEQ ID NO: 62997 - DNA, 20 bp, Artificial Sequence
  Description of Artificial Sequence: Synthetic oligonucleotide
  Target: SCN9A; (-) strand; PAM type: YTN; PAM sequence: TTT
gttatcatgaagtatatttc

SEQ ID NO: 62998 - DNA, 20 bp, Artificial Sequence
  Description of Artificial Sequence: Synthetic oligonucleotide
  Target: SCN9A; (-) strand; PAM type: YTN; PAM sequence: CTT
tgttatcatgaagtatattt

SEQ ID NO: 62999 - DNA, 20 bp, Artificial Sequence
  Description of Artificial Sequence: Synthetic oligonucleotide
  Target: SCN9A; (-) strand; PAM type: YTN; PAM sequence: TTC
aagtagtctttgttatcatg

SEQ ID NO: 63000 - DNA, 20 bp, Artificial Sequence
  Description of Artificial Sequence: Synthetic oligonucleotide
  Target: SCN9A; (-) strand; PAM type: YTN; PAM sequence: TTT
caagtagtctttgttatcat

SEQ ID NO: 63001 - DNA, 20 bp, Artificial Sequence
  Description of Artificial Sequence: Synthetic oligonucleotide
  Target: SCN9A; (-) strand; PAM type: YTN; PAM sequence: TTT
tcaagtagtctttgttatca

SEQ ID NO: 63002 - DNA, 20 bp, Artificial Sequence
  Description of Artificial Sequence: Synthetic oligonucleotide
  Target: SCN9A; (-) strand; PAM type: YTN; PAM sequence: CTG
tgggattttcaagtagtctt

SEQ ID NO: 63003 - DNA, 20 bp, Artificial Sequence
  Description of Artificial Sequence: Synthetic oligonucleotide
  Target: SCN9A; (-) strand; PAM type: YTN; PAM sequence: TTA
gctgtgggattttcaagtag

SEQ ID NO: 63004 - DNA, 20 bp, Artificial Sequence
  Description of Artificial Sequence: Synthetic oligonucleotide
  Target: SCN9A; (-) strand; PAM type: YTN; PAM sequence: TTG
aatacgatgttagctgtggg

SEQ ID NO: 63005 - DNA, 20 bp, Artificial Sequence
  Description of Artificial Sequence: Synthetic oligonucleotide
  Target: SCN9A; (-) strand; PAM type: YTN; PAM sequence: TTC
accattgaatacgatgttag

SEQ ID NO: 63006 - DNA, 20 bp, Artificial Sequence
  Description of Artificial Sequence: Synthetic oligonucleotide
  Target: SCN9A; (-) strand; PAM type: YTN; PAM sequence: TTT
caccattgaatacgatgtta

SEQ ID NO: 63007 - DNA, 20 bp, Artificial Sequence
  Description of Artificial Sequence: Synthetic oligonucleotide
  Target: SCN9A; (-) strand; PAM type: YTN; PAM sequence: TTT
tcaccattgaatacgatgtt

SEQ ID NO: 63008 - DNA, 20 bp, Artificial Sequence
  Description of Artificial Sequence: Synthetic oligonucleotide
  Target: SCN9A; (-) strand; PAM type: YTN; PAM sequence: TTT
ttcaccattgaatacgatgt

SEQ ID NO: 63009 - DNA, 20 bp, Artificial Sequence
  Description of Artificial Sequence: Synthetic oligonucleotide
  Target: SCN9A; (-) strand; PAM type: YTN; PAM sequence: TTC
agtttttcaccattgaatac

SEQ ID NO: 63010 - DNA, 20 bp, Artificial Sequence
  Description of Artificial Sequence: Synthetic oligonucleotide
  Target: SCN9A; (-) strand; PAM type: YTN; PAM sequence: TTT
cagtttttcaccattgaata

SEQ ID NO: 63011 - DNA, 20 bp, Artificial Sequence
  Description of Artificial Sequence: Synthetic oligonucleotide
  Target: SCN9A; (-) strand; PAM type: YTN; PAM sequence: TTT
tcagtttttcaccattgaat

SEQ ID NO: 63012 - DNA, 20 bp, Artificial Sequence
  Description of Artificial Sequence: Synthetic oligonucleotide
  Target: SCN9A; (-) strand; PAM type: YTN; PAM sequence: TTT
ttcagtttttcaccattgaa

SEQ ID NO: 63013 - DNA, 20 bp, Artificial Sequence
  Description of Artificial Sequence: Synthetic oligonucleotide
  Target: SCN9A; (-) strand; PAM type: YTN; PAM sequence: TTA
caggaaagtttttcagtttt

SEQ ID NO: 63014 - DNA, 20 bp, Artificial Sequence
  Description of Artificial Sequence: Synthetic oligonucleotide
  Target: SCN9A; (-) strand; PAM type: YTN; PAM sequence: CTT
acaggaaagtttttcagttt

SEQ ID NO: 63015 - DNA, 20 bp, Artificial Sequence
  Description of Artificial Sequence: Synthetic oligonucleotide
  Target: SCN9A; (-) strand; PAM type: YTN; PAM sequence: CTG
atcttacaggaaagtttttc

SEQ ID NO: 63016 - DNA, 20 bp, Artificial Sequence
  Description of Artificial Sequence: Synthetic oligonucleotide
  Target: SCN9A; (-) strand; PAM type: YTN; PAM sequence: TTC
ctgatcttacaggaaagttt

SEQ ID NO: 63017 - DNA, 20 bp, Artificial Sequence
  Description of Artificial Sequence: Synthetic oligonucleotide
  Target: SCN9A; (-) strand; PAM type: YTN; PAM sequence: TTA
ttcctgatcttacaggaaag

SEQ ID NO: 63018 - DNA, 20 bp, Artificial Sequence
  Description of Artificial Sequence: Synthetic oligonucleotide
  Target: SCN9A; (-) strand; PAM type: YTN; PAM sequence: CTT
attcctgatcttacaggaaa

SEQ ID NO: 63019 - DNA, 20 bp, Artificial Sequence
  Description of Artificial Sequence: Synthetic oligonucleotide
  Target: SCN9A; (-) strand; PAM type: YTN; PAM sequence: TTG
tcttattcctgatcttacag

SEQ ID NO: 63020 - DNA, 20 bp, Artificial Sequence
  Description of Artificial Sequence: Synthetic oligonucleotide
  Target: SCN9A; (-) strand; PAM type: YTN; PAM sequence: TTT
gtcttattcctgatcttaca

SEQ ID NO: 63021 - DNA, 20 bp, Artificial Sequence
  Description of Artificial Sequence: Synthetic oligonucleotide
  Target: SCN9A; (-) strand; PAM type: YTN; PAM sequence: TTA
aatacaagtggcaagagtag

SEQ ID NO: 63022 - DNA, 20 bp, Artificial Sequence
  Description of Artificial Sequence: Synthetic oligonucleotide
  Target: SCN9A; (-) strand; PAM type: YTN; PAM sequence: CTG
tgttaaatacaagtggcaag

SEQ ID NO: 63023 - DNA, 20 bp, Artificial Sequence
  Description of Artificial Sequence: Synthetic oligonucleotide
  Target: SCN9A; (-) strand; PAM type: YTN; PAM sequence: CTA
gtgctgtgttaaatacaagt

SEQ ID NO: 63024 - DNA, 20 bp, Artificial Sequence
  Description of Artificial Sequence: Synthetic oligonucleotide
  Target: SCN9A; (-) strand; PAM type: YTN; PAM sequence: TTC
tagtgctgtgttaaatacaa

SEQ ID NO: 63025 - DNA, 20 bp, Artificial Sequence
  Description of Artificial Sequence: Synthetic oligonucleotide
  Target: SCN9A; (-) strand; PAM type: YTN; PAM sequence: CTT
ctagtgctgtgttaaataca

SEQ ID NO: 63026 - DNA, 20 bp, Artificial Sequence
  Description of Artificial Sequence: Synthetic oligonucleotide
  Target: SCN9A; (-) strand; PAM type: YTN; PAM sequence: CTA
ggacttctagtgctgtgtta

SEQ ID NO: 63027 - DNA, 20 bp, Artificial Sequence
  Description of Artificial Sequence: Synthetic oligonucleotide
  Target: SCN9A; (-) strand; PAM type: YTN; PAM sequence: CTG
gctaggacttctagtgctgt

SEQ ID NO: 63028 - DNA, 20 bp, Artificial Sequence
  Description of Artificial Sequence: Synthetic oligonucleotide
  Target: SCN9A; (-) strand; PAM type: YTN; PAM sequence: CTC
tggctaggacttctagtgct

SEQ ID NO: 63029 - DNA, 20 bp, Artificial Sequence
  Description of Artificial Sequence: Synthetic oligonucleotide
  Target: SCN9A; (-) strand; PAM type: YTN; PAM sequence: TTC
tctggctaggacttctagtg

SEQ ID NO: 63030 - DNA, 20 bp, Artificial Sequence
  Description of Artificial Sequence: Synthetic oligonucleotide
  Target: SCN9A; (-) strand; PAM type: YTN; PAM sequence: TTT
ctctggctaggacttctagt

SEQ ID NO: 63031 - DNA, 20 bp, Artificial Sequence
  Description of Artificial Sequence: Synthetic oligonucleotide
  Target: SCN9A; (-) strand; PAM type: YTN; PAM sequence: CTA
atttctctggctaggacttc

SEQ ID NO: 63032 - DNA, 20 bp, Artificial Sequence
  Description of Artificial Sequence: Synthetic oligonucleotide
  Target: SCN9A; (-) strand; PAM type: YTN; PAM sequence: TTG
cctaatttctctggctagga

SEQ ID NO: 63033 - DNA, 20 bp, Artificial Sequence
  Description of Artificial Sequence: Synthetic oligonucleotide
  Target: SCN9A; (-) strand; PAM type: YTN; PAM sequence: CTT
gcctaatttctctggctagg

SEQ ID NO: 63034 - DNA, 20 bp, Artificial Sequence
  Description of Artificial Sequence: Synthetic oligonucleotide
  Target: SCN9A; (-) strand; PAM type: YTN; PAM sequence: TTC
ttgcctaatttctctggcta

SEQ ID NO: 63035 - DNA, 20 bp, Artificial Sequence
  Description of Artificial Sequence: Synthetic oligonucleotide
  Target: SCN9A; (-) strand; PAM type: YTN; PAM sequence: TTT
cttgcctaatttctctggct

SEQ ID NO: 63036 - DNA, 20 bp, Artificial Sequence
  Description of Artificial Sequence: Synthetic oligonucleotide
  Target: SCN9A; (-) strand; PAM type: YTN; PAM sequence: TTT
tcttgcctaatttctctggc

SEQ ID NO: 63037 - DNA, 20 bp, Artificial Sequence
  Description of Artificial Sequence: Synthetic oligonucleotide
  Target: SCN9A; (-) strand; PAM type: YTN; PAM sequence: TTT
ttcttgcctaatttctctgg

SEQ ID NO: 63038 - DNA, 20 bp, Artificial Sequence
  Description of Artificial Sequence: Synthetic oligonucleotide
  Target: SCN9A; (-) strand; PAM type: YTN; PAM sequence: TTG
tttttcttgcctaatttctc

SEQ ID NO: 63039 - DNA, 20 bp, Artificial Sequence
  Description of Artificial Sequence: Synthetic oligonucleotide
  Target: SCN9A; (-) strand; PAM type: YTN; PAM sequence: CTT
gtttttcttgcctaatttct

SEQ ID NO: 63040 - DNA, 20 bp, Artificial Sequence
  Description of Artificial Sequence: Synthetic oligonucleotide
  Target: SCN9A; (-) strand; PAM type: YTN; PAM sequence: TTA
cttgtttttcttgcctaatt

SEQ ID NO: 63041 - DNA, 20 bp, Artificial Sequence
  Description of Artificial Sequence: Synthetic oligonucleotide
  Target: SCN9A; (-) strand; PAM type: YTN; PAM sequence: TTT
acttgtttttcttgcctaat

SEQ ID NO: 63042 - DNA, 20 bp, Artificial Sequence
  Description of Artificial Sequence: Synthetic oligonucleotide
  Target: SCN9A; (-) strand; PAM type: YTN; PAM sequence: TTT
tacttgtttttcttgcctaa

SEQ ID NO: 63043 - DNA, 20 bp, Artificial Sequence
  Description of Artificial Sequence: Synthetic oligonucleotide
  Target: SCN9A; (-) strand; PAM type: YTN; PAM sequence: CTT
ttacttgtttttcttgccta

SEQ ID NO: 63044 - DNA, 20 bp, Artificial Sequence
  Description of Artificial Sequence: Synthetic oligonucleotide
  Target: SCN9A; (-) strand; PAM type: YTN; PAM sequence: TTG
ggatgtcttttacttgtttt

SEQ ID NO: 63045 - DNA, 20 bp, Artificial Sequence
  Description of Artificial Sequence: Synthetic oligonucleotide
  Target: SCN9A; (-) strand; PAM type: YTN; PAM sequence: TTC
agattgggatgtcttttact

SEQ ID NO: 63046 - DNA, 20 bp, Artificial Sequence
  Description of Artificial Sequence: Synthetic oligonucleotide
  Target: SCN9A; (-) strand; PAM type: YTN; PAM sequence: TTT
cagattgggatgtcttttac

SEQ ID NO: 63047 - DNA, 20 bp, Artificial Sequence
  Description of Artificial Sequence: Synthetic oligonucleotide
  Target: SCN9A; (-) strand; PAM type: YTN; PAM sequence: CTT
tcagattgggatgtctttta

SEQ ID NO: 63048 - DNA, 20 bp, Artificial Sequence
  Description of Artificial Sequence: Synthetic oligonucleotide
  Target: SCN9A; (-) strand; PAM type: YTN; PAM sequence: TTC
tttcagattgggatgtcttt

SEQ ID NO: 63049 - DNA, 20 bp, Artificial Sequence
  Description of Artificial Sequence: Synthetic oligonucleotide
  Target: SCN9A; (-) strand; PAM type: YTN; PAM sequence: TTT
ctttcagattgggatgtctt

SEQ ID NO: 63050 - DNA, 20 bp, Artificial Sequence
  Description of Artificial Sequence: Synthetic oligonucleotide
  Target: SCN9A; (-) strand; PAM type: YTN; PAM sequence: TTT
tctttcagattgggatgtct

SEQ ID NO: 63051 - DNA, 20 bp, Artificial Sequence
  Description of Artificial Sequence: Synthetic oligonucleotide
  Target: SCN9A; (-) strand; PAM type: YTN; PAM sequence: TTT
ttctttcagattgggatgtc

SEQ ID NO: 63052 - DNA, 20 bp, Artificial Sequence
  Description of Artificial Sequence: Synthetic oligonucleotide
  Target: SCN9A; (-) strand; PAM type: YTN; PAM sequence: TTT
tttctttcagattgggatgt

SEQ ID NO: 63053 - DNA, 20 bp, Artificial Sequence
  Description of Artificial Sequence: Synthetic oligonucleotide
  Target: SCN9A; (-) strand; PAM type: YTN; PAM sequence: CTT
ttttctttcagattgggatg

SEQ ID NO: 63054 - DNA, 20 bp, Artificial Sequence
  Description of Artificial Sequence: Synthetic oligonucleotide
  Target: SCN9A; (-) strand; PAM type: YTN; PAM sequence: CTG
taaacacttttttctttcag

SEQ ID NO: 63055 - DNA, 20 bp, Artificial Sequence
  Description of Artificial Sequence: Synthetic oligonucleotide
  Target: SCN9A; (-) strand; PAM type: YTN; PAM sequence: CTC
catataaaataatgtcatct

SEQ ID NO: 63056 - DNA, 20 bp, Artificial Sequence
  Description of Artificial Sequence: Synthetic oligonucleotide
  Target: SCN9A; (-) strand; PAM type: YTN; PAM sequence: CTC
tccatataaaataatgtcat

SEQ ID NO: 63057 - DNA, 20 bp, Artificial Sequence
  Description of Artificial Sequence: Synthetic oligonucleotide
  Target: SCN9A; (-) strand; PAM type: YTN; PAM sequence: TTA
gggtactctccatataaaat

SEQ ID NO: 63058 - DNA, 20 bp, Artificial Sequence
  Description of Artificial Sequence: Synthetic oligonucleotide
  Target: SCN9A; (-) strand; PAM type: YTN; PAM sequence: TTT
agggtactctccatataaaa

SEQ ID NO: 63059 - DNA, 20 bp, Artificial Sequence
  Description of Artificial Sequence: Synthetic oligonucleotide
  Target: SCN9A; (-) strand; PAM type: YTN; PAM sequence: CTT
tagggtactctccatataaa

SEQ ID NO: 63060 - DNA, 20 bp, Artificial Sequence
  Description of Artificial Sequence: Synthetic oligonucleotide
  Target: SCN9A; (-) strand; PAM type: YTN; PAM sequence: CTG
atgtgtggagtctttagggt

SEQ ID NO: 63061 - DNA, 20 bp, Artificial Sequence
  Description of Artificial Sequence: Synthetic oligonucleotide
  Target: SCN9A; (-) strand; PAM type: YTN; PAM sequence: TTC
ctgatgtgtggagtctttag

SEQ ID NO: 63062 - DNA, 20 bp, Artificial Sequence
  Description of Artificial Sequence: Synthetic oligonucleotide
  Target: SCN9A; (-) strand; PAM type: YTN; PAM sequence: TTT
cctgatgtgtggagtcttta

SEQ ID NO: 63063 - DNA, 20 bp, Artificial Sequence
  Description of Artificial Sequence: Synthetic oligonucleotide
  Target: SCN9A; (-) strand; PAM type: YTN; PAM sequence: TTT
tcctgatgtgtggagtcttt

SEQ ID NO: 63064 - DNA, 20 bp, Artificial Sequence
  Description of Artificial Sequence: Synthetic oligonucleotide
  Target: SCN9A; (-) strand; PAM type: YTN; PAM sequence: CTA
acagattttcctgatgtgtg

SEQ ID NO: 63065 - DNA, 20 bp, Artificial Sequence
  Description of Artificial Sequence: Synthetic oligonucleotide
  Target: SCN9A; (-) strand; PAM type: YTN; PAM sequence: TTC
taacagattttcctgatgtg

SEQ ID NO: 63066 - DNA, 20 bp, Artificial Sequence
  Description of Artificial Sequence: Synthetic oligonucleotide
  Target: SCN9A; (-) strand; PAM type: YTN; PAM sequence: TTA
gttctaacagattttcctga

SEQ ID NO: 63067 - DNA, 20 bp, Artificial Sequence
  Description of Artificial Sequence: Synthetic oligonucleotide
  Target: SCN9A; (-) strand; PAM type: YTN; PAM sequence: TTA
ttagttctaacagattttcc

SEQ ID NO: 63068 - DNA, 20 bp, Artificial Sequence
  Description of Artificial Sequence: Synthetic oligonucleotide
  Target: SCN9A; (-) strand; PAM type: YTN; PAM sequence: TTT
attagttctaacagattttc

SEQ ID NO: 63069 - DNA, 20 bp, Artificial Sequence
  Description of Artificial Sequence: Synthetic oligonucleotide
  Target: SCN9A; (-) strand; PAM type: YTN; PAM sequence: TTG
tttattagttctaacagatt

SEQ ID NO: 63070 - DNA, 20 bp, Artificial Sequence
  Description of Artificial Sequence: Synthetic oligonucleotide
  Target: SCN9A; (-) strand; PAM type: YTN; PAM sequence: TTT
gtttattagttctaacagat

SEQ ID NO: 63071 - DNA, 20 bp, Artificial Sequence
  Description of Artificial Sequence: Synthetic oligonucleotide
  Target: SCN9A; (-) strand; PAM type: YTN; PAM sequence: CTA
gtaaatttgtttattagttc

SEQ ID NO: 63072 - DNA, 20 bp, Artificial Sequence
  Description of Artificial Sequence: Synthetic oligonucleotide
  Target: SCN9A; (-) strand; PAM type: YTN; PAM sequence: TTC
aacatctagtaaatttgttt

SEQ ID NO: 63073 - DNA, 20 bp, Artificial Sequence
  Description of Artificial Sequence: Synthetic oligonucleotide
  Target: SCN9A; (-) strand; PAM type: YTN; PAM sequence: CTT
caacatctagtaaatttgtt

SEQ ID NO: 63074 - DNA, 20 bp, Artificial Sequence
  Description of Artificial Sequence: Synthetic oligonucleotide
  Target: SCN9A; (-) strand; PAM type: YTN; PAM sequence: TTA
tatccttcaacatctagtaa

SEQ ID NO: 63075 - DNA, 20 bp, Artificial Sequence
  Description of Artificial Sequence: Synthetic oligonucleotide
  Target: SCN9A; (-) strand; PAM type: YTN; PAM sequence: TTT
atatccttcaacatctagta

SEQ ID NO: 63076 - DNA, 20 bp, Artificial Sequence
  Description of Artificial Sequence: Synthetic oligonucleotide
  Target: SCN9A; (-) strand; PAM type: YTN; PAM sequence: TTT
tatatccttcaacatctagt

SEQ ID NO: 63077 - DNA, 20 bp, Artificial Sequence
  Description of Artificial Sequence: Synthetic oligonucleotide
  Target: SCN9A; (-) strand; PAM type: YTN; PAM sequence: TTG
attttatatccttcaacatc

SEQ ID NO: 63078 - DNA, 20 bp, Artificial Sequence
  Description of Artificial Sequence: Synthetic oligonucleotide
  Target: SCN9A; (-) strand; PAM type: YTN; PAM sequence: TTG
tatgttgattttatatcctt

SEQ ID NO: 63079 - DNA, 20 bp, Artificial Sequence
  Description of Artificial Sequence: Synthetic oligonucleotide
  Target: SCN9A; (-) strand; PAM type: YTN; PAM sequence: TTT
gtatgttgattttatatcct

SEQ ID NO: 63080 - DNA, 20 bp, Artificial Sequence
  Description of Artificial Sequence: Synthetic oligonucleotide
  Target: SCN9A; (-) strand; PAM type: YTN; PAM sequence: TTT
tgtatgttgattttatatcc

SEQ ID NO: 63081 - DNA, 20 bp, Artificial Sequence
  Description of Artificial Sequence: Synthetic oligonucleotide
  Target: SCN9A; (-) strand; PAM type: YTN; PAM sequence: TTT
ttgtatgttgattttatatc

SEQ ID NO: 63082 - DNA, 20 bp, Artificial Sequence
  Description of Artificial Sequence: Synthetic oligonucleotide
  Target: SCN9A; (-) strand; PAM type: YTN; PAM sequence: TTA
gtgtatagaaacgcaggtga

SEQ ID NO: 63083 - DNA, 20 bp, Artificial Sequence
  Description of Artificial Sequence: Synthetic oligonucleotide
  Target: SCN9A; (-) strand; PAM type: YTN; PAM sequence: TTG
ttagtgtatagaaacgcagg

SEQ ID NO: 63084 - DNA, 20 bp, Artificial Sequence
  Description of Artificial Sequence: Synthetic oligonucleotide
  Target: SCN9A; (-) strand; PAM type: YTN; PAM sequence: TTA
ttgttagtgtatagaaacgc

SEQ ID NO: 63085 - DNA, 20 bp, Artificial Sequence
  Description of Artificial Sequence: Synthetic oligonucleotide
  Target: SCN9A; (-) strand; PAM type: YTN; PAM sequence: TTT
attgttagtgtatagaaacg

SEQ ID NO: 63086 - DNA, 20 bp, Artificial Sequence
  Description of Artificial Sequence: Synthetic oligonucleotide
  Target: SCN9A; (-) strand; PAM type: YTN; PAM sequence: TTG
tttattgttagtgtatagaa

SEQ ID NO: 63087 - DNA, 20 bp, Artificial Sequence
  Description of Artificial Sequence: Synthetic oligonucleotide
  Target: SCN9A; (-) strand; PAM type: YTN; PAM sequence: TTC
agattgtttattgttagtgt

SEQ ID NO: 63088 - DNA, 20 bp, Artificial Sequence
  Description of Artificial Sequence: Synthetic oligonucleotide
  Target: SCN9A; (-) strand; PAM type: YTN; PAM sequence: CTT
cagattgtttattgttagtg

SEQ ID NO: 63089 - DNA, 20 bp, Artificial Sequence
  Description of Artificial Sequence: Synthetic oligonucleotide
  Target: SCN9A; (-) strand; PAM type: YTN; PAM sequence: CTC
ttcagattgtttattgttag

SEQ ID NO: 63090 - DNA, 20 bp, Artificial Sequence
  Description of Artificial Sequence: Synthetic oligonucleotide
  Target: SCN9A; (-) strand; PAM type: YTN; PAM sequence: TTC
tcttcagattgtttattgtt

SEQ ID NO: 63091 - DNA, 20 bp, Artificial Sequence
  Description of Artificial Sequence: Synthetic oligonucleotide
  Target: SCN9A; (-) strand; PAM type: YTN; PAM sequence: TTT
ctcttcagattgtttattgt

SEQ ID NO: 63092 - DNA, 20 bp, Artificial Sequence
  Description of Artificial Sequence: Synthetic oligonucleotide
  Target: SCN9A; (-) strand; PAM type: YTN; PAM sequence: TTT
tctcttcagattgtttattg

SEQ ID NO: 63093 - DNA, 20 bp, Artificial Sequence
  Description of Artificial Sequence: Synthetic oligonucleotide
  Target: SCN9A; (-) strand; PAM type: YTN; PAM sequence: CTA
attttctcttcagattgttt

SEQ ID NO: 63094 - DNA, 20 bp, Artificial Sequence
  Description of Artificial Sequence: Synthetic oligonucleotide
  Target: SCN9A; (-) strand; PAM type: YTN; PAM sequence: TTC
ctaattttctcttcagattg

SEQ ID NO: 63095 - DNA, 20 bp, Artificial Sequence
  Description of Artificial Sequence: Synthetic oligonucleotide
  Target: SCN9A; (-) strand; PAM type: YTN; PAM sequence: TTT
cctaattttctcttcagatt

SEQ ID NO: 63096 - DNA, 20 bp, Artificial Sequence
  Description of Artificial Sequence: Synthetic oligonucleotide
  Target: SCN9A; (-) strand; PAM type: YTN; PAM sequence: CTT
tcctaattttctcttcagat

SEQ ID NO: 63097 - DNA, 20 bp, Artificial Sequence
  Description of Artificial Sequence: Synthetic oligonucleotide
  Target: SCN9A; (-) strand; PAM type: YTN; PAM sequence: TTC
tttcctaattttctcttcag

SEQ ID NO: 63098 - DNA, 20 bp, Artificial Sequence
  Description of Artificial Sequence: Synthetic oligonucleotide
  Target: SCN9A; (-) strand; PAM type: YTN; PAM sequence: TTT
ctttcctaattttctcttca

SEQ ID NO: 63099 - DNA, 20 bp, Artificial Sequence
  Description of Artificial Sequence: Synthetic oligonucleotide
  Target: SCN9A; (-) strand; PAM type: YTN; PAM sequence: TTA
tcataaatgggatttctttc

SEQ ID NO: 63100 - DNA, 20 bp, Artificial Sequence
  Description of Artificial Sequence: Synthetic oligonucleotide
  Target: SCN9A; (-) strand; PAM type: YTN; PAM sequence: TTG
atgttatcataaatgggatt

SEQ ID NO: 63101 - DNA, 20 bp, Artificial Sequence
  Description of Artificial Sequence: Synthetic oligonucleotide
  Target: SCN9A; (-) strand; PAM type: YTN; PAM sequence: TTT
gatgttatcataaatgggat

SEQ ID NO: 63102 - DNA, 20 bp, Artificial Sequence
  Description of Artificial Sequence: Synthetic oligonucleotide
  Target: SCN9A; (-) strand; PAM type: YTN; PAM sequence: TTT
tgatgttatcataaatggga

SEQ ID NO: 63103 - DNA, 20 bp, Artificial Sequence
  Description of Artificial Sequence: Synthetic oligonucleotide
  Target: SCN9A; (-) strand; PAM type: YTN; PAM sequence: CTT
ttgatgttatcataaatggg

SEQ ID NO: 63104 - DNA, 20 bp, Artificial Sequence
  Description of Artificial Sequence: Synthetic oligonucleotide
  Target: SCN9A; (-) strand; PAM type: YTN; PAM sequence: TTC
ttttgatgttatcataaatg

SEQ ID NO: 63105 - DNA, 20 bp, Artificial Sequence
  Description of Artificial Sequence: Synthetic oligonucleotide
  Target: SCN9A; (-) strand; PAM type: YTN; PAM sequence: TTT
cttttgatgttatcataaat

SEQ ID NO: 63106 - DNA, 20 bp, Artificial Sequence
  Description of Artificial Sequence: Synthetic oligonucleotide
  Target: SCN9A; (-) strand; PAM type: YTN; PAM sequence: TTA
tttcttttgatgttatcata

SEQ ID NO: 63107 - DNA, 20 bp, Artificial Sequence
  Description of Artificial Sequence: Synthetic oligonucleotide
  Target: SCN9A; (-) strand; PAM type: YTN; PAM sequence: TTT
atttcttttgatgttatcat

SEQ ID NO: 63108 - DNA, 20 bp, Artificial Sequence
  Description of Artificial Sequence: Synthetic oligonucleotide
  Target: SCN9A; (-) strand; PAM type: YTN; PAM sequence: TTT
tatttcttttgatgttatca

SEQ ID NO: 63109 - DNA, 20 bp, Artificial Sequence
  Description of Artificial Sequence: Synthetic oligonucleotide
  Target: SCN9A; (-) strand; PAM type: YTN; PAM sequence: CTA
agtattttatttcttttgat

SEQ ID NO: 63110 - DNA, 20 bp, Artificial Sequence
  Description of Artificial Sequence: Synthetic oligonucleotide
  Target: SCN9A; (-) strand; PAM type: YTN; PAM sequence: TTA
agcatatcctaagtatttta

SEQ ID NO: 63111 - DNA, 20 bp, Artificial Sequence
  Description of Artificial Sequence: Synthetic oligonucleotide
  Target: SCN9A; (-) strand; PAM type: YTN; PAM sequence: TTG
gttaagcatatcctaagtat

SEQ ID NO: 63112 - DNA, 20 bp, Artificial Sequence
  Description of Artificial Sequence: Synthetic oligonucleotide
  Target: SCN9A; (-) strand; PAM type: YTN; PAM sequence: CTT
ggttaagcatatcctaagta

SEQ ID NO: 63113 - DNA, 20 bp, Artificial Sequence
  Description of Artificial Sequence: Synthetic oligonucleotide
  Target: SCN9A; (-) strand; PAM type: YTN; PAM sequence: TTC
aatgccttggttaagcatat

SEQ ID NO: 63114 - DNA, 20 bp, Artificial Sequence
  Description of Artificial Sequence: Synthetic oligonucleotide
  Target: SCN9A; (-) strand; PAM type: YTN; PAM sequence: TTT
caatgccttggttaagcata

SEQ ID NO: 63115 - DNA, 20 bp, Artificial Sequence
  Description of Artificial Sequence: Synthetic oligonucleotide
  Target: SCN9A; (-) strand; PAM type: YTN; PAM sequence: TTT
tcaatgccttggttaagcat

SEQ ID NO: 63116 - DNA, 20 bp, Artificial Sequence
  Description of Artificial Sequence: Synthetic oligonucleotide
  Target: SCN9A; (-) strand; PAM type: YTN; PAM sequence: TTC
agtgcatacattttcaatgc

SEQ ID NO: 63117 - DNA, 20 bp, Artificial Sequence
  Description of Artificial Sequence: Synthetic oligonucleotide
  Target: SCN9A; (-) strand; PAM type: YTN; PAM sequence: TTT
cagtgcatacattttcaatg

SEQ ID NO: 63118 - DNA, 20 bp, Artificial Sequence
  Description of Artificial Sequence: Synthetic oligonucleotide
  Target: SCN9A; (-) strand; PAM type: YTN; PAM sequence: TTT
tcagtgcatacattttcaat

SEQ ID NO: 63119 - DNA, 20 bp, Artificial Sequence
  Description of Artificial Sequence: Synthetic oligonucleotide
  Target: SCN9A; (-) strand; PAM type: YTN; PAM sequence: TTG
tagttttcagtgcatacatt

SEQ ID NO: 63120 - DNA, 20 bp, Artificial Sequence
  Description of Artificial Sequence: Synthetic oligonucleotide
  Target: SCN9A; (-) strand; PAM type: YTN; PAM sequence: TTT
gtagttttcagtgcatacat

SEQ ID NO: 63121 - DNA, 20 bp, Artificial Sequence
  Description of Artificial Sequence: Synthetic oligonucleotide
  Target: SCN9A; (-) strand; PAM type: YTN; PAM sequence: TTT
tgtagttttcagtgcataca

SEQ ID NO: 63122 - DNA, 20 bp, Artificial Sequence
  Description of Artificial Sequence: Synthetic oligonucleotide
  Target: SCN9A; (-) strand; PAM type: YTN; PAM sequence: TTC
atgaacattttgtagttttc

SEQ ID NO: 63123 - DNA, 20 bp, Artificial Sequence
  Description of Artificial Sequence: Synthetic oligonucleotide
  Target: SCN9A; (-) strand; PAM type: YTN; PAM sequence: CTT
catgaacattttgtagtttt

SEQ ID NO: 63124 - DNA, 20 bp, Artificial Sequence
  Description of Artificial Sequence: Synthetic oligonucleotide
  Target: SCN9A; (-) strand; PAM type: YTN; PAM sequence: TTC
cttcatgaacattttgtagt

SEQ ID NO: 63125 - DNA, 20 bp, Artificial Sequence
  Description of Artificial Sequence: Synthetic oligonucleotide
  Target: SCN9A; (-) strand; PAM type: YTN; PAM sequence: TTT
ccttcatgaacattttgtag

SEQ ID NO: 63126 - DNA, 20 bp, Artificial Sequence
  Description of Artificial Sequence: Synthetic oligonucleotide
  Target: SCN9A; (-) strand; PAM type: YTN; PAM sequence: TTA
atttccttcatgaacatttt

SEQ ID NO: 63127 - DNA, 20 bp, Artificial Sequence
  Description of Artificial Sequence: Synthetic oligonucleotide
  Target: SCN9A; (-) strand; PAM type: YTN; PAM sequence: TTT
aatttccttcatgaacattt

SEQ ID NO: 63128 - DNA, 20 bp, Artificial Sequence
  Description of Artificial Sequence: Synthetic oligonucleotide
  Target: SCN9A; (-) strand; PAM type: YTN; PAM sequence: CTT
taatttccttcatgaacatt

SEQ ID NO: 63129 - DNA, 20 bp, Artificial Sequence
  Description of Artificial Sequence: Synthetic oligonucleotide
  Target: SCN9A; (-) strand; PAM type: YTN; PAM sequence: TTC
tttaatttccttcatgaaca

SEQ ID NO: 63130 - DNA, 20 bp, Artificial Sequence
  Description of Artificial Sequence: Synthetic oligonucleotide
  Target: SCN9A; (-) strand; PAM type: YTN; PAM sequence: CTT
ctttaatttccttcatgaac

SEQ ID NO: 63131 - DNA, 20 bp, Artificial Sequence
  Description of Artificial Sequence: Synthetic oligonucleotide
  Target: SCN9A; (-) strand; PAM type: YTN; PAM sequence: TTG
tgtcttctttaatttccttc

SEQ ID NO: 63132 - DNA, 20 bp, Artificial Sequence
  Description of Artificial Sequence: Synthetic oligonucleotide
  Target: SCN9A; (-) strand; PAM type: YTN; PAM sequence: TTT
gtgtcttctttaatttcctt

SEQ ID NO: 63133 - DNA, 20 bp, Artificial Sequence
  Description of Artificial Sequence: Synthetic oligonucleotide
  Target: SCN9A; (-) strand; PAM type: YTN; PAM sequence: TTA
tttgtgtcttctttaatttc

SEQ ID NO: 63134 - DNA, 20 bp, Artificial Sequence
  Description of Artificial Sequence: Synthetic oligonucleotide
  Target: SCN9A; (-) strand; PAM type: YTN; PAM sequence: TTT
atttgtgtcttctttaattt

SEQ ID NO: 63135 - DNA, 20 bp, Artificial Sequence
  Description of Artificial Sequence: Synthetic oligonucleotide
  Target: SCN9A; (-) strand; PAM type: YTN; PAM sequence: TTC
catttatttgtgtcttcttt

SEQ ID NO: 63136 - DNA, 20 bp, Artificial Sequence
  Description of Artificial Sequence: Synthetic oligonucleotide
  Target: SCN9A; (-) strand; PAM type: YTN; PAM sequence: TTT
ccatttatttgtgtcttctt

SEQ ID NO: 63137 - DNA, 20 bp, Artificial Sequence
  Description of Artificial Sequence: Synthetic oligonucleotide
  Target: SCN9A; (-) strand; PAM type: YTN; PAM sequence: CTT
tccatttatttgtgtcttct

SEQ ID NO: 63138 - DNA, 20 bp, Artificial Sequence
  Description of Artificial Sequence: Synthetic oligonucleotide
  Target: SCN9A; (-) strand; PAM type: YTN; PAM sequence: CTG
ggtctttccatttatttgtg

SEQ ID NO: 63139 - DNA, 20 bp, Artificial Sequence
  Description of Artificial Sequence: Synthetic oligonucleotide
  Target: SCN9A; (-) strand; PAM type: YTN; PAM sequence: TTC
gtgaatactgggtctttcca

SEQ ID NO: 63140 - DNA, 20 bp, Artificial Sequence
  Description of Artificial Sequence: Synthetic oligonucleotide
  Target: SCN9A; (-) strand; PAM type: YTN; PAM sequence: TTA
attcgtgaatactgggtctt

SEQ ID NO: 63141 - DNA, 20 bp, Artificial Sequence
  Description of Artificial Sequence: Synthetic oligonucleotide
  Target: SCN9A; (-) strand; PAM type: YTN; PAM sequence: TTT
aattcgtgaatactgggtct

SEQ ID NO: 63142 - DNA, 20 bp, Artificial Sequence
  Description of Artificial Sequence: Synthetic oligonucleotide
  Target: SCN9A; (-) strand; PAM type: YTN; PAM sequence: TTA
agtcatttaattcgtgaata

SEQ ID NO: 63143 - DNA, 20 bp, Artificial Sequence
  Description of Artificial Sequence: Synthetic oligonucleotide
  Target: SCN9A; (-) strand; PAM type: YTN; PAM sequence: TTA
acaatattaagtcatttaat

SEQ ID NO: 63144 - DNA, 20 bp, Artificial Sequence
  Description of Artificial Sequence: Synthetic oligonucleotide
  Target: SCN9A; (-) strand; PAM type: YTN; PAM sequence: TTT
aacaatattaagtcatttaa

SEQ ID NO: 63145 - DNA, 20 bp, Artificial Sequence
  Description of Artificial Sequence: Synthetic oligonucleotide
  Target: SCN9A; (-) strand; PAM type: YTN; PAM sequence: TTT
taacaatattaagtcattta

SEQ ID NO: 63146 - DNA, 20 bp, Artificial Sequence
  Description of Artificial Sequence: Synthetic oligonucleotide
  Target: SCN9A; (-) strand; PAM type: YTN; PAM sequence: TTA
gggtagtatgggcattttaa

SEQ ID NO: 63147 - DNA, 20 bp, Artificial Sequence
  Description of Artificial Sequence: Synthetic oligonucleotide
  Target: SCN9A; (-) strand; PAM type: YTN; PAM sequence: CTT
agggtagtatgggcatttta

SEQ ID NO: 63148 - DNA, 20 bp, Artificial Sequence
  Description of Artificial Sequence: Synthetic oligonucleotide
  Target: SCN9A; (-) strand; PAM type: YTN; PAM sequence: TTC
acagatcacttagggtagta

SEQ ID NO: 63149 - DNA, 20 bp, Artificial Sequence
  Description of Artificial Sequence: Synthetic oligonucleotide
  Target: SCN9A; (-) strand; PAM type: YTN; PAM sequence: TTG
aattcacagatcacttaggg

SEQ ID NO: 63150 - DNA, 20 bp, Artificial Sequence
  Description of Artificial Sequence: Synthetic oligonucleotide
  Target: SCN9A; (-) strand; PAM type: YTN; PAM sequence: CTG
tattgaattcacagatcact

SEQ ID NO: 63151 - DNA, 20 bp, Artificial Sequence
  Description of Artificial Sequence: Synthetic oligonucleotide
  Target: SCN9A; (-) strand; PAM type: YTN; PAM sequence: TTG
atatgtactgtattgaattc

SEQ ID NO: 63152 - DNA, 20 bp, Artificial Sequence
  Description of Artificial Sequence: Synthetic oligonucleotide
  Target: SCN9A; (-) strand; PAM type: YTN; PAM sequence: TTT
gatatgtactgtattgaatt

SEQ ID NO: 63153 - DNA, 20 bp, Artificial Sequence
  Description of Artificial Sequence: Synthetic oligonucleotide
  Target: SCN9A; (-) strand; PAM type: YTN; PAM sequence: TTT
tgatatgtactgtattgaat

SEQ ID NO: 63154 - DNA, 20 bp, Artificial Sequence
  Description of Artificial Sequence: Synthetic oligonucleotide
  Target: SCN9A; (-) strand; PAM type: YTN; PAM sequence: TTG
ggattttgatatgtactgta

SEQ ID NO: 63155 - DNA, 20 bp, Artificial Sequence
  Description of Artificial Sequence: Synthetic oligonucleotide
  Target: SCN9A; (-) strand; PAM type: YTN; PAM sequence: CTA
ttgggattttgatatgtact

SEQ ID NO: 63156 - DNA, 20 bp, Artificial Sequence
  Description of Artificial Sequence: Synthetic oligonucleotide
  Target: SCN9A; (-) strand; PAM type: YTN; PAM sequence: TTA
gtaaataatgctattgggat

SEQ ID NO: 63157 - DNA, 20 bp, Artificial Sequence
  Description of Artificial Sequence: Synthetic oligonucleotide
  Target: SCN9A; (-) strand; PAM type: YTN; PAM sequence: TTT
agtaaataatgctattggga

SEQ ID NO: 63158 - DNA, 20 bp, Artificial Sequence
  Description of Artificial Sequence: Synthetic oligonucleotide
  Target: SCN9A; (-) strand; PAM type: YTN; PAM sequence: TTT
tagtaaataatgctattggg

SEQ ID NO: 63159 - DNA, 20 bp, Artificial Sequence
  Description of Artificial Sequence: Synthetic oligonucleotide
  Target: SCN9A; (-) strand; PAM type: YTN; PAM sequence: TTA
ttttagtaaataatgctatt

SEQ ID NO: 63160 - DNA, 20 bp, Artificial Sequence
  Description of Artificial Sequence: Synthetic oligonucleotide
  Target: SCN9A; (-) strand; PAM type: YTN; PAM sequence: TTT
attttagtaaataatgctat

SEQ ID NO: 63161 - DNA, 20 bp, Artificial Sequence
  Description of Artificial Sequence: Synthetic oligonucleotide
  Target: SCN9A; (-) strand; PAM type: YTN; PAM sequence: TTT
tattttagtaaataatgcta

SEQ ID NO: 63162 - DNA, 20 bp, Artificial Sequence
  Description of Artificial Sequence: Synthetic oligonucleotide
  Target: SCN9A; (-) strand; PAM type: YTN; PAM sequence: TTT
ttattttagtaaataatgct

SEQ ID NO: 63163 - DNA, 20 bp, Artificial Sequence
  Description of Artificial Sequence: Synthetic oligonucleotide
  Target: SCN9A; (-) strand; PAM type: YTN; PAM sequence: TTT
tttattttagtaaataatgc

SEQ ID NO: 63164 - DNA, 20 bp, Artificial Sequence
  Description of Artificial Sequence: Synthetic oligonucleotide
  Target: SCN9A; (-) strand; PAM type: YTN; PAM sequence: TTT
ttttattttagtaaataatg

SEQ ID NO: 63165 - DNA, 20 bp, Artificial Sequence
  Description of Artificial Sequence: Synthetic oligonucleotide
  Target: SCN9A; (-) strand; PAM type: YTN; PAM sequence: CTT
tttttattttagtaaataat

SEQ ID NO: 63166 - DNA, 20 bp, Artificial Sequence
  Description of Artificial Sequence: Synthetic oligonucleotide
  Target: SCN9A; (-) strand; PAM type: YTN; PAM sequence: TTA
ggatctttttttattttagt

SEQ ID NO: 63167 - DNA, 20 bp, Artificial Sequence
  Description of Artificial Sequence: Synthetic oligonucleotide
  Target: SCN9A; (-) strand; PAM type: YTN; PAM sequence: TTT
aggatctttttttattttag

SEQ ID NO: 63168 - DNA, 20 bp, Artificial Sequence
  Description of Artificial Sequence: Synthetic oligonucleotide
  Target: SCN9A; (-) strand; PAM type: YTN; PAM sequence: TTT
taggatctttttttatttta

SEQ ID NO: 63169 - DNA, 20 bp, Artificial Sequence
  Description of Artificial Sequence: Synthetic oligonucleotide
  Target: SCN9A; (-) strand; PAM type: YTN; PAM sequence: TTC
catatgaattttaggatctt

SEQ ID NO: 63170 - DNA, 20 bp, Artificial Sequence
  Description of Artificial Sequence: Synthetic oligonucleotide
  Target: SCN9A; (-) strand; PAM type: YTN; PAM sequence: TTG
tggttccatatgaattttag

SEQ ID NO: 63171 - DNA, 20 bp, Artificial Sequence
  Description of Artificial Sequence: Synthetic oligonucleotide
  Target: SCN9A; (-) strand; PAM type: YTN; PAM sequence: TTT
gtggttccatatgaatttta

SEQ ID NO: 63172 - DNA, 20 bp, Artificial Sequence
  Description of Artificial Sequence: Synthetic oligonucleotide
  Target: SCN9A; (-) strand; PAM type: YTN; PAM sequence: TTT
tgtggttccatatgaatttt

SEQ ID NO: 63173 - DNA, 20 bp, Artificial Sequence
  Description of Artificial Sequence: Synthetic oligonucleotide
  Target: SCN9A; (-) strand; PAM type: YTN; PAM sequence: CTT
ttgtggttccatatgaattt

SEQ ID NO: 63174 - DNA, 20 bp, Artificial Sequence
  Description of Artificial Sequence: Synthetic oligonucleotide
  Target: SCN9A; (-) strand; PAM type: YTN; PAM sequence: TTC
agagtcttttgtggttccat

SEQ ID NO: 63175 - DNA, 20 bp, Artificial Sequence
  Description of Artificial Sequence: Synthetic oligonucleotide
  Target: SCN9A; (-) strand; PAM type: YTN; PAM sequence: CTA
ttcagagtcttttgtggttc

SEQ ID NO: 63176 - DNA, 20 bp, Artificial Sequence
  Description of Artificial Sequence: Synthetic oligonucleotide
  Target: SCN9A; (-) strand; PAM type: YTN; PAM sequence: TTG
gctattcagagtcttttgtg

SEQ ID NO: 63177 - DNA, 20 bp, Artificial Sequence
  Description of Artificial Sequence: Synthetic oligonucleotide
  Target: SCN9A; (-) strand; PAM type: YTN; PAM sequence: TTT
ggctattcagagtcttttgt

SEQ ID NO: 63178 - DNA, 20 bp, Artificial Sequence
  Description of Artificial Sequence: Synthetic oligonucleotide
  Target: SCN9A; (-) strand; PAM type: YTN; PAM sequence: CTT
tggctattcagagtcttttg

SEQ ID NO: 63179 - DNA, 20 bp, Artificial Sequence
  Description of Artificial Sequence: Synthetic oligonucleotide
  Target: SCN9A; (-) strand; PAM type: YTN; PAM sequence: TTG
ctttggctattcagagtctt

SEQ ID NO: 63180 - DNA, 20 bp, Artificial Sequence
  Description of Artificial Sequence: Synthetic oligonucleotide
  Target: SCN9A; (-) strand; PAM type: YTN; PAM sequence: TTA
agattgctttggctattcag

SEQ ID NO: 63181 - DNA, 20 bp, Artificial Sequence
  Description of Artificial Sequence: Synthetic oligonucleotide
  Target: SCN9A; (-) strand; PAM type: YTN; PAM sequence: CTT
aagattgctttggctattca

SEQ ID NO: 63182 - DNA, 20 bp, Artificial Sequence
  Description of Artificial Sequence: Synthetic oligonucleotide
  Target: SCN9A; (-) strand; PAM type: YTN; PAM sequence: TTC
ttaagattgctttggctatt

SEQ ID NO: 63183 - DNA, 20 bp, Artificial Sequence
  Description of Artificial Sequence: Synthetic oligonucleotide
  Target: SCN9A; (-) strand; PAM type: YTN; PAM sequence: TTT
cttaagattgctttggctat

SEQ ID NO: 63184 - DNA, 20 bp, Artificial Sequence
  Description of Artificial Sequence: Synthetic oligonucleotide
  Target: SCN9A; (-) strand; PAM type: YTN; PAM sequence: TTT
tcttaagattgctttggcta

SEQ ID NO: 63185 - DNA, 20 bp, Artificial Sequence
  Description of Artificial Sequence: Synthetic oligonucleotide
  Target: SCN9A; (-) strand; PAM type: YTN; PAM sequence: TTT
ttcttaagattgctttggct

SEQ ID NO: 63186 - DNA, 20 bp, Artificial Sequence
  Description of Artificial Sequence: Synthetic oligonucleotide
  Target: SCN9A; (-) strand; PAM type: YTN; PAM sequence: TTT
tttcttaagattgctttggc

SEQ ID NO: 63187 - DNA, 20 bp, Artificial Sequence
  Description of Artificial Sequence: Synthetic oligonucleotide
  Target: SCN9A; (-) strand; PAM type: YTN; PAM sequence: CTT
ttttcttaagattgctttgg

SEQ ID NO: 63188 - DNA, 20 bp, Artificial Sequence
  Description of Artificial Sequence: Synthetic oligonucleotide
  Target: SCN9A; (-) strand; PAM type: YTN; PAM sequence: TTC
ttttttcttaagattgcttt

SEQ ID NO: 63189 - DNA, 20 bp, Artificial Sequence
  Description of Artificial Sequence: Synthetic oligonucleotide
  Target: SCN9A; (-) strand; PAM type: YTN; PAM sequence: TTG
ttcttttttcttaagattgc

SEQ ID NO: 63190 - DNA, 20 bp, Artificial Sequence
  Description of Artificial Sequence: Synthetic oligonucleotide
  Target: SCN9A; (-) strand; PAM type: YTN; PAM sequence: TTT
gttcttttttcttaagattg

SEQ ID NO: 63191 - DNA, 20 bp, Artificial Sequence
  Description of Artificial Sequence: Synthetic oligonucleotide
  Target: SCN9A; (-) strand; PAM type: YTN; PAM sequence: TTT
tgttcttttttcttaagatt

SEQ ID NO: 63192 - DNA, 20 bp, Artificial Sequence
  Description of Artificial Sequence: Synthetic oligonucleotide
  Target: SCN9A; (-) strand; PAM type: YTN; PAM sequence: TTC
cattttgttcttttttctta

SEQ ID NO: 63193 - DNA, 20 bp, Artificial Sequence
  Description of Artificial Sequence: Synthetic oligonucleotide
  Target: SCN9A; (-) strand; PAM type: YTN; PAM sequence: CTT
ccattttgttcttttttctt

SEQ ID NO: 63194 - DNA, 20 bp, Artificial Sequence
  Description of Artificial Sequence: Synthetic oligonucleotide
  Target: SCN9A; (-) strand; PAM type: YTN; PAM sequence: TTC
ttccattttgttcttttttc

SEQ ID NO: 63195 - DNA, 20 bp, Artificial Sequence
  Description of Artificial Sequence: Synthetic oligonucleotide
  Target: SCN9A; (-) strand; PAM type: YTN; PAM sequence: CTC
aataaataaataaataagaa

SEQ ID NO: 63196 - DNA, 20 bp, Artificial Sequence
  Description of Artificial Sequence: Synthetic oligonucleotide
  Target: SCN9A; (-) strand; PAM type: YTN; PAM sequence: CTC
tcaataaataaataaataag

SEQ ID NO: 63197 - DNA, 20 bp, Artificial Sequence
  Description of Artificial Sequence: Synthetic oligonucleotide
  Target: SCN9A; (-) strand; PAM type: YTN; PAM sequence: CTC
tctcaataaataaataaata

SEQ ID NO: 63198 - DNA, 20 bp, Artificial Sequence
  Description of Artificial Sequence: Synthetic oligonucleotide
  Target: SCN9A; (-) strand; PAM type: YTN; PAM sequence: TTC
tctctcaataaataaataaa

SEQ ID NO: 63199 - DNA, 20 bp, Artificial Sequence
  Description of Artificial Sequence: Synthetic oligonucleotide
  Target: SCN9A; (-) strand; PAM type: YTN; PAM sequence: CTT
ctctctcaataaataaataa

SEQ ID NO: 63200 - DNA, 20 bp, Artificial Sequence
  Description of Artificial Sequence: Synthetic oligonucleotide
  Target: SCN9A; (-) strand; PAM type: YTN; PAM sequence: CTG
ggcaacagggtgagatcttc

SEQ ID NO: 63201 - DNA, 20 bp, Artificial Sequence
  Description of Artificial Sequence: Synthetic oligonucleotide
  Target: SCN9A; (-) strand; PAM type: YTN; PAM sequence: CTG
gcctgggcaacagggtgaga

SEQ ID NO: 63202 - DNA, 20 bp, Artificial Sequence
  Description of Artificial Sequence: Synthetic oligonucleotide
  Target: SCN9A; (-) strand; PAM type: YTN; PAM sequence: CTC
tggcctgggcaacagggtga

SEQ ID NO: 63203 - DNA, 20 bp, Artificial Sequence
  Description of Artificial Sequence: Synthetic oligonucleotide
  Target: SCN9A; (-) strand; PAM type: YTN; PAM sequence: CTG
cactctggcctgggcaacag

SEQ ID NO: 63204 - DNA, 20 bp, Artificial Sequence
  Description of Artificial Sequence: Synthetic oligonucleotide
  Target: SCN9A; (-) strand; PAM type: YTN; PAM sequence: CTA
tgatcatgccactgcactct

SEQ ID NO: 63205 - DNA, 20 bp, Artificial Sequence
  Description of Artificial Sequence: Synthetic oligonucleotide
  Target: SCN9A; (-) strand; PAM type: YTN; PAM sequence: CTG
cagtgagctatgatcatgcc

SEQ ID NO: 63206 - DNA, 20 bp, Artificial Sequence
  Description of Artificial Sequence: Synthetic oligonucleotide
  Target: SCN9A; (-) strand; PAM type: YTN; PAM sequence: CTG
aagcccaagagtatgaggct

SEQ ID NO: 63207 - DNA, 20 bp, Artificial Sequence
  Description of Artificial Sequence: Synthetic oligonucleotide
  Target: SCN9A; (-) strand; PAM type: YTN; PAM sequence: CTG
aggtgggaggatcactgaag

SEQ ID NO: 63208 - DNA, 20 bp, Artificial Sequence
  Description of Artificial Sequence: Synthetic oligonucleotide
  Target: SCN9A; (-) strand; PAM type: YTN; PAM sequence: TTA
ggagcctgaggtgggaggat

SEQ ID NO: 63209 - DNA, 20 bp, Artificial Sequence
  Description of Artificial Sequence: Synthetic oligonucleotide
  Target: SCN9A; (-) strand; PAM type: YTN; PAM sequence: CTT
aggagcctgaggtgggagga

SEQ ID NO: 63210 - DNA, 20 bp, Artificial Sequence
  Description of Artificial Sequence: Synthetic oligonucleotide
  Target: SCN9A; (-) strand; PAM type: YTN; PAM sequence: CTA
cttaggagcctgaggtggga

SEQ ID NO: 63211 - DNA, 20 bp, Artificial Sequence
  Description of Artificial Sequence: Synthetic oligonucleotide
  Target: SCN9A; (-) strand; PAM type: YTN; PAM sequence: CTA
gctacttaggagcctgaggt

SEQ ID NO: 63212 - DNA, 20 bp, Artificial Sequence
  Description of Artificial Sequence: Synthetic oligonucleotide
  Target: SCN9A; (-) strand; PAM type: YTN; PAM sequence: CTA
tagtcctagctacttaggag

SEQ ID NO: 63213 - DNA, 20 bp, Artificial Sequence
  Description of Artificial Sequence: Synthetic oligonucleotide
  Target: SCN9A; (-) strand; PAM type: YTN; PAM sequence: TTG
aaaagtagccaagcatgatg

SEQ ID NO: 63214 - DNA, 20 bp, Artificial Sequence
  Description of Artificial Sequence: Synthetic oligonucleotide
  Target: SCN9A; (-) strand; PAM type: YTN; PAM sequence: TTT
gaaaagtagccaagcatgat

SEQ ID NO: 63215 - DNA, 20 bp, Artificial Sequence
  Description of Artificial Sequence: Synthetic oligonucleotide
  Target: SCN9A; (-) strand; PAM type: YTN; PAM sequence: TTA
cgaagatatttgaaaagtag

SEQ ID NO: 63216 - DNA, 20 bp, Artificial Sequence
  Description of Artificial Sequence: Synthetic oligonucleotide
  Target: SCN9A; (-) strand; PAM type: YTN; PAM sequence: TTT
acgaagatatttgaaaagta

SEQ ID NO: 63217 - DNA, 20 bp, Artificial Sequence
  Description of Artificial Sequence: Synthetic oligonucleotide
  Target: SCN9A; (-) strand; PAM type: YTN; PAM sequence: CTT
tacgaagatatttgaaaagt

SEQ ID NO: 63218 - DNA, 20 bp, Artificial Sequence
  Description of Artificial Sequence: Synthetic oligonucleotide
  Target: SCN9A; (-) strand; PAM type: YTN; PAM sequence: TTC
tttacgaagatatttgaaaa

SEQ ID NO: 63219 - DNA, 20 bp, Artificial Sequence
  Description of Artificial Sequence: Synthetic oligonucleotide
  Target: SCN9A; (-) strand; PAM type: YTN; PAM sequence: CTT
ctttacgaagatatttgaaa

SEQ ID NO: 63220 - DNA, 20 bp, Artificial Sequence
  Description of Artificial Sequence: Synthetic oligonucleotide
  Target: SCN9A; (-) strand; PAM type: YTN; PAM sequence: CTC
cttctttacgaagatatttg

SEQ ID NO: 63221 - DNA, 20 bp, Artificial Sequence
  Description of Artificial Sequence: Synthetic oligonucleotide
  Target: SCN9A; (-) strand; PAM type: YTN; PAM sequence: CTG
ggcaagatagactccttctt

SEQ ID NO: 63222 - DNA, 20 bp, Artificial Sequence
  Description of Artificial Sequence: Synthetic oligonucleotide
  Target: SCN9A; (-) strand; PAM type: YTN; PAM sequence: TTG
agaccagcctgggcaagata

SEQ ID NO: 63223 - DNA, 20 bp, Artificial Sequence
  Description of Artificial Sequence: Synthetic oligonucleotide
  Target: SCN9A; (-) strand; PAM type: YTN; PAM sequence: TTT
gagaccagcctgggcaagat

SEQ ID NO: 63224 - DNA, 20 bp, Artificial Sequence
  Description of Artificial Sequence: Synthetic oligonucleotide
  Target: SCN9A; (-) strand; PAM type: YTN; PAM sequence: TTG
tggccaagagtttgagacca

SEQ ID NO: 63225 - DNA, 20 bp, Artificial Sequence
  Description of Artificial Sequence: Synthetic oligonucleotide
  Target: SCN9A; (-) strand; PAM type: YTN; PAM sequence: CTT
gtggccaagagtttgagacc

SEQ ID NO: 63226 - DNA, 20 bp, Artificial Sequence
  Description of Artificial Sequence: Synthetic oligonucleotide
  Target: SCN9A; (-) strand; PAM type: YTN; PAM sequence: CTG
gaggatcacttgtggccaag

SEQ ID NO: 63227 - DNA, 20 bp, Artificial Sequence
  Description of Artificial Sequence: Synthetic oligonucleotide
  Target: SCN9A; (-) strand; PAM type: YTN; PAM sequence: CTA
aggctggaggatcacttgtg

SEQ ID NO: 63228 - DNA, 20 bp, Artificial Sequence
  Description of Artificial Sequence: Synthetic oligonucleotide
  Target: SCN9A; (-) strand; PAM type: YTN; PAM sequence: CTC
gggaggctaaggctggagga

SEQ ID NO: 63229 - DNA, 20 bp, Artificial Sequence
  Description of Artificial Sequence: Synthetic oligonucleotide
  Target: SCN9A; (-) strand; PAM type: YTN; PAM sequence: TTA
taatcccagcaactcgggag

SEQ ID NO: 63230 - DNA, 20 bp, Artificial Sequence
  Description of Artificial Sequence: Synthetic oligonucleotide
  Target: SCN9A; (-) strand; PAM type: YTN; PAM sequence: CTT
ataatcccagcaactcggga

SEQ ID NO: 63231 - DNA, 20 bp, Artificial Sequence
  Description of Artificial Sequence: Synthetic oligonucleotide
  Target: SCN9A; (-) strand; PAM type: YTN; PAM sequence: CTC
atgcttataatcccagcaac

SEQ ID NO: 63232 - DNA, 20 bp, Artificial Sequence
  Description of Artificial Sequence: Synthetic oligonucleotide
  Target: SCN9A; (-) strand; PAM type: YTN; PAM sequence: CTG
ggtgcaatggctcatgctta

SEQ ID NO: 63233 - DNA, 20 bp, Artificial Sequence
  Description of Artificial Sequence: Synthetic oligonucleotide
  Target: SCN9A; (-) strand; PAM type: YTN; PAM sequence: CTG
tggggactgggtgcaatggc

SEQ ID NO: 63234 - DNA, 20 bp, Artificial Sequence
  Description of Artificial Sequence: Synthetic oligonucleotide
  Target: SCN9A; (-) strand; PAM type: YTN; PAM sequence: TTG
aaatgaggacctgtggggac

SEQ ID NO: 63235 - DNA, 20 bp, Artificial Sequence
  Description of Artificial Sequence: Synthetic oligonucleotide
  Target: SCN9A; (-) strand; PAM type: YTN; PAM sequence: TTT
gaaatgaggacctgtgggga

SEQ ID NO: 63236 - DNA, 20 bp, Artificial Sequence
  Description of Artificial Sequence: Synthetic oligonucleotide
  Target: SCN9A; (-) strand; PAM type: YTN; PAM sequence: TTT
tgaaatgaggacctgtgggg

SEQ ID NO: 63237 - DNA, 20 bp, Artificial Sequence
  Description of Artificial Sequence: Synthetic oligonucleotide
  Target: SCN9A; (-) strand; PAM type: YTN; PAM sequence: TTA
tacattttgaaatgaggacc

SEQ ID NO: 63238 - DNA, 20 bp, Artificial Sequence
  Description of Artificial Sequence: Synthetic oligonucleotide
  Target: SCN9A; (-) strand; PAM type: YTN; PAM sequence: TTG
ttatacattttgaaatgagg

SEQ ID NO: 63239 - DNA, 20 bp, Artificial Sequence
  Description of Artificial Sequence: Synthetic oligonucleotide
  Target: SCN9A; (-) strand; PAM type: YTN; PAM sequence: TTT
gttatacattttgaaatgag

SEQ ID NO: 63240 - DNA, 20 bp, Artificial Sequence
  Description of Artificial Sequence: Synthetic oligonucleotide
  Target: SCN9A; (-) strand; PAM type: YTN; PAM sequence: CTT
tgttatacattttgaaatga

SEQ ID NO: 63241 - DNA, 20 bp, Artificial Sequence
  Description of Artificial Sequence: Synthetic oligonucleotide
  Target: SCN9A; (-) strand; PAM type: YTN; PAM sequence: TTG
tagctttgttatacattttg

SEQ ID NO: 63242 - DNA, 20 bp, Artificial Sequence
  Description of Artificial Sequence: Synthetic oligonucleotide
  Target: SCN9A; (-) strand; PAM type: YTN; PAM sequence: TTG
ttgtagctttgttatacatt

SEQ ID NO: 63243 - DNA, 20 bp, Artificial Sequence
  Description of Artificial Sequence: Synthetic oligonucleotide
  Target: SCN9A; (-) strand; PAM type: YTN; PAM sequence: TTA
attgttgtagctttgttata

SEQ ID NO: 63244 - DNA, 20 bp, Artificial Sequence
  Description of Artificial Sequence: Synthetic oligonucleotide
  Target: SCN9A; (-) strand; PAM type: YTN; PAM sequence: TTT
aattgttgtagctttgttat

SEQ ID NO: 63245 - DNA, 20 bp, Artificial Sequence
  Description of Artificial Sequence: Synthetic oligonucleotide
  Target: SCN9A; (-) strand; PAM type: YTN; PAM sequence: TTT
taattgttgtagctttgtta

SEQ ID NO: 63246 - DNA, 20 bp, Artificial Sequence
  Description of Artificial Sequence: Synthetic oligonucleotide
  Target: SCN9A; (-) strand; PAM type: YTN; PAM sequence: CTA
ttttaattgttgtagctttg

SEQ ID NO: 63247 - DNA, 20 bp, Artificial Sequence
  Description of Artificial Sequence: Synthetic oligonucleotide
  Target: SCN9A; (-) strand; PAM type: YTN; PAM sequence: TTA
tgccaggaccatactatttt

SEQ ID NO: 63248 - DNA, 20 bp, Artificial Sequence
  Description of Artificial Sequence: Synthetic oligonucleotide
  Target: SCN9A; (-) strand; PAM type: YTN; PAM sequence: TTT
atgccaggaccatactattt

SEQ ID NO: 63249 - DNA, 20 bp, Artificial Sequence
  Description of Artificial Sequence: Synthetic oligonucleotide
  Target: SCN9A; (-) strand; PAM type: YTN; PAM sequence: TTT
tatgccaggaccatactatt

SEQ ID NO: 63250 - DNA, 20 bp, Artificial Sequence
  Description of Artificial Sequence: Synthetic oligonucleotide
  Target: SCN9A; (-) strand; PAM type: YTN; PAM sequence: TTG
ttttatgccaggaccatact

SEQ ID NO: 63251 - DNA, 20 bp, Artificial Sequence
  Description of Artificial Sequence: Synthetic oligonucleotide
  Target: SCN9A; (-) strand; PAM type: YTN; PAM sequence: TTT
gttttatgccaggaccatac

SEQ ID NO: 63252 - DNA, 20 bp, Artificial Sequence
  Description of Artificial Sequence: Synthetic oligonucleotide
  Target: SCN9A; (-) strand; PAM type: YTN; PAM sequence: CTA
tatatttgttttatgccagg

SEQ ID NO: 63253 - DNA, 20 bp, Artificial Sequence
  Description of Artificial Sequence: Synthetic oligonucleotide
  Target: SCN9A; (-) strand; PAM type: YTN; PAM sequence: TTG
gcctatatatttgttttatg

SEQ ID NO: 63254 - DNA, 20 bp, Artificial Sequence
  Description of Artificial Sequence: Synthetic oligonucleotide
  Target: SCN9A; (-) strand; PAM type: YTN; PAM sequence: TTC
attggcctatatatttgttt

SEQ ID NO: 63255 - DNA, 20 bp, Artificial Sequence
  Description of Artificial Sequence: Synthetic oligonucleotide
  Target: SCN9A; (-) strand; PAM type: YTN; PAM sequence: TTT
cattggcctatatatttgtt

SEQ ID NO: 63256 - DNA, 20 bp, Artificial Sequence
  Description of Artificial Sequence: Synthetic oligonucleotide
  Target: SCN9A; (-) strand; PAM type: YTN; PAM sequence: CTG
tttcattggcctatatattt

SEQ ID NO: 63257 - DNA, 20 bp, Artificial Sequence
  Description of Artificial Sequence: Synthetic oligonucleotide
  Target: SCN9A; (-) strand; PAM type: YTN; PAM sequence: CTA
tcctgtttcattggcctata

SEQ ID NO: 63258 - DNA, 20 bp, Artificial Sequence
  Description of Artificial Sequence: Synthetic oligonucleotide
  Target: SCN9A; (-) strand; PAM type: YTN; PAM sequence: CTC
tatcctgtttcattggccta

SEQ ID NO: 63259 - DNA, 20 bp, Artificial Sequence
  Description of Artificial Sequence: Synthetic oligonucleotide
  Target: SCN9A; (-) strand; PAM type: YTN; PAM sequence: CTC
tctatcctgtttcattggcc

SEQ ID NO: 63260 - DNA, 20 bp, Artificial Sequence
  Description of Artificial Sequence: Synthetic oligonucleotide
  Target: SCN9A; (-) strand; PAM type: YTN; PAM sequence: CTG
ggctctctatcctgtttcat

SEQ ID NO: 63261 - DNA, 20 bp, Artificial Sequence
  Description of Artificial Sequence: Synthetic oligonucleotide
  Target: SCN9A; (-) strand; PAM type: YTN; PAM sequence: TTC
tgggctctctatcctgtttc

SEQ ID NO: 63262 - DNA, 20 bp, Artificial Sequence
  Description of Artificial Sequence: Synthetic oligonucleotide
  Target: SCN9A; (-) strand; PAM type: YTN; PAM sequence: TTT
ctgggctctctatcctgttt

SEQ ID NO: 63263 - DNA, 20 bp, Artificial Sequence
  Description of Artificial Sequence: Synthetic oligonucleotide
  Target: SCN9A; (-) strand; PAM type: YTN; PAM sequence: TTA
tttctgggctctctatcctg

SEQ ID NO: 63264 - DNA, 20 bp, Artificial Sequence
  Description of Artificial Sequence: Synthetic oligonucleotide
  Target: SCN9A; (-) strand; PAM type: YTN; PAM sequence: TTT
atttctgggctctctatcct

SEQ ID NO: 63265 - DNA, 20 bp, Artificial Sequence
  Description of Artificial Sequence: Synthetic oligonucleotide
  Target: SCN9A; (-) strand; PAM type: YTN; PAM sequence: TTA
tgcatgggtttatttctggg

SEQ ID NO: 63266 - DNA, 20 bp, Artificial Sequence
  Description of Artificial Sequence: Synthetic oligonucleotide
  Target: SCN9A; (-) strand; PAM type: YTN; PAM sequence: TTT
atgcatgggtttatttctgg

SEQ ID NO: 63267 - DNA, 20 bp, Artificial Sequence
  Description of Artificial Sequence: Synthetic oligonucleotide
  Target: SCN9A; (-) strand; PAM type: YTN; PAM sequence: CTA
tttatgcatgggtttatttc

SEQ ID NO: 63268 - DNA, 20 bp, Artificial Sequence
  Description of Artificial Sequence: Synthetic oligonucleotide
  Target: SCN9A; (-) strand; PAM type: YTN; PAM sequence: TTA
actatttatgcatgggttta

SEQ ID NO: 63269 - DNA, 20 bp, Artificial Sequence
  Description of Artificial Sequence: Synthetic oligonucleotide
  Target: SCN9A; (-) strand; PAM type: YTN; PAM sequence: TTG
aatatgagttaactatttat

SEQ ID NO: 63270 - DNA, 20 bp, Artificial Sequence
  Description of Artificial Sequence: Synthetic oligonucleotide
  Target: SCN9A; (-) strand; PAM type: YTN; PAM sequence: CTG
ttgaatatgagttaactatt

SEQ ID NO: 63271 - DNA, 20 bp, Artificial Sequence
  Description of Artificial Sequence: Synthetic oligonucleotide
  Target: SCN9A; (-) strand; PAM type: YTN; PAM sequence: TTG
gcacccctgttgaatatgag

SEQ ID NO: 63272 - DNA, 20 bp, Artificial Sequence
  Description of Artificial Sequence: Synthetic oligonucleotide
  Target: SCN9A; (-) strand; PAM type: YTN; PAM sequence: CTT
ggcacccctgttgaatatga

SEQ ID NO: 63273 - DNA, 20 bp, Artificial Sequence
  Description of Artificial Sequence: Synthetic oligonucleotide
  Target: SCN9A; (-) strand; PAM type: YTN; PAM sequence: TTC
ttggcacccctgttgaatat

SEQ ID NO: 63274 - DNA, 20 bp, Artificial Sequence
  Description of Artificial Sequence: Synthetic oligonucleotide
  Target: SCN9A; (-) strand; PAM type: YTN; PAM sequence: TTG
tgtattcttggcacccctgt

SEQ ID NO: 63275 - DNA, 20 bp, Artificial Sequence
  Description of Artificial Sequence: Synthetic oligonucleotide
  Target: SCN9A; (-) strand; PAM type: YTN; PAM sequence: CTA
ttgtgtattcttggcacccc

SEQ ID NO: 63276 - DNA, 20 bp, Artificial Sequence
  Description of Artificial Sequence: Synthetic oligonucleotide
  Target: SCN9A; (-) strand; PAM type: YTN; PAM sequence: TTC
tattgtgtattcttggcacc

SEQ ID NO: 63277 - DNA, 20 bp, Artificial Sequence
  Description of Artificial Sequence: Synthetic oligonucleotide
  Target: SCN9A; (-) strand; PAM type: YTN; PAM sequence: TTT
ctattgtgtattcttggcac

SEQ ID NO: 63278 - DNA, 20 bp, Artificial Sequence
  Description of Artificial Sequence: Synthetic oligonucleotide
  Target: SCN9A; (-) strand; PAM type: YTN; PAM sequence: TTT
tctattgtgtattcttggca

SEQ ID NO: 63279 - DNA, 20 bp, Artificial Sequence
  Description of Artificial Sequence: Synthetic oligonucleotide
  Target: SCN9A; (-) strand; PAM type: YTN; PAM sequence: CTT
ttctattgtgtattcttggc

SEQ ID NO: 63280 - DNA, 20 bp, Artificial Sequence
  Description of Artificial Sequence: Synthetic oligonucleotide
  Target: SCN9A; (-) strand; PAM type: YTN; PAM sequence: CTC
ttttctattgtgtattcttg

SEQ ID NO: 63281 - DNA, 20 bp, Artificial Sequence
  Description of Artificial Sequence: Synthetic oligonucleotide
  Target: SCN9A; (-) strand; PAM type: YTN; PAM sequence: TTG
agtggcctcttttctattgt

SEQ ID NO: 63282 - DNA, 20 bp, Artificial Sequence
  Description of Artificial Sequence: Synthetic oligonucleotide
  Target: SCN9A; (-) strand; PAM type: YTN; PAM sequence: TTG
ttgagtggcctcttttctat

SEQ ID NO: 63283 - DNA, 20 bp, Artificial Sequence
  Description of Artificial Sequence: Synthetic oligonucleotide
  Target: SCN9A; (-) strand; PAM type: YTN; PAM sequence: TTT
gttgagtggcctcttttcta

SEQ ID NO: 63284 - DNA, 20 bp, Artificial Sequence
  Description of Artificial Sequence: Synthetic oligonucleotide
  Target: SCN9A; (-) strand; PAM type: YTN; PAM sequence: TTA
tttgttgagtggcctctttt

SEQ ID NO: 63285 - DNA, 20 bp, Artificial Sequence
  Description of Artificial Sequence: Synthetic oligonucleotide
  Target: SCN9A; (-) strand; PAM type: YTN; PAM sequence: TTC
ccaacattatttgttgagtg

SEQ ID NO: 63286 - DNA, 20 bp, Artificial Sequence
  Description of Artificial Sequence: Synthetic oligonucleotide
  Target: SCN9A; (-) strand; PAM type: YTN; PAM sequence: TTT
cccaacattatttgttgagt

SEQ ID NO: 63287 - DNA, 20 bp, Artificial Sequence
  Description of Artificial Sequence: Synthetic oligonucleotide
  Target: SCN9A; (-) strand; PAM type: YTN; PAM sequence: TTT
tcccaacattatttgttgag

SEQ ID NO: 63288 - DNA, 20 bp, Artificial Sequence
  Description of Artificial Sequence: Synthetic oligonucleotide
  Target: SCN9A; (-) strand; PAM type: YTN; PAM sequence: TTA
tatgtgaatatccagttttc

SEQ ID NO: 63289 - DNA, 20 bp, Artificial Sequence
  Description of Artificial Sequence: Synthetic oligonucleotide
  Target: SCN9A; (-) strand; PAM type: YTN; PAM sequence: TTT
atatgtgaatatccagtttt

SEQ ID NO: 63290 - DNA, 20 bp, Artificial Sequence
  Description of Artificial Sequence: Synthetic oligonucleotide
  Target: SCN9A; (-) strand; PAM type: YTN; PAM sequence: TTT
tatatgtgaatatccagttt

SEQ ID NO: 63291 - DNA, 20 bp, Artificial Sequence
  Description of Artificial Sequence: Synthetic oligonucleotide
  Target: SCN9A; (-) strand; PAM type: YTN; PAM sequence: TTT
ttatatgtgaatatccagtt

SEQ ID NO: 63292 - DNA, 20 bp, Artificial Sequence
  Description of Artificial Sequence: Synthetic oligonucleotide
  Target: SCN9A; (-) strand; PAM type: YTN; PAM sequence: TTT
tttatatgtgaatatccagt

SEQ ID NO: 63293 - DNA, 20 bp, Artificial Sequence
  Description of Artificial Sequence: Synthetic oligonucleotide
  Target: SCN9A; (-) strand; PAM type: YTN; PAM sequence: TTT
ttttatatgtgaatatccag

SEQ ID NO: 63294 - DNA, 20 bp, Artificial Sequence
  Description of Artificial Sequence: Synthetic oligonucleotide
  Target: SCN9A; (-) strand; PAM type: YTN; PAM sequence: TTA
tttttttatatgtgaatatc

SEQ ID NO: 63295 - DNA, 20 bp, Artificial Sequence
  Description of Artificial Sequence: Synthetic oligonucleotide
  Target: SCN9A; (-) strand; PAM type: YTN; PAM sequence: TTT
atttttttatatgtgaatat

SEQ ID NO: 63296 - DNA, 20 bp, Artificial Sequence
  Description of Artificial Sequence: Synthetic oligonucleotide
  Target: SCN9A; (-) strand; PAM type: YTN; PAM sequence: TTT
tatttttttatatgtgaata

SEQ ID NO: 63297 - DNA, 20 bp, Artificial Sequence
  Description of Artificial Sequence: Synthetic oligonucleotide
  Target: SCN9A; (-) strand; PAM type: YTN; PAM sequence: TTC
aattttatttttttatatgt

SEQ ID NO: 63298 - DNA, 20 bp, Artificial Sequence
  Description of Artificial Sequence: Synthetic oligonucleotide
  Target: SCN9A; (-) strand; PAM type: YTN; PAM sequence: TTG
tgtatggtataatataagaa

SEQ ID NO: 63299 - DNA, 20 bp, Artificial Sequence
  Description of Artificial Sequence: Synthetic oligonucleotide
  Target: SCN9A; (-) strand; PAM type: YTN; PAM sequence: TTT
gtgtatggtataatataaga

SEQ ID NO: 63300 - DNA, 20 bp, Artificial Sequence
  Description of Artificial Sequence: Synthetic oligonucleotide
  Target: SCN9A; (-) strand; PAM type: YTN; PAM sequence: TTT
tgtgtatggtataatataag

SEQ ID NO: 63301 - DNA, 20 bp, Artificial Sequence
  Description of Artificial Sequence: Synthetic oligonucleotide
  Target: SCN9A; (-) strand; PAM type: YTN; PAM sequence: TTT
ttgtgtatggtataatataa

SEQ ID NO: 63302 - DNA, 20 bp, Artificial Sequence
  Description of Artificial Sequence: Synthetic oligonucleotide
  Target: SCN9A; (-) strand; PAM type: YTN; PAM sequence: TTA
tttttgtgtatggtataata

SEQ ID NO: 63303 - DNA, 20 bp, Artificial Sequence
  Description of Artificial Sequence: Synthetic oligonucleotide
  Target: SCN9A; (-) strand; PAM type: YTN; PAM sequence: TTT
atttttgtgtatggtataat

SEQ ID NO: 63304 - DNA, 20 bp, Artificial Sequence
  Description of Artificial Sequence: Synthetic oligonucleotide
  Target: SCN9A; (-) strand; PAM type: YTN; PAM sequence: TTG
agtttatttttgtgtatggt

SEQ ID NO: 63305 - DNA, 20 bp, Artificial Sequence
  Description of Artificial Sequence: Synthetic oligonucleotide
  Target: SCN9A; (-) strand; PAM type: YTN; PAM sequence: TTT
gagtttatttttgtgtatgg

SEQ ID NO: 63306 - DNA, 20 bp, Artificial Sequence
  Description of Artificial Sequence: Synthetic oligonucleotide
  Target: SCN9A; (-) strand; PAM type: YTN; PAM sequence: TTT
tgagtttatttttgtgtatg

SEQ ID NO: 63307 - DNA, 20 bp, Artificial Sequence
  Description of Artificial Sequence: Synthetic oligonucleotide
  Target: SCN9A; (-) strand; PAM type: YTN; PAM sequence: CTA
ttttgagtttatttttgtgt

SEQ ID NO: 63308 - DNA, 20 bp, Artificial Sequence
  Description of Artificial Sequence: Synthetic oligonucleotide
  Target: SCN9A; (-) strand; PAM type: YTN; PAM sequence: TTA
atctattttgagtttatttt

SEQ ID NO: 63309 - DNA, 20 bp, Artificial Sequence
  Description of Artificial Sequence: Synthetic oligonucleotide
  Target: SCN9A; (-) strand; PAM type: YTN; PAM sequence: TTT
aatctattttgagtttattt

SEQ ID NO: 63310 - DNA, 20 bp, Artificial Sequence
  Description of Artificial Sequence: Synthetic oligonucleotide
  Target: SCN9A; (-) strand; PAM type: YTN; PAM sequence: TTA
aatgtttaatctattttgag

SEQ ID NO: 63311 - DNA, 20 bp, Artificial Sequence
  Description of Artificial Sequence: Synthetic oligonucleotide
  Target: SCN9A; (-) strand; PAM type: YTN; PAM sequence: TTT
aaatgtttaatctattttga

SEQ ID NO: 63312 - DNA, 20 bp, Artificial Sequence
  Description of Artificial Sequence: Synthetic oligonucleotide
  Target: SCN9A; (-) strand; PAM type: YTN; PAM sequence: TTA
ggtttaaatgtttaatctat

SEQ ID NO: 63313 - DNA, 20 bp, Artificial Sequence
  Description of Artificial Sequence: Synthetic oligonucleotide
  Target: SCN9A; (-) strand; PAM type: YTN; PAM sequence: CTT
aggtttaaatgtttaatcta

SEQ ID NO: 63314 - DNA, 20 bp, Artificial Sequence
  Description of Artificial Sequence: Synthetic oligonucleotide
  Target: SCN9A; (-) strand; PAM type: YTN; PAM sequence: TTC
aggtcttaggtttaaatgtt

SEQ ID NO: 63315 - DNA, 20 bp, Artificial Sequence
  Description of Artificial Sequence: Synthetic oligonucleotide
  Target: SCN9A; (-) strand; PAM type: YTN; PAM sequence: TTT
caggtcttaggtttaaatgt

SEQ ID NO: 63316 - DNA, 20 bp, Artificial Sequence
  Description of Artificial Sequence: Synthetic oligonucleotide
  Target: SCN9A; (-) strand; PAM type: YTN; PAM sequence: TTT
tcaggtcttaggtttaaatg

SEQ ID NO: 63317 - DNA, 20 bp, Artificial Sequence
  Description of Artificial Sequence: Synthetic oligonucleotide
  Target: SCN9A; (-) strand; PAM type: YTN; PAM sequence: TTA
cagttttcaggtcttaggtt

SEQ ID NO: 63318 - DNA, 20 bp, Artificial Sequence
  Description of Artificial Sequence: Synthetic oligonucleotide
  Target: SCN9A; (-) strand; PAM type: YTN; PAM sequence: TTT
acagttttcaggtcttaggt

SEQ ID NO: 63319 - DNA, 20 bp, Artificial Sequence
  Description of Artificial Sequence: Synthetic oligonucleotide
  Target: SCN9A; (-) strand; PAM type: YTN; PAM sequence: TTT
tacagttttcaggtcttagg

SEQ ID NO: 63320 - DNA, 20 bp, Artificial Sequence
  Description of Artificial Sequence: Synthetic oligonucleotide
  Target: SCN9A; (-) strand; PAM type: YTN; PAM sequence: CTA
caagttttacagttttcagg

SEQ ID NO: 63321 - DNA, 20 bp, Artificial Sequence
  Description of Artificial Sequence: Synthetic oligonucleotide
  Target: SCN9A; (-) strand; PAM type: YTN; PAM sequence: TTC
tacaagttttacagttttca

SEQ ID NO: 63322 - DNA, 20 bp, Artificial Sequence
  Description of Artificial Sequence: Synthetic oligonucleotide
  Target: SCN9A; (-) strand; PAM type: YTN; PAM sequence: CTT
ctacaagttttacagttttc

SEQ ID NO: 63323 - DNA, 20 bp, Artificial Sequence
  Description of Artificial Sequence: Synthetic oligonucleotide
  Target: SCN9A; (-) strand; PAM type: YTN; PAM sequence: TTC
ttctacaagttttacagttt

SEQ ID NO: 63324 - DNA, 20 bp, Artificial Sequence
  Description of Artificial Sequence: Synthetic oligonucleotide
  Target: SCN9A; (-) strand; PAM type: YTN; PAM sequence: TTT
cttctacaagttttacagtt

SEQ ID NO: 63325 - DNA, 20 bp, Artificial Sequence
  Description of Artificial Sequence: Synthetic oligonucleotide
  Target: SCN9A; (-) strand; PAM type: YTN; PAM sequence: TTT
tcttctacaagttttacagt

SEQ ID NO: 63326 - DNA, 20 bp, Artificial Sequence
  Description of Artificial Sequence: Synthetic oligonucleotide
  Target: SCN9A; (-) strand; PAM type: YTN; PAM sequence: CTA
tgttttcttctacaagtttt

SEQ ID NO: 63327 - DNA, 20 bp, Artificial Sequence
  Description of Artificial Sequence: Synthetic oligonucleotide
  Target: SCN9A; (-) strand; PAM type: YTN; PAM sequence: CTG
ctatgttttcttctacaagt

SEQ ID NO: 63328 - DNA, 20 bp, Artificial Sequence
  Description of Artificial Sequence: Synthetic oligonucleotide
  Target: SCN9A; (-) strand; PAM type: YTN; PAM sequence: TTC
ctgctatgttttcttctaca

SEQ ID NO: 63329 - DNA, 20 bp, Artificial Sequence
  Description of Artificial Sequence: Synthetic oligonucleotide
  Target: SCN9A; (-) strand; PAM type: YTN; PAM sequence: TTT
cctgctatgttttcttctac

SEQ ID NO: 63330 - DNA, 20 bp, Artificial Sequence
  Description of Artificial Sequence: Synthetic oligonucleotide
  Target: SCN9A; (-) strand; PAM type: YTN; PAM sequence: CTT
tcctgctatgttttcttcta

SEQ ID NO: 63331 - DNA, 20 bp, Artificial Sequence
  Description of Artificial Sequence: Synthetic oligonucleotide
  Target: SCN9A; (-) strand; PAM type: YTN; PAM sequence: TTG
tcaagaacagtatcatgaag

SEQ ID NO: 63332 - DNA, 20 bp, Artificial Sequence
  Description of Artificial Sequence: Synthetic oligonucleotide
  Target: SCN9A; (-) strand; PAM type: YTN; PAM sequence: TTG
ccaagaaatcattgtcaaga

SEQ ID NO: 63333 - DNA, 20 bp, Artificial Sequence
  Description of Artificial Sequence: Synthetic oligonucleotide
  Target: SCN9A; (-) strand; PAM type: YTN; PAM sequence: TTG
gagtcattgccaagaaatca

SEQ ID NO: 63334 - DNA, 20 bp, Artificial Sequence
  Description of Artificial Sequence: Synthetic oligonucleotide
  Target: SCN9A; (-) strand; PAM type: YTN; PAM sequence: TTT
ggagtcattgccaagaaatc

SEQ ID NO: 63335 - DNA, 20 bp, Artificial Sequence
  Description of Artificial Sequence: Synthetic oligonucleotide
  Target: SCN9A; (-) strand; PAM type: YTN; PAM sequence: TTT
tggagtcattgccaagaaat

SEQ ID NO: 63336 - DNA, 20 bp, Artificial Sequence
  Description of Artificial Sequence: Synthetic oligonucleotide
  Target: SCN9A; (-) strand; PAM type: YTN; PAM sequence: TTG
aattttggagtcattgccaa

SEQ ID NO: 63337 - DNA, 20 bp, Artificial Sequence
  Description of Artificial Sequence: Synthetic oligonucleotide
  Target: SCN9A; (-) strand; PAM type: YTN; PAM sequence: TTT
gaattttggagtcattgcca

SEQ ID NO: 63338 - DNA, 20 bp, Artificial Sequence
  Description of Artificial Sequence: Synthetic oligonucleotide
  Target: SCN9A; (-) strand; PAM type: YTN; PAM sequence: TTG
tttgaattttggagtcattg

SEQ ID NO: 63339 - DNA, 20 bp, Artificial Sequence
  Description of Artificial Sequence: Synthetic oligonucleotide
  Target: SCN9A; (-) strand; PAM type: YTN; PAM sequence: CTT
gtttgaattttggagtcatt

SEQ ID NO: 63340 - DNA, 20 bp, Artificial Sequence
  Description of Artificial Sequence: Synthetic oligonucleotide
  Target: SCN9A; (-) strand; PAM type: YTN; PAM sequence: CTC
ttgtttgaattttggagtca

SEQ ID NO: 63341 - DNA, 20 bp, Artificial Sequence
  Description of Artificial Sequence: Synthetic oligonucleotide
  Target: SCN9A; (-) strand; PAM type: YTN; PAM sequence: TTG
ctcttgtttgaattttggag

SEQ ID NO: 63342 - DNA, 20 bp, Artificial Sequence
  Description of Artificial Sequence: Synthetic oligonucleotide
  Target: SCN9A; (-) strand; PAM type: YTN; PAM sequence: TTT
gctcttgtttgaattttgga

SEQ ID NO: 63343 - DNA, 20 bp, Artificial Sequence
  Description of Artificial Sequence: Synthetic oligonucleotide
  Target: SCN9A; (-) strand; PAM type: YTN; PAM sequence: TTT
tgctcttgtttgaattttgg

SEQ ID NO: 63344 - DNA, 20 bp, Artificial Sequence
  Description of Artificial Sequence: Synthetic oligonucleotide
  Target: SCN9A; (-) strand; PAM type: YTN; PAM sequence: TTT
ttgctcttgtttgaattttg

SEQ ID NO: 63345 - DNA, 20 bp, Artificial Sequence
  Description of Artificial Sequence: Synthetic oligonucleotide
  Target: SCN9A; (-) strand; PAM type: YTN; PAM sequence: CTA
tttttgctcttgtttgaatt

SEQ ID NO: 63346 - DNA, 20 bp, Artificial Sequence
  Description of Artificial Sequence: Synthetic oligonucleotide
  Target: SCN9A; (-) strand; PAM type: YTN; PAM sequence: TTG
tctatttttgctcttgtttg

SEQ ID NO: 63347 - DNA, 20 bp, Artificial Sequence
  Description of Artificial Sequence: Synthetic oligonucleotide
  Target: SCN9A; (-) strand; PAM type: YTN; PAM sequence: CTC
aattgtctatttttgctctt

SEQ ID NO: 63348 - DNA, 20 bp, Artificial Sequence
  Description of Artificial Sequence: Synthetic oligonucleotide
  Target: SCN9A; (-) strand; PAM type: YTN; PAM sequence: TTG
atatggtctcaattgtctat

SEQ ID NO: 63349 - DNA, 20 bp, Artificial Sequence
  Description of Artificial Sequence: Synthetic oligonucleotide
  Target: SCN9A; (-) strand; PAM type: YTN; PAM sequence: TTT
gatatggtctcaattgtcta

SEQ ID NO: 63350 - DNA, 20 bp, Artificial Sequence
  Description of Artificial Sequence: Synthetic oligonucleotide
  Target: SCN9A; (-) strand; PAM type: YTN; PAM sequence: TTA
gtttgatatggtctcaattg

SEQ ID NO: 63351 - DNA, 20 bp, Artificial Sequence
  Description of Artificial Sequence: Synthetic oligonucleotide
  Target: SCN9A; (-) strand; PAM type: YTN; PAM sequence: TTT
agtttgatatggtctcaatt

SEQ ID NO: 63352 - DNA, 20 bp, Artificial Sequence
  Description of Artificial Sequence: Synthetic oligonucleotide
  Target: SCN9A; (-) strand; PAM type: YTN; PAM sequence: TTT
tagtttgatatggtctcaat

SEQ ID NO: 63353 - DNA, 20 bp, Artificial Sequence
  Description of Artificial Sequence: Synthetic oligonucleotide
  Target: SCN9A; (-) strand; PAM type: YTN; PAM sequence: TTT
ttagtttgatatggtctcaa

SEQ ID NO: 63354 - DNA, 20 bp, Artificial Sequence
  Description of Artificial Sequence: Synthetic oligonucleotide
  Target: SCN9A; (-) strand; PAM type: YTN; PAM sequence: CTT
tttagtttgatatggtctca

SEQ ID NO: 63355 - DNA, 20 bp, Artificial Sequence
  Description of Artificial Sequence: Synthetic oligonucleotide
  Target: SCN9A; (-) strand; PAM type: YTN; PAM sequence: TTC
ccaaagctttttagtttgat

SEQ ID NO: 63356 - DNA, 20 bp, Artificial Sequence
  Description of Artificial Sequence: Synthetic oligonucleotide
  Target: SCN9A; (-) strand; PAM type: YTN; PAM sequence: TTT
cccaaagctttttagtttga

SEQ ID NO: 63357 - DNA, 20 bp, Artificial Sequence
  Description of Artificial Sequence: Synthetic oligonucleotide
  Target: SCN9A; (-) strand; PAM type: YTN; PAM sequence: TTT
tcccaaagctttttagtttg

SEQ ID NO: 63358 - DNA, 20 bp, Artificial Sequence
  Description of Artificial Sequence: Synthetic oligonucleotide
  Target: SCN9A; (-) strand; PAM type: YTN; PAM sequence: TTT
ttcccaaagctttttagttt

SEQ ID NO: 63359 - DNA, 20 bp, Artificial Sequence
  Description of Artificial Sequence: Synthetic oligonucleotide
  Target: SCN9A; (-) strand; PAM type: YTN; PAM sequence: TTT
tttcccaaagctttttagtt

SEQ ID NO: 63360 - DNA, 20 bp, Artificial Sequence
  Description of Artificial Sequence: Synthetic oligonucleotide
  Target: SCN9A; (-) strand; PAM type: YTN; PAM sequence: TTT
ttttcccaaagctttttagt

SEQ ID NO: 63361 - DNA, 20 bp, Artificial Sequence
  Description of Artificial Sequence: Synthetic oligonucleotide
  Target: SCN9A; (-) strand; PAM type: YTN; PAM sequence: CTT
tttttcccaaagctttttag

SEQ ID NO: 63362 - DNA, 20 bp, Artificial Sequence
  Description of Artificial Sequence: Synthetic oligonucleotide
  Target: SCN9A; (-) strand; PAM type: YTN; PAM sequence: TTC
ctttttttcccaaagctttt

SEQ ID NO: 63363 - DNA, 20 bp, Artificial Sequence
  Description of Artificial Sequence: Synthetic oligonucleotide
  Target: SCN9A; (-) strand; PAM type: YTN; PAM sequence: CTT
cctttttttcccaaagcttt

SEQ ID NO: 63364 - DNA, 20 bp, Artificial Sequence
  Description of Artificial Sequence: Synthetic oligonucleotide
  Target: SCN9A; (-) strand; PAM type: YTN; PAM sequence: TTG
aatgcttcctttttttccca

SEQ ID NO: 63365 - DNA, 20 bp, Artificial Sequence
  Description of Artificial Sequence: Synthetic oligonucleotide
  Target: SCN9A; (-) strand; PAM type: YTN; PAM sequence: CTT
gaatgcttcctttttttccc

SEQ ID NO: 63366 - DNA, 20 bp, Artificial Sequence
  Description of Artificial Sequence: Synthetic oligonucleotide
  Target: SCN9A; (-) strand; PAM type: YTN; PAM sequence: CTC
ttgaatgcttcctttttttc

SEQ ID NO: 63367 - DNA, 20 bp, Artificial Sequence
  Description of Artificial Sequence: Synthetic oligonucleotide
  Target: SCN9A; (-) strand; PAM type: YTN; PAM sequence: TTC
accctcttgaatgcttcctt

SEQ ID NO: 63368 - DNA, 20 bp, Artificial Sequence
  Description of Artificial Sequence: Synthetic oligonucleotide
  Target: SCN9A; (-) strand; PAM type: YTN; PAM sequence: TTT
caccctcttgaatgcttcct

SEQ ID NO: 63369 - DNA, 20 bp, Artificial Sequence
  Description of Artificial Sequence: Synthetic oligonucleotide
  Target: SCN9A; (-) strand; PAM type: YTN; PAM sequence: TTT
tcaccctcttgaatgcttcc

SEQ ID NO: 63370 - DNA, 20 bp, Artificial Sequence
  Description of Artificial Sequence: Synthetic oligonucleotide
  Target: SCN9A; (-) strand; PAM type: YTN; PAM sequence: TTT
ttcaccctcttgaatgcttc

SEQ ID NO: 63371 - DNA, 20 bp, Artificial Sequence
  Description of Artificial Sequence: Synthetic oligonucleotide
  Target: SCN9A; (-) strand; PAM type: YTN; PAM sequence: CTT
tttcaccctcttgaatgctt

SEQ ID NO: 63372 - DNA, 20 bp, Artificial Sequence
  Description of Artificial Sequence: Synthetic oligonucleotide
  Target: SCN9A; (-) strand; PAM type: YTN; PAM sequence: TTG
ctttttcaccctcttgaatg

SEQ ID NO: 63373 - DNA, 20 bp, Artificial Sequence
  Description of Artificial Sequence: Synthetic oligonucleotide
  Target: SCN9A; (-) strand; PAM type: YTN; PAM sequence: CTA
taggttgctttttcaccctc

SEQ ID NO: 63374 - DNA, 20 bp, Artificial Sequence
  Description of Artificial Sequence: Synthetic oligonucleotide
  Target: SCN9A; (-) strand; PAM type: YTN; PAM sequence: TTC
tataggttgctttttcaccc

SEQ ID NO: 63375 - DNA, 20 bp, Artificial Sequence
  Description of Artificial Sequence: Synthetic oligonucleotide
  Target: SCN9A; (-) strand; PAM type: YTN; PAM sequence: CTC
ccattctataggttgctttt

SEQ ID NO: 63376 - DNA, 20 bp, Artificial Sequence
  Description of Artificial Sequence: Synthetic oligonucleotide
  Target: SCN9A; (-) strand; PAM type: YTN; PAM sequence: TTC
tcccattctataggttgctt

SEQ ID NO: 63377 - DNA, 20 bp, Artificial Sequence
  Description of Artificial Sequence: Synthetic oligonucleotide
  Target: SCN9A; (-) strand; PAM type: YTN; PAM sequence: TTT
ctcccattctataggttgct

SEQ ID NO: 63378 - DNA, 20 bp, Artificial Sequence
  Description of Artificial Sequence: Synthetic oligonucleotide
  Target: SCN9A; (-) strand; PAM type: YTN; PAM sequence: TTT
tctcccattctataggttgc

SEQ ID NO: 63379 - DNA, 20 bp, Artificial Sequence
  Description of Artificial Sequence: Synthetic oligonucleotide
  Target: SCN9A; (-) strand; PAM type: YTN; PAM sequence: TTG
gaaatattttctcccattct

SEQ ID NO: 63380 - DNA, 20 bp, Artificial Sequence
  Description of Artificial Sequence: Synthetic oligonucleotide
  Target: SCN9A; (-) strand; PAM type: YTN; PAM sequence: TTA
gatatatagttggaaatatt

SEQ ID NO: 63381 - DNA, 20 bp, Artificial Sequence
  Description of Artificial Sequence: Synthetic oligonucleotide
  Target: SCN9A; (-) strand; PAM type: YTN; PAM sequence: TTA
ttagatatatagttggaaat

SEQ ID NO: 63382 - DNA, 20 bp, Artificial Sequence
  Description of Artificial Sequence: Synthetic oligonucleotide
  Target: SCN9A; (-) strand; PAM type: YTN; PAM sequence: TTT
attagatatatagttggaaa

SEQ ID NO: 63383 - DNA, 20 bp, Artificial Sequence
  Description of Artificial Sequence: Synthetic oligonucleotide
  Target: SCN9A; (-) strand; PAM type: YTN; PAM sequence: TTA
accatttattagatatatag

SEQ ID NO: 63384 - DNA, 20 bp, Artificial Sequence
  Description of Artificial Sequence: Synthetic oligonucleotide
  Target: SCN9A; (-) strand; PAM type: YTN; PAM sequence: TTG
gatattaaccatttattaga

SEQ ID NO: 63385 - DNA, 20 bp, Artificial Sequence
  Description of Artificial Sequence: Synthetic oligonucleotide
  Target: SCN9A; (-) strand; PAM type: YTN; PAM sequence: TTT
ggatattaaccatttattag

SEQ ID NO: 63386 - DNA, 20 bp, Artificial Sequence
  Description of Artificial Sequence: Synthetic oligonucleotide
  Target: SCN9A; (-) strand; PAM type: YTN; PAM sequence: TTT
tggatattaaccatttatta

SEQ ID NO: 63387 - DNA, 20 bp, Artificial Sequence
  Description of Artificial Sequence: Synthetic oligonucleotide
  Target: SCN9A; (-) strand; PAM type: YTN; PAM sequence: CTA
tatattttggatattaacca

SEQ ID NO: 63388 - DNA, 20 bp, Artificial Sequence
  Description of Artificial Sequence: Synthetic oligonucleotide
  Target: SCN9A; (-) strand; PAM type: YTN; PAM sequence: TTC
cctatatattttggatatta

SEQ ID NO: 63389 - DNA, 20 bp, Artificial Sequence
  Description of Artificial Sequence: Synthetic oligonucleotide
  Target: SCN9A; (-) strand; PAM type: YTN; PAM sequence: TTG
caggagttccctatatattt

SEQ ID NO: 63390 - DNA, 20 bp, Artificial Sequence
  Description of Artificial Sequence: Synthetic oligonucleotide
  Target: SCN9A; (-) strand; PAM type: YTN; PAM sequence: TTA
agttgcaggagttccctata

SEQ ID NO: 63391 - DNA, 20 bp, Artificial Sequence
  Description of Artificial Sequence: Synthetic oligonucleotide
  Target: SCN9A; (-) strand; PAM type: YTN; PAM sequence: CTT
aagttgcaggagttccctat

SEQ ID NO: 63392 - DNA, 20 bp, Artificial Sequence
  Description of Artificial Sequence: Synthetic oligonucleotide
  Target: SCN9A; (-) strand; PAM type: YTN; PAM sequence: TTC
ttaagttgcaggagttccct

SEQ ID NO: 63393 - DNA, 20 bp, Artificial Sequence
  Description of Artificial Sequence: Synthetic oligonucleotide
  Target: SCN9A; (-) strand; PAM type: YTN; PAM sequence: CTT
cttaagttgcaggagttccc

SEQ ID NO: 63394 - DNA, 20 bp, Artificial Sequence
  Description of Artificial Sequence: Synthetic oligonucleotide
  Target: SCN9A; (-) strand; PAM type: YTN; PAM sequence: TTG
catgccttcttaagttgcag

SEQ ID NO: 63395 - DNA, 20 bp, Artificial Sequence
  Description of Artificial Sequence: Synthetic oligonucleotide
  Target: SCN9A; (-) strand; PAM type: YTN; PAM sequence: TTT
gcatgccttcttaagttgca

SEQ ID NO: 63396 - DNA, 20 bp, Artificial Sequence
  Description of Artificial Sequence: Synthetic oligonucleotide
  Target: SCN9A; (-) strand; PAM type: YTN; PAM sequence: TTG
gtcatttgcatgccttctta

SEQ ID NO: 63397 - DNA, 20 bp, Artificial Sequence
  Description of Artificial Sequence: Synthetic oligonucleotide
  Target: SCN9A; (-) strand; PAM type: YTN; PAM sequence: TTA
atatacatgttggtcatttg

SEQ ID NO: 63398 - DNA, 20 bp, Artificial Sequence
  Description of Artificial Sequence: Synthetic oligonucleotide
  Target: SCN9A; (-) strand; PAM type: YTN; PAM sequence: TTT
aatatacatgttggtcattt

SEQ ID NO: 63399 - DNA, 20 bp, Artificial Sequence
  Description of Artificial Sequence: Synthetic oligonucleotide
  Target: SCN9A; (-) strand; PAM type: YTN; PAM sequence: TTT
taatatacatgttggtcatt

SEQ ID NO: 63400 - DNA, 20 bp, Artificial Sequence
  Description of Artificial Sequence: Synthetic oligonucleotide
  Target: SCN9A; (-) strand; PAM type: YTN; PAM sequence: CTT
ttaatatacatgttggtcat

SEQ ID NO: 63401 - DNA, 20 bp, Artificial Sequence
  Description of Artificial Sequence: Synthetic oligonucleotide
  Target: SCN9A; (-) strand; PAM type: YTN; PAM sequence: CTG
agcatcttttaatatacatg

SEQ ID NO: 63402 - DNA, 20 bp, Artificial Sequence
  Description of Artificial Sequence: Synthetic oligonucleotide
  Target: SCN9A; (-) strand; PAM type: YTN; PAM sequence: TTA
gtgatactgagcatctttta

SEQ ID NO: 63403 - DNA, 20 bp, Artificial Sequence
  Description of Artificial Sequence: Synthetic oligonucleotide
  Target: SCN9A; (-) strand; PAM type: YTN; PAM sequence: CTG
atgattagtgatactgagca

SEQ ID NO: 63404 - DNA, 20 bp, Artificial Sequence
  Description of Artificial Sequence: Synthetic oligonucleotide
  Target: SCN9A; (-) strand; PAM type: YTN; PAM sequence: TTC
tgatgattagtgatactgag

SEQ ID NO: 63405 - DNA, 20 bp, Artificial Sequence
  Description of Artificial Sequence: Synthetic oligonucleotide
  Target: SCN9A; (-) strand; PAM type: YTN; PAM sequence: TTT
ctgatgattagtgatactga

SEQ ID NO: 63406 - DNA, 20 bp, Artificial Sequence
  Description of Artificial Sequence: Synthetic oligonucleotide
  Target: SCN9A; (-) strand; PAM type: YTN; PAM sequence: TTT
tctgatgattagtgatactg

SEQ ID NO: 63407 - DNA, 20 bp, Artificial Sequence
  Description of Artificial Sequence: Synthetic oligonucleotide
  Target: SCN9A; (-) strand; PAM type: YTN; PAM sequence: TTG
aattttctgatgattagtga

SEQ ID NO: 63408 - DNA, 20 bp, Artificial Sequence
  Description of Artificial Sequence: Synthetic oligonucleotide
  Target: SCN9A; (-) strand; PAM type: YTN; PAM sequence: TTT
gaattttctgatgattagtg

SEQ ID NO: 63409 - DNA, 20 bp, Artificial Sequence
  Description of Artificial Sequence: Synthetic oligonucleotide
  Target: SCN9A; (-) strand; PAM type: YTN; PAM sequence: TTA
tttgaattttctgatgatta

SEQ ID NO: 63410 - DNA, 20 bp, Artificial Sequence
  Description of Artificial Sequence: Synthetic oligonucleotide
  Target: SCN9A; (-) strand; PAM type: YTN; PAM sequence: TTT
atttgaattttctgatgatt

SEQ ID NO: 63411 - DNA, 20 bp, Artificial Sequence
  Description of Artificial Sequence: Synthetic oligonucleotide
  Target: SCN9A; (-) strand; PAM type: YTN; PAM sequence: TTT
tatttgaattttctgatgat

SEQ ID NO: 63412 - DNA, 20 bp, Artificial Sequence
  Description of Artificial Sequence: Synthetic oligonucleotide
  Target: SCN9A; (-) strand; PAM type: YTN; PAM sequence: TTT
ttatttgaattttctgatga

SEQ ID NO: 63413 - DNA, 20 bp, Artificial Sequence
  Description of Artificial Sequence: Synthetic oligonucleotide
  Target: SCN9A; (-) strand; PAM type: YTN; PAM sequence: TTA
cagtttttatttgaattttc

SEQ ID NO: 63414 - DNA, 20 bp, Artificial Sequence
  Description of Artificial Sequence: Synthetic oligonucleotide
  Target: SCN9A; (-) strand; PAM type: YTN; PAM sequence: CTC
attacagtttttatttgaat

SEQ ID NO: 63415 - DNA, 20 bp, Artificial Sequence
  Description of Artificial Sequence: Synthetic oligonucleotide
  Target: SCN9A; (-) strand; PAM type: YTN; PAM sequence: CTG
gccctcattacagtttttat

SEQ ID NO: 63416 - DNA, 20 bp, Artificial Sequence
  Description of Artificial Sequence: Synthetic oligonucleotide
  Target: SCN9A; (-) strand; PAM type: YTN; PAM sequence: CTG
cacctggccctcattacagt

SEQ ID NO: 63417 - DNA, 20 bp, Artificial Sequence
  Description of Artificial Sequence: Synthetic oligonucleotide
  Target: SCN9A; (-) strand; PAM type: YTN; PAM sequence: CTG
ggataacaggcatgagccac

SEQ ID NO: 63418 - DNA, 20 bp, Artificial Sequence
  Description of Artificial Sequence: Synthetic oligonucleotide
  Target: SCN9A; (-) strand; PAM type: YTN; PAM sequence: CTC
ccaaagtgctgggataacag

SEQ ID NO: 63419 - DNA, 20 bp, Artificial Sequence
  Description of Artificial Sequence: Synthetic oligonucleotide
  Target: SCN9A; (-) strand; PAM type: YTN; PAM sequence: TTG
gcctcccaaagtgctgggat

SEQ ID NO: 63420 - DNA, 20 bp, Artificial Sequence
  Description of Artificial Sequence: Synthetic oligonucleotide
  Target: SCN9A; (-) strand; PAM type: YTN; PAM sequence: CTT
ggcctcccaaagtgctggga

SEQ ID NO: 63421 - DNA, 20 bp, Artificial Sequence
  Description of Artificial Sequence: Synthetic oligonucleotide
  Target: SCN9A; (-) strand; PAM type: YTN; PAM sequence: CTC
atgatccacccaccttggcc

SEQ ID NO: 63422 - DNA, 20 bp, Artificial Sequence
  Description of Artificial Sequence: Synthetic oligonucleotide
  Target: SCN9A; (-) strand; PAM type: YTN; PAM sequence: CTG
acctcatgatccacccacct

SEQ ID NO: 63423 - DNA, 20 bp, Artificial Sequence
  Description of Artificial Sequence: Synthetic oligonucleotide
  Target: SCN9A; (-) strand; PAM type: YTN; PAM sequence: CTC
ctgacctcatgatccaccca

SEQ ID NO: 63424 - DNA, 20 bp, Artificial Sequence
  Description of Artificial Sequence: Synthetic oligonucleotide
  Target: SCN9A; (-) strand; PAM type: YTN; PAM sequence: TTG
atctcctgacctcatgatcc

SEQ ID NO: 63425 - DNA, 20 bp, Artificial Sequence
  Description of Artificial Sequence: Synthetic oligonucleotide
  Target: SCN9A; (-) strand; PAM type: YTN; PAM sequence: CTT
gatctcctgacctcatgatc

SEQ ID NO: 63426 - DNA, 20 bp, Artificial Sequence
  Description of Artificial Sequence: Synthetic oligonucleotide
  Target: SCN9A; (-) strand; PAM type: YTN; PAM sequence: TTG
gccaggatggtcttgatctc

SEQ ID NO: 63427 - DNA, 20 bp, Artificial Sequence
  Description of Artificial Sequence: Synthetic oligonucleotide
  Target: SCN9A; (-) strand; PAM type: YTN; PAM sequence: TTT
ggccaggatggtcttgatct

SEQ ID NO: 63428 - DNA, 20 bp, Artificial Sequence
  Description of Artificial Sequence: Synthetic oligonucleotide
  Target: SCN9A; (-) strand; PAM type: YTN; PAM sequence: TTT
tggccaggatggtcttgatc

SEQ ID NO: 63429 - DNA, 20 bp, Artificial Sequence
  Description of Artificial Sequence: Synthetic oligonucleotide
  Target: SCN9A; (-) strand; PAM type: YTN; PAM sequence: TTC
accattttggccaggatggt

SEQ ID NO: 63430 - DNA, 20 bp, Artificial Sequence
  Description of Artificial Sequence: Synthetic oligonucleotide
  Target: SCN9A; (-) strand; PAM type: YTN; PAM sequence: TTT
caccattttggccaggatgg

SEQ ID NO: 63431 - DNA, 20 bp, Artificial Sequence
  Description of Artificial Sequence: Synthetic oligonucleotide
  Target: SCN9A; (-) strand; PAM type: YTN; PAM sequence: TTC
agtagagatggagtttcacc

SEQ ID NO: 63432 - DNA, 20 bp, Artificial Sequence
  Description of Artificial Sequence: Synthetic oligonucleotide
  Target: SCN9A; (-) strand; PAM type: YTN; PAM sequence: TTT
cagtagagatggagtttcac

SEQ ID NO: 63433 - DNA, 20 bp, Artificial Sequence
  Description of Artificial Sequence: Synthetic oligonucleotide
  Target: SCN9A; (-) strand; PAM type: YTN; PAM sequence: TTT
tcagtagagatggagtttca

SEQ ID NO: 63434 - DNA, 20 bp, Artificial Sequence
  Description of Artificial Sequence: Synthetic oligonucleotide
  Target: SCN9A; (-) strand; PAM type: YTN; PAM sequence: TTG
tattttcagtagagatggag

SEQ ID NO: 63435 - DNA, 20 bp, Artificial Sequence
  Description of Artificial Sequence: Synthetic oligonucleotide
  Target: SCN9A; (-) strand; PAM type: YTN; PAM sequence: TTT
gtattttcagtagagatgga

SEQ ID NO: 63436 - DNA, 20 bp, Artificial Sequence
  Description of Artificial Sequence: Synthetic oligonucleotide
  Target: SCN9A; (-) strand; PAM type: YTN; PAM sequence: TTT
tgtattttcagtagagatgg

SEQ ID NO: 63437 - DNA, 20 bp, Artificial Sequence
  Description of Artificial Sequence: Synthetic oligonucleotide
  Target: SCN9A; (-) strand; PAM type: YTN; PAM sequence: TTT
ttgtattttcagtagagatg

SEQ ID NO: 63438 - DNA, 20 bp, Artificial Sequence
  Description of Artificial Sequence: Synthetic oligonucleotide
  Target: SCN9A; (-) strand; PAM type: YTN; PAM sequence: CTA
atttttgtattttcagtaga

SEQ ID NO: 63439 - DNA, 20 bp, Artificial Sequence
  Description of Artificial Sequence: Synthetic oligonucleotide
  Target: SCN9A; (-) strand; PAM type: YTN; PAM sequence: TTA
caggcatgtgccaccatgcc

SEQ ID NO: 63440 - DNA, 20 bp, Artificial Sequence
  Description of Artificial Sequence: Synthetic oligonucleotide
  Target: SCN9A; (-) strand; PAM type: YTN; PAM sequence: CTG
ggattacaggcatgtgccac

SEQ ID NO: 63441 - DNA, 20 bp, Artificial Sequence
  Description of Artificial Sequence: Synthetic oligonucleotide
  Target: SCN9A; (-) strand; PAM type: YTN; PAM sequence: TTC
ccaagtagctgggattacag

SEQ ID NO: 63442 - DNA, 20 bp, Artificial Sequence
  Description of Artificial Sequence: Synthetic oligonucleotide
  Target: SCN9A; (-) strand; PAM type: YTN; PAM sequence: CTT
cccaagtagctgggattaca

SEQ ID NO: 63443 - DNA, 20 bp, Artificial Sequence
  Description of Artificial Sequence: Synthetic oligonucleotide
  Target: SCN9A; (-) strand; PAM type: YTN; PAM sequence: CTC
agcttcccaagtagctggga

SEQ ID NO: 63444 - DNA, 20 bp, Artificial Sequence
  Description of Artificial Sequence: Synthetic oligonucleotide
  Target: SCN9A; (-) strand; PAM type: YTN; PAM sequence: CTG
cctcagcttcccaagtagct

SEQ ID NO: 63445 - DNA, 20 bp, Artificial Sequence
  Description of Artificial Sequence: Synthetic oligonucleotide
  Target: SCN9A; (-) strand; PAM type: YTN; PAM sequence: CTC
ctgcctcagcttcccaagta

SEQ ID NO: 63446 - DNA, 20 bp, Artificial Sequence
  Description of Artificial Sequence: Synthetic oligonucleotide
  Target: SCN9A; (-) strand; PAM type: YTN; PAM sequence: TTC
tcctgcctcagcttcccaag

SEQ ID NO: 63447 - DNA, 20 bp, Artificial Sequence
  Description of Artificial Sequence: Synthetic oligonucleotide
  Target: SCN9A; (-) strand; PAM type: YTN; PAM sequence: TTC
aagtgattctcctgcctcag

SEQ ID NO: 63448 - DNA, 20 bp, Artificial Sequence
  Description of Artificial Sequence: Synthetic oligonucleotide
  Target: SCN9A; (-) strand; PAM type: YTN; PAM sequence: CTG
gttcaagtgattctcctgcc

SEQ ID NO: 63449 - DNA, 20 bp, Artificial Sequence
  Description of Artificial Sequence: Synthetic oligonucleotide
  Target: SCN9A; (-) strand; PAM type: YTN; PAM sequence: CTC
cctggttcaagtgattctcc

SEQ ID NO: 63450 - DNA, 20 bp, Artificial Sequence
  Description of Artificial Sequence: Synthetic oligonucleotide
  Target: SCN9A; (-) strand; PAM type: YTN; PAM sequence: CTC
cgactccctggttcaagtga

SEQ ID NO: 63451 - DNA, 20 bp, Artificial Sequence
  Description of Artificial Sequence: Synthetic oligonucleotide
  Target: SCN9A; (-) strand; PAM type: YTN; PAM sequence: CTG
caacctccgactccctggtt

SEQ ID NO: 63452 - DNA, 20 bp, Artificial Sequence
  Description of Artificial Sequence: Synthetic oligonucleotide
  Target: SCN9A; (-) strand; PAM type: YTN; PAM sequence: CTC
actgcaacctccgactccct

SEQ ID NO: 63453 - DNA, 20 bp, Artificial Sequence
  Description of Artificial Sequence: Synthetic oligonucleotide
  Target: SCN9A; (-) strand; PAM type: YTN; PAM sequence: CTC
agctcactgcaacctccgac

SEQ ID NO: 63454 - DNA, 20 bp, Artificial Sequence
  Description of Artificial Sequence: Synthetic oligonucleotide
  Target: SCN9A; (-) strand; PAM type: YTN; PAM sequence: CTG
gagtgcagtggcgcgatctc

SEQ ID NO: 63455 - DNA, 20 bp, Artificial Sequence
  Description of Artificial Sequence: Synthetic oligonucleotide
  Target: SCN9A; (-) strand; PAM type: YTN; PAM sequence: CTG
tcaccaggctggagtgcagt

SEQ ID NO: 63456 - DNA, 20 bp, Artificial Sequence
  Description of Artificial Sequence: Synthetic oligonucleotide
  Target: SCN9A; (-) strand; PAM type: YTN; PAM sequence: CTC
tgtcaccaggctggagtgca

SEQ ID NO: 63457 - DNA, 20 bp, Artificial Sequence
  Description of Artificial Sequence: Synthetic oligonucleotide
  Target: SCN9A; (-) strand; PAM type: YTN; PAM sequence: CTC
actctgtcaccaggctggag

SEQ ID NO: 63458 - DNA, 20 bp, Artificial Sequence
  Description of Artificial Sequence: Synthetic oligonucleotide
  Target: SCN9A; (-) strand; PAM type: YTN; PAM sequence: TTG
aaggagtctcactctgtcac

SEQ ID NO: 63459 - DNA, 20 bp, Artificial Sequence
  Description of Artificial Sequence: Synthetic oligonucleotide
  Target: SCN9A; (-) strand; PAM type: YTN; PAM sequence: TTT
gaaggagtctcactctgtca

SEQ ID NO: 63460 - DNA, 20 bp, Artificial Sequence
  Description of Artificial Sequence: Synthetic oligonucleotide
  Target: SCN9A; (-) strand; PAM type: YTN; PAM sequence: TTT
tgaaggagtctcactctgtc

SEQ ID NO: 63461 - DNA, 20 bp, Artificial Sequence
  Description of Artificial Sequence: Synthetic oligonucleotide
  Target: SCN9A; (-) strand; PAM type: YTN; PAM sequence: TTT
ttgaaggagtctcactctgt

SEQ ID NO: 63462 - DNA, 20 bp, Artificial Sequence
  Description of Artificial Sequence: Synthetic oligonucleotide
  Target: SCN9A; (-) strand; PAM type: YTN; PAM sequence: TTG
tttttgaaggagtctcactc

SEQ ID NO: 63463 - DNA, 20 bp, Artificial Sequence
  Description of Artificial Sequence: Synthetic oligonucleotide
  Target: SCN9A; (-) strand; PAM type: YTN; PAM sequence: TTT
gtttttgaaggagtctcact

SEQ ID NO: 63464 - DNA, 20 bp, Artificial Sequence
  Description of Artificial Sequence: Synthetic oligonucleotide
  Target: SCN9A; (-) strand; PAM type: YTN; PAM sequence: TTG
tttgtttttgaaggagtctc

SEQ ID NO: 63465 - DNA, 20 bp, Artificial Sequence
  Description of Artificial Sequence: Synthetic oligonucleotide
  Target: SCN9A; (-) strand; PAM type: YTN; PAM sequence: TTT
gtttgtttttgaaggagtct

SEQ ID NO: 63466 - DNA, 20 bp, Artificial Sequence
  Description of Artificial Sequence: Synthetic oligonucleotide
  Target: SCN9A; (-) strand; PAM type: YTN; PAM sequence: TTG
tttgtttgtttttgaaggag

SEQ ID NO: 63467 - DNA, 20 bp, Artificial Sequence
  Description of Artificial Sequence: Synthetic oligonucleotide
  Target: SCN9A; (-) strand; PAM type: YTN; PAM sequence: TTT
gtttgtttgtttttgaagga

SEQ ID NO: 63468 - DNA, 20 bp, Artificial Sequence
  Description of Artificial Sequence: Synthetic oligonucleotide
  Target: SCN9A; (-) strand; PAM type: YTN; PAM sequence: CTG
tttgtttgtttgtttttgaa

SEQ ID NO: 63469 - DNA, 20 bp, Artificial Sequence
  Description of Artificial Sequence: Synthetic oligonucleotide
  Target: SCN9A; (-) strand; PAM type: YTN; PAM sequence: TTG
ctgtttgtttgtttgttttt

SEQ ID NO: 63470 - DNA, 20 bp, Artificial Sequence
  Description of Artificial Sequence: Synthetic oligonucleotide
  Target: SCN9A; (-) strand; PAM type: YTN; PAM sequence: TTG
ttgctgtttgtttgtttgtt

SEQ ID NO: 63471 - DNA, 20 bp, Artificial Sequence
  Description of Artificial Sequence: Synthetic oligonucleotide
  Target: SCN9A; (-) strand; PAM type: YTN; PAM sequence: CTT
gttgctgtttgtttgtttgt

SEQ ID NO: 63472 - DNA, 20 bp, Artificial Sequence
  Description of Artificial Sequence: Synthetic oligonucleotide
  Target: SCN9A; (-) strand; PAM type: YTN; PAM sequence: TTA
caggcgtgagccaccacgcc

SEQ ID NO: 63473 - DNA, 20 bp, Artificial Sequence
  Description of Artificial Sequence: Synthetic oligonucleotide
  Target: SCN9A; (-) strand; PAM type: YTN; PAM sequence: CTG
ggattacaggcgtgagccac

SEQ ID NO: 63474 - DNA, 20 bp, Artificial Sequence
  Description of Artificial Sequence: Synthetic oligonucleotide
  Target: SCN9A; (-) strand; PAM type: YTN; PAM sequence: CTC
ccaaagtgctgggattacag

SEQ ID NO: 63475 - DNA, 20 bp, Artificial Sequence
  Description of Artificial Sequence: Synthetic oligonucleotide
  Target: SCN9A; (-) strand; PAM type: YTN; PAM sequence: CTC
ggcctcccaaagtgctggga

SEQ ID NO: 63476 - DNA, 20 bp, Artificial Sequence
  Description of Artificial Sequence: Synthetic oligonucleotide
  Target: SCN9A; (-) strand; PAM type: YTN; PAM sequence: CTC
gtgatccgcccgtctcggcc

SEQ ID NO: 63477 - DNA, 20 bp, Artificial Sequence
  Description of Artificial Sequence: Synthetic oligonucleotide
  Target: SCN9A; (-) strand; PAM type: YTN; PAM sequence: CTG
acctcgtgatccgcccgtct

SEQ ID NO: 63478 - DNA, 20 bp, Artificial Sequence
  Description of Artificial Sequence: Synthetic oligonucleotide
  Target: SCN9A; (-) strand; PAM type: YTN; PAM sequence: CTC
ctgacctcgtgatccgcccg

SEQ ID NO: 63479 - DNA, 20 bp, Artificial Sequence
  Description of Artificial Sequence: Synthetic oligonucleotide
  Target: SCN9A; (-) strand; PAM type: YTN; PAM sequence: CTC
gatctcctgacctcgtgatc

SEQ ID NO: 63480 - DNA, 20 bp, Artificial Sequence
  Description of Artificial Sequence: Synthetic oligonucleotide
  Target: SCN9A; (-) strand; PAM type: YTN; PAM sequence: TTA
gccaggatggtctcgatctc

SEQ ID NO: 63481 - DNA, 20 bp, Artificial Sequence
  Description of Artificial Sequence: Synthetic oligonucleotide
  Target: SCN9A; (-) strand; PAM type: YTN; PAM sequence: CTG
ttagccaggatggtctcgat

SEQ ID NO: 63482 - DNA, 20 bp, Artificial Sequence
  Description of Artificial Sequence: Synthetic oligonucleotide
  Target: SCN9A; (-) strand; PAM type: YTN; PAM sequence: TTC
accctgttagccaggatggt

SEQ ID NO: 63483 - DNA, 20 bp, Artificial Sequence
  Description of Artificial Sequence: Synthetic oligonucleotide
  Target: SCN9A; (-) strand; PAM type: YTN; PAM sequence: TTT
caccctgttagccaggatgg

SEQ ID NO: 63484 - DNA, 20 bp, Artificial Sequence
  Description of Artificial Sequence: Synthetic oligonucleotide
  Target: SCN9A; (-) strand; PAM type: YTN; PAM sequence: TTA
gtagagacggggtttcaccc

SEQ ID NO: 63485 - DNA, 20 bp, Artificial Sequence
  Description of Artificial Sequence: Synthetic oligonucleotide
  Target: SCN9A; (-) strand; PAM type: YTN; PAM sequence: TTT
agtagagacggggtttcacc

SEQ ID NO: 63486 - DNA, 20 bp, Artificial Sequence
  Description of Artificial Sequence: Synthetic oligonucleotide
  Target: SCN9A; (-) strand; PAM type: YTN; PAM sequence: TTT
tagtagagacggggtttcac

SEQ ID NO: 63487 - DNA, 20 bp, Artificial Sequence
  Description of Artificial Sequence: Synthetic oligonucleotide
  Target: SCN9A; (-) strand; PAM type: YTN; PAM sequence: TTT
ttagtagagacggggtttca

SEQ ID NO: 63488 - DNA, 20 bp, Artificial Sequence
  Description of Artificial Sequence: Synthetic oligonucleotide
  Target: SCN9A; (-) strand; PAM type: YTN; PAM sequence: TTG
tatttttagtagagacgggg

SEQ ID NO: 63489 - DNA, 20 bp, Artificial Sequence
  Description of Artificial Sequence: Synthetic oligonucleotide
  Target: SCN9A; (-) strand; PAM type: YTN; PAM sequence: TTT
gtatttttagtagagacggg

SEQ ID NO: 63490 - DNA, 20 bp, Artificial Sequence
  Description of Artificial Sequence: Synthetic oligonucleotide
  Target: SCN9A; (-) strand; PAM type: YTN; PAM sequence: TTT
tgtatttttagtagagacgg

SEQ ID NO: 63491 - DNA, 20 bp, Artificial Sequence
  Description of Artificial Sequence: Synthetic oligonucleotide
  Target: SCN9A; (-) strand; PAM type: YTN; PAM sequence: TTT
ttgtatttttagtagagacg

SEQ ID NO: 63492 - DNA, 20 bp, Artificial Sequence
  Description of Artificial Sequence: Synthetic oligonucleotide
  Target: SCN9A; (-) strand; PAM type: YTN; PAM sequence: CTA
atttttgtatttttagtaga

SEQ ID NO: 63493 - DNA, 20 bp, Artificial Sequence
  Description of Artificial Sequence: Synthetic oligonucleotide
  Target: SCN9A; (-) strand; PAM type: YTN; PAM sequence: CTA
caggcgtgcgccaccatgcc

SEQ ID NO: 63494 - DNA, 20 bp, Artificial Sequence
  Description of Artificial Sequence: Synthetic oligonucleotide
  Target: SCN9A; (-) strand; PAM type: YTN; PAM sequence: CTG
ggactacaggcgtgcgccac

SEQ ID NO: 63495 - DNA, 20 bp, Artificial Sequence
  Description of Artificial Sequence: Synthetic oligonucleotide
  Target: SCN9A; (-) strand; PAM type: YTN; PAM sequence: CTC
ccgtgtagctgggactacag

SEQ ID NO: 63496 - DNA, 20 bp, Artificial Sequence
  Description of Artificial Sequence: Synthetic oligonucleotide
  Target: SCN9A; (-) strand; PAM type: YTN; PAM sequence: CTC
agcctcccgtgtagctggga

SEQ ID NO: 63497 - DNA, 20 bp, Artificial Sequence
  Description of Artificial Sequence: Synthetic oligonucleotide
  Target: SCN9A; (-) strand; PAM type: YTN; PAM sequence: CTG
cctcagcctcccgtgtagct

SEQ ID NO: 63498 - DNA, 20 bp, Artificial Sequence
  Description of Artificial Sequence: Synthetic oligonucleotide
  Target: SCN9A; (-) strand; PAM type: YTN; PAM sequence: CTC
ctgcctcagcctcccgtgta

SEQ ID NO: 63499 - DNA, 20 bp, Artificial Sequence
  Description of Artificial Sequence: Synthetic oligonucleotide
  Target: SCN9A; (-) strand; PAM type: YTN; PAM sequence: TTC
tcctgcctcagcctcccgtg

SEQ ID NO: 63500 - DNA, 20 bp, Artificial Sequence
  Description of Artificial Sequence: Synthetic oligonucleotide
  Target: SCN9A; (-) strand; PAM type: YTN; PAM sequence: TTC
acgccattctcctgcctcag

SEQ ID NO: 63501 - DNA, 20 bp, Artificial Sequence
  Description of Artificial Sequence: Synthetic oligonucleotide
  Target: SCN9A; (-) strand; PAM type: YTN; PAM sequence: CTC
ccgggttcacgccattctcc

SEQ ID NO: 63502 - DNA, 20 bp, Artificial Sequence
  Description of Artificial Sequence: Synthetic oligonucleotide
  Target: SCN9A; (-) strand; PAM type: YTN; PAM sequence: CTC
cgcctcccgggttcacgcca

SEQ ID NO: 63503 - DNA, 20 bp, Artificial Sequence
  Description of Artificial Sequence: Synthetic oligonucleotide
  Target: SCN9A; (-) strand; PAM type: YTN; PAM sequence: CTG
caagctccgcctcccgggtt

SEQ ID NO: 63504 - DNA, 20 bp, Artificial Sequence
  Description of Artificial Sequence: Synthetic oligonucleotide
  Target: SCN9A; (-) strand; PAM type: YTN; PAM sequence: CTC
actgcaagctccgcctcccg

SEQ ID NO: 63505 - DNA, 20 bp, Artificial Sequence
  Description of Artificial Sequence: Synthetic oligonucleotide
  Target: SCN9A; (-) strand; PAM type: YTN; PAM sequence: CTC
gactcactgcaagctccgcc

SEQ ID NO: 63506 - DNA, 20 bp, Artificial Sequence
  Description of Artificial Sequence: Synthetic oligonucleotide
  Target: SCN9A; (-) strand; PAM type: YTN; PAM sequence: CTG
gagtgcagtggcgcgatctc

SEQ ID NO: 63507 - DNA, 20 bp, Artificial Sequence
  Description of Artificial Sequence: Synthetic oligonucleotide
  Target: SCN9A; (-) strand; PAM type: YTN; PAM sequence: CTG
tcgcccaggctggagtgcag

SEQ ID NO: 63508 - DNA, 20 bp, Artificial Sequence
  Description of Artificial Sequence: Synthetic oligonucleotide
  Target: SCN9A; (-) strand; PAM type: YTN; PAM sequence: CTC
tgtcgcccaggctggagtgc

SEQ ID NO: 63509 - DNA, 20 bp, Artificial Sequence
  Description of Artificial Sequence: Synthetic oligonucleotide
  Target: SCN9A; (-) strand; PAM type: YTN; PAM sequence: TTC
gctctgtcgcccaggctgga

SEQ ID NO: 63510 - DNA, 20 bp, Artificial Sequence
  Description of Artificial Sequence: Synthetic oligonucleotide
  Target: SCN9A; (-) strand; PAM type: YTN; PAM sequence: TTT
cgctctgtcgcccaggctgg

SEQ ID NO: 63511 - DNA, 20 bp, Artificial Sequence
  Description of Artificial Sequence: Synthetic oligonucleotide
  Target: SCN9A; (-) strand; PAM type: YTN; PAM sequence: TTG
agacggagtttcgctctgtc

SEQ ID NO: 63512 - DNA, 20 bp, Artificial Sequence
  Description of Artificial Sequence: Synthetic oligonucleotide
  Target: SCN9A; (-) strand; PAM type: YTN; PAM sequence: TTT
gagacggagtttcgctctgt

SEQ ID NO: 63513 - DNA, 20 bp, Artificial Sequence
  Description of Artificial Sequence: Synthetic oligonucleotide
  Target: SCN9A; (-) strand; PAM type: YTN; PAM sequence: TTT
tgagacggagtttcgctctg

SEQ ID NO: 63514 - DNA, 20 bp, Artificial Sequence
  Description of Artificial Sequence: Synthetic oligonucleotide
  Target: SCN9A; (-) strand; PAM type: YTN; PAM sequence: TTT
ttgagacggagtttcgctct

SEQ ID NO: 63515 - DNA, 20 bp, Artificial Sequence
  Description of Artificial Sequence: Synthetic oligonucleotide
  Target: SCN9A; (-) strand; PAM type: YTN; PAM sequence: TTT
tttgagacggagtttcgctc

SEQ ID NO: 63516 - DNA, 20 bp, Artificial Sequence
  Description of Artificial Sequence: Synthetic oligonucleotide
  Target: SCN9A; (-) strand; PAM type: YTN; PAM sequence: TTT
ttttgagacggagtttcgct

SEQ ID NO: 63517 - DNA, 20 bp, Artificial Sequence
  Description of Artificial Sequence: Synthetic oligonucleotide
  Target: SCN9A; (-) strand; PAM type: YTN; PAM sequence: TTT
tttttgagacggagtttcgc

SEQ ID NO: 63518 - DNA, 20 bp, Artificial Sequence
  Description of Artificial Sequence: Synthetic oligonucleotide
  Target: SCN9A; (-) strand; PAM type: YTN; PAM sequence: TTT
ttttttgagacggagtttcg

SEQ ID NO: 63519 - DNA, 20 bp, Artificial Sequence
  Description of Artificial Sequence: Synthetic oligonucleotide
  Target: SCN9A; (-) strand; PAM type: YTN; PAM sequence: TTT
tttttttgagacggagtttc

SEQ ID NO: 63520 - DNA, 20 bp, Artificial Sequence
  Description of Artificial Sequence: Synthetic oligonucleotide
  Target: SCN9A; (-) strand; PAM type: YTN; PAM sequence: TTT
ttttttttgagacggagttt

SEQ ID NO: 63521 - DNA, 20 bp, Artificial Sequence
  Description of Artificial Sequence: Synthetic oligonucleotide
  Target: SCN9A; (-) strand; PAM type: YTN; PAM sequence: TTG
tttttttttttgagacggag

SEQ ID NO: 63522 - DNA, 20 bp, Artificial Sequence
  Description of Artificial Sequence: Synthetic oligonucleotide
  Target: SCN9A; (-) strand; PAM type: YTN; PAM sequence: TTG
ttgtttttttttttgagacg

SEQ ID NO: 63523 - DNA, 20 bp, Artificial Sequence
  Description of Artificial Sequence: Synthetic oligonucleotide
  Target: SCN9A; (-) strand; PAM type: YTN; PAM sequence: TTT
gttgtttttttttttgagac

SEQ ID NO: 63524 - DNA, 20 bp, Artificial Sequence
  Description of Artificial Sequence: Synthetic oligonucleotide
  Target: SCN9A; (-) strand; PAM type: YTN; PAM sequence: TTT
tgttgtttttttttttgaga

SEQ ID NO: 63525 - DNA, 20 bp, Artificial Sequence
  Description of Artificial Sequence: Synthetic oligonucleotide
  Target: SCN9A; (-) strand; PAM type: YTN; PAM sequence: TTT
ttgttgtttttttttttgag

SEQ ID NO: 63526 - DNA, 20 bp, Artificial Sequence
  Description of Artificial Sequence: Synthetic oligonucleotide
  Target: SCN9A; (-) strand; PAM type: YTN; PAM sequence: TTT
tttgttgtttttttttttga

SEQ ID NO: 63527 - DNA, 20 bp, Artificial Sequence
  Description of Artificial Sequence: Synthetic oligonucleotide
  Target: SCN9A; (-) strand; PAM type: YTN; PAM sequence: TTT
ttttgttgtttttttttttg

SEQ ID NO: 63528 - DNA, 20 bp, Artificial Sequence
  Description of Artificial Sequence: Synthetic oligonucleotide
  Target: SCN9A; (-) strand; PAM type: YTN; PAM sequence: TTT
tttttgttgttttttttttt

SEQ ID NO: 63529 - DNA, 20 bp, Artificial Sequence
  Description of Artificial Sequence: Synthetic oligonucleotide
  Target: SCN9A; (-) strand; PAM type: YTN; PAM sequence: TTT
ttttttgttgtttttttttt

SEQ ID NO: 63530 - DNA, 20 bp, Artificial Sequence
  Description of Artificial Sequence: Synthetic oligonucleotide
  Target: SCN9A; (-) strand; PAM type: YTN; PAM sequence: TTT
tttttttgttgttttttttt

SEQ ID NO: 63531 - DNA, 20 bp, Artificial Sequence
  Description of Artificial Sequence: Synthetic oligonucleotide
  Target: SCN9A; (-) strand; PAM type: YTN; PAM sequence: TTT
ttttttttgttgtttttttt

SEQ ID NO: 63532 - DNA, 20 bp, Artificial Sequence
  Description of Artificial Sequence: Synthetic oligonucleotide
  Target: SCN9A; (-) strand; PAM type: YTN; PAM sequence: TTT
tttttttttgttgttttttt

SEQ ID NO: 63533 - DNA, 20 bp, Artificial Sequence
  Description of Artificial Sequence: Synthetic oligonucleotide
  Target: SCN9A; (-) strand; PAM type: YTN; PAM sequence: TTT
ttttttttttgttgtttttt

SEQ ID NO: 63534 - DNA, 20 bp, Artificial Sequence
  Description of Artificial Sequence: Synthetic oligonucleotide
  Target: SCN9A; (-) strand; PAM type: YTN; PAM sequence: TTT
tttttttttttgttgttttt

SEQ ID NO: 63535 - DNA, 20 bp, Artificial Sequence
  Description of Artificial Sequence: Synthetic oligonucleotide
  Target: SCN9A; (-) strand; PAM type: YTN; PAM sequence: TTT
ttttttttttttgttgtttt

SEQ ID NO: 63536 - DNA, 20 bp, Artificial Sequence
  Description of Artificial Sequence: Synthetic oligonucleotide
  Target: SCN9A; (-) strand; PAM type: YTN; PAM sequence: TTT
tttttttttttttgttgttt

SEQ ID NO: 63537 - DNA, 20 bp, Artificial Sequence
  Description of Artificial Sequence: Synthetic oligonucleotide
  Target: SCN9A; (-) strand; PAM type: YTN; PAM sequence: TTT
ttttttttttttttgttgtt

SEQ ID NO: 63538 - DNA, 20 bp, Artificial Sequence
  Description of Artificial Sequence: Synthetic oligonucleotide
  Target: SCN9A; (-) strand; PAM type: YTN; PAM sequence: TTT
tttttttttttttttgttgt

SEQ ID NO: 63539 - DNA, 20 bp, Artificial Sequence
  Description of Artificial Sequence: Synthetic oligonucleotide
  Target: SCN9A; (-) strand; PAM type: YTN; PAM sequence: TTT
ttttttttttttttttgttg

SEQ ID NO: 63540 - DNA, 20 bp, Artificial Sequence
  Description of Artificial Sequence: Synthetic oligonucleotide
  Target: SCN9A; (-) strand; PAM type: YTN; PAM sequence: TTT
tttttttttttttttttgtt

SEQ ID NO: 63541 - DNA, 20 bp, Artificial Sequence
  Description of Artificial Sequence: Synthetic oligonucleotide
  Target: SCN9A; (-) strand; PAM type: YTN; PAM sequence: TTT
ttttttttttttttttttgt

SEQ ID NO: 63542 - DNA, 20 bp, Artificial Sequence
  Description of Artificial Sequence: Synthetic oligonucleotide
  Target: SCN9A; (-) strand; PAM type: YTN; PAM sequence: TTT
tttttttttttttttttttg

SEQ ID NO: 63543 - DNA, 20 bp, Artificial Sequence
  Description of Artificial Sequence: Synthetic oligonucleotide
  Target: SCN9A; (-) strand; PAM type: YTN; PAM sequence: TTT
tttttttttttttttttttt

SEQ ID NO: 63544 - DNA, 20 bp, Artificial Sequence
  Description of Artificial Sequence: Synthetic oligonucleotide
  Target: SCN9A; (-) strand; PAM type: YTN; PAM sequence: TTT
tttttttttttttttttttt

SEQ ID NO: 63545 - DNA, 20 bp, Artificial Sequence
  Description of Artificial Sequence: Synthetic oligonucleotide
  Target: SCN9A; (-) strand; PAM type: YTN; PAM sequence: TTT
tttttttttttttttttttt

SEQ ID NO: 63546 - DNA, 20 bp, Artificial Sequence
  Description of Artificial Sequence: Synthetic oligonucleotide
  Target: SCN9A; (-) strand; PAM type: YTN; PAM sequence: TTT
tttttttttttttttttttt

SEQ ID NO: 63547 - DNA, 20 bp, Artificial Sequence
  Description of Artificial Sequence: Synthetic oligonucleotide
  Target: SCN9A; (-) strand; PAM type: YTN; PAM sequence: TTT
tttttttttttttttttttt

SEQ ID NO: 63548 - DNA, 20 bp, Artificial Sequence
  Description of Artificial Sequence: Synthetic oligonucleotide
  Target: SCN9A; (-) strand; PAM type: YTN; PAM sequence: CTG
tttttttttttttttttttt

SEQ ID NO: 63549 - DNA, 20 bp, Artificial Sequence
  Description of Artificial Sequence: Synthetic oligonucleotide
  Target: SCN9A; (-) strand; PAM type: YTN; PAM sequence: TTG
ctgttttttttttttttttt

SEQ ID NO: 63550 - DNA, 20 bp, Artificial Sequence
  Description of Artificial Sequence: Synthetic oligonucleotide
  Target: SCN9A; (-) strand; PAM type: YTN; PAM sequence: TTG
ttgctgtttttttttttttt

SEQ ID NO: 63551 - DNA, 20 bp, Artificial Sequence
  Description of Artificial Sequence: Synthetic oligonucleotide
  Target: SCN9A; (-) strand; PAM type: YTN; PAM sequence: TTT
gttgctgttttttttttttt

SEQ ID NO: 63552 - DNA, 20 bp, Artificial Sequence
  Description of Artificial Sequence: Synthetic oligonucleotide
  Target: SCN9A; (-) strand; PAM type: YTN; PAM sequence: TTT
tgttgctgtttttttttttt

SEQ ID NO: 63553 - DNA, 20 bp, Artificial Sequence
  Description of Artificial Sequence: Synthetic oligonucleotide
  Target: SCN9A; (-) strand; PAM type: YTN; PAM sequence: TTT
ttgttgctgttttttttttt

SEQ ID NO: 63554 - DNA, 20 bp, Artificial Sequence
  Description of Artificial Sequence: Synthetic oligonucleotide
  Target: SCN9A; (-) strand; PAM type: YTN; PAM sequence: TTT
tttgttgctgtttttttttt

SEQ ID NO: 63555 - DNA, 20 bp, Artificial Sequence
  Description of Artificial Sequence: Synthetic oligonucleotide
  Target: SCN9A; (-) strand; PAM type: YTN; PAM sequence: TTA
cggttttttgttgctgtttt

SEQ ID NO: 63556 - DNA, 20 bp, Artificial Sequence
  Description of Artificial Sequence: Synthetic oligonucleotide
  Target: SCN9A; (-) strand; PAM type: YTN; PAM sequence: TTT
acggttttttgttgctgttt

SEQ ID NO: 63557 - DNA, 20 bp, Artificial Sequence
  Description of Artificial Sequence: Synthetic oligonucleotide
  Target: SCN9A; (-) strand; PAM type: YTN; PAM sequence: CTT
tacggttttttgttgctgtt

SEQ ID NO: 63558 - DNA, 20 bp, Artificial Sequence
  Description of Artificial Sequence: Synthetic oligonucleotide
  Target: SCN9A; (-) strand; PAM type: YTN; PAM sequence: CTC
tttacggttttttgttgctg

SEQ ID NO: 63559 - DNA, 20 bp, Artificial Sequence
  Description of Artificial Sequence: Synthetic oligonucleotide
  Target: SCN9A; (-) strand; PAM type: YTN; PAM sequence: CTA
gcaggtatgaaatgatatct

SEQ ID NO: 63560 - DNA, 20 bp, Artificial Sequence
  Description of Artificial Sequence: Synthetic oligonucleotide
  Target: SCN9A; (-) strand; PAM type: YTN; PAM sequence: TTG
gtaatagccatcctagcagg

SEQ ID NO: 63561 - DNA, 20 bp, Artificial Sequence
  Description of Artificial Sequence: Synthetic oligonucleotide
  Target: SCN9A; (-) strand; PAM type: YTN; PAM sequence: TTT
ggtaatagccatcctagcag

SEQ ID NO: 63562 - DNA, 20 bp, Artificial Sequence
  Description of Artificial Sequence: Synthetic oligonucleotide
  Target: SCN9A; (-) strand; PAM type: YTN; PAM sequence: TTT
tggtaatagccatcctagca

SEQ ID NO: 63563 - DNA, 20 bp, Artificial Sequence
  Description of Artificial Sequence: Synthetic oligonucleotide
  Target: SCN9A; (-) strand; PAM type: YTN; PAM sequence: TTG
ttttggtaatagccatccta

SEQ ID NO: 63564 - DNA, 20 bp, Artificial Sequence
  Description of Artificial Sequence: Synthetic oligonucleotide
  Target: SCN9A; (-) strand; PAM type: YTN; PAM sequence: TTT
gttttggtaatagccatcct

SEQ ID NO: 63565 - DNA, 20 bp, Artificial Sequence
  Description of Artificial Sequence: Synthetic oligonucleotide
  Target: SCN9A; (-) strand; PAM type: YTN; PAM sequence: TTT
tgttttggtaatagccatcc

SEQ ID NO: 63566 - DNA, 20 bp, Artificial Sequence
  Description of Artificial Sequence: Synthetic oligonucleotide
  Target: SCN9A; (-) strand; PAM type: YTN; PAM sequence: TTT
ttgttttggtaatagccatc

SEQ ID NO: 63567 - DNA, 20 bp, Artificial Sequence
  Description of Artificial Sequence: Synthetic oligonucleotide
  Target: SCN9A; (-) strand; PAM type: YTN; PAM sequence: TTG
tttttgttttggtaatagcc

SEQ ID NO: 63568 - DNA, 20 bp, Artificial Sequence
  Description of Artificial Sequence: Synthetic oligonucleotide
  Target: SCN9A; (-) strand; PAM type: YTN; PAM sequence: TTT
gtttttgttttggtaatagc

SEQ ID NO: 63569 - DNA, 20 bp, Artificial Sequence
  Description of Artificial Sequence: Synthetic oligonucleotide
  Target: SCN9A; (-) strand; PAM type: YTN; PAM sequence: TTT
tgtttttgttttggtaatag

SEQ ID NO: 63570 - DNA, 20 bp, Artificial Sequence
  Description of Artificial Sequence: Synthetic oligonucleotide
  Target: SCN9A; (-) strand; PAM type: YTN; PAM sequence: TTT
ttgtttttgttttggtaata

SEQ ID NO: 63571 - DNA, 20 bp, Artificial Sequence
  Description of Artificial Sequence: Synthetic oligonucleotide
  Target: SCN9A; (-) strand; PAM type: YTN; PAM sequence: TTG
ggtggtttttgtttttgttt

SEQ ID NO: 63572 - DNA, 20 bp, Artificial Sequence
  Description of Artificial Sequence: Synthetic oligonucleotide
  Target: SCN9A; (-) strand; PAM type: YTN; PAM sequence: TTT
gggtggtttttgtttttgtt

SEQ ID NO: 63573 - DNA, 20 bp, Artificial Sequence
  Description of Artificial Sequence: Synthetic oligonucleotide
  Target: SCN9A; (-) strand; PAM type: YTN; PAM sequence: TTG
atttgggtggtttttgtttt

SEQ ID NO: 63574 - DNA, 20 bp, Artificial Sequence
  Description of Artificial Sequence: Synthetic oligonucleotide
  Target: SCN9A; (-) strand; PAM type: YTN; PAM sequence: TTT
gatttgggtggtttttgttt

SEQ ID NO: 63575 - DNA, 20 bp, Artificial Sequence
  Description of Artificial Sequence: Synthetic oligonucleotide
  Target: SCN9A; (-) strand; PAM type: YTN; PAM sequence: TTT
tgatttgggtggtttttgtt

SEQ ID NO: 63576 - DNA, 20 bp, Artificial Sequence
  Description of Artificial Sequence: Synthetic oligonucleotide
  Target: SCN9A; (-) strand; PAM type: YTN; PAM sequence: CTT
ttgatttgggtggtttttgt

SEQ ID NO: 63577 - DNA, 20 bp, Artificial Sequence
  Description of Artificial Sequence: Synthetic oligonucleotide
  Target: SCN9A; (-) strand; PAM type: YTN; PAM sequence: TTA
tcttttgatttgggtggttt

SEQ ID NO: 63578 - DNA, 20 bp, Artificial Sequence
  Description of Artificial Sequence: Synthetic oligonucleotide
  Target: SCN9A; (-) strand; PAM type: YTN; PAM sequence: CTA
ttatcttttgatttgggtgg

SEQ ID NO: 63579 - DNA, 20 bp, Artificial Sequence
  Description of Artificial Sequence: Synthetic oligonucleotide
  Target: SCN9A; (-) strand; PAM type: YTN; PAM sequence: TTG
ccaacacctattatcttttg

SEQ ID NO: 63580 - DNA, 20 bp, Artificial Sequence
  Description of Artificial Sequence: Synthetic oligonucleotide
  Target: SCN9A; (-) strand; PAM type: YTN; PAM sequence: CTT
gccaacacctattatctttt

SEQ ID NO: 63581 - DNA, 20 bp, Artificial Sequence
  Description of Artificial Sequence: Synthetic oligonucleotide
  Target: SCN9A; (-) strand; PAM type: YTN; PAM sequence: CTC
catatccttgccaacaccta

SEQ ID NO: 63582 - DNA, 20 bp, Artificial Sequence
  Description of Artificial Sequence: Synthetic oligonucleotide
  Target: SCN9A; (-) strand; PAM type: YTN; PAM sequence: TTC
tccatatccttgccaacacc

SEQ ID NO: 63583 - DNA, 20 bp, Artificial Sequence
  Description of Artificial Sequence: Synthetic oligonucleotide
  Target: SCN9A; (-) strand; PAM type: YTN; PAM sequence: TTT
ctccatatccttgccaacac

SEQ ID NO: 63584 - DNA, 20 bp, Artificial Sequence
  Description of Artificial Sequence: Synthetic oligonucleotide
  Target: SCN9A; (-) strand; PAM type: YTN; PAM sequence: CTA
atttctccatatccttgcca

SEQ ID NO: 63585 - DNA, 20 bp, Artificial Sequence
  Description of Artificial Sequence: Synthetic oligonucleotide
  Target: SCN9A; (-) strand; PAM type: YTN; PAM sequence: TTC
taatttctccatatccttgc

SEQ ID NO: 63586 - DNA, 20 bp, Artificial Sequence
  Description of Artificial Sequence: Synthetic oligonucleotide
  Target: SCN9A; (-) strand; PAM type: YTN; PAM sequence: TTC
caacaatgtacaaaggttct

SEQ ID NO: 63587 - DNA, 20 bp, Artificial Sequence
  Description of Artificial Sequence: Synthetic oligonucleotide
  Target: SCN9A; (-) strand; PAM type: YTN; PAM sequence: TTA
cattccaacaatgtacaaag

SEQ ID NO: 63588 - DNA, 20 bp, Artificial Sequence
  Description of Artificial Sequence: Synthetic oligonucleotide
  Target: SCN9A; (-) strand; PAM type: YTN; PAM sequence: TTT
acattccaacaatgtacaaa

SEQ ID NO: 63589 - DNA, 20 bp, Artificial Sequence
  Description of Artificial Sequence: Synthetic oligonucleotide
  Target: SCN9A; (-) strand; PAM type: YTN; PAM sequence: TTT
tacattccaacaatgtacaa

SEQ ID NO: 63590 - DNA, 20 bp, Artificial Sequence
  Description of Artificial Sequence: Synthetic oligonucleotide
  Target: SCN9A; (-) strand; PAM type: YTN; PAM sequence: CTA
catcattttacattccaaca

SEQ ID NO: 63591 - DNA, 20 bp, Artificial Sequence
  Description of Artificial Sequence: Synthetic oligonucleotide
  Target: SCN9A; (-) strand; PAM type: YTN; PAM sequence: CTA
tggcagctacatcattttac

SEQ ID NO: 63592 - DNA, 20 bp, Artificial Sequence
  Description of Artificial Sequence: Synthetic oligonucleotide
  Target: SCN9A; (-) strand; PAM type: YTN; PAM sequence: TTC
tatggcagctacatcatttt

SEQ ID NO: 63593 - DNA, 20 bp, Artificial Sequence
  Description of Artificial Sequence: Synthetic oligonucleotide
  Target: SCN9A; (-) strand; PAM type: YTN; PAM sequence: TTT
ctatggcagctacatcattt

SEQ ID NO: 63594 - DNA, 20 bp, Artificial Sequence
  Description of Artificial Sequence: Synthetic oligonucleotide
  Target: SCN9A; (-) strand; PAM type: YTN; PAM sequence: TTT
tctatggcagctacatcatt

SEQ ID NO: 63595 - DNA, 20 bp, Artificial Sequence
  Description of Artificial Sequence: Synthetic oligonucleotide
  Target: SCN9A; (-) strand; PAM type: YTN; PAM sequence: CTG
ttttctatggcagctacatc

SEQ ID NO: 63596 - DNA, 20 bp, Artificial Sequence
  Description of Artificial Sequence: Synthetic oligonucleotide
  Target: SCN9A; (-) strand; PAM type: YTN; PAM sequence: TTC
atactgttttctatggcagc

SEQ ID NO: 63597 - DNA, 20 bp, Artificial Sequence
  Description of Artificial Sequence: Synthetic oligonucleotide
  Target: SCN9A; (-) strand; PAM type: YTN; PAM sequence: TTT
catactgttttctatggcag

SEQ ID NO: 63598 - DNA, 20 bp, Artificial Sequence
  Description of Artificial Sequence: Synthetic oligonucleotide
  Target: SCN9A; (-) strand; PAM type: YTN; PAM sequence: CTT
tcatactgttttctatggca

SEQ ID NO: 63599 - DNA, 20 bp, Artificial Sequence
  Description of Artificial Sequence: Synthetic oligonucleotide
  Target: SCN9A; (-) strand; PAM type: YTN; PAM sequence: TTC
aggaactttcatactgtttt

SEQ ID NO: 63600 - DNA, 20 bp, Artificial Sequence
  Description of Artificial Sequence: Synthetic oligonucleotide
  Target: SCN9A; (-) strand; PAM type: YTN; PAM sequence: TTT
caggaactttcatactgttt

SEQ ID NO: 63601 - DNA, 20 bp, Artificial Sequence
  Description of Artificial Sequence: Synthetic oligonucleotide
  Target: SCN9A; (-) strand; PAM type: YTN; PAM sequence: TTT
tcaggaactttcatactgtt

SEQ ID NO: 63602 - DNA, 20 bp, Artificial Sequence
  Description of Artificial Sequence: Synthetic oligonucleotide
  Target: SCN9A; (-) strand; PAM type: YTN; PAM sequence: TTT
ttcaggaactttcatactgt

SEQ ID NO: 63603 - DNA, 20 bp, Artificial Sequence
  Description of Artificial Sequence: Synthetic oligonucleotide
  Target: SCN9A; (-) strand; PAM type: YTN; PAM sequence: TTT
tttcaggaactttcatactg

SEQ ID NO: 63604 - DNA, 20 bp, Artificial Sequence
  Description of Artificial Sequence: Synthetic oligonucleotide
  Target: SCN9A; (-) strand; PAM type: YTN; PAM sequence: TTA
attttttcaggaactttcat

SEQ ID NO: 63605 - DNA, 20 bp, Artificial Sequence
  Description of Artificial Sequence: Synthetic oligonucleotide
  Target: SCN9A; (-) strand; PAM type: YTN; PAM sequence: TTT
aattttttcaggaactttca

SEQ ID NO: 63606 - DNA, 20 bp, Artificial Sequence
  Description of Artificial Sequence: Synthetic oligonucleotide
  Target: SCN9A; (-) strand; PAM type: YTN; PAM sequence: TTT
taattttttcaggaactttc

SEQ ID NO: 63607 - DNA, 20 bp, Artificial Sequence
  Description of Artificial Sequence: Synthetic oligonucleotide
  Target: SCN9A; (-) strand; PAM type: YTN; PAM sequence: TTT
ttaattttttcaggaacttt

SEQ ID NO: 63608 - DNA, 20 bp, Artificial Sequence
  Description of Artificial Sequence: Synthetic oligonucleotide
  Target: SCN9A; (-) strand; PAM type: YTN; PAM sequence: TTA
tatttttaattttttcagga

SEQ ID NO: 63609 - DNA, 20 bp, Artificial Sequence
  Description of Artificial Sequence: Synthetic oligonucleotide
  Target: SCN9A; (-) strand; PAM type: YTN; PAM sequence: CTA
gatcaaatggtagttatatt

SEQ ID NO: 63610 - DNA, 20 bp, Artificial Sequence
  Description of Artificial Sequence: Synthetic oligonucleotide
  Target: SCN9A; (-) strand; PAM type: YTN; PAM sequence: TTG
ctagatcaaatggtagttat

SEQ ID NO: 63611 - DNA, 20 bp, Artificial Sequence
  Description of Artificial Sequence: Synthetic oligonucleotide
  Target: SCN9A; (-) strand; PAM type: YTN; PAM sequence: CTC
agatgtggcattgctagatc

SEQ ID NO: 63612 - DNA, 20 bp, Artificial Sequence
  Description of Artificial Sequence: Synthetic oligonucleotide
  Target: SCN9A; (-) strand; PAM type: YTN; PAM sequence: TTA
aaatatgctcagatgtggca

SEQ ID NO: 63613 - DNA, 20 bp, Artificial Sequence
  Description of Artificial Sequence: Synthetic oligonucleotide
  Target: SCN9A; (-) strand; PAM type: YTN; PAM sequence: TTT
aaaatatgctcagatgtggc

SEQ ID NO: 63614 - DNA, 20 bp, Artificial Sequence
  Description of Artificial Sequence: Synthetic oligonucleotide
  Target: SCN9A; (-) strand; PAM type: YTN; PAM sequence: TTT
taaaatatgctcagatgtgg

SEQ ID NO: 63615 - DNA, 20 bp, Artificial Sequence
  Description of Artificial Sequence: Synthetic oligonucleotide
  Target: SCN9A; (-) strand; PAM type: YTN; PAM sequence: TTT
ttaaaatatgctcagatgtg

SEQ ID NO: 63616 - DNA, 20 bp, Artificial Sequence
  Description of Artificial Sequence: Synthetic oligonucleotide
  Target: SCN9A; (-) strand; PAM type: YTN; PAM sequence: TTC
aaatttttaaaatatgctca

SEQ ID NO: 63617 - DNA, 20 bp, Artificial Sequence
  Description of Artificial Sequence: Synthetic oligonucleotide
  Target: SCN9A; (-) strand; PAM type: YTN; PAM sequence: CTG
agttcaaatttttaaaatat

SEQ ID NO: 63618 - DNA, 20 bp, Artificial Sequence
  Description of Artificial Sequence: Synthetic oligonucleotide
  Target: SCN9A; (-) strand; PAM type: YTN; PAM sequence: CTG
agatcctgagttcaaatttt

SEQ ID NO: 63619 - DNA, 20 bp, Artificial Sequence
  Description of Artificial Sequence: Synthetic oligonucleotide
  Target: SCN9A; (-) strand; PAM type: YTN; PAM sequence: CTC
tgagatcctgagttcaaatt

SEQ ID NO: 63620 - DNA, 20 bp, Artificial Sequence
  Description of Artificial Sequence: Synthetic oligonucleotide
  Target: SCN9A; (-) strand; PAM type: YTN; PAM sequence: CTG
aagtgaacatggaagtaagg

SEQ ID NO: 63621 - DNA, 20 bp, Artificial Sequence
  Description of Artificial Sequence: Synthetic oligonucleotide
  Target: SCN9A; (-) strand; PAM type: YTN; PAM sequence: TTG
gatacagtaaatagtgctga

SEQ ID NO: 63622 - DNA, 20 bp, Artificial Sequence
  Description of Artificial Sequence: Synthetic oligonucleotide
  Target: SCN9A; (-) strand; PAM type: YTN; PAM sequence: TTT
ggatacagtaaatagtgctg

SEQ ID NO: 63623 - DNA, 20 bp, Artificial Sequence
  Description of Artificial Sequence: Synthetic oligonucleotide
  Target: SCN9A; (-) strand; PAM type: YTN; PAM sequence: TTC
atatttggatacagtaaata

SEQ ID NO: 63624 - DNA, 20 bp, Artificial Sequence
  Description of Artificial Sequence: Synthetic oligonucleotide
  Target: SCN9A; (-) strand; PAM type: YTN; PAM sequence: TTT
catatttggatacagtaaat

SEQ ID NO: 63625 - DNA, 20 bp, Artificial Sequence
  Description of Artificial Sequence: Synthetic oligonucleotide
  Target: SCN9A; (-) strand; PAM type: YTN; PAM sequence: TTT
tcatatttggatacagtaaa

SEQ ID NO: 63626 - DNA, 20 bp, Artificial Sequence
  Description of Artificial Sequence: Synthetic oligonucleotide
  Target: SCN9A; (-) strand; PAM type: YTN; PAM sequence: TTG
ttttcatatttggatacagt

SEQ ID NO: 63627 - DNA, 20 bp, Artificial Sequence
  Description of Artificial Sequence: Synthetic oligonucleotide
  Target: SCN9A; (-) strand; PAM type: YTN; PAM sequence: TTA
ggttgttttcatatttggat

SEQ ID NO: 63628 - DNA, 20 bp, Artificial Sequence
  Description of Artificial Sequence: Synthetic oligonucleotide
  Target: SCN9A; (-) strand; PAM type: YTN; PAM sequence: TTT
aggttgttttcatatttgga

SEQ ID NO: 63629 - DNA, 20 bp, Artificial Sequence
  Description of Artificial Sequence: Synthetic oligonucleotide
  Target: SCN9A; (-) strand; PAM type: YTN; PAM sequence: TTC
atcaatagacatttaggttg

SEQ ID NO: 63630 - DNA, 20 bp, Artificial Sequence
  Description of Artificial Sequence: Synthetic oligonucleotide
  Target: SCN9A; (-) strand; PAM type: YTN; PAM sequence: CTA
tcccatcattcatcaataga

SEQ ID NO: 63631 - DNA, 20 bp, Artificial Sequence
  Description of Artificial Sequence: Synthetic oligonucleotide
  Target: SCN9A; (-) strand; PAM type: YTN; PAM sequence: TTC
tatcccatcattcatcaata

SEQ ID NO: 63632 - DNA, 20 bp, Artificial Sequence
  Description of Artificial Sequence: Synthetic oligonucleotide
  Target: SCN9A; (-) strand; PAM type: YTN; PAM sequence: TTT
ctatcccatcattcatcaat

SEQ ID NO: 63633 - DNA, 20 bp, Artificial Sequence
  Description of Artificial Sequence: Synthetic oligonucleotide
  Target: SCN9A; (-) strand; PAM type: YTN; PAM sequence: TTT
tctatcccatcattcatcaa

SEQ ID NO: 63634 - DNA, 20 bp, Artificial Sequence
  Description of Artificial Sequence: Synthetic oligonucleotide
  Target: SCN9A; (-) strand; PAM type: YTN; PAM sequence: TTG
tgtgtgtgtgtgtacgtgca

SEQ ID NO: 63635 - DNA, 20 bp, Artificial Sequence
  Description of Artificial Sequence: Synthetic oligonucleotide
  Target: SCN9A; (-) strand; PAM type: YTN; PAM sequence: TTT
gtgtgtgtgtgtgtacgtgc

SEQ ID NO: 63636 - DNA, 20 bp, Artificial Sequence
  Description of Artificial Sequence: Synthetic oligonucleotide
  Target: SCN9A; (-) strand; PAM type: YTN; PAM sequence: CTG
aatagtgtgtgtttgtgtgt

SEQ ID NO: 63637 - DNA, 20 bp, Artificial Sequence
  Description of Artificial Sequence: Synthetic oligonucleotide
  Target: SCN9A; (-) strand; PAM type: YTN; PAM sequence: TTA
taaggctgaatagtgtgtgt

SEQ ID NO: 63638 - DNA, 20 bp, Artificial Sequence
  Description of Artificial Sequence: Synthetic oligonucleotide
  Target: SCN9A; (-) strand; PAM type: YTN; PAM sequence: TTT
ataaggctgaatagtgtgtg

SEQ ID NO: 63639 - DNA, 20 bp, Artificial Sequence
  Description of Artificial Sequence: Synthetic oligonucleotide
  Target: SCN9A; (-) strand; PAM type: YTN; PAM sequence: CTT
tataaggctgaatagtgtgt

SEQ ID NO: 63640 - DNA, 20 bp, Artificial Sequence
  Description of Artificial Sequence: Synthetic oligonucleotide
  Target: SCN9A; (-) strand; PAM type: YTN; PAM sequence: TTC
tttataaggctgaatagtgt

SEQ ID NO: 63641 - DNA, 20 bp, Artificial Sequence
  Description of Artificial Sequence: Synthetic oligonucleotide
  Target: SCN9A; (-) strand; PAM type: YTN; PAM sequence: CTT
ctttataaggctgaatagtg

SEQ ID NO: 63642 - DNA, 20 bp, Artificial Sequence
  Description of Artificial Sequence: Synthetic oligonucleotide
  Target: SCN9A; (-) strand; PAM type: YTN; PAM sequence: TTC
cttctttataaggctgaata

SEQ ID NO: 63643 - DNA, 20 bp, Artificial Sequence
  Description of Artificial Sequence: Synthetic oligonucleotide
  Target: SCN9A; (-) strand; PAM type: YTN; PAM sequence: TTT
ccttctttataaggctgaat

SEQ ID NO: 63644 - DNA, 20 bp, Artificial Sequence
  Description of Artificial Sequence: Synthetic oligonucleotide
  Target: SCN9A; (-) strand; PAM type: YTN; PAM sequence: CTG
catatggcaggatttccttc

SEQ ID NO: 63645 - DNA, 20 bp, Artificial Sequence
  Description of Artificial Sequence: Synthetic oligonucleotide
  Target: SCN9A; (-) strand; PAM type: YTN; PAM sequence: TTG
ctgcatatggcaggatttcc

SEQ ID NO: 63646 - DNA, 20 bp, Artificial Sequence
  Description of Artificial Sequence: Synthetic oligonucleotide
  Target: SCN9A; (-) strand; PAM type: YTN; PAM sequence: TTC
aagttgctgcatatggcagg

SEQ ID NO: 63647 - DNA, 20 bp, Artificial Sequence
  Description of Artificial Sequence: Synthetic oligonucleotide
  Target: SCN9A; (-) strand; PAM type: YTN; PAM sequence: TTC
attcaagttgctgcatatgg

SEQ ID NO: 63648 - DNA, 20 bp, Artificial Sequence
  Description of Artificial Sequence: Synthetic oligonucleotide
  Target: SCN9A; (-) strand; PAM type: YTN; PAM sequence: TTA
tccaggttcattcaagttgc

SEQ ID NO: 63649 - DNA, 20 bp, Artificial Sequence
  Description of Artificial Sequence: Synthetic oligonucleotide
  Target: SCN9A; (-) strand; PAM type: YTN; PAM sequence: TTT
atccaggttcattcaagttg

SEQ ID NO: 63650 - DNA, 20 bp, Artificial Sequence
  Description of Artificial Sequence: Synthetic oligonucleotide
  Target: SCN9A; (-) strand; PAM type: YTN; PAM sequence: CTC
agcataaatttatccaggtt

SEQ ID NO: 63651 - DNA, 20 bp, Artificial Sequence
  Description of Artificial Sequence: Synthetic oligonucleotide
  Target: SCN9A; (-) strand; PAM type: YTN; PAM sequence: TTC
actcagcataaatttatcca

SEQ ID NO: 63652 - DNA, 20 bp, Artificial Sequence
  Description of Artificial Sequence: Synthetic oligonucleotide
  Target: SCN9A; (-) strand; PAM type: YTN; PAM sequence: CTT
cactcagcataaatttatcc

SEQ ID NO: 63653 - DNA, 20 bp, Artificial Sequence
  Description of Artificial Sequence: Synthetic oligonucleotide
  Target: SCN9A; (-) strand; PAM type: YTN; PAM sequence: TTA
cttcactcagcataaattta

SEQ ID NO: 63654 - DNA, 20 bp, Artificial Sequence
  Description of Artificial Sequence: Synthetic oligonucleotide
  Target: SCN9A; (-) strand; PAM type: YTN; PAM sequence: CTG
ttacttcactcagcataaat

SEQ ID NO: 63655 - DNA, 20 bp, Artificial Sequence
  Description of Artificial Sequence: Synthetic oligonucleotide
  Target: SCN9A; (-) strand; PAM type: YTN; PAM sequence: TTC
tgttacttcactcagcataa

SEQ ID NO: 63656 - DNA, 20 bp, Artificial Sequence
  Description of Artificial Sequence: Synthetic oligonucleotide
  Target: SCN9A; (-) strand; PAM type: YTN; PAM sequence: TTT
ctgttacttcactcagcata

SEQ ID NO: 63657 - DNA, 20 bp, Artificial Sequence
  Description of Artificial Sequence: Synthetic oligonucleotide
  Target: SCN9A; (-) strand; PAM type: YTN; PAM sequence: TTT
tctgttacttcactcagcat

SEQ ID NO: 63658 - DNA, 20 bp, Artificial Sequence
  Description of Artificial Sequence: Synthetic oligonucleotide
  Target: SCN9A; (-) strand; PAM type: YTN; PAM sequence: TTT
ttctgttacttcactcagca

SEQ ID NO: 63659 - DNA, 20 bp, Artificial Sequence
  Description of Artificial Sequence: Synthetic oligonucleotide
  Target: SCN9A; (-) strand; PAM type: YTN; PAM sequence: TTT
tttctgttacttcactcagc

SEQ ID NO: 63660 - DNA, 20 bp, Artificial Sequence
  Description of Artificial Sequence: Synthetic oligonucleotide
  Target: SCN9A; (-) strand; PAM type: YTN; PAM sequence: TTA
tgcaatattttttctgttac

SEQ ID NO: 63661 - DNA, 20 bp, Artificial Sequence
  Description of Artificial Sequence: Synthetic oligonucleotide
  Target: SCN9A; (-) strand; PAM type: YTN; PAM sequence: TTC
accgaagtggaattatgcaa

SEQ ID NO: 63662 - DNA, 20 bp, Artificial Sequence
  Description of Artificial Sequence: Synthetic oligonucleotide
  Target: SCN9A; (-) strand; PAM type: YTN; PAM sequence: CTT
caccgaagtggaattatgca

SEQ ID NO: 63663 - DNA, 20 bp, Artificial Sequence
  Description of Artificial Sequence: Synthetic oligonucleotide
  Target: SCN9A; (-) strand; PAM type: YTN; PAM sequence: TTA
cttcaccgaagtggaattat

SEQ ID NO: 63664 - DNA, 20 bp, Artificial Sequence
  Description of Artificial Sequence: Synthetic oligonucleotide
  Target: SCN9A; (-) strand; PAM type: YTN; PAM sequence: TTA
gttacttcaccgaagtggaa

SEQ ID NO: 63665 - DNA, 20 bp, Artificial Sequence
  Description of Artificial Sequence: Synthetic oligonucleotide
  Target: SCN9A; (-) strand; PAM type: YTN; PAM sequence: TTT
agttacttcaccgaagtgga

SEQ ID NO: 63666 - DNA, 20 bp, Artificial Sequence
  Description of Artificial Sequence: Synthetic oligonucleotide
  Target: SCN9A; (-) strand; PAM type: YTN; PAM sequence: TTT
tagttacttcaccgaagtgg

SEQ ID NO: 63667 - DNA, 20 bp, Artificial Sequence
  Description of Artificial Sequence: Synthetic oligonucleotide
  Target: SCN9A; (-) strand; PAM type: YTN; PAM sequence: TTG
accattttagttacttcacc

SEQ ID NO: 63668 - DNA, 20 bp, Artificial Sequence
  Description of Artificial Sequence: Synthetic oligonucleotide
  Target: SCN9A; (-) strand; PAM type: YTN; PAM sequence: TTT
gaccattttagttacttcac

SEQ ID NO: 63669 - DNA, 20 bp, Artificial Sequence
  Description of Artificial Sequence: Synthetic oligonucleotide
  Target: SCN9A; (-) strand; PAM type: YTN; PAM sequence: TTC
catgagtttgaccattttag

SEQ ID NO: 63670 - DNA, 20 bp, Artificial Sequence
  Description of Artificial Sequence: Synthetic oligonucleotide
  Target: SCN9A; (-) strand; PAM type: YTN; PAM sequence: TTT
ccatgagtttgaccatttta

SEQ ID NO: 63671 - DNA, 20 bp, Artificial Sequence
  Description of Artificial Sequence: Synthetic oligonucleotide
  Target: SCN9A; (-) strand; PAM type: YTN; PAM sequence: CTG
tttccatgagtttgaccatt

SEQ ID NO: 63672 - DNA, 20 bp, Artificial Sequence
  Description of Artificial Sequence: Synthetic oligonucleotide
  Target: SCN9A; (-) strand; PAM type: YTN; PAM sequence: CTC
tgtttccatgagtttgacca

SEQ ID NO: 63673 - DNA, 20 bp, Artificial Sequence
  Description of Artificial Sequence: Synthetic oligonucleotide
  Target: SCN9A; (-) strand; PAM type: YTN; PAM sequence: CTC
tctgtttccatgagtttgac

SEQ ID NO: 63674 - DNA, 20 bp, Artificial Sequence
  Description of Artificial Sequence: Synthetic oligonucleotide
  Target: SCN9A; (-) strand; PAM type: YTN; PAM sequence: TTC
tctctgtttccatgagtttg

SEQ ID NO: 63675 - DNA, 20 bp, Artificial Sequence
  Description of Artificial Sequence: Synthetic oligonucleotide
  Target: SCN9A; (-) strand; PAM type: YTN; PAM sequence: CTT
ctctctgtttccatgagttt

SEQ ID NO: 63676 - DNA, 20 bp, Artificial Sequence
  Description of Artificial Sequence: Synthetic oligonucleotide
  Target: SCN9A; (-) strand; PAM type: YTN; PAM sequence: TTC
ttctctctgtttccatgagt

SEQ ID NO: 63677 - DNA, 20 bp, Artificial Sequence
  Description of Artificial Sequence: Synthetic oligonucleotide
  Target: SCN9A; (-) strand; PAM type: YTN; PAM sequence: CTG
gcaatcaccattcttctctc

SEQ ID NO: 63678 - DNA, 20 bp, Artificial Sequence
  Description of Artificial Sequence: Synthetic oligonucleotide
  Target: SCN9A; (-) strand; PAM type: YTN; PAM sequence: TTC
atgccctggcaatcaccatt

SEQ ID NO: 63679 - DNA, 20 bp, Artificial Sequence
  Description of Artificial Sequence: Synthetic oligonucleotide
  Target: SCN9A; (-) strand; PAM type: YTN; PAM sequence: TTT
catgccctggcaatcaccat

SEQ ID NO: 63680 - DNA, 20 bp, Artificial Sequence
  Description of Artificial Sequence: Synthetic oligonucleotide
  Target: SCN9A; (-) strand; PAM type: YTN; PAM sequence: CTT
tcatgccctggcaatcacca

SEQ ID NO: 63681 - DNA, 20 bp, Artificial Sequence
  Description of Artificial Sequence: Synthetic oligonucleotide
  Target: SCN9A; (-) strand; PAM type: YTN; PAM sequence: CTC
ccatcctttcatgccctggc

SEQ ID NO: 63682 - DNA, 20 bp, Artificial Sequence
  Description of Artificial Sequence: Synthetic oligonucleotide
  Target: SCN9A; (-) strand; PAM type: YTN; PAM sequence: TTC
tcccatcctttcatgccctg

SEQ ID NO: 63683 - DNA, 20 bp, Artificial Sequence
  Description of Artificial Sequence: Synthetic oligonucleotide
  Target: SCN9A; (-) strand; PAM type: YTN; PAM sequence: CTC
cattctcccatcctttcatg

SEQ ID NO: 63684 - DNA, 20 bp, Artificial Sequence
  Description of Artificial Sequence: Synthetic oligonucleotide
  Target: SCN9A; (-) strand; PAM type: YTN; PAM sequence: TTC
tccattctcccatcctttca

SEQ ID NO: 63685 - DNA, 20 bp, Artificial Sequence
  Description of Artificial Sequence: Synthetic oligonucleotide
  Target: SCN9A; (-) strand; PAM type: YTN; PAM sequence: TTG
aatagcaattctccattctc

SEQ ID NO: 63686 - DNA, 20 bp, Artificial Sequence
  Description of Artificial Sequence: Synthetic oligonucleotide
  Target: SCN9A; (-) strand; PAM type: YTN; PAM sequence: TTC
ccattgaatagcaattctcc

SEQ ID NO: 63687 - DNA, 20 bp, Artificial Sequence
  Description of Artificial Sequence: Synthetic oligonucleotide
  Target: SCN9A; (-) strand; PAM type: YTN; PAM sequence: TTA
ttcccattgaatagcaattc

SEQ ID NO: 63688 - DNA, 20 bp, Artificial Sequence
  Description of Artificial Sequence: Synthetic oligonucleotide
  Target: SCN9A; (-) strand; PAM type: YTN; PAM sequence: TTT
attcccattgaatagcaatt

SEQ ID NO: 63689 - DNA, 20 bp, Artificial Sequence
  Description of Artificial Sequence: Synthetic oligonucleotide
  Target: SCN9A; (-) strand; PAM type: YTN; PAM sequence: CTT
tattcccattgaatagcaat

SEQ ID NO: 63690 - DNA, 20 bp, Artificial Sequence
  Description of Artificial Sequence: Synthetic oligonucleotide
  Target: SCN9A; (-) strand; PAM type: YTN; PAM sequence: TTG
aaactttattcccattgaat

SEQ ID NO: 63691 - DNA, 20 bp, Artificial Sequence
  Description of Artificial Sequence: Synthetic oligonucleotide
  Target: SCN9A; (-) strand; PAM type: YTN; PAM sequence: TTG
cataattgaaactttattcc

SEQ ID NO: 63692 - DNA, 20 bp, Artificial Sequence
  Description of Artificial Sequence: Synthetic oligonucleotide
  Target: SCN9A; (-) strand; PAM type: YTN; PAM sequence: CTT
gcataattgaaactttattc

SEQ ID NO: 63693 - DNA, 20 bp, Artificial Sequence
  Description of Artificial Sequence: Synthetic oligonucleotide
  Target: SCN9A; (-) strand; PAM type: YTN; PAM sequence: TTC
atcttgcataattgaaactt

SEQ ID NO: 63694 - DNA, 20 bp, Artificial Sequence
  Description of Artificial Sequence: Synthetic oligonucleotide
  Target: SCN9A; (-) strand; PAM type: YTN; PAM sequence: TTA
ttcatcttgcataattgaaa

SEQ ID NO: 63695 - DNA, 20 bp, Artificial Sequence
  Description of Artificial Sequence: Synthetic oligonucleotide
  Target: SCN9A; (-) strand; PAM type: YTN; PAM sequence: CTT
attcatcttgcataattgaa

SEQ ID NO: 63696 - DNA, 20 bp, Artificial Sequence
  Description of Artificial Sequence: Synthetic oligonucleotide
  Target: SCN9A; (-) strand; PAM type: YTN; PAM sequence: CTA
gaacttattcatcttgcata

SEQ ID NO: 63697 - DNA, 20 bp, Artificial Sequence
  Description of Artificial Sequence: Synthetic oligonucleotide
  Target: SCN9A; (-) strand; PAM type: YTN; PAM sequence: CTA
caggaagtccctagaactta

SEQ ID NO: 63698 - DNA, 20 bp, Artificial Sequence
  Description of Artificial Sequence: Synthetic oligonucleotide
  Target: SCN9A; (-) strand; PAM type: YTN; PAM sequence: TTA
cgaagtactacaggaagtcc

SEQ ID NO: 63699 - DNA, 20 bp, Artificial Sequence
  Description of Artificial Sequence: Synthetic oligonucleotide
  Target: SCN9A; (-) strand; PAM type: YTN; PAM sequence: CTA
tagttacgaagtactacagg

SEQ ID NO: 63700 - DNA, 20 bp, Artificial Sequence
  Description of Artificial Sequence: Synthetic oligonucleotide
  Target: SCN9A; (-) strand; PAM type: YTN; PAM sequence: TTA
actatagttacgaagtacta

SEQ ID NO: 63701 - DNA, 20 bp, Artificial Sequence
  Description of Artificial Sequence: Synthetic oligonucleotide
  Target: SCN9A; (-) strand; PAM type: YTN; PAM sequence: TTG
ttaactatagttacgaagta

SEQ ID NO: 63702 - DNA, 20 bp, Artificial Sequence
  Description of Artificial Sequence: Synthetic oligonucleotide
  Target: SCN9A; (-) strand; PAM type: YTN; PAM sequence: CTA
tatatattgttaactatagt

SEQ ID NO: 63703 - DNA, 20 bp, Artificial Sequence
  Description of Artificial Sequence: Synthetic oligonucleotide
  Target: SCN9A; (-) strand; PAM type: YTN; PAM sequence: TTA
agtatactatatatattgtt

SEQ ID NO: 63704 - DNA, 20 bp, Artificial Sequence
  Description of Artificial Sequence: Synthetic oligonucleotide
  Target: SCN9A; (-) strand; PAM type: YTN; PAM sequence: TTT
aagtatactatatatattgt

SEQ ID NO: 63705 - DNA, 20 bp, Artificial Sequence
  Description of Artificial Sequence: Synthetic oligonucleotide
  Target: SCN9A; (-) strand; PAM type: YTN; PAM sequence: TTT
taagtatactatatatattg

SEQ ID NO: 63706 - DNA, 20 bp, Artificial Sequence
  Description of Artificial Sequence: Synthetic oligonucleotide
  Target: SCN9A; (-) strand; PAM type: YTN; PAM sequence: TTT
ttaagtatactatatatatt

SEQ ID NO: 63707 - DNA, 20 bp, Artificial Sequence
  Description of Artificial Sequence: Synthetic oligonucleotide
  Target: SCN9A; (-) strand; PAM type: YTN; PAM sequence: TTA
acaaaatttttaagtatact

SEQ ID NO: 63708 - DNA, 20 bp, Artificial Sequence
  Description of Artificial Sequence: Synthetic oligonucleotide
  Target: SCN9A; (-) strand; PAM type: YTN; PAM sequence: CTT
aacaaaatttttaagtatac

SEQ ID NO: 63709 - DNA, 20 bp, Artificial Sequence
  Description of Artificial Sequence: Synthetic oligonucleotide
  Target: SCN9A; (-) strand; PAM type: YTN; PAM sequence: CTG
cttaacaaaatttttaagta

SEQ ID NO: 63710 - DNA, 20 bp, Artificial Sequence
  Description of Artificial Sequence: Synthetic oligonucleotide
  Target: SCN9A; (-) strand; PAM type: YTN; PAM sequence: CTA
cctgcttaacaaaattttta

SEQ ID NO: 63711 - DNA, 20 bp, Artificial Sequence
  Description of Artificial Sequence: Synthetic oligonucleotide
  Target: SCN9A; (-) strand; PAM type: YTN; PAM sequence: TTA
atatgagatctacctgctta

SEQ ID NO: 63712 - DNA, 20 bp, Artificial Sequence
  Description of Artificial Sequence: Synthetic oligonucleotide
  Target: SCN9A; (-) strand; PAM type: YTN; PAM sequence: CTT
aatatgagatctacctgctt

SEQ ID NO: 63713 - DNA, 20 bp, Artificial Sequence
  Description of Artificial Sequence: Synthetic oligonucleotide
  Target: SCN9A; (-) strand; PAM type: YTN; PAM sequence: TTG
tggtaaggaaacttaatatg

SEQ ID NO: 63714 - DNA, 20 bp, Artificial Sequence
  Description of Artificial Sequence: Synthetic oligonucleotide
  Target: SCN9A; (-) strand; PAM type: YTN; PAM sequence: TTA
ttgtggtaaggaaacttaat

SEQ ID NO: 63715 - DNA, 20 bp, Artificial Sequence
  Description of Artificial Sequence: Synthetic oligonucleotide
  Target: SCN9A; (-) strand; PAM type: YTN; PAM sequence: TTA
attattgtggtaaggaaact

SEQ ID NO: 63716 - DNA, 20 bp, Artificial Sequence
  Description of Artificial Sequence: Synthetic oligonucleotide
  Target: SCN9A; (-) strand; PAM type: YTN; PAM sequence: TTT
aattattgtggtaaggaaac

SEQ ID NO: 63717 - DNA, 20 bp, Artificial Sequence
  Description of Artificial Sequence: Synthetic oligonucleotide
  Target: SCN9A; (-) strand; PAM type: YTN; PAM sequence: TTT
taattattgtggtaaggaaa

SEQ ID NO: 63718 - DNA, 20 bp, Artificial Sequence
  Description of Artificial Sequence: Synthetic oligonucleotide
  Target: SCN9A; (-) strand; PAM type: YTN; PAM sequence: CTA
attttaattattgtggtaag

SEQ ID NO: 63719 - DNA, 20 bp, Artificial Sequence
  Description of Artificial Sequence: Synthetic oligonucleotide
  Target: SCN9A; (-) strand; PAM type: YTN; PAM sequence: TTC
ctaattttaattattgtggt

SEQ ID NO: 63720 - DNA, 20 bp, Artificial Sequence
  Description of Artificial Sequence: Synthetic oligonucleotide
  Target: SCN9A; (-) strand; PAM type: YTN; PAM sequence: TTT
cctaattttaattattgtgg

SEQ ID NO: 63721 - DNA, 20 bp, Artificial Sequence
  Description of Artificial Sequence: Synthetic oligonucleotide
  Target: SCN9A; (-) strand; PAM type: YTN; PAM sequence: CTT
tcctaattttaattattgtg

SEQ ID NO: 63722 - DNA, 20 bp, Artificial Sequence
  Description of Artificial Sequence: Synthetic oligonucleotide
  Target: SCN9A; (-) strand; PAM type: YTN; PAM sequence: TTG
cctttcctaattttaattat

SEQ ID NO: 63723 - DNA, 20 bp, Artificial Sequence
  Description of Artificial Sequence: Synthetic oligonucleotide
  Target: SCN9A; (-) strand; PAM type: YTN; PAM sequence: TTT
gcctttcctaattttaatta

SEQ ID NO: 63724 - DNA, 20 bp, Artificial Sequence
  Description of Artificial Sequence: Synthetic oligonucleotide
  Target: SCN9A; (-) strand; PAM type: YTN; PAM sequence: CTT
tgcctttcctaattttaatt

SEQ ID NO: 63725 - DNA, 20 bp, Artificial Sequence
  Description of Artificial Sequence: Synthetic oligonucleotide
  Target: SCN9A; (-) strand; PAM type: YTN; PAM sequence: TTC
tttgcctttcctaattttaa

SEQ ID NO: 63726 - DNA, 20 bp, Artificial Sequence
  Description of Artificial Sequence: Synthetic oligonucleotide
  Target: SCN9A; (-) strand; PAM type: YTN; PAM sequence: TTT
ctttgcctttcctaatttta

SEQ ID NO: 63727 - DNA, 20 bp, Artificial Sequence
  Description of Artificial Sequence: Synthetic oligonucleotide
  Target: SCN9A; (-) strand; PAM type: YTN; PAM sequence: TTT
tctttgcctttcctaatttt

SEQ ID NO: 63728 - DNA, 20 bp, Artificial Sequence
  Description of Artificial Sequence: Synthetic oligonucleotide
  Target: SCN9A; (-) strand; PAM type: YTN; PAM sequence: CTT
ttctttgcctttcctaattt

SEQ ID NO: 63729 - DNA, 20 bp, Artificial Sequence
  Description of Artificial Sequence: Synthetic oligonucleotide
  Target: SCN9A; (-) strand; PAM type: YTN; PAM sequence: TTC
caaagaaaaaaaacaaatga

SEQ ID NO: 63730 - DNA, 20 bp, Artificial Sequence
  Description of Artificial Sequence: Synthetic oligonucleotide
  Target: SCN9A; (-) strand; PAM type: YTN; PAM sequence: TTA
ttccaaagaaaaaaaacaaa

SEQ ID NO: 63731 - DNA, 20 bp, Artificial Sequence
  Description of Artificial Sequence: Synthetic oligonucleotide
  Target: SCN9A; (-) strand; PAM type: YTN; PAM sequence: TTT
attccaaagaaaaaaaacaa

SEQ ID NO: 63732 - DNA, 20 bp, Artificial Sequence
  Description of Artificial Sequence: Synthetic oligonucleotide
  Target: SCN9A; (-) strand; PAM type: YTN; PAM sequence: CTC
atttattccaaagaaaaaaa

SEQ ID NO: 63733 - DNA, 20 bp, Artificial Sequence
  Description of Artificial Sequence: Synthetic oligonucleotide
  Target: SCN9A; (-) strand; PAM type: YTN; PAM sequence: TTG
tgatgaactcatttattcca

SEQ ID NO: 63734 - DNA, 20 bp, Artificial Sequence
  Description of Artificial Sequence: Synthetic oligonucleotide
  Target: SCN9A; (-) strand; PAM type: YTN; PAM sequence: TTT
gtgatgaactcatttattcc

SEQ ID NO: 63735 - DNA, 20 bp, Artificial Sequence
  Description of Artificial Sequence: Synthetic oligonucleotide
  Target: SCN9A; (-) strand; PAM type: YTN; PAM sequence: CTT
tgtgatgaactcatttattc

SEQ ID NO: 63736 - DNA, 20 bp, Artificial Sequence
  Description of Artificial Sequence: Synthetic oligonucleotide
  Target: SCN9A; (-) strand; PAM type: YTN; PAM sequence: CTA
tgtagaagtacgtagtagat

SEQ ID NO: 63737 - DNA, 20 bp, Artificial Sequence
  Description of Artificial Sequence: Synthetic oligonucleotide
  Target: SCN9A; (-) strand; PAM type: YTN; PAM sequence: TTA
acacatgctatgtagaagta

SEQ ID NO: 63738 - DNA, 20 bp, Artificial Sequence
  Description of Artificial Sequence: Synthetic oligonucleotide
  Target: SCN9A; (-) strand; PAM type: YTN; PAM sequence: TTA
gttaacacatgctatgtaga

SEQ ID NO: 63739 - DNA, 20 bp, Artificial Sequence
  Description of Artificial Sequence: Synthetic oligonucleotide
  Target: SCN9A; (-) strand; PAM type: YTN; PAM sequence: TTC
aattagttaacacatgctat

SEQ ID NO: 63740 - DNA, 20 bp, Artificial Sequence
  Description of Artificial Sequence: Synthetic oligonucleotide
  Target: SCN9A; (-) strand; PAM type: YTN; PAM sequence: CTT
caattagttaacacatgcta

SEQ ID NO: 63741 - DNA, 20 bp, Artificial Sequence
  Description of Artificial Sequence: Synthetic oligonucleotide
  Target: SCN9A; (-) strand; PAM type: YTN; PAM sequence: CTG
aaaaaacatgaccaacactt

SEQ ID NO: 63742 - DNA, 20 bp, Artificial Sequence
  Description of Artificial Sequence: Synthetic oligonucleotide
  Target: SCN9A; (-) strand; PAM type: YTN; PAM sequence: TTC
cctgaaaaaacatgaccaac

SEQ ID NO: 63743 - DNA, 20 bp, Artificial Sequence
  Description of Artificial Sequence: Synthetic oligonucleotide
  Target: SCN9A; (-) strand; PAM type: YTN; PAM sequence: CTT
ccctgaaaaaacatgaccaa

SEQ ID NO: 63744 - DNA, 20 bp, Artificial Sequence
  Description of Artificial Sequence: Synthetic oligonucleotide
  Target: SCN9A; (-) strand; PAM type: YTN; PAM sequence: CTC
ttccctgaaaaaacatgacc

SEQ ID NO: 63745 - DNA, 20 bp, Artificial Sequence
  Description of Artificial Sequence: Synthetic oligonucleotide
  Target: SCN9A; (-) strand; PAM type: YTN; PAM sequence: TTC
cactcttccctgaaaaaaca

SEQ ID NO: 63746 - DNA, 20 bp, Artificial Sequence
  Description of Artificial Sequence: Synthetic oligonucleotide
  Target: SCN9A; (-) strand; PAM type: YTN; PAM sequence: TTT
ccactcttccctgaaaaaac

SEQ ID NO: 63747 - DNA, 20 bp, Artificial Sequence
  Description of Artificial Sequence: Synthetic oligonucleotide
  Target: SCN9A; (-) strand; PAM type: YTN; PAM sequence: CTT
tccactcttccctgaaaaaa

SEQ ID NO: 63748 - DNA, 20 bp, Artificial Sequence
  Description of Artificial Sequence: Synthetic oligonucleotide
  Target: SCN9A; (-) strand; PAM type: YTN; PAM sequence: TTC
tttccactcttccctgaaaa

SEQ ID NO: 63749 - DNA, 20 bp, Artificial Sequence
  Description of Artificial Sequence: Synthetic oligonucleotide
  Target: SCN9A; (-) strand; PAM type: YTN; PAM sequence: TTT
ctttccactcttccctgaaa

SEQ ID NO: 63750 - DNA, 20 bp, Artificial Sequence
  Description of Artificial Sequence: Synthetic oligonucleotide
  Target: SCN9A; (-) strand; PAM type: YTN; PAM sequence: TTA
gaatttctttccactcttcc

SEQ ID NO: 63751 - DNA, 20 bp, Artificial Sequence
  Description of Artificial Sequence: Synthetic oligonucleotide
  Target: SCN9A; (-) strand; PAM type: YTN; PAM sequence: TTT
agaatttctttccactcttc

SEQ ID NO: 63752 - DNA, 20 bp, Artificial Sequence
  Description of Artificial Sequence: Synthetic oligonucleotide
  Target: SCN9A; (-) strand; PAM type: YTN; PAM sequence: CTG
aatgatttagaatttctttc

SEQ ID NO: 63753 - DNA, 20 bp, Artificial Sequence
  Description of Artificial Sequence: Synthetic oligonucleotide
  Target: SCN9A; (-) strand; PAM type: YTN; PAM sequence: TTC
tgaatgatttagaatttctt

SEQ ID NO: 63754 - DNA, 20 bp, Artificial Sequence
  Description of Artificial Sequence: Synthetic oligonucleotide
  Target: SCN9A; (-) strand; PAM type: YTN; PAM sequence: TTT
ctgaatgatttagaatttct

SEQ ID NO: 63755 - DNA, 20 bp, Artificial Sequence
  Description of Artificial Sequence: Synthetic oligonucleotide
  Target: SCN9A; (-) strand; PAM type: YTN; PAM sequence: TTT
tctgaatgatttagaatttc

SEQ ID NO: 63756 - DNA, 20 bp, Artificial Sequence
  Description of Artificial Sequence: Synthetic oligonucleotide
  Target: SCN9A; (-) strand; PAM type: YTN; PAM sequence: CTT
ttctgaatgatttagaattt

SEQ ID NO: 63757 - DNA, 20 bp, Artificial Sequence
  Description of Artificial Sequence: Synthetic oligonucleotide
  Target: SCN9A; (-) strand; PAM type: YTN; PAM sequence: CTG
accttttctgaatgatttag

SEQ ID NO: 63758 - DNA, 20 bp, Artificial Sequence
  Description of Artificial Sequence: Synthetic oligonucleotide
  Target: SCN9A; (-) strand; PAM type: YTN; PAM sequence: TTC
tgaccttttctgaatgattt

SEQ ID NO: 63759 - DNA, 20 bp, Artificial Sequence
  Description of Artificial Sequence: Synthetic oligonucleotide
  Target: SCN9A; (-) strand; PAM type: YTN; PAM sequence: TTT
ctgaccttttctgaatgatt

SEQ ID NO: 63760 - DNA, 20 bp, Artificial Sequence
  Description of Artificial Sequence: Synthetic oligonucleotide
  Target: SCN9A; (-) strand; PAM type: YTN; PAM sequence: TTT
tctgaccttttctgaatgat

SEQ ID NO: 63761 - DNA, 20 bp, Artificial Sequence
  Description of Artificial Sequence: Synthetic oligonucleotide
  Target: SCN9A; (-) strand; PAM type: YTN; PAM sequence: TTA
ttttctgaccttttctgaat

SEQ ID NO: 63762 - DNA, 20 bp, Artificial Sequence
  Description of Artificial Sequence: Synthetic oligonucleotide
  Target: SCN9A; (-) strand; PAM type: YTN; PAM sequence: TTT
attttctgaccttttctgaa

SEQ ID NO: 63763 - DNA, 20 bp, Artificial Sequence
  Description of Artificial Sequence: Synthetic oligonucleotide
  Target: SCN9A; (-) strand; PAM type: YTN; PAM sequence: TTT
tattttctgaccttttctga

SEQ ID NO: 63764 - DNA, 20 bp, Artificial Sequence
  Description of Artificial Sequence: Synthetic oligonucleotide
  Target: SCN9A; (-) strand; PAM type: YTN; PAM sequence: CTT
ttattttctgaccttttctg

SEQ ID NO: 63765 - DNA, 20 bp, Artificial Sequence
  Description of Artificial Sequence: Synthetic oligonucleotide
  Target: SCN9A; (-) strand; PAM type: YTN; PAM sequence: CTA
agtatagcttttattttctg

SEQ ID NO: 63766 - DNA, 20 bp, Artificial Sequence
  Description of Artificial Sequence: Synthetic oligonucleotide
  Target: SCN9A; (-) strand; PAM type: YTN; PAM sequence: TTG
caatctaagtatagctttta

SEQ ID NO: 63767 - DNA, 20 bp, Artificial Sequence
  Description of Artificial Sequence: Synthetic oligonucleotide
  Target: SCN9A; (-) strand; PAM type: YTN; PAM sequence: CTT
gcaatctaagtatagctttt

SEQ ID NO: 63768 - DNA, 20 bp, Artificial Sequence
  Description of Artificial Sequence: Synthetic oligonucleotide
  Target: SCN9A; (-) strand; PAM type: YTN; PAM sequence: TTC
atcttgcaatctaagtatag

SEQ ID NO: 63769 - DNA, 20 bp, Artificial Sequence
  Description of Artificial Sequence: Synthetic oligonucleotide
  Target: SCN9A; (-) strand; PAM type: YTN; PAM sequence: TTT
catcttgcaatctaagtata

SEQ ID NO: 63770 - DNA, 20 bp, Artificial Sequence
  Description of Artificial Sequence: Synthetic oligonucleotide
  Target: SCN9A; (-) strand; PAM type: YTN; PAM sequence: TTC
cagtatttcatcttgcaatc

SEQ ID NO: 63771 - DNA, 20 bp, Artificial Sequence
  Description of Artificial Sequence: Synthetic oligonucleotide
  Target: SCN9A; (-) strand; PAM type: YTN; PAM sequence: CTT
ccagtatttcatcttgcaat

SEQ ID NO: 63772 - DNA, 20 bp, Artificial Sequence
  Description of Artificial Sequence: Synthetic oligonucleotide
  Target: SCN9A; (-) strand; PAM type: YTN; PAM sequence: TTC
ttccagtatttcatcttgca

SEQ ID NO: 63773 - DNA, 20 bp, Artificial Sequence
  Description of Artificial Sequence: Synthetic oligonucleotide
  Target: SCN9A; (-) strand; PAM type: YTN; PAM sequence: CTA
tcattcttccagtatttcat

SEQ ID NO: 63774 - DNA, 20 bp, Artificial Sequence
  Description of Artificial Sequence: Synthetic oligonucleotide
  Target: SCN9A; (-) strand; PAM type: YTN; PAM sequence: CTC
atatcccctatcattcttcc

SEQ ID NO: 63775 - DNA, 20 bp, Artificial Sequence
  Description of Artificial Sequence: Synthetic oligonucleotide
  Target: SCN9A; (-) strand; PAM type: YTN; PAM sequence: TTA
gaagcatcaaaaactcatat

SEQ ID NO: 63776 - DNA, 20 bp, Artificial Sequence
  Description of Artificial Sequence: Synthetic oligonucleotide
  Target: SCN9A; (-) strand; PAM type: YTN; PAM sequence: TTT
agaagcatcaaaaactcata

SEQ ID NO: 63777 - DNA, 20 bp, Artificial Sequence
  Description of Artificial Sequence: Synthetic oligonucleotide
  Target: SCN9A; (-) strand; PAM type: YTN; PAM sequence: CTG
atttagaagcatcaaaaact

SEQ ID NO: 63778 - DNA, 20 bp, Artificial Sequence
  Description of Artificial Sequence: Synthetic oligonucleotide
  Target: SCN9A; (-) strand; PAM type: YTN; PAM sequence: TTA
ctgatttagaagcatcaaaa

SEQ ID NO: 63779 - DNA, 20 bp, Artificial Sequence
  Description of Artificial Sequence: Synthetic oligonucleotide
  Target: SCN9A; (-) strand; PAM type: YTN; PAM sequence: CTA
tcaccaccaaagtcaggaaa

SEQ ID NO: 63780 - DNA, 20 bp, Artificial Sequence
  Description of Artificial Sequence: Synthetic oligonucleotide
  Target: SCN9A; (-) strand; PAM type: YTN; PAM sequence: TTG
atactatcaccaccaaagtc

SEQ ID NO: 63781 - DNA, 20 bp, Artificial Sequence
  Description of Artificial Sequence: Synthetic oligonucleotide
  Target: SCN9A; (-) strand; PAM type: YTN; PAM sequence: CTG
caggaagtaaaataggatgg

SEQ ID NO: 63782 - DNA, 20 bp, Artificial Sequence
  Description of Artificial Sequence: Synthetic oligonucleotide
  Target: SCN9A; (-) strand; PAM type: YTN; PAM sequence: CTA
ctgcaggaagtaaaatagga

SEQ ID NO: 63783 - DNA, 20 bp, Artificial Sequence
  Description of Artificial Sequence: Synthetic oligonucleotide
  Target: SCN9A; (-) strand; PAM type: YTN; PAM sequence: TTC
tactgcaggaagtaaaatag

SEQ ID NO: 63784 - DNA, 20 bp, Artificial Sequence
  Description of Artificial Sequence: Synthetic oligonucleotide
  Target: SCN9A; (-) strand; PAM type: YTN; PAM sequence: TTT
ctactgcaggaagtaaaata

SEQ ID NO: 63785 - DNA, 20 bp, Artificial Sequence
  Description of Artificial Sequence: Synthetic oligonucleotide
  Target: SCN9A; (-) strand; PAM type: YTN; PAM sequence: TTA
caacatttctactgcaggaa

SEQ ID NO: 63786 - DNA, 20 bp, Artificial Sequence
  Description of Artificial Sequence: Synthetic oligonucleotide
  Target: SCN9A; (-) strand; PAM type: YTN; PAM sequence: CTT
acaacatttctactgcagga

SEQ ID NO: 63787 - DNA, 20 bp, Artificial Sequence
  Description of Artificial Sequence: Synthetic oligonucleotide
  Target: SCN9A; (-) strand; PAM type: YTN; PAM sequence: TTC
ttacaacatttctactgcag

SEQ ID NO: 63788 - DNA, 20 bp, Artificial Sequence
  Description of Artificial Sequence: Synthetic oligonucleotide
  Target: SCN9A; (-) strand; PAM type: YTN; PAM sequence: TTA
ttcttacaacatttctactg

SEQ ID NO: 63789 - DNA, 20 bp, Artificial Sequence
  Description of Artificial Sequence: Synthetic oligonucleotide
  Target: SCN9A; (-) strand; PAM type: YTN; PAM sequence: TTA
atgttattcttacaacattt

SEQ ID NO: 63790 - DNA, 20 bp, Artificial Sequence
  Description of Artificial Sequence: Synthetic oligonucleotide
  Target: SCN9A; (-) strand; PAM type: YTN; PAM sequence: TTG
ttaatgttattcttacaaca

SEQ ID NO: 63791 - DNA, 20 bp, Artificial Sequence
  Description of Artificial Sequence: Synthetic oligonucleotide
  Target: SCN9A; (-) strand; PAM type: YTN; PAM sequence: CTT
gttaatgttattcttacaac

SEQ ID NO: 63792 - DNA, 20 bp, Artificial Sequence
  Description of Artificial Sequence: Synthetic oligonucleotide
  Target: SCN9A; (-) strand; PAM type: YTN; PAM sequence: CTG
cttgttaatgttattcttac

SEQ ID NO: 63793 - DNA, 20 bp, Artificial Sequence
  Description of Artificial Sequence: Synthetic oligonucleotide
  Target: SCN9A; (-) strand; PAM type: YTN; PAM sequence: TTC
ctgcttgttaatgttattct

SEQ ID NO: 63794 - DNA, 20 bp, Artificial Sequence
  Description of Artificial Sequence: Synthetic oligonucleotide
  Target: SCN9A; (-) strand; PAM type: YTN; PAM sequence: CTT
cctgcttgttaatgttattc

SEQ ID NO: 63795 - DNA, 20 bp, Artificial Sequence
  Description of Artificial Sequence: Synthetic oligonucleotide
  Target: SCN9A; (-) strand; PAM type: YTN; PAM sequence: TTA
atcttcctgcttgttaatgt

SEQ ID NO: 63796 - DNA, 20 bp, Artificial Sequence
  Description of Artificial Sequence: Synthetic oligonucleotide
  Target: SCN9A; (-) strand; PAM type: YTN; PAM sequence: TTT
aatcttcctgcttgttaatg

SEQ ID NO: 63797 - DNA, 20 bp, Artificial Sequence
  Description of Artificial Sequence: Synthetic oligonucleotide
  Target: SCN9A; (-) strand; PAM type: YTN; PAM sequence: CTT
taatcttcctgcttgttaat

SEQ ID NO: 63798 - DNA, 20 bp, Artificial Sequence
  Description of Artificial Sequence: Synthetic oligonucleotide
  Target: SCN9A; (-) strand; PAM type: YTN; PAM sequence: TTG
actttaatcttcctgcttgt

SEQ ID NO: 63799 - DNA, 20 bp, Artificial Sequence
  Description of Artificial Sequence: Synthetic oligonucleotide
  Target: SCN9A; (-) strand; PAM type: YTN; PAM sequence: CTA
gaaagagcagtatgagcata

SEQ ID NO: 63800 - DNA, 20 bp, Artificial Sequence
  Description of Artificial Sequence: Synthetic oligonucleotide
  Target: SCN9A; (-) strand; PAM type: YTN; PAM sequence: TTA
agcgtgtctagaaagagcag

SEQ ID NO: 63801 - DNA, 20 bp, Artificial Sequence
  Description of Artificial Sequence: Synthetic oligonucleotide
  Target: SCN9A; (-) strand; PAM type: YTN; PAM sequence: CTG
cataggataaattaagcgtg

SEQ ID NO: 63802 - DNA, 20 bp, Artificial Sequence
  Description of Artificial Sequence: Synthetic oligonucleotide
  Target: SCN9A; (-) strand; PAM type: YTN; PAM sequence: TTC
cctgcataggataaattaag

SEQ ID NO: 63803 - DNA, 20 bp, Artificial Sequence
  Description of Artificial Sequence: Synthetic oligonucleotide
  Target: SCN9A; (-) strand; PAM type: YTN; PAM sequence: CTT
ccctgcataggataaattaa

SEQ ID NO: 63804 - DNA, 20 bp, Artificial Sequence
  Description of Artificial Sequence: Synthetic oligonucleotide
  Target: SCN9A; (-) strand; PAM type: YTN; PAM sequence: CTC
agtcttccctgcataggata

SEQ ID NO: 63805 - DNA, 20 bp, Artificial Sequence
  Description of Artificial Sequence: Synthetic oligonucleotide
  Target: SCN9A; (-) strand; PAM type: YTN; PAM sequence: TTC
ctcagtcttccctgcatagg

SEQ ID NO: 63806 - DNA, 20 bp, Artificial Sequence
  Description of Artificial Sequence: Synthetic oligonucleotide
  Target: SCN9A; (-) strand; PAM type: YTN; PAM sequence: TTA
tatatacatacatgtaatat

SEQ ID NO: 63807 - DNA, 20 bp, Artificial Sequence
  Description of Artificial Sequence: Synthetic oligonucleotide
  Target: SCN9A; (-) strand; PAM type: YTN; PAM sequence: TTA
agcattatatatacatacat

SEQ ID NO: 63808 - DNA, 20 bp, Artificial Sequence
  Description of Artificial Sequence: Synthetic oligonucleotide
  Target: SCN9A; (-) strand; PAM type: YTN; PAM sequence: CTT
aagcattatatatacataca

SEQ ID NO: 63809 - DNA, 20 bp, Artificial Sequence
  Description of Artificial Sequence: Synthetic oligonucleotide
  Target: SCN9A; (-) strand; PAM type: YTN; PAM sequence: CTC
aacttaagcattatatatac

SEQ ID NO: 63810 - DNA, 20 bp, Artificial Sequence
  Description of Artificial Sequence: Synthetic oligonucleotide
  Target: SCN9A; (-) strand; PAM type: YTN; PAM sequence: TTC
tcaacttaagcattatatat

SEQ ID NO: 63811 - DNA, 20 bp, Artificial Sequence
  Description of Artificial Sequence: Synthetic oligonucleotide
  Target: SCN9A; (-) strand; PAM type: YTN; PAM sequence: TTT
ctcaacttaagcattatata

SEQ ID NO: 63812 - DNA, 20 bp, Artificial Sequence
  Description of Artificial Sequence: Synthetic oligonucleotide
  Target: SCN9A; (-) strand; PAM type: YTN; PAM sequence: TTT
tctcaacttaagcattatat

SEQ ID NO: 63813 - DNA, 20 bp, Artificial Sequence
  Description of Artificial Sequence: Synthetic oligonucleotide
  Target: SCN9A; (-) strand; PAM type: YTN; PAM sequence: TTT
ttctcaacttaagcattata

SEQ ID NO: 63814 - DNA, 20 bp, Artificial Sequence
  Description of Artificial Sequence: Synthetic oligonucleotide
  Target: SCN9A; (-) strand; PAM type: YTN; PAM sequence: TTA
tttttctcaacttaagcatt

SEQ ID NO: 63815 - DNA, 20 bp, Artificial Sequence
  Description of Artificial Sequence: Synthetic oligonucleotide
  Target: SCN9A; (-) strand; PAM type: YTN; PAM sequence: TTT
atttttctcaacttaagcat

SEQ ID NO: 63816 - DNA, 20 bp, Artificial Sequence
  Description of Artificial Sequence: Synthetic oligonucleotide
  Target: SCN9A; (-) strand; PAM type: YTN; PAM sequence: TTC
aatttatttttctcaactta

SEQ ID NO: 63817 - DNA, 20 bp, Artificial Sequence
  Description of Artificial Sequence: Synthetic oligonucleotide
  Target: SCN9A; (-) strand; PAM type: YTN; PAM sequence: TTT
caatttatttttctcaactt

SEQ ID NO: 63818 - DNA, 20 bp, Artificial Sequence
  Description of Artificial Sequence: Synthetic oligonucleotide
  Target: SCN9A; (-) strand; PAM type: YTN; PAM sequence: TTT
tcaatttatttttctcaact

SEQ ID NO: 63819 - DNA, 20 bp, Artificial Sequence
  Description of Artificial Sequence: Synthetic oligonucleotide
  Target: SCN9A; (-) strand; PAM type: YTN; PAM sequence: CTG
attttcaatttatttttctc

SEQ ID NO: 63820 - DNA, 20 bp, Artificial Sequence
  Description of Artificial Sequence: Synthetic oligonucleotide
  Target: SCN9A; (-) strand; PAM type: YTN; PAM sequence: TTA
taaagtgtacactgattttc

SEQ ID NO: 63821 - DNA, 20 bp, Artificial Sequence
  Description of Artificial Sequence: Synthetic oligonucleotide
  Target: SCN9A; (-) strand; PAM type: YTN; PAM sequence: TTT
ataaagtgtacactgatttt

SEQ ID NO: 63822 - DNA, 20 bp, Artificial Sequence
  Description of Artificial Sequence: Synthetic oligonucleotide
  Target: SCN9A; (-) strand; PAM type: YTN; PAM sequence: TTA
catttataaagtgtacactg

SEQ ID NO: 63823 - DNA, 20 bp, Artificial Sequence
  Description of Artificial Sequence: Synthetic oligonucleotide
  Target: SCN9A; (-) strand; PAM type: YTN; PAM sequence: TTT
acatttataaagtgtacact

SEQ ID NO: 63824 - DNA, 20 bp, Artificial Sequence
  Description of Artificial Sequence: Synthetic oligonucleotide
  Target: SCN9A; (-) strand; PAM type: YTN; PAM sequence: TTT
tacatttataaagtgtacac

SEQ ID NO: 63825 - DNA, 20 bp, Artificial Sequence
  Description of Artificial Sequence: Synthetic oligonucleotide
  Target: SCN9A; (-) strand; PAM type: YTN; PAM sequence: TTC
cattttacatttataaagtg

SEQ ID NO: 63826 - DNA, 20 bp, Artificial Sequence
  Description of Artificial Sequence: Synthetic oligonucleotide
  Target: SCN9A; (-) strand; PAM type: YTN; PAM sequence: TTC
atgttccattttacatttat

SEQ ID NO: 63827 - DNA, 20 bp, Artificial Sequence
  Description of Artificial Sequence: Synthetic oligonucleotide
  Target: SCN9A; (-) strand; PAM type: YTN; PAM sequence: TTT
catgttccattttacattta

SEQ ID NO: 63828 - DNA, 20 bp, Artificial Sequence
  Description of Artificial Sequence: Synthetic oligonucleotide
  Target: SCN9A; (-) strand; PAM type: YTN; PAM sequence: TTA
aatttcatgttccattttac

SEQ ID NO: 63829 - DNA, 20 bp, Artificial Sequence
  Description of Artificial Sequence: Synthetic oligonucleotide
  Target: SCN9A; (-) strand; PAM type: YTN; PAM sequence: TTT
aaatttcatgttccatttta

SEQ ID NO: 63830 - DNA, 20 bp, Artificial Sequence
  Description of Artificial Sequence: Synthetic oligonucleotide
  Target: SCN9A; (-) strand; PAM type: YTN; PAM sequence: TTT
taaatttcatgttccatttt

SEQ ID NO: 63831 - DNA, 20 bp, Artificial Sequence
  Description of Artificial Sequence: Synthetic oligonucleotide
  Target: SCN9A; (-) strand; PAM type: YTN; PAM sequence: TTT
ttaaatttcatgttccattt

SEQ ID NO: 63832 - DNA, 20 bp, Artificial Sequence
  Description of Artificial Sequence: Synthetic oligonucleotide
  Target: SCN9A; (-) strand; PAM type: YTN; PAM sequence: TTA
aagatttttaaatttcatgt

SEQ ID NO: 63833 - DNA, 20 bp, Artificial Sequence
  Description of Artificial Sequence: Synthetic oligonucleotide
  Target: SCN9A; (-) strand; PAM type: YTN; PAM sequence: TTT
aaagatttttaaatttcatg

SEQ ID NO: 63834 - DNA, 20 bp, Artificial Sequence
  Description of Artificial Sequence: Synthetic oligonucleotide
  Target: SCN9A; (-) strand; PAM type: YTN; PAM sequence: TTT
taaagatttttaaatttcat

SEQ ID NO: 63835 - DNA, 20 bp, Artificial Sequence
  Description of Artificial Sequence: Synthetic oligonucleotide
  Target: SCN9A; (-) strand; PAM type: YTN; PAM sequence: TTT
ttaaagatttttaaatttca

SEQ ID NO: 63836 - DNA, 20 bp, Artificial Sequence
  Description of Artificial Sequence: Synthetic oligonucleotide
  Target: SCN9A; (-) strand; PAM type: YTN; PAM sequence: TTA
tttttaaagatttttaaatt

SEQ ID NO: 63837 - DNA, 20 bp, Artificial Sequence
  Description of Artificial Sequence: Synthetic oligonucleotide
  Target: SCN9A; (-) strand; PAM type: YTN; PAM sequence: TTT
atttttaaagatttttaaat

SEQ ID NO: 63838 - DNA, 20 bp, Artificial Sequence
  Description of Artificial Sequence: Synthetic oligonucleotide
  Target: SCN9A; (-) strand; PAM type: YTN; PAM sequence: TTA
caaatacagatgtttatttt

SEQ ID NO: 63839 - DNA, 20 bp, Artificial Sequence
  Description of Artificial Sequence: Synthetic oligonucleotide
  Target: SCN9A; (-) strand; PAM type: YTN; PAM sequence: TTT
acaaatacagatgtttattt

SEQ ID NO: 63840 - DNA, 20 bp, Artificial Sequence
  Description of Artificial Sequence: Synthetic oligonucleotide
  Target: SCN9A; (-) strand; PAM type: YTN; PAM sequence: CTG
acatttacaaatacagatgt

SEQ ID NO: 63841 - DNA, 20 bp, Artificial Sequence
  Description of Artificial Sequence: Synthetic oligonucleotide
  Target: SCN9A; (-) strand; PAM type: YTN; PAM sequence: TTA
tcctgacatttacaaataca

SEQ ID NO: 63842 - DNA, 20 bp, Artificial Sequence
  Description of Artificial Sequence: Synthetic oligonucleotide
  Target: SCN9A; (-) strand; PAM type: YTN; PAM sequence: TTT
atcctgacatttacaaatac

SEQ ID NO: 63843 - DNA, 20 bp, Artificial Sequence
  Description of Artificial Sequence: Synthetic oligonucleotide
  Target: SCN9A; (-) strand; PAM type: YTN; PAM sequence: TTA
tttatcctgacatttacaaa

SEQ ID NO: 63844 - DNA, 20 bp, Artificial Sequence
  Description of Artificial Sequence: Synthetic oligonucleotide
  Target: SCN9A; (-) strand; PAM type: YTN; PAM sequence: TTG
cattatttatcctgacattt

SEQ ID NO: 63845 - DNA, 20 bp, Artificial Sequence
  Description of Artificial Sequence: Synthetic oligonucleotide
  Target: SCN9A; (-) strand; PAM type: YTN; PAM sequence: TTA
gtaaatattgcattatttat

SEQ ID NO: 63846 - DNA, 20 bp, Artificial Sequence
  Description of Artificial Sequence: Synthetic oligonucleotide
  Target: SCN9A; (-) strand; PAM type: YTN; PAM sequence: TTT
agtaaatattgcattattta

SEQ ID NO: 63847 - DNA, 20 bp, Artificial Sequence
  Description of Artificial Sequence: Synthetic oligonucleotide
  Target: SCN9A; (-) strand; PAM type: YTN; PAM sequence: TTG
caagtagacaaaaatttagt

SEQ ID NO: 63848 - DNA, 20 bp, Artificial Sequence
  Description of Artificial Sequence: Synthetic oligonucleotide
  Target: SCN9A; (-) strand; PAM type: YTN; PAM sequence: TTT
gcaagtagacaaaaatttag

SEQ ID NO: 63849 - DNA, 20 bp, Artificial Sequence
  Description of Artificial Sequence: Synthetic oligonucleotide
  Target: SCN9A; (-) strand; PAM type: YTN; PAM sequence: CTA
tttgcaagtagacaaaaatt

SEQ ID NO: 63850 - DNA, 20 bp, Artificial Sequence
  Description of Artificial Sequence: Synthetic oligonucleotide
  Target: SCN9A; (-) strand; PAM type: YTN; PAM sequence: TTG
actatttgcaagtagacaaa

SEQ ID NO: 63851 - DNA, 20 bp, Artificial Sequence
  Description of Artificial Sequence: Synthetic oligonucleotide
  Target: SCN9A; (-) strand; PAM type: YTN; PAM sequence: TTA
gtgtgcatgattgactattt

SEQ ID NO: 63852 - DNA, 20 bp, Artificial Sequence
  Description of Artificial Sequence: Synthetic oligonucleotide
  Target: SCN9A; (-) strand; PAM type: YTN; PAM sequence: CTA
agaagacagatgtacatgta

SEQ ID NO: 63853 - DNA, 20 bp, Artificial Sequence
  Description of Artificial Sequence: Synthetic oligonucleotide
  Target: SCN9A; (-) strand; PAM type: YTN; PAM sequence: TTA
gcatctaagaagacagatgt

SEQ ID NO: 63854 - DNA, 20 bp, Artificial Sequence
  Description of Artificial Sequence: Synthetic oligonucleotide
  Target: SCN9A; (-) strand; PAM type: YTN; PAM sequence: CTT
agcatctaagaagacagatg

SEQ ID NO: 63855 - DNA, 20 bp, Artificial Sequence
  Description of Artificial Sequence: Synthetic oligonucleotide
  Target: SCN9A; (-) strand; PAM type: YTN; PAM sequence: CTG
gcttagcatctaagaagaca

SEQ ID NO: 63856 - DNA, 20 bp, Artificial Sequence
  Description of Artificial Sequence: Synthetic oligonucleotide
  Target: SCN9A; (-) strand; PAM type: YTN; PAM sequence: TTG
ggtactggcttagcatctaa

SEQ ID NO: 63857 - DNA, 20 bp, Artificial Sequence
  Description of Artificial Sequence: Synthetic oligonucleotide
  Target: SCN9A; (-) strand; PAM type: YTN; PAM sequence: TTT
gggtactggcttagcatcta

SEQ ID NO: 63858 - DNA, 20 bp, Artificial Sequence
  Description of Artificial Sequence: Synthetic oligonucleotide
  Target: SCN9A; (-) strand; PAM type: YTN; PAM sequence: TTT
tgggtactggcttagcatct

SEQ ID NO: 63859 - DNA, 20 bp, Artificial Sequence
  Description of Artificial Sequence: Synthetic oligonucleotide
  Target: SCN9A; (-) strand; PAM type: YTN; PAM sequence: TTA
caaaagagaataataatttt

SEQ ID NO: 63860 - DNA, 20 bp, Artificial Sequence
  Description of Artificial Sequence: Synthetic oligonucleotide
  Target: SCN9A; (-) strand; PAM type: YTN; PAM sequence: CTA
aatggtagaattacaaaaga

SEQ ID NO: 63861 - DNA, 20 bp, Artificial Sequence
  Description of Artificial Sequence: Synthetic oligonucleotide
  Target: SCN9A; (-) strand; PAM type: YTN; PAM sequence: TTG
gagactaaatggtagaatta

SEQ ID NO: 63862 - DNA, 20 bp, Artificial Sequence
  Description of Artificial Sequence: Synthetic oligonucleotide
  Target: SCN9A; (-) strand; PAM type: YTN; PAM sequence: TTT
ggagactaaatggtagaatt

SEQ ID NO: 63863 - DNA, 20 bp, Artificial Sequence
  Description of Artificial Sequence: Synthetic oligonucleotide
  Target: SCN9A; (-) strand; PAM type: YTN; PAM sequence: CTT
tggagactaaatggtagaat

SEQ ID NO: 63864 - DNA, 20 bp, Artificial Sequence
  Description of Artificial Sequence: Synthetic oligonucleotide
  Target: SCN9A; (-) strand; PAM type: YTN; PAM sequence: CTA
tacaaaaagagatctttgga

SEQ ID NO: 63865 - DNA, 20 bp, Artificial Sequence
  Description of Artificial Sequence: Synthetic oligonucleotide
  Target: SCN9A; (-) strand; PAM type: YTN; PAM sequence: TTG
tggtaccacctatacaaaaa

SEQ ID NO: 63866 - DNA, 20 bp, Artificial Sequence
  Description of Artificial Sequence: Synthetic oligonucleotide
  Target: SCN9A; (-) strand; PAM type: YTN; PAM sequence: CTG
gttgtggtaccacctataca

SEQ ID NO: 63867 - DNA, 20 bp, Artificial Sequence
  Description of Artificial Sequence: Synthetic oligonucleotide
  Target: SCN9A; (-) strand; PAM type: YTN; PAM sequence: CTC
tggttgtggtaccacctata

SEQ ID NO: 63868 - DNA, 20 bp, Artificial Sequence
  Description of Artificial Sequence: Synthetic oligonucleotide
  Target: SCN9A; (-) strand; PAM type: YTN; PAM sequence: CTG
agatactctggttgtggtac

SEQ ID NO: 63869 - DNA, 20 bp, Artificial Sequence
  Description of Artificial Sequence: Synthetic oligonucleotide
  Target: SCN9A; (-) strand; PAM type: YTN; PAM sequence: CTA
actgagatactctggttgtg

SEQ ID NO: 63870 - DNA, 20 bp, Artificial Sequence
  Description of Artificial Sequence: Synthetic oligonucleotide
  Target: SCN9A; (-) strand; PAM type: YTN; PAM sequence: TTG
tcaactaactgagatactct

SEQ ID NO: 63871 - DNA, 20 bp, Artificial Sequence
  Description of Artificial Sequence: Synthetic oligonucleotide
  Target: SCN9A; (-) strand; PAM type: YTN; PAM sequence: CTT
gtcaactaactgagatactc

SEQ ID NO: 63872 - DNA, 20 bp, Artificial Sequence
  Description of Artificial Sequence: Synthetic oligonucleotide
  Target: SCN9A; (-) strand; PAM type: YTN; PAM sequence: TTC
ttgtcaactaactgagatac

SEQ ID NO: 63873 - DNA, 20 bp, Artificial Sequence
  Description of Artificial Sequence: Synthetic oligonucleotide
  Target: SCN9A; (-) strand; PAM type: YTN; PAM sequence: TTT
cttgtcaactaactgagata

SEQ ID NO: 63874 - DNA, 20 bp, Artificial Sequence
  Description of Artificial Sequence: Synthetic oligonucleotide
  Target: SCN9A; (-) strand; PAM type: YTN; PAM sequence: CTG
gagtttcttgtcaactaact

SEQ ID NO: 63875 - DNA, 20 bp, Artificial Sequence
  Description of Artificial Sequence: Synthetic oligonucleotide
  Target: SCN9A; (-) strand; PAM type: YTN; PAM sequence: TTC
tggagtttcttgtcaactaa

SEQ ID NO: 63876 - DNA, 20 bp, Artificial Sequence
  Description of Artificial Sequence: Synthetic oligonucleotide
  Target: SCN9A; (-) strand; PAM type: YTN; PAM sequence: CTA
attctggagtttcttgtcaa

SEQ ID NO: 63877 - DNA, 20 bp, Artificial Sequence
  Description of Artificial Sequence: Synthetic oligonucleotide
  Target: SCN9A; (-) strand; PAM type: YTN; PAM sequence: TTG
caagagataaaggagtctaa

SEQ ID NO: 63878 - DNA, 20 bp, Artificial Sequence
  Description of Artificial Sequence: Synthetic oligonucleotide
  Target: SCN9A; (-) strand; PAM type: YTN; PAM sequence: TTT
gcaagagataaaggagtcta

SEQ ID NO: 63879 - DNA, 20 bp, Artificial Sequence
  Description of Artificial Sequence: Synthetic oligonucleotide
  Target: SCN9A; (-) strand; PAM type: YTN; PAM sequence: TTG
tgatttgcaagagataaagg

SEQ ID NO: 63880 - DNA, 20 bp, Artificial Sequence
  Description of Artificial Sequence: Synthetic oligonucleotide
  Target: SCN9A; (-) strand; PAM type: YTN; PAM sequence: CTT
gtgatttgcaagagataaag

SEQ ID NO: 63881 - DNA, 20 bp, Artificial Sequence
  Description of Artificial Sequence: Synthetic oligonucleotide
  Target: SCN9A; (-) strand; PAM type: YTN; PAM sequence: TTG
cttgtgatttgcaagagata

SEQ ID NO: 63882 - DNA, 20 bp, Artificial Sequence
  Description of Artificial Sequence: Synthetic oligonucleotide
  Target: SCN9A; (-) strand; PAM type: YTN; PAM sequence: CTA
cagtattgcttgtgatttgc

SEQ ID NO: 63883 - DNA, 20 bp, Artificial Sequence
  Description of Artificial Sequence: Synthetic oligonucleotide
  Target: SCN9A; (-) strand; PAM type: YTN; PAM sequence: TTA
gagggtagaatctacagtat

SEQ ID NO: 63884 - DNA, 20 bp, Artificial Sequence
  Description of Artificial Sequence: Synthetic oligonucleotide
  Target: SCN9A; (-) strand; PAM type: YTN; PAM sequence: TTT
agagggtagaatctacagta

SEQ ID NO: 63885 - DNA, 20 bp, Artificial Sequence
  Description of Artificial Sequence: Synthetic oligonucleotide
  Target: SCN9A; (-) strand; PAM type: YTN; PAM sequence: TTT
tagagggtagaatctacagt

SEQ ID NO: 63886 - DNA, 20 bp, Artificial Sequence
  Description of Artificial Sequence: Synthetic oligonucleotide
  Target: SCN9A; (-) strand; PAM type: YTN; PAM sequence: TTA
aaacattttagagggtagaa

SEQ ID NO: 63887 - DNA, 20 bp, Artificial Sequence
  Description of Artificial Sequence: Synthetic oligonucleotide
  Target: SCN9A; (-) strand; PAM type: YTN; PAM sequence: TTC
cattaaaacattttagaggg

SEQ ID NO: 63888 - DNA, 20 bp, Artificial Sequence
  Description of Artificial Sequence: Synthetic oligonucleotide
  Target: SCN9A; (-) strand; PAM type: YTN; PAM sequence: CTG
tgtgtcaatggagaatagga

SEQ ID NO: 63889 - DNA, 20 bp, Artificial Sequence
  Description of Artificial Sequence: Synthetic oligonucleotide
  Target: SCN9A; (-) strand; PAM type: YTN; PAM sequence: TTA
gtcctgtgtgtcaatggaga

SEQ ID NO: 63890 - DNA, 20 bp, Artificial Sequence
  Description of Artificial Sequence: Synthetic oligonucleotide
  Target: SCN9A; (-) strand; PAM type: YTN; PAM sequence: CTC
caaattagtcctgtgtgtca

SEQ ID NO: 63891 - DNA, 20 bp, Artificial Sequence
  Description of Artificial Sequence: Synthetic oligonucleotide
  Target: SCN9A; (-) strand; PAM type: YTN; PAM sequence: CTA
agtctccaaattagtcctgt

SEQ ID NO: 63892 - DNA, 20 bp, Artificial Sequence
  Description of Artificial Sequence: Synthetic oligonucleotide
  Target: SCN9A; (-) strand; PAM type: YTN; PAM sequence: CTG
gaccacactaagtctccaaa

SEQ ID NO: 63893 - DNA, 20 bp, Artificial Sequence
  Description of Artificial Sequence: Synthetic oligonucleotide
  Target: SCN9A; (-) strand; PAM type: YTN; PAM sequence: CTG
ccacctggaccacactaagt

SEQ ID NO: 63894 - DNA, 20 bp, Artificial Sequence
  Description of Artificial Sequence: Synthetic oligonucleotide
  Target: SCN9A; (-) strand; PAM type: YTN; PAM sequence: TTG
acctgccacctggaccacac

SEQ ID NO: 63895 - DNA, 20 bp, Artificial Sequence
  Description of Artificial Sequence: Synthetic oligonucleotide
  Target: SCN9A; (-) strand; PAM type: YTN; PAM sequence: CTT
gacctgccacctggaccaca

SEQ ID NO: 63896 - DNA, 20 bp, Artificial Sequence
  Description of Artificial Sequence: Synthetic oligonucleotide
  Target: SCN9A; (-) strand; PAM type: YTN; PAM sequence: CTG
cttgacctgccacctggacc

SEQ ID NO: 63897 - DNA, 20 bp, Artificial Sequence
  Description of Artificial Sequence: Synthetic oligonucleotide
  Target: SCN9A; (-) strand; PAM type: YTN; PAM sequence: TTC
agaccctgcttgacctgcca

SEQ ID NO: 63898 - DNA, 20 bp, Artificial Sequence
  Description of Artificial Sequence: Synthetic oligonucleotide
  Target: SCN9A; (-) strand; PAM type: YTN; PAM sequence: TTT
cagaccctgcttgacctgcc

SEQ ID NO: 63899 - DNA, 20 bp, Artificial Sequence
  Description of Artificial Sequence: Synthetic oligonucleotide
  Target: SCN9A; (-) strand; PAM type: YTN; PAM sequence: CTA
tttcagaccctgcttgacct

SEQ ID NO: 63900 - DNA, 20 bp, Artificial Sequence
  Description of Artificial Sequence: Synthetic oligonucleotide
  Target: SCN9A; (-) strand; PAM type: YTN; PAM sequence: CTA
gggaaggaccaaagactatt

SEQ ID NO: 63901 - DNA, 20 bp, Artificial Sequence
  Description of Artificial Sequence: Synthetic oligonucleotide
  Target: SCN9A; (-) strand; PAM type: YTN; PAM sequence: CTA
gcagtgatgcacaaaatgac

SEQ ID NO: 63902 - DNA, 20 bp, Artificial Sequence
  Description of Artificial Sequence: Synthetic oligonucleotide
  Target: SCN9A; (-) strand; PAM type: YTN; PAM sequence: TTA
atctagcagtgatgcacaaa

SEQ ID NO: 63903 - DNA, 20 bp, Artificial Sequence
  Description of Artificial Sequence: Synthetic oligonucleotide
  Target: SCN9A; (-) strand; PAM type: YTN; PAM sequence: TTA
caaaaaattaatctagcagt

SEQ ID NO: 63904 - DNA, 20 bp, Artificial Sequence
  Description of Artificial Sequence: Synthetic oligonucleotide
  Target: SCN9A; (-) strand; PAM type: YTN; PAM sequence: TTT
acaaaaaattaatctagcag

SEQ ID NO: 63905 - DNA, 20 bp, Artificial Sequence
  Description of Artificial Sequence: Synthetic oligonucleotide
  Target: SCN9A; (-) strand; PAM type: YTN; PAM sequence: CTT
tacaaaaaattaatctagca

SEQ ID NO: 63906 - DNA, 20 bp, Artificial Sequence
  Description of Artificial Sequence: Synthetic oligonucleotide
  Target: SCN9A; (-) strand; PAM type: YTN; PAM sequence: CTG
agctttacaaaaaattaatc

SEQ ID NO: 63907 - DNA, 20 bp, Artificial Sequence
  Description of Artificial Sequence: Synthetic oligonucleotide
  Target: SCN9A; (-) strand; PAM type: YTN; PAM sequence: CTA
gagactgagctttacaaaaa

SEQ ID NO: 63908 - DNA, 20 bp, Artificial Sequence
  Description of Artificial Sequence: Synthetic oligonucleotide
  Target: SCN9A; (-) strand; PAM type: YTN; PAM sequence: TTC
tagagactgagctttacaaa

SEQ ID NO: 63909 - DNA, 20 bp, Artificial Sequence
  Description of Artificial Sequence: Synthetic oligonucleotide
  Target: SCN9A; (-) strand; PAM type: YTN; PAM sequence: TTT
ctagagactgagctttacaa

SEQ ID NO: 63910 - DNA, 20 bp, Artificial Sequence
  Description of Artificial Sequence: Synthetic oligonucleotide
  Target: SCN9A; (-) strand; PAM type: YTN; PAM sequence: TTT
tctagagactgagctttaca

SEQ ID NO: 63911 - DNA, 20 bp, Artificial Sequence
  Description of Artificial Sequence: Synthetic oligonucleotide
  Target: SCN9A; (-) strand; PAM type: YTN; PAM sequence: TTT
ttctagagactgagctttac

SEQ ID NO: 63912 - DNA, 20 bp, Artificial Sequence
  Description of Artificial Sequence: Synthetic oligonucleotide
  Target: SCN9A; (-) strand; PAM type: YTN; PAM sequence: CTT
tttctagagactgagcttta

SEQ ID NO: 63913 - DNA, 20 bp, Artificial Sequence
  Description of Artificial Sequence: Synthetic oligonucleotide
  Target: SCN9A; (-) strand; PAM type: YTN; PAM sequence: TTG
ctttttctagagactgagct

SEQ ID NO: 63914 - DNA, 20 bp, Artificial Sequence
  Description of Artificial Sequence: Synthetic oligonucleotide
  Target: SCN9A; (-) strand; PAM type: YTN; PAM sequence: CTC
cagaattgctttttctagag

SEQ ID NO: 63915 - DNA, 20 bp, Artificial Sequence
  Description of Artificial Sequence: Synthetic oligonucleotide
  Target: SCN9A; (-) strand; PAM type: YTN; PAM sequence: CTA
gctccagaattgctttttct

SEQ ID NO: 63916 - DNA, 20 bp, Artificial Sequence
  Description of Artificial Sequence: Synthetic oligonucleotide
  Target: SCN9A; (-) strand; PAM type: YTN; PAM sequence: TTA
tggatctagctccagaattg

SEQ ID NO: 63917 - DNA, 20 bp, Artificial Sequence
  Description of Artificial Sequence: Synthetic oligonucleotide
  Target: SCN9A; (-) strand; PAM type: YTN; PAM sequence: TTC
attatggatctagctccaga

SEQ ID NO: 63918 - DNA, 20 bp, Artificial Sequence
  Description of Artificial Sequence: Synthetic oligonucleotide
  Target: SCN9A; (-) strand; PAM type: YTN; PAM sequence: TTT
cattatggatctagctccag

SEQ ID NO: 63919 - DNA, 20 bp, Artificial Sequence
  Description of Artificial Sequence: Synthetic oligonucleotide
  Target: SCN9A; (-) strand; PAM type: YTN; PAM sequence: CTA
aaaagtagtttcattatgga

SEQ ID NO: 63920 - DNA, 20 bp, Artificial Sequence
  Description of Artificial Sequence: Synthetic oligonucleotide
  Target: SCN9A; (-) strand; PAM type: YTN; PAM sequence: CTG
acagctaaaaagtagtttca

SEQ ID NO: 63921 - DNA, 20 bp, Artificial Sequence
  Description of Artificial Sequence: Synthetic oligonucleotide
  Target: SCN9A; (-) strand; PAM type: YTN; PAM sequence: TTG
cacatggcctgacagctaaa

SEQ ID NO: 63922 - DNA, 20 bp, Artificial Sequence
  Description of Artificial Sequence: Synthetic oligonucleotide
  Target: SCN9A; (-) strand; PAM type: YTN; PAM sequence: TTT
gcacatggcctgacagctaa

SEQ ID NO: 63923 - DNA, 20 bp, Artificial Sequence
  Description of Artificial Sequence: Synthetic oligonucleotide
  Target: SCN9A; (-) strand; PAM type: YTN; PAM sequence: TTA
tttgcacatggcctgacagc

SEQ ID NO: 63924 - DNA, 20 bp, Artificial Sequence
  Description of Artificial Sequence: Synthetic oligonucleotide
  Target: SCN9A; (-) strand; PAM type: YTN; PAM sequence: CTT
atttgcacatggcctgacag

SEQ ID NO: 63925 - DNA, 20 bp, Artificial Sequence
  Description of Artificial Sequence: Synthetic oligonucleotide
  Target: SCN9A; (-) strand; PAM type: YTN; PAM sequence: TTA
tcttatttgcacatggcctg

SEQ ID NO: 63926 - DNA, 20 bp, Artificial Sequence
  Description of Artificial Sequence: Synthetic oligonucleotide
  Target: SCN9A; (-) strand; PAM type: YTN; PAM sequence: CTC
agaaaaattatcttatttgc

SEQ ID NO: 63927 - DNA, 20 bp, Artificial Sequence
  Description of Artificial Sequence: Synthetic oligonucleotide
  Target: SCN9A; (-) strand; PAM type: YTN; PAM sequence: CTC
tcagaaaaattatcttattt

SEQ ID NO: 63928 - DNA, 20 bp, Artificial Sequence
  Description of Artificial Sequence: Synthetic oligonucleotide
  Target: SCN9A; (-) strand; PAM type: YTN; PAM sequence: TTA
acctctcagaaaaattatct

SEQ ID NO: 63929 - DNA, 20 bp, Artificial Sequence
  Description of Artificial Sequence: Synthetic oligonucleotide
  Target: SCN9A; (-) strand; PAM type: YTN; PAM sequence: TTT
aacctctcagaaaaattatc

SEQ ID NO: 63930 - DNA, 20 bp, Artificial Sequence
  Description of Artificial Sequence: Synthetic oligonucleotide
  Target: SCN9A; (-) strand; PAM type: YTN; PAM sequence: CTC
atttaacctctcagaaaaat

SEQ ID NO: 63931 - DNA, 20 bp, Artificial Sequence
  Description of Artificial Sequence: Synthetic oligonucleotide
  Target: SCN9A; (-) strand; PAM type: YTN; PAM sequence: CTA
aaagacatagtatcctcatt

SEQ ID NO: 63932 - DNA, 20 bp, Artificial Sequence
  Description of Artificial Sequence: Synthetic oligonucleotide
  Target: SCN9A; (-) strand; PAM type: YTN; PAM sequence: TTA
caacaaatctaaaagacata

SEQ ID NO: 63933 - DNA, 20 bp, Artificial Sequence
  Description of Artificial Sequence: Synthetic oligonucleotide
  Target: SCN9A; (-) strand; PAM type: YTN; PAM sequence: TTT
acaacaaatctaaaagacat

SEQ ID NO: 63934 - DNA, 20 bp, Artificial Sequence
  Description of Artificial Sequence: Synthetic oligonucleotide
  Target: SCN9A; (-) strand; PAM type: YTN; PAM sequence: TTT
tacaacaaatctaaaagaca

SEQ ID NO: 63935 - DNA, 20 bp, Artificial Sequence
  Description of Artificial Sequence: Synthetic oligonucleotide
  Target: SCN9A; (-) strand; PAM type: YTN; PAM sequence: TTG
tagtcaaattttacaacaaa

SEQ ID NO: 63936 - DNA, 20 bp, Artificial Sequence
  Description of Artificial Sequence: Synthetic oligonucleotide
  Target: SCN9A; (-) strand; PAM type: YTN; PAM sequence: CTA
acataattgtagtcaaattt

SEQ ID NO: 63937 - DNA, 20 bp, Artificial Sequence
  Description of Artificial Sequence: Synthetic oligonucleotide
  Target: SCN9A; (-) strand; PAM type: YTN; PAM sequence: TTC
taacataattgtagtcaaat

SEQ ID NO: 63938 - DNA, 20 bp, Artificial Sequence
  Description of Artificial Sequence: Synthetic oligonucleotide
  Target: SCN9A; (-) strand; PAM type: YTN; PAM sequence: CTT
ctaacataattgtagtcaaa

SEQ ID NO: 63939 - DNA, 20 bp, Artificial Sequence
  Description of Artificial Sequence: Synthetic oligonucleotide
  Target: SCN9A; (-) strand; PAM type: YTN; PAM sequence: CTG
tgtaaaatacttctaacata

SEQ ID NO: 63940 - DNA, 20 bp, Artificial Sequence
  Description of Artificial Sequence: Synthetic oligonucleotide
  Target: SCN9A; (-) strand; PAM type: YTN; PAM sequence: CTC
catgatatgtcagatcctgt

SEQ ID NO: 63941 - DNA, 20 bp, Artificial Sequence
  Description of Artificial Sequence: Synthetic oligonucleotide
  Target: SCN9A; (-) strand; PAM type: YTN; PAM sequence: TTA
agactccatgatatgtcaga

SEQ ID NO: 63942 - DNA, 20 bp, Artificial Sequence
  Description of Artificial Sequence: Synthetic oligonucleotide
  Target: SCN9A; (-) strand; PAM type: YTN; PAM sequence: TTA
ttaagactccatgatatgtc

SEQ ID NO: 63943 - DNA, 20 bp, Artificial Sequence
  Description of Artificial Sequence: Synthetic oligonucleotide
  Target: SCN9A; (-) strand; PAM type: YTN; PAM sequence: TTT
attaagactccatgatatgt

SEQ ID NO: 63944 - DNA, 20 bp, Artificial Sequence
  Description of Artificial Sequence: Synthetic oligonucleotide
  Target: SCN9A; (-) strand; PAM type: YTN; PAM sequence: TTG
atgtttattaagactccatg

SEQ ID NO: 63945 - DNA, 20 bp, Artificial Sequence
  Description of Artificial Sequence: Synthetic oligonucleotide
  Target: SCN9A; (-) strand; PAM type: YTN; PAM sequence: TTG
agtagggaagaatatggaag

SEQ ID NO: 63946 - DNA, 20 bp, Artificial Sequence
  Description of Artificial Sequence: Synthetic oligonucleotide
  Target: SCN9A; (-) strand; PAM type: YTN; PAM sequence: TTC
atatatgttgagtagggaag

SEQ ID NO: 63947 - DNA, 20 bp, Artificial Sequence
  Description of Artificial Sequence: Synthetic oligonucleotide
  Target: SCN9A; (-) strand; PAM type: YTN; PAM sequence: TTC
attcatatatgttgagtagg

SEQ ID NO: 63948 - DNA, 20 bp, Artificial Sequence
  Description of Artificial Sequence: Synthetic oligonucleotide
  Target: SCN9A; (-) strand; PAM type: YTN; PAM sequence: TTT
cattcatatatgttgagtag

SEQ ID NO: 63949 - DNA, 20 bp, Artificial Sequence
  Description of Artificial Sequence: Synthetic oligonucleotide
  Target: SCN9A; (-) strand; PAM type: YTN; PAM sequence: CTG
gtgtttcattcatatatgtt

SEQ ID NO: 63950 - DNA, 20 bp, Artificial Sequence
  Description of Artificial Sequence: Synthetic oligonucleotide
  Target: SCN9A; (-) strand; PAM type: YTN; PAM sequence: TTA
atagcagctggtgtttcatt

SEQ ID NO: 63951 - DNA, 20 bp, Artificial Sequence
  Description of Artificial Sequence: Synthetic oligonucleotide
  Target: SCN9A; (-) strand; PAM type: YTN; PAM sequence: TTT
aatagcagctggtgtttcat

SEQ ID NO: 63952 - DNA, 20 bp, Artificial Sequence
  Description of Artificial Sequence: Synthetic oligonucleotide
  Target: SCN9A; (-) strand; PAM type: YTN; PAM sequence: TTT
taatagcagctggtgtttca

SEQ ID NO: 63953 - DNA, 20 bp, Artificial Sequence
  Description of Artificial Sequence: Synthetic oligonucleotide
  Target: SCN9A; (-) strand; PAM type: YTN; PAM sequence: TTT
ttaatagcagctggtgtttc

SEQ ID NO: 63954 - DNA, 20 bp, Artificial Sequence
  Description of Artificial Sequence: Synthetic oligonucleotide
  Target: SCN9A; (-) strand; PAM type: YTN; PAM sequence: TTT
tttaatagcagctggtgttt

SEQ ID NO: 63955 - DNA, 20 bp, Artificial Sequence
  Description of Artificial Sequence: Synthetic oligonucleotide
  Target: SCN9A; (-) strand; PAM type: YTN; PAM sequence: CTT
ttttaatagcagctggtgtt

SEQ ID NO: 63956 - DNA, 20 bp, Artificial Sequence
  Description of Artificial Sequence: Synthetic oligonucleotide
  Target: SCN9A; (-) strand; PAM type: YTN; PAM sequence: TTA
gaccttttttaatagcagct

SEQ ID NO: 63957 - DNA, 20 bp, Artificial Sequence
  Description of Artificial Sequence: Synthetic oligonucleotide
  Target: SCN9A; (-) strand; PAM type: YTN; PAM sequence: CTG
agagtagatataaaaagccg

SEQ ID NO: 63958 - DNA, 20 bp, Artificial Sequence
  Description of Artificial Sequence: Synthetic oligonucleotide
  Target: SCN9A; (-) strand; PAM type: YTN; PAM sequence: CTG
cctgagagtagatataaaaa

SEQ ID NO: 63959 - DNA, 20 bp, Artificial Sequence
  Description of Artificial Sequence: Synthetic oligonucleotide
  Target: SCN9A; (-) strand; PAM type: YTN; PAM sequence: TTA
acctgcctgagagtagatat

SEQ ID NO: 63960 - DNA, 20 bp, Artificial Sequence
  Description of Artificial Sequence: Synthetic oligonucleotide
  Target: SCN9A; (-) strand; PAM type: YTN; PAM sequence: TTT
aacctgcctgagagtagata

SEQ ID NO: 63961 - DNA, 20 bp, Artificial Sequence
  Description of Artificial Sequence: Synthetic oligonucleotide
  Target: SCN9A; (-) strand; PAM type: YTN; PAM sequence: TTT
taacctgcctgagagtagat

SEQ ID NO: 63962 - DNA, 20 bp, Artificial Sequence
  Description of Artificial Sequence: Synthetic oligonucleotide
  Target: SCN9A; (-) strand; PAM type: YTN; PAM sequence: TTG
gagaaatagtaaaagatgag

SEQ ID NO: 63963 - DNA, 20 bp, Artificial Sequence
  Description of Artificial Sequence: Synthetic oligonucleotide
  Target: SCN9A; (-) strand; PAM type: YTN; PAM sequence: TTT
ggagaaatagtaaaagatga

SEQ ID NO: 63964 - DNA, 20 bp, Artificial Sequence
  Description of Artificial Sequence: Synthetic oligonucleotide
  Target: SCN9A; (-) strand; PAM type: YTN; PAM sequence: TTA
agatttggagaaatagtaaa

SEQ ID NO: 63965 - DNA, 20 bp, Artificial Sequence
  Description of Artificial Sequence: Synthetic oligonucleotide
  Target: SCN9A; (-) strand; PAM type: YTN; PAM sequence: TTT
aagatttggagaaatagtaa

SEQ ID NO: 63966 - DNA, 20 bp, Artificial Sequence
  Description of Artificial Sequence: Synthetic oligonucleotide
  Target: SCN9A; (-) strand; PAM type: YTN; PAM sequence: TTG
aagaaatttaagatttggag

SEQ ID NO: 63967 - DNA, 20 bp, Artificial Sequence
  Description of Artificial Sequence: Synthetic oligonucleotide
  Target: SCN9A; (-) strand; PAM type: YTN; PAM sequence: TTT
gaagaaatttaagatttgga

SEQ ID NO: 63968 - DNA, 20 bp, Artificial Sequence
  Description of Artificial Sequence: Synthetic oligonucleotide
  Target: SCN9A; (-) strand; PAM type: YTN; PAM sequence: TTT
tgaagaaatttaagatttgg

SEQ ID NO: 63969 - DNA, 20 bp, Artificial Sequence
  Description of Artificial Sequence: Synthetic oligonucleotide
  Target: SCN9A; (-) strand; PAM type: YTN; PAM sequence: TTC
ggttttgaagaaatttaaga

SEQ ID NO: 63970 - DNA, 20 bp, Artificial Sequence
  Description of Artificial Sequence: Synthetic oligonucleotide
  Target: SCN9A; (-) strand; PAM type: YTN; PAM sequence: TTT
cggttttgaagaaatttaag

SEQ ID NO: 63971 - DNA, 20 bp, Artificial Sequence
  Description of Artificial Sequence: Synthetic oligonucleotide
  Target: SCN9A; (-) strand; PAM type: YTN; PAM sequence: CTT
tcggttttgaagaaatttaa

SEQ ID NO: 63972 - DNA, 20 bp, Artificial Sequence
  Description of Artificial Sequence: Synthetic oligonucleotide
  Target: SCN9A; (-) strand; PAM type: YTN; PAM sequence: TTC
aggggggatagcaatgcttt

SEQ ID NO: 63973 - DNA, 20 bp, Artificial Sequence
  Description of Artificial Sequence: Synthetic oligonucleotide
  Target: SCN9A; (-) strand; PAM type: YTN; PAM sequence: TTG
ataaaagaggcagcaattca

SEQ ID NO: 63974 - DNA, 20 bp, Artificial Sequence
  Description of Artificial Sequence: Synthetic oligonucleotide
  Target: SCN9A; (-) strand; PAM type: YTN; PAM sequence: TTG
tgttgataaaagaggcagca

SEQ ID NO: 63975 - DNA, 20 bp, Artificial Sequence
  Description of Artificial Sequence: Synthetic oligonucleotide
  Target: SCN9A; (-) strand; PAM type: YTN; PAM sequence: CTA
acccacatggagtgaaacag

SEQ ID NO: 63976 - DNA, 20 bp, Artificial Sequence
  Description of Artificial Sequence: Synthetic oligonucleotide
  Target: SCN9A; (-) strand; PAM type: YTN; PAM sequence: TTG
gaaggtgggaaagaagacat

SEQ ID NO: 63977 - DNA, 20 bp, Artificial Sequence
  Description of Artificial Sequence: Synthetic oligonucleotide
  Target: SCN9A; (-) strand; PAM type: YTN; PAM sequence: TTT
ggaaggtgggaaagaagaca

SEQ ID NO: 63978 - DNA, 20 bp, Artificial Sequence
  Description of Artificial Sequence: Synthetic oligonucleotide
  Target: SCN9A; (-) strand; PAM type: YTN; PAM sequence: CTT
tggaaggtgggaaagaagac

SEQ ID NO: 63979 - DNA, 20 bp, Artificial Sequence
  Description of Artificial Sequence: Synthetic oligonucleotide
  Target: SCN9A; (-) strand; PAM type: YTN; PAM sequence: TTG
agaaggctttggaaggtggg

SEQ ID NO: 63980 - DNA, 20 bp, Artificial Sequence
  Description of Artificial Sequence: Synthetic oligonucleotide
  Target: SCN9A; (-) strand; PAM type: YTN; PAM sequence: TTA
tgaaatacgtgacaattgag

SEQ ID NO: 63981 - DNA, 20 bp, Artificial Sequence
  Description of Artificial Sequence: Synthetic oligonucleotide
  Target: SCN9A; (-) strand; PAM type: YTN; PAM sequence: TTT
atgaaatacgtgacaattga

SEQ ID NO: 63982 - DNA, 20 bp, Artificial Sequence
  Description of Artificial Sequence: Synthetic oligonucleotide
  Target: SCN9A; (-) strand; PAM type: YTN; PAM sequence: CTA
tagaatggtttatgaaatac

SEQ ID NO: 63983 - DNA, 20 bp, Artificial Sequence
  Description of Artificial Sequence: Synthetic oligonucleotide
  Target: SCN9A; (-) strand; PAM type: YTN; PAM sequence: CTG
ctatagaatggtttatgaaa

SEQ ID NO: 63984 - DNA, 20 bp, Artificial Sequence
  Description of Artificial Sequence: Synthetic oligonucleotide
  Target: SCN9A; (-) strand; PAM type: YTN; PAM sequence: TTA
acaagcacaaaaaatataca

SEQ ID NO: 63985 - DNA, 20 bp, Artificial Sequence
  Description of Artificial Sequence: Synthetic oligonucleotide
  Target: SCN9A; (-) strand; PAM type: YTN; PAM sequence: CTA
taatcatgataaatacaata

SEQ ID NO: 63986 - DNA, 20 bp, Artificial Sequence
  Description of Artificial Sequence: Synthetic oligonucleotide
  Target: SCN9A; (-) strand; PAM type: YTN; PAM sequence: CTA
tccccaaatactataatcat

SEQ ID NO: 63987 - DNA, 20 bp, Artificial Sequence
  Description of Artificial Sequence: Synthetic oligonucleotide
  Target: SCN9A; (-) strand; PAM type: YTN; PAM sequence: CTC
tatccccaaatactataatc

SEQ ID NO: 63988 - DNA, 20 bp, Artificial Sequence
  Description of Artificial Sequence: Synthetic oligonucleotide
  Target: SCN9A; (-) strand; PAM type: YTN; PAM sequence: CTA
tgctctatccccaaatacta

SEQ ID NO: 63989 - DNA, 20 bp, Artificial Sequence
  Description of Artificial Sequence: Synthetic oligonucleotide
  Target: SCN9A; (-) strand; PAM type: YTN; PAM sequence: CTA
ctatgctctatccccaaata

SEQ ID NO: 63990 - DNA, 20 bp, Artificial Sequence
  Description of Artificial Sequence: Synthetic oligonucleotide
  Target: SCN9A; (-) strand; PAM type: YTN; PAM sequence: CTC
tactatgctctatccccaaa

SEQ ID NO: 63991 - DNA, 20 bp, Artificial Sequence
  Description of Artificial Sequence: Synthetic oligonucleotide
  Target: SCN9A; (-) strand; PAM type: YTN; PAM sequence: CTC
tctactatgctctatcccca

SEQ ID NO: 63992 - DNA, 20 bp, Artificial Sequence
  Description of Artificial Sequence: Synthetic oligonucleotide
  Target: SCN9A; (-) strand; PAM type: YTN; PAM sequence: TTA
aactctctactatgctctat

SEQ ID NO: 63993 - DNA, 20 bp, Artificial Sequence
  Description of Artificial Sequence: Synthetic oligonucleotide
  Target: SCN9A; (-) strand; PAM type: YTN; PAM sequence: CTA
ttaaactctctactatgctc

SEQ ID NO: 63994 - DNA, 20 bp, Artificial Sequence
  Description of Artificial Sequence: Synthetic oligonucleotide
  Target: SCN9A; (-) strand; PAM type: YTN; PAM sequence: CTC
tattaaactctctactatgc

SEQ ID NO: 63995 - DNA, 20 bp, Artificial Sequence
  Description of Artificial Sequence: Synthetic oligonucleotide
  Target: SCN9A; (-) strand; PAM type: YTN; PAM sequence: TTG
tactctattaaactctctac

SEQ ID NO: 63996 - DNA, 20 bp, Artificial Sequence
  Description of Artificial Sequence: Synthetic oligonucleotide
  Target: SCN9A; (-) strand; PAM type: YTN; PAM sequence: CTT
gtactctattaaactctcta

SEQ ID NO: 63997 - DNA, 20 bp, Artificial Sequence
  Description of Artificial Sequence: Synthetic oligonucleotide
  Target: SCN9A; (-) strand; PAM type: YTN; PAM sequence: TTC
gatgtatcttgtactctatt

SEQ ID NO: 63998 - DNA, 20 bp, Artificial Sequence
  Description of Artificial Sequence: Synthetic oligonucleotide
  Target: SCN9A; (-) strand; PAM type: YTN; PAM sequence: TTA
gatagagtcagtagtaaatt

SEQ ID NO: 63999 - DNA, 20 bp, Artificial Sequence
  Description of Artificial Sequence: Synthetic oligonucleotide
  Target: SCN9A; (-) strand; PAM type: YTN; PAM sequence: TTA
cccaaggtcatatatcgagt

SEQ ID NO: 64000 - DNA, 20 bp, Artificial Sequence
  Description of Artificial Sequence: Synthetic oligonucleotide
  Target: SCN9A; (-) strand; PAM type: YTN; PAM sequence: CTT
acccaaggtcatatatcgag

SEQ ID NO: 64001 - DNA, 20 bp, Artificial Sequence
  Description of Artificial Sequence: Synthetic oligonucleotide
  Target: SCN9A; (-) strand; PAM type: YTN; PAM sequence: TTA
agtgacttacccaaggtcat

SEQ ID NO: 64002 - DNA, 20 bp, Artificial Sequence
  Description of Artificial Sequence: Synthetic oligonucleotide
  Target: SCN9A; (-) strand; PAM type: YTN; PAM sequence: TTC
acaaatgaggaaaggcacac

SEQ ID NO: 64003 - DNA, 20 bp, Artificial Sequence
  Description of Artificial Sequence: Synthetic oligonucleotide
  Target: SCN9A; (-) strand; PAM type: YTN; PAM sequence: TTT
cacaaatgaggaaaggcaca

SEQ ID NO: 64004 - DNA, 20 bp, Artificial Sequence
  Description of Artificial Sequence: Synthetic oligonucleotide
  Target: SCN9A; (-) strand; PAM type: YTN; PAM sequence: CTT
tcacaaatgaggaaaggcac

SEQ ID NO: 64005 - DNA, 20 bp, Artificial Sequence
  Description of Artificial Sequence: Synthetic oligonucleotide
  Target: SCN9A; (-) strand; PAM type: YTN; PAM sequence: CTC
tttcacaaatgaggaaaggc

SEQ ID NO: 64006 - DNA, 20 bp, Artificial Sequence
  Description of Artificial Sequence: Synthetic oligonucleotide
  Target: SCN9A; (-) strand; PAM type: YTN; PAM sequence: TTA
cagagtctctttcacaaatg

SEQ ID NO: 64007 - DNA, 20 bp, Artificial Sequence
  Description of Artificial Sequence: Synthetic oligonucleotide
  Target: SCN9A; (-) strand; PAM type: YTN; PAM sequence: TTA
ttacagagtctctttcacaa

SEQ ID NO: 64008 - DNA, 20 bp, Artificial Sequence
  Description of Artificial Sequence: Synthetic oligonucleotide
  Target: SCN9A; (-) strand; PAM type: YTN; PAM sequence: TTA
gggcacacaatccaacccat

SEQ ID NO: 64009 - DNA, 20 bp, Artificial Sequence
  Description of Artificial Sequence: Synthetic oligonucleotide
  Target: SCN9A; (-) strand; PAM type: YTN; PAM sequence: CTT
agggcacacaatccaaccca

SEQ ID NO: 64010 - DNA, 20 bp, Artificial Sequence
  Description of Artificial Sequence: Synthetic oligonucleotide
  Target: SCN9A; (-) strand; PAM type: YTN; PAM sequence: TTC
ttagggcacacaatccaacc

SEQ ID NO: 64011 - DNA, 20 bp, Artificial Sequence
  Description of Artificial Sequence: Synthetic oligonucleotide
  Target: SCN9A; (-) strand; PAM type: YTN; PAM sequence: CTT
cttagggcacacaatccaac

SEQ ID NO: 64012 - DNA, 20 bp, Artificial Sequence
  Description of Artificial Sequence: Synthetic oligonucleotide
  Target: SCN9A; (-) strand; PAM type: YTN; PAM sequence: TTA
tatgtaccttcttagggcac

SEQ ID NO: 64013 - DNA, 20 bp, Artificial Sequence
  Description of Artificial Sequence: Synthetic oligonucleotide
  Target: SCN9A; (-) strand; PAM type: YTN; PAM sequence: CTT
atatgtaccttcttagggca

SEQ ID NO: 64014 - DNA, 20 bp, Artificial Sequence
  Description of Artificial Sequence: Synthetic oligonucleotide
  Target: SCN9A; (-) strand; PAM type: YTN; PAM sequence: TTA
ggacttatatgtaccttctt

SEQ ID NO: 64015 - DNA, 20 bp, Artificial Sequence
  Description of Artificial Sequence: Synthetic oligonucleotide
  Target: SCN9A; (-) strand; PAM type: YTN; PAM sequence: CTA
agggttaggacttatatgta

SEQ ID NO: 64016 - DNA, 20 bp, Artificial Sequence
  Description of Artificial Sequence: Synthetic oligonucleotide
  Target: SCN9A; (-) strand; PAM type: YTN; PAM sequence: CTG
aagtgctaagggttaggact

SEQ ID NO: 64017 - DNA, 20 bp, Artificial Sequence
  Description of Artificial Sequence: Synthetic oligonucleotide
  Target: SCN9A; (-) strand; PAM type: YTN; PAM sequence: TTC
tgaagtgctaagggttagga

SEQ ID NO: 64018 - DNA, 20 bp, Artificial Sequence
  Description of Artificial Sequence: Synthetic oligonucleotide
  Target: SCN9A; (-) strand; PAM type: YTN; PAM sequence: TTC
aaataaggtcacattctgaa

SEQ ID NO: 64019 - DNA, 20 bp, Artificial Sequence
  Description of Artificial Sequence: Synthetic oligonucleotide
  Target: SCN9A; (-) strand; PAM type: YTN; PAM sequence: TTT
caaataaggtcacattctga

SEQ ID NO: 64020 - DNA, 20 bp, Artificial Sequence
  Description of Artificial Sequence: Synthetic oligonucleotide
  Target: SCN9A; (-) strand; PAM type: YTN; PAM sequence: TTT
tcaaataaggtcacattctg

SEQ ID NO: 64021 - DNA, 20 bp, Artificial Sequence
  Description of Artificial Sequence: Synthetic oligonucleotide
  Target: SCN9A; (-) strand; PAM type: YTN; PAM sequence: TTA
ttttcaaataaggtcacatt

SEQ ID NO: 64022 - DNA, 20 bp, Artificial Sequence
  Description of Artificial Sequence: Synthetic oligonucleotide
  Target: SCN9A; (-) strand; PAM type: YTN; PAM sequence: CTG
caatgacattattttcaaat

SEQ ID NO: 64023 - DNA, 20 bp, Artificial Sequence
  Description of Artificial Sequence: Synthetic oligonucleotide
  Target: SCN9A; (-) strand; PAM type: YTN; PAM sequence: TTA
catctgcaatgacattattt

SEQ ID NO: 64024 - DNA, 20 bp, Artificial Sequence
  Description of Artificial Sequence: Synthetic oligonucleotide
  Target: SCN9A; (-) strand; PAM type: YTN; PAM sequence: TTA
attacatctgcaatgacatt

SEQ ID NO: 64025 - DNA, 20 bp, Artificial Sequence
  Description of Artificial Sequence: Synthetic oligonucleotide
  Target: SCN9A; (-) strand; PAM type: YTN; PAM sequence: CTT
aattacatctgcaatgacat

SEQ ID NO: 64026 - DNA, 20 bp, Artificial Sequence
  Description of Artificial Sequence: Synthetic oligonucleotide
  Target: SCN9A; (-) strand; PAM type: YTN; PAM sequence: TTC
atcttaattacatctgcaat

SEQ ID NO: 64027 - DNA, 20 bp, Artificial Sequence
  Description of Artificial Sequence: Synthetic oligonucleotide
  Target: SCN9A; (-) strand; PAM type: YTN; PAM sequence: CTT
catcttaattacatctgcaa

SEQ ID NO: 64028 - DNA, 20 bp, Artificial Sequence
  Description of Artificial Sequence: Synthetic oligonucleotide
  Target: SCN9A; (-) strand; PAM type: YTN; PAM sequence: CTC
cagtatgacttcatcttaat

SEQ ID NO: 64029 - DNA, 20 bp, Artificial Sequence
  Description of Artificial Sequence: Synthetic oligonucleotide
  Target: SCN9A; (-) strand; PAM type: YTN; PAM sequence: CTC
cactccagtatgacttcatc

SEQ ID NO: 64030 - DNA, 20 bp, Artificial Sequence
  Description of Artificial Sequence: Synthetic oligonucleotide
  Target: SCN9A; (-) strand; PAM type: YTN; PAM sequence: TTA
agagcccactccactccagt

SEQ ID NO: 64031 - DNA, 20 bp, Artificial Sequence
  Description of Artificial Sequence: Synthetic oligonucleotide
  Target: SCN9A; (-) strand; PAM type: YTN; PAM sequence: CTG
gattaagagcccactccact

SEQ ID NO: 64032 - DNA, 20 bp, Artificial Sequence
  Description of Artificial Sequence: Synthetic oligonucleotide
  Target: SCN9A; (-) strand; PAM type: YTN; PAM sequence: CTA
gtaaggatgccagtcacact

SEQ ID NO: 64033 - DNA, 20 bp, Artificial Sequence
  Description of Artificial Sequence: Synthetic oligonucleotide
  Target: SCN9A; (-) strand; PAM type: YTN; PAM sequence: CTA
ctagtaaggatgccagtcac

SEQ ID NO: 64034 - DNA, 20 bp, Artificial Sequence
  Description of Artificial Sequence: Synthetic oligonucleotide
  Target: SCN9A; (-) strand; PAM type: YTN; PAM sequence: CTC
tactagtaaggatgccagtc

SEQ ID NO: 64035 - DNA, 20 bp, Artificial Sequence
  Description of Artificial Sequence: Synthetic oligonucleotide
  Target: SCN9A; (-) strand; PAM type: YTN; PAM sequence: CTC
ctctactagtaaggatgcca

SEQ ID NO: 64036 - DNA, 20 bp, Artificial Sequence
  Description of Artificial Sequence: Synthetic oligonucleotide
  Target: SCN9A; (-) strand; PAM type: YTN; PAM sequence: TTC
tcctctactagtaaggatgc

SEQ ID NO: 64037 - DNA, 20 bp, Artificial Sequence
  Description of Artificial Sequence: Synthetic oligonucleotide
  Target: SCN9A; (-) strand; PAM type: YTN; PAM sequence: TTT
ctcctctactagtaaggatg

SEQ ID NO: 64038 - DNA, 20 bp, Artificial Sequence
  Description of Artificial Sequence: Synthetic oligonucleotide
  Target: SCN9A; (-) strand; PAM type: YTN; PAM sequence: CTT
tctcctctactagtaaggat

SEQ ID NO: 64039 - DNA, 20 bp, Artificial Sequence
  Description of Artificial Sequence: Synthetic oligonucleotide
  Target: SCN9A; (-) strand; PAM type: YTN; PAM sequence: CTG
tgtgtctttctcctctacta

SEQ ID NO: 64040 - DNA, 20 bp, Artificial Sequence
  Description of Artificial Sequence: Synthetic oligonucleotide
  Target: SCN9A; (-) strand; PAM type: YTN; PAM sequence: CTC
tgtgtgtctttctcctctac

SEQ ID NO: 64041 - DNA, 20 bp, Artificial Sequence
  Description of Artificial Sequence: Synthetic oligonucleotide
  Target: SCN9A; (-) strand; PAM type: YTN; PAM sequence: TTC
cctctgtgtgtctttctcct

SEQ ID NO: 64042 - DNA, 20 bp, Artificial Sequence
  Description of Artificial Sequence: Synthetic oligonucleotide
  Target: SCN9A; (-) strand; PAM type: YTN; PAM sequence: TTT
ccctctgtgtgtctttctcc

SEQ ID NO: 64043 - DNA, 20 bp, Artificial Sequence
  Description of Artificial Sequence: Synthetic oligonucleotide
  Target: SCN9A; (-) strand; PAM type: YTN; PAM sequence: TTT
tccctctgtgtgtctttctc

SEQ ID NO: 64044 - DNA, 20 bp, Artificial Sequence
  Description of Artificial Sequence: Synthetic oligonucleotide
  Target: SCN9A; (-) strand; PAM type: YTN; PAM sequence: TTA
tagtgacatgccattttccc

SEQ ID NO: 64045 - DNA, 20 bp, Artificial Sequence
  Description of Artificial Sequence: Synthetic oligonucleotide
  Target: SCN9A; (-) strand; PAM type: YTN; PAM sequence: CTC
ccattatagtgacatgccat

SEQ ID NO: 64046 - DNA, 20 bp, Artificial Sequence
  Description of Artificial Sequence: Synthetic oligonucleotide
  Target: SCN9A; (-) strand; PAM type: YTN; PAM sequence: CTC
tcccattatagtgacatgcc

SEQ ID NO: 64047 - DNA, 20 bp, Artificial Sequence
  Description of Artificial Sequence: Synthetic oligonucleotide
  Target: SCN9A; (-) strand; PAM type: YTN; PAM sequence: CTC
caatctctcccattatagtg

SEQ ID NO: 64048 - DNA, 20 bp, Artificial Sequence
  Description of Artificial Sequence: Synthetic oligonucleotide
  Target: SCN9A; (-) strand; PAM type: YTN; PAM sequence: TTA
tggcaacagaactccaatct

SEQ ID NO: 64049 - DNA, 20 bp, Artificial Sequence
  Description of Artificial Sequence: Synthetic oligonucleotide
  Target: SCN9A; (-) strand; PAM type: YTN; PAM sequence: TTT
atggcaacagaactccaatc

SEQ ID NO: 64050 - DNA, 20 bp, Artificial Sequence
  Description of Artificial Sequence: Synthetic oligonucleotide
  Target: SCN9A; (-) strand; PAM type: YTN; PAM sequence: TTG
gtttatggcaacagaactcc

SEQ ID NO: 64051 - DNA, 20 bp, Artificial Sequence
  Description of Artificial Sequence: Synthetic oligonucleotide
  Target: SCN9A; (-) strand; PAM type: YTN; PAM sequence: CTT
ggtttatggcaacagaactc

SEQ ID NO: 64052 - DNA, 20 bp, Artificial Sequence
  Description of Artificial Sequence: Synthetic oligonucleotide
  Target: SCN9A; (-) strand; PAM type: YTN; PAM sequence: TTC
ttggtttatggcaacagaac

SEQ ID NO: 64053 - DNA, 20 bp, Artificial Sequence
  Description of Artificial Sequence: Synthetic oligonucleotide
  Target: SCN9A; (-) strand; PAM type: YTN; PAM sequence: TTT
cttggtttatggcaacagaa

SEQ ID NO: 64054 - DNA, 20 bp, Artificial Sequence
  Description of Artificial Sequence: Synthetic oligonucleotide
  Target: SCN9A; (-) strand; PAM type: YTN; PAM sequence: CTG
gtagcccaggtgtttcttgg

SEQ ID NO: 64055 - DNA, 20 bp, Artificial Sequence
  Description of Artificial Sequence: Synthetic oligonucleotide
  Target: SCN9A; (-) strand; PAM type: YTN; PAM sequence: TTC
tggtagcccaggtgtttctt

SEQ ID NO: 64056 - DNA, 20 bp, Artificial Sequence
  Description of Artificial Sequence: Synthetic oligonucleotide
  Target: SCN9A; (-) strand; PAM type: YTN; PAM sequence: CTT
ctggtagcccaggtgtttct

SEQ ID NO: 64057 - DNA, 20 bp, Artificial Sequence
  Description of Artificial Sequence: Synthetic oligonucleotide
  Target: SCN9A; (-) strand; PAM type: YTN; PAM sequence: TTC
cagcttctggtagcccaggt

SEQ ID NO: 64058 - DNA, 20 bp, Artificial Sequence
  Description of Artificial Sequence: Synthetic oligonucleotide
  Target: SCN9A; (-) strand; PAM type: YTN; PAM sequence: CTT
ccagcttctggtagcccagg

SEQ ID NO: 64059 - DNA, 20 bp, Artificial Sequence
  Description of Artificial Sequence: Synthetic oligonucleotide
  Target: SCN9A; (-) strand; PAM type: YTN; PAM sequence: CTC
ttccagcttctggtagccca

SEQ ID NO: 64060 - DNA, 20 bp, Artificial Sequence
  Description of Artificial Sequence: Synthetic oligonucleotide
  Target: SCN9A; (-) strand; PAM type: YTN; PAM sequence: TTG
cctcttccagcttctggtag

SEQ ID NO: 64061 - DNA, 20 bp, Artificial Sequence
  Description of Artificial Sequence: Synthetic oligonucleotide
  Target: SCN9A; (-) strand; PAM type: YTN; PAM sequence: TTA
ttgcctcttccagcttctgg

SEQ ID NO: 64062 - DNA, 20 bp, Artificial Sequence
  Description of Artificial Sequence: Synthetic oligonucleotide
  Target: SCN9A; (-) strand; PAM type: YTN; PAM sequence: TTT
attgcctcttccagcttctg

SEQ ID NO: 64063 - DNA, 20 bp, Artificial Sequence
  Description of Artificial Sequence: Synthetic oligonucleotide
  Target: SCN9A; (-) strand; PAM type: YTN; PAM sequence: TTT
tattgcctcttccagcttct

SEQ ID NO: 64064 - DNA, 20 bp, Artificial Sequence
  Description of Artificial Sequence: Synthetic oligonucleotide
  Target: SCN9A; (-) strand; PAM type: YTN; PAM sequence: CTA
agaaaatatattttattgcc

SEQ ID NO: 64065 - DNA, 20 bp, Artificial Sequence
  Description of Artificial Sequence: Synthetic oligonucleotide
  Target: SCN9A; (-) strand; PAM type: YTN; PAM sequence: CTC
taagaaaatatattttattg

SEQ ID NO: 64066 - DNA, 20 bp, Artificial Sequence
  Description of Artificial Sequence: Synthetic oligonucleotide
  Target: SCN9A; (-) strand; PAM type: YTN; PAM sequence: TTA
aagcctctaagaaaatatat

SEQ ID NO: 64067 - DNA, 20 bp, Artificial Sequence
  Description of Artificial Sequence: Synthetic oligonucleotide
  Target: SCN9A; (-) strand; PAM type: YTN; PAM sequence: TTT
aaagcctctaagaaaatata

SEQ ID NO: 64068 - DNA, 20 bp, Artificial Sequence
  Description of Artificial Sequence: Synthetic oligonucleotide
  Target: SCN9A; (-) strand; PAM type: YTN; PAM sequence: CTT
taaagcctctaagaaaatat

SEQ ID NO: 64069 - DNA, 20 bp, Artificial Sequence
  Description of Artificial Sequence: Synthetic oligonucleotide
  Target: SCN9A; (-) strand; PAM type: YTN; PAM sequence: CTC
tttaaagcctctaagaaaat

SEQ ID NO: 64070 - DNA, 20 bp, Artificial Sequence
  Description of Artificial Sequence: Synthetic oligonucleotide
  Target: SCN9A; (-) strand; PAM type: YTN; PAM sequence: TTC
tctttaaagcctctaagaaa

SEQ ID NO: 64071 - DNA, 20 bp, Artificial Sequence
  Description of Artificial Sequence: Synthetic oligonucleotide
  Target: SCN9A; (-) strand; PAM type: YTN; PAM sequence: TTC
aaagtgtcagcaggtccatg

SEQ ID NO: 64072 - DNA, 20 bp, Artificial Sequence
  Description of Artificial Sequence: Synthetic oligonucleotide
  Target: SCN9A; (-) strand; PAM type: YTN; PAM sequence: TTA
gaagtccaaattcaaagtgt

SEQ ID NO: 64073 - DNA, 20 bp, Artificial Sequence
  Description of Artificial Sequence: Synthetic oligonucleotide
  Target: SCN9A; (-) strand; PAM type: YTN; PAM sequence: TTG
gaggttagaagtccaaattc

SEQ ID NO: 64074 - DNA, 20 bp, Artificial Sequence
  Description of Artificial Sequence: Synthetic oligonucleotide
  Target: SCN9A; (-) strand; PAM type: YTN; PAM sequence: TTT
ggaggttagaagtccaaatt

SEQ ID NO: 64075 - DNA, 20 bp, Artificial Sequence
  Description of Artificial Sequence: Synthetic oligonucleotide
  Target: SCN9A; (-) strand; PAM type: YTN; PAM sequence: TTT
tggaggttagaagtccaaat

SEQ ID NO: 64076 - DNA, 20 bp, Artificial Sequence
  Description of Artificial Sequence: Synthetic oligonucleotide
  Target: SCN9A; (-) strand; PAM type: YTN; PAM sequence: CTT
ttggaggttagaagtccaaa

SEQ ID NO: 64077 - DNA, 20 bp, Artificial Sequence
  Description of Artificial Sequence: Synthetic oligonucleotide
  Target: SCN9A; (-) strand; PAM type: YTN; PAM sequence: CTC
acacttttggaggttagaag

SEQ ID NO: 64078 - DNA, 20 bp, Artificial Sequence
  Description of Artificial Sequence: Synthetic oligonucleotide
  Target: SCN9A; (-) strand; PAM type: YTN; PAM sequence: CTC
tcacacttttggaggttaga

SEQ ID NO: 64079 - DNA, 20 bp, Artificial Sequence
  Description of Artificial Sequence: Synthetic oligonucleotide
  Target: SCN9A; (-) strand; PAM type: YTN; PAM sequence: TTC
tctcacacttttggaggtta

SEQ ID NO: 64080 - DNA, 20 bp, Artificial Sequence
  Description of Artificial Sequence: Synthetic oligonucleotide
  Target: SCN9A; (-) strand; PAM type: YTN; PAM sequence: TTA
aaacaagagaaatatattct

SEQ ID NO: 64081 - DNA, 20 bp, Artificial Sequence
  Description of Artificial Sequence: Synthetic oligonucleotide
  Target: SCN9A; (-) strand; PAM type: YTN; PAM sequence: CTT
aaaacaagagaaatatattc

SEQ ID NO: 64082 - DNA, 20 bp, Artificial Sequence
  Description of Artificial Sequence: Synthetic oligonucleotide
  Target: SCN9A; (-) strand; PAM type: YTN; PAM sequence: CTG
agggcttaaaacaagagaaa

SEQ ID NO: 64083 - DNA, 20 bp, Artificial Sequence
  Description of Artificial Sequence: Synthetic oligonucleotide
  Target: SCN9A; (-) strand; PAM type: YTN; PAM sequence: CTA
cgagaacaggataatacaaa

SEQ ID NO: 64084 - DNA, 20 bp, Artificial Sequence
  Description of Artificial Sequence: Synthetic oligonucleotide
  Target: SCN9A; (-) strand; PAM type: YTN; PAM sequence: TTG
acctacgagaacaggataat

SEQ ID NO: 64085 - DNA, 20 bp, Artificial Sequence
  Description of Artificial Sequence: Synthetic oligonucleotide
  Target: SCN9A; (-) strand; PAM type: YTN; PAM sequence: TTT
gacctacgagaacaggataa

SEQ ID NO: 64086 - DNA, 20 bp, Artificial Sequence
  Description of Artificial Sequence: Synthetic oligonucleotide
  Target: SCN9A; (-) strand; PAM type: YTN; PAM sequence: CTT
tgacctacgagaacaggata

SEQ ID NO: 64087 - DNA, 20 bp, Artificial Sequence
  Description of Artificial Sequence: Synthetic oligonucleotide
  Target: SCN9A; (-) strand; PAM type: YTN; PAM sequence: TTC
tttgacctacgagaacagga

SEQ ID NO: 64088 - DNA, 20 bp, Artificial Sequence
  Description of Artificial Sequence: Synthetic oligonucleotide
  Target: SCN9A; (-) strand; PAM type: YTN; PAM sequence: TTT
ctttgacctacgagaacagg

SEQ ID NO: 64089 - DNA, 20 bp, Artificial Sequence
  Description of Artificial Sequence: Synthetic oligonucleotide
  Target: SCN9A; (-) strand; PAM type: YTN; PAM sequence: TTA
gtttctttgacctacgagaa

SEQ ID NO: 64090 - DNA, 20 bp, Artificial Sequence
  Description of Artificial Sequence: Synthetic oligonucleotide
  Target: SCN9A; (-) strand; PAM type: YTN; PAM sequence: CTG
tattagtttctttgacctac

SEQ ID NO: 64091 - DNA, 20 bp, Artificial Sequence
  Description of Artificial Sequence: Synthetic oligonucleotide
  Target: SCN9A; (-) strand; PAM type: YTN; PAM sequence: TTC
acatcaactgtattagtttc

SEQ ID NO: 64092 - DNA, 20 bp, Artificial Sequence
  Description of Artificial Sequence: Synthetic oligonucleotide
  Target: SCN9A; (-) strand; PAM type: YTN; PAM sequence: CTT
cacatcaactgtattagttt

SEQ ID NO: 64093 - DNA, 20 bp, Artificial Sequence
  Description of Artificial Sequence: Synthetic oligonucleotide
  Target: SCN9A; (-) strand; PAM type: YTN; PAM sequence: TTA
atcttcacatcaactgtatt

SEQ ID NO: 64094 - DNA, 20 bp, Artificial Sequence
  Description of Artificial Sequence: Synthetic oligonucleotide
  Target: SCN9A; (-) strand; PAM type: YTN; PAM sequence: TTA
attaatcttcacatcaactg

SEQ ID NO: 64095 - DNA, 20 bp, Artificial Sequence
  Description of Artificial Sequence: Synthetic oligonucleotide
  Target: SCN9A; (-) strand; PAM type: YTN; PAM sequence: TTA
attaattaatcttcacatca

SEQ ID NO: 64096 - DNA, 20 bp, Artificial Sequence
  Description of Artificial Sequence: Synthetic oligonucleotide
  Target: SCN9A; (-) strand; PAM type: YTN; PAM sequence: TTT
aattaattaatcttcacatc

SEQ ID NO: 64097 - DNA, 20 bp, Artificial Sequence
  Description of Artificial Sequence: Synthetic oligonucleotide
  Target: SCN9A; (-) strand; PAM type: YTN; PAM sequence: TTT
taattaattaatcttcacat

SEQ ID NO: 64098 - DNA, 20 bp, Artificial Sequence
  Description of Artificial Sequence: Synthetic oligonucleotide
  Target: SCN9A; (-) strand; PAM type: YTN; PAM sequence: TTT
ttaattaattaatcttcaca

SEQ ID NO: 64099 - DNA, 20 bp, Artificial Sequence
  Description of Artificial Sequence: Synthetic oligonucleotide
  Target: SCN9A; (-) strand; PAM type: YTN; PAM sequence: CTG
aaatttttaattaattaatc

SEQ ID NO: 64100 - DNA, 20 bp, Artificial Sequence
  Description of Artificial Sequence: Synthetic oligonucleotide
  Target: SCN9A; (-) strand; PAM type: YTN; PAM sequence: TTC
tgaaatttttaattaattaa

SEQ ID NO: 64101 - DNA, 20 bp, Artificial Sequence
  Description of Artificial Sequence: Synthetic oligonucleotide
  Target: SCN9A; (-) strand; PAM type: YTN; PAM sequence: CTT
ctgaaatttttaattaatta

SEQ ID NO: 64102 - DNA, 20 bp, Artificial Sequence
  Description of Artificial Sequence: Synthetic oligonucleotide
  Target: SCN9A; (-) strand; PAM type: YTN; PAM sequence: TTG
agcaatcttctgaaattttt

SEQ ID NO: 64103 - DNA, 20 bp, Artificial Sequence
  Description of Artificial Sequence: Synthetic oligonucleotide
  Target: SCN9A; (-) strand; PAM type: YTN; PAM sequence: TTT
gagcaatcttctgaaatttt

SEQ ID NO: 64104 - DNA, 20 bp, Artificial Sequence
  Description of Artificial Sequence: Synthetic oligonucleotide
  Target: SCN9A; (-) strand; PAM type: YTN; PAM sequence: CTG
taatttgagcaatcttctga

SEQ ID NO: 64105 - DNA, 20 bp, Artificial Sequence
  Description of Artificial Sequence: Synthetic oligonucleotide
  Target: SCN9A; (-) strand; PAM type: YTN; PAM sequence: TTG
aatactgtaatttgagcaat

SEQ ID NO: 64106 - DNA, 20 bp, Artificial Sequence
  Description of Artificial Sequence: Synthetic oligonucleotide
  Target: SCN9A; (-) strand; PAM type: YTN; PAM sequence: TTG
ttgaatactgtaatttgagc

SEQ ID NO: 64107 - DNA, 20 bp, Artificial Sequence
  Description of Artificial Sequence: Synthetic oligonucleotide
  Target: SCN9A; (-) strand; PAM type: YTN; PAM sequence: CTT
gttgaatactgtaatttgag

SEQ ID NO: 64108 - DNA, 20 bp, Artificial Sequence
  Description of Artificial Sequence: Synthetic oligonucleotide
  Target: SCN9A; (-) strand; PAM type: YTN; PAM sequence: TTA
agacttgttgaatactgtaa

SEQ ID NO: 64109 - DNA, 20 bp, Artificial Sequence
  Description of Artificial Sequence: Synthetic oligonucleotide
  Target: SCN9A; (-) strand; PAM type: YTN; PAM sequence: TTA
tgtcatagcagaataaataa

SEQ ID NO: 64110 - DNA, 20 bp, Artificial Sequence
  Description of Artificial Sequence: Synthetic oligonucleotide
  Target: SCN9A; (-) strand; PAM type: YTN; PAM sequence: TTT
atgtcatagcagaataaata

SEQ ID NO: 64111 - DNA, 20 bp, Artificial Sequence
  Description of Artificial Sequence: Synthetic oligonucleotide
  Target: SCN9A; (-) strand; PAM type: YTN; PAM sequence: CTC
aaggagtttatgtcatagca

SEQ ID NO: 64112 - DNA, 20 bp, Artificial Sequence
  Description of Artificial Sequence: Synthetic oligonucleotide
  Target: SCN9A; (-) strand; PAM type: YTN; PAM sequence: CTG
agctcaaggagtttatgtca

SEQ ID NO: 64113 - DNA, 20 bp, Artificial Sequence
  Description of Artificial Sequence: Synthetic oligonucleotide
  Target: SCN9A; (-) strand; PAM type: YTN; PAM sequence: TTC
ctgagctcaaggagtttatg

SEQ ID NO: 64114 - DNA, 20 bp, Artificial Sequence
  Description of Artificial Sequence: Synthetic oligonucleotide
  Target: SCN9A; (-) strand; PAM type: YTN; PAM sequence: TTG
gggagaccaacgtaagatat

SEQ ID NO: 64115 - DNA, 20 bp, Artificial Sequence
  Description of Artificial Sequence: Synthetic oligonucleotide
  Target: SCN9A; (-) strand; PAM type: YTN; PAM sequence: CTT
ggggagaccaacgtaagata

SEQ ID NO: 64116 - DNA, 20 bp, Artificial Sequence
  Description of Artificial Sequence: Synthetic oligonucleotide
  Target: SCN9A; (-) strand; PAM type: YTN; PAM sequence: TTG
gagcttggggagaccaacgt

SEQ ID NO: 64117 - DNA, 20 bp, Artificial Sequence
  Description of Artificial Sequence: Synthetic oligonucleotide
  Target: SCN9A; (-) strand; PAM type: YTN; PAM sequence: TTG
ggttggagcttggggagacc

SEQ ID NO: 64118 - DNA, 20 bp, Artificial Sequence
  Description of Artificial Sequence: Synthetic oligonucleotide
  Target: SCN9A; (-) strand; PAM type: YTN; PAM sequence: TTG
tgtaatatatattgggttgg

SEQ ID NO: 64119 - DNA, 20 bp, Artificial Sequence
  Description of Artificial Sequence: Synthetic oligonucleotide
  Target: SCN9A; (-) strand; PAM type: YTN; PAM sequence: TTT
gtgtaatatatattgggttg

SEQ ID NO: 64120 - DNA, 20 bp, Artificial Sequence
  Description of Artificial Sequence: Synthetic oligonucleotide
  Target: SCN9A; (-) strand; PAM type: YTN; PAM sequence: TTT
tgtgtaatatatattgggtt

SEQ ID NO: 64121 - DNA, 20 bp, Artificial Sequence
  Description of Artificial Sequence: Synthetic oligonucleotide
  Target: SCN9A; (-) strand; PAM type: YTN; PAM sequence: TTA
ttttgtgtaatatatattgg

SEQ ID NO: 64122 - DNA, 20 bp, Artificial Sequence
  Description of Artificial Sequence: Synthetic oligonucleotide
  Target: SCN9A; (-) strand; PAM type: YTN; PAM sequence: TTT
attttgtgtaatatatattg

SEQ ID NO: 64123 - DNA, 20 bp, Artificial Sequence
  Description of Artificial Sequence: Synthetic oligonucleotide
  Target: SCN9A; (-) strand; PAM type: YTN; PAM sequence: TTT
tattttgtgtaatatatatt

SEQ ID NO: 64124 - DNA, 20 bp, Artificial Sequence
  Description of Artificial Sequence: Synthetic oligonucleotide
  Target: SCN9A; (-) strand; PAM type: YTN; PAM sequence: TTA
ttttattttgtgtaatatat

SEQ ID NO: 64125 - DNA, 20 bp, Artificial Sequence
  Description of Artificial Sequence: Synthetic oligonucleotide
  Target: SCN9A; (-) strand; PAM type: YTN; PAM sequence: TTT
attttattttgtgtaatata

SEQ ID NO: 64126 - DNA, 20 bp, Artificial Sequence
  Description of Artificial Sequence: Synthetic oligonucleotide
  Target: SCN9A; (-) strand; PAM type: YTN; PAM sequence: TTA
tttattttattttgtgtaat

SEQ ID NO: 64127 - DNA, 20 bp, Artificial Sequence
  Description of Artificial Sequence: Synthetic oligonucleotide
  Target: SCN9A; (-) strand; PAM type: YTN; PAM sequence: TTA
taagtagttatttattttat

SEQ ID NO: 64128 - DNA, 20 bp, Artificial Sequence
  Description of Artificial Sequence: Synthetic oligonucleotide
  Target: SCN9A; (-) strand; PAM type: YTN; PAM sequence: TTT
ataagtagttatttatttta

SEQ ID NO: 64129 - DNA, 20 bp, Artificial Sequence
  Description of Artificial Sequence: Synthetic oligonucleotide
  Target: SCN9A; (-) strand; PAM type: YTN; PAM sequence: TTT
tataagtagttatttatttt

SEQ ID NO: 64130 - DNA, 20 bp, Artificial Sequence
  Description of Artificial Sequence: Synthetic oligonucleotide
  Target: SCN9A; (-) strand; PAM type: YTN; PAM sequence: TTC
aaaacacattttataagtag

SEQ ID NO: 64131 - DNA, 20 bp, Artificial Sequence
  Description of Artificial Sequence: Synthetic oligonucleotide
  Target: SCN9A; (-) strand; PAM type: YTN; PAM sequence: TTA
ttcaaaacacattttataag

SEQ ID NO: 64132 - DNA, 20 bp, Artificial Sequence
  Description of Artificial Sequence: Synthetic oligonucleotide
  Target: SCN9A; (-) strand; PAM type: YTN; PAM sequence: TTT
attcaaaacacattttataa

SEQ ID NO: 64133 - DNA, 20 bp, Artificial Sequence
  Description of Artificial Sequence: Synthetic oligonucleotide
  Target: SCN9A; (-) strand; PAM type: YTN; PAM sequence: CTA
tttattcaaaacacatttta

SEQ ID NO: 64134 - DNA, 20 bp, Artificial Sequence
  Description of Artificial Sequence: Synthetic oligonucleotide
  Target: SCN9A; (-) strand; PAM type: YTN; PAM sequence: TTA
agaaaaatcaatacactatt

SEQ ID NO: 64135 - DNA, 20 bp, Artificial Sequence
  Description of Artificial Sequence: Synthetic oligonucleotide
  Target: SCN9A; (-) strand; PAM type: YTN; PAM sequence: TTG
aataattaagaaaaatcaat

SEQ ID NO: 64136 - DNA, 20 bp, Artificial Sequence
  Description of Artificial Sequence: Synthetic oligonucleotide
  Target: SCN9A; (-) strand; PAM type: YTN; PAM sequence: CTA
tagaggattgaataattaag

SEQ ID NO: 64137 - DNA, 20 bp, Artificial Sequence
  Description of Artificial Sequence: Synthetic oligonucleotide
  Target: SCN9A; (-) strand; PAM type: YTN; PAM sequence: TTC
ctatagaggattgaataatt

SEQ ID NO: 64138 - DNA, 20 bp, Artificial Sequence
  Description of Artificial Sequence: Synthetic oligonucleotide
  Target: SCN9A; (-) strand; PAM type: YTN; PAM sequence: TTT
cctatagaggattgaataat

SEQ ID NO: 64139 - DNA, 20 bp, Artificial Sequence
  Description of Artificial Sequence: Synthetic oligonucleotide
  Target: SCN9A; (-) strand; PAM type: YTN; PAM sequence: TTC
caatgtttcctatagaggat

SEQ ID NO: 64140 - DNA, 20 bp, Artificial Sequence
  Description of Artificial Sequence: Synthetic oligonucleotide
  Target: SCN9A; (-) strand; PAM type: YTN; PAM sequence: TTT
ccaatgtttcctatagagga

SEQ ID NO: 64141 - DNA, 20 bp, Artificial Sequence
  Description of Artificial Sequence: Synthetic oligonucleotide
  Target: SCN9A; (-) strand; PAM type: YTN; PAM sequence: TTT
tccaatgtttcctatagagg

SEQ ID NO: 64142 - DNA, 20 bp, Artificial Sequence
  Description of Artificial Sequence: Synthetic oligonucleotide
  Target: SCN9A; (-) strand; PAM type: YTN; PAM sequence: TTT
ttccaatgtttcctatagag

SEQ ID NO: 64143 - DNA, 20 bp, Artificial Sequence
  Description of Artificial Sequence: Synthetic oligonucleotide
  Target: SCN9A; (-) strand; PAM type: YTN; PAM sequence: TTT
tttccaatgtttcctataga

SEQ ID NO: 64144 - DNA, 20 bp, Artificial Sequence
  Description of Artificial Sequence: Synthetic oligonucleotide
  Target: SCN9A; (-) strand; PAM type: YTN; PAM sequence: CTG
ttttttccaatgtttcctat

SEQ ID NO: 64145 - DNA, 20 bp, Artificial Sequence
  Description of Artificial Sequence: Synthetic oligonucleotide
  Target: SCN9A; (-) strand; PAM type: YTN; PAM sequence: TTC
tgttttttccaatgtttcct

SEQ ID NO: 64146 - DNA, 20 bp, Artificial Sequence
  Description of Artificial Sequence: Synthetic oligonucleotide
  Target: SCN9A; (-) strand; PAM type: YTN; PAM sequence: CTA
ttctgttttttccaatgttt

SEQ ID NO: 64147 - DNA, 20 bp, Artificial Sequence
  Description of Artificial Sequence: Synthetic oligonucleotide
  Target: SCN9A; (-) strand; PAM type: YTN; PAM sequence: TTG
agcaatatatcaactattct

SEQ ID NO: 64148 - DNA, 20 bp, Artificial Sequence
  Description of Artificial Sequence: Synthetic oligonucleotide
  Target: SCN9A; (-) strand; PAM type: YTN; PAM sequence: TTT
gagcaatatatcaactattc

SEQ ID NO: 64149 - DNA, 20 bp, Artificial Sequence
  Description of Artificial Sequence: Synthetic oligonucleotide
  Target: SCN9A; (-) strand; PAM type: YTN; PAM sequence: TTT
tgagcaatatatcaactatt

SEQ ID NO: 64150 - DNA, 20 bp, Artificial Sequence
  Description of Artificial Sequence: Synthetic oligonucleotide
  Target: SCN9A; (-) strand; PAM type: YTN; PAM sequence: TTA
aacccataggttttgagcaa

SEQ ID NO: 64151 - DNA, 20 bp, Artificial Sequence
  Description of Artificial Sequence: Synthetic oligonucleotide
  Target: SCN9A; (-) strand; PAM type: YTN; PAM sequence: TTA
ggttaaacccataggttttg

SEQ ID NO: 64152 - DNA, 20 bp, Artificial Sequence
  Description of Artificial Sequence: Synthetic oligonucleotide
  Target: SCN9A; (-) strand; PAM type: YTN; PAM sequence: TTT
aggttaaacccataggtttt

SEQ ID NO: 64153 - DNA, 20 bp, Artificial Sequence
  Description of Artificial Sequence: Synthetic oligonucleotide
  Target: SCN9A; (-) strand; PAM type: YTN; PAM sequence: TTA
tgatttaggttaaacccata

SEQ ID NO: 64154 - DNA, 20 bp, Artificial Sequence
  Description of Artificial Sequence: Synthetic oligonucleotide
  Target: SCN9A; (-) strand; PAM type: YTN; PAM sequence: CTT
atgatttaggttaaacccat

SEQ ID NO: 64155 - DNA, 20 bp, Artificial Sequence
  Description of Artificial Sequence: Synthetic oligonucleotide
  Target: SCN9A; (-) strand; PAM type: YTN; PAM sequence: CTA
acttatgatttaggttaaac

SEQ ID NO: 64156 - DNA, 20 bp, Artificial Sequence
  Description of Artificial Sequence: Synthetic oligonucleotide
  Target: SCN9A; (-) strand; PAM type: YTN; PAM sequence: CTG
gctaacttatgatttaggtt

SEQ ID NO: 64157 - DNA, 20 bp, Artificial Sequence
  Description of Artificial Sequence: Synthetic oligonucleotide
  Target: SCN9A; (-) strand; PAM type: YTN; PAM sequence: TTC
tggctaacttatgatttagg

SEQ ID NO: 64158 - DNA, 20 bp, Artificial Sequence
  Description of Artificial Sequence: Synthetic oligonucleotide
  Target: SCN9A; (-) strand; PAM type: YTN; PAM sequence: CTA
aataataggttctggctaac

SEQ ID NO: 64159 - DNA, 20 bp, Artificial Sequence
  Description of Artificial Sequence: Synthetic oligonucleotide
  Target: SCN9A; (-) strand; PAM type: YTN; PAM sequence: TTC
taaataataggttctggcta

SEQ ID NO: 64160 - DNA, 20 bp, Artificial Sequence
  Description of Artificial Sequence: Synthetic oligonucleotide
  Target: SCN9A; (-) strand; PAM type: YTN; PAM sequence: TTT
ctaaataataggttctggct

SEQ ID NO: 64161 - DNA, 20 bp, Artificial Sequence
  Description of Artificial Sequence: Synthetic oligonucleotide
  Target: SCN9A; (-) strand; PAM type: YTN; PAM sequence: TTT
tctaaataataggttctggc

SEQ ID NO: 64162 - DNA, 20 bp, Artificial Sequence
  Description of Artificial Sequence: Synthetic oligonucleotide
  Target: SCN9A; (-) strand; PAM type: YTN; PAM sequence: TTG
cacagaaaacaattttctaa

SEQ ID NO: 64163 - DNA, 20 bp, Artificial Sequence
  Description of Artificial Sequence: Synthetic oligonucleotide
  Target: SCN9A; (-) strand; PAM type: YTN; PAM sequence: TTT
gcacagaaaacaattttcta

SEQ ID NO: 64164 - DNA, 20 bp, Artificial Sequence
  Description of Artificial Sequence: Synthetic oligonucleotide
  Target: SCN9A; (-) strand; PAM type: YTN; PAM sequence: TTT
tgcacagaaaacaattttct

SEQ ID NO: 64165 - DNA, 20 bp, Artificial Sequence
  Description of Artificial Sequence: Synthetic oligonucleotide
  Target: SCN9A; (-) strand; PAM type: YTN; PAM sequence: TTT
ttgcacagaaaacaattttc

SEQ ID NO: 64166 - DNA, 20 bp, Artificial Sequence
  Description of Artificial Sequence: Synthetic oligonucleotide
  Target: SCN9A; (-) strand; PAM type: YTN; PAM sequence: TTC
atttttgcacagaaaacaat

SEQ ID NO: 64167 - DNA, 20 bp, Artificial Sequence
  Description of Artificial Sequence: Synthetic oligonucleotide
  Target: SCN9A; (-) strand; PAM type: YTN; PAM sequence: TTA
ttcatttttgcacagaaaac

SEQ ID NO: 64168 - DNA, 20 bp, Artificial Sequence
  Description of Artificial Sequence: Synthetic oligonucleotide
  Target: SCN9A; (-) strand; PAM type: YTN; PAM sequence: CTT
attcatttttgcacagaaaa

SEQ ID NO: 64169 - DNA, 20 bp, Artificial Sequence
  Description of Artificial Sequence: Synthetic oligonucleotide
  Target: SCN9A; (-) strand; PAM type: YTN; PAM sequence: TTA
atcttattcatttttgcaca

SEQ ID NO: 64170 - DNA, 20 bp, Artificial Sequence
  Description of Artificial Sequence: Synthetic oligonucleotide
  Target: SCN9A; (-) strand; PAM type: YTN; PAM sequence: CTT
aatcttattcatttttgcac

SEQ ID NO: 64171 - DNA, 20 bp, Artificial Sequence
  Description of Artificial Sequence: Synthetic oligonucleotide
  Target: SCN9A; (-) strand; PAM type: YTN; PAM sequence: TTA
caaatatgcttaatcttatt

SEQ ID NO: 64172 - DNA, 20 bp, Artificial Sequence
  Description of Artificial Sequence: Synthetic oligonucleotide
  Target: SCN9A; (-) strand; PAM type: YTN; PAM sequence: CTA
gtatacaattacaaatatgc

SEQ ID NO: 64173 - DNA, 20 bp, Artificial Sequence
  Description of Artificial Sequence: Synthetic oligonucleotide
  Target: SCN9A; (-) strand; PAM type: YTN; PAM sequence: TTG
actagtatacaattacaaat

SEQ ID NO: 64174 - DNA, 20 bp, Artificial Sequence
  Description of Artificial Sequence: Synthetic oligonucleotide
  Target: SCN9A; (-) strand; PAM type: YTN; PAM sequence: TTC
aaataattgactagtataca

SEQ ID NO: 64175 - DNA, 20 bp, Artificial Sequence
  Description of Artificial Sequence: Synthetic oligonucleotide
  Target: SCN9A; (-) strand; PAM type: YTN; PAM sequence: TTT
caaataattgactagtatac

SEQ ID NO: 64176 - DNA, 20 bp, Artificial Sequence
  Description of Artificial Sequence: Synthetic oligonucleotide
  Target: SCN9A; (-) strand; PAM type: YTN; PAM sequence: TTT
tcaaataattgactagtata

SEQ ID NO: 64177 - DNA, 20 bp, Artificial Sequence
  Description of Artificial Sequence: Synthetic oligonucleotide
  Target: SCN9A; (-) strand; PAM type: YTN; PAM sequence: TTT
ttcaaataattgactagtat

SEQ ID NO: 64178 - DNA, 20 bp, Artificial Sequence
  Description of Artificial Sequence: Synthetic oligonucleotide
  Target: SCN9A; (-) strand; PAM type: YTN; PAM sequence: TTA
tttttcaaataattgactag

SEQ ID NO: 64179 - DNA, 20 bp, Artificial Sequence
  Description of Artificial Sequence: Synthetic oligonucleotide
  Target: SCN9A; (-) strand; PAM type: YTN; PAM sequence: TTT
atttttcaaataattgacta

SEQ ID NO: 64180 - DNA, 20 bp, Artificial Sequence
  Description of Artificial Sequence: Synthetic oligonucleotide
  Target: SCN9A; (-) strand; PAM type: YTN; PAM sequence: TTC
atttatttttcaaataattg

SEQ ID NO: 64181 - DNA, 20 bp, Artificial Sequence
  Description of Artificial Sequence: Synthetic oligonucleotide
  Target: SCN9A; (-) strand; PAM type: YTN; PAM sequence: CTT
catttatttttcaaataatt

SEQ ID NO: 64182 - DNA, 20 bp, Artificial Sequence
  Description of Artificial Sequence: Synthetic oligonucleotide
  Target: SCN9A; (-) strand; PAM type: YTN; PAM sequence: TTA
gaacttcatttatttttcaa

SEQ ID NO: 64183 - DNA, 20 bp, Artificial Sequence
  Description of Artificial Sequence: Synthetic oligonucleotide
  Target: SCN9A; (-) strand; PAM type: YTN; PAM sequence: TTA
ttagaacttcatttattttt

SEQ ID NO: 64184 - DNA, 20 bp, Artificial Sequence
  Description of Artificial Sequence: Synthetic oligonucleotide
  Target: SCN9A; (-) strand; PAM type: YTN; PAM sequence: TTT
attagaacttcatttatttt

SEQ ID NO: 64185 - DNA, 20 bp, Artificial Sequence
  Description of Artificial Sequence: Synthetic oligonucleotide
  Target: SCN9A; (-) strand; PAM type: YTN; PAM sequence: TTT
tattagaacttcatttattt

SEQ ID NO: 64186 - DNA, 20 bp, Artificial Sequence
  Description of Artificial Sequence: Synthetic oligonucleotide
  Target: SCN9A; (-) strand; PAM type: YTN; PAM sequence: TTA
attttattagaacttcattt

SEQ ID NO: 64187 - DNA, 20 bp, Artificial Sequence
  Description of Artificial Sequence: Synthetic oligonucleotide
  Target: SCN9A; (-) strand; PAM type: YTN; PAM sequence: TTC
atgattaattttattagaac

SEQ ID NO: 64188 - DNA, 20 bp, Artificial Sequence
  Description of Artificial Sequence: Synthetic oligonucleotide
  Target: SCN9A; (-) strand; PAM type: YTN; PAM sequence: TTG
atatcaattcatgattaatt

SEQ ID NO: 64189 - DNA, 20 bp, Artificial Sequence
  Description of Artificial Sequence: Synthetic oligonucleotide
  Target: SCN9A; (-) strand; PAM type: YTN; PAM sequence: TTT
gatatcaattcatgattaat

SEQ ID NO: 64190 - DNA, 20 bp, Artificial Sequence
  Description of Artificial Sequence: Synthetic oligonucleotide
  Target: SCN9A; (-) strand; PAM type: YTN; PAM sequence: TTA
atttgatatcaattcatgat

SEQ ID NO: 64191 - DNA, 20 bp, Artificial Sequence
  Description of Artificial Sequence: Synthetic oligonucleotide
  Target: SCN9A; (-) strand; PAM type: YTN; PAM sequence: TTT
aatttgatatcaattcatga

SEQ ID NO: 64192 - DNA, 20 bp, Artificial Sequence
  Description of Artificial Sequence: Synthetic oligonucleotide
  Target: SCN9A; (-) strand; PAM type: YTN; PAM sequence: TTC
caaaaaagataatgtaaagt

SEQ ID NO: 64193 - DNA, 20 bp, Artificial Sequence
  Description of Artificial Sequence: Synthetic oligonucleotide
  Target: SCN9A; (-) strand; PAM type: YTN; PAM sequence: TTT
ccaaaaaagataatgtaaag

SEQ ID NO: 64194 - DNA, 20 bp, Artificial Sequence
  Description of Artificial Sequence: Synthetic oligonucleotide
  Target: SCN9A; (-) strand; PAM type: YTN; PAM sequence: TTT
tccaaaaaagataatgtaaa

SEQ ID NO: 64195 - DNA, 20 bp, Artificial Sequence
  Description of Artificial Sequence: Synthetic oligonucleotide
  Target: SCN9A; (-) strand; PAM type: YTN; PAM sequence: TTA
ttttccaaaaaagataatgt

SEQ ID NO: 64196 - DNA, 20 bp, Artificial Sequence
  Description of Artificial Sequence: Synthetic oligonucleotide
  Target: SCN9A; (-) strand; PAM type: YTN; PAM sequence: TTG
taatgaaagggatgaacaat

SEQ ID NO: 64197 - DNA, 20 bp, Artificial Sequence
  Description of Artificial Sequence: Synthetic oligonucleotide
  Target: SCN9A; (-) strand; PAM type: YTN; PAM sequence: TTC
attgtaatgaaagggatgaa

SEQ ID NO: 64198 - DNA, 20 bp, Artificial Sequence
  Description of Artificial Sequence: Synthetic oligonucleotide
  Target: SCN9A; (-) strand; PAM type: YTN; PAM sequence: TTT
cattgtaatgaaagggatga

SEQ ID NO: 64199 - DNA, 20 bp, Artificial Sequence
  Description of Artificial Sequence: Synthetic oligonucleotide
  Target: SCN9A; (-) strand; PAM type: YTN; PAM sequence: TTT
tcattgtaatgaaagggatg

SEQ ID NO: 64200 - DNA, 20 bp, Artificial Sequence
  Description of Artificial Sequence: Synthetic oligonucleotide
  Target: SCN9A; (-) strand; PAM type: YTN; PAM sequence: TTT
ttcattgtaatgaaagggat

SEQ ID NO: 64201 - DNA, 20 bp, Artificial Sequence
  Description of Artificial Sequence: Synthetic oligonucleotide
  Target: SCN9A; (-) strand; PAM type: YTN; PAM sequence: TTC
aaatatttttcattgtaatg

SEQ ID NO: 64202 - DNA, 20 bp, Artificial Sequence
  Description of Artificial Sequence: Synthetic oligonucleotide
  Target: SCN9A; (-) strand; PAM type: YTN; PAM sequence: TTT
caaatatttttcattgtaat

SEQ ID NO: 64203 - DNA, 20 bp, Artificial Sequence
  Description of Artificial Sequence: Synthetic oligonucleotide
  Target: SCN9A; (-) strand; PAM type: YTN; PAM sequence: TTC
aaccaacagaaaaagaagat

SEQ ID NO: 64204 - DNA, 20 bp, Artificial Sequence
  Description of Artificial Sequence: Synthetic oligonucleotide
  Target: SCN9A; (-) strand; PAM type: YTN; PAM sequence: TTT
caaccaacagaaaaagaaga

SEQ ID NO: 64205 - DNA, 20 bp, Artificial Sequence
  Description of Artificial Sequence: Synthetic oligonucleotide
  Target: SCN9A; (-) strand; PAM type: YTN; PAM sequence: TTG
gtgtcatcatagataatttc

SEQ ID NO: 64206 - DNA, 20 bp, Artificial Sequence
  Description of Artificial Sequence: Synthetic oligonucleotide
  Target: SCN9A; (-) strand; PAM type: YTN; PAM sequence: TTC
attggtgtcatcatagataa

SEQ ID NO: 64207 - DNA, 20 bp, Artificial Sequence
  Description of Artificial Sequence: Synthetic oligonucleotide
  Target: SCN9A; (-) strand; PAM type: YTN; PAM sequence: TTG
ttcattggtgtcatcataga

SEQ ID NO: 64208 - DNA, 20 bp, Artificial Sequence
  Description of Artificial Sequence: Synthetic oligonucleotide
  Target: SCN9A; (-) strand; PAM type: YTN; PAM sequence: CTT
gttcattggtgtcatcatag

SEQ ID NO: 64209 - DNA, 20 bp, Artificial Sequence
  Description of Artificial Sequence: Synthetic oligonucleotide
  Target: SCN9A; (-) strand; PAM type: YTN; PAM sequence: TTG
aacttgttcattggtgtcat

SEQ ID NO: 64210 - DNA, 20 bp, Artificial Sequence
  Description of Artificial Sequence: Synthetic oligonucleotide
  Target: SCN9A; (-) strand; PAM type: YTN; PAM sequence: TTT
gaacttgttcattggtgtca

SEQ ID NO: 64211 - DNA, 20 bp, Artificial Sequence
  Description of Artificial Sequence: Synthetic oligonucleotide
  Target: SCN9A; (-) strand; PAM type: YTN; PAM sequence: CTT
tgaacttgttcattggtgtc

SEQ ID NO: 64212 - DNA, 20 bp, Artificial Sequence
  Description of Artificial Sequence: Synthetic oligonucleotide
  Target: SCN9A; (-) strand; PAM type: YTN; PAM sequence: TTC
actttgaacttgttcattgg

SEQ ID NO: 64213 - DNA, 20 bp, Artificial Sequence
  Description of Artificial Sequence: Synthetic oligonucleotide
  Target: SCN9A; (-) strand; PAM type: YTN; PAM sequence: CTT
cactttgaacttgttcattg

SEQ ID NO: 64214 - DNA, 20 bp, Artificial Sequence
  Description of Artificial Sequence: Synthetic oligonucleotide
  Target: SCN9A; (-) strand; PAM type: YTN; PAM sequence: TTC
ttcactttgaacttgttcat

SEQ ID NO: 64215 - DNA, 20 bp, Artificial Sequence
  Description of Artificial Sequence: Synthetic oligonucleotide
  Target: SCN9A; (-) strand; PAM type: YTN; PAM sequence: TTG
ggtcattcttcactttgaac

SEQ ID NO: 64216 - DNA, 20 bp, Artificial Sequence
  Description of Artificial Sequence: Synthetic oligonucleotide
  Target: SCN9A; (-) strand; PAM type: YTN; PAM sequence: TTT
gggtcattcttcactttgaa

SEQ ID NO: 64217 - DNA, 20 bp, Artificial Sequence
  Description of Artificial Sequence: Synthetic oligonucleotide
  Target: SCN9A; (-) strand; PAM type: YTN; PAM sequence: CTT
tgggtcattcttcactttga

SEQ ID NO: 64218 - DNA, 20 bp, Artificial Sequence
  Description of Artificial Sequence: Synthetic oligonucleotide
  Target: SCN9A; (-) strand; PAM type: YTN; PAM sequence: TTA
tcatctttgggtcattcttc

SEQ ID NO: 64219 - DNA, 20 bp, Artificial Sequence
  Description of Artificial Sequence: Synthetic oligonucleotide
  Target: SCN9A; (-) strand; PAM type: YTN; PAM sequence: TTT
atcatctttgggtcattctt

SEQ ID NO: 64220 - DNA, 20 bp, Artificial Sequence
  Description of Artificial Sequence: Synthetic oligonucleotide
  Target: SCN9A; (-) strand; PAM type: YTN; PAM sequence: CTT
tatcatctttgggtcattct

SEQ ID NO: 64221 - DNA, 20 bp, Artificial Sequence
  Description of Artificial Sequence: Synthetic oligonucleotide
  Target: SCN9A; (-) strand; PAM type: YTN; PAM sequence: TTG
tcgtctttatcatctttggg

SEQ ID NO: 64222 - DNA, 20 bp, Artificial Sequence
  Description of Artificial Sequence: Synthetic oligonucleotide
  Target: SCN9A; (-) strand; PAM type: YTN; PAM sequence: TTT
gtcgtctttatcatctttgg

SEQ ID NO: 64223 - DNA, 20 bp, Artificial Sequence
  Description of Artificial Sequence: Synthetic oligonucleotide
  Target: SCN9A; (-) strand; PAM type: YTN; PAM sequence: TTT
tgtcgtctttatcatctttg

SEQ ID NO: 64224 - DNA, 20 bp, Artificial Sequence
  Description of Artificial Sequence: Synthetic oligonucleotide
  Target: SCN9A; (-) strand; PAM type: YTN; PAM sequence: TTA
ttttgtcgtctttatcatct

SEQ ID NO: 64225 - DNA, 20 bp, Artificial Sequence
  Description of Artificial Sequence: Synthetic oligonucleotide
  Target: SCN9A; (-) strand; PAM type: YTN; PAM sequence: TTT
attttgtcgtctttatcatc

SEQ ID NO: 64226 - DNA, 20 bp, Artificial Sequence
  Description of Artificial Sequence: Synthetic oligonucleotide
  Target: SCN9A; (-) strand; PAM type: YTN; PAM sequence: CTA
catgtatatttattttgtcg

SEQ ID NO: 64227 - DNA, 20 bp, Artificial Sequence
  Description of Artificial Sequence: Synthetic oligonucleotide
  Target: SCN9A; (-) strand; PAM type: YTN; PAM sequence: CTC
tacatgtatatttattttgt

SEQ ID NO: 64228 - DNA, 20 bp, Artificial Sequence
  Description of Artificial Sequence: Synthetic oligonucleotide
  Target: SCN9A; (-) strand; PAM type: YTN; PAM sequence: TTA
taggtagacaagcagcccaa

SEQ ID NO: 64229 - DNA, 20 bp, Artificial Sequence
  Description of Artificial Sequence: Synthetic oligonucleotide
  Target: SCN9A; (-) strand; PAM type: YTN; PAM sequence: TTT
ataggtagacaagcagccca

SEQ ID NO: 64230 - DNA, 20 bp, Artificial Sequence
  Description of Artificial Sequence: Synthetic oligonucleotide
  Target: SCN9A; (-) strand; PAM type: YTN; PAM sequence: TTT
tataggtagacaagcagccc

SEQ ID NO: 64231 - DNA, 20 bp, Artificial Sequence
  Description of Artificial Sequence: Synthetic oligonucleotide
  Target: SCN9A; (-) strand; PAM type: YTN; PAM sequence: TTG
taaattttataggtagacaa

SEQ ID NO: 64232 - DNA, 20 bp, Artificial Sequence
  Description of Artificial Sequence: Synthetic oligonucleotide
  Target: SCN9A; (-) strand; PAM type: YTN; PAM sequence: TTT
gtaaattttataggtagaca

SEQ ID NO: 64233 - DNA, 20 bp, Artificial Sequence
  Description of Artificial Sequence: Synthetic oligonucleotide
  Target: SCN9A; (-) strand; PAM type: YTN; PAM sequence: TTT
tgtaaattttataggtagac

SEQ ID NO: 64234 - DNA, 20 bp, Artificial Sequence
  Description of Artificial Sequence: Synthetic oligonucleotide
  Target: SCN9A; (-) strand; PAM type: YTN; PAM sequence: CTT
ttgtaaattttataggtaga

SEQ ID NO: 64235 - DNA, 20 bp, Artificial Sequence
  Description of Artificial Sequence: Synthetic oligonucleotide
  Target: SCN9A; (-) strand; PAM type: YTN; PAM sequence: CTA
acttttgtaaattttatagg

SEQ ID NO: 64236 - DNA, 20 bp, Artificial Sequence
  Description of Artificial Sequence: Synthetic oligonucleotide
  Target: SCN9A; (-) strand; PAM type: YTN; PAM sequence: CTG
tccatataatgctaactttt

SEQ ID NO: 64237 - DNA, 20 bp, Artificial Sequence
  Description of Artificial Sequence: Synthetic oligonucleotide
  Target: SCN9A; (-) strand; PAM type: YTN; PAM sequence: TTA
ctgtccatataatgctaact

SEQ ID NO: 64238 - DNA, 20 bp, Artificial Sequence
  Description of Artificial Sequence: Synthetic oligonucleotide
  Target: SCN9A; (-) strand; PAM type: YTN; PAM sequence: CTG
gtcaaaccatgtgaaaaaga

SEQ ID NO: 64239 - DNA, 20 bp, Artificial Sequence
  Description of Artificial Sequence: Synthetic oligonucleotide
  Target: SCN9A; (-) strand; PAM type: YTN; PAM sequence: TTA
cctggtcaaaccatgtgaaa

SEQ ID NO: 64240 - DNA, 20 bp, Artificial Sequence
  Description of Artificial Sequence: Synthetic oligonucleotide
  Target: SCN9A; (-) strand; PAM type: YTN; PAM sequence: TTG
aattacctggtcaaaccatg

SEQ ID NO: 64241 - DNA, 20 bp, Artificial Sequence
  Description of Artificial Sequence: Synthetic oligonucleotide
  Target: SCN9A; (-) strand; PAM type: YTN; PAM sequence: TTT
gaattacctggtcaaaccat

SEQ ID NO: 64242 - DNA, 20 bp, Artificial Sequence
  Description of Artificial Sequence: Synthetic oligonucleotide
  Target: SCN9A; (-) strand; PAM type: YTN; PAM sequence: CTG
tttgaattacctggtcaaac

SEQ ID NO: 64243 - DNA, 20 bp, Artificial Sequence
  Description of Artificial Sequence: Synthetic oligonucleotide
  Target: SCN9A; (-) strand; PAM type: YTN; PAM sequence: CTA
ggatagcactgtttgaatta

SEQ ID NO: 64244 - DNA, 20 bp, Artificial Sequence
  Description of Artificial Sequence: Synthetic oligonucleotide
  Target: SCN9A; (-) strand; PAM type: YTN; PAM sequence: TTA
cctaggatagcactgtttga

SEQ ID NO: 64245 - DNA, 20 bp, Artificial Sequence
  Description of Artificial Sequence: Synthetic oligonucleotide
  Target: SCN9A; (-) strand; PAM type: YTN; PAM sequence: TTT
acctaggatagcactgtttg

SEQ ID NO: 64246 - DNA, 20 bp, Artificial Sequence
  Description of Artificial Sequence: Synthetic oligonucleotide
  Target: SCN9A; (-) strand; PAM type: YTN; PAM sequence: CTA
tgtttacctaggatagcact

SEQ ID NO: 64247 - DNA, 20 bp, Artificial Sequence
  Description of Artificial Sequence: Synthetic oligonucleotide
  Target: SCN9A; (-) strand; PAM type: YTN; PAM sequence: TTA
aatcctatgtttacctagga

SEQ ID NO: 64248 - DNA, 20 bp, Artificial Sequence
  Description of Artificial Sequence: Synthetic oligonucleotide
  Target: SCN9A; (-) strand; PAM type: YTN; PAM sequence: CTT
aaatcctatgtttacctagg

SEQ ID NO: 64249 - DNA, 20 bp, Artificial Sequence
  Description of Artificial Sequence: Synthetic oligonucleotide
  Target: SCN9A; (-) strand; PAM type: YTN; PAM sequence: TTC
ttaaatcctatgtttaccta

SEQ ID NO: 64250 - DNA, 20 bp, Artificial Sequence
  Description of Artificial Sequence: Synthetic oligonucleotide
  Target: SCN9A; (-) strand; PAM type: YTN; PAM sequence: CTT
cttaaatcctatgtttacct

SEQ ID NO: 64251 - DNA, 20 bp, Artificial Sequence
  Description of Artificial Sequence: Synthetic oligonucleotide
  Target: SCN9A; (-) strand; PAM type: YTN; PAM sequence: CTA
tggcttcttaaatcctatgt

SEQ ID NO: 64252 - DNA, 20 bp, Artificial Sequence
  Description of Artificial Sequence: Synthetic oligonucleotide
  Target: SCN9A; (-) strand; PAM type: YTN; PAM sequence: CTC
aacaatgctatggcttctta

SEQ ID NO: 64253 - DNA, 20 bp, Artificial Sequence
  Description of Artificial Sequence: Synthetic oligonucleotide
  Target: SCN9A; (-) strand; PAM type: YTN; PAM sequence: TTA
aacctcaacaatgctatggc

SEQ ID NO: 64254 - DNA, 20 bp, Artificial Sequence
  Description of Artificial Sequence: Synthetic oligonucleotide
  Target: SCN9A; (-) strand; PAM type: YTN; PAM sequence: TTA
tgttaaacctcaacaatgct

SEQ ID NO: 64255 - DNA, 20 bp, Artificial Sequence
  Description of Artificial Sequence: Synthetic oligonucleotide
  Target: SCN9A; (-) strand; PAM type: YTN; PAM sequence: TTA
agagtgattatgttaaacct

SEQ ID NO: 64256 - DNA, 20 bp, Artificial Sequence
  Description of Artificial Sequence: Synthetic oligonucleotide
  Target: SCN9A; (-) strand; PAM type: YTN; PAM sequence: TTG
ttaagagtgattatgttaaa

SEQ ID NO: 64257 - DNA, 20 bp, Artificial Sequence
  Description of Artificial Sequence: Synthetic oligonucleotide
  Target: SCN9A; (-) strand; PAM type: YTN; PAM sequence: TTG
aataaattgttaagagtgat

SEQ ID NO: 64258 - DNA, 20 bp, Artificial Sequence
  Description of Artificial Sequence: Synthetic oligonucleotide
  Target: SCN9A; (-) strand; PAM type: YTN; PAM sequence: TTA
aataataagtatgtaatgaa

SEQ ID NO: 64259 - DNA, 20 bp, Artificial Sequence
  Description of Artificial Sequence: Synthetic oligonucleotide
  Target: SCN9A; (-) strand; PAM type: YTN; PAM sequence: TTA
cataagtatgtaataaatta

SEQ ID NO: 64260 - DNA, 20 bp, Artificial Sequence
  Description of Artificial Sequence: Synthetic oligonucleotide
  Target: SCN9A; (-) strand; PAM type: YTN; PAM sequence: TTA
ttacataagtatgtaataaa

SEQ ID NO: 64261 - DNA, 20 bp, Artificial Sequence
  Description of Artificial Sequence: Synthetic oligonucleotide
  Target: SCN9A; (-) strand; PAM type: YTN; PAM sequence: TTT
attacataagtatgtaataa

SEQ ID NO: 64262 - DNA, 20 bp, Artificial Sequence
  Description of Artificial Sequence: Synthetic oligonucleotide
  Target: SCN9A; (-) strand; PAM type: YTN; PAM sequence: TTA
tttattacataagtatgtaa

SEQ ID NO: 64263 - DNA, 20 bp, Artificial Sequence
  Description of Artificial Sequence: Synthetic oligonucleotide
  Target: SCN9A; (-) strand; PAM type: YTN; PAM sequence: TTA
tattatttattacataagta

SEQ ID NO: 64264 - DNA, 20 bp, Artificial Sequence
  Description of Artificial Sequence: Synthetic oligonucleotide
  Target: SCN9A; (-) strand; PAM type: YTN; PAM sequence: TTG
aagattatattatttattac

SEQ ID NO: 64265 - DNA, 20 bp, Artificial Sequence
  Description of Artificial Sequence: Synthetic oligonucleotide
  Target: SCN9A; (-) strand; PAM type: YTN; PAM sequence: TTT
gaagattatattatttatta

SEQ ID NO: 64266 - DNA, 20 bp, Artificial Sequence
  Description of Artificial Sequence: Synthetic oligonucleotide
  Target: SCN9A; (-) strand; PAM type: YTN; PAM sequence: TTA
tttgaagattatattattta

SEQ ID NO: 64267 - DNA, 20 bp, Artificial Sequence
  Description of Artificial Sequence: Synthetic oligonucleotide
  Target: SCN9A; (-) strand; PAM type: YTN; PAM sequence: TTG
tagttatttgaagattatat

SEQ ID NO: 64268 - DNA, 20 bp, Artificial Sequence
  Description of Artificial Sequence: Synthetic oligonucleotide
  Target: SCN9A; (-) strand; PAM type: YTN; PAM sequence: TTT
gtagttatttgaagattata

SEQ ID NO: 64269 - DNA, 20 bp, Artificial Sequence
  Description of Artificial Sequence: Synthetic oligonucleotide
  Target: SCN9A; (-) strand; PAM type: YTN; PAM sequence: CTT
tgtagttatttgaagattat

SEQ ID NO: 64270 - DNA, 20 bp, Artificial Sequence
  Description of Artificial Sequence: Synthetic oligonucleotide
  Target: SCN9A; (-) strand; PAM type: YTN; PAM sequence: TTA
agccctttgtagttatttga

SEQ ID NO: 64271 - DNA, 20 bp, Artificial Sequence
  Description of Artificial Sequence: Synthetic oligonucleotide
  Target: SCN9A; (-) strand; PAM type: YTN; PAM sequence: CTA
ccaatatgagcacaaatatg

SEQ ID NO: 64272 - DNA, 20 bp, Artificial Sequence
  Description of Artificial Sequence: Synthetic oligonucleotide
  Target: SCN9A; (-) strand; PAM type: YTN; PAM sequence: TTC
ctaccaatatgagcacaaat

SEQ ID NO: 64273 - DNA, 20 bp, Artificial Sequence
  Description of Artificial Sequence: Synthetic oligonucleotide
  Target: SCN9A; (-) strand; PAM type: YTN; PAM sequence: TTT
cctaccaatatgagcacaaa

SEQ ID NO: 64274 - DNA, 20 bp, Artificial Sequence
  Description of Artificial Sequence: Synthetic oligonucleotide
  Target: SCN9A; (-) strand; PAM type: YTN; PAM sequence: TTT
tcctaccaatatgagcacaa

SEQ ID NO: 64275 - DNA, 20 bp, Artificial Sequence
  Description of Artificial Sequence: Synthetic oligonucleotide
  Target: SCN9A; (-) strand; PAM type: YTN; PAM sequence: TTG
aattttcctaccaatatgag

SEQ ID NO: 64276 - DNA, 20 bp, Artificial Sequence
  Description of Artificial Sequence: Synthetic oligonucleotide
  Target: SCN9A; (-) strand; PAM type: YTN; PAM sequence: TTA
ttgaattttcctaccaatat

SEQ ID NO: 64277 - DNA, 20 bp, Artificial Sequence
  Description of Artificial Sequence: Synthetic oligonucleotide
  Target: SCN9A; (-) strand; PAM type: YTN; PAM sequence: TTA
gttattgaattttcctacca

SEQ ID NO: 64278 - DNA, 20 bp, Artificial Sequence
  Description of Artificial Sequence: Synthetic oligonucleotide
  Target: SCN9A; (-) strand; PAM type: YTN; PAM sequence: CTT
agttattgaattttcctacc

SEQ ID NO: 64279 - DNA, 20 bp, Artificial Sequence
  Description of Artificial Sequence: Synthetic oligonucleotide
  Target: SCN9A; (-) strand; PAM type: YTN; PAM sequence: TTG
gaaataacatatacatagta

SEQ ID NO: 64280 - DNA, 20 bp, Artificial Sequence
  Description of Artificial Sequence: Synthetic oligonucleotide
  Target: SCN9A; (-) strand; PAM type: YTN; PAM sequence: TTT
ggaaataacatatacatagt

SEQ ID NO: 64281 - DNA, 20 bp, Artificial Sequence
  Description of Artificial Sequence: Synthetic oligonucleotide
  Target: SCN9A; (-) strand; PAM type: YTN; PAM sequence: TTT
tggaaataacatatacatag

SEQ ID NO: 64282 - DNA, 20 bp, Artificial Sequence
  Description of Artificial Sequence: Synthetic oligonucleotide
  Target: SCN9A; (-) strand; PAM type: YTN; PAM sequence: CTT
ttggaaataacatatacata

SEQ ID NO: 64283 - DNA, 20 bp, Artificial Sequence
  Description of Artificial Sequence: Synthetic oligonucleotide
  Target: SCN9A; (-) strand; PAM type: YTN; PAM sequence: TTA
cagtacttttggaaataaca

SEQ ID NO: 64284 - DNA, 20 bp, Artificial Sequence
  Description of Artificial Sequence: Synthetic oligonucleotide
  Target: SCN9A; (-) strand; PAM type: YTN; PAM sequence: TTT
acagtacttttggaaataac

SEQ ID NO: 64285 - DNA, 20 bp, Artificial Sequence
  Description of Artificial Sequence: Synthetic oligonucleotide
  Target: SCN9A; (-) strand; PAM type: YTN; PAM sequence: CTC
atttacagtacttttggaaa

SEQ ID NO: 64286 - DNA, 20 bp, Artificial Sequence
  Description of Artificial Sequence: Synthetic oligonucleotide
  Target: SCN9A; (-) strand; PAM type: YTN; PAM sequence: TTC
ggaatcaaaagaaaatacat

SEQ ID NO: 64287 - DNA, 20 bp, Artificial Sequence
  Description of Artificial Sequence: Synthetic oligonucleotide
  Target: SCN9A; (-) strand; PAM type: YTN; PAM sequence: TTA
caaaatataataaagatgta

SEQ ID NO: 64288 - DNA, 20 bp, Artificial Sequence
  Description of Artificial Sequence: Synthetic oligonucleotide
  Target: SCN9A; (-) strand; PAM type: YTN; PAM sequence: TTT
acaaaatataataaagatgt

SEQ ID NO: 64289 - DNA, 20 bp, Artificial Sequence
  Description of Artificial Sequence: Synthetic oligonucleotide
  Target: SCN9A; (-) strand; PAM type: YTN; PAM sequence: TTT
tacaaaatataataaagatg

SEQ ID NO: 64290 - DNA, 20 bp, Artificial Sequence
  Description of Artificial Sequence: Synthetic oligonucleotide
  Target: SCN9A; (-) strand; PAM type: YTN; PAM sequence: TTT
ttacaaaatataataaagat

SEQ ID NO: 64291 - DNA, 20 bp, Artificial Sequence
  Description of Artificial Sequence: Synthetic oligonucleotide
  Target: SCN9A; (-) strand; PAM type: YTN; PAM sequence: CTA
ggtaatatttttacaaaata

SEQ ID NO: 64292 - DNA, 20 bp, Artificial Sequence
  Description of Artificial Sequence: Synthetic oligonucleotide
  Target: SCN9A; (-) strand; PAM type: YTN; PAM sequence: CTC
cctaggtaatatttttacaa

SEQ ID NO: 64293 - DNA, 20 bp, Artificial Sequence
  Description of Artificial Sequence: Synthetic oligonucleotide
  Target: SCN9A; (-) strand; PAM type: YTN; PAM sequence: TTA
ctccctaggtaatattttta

SEQ ID NO: 64294 - DNA, 20 bp, Artificial Sequence
  Description of Artificial Sequence: Synthetic oligonucleotide
  Target: SCN9A; (-) strand; PAM type: YTN; PAM sequence: TTA
atgattactccctaggtaat

SEQ ID NO: 64295 - DNA, 20 bp, Artificial Sequence
  Description of Artificial Sequence: Synthetic oligonucleotide
  Target: SCN9A; (-) strand; PAM type: YTN; PAM sequence: TTT
aatgattactccctaggtaa

SEQ ID NO: 64296 - DNA, 20 bp, Artificial Sequence
  Description of Artificial Sequence: Synthetic oligonucleotide
  Target: SCN9A; (-) strand; PAM type: YTN; PAM sequence: CTT
taatgattactccctaggta

SEQ ID NO: 64297 - DNA, 20 bp, Artificial Sequence
  Description of Artificial Sequence: Synthetic oligonucleotide
  Target: SCN9A; (-) strand; PAM type: YTN; PAM sequence: CTA
agaaactttaatgattactc

SEQ ID NO: 64298 - DNA, 20 bp, Artificial Sequence
  Description of Artificial Sequence: Synthetic oligonucleotide
  Target: SCN9A; (-) strand; PAM type: YTN; PAM sequence: TTC
catgctaagaaactttaatg

SEQ ID NO: 64299 - DNA, 20 bp, Artificial Sequence
  Description of Artificial Sequence: Synthetic oligonucleotide
  Target: SCN9A; (-) strand; PAM type: YTN; PAM sequence: TTA
tgtgaaataagttccatgct

SEQ ID NO: 64300 - DNA, 20 bp, Artificial Sequence
  Description of Artificial Sequence: Synthetic oligonucleotide
  Target: SCN9A; (-) strand; PAM type: YTN; PAM sequence: TTT
atgtgaaataagttccatgc

SEQ ID NO: 64301 - DNA, 20 bp, Artificial Sequence
  Description of Artificial Sequence: Synthetic oligonucleotide
  Target: SCN9A; (-) strand; PAM type: YTN; PAM sequence: TTG
gatgagtttatgtgaaataa

SEQ ID NO: 64302 - DNA, 20 bp, Artificial Sequence
  Description of Artificial Sequence: Synthetic oligonucleotide
  Target: SCN9A; (-) strand; PAM type: YTN; PAM sequence: CTT
ggatgagtttatgtgaaata

SEQ ID NO: 64303 - DNA, 20 bp, Artificial Sequence
  Description of Artificial Sequence: Synthetic oligonucleotide
  Target: SCN9A; (-) strand; PAM type: YTN; PAM sequence: TTA
aaacaccttggatgagttta

SEQ ID NO: 64304 - DNA, 20 bp, Artificial Sequence
  Description of Artificial Sequence: Synthetic oligonucleotide
  Target: SCN9A; (-) strand; PAM type: YTN; PAM sequence: TTT
aaaacaccttggatgagttt

SEQ ID NO: 64305 - DNA, 20 bp, Artificial Sequence
  Description of Artificial Sequence: Synthetic oligonucleotide
  Target: SCN9A; (-) strand; PAM type: YTN; PAM sequence: TTA
cagtttaaaacaccttggat

SEQ ID NO: 64306 - DNA, 20 bp, Artificial Sequence
  Description of Artificial Sequence: Synthetic oligonucleotide
  Target: SCN9A; (-) strand; PAM type: YTN; PAM sequence: TTT
acagtttaaaacaccttgga

SEQ ID NO: 64307 - DNA, 20 bp, Artificial Sequence
  Description of Artificial Sequence: Synthetic oligonucleotide
  Target: SCN9A; (-) strand; PAM type: YTN; PAM sequence: TTT
tacagtttaaaacaccttgg

SEQ ID NO: 64308 - DNA, 20 bp, Artificial Sequence
  Description of Artificial Sequence: Synthetic oligonucleotide
  Target: SCN9A; (-) strand; PAM type: YTN; PAM sequence: TTT
ttacagtttaaaacaccttg

SEQ ID NO: 64309 - DNA, 20 bp, Artificial Sequence
  Description of Artificial Sequence: Synthetic oligonucleotide
  Target: SCN9A; (-) strand; PAM type: YTN; PAM sequence: CTG
tttttacagtttaaaacacc

SEQ ID NO: 64310 - DNA, 20 bp, Artificial Sequence
  Description of Artificial Sequence: Synthetic oligonucleotide
  Target: SCN9A; (-) strand; PAM type: YTN; PAM sequence: TTA
ctgtttttacagtttaaaac

SEQ ID NO: 64311 - DNA, 20 bp, Artificial Sequence
  Description of Artificial Sequence: Synthetic oligonucleotide
  Target: SCN9A; (-) strand; PAM type: YTN; PAM sequence: TTT
actgtttttacagtttaaaa

SEQ ID NO: 64312 - DNA, 20 bp, Artificial Sequence
  Description of Artificial Sequence: Synthetic oligonucleotide
  Target: SCN9A; (-) strand; PAM type: YTN; PAM sequence: TTT
tactgtttttacagtttaaa

SEQ ID NO: 64313 - DNA, 20 bp, Artificial Sequence
  Description of Artificial Sequence: Synthetic oligonucleotide
  Target: SCN9A; (-) strand; PAM type: YTN; PAM sequence: CTT
ttactgtttttacagtttaa

SEQ ID NO: 64314 - DNA, 20 bp, Artificial Sequence
  Description of Artificial Sequence: Synthetic oligonucleotide
  Target: SCN9A; (-) strand; PAM type: YTN; PAM sequence: TTA
atgtatagcttttactgttt

SEQ ID NO: 64315 - DNA, 20 bp, Artificial Sequence
  Description of Artificial Sequence: Synthetic oligonucleotide
  Target: SCN9A; (-) strand; PAM type: YTN; PAM sequence: TTT
aatgtatagcttttactgtt

SEQ ID NO: 64316 - DNA, 20 bp, Artificial Sequence
  Description of Artificial Sequence: Synthetic oligonucleotide
  Target: SCN9A; (-) strand; PAM type: YTN; PAM sequence: TTT
taatgtatagcttttactgt

SEQ ID NO: 64317 - DNA, 20 bp, Artificial Sequence
  Description of Artificial Sequence: Synthetic oligonucleotide
  Target: SCN9A; (-) strand; PAM type: YTN; PAM sequence: TTA
tcaaaataaaaataaaataa

SEQ ID NO: 64318 - DNA, 20 bp, Artificial Sequence
  Description of Artificial Sequence: Synthetic oligonucleotide
  Target: SCN9A; (-) strand; PAM type: YTN; PAM sequence: CTT
atcaaaataaaaataaaata

SEQ ID NO: 64319 - DNA, 20 bp, Artificial Sequence
  Description of Artificial Sequence: Synthetic oligonucleotide
  Target: SCN9A; (-) strand; PAM type: YTN; PAM sequence: CTC
agtaaatatgcgcttatcaa

SEQ ID NO: 64320 - DNA, 20 bp, Artificial Sequence
  Description of Artificial Sequence: Synthetic oligonucleotide
  Target: SCN9A; (-) strand; PAM type: YTN; PAM sequence: CTA
aatgctcagtaaatatgcgc

SEQ ID NO: 64321 - DNA, 20 bp, Artificial Sequence
  Description of Artificial Sequence: Synthetic oligonucleotide
  Target: SCN9A; (-) strand; PAM type: YTN; PAM sequence: TTA
ctaaatgctcagtaaatatg

SEQ ID NO: 64322 - DNA, 20 bp, Artificial Sequence
  Description of Artificial Sequence: Synthetic oligonucleotide
  Target: SCN9A; (-) strand; PAM type: YTN; PAM sequence: CTG
gcattactaaatgctcagta

SEQ ID NO: 64323 - DNA, 20 bp, Artificial Sequence
  Description of Artificial Sequence: Synthetic oligonucleotide
  Target: SCN9A; (-) strand; PAM type: YTN; PAM sequence: TTA
gtgcaggctggcattactaa

SEQ ID NO: 64324 - DNA, 20 bp, Artificial Sequence
  Description of Artificial Sequence: Synthetic oligonucleotide
  Target: SCN9A; (-) strand; PAM type: YTN; PAM sequence: CTT
agtgcaggctggcattacta

SEQ ID NO: 64325 - DNA, 20 bp, Artificial Sequence
  Description of Artificial Sequence: Synthetic oligonucleotide
  Target: SCN9A; (-) strand; PAM type: YTN; PAM sequence: TTG
tgaggacccaacaagaaaat

SEQ ID NO: 64326 - DNA, 20 bp, Artificial Sequence
  Description of Artificial Sequence: Synthetic oligonucleotide
  Target: SCN9A; (-) strand; PAM type: YTN; PAM sequence: CTC
catagtgttgtgaggaccca

SEQ ID NO: 64327 - DNA, 20 bp, Artificial Sequence
  Description of Artificial Sequence: Synthetic oligonucleotide
  Target: SCN9A; (-) strand; PAM type: YTN; PAM sequence: CTA
ctccatagtgttgtgaggac

SEQ ID NO: 64328 - DNA, 20 bp, Artificial Sequence
  Description of Artificial Sequence: Synthetic oligonucleotide
  Target: SCN9A; (-) strand; PAM type: YTN; PAM sequence: CTA
caatcatccaatgcctactc

SEQ ID NO: 64329 - DNA, 20 bp, Artificial Sequence
  Description of Artificial Sequence: Synthetic oligonucleotide
  Target: SCN9A; (-) strand; PAM type: YTN; PAM sequence: CTA
ataaatgtctacaatcatcc

SEQ ID NO: 64330 - DNA, 20 bp, Artificial Sequence
  Description of Artificial Sequence: Synthetic oligonucleotide
  Target: SCN9A; (-) strand; PAM type: YTN; PAM sequence: TTG
tctaataaatgtctacaatc

SEQ ID NO: 64331 - DNA, 20 bp, Artificial Sequence
  Description of Artificial Sequence: Synthetic oligonucleotide
  Target: SCN9A; (-) strand; PAM type: YTN; PAM sequence: TTT
gtctaataaatgtctacaat

SEQ ID NO: 64332 - DNA, 20 bp, Artificial Sequence
  Description of Artificial Sequence: Synthetic oligonucleotide
  Target: SCN9A; (-) strand; PAM type: YTN; PAM sequence: CTA
tcatttgtctaataaatgtc

SEQ ID NO: 64333 - DNA, 20 bp, Artificial Sequence
  Description of Artificial Sequence: Synthetic oligonucleotide
  Target: SCN9A; (-) strand; PAM type: YTN; PAM sequence: TTA
atgaatctatcatttgtcta

SEQ ID NO: 64334 - DNA, 20 bp, Artificial Sequence
  Description of Artificial Sequence: Synthetic oligonucleotide
  Target: SCN9A; (-) strand; PAM type: YTN; PAM sequence: TTT
aatgaatctatcatttgtct

SEQ ID NO: 64335 - DNA, 20 bp, Artificial Sequence
  Description of Artificial Sequence: Synthetic oligonucleotide
  Target: SCN9A; (-) strand; PAM type: YTN; PAM sequence: CTA
taatttaatgaatctatcat

SEQ ID NO: 64336 - DNA, 20 bp, Artificial Sequence
  Description of Artificial Sequence: Synthetic oligonucleotide
  Target: SCN9A; (-) strand; PAM type: YTN; PAM sequence: CTA
atctataatttaatgaatct

SEQ ID NO: 64337 - DNA, 20 bp, Artificial Sequence
  Description of Artificial Sequence: Synthetic oligonucleotide
  Target: SCN9A; (-) strand; PAM type: YTN; PAM sequence: TTG
tctaatctataatttaatga

SEQ ID NO: 64338 - DNA, 20 bp, Artificial Sequence
  Description of Artificial Sequence: Synthetic oligonucleotide
  Target: SCN9A; (-) strand; PAM type: YTN; PAM sequence: TTT
gtctaatctataatttaatg

SEQ ID NO: 64339 - DNA, 20 bp, Artificial Sequence
  Description of Artificial Sequence: Synthetic oligonucleotide
  Target: SCN9A; (-) strand; PAM type: YTN; PAM sequence: TTA
tttgtctaatctataattta

SEQ ID NO: 64340 - DNA, 20 bp, Artificial Sequence
  Description of Artificial Sequence: Synthetic oligonucleotide
  Target: SCN9A; (-) strand; PAM type: YTN; PAM sequence: TTT
atttgtctaatctataattt

SEQ ID NO: 64341 - DNA, 20 bp, Artificial Sequence
  Description of Artificial Sequence: Synthetic oligonucleotide
  Target: SCN9A; (-) strand; PAM type: YTN; PAM sequence: TTA
gtttatttgtctaatctata

SEQ ID NO: 64342 - DNA, 20 bp, Artificial Sequence
  Description of Artificial Sequence: Synthetic oligonucleotide
  Target: SCN9A; (-) strand; PAM type: YTN; PAM sequence: CTT
agtttatttgtctaatctat

SEQ ID NO: 64343 - DNA, 20 bp, Artificial Sequence
  Description of Artificial Sequence: Synthetic oligonucleotide
  Target: SCN9A; (-) strand; PAM type: YTN; PAM sequence: TTG
agacttagtttatttgtcta

SEQ ID NO: 64344 - DNA, 20 bp, Artificial Sequence
  Description of Artificial Sequence: Synthetic oligonucleotide
  Target: SCN9A; (-) strand; PAM type: YTN; PAM sequence: CTT
gagacttagtttatttgtct

SEQ ID NO: 64345 - DNA, 20 bp, Artificial Sequence
  Description of Artificial Sequence: Synthetic oligonucleotide
  Target: SCN9A; (-) strand; PAM type: YTN; PAM sequence: TTC
ttgagacttagtttatttgt

SEQ ID NO: 64346 - DNA, 20 bp, Artificial Sequence
  Description of Artificial Sequence: Synthetic oligonucleotide
  Target: SCN9A; (-) strand; PAM type: YTN; PAM sequence: CTT
cttgagacttagtttatttg

SEQ ID NO: 64347 - DNA, 20 bp, Artificial Sequence
  Description of Artificial Sequence: Synthetic oligonucleotide
  Target: SCN9A; (-) strand; PAM type: YTN; PAM sequence: TTA
ccttcttgagacttagttta

SEQ ID NO: 64348 - DNA, 20 bp, Artificial Sequence
  Description of Artificial Sequence: Synthetic oligonucleotide
  Target: SCN9A; (-) strand; PAM type: YTN; PAM sequence: CTT
accttcttgagacttagttt

SEQ ID NO: 64349 - DNA, 20 bp, Artificial Sequence
  Description of Artificial Sequence: Synthetic oligonucleotide
  Target: SCN9A; (-) strand; PAM type: YTN; PAM sequence: TTA
ccttaccttcttgagactta

SEQ ID NO: 64350 - DNA, 20 bp, Artificial Sequence
  Description of Artificial Sequence: Synthetic oligonucleotide
  Target: SCN9A; (-) strand; PAM type: YTN; PAM sequence: TTC
gggcaaattaccttaccttc

SEQ ID NO: 64351 - DNA, 20 bp, Artificial Sequence
  Description of Artificial Sequence: Synthetic oligonucleotide
  Target: SCN9A; (-) strand; PAM type: YTN; PAM sequence: CTT
cgggcaaattaccttacctt

SEQ ID NO: 64352 - DNA, 20 bp, Artificial Sequence
  Description of Artificial Sequence: Synthetic oligonucleotide
  Target: SCN9A; (-) strand; PAM type: YTN; PAM sequence: CTG
acttcgggcaaattacctta

SEQ ID NO: 64353 - DNA, 20 bp, Artificial Sequence
  Description of Artificial Sequence: Synthetic oligonucleotide
  Target: SCN9A; (-) strand; PAM type: YTN; PAM sequence: CTA
caactgacttcgggcaaatt

SEQ ID NO: 64354 - DNA, 20 bp, Artificial Sequence
  Description of Artificial Sequence: Synthetic oligonucleotide
  Target: SCN9A; (-) strand; PAM type: YTN; PAM sequence: CTC
tacaactgacttcgggcaaa

SEQ ID NO: 64355 - DNA, 20 bp, Artificial Sequence
  Description of Artificial Sequence: Synthetic oligonucleotide
  Target: SCN9A; (-) strand; PAM type: YTN; PAM sequence: CTG
taccatatcatccaagctct

SEQ ID NO: 64356 - DNA, 20 bp, Artificial Sequence
  Description of Artificial Sequence: Synthetic oligonucleotide
  Target: SCN9A; (-) strand; PAM type: YTN; PAM sequence: CTA
gctgtaccatatcatccaag

SEQ ID NO: 64357 - DNA, 20 bp, Artificial Sequence
  Description of Artificial Sequence: Synthetic oligonucleotide
  Target: SCN9A; (-) strand; PAM type: YTN; PAM sequence: TTC
tagctgtaccatatcatcca

SEQ ID NO: 64358 - DNA, 20 bp, Artificial Sequence
  Description of Artificial Sequence: Synthetic oligonucleotide
  Target: SCN9A; (-) strand; PAM type: YTN; PAM sequence: TTC
aaattctagctgtaccatat

SEQ ID NO: 64359 - DNA, 20 bp, Artificial Sequence
  Description of Artificial Sequence: Synthetic oligonucleotide
  Target: SCN9A; (-) strand; PAM type: YTN; PAM sequence: CTG
attcaaattctagctgtacc

SEQ ID NO: 64360 - DNA, 20 bp, Artificial Sequence
  Description of Artificial Sequence: Synthetic oligonucleotide
  Target: SCN9A; (-) strand; PAM type: YTN; PAM sequence: TTG
gagatagagcctgattcaaa

SEQ ID NO: 64361 - DNA, 20 bp, Artificial Sequence
  Description of Artificial Sequence: Synthetic oligonucleotide
  Target: SCN9A; (-) strand; PAM type: YTN; PAM sequence: TTG
tgagtacagcagttggagat

SEQ ID NO: 64362 - DNA, 20 bp, Artificial Sequence
  Description of Artificial Sequence: Synthetic oligonucleotide
  Target: SCN9A; (-) strand; PAM type: YTN; PAM sequence: CTA
gtggttgtgagtacagcagt

SEQ ID NO: 64363 - DNA, 20 bp, Artificial Sequence
  Description of Artificial Sequence: Synthetic oligonucleotide
  Target: SCN9A; (-) strand; PAM type: YTN; PAM sequence: CTG
atagtagcctagtggttgtg

SEQ ID NO: 64364 - DNA, 20 bp, Artificial Sequence
  Description of Artificial Sequence: Synthetic oligonucleotide
  Target: SCN9A; (-) strand; PAM type: YTN; PAM sequence: CTC
acatagacaatgaagaacat

SEQ ID NO: 64365 - DNA, 20 bp, Artificial Sequence
  Description of Artificial Sequence: Synthetic oligonucleotide
  Target: SCN9A; (-) strand; PAM type: YTN; PAM sequence: TTG
ggactcacatagacaatgaa

SEQ ID NO: 64366 - DNA, 20 bp, Artificial Sequence
  Description of Artificial Sequence: Synthetic oligonucleotide
  Target: SCN9A; (-) strand; PAM type: YTN; PAM sequence: CTT
gggactcacatagacaatga

SEQ ID NO: 64367 - DNA, 20 bp, Artificial Sequence
  Description of Artificial Sequence: Synthetic oligonucleotide
  Target: SCN9A; (-) strand; PAM type: YTN; PAM sequence: TTC
atgaagcccttgggactcac

SEQ ID NO: 64368 - DNA, 20 bp, Artificial Sequence
  Description of Artificial Sequence: Synthetic oligonucleotide
  Target: SCN9A; (-) strand; PAM type: YTN; PAM sequence: CTT
catgaagcccttgggactca

SEQ ID NO: 64369 - DNA, 20 bp, Artificial Sequence
  Description of Artificial Sequence: Synthetic oligonucleotide
  Target: SCN9A; (-) strand; PAM type: YTN; PAM sequence: CTA
taacttcatgaagcccttgg

SEQ ID NO: 64370 - DNA, 20 bp, Artificial Sequence
  Description of Artificial Sequence: Synthetic oligonucleotide
  Target: SCN9A; (-) strand; PAM type: YTN; PAM sequence: TTC
caaactataacttcatgaag

SEQ ID NO: 64371 - DNA, 20 bp, Artificial Sequence
  Description of Artificial Sequence: Synthetic oligonucleotide
  Target: SCN9A; (-) strand; PAM type: YTN; PAM sequence: TTT
ccaaactataacttcatgaa

SEQ ID NO: 64372 - DNA, 20 bp, Artificial Sequence
  Description of Artificial Sequence: Synthetic oligonucleotide
  Target: SCN9A; (-) strand; PAM type: YTN; PAM sequence: TTC
agtgatttccaaactataac

SEQ ID NO: 64373 - DNA, 20 bp, Artificial Sequence
  Description of Artificial Sequence: Synthetic oligonucleotide
  Target: SCN9A; (-) strand; PAM type: YTN; PAM sequence: TTT
cagtgatttccaaactataa

SEQ ID NO: 64374 - DNA, 20 bp, Artificial Sequence
  Description of Artificial Sequence: Synthetic oligonucleotide
  Target: SCN9A; (-) strand; PAM type: YTN; PAM sequence: TTA
tttcagtgatttccaaacta

SEQ ID NO: 64375 - DNA, 20 bp, Artificial Sequence
  Description of Artificial Sequence: Synthetic oligonucleotide
  Target: SCN9A; (-) strand; PAM type: YTN; PAM sequence: TTT
atttcagtgatttccaaact

SEQ ID NO: 64376 - DNA, 20 bp, Artificial Sequence
  Description of Artificial Sequence: Synthetic oligonucleotide
  Target: SCN9A; (-) strand; PAM type: YTN; PAM sequence: TTA
gtttatttcagtgatttcca

SEQ ID NO: 64377 - DNA, 20 bp, Artificial Sequence
  Description of Artificial Sequence: Synthetic oligonucleotide
  Target: SCN9A; (-) strand; PAM type: YTN; PAM sequence: CTT
agtttatttcagtgatttcc

SEQ ID NO: 64378 - DNA, 20 bp, Artificial Sequence
  Description of Artificial Sequence: Synthetic oligonucleotide
  Target: SCN9A; (-) strand; PAM type: YTN; PAM sequence: TTC
ttagtttatttcagtgattt

SEQ ID NO: 64379 - DNA, 20 bp, Artificial Sequence
  Description of Artificial Sequence: Synthetic oligonucleotide
  Target: SCN9A; (-) strand; PAM type: YTN; PAM sequence: CTT
cttagtttatttcagtgatt

SEQ ID NO: 64380 - DNA, 20 bp, Artificial Sequence
  Description of Artificial Sequence: Synthetic oligonucleotide
  Target: SCN9A; (-) strand; PAM type: YTN; PAM sequence: TTA
aaagcttcttagtttatttc

SEQ ID NO: 64381 - DNA, 20 bp, Artificial Sequence
  Description of Artificial Sequence: Synthetic oligonucleotide
  Target: SCN9A; (-) strand; PAM type: YTN; PAM sequence: TTT
aaaagcttcttagtttattt

SEQ ID NO: 64382 - DNA, 20 bp, Artificial Sequence
  Description of Artificial Sequence: Synthetic oligonucleotide
  Target: SCN9A; (-) strand; PAM type: YTN; PAM sequence: TTT
taaaagcttcttagtttatt

SEQ ID NO: 64383 - DNA, 20 bp, Artificial Sequence
  Description of Artificial Sequence: Synthetic oligonucleotide
  Target: SCN9A; (-) strand; PAM type: YTN; PAM sequence: TTT
ttaaaagcttcttagtttat

SEQ ID NO: 64384 - DNA, 20 bp, Artificial Sequence
  Description of Artificial Sequence: Synthetic oligonucleotide
  Target: SCN9A; (-) strand; PAM type: YTN; PAM sequence: TTA
tttttaaaagcttcttagtt

SEQ ID NO: 64385 - DNA, 20 bp, Artificial Sequence
  Description of Artificial Sequence: Synthetic oligonucleotide
  Target: SCN9A; (-) strand; PAM type: YTN; PAM sequence: TTT
atttttaaaagcttcttagt

SEQ ID NO: 64386 - DNA, 20 bp, Artificial Sequence
  Description of Artificial Sequence: Synthetic oligonucleotide
  Target: SCN9A; (-) strand; PAM type: YTN; PAM sequence: CTT
tatttttaaaagcttcttag

SEQ ID NO: 64387 - DNA, 20 bp, Artificial Sequence
  Description of Artificial Sequence: Synthetic oligonucleotide
  Target: SCN9A; (-) strand; PAM type: YTN; PAM sequence: CTA
aactttatttttaaaagctt

SEQ ID NO: 64388 - DNA, 20 bp, Artificial Sequence
  Description of Artificial Sequence: Synthetic oligonucleotide
  Target: SCN9A; (-) strand; PAM type: YTN; PAM sequence: TTA
gcactaaactttatttttaa

SEQ ID NO: 64389 - DNA, 20 bp, Artificial Sequence
  Description of Artificial Sequence: Synthetic oligonucleotide
  Target: SCN9A; (-) strand; PAM type: YTN; PAM sequence: CTT
agcactaaactttattttta

SEQ ID NO: 64390 - DNA, 20 bp, Artificial Sequence
  Description of Artificial Sequence: Synthetic oligonucleotide
  Target: SCN9A; (-) strand; PAM type: YTN; PAM sequence: TTA
tcttagcactaaactttatt

SEQ ID NO: 64391 - DNA, 20 bp, Artificial Sequence
  Description of Artificial Sequence: Synthetic oligonucleotide
  Target: SCN9A; (-) strand; PAM type: YTN; PAM sequence: TTG
attatcttagcactaaactt

SEQ ID NO: 64392 - DNA, 20 bp, Artificial Sequence
  Description of Artificial Sequence: Synthetic oligonucleotide
  Target: SCN9A; (-) strand; PAM type: YTN; PAM sequence: TTA
atgtaagtattgattatctt

SEQ ID NO: 64393 - DNA, 20 bp, Artificial Sequence
  Description of Artificial Sequence: Synthetic oligonucleotide
  Target: SCN9A; (-) strand; PAM type: YTN; PAM sequence: CTG
ttaatgtaagtattgattat

SEQ ID NO: 64394 - DNA, 20 bp, Artificial Sequence
  Description of Artificial Sequence: Synthetic oligonucleotide
  Target: SCN9A; (-) strand; PAM type: YTN; PAM sequence: TTC
tgttaatgtaagtattgatt

SEQ ID NO: 64395 - DNA, 20 bp, Artificial Sequence
  Description of Artificial Sequence: Synthetic oligonucleotide
  Target: SCN9A; (-) strand; PAM type: YTN; PAM sequence: TTA
tgtatgcagcagtggattct

SEQ ID NO: 64396 - DNA, 20 bp, Artificial Sequence
  Description of Artificial Sequence: Synthetic oligonucleotide
  Target: SCN9A; (-) strand; PAM type: YTN; PAM sequence: TTA
ttatgtatgcagcagtggat

SEQ ID NO: 64397 - DNA, 20 bp, Artificial Sequence
  Description of Artificial Sequence: Synthetic oligonucleotide
  Target: SCN9A; (-) strand; PAM type: YTN; PAM sequence: TTA
agggatggacgattattatg

SEQ ID NO: 64398 - DNA, 20 bp, Artificial Sequence
  Description of Artificial Sequence: Synthetic oligonucleotide
  Target: SCN9A; (-) strand; PAM type: YTN; PAM sequence: TTT
aagggatggacgattattat

SEQ ID NO: 64399 - DNA, 20 bp, Artificial Sequence
  Description of Artificial Sequence: Synthetic oligonucleotide
  Target: SCN9A; (-) strand; PAM type: YTN; PAM sequence: TTT
taagggatggacgattatta

SEQ ID NO: 64400 - DNA, 20 bp, Artificial Sequence
  Description of Artificial Sequence: Synthetic oligonucleotide
  Target: SCN9A; (-) strand; PAM type: YTN; PAM sequence: CTT
ttaagggatggacgattatt

SEQ ID NO: 64401 - DNA, 20 bp, Artificial Sequence
  Description of Artificial Sequence: Synthetic oligonucleotide
  Target: SCN9A; (-) strand; PAM type: YTN; PAM sequence: TTA
aaggcaacttttaagggatg

SEQ ID NO: 64402 - DNA, 20 bp, Artificial Sequence
  Description of Artificial Sequence: Synthetic oligonucleotide
  Target: SCN9A; (-) strand; PAM type: YTN; PAM sequence: CTT
aaaggcaacttttaagggat

SEQ ID NO: 64403 - DNA, 20 bp, Artificial Sequence
  Description of Artificial Sequence: Synthetic oligonucleotide
  Target: SCN9A; (-) strand; PAM type: YTN; PAM sequence: TTC
ttaaaggcaacttttaaggg

SEQ ID NO: 64404 - DNA, 20 bp, Artificial Sequence
  Description of Artificial Sequence: Synthetic oligonucleotide
  Target: SCN9A; (-) strand; PAM type: YTN; PAM sequence: TTA
ttcttaaaggcaacttttaa

SEQ ID NO: 64405 - DNA, 20 bp, Artificial Sequence
  Description of Artificial Sequence: Synthetic oligonucleotide
  Target: SCN9A; (-) strand; PAM type: YTN; PAM sequence: TTA
atgttattcttaaaggcaac

SEQ ID NO: 64406 - DNA, 20 bp, Artificial Sequence
  Description of Artificial Sequence: Synthetic oligonucleotide
  Target: SCN9A; (-) strand; PAM type: YTN; PAM sequence: CTA
ttaatgttattcttaaaggc

SEQ ID NO: 64407 - DNA, 20 bp, Artificial Sequence
  Description of Artificial Sequence: Synthetic oligonucleotide
  Target: SCN9A; (-) strand; PAM type: YTN; PAM sequence: TTC
tattaatgttattcttaaag

SEQ ID NO: 64408 - DNA, 20 bp, Artificial Sequence
  Description of Artificial Sequence: Synthetic oligonucleotide
  Target: SCN9A; (-) strand; PAM type: YTN; PAM sequence: TTC
aaattctattaatgttattc

SEQ ID NO: 64409 - DNA, 20 bp, Artificial Sequence
  Description of Artificial Sequence: Synthetic oligonucleotide
  Target: SCN9A; (-) strand; PAM type: YTN; PAM sequence: TTA
acattcaaattctattaatg

SEQ ID NO: 64410 - DNA, 20 bp, Artificial Sequence
  Description of Artificial Sequence: Synthetic oligonucleotide
  Target: SCN9A; (-) strand; PAM type: YTN; PAM sequence: CTT
aacattcaaattctattaat

SEQ ID NO: 64411 - DNA, 20 bp, Artificial Sequence
  Description of Artificial Sequence: Synthetic oligonucleotide
  Target: SCN9A; (-) strand; PAM type: YTN; PAM sequence: TTA
gaatatgagcttaacattca

SEQ ID NO: 64412 - DNA, 20 bp, Artificial Sequence
  Description of Artificial Sequence: Synthetic oligonucleotide
  Target: SCN9A; (-) strand; PAM type: YTN; PAM sequence: TTT
agaatatgagcttaacattc

SEQ ID NO: 64413 - DNA, 20 bp, Artificial Sequence
  Description of Artificial Sequence: Synthetic oligonucleotide
  Target: SCN9A; (-) strand; PAM type: YTN; PAM sequence: TTT
tagaatatgagcttaacatt

SEQ ID NO: 64414 - DNA, 20 bp, Artificial Sequence
  Description of Artificial Sequence: Synthetic oligonucleotide
  Target: SCN9A; (-) strand; PAM type: YTN; PAM sequence: CTA
ttttagaatatgagcttaac

SEQ ID NO: 64415 - DNA, 20 bp, Artificial Sequence
  Description of Artificial Sequence: Synthetic oligonucleotide
  Target: SCN9A; (-) strand; PAM type: YTN; PAM sequence: TTA
tggctattttagaatatgag

SEQ ID NO: 64416 - DNA, 20 bp, Artificial Sequence
  Description of Artificial Sequence: Synthetic oligonucleotide
  Target: SCN9A; (-) strand; PAM type: YTN; PAM sequence: TTT
atggctattttagaatatga

SEQ ID NO: 64417 - DNA, 20 bp, Artificial Sequence
  Description of Artificial Sequence: Synthetic oligonucleotide
  Target: SCN9A; (-) strand; PAM type: YTN; PAM sequence: CTG
tttatggctattttagaata

SEQ ID NO: 64418 - DNA, 20 bp, Artificial Sequence
  Description of Artificial Sequence: Synthetic oligonucleotide
  Target: SCN9A; (-) strand; PAM type: YTN; PAM sequence: CTC
tgtttatggctattttagaa

SEQ ID NO: 64419 - DNA, 20 bp, Artificial Sequence
  Description of Artificial Sequence: Synthetic oligonucleotide
  Target: SCN9A; (-) strand; PAM type: YTN; PAM sequence: TTA
aacagacaaaactctgttta

SEQ ID NO: 64420 - DNA, 20 bp, Artificial Sequence
  Description of Artificial Sequence: Synthetic oligonucleotide
  Target: SCN9A; (-) strand; PAM type: YTN; PAM sequence: TTG
tggtaacattaaacagacaa

SEQ ID NO: 64421 - DNA, 20 bp, Artificial Sequence
  Description of Artificial Sequence: Synthetic oligonucleotide
  Target: SCN9A; (-) strand; PAM type: YTN; PAM sequence: TTA
ataattgtggtaacattaaa

SEQ ID NO: 64422 - DNA, 20 bp, Artificial Sequence
  Description of Artificial Sequence: Synthetic oligonucleotide
  Target: SCN9A; (-) strand; PAM type: YTN; PAM sequence: CTT
aataattgtggtaacattaa

SEQ ID NO: 64423 - DNA, 20 bp, Artificial Sequence
  Description of Artificial Sequence: Synthetic oligonucleotide
  Target: SCN9A; (-) strand; PAM type: YTN; PAM sequence: TTA
cttaataattgtggtaacat

SEQ ID NO: 64424 - DNA, 20 bp, Artificial Sequence
  Description of Artificial Sequence: Synthetic oligonucleotide
  Target: SCN9A; (-) strand; PAM type: YTN; PAM sequence: CTA
gtattacttaataattgtgg

SEQ ID NO: 64425 - DNA, 20 bp, Artificial Sequence
  Description of Artificial Sequence: Synthetic oligonucleotide
  Target: SCN9A; (-) strand; PAM type: YTN; PAM sequence: TTA
ctagtattacttaataattg

SEQ ID NO: 64426 - DNA, 20 bp, Artificial Sequence
  Description of Artificial Sequence: Synthetic oligonucleotide
  Target: SCN9A; (-) strand; PAM type: YTN; PAM sequence: CTT
actagtattacttaataatt

SEQ ID NO: 64427 - DNA, 20 bp, Artificial Sequence
  Description of Artificial Sequence: Synthetic oligonucleotide
  Target: SCN9A; (-) strand; PAM type: YTN; PAM sequence: TTG
aatacagcaaaacttactag

SEQ ID NO: 64428 - DNA, 20 bp, Artificial Sequence
  Description of Artificial Sequence: Synthetic oligonucleotide
  Target: SCN9A; (-) strand; PAM type: YTN; PAM sequence: TTA
aatggacatgttgaatacag

SEQ ID NO: 64429 - DNA, 20 bp, Artificial Sequence
  Description of Artificial Sequence: Synthetic oligonucleotide
  Target: SCN9A; (-) strand; PAM type: YTN; PAM sequence: TTA
cattaaatggacatgttgaa

SEQ ID NO: 64430 - DNA, 20 bp, Artificial Sequence
  Description of Artificial Sequence: Synthetic oligonucleotide
  Target: SCN9A; (-) strand; PAM type: YTN; PAM sequence: TTT
acattaaatggacatgttga

SEQ ID NO: 64431 - DNA, 20 bp, Artificial Sequence
  Description of Artificial Sequence: Synthetic oligonucleotide
  Target: SCN9A; (-) strand; PAM type: YTN; PAM sequence: CTT
tacattaaatggacatgttg

SEQ ID NO: 64432 - DNA, 20 bp, Artificial Sequence
  Description of Artificial Sequence: Synthetic oligonucleotide
  Target: SCN9A; (-) strand; PAM type: YTN; PAM sequence: TTA
aaaaaatctttacattaaat

SEQ ID NO: 64433 - DNA, 20 bp, Artificial Sequence
  Description of Artificial Sequence: Synthetic oligonucleotide
  Target: SCN9A; (-) strand; PAM type: YTN; PAM sequence: TTT
aaaaaaatctttacattaaa

SEQ ID NO: 64434 - DNA, 20 bp, Artificial Sequence
  Description of Artificial Sequence: Synthetic oligonucleotide
  Target: SCN9A; (-) strand; PAM type: YTN; PAM sequence: TTT
taaaaaaatctttacattaa

SEQ ID NO: 64435 - DNA, 20 bp, Artificial Sequence
  Description of Artificial Sequence: Synthetic oligonucleotide
  Target: SCN9A; (-) strand; PAM type: YTN; PAM sequence: TTT
ttaaaaaaatctttacatta

SEQ ID NO: 64436 - DNA, 20 bp, Artificial Sequence
  Description of Artificial Sequence: Synthetic oligonucleotide
  Target: SCN9A; (-) strand; PAM type: YTN; PAM sequence: CTT
tttaaaaaaatctttacatt

SEQ ID NO: 64437 - DNA, 20 bp, Artificial Sequence
  Description of Artificial Sequence: Synthetic oligonucleotide
  Target: SCN9A; (-) strand; PAM type: YTN; PAM sequence: TTG
ggaatatgtcctttttaaaa

SEQ ID NO: 64438 - DNA, 20 bp, Artificial Sequence
  Description of Artificial Sequence: Synthetic oligonucleotide
  Target: SCN9A; (-) strand; PAM type: YTN; PAM sequence: CTT
gggaatatgtcctttttaaa

SEQ ID NO: 64439 - DNA, 20 bp, Artificial Sequence
  Description of Artificial Sequence: Synthetic oligonucleotide
  Target: SCN9A; (-) strand; PAM type: YTN; PAM sequence: TTA
cttgggaatatgtccttttt

SEQ ID NO: 64440 - DNA, 20 bp, Artificial Sequence
  Description of Artificial Sequence: Synthetic oligonucleotide
  Target: SCN9A; (-) strand; PAM type: YTN; PAM sequence: TTA
gaatgttacttgggaatatg

SEQ ID NO: 64441 - DNA, 20 bp, Artificial Sequence
  Description of Artificial Sequence: Synthetic oligonucleotide
  Target: SCN9A; (-) strand; PAM type: YTN; PAM sequence: TTT
agaatgttacttgggaatat

SEQ ID NO: 64442 - DNA, 20 bp, Artificial Sequence
  Description of Artificial Sequence: Synthetic oligonucleotide
  Target: SCN9A; (-) strand; PAM type: YTN; PAM sequence: CTA
agatttagaatgttacttgg

SEQ ID NO: 64443 - DNA, 20 bp, Artificial Sequence
  Description of Artificial Sequence: Synthetic oligonucleotide
  Target: SCN9A; (-) strand; PAM type: YTN; PAM sequence: CTG
ggactaagatttagaatgtt

SEQ ID NO: 64444 - DNA, 20 bp, Artificial Sequence
  Description of Artificial Sequence: Synthetic oligonucleotide
  Target: SCN9A; (-) strand; PAM type: YTN; PAM sequence: TTA
actgggactaagatttagaa

SEQ ID NO: 64445 - DNA, 20 bp, Artificial Sequence
  Description of Artificial Sequence: Synthetic oligonucleotide
  Target: SCN9A; (-) strand; PAM type: YTN; PAM sequence: TTA
gaaataattaactgggacta

SEQ ID NO: 64446 - DNA, 20 bp, Artificial Sequence
  Description of Artificial Sequence: Synthetic oligonucleotide
  Target: SCN9A; (-) strand; PAM type: YTN; PAM sequence: TTT
agaaataattaactgggact

SEQ ID NO: 64447 - DNA, 20 bp, Artificial Sequence
  Description of Artificial Sequence: Synthetic oligonucleotide
  Target: SCN9A; (-) strand; PAM type: YTN; PAM sequence: CTG
taacaatttagaaataatta

SEQ ID NO: 64448 - DNA, 20 bp, Artificial Sequence
  Description of Artificial Sequence: Synthetic oligonucleotide
  Target: SCN9A; (-) strand; PAM type: YTN; PAM sequence: TTC
acaggcaactgtaacaattt

SEQ ID NO: 64449 - DNA, 20 bp, Artificial Sequence
  Description of Artificial Sequence: Synthetic oligonucleotide
  Target: SCN9A; (-) strand; PAM type: YTN; PAM sequence: TTA
tgtgcgaaattcacaggcaa

SEQ ID NO: 64450 - DNA, 20 bp, Artificial Sequence
  Description of Artificial Sequence: Synthetic oligonucleotide
  Target: SCN9A; (-) strand; PAM type: YTN; PAM sequence: TTA
aaaaataaaaggttatgtgc

SEQ ID NO: 64451 - DNA, 20 bp, Artificial Sequence
  Description of Artificial Sequence: Synthetic oligonucleotide
  Target: SCN9A; (-) strand; PAM type: YTN; PAM sequence: TTT
aaaaaataaaaggttatgtg

SEQ ID NO: 64452 - DNA, 20 bp, Artificial Sequence
  Description of Artificial Sequence: Synthetic oligonucleotide
  Target: SCN9A; (-) strand; PAM type: YTN; PAM sequence: CTT
taaaaaataaaaggttatgt

SEQ ID NO: 64453 - DNA, 20 bp, Artificial Sequence
  Description of Artificial Sequence: Synthetic oligonucleotide
  Target: SCN9A; (-) strand; PAM type: YTN; PAM sequence: TTC
acctttaaaaaataaaaggt

SEQ ID NO: 64454 - DNA, 20 bp, Artificial Sequence
  Description of Artificial Sequence: Synthetic oligonucleotide
  Target: SCN9A; (-) strand; PAM type: YTN; PAM sequence: CTT
cacctttaaaaaataaaagg

SEQ ID NO: 64455 - DNA, 20 bp, Artificial Sequence
  Description of Artificial Sequence: Synthetic oligonucleotide
  Target: SCN9A; (-) strand; PAM type: YTN; PAM sequence: TTC
cttcacctttaaaaaataaa

SEQ ID NO: 64456 - DNA, 20 bp, Artificial Sequence
  Description of Artificial Sequence: Synthetic oligonucleotide
  Target: SCN9A; (-) strand; PAM type: YTN; PAM sequence: TTT
ccttcacctttaaaaaataa

SEQ ID NO: 64457 - DNA, 20 bp, Artificial Sequence
  Description of Artificial Sequence: Synthetic oligonucleotide
  Target: SCN9A; (-) strand; PAM type: YTN; PAM sequence: TTT
tccttcacctttaaaaaata

SEQ ID NO: 64458 - DNA, 20 bp, Artificial Sequence
  Description of Artificial Sequence: Synthetic oligonucleotide
  Target: SCN9A; (-) strand; PAM type: YTN; PAM sequence: TTC
ataaaattttccttcacctt

SEQ ID NO: 64459 - DNA, 20 bp, Artificial Sequence
  Description of Artificial Sequence: Synthetic oligonucleotide
  Target: SCN9A; (-) strand; PAM type: YTN; PAM sequence: TTA
ttcataaaattttccttcac

SEQ ID NO: 64460 - DNA, 20 bp, Artificial Sequence
  Description of Artificial Sequence: Synthetic oligonucleotide
  Target: SCN9A; (-) strand; PAM type: YTN; PAM sequence: CTT
attcataaaattttccttca

SEQ ID NO: 64461 - DNA, 20 bp, Artificial Sequence
  Description of Artificial Sequence: Synthetic oligonucleotide
  Target: SCN9A; (-) strand; PAM type: YTN; PAM sequence: CTG
tcttattcataaaattttcc

SEQ ID NO: 64462 - DNA, 20 bp, Artificial Sequence
  Description of Artificial Sequence: Synthetic oligonucleotide
  Target: SCN9A; (-) strand; PAM type: YTN; PAM sequence: TTC
ctgtcttattcataaaattt

SEQ ID NO: 64463 - DNA, 20 bp, Artificial Sequence
  Description of Artificial Sequence: Synthetic oligonucleotide
  Target: SCN9A; (-) strand; PAM type: YTN; PAM sequence: TTT
cctgtcttattcataaaatt

SEQ ID NO: 64464 - DNA, 20 bp, Artificial Sequence
  Description of Artificial Sequence: Synthetic oligonucleotide
  Target: SCN9A; (-) strand; PAM type: YTN; PAM sequence: TTA
aaaaatggagaaaagatgtt

SEQ ID NO: 64465 - DNA, 20 bp, Artificial Sequence
  Description of Artificial Sequence: Synthetic oligonucleotide
  Target: SCN9A; (-) strand; PAM type: YTN; PAM sequence: TTT
aaaaaatggagaaaagatgt

SEQ ID NO: 64466 - DNA, 20 bp, Artificial Sequence
  Description of Artificial Sequence: Synthetic oligonucleotide
  Target: SCN9A; (-) strand; PAM type: YTN; PAM sequence: CTT
taaaaaatggagaaaagatg

SEQ ID NO: 64467 - DNA, 20 bp, Artificial Sequence
  Description of Artificial Sequence: Synthetic oligonucleotide
  Target: SCN9A; (-) strand; PAM type: YTN; PAM sequence: TTC
ccacaggcatggagaaccct

SEQ ID NO: 64468 - DNA, 20 bp, Artificial Sequence
  Description of Artificial Sequence: Synthetic oligonucleotide
  Target: SCN9A; (-) strand; PAM type: YTN; PAM sequence: CTT
cccacaggcatggagaaccc

SEQ ID NO: 64469 - DNA, 20 bp, Artificial Sequence
  Description of Artificial Sequence: Synthetic oligonucleotide
  Target: SCN9A; (-) strand; PAM type: YTN; PAM sequence: CTA
tgaagggatgagaggaactt

SEQ ID NO: 64470 - DNA, 20 bp, Artificial Sequence
  Description of Artificial Sequence: Synthetic oligonucleotide
  Target: SCN9A; (-) strand; PAM type: YTN; PAM sequence: TTC
acactatgaagggatgagag

SEQ ID NO: 64471 - DNA, 20 bp, Artificial Sequence
  Description of Artificial Sequence: Synthetic oligonucleotide
  Target: SCN9A; (-) strand; PAM type: YTN; PAM sequence: CTT
cacactatgaagggatgaga

SEQ ID NO: 64472 - DNA, 20 bp, Artificial Sequence
  Description of Artificial Sequence: Synthetic oligonucleotide
  Target: SCN9A; (-) strand; PAM type: YTN; PAM sequence: CTG
cttcacactatgaagggatg

SEQ ID NO: 64473 - DNA, 20 bp, Artificial Sequence
  Description of Artificial Sequence: Synthetic oligonucleotide
  Target: SCN9A; (-) strand; PAM type: YTN; PAM sequence: TTC
ctgcttcacactatgaaggg

SEQ ID NO: 64474 - DNA, 20 bp, Artificial Sequence
  Description of Artificial Sequence: Synthetic oligonucleotide
  Target: SCN9A; (-) strand; PAM type: YTN; PAM sequence: CTT
cctgcttcacactatgaagg

SEQ ID NO: 64475 - DNA, 20 bp, Artificial Sequence
  Description of Artificial Sequence: Synthetic oligonucleotide
  Target: SCN9A; (-) strand; PAM type: YTN; PAM sequence: TTG
aacttcctgcttcacactat

SEQ ID NO: 64476 - DNA, 20 bp, Artificial Sequence
  Description of Artificial Sequence: Synthetic oligonucleotide
  Target: SCN9A; (-) strand; PAM type: YTN; PAM sequence: TTT
gaacttcctgcttcacacta

SEQ ID NO: 64477 - DNA, 20 bp, Artificial Sequence
  Description of Artificial Sequence: Synthetic oligonucleotide
  Target: SCN9A; (-) strand; PAM type: YTN; PAM sequence: TTT
tgaacttcctgcttcacact

SEQ ID NO: 64478 - DNA, 20 bp, Artificial Sequence
  Description of Artificial Sequence: Synthetic oligonucleotide
  Target: SCN9A; (-) strand; PAM type: YTN; PAM sequence: TTT
ttgaacttcctgcttcacac

SEQ ID NO: 64479 - DNA, 20 bp, Artificial Sequence
  Description of Artificial Sequence: Synthetic oligonucleotide
  Target: SCN9A; (-) strand; PAM type: YTN; PAM sequence: TTC
aaaaatgaacgtttttgaac

SEQ ID NO: 64480 - DNA, 20 bp, Artificial Sequence
  Description of Artificial Sequence: Synthetic oligonucleotide
  Target: SCN9A; (-) strand; PAM type: YTN; PAM sequence: CTT
caaaaatgaacgtttttgaa

SEQ ID NO: 64481 - DNA, 20 bp, Artificial Sequence
  Description of Artificial Sequence: Synthetic oligonucleotide
  Target: SCN9A; (-) strand; PAM type: YTN; PAM sequence: TTG
cttcaaaaatgaacgttttt

SEQ ID NO: 64482 - DNA, 20 bp, Artificial Sequence
  Description of Artificial Sequence: Synthetic oligonucleotide
  Target: SCN9A; (-) strand; PAM type: YTN; PAM sequence: TTC
aaatattgcttcaaaaatga

SEQ ID NO: 64483 - DNA, 20 bp, Artificial Sequence
  Description of Artificial Sequence: Synthetic oligonucleotide
  Target: SCN9A; (-) strand; PAM type: YTN; PAM sequence: TTG
caccattcaaatattgcttc

SEQ ID NO: 64484 - DNA, 20 bp, Artificial Sequence
  Description of Artificial Sequence: Synthetic oligonucleotide
  Target: SCN9A; (-) strand; PAM type: YTN; PAM sequence: CTT
gcaccattcaaatattgctt

SEQ ID NO: 64485 - DNA, 20 bp, Artificial Sequence
  Description of Artificial Sequence: Synthetic oligonucleotide
  Target: SCN9A; (-) strand; PAM type: YTN; PAM sequence: CTC
ccatcttgcaccattcaaat

SEQ ID NO: 64486 - DNA, 20 bp, Artificial Sequence
  Description of Artificial Sequence: Synthetic oligonucleotide
  Target: SCN9A; (-) strand; PAM type: YTN; PAM sequence: TTG
gtgtcatgtggactcccatc

SEQ ID NO: 64487 - DNA, 20 bp, Artificial Sequence
  Description of Artificial Sequence: Synthetic oligonucleotide
  Target: SCN9A; (-) strand; PAM type: YTN; PAM sequence: TTT
ggtgtcatgtggactcccat

SEQ ID NO: 64488 - DNA, 20 bp, Artificial Sequence
  Description of Artificial Sequence: Synthetic oligonucleotide
  Target: SCN9A; (-) strand; PAM type: YTN; PAM sequence: CTT
tggtgtcatgtggactccca

SEQ ID NO: 64489 - DNA, 20 bp, Artificial Sequence
  Description of Artificial Sequence: Synthetic oligonucleotide
  Target: SCN9A; (-) strand; PAM type: YTN; PAM sequence: CTC
tttggtgtcatgtggactcc

SEQ ID NO: 64490 - DNA, 20 bp, Artificial Sequence
  Description of Artificial Sequence: Synthetic oligonucleotide
  Target: SCN9A; (-) strand; PAM type: YTN; PAM sequence: TTG
actctttggtgtcatgtgga

SEQ ID NO: 64491 - DNA, 20 bp, Artificial Sequence
  Description of Artificial Sequence: Synthetic oligonucleotide
  Target: SCN9A; (-) strand; PAM type: YTN; PAM sequence: TTA
taattgactctttggtgtca

SEQ ID NO: 64492 - DNA, 20 bp, Artificial Sequence
  Description of Artificial Sequence: Synthetic oligonucleotide
  Target: SCN9A; (-) strand; PAM type: YTN; PAM sequence: TTT
ataattgactctttggtgtc

SEQ ID NO: 64493 - DNA, 20 bp, Artificial Sequence
  Description of Artificial Sequence: Synthetic oligonucleotide
  Target: SCN9A; (-) strand; PAM type: YTN; PAM sequence: TTA
atttataattgactctttgg

SEQ ID NO: 64494 - DNA, 20 bp, Artificial Sequence
  Description of Artificial Sequence: Synthetic oligonucleotide
  Target: SCN9A; (-) strand; PAM type: YTN; PAM sequence: TTA
ttaatttataattgactctt

SEQ ID NO: 64495 - DNA, 20 bp, Artificial Sequence
  Description of Artificial Sequence: Synthetic oligonucleotide
  Target: SCN9A; (-) strand; PAM type: YTN; PAM sequence: TTG
agttattaatttataattga

SEQ ID NO: 64496 - DNA, 20 bp, Artificial Sequence
  Description of Artificial Sequence: Synthetic oligonucleotide
  Target: SCN9A; (-) strand; PAM type: YTN; PAM sequence: TTT
gagttattaatttataattg

SEQ ID NO: 64497 - DNA, 20 bp, Artificial Sequence
  Description of Artificial Sequence: Synthetic oligonucleotide
  Target: SCN9A; (-) strand; PAM type: YTN; PAM sequence: TTG
catttgagttattaatttat

SEQ ID NO: 64498 - DNA, 20 bp, Artificial Sequence
  Description of Artificial Sequence: Synthetic oligonucleotide
  Target: SCN9A; (-) strand; PAM type: YTN; PAM sequence: CTG
ttgcatttgagttattaatt

SEQ ID NO: 64499 - DNA, 20 bp, Artificial Sequence
  Description of Artificial Sequence: Synthetic oligonucleotide
  Target: SCN9A; (-) strand; PAM type: YTN; PAM sequence: TTC
tgttgcatttgagttattaa

SEQ ID NO: 64500 - DNA, 20 bp, Artificial Sequence
  Description of Artificial Sequence: Synthetic oligonucleotide
  Target: SCN9A; (-) strand; PAM type: YTN; PAM sequence: CTA
catgaataagaagcatgggt

SEQ ID NO: 64501 - DNA, 20 bp, Artificial Sequence
  Description of Artificial Sequence: Synthetic oligonucleotide
  Target: SCN9A; (-) strand; PAM type: YTN; PAM sequence: TTC
ctacatgaataagaagcatg

SEQ ID NO: 64502 - DNA, 20 bp, Artificial Sequence
  Description of Artificial Sequence: Synthetic oligonucleotide
  Target: SCN9A; (-) strand; PAM type: YTN; PAM sequence: CTA
gaacatgttcctacatgaat

SEQ ID NO: 64503 - DNA, 20 bp, Artificial Sequence
  Description of Artificial Sequence: Synthetic oligonucleotide
  Target: SCN9A; (-) strand; PAM type: YTN; PAM sequence: TTC
ctagaacatgttcctacatg

SEQ ID NO: 64504 - DNA, 20 bp, Artificial Sequence
  Description of Artificial Sequence: Synthetic oligonucleotide
  Target: SCN9A; (-) strand; PAM type: YTN; PAM sequence: TTT
cctagaacatgttcctacat

SEQ ID NO: 64505 - DNA, 20 bp, Artificial Sequence
  Description of Artificial Sequence: Synthetic oligonucleotide
  Target: SCN9A; (-) strand; PAM type: YTN; PAM sequence: CTT
tcctagaacatgttcctaca

SEQ ID NO: 64506 - DNA, 20 bp, Artificial Sequence
  Description of Artificial Sequence: Synthetic oligonucleotide
  Target: SCN9A; (-) strand; PAM type: YTN; PAM sequence: TTG
gtctttcctagaacatgttc

SEQ ID NO: 64507 - DNA, 20 bp, Artificial Sequence
  Description of Artificial Sequence: Synthetic oligonucleotide
  Target: SCN9A; (-) strand; PAM type: YTN; PAM sequence: CTC
aaaaaaaaaaaaaaaaaaaa

SEQ ID NO: 64508 - DNA, 20 bp, Artificial Sequence
  Description of Artificial Sequence: Synthetic oligonucleotide
  Target: SCN9A; (-) strand; PAM type: YTN; PAM sequence: TTG
tctcaaaaaaaaaaaaaaaa

SEQ ID NO: 64509 - DNA, 20 bp, Artificial Sequence
  Description of Artificial Sequence: Synthetic oligonucleotide
  Target: SCN9A; (-) strand; PAM type: YTN; PAM sequence: CTT
gtctcaaaaaaaaaaaaaaa

SEQ ID NO: 64510 - DNA, 20 bp, Artificial Sequence
  Description of Artificial Sequence: Synthetic oligonucleotide
  Target: SCN9A; (-) strand; PAM type: YTN; PAM sequence: CTC
ttgtctcaaaaaaaaaaaaa

SEQ ID NO: 64511 - DNA, 20 bp, Artificial Sequence
  Description of Artificial Sequence: Synthetic oligonucleotide
  Target: SCN9A; (-) strand; PAM type: YTN; PAM sequence: CTA
cagagcgagactcttgtctc

SEQ ID NO: 64512 - DNA, 20 bp, Artificial Sequence
  Description of Artificial Sequence: Synthetic oligonucleotide
  Target: SCN9A; (-) strand; PAM type: YTN; PAM sequence: CTG
ggctacagagcgagactctt

SEQ ID NO: 64513 - DNA, 20 bp, Artificial Sequence
  Description of Artificial Sequence: Synthetic oligonucleotide
  Target: SCN9A; (-) strand; PAM type: YTN; PAM sequence: CTC
cagcctgggctacagagcga

SEQ ID NO: 64514 - DNA, 20 bp, Artificial Sequence
  Description of Artificial Sequence: Synthetic oligonucleotide
  Target: SCN9A; (-) strand; PAM type: YTN; PAM sequence: CTG
cactccagcctgggctacag

SEQ ID NO: 64515 - DNA, 20 bp, Artificial Sequence
  Description of Artificial Sequence: Synthetic oligonucleotide
  Target: SCN9A; (-) strand; PAM type: YTN; PAM sequence: TTG
cagtgggccaagatcgtgcc

SEQ ID NO: 64516 - DNA, 20 bp, Artificial Sequence
  Description of Artificial Sequence: Synthetic oligonucleotide
  Target: SCN9A; (-) strand; PAM type: YTN; PAM sequence: CTG
ggaggcggaggttgcagtgg

SEQ ID NO: 64517 - DNA, 20 bp, Artificial Sequence
  Description of Artificial Sequence: Synthetic oligonucleotide
  Target: SCN9A; (-) strand; PAM type: YTN; PAM sequence: CTG
aggcaggagaatcacgtgaa

SEQ ID NO: 64518 - DNA, 20 bp, Artificial Sequence
  Description of Artificial Sequence: Synthetic oligonucleotide
  Target: SCN9A; (-) strand; PAM type: YTN; PAM sequence: TTG
ggaggctgaggcaggagaat

SEQ ID NO: 64519 - DNA, 20 bp, Artificial Sequence
  Description of Artificial Sequence: Synthetic oligonucleotide
  Target: SCN9A; (-) strand; PAM type: YTN; PAM sequence: CTT
gggaggctgaggcaggagaa

SEQ ID NO: 64520 - DNA, 20 bp, Artificial Sequence
  Description of Artificial Sequence: Synthetic oligonucleotide
  Target: SCN9A; (-) strand; PAM type: YTN; PAM sequence: CTG
cttgggaggctgaggcagga

SEQ ID NO: 64521 - DNA, 20 bp, Artificial Sequence
  Description of Artificial Sequence: Synthetic oligonucleotide
  Target: SCN9A; (-) strand; PAM type: YTN; PAM sequence: CTA
gctgcttgggaggctgaggc

SEQ ID NO: 64522 - DNA, 20 bp, Artificial Sequence
  Description of Artificial Sequence: Synthetic oligonucleotide
  Target: SCN9A; (-) strand; PAM type: YTN; PAM sequence: CTG
taatcctagctgcttgggag

SEQ ID NO: 64523 - DNA, 20 bp, Artificial Sequence
  Description of Artificial Sequence: Synthetic oligonucleotide
  Target: SCN9A; (-) strand; PAM type: YTN; PAM sequence: CTG
ggtgtggtggcaggcgcctg

SEQ ID NO: 64524 - DNA, 20 bp, Artificial Sequence
  Description of Artificial Sequence: Synthetic oligonucleotide
  Target: SCN9A; (-) strand; PAM type: YTN; PAM sequence: TTA
gctgggtgtggtggcaggcg

SEQ ID NO: 64525 - DNA, 20 bp, Artificial Sequence
  Description of Artificial Sequence: Synthetic oligonucleotide
  Target: SCN9A; (-) strand; PAM type: YTN; PAM sequence: CTA
aaaatacaaaaaaattagct

SEQ ID NO: 64526 - DNA, 20 bp, Artificial Sequence
  Description of Artificial Sequence: Synthetic oligonucleotide
  Target: SCN9A; (-) strand; PAM type: YTN; PAM sequence: CTA
ctaaaaatacaaaaaaatta

SEQ ID NO: 64527 - DNA, 20 bp, Artificial Sequence
  Description of Artificial Sequence: Synthetic oligonucleotide
  Target: SCN9A; (-) strand; PAM type: YTN; PAM sequence: CTC
tactaaaaatacaaaaaaat

SEQ ID NO: 64528 - DNA, 20 bp, Artificial Sequence
  Description of Artificial Sequence: Synthetic oligonucleotide
  Target: SCN9A; (-) strand; PAM type: YTN; PAM sequence: CTG
gccaacatagtgaaacccca

SEQ ID NO: 64529 - DNA, 20 bp, Artificial Sequence
  Description of Artificial Sequence: Synthetic oligonucleotide
  Target: SCN9A; (-) strand; PAM type: YTN; PAM sequence: TTC
gagaccagtctggccaacat

SEQ ID NO: 64530 - DNA, 20 bp, Artificial Sequence
  Description of Artificial Sequence: Synthetic oligonucleotide
  Target: SCN9A; (-) strand; PAM type: YTN; PAM sequence: TTG
ggaggccaaggtgggcagat

SEQ ID NO: 64531 - DNA, 20 bp, Artificial Sequence
  Description of Artificial Sequence: Synthetic oligonucleotide
  Target: SCN9A; (-) strand; PAM type: YTN; PAM sequence: TTT
gggaggccaaggtgggcaga

SEQ ID NO: 64532 - DNA, 20 bp, Artificial Sequence
  Description of Artificial Sequence: Synthetic oligonucleotide
  Target: SCN9A; (-) strand; PAM type: YTN; PAM sequence: CTT
tgggaggccaaggtgggcag

SEQ ID NO: 64533 - DNA, 20 bp, Artificial Sequence
  Description of Artificial Sequence: Synthetic oligonucleotide
  Target: SCN9A; (-) strand; PAM type: YTN; PAM sequence: TTC
actttgggaggccaaggtgg

SEQ ID NO: 64534 - DNA, 20 bp, Artificial Sequence
  Description of Artificial Sequence: Synthetic oligonucleotide
  Target: SCN9A; (-) strand; PAM type: YTN; PAM sequence: CTT
cactttgggaggccaaggtg

SEQ ID NO: 64535 - DNA, 20 bp, Artificial Sequence
  Description of Artificial Sequence: Synthetic oligonucleotide
  Target: SCN9A; (-) strand; PAM type: YTN; PAM sequence: CTC
ttcactttgggaggccaagg

SEQ ID NO: 64536 - DNA, 20 bp, Artificial Sequence
  Description of Artificial Sequence: Synthetic oligonucleotide
  Target: SCN9A; (-) strand; PAM type: YTN; PAM sequence: CTG
tagtctcttcactttgggag

SEQ ID NO: 64537 - DNA, 20 bp, Artificial Sequence
  Description of Artificial Sequence: Synthetic oligonucleotide
  Target: SCN9A; (-) strand; PAM type: YTN; PAM sequence: CTC
atgcctgtagtctcttcact

SEQ ID NO: 64538 - DNA, 20 bp, Artificial Sequence
  Description of Artificial Sequence: Synthetic oligonucleotide
  Target: SCN9A; (-) strand; PAM type: YTN; PAM sequence: TTG
gccgggcgcagtggctcatg

SEQ ID NO: 64539 - DNA, 20 bp, Artificial Sequence
  Description of Artificial Sequence: Synthetic oligonucleotide
  Target: SCN9A; (-) strand; PAM type: YTN; PAM sequence: CTT
ggccgggcgcagtggctcat

SEQ ID NO: 64540 - DNA, 20 bp, Artificial Sequence
  Description of Artificial Sequence: Synthetic oligonucleotide
  Target: SCN9A; (-) strand; PAM type: YTN; PAM sequence: TTA
aaacagtgccagtcttggcc

SEQ ID NO: 64541 - DNA, 20 bp, Artificial Sequence
  Description of Artificial Sequence: Synthetic oligonucleotide
  Target: SCN9A; (-) strand; PAM type: YTN; PAM sequence: TTT
aaaacagtgccagtcttggc

SEQ ID NO: 64542 - DNA, 20 bp, Artificial Sequence
  Description of Artificial Sequence: Synthetic oligonucleotide
  Target: SCN9A; (-) strand; PAM type: YTN; PAM sequence: TTT
taaaacagtgccagtcttgg

SEQ ID NO: 64543 - DNA, 20 bp, Artificial Sequence
  Description of Artificial Sequence: Synthetic oligonucleotide
  Target: SCN9A; (-) strand; PAM type: YTN; PAM sequence: TTT
ttaaaacagtgccagtcttg

SEQ ID NO: 64544 - DNA, 20 bp, Artificial Sequence
  Description of Artificial Sequence: Synthetic oligonucleotide
  Target: SCN9A; (-) strand; PAM type: YTN; PAM sequence: CTG
tgtggtttttaaaacagtgc

SEQ ID NO: 64545 - DNA, 20 bp, Artificial Sequence
  Description of Artificial Sequence: Synthetic oligonucleotide
  Target: SCN9A; (-) strand; PAM type: YTN; PAM sequence: TTG
aagataaaatactgtgtggt

SEQ ID NO: 64546 - DNA, 20 bp, Artificial Sequence
  Description of Artificial Sequence: Synthetic oligonucleotide
  Target: SCN9A; (-) strand; PAM type: YTN; PAM sequence: TTA
taaattgaagataaaatact

SEQ ID NO: 64547 - DNA, 20 bp, Artificial Sequence
  Description of Artificial Sequence: Synthetic oligonucleotide
  Target: SCN9A; (-) strand; PAM type: YTN; PAM sequence: TTA
attataaattgaagataaaa

SEQ ID NO: 64548 - DNA, 20 bp, Artificial Sequence
  Description of Artificial Sequence: Synthetic oligonucleotide
  Target: SCN9A; (-) strand; PAM type: YTN; PAM sequence: TTA
aatagtatattaattataaa

SEQ ID NO: 64549 - DNA, 20 bp, Artificial Sequence
  Description of Artificial Sequence: Synthetic oligonucleotide
  Target: SCN9A; (-) strand; PAM type: YTN; PAM sequence: TTT
aaatagtatattaattataa

SEQ ID NO: 64550 - DNA, 20 bp, Artificial Sequence
  Description of Artificial Sequence: Synthetic oligonucleotide
  Target: SCN9A; (-) strand; PAM type: YTN; PAM sequence: CTT
taaatagtatattaattata

SEQ ID NO: 64551 - DNA, 20 bp, Artificial Sequence
  Description of Artificial Sequence: Synthetic oligonucleotide
  Target: SCN9A; (-) strand; PAM type: YTN; PAM sequence: TTC
tttaaatagtatattaatta

SEQ ID NO: 64552 - DNA, 20 bp, Artificial Sequence
  Description of Artificial Sequence: Synthetic oligonucleotide
  Target: SCN9A; (-) strand; PAM type: YTN; PAM sequence: TTA
ttctttaaatagtatattaa

SEQ ID NO: 64553 - DNA, 20 bp, Artificial Sequence
  Description of Artificial Sequence: Synthetic oligonucleotide
  Target: SCN9A; (-) strand; PAM type: YTN; PAM sequence: TTG
gacgaaggatataagttatt

SEQ ID NO: 64554 - DNA, 20 bp, Artificial Sequence
  Description of Artificial Sequence: Synthetic oligonucleotide
  Target: SCN9A; (-) strand; PAM type: YTN; PAM sequence: TTA
atagatattggacgaaggat

SEQ ID NO: 64555 - DNA, 20 bp, Artificial Sequence
  Description of Artificial Sequence: Synthetic oligonucleotide
  Target: SCN9A; (-) strand; PAM type: YTN; PAM sequence: TTT
aatagatattggacgaagga

SEQ ID NO: 64556 - DNA, 20 bp, Artificial Sequence
  Description of Artificial Sequence: Synthetic oligonucleotide
  Target: SCN9A; (-) strand; PAM type: YTN; PAM sequence: TTT
taatagatattggacgaagg

SEQ ID NO: 64557 - DNA, 20 bp, Artificial Sequence
  Description of Artificial Sequence: Synthetic oligonucleotide
  Target: SCN9A; (-) strand; PAM type: YTN; PAM sequence: TTG
gtattttaatagatattgga

SEQ ID NO: 64558 - DNA, 20 bp, Artificial Sequence
  Description of Artificial Sequence: Synthetic oligonucleotide
  Target: SCN9A; (-) strand; PAM type: YTN; PAM sequence: CTT
ggtattttaatagatattgg

SEQ ID NO: 64559 - DNA, 20 bp, Artificial Sequence
  Description of Artificial Sequence: Synthetic oligonucleotide
  Target: SCN9A; (-) strand; PAM type: YTN; PAM sequence: TTC
atgagtgcttggtattttaa

SEQ ID NO: 64560 - DNA, 20 bp, Artificial Sequence
  Description of Artificial Sequence: Synthetic oligonucleotide
  Target: SCN9A; (-) strand; PAM type: YTN; PAM sequence: TTT
catgagtgcttggtatttta

SEQ ID NO: 64561 - DNA, 20 bp, Artificial Sequence
  Description of Artificial Sequence: Synthetic oligonucleotide
  Target: SCN9A; (-) strand; PAM type: YTN; PAM sequence: TTG
taagtgtcccatttcatgag

SEQ ID NO: 64562 - DNA, 20 bp, Artificial Sequence
  Description of Artificial Sequence: Synthetic oligonucleotide
  Target: SCN9A; (-) strand; PAM type: YTN; PAM sequence: TTC
aagttgtaagtgtcccattt

SEQ ID NO: 64563 - DNA, 20 bp, Artificial Sequence
  Description of Artificial Sequence: Synthetic oligonucleotide
  Target: SCN9A; (-) strand; PAM type: YTN; PAM sequence: CTT
caagttgtaagtgtcccatt

SEQ ID NO: 64564 - DNA, 20 bp, Artificial Sequence
  Description of Artificial Sequence: Synthetic oligonucleotide
  Target: SCN9A; (-) strand; PAM type: YTN; PAM sequence: CTG
cttcaagttgtaagtgtccc

SEQ ID NO: 64565 - DNA, 20 bp, Artificial Sequence
  Description of Artificial Sequence: Synthetic oligonucleotide
  Target: SCN9A; (-) strand; PAM type: YTN; PAM sequence: CTC
tgcttcaagttgtaagtgtc

SEQ ID NO: 64566 - DNA, 20 bp, Artificial Sequence
  Description of Artificial Sequence: Synthetic oligonucleotide
  Target: SCN9A; (-) strand; PAM type: YTN; PAM sequence: CTA
tctctgcttcaagttgtaag

SEQ ID NO: 64567 - DNA, 20 bp, Artificial Sequence
  Description of Artificial Sequence: Synthetic oligonucleotide
  Target: SCN9A; (-) strand; PAM type: YTN; PAM sequence: TTA
cctatctctgcttcaagttg

SEQ ID NO: 64568 - DNA, 20 bp, Artificial Sequence
  Description of Artificial Sequence: Synthetic oligonucleotide
  Target: SCN9A; (-) strand; PAM type: YTN; PAM sequence: TTG
gttacctatctctgcttcaa

SEQ ID NO: 64569 - DNA, 20 bp, Artificial Sequence
  Description of Artificial Sequence: Synthetic oligonucleotide
  Target: SCN9A; (-) strand; PAM type: YTN; PAM sequence: CTT
ggttacctatctctgcttca

SEQ ID NO: 64570 - DNA, 20 bp, Artificial Sequence
  Description of Artificial Sequence: Synthetic oligonucleotide
  Target: SCN9A; (-) strand; PAM type: YTN; PAM sequence: TTG
ataatgtcggacttggttac

SEQ ID NO: 64571 - DNA, 20 bp, Artificial Sequence
  Description of Artificial Sequence: Synthetic oligonucleotide
  Target: SCN9A; (-) strand; PAM type: YTN; PAM sequence: TTT
gataatgtcggacttggtta

SEQ ID NO: 64572 - DNA, 20 bp, Artificial Sequence
  Description of Artificial Sequence: Synthetic oligonucleotide
  Target: SCN9A; (-) strand; PAM type: YTN; PAM sequence: CTT
tgataatgtcggacttggtt

SEQ ID NO: 64573 - DNA, 20 bp, Artificial Sequence
  Description of Artificial Sequence: Synthetic oligonucleotide
  Target: SCN9A; (-) strand; PAM type: YTN; PAM sequence: CTG
aaagtgaactttgataatgt

SEQ ID NO: 64574 - DNA, 20 bp, Artificial Sequence
  Description of Artificial Sequence: Synthetic oligonucleotide
  Target: SCN9A; (-) strand; PAM type: YTN; PAM sequence: TTA
gtcaaaatgtgcgatggaaa

SEQ ID NO: 64575 - DNA, 20 bp, Artificial Sequence
  Description of Artificial Sequence: Synthetic oligonucleotide
  Target: SCN9A; (-) strand; PAM type: YTN; PAM sequence: TTA
tgaatgttagtcaaaatgtg

SEQ ID NO: 64576 - DNA, 20 bp, Artificial Sequence
  Description of Artificial Sequence: Synthetic oligonucleotide
  Target: SCN9A; (-) strand; PAM type: YTN; PAM sequence: CTT
atgaatgttagtcaaaatgt

SEQ ID NO: 64577 - DNA, 20 bp, Artificial Sequence
  Description of Artificial Sequence: Synthetic oligonucleotide
  Target: SCN9A; (-) strand; PAM type: YTN; PAM sequence: TTG
cccttatgaatgttagtcaa

SEQ ID NO: 64578 - DNA, 20 bp, Artificial Sequence
  Description of Artificial Sequence: Synthetic oligonucleotide
  Target: SCN9A; (-) strand; PAM type: YTN; PAM sequence: TTT
gcccttatgaatgttagtca

SEQ ID NO: 64579 - DNA, 20 bp, Artificial Sequence
  Description of Artificial Sequence: Synthetic oligonucleotide
  Target: SCN9A; (-) strand; PAM type: YTN; PAM sequence: TTT
tgcccttatgaatgttagtc

SEQ ID NO: 64580 - DNA, 20 bp, Artificial Sequence
  Description of Artificial Sequence: Synthetic oligonucleotide
  Target: SCN9A; (-) strand; PAM type: YTN; PAM sequence: TTC
cgaatgttttgcccttatga

SEQ ID NO: 64581 - DNA, 20 bp, Artificial Sequence
  Description of Artificial Sequence: Synthetic oligonucleotide
  Target: SCN9A; (-) strand; PAM type: YTN; PAM sequence: TTC
caaatcgttccgaatgtttt

SEQ ID NO: 64582 - DNA, 20 bp, Artificial Sequence
  Description of Artificial Sequence: Synthetic oligonucleotide
  Target: SCN9A; (-) strand; PAM type: YTN; PAM sequence: CTG
caagtcaagttccaaatcgt

SEQ ID NO: 64583 - DNA, 20 bp, Artificial Sequence
  Description of Artificial Sequence: Synthetic oligonucleotide
  Target: SCN9A; (-) strand; PAM type: YTN; PAM sequence: TTC
ctgcaagtcaagttccaaat

SEQ ID NO: 64584 - DNA, 20 bp, Artificial Sequence
  Description of Artificial Sequence: Synthetic oligonucleotide
  Target: SCN9A; (-) strand; PAM type: YTN; PAM sequence: TTT
cctgcaagtcaagttccaaa

SEQ ID NO: 64585 - DNA, 20 bp, Artificial Sequence
  Description of Artificial Sequence: Synthetic oligonucleotide
  Target: SCN9A; (-) strand; PAM type: YTN; PAM sequence: TTA
acaccacagatgggtcacgg

SEQ ID NO: 64586 - DNA, 20 bp, Artificial Sequence
  Description of Artificial Sequence: Synthetic oligonucleotide
  Target: SCN9A; (-) strand; PAM type: YTN; PAM sequence: CTA
tgagtgtattaacaccacag

SEQ ID NO: 64587 - DNA, 20 bp, Artificial Sequence
  Description of Artificial Sequence: Synthetic oligonucleotide
  Target: SCN9A; (-) strand; PAM type: YTN; PAM sequence: TTC
tatgagtgtattaacaccac

SEQ ID NO: 64588 - DNA, 20 bp, Artificial Sequence
  Description of Artificial Sequence: Synthetic oligonucleotide
  Target: SCN9A; (-) strand; PAM type: YTN; PAM sequence: CTG
gcaagttctatgagtgtatt

SEQ ID NO: 64589 - DNA, 20 bp, Artificial Sequence
  Description of Artificial Sequence: Synthetic oligonucleotide
  Target: SCN9A; (-) strand; PAM type: YTN; PAM sequence: TTG
ctggcaagttctatgagtgt

SEQ ID NO: 64590 - DNA, 20 bp, Artificial Sequence
  Description of Artificial Sequence: Synthetic oligonucleotide
  Target: SCN9A; (-) strand; PAM type: YTN; PAM sequence: TTT
gctggcaagttctatgagtg

SEQ ID NO: 64591 - DNA, 20 bp, Artificial Sequence
  Description of Artificial Sequence: Synthetic oligonucleotide
  Target: SCN9A; (-) strand; PAM type: YTN; PAM sequence: TTG
tttgctggcaagttctatga

SEQ ID NO: 64592 - DNA, 20 bp, Artificial Sequence
  Description of Artificial Sequence: Synthetic oligonucleotide
  Target: SCN9A; (-) strand; PAM type: YTN; PAM sequence: TTT
gtttgctggcaagttctatg

SEQ ID NO: 64593 - DNA, 20 bp, Artificial Sequence
  Description of Artificial Sequence: Synthetic oligonucleotide
  Target: SCN9A; (-) strand; PAM type: YTN; PAM sequence: TTC
agcatcatgggagtaaattt

SEQ ID NO: 64594 - DNA, 20 bp, Artificial Sequence
  Description of Artificial Sequence: Synthetic oligonucleotide
  Target: SCN9A; (-) strand; PAM type: YTN; PAM sequence: CTG
atattcagcatcatgggagt

SEQ ID NO: 64595 - DNA, 20 bp, Artificial Sequence
  Description of Artificial Sequence: Synthetic oligonucleotide
  Target: SCN9A; (-) strand; PAM type: YTN; PAM sequence: CTG
gctgatattcagcatcatgg

SEQ ID NO: 64596 - DNA, 20 bp, Artificial Sequence
  Description of Artificial Sequence: Synthetic oligonucleotide
  Target: SCN9A; (-) strand; PAM type: YTN; PAM sequence: TTC
tggctgatattcagcatcat

SEQ ID NO: 64597 - DNA, 20 bp, Artificial Sequence
  Description of Artificial Sequence: Synthetic oligonucleotide
  Target: SCN9A; (-) strand; PAM type: YTN; PAM sequence: TTA
tattctggctgatattcagc

SEQ ID NO: 64598 - DNA, 20 bp, Artificial Sequence
  Description of Artificial Sequence: Synthetic oligonucleotide
  Target: SCN9A; (-) strand; PAM type: YTN; PAM sequence: CTT
atattctggctgatattcag

SEQ ID NO: 64599 - DNA, 20 bp, Artificial Sequence
  Description of Artificial Sequence: Synthetic oligonucleotide
  Target: SCN9A; (-) strand; PAM type: YTN; PAM sequence: TTG
tgtgtcttatattctggctg

SEQ ID NO: 64600 - DNA, 20 bp, Artificial Sequence
  Description of Artificial Sequence: Synthetic oligonucleotide
  Target: SCN9A; (-) strand; PAM type: YTN; PAM sequence: CTT
gtgtgtcttatattctggct

SEQ ID NO: 64601 - DNA, 20 bp, Artificial Sequence
  Description of Artificial Sequence: Synthetic oligonucleotide
  Target: SCN9A; (-) strand; PAM type: YTN; PAM sequence: CTA
cttgtgtgtcttatattctg

SEQ ID NO: 64602 - DNA, 20 bp, Artificial Sequence
  Description of Artificial Sequence: Synthetic oligonucleotide
  Target: SCN9A; (-) strand; PAM type: YTN; PAM sequence: TTC
catcatgaatgtgctacttg

SEQ ID NO: 64603 - DNA, 20 bp, Artificial Sequence
  Description of Artificial Sequence: Synthetic oligonucleotide
  Target: SCN9A; (-) strand; PAM type: YTN; PAM sequence: CTT
ccatcatgaatgtgctactt

SEQ ID NO: 64604 - DNA, 20 bp, Artificial Sequence
  Description of Artificial Sequence: Synthetic oligonucleotide
  Target: SCN9A; (-) strand; PAM type: YTN; PAM sequence: TTC
cttccatcatgaatgtgcta

SEQ ID NO: 64605 - DNA, 20 bp, Artificial Sequence
  Description of Artificial Sequence: Synthetic oligonucleotide
  Target: SCN9A; (-) strand; PAM type: YTN; PAM sequence: CTC
ataggagcaattccttccat

SEQ ID NO: 64606 - DNA, 20 bp, Artificial Sequence
  Description of Artificial Sequence: Synthetic oligonucleotide
  Target: SCN9A; (-) strand; PAM type: YTN; PAM sequence: TTG
tgaatgcactcataggagca

SEQ ID NO: 64607 - DNA, 20 bp, Artificial Sequence
  Description of Artificial Sequence: Synthetic oligonucleotide
  Target: SCN9A; (-) strand; PAM type: YTN; PAM sequence: CTA
ggtcgttgtgaatgcactca

SEQ ID NO: 64608 - DNA, 20 bp, Artificial Sequence
  Description of Artificial Sequence: Synthetic oligonucleotide
  Target: SCN9A; (-) strand; PAM type: YTN; PAM sequence: TTG
aatactaggtcgttgtgaat

SEQ ID NO: 64609 - DNA, 20 bp, Artificial Sequence
  Description of Artificial Sequence: Synthetic oligonucleotide
  Target: SCN9A; (-) strand; PAM type: YTN; PAM sequence: TTT
gaatactaggtcgttgtgaa

SEQ ID NO: 64610 - DNA, 20 bp, Artificial Sequence
  Description of Artificial Sequence: Synthetic oligonucleotide
  Target: SCN9A; (-) strand; PAM type: YTN; PAM sequence: TTT
tgaatactaggtcgttgtga

SEQ ID NO: 64611 - DNA, 20 bp, Artificial Sequence
  Description of Artificial Sequence: Synthetic oligonucleotide
  Target: SCN9A; (-) strand; PAM type: YTN; PAM sequence: CTT
ttgaatactaggtcgttgtg

SEQ ID NO: 64612 - DNA, 20 bp, Artificial Sequence
  Description of Artificial Sequence: Synthetic oligonucleotide
  Target: SCN9A; (-) strand; PAM type: YTN; PAM sequence: TTC
ttttgaatactaggtcgttg

SEQ ID NO: 64613 - DNA, 20 bp, Artificial Sequence
  Description of Artificial Sequence: Synthetic oligonucleotide
  Target: SCN9A; (-) strand; PAM type: YTN; PAM sequence: TTT
cttttgaatactaggtcgtt

SEQ ID NO: 64614 - DNA, 20 bp, Artificial Sequence
  Description of Artificial Sequence: Synthetic oligonucleotide
  Target: SCN9A; (-) strand; PAM type: YTN; PAM sequence: CTT
tcttttgaatactaggtcgt

SEQ ID NO: 64615 - DNA, 20 bp, Artificial Sequence
  Description of Artificial Sequence: Synthetic oligonucleotide
  Target: SCN9A; (-) strand; PAM type: YTN; PAM sequence: TTC
tttcttttgaatactaggtc

SEQ ID NO: 64616 - DNA, 20 bp, Artificial Sequence
  Description of Artificial Sequence: Synthetic oligonucleotide
  Target: SCN9A; (-) strand; PAM type: YTN; PAM sequence: TTT
ctttcttttgaatactaggt

SEQ ID NO: 64617 - DNA, 20 bp, Artificial Sequence
  Description of Artificial Sequence: Synthetic oligonucleotide
  Target: SCN9A; (-) strand; PAM type: YTN; PAM sequence: TTT
tctttcttttgaatactagg

SEQ ID NO: 64618 - DNA, 20 bp, Artificial Sequence
  Description of Artificial Sequence: Synthetic oligonucleotide
  Target: SCN9A; (-) strand; PAM type: YTN; PAM sequence: CTT
ttctttcttttgaatactag

SEQ ID NO: 64619 - DNA, 20 bp, Artificial Sequence
  Description of Artificial Sequence: Synthetic oligonucleotide
  Target: SCN9A; (-) strand; PAM type: YTN; PAM sequence: CTA
atcatgcttttctttctttt

SEQ ID NO: 64620 - DNA, 20 bp, Artificial Sequence
  Description of Artificial Sequence: Synthetic oligonucleotide
  Target: SCN9A; (-) strand; PAM type: YTN; PAM sequence: CTA
atcctaatcatgcttttctt

SEQ ID NO: 64621 - DNA, 20 bp, Artificial Sequence
  Description of Artificial Sequence: Synthetic oligonucleotide
  Target: SCN9A; (-) strand; PAM type: YTN; PAM sequence: TTA
ctaatcctaatcatgctttt

SEQ ID NO: 64622 - DNA, 20 bp, Artificial Sequence
  Description of Artificial Sequence: Synthetic oligonucleotide
  Target: SCN9A; (-) strand; PAM type: YTN; PAM sequence: CTT
actaatcctaatcatgcttt

SEQ ID NO: 64623 - DNA, 20 bp, Artificial Sequence
  Description of Artificial Sequence: Synthetic oligonucleotide
  Target: SCN9A; (-) strand; PAM type: YTN; PAM sequence: TTA
acatcttactaatcctaatc

SEQ ID NO: 64624 - DNA, 20 bp, Artificial Sequence
  Description of Artificial Sequence: Synthetic oligonucleotide
  Target: SCN9A; (-) strand; PAM type: YTN; PAM sequence: TTT
aacatcttactaatcctaat

SEQ ID NO: 64625 - DNA, 20 bp, Artificial Sequence
  Description of Artificial Sequence: Synthetic oligonucleotide
  Target: SCN9A; (-) strand; PAM type: YTN; PAM sequence: CTA
tttaacatcttactaatcct

SEQ ID NO: 64626 - DNA, 20 bp, Artificial Sequence
  Description of Artificial Sequence: Synthetic oligonucleotide
  Target: SCN9A; (-) strand; PAM type: YTN; PAM sequence: TTG
cctatttaacatcttactaa

SEQ ID NO: 64627 - DNA, 20 bp, Artificial Sequence
  Description of Artificial Sequence: Synthetic oligonucleotide
  Target: SCN9A; (-) strand; PAM type: YTN; PAM sequence: TTC
atgttgcctatttaacatct

SEQ ID NO: 64628 - DNA, 20 bp, Artificial Sequence
  Description of Artificial Sequence: Synthetic oligonucleotide
  Target: SCN9A; (-) strand; PAM type: YTN; PAM sequence: TTT
catgttgcctatttaacatc

SEQ ID NO: 64629 - DNA, 20 bp, Artificial Sequence
  Description of Artificial Sequence: Synthetic oligonucleotide
  Target: SCN9A; (-) strand; PAM type: YTN; PAM sequence: CTT
tcatgttgcctatttaacat

SEQ ID NO: 64630 - DNA, 20 bp, Artificial Sequence
  Description of Artificial Sequence: Synthetic oligonucleotide
  Target: SCN9A; (-) strand; PAM type: YTN; PAM sequence: TTC
tttcatgttgcctatttaac

SEQ ID NO: 64631 - DNA, 20 bp, Artificial Sequence
  Description of Artificial Sequence: Synthetic oligonucleotide
  Target: SCN9A; (-) strand; PAM type: YTN; PAM sequence: TTT
ctttcatgttgcctatttaa

SEQ ID NO: 64632 - DNA, 20 bp, Artificial Sequence
  Description of Artificial Sequence: Synthetic oligonucleotide
  Target: SCN9A; (-) strand; PAM type: YTN; PAM sequence: CTG
catggcatttctttcatgtt

SEQ ID NO: 64633 - DNA, 20 bp, Artificial Sequence
  Description of Artificial Sequence: Synthetic oligonucleotide
  Target: SCN9A; (-) strand; PAM type: YTN; PAM sequence: TTA
tgtctgcatggcatttcttt

SEQ ID NO: 64634 - DNA, 20 bp, Artificial Sequence
  Description of Artificial Sequence: Synthetic oligonucleotide
  Target: SCN9A; (-) strand; PAM type: YTN; PAM sequence: TTT
atgtctgcatggcatttctt

SEQ ID NO: 64635 - DNA, 20 bp, Artificial Sequence
  Description of Artificial Sequence: Synthetic oligonucleotide
  Target: SCN9A; (-) strand; PAM type: YTN; PAM sequence: TTA
tttatgtctgcatggcattt

SEQ ID NO: 64636 - DNA, 20 bp, Artificial Sequence
  Description of Artificial Sequence: Synthetic oligonucleotide
  Target: SCN9A; (-) strand; PAM type: YTN; PAM sequence: TTT
atttatgtctgcatggcatt

SEQ ID NO: 64637 - DNA, 20 bp, Artificial Sequence
  Description of Artificial Sequence: Synthetic oligonucleotide
  Target: SCN9A; (-) strand; PAM type: YTN; PAM sequence: CTA
atttatttatgtctgcatgg

SEQ ID NO: 64638 - DNA, 20 bp, Artificial Sequence
  Description of Artificial Sequence: Synthetic oligonucleotide
  Target: SCN9A; (-) strand; PAM type: YTN; PAM sequence: TTC
taatttatttatgtctgcat

SEQ ID NO: 64639 - DNA, 20 bp, Artificial Sequence
  Description of Artificial Sequence: Synthetic oligonucleotide
  Target: SCN9A; (-) strand; PAM type: YTN; PAM sequence: TTT
ctaatttatttatgtctgca

SEQ ID NO: 64640 - DNA, 20 bp, Artificial Sequence
  Description of Artificial Sequence: Synthetic oligonucleotide
  Target: SCN9A; (-) strand; PAM type: YTN; PAM sequence: TTT
tctaatttatttatgtctgc

SEQ ID NO: 64641 - DNA, 20 bp, Artificial Sequence
  Description of Artificial Sequence: Synthetic oligonucleotide
  Target: SCN9A; (-) strand; PAM type: YTN; PAM sequence: CTT
ttctaatttatttatgtctg

SEQ ID NO: 64642 - DNA, 20 bp, Artificial Sequence
  Description of Artificial Sequence: Synthetic oligonucleotide
  Target: SCN9A; (-) strand; PAM type: YTN; PAM sequence: TTA
agggcggcttttctaattta

SEQ ID NO: 64643 - DNA, 20 bp, Artificial Sequence
  Description of Artificial Sequence: Synthetic oligonucleotide
  Target: SCN9A; (-) strand; PAM type: YTN; PAM sequence: TTT
aagggcggcttttctaattt

SEQ ID NO: 64644 - DNA, 20 bp, Artificial Sequence
  Description of Artificial Sequence: Synthetic oligonucleotide
  Target: SCN9A; (-) strand; PAM type: YTN; PAM sequence: TTA
gatatttaagggcggctttt

SEQ ID NO: 64645 - DNA, 20 bp, Artificial Sequence
  Description of Artificial Sequence: Synthetic oligonucleotide
  Target: SCN9A; (-) strand; PAM type: YTN; PAM sequence: CTT
agatatttaagggcggcttt

SEQ ID NO: 64646 - DNA, 20 bp, Artificial Sequence
  Description of Artificial Sequence: Synthetic oligonucleotide
  Target: SCN9A; (-) strand; PAM type: YTN; PAM sequence: TTG
atgtcttagatatttaaggg

SEQ ID NO: 64647 - DNA, 20 bp, Artificial Sequence
  Description of Artificial Sequence: Synthetic oligonucleotide
  Target: SCN9A; (-) strand; PAM type: YTN; PAM sequence: TTT
gatgtcttagatatttaagg

SEQ ID NO: 64648 - DNA, 20 bp, Artificial Sequence
  Description of Artificial Sequence: Synthetic oligonucleotide
  Target: SCN9A; (-) strand; PAM type: YTN; PAM sequence: TTG
gtttgatgtcttagatattt

SEQ ID NO: 64649 - DNA, 20 bp, Artificial Sequence
  Description of Artificial Sequence: Synthetic oligonucleotide
  Target: SCN9A; (-) strand; PAM type: YTN; PAM sequence: CTG
gttggtttgatgtcttagat

SEQ ID NO: 64650 - DNA, 20 bp, Artificial Sequence
  Description of Artificial Sequence: Synthetic oligonucleotide
  Target: SCN9A; (-) strand; PAM type: YTN; PAM sequence: TTA
ataaacatgagtcggctggt

SEQ ID NO: 64651 - DNA, 20 bp, Artificial Sequence
  Description of Artificial Sequence: Synthetic oligonucleotide
  Target: SCN9A; (-) strand; PAM type: YTN; PAM sequence: TTT
aataaacatgagtcggctgg

SEQ ID NO: 64652 - DNA, 20 bp, Artificial Sequence
  Description of Artificial Sequence: Synthetic oligonucleotide
  Target: SCN9A; (-) strand; PAM type: YTN; PAM sequence: CTG
agtgtagagtaggcatttaa

SEQ ID NO: 64653 - DNA, 20 bp, Artificial Sequence
  Description of Artificial Sequence: Synthetic oligonucleotide
  Target: SCN9A; (-) strand; PAM type: YTN; PAM sequence: CTG
ctgagtgtagagtaggcatt

SEQ ID NO: 64654 - DNA, 20 bp, Artificial Sequence
  Description of Artificial Sequence: Synthetic oligonucleotide
  Target: SCN9A; (-) strand; PAM type: YTN; PAM sequence: TTG
gcacactgctgagtgtagag

SEQ ID NO: 64655 - DNA, 20 bp, Artificial Sequence
  Description of Artificial Sequence: Synthetic oligonucleotide
  Target: SCN9A; (-) strand; PAM type: YTN; PAM sequence: CTT
ggcacactgctgagtgtaga

SEQ ID NO: 64656 - DNA, 20 bp, Artificial Sequence
  Description of Artificial Sequence: Synthetic oligonucleotide
  Target: SCN9A; (-) strand; PAM type: YTN; PAM sequence: TTG
cttggcacactgctgagtgt

SEQ ID NO: 64657 - DNA, 20 bp, Artificial Sequence
  Description of Artificial Sequence: Synthetic oligonucleotide
  Target: SCN9A; (-) strand; PAM type: YTN; PAM sequence: CTT
gcttggcacactgctgagtg

SEQ ID NO: 64658 - DNA, 20 bp, Artificial Sequence
  Description of Artificial Sequence: Synthetic oligonucleotide
  Target: SCN9A; (-) strand; PAM type: YTN; PAM sequence: TTG
tcttgcttggcacactgctg

SEQ ID NO: 64659 - DNA, 20 bp, Artificial Sequence
  Description of Artificial Sequence: Synthetic oligonucleotide
  Target: SCN9A; (-) strand; PAM type: YTN; PAM sequence: TTT
gtcttgcttggcacactgct

SEQ ID NO: 64660 - DNA, 20 bp, Artificial Sequence
  Description of Artificial Sequence: Synthetic oligonucleotide
  Target: SCN9A; (-) strand; PAM type: YTN; PAM sequence: TTT
tgtcttgcttggcacactgc

SEQ ID NO: 64661 - DNA, 20 bp, Artificial Sequence
  Description of Artificial Sequence: Synthetic oligonucleotide
  Target: SCN9A; (-) strand; PAM type: YTN; PAM sequence: TTA
ttttgtcttgcttggcacac

SEQ ID NO: 64662 - DNA, 20 bp, Artificial Sequence
  Description of Artificial Sequence: Synthetic oligonucleotide
  Target: SCN9A; (-) strand; PAM type: YTN; PAM sequence: CTT
attttgtcttgcttggcaca

SEQ ID NO: 64663 - DNA, 20 bp, Artificial Sequence
  Description of Artificial Sequence: Synthetic oligonucleotide
  Target: SCN9A; (-) strand; PAM type: YTN; PAM sequence: TTC
atgtcttattttgtcttgct

SEQ ID NO: 64664 - DNA, 20 bp, Artificial Sequence
  Description of Artificial Sequence: Synthetic oligonucleotide
  Target: SCN9A; (-) strand; PAM type: YTN; PAM sequence: CTG
gtgatcacagagttcatgtc

SEQ ID NO: 64665 - DNA, 20 bp, Artificial Sequence
  Description of Artificial Sequence: Synthetic oligonucleotide
  Target: SCN9A; (-) strand; PAM type: YTN; PAM sequence: TTG
taagcctggtgatcacagag

SEQ ID NO: 64666 - DNA, 20 bp, Artificial Sequence
  Description of Artificial Sequence: Synthetic oligonucleotide
  Target: SCN9A; (-) strand; PAM type: YTN; PAM sequence: TTT
gtaagcctggtgatcacaga

SEQ ID NO: 64667 - DNA, 20 bp, Artificial Sequence
  Description of Artificial Sequence: Synthetic oligonucleotide
  Target: SCN9A; (-) strand; PAM type: YTN; PAM sequence: TTG
tgtgataatcatgtaatttg

SEQ ID NO: 64668 - DNA, 20 bp, Artificial Sequence
  Description of Artificial Sequence: Synthetic oligonucleotide
  Target: SCN9A; (-) strand; PAM type: YTN; PAM sequence: TTA
ttgtgtgataatcatgtaat

SEQ ID NO: 64669 - DNA, 20 bp, Artificial Sequence
  Description of Artificial Sequence: Synthetic oligonucleotide
  Target: SCN9A; (-) strand; PAM type: YTN; PAM sequence: TTT
attgtgtgataatcatgtaa

SEQ ID NO: 64670 - DNA, 20 bp, Artificial Sequence
  Description of Artificial Sequence: Synthetic oligonucleotide
  Target: SCN9A; (-) strand; PAM type: YTN; PAM sequence: TTT
tattgtgtgataatcatgta

SEQ ID NO: 64671 - DNA, 20 bp, Artificial Sequence
  Description of Artificial Sequence: Synthetic oligonucleotide
  Target: SCN9A; (-) strand; PAM type: YTN; PAM sequence: CTA
acaattttattgtgtgataa

SEQ ID NO: 64672 - DNA, 20 bp, Artificial Sequence
  Description of Artificial Sequence: Synthetic oligonucleotide
  Target: SCN9A; (-) strand; PAM type: YTN; PAM sequence: TTG
ctaacaattttattgtgtga

SEQ ID NO: 64673 - DNA, 20 bp, Artificial Sequence
  Description of Artificial Sequence: Synthetic oligonucleotide
  Target: SCN9A; (-) strand; PAM type: YTN; PAM sequence: TTT
gctaacaattttattgtgtg

SEQ ID NO: 64674 - DNA, 20 bp, Artificial Sequence
  Description of Artificial Sequence: Synthetic oligonucleotide
  Target: SCN9A; (-) strand; PAM type: YTN; PAM sequence: TTT
tgctaacaattttattgtgt

SEQ ID NO: 64675 - DNA, 20 bp, Artificial Sequence
  Description of Artificial Sequence: Synthetic oligonucleotide
  Target: SCN9A; (-) strand; PAM type: YTN; PAM sequence: TTA
tattttgctaacaattttat

SEQ ID NO: 64676 - DNA, 20 bp, Artificial Sequence
  Description of Artificial Sequence: Synthetic oligonucleotide
  Target: SCN9A; (-) strand; PAM type: YTN; PAM sequence: CTT
atattttgctaacaatttta

SEQ ID NO: 64677 - DNA, 20 bp, Artificial Sequence
  Description of Artificial Sequence: Synthetic oligonucleotide
  Target: SCN9A; (-) strand; PAM type: YTN; PAM sequence: TTG
tcttatattttgctaacaat

SEQ ID NO: 64678 - DNA, 20 bp, Artificial Sequence
  Description of Artificial Sequence: Synthetic oligonucleotide
  Target: SCN9A; (-) strand; PAM type: YTN; PAM sequence: TTT
gtcttatattttgctaacaa

SEQ ID NO: 64679 - DNA, 20 bp, Artificial Sequence
  Description of Artificial Sequence: Synthetic oligonucleotide
  Target: SCN9A; (-) strand; PAM type: YTN; PAM sequence: TTT
tgtcttatattttgctaaca

SEQ ID NO: 64680 - DNA, 20 bp, Artificial Sequence
  Description of Artificial Sequence: Synthetic oligonucleotide
  Target: SCN9A; (-) strand; PAM type: YTN; PAM sequence: TTA
ttttgtcttatattttgcta

SEQ ID NO: 64681 - DNA, 20 bp, Artificial Sequence
  Description of Artificial Sequence: Synthetic oligonucleotide
  Target: SCN9A; (-) strand; PAM type: YTN; PAM sequence: TTA
gttattttgtcttatatttt

SEQ ID NO: 64682 - DNA, 20 bp, Artificial Sequence
  Description of Artificial Sequence: Synthetic oligonucleotide
  Target: SCN9A; (-) strand; PAM type: YTN; PAM sequence: CTT
agttattttgtcttatattt

SEQ ID NO: 64683 - DNA, 20 bp, Artificial Sequence
  Description of Artificial Sequence: Synthetic oligonucleotide
  Target: SCN9A; (-) strand; PAM type: YTN; PAM sequence: TTA
tcttagttattttgtcttat

SEQ ID NO: 64684 - DNA, 20 bp, Artificial Sequence
  Description of Artificial Sequence: Synthetic oligonucleotide
  Target: SCN9A; (-) strand; PAM type: YTN; PAM sequence: TTA
tattatcttagttattttgt

SEQ ID NO: 64685 - DNA, 20 bp, Artificial Sequence
  Description of Artificial Sequence: Synthetic oligonucleotide
  Target: SCN9A; (-) strand; PAM type: YTN; PAM sequence: CTA
ttatattatcttagttattt

SEQ ID NO: 64686 - DNA, 20 bp, Artificial Sequence
  Description of Artificial Sequence: Synthetic oligonucleotide
  Target: SCN9A; (-) strand; PAM type: YTN; PAM sequence: TTA
agctattatattatcttagt

SEQ ID NO: 64687 - DNA, 20 bp, Artificial Sequence
  Description of Artificial Sequence: Synthetic oligonucleotide
  Target: SCN9A; (-) strand; PAM type: YTN; PAM sequence: TTT
aagctattatattatcttag

SEQ ID NO: 64688 - DNA, 20 bp, Artificial Sequence
  Description of Artificial Sequence: Synthetic oligonucleotide
  Target: SCN9A; (-) strand; PAM type: YTN; PAM sequence: TTA
tttaagctattatattatct

SEQ ID NO: 64689 - DNA, 20 bp, Artificial Sequence
  Description of Artificial Sequence: Synthetic oligonucleotide
  Target: SCN9A; (-) strand; PAM type: YTN; PAM sequence: TTT
atttaagctattatattatc

SEQ ID NO: 64690 - DNA, 20 bp, Artificial Sequence
  Description of Artificial Sequence: Synthetic oligonucleotide
  Target: SCN9A; (-) strand; PAM type: YTN; PAM sequence: TTA
catttatttaagctattata

SEQ ID NO: 64691 - DNA, 20 bp, Artificial Sequence
  Description of Artificial Sequence: Synthetic oligonucleotide
  Target: SCN9A; (-) strand; PAM type: YTN; PAM sequence: TTT
acatttatttaagctattat

SEQ ID NO: 64692 - DNA, 20 bp, Artificial Sequence
  Description of Artificial Sequence: Synthetic oligonucleotide
  Target: SCN9A; (-) strand; PAM type: YTN; PAM sequence: TTT
tacatttatttaagctatta

SEQ ID NO: 64693 - DNA, 20 bp, Artificial Sequence
  Description of Artificial Sequence: Synthetic oligonucleotide
  Target: SCN9A; (-) strand; PAM type: YTN; PAM sequence: TTA
ttttacatttatttaagcta

SEQ ID NO: 64694 - DNA, 20 bp, Artificial Sequence
  Description of Artificial Sequence: Synthetic oligonucleotide
  Target: SCN9A; (-) strand; PAM type: YTN; PAM sequence: TTT
attttacatttatttaagct

SEQ ID NO: 64695 - DNA, 20 bp, Artificial Sequence
  Description of Artificial Sequence: Synthetic oligonucleotide
  Target: SCN9A; (-) strand; PAM type: YTN; PAM sequence: TTA
tttattttacatttatttaa

SEQ ID NO: 64696 - DNA, 20 bp, Artificial Sequence
  Description of Artificial Sequence: Synthetic oligonucleotide
  Target: SCN9A; (-) strand; PAM type: YTN; PAM sequence: TTT
atttattttacatttattta

SEQ ID NO: 64697 - DNA, 20 bp, Artificial Sequence
  Description of Artificial Sequence: Synthetic oligonucleotide
  Target: SCN9A; (-) strand; PAM type: YTN; PAM sequence: TTT
tatttattttacatttattt

SEQ ID NO: 64698 - DNA, 20 bp, Artificial Sequence
  Description of Artificial Sequence: Synthetic oligonucleotide
  Target: SCN9A; (-) strand; PAM type: YTN; PAM sequence: TTT
ttatttattttacatttatt

SEQ ID NO: 64699 - DNA, 20 bp, Artificial Sequence
  Description of Artificial Sequence: Synthetic oligonucleotide
  Target: SCN9A; (-) strand; PAM type: YTN; PAM sequence: TTA
tttttatttattttacattt

SEQ ID NO: 64700 - DNA, 20 bp, Artificial Sequence
  Description of Artificial Sequence: Synthetic oligonucleotide
  Target: SCN9A; (-) strand; PAM type: YTN; PAM sequence: TTA
ttatttttatttattttaca

SEQ ID NO: 64701 - DNA, 20 bp, Artificial Sequence
  Description of Artificial Sequence: Synthetic oligonucleotide
  Target: SCN9A; (-) strand; PAM type: YTN; PAM sequence: TTT
attatttttatttattttac

SEQ ID NO: 64702 - DNA, 20 bp, Artificial Sequence
  Description of Artificial Sequence: Synthetic oligonucleotide
  Target: SCN9A; (-) strand; PAM type: YTN; PAM sequence: TTG
gtttattatttttatttatt

SEQ ID NO: 64703 - DNA, 20 bp, Artificial Sequence
  Description of Artificial Sequence: Synthetic oligonucleotide
  Target: SCN9A; (-) strand; PAM type: YTN; PAM sequence: TTT
ggtttattatttttatttat

SEQ ID NO: 64704 - DNA, 20 bp, Artificial Sequence
  Description of Artificial Sequence: Synthetic oligonucleotide
  Target: SCN9A; (-) strand; PAM type: YTN; PAM sequence: TTT
tggtttattatttttattta

SEQ ID NO: 64705 - DNA, 20 bp, Artificial Sequence
  Description of Artificial Sequence: Synthetic oligonucleotide
  Target: SCN9A; (-) strand; PAM type: YTN; PAM sequence: TTA
tcaataacaggttttggttt

SEQ ID NO: 64706 - DNA, 20 bp, Artificial Sequence
  Description of Artificial Sequence: Synthetic oligonucleotide
  Target: SCN9A; (-) strand; PAM type: YTN; PAM sequence: CTT
atcaataacaggttttggtt

SEQ ID NO: 64707 - DNA, 20 bp, Artificial Sequence
  Description of Artificial Sequence: Synthetic oligonucleotide
  Target: SCN9A; (-) strand; PAM type: YTN; PAM sequence: TTA
ccttatcaataacaggtttt

SEQ ID NO: 64708 - DNA, 20 bp, Artificial Sequence
  Description of Artificial Sequence: Synthetic oligonucleotide
  Target: SCN9A; (-) strand; PAM type: YTN; PAM sequence: TTT
accttatcaataacaggttt

SEQ ID NO: 64709 - DNA, 20 bp, Artificial Sequence
  Description of Artificial Sequence: Synthetic oligonucleotide
  Target: SCN9A; (-) strand; PAM type: YTN; PAM sequence: TTA
caagtttaccttatcaataa

SEQ ID NO: 64710 - DNA, 20 bp, Artificial Sequence
  Description of Artificial Sequence: Synthetic oligonucleotide
  Target: SCN9A; (-) strand; PAM type: YTN; PAM sequence: TTT
acaagtttaccttatcaata

SEQ ID NO: 64711 - DNA, 20 bp, Artificial Sequence
  Description of Artificial Sequence: Synthetic oligonucleotide
  Target: SCN9A; (-) strand; PAM type: YTN; PAM sequence: TTT
tacaagtttaccttatcaat

SEQ ID NO: 64712 - DNA, 20 bp, Artificial Sequence
  Description of Artificial Sequence: Synthetic oligonucleotide
  Target: SCN9A; (-) strand; PAM type: YTN; PAM sequence: TTC
cagagtgtacagattttaca

SEQ ID NO: 64713 - DNA, 20 bp, Artificial Sequence
  Description of Artificial Sequence: Synthetic oligonucleotide
  Target: SCN9A; (-) strand; PAM type: YTN; PAM sequence: TTT
ccagagtgtacagattttac

SEQ ID NO: 64714 - DNA, 20 bp, Artificial Sequence
  Description of Artificial Sequence: Synthetic oligonucleotide
  Target: SCN9A; (-) strand; PAM type: YTN; PAM sequence: TTT
tccagagtgtacagatttta

SEQ ID NO: 64715 - DNA, 20 bp, Artificial Sequence
  Description of Artificial Sequence: Synthetic oligonucleotide
  Target: SCN9A; (-) strand; PAM type: YTN; PAM sequence: TTT
ttccagagtgtacagatttt

SEQ ID NO: 64716 - DNA, 20 bp, Artificial Sequence
  Description of Artificial Sequence: Synthetic oligonucleotide
  Target: SCN9A; (-) strand; PAM type: YTN; PAM sequence: TTT
tttccagagtgtacagattt

SEQ ID NO: 64717 - DNA, 20 bp, Artificial Sequence
  Description of Artificial Sequence: Synthetic oligonucleotide
  Target: SCN9A; (-) strand; PAM type: YTN; PAM sequence: TTT
ttttccagagtgtacagatt

SEQ ID NO: 64718 - DNA, 20 bp, Artificial Sequence
  Description of Artificial Sequence: Synthetic oligonucleotide
  Target: SCN9A; (-) strand; PAM type: YTN; PAM sequence: TTT
tttttccagagtgtacagat

SEQ ID NO: 64719 - DNA, 20 bp, Artificial Sequence
  Description of Artificial Sequence: Synthetic oligonucleotide
  Target: SCN9A; (-) strand; PAM type: YTN; PAM sequence: CTT
ttttttccagagtgtacaga

SEQ ID NO: 64720 - DNA, 20 bp, Artificial Sequence
  Description of Artificial Sequence: Synthetic oligonucleotide
  Target: SCN9A; (-) strand; PAM type: YTN; PAM sequence: TTC
ttttttttccagagtgtaca

SEQ ID NO: 64721 - DNA, 20 bp, Artificial Sequence
  Description of Artificial Sequence: Synthetic oligonucleotide
  Target: SCN9A; (-) strand; PAM type: YTN; PAM sequence: TTT
cttttttttccagagtgtac

SEQ ID NO: 64722 - DNA, 20 bp, Artificial Sequence
  Description of Artificial Sequence: Synthetic oligonucleotide
  Target: SCN9A; (-) strand; PAM type: YTN; PAM sequence: TTA
tacatttcttttttttccag

SEQ ID NO: 64723 - DNA, 20 bp, Artificial Sequence
  Description of Artificial Sequence: Synthetic oligonucleotide
  Target: SCN9A; (-) strand; PAM type: YTN; PAM sequence: TTT
atacatttcttttttttcca

SEQ ID NO: 64724 - DNA, 20 bp, Artificial Sequence
  Description of Artificial Sequence: Synthetic oligonucleotide
  Target: SCN9A; (-) strand; PAM type: YTN; PAM sequence: TTA
tgtttatacatttctttttt

SEQ ID NO: 64725 - DNA, 20 bp, Artificial Sequence
  Description of Artificial Sequence: Synthetic oligonucleotide
  Target: SCN9A; (-) strand; PAM type: YTN; PAM sequence: TTT
atgtttatacatttcttttt

SEQ ID NO: 64726 - DNA, 20 bp, Artificial Sequence
  Description of Artificial Sequence: Synthetic oligonucleotide
  Target: SCN9A; (-) strand; PAM type: YTN; PAM sequence: TTC
atttatgtttatacatttct

SEQ ID NO: 64727 - DNA, 20 bp, Artificial Sequence
  Description of Artificial Sequence: Synthetic oligonucleotide
  Target: SCN9A; (-) strand; PAM type: YTN; PAM sequence: TTT
catttatgtttatacatttc

SEQ ID NO: 64728 - DNA, 20 bp, Artificial Sequence
  Description of Artificial Sequence: Synthetic oligonucleotide
  Target: SCN9A; (-) strand; PAM type: YTN; PAM sequence: TTT
tcatttatgtttatacattt

SEQ ID NO: 64729 - DNA, 20 bp, Artificial Sequence
  Description of Artificial Sequence: Synthetic oligonucleotide
  Target: SCN9A; (-) strand; PAM type: YTN; PAM sequence: TTT
ttcatttatgtttatacatt

SEQ ID NO: 64730 - DNA, 20 bp, Artificial Sequence
  Description of Artificial Sequence: Synthetic oligonucleotide
  Target: SCN9A; (-) strand; PAM type: YTN; PAM sequence: TTA
aatgtatataaatatatatt

SEQ ID NO: 64731 - DNA, 20 bp, Artificial Sequence
  Description of Artificial Sequence: Synthetic oligonucleotide
  Target: SCN9A; (-) strand; PAM type: YTN; PAM sequence: TTT
aaatgtatataaatatatat

SEQ ID NO: 64732 - DNA, 20 bp, Artificial Sequence
  Description of Artificial Sequence: Synthetic oligonucleotide
  Target: SCN9A; (-) strand; PAM type: YTN; PAM sequence: CTG
gtaataataggatcatgaac

SEQ ID NO: 64733 - DNA, 20 bp, Artificial Sequence
  Description of Artificial Sequence: Synthetic oligonucleotide
  Target: SCN9A; (-) strand; PAM type: YTN; PAM sequence: TTA
atgctggtaataataggatc

SEQ ID NO: 64734 - DNA, 20 bp, Artificial Sequence
  Description of Artificial Sequence: Synthetic oligonucleotide
  Target: SCN9A; (-) strand; PAM type: YTN; PAM sequence: TTT
aatgctggtaataataggat

SEQ ID NO: 64735 - DNA, 20 bp, Artificial Sequence
  Description of Artificial Sequence: Synthetic oligonucleotide
  Target: SCN9A; (-) strand; PAM type: YTN; PAM sequence: CTT
taatgctggtaataatagga

SEQ ID NO: 64736 - DNA, 20 bp, Artificial Sequence
  Description of Artificial Sequence: Synthetic oligonucleotide
  Target: SCN9A; (-) strand; PAM type: YTN; PAM sequence: CTA
tgggggaatctttaatgctg

SEQ ID NO: 64737 - DNA, 20 bp, Artificial Sequence
  Description of Artificial Sequence: Synthetic oligonucleotide
  Target: SCN9A; (-) strand; PAM type: YTN; PAM sequence: CTC
tatgggggaatctttaatgc

SEQ ID NO: 64738 - DNA, 20 bp, Artificial Sequence
  Description of Artificial Sequence: Synthetic oligonucleotide
  Target: SCN9A; (-) strand; PAM type: YTN; PAM sequence: TTC
tctatgggggaatctttaat

SEQ ID NO: 64739 - DNA, 20 bp, Artificial Sequence
  Description of Artificial Sequence: Synthetic oligonucleotide
  Target: SCN9A; (-) strand; PAM type: YTN; PAM sequence: TTT
ctctatgggggaatctttaa

SEQ ID NO: 64740 - DNA, 20 bp, Artificial Sequence
  Description of Artificial Sequence: Synthetic oligonucleotide
  Target: SCN9A; (-) strand; PAM type: YTN; PAM sequence: CTG
atatacaccaatagtttctc

SEQ ID NO: 64741 - DNA, 20 bp, Artificial Sequence
  Description of Artificial Sequence: Synthetic oligonucleotide
  Target: SCN9A; (-) strand; PAM type: YTN; PAM sequence: CTA
cctgatatacaccaatagtt

SEQ ID NO: 64742 - DNA, 20 bp, Artificial Sequence
  Description of Artificial Sequence: Synthetic oligonucleotide
  Target: SCN9A; (-) strand; PAM type: YTN; PAM sequence: TTC
cacctacctgatatacacca

SEQ ID NO: 64743 - DNA, 20 bp, Artificial Sequence
  Description of Artificial Sequence: Synthetic oligonucleotide
  Target: SCN9A; (-) strand; PAM type: YTN; PAM sequence: TTA
aaatgatgtccagtcataat

SEQ ID NO: 64744 - DNA, 20 bp, Artificial Sequence
  Description of Artificial Sequence: Synthetic oligonucleotide
  Target: SCN9A; (-) strand; PAM type: YTN; PAM sequence: TTA
aattaaaatgatgtccagtc

SEQ ID NO: 64745 - DNA, 20 bp, Artificial Sequence
  Description of Artificial Sequence: Synthetic oligonucleotide
  Target: SCN9A; (-) strand; PAM type: YTN; PAM sequence: TTA
aattaaattaaaatgatgtc

SEQ ID NO: 64746 - DNA, 20 bp, Artificial Sequence
  Description of Artificial Sequence: Synthetic oligonucleotide
  Target: SCN9A; (-) strand; PAM type: YTN; PAM sequence: CTC
aaaaaaagagaataagaaaa

SEQ ID NO: 64747 - DNA, 20 bp, Artificial Sequence
  Description of Artificial Sequence: Synthetic oligonucleotide
  Target: SCN9A; (-) strand; PAM type: YTN; PAM sequence: TTG
tggagaatgtctcaaaaaaa

SEQ ID NO: 64748 - DNA, 20 bp, Artificial Sequence
  Description of Artificial Sequence: Synthetic oligonucleotide
  Target: SCN9A; (-) strand; PAM type: YTN; PAM sequence: TTT
gtggagaatgtctcaaaaaa

SEQ ID NO: 64749 - DNA, 20 bp, Artificial Sequence
  Description of Artificial Sequence: Synthetic oligonucleotide
  Target: SCN9A; (-) strand; PAM type: YTN; PAM sequence: TTT
tgtggagaatgtctcaaaaa

SEQ ID NO: 64750 - DNA, 20 bp, Artificial Sequence
  Description of Artificial Sequence: Synthetic oligonucleotide
  Target: SCN9A; (-) strand; PAM type: YTN; PAM sequence: CTT
ttgtggagaatgtctcaaaa

SEQ ID NO: 64751 - DNA, 20 bp, Artificial Sequence
  Description of Artificial Sequence: Synthetic oligonucleotide
  Target: SCN9A; (-) strand; PAM type: YTN; PAM sequence: CTC
aatccttttgtggagaatgt

SEQ ID NO: 64752 - DNA, 20 bp, Artificial Sequence
  Description of Artificial Sequence: Synthetic oligonucleotide
  Target: SCN9A; (-) strand; PAM type: YTN; PAM sequence: TTC
tcaatccttttgtggagaat

SEQ ID NO: 64753 - DNA, 20 bp, Artificial Sequence
  Description of Artificial Sequence: Synthetic oligonucleotide
  Target: SCN9A; (-) strand; PAM type: YTN; PAM sequence: TTA
aagattctcaatccttttgt

SEQ ID NO: 64754 - DNA, 20 bp, Artificial Sequence
  Description of Artificial Sequence: Synthetic oligonucleotide
  Target: SCN9A; (-) strand; PAM type: YTN; PAM sequence: TTT
aaagattctcaatccttttg

SEQ ID NO: 64755 - DNA, 20 bp, Artificial Sequence
  Description of Artificial Sequence: Synthetic oligonucleotide
  Target: SCN9A; (-) strand; PAM type: YTN; PAM sequence: TTA
aaccatttaaagattctcaa

SEQ ID NO: 64756 - DNA, 20 bp, Artificial Sequence
  Description of Artificial Sequence: Synthetic oligonucleotide
  Target: SCN9A; (-) strand; PAM type: YTN; PAM sequence: TTT
aaaccatttaaagattctca

SEQ ID NO: 64757 - DNA, 20 bp, Artificial Sequence
  Description of Artificial Sequence: Synthetic oligonucleotide
  Target: SCN9A; (-) strand; PAM type: YTN; PAM sequence: CTA
aaggatttaaaccatttaaa

SEQ ID NO: 64758 - DNA, 20 bp, Artificial Sequence
  Description of Artificial Sequence: Synthetic oligonucleotide
  Target: SCN9A; (-) strand; PAM type: YTN; PAM sequence: TTC
gtagaaccagccaaatctaa

SEQ ID NO: 64759 - DNA, 20 bp, Artificial Sequence
  Description of Artificial Sequence: Synthetic oligonucleotide
  Target: SCN9A; (-) strand; PAM type: YTN; PAM sequence: TTT
cgtagaaccagccaaatcta

SEQ ID NO: 64760 - DNA, 20 bp, Artificial Sequence
  Description of Artificial Sequence: Synthetic oligonucleotide
  Target: SCN9A; (-) strand; PAM type: YTN; PAM sequence: TTA
tttcgtagaaccagccaaat

SEQ ID NO: 64761 - DNA, 20 bp, Artificial Sequence
  Description of Artificial Sequence: Synthetic oligonucleotide
  Target: SCN9A; (-) strand; PAM type: YTN; PAM sequence: CTT
atttcgtagaaccagccaaa

SEQ ID NO: 64762 - DNA, 20 bp, Artificial Sequence
  Description of Artificial Sequence: Synthetic oligonucleotide
  Target: SCN9A; (-) strand; PAM type: YTN; PAM sequence: CTC
ttatttcgtagaaccagcca

SEQ ID NO: 64763 - DNA, 20 bp, Artificial Sequence
  Description of Artificial Sequence: Synthetic oligonucleotide
  Target: SCN9A; (-) strand; PAM type: YTN; PAM sequence: TTG
ctcttatttcgtagaaccag

SEQ ID NO: 64764 - DNA, 20 bp, Artificial Sequence
  Description of Artificial Sequence: Synthetic oligonucleotide
  Target: SCN9A; (-) strand; PAM type: YTN; PAM sequence: TTA
aaacgattgctcttatttcg

SEQ ID NO: 64765 - DNA, 20 bp, Artificial Sequence
  Description of Artificial Sequence: Synthetic oligonucleotide
  Target: SCN9A; (-) strand; PAM type: YTN; PAM sequence: TTT
aaaacgattgctcttatttc

SEQ ID NO: 64766 - DNA, 20 bp, Artificial Sequence
  Description of Artificial Sequence: Synthetic oligonucleotide
  Target: SCN9A; (-) strand; PAM type: YTN; PAM sequence: TTA
gagtaataataataaattta

SEQ ID NO: 64767 - DNA, 20 bp, Artificial Sequence
  Description of Artificial Sequence: Synthetic oligonucleotide
  Target: SCN9A; (-) strand; PAM type: YTN; PAM sequence: TTT
agagtaataataataaattt

SEQ ID NO: 64768 - DNA, 20 bp, Artificial Sequence
  Description of Artificial Sequence: Synthetic oligonucleotide
  Target: SCN9A; (-) strand; PAM type: YTN; PAM sequence: TTA
catataaagtatttagagta

SEQ ID NO: 64769 - DNA, 20 bp, Artificial Sequence
  Description of Artificial Sequence: Synthetic oligonucleotide
  Target: SCN9A; (-) strand; PAM type: YTN; PAM sequence: CTT
acatataaagtatttagagt

SEQ ID NO: 64770 - DNA, 20 bp, Artificial Sequence
  Description of Artificial Sequence: Synthetic oligonucleotide
  Target: SCN9A; (-) strand; PAM type: YTN; PAM sequence: TTA
gtcaaaggcttacatataaa

SEQ ID NO: 64771 - DNA, 20 bp, Artificial Sequence
  Description of Artificial Sequence: Synthetic oligonucleotide
  Target: SCN9A; (-) strand; PAM type: YTN; PAM sequence: TTT
agtcaaaggcttacatataa

SEQ ID NO: 64772 - DNA, 20 bp, Artificial Sequence
  Description of Artificial Sequence: Synthetic oligonucleotide
  Target: SCN9A; (-) strand; PAM type: YTN; PAM sequence: CTA
tatatatttagtcaaaggct

SEQ ID NO: 64773 - DNA, 20 bp, Artificial Sequence
  Description of Artificial Sequence: Synthetic oligonucleotide
  Target: SCN9A; (-) strand; PAM type: YTN; PAM sequence: CTG
aggccagcactatatatatt

SEQ ID NO: 64774 - DNA, 20 bp, Artificial Sequence
  Description of Artificial Sequence: Synthetic oligonucleotide
  Target: SCN9A; (-) strand; PAM type: YTN; PAM sequence: TTA
actgaggccagcactatata

SEQ ID NO: 64775 - DNA, 20 bp, Artificial Sequence
  Description of Artificial Sequence: Synthetic oligonucleotide
  Target: SCN9A; (-) strand; PAM type: YTN; PAM sequence: CTT
aactgaggccagcactatat

SEQ ID NO: 64776 - DNA, 20 bp, Artificial Sequence
  Description of Artificial Sequence: Synthetic oligonucleotide
  Target: SCN9A; (-) strand; PAM type: YTN; PAM sequence: TTG
tcttaactgaggccagcact

SEQ ID NO: 64777 - DNA, 20 bp, Artificial Sequence
  Description of Artificial Sequence: Synthetic oligonucleotide
  Target: SCN9A; (-) strand; PAM type: YTN; PAM sequence: TTT
gtcttaactgaggccagcac

SEQ ID NO: 64778 - DNA, 20 bp, Artificial Sequence
  Description of Artificial Sequence: Synthetic oligonucleotide
  Target: SCN9A; (-) strand; PAM type: YTN; PAM sequence: TTT
tgtcttaactgaggccagca

SEQ ID NO: 64779 - DNA, 20 bp, Artificial Sequence
  Description of Artificial Sequence: Synthetic oligonucleotide
  Target: SCN9A; (-) strand; PAM type: YTN; PAM sequence: TTT
ttgtcttaactgaggccagc

SEQ ID NO: 64780 - DNA, 20 bp, Artificial Sequence
  Description of Artificial Sequence: Synthetic oligonucleotide
  Target: SCN9A; (-) strand; PAM type: YTN; PAM sequence: CTA
atttttgtcttaactgaggc

SEQ ID NO: 64781 - DNA, 20 bp, Artificial Sequence
  Description of Artificial Sequence: Synthetic oligonucleotide
  Target: SCN9A; (-) strand; PAM type: YTN; PAM sequence: TTC
ctaatttttgtcttaactga

SEQ ID NO: 64782 - DNA, 20 bp, Artificial Sequence
  Description of Artificial Sequence: Synthetic oligonucleotide
  Target: SCN9A; (-) strand; PAM type: YTN; PAM sequence: CTG
ttcctaatttttgtcttaac

SEQ ID NO: 64783 - DNA, 20 bp, Artificial Sequence
  Description of Artificial Sequence: Synthetic oligonucleotide
  Target: SCN9A; (-) strand; PAM type: YTN; PAM sequence: TTA
aagaaaaactgttcctaatt

SEQ ID NO: 64784 - DNA, 20 bp, Artificial Sequence
  Description of Artificial Sequence: Synthetic oligonucleotide
  Target: SCN9A; (-) strand; PAM type: YTN; PAM sequence: CTG
aaaagcagaaataaagaaag

SEQ ID NO: 64785 - DNA, 20 bp, Artificial Sequence
  Description of Artificial Sequence: Synthetic oligonucleotide
  Target: SCN9A; (-) strand; PAM type: YTN; PAM sequence: CTG
gtgatcaatagcagtacaaa

SEQ ID NO: 64786 - DNA, 20 bp, Artificial Sequence
  Description of Artificial Sequence: Synthetic oligonucleotide
  Target: SCN9A; (-) strand; PAM type: YTN; PAM sequence: CTG
gagtggcaaagacaaactgg

SEQ ID NO: 64787 - DNA, 20 bp, Artificial Sequence
  Description of Artificial Sequence: Synthetic oligonucleotide
  Target: SCN9A; (-) strand; PAM type: YTN; PAM sequence: CTG
gatgaaaactggagtggcaa

SEQ ID NO: 64788 - DNA, 20 bp, Artificial Sequence
  Description of Artificial Sequence: Synthetic oligonucleotide
  Target: SCN9A; (-) strand; PAM type: YTN; PAM sequence: TTG
ccctggatgaaaactggagt

SEQ ID NO: 64789 - DNA, 20 bp, Artificial Sequence
  Description of Artificial Sequence: Synthetic oligonucleotide
  Target: SCN9A; (-) strand; PAM type: YTN; PAM sequence: TTA
aatgccacaggaattgccct

SEQ ID NO: 64790 - DNA, 20 bp, Artificial Sequence
  Description of Artificial Sequence: Synthetic oligonucleotide
  Target: SCN9A; (-) strand; PAM type: YTN; PAM sequence: CTG
gagagtgttaaatgccacag

SEQ ID NO: 64791 - DNA, 20 bp, Artificial Sequence
  Description of Artificial Sequence: Synthetic oligonucleotide
  Target: SCN9A; (-) strand; PAM type: YTN; PAM sequence: TTA
agtaaataagaaaatctgga

SEQ ID NO: 64792 - DNA, 20 bp, Artificial Sequence
  Description of Artificial Sequence: Synthetic oligonucleotide
  Target: SCN9A; (-) strand; PAM type: YTN; PAM sequence: TTG
aaagattaagtaaataagaa

SEQ ID NO: 64793 - DNA, 20 bp, Artificial Sequence
  Description of Artificial Sequence: Synthetic oligonucleotide
  Target: SCN9A; (-) strand; PAM type: YTN; PAM sequence: TTT
gaaagattaagtaaataaga

SEQ ID NO: 64794 - DNA, 20 bp, Artificial Sequence
  Description of Artificial Sequence: Synthetic oligonucleotide
  Target: SCN9A; (-) strand; PAM type: YTN; PAM sequence: TTT
tgaaagattaagtaaataag

SEQ ID NO: 64795 - DNA, 20 bp, Artificial Sequence
  Description of Artificial Sequence: Synthetic oligonucleotide
  Target: SCN9A; (-) strand; PAM type: YTN; PAM sequence: CTG
aagtgtaagatgacaggtag

SEQ ID NO: 64796 - DNA, 20 bp, Artificial Sequence
  Description of Artificial Sequence: Synthetic oligonucleotide
  Target: SCN9A; (-) strand; PAM type: YTN; PAM sequence: CTC
aagctgaagtgtaagatgac

SEQ ID NO: 64797 - DNA, 20 bp, Artificial Sequence
  Description of Artificial Sequence: Synthetic oligonucleotide
  Target: SCN9A; (-) strand; PAM type: YTN; PAM sequence: TTG
aatgggtgctcaagctgaag

SEQ ID NO: 64798 - DNA, 20 bp, Artificial Sequence
  Description of Artificial Sequence: Synthetic oligonucleotide
  Target: SCN9A; (-) strand; PAM type: YTN; PAM sequence: CTT
gaatgggtgctcaagctgaa

SEQ ID NO: 64799 - DNA, 20 bp, Artificial Sequence
  Description of Artificial Sequence: Synthetic oligonucleotide
  Target: SCN9A; (-) strand; PAM type: YTN; PAM sequence: TTG
tacttgaatgggtgctcaag

SEQ ID NO: 64800 - DNA, 20 bp, Artificial Sequence
  Description of Artificial Sequence: Synthetic oligonucleotide
  Target: SCN9A; (-) strand; PAM type: YTN; PAM sequence: TTT
gtacttgaatgggtgctcaa

SEQ ID NO: 64801 - DNA, 20 bp, Artificial Sequence
  Description of Artificial Sequence: Synthetic oligonucleotide
  Target: SCN9A; (-) strand; PAM type: YTN; PAM sequence: TTA
acacatttgtacttgaatgg

SEQ ID NO: 64802 - DNA, 20 bp, Artificial Sequence
  Description of Artificial Sequence: Synthetic oligonucleotide
  Target: SCN9A; (-) strand; PAM type: YTN; PAM sequence: TTT
aacacatttgtacttgaatg

SEQ ID NO: 64803 - DNA, 20 bp, Artificial Sequence
  Description of Artificial Sequence: Synthetic oligonucleotide
  Target: SCN9A; (-) strand; PAM type: YTN; PAM sequence: CTT
taacacatttgtacttgaat

SEQ ID NO: 64804 - DNA, 20 bp, Artificial Sequence
  Description of Artificial Sequence: Synthetic oligonucleotide
  Target: SCN9A; (-) strand; PAM type: YTN; PAM sequence: TTA
atctttaacacatttgtact

SEQ ID NO: 64805 - DNA, 20 bp, Artificial Sequence
  Description of Artificial Sequence: Synthetic oligonucleotide
  Target: SCN9A; (-) strand; PAM type: YTN; PAM sequence: CTA
acaggttaatctttaacaca

SEQ ID NO: 64806 - DNA, 20 bp, Artificial Sequence
  Description of Artificial Sequence: Synthetic oligonucleotide
  Target: SCN9A; (-) strand; PAM type: YTN; PAM sequence: TTC
cctaacaggttaatctttaa

SEQ ID NO: 64807 - DNA, 20 bp, Artificial Sequence
  Description of Artificial Sequence: Synthetic oligonucleotide
  Target: SCN9A; (-) strand; PAM type: YTN; PAM sequence: CTT
ccctaacaggttaatcttta

SEQ ID NO: 64808 - DNA, 20 bp, Artificial Sequence
  Description of Artificial Sequence: Synthetic oligonucleotide
  Target: SCN9A; (-) strand; PAM type: YTN; PAM sequence: CTC
cttccctaacaggttaatct

SEQ ID NO: 64809 - DNA, 20 bp, Artificial Sequence
  Description of Artificial Sequence: Synthetic oligonucleotide
  Target: SCN9A; (-) strand; PAM type: YTN; PAM sequence: TTG
cagaaaagaaggatcccagt

SEQ ID NO: 64810 - DNA, 20 bp, Artificial Sequence
  Description of Artificial Sequence: Synthetic oligonucleotide
  Target: SCN9A; (-) strand; PAM type: YTN; PAM sequence: TTA
atacattgcagaaaagaagg

SEQ ID NO: 64811 - DNA, 20 bp, Artificial Sequence
  Description of Artificial Sequence: Synthetic oligonucleotide
  Target: SCN9A; (-) strand; PAM type: YTN; PAM sequence: CTT
aatacattgcagaaaagaag

SEQ ID NO: 64812 - DNA, 20 bp, Artificial Sequence
  Description of Artificial Sequence: Synthetic oligonucleotide
  Target: SCN9A; (-) strand; PAM type: YTN; PAM sequence: CTG
cttaatacattgcagaaaag

SEQ ID NO: 64813 - DNA, 20 bp, Artificial Sequence
  Description of Artificial Sequence: Synthetic oligonucleotide
  Target: SCN9A; (-) strand; PAM type: YTN; PAM sequence: TTG
agaacctgcttaatacattg

SEQ ID NO: 64814 - DNA, 20 bp, Artificial Sequence
  Description of Artificial Sequence: Synthetic oligonucleotide
  Target: SCN9A; (-) strand; PAM type: YTN; PAM sequence: CTT
gagaacctgcttaatacatt

SEQ ID NO: 64815 - DNA, 20 bp, Artificial Sequence
  Description of Artificial Sequence: Synthetic oligonucleotide
  Target: SCN9A; (-) strand; PAM type: YTN; PAM sequence: TTA
aagcatcttgagaacctgct

SEQ ID NO: 64816 - DNA, 20 bp, Artificial Sequence
  Description of Artificial Sequence: Synthetic oligonucleotide
  Target: SCN9A; (-) strand; PAM type: YTN; PAM sequence: TTT
aaagcatcttgagaacctgc

SEQ ID NO: 64817 - DNA, 20 bp, Artificial Sequence
  Description of Artificial Sequence: Synthetic oligonucleotide
  Target: SCN9A; (-) strand; PAM type: YTN; PAM sequence: TTT
taaagcatcttgagaacctg

SEQ ID NO: 64818 - DNA, 20 bp, Artificial Sequence
  Description of Artificial Sequence: Synthetic oligonucleotide
  Target: SCN9A; (-) strand; PAM type: YTN; PAM sequence: CTA
ttttaaagcatcttgagaac

SEQ ID NO: 64819 - DNA, 20 bp, Artificial Sequence
  Description of Artificial Sequence: Synthetic oligonucleotide
  Target: SCN9A; (-) strand; PAM type: YTN; PAM sequence: CTC
tattttaaagcatcttgaga

SEQ ID NO: 64820 - DNA, 20 bp, Artificial Sequence
  Description of Artificial Sequence: Synthetic oligonucleotide
  Target: SCN9A; (-) strand; PAM type: YTN; PAM sequence: TTC
tctattttaaagcatcttga

SEQ ID NO: 64821 - DNA, 20 bp, Artificial Sequence
  Description of Artificial Sequence: Synthetic oligonucleotide
  Target: SCN9A; (-) strand; PAM type: YTN; PAM sequence: TTT
ctctattttaaagcatcttg

SEQ ID NO: 64822 - DNA, 20 bp, Artificial Sequence
  Description of Artificial Sequence: Synthetic oligonucleotide
  Target: SCN9A; (-) strand; PAM type: YTN; PAM sequence: TTA
gtatttctctattttaaagc

SEQ ID NO: 64823 - DNA, 20 bp, Artificial Sequence
  Description of Artificial Sequence: Synthetic oligonucleotide
  Target: SCN9A; (-) strand; PAM type: YTN; PAM sequence: CTT
agtatttctctattttaaag

SEQ ID NO: 64824 - DNA, 20 bp, Artificial Sequence
  Description of Artificial Sequence: Synthetic oligonucleotide
  Target: SCN9A; (-) strand; PAM type: YTN; PAM sequence: TTA
gtagtcagagatccttagta

SEQ ID NO: 64825 - DNA, 20 bp, Artificial Sequence
  Description of Artificial Sequence: Synthetic oligonucleotide
  Target: SCN9A; (-) strand; PAM type: YTN; PAM sequence: CTG
attagtagtcagagatcctt

SEQ ID NO: 64826 - DNA, 20 bp, Artificial Sequence
  Description of Artificial Sequence: Synthetic oligonucleotide
  Target: SCN9A; (-) strand; PAM type: YTN; PAM sequence: CTA
gatgatctgattagtagtca

SEQ ID NO: 64827 - DNA, 20 bp, Artificial Sequence
  Description of Artificial Sequence: Synthetic oligonucleotide
  Target: SCN9A; (-) strand; PAM type: YTN; PAM sequence: CTC
cctagatgatctgattagta

SEQ ID NO: 64828 - DNA, 20 bp, Artificial Sequence
  Description of Artificial Sequence: Synthetic oligonucleotide
  Target: SCN9A; (-) strand; PAM type: YTN; PAM sequence: TTC
tccctagatgatctgattag

SEQ ID NO: 64829 - DNA, 20 bp, Artificial Sequence
  Description of Artificial Sequence: Synthetic oligonucleotide
  Target: SCN9A; (-) strand; PAM type: YTN; PAM sequence: CTT
ctccctagatgatctgatta

SEQ ID NO: 64830 - DNA, 20 bp, Artificial Sequence
  Description of Artificial Sequence: Synthetic oligonucleotide
  Target: SCN9A; (-) strand; PAM type: YTN; PAM sequence: TTG
caaaccttctccctagatga

SEQ ID NO: 64831 - DNA, 20 bp, Artificial Sequence
  Description of Artificial Sequence: Synthetic oligonucleotide
  Target: SCN9A; (-) strand; PAM type: YTN; PAM sequence: TTT
gcaaaccttctccctagatg

SEQ ID NO: 64832 - DNA, 20 bp, Artificial Sequence
  Description of Artificial Sequence: Synthetic oligonucleotide
  Target: SCN9A; (-) strand; PAM type: YTN; PAM sequence: TTA
taaaaatgtttgcaaacctt

SEQ ID NO: 64833 - DNA, 20 bp, Artificial Sequence
  Description of Artificial Sequence: Synthetic oligonucleotide
  Target: SCN9A; (-) strand; PAM type: YTN; PAM sequence: TTT
ataaaaatgtttgcaaacct

SEQ ID NO: 64834 - DNA, 20 bp, Artificial Sequence
  Description of Artificial Sequence: Synthetic oligonucleotide
  Target: SCN9A; (-) strand; PAM type: YTN; PAM sequence: CTA
aaaatatttataaaaatgtt

SEQ ID NO: 64835 - DNA, 20 bp, Artificial Sequence
  Description of Artificial Sequence: Synthetic oligonucleotide
  Target: SCN9A; (-) strand; PAM type: YTN; PAM sequence: TTG
caacggagatataacccaca

SEQ ID NO: 64836 - DNA, 20 bp, Artificial Sequence
  Description of Artificial Sequence: Synthetic oligonucleotide
  Target: SCN9A; (-) strand; PAM type: YTN; PAM sequence: TTG
aatagttgcaacggagatat

SEQ ID NO: 64837 - DNA, 20 bp, Artificial Sequence
  Description of Artificial Sequence: Synthetic oligonucleotide
  Target: SCN9A; (-) strand; PAM type: YTN; PAM sequence: CTA
ccatggcagagttgaatagt

SEQ ID NO: 64838 - DNA, 20 bp, Artificial Sequence
  Description of Artificial Sequence: Synthetic oligonucleotide
  Target: SCN9A; (-) strand; PAM type: YTN; PAM sequence: TTA
tgtatgacccatgactacca

SEQ ID NO: 64839 - DNA, 20 bp, Artificial Sequence
  Description of Artificial Sequence: Synthetic oligonucleotide
  Target: SCN9A; (-) strand; PAM type: YTN; PAM sequence: TTT
atgtatgacccatgactacc

SEQ ID NO: 64840 - DNA, 20 bp, Artificial Sequence
  Description of Artificial Sequence: Synthetic oligonucleotide
  Target: SCN9A; (-) strand; PAM type: YTN; PAM sequence: TTG
tttatgtatgacccatgact

SEQ ID NO: 64841 - DNA, 20 bp, Artificial Sequence
  Description of Artificial Sequence: Synthetic oligonucleotide
  Target: SCN9A; (-) strand; PAM type: YTN; PAM sequence: TTT
gtttatgtatgacccatgac

SEQ ID NO: 64842 - DNA, 20 bp, Artificial Sequence
  Description of Artificial Sequence: Synthetic oligonucleotide
  Target: SCN9A; (-) strand; PAM type: YTN; PAM sequence: TTG
gaacacagccataccagttt

SEQ ID NO: 64843 - DNA, 20 bp, Artificial Sequence
  Description of Artificial Sequence: Synthetic oligonucleotide
  Target: SCN9A; (-) strand; PAM type: YTN; PAM sequence: CTT
ggaacacagccataccagtt

SEQ ID NO: 64844 - DNA, 20 bp, Artificial Sequence
  Description of Artificial Sequence: Synthetic oligonucleotide
  Target: SCN9A; (-) strand; PAM type: YTN; PAM sequence: TTC
ttggaacacagccataccag

SEQ ID NO: 64845 - DNA, 20 bp, Artificial Sequence
  Description of Artificial Sequence: Synthetic oligonucleotide
  Target: SCN9A; (-) strand; PAM type: YTN; PAM sequence: TTG
taaaaatgttcttggaacac

SEQ ID NO: 64846 - DNA, 20 bp, Artificial Sequence
  Description of Artificial Sequence: Synthetic oligonucleotide
  Target: SCN9A; (-) strand; PAM type: YTN; PAM sequence: TTT
gtaaaaatgttcttggaaca

SEQ ID NO: 64847 - DNA, 20 bp, Artificial Sequence
  Description of Artificial Sequence: Synthetic oligonucleotide
  Target: SCN9A; (-) strand; PAM type: YTN; PAM sequence: TTT
tgtaaaaatgttcttggaac

SEQ ID NO: 64848 - DNA, 20 bp, Artificial Sequence
  Description of Artificial Sequence: Synthetic oligonucleotide
  Target: SCN9A; (-) strand; PAM type: YTN; PAM sequence: TTT
ttgtaaaaatgttcttggaa

SEQ ID NO: 64849 - DNA, 20 bp, Artificial Sequence
  Description of Artificial Sequence: Synthetic oligonucleotide
  Target: SCN9A; (-) strand; PAM type: YTN; PAM sequence: CTG
tttttgtaaaaatgttcttg

SEQ ID NO: 64850 - DNA, 20 bp, Artificial Sequence
  Description of Artificial Sequence: Synthetic oligonucleotide
  Target: SCN9A; (-) strand; PAM type: YTN; PAM sequence: CTG
gaccaaaggtcaacaaaccc

SEQ ID NO: 64851 - DNA, 20 bp, Artificial Sequence
  Description of Artificial Sequence: Synthetic oligonucleotide
  Target: SCN9A; (-) strand; PAM type: YTN; PAM sequence: CTC
tggaccaaaggtcaacaaac

SEQ ID NO: 64852 - DNA, 20 bp, Artificial Sequence
  Description of Artificial Sequence: Synthetic oligonucleotide
  Target: SCN9A; (-) strand; PAM type: YTN; PAM sequence: TTG
ctctggaccaaaggtcaaca

SEQ ID NO: 64853 - DNA, 20 bp, Artificial Sequence
  Description of Artificial Sequence: Synthetic oligonucleotide
  Target: SCN9A; (-) strand; PAM type: YTN; PAM sequence: CTC
caaataatcattgctctgga

SEQ ID NO: 64854 - DNA, 20 bp, Artificial Sequence
  Description of Artificial Sequence: Synthetic oligonucleotide
  Target: SCN9A; (-) strand; PAM type: YTN; PAM sequence: CTA
caggtccatgaactccaaat

SEQ ID NO: 64855 - DNA, 20 bp, Artificial Sequence
  Description of Artificial Sequence: Synthetic oligonucleotide
  Target: SCN9A; (-) strand; PAM type: YTN; PAM sequence: CTC
tacaggtccatgaactccaa

SEQ ID NO: 64856 - DNA, 20 bp, Artificial Sequence
  Description of Artificial Sequence: Synthetic oligonucleotide
  Target: SCN9A; (-) strand; PAM type: YTN; PAM sequence: TTC
atgcccccaggaaacctcta

SEQ ID NO: 64857 - DNA, 20 bp, Artificial Sequence
  Description of Artificial Sequence: Synthetic oligonucleotide
  Target: SCN9A; (-) strand; PAM type: YTN; PAM sequence: TTT
catgcccccaggaaacctct

SEQ ID NO: 64858 - DNA, 20 bp, Artificial Sequence
  Description of Artificial Sequence: Synthetic oligonucleotide
  Target: SCN9A; (-) strand; PAM type: YTN; PAM sequence: TTA
tataatttcatgcccccagg

SEQ ID NO: 64859 - DNA, 20 bp, Artificial Sequence
  Description of Artificial Sequence: Synthetic oligonucleotide
  Target: SCN9A; (-) strand; PAM type: YTN; PAM sequence: TTG
ttatataatttcatgccccc

SEQ ID NO: 64860 - DNA, 20 bp, Artificial Sequence
  Description of Artificial Sequence: Synthetic oligonucleotide
  Target: SCN9A; (-) strand; PAM type: YTN; PAM sequence: TTT
gttatataatttcatgcccc

SEQ ID NO: 64861 - DNA, 20 bp, Artificial Sequence
  Description of Artificial Sequence: Synthetic oligonucleotide
  Target: SCN9A; (-) strand; PAM type: YTN; PAM sequence: TTC
cggaaagacagcacaaccat

SEQ ID NO: 64862 - DNA, 20 bp, Artificial Sequence
  Description of Artificial Sequence: Synthetic oligonucleotide
  Target: SCN9A; (-) strand; PAM type: YTN; PAM sequence: TTT
ccggaaagacagcacaacca

SEQ ID NO: 64863 - DNA, 20 bp, Artificial Sequence
  Description of Artificial Sequence: Synthetic oligonucleotide
  Target: SCN9A; (-) strand; PAM type: YTN; PAM sequence: CTT
tccggaaagacagcacaacc

SEQ ID NO: 64864 - DNA, 20 bp, Artificial Sequence
  Description of Artificial Sequence: Synthetic oligonucleotide
  Target: SCN9A; (-) strand; PAM type: YTN; PAM sequence: TTG
tctttccggaaagacagcac

SEQ ID NO: 64865 - DNA, 20 bp, Artificial Sequence
  Description of Artificial Sequence: Synthetic oligonucleotide
  Target: SCN9A; (-) strand; PAM type: YTN; PAM sequence: TTA
gaattgtctttccggaaaga

SEQ ID NO: 64866 - DNA, 20 bp, Artificial Sequence
  Description of Artificial Sequence: Synthetic oligonucleotide
  Target: SCN9A; (-) strand; PAM type: YTN; PAM sequence: CTG
atgaaagttagaattgtctt

SEQ ID NO: 64867 - DNA, 20 bp, Artificial Sequence
  Description of Artificial Sequence: Synthetic oligonucleotide
  Target: SCN9A; (-) strand; PAM type: YTN; PAM sequence: CTG
taagaatctgatgaaagtta

SEQ ID NO: 64868 - DNA, 20 bp, Artificial Sequence
  Description of Artificial Sequence: Synthetic oligonucleotide
  Target: SCN9A; (-) strand; PAM type: YTN; PAM sequence: TTG
aggtcacatagactgtaaga

SEQ ID NO: 64869 - DNA, 20 bp, Artificial Sequence
  Description of Artificial Sequence: Synthetic oligonucleotide
  Target: SCN9A; (-) strand; PAM type: YTN; PAM sequence: TTT
gaggtcacatagactgtaag

SEQ ID NO: 64870 - DNA, 20 bp, Artificial Sequence
  Description of Artificial Sequence: Synthetic oligonucleotide
  Target: SCN9A; (-) strand; PAM type: YTN; PAM sequence: TTT
tgaggtcacatagactgtaa

SEQ ID NO: 64871 - DNA, 20 bp, Artificial Sequence
  Description of Artificial Sequence: Synthetic oligonucleotide
  Target: SCN9A; (-) strand; PAM type: YTN; PAM sequence: TTT
ttgaggtcacatagactgta

SEQ ID NO: 64872 - DNA, 20 bp, Artificial Sequence
  Description of Artificial Sequence: Synthetic oligonucleotide
  Target: SCN9A; (-) strand; PAM type: YTN; PAM sequence: TTT
tttgaggtcacatagactgt

SEQ ID NO: 64873 - DNA, 20 bp, Artificial Sequence
  Description of Artificial Sequence: Synthetic oligonucleotide
  Target: SCN9A; (-) strand; PAM type: YTN; PAM sequence: CTT
ttttgaggtcacatagactg

SEQ ID NO: 64874 - DNA, 20 bp, Artificial Sequence
  Description of Artificial Sequence: Synthetic oligonucleotide
  Target: SCN9A; (-) strand; PAM type: YTN; PAM sequence: CTA
atcttttttgaggtcacata

SEQ ID NO: 64875 - DNA, 20 bp, Artificial Sequence
  Description of Artificial Sequence: Synthetic oligonucleotide
  Target: SCN9A; (-) strand; PAM type: YTN; PAM sequence: CTC
ctaatcttttttgaggtcac

SEQ ID NO: 64876 - DNA, 20 bp, Artificial Sequence
  Description of Artificial Sequence: Synthetic oligonucleotide
  Target: SCN9A; (-) strand; PAM type: YTN; PAM sequence: TTC
ctcctaatcttttttgaggt

SEQ ID NO: 64877 - DNA, 20 bp, Artificial Sequence
  Description of Artificial Sequence: Synthetic oligonucleotide
  Target: SCN9A; (-) strand; PAM type: YTN; PAM sequence: CTA
ttcctcctaatcttttttga

SEQ ID NO: 64878 - DNA, 20 bp, Artificial Sequence
  Description of Artificial Sequence: Synthetic oligonucleotide
  Target: SCN9A; (-) strand; PAM type: YTN; PAM sequence: TTC
ctattcctcctaatcttttt

SEQ ID NO: 64879 - DNA, 20 bp, Artificial Sequence
  Description of Artificial Sequence: Synthetic oligonucleotide
  Target: SCN9A; (-) strand; PAM type: YTN; PAM sequence: CTA
ttcctattcctcctaatctt

SEQ ID NO: 64880 - DNA, 20 bp, Artificial Sequence
  Description of Artificial Sequence: Synthetic oligonucleotide
  Target: SCN9A; (-) strand; PAM type: YTN; PAM sequence: CTC
tattcctattcctcctaatc

SEQ ID NO: 64881 - DNA, 20 bp, Artificial Sequence
  Description of Artificial Sequence: Synthetic oligonucleotide
  Target: SCN9A; (-) strand; PAM type: YTN; PAM sequence: TTC
tctattcctattcctcctaa

SEQ ID NO: 64882 - DNA, 20 bp, Artificial Sequence
  Description of Artificial Sequence: Synthetic oligonucleotide
  Target: SCN9A; (-) strand; PAM type: YTN; PAM sequence: TTC
attctctattcctattcctc

SEQ ID NO: 64883 - DNA, 20 bp, Artificial Sequence
  Description of Artificial Sequence: Synthetic oligonucleotide
  Target: SCN9A; (-) strand; PAM type: YTN; PAM sequence: CTT
cattctctattcctattcct

SEQ ID NO: 64884 - DNA, 20 bp, Artificial Sequence
  Description of Artificial Sequence: Synthetic oligonucleotide
  Target: SCN9A; (-) strand; PAM type: YTN; PAM sequence: TTG
aacttcattctctattccta

SEQ ID NO: 64885 - DNA, 20 bp, Artificial Sequence
  Description of Artificial Sequence: Synthetic oligonucleotide
  Target: SCN9A; (-) strand; PAM type: YTN; PAM sequence: TTT
gaacttcattctctattcct

SEQ ID NO: 64886 - DNA, 20 bp, Artificial Sequence
  Description of Artificial Sequence: Synthetic oligonucleotide
  Target: SCN9A; (-) strand; PAM type: YTN; PAM sequence: CTT
tgaacttcattctctattcc

SEQ ID NO: 64887 - DNA, 20 bp, Artificial Sequence
  Description of Artificial Sequence: Synthetic oligonucleotide
  Target: SCN9A; (-) strand; PAM type: YTN; PAM sequence: CTA
ctttgaacttcattctctat

SEQ ID NO: 64888 - DNA, 20 bp, Artificial Sequence
  Description of Artificial Sequence: Synthetic oligonucleotide
  Target: SCN9A; (-) strand; PAM type: YTN; PAM sequence: CTG
gctactttgaacttcattct

SEQ ID NO: 64889 - DNA, 20 bp, Artificial Sequence
  Description of Artificial Sequence: Synthetic oligonucleotide
  Target: SCN9A; (-) strand; PAM type: YTN; PAM sequence: TTA
agagctggctactttgaact

SEQ ID NO: 64890 - DNA, 20 bp, Artificial Sequence
  Description of Artificial Sequence: Synthetic oligonucleotide
  Target: SCN9A; (-) strand; PAM type: YTN; PAM sequence: CTA
ttaagagctggctactttga

SEQ ID NO: 64891 - DNA, 20 bp, Artificial Sequence
  Description of Artificial Sequence: Synthetic oligonucleotide
  Target: SCN9A; (-) strand; PAM type: YTN; PAM sequence: CTC
tattaagagctggctacttt

SEQ ID NO: 64892 - DNA, 20 bp, Artificial Sequence
  Description of Artificial Sequence: Synthetic oligonucleotide
  Target: SCN9A; (-) strand; PAM type: YTN; PAM sequence: CTA
cgtgataaacatagtaggga

SEQ ID NO: 64893 - DNA, 20 bp, Artificial Sequence
  Description of Artificial Sequence: Synthetic oligonucleotide
  Target: SCN9A; (-) strand; PAM type: YTN; PAM sequence: CTA
gatgtatcagagtgcctacg

SEQ ID NO: 64894 - DNA, 20 bp, Artificial Sequence
  Description of Artificial Sequence: Synthetic oligonucleotide
  Target: SCN9A; (-) strand; PAM type: YTN; PAM sequence: TTG
gtcagtgactagatgtatca

SEQ ID NO: 64895 - DNA, 20 bp, Artificial Sequence
  Description of Artificial Sequence: Synthetic oligonucleotide
  Target: SCN9A; (-) strand; PAM type: YTN; PAM sequence: CTT
ggtcagtgactagatgtatc

SEQ ID NO: 64896 - DNA, 20 bp, Artificial Sequence
  Description of Artificial Sequence: Synthetic oligonucleotide
  Target: SCN9A; (-) strand; PAM type: YTN; PAM sequence: TTG
tgcaaggtgtgcttggtcag

SEQ ID NO: 64897 - DNA, 20 bp, Artificial Sequence
  Description of Artificial Sequence: Synthetic oligonucleotide
  Target: SCN9A; (-) strand; PAM type: YTN; PAM sequence: TTC
aaggcagtgataccacatgg

SEQ ID NO: 64898 - DNA, 20 bp, Artificial Sequence
  Description of Artificial Sequence: Synthetic oligonucleotide
  Target: SCN9A; (-) strand; PAM type: YTN; PAM sequence: CTG
aagagtaagccccaaatcat

SEQ ID NO: 64899 - DNA, 20 bp, Artificial Sequence
  Description of Artificial Sequence: Synthetic oligonucleotide
  Target: SCN9A; (-) strand; PAM type: YTN; PAM sequence: TTC
atgactgaagagtaagcccc

SEQ ID NO: 64900 - DNA, 20 bp, Artificial Sequence
  Description of Artificial Sequence: Synthetic oligonucleotide
  Target: SCN9A; (-) strand; PAM type: YTN; PAM sequence: TTT
catgactgaagagtaagccc

SEQ ID NO: 64901 - DNA, 20 bp, Artificial Sequence
  Description of Artificial Sequence: Synthetic oligonucleotide
  Target: SCN9A; (-) strand; PAM type: YTN; PAM sequence: TTC
agacatttcatgactgaaga

SEQ ID NO: 64902 - DNA, 20 bp, Artificial Sequence
  Description of Artificial Sequence: Synthetic oligonucleotide
  Target: SCN9A; (-) strand; PAM type: YTN; PAM sequence: TTT
cagacatttcatgactgaag

SEQ ID NO: 64903 - DNA, 20 bp, Artificial Sequence
  Description of Artificial Sequence: Synthetic oligonucleotide
  Target: SCN9A; (-) strand; PAM type: YTN; PAM sequence: CTG
ggaagacatcacaaggaggt

SEQ ID NO: 64904 - DNA, 20 bp, Artificial Sequence
  Description of Artificial Sequence: Synthetic oligonucleotide
  Target: SCN9A; (-) strand; PAM type: YTN; PAM sequence: CTA
tccggggaagtctgggaaga

SEQ ID NO: 64905 - DNA, 20 bp, Artificial Sequence
  Description of Artificial Sequence: Synthetic oligonucleotide
  Target: SCN9A; (-) strand; PAM type: YTN; PAM sequence: TTA
caagagagacagacaagggc

SEQ ID NO: 64906 - DNA, 20 bp, Artificial Sequence
  Description of Artificial Sequence: Synthetic oligonucleotide
  Target: SCN9A; (-) strand; PAM type: YTN; PAM sequence: TTG
tgatataaaaaacacagagt

SEQ ID NO: 64907 - DNA, 20 bp, Artificial Sequence
  Description of Artificial Sequence: Synthetic oligonucleotide
  Target: SCN9A; (-) strand; PAM type: YTN; PAM sequence: CTA
tgtgtcaggtgttgtgatat

SEQ ID NO: 64908 - DNA, 20 bp, Artificial Sequence
  Description of Artificial Sequence: Synthetic oligonucleotide
  Target: SCN9A; (-) strand; PAM type: YTN; PAM sequence: TTA
aacaccaactatgtgtcagg

SEQ ID NO: 64909 - DNA, 20 bp, Artificial Sequence
  Description of Artificial Sequence: Synthetic oligonucleotide
  Target: SCN9A; (-) strand; PAM type: YTN; PAM sequence: TTT
aaacaccaactatgtgtcag

SEQ ID NO: 64910 - DNA, 20 bp, Artificial Sequence
  Description of Artificial Sequence: Synthetic oligonucleotide
  Target: SCN9A; (-) strand; PAM type: YTN; PAM sequence: TTT
taaacaccaactatgtgtca

SEQ ID NO: 64911 - DNA, 20 bp, Artificial Sequence
  Description of Artificial Sequence: Synthetic oligonucleotide
  Target: SCN9A; (-) strand; PAM type: YTN; PAM sequence: TTA
gaaaaacattttaaacacca

SEQ ID NO: 64912 - DNA, 20 bp, Artificial Sequence
  Description of Artificial Sequence: Synthetic oligonucleotide
  Target: SCN9A; (-) strand; PAM type: YTN; PAM sequence: TTT
agaaaaacattttaaacacc

SEQ ID NO: 64913 - DNA, 20 bp, Artificial Sequence
  Description of Artificial Sequence: Synthetic oligonucleotide
  Target: SCN9A; (-) strand; PAM type: YTN; PAM sequence: TTT
tagaaaaacattttaaacac

SEQ ID NO: 64914 - DNA, 20 bp, Artificial Sequence
  Description of Artificial Sequence: Synthetic oligonucleotide
  Target: SCN9A; (-) strand; PAM type: YTN; PAM sequence: TTT
ttagaaaaacattttaaaca

SEQ ID NO: 64915 - DNA, 20 bp, Artificial Sequence
  Description of Artificial Sequence: Synthetic oligonucleotide
  Target: SCN9A; (-) strand; PAM type: YTN; PAM sequence: TTT
tttagaaaaacattttaaac

SEQ ID NO: 64916 - DNA, 20 bp, Artificial Sequence
  Description of Artificial Sequence: Synthetic oligonucleotide
  Target: SCN9A; (-) strand; PAM type: YTN; PAM sequence: CTC
acattttttagaaaaacatt

SEQ ID NO: 64917 - DNA, 20 bp, Artificial Sequence
  Description of Artificial Sequence: Synthetic oligonucleotide
  Target: SCN9A; (-) strand; PAM type: YTN; PAM sequence: TTA
ctcacattttttagaaaaac

SEQ ID NO: 64918 - DNA, 20 bp, Artificial Sequence
  Description of Artificial Sequence: Synthetic oligonucleotide
  Target: SCN9A; (-) strand; PAM type: YTN; PAM sequence: TTC
catcattactcacatttttt

SEQ ID NO: 64919 - DNA, 20 bp, Artificial Sequence
  Description of Artificial Sequence: Synthetic oligonucleotide
  Target: SCN9A; (-) strand; PAM type: YTN; PAM sequence: CTC
agagacccatgattccatca

SEQ ID NO: 64920 - DNA, 20 bp, Artificial Sequence
  Description of Artificial Sequence: Synthetic oligonucleotide
  Target: SCN9A; (-) strand; PAM type: YTN; PAM sequence: TTC
tcagagacccatgattccat

SEQ ID NO: 64921 - DNA, 20 bp, Artificial Sequence
  Description of Artificial Sequence: Synthetic oligonucleotide
  Target: SCN9A; (-) strand; PAM type: YTN; PAM sequence: TTT
ctcagagacccatgattcca

SEQ ID NO: 64922 - DNA, 20 bp, Artificial Sequence
  Description of Artificial Sequence: Synthetic oligonucleotide
  Target: SCN9A; (-) strand; PAM type: YTN; PAM sequence: CTT
tctcagagacccatgattcc

SEQ ID NO: 64923 - DNA, 20 bp, Artificial Sequence
  Description of Artificial Sequence: Synthetic oligonucleotide
  Target: SCN9A; (-) strand; PAM type: YTN; PAM sequence: CTG
tctttctcagagacccatga

SEQ ID NO: 64924 - DNA, 20 bp, Artificial Sequence
  Description of Artificial Sequence: Synthetic oligonucleotide
  Target: SCN9A; (-) strand; PAM type: YTN; PAM sequence: CTC
atcagaccaataggtgcctg

SEQ ID NO: 64925 - DNA, 20 bp, Artificial Sequence
  Description of Artificial Sequence: Synthetic oligonucleotide
  Target: SCN9A; (-) strand; PAM type: YTN; PAM sequence: TTC
tcatcagaccaataggtgcc

SEQ ID NO: 64926 - DNA, 20 bp, Artificial Sequence
  Description of Artificial Sequence: Synthetic oligonucleotide
  Target: SCN9A; (-) strand; PAM type: YTN; PAM sequence: CTT
ctcatcagaccaataggtgc

SEQ ID NO: 64927 - DNA, 20 bp, Artificial Sequence
  Description of Artificial Sequence: Synthetic oligonucleotide
  Target: SCN9A; (-) strand; PAM type: YTN; PAM sequence: CTG
gcttctcatcagaccaatag

SEQ ID NO: 64928 - DNA, 20 bp, Artificial Sequence
  Description of Artificial Sequence: Synthetic oligonucleotide
  Target: SCN9A; (-) strand; PAM type: YTN; PAM sequence: TTC
ccaactggcttctcatcaga

SEQ ID NO: 64929 - DNA, 20 bp, Artificial Sequence
  Description of Artificial Sequence: Synthetic oligonucleotide
  Target: SCN9A; (-) strand; PAM type: YTN; PAM sequence: TTT
cccaactggcttctcatcag

SEQ ID NO: 64930 - DNA, 20 bp, Artificial Sequence
  Description of Artificial Sequence: Synthetic oligonucleotide
  Target: SCN9A; (-) strand; PAM type: YTN; PAM sequence: CTT
tcccaactggcttctcatca

SEQ ID NO: 64931 - DNA, 20 bp, Artificial Sequence
  Description of Artificial Sequence: Synthetic oligonucleotide
  Target: SCN9A; (-) strand; PAM type: YTN; PAM sequence: TTA
gctttcccaactggcttctc

SEQ ID NO: 64932 - DNA, 20 bp, Artificial Sequence
  Description of Artificial Sequence: Synthetic oligonucleotide
  Target: SCN9A; (-) strand; PAM type: YTN; PAM sequence: TTT
agctttcccaactggcttct

SEQ ID NO: 64933 - DNA, 20 bp, Artificial Sequence
  Description of Artificial Sequence: Synthetic oligonucleotide
  Target: SCN9A; (-) strand; PAM type: YTN; PAM sequence: CTT
tagctttcccaactggcttc

SEQ ID NO: 64934 - DNA, 20 bp, Artificial Sequence
  Description of Artificial Sequence: Synthetic oligonucleotide
  Target: SCN9A; (-) strand; PAM type: YTN; PAM sequence: CTC
tttagctttcccaactggct

SEQ ID NO: 64935 - DNA, 20 bp, Artificial Sequence
  Description of Artificial Sequence: Synthetic oligonucleotide
  Target: SCN9A; (-) strand; PAM type: YTN; PAM sequence: TTA
ggctctttagctttcccaac

SEQ ID NO: 64936 - DNA, 20 bp, Artificial Sequence
  Description of Artificial Sequence: Synthetic oligonucleotide
  Target: SCN9A; (-) strand; PAM type: YTN; PAM sequence: CTT
aggctctttagctttcccaa

SEQ ID NO: 64937 - DNA, 20 bp, Artificial Sequence
  Description of Artificial Sequence: Synthetic oligonucleotide
  Target: SCN9A; (-) strand; PAM type: YTN; PAM sequence: TTG
agtccttaggctctttagct

SEQ ID NO: 64938 - DNA, 20 bp, Artificial Sequence
  Description of Artificial Sequence: Synthetic oligonucleotide
  Target: SCN9A; (-) strand; PAM type: YTN; PAM sequence: TTT
gagtccttaggctctttagc

SEQ ID NO: 64939 - DNA, 20 bp, Artificial Sequence
  Description of Artificial Sequence: Synthetic oligonucleotide
  Target: SCN9A; (-) strand; PAM type: YTN; PAM sequence: TTG
tttgagtccttaggctcttt

SEQ ID NO: 64940 - DNA, 20 bp, Artificial Sequence
  Description of Artificial Sequence: Synthetic oligonucleotide
  Target: SCN9A; (-) strand; PAM type: YTN; PAM sequence: CTT
gtttgagtccttaggctctt

SEQ ID NO: 64941 - DNA, 20 bp, Artificial Sequence
  Description of Artificial Sequence: Synthetic oligonucleotide
  Target: SCN9A; (-) strand; PAM type: YTN; PAM sequence: TTG
tagtcagcttgtttgagtcc

SEQ ID NO: 64942 - DNA, 20 bp, Artificial Sequence
  Description of Artificial Sequence: Synthetic oligonucleotide
  Target: SCN9A; (-) strand; PAM type: YTN; PAM sequence: TTG
aggcatattgtagtcagctt

SEQ ID NO: 64943 - DNA, 20 bp, Artificial Sequence
  Description of Artificial Sequence: Synthetic oligonucleotide
  Target: SCN9A; (-) strand; PAM type: YTN; PAM sequence: TTT
gaggcatattgtagtcagct

SEQ ID NO: 64944 - DNA, 20 bp, Artificial Sequence
  Description of Artificial Sequence: Synthetic oligonucleotide
  Target: SCN9A; (-) strand; PAM type: YTN; PAM sequence: TTG
aaggataaatgaaataatga

SEQ ID NO: 64945 - DNA, 20 bp, Artificial Sequence
  Description of Artificial Sequence: Synthetic oligonucleotide
  Target: SCN9A; (-) strand; PAM type: YTN; PAM sequence: TTT
gaaggataaatgaaataatg

SEQ ID NO: 64946 - DNA, 20 bp, Artificial Sequence
  Description of Artificial Sequence: Synthetic oligonucleotide
  Target: SCN9A; (-) strand; PAM type: YTN; PAM sequence: TTT
tgaaggataaatgaaataat

SEQ ID NO: 64947 - DNA, 20 bp, Artificial Sequence
  Description of Artificial Sequence: Synthetic oligonucleotide
  Target: SCN9A; (-) strand; PAM type: YTN; PAM sequence: CTA
ttttgaaggataaatgaaat

SEQ ID NO: 64948 - DNA, 20 bp, Artificial Sequence
  Description of Artificial Sequence: Synthetic oligonucleotide
  Target: SCN9A; (-) strand; PAM type: YTN; PAM sequence: TTC
atgccgcagggctattttga

SEQ ID NO: 64949 - DNA, 20 bp, Artificial Sequence
  Description of Artificial Sequence: Synthetic oligonucleotide
  Target: SCN9A; (-) strand; PAM type: YTN; PAM sequence: TTA
ttcatgccgcagggctattt

SEQ ID NO: 64950 - DNA, 20 bp, Artificial Sequence
  Description of Artificial Sequence: Synthetic oligonucleotide
  Target: SCN9A; (-) strand; PAM type: YTN; PAM sequence: TTT
attcatgccgcagggctatt

SEQ ID NO: 64951 - DNA, 20 bp, Artificial Sequence
  Description of Artificial Sequence: Synthetic oligonucleotide
  Target: SCN9A; (-) strand; PAM type: YTN; PAM sequence: TTA
accatgcaaaaagagacatt

SEQ ID NO: 64952 - DNA, 20 bp, Artificial Sequence
  Description of Artificial Sequence: Synthetic oligonucleotide
  Target: SCN9A; (-) strand; PAM type: YTN; PAM sequence: TTG
ttaaccatgcaaaaagagac

SEQ ID NO: 64953 - DNA, 20 bp, Artificial Sequence
  Description of Artificial Sequence: Synthetic oligonucleotide
  Target: SCN9A; (-) strand; PAM type: YTN; PAM sequence: TTT
gttaaccatgcaaaaagaga

SEQ ID NO: 64954 - DNA, 20 bp, Artificial Sequence
  Description of Artificial Sequence: Synthetic oligonucleotide
  Target: SCN9A; (-) strand; PAM type: YTN; PAM sequence: TTA
catttgttaaccatgcaaaa

SEQ ID NO: 64955 - DNA, 20 bp, Artificial Sequence
  Description of Artificial Sequence: Synthetic oligonucleotide
  Target: SCN9A; (-) strand; PAM type: YTN; PAM sequence: TTA
gttacatttgttaaccatgc

SEQ ID NO: 64956 - DNA, 20 bp, Artificial Sequence
  Description of Artificial Sequence: Synthetic oligonucleotide
  Target: SCN9A; (-) strand; PAM type: YTN; PAM sequence: TTT
agttacatttgttaaccatg

SEQ ID NO: 64957 - DNA, 20 bp, Artificial Sequence
  Description of Artificial Sequence: Synthetic oligonucleotide
  Target: SCN9A; (-) strand; PAM type: YTN; PAM sequence: CTA
tttagttacatttgttaacc

SEQ ID NO: 64958 - DNA, 20 bp, Artificial Sequence
  Description of Artificial Sequence: Synthetic oligonucleotide
  Target: SCN9A; (-) strand; PAM type: YTN; PAM sequence: TTG
agaggcaaatgtctatttag

SEQ ID NO: 64959 - DNA, 20 bp, Artificial Sequence
  Description of Artificial Sequence: Synthetic oligonucleotide
  Target: SCN9A; (-) strand; PAM type: YTN; PAM sequence: TTT
gagaggcaaatgtctattta

SEQ ID NO: 64960 - DNA, 20 bp, Artificial Sequence
  Description of Artificial Sequence: Synthetic oligonucleotide
  Target: SCN9A; (-) strand; PAM type: YTN; PAM sequence: TTT
tgagaggcaaatgtctattt

SEQ ID NO: 64961 - DNA, 20 bp, Artificial Sequence
  Description of Artificial Sequence: Synthetic oligonucleotide
  Target: SCN9A; (-) strand; PAM type: YTN; PAM sequence: TTA
gtatattttgagaggcaaat

SEQ ID NO: 64962 - DNA, 20 bp, Artificial Sequence
  Description of Artificial Sequence: Synthetic oligonucleotide
  Target: SCN9A; (-) strand; PAM type: YTN; PAM sequence: TTT
agtatattttgagaggcaaa

SEQ ID NO: 64963 - DNA, 20 bp, Artificial Sequence
  Description of Artificial Sequence: Synthetic oligonucleotide
  Target: SCN9A; (-) strand; PAM type: YTN; PAM sequence: TTG
gatgcaggagaatagtttag

SEQ ID NO: 64964 - DNA, 20 bp, Artificial Sequence
  Description of Artificial Sequence: Synthetic oligonucleotide
  Target: SCN9A; (-) strand; PAM type: YTN; PAM sequence: TTA
caggtgaattggatgcagga

SEQ ID NO: 64965 - DNA, 20 bp, Artificial Sequence
  Description of Artificial Sequence: Synthetic oligonucleotide
  Target: SCN9A; (-) strand; PAM type: YTN; PAM sequence: CTG
tattacaggtgaattggatg

SEQ ID NO: 64966 - DNA, 20 bp, Artificial Sequence
  Description of Artificial Sequence: Synthetic oligonucleotide
  Target: SCN9A; (-) strand; PAM type: YTN; PAM sequence: TTA
tctgtattacaggtgaattg

SEQ ID NO: 64967 - DNA, 20 bp, Artificial Sequence
  Description of Artificial Sequence: Synthetic oligonucleotide
  Target: SCN9A; (-) strand; PAM type: YTN; PAM sequence: TTT
atctgtattacaggtgaatt

SEQ ID NO: 64968 - DNA, 20 bp, Artificial Sequence
  Description of Artificial Sequence: Synthetic oligonucleotide
  Target: SCN9A; (-) strand; PAM type: YTN; PAM sequence: CTT
tatctgtattacaggtgaat

SEQ ID NO: 64969 - DNA, 20 bp, Artificial Sequence
  Description of Artificial Sequence: Synthetic oligonucleotide
  Target: SCN9A; (-) strand; PAM type: YTN; PAM sequence: TTC
tttatctgtattacaggtga

SEQ ID NO: 64970 - DNA, 20 bp, Artificial Sequence
  Description of Artificial Sequence: Synthetic oligonucleotide
  Target: SCN9A; (-) strand; PAM type: YTN; PAM sequence: TTG
ttctttatctgtattacagg

SEQ ID NO: 64971 - DNA, 20 bp, Artificial Sequence
  Description of Artificial Sequence: Synthetic oligonucleotide
  Target: SCN9A; (-) strand; PAM type: YTN; PAM sequence: TTT
gttctttatctgtattacag

SEQ ID NO: 64972 - DNA, 20 bp, Artificial Sequence
  Description of Artificial Sequence: Synthetic oligonucleotide
  Target: SCN9A; (-) strand; PAM type: YTN; PAM sequence: CTT
tgttctttatctgtattaca

SEQ ID NO: 64973 - DNA, 20 bp, Artificial Sequence
  Description of Artificial Sequence: Synthetic oligonucleotide
  Target: SCN9A; (-) strand; PAM type: YTN; PAM sequence: CTC
tttgttctttatctgtatta

SEQ ID NO: 64974 - DNA, 20 bp, Artificial Sequence
  Description of Artificial Sequence: Synthetic oligonucleotide
  Target: SCN9A; (-) strand; PAM type: YTN; PAM sequence: TTG
ctctttgttctttatctgta

SEQ ID NO: 64975 - DNA, 20 bp, Artificial Sequence
  Description of Artificial Sequence: Synthetic oligonucleotide
  Target: SCN9A; (-) strand; PAM type: YTN; PAM sequence: TTT
gctctttgttctttatctgt

SEQ ID NO: 64976 - DNA, 20 bp, Artificial Sequence
  Description of Artificial Sequence: Synthetic oligonucleotide
  Target: SCN9A; (-) strand; PAM type: YTN; PAM sequence: CTG
tttgctctttgttctttatc

SEQ ID NO: 64977 - DNA, 20 bp, Artificial Sequence
  Description of Artificial Sequence: Synthetic oligonucleotide
  Target: SCN9A; (-) strand; PAM type: YTN; PAM sequence: CTC
tgtttgctctttgttcttta

SEQ ID NO: 64978 - DNA, 20 bp, Artificial Sequence
  Description of Artificial Sequence: Synthetic oligonucleotide
  Target: SCN9A; (-) strand; PAM type: YTN; PAM sequence: TTA
actctgtttgctctttgttc

SEQ ID NO: 64979 - DNA, 20 bp, Artificial Sequence
  Description of Artificial Sequence: Synthetic oligonucleotide
  Target: SCN9A; (-) strand; PAM type: YTN; PAM sequence: TTT
aactctgtttgctctttgtt

SEQ ID NO: 64980 - DNA, 20 bp, Artificial Sequence
  Description of Artificial Sequence: Synthetic oligonucleotide
  Target: SCN9A; (-) strand; PAM type: YTN; PAM sequence: CTA
tttaactctgtttgctcttt

SEQ ID NO: 64981 - DNA, 20 bp, Artificial Sequence
  Description of Artificial Sequence: Synthetic oligonucleotide
  Target: SCN9A; (-) strand; PAM type: YTN; PAM sequence: TTA
agccagcccactatttaact

SEQ ID NO: 64982 - DNA, 20 bp, Artificial Sequence
  Description of Artificial Sequence: Synthetic oligonucleotide
  Target: SCN9A; (-) strand; PAM type: YTN; PAM sequence: TTC
agtgattaagccagcccact

SEQ ID NO: 64983 - DNA, 20 bp, Artificial Sequence
  Description of Artificial Sequence: Synthetic oligonucleotide
  Target: SCN9A; (-) strand; PAM type: YTN; PAM sequence: CTT
cagtgattaagccagcccac

SEQ ID NO: 64984 - DNA, 20 bp, Artificial Sequence
  Description of Artificial Sequence: Synthetic oligonucleotide
  Target: SCN9A; (-) strand; PAM type: YTN; PAM sequence: TTC
cttcagtgattaagccagcc

SEQ ID NO: 64985 - DNA, 20 bp, Artificial Sequence
  Description of Artificial Sequence: Synthetic oligonucleotide
  Target: SCN9A; (-) strand; PAM type: YTN; PAM sequence: CTT
ccttcagtgattaagccagc

SEQ ID NO: 64986 - DNA, 20 bp, Artificial Sequence
  Description of Artificial Sequence: Synthetic oligonucleotide
  Target: SCN9A; (-) strand; PAM type: YTN; PAM sequence: CTA
caaaaccacttccttcagtg

SEQ ID NO: 64987 - DNA, 20 bp, Artificial Sequence
  Description of Artificial Sequence: Synthetic oligonucleotide
  Target: SCN9A; (-) strand; PAM type: YTN; PAM sequence: TTC
ccctacaaaaccacttcctt

SEQ ID NO: 64988 - DNA, 20 bp, Artificial Sequence
  Description of Artificial Sequence: Synthetic oligonucleotide
  Target: SCN9A; (-) strand; PAM type: YTN; PAM sequence: TTT
cccctacaaaaccacttcct

SEQ ID NO: 64989 - DNA, 20 bp, Artificial Sequence
  Description of Artificial Sequence: Synthetic oligonucleotide
  Target: SCN9A; (-) strand; PAM type: YTN; PAM sequence: CTT
tcccctacaaaaccacttcc

SEQ ID NO: 64990 - DNA, 20 bp, Artificial Sequence
  Description of Artificial Sequence: Synthetic oligonucleotide
  Target: SCN9A; (-) strand; PAM type: YTN; PAM sequence: CTA
tcacaactttcccctacaaa

SEQ ID NO: 64991 - DNA, 20 bp, Artificial Sequence
  Description of Artificial Sequence: Synthetic oligonucleotide
  Target: SCN9A; (-) strand; PAM type: YTN; PAM sequence: TTA
caatctatcacaactttccc

SEQ ID NO: 64992 - DNA, 20 bp, Artificial Sequence
  Description of Artificial Sequence: Synthetic oligonucleotide
  Target: SCN9A; (-) strand; PAM type: YTN; PAM sequence: TTA
atagaatgttacaatctatc

SEQ ID NO: 64993 - DNA, 20 bp, Artificial Sequence
  Description of Artificial Sequence: Synthetic oligonucleotide
  Target: SCN9A; (-) strand; PAM type: YTN; PAM sequence: TTG
agcattaatagaatgttaca

SEQ ID NO: 64994 - DNA, 20 bp, Artificial Sequence
  Description of Artificial Sequence: Synthetic oligonucleotide
  Target: SCN9A; (-) strand; PAM type: YTN; PAM sequence: TTT
gagcattaatagaatgttac

SEQ ID NO: 64995 - DNA, 20 bp, Artificial Sequence
  Description of Artificial Sequence: Synthetic oligonucleotide
  Target: SCN9A; (-) strand; PAM type: YTN; PAM sequence: TTT
tgagcattaatagaatgtta

SEQ ID NO: 64996 - DNA, 20 bp, Artificial Sequence
  Description of Artificial Sequence: Synthetic oligonucleotide
  Target: SCN9A; (-) strand; PAM type: YTN; PAM sequence: TTT
ttgagcattaatagaatgtt

SEQ ID NO: 64997 - DNA, 20 bp, Artificial Sequence
  Description of Artificial Sequence: Synthetic oligonucleotide
  Target: SCN9A; (-) strand; PAM type: YTN; PAM sequence: TTT
tttgagcattaatagaatgt

SEQ ID NO: 64998 - DNA, 20 bp, Artificial Sequence
  Description of Artificial Sequence: Synthetic oligonucleotide
  Target: SCN9A; (-) strand; PAM type: YTN; PAM sequence: TTA
attttttgagcattaataga

SEQ ID NO: 64999 - DNA, 20 bp, Artificial Sequence
  Description of Artificial Sequence: Synthetic oligonucleotide
  Target: SCN9A; (-) strand; PAM type: YTN; PAM sequence: CTT
aattttttgagcattaatag

SEQ ID NO: 65000 - DNA, 20 bp, Artificial Sequence
  Description of Artificial Sequence: Synthetic oligonucleotide
  Target: SCN9A; (-) strand; PAM type: YTN; PAM sequence: TTA
acttaattttttgagcatta

SEQ ID NO: 65001 - DNA, 20 bp, Artificial Sequence
  Description of Artificial Sequence: Synthetic oligonucleotide
  Target: SCN9A; (-) strand; PAM type: YTN; PAM sequence: TTG
acattaacttaattttttga

SEQ ID NO: 65002 - DNA, 20 bp, Artificial Sequence
  Description of Artificial Sequence: Synthetic oligonucleotide
  Target: SCN9A; (-) strand; PAM type: YTN; PAM sequence: TTC
attgacattaacttaatttt

SEQ ID NO: 65003 - DNA, 20 bp, Artificial Sequence
  Description of Artificial Sequence: Synthetic oligonucleotide
  Target: SCN9A; (-) strand; PAM type: YTN; PAM sequence: TTA
gaattcattgacattaactt

SEQ ID NO: 65004 - DNA, 20 bp, Artificial Sequence
  Description of Artificial Sequence: Synthetic oligonucleotide
  Target: SCN9A; (-) strand; PAM type: YTN; PAM sequence: TTG
tgcagaaaggtggtattaga

SEQ ID NO: 65005 - DNA, 20 bp, Artificial Sequence
  Description of Artificial Sequence: Synthetic oligonucleotide
  Target: SCN9A; (-) strand; PAM type: YTN; PAM sequence: TTT
gtgcagaaaggtggtattag

SEQ ID NO: 65006 - DNA, 20 bp, Artificial Sequence
  Description of Artificial Sequence: Synthetic oligonucleotide
  Target: SCN9A; (-) strand; PAM type: YTN; PAM sequence: TTT
tgtgcagaaaggtggtatta

SEQ ID NO: 65007 - DNA, 20 bp, Artificial Sequence
  Description of Artificial Sequence: Synthetic oligonucleotide
  Target: SCN9A; (-) strand; PAM type: YTN; PAM sequence: TTC
attttgtgcagaaaggtggt

SEQ ID NO: 65008 - DNA, 20 bp, Artificial Sequence
  Description of Artificial Sequence: Synthetic oligonucleotide
  Target: SCN9A; (-) strand; PAM type: YTN; PAM sequence: TTT
cattttgtgcagaaaggtgg

SEQ ID NO: 65009 - DNA, 20 bp, Artificial Sequence
  Description of Artificial Sequence: Synthetic oligonucleotide
  Target: SCN9A; (-) strand; PAM type: YTN; PAM sequence: TTA
caagtttcattttgtgcaga

SEQ ID NO: 65010 - DNA, 20 bp, Artificial Sequence
  Description of Artificial Sequence: Synthetic oligonucleotide
  Target: SCN9A; (-) strand; PAM type: YTN; PAM sequence: TTG
aaaattacaagtttcatttt

SEQ ID NO: 65011 - DNA, 20 bp, Artificial Sequence
  Description of Artificial Sequence: Synthetic oligonucleotide
  Target: SCN9A; (-) strand; PAM type: YTN; PAM sequence: CTA
caagttgaaaattacaagtt

SEQ ID NO: 65012 - DNA, 20 bp, Artificial Sequence
  Description of Artificial Sequence: Synthetic oligonucleotide
  Target: SCN9A; (-) strand; PAM type: YTN; PAM sequence: CTA
tctacaagttgaaaattaca

SEQ ID NO: 65013 - DNA, 20 bp, Artificial Sequence
  Description of Artificial Sequence: Synthetic oligonucleotide
  Target: SCN9A; (-) strand; PAM type: YTN; PAM sequence: TTC
tatctacaagttgaaaatta

SEQ ID NO: 65014 - DNA, 20 bp, Artificial Sequence
  Description of Artificial Sequence: Synthetic oligonucleotide
  Target: SCN9A; (-) strand; PAM type: YTN; PAM sequence: TTC
aaaaatattctatctacaag

SEQ ID NO: 65015 - DNA, 20 bp, Artificial Sequence
  Description of Artificial Sequence: Synthetic oligonucleotide
  Target: SCN9A; (-) strand; PAM type: YTN; PAM sequence: TTC
ataagcacaattcaaaaata

SEQ ID NO: 65016 - DNA, 20 bp, Artificial Sequence
  Description of Artificial Sequence: Synthetic oligonucleotide
  Target: SCN9A; (-) strand; PAM type: YTN; PAM sequence: TTA
tacaaaaaagttcataagca

SEQ ID NO: 65017 - DNA, 20 bp, Artificial Sequence
  Description of Artificial Sequence: Synthetic oligonucleotide
  Target: SCN9A; (-) strand; PAM type: YTN; PAM sequence: TTC
caagtataaaagaaagatca

SEQ ID NO: 65018 - DNA, 20 bp, Artificial Sequence
  Description of Artificial Sequence: Synthetic oligonucleotide
  Target: SCN9A; (-) strand; PAM type: YTN; PAM sequence: TTT
ccaagtataaaagaaagatc

SEQ ID NO: 65019 - DNA, 20 bp, Artificial Sequence
  Description of Artificial Sequence: Synthetic oligonucleotide
  Target: SCN9A; (-) strand; PAM type: YTN; PAM sequence: TTA
tccagtgtataacggtttcc

SEQ ID NO: 65020 - DNA, 20 bp, Artificial Sequence
  Description of Artificial Sequence: Synthetic oligonucleotide
  Target: SCN9A; (-) strand; PAM type: YTN; PAM sequence: TTA
attatccagtgtataacggt

SEQ ID NO: 65021 - DNA, 20 bp, Artificial Sequence
  Description of Artificial Sequence: Synthetic oligonucleotide
  Target: SCN9A; (-) strand; PAM type: YTN; PAM sequence: TTT
aattatccagtgtataacgg

SEQ ID NO: 65022 - DNA, 20 bp, Artificial Sequence
  Description of Artificial Sequence: Synthetic oligonucleotide
  Target: SCN9A; (-) strand; PAM type: YTN; PAM sequence: TTT
taattatccagtgtataacg

SEQ ID NO: 65023 - DNA, 20 bp, Artificial Sequence
  Description of Artificial Sequence: Synthetic oligonucleotide
  Target: SCN9A; (-) strand; PAM type: YTN; PAM sequence: CTA
ttttaattatccagtgtata

SEQ ID NO: 65024 - DNA, 20 bp, Artificial Sequence
  Description of Artificial Sequence: Synthetic oligonucleotide
  Target: SCN9A; (-) strand; PAM type: YTN; PAM sequence: CTG
ctattttaattatccagtgt

SEQ ID NO: 65025 - DNA, 20 bp, Artificial Sequence
  Description of Artificial Sequence: Synthetic oligonucleotide
  Target: SCN9A; (-) strand; PAM type: YTN; PAM sequence: CTC
tgctattttaattatccagt

SEQ ID NO: 65026 - DNA, 20 bp, Artificial Sequence
  Description of Artificial Sequence: Synthetic oligonucleotide
  Target: SCN9A; (-) strand; PAM type: YTN; PAM sequence: CTG
caatctctgctattttaatt

SEQ ID NO: 65027 - DNA, 20 bp, Artificial Sequence
  Description of Artificial Sequence: Synthetic oligonucleotide
  Target: SCN9A; (-) strand; PAM type: YTN; PAM sequence: TTA
tgactgcaatctctgctatt

SEQ ID NO: 65028 - DNA, 20 bp, Artificial Sequence
  Description of Artificial Sequence: Synthetic oligonucleotide
  Target: SCN9A; (-) strand; PAM type: YTN; PAM sequence: CTA
attatgactgcaatctctgc

SEQ ID NO: 65029 - DNA, 20 bp, Artificial Sequence
  Description of Artificial Sequence: Synthetic oligonucleotide
  Target: SCN9A; (-) strand; PAM type: YTN; PAM sequence: CTA
caaacctaattatgactgca

SEQ ID NO: 65030 - DNA, 20 bp, Artificial Sequence
  Description of Artificial Sequence: Synthetic oligonucleotide
  Target: SCN9A; (-) strand; PAM type: YTN; PAM sequence: TTA
tccctacaaacctaattatg

SEQ ID NO: 65031 - DNA, 20 bp, Artificial Sequence
  Description of Artificial Sequence: Synthetic oligonucleotide
  Target: SCN9A; (-) strand; PAM type: YTN; PAM sequence: CTG
ttatccctacaaacctaatt

SEQ ID NO: 65032 - DNA, 20 bp, Artificial Sequence
  Description of Artificial Sequence: Synthetic oligonucleotide
  Target: SCN9A; (-) strand; PAM type: YTN; PAM sequence: TTC
actgttatccctacaaacct

SEQ ID NO: 65033 - DNA, 20 bp, Artificial Sequence
  Description of Artificial Sequence: Synthetic oligonucleotide
  Target: SCN9A; (-) strand; PAM type: YTN; PAM sequence: CTT
cactgttatccctacaaacc

SEQ ID NO: 65034 - DNA, 20 bp, Artificial Sequence
  Description of Artificial Sequence: Synthetic oligonucleotide
  Target: SCN9A; (-) strand; PAM type: YTN; PAM sequence: CTA
ccaaatcttcactgttatcc

SEQ ID NO: 65035 - DNA, 20 bp, Artificial Sequence
  Description of Artificial Sequence: Synthetic oligonucleotide
  Target: SCN9A; (-) strand; PAM type: YTN; PAM sequence: TTC
agcctaccaaatcttcactg

SEQ ID NO: 65036 - DNA, 20 bp, Artificial Sequence
  Description of Artificial Sequence: Synthetic oligonucleotide
  Target: SCN9A; (-) strand; PAM type: YTN; PAM sequence: TTT
cagcctaccaaatcttcact

SEQ ID NO: 65037 - DNA, 20 bp, Artificial Sequence
  Description of Artificial Sequence: Synthetic oligonucleotide
  Target: SCN9A; (-) strand; PAM type: YTN; PAM sequence: CTT
tcagcctaccaaatcttcac

SEQ ID NO: 65038 - DNA, 20 bp, Artificial Sequence
  Description of Artificial Sequence: Synthetic oligonucleotide
  Target: SCN9A; (-) strand; PAM type: YTN; PAM sequence: TTA
gagatctttcagcctaccaa

SEQ ID NO: 65039 - DNA, 20 bp, Artificial Sequence
  Description of Artificial Sequence: Synthetic oligonucleotide
  Target: SCN9A; (-) strand; PAM type: YTN; PAM sequence: CTC
aagtgaacattagagatctt

SEQ ID NO: 65040 - DNA, 20 bp, Artificial Sequence
  Description of Artificial Sequence: Synthetic oligonucleotide
  Target: SCN9A; (-) strand; PAM type: YTN; PAM sequence: TTA
accagcctcaagtgaacatt

SEQ ID NO: 65041 - DNA, 20 bp, Artificial Sequence
  Description of Artificial Sequence: Synthetic oligonucleotide
  Target: SCN9A; (-) strand; PAM type: YTN; PAM sequence: TTT
aaccagcctcaagtgaacat

SEQ ID NO: 65042 - DNA, 20 bp, Artificial Sequence
  Description of Artificial Sequence: Synthetic oligonucleotide
  Target: SCN9A; (-) strand; PAM type: YTN; PAM sequence: TTT
taaccagcctcaagtgaaca

SEQ ID NO: 65043 - DNA, 20 bp, Artificial Sequence
  Description of Artificial Sequence: Synthetic oligonucleotide
  Target: SCN9A; (-) strand; PAM type: YTN; PAM sequence: TTG
ggttttaaccagcctcaagt

SEQ ID NO: 65044 - DNA, 20 bp, Artificial Sequence
  Description of Artificial Sequence: Synthetic oligonucleotide
  Target: SCN9A; (-) strand; PAM type: YTN; PAM sequence: CTT
gggttttaaccagcctcaag

SEQ ID NO: 65045 - DNA, 20 bp, Artificial Sequence
  Description of Artificial Sequence: Synthetic oligonucleotide
  Target: SCN9A; (-) strand; PAM type: YTN; PAM sequence: CTC
caggatggggataagaaact

SEQ ID NO: 65046 - DNA, 20 bp, Artificial Sequence
  Description of Artificial Sequence: Synthetic oligonucleotide
  Target: SCN9A; (-) strand; PAM type: YTN; PAM sequence: CTG
agtcagaaactccaggatgg

SEQ ID NO: 65047 - DNA, 20 bp, Artificial Sequence
  Description of Artificial Sequence: Synthetic oligonucleotide
  Target: SCN9A; (-) strand; PAM type: YTN; PAM sequence: CTA
ctgagtcagaaactccagga

SEQ ID NO: 65048 - DNA, 20 bp, Artificial Sequence
  Description of Artificial Sequence: Synthetic oligonucleotide
  Target: SCN9A; (-) strand; PAM type: YTN; PAM sequence: CTC
accccagacctactgagtca

SEQ ID NO: 65049 - DNA, 20 bp, Artificial Sequence
  Description of Artificial Sequence: Synthetic oligonucleotide
  Target: SCN9A; (-) strand; PAM type: YTN; PAM sequence: TTG
gatctcaccccagacctact

SEQ ID NO: 65050 - DNA, 20 bp, Artificial Sequence
  Description of Artificial Sequence: Synthetic oligonucleotide
  Target: SCN9A; (-) strand; PAM type: YTN; PAM sequence: CTT
ggatctcaccccagacctac

SEQ ID NO: 65051 - DNA, 20 bp, Artificial Sequence
  Description of Artificial Sequence: Synthetic oligonucleotide
  Target: SCN9A; (-) strand; PAM type: YTN; PAM sequence: TTC
ttggatctcaccccagacct

SEQ ID NO: 65052 - DNA, 20 bp, Artificial Sequence
  Description of Artificial Sequence: Synthetic oligonucleotide
  Target: SCN9A; (-) strand; PAM type: YTN; PAM sequence: CTG
tatcaaaaaaaaaaaaaaaa

SEQ ID NO: 65053 - DNA, 20 bp, Artificial Sequence
  Description of Artificial Sequence: Synthetic oligonucleotide
  Target: SCN9A; (-) strand; PAM type: YTN; PAM sequence: CTC
tgtatcaaaaaaaaaaaaaa

SEQ ID NO: 65054 - DNA, 20 bp, Artificial Sequence
  Description of Artificial Sequence: Synthetic oligonucleotide
  Target: SCN9A; (-) strand; PAM type: YTN; PAM sequence: CTG
gggaacagagcaagactctg

SEQ ID NO: 65055 - DNA, 20 bp, Artificial Sequence
  Description of Artificial Sequence: Synthetic oligonucleotide
  Target: SCN9A; (-) strand; PAM type: YTN; PAM sequence: CTC
cagcctggggaacagagcaa

SEQ ID NO: 65056 - DNA, 20 bp, Artificial Sequence
  Description of Artificial Sequence: Synthetic oligonucleotide
  Target: SCN9A; (-) strand; PAM type: YTN; PAM sequence: CTG
cactccagcctggggaacag

SEQ ID NO: 65057 - DNA, 20 bp, Artificial Sequence
  Description of Artificial Sequence: Synthetic oligonucleotide
  Target: SCN9A; (-) strand; PAM type: YTN; PAM sequence: TTG
cagtgagccgagatcatgca

SEQ ID NO: 65058 - DNA, 20 bp, Artificial Sequence
  Description of Artificial Sequence: Synthetic oligonucleotide
  Target: SCN9A; (-) strand; PAM type: YTN; PAM sequence: TTG
aacccgggaggcagaggttg

SEQ ID NO: 65059 - DNA, 20 bp, Artificial Sequence
  Description of Artificial Sequence: Synthetic oligonucleotide
  Target: SCN9A; (-) strand; PAM type: YTN; PAM sequence: CTT
gaacccgggaggcagaggtt

SEQ ID NO: 65060 - DNA, 20 bp, Artificial Sequence
  Description of Artificial Sequence: Synthetic oligonucleotide
  Target: SCN9A; (-) strand; PAM type: YTN; PAM sequence: CTG
aggcagaagaatcgcttgaa

SEQ ID NO: 65061 - DNA, 20 bp, Artificial Sequence
  Description of Artificial Sequence: Synthetic oligonucleotide
  Target: SCN9A; (-) strand; PAM type: YTN; PAM sequence: CTA
gggaggctgaggcagaagaa

SEQ ID NO: 65062 - DNA, 20 bp, Artificial Sequence
  Description of Artificial Sequence: Synthetic oligonucleotide
  Target: SCN9A; (-) strand; PAM type: YTN; PAM sequence: CTA
ctagggaggctgaggcagaa

SEQ ID NO: 65063 - DNA, 20 bp, Artificial Sequence
  Description of Artificial Sequence: Synthetic oligonucleotide
  Target: SCN9A; (-) strand; PAM type: YTN; PAM sequence: CTC
agctactagggaggctgagg

SEQ ID NO: 65064 - DNA, 20 bp, Artificial Sequence
  Description of Artificial Sequence: Synthetic oligonucleotide
  Target: SCN9A; (-) strand; PAM type: YTN; PAM sequence: CTG
tagtctcagctactagggag

SEQ ID NO: 65065 - DNA, 20 bp, Artificial Sequence
  Description of Artificial Sequence: Synthetic oligonucleotide
  Target: SCN9A; (-) strand; PAM type: YTN; PAM sequence: CTC
acctgtagtctcagctacta

SEQ ID NO: 65066 - DNA, 20 bp, Artificial Sequence
  Description of Artificial Sequence: Synthetic oligonucleotide
  Target: SCN9A; (-) strand; PAM type: YTN; PAM sequence: TTA
cccgggcatagtggtgctca

SEQ ID NO: 65067 - DNA, 20 bp, Artificial Sequence
  Description of Artificial Sequence: Synthetic oligonucleotide
  Target: SCN9A; (-) strand; PAM type: YTN; PAM sequence: CTA
aaaatgcaaaaaattacccg

SEQ ID NO: 65068 - DNA, 20 bp, Artificial Sequence
  Description of Artificial Sequence: Synthetic oligonucleotide
  Target: SCN9A; (-) strand; PAM type: YTN; PAM sequence: CTA
ctaaaaatgcaaaaaattac

SEQ ID NO: 65069 - DNA, 20 bp, Artificial Sequence
  Description of Artificial Sequence: Synthetic oligonucleotide
  Target: SCN9A; (-) strand; PAM type: YTN; PAM sequence: CTC
tactaaaaatgcaaaaaatt

SEQ ID NO: 65070 - DNA, 20 bp, Artificial Sequence
  Description of Artificial Sequence: Synthetic oligonucleotide
  Target: SCN9A; (-) strand; PAM type: YTN; PAM sequence: CTG
gccaatatggtgaaacccca

SEQ ID NO: 65071 - DNA, 20 bp, Artificial Sequence
  Description of Artificial Sequence: Synthetic oligonucleotide
  Target: SCN9A; (-) strand; PAM type: YTN; PAM sequence: TTC
gagaccagcctggccaatat

SEQ ID NO: 65072 - DNA, 20 bp, Artificial Sequence
  Description of Artificial Sequence: Synthetic oligonucleotide
  Target: SCN9A; (-) strand; PAM type: YTN; PAM sequence: TTA
aaaagacggacggatcatga

SEQ ID NO: 65073 - DNA, 20 bp, Artificial Sequence
  Description of Artificial Sequence: Synthetic oligonucleotide
  Target: SCN9A; (-) strand; PAM type: YTN; PAM sequence: TTA
ttaaaaagacggacggatca

SEQ ID NO: 65074 - DNA, 20 bp, Artificial Sequence
  Description of Artificial Sequence: Synthetic oligonucleotide
  Target: SCN9A; (-) strand; PAM type: YTN; PAM sequence: CTT
attaaaaagacggacggatc

SEQ ID NO: 65075 - DNA, 20 bp, Artificial Sequence
  Description of Artificial Sequence: Synthetic oligonucleotide
  Target: SCN9A; (-) strand; PAM type: YTN; PAM sequence: CTA
caaacttattaaaaagacgg

SEQ ID NO: 65076 - DNA, 20 bp, Artificial Sequence
  Description of Artificial Sequence: Synthetic oligonucleotide
  Target: SCN9A; (-) strand; PAM type: YTN; PAM sequence: TTA
tctacaaacttattaaaaag

SEQ ID NO: 65077 - DNA, 20 bp, Artificial Sequence
  Description of Artificial Sequence: Synthetic oligonucleotide
  Target: SCN9A; (-) strand; PAM type: YTN; PAM sequence: TTA
gcattatctacaaacttatt

SEQ ID NO: 65078 - DNA, 20 bp, Artificial Sequence
  Description of Artificial Sequence: Synthetic oligonucleotide
  Target: SCN9A; (-) strand; PAM type: YTN; PAM sequence: CTA
ttagcattatctacaaactt

SEQ ID NO: 65079 - DNA, 20 bp, Artificial Sequence
  Description of Artificial Sequence: Synthetic oligonucleotide
  Target: SCN9A; (-) strand; PAM type: YTN; PAM sequence: CTG
accagctattagcattatct

SEQ ID NO: 65080 - DNA, 20 bp, Artificial Sequence
  Description of Artificial Sequence: Synthetic oligonucleotide
  Target: SCN9A; (-) strand; PAM type: YTN; PAM sequence: TTA
ctgaccagctattagcatta

SEQ ID NO: 65081 - DNA, 20 bp, Artificial Sequence
  Description of Artificial Sequence: Synthetic oligonucleotide
  Target: SCN9A; (-) strand; PAM type: YTN; PAM sequence: TTT
actgaccagctattagcatt

SEQ ID NO: 65082 - DNA, 20 bp, Artificial Sequence
  Description of Artificial Sequence: Synthetic oligonucleotide
  Target: SCN9A; (-) strand; PAM type: YTN; PAM sequence: TTA
agtgtggtttactgaccagc

SEQ ID NO: 65083 - DNA, 20 bp, Artificial Sequence
  Description of Artificial Sequence: Synthetic oligonucleotide
  Target: SCN9A; (-) strand; PAM type: YTN; PAM sequence: TTT
aagtgtggtttactgaccag

SEQ ID NO: 65084 - DNA, 20 bp, Artificial Sequence
  Description of Artificial Sequence: Synthetic oligonucleotide
  Target: SCN9A; (-) strand; PAM type: YTN; PAM sequence: CTT
taagtgtggtttactgacca

SEQ ID NO: 65085 - DNA, 20 bp, Artificial Sequence
  Description of Artificial Sequence: Synthetic oligonucleotide
  Target: SCN9A; (-) strand; PAM type: YTN; PAM sequence: CTG
atactttaagtgtggtttac

SEQ ID NO: 65086 - DNA, 20 bp, Artificial Sequence
  Description of Artificial Sequence: Synthetic oligonucleotide
  Target: SCN9A; (-) strand; PAM type: YTN; PAM sequence: TTA
ctgatactttaagtgtggtt

SEQ ID NO: 65087 - DNA, 20 bp, Artificial Sequence
  Description of Artificial Sequence: Synthetic oligonucleotide
  Target: SCN9A; (-) strand; PAM type: YTN; PAM sequence: CTT
actgatactttaagtgtggt

SEQ ID NO: 65088 - DNA, 20 bp, Artificial Sequence
  Description of Artificial Sequence: Synthetic oligonucleotide
  Target: SCN9A; (-) strand; PAM type: YTN; PAM sequence: TTA
gtccagcttactgatacttt

SEQ ID NO: 65089 - DNA, 20 bp, Artificial Sequence
  Description of Artificial Sequence: Synthetic oligonucleotide
  Target: SCN9A; (-) strand; PAM type: YTN; PAM sequence: TTA
acacggagattagtccagct

SEQ ID NO: 65090 - DNA, 20 bp, Artificial Sequence
  Description of Artificial Sequence: Synthetic oligonucleotide
  Target: SCN9A; (-) strand; PAM type: YTN; PAM sequence: TTT
aacacggagattagtccagc

SEQ ID NO: 65091 - DNA, 20 bp, Artificial Sequence
  Description of Artificial Sequence: Synthetic oligonucleotide
  Target: SCN9A; (-) strand; PAM type: YTN; PAM sequence: CTG
agcaatttaacacggagatt

SEQ ID NO: 65092 - DNA, 20 bp, Artificial Sequence
  Description of Artificial Sequence: Synthetic oligonucleotide
  Target: SCN9A; (-) strand; PAM type: YTN; PAM sequence: CTC
tgagcaatttaacacggaga

SEQ ID NO: 65093 - DNA, 20 bp, Artificial Sequence
  Description of Artificial Sequence: Synthetic oligonucleotide
  Target: SCN9A; (-) strand; PAM type: YTN; PAM sequence: TTC
tctgagcaatttaacacgga

SEQ ID NO: 65094 - DNA, 20 bp, Artificial Sequence
  Description of Artificial Sequence: Synthetic oligonucleotide
  Target: SCN9A; (-) strand; PAM type: YTN; PAM sequence: CTT
ctctgagcaatttaacacgg

SEQ ID NO: 65095 - DNA, 20 bp, Artificial Sequence
  Description of Artificial Sequence: Synthetic oligonucleotide
  Target: SCN9A; (-) strand; PAM type: YTN; PAM sequence: TTA
ccttctctgagcaatttaac

SEQ ID NO: 65096 - DNA, 20 bp, Artificial Sequence
  Description of Artificial Sequence: Synthetic oligonucleotide
  Target: SCN9A; (-) strand; PAM type: YTN; PAM sequence: CTT
accttctctgagcaatttaa

SEQ ID NO: 65097 - DNA, 20 bp, Artificial Sequence
  Description of Artificial Sequence: Synthetic oligonucleotide
  Target: SCN9A; (-) strand; PAM type: YTN; PAM sequence: CTA
ccttaccttctctgagcaat

SEQ ID NO: 65098 - DNA, 20 bp, Artificial Sequence
  Description of Artificial Sequence: Synthetic oligonucleotide
  Target: SCN9A; (-) strand; PAM type: YTN; PAM sequence: CTC
cctaccttaccttctctgag

SEQ ID NO: 65099 - DNA, 20 bp, Artificial Sequence
  Description of Artificial Sequence: Synthetic oligonucleotide
  Target: SCN9A; (-) strand; PAM type: YTN; PAM sequence: CTG
cctccctaccttaccttctc

SEQ ID NO: 65100 - DNA, 20 bp, Artificial Sequence
  Description of Artificial Sequence: Synthetic oligonucleotide
  Target: SCN9A; (-) strand; PAM type: YTN; PAM sequence: TTA
actgcctccctaccttacct

SEQ ID NO: 65101 - DNA, 20 bp, Artificial Sequence
  Description of Artificial Sequence: Synthetic oligonucleotide
  Target: SCN9A; (-) strand; PAM type: YTN; PAM sequence: CTT
aactgcctccctaccttacc

SEQ ID NO: 65102 - DNA, 20 bp, Artificial Sequence
  Description of Artificial Sequence: Synthetic oligonucleotide
  Target: SCN9A; (-) strand; PAM type: YTN; PAM sequence: TTA
cttaactgcctccctacctt

SEQ ID NO: 65103 - DNA, 20 bp, Artificial Sequence
  Description of Artificial Sequence: Synthetic oligonucleotide
  Target: SCN9A; (-) strand; PAM type: YTN; PAM sequence: TTT
acttaactgcctccctacct

SEQ ID NO: 65104 - DNA, 20 bp, Artificial Sequence
  Description of Artificial Sequence: Synthetic oligonucleotide
  Target: SCN9A; (-) strand; PAM type: YTN; PAM sequence: TTG
tttacttaactgcctcccta

SEQ ID NO: 65105 - DNA, 20 bp, Artificial Sequence
  Description of Artificial Sequence: Synthetic oligonucleotide
  Target: SCN9A; (-) strand; PAM type: YTN; PAM sequence: TTT
gtttacttaactgcctccct

SEQ ID NO: 65106 - DNA, 20 bp, Artificial Sequence
  Description of Artificial Sequence: Synthetic oligonucleotide
  Target: SCN9A; (-) strand; PAM type: YTN; PAM sequence: TTA
tttgtttacttaactgcctc

SEQ ID NO: 65107 - DNA, 20 bp, Artificial Sequence
  Description of Artificial Sequence: Synthetic oligonucleotide
  Target: SCN9A; (-) strand; PAM type: YTN; PAM sequence: CTT
atttgtttacttaactgcct

SEQ ID NO: 65108 - DNA, 20 bp, Artificial Sequence
  Description of Artificial Sequence: Synthetic oligonucleotide
  Target: SCN9A; (-) strand; PAM type: YTN; PAM sequence: TTA
cttatttgtttacttaactg

SEQ ID NO: 65109 - DNA, 20 bp, Artificial Sequence
  Description of Artificial Sequence: Synthetic oligonucleotide
  Target: SCN9A; (-) strand; PAM type: YTN; PAM sequence: TTT
acttatttgtttacttaact

SEQ ID NO: 65110 - DNA, 20 bp, Artificial Sequence
  Description of Artificial Sequence: Synthetic oligonucleotide
  Target: SCN9A; (-) strand; PAM type: YTN; PAM sequence: TTT
tacttatttgtttacttaac

SEQ ID NO: 65111 - DNA, 20 bp, Artificial Sequence
  Description of Artificial Sequence: Synthetic oligonucleotide
  Target: SCN9A; (-) strand; PAM type: YTN; PAM sequence: TTG
tattttacttatttgtttac

SEQ ID NO: 65112 - DNA, 20 bp, Artificial Sequence
  Description of Artificial Sequence: Synthetic oligonucleotide
  Target: SCN9A; (-) strand; PAM type: YTN; PAM sequence: TTA
tattgtattttacttatttg

SEQ ID NO: 65113 - DNA, 20 bp, Artificial Sequence
  Description of Artificial Sequence: Synthetic oligonucleotide
  Target: SCN9A; (-) strand; PAM type: YTN; PAM sequence: CTC
attatattgtattttactta

SEQ ID NO: 65114 - DNA, 20 bp, Artificial Sequence
  Description of Artificial Sequence: Synthetic oligonucleotide
  Target: SCN9A; (-) strand; PAM type: YTN; PAM sequence: CTA
aaatcctcattatattgtat

SEQ ID NO: 65115 - DNA, 20 bp, Artificial Sequence
  Description of Artificial Sequence: Synthetic oligonucleotide
  Target: SCN9A; (-) strand; PAM type: YTN; PAM sequence: TTC
agacacctaaaatcctcatt

SEQ ID NO: 65116 - DNA, 20 bp, Artificial Sequence
  Description of Artificial Sequence: Synthetic oligonucleotide
  Target: SCN9A; (-) strand; PAM type: YTN; PAM sequence: CTG
ttcagacacctaaaatcctc

SEQ ID NO: 65117 - DNA, 20 bp, Artificial Sequence
  Description of Artificial Sequence: Synthetic oligonucleotide
  Target: SCN9A; (-) strand; PAM type: YTN; PAM sequence: CTC
tgttcagacacctaaaatcc

SEQ ID NO: 65118 - DNA, 20 bp, Artificial Sequence
  Description of Artificial Sequence: Synthetic oligonucleotide
  Target: SCN9A; (-) strand; PAM type: YTN; PAM sequence: CTC
tctgttcagacacctaaaat

SEQ ID NO: 65119 - DNA, 20 bp, Artificial Sequence
  Description of Artificial Sequence: Synthetic oligonucleotide
  Target: SCN9A; (-) strand; PAM type: YTN; PAM sequence: CTC
tctctgttcagacacctaaa

SEQ ID NO: 65120 - DNA, 20 bp, Artificial Sequence
  Description of Artificial Sequence: Synthetic oligonucleotide
  Target: SCN9A; (-) strand; PAM type: YTN; PAM sequence: TTC
tctctctgttcagacaccta

SEQ ID NO: 65121 - DNA, 20 bp, Artificial Sequence
  Description of Artificial Sequence: Synthetic oligonucleotide
  Target: SCN9A; (-) strand; PAM type: YTN; PAM sequence: CTG
gatattctctctctgttcag

SEQ ID NO: 65122 - DNA, 20 bp, Artificial Sequence
  Description of Artificial Sequence: Synthetic oligonucleotide
  Target: SCN9A; (-) strand; PAM type: YTN; PAM sequence: TTG
tccgtccaccaggagacata

SEQ ID NO: 65123 - DNA, 20 bp, Artificial Sequence
  Description of Artificial Sequence: Synthetic oligonucleotide
  Target: SCN9A; (-) strand; PAM type: YTN; PAM sequence: CTT
gtccgtccaccaggagacat

SEQ ID NO: 65124 - DNA, 20 bp, Artificial Sequence
  Description of Artificial Sequence: Synthetic oligonucleotide
  Target: SCN9A; (-) strand; PAM type: YTN; PAM sequence: TTG
ccttgtccgtccaccaggag

SEQ ID NO: 65125 - DNA, 20 bp, Artificial Sequence
  Description of Artificial Sequence: Synthetic oligonucleotide
  Target: SCN9A; (-) strand; PAM type: YTN; PAM sequence: TTA
aagttgccttgtccgtccac

SEQ ID NO: 65126 - DNA, 20 bp, Artificial Sequence
  Description of Artificial Sequence: Synthetic oligonucleotide
  Target: SCN9A; (-) strand; PAM type: YTN; PAM sequence: TTT
aaagttgccttgtccgtcca

SEQ ID NO: 65127 - DNA, 20 bp, Artificial Sequence
  Description of Artificial Sequence: Synthetic oligonucleotide
  Target: SCN9A; (-) strand; PAM type: YTN; PAM sequence: CTC
aatttaaagttgccttgtcc

SEQ ID NO: 65128 - DNA, 20 bp, Artificial Sequence
  Description of Artificial Sequence: Synthetic oligonucleotide
  Target: SCN9A; (-) strand; PAM type: YTN; PAM sequence: TTA
aggctcaatttaaagttgcc

SEQ ID NO: 65129 - DNA, 20 bp, Artificial Sequence
  Description of Artificial Sequence: Synthetic oligonucleotide
  Target: SCN9A; (-) strand; PAM type: YTN; PAM sequence: TTT
aaggctcaatttaaagttgc

SEQ ID NO: 65130 - DNA, 20 bp, Artificial Sequence
  Description of Artificial Sequence: Synthetic oligonucleotide
  Target: SCN9A; (-) strand; PAM type: YTN; PAM sequence: CTT
taaggctcaatttaaagttg

SEQ ID NO: 65131 - DNA, 20 bp, Artificial Sequence
  Description of Artificial Sequence: Synthetic oligonucleotide
  Target: SCN9A; (-) strand; PAM type: YTN; PAM sequence: CTG
tcctttaaggctcaatttaa

SEQ ID NO: 65132 - DNA, 20 bp, Artificial Sequence
  Description of Artificial Sequence: Synthetic oligonucleotide
  Target: SCN9A; (-) strand; PAM type: YTN; PAM sequence: CTA
tctgtcctttaaggctcaat

SEQ ID NO: 65133 - DNA, 20 bp, Artificial Sequence
  Description of Artificial Sequence: Synthetic oligonucleotide
  Target: SCN9A; (-) strand; PAM type: YTN; PAM sequence: TTG
tatagcagacaaacacctat

SEQ ID NO: 65134 - DNA, 20 bp, Artificial Sequence
  Description of Artificial Sequence: Synthetic oligonucleotide
  Target: SCN9A; (-) strand; PAM type: YTN; PAM sequence: TTT
gtatagcagacaaacaccta

SEQ ID NO: 65135 - DNA, 20 bp, Artificial Sequence
  Description of Artificial Sequence: Synthetic oligonucleotide
  Target: SCN9A; (-) strand; PAM type: YTN; PAM sequence: CTA
acccgtttgtatagcagaca

SEQ ID NO: 65136 - DNA, 20 bp, Artificial Sequence
  Description of Artificial Sequence: Synthetic oligonucleotide
  Target: SCN9A; (-) strand; PAM type: YTN; PAM sequence: CTG
tcccgaccctaacccgtttg

SEQ ID NO: 65137 - DNA, 20 bp, Artificial Sequence
  Description of Artificial Sequence: Synthetic oligonucleotide
  Target: SCN9A; (-) strand; PAM type: YTN; PAM sequence: CTG
ccctgtcccgaccctaaccc

SEQ ID NO: 65138 - DNA, 20 bp, Artificial Sequence
  Description of Artificial Sequence: Synthetic oligonucleotide
  Target: SCN9A; (-) strand; PAM type: YTN; PAM sequence: TTC
ccctgccctgtcccgaccct

SEQ ID NO: 65139 - DNA, 20 bp, Artificial Sequence
  Description of Artificial Sequence: Synthetic oligonucleotide
  Target: SCN9A; (-) strand; PAM type: YTN; PAM sequence: CTT
cccctgccctgtcccgaccc

SEQ ID NO: 65140 - DNA, 20 bp, Artificial Sequence
  Description of Artificial Sequence: Synthetic oligonucleotide
  Target: SCN9A; (-) strand; PAM type: YTN; PAM sequence: CTG
gaatgcttcccctgccctgt

SEQ ID NO: 65141 - DNA, 20 bp, Artificial Sequence
  Description of Artificial Sequence: Synthetic oligonucleotide
  Target: SCN9A; (-) strand; PAM type: YTN; PAM sequence: TTC
tggaatgcttcccctgccct

SEQ ID NO: 65142 - DNA, 20 bp, Artificial Sequence
  Description of Artificial Sequence: Synthetic oligonucleotide
  Target: SCN9A; (-) strand; PAM type: YTN; PAM sequence: CTG
ttctggaatgcttcccctgc

SEQ ID NO: 65143 - DNA, 20 bp, Artificial Sequence
  Description of Artificial Sequence: Synthetic oligonucleotide
  Target: SCN9A; (-) strand; PAM type: YTN; PAM sequence: CTC
tgttctggaatgcttcccct

SEQ ID NO: 65144 - DNA, 20 bp, Artificial Sequence
  Description of Artificial Sequence: Synthetic oligonucleotide
  Target: SCN9A; (-) strand; PAM type: YTN; PAM sequence: TTA
tgcctctgttctggaatgct

SEQ ID NO: 65145 - DNA, 20 bp, Artificial Sequence
  Description of Artificial Sequence: Synthetic oligonucleotide
  Target: SCN9A; (-) strand; PAM type: YTN; PAM sequence: TTT
atgcctctgttctggaatgc

SEQ ID NO: 65146 - DNA, 20 bp, Artificial Sequence
  Description of Artificial Sequence: Synthetic oligonucleotide
  Target: SCN9A; (-) strand; PAM type: YTN; PAM sequence: TTT
tatgcctctgttctggaatg

SEQ ID NO: 65147 - DNA, 20 bp, Artificial Sequence
  Description of Artificial Sequence: Synthetic oligonucleotide
  Target: SCN9A; (-) strand; PAM type: YTN; PAM sequence: CTA
ttttatgcctctgttctgga

SEQ ID NO: 65148 - DNA, 20 bp, Artificial Sequence
  Description of Artificial Sequence: Synthetic oligonucleotide
  Target: SCN9A; (-) strand; PAM type: YTN; PAM sequence: CTG
ctattttatgcctctgttct

SEQ ID NO: 65149 - DNA, 20 bp, Artificial Sequence
  Description of Artificial Sequence: Synthetic oligonucleotide
  Target: SCN9A; (-) strand; PAM type: YTN; PAM sequence: TTA
tacctgctattttatgcctc

SEQ ID NO: 65150 - DNA, 20 bp, Artificial Sequence
  Description of Artificial Sequence: Synthetic oligonucleotide
  Target: SCN9A; (-) strand; PAM type: YTN; PAM sequence: TTT
atacctgctattttatgcct

SEQ ID NO: 65151 - DNA, 20 bp, Artificial Sequence
  Description of Artificial Sequence: Synthetic oligonucleotide
  Target: SCN9A; (-) strand; PAM type: YTN; PAM sequence: CTC
cagatttatacctgctattt

SEQ ID NO: 65152 - DNA, 20 bp, Artificial Sequence
  Description of Artificial Sequence: Synthetic oligonucleotide
  Target: SCN9A; (-) strand; PAM type: YTN; PAM sequence: TTC
tccagatttatacctgctat

SEQ ID NO: 65153 - DNA, 20 bp, Artificial Sequence
  Description of Artificial Sequence: Synthetic oligonucleotide
  Target: SCN9A; (-) strand; PAM type: YTN; PAM sequence: CTT
ctccagatttatacctgcta

SEQ ID NO: 65154 - DNA, 20 bp, Artificial Sequence
  Description of Artificial Sequence: Synthetic oligonucleotide
  Target: SCN9A; (-) strand; PAM type: YTN; PAM sequence: TTC
ttctccagatttatacctgc

SEQ ID NO: 65155 - DNA, 20 bp, Artificial Sequence
  Description of Artificial Sequence: Synthetic oligonucleotide
  Target: SCN9A; (-) strand; PAM type: YTN; PAM sequence: TTT
cttctccagatttatacctg

SEQ ID NO: 65156 - DNA, 20 bp, Artificial Sequence
  Description of Artificial Sequence: Synthetic oligonucleotide
  Target: SCN9A; (-) strand; PAM type: YTN; PAM sequence: CTA
aaatttcttctccagattta

SEQ ID NO: 65157 - DNA, 20 bp, Artificial Sequence
  Description of Artificial Sequence: Synthetic oligonucleotide
  Target: SCN9A; (-) strand; PAM type: YTN; PAM sequence: CTC
taaaatttcttctccagatt

SEQ ID NO: 65158 - DNA, 20 bp, Artificial Sequence
  Description of Artificial Sequence: Synthetic oligonucleotide
  Target: SCN9A; (-) strand; PAM type: YTN; PAM sequence: CTC
ctctaaaatttcttctccag

SEQ ID NO: 65159 - DNA, 20 bp, Artificial Sequence
  Description of Artificial Sequence: Synthetic oligonucleotide
  Target: SCN9A; (-) strand; PAM type: YTN; PAM sequence: TTG
gtactcctctaaaatttctt

SEQ ID NO: 65160 - DNA, 20 bp, Artificial Sequence
  Description of Artificial Sequence: Synthetic oligonucleotide
  Target: SCN9A; (-) strand; PAM type: YTN; PAM sequence: CTC
atgtgttggtactcctctaa

SEQ ID NO: 65161 - DNA, 20 bp, Artificial Sequence
  Description of Artificial Sequence: Synthetic oligonucleotide
  Target: SCN9A; (-) strand; PAM type: YTN; PAM sequence: TTA
gtccatatcctcatgtgttg

SEQ ID NO: 65162 - DNA, 20 bp, Artificial Sequence
  Description of Artificial Sequence: Synthetic oligonucleotide
  Target: SCN9A; (-) strand; PAM type: YTN; PAM sequence: CTG
taattagtccatatcctcat

SEQ ID NO: 65163 - DNA, 20 bp, Artificial Sequence
  Description of Artificial Sequence: Synthetic oligonucleotide
  Target: SCN9A; (-) strand; PAM type: YTN; PAM sequence: TTC
tgtaattagtccatatcctc

SEQ ID NO: 65164 - DNA, 20 bp, Artificial Sequence
  Description of Artificial Sequence: Synthetic oligonucleotide
  Target: SCN9A; (-) strand; PAM type: YTN; PAM sequence: TTT
ctgtaattagtccatatcct

SEQ ID NO: 65165 - DNA, 20 bp, Artificial Sequence
  Description of Artificial Sequence: Synthetic oligonucleotide
  Target: SCN9A; (-) strand; PAM type: YTN; PAM sequence: TTT
tctgtaattagtccatatcc

SEQ ID NO: 65166 - DNA, 20 bp, Artificial Sequence
  Description of Artificial Sequence: Synthetic oligonucleotide
  Target: SCN9A; (-) strand; PAM type: YTN; PAM sequence: CTA
ttttctgtaattagtccata

SEQ ID NO: 65167 - DNA, 20 bp, Artificial Sequence
  Description of Artificial Sequence: Synthetic oligonucleotide
  Target: SCN9A; (-) strand; PAM type: YTN; PAM sequence: CTC
tattttctgtaattagtcca

SEQ ID NO: 65168 - DNA, 20 bp, Artificial Sequence
  Description of Artificial Sequence: Synthetic oligonucleotide
  Target: SCN9A; (-) strand; PAM type: YTN; PAM sequence: TTG
taacacacatggaggacaac

SEQ ID NO: 65169 - DNA, 20 bp, Artificial Sequence
  Description of Artificial Sequence: Synthetic oligonucleotide
  Target: SCN9A; (-) strand; PAM type: YTN; PAM sequence: TTT
gtaacacacatggaggacaa

SEQ ID NO: 65170 - DNA, 20 bp, Artificial Sequence
  Description of Artificial Sequence: Synthetic oligonucleotide
  Target: SCN9A; (-) strand; PAM type: YTN; PAM sequence: CTT
tgtaacacacatggaggaca

SEQ ID NO: 65171 - DNA, 20 bp, Artificial Sequence
  Description of Artificial Sequence: Synthetic oligonucleotide
  Target: SCN9A; (-) strand; PAM type: YTN; PAM sequence: TTA
aaccagcaactttgtaacac

SEQ ID NO: 65172 - DNA, 20 bp, Artificial Sequence
  Description of Artificial Sequence: Synthetic oligonucleotide
  Target: SCN9A; (-) strand; PAM type: YTN; PAM sequence: TTG
tattaaaccagcaactttgt

SEQ ID NO: 65173 - DNA, 20 bp, Artificial Sequence
  Description of Artificial Sequence: Synthetic oligonucleotide
  Target: SCN9A; (-) strand; PAM type: YTN; PAM sequence: TTA
aggattgtattaaaccagca

SEQ ID NO: 65174 - DNA, 20 bp, Artificial Sequence
  Description of Artificial Sequence: Synthetic oligonucleotide
  Target: SCN9A; (-) strand; PAM type: YTN; PAM sequence: TTT
aaggattgtattaaaccagc

SEQ ID NO: 65175 - DNA, 20 bp, Artificial Sequence
  Description of Artificial Sequence: Synthetic oligonucleotide
  Target: SCN9A; (-) strand; PAM type: YTN; PAM sequence: CTT
taaggattgtattaaaccag

SEQ ID NO: 65176 - DNA, 20 bp, Artificial Sequence
  Description of Artificial Sequence: Synthetic oligonucleotide
  Target: SCN9A; (-) strand; PAM type: YTN; PAM sequence: CTA
gctttaaggattgtattaaa

SEQ ID NO: 65177 - DNA, 20 bp, Artificial Sequence
  Description of Artificial Sequence: Synthetic oligonucleotide
  Target: SCN9A; (-) strand; PAM type: YTN; PAM sequence: CTA
ccataacctagctttaagga

SEQ ID NO: 65178 - DNA, 20 bp, Artificial Sequence
  Description of Artificial Sequence: Synthetic oligonucleotide
  Target: SCN9A; (-) strand; PAM type: YTN; PAM sequence: TTA
taatgaataacaactaccat

SEQ ID NO: 65179 - DNA, 20 bp, Artificial Sequence
  Description of Artificial Sequence: Synthetic oligonucleotide
  Target: SCN9A; (-) strand; PAM type: YTN; PAM sequence: TTA
gcagagacaaacaagttata

SEQ ID NO: 65180 - DNA, 20 bp, Artificial Sequence
  Description of Artificial Sequence: Synthetic oligonucleotide
  Target: SCN9A; (-) strand; PAM type: YTN; PAM sequence: CTC
aattagcagagacaaacaag

SEQ ID NO: 65181 - DNA, 20 bp, Artificial Sequence
  Description of Artificial Sequence: Synthetic oligonucleotide
  Target: SCN9A; (-) strand; PAM type: YTN; PAM sequence: CTG
aaaagatactcaattagcag

SEQ ID NO: 65182 - DNA, 20 bp, Artificial Sequence
  Description of Artificial Sequence: Synthetic oligonucleotide
  Target: SCN9A; (-) strand; PAM type: YTN; PAM sequence: CTG
cagagtgcctgaaaagatac

SEQ ID NO: 65183 - DNA, 20 bp, Artificial Sequence
  Description of Artificial Sequence: Synthetic oligonucleotide
  Target: SCN9A; (-) strand; PAM type: YTN; PAM sequence: TTA
ggctgcagagtgcctgaaaa

SEQ ID NO: 65184 - DNA, 20 bp, Artificial Sequence
  Description of Artificial Sequence: Synthetic oligonucleotide
  Target: SCN9A; (-) strand; PAM type: YTN; PAM sequence: CTT
aggctgcagagtgcctgaaa

SEQ ID NO: 65185 - DNA, 20 bp, Artificial Sequence
  Description of Artificial Sequence: Synthetic oligonucleotide
  Target: SCN9A; (-) strand; PAM type: YTN; PAM sequence: TTG
cacttaggctgcagagtgcc

SEQ ID NO: 65186 - DNA, 20 bp, Artificial Sequence
  Description of Artificial Sequence: Synthetic oligonucleotide
  Target: SCN9A; (-) strand; PAM type: YTN; PAM sequence: TTT
gcacttaggctgcagagtgc

SEQ ID NO: 65187 - DNA, 20 bp, Artificial Sequence
  Description of Artificial Sequence: Synthetic oligonucleotide
  Target: SCN9A; (-) strand; PAM type: YTN; PAM sequence: TTA
atttgcacttaggctgcaga

SEQ ID NO: 65188 - DNA, 20 bp, Artificial Sequence
  Description of Artificial Sequence: Synthetic oligonucleotide
  Target: SCN9A; (-) strand; PAM type: YTN; PAM sequence: CTT
aatttgcacttaggctgcag

SEQ ID NO: 65189 - DNA, 20 bp, Artificial Sequence
  Description of Artificial Sequence: Synthetic oligonucleotide
  Target: SCN9A; (-) strand; PAM type: YTN; PAM sequence: TTA
cttaatttgcacttaggctg

SEQ ID NO: 65190 - DNA, 20 bp, Artificial Sequence
  Description of Artificial Sequence: Synthetic oligonucleotide
  Target: SCN9A; (-) strand; PAM type: YTN; PAM sequence: TTT
acttaatttgcacttaggct

SEQ ID NO: 65191 - DNA, 20 bp, Artificial Sequence
  Description of Artificial Sequence: Synthetic oligonucleotide
  Target: SCN9A; (-) strand; PAM type: YTN; PAM sequence: CTC
agagagtttacttaatttgc

SEQ ID NO: 65192 - DNA, 20 bp, Artificial Sequence
  Description of Artificial Sequence: Synthetic oligonucleotide
  Target: SCN9A; (-) strand; PAM type: YTN; PAM sequence: CTA
aagctcagagagtttactta

SEQ ID NO: 65193 - DNA, 20 bp, Artificial Sequence
  Description of Artificial Sequence: Synthetic oligonucleotide
  Target: SCN9A; (-) strand; PAM type: YTN; PAM sequence: TTG
agaaaactaaagctcagaga

SEQ ID NO: 65194 - DNA, 20 bp, Artificial Sequence
  Description of Artificial Sequence: Synthetic oligonucleotide
  Target: SCN9A; (-) strand; PAM type: YTN; PAM sequence: TTT
gagaaaactaaagctcagag

SEQ ID NO: 65195 - DNA, 20 bp, Artificial Sequence
  Description of Artificial Sequence: Synthetic oligonucleotide
  Target: SCN9A; (-) strand; PAM type: YTN; PAM sequence: TTA
tatttgagaaaactaaagct

SEQ ID NO: 65196 - DNA, 20 bp, Artificial Sequence
  Description of Artificial Sequence: Synthetic oligonucleotide
  Target: SCN9A; (-) strand; PAM type: YTN; PAM sequence: CTA
aattatatttgagaaaacta

SEQ ID NO: 65197 - DNA, 20 bp, Artificial Sequence
  Description of Artificial Sequence: Synthetic oligonucleotide
  Target: SCN9A; (-) strand; PAM type: YTN; PAM sequence: TTA
taactaaattatatttgaga

SEQ ID NO: 65198 - DNA, 20 bp, Artificial Sequence
  Description of Artificial Sequence: Synthetic oligonucleotide
  Target: SCN9A; (-) strand; PAM type: YTN; PAM sequence: TTG
caaagtaagtggaattataa

SEQ ID NO: 65199 - DNA, 20 bp, Artificial Sequence
  Description of Artificial Sequence: Synthetic oligonucleotide
  Target: SCN9A; (-) strand; PAM type: YTN; PAM sequence: TTA
aaataacattgcaaagtaag

SEQ ID NO: 65200 - DNA, 20 bp, Artificial Sequence
  Description of Artificial Sequence: Synthetic oligonucleotide
  Target: SCN9A; (-) strand; PAM type: YTN; PAM sequence: TTT
aaaataacattgcaaagtaa

SEQ ID NO: 65201 - DNA, 20 bp, Artificial Sequence
  Description of Artificial Sequence: Synthetic oligonucleotide
  Target: SCN9A; (-) strand; PAM type: YTN; PAM sequence: CTT
taaaataacattgcaaagta

SEQ ID NO: 65202 - DNA, 20 bp, Artificial Sequence
  Description of Artificial Sequence: Synthetic oligonucleotide
  Target: SCN9A; (-) strand; PAM type: YTN; PAM sequence: TTC
acctttaaaataacattgca

SEQ ID NO: 65203 - DNA, 20 bp, Artificial Sequence
  Description of Artificial Sequence: Synthetic oligonucleotide
  Target: SCN9A; (-) strand; PAM type: YTN; PAM sequence: TTT
cacctttaaaataacattgc

SEQ ID NO: 65204 - DNA, 20 bp, Artificial Sequence
  Description of Artificial Sequence: Synthetic oligonucleotide
  Target: SCN9A; (-) strand; PAM type: YTN; PAM sequence: TTA
atttcacctttaaaataaca

SEQ ID NO: 65205 - DNA, 20 bp, Artificial Sequence
  Description of Artificial Sequence: Synthetic oligonucleotide
  Target: SCN9A; (-) strand; PAM type: YTN; PAM sequence: TTT
aatttcacctttaaaataac

SEQ ID NO: 65206 - DNA, 20 bp, Artificial Sequence
  Description of Artificial Sequence: Synthetic oligonucleotide
  Target: SCN9A; (-) strand; PAM type: YTN; PAM sequence: TTA
gaaaagataggtaagtgaga

SEQ ID NO: 65207 - DNA, 20 bp, Artificial Sequence
  Description of Artificial Sequence: Synthetic oligonucleotide
  Target: SCN9A; (-) strand; PAM type: YTN; PAM sequence: CTG
ggtaaggagcattagaaaag

SEQ ID NO: 65208 - DNA, 20 bp, Artificial Sequence
  Description of Artificial Sequence: Synthetic oligonucleotide
  Target: SCN9A; (-) strand; PAM type: YTN; PAM sequence: CTA
cctgggtaaggagcattaga

SEQ ID NO: 65209 - DNA, 20 bp, Artificial Sequence
  Description of Artificial Sequence: Synthetic oligonucleotide
  Target: SCN9A; (-) strand; PAM type: YTN; PAM sequence: TTA
agaaactacctgggtaagga

SEQ ID NO: 65210 - DNA, 20 bp, Artificial Sequence
  Description of Artificial Sequence: Synthetic oligonucleotide
  Target: SCN9A; (-) strand; PAM type: YTN; PAM sequence: TTT
aagaaactacctgggtaagg

SEQ ID NO: 65211 - DNA, 20 bp, Artificial Sequence
  Description of Artificial Sequence: Synthetic oligonucleotide
  Target: SCN9A; (-) strand; PAM type: YTN; PAM sequence: TTG
tttaagaaactacctgggta

SEQ ID NO: 65212 - DNA, 20 bp, Artificial Sequence
  Description of Artificial Sequence: Synthetic oligonucleotide
  Target: SCN9A; (-) strand; PAM type: YTN; PAM sequence: TTT
gtttaagaaactacctgggt

SEQ ID NO: 65213 - DNA, 20 bp, Artificial Sequence
  Description of Artificial Sequence: Synthetic oligonucleotide
  Target: SCN9A; (-) strand; PAM type: YTN; PAM sequence: TTC
aaataatatttgtttaagaa

SEQ ID NO: 65214 - DNA, 20 bp, Artificial Sequence
  Description of Artificial Sequence: Synthetic oligonucleotide
  Target: SCN9A; (-) strand; PAM type: YTN; PAM sequence: TTA
tatcaggtgttcaaataata

SEQ ID NO: 65215 - DNA, 20 bp, Artificial Sequence
  Description of Artificial Sequence: Synthetic oligonucleotide
  Target: SCN9A; (-) strand; PAM type: YTN; PAM sequence: CTT
atatcaggtgttcaaataat

SEQ ID NO: 65216 - DNA, 20 bp, Artificial Sequence
  Description of Artificial Sequence: Synthetic oligonucleotide
  Target: SCN9A; (-) strand; PAM type: YTN; PAM sequence: CTA
cttatatcaggtgttcaaat

SEQ ID NO: 65217 - DNA, 20 bp, Artificial Sequence
  Description of Artificial Sequence: Synthetic oligonucleotide
  Target: SCN9A; (-) strand; PAM type: YTN; PAM sequence: CTC
atacataagtaatcaaggac

SEQ ID NO: 65218 - DNA, 20 bp, Artificial Sequence
  Description of Artificial Sequence: Synthetic oligonucleotide
  Target: SCN9A; (-) strand; PAM type: YTN; PAM sequence: CTC
tcatacataagtaatcaagg

SEQ ID NO: 65219 - DNA, 20 bp, Artificial Sequence
  Description of Artificial Sequence: Synthetic oligonucleotide
  Target: SCN9A; (-) strand; PAM type: YTN; PAM sequence: CTA
acatcatctctcatacataa

SEQ ID NO: 65220 - DNA, 20 bp, Artificial Sequence
  Description of Artificial Sequence: Synthetic oligonucleotide
  Target: SCN9A; (-) strand; PAM type: YTN; PAM sequence: TTC
ctaacatcatctctcataca

SEQ ID NO: 65221 - DNA, 20 bp, Artificial Sequence
  Description of Artificial Sequence: Synthetic oligonucleotide
  Target: SCN9A; (-) strand; PAM type: YTN; PAM sequence: TTG
ttcctaacatcatctctcat

SEQ ID NO: 65222 - DNA, 20 bp, Artificial Sequence
  Description of Artificial Sequence: Synthetic oligonucleotide
  Target: SCN9A; (-) strand; PAM type: YTN; PAM sequence: CTA
ttgttcctaacatcatctct

SEQ ID NO: 65223 - DNA, 20 bp, Artificial Sequence
  Description of Artificial Sequence: Synthetic oligonucleotide
  Target: SCN9A; (-) strand; PAM type: YTN; PAM sequence: CTA
ggaagtccaagtgaaagggg

SEQ ID NO: 65224 - DNA, 20 bp, Artificial Sequence
  Description of Artificial Sequence: Synthetic oligonucleotide
  Target: SCN9A; (-) strand; PAM type: YTN; PAM sequence: CTG
tgctaggaagtccaagtgaa

SEQ ID NO: 65225 - DNA, 20 bp, Artificial Sequence
  Description of Artificial Sequence: Synthetic oligonucleotide
  Target: SCN9A; (-) strand; PAM type: YTN; PAM sequence: TTC
cctgtgctaggaagtccaag

SEQ ID NO: 65226 - DNA, 20 bp, Artificial Sequence
  Description of Artificial Sequence: Synthetic oligonucleotide
  Target: SCN9A; (-) strand; PAM type: YTN; PAM sequence: CTT
ccctgtgctaggaagtccaa

SEQ ID NO: 65227 - DNA, 20 bp, Artificial Sequence
  Description of Artificial Sequence: Synthetic oligonucleotide
  Target: SCN9A; (-) strand; PAM type: YTN; PAM sequence: TTA
aatggaaatcttccctgtgc

SEQ ID NO: 65228 - DNA, 20 bp, Artificial Sequence
  Description of Artificial Sequence: Synthetic oligonucleotide
  Target: SCN9A; (-) strand; PAM type: YTN; PAM sequence: TTC
atattaaatggaaatcttcc

SEQ ID NO: 65229 - DNA, 20 bp, Artificial Sequence
  Description of Artificial Sequence: Synthetic oligonucleotide
  Target: SCN9A; (-) strand; PAM type: YTN; PAM sequence: TTT
catattaaatggaaatcttc

SEQ ID NO: 65230 - DNA, 20 bp, Artificial Sequence
  Description of Artificial Sequence: Synthetic oligonucleotide
  Target: SCN9A; (-) strand; PAM type: YTN; PAM sequence: TTT
tcatattaaatggaaatctt

SEQ ID NO: 65231 - DNA, 20 bp, Artificial Sequence
  Description of Artificial Sequence: Synthetic oligonucleotide
  Target: SCN9A; (-) strand; PAM type: YTN; PAM sequence: TTT
ttcatattaaatggaaatct

SEQ ID NO: 65232 - DNA, 20 bp, Artificial Sequence
  Description of Artificial Sequence: Synthetic oligonucleotide
  Target: SCN9A; (-) strand; PAM type: YTN; PAM sequence: TTT
tttcatattaaatggaaatc

SEQ ID NO: 65233 - DNA, 20 bp, Artificial Sequence
  Description of Artificial Sequence: Synthetic oligonucleotide
  Target: SCN9A; (-) strand; PAM type: YTN; PAM sequence: CTT
ttttcatattaaatggaaat

SEQ ID NO: 65234 - DNA, 20 bp, Artificial Sequence
  Description of Artificial Sequence: Synthetic oligonucleotide
  Target: SCN9A; (-) strand; PAM type: YTN; PAM sequence: TTG
tcaaacaatagaatgatcca

SEQ ID NO: 65235 - DNA, 20 bp, Artificial Sequence
  Description of Artificial Sequence: Synthetic oligonucleotide
  Target: SCN9A; (-) strand; PAM type: YTN; PAM sequence: CTA
atattgtcaaacaatagaat

SEQ ID NO: 65236 - DNA, 20 bp, Artificial Sequence
  Description of Artificial Sequence: Synthetic oligonucleotide
  Target: SCN9A; (-) strand; PAM type: YTN; PAM sequence: TTA
tctaatattgtcaaacaata

SEQ ID NO: 65237 - DNA, 20 bp, Artificial Sequence
  Description of Artificial Sequence: Synthetic oligonucleotide
  Target: SCN9A; (-) strand; PAM type: YTN; PAM sequence: TTT
atctaatattgtcaaacaat

SEQ ID NO: 65238 - DNA, 20 bp, Artificial Sequence
  Description of Artificial Sequence: Synthetic oligonucleotide
  Target: SCN9A; (-) strand; PAM type: YTN; PAM sequence: CTT
tatctaatattgtcaaacaa

SEQ ID NO: 65239 - DNA, 20 bp, Artificial Sequence
  Description of Artificial Sequence: Synthetic oligonucleotide
  Target: SCN9A; (-) strand; PAM type: YTN; PAM sequence: CTG
cctttatctaatattgtcaa

SEQ ID NO: 65240 - DNA, 20 bp, Artificial Sequence
  Description of Artificial Sequence: Synthetic oligonucleotide
  Target: SCN9A; (-) strand; PAM type: YTN; PAM sequence: TTA
atcacagtaatcctgccttt

SEQ ID NO: 65241 - DNA, 20 bp, Artificial Sequence
  Description of Artificial Sequence: Synthetic oligonucleotide
  Target: SCN9A; (-) strand; PAM type: YTN; PAM sequence: TTA
acaagggaataagttaatca

SEQ ID NO: 65242 - DNA, 20 bp, Artificial Sequence
  Description of Artificial Sequence: Synthetic oligonucleotide
  Target: SCN9A; (-) strand; PAM type: YTN; PAM sequence: TTT
aacaagggaataagttaatc

SEQ ID NO: 65243 - DNA, 20 bp, Artificial Sequence
  Description of Artificial Sequence: Synthetic oligonucleotide
  Target: SCN9A; (-) strand; PAM type: YTN; PAM sequence: TTG
tttaacaagggaataagtta

SEQ ID NO: 65244 - DNA, 20 bp, Artificial Sequence
  Description of Artificial Sequence: Synthetic oligonucleotide
  Target: SCN9A; (-) strand; PAM type: YTN; PAM sequence: TTC
agtgcatattgtttaacaag

SEQ ID NO: 65245 - DNA, 20 bp, Artificial Sequence
  Description of Artificial Sequence: Synthetic oligonucleotide
  Target: SCN9A; (-) strand; PAM type: YTN; PAM sequence: TTT
cagtgcatattgtttaacaa

SEQ ID NO: 65246 - DNA, 20 bp, Artificial Sequence
  Description of Artificial Sequence: Synthetic oligonucleotide
  Target: SCN9A; (-) strand; PAM type: YTN; PAM sequence: CTA
tatatatatatatatacaca

SEQ ID NO: 65247 - DNA, 20 bp, Artificial Sequence
  Description of Artificial Sequence: Synthetic oligonucleotide
  Target: SCN9A; (-) strand; PAM type: YTN; PAM sequence: CTC
tatatatatatatatataca

SEQ ID NO: 65248 - DNA, 20 bp, Artificial Sequence
  Description of Artificial Sequence: Synthetic oligonucleotide
  Target: SCN9A; (-) strand; PAM type: YTN; PAM sequence: CTC
tctatatatatatatatata

SEQ ID NO: 65249 - DNA, 20 bp, Artificial Sequence
  Description of Artificial Sequence: Synthetic oligonucleotide
  Target: SCN9A; (-) strand; PAM type: YTN; PAM sequence: CTC
tctctatatatatatatata

SEQ ID NO: 65250 - DNA, 20 bp, Artificial Sequence
  Description of Artificial Sequence: Synthetic oligonucleotide
  Target: SCN9A; (-) strand; PAM type: YTN; PAM sequence: CTC
tctctctatatatatatata

SEQ ID NO: 65251 - DNA, 20 bp, Artificial Sequence
  Description of Artificial Sequence: Synthetic oligonucleotide
  Target: SCN9A; (-) strand; PAM type: YTN; PAM sequence: CTC
tctctctctatatatatata

SEQ ID NO: 65252 - DNA, 20 bp, Artificial Sequence
  Description of Artificial Sequence: Synthetic oligonucleotide
  Target: SCN9A; (-) strand; PAM type: YTN; PAM sequence: CTC
tctctctctctatatatata

SEQ ID NO: 65253 - DNA, 20 bp, Artificial Sequence
  Description of Artificial Sequence: Synthetic oligonucleotide
  Target: SCN9A; (-) strand; PAM type: YTN; PAM sequence: TTA
gtatatatatgcatactctc

SEQ ID NO: 65254 - DNA, 20 bp, Artificial Sequence
  Description of Artificial Sequence: Synthetic oligonucleotide
  Target: SCN9A; (-) strand; PAM type: YTN; PAM sequence: CTG
tacatattagtatatatatg

SEQ ID NO: 65255 - DNA, 20 bp, Artificial Sequence
  Description of Artificial Sequence: Synthetic oligonucleotide
  Target: SCN9A; (-) strand; PAM type: YTN; PAM sequence: TTA
ctgtacatattagtatatat

SEQ ID NO: 65256 - DNA, 20 bp, Artificial Sequence
  Description of Artificial Sequence: Synthetic oligonucleotide
  Target: SCN9A; (-) strand; PAM type: YTN; PAM sequence: TTT
actgtacatattagtatata

SEQ ID NO: 65257 - DNA, 20 bp, Artificial Sequence
  Description of Artificial Sequence: Synthetic oligonucleotide
  Target: SCN9A; (-) strand; PAM type: YTN; PAM sequence: TTC
atttactgtacatattagta

SEQ ID NO: 65258 - DNA, 20 bp, Artificial Sequence
  Description of Artificial Sequence: Synthetic oligonucleotide
  Target: SCN9A; (-) strand; PAM type: YTN; PAM sequence: TTT
catttactgtacatattagt

SEQ ID NO: 65259 - DNA, 20 bp, Artificial Sequence
  Description of Artificial Sequence: Synthetic oligonucleotide
  Target: SCN9A; (-) strand; PAM type: YTN; PAM sequence: TTA
tttcatttactgtacatatt

SEQ ID NO: 65260 - DNA, 20 bp, Artificial Sequence
  Description of Artificial Sequence: Synthetic oligonucleotide
  Target: SCN9A; (-) strand; PAM type: YTN; PAM sequence: CTA
tatataaaatatgcatatat

SEQ ID NO: 65261 - DNA, 20 bp, Artificial Sequence
  Description of Artificial Sequence: Synthetic oligonucleotide
  Target: SCN9A; (-) strand; PAM type: YTN; PAM sequence: TTA
atatatacagaatatgaaag

SEQ ID NO: 65262 - DNA, 20 bp, Artificial Sequence
  Description of Artificial Sequence: Synthetic oligonucleotide
  Target: SCN9A; (-) strand; PAM type: YTN; PAM sequence: TTA
tatattaatatatacagaat

SEQ ID NO: 65263 - DNA, 20 bp, Artificial Sequence
  Description of Artificial Sequence: Synthetic oligonucleotide
  Target: SCN9A; (-) strand; PAM type: YTN; PAM sequence: CTA
ttatatattaatatatacag

SEQ ID NO: 65264 - DNA, 20 bp, Artificial Sequence
  Description of Artificial Sequence: Synthetic oligonucleotide
  Target: SCN9A; (-) strand; PAM type: YTN; PAM sequence: TTA
gtatatactattatatatta

SEQ ID NO: 65265 - DNA, 20 bp, Artificial Sequence
  Description of Artificial Sequence: Synthetic oligonucleotide
  Target: SCN9A; (-) strand; PAM type: YTN; PAM sequence: CTA
attagtatatactattatat

SEQ ID NO: 65266 - DNA, 20 bp, Artificial Sequence
  Description of Artificial Sequence: Synthetic oligonucleotide
  Target: SCN9A; (-) strand; PAM type: YTN; PAM sequence: CTA
aaaaagtataatactaatta

SEQ ID NO: 65267 - DNA, 20 bp, Artificial Sequence
  Description of Artificial Sequence: Synthetic oligonucleotide
  Target: SCN9A; (-) strand; PAM type: YTN; PAM sequence: TTA
ctaaaaaagtataatactaa

SEQ ID NO: 65268 - DNA, 20 bp, Artificial Sequence
  Description of Artificial Sequence: Synthetic oligonucleotide
  Target: SCN9A; (-) strand; PAM type: YTN; PAM sequence: CTA
gtatattactaaaaaagtat

SEQ ID NO: 65269 - DNA, 20 bp, Artificial Sequence
  Description of Artificial Sequence: Synthetic oligonucleotide
  Target: SCN9A; (-) strand; PAM type: YTN; PAM sequence: TTA
gtatatactagtatattact

SEQ ID NO: 65270 - DNA, 20 bp, Artificial Sequence
  Description of Artificial Sequence: Synthetic oligonucleotide
  Target: SCN9A; (-) strand; PAM type: YTN; PAM sequence: CTC
attagtatatactagtatat

SEQ ID NO: 65271 - DNA, 20 bp, Artificial Sequence
  Description of Artificial Sequence: Synthetic oligonucleotide
  Target: SCN9A; (-) strand; PAM type: YTN; PAM sequence: CTA
aaaatagtataatactcatt

SEQ ID NO: 65272 - DNA, 20 bp, Artificial Sequence
  Description of Artificial Sequence: Synthetic oligonucleotide
  Target: SCN9A; (-) strand; PAM type: YTN; PAM sequence: TTA
ctaaaaatagtataatactc

SEQ ID NO: 65273 - DNA, 20 bp, Artificial Sequence
  Description of Artificial Sequence: Synthetic oligonucleotide
  Target: SCN9A; (-) strand; PAM type: YTN; PAM sequence: TTA
aatagtatattactaaaaat

SEQ ID NO: 65274 - DNA, 20 bp, Artificial Sequence
  Description of Artificial Sequence: Synthetic oligonucleotide
  Target: SCN9A; (-) strand; PAM type: YTN; PAM sequence: TTA
attaaatagtatattactaa

SEQ ID NO: 65275 - DNA, 20 bp, Artificial Sequence
  Description of Artificial Sequence: Synthetic oligonucleotide
  Target: SCN9A; (-) strand; PAM type: YTN; PAM sequence: TTA
tagcattaattaaatagtat

SEQ ID NO: 65276 - DNA, 20 bp, Artificial Sequence
  Description of Artificial Sequence: Synthetic oligonucleotide
  Target: SCN9A; (-) strand; PAM type: YTN; PAM sequence: CTA
attatagcattaattaaata

SEQ ID NO: 65277 - DNA, 20 bp, Artificial Sequence
  Description of Artificial Sequence: Synthetic oligonucleotide
  Target: SCN9A; (-) strand; PAM type: YTN; PAM sequence: CTA
atatataaatactaattata

SEQ ID NO: 65278 - DNA, 20 bp, Artificial Sequence
  Description of Artificial Sequence: Synthetic oligonucleotide
  Target: SCN9A; (-) strand; PAM type: YTN; PAM sequence: CTA
atggtatatatgcatactaa

SEQ ID NO: 65279 - DNA, 20 bp, Artificial Sequence
  Description of Artificial Sequence: Synthetic oligonucleotide
  Target: SCN9A; (-) strand; PAM type: YTN; PAM sequence: TTA
tatatactaatggtatatat

SEQ ID NO: 65280 - DNA, 20 bp, Artificial Sequence
  Description of Artificial Sequence: Synthetic oligonucleotide
  Target: SCN9A; (-) strand; PAM type: YTN; PAM sequence: CTA
atagtatatatgcatattat

SEQ ID NO: 65281 - DNA, 20 bp, Artificial Sequence
  Description of Artificial Sequence: Synthetic oligonucleotide
  Target: SCN9A; (-) strand; PAM type: YTN; PAM sequence: TTA
catatactaatagtatatat

SEQ ID NO: 65282 - DNA, 20 bp, Artificial Sequence
  Description of Artificial Sequence: Synthetic oligonucleotide
  Target: SCN9A; (-) strand; PAM type: YTN; PAM sequence: CTA
atagtatatatatgcatatt

SEQ ID NO: 65283 - DNA, 20 bp, Artificial Sequence
  Description of Artificial Sequence: Synthetic oligonucleotide
  Target: SCN9A; (-) strand; PAM type: YTN; PAM sequence: TTA
tatacactaatagtatatat

SEQ ID NO: 65284 - DNA, 20 bp, Artificial Sequence
  Description of Artificial Sequence: Synthetic oligonucleotide
  Target: SCN9A; (-) strand; PAM type: YTN; PAM sequence: CTA
tatatagtatgcatatatgg

SEQ ID NO: 65285 - DNA, 20 bp, Artificial Sequence
  Description of Artificial Sequence: Synthetic oligonucleotide
  Target: SCN9A; (-) strand; PAM type: YTN; PAM sequence: CTA
tatacagtatgcatatatac

SEQ ID NO: 65286 - DNA, 20 bp, Artificial Sequence
  Description of Artificial Sequence: Synthetic oligonucleotide
  Target: SCN9A; (-) strand; PAM type: YTN; PAM sequence: TTA
catactatatacagtatgca

SEQ ID NO: 65287 - DNA, 20 bp, Artificial Sequence
  Description of Artificial Sequence: Synthetic oligonucleotide
  Target: SCN9A; (-) strand; PAM type: YTN; PAM sequence: TTT
acatactatatacagtatgc

SEQ ID NO: 65288 - DNA, 20 bp, Artificial Sequence
  Description of Artificial Sequence: Synthetic oligonucleotide
  Target: SCN9A; (-) strand; PAM type: YTN; PAM sequence: CTA
tatagtatgcatttacatac

SEQ ID NO: 65289 - DNA, 20 bp, Artificial Sequence
  Description of Artificial Sequence: Synthetic oligonucleotide
  Target: SCN9A; (-) strand; PAM type: YTN; PAM sequence: TTA
tgtatgtgtgtgtacatata

SEQ ID NO: 65290 - DNA, 20 bp, Artificial Sequence
  Description of Artificial Sequence: Synthetic oligonucleotide
  Target: SCN9A; (-) strand; PAM type: YTN; PAM sequence: TTT
atgtatgtgtgtgtacatat

SEQ ID NO: 65291 - DNA, 20 bp, Artificial Sequence
  Description of Artificial Sequence: Synthetic oligonucleotide
  Target: SCN9A; (-) strand; PAM type: YTN; PAM sequence: CTG
tttatgtatgtgtgtgtaca

SEQ ID NO: 65292 - DNA, 20 bp, Artificial Sequence
  Description of Artificial Sequence: Synthetic oligonucleotide
  Target: SCN9A; (-) strand; PAM type: YTN; PAM sequence: TTA
cataaatacataggctgttt

SEQ ID NO: 65293 - DNA, 20 bp, Artificial Sequence
  Description of Artificial Sequence: Synthetic oligonucleotide
  Target: SCN9A; (-) strand; PAM type: YTN; PAM sequence: TTT
acataaatacataggctgtt

SEQ ID NO: 65294 - DNA, 20 bp, Artificial Sequence
  Description of Artificial Sequence: Synthetic oligonucleotide
  Target: SCN9A; (-) strand; PAM type: YTN; PAM sequence: CTG
tttacataaatacataggct

SEQ ID NO: 65295 - DNA, 20 bp, Artificial Sequence
  Description of Artificial Sequence: Synthetic oligonucleotide
  Target: SCN9A; (-) strand; PAM type: YTN; PAM sequence: TTC
tgtttacataaatacatagg

SEQ ID NO: 65296 - DNA, 20 bp, Artificial Sequence
  Description of Artificial Sequence: Synthetic oligonucleotide
  Target: SCN9A; (-) strand; PAM type: YTN; PAM sequence: TTT
ctgtttacataaatacatag

SEQ ID NO: 65297 - DNA, 20 bp, Artificial Sequence
  Description of Artificial Sequence: Synthetic oligonucleotide
  Target: SCN9A; (-) strand; PAM type: YTN; PAM sequence: TTG
tttctgtttacataaataca

SEQ ID NO: 65298 - DNA, 20 bp, Artificial Sequence
  Description of Artificial Sequence: Synthetic oligonucleotide
  Target: SCN9A; (-) strand; PAM type: YTN; PAM sequence: TTA
tgagttgtttctgtttacat

SEQ ID NO: 65299 - DNA, 20 bp, Artificial Sequence
  Description of Artificial Sequence: Synthetic oligonucleotide
  Target: SCN9A; (-) strand; PAM type: YTN; PAM sequence: TTA
aaatataaaaacaatgggta

SEQ ID NO: 65300 - DNA, 20 bp, Artificial Sequence
  Description of Artificial Sequence: Synthetic oligonucleotide
  Target: SCN9A; (-) strand; PAM type: YTN; PAM sequence: TTT
aaaatataaaaacaatgggt

SEQ ID NO: 65301 - DNA, 20 bp, Artificial Sequence
  Description of Artificial Sequence: Synthetic oligonucleotide
  Target: SCN9A; (-) strand; PAM type: YTN; PAM sequence: TTA
atggggtttaaaatataaaa

SEQ ID NO: 65302 - DNA, 20 bp, Artificial Sequence
  Description of Artificial Sequence: Synthetic oligonucleotide
  Target: SCN9A; (-) strand; PAM type: YTN; PAM sequence: TTT
aatggggtttaaaatataaa

SEQ ID NO: 65303 - DNA, 20 bp, Artificial Sequence
  Description of Artificial Sequence: Synthetic oligonucleotide
  Target: SCN9A; (-) strand; PAM type: YTN; PAM sequence: TTT
taatggggtttaaaatataa

SEQ ID NO: 65304 - DNA, 20 bp, Artificial Sequence
  Description of Artificial Sequence: Synthetic oligonucleotide
  Target: SCN9A; (-) strand; PAM type: YTN; PAM sequence: TTT
ttaatggggtttaaaatata

SEQ ID NO: 65305 - DNA, 20 bp, Artificial Sequence
  Description of Artificial Sequence: Synthetic oligonucleotide
  Target: SCN9A; (-) strand; PAM type: YTN; PAM sequence: TTT
tttaatggggtttaaaatat

SEQ ID NO: 65306 - DNA, 20 bp, Artificial Sequence
  Description of Artificial Sequence: Synthetic oligonucleotide
  Target: SCN9A; (-) strand; PAM type: YTN; PAM sequence: TTA
ttttttaatggggtttaaaa

SEQ ID NO: 65307 - DNA, 20 bp, Artificial Sequence
  Description of Artificial Sequence: Synthetic oligonucleotide
  Target: SCN9A; (-) strand; PAM type: YTN; PAM sequence: CTT
attttttaatggggtttaaa

SEQ ID NO: 65308 - DNA, 20 bp, Artificial Sequence
  Description of Artificial Sequence: Synthetic oligonucleotide
  Target: SCN9A; (-) strand; PAM type: YTN; PAM sequence: TTC
ttattttttaatggggttta

SEQ ID NO: 65309 - DNA, 20 bp, Artificial Sequence
  Description of Artificial Sequence: Synthetic oligonucleotide
  Target: SCN9A; (-) strand; PAM type: YTN; PAM sequence: TTA
taatgttcttattttttaat

SEQ ID NO: 65310 - DNA, 20 bp, Artificial Sequence
  Description of Artificial Sequence: Synthetic oligonucleotide
  Target: SCN9A; (-) strand; PAM type: YTN; PAM sequence: TTT
ataatgttcttattttttaa

SEQ ID NO: 65311 - DNA, 20 bp, Artificial Sequence
  Description of Artificial Sequence: Synthetic oligonucleotide
  Target: SCN9A; (-) strand; PAM type: YTN; PAM sequence: CTT
tataatgttcttatttttta

SEQ ID NO: 65312 - DNA, 20 bp, Artificial Sequence
  Description of Artificial Sequence: Synthetic oligonucleotide
  Target: SCN9A; (-) strand; PAM type: YTN; PAM sequence: CTA
aactttataatgttcttatt

SEQ ID NO: 65313 - DNA, 20 bp, Artificial Sequence
  Description of Artificial Sequence: Synthetic oligonucleotide
  Target: SCN9A; (-) strand; PAM type: YTN; PAM sequence: TTG
aaggaatgagggtaagaaaa

SEQ ID NO: 65314 - DNA, 20 bp, Artificial Sequence
  Description of Artificial Sequence: Synthetic oligonucleotide
  Target: SCN9A; (-) strand; PAM type: YTN; PAM sequence: TTT
gaaggaatgagggtaagaaa

SEQ ID NO: 65315 - DNA, 20 bp, Artificial Sequence
  Description of Artificial Sequence: Synthetic oligonucleotide
  Target: SCN9A; (-) strand; PAM type: YTN; PAM sequence: CTA
gatttgaaggaatgagggta

SEQ ID NO: 65316 - DNA, 20 bp, Artificial Sequence
  Description of Artificial Sequence: Synthetic oligonucleotide
  Target: SCN9A; (-) strand; PAM type: YTN; PAM sequence: TTA
tctagatttgaaggaatgag

SEQ ID NO: 65317 - DNA, 20 bp, Artificial Sequence
  Description of Artificial Sequence: Synthetic oligonucleotide
  Target: SCN9A; (-) strand; PAM type: YTN; PAM sequence: CTT
atctagatttgaaggaatga

SEQ ID NO: 65318 - DNA, 20 bp, Artificial Sequence
  Description of Artificial Sequence: Synthetic oligonucleotide
  Target: SCN9A; (-) strand; PAM type: YTN; PAM sequence: CTA
agagccttatctagatttga

SEQ ID NO: 65319 - DNA, 20 bp, Artificial Sequence
  Description of Artificial Sequence: Synthetic oligonucleotide
  Target: SCN9A; (-) strand; PAM type: YTN; PAM sequence: CTC
taagagccttatctagattt

SEQ ID NO: 65320 - DNA, 20 bp, Artificial Sequence
  Description of Artificial Sequence: Synthetic oligonucleotide
  Target: SCN9A; (-) strand; PAM type: YTN; PAM sequence: TTA
agacctctaagagccttatc

SEQ ID NO: 65321 - DNA, 20 bp, Artificial Sequence
  Description of Artificial Sequence: Synthetic oligonucleotide
  Target: SCN9A; (-) strand; PAM type: YTN; PAM sequence: TTT
aagacctctaagagccttat

SEQ ID NO: 65322 - DNA, 20 bp, Artificial Sequence
  Description of Artificial Sequence: Synthetic oligonucleotide
  Target: SCN9A; (-) strand; PAM type: YTN; PAM sequence: CTT
taagacctctaagagcctta

SEQ ID NO: 65323 - DNA, 20 bp, Artificial Sequence
  Description of Artificial Sequence: Synthetic oligonucleotide
  Target: SCN9A; (-) strand; PAM type: YTN; PAM sequence: CTG
agagctttaagacctctaag

SEQ ID NO: 65324 - DNA, 20 bp, Artificial Sequence
  Description of Artificial Sequence: Synthetic oligonucleotide
  Target: SCN9A; (-) strand; PAM type: YTN; PAM sequence: TTC
ggacactgagagctttaaga

SEQ ID NO: 65325 - DNA, 20 bp, Artificial Sequence
  Description of Artificial Sequence: Synthetic oligonucleotide
  Target: SCN9A; (-) strand; PAM type: YTN; PAM sequence: CTT
cggacactgagagctttaag

SEQ ID NO: 65326 - DNA, 20 bp, Artificial Sequence
  Description of Artificial Sequence: Synthetic oligonucleotide
  Target: SCN9A; (-) strand; PAM type: YTN; PAM sequence: TTA
aatcccttcggacactgaga

SEQ ID NO: 65327 - DNA, 20 bp, Artificial Sequence
  Description of Artificial Sequence: Synthetic oligonucleotide
  Target: SCN9A; (-) strand; PAM type: YTN; PAM sequence: TTG
gccccattaaatcccttcgg

SEQ ID NO: 65328 - DNA, 20 bp, Artificial Sequence
  Description of Artificial Sequence: Synthetic oligonucleotide
  Target: SCN9A; (-) strand; PAM type: YTN; PAM sequence: CTT
ggccccattaaatcccttcg

SEQ ID NO: 65329 - DNA, 20 bp, Artificial Sequence
  Description of Artificial Sequence: Synthetic oligonucleotide
  Target: SCN9A; (-) strand; PAM type: YTN; PAM sequence: CTC
agatcttggccccattaaat

SEQ ID NO: 65330 - DNA, 20 bp, Artificial Sequence
  Description of Artificial Sequence: Synthetic oligonucleotide
  Target: SCN9A; (-) strand; PAM type: YTN; PAM sequence: CTA
ctcagatcttggccccatta

SEQ ID NO: 65331 - DNA, 20 bp, Artificial Sequence
  Description of Artificial Sequence: Synthetic oligonucleotide
  Target: SCN9A; (-) strand; PAM type: YTN; PAM sequence: TTG
gctactcagatcttggcccc

SEQ ID NO: 65332 - DNA, 20 bp, Artificial Sequence
  Description of Artificial Sequence: Synthetic oligonucleotide
  Target: SCN9A; (-) strand; PAM type: YTN; PAM sequence: CTT
ggctactcagatcttggccc

SEQ ID NO: 65333 - DNA, 20 bp, Artificial Sequence
  Description of Artificial Sequence: Synthetic oligonucleotide
  Target: SCN9A; (-) strand; PAM type: YTN; PAM sequence: CTC
ttggctactcagatcttggc

SEQ ID NO: 65334 - DNA, 20 bp, Artificial Sequence
  Description of Artificial Sequence: Synthetic oligonucleotide
  Target: SCN9A; (-) strand; PAM type: YTN; PAM sequence: TTA
gtggcaaacactcttggcta

SEQ ID NO: 65335 - DNA, 20 bp, Artificial Sequence
  Description of Artificial Sequence: Synthetic oligonucleotide
  Target: SCN9A; (-) strand; PAM type: YTN; PAM sequence: TTT
agtggcaaacactcttggct

SEQ ID NO: 65336 - DNA, 20 bp, Artificial Sequence
  Description of Artificial Sequence: Synthetic oligonucleotide
  Target: SCN9A; (-) strand; PAM type: YTN; PAM sequence: CTT
tagtggcaaacactcttggc

SEQ ID NO: 65337 - DNA, 20 bp, Artificial Sequence
  Description of Artificial Sequence: Synthetic oligonucleotide
  Target: SCN9A; (-) strand; PAM type: YTN; PAM sequence: TTA
ctttagtggcaaacactctt

SEQ ID NO: 65338 - DNA, 20 bp, Artificial Sequence
  Description of Artificial Sequence: Synthetic oligonucleotide
  Target: SCN9A; (-) strand; PAM type: YTN; PAM sequence: TTG
gttactttagtggcaaacac

SEQ ID NO: 65339 - DNA, 20 bp, Artificial Sequence
  Description of Artificial Sequence: Synthetic oligonucleotide
  Target: SCN9A; (-) strand; PAM type: YTN; PAM sequence: TTT
ggttactttagtggcaaaca

SEQ ID NO: 65340 - DNA, 20 bp, Artificial Sequence
  Description of Artificial Sequence: Synthetic oligonucleotide
  Target: SCN9A; (-) strand; PAM type: YTN; PAM sequence: CTT
tggttactttagtggcaaac

SEQ ID NO: 65341 - DNA, 20 bp, Artificial Sequence
  Description of Artificial Sequence: Synthetic oligonucleotide
  Target: SCN9A; (-) strand; PAM type: YTN; PAM sequence: TTC
tttggttactttagtggcaa

SEQ ID NO: 65342 - DNA, 20 bp, Artificial Sequence
  Description of Artificial Sequence: Synthetic oligonucleotide
  Target: SCN9A; (-) strand; PAM type: YTN; PAM sequence: TTT
ctttggttactttagtggca

SEQ ID NO: 65343 - DNA, 20 bp, Artificial Sequence
  Description of Artificial Sequence: Synthetic oligonucleotide
  Target: SCN9A; (-) strand; PAM type: YTN; PAM sequence: TTA
taggtttctttggttacttt

SEQ ID NO: 65344 - DNA, 20 bp, Artificial Sequence
  Description of Artificial Sequence: Synthetic oligonucleotide
  Target: SCN9A; (-) strand; PAM type: YTN; PAM sequence: TTT
ataggtttctttggttactt

SEQ ID NO: 65345 - DNA, 20 bp, Artificial Sequence
  Description of Artificial Sequence: Synthetic oligonucleotide
  Target: SCN9A; (-) strand; PAM type: YTN; PAM sequence: TTT
tataggtttctttggttact

SEQ ID NO: 65346 - DNA, 20 bp, Artificial Sequence
  Description of Artificial Sequence: Synthetic oligonucleotide
  Target: SCN9A; (-) strand; PAM type: YTN; PAM sequence: TTT
ttataggtttctttggttac

SEQ ID NO: 65347 - DNA, 20 bp, Artificial Sequence
  Description of Artificial Sequence: Synthetic oligonucleotide
  Target: SCN9A; (-) strand; PAM type: YTN; PAM sequence: TTA
tttttataggtttctttggt

SEQ ID NO: 65348 - DNA, 20 bp, Artificial Sequence
  Description of Artificial Sequence: Synthetic oligonucleotide
  Target: SCN9A; (-) strand; PAM type: YTN; PAM sequence: TTA
atgaaaatgttatttttata

SEQ ID NO: 65349 - DNA, 20 bp, Artificial Sequence
  Description of Artificial Sequence: Synthetic oligonucleotide
  Target: SCN9A; (-) strand; PAM type: YTN; PAM sequence: TTG
acacaattaatgaaaatgtt

SEQ ID NO: 65350 - DNA, 20 bp, Artificial Sequence
  Description of Artificial Sequence: Synthetic oligonucleotide
  Target: SCN9A; (-) strand; PAM type: YTN; PAM sequence: TTA
ttgacacaattaatgaaaat

SEQ ID NO: 65351 - DNA, 20 bp, Artificial Sequence
  Description of Artificial Sequence: Synthetic oligonucleotide
  Target: SCN9A; (-) strand; PAM type: YTN; PAM sequence: TTT
attgacacaattaatgaaaa

SEQ ID NO: 65352 - DNA, 20 bp, Artificial Sequence
  Description of Artificial Sequence: Synthetic oligonucleotide
  Target: SCN9A; (-) strand; PAM type: YTN; PAM sequence: TTT
tattgacacaattaatgaaa

SEQ ID NO: 65353 - DNA, 20 bp, Artificial Sequence
  Description of Artificial Sequence: Synthetic oligonucleotide
  Target: SCN9A; (-) strand; PAM type: YTN; PAM sequence: TTC
atcattttattgacacaatt

SEQ ID NO: 65354 - DNA, 20 bp, Artificial Sequence
  Description of Artificial Sequence: Synthetic oligonucleotide
  Target: SCN9A; (-) strand; PAM type: YTN; PAM sequence: CTT
catcattttattgacacaat

SEQ ID NO: 65355 - DNA, 20 bp, Artificial Sequence
  Description of Artificial Sequence: Synthetic oligonucleotide
  Target: SCN9A; (-) strand; PAM type: YTN; PAM sequence: TTA
tgcttcatcattttattgac

SEQ ID NO: 65356 - DNA, 20 bp, Artificial Sequence
  Description of Artificial Sequence: Synthetic oligonucleotide
  Target: SCN9A; (-) strand; PAM type: YTN; PAM sequence: TTT
atgcttcatcattttattga

SEQ ID NO: 65357 - DNA, 20 bp, Artificial Sequence
  Description of Artificial Sequence: Synthetic oligonucleotide
  Target: SCN9A; (-) strand; PAM type: YTN; PAM sequence: TTT
tatgcttcatcattttattg

SEQ ID NO: 65358 - DNA, 20 bp, Artificial Sequence
  Description of Artificial Sequence: Synthetic oligonucleotide
  Target: SCN9A; (-) strand; PAM type: YTN; PAM sequence: CTT
ttatgcttcatcattttatt

SEQ ID NO: 65359 - DNA, 20 bp, Artificial Sequence
  Description of Artificial Sequence: Synthetic oligonucleotide
  Target: SCN9A; (-) strand; PAM type: YTN; PAM sequence: TTC
cttttatgcttcatcatttt

SEQ ID NO: 65360 - DNA, 20 bp, Artificial Sequence
  Description of Artificial Sequence: Synthetic oligonucleotide
  Target: SCN9A; (-) strand; PAM type: YTN; PAM sequence: TTT
ccttttatgcttcatcattt

SEQ ID NO: 65361 - DNA, 20 bp, Artificial Sequence
  Description of Artificial Sequence: Synthetic oligonucleotide
  Target: SCN9A; (-) strand; PAM type: YTN; PAM sequence: TTT
tccttttatgcttcatcatt

SEQ ID NO: 65362 - DNA, 20 bp, Artificial Sequence
  Description of Artificial Sequence: Synthetic oligonucleotide
  Target: SCN9A; (-) strand; PAM type: YTN; PAM sequence: TTT
ttccttttatgcttcatcat

SEQ ID NO: 65363 - DNA, 20 bp, Artificial Sequence
  Description of Artificial Sequence: Synthetic oligonucleotide
  Target: SCN9A; (-) strand; PAM type: YTN; PAM sequence: CTT
tttccttttatgcttcatca

SEQ ID NO: 65364 - DNA, 20 bp, Artificial Sequence
  Description of Artificial Sequence: Synthetic oligonucleotide
  Target: SCN9A; (-) strand; PAM type: YTN; PAM sequence: TTG
actttttccttttatgcttc

SEQ ID NO: 65365 - DNA, 20 bp, Artificial Sequence
  Description of Artificial Sequence: Synthetic oligonucleotide
  Target: SCN9A; (-) strand; PAM type: YTN; PAM sequence: TTC
agaattgactttttcctttt

SEQ ID NO: 65366 - DNA, 20 bp, Artificial Sequence
  Description of Artificial Sequence: Synthetic oligonucleotide
  Target: SCN9A; (-) strand; PAM type: YTN; PAM sequence: TTT
cagaattgactttttccttt

SEQ ID NO: 65367 - DNA, 20 bp, Artificial Sequence
  Description of Artificial Sequence: Synthetic oligonucleotide
  Target: SCN9A; (-) strand; PAM type: YTN; PAM sequence: TTA
gtgagtttcagaattgactt

SEQ ID NO: 65368 - DNA, 20 bp, Artificial Sequence
  Description of Artificial Sequence: Synthetic oligonucleotide
  Target: SCN9A; (-) strand; PAM type: YTN; PAM sequence: TTT
agtgagtttcagaattgact

SEQ ID NO: 65369 - DNA, 20 bp, Artificial Sequence
  Description of Artificial Sequence: Synthetic oligonucleotide
  Target: SCN9A; (-) strand; PAM type: YTN; PAM sequence: TTT
tagtgagtttcagaattgac

SEQ ID NO: 65370 - DNA, 20 bp, Artificial Sequence
  Description of Artificial Sequence: Synthetic oligonucleotide
  Target: SCN9A; (-) strand; PAM type: YTN; PAM sequence: CTT
ttagtgagtttcagaattga

SEQ ID NO: 65371 - DNA, 20 bp, Artificial Sequence
  Description of Artificial Sequence: Synthetic oligonucleotide
  Target: SCN9A; (-) strand; PAM type: YTN; PAM sequence: TTG
cttttagtgagtttcagaat

SEQ ID NO: 65372 - DNA, 20 bp, Artificial Sequence
  Description of Artificial Sequence: Synthetic oligonucleotide
  Target: SCN9A; (-) strand; PAM type: YTN; PAM sequence: TTG
agttgcttttagtgagtttc

SEQ ID NO: 65373 - DNA, 20 bp, Artificial Sequence
  Description of Artificial Sequence: Synthetic oligonucleotide
  Target: SCN9A; (-) strand; PAM type: YTN; PAM sequence: CTG
ttgagttgcttttagtgagt

SEQ ID NO: 65374 - DNA, 20 bp, Artificial Sequence
  Description of Artificial Sequence: Synthetic oligonucleotide
  Target: SCN9A; (-) strand; PAM type: YTN; PAM sequence: TTC
ctgttgagttgcttttagtg

SEQ ID NO: 65375 - DNA, 20 bp, Artificial Sequence
  Description of Artificial Sequence: Synthetic oligonucleotide
  Target: SCN9A; (-) strand; PAM type: YTN; PAM sequence: TTG
ttcctgttgagttgctttta

SEQ ID NO: 65376 - DNA, 20 bp, Artificial Sequence
  Description of Artificial Sequence: Synthetic oligonucleotide
  Target: SCN9A; (-) strand; PAM type: YTN; PAM sequence: TTA
ttgttcctgttgagttgctt

SEQ ID NO: 65377 - DNA, 20 bp, Artificial Sequence
  Description of Artificial Sequence: Synthetic oligonucleotide
  Target: SCN9A; (-) strand; PAM type: YTN; PAM sequence: CTT
attgttcctgttgagttgct

SEQ ID NO: 65378 - DNA, 20 bp, Artificial Sequence
  Description of Artificial Sequence: Synthetic oligonucleotide
  Target: SCN9A; (-) strand; PAM type: YTN; PAM sequence: CTC
cgtatataccatcttattgt

SEQ ID NO: 65379 - DNA, 20 bp, Artificial Sequence
  Description of Artificial Sequence: Synthetic oligonucleotide
  Target: SCN9A; (-) strand; PAM type: YTN; PAM sequence: CTA
cacaactccgtatataccat

SEQ ID NO: 65380 - DNA, 20 bp, Artificial Sequence
  Description of Artificial Sequence: Synthetic oligonucleotide
  Target: SCN9A; (-) strand; PAM type: YTN; PAM sequence: TTG
actacacaactccgtatata

SEQ ID NO: 65381 - DNA, 20 bp, Artificial Sequence
  Description of Artificial Sequence: Synthetic oligonucleotide
  Target: SCN9A; (-) strand; PAM type: YTN; PAM sequence: TTA
ggcattgactacacaactcc

SEQ ID NO: 65382 - DNA, 20 bp, Artificial Sequence
  Description of Artificial Sequence: Synthetic oligonucleotide
  Target: SCN9A; (-) strand; PAM type: YTN; PAM sequence: TTT
aggcattgactacacaactc

SEQ ID NO: 65383 - DNA, 20 bp, Artificial Sequence
  Description of Artificial Sequence: Synthetic oligonucleotide
  Target: SCN9A; (-) strand; PAM type: YTN; PAM sequence: TTT
taggcattgactacacaact

SEQ ID NO: 65384 - DNA, 20 bp, Artificial Sequence
  Description of Artificial Sequence: Synthetic oligonucleotide
  Target: SCN9A; (-) strand; PAM type: YTN; PAM sequence: TTT
ttaggcattgactacacaac

SEQ ID NO: 65385 - DNA, 20 bp, Artificial Sequence
  Description of Artificial Sequence: Synthetic oligonucleotide
  Target: SCN9A; (-) strand; PAM type: YTN; PAM sequence: CTA
tttttaggcattgactacac

SEQ ID NO: 65386 - DNA, 20 bp, Artificial Sequence
  Description of Artificial Sequence: Synthetic oligonucleotide
  Target: SCN9A; (-) strand; PAM type: YTN; PAM sequence: TTA
ccctatttttaggcattgac

SEQ ID NO: 65387 - DNA, 20 bp, Artificial Sequence
  Description of Artificial Sequence: Synthetic oligonucleotide
  Target: SCN9A; (-) strand; PAM type: YTN; PAM sequence: CTT
accctatttttaggcattga

SEQ ID NO: 65388 - DNA, 20 bp, Artificial Sequence
  Description of Artificial Sequence: Synthetic oligonucleotide
  Target: SCN9A; (-) strand; PAM type: YTN; PAM sequence: TTA
cagaaacatccatcttaccc

SEQ ID NO: 65389 - DNA, 20 bp, Artificial Sequence
  Description of Artificial Sequence: Synthetic oligonucleotide
  Target: SCN9A; (-) strand; PAM type: YTN; PAM sequence: CTT
acagaaacatccatcttacc

SEQ ID NO: 65390 - DNA, 20 bp, Artificial Sequence
  Description of Artificial Sequence: Synthetic oligonucleotide
  Target: SCN9A; (-) strand; PAM type: YTN; PAM sequence: TTC
cttacagaaacatccatctt

SEQ ID NO: 65391 - DNA, 20 bp, Artificial Sequence
  Description of Artificial Sequence: Synthetic oligonucleotide
  Target: SCN9A; (-) strand; PAM type: YTN; PAM sequence: TTT
ccttacagaaacatccatct

SEQ ID NO: 65392 - DNA, 20 bp, Artificial Sequence
  Description of Artificial Sequence: Synthetic oligonucleotide
  Target: SCN9A; (-) strand; PAM type: YTN; PAM sequence: CTA
tttccttacagaaacatcca

SEQ ID NO: 65393 - DNA, 20 bp, Artificial Sequence
  Description of Artificial Sequence: Synthetic oligonucleotide
  Target: SCN9A; (-) strand; PAM type: YTN; PAM sequence: TTA
aatctatttccttacagaaa

SEQ ID NO: 65394 - DNA, 20 bp, Artificial Sequence
  Description of Artificial Sequence: Synthetic oligonucleotide
  Target: SCN9A; (-) strand; PAM type: YTN; PAM sequence: TTT
aaatctatttccttacagaa

SEQ ID NO: 65395 - DNA, 20 bp, Artificial Sequence
  Description of Artificial Sequence: Synthetic oligonucleotide
  Target: SCN9A; (-) strand; PAM type: YTN; PAM sequence: TTT
taaatctatttccttacaga

SEQ ID NO: 65396 - DNA, 20 bp, Artificial Sequence
  Description of Artificial Sequence: Synthetic oligonucleotide
  Target: SCN9A; (-) strand; PAM type: YTN; PAM sequence: CTT
ttaaatctatttccttacag

SEQ ID NO: 65397 - DNA, 20 bp, Artificial Sequence
  Description of Artificial Sequence: Synthetic oligonucleotide
  Target: SCN9A; (-) strand; PAM type: YTN; PAM sequence: TTC
ttttaaatctatttccttac

SEQ ID NO: 65398 - DNA, 20 bp, Artificial Sequence
  Description of Artificial Sequence: Synthetic oligonucleotide
  Target: SCN9A; (-) strand; PAM type: YTN; PAM sequence: CTT
cttttaaatctatttcctta

SEQ ID NO: 65399 - DNA, 20 bp, Artificial Sequence
  Description of Artificial Sequence: Synthetic oligonucleotide
  Target: SCN9A; (-) strand; PAM type: YTN; PAM sequence: TTA
accttcttttaaatctattt

SEQ ID NO: 65400 - DNA, 20 bp, Artificial Sequence
  Description of Artificial Sequence: Synthetic oligonucleotide
  Target: SCN9A; (-) strand; PAM type: YTN; PAM sequence: TTG
gttaaccttcttttaaatct

SEQ ID NO: 65401 - DNA, 20 bp, Artificial Sequence
  Description of Artificial Sequence: Synthetic oligonucleotide
  Target: SCN9A; (-) strand; PAM type: YTN; PAM sequence: TTT
ggttaaccttcttttaaatc

SEQ ID NO: 65402 - DNA, 20 bp, Artificial Sequence
  Description of Artificial Sequence: Synthetic oligonucleotide
  Target: SCN9A; (-) strand; PAM type: YTN; PAM sequence: TTT
tggttaaccttcttttaaat

SEQ ID NO: 65403 - DNA, 20 bp, Artificial Sequence
  Description of Artificial Sequence: Synthetic oligonucleotide
  Target: SCN9A; (-) strand; PAM type: YTN; PAM sequence: TTA
ttttggttaaccttctttta

SEQ ID NO: 65404 - DNA, 20 bp, Artificial Sequence
  Description of Artificial Sequence: Synthetic oligonucleotide
  Target: SCN9A; (-) strand; PAM type: YTN; PAM sequence: CTT
attttggttaaccttctttt

SEQ ID NO: 65405 - DNA, 20 bp, Artificial Sequence
  Description of Artificial Sequence: Synthetic oligonucleotide
  Target: SCN9A; (-) strand; PAM type: YTN; PAM sequence: TTC
ttattttggttaaccttctt

SEQ ID NO: 65406 - DNA, 20 bp, Artificial Sequence
  Description of Artificial Sequence: Synthetic oligonucleotide
  Target: SCN9A; (-) strand; PAM type: YTN; PAM sequence: CTT
cttattttggttaaccttct

SEQ ID NO: 65407 - DNA, 20 bp, Artificial Sequence
  Description of Artificial Sequence: Synthetic oligonucleotide
  Target: SCN9A; (-) strand; PAM type: YTN; PAM sequence: TTC
ttcttattttggttaacctt

SEQ ID NO: 65408 - DNA, 20 bp, Artificial Sequence
  Description of Artificial Sequence: Synthetic oligonucleotide
  Target: SCN9A; (-) strand; PAM type: YTN; PAM sequence: TTT
cttcttattttggttaacct

SEQ ID NO: 65409 - DNA, 20 bp, Artificial Sequence
  Description of Artificial Sequence: Synthetic oligonucleotide
  Target: SCN9A; (-) strand; PAM type: YTN; PAM sequence: TTA
tttcttcttattttggttaa

SEQ ID NO: 65410 - DNA, 20 bp, Artificial Sequence
  Description of Artificial Sequence: Synthetic oligonucleotide
  Target: SCN9A; (-) strand; PAM type: YTN; PAM sequence: TTA
cattatttcttcttattttg

SEQ ID NO: 65411 - DNA, 20 bp, Artificial Sequence
  Description of Artificial Sequence: Synthetic oligonucleotide
  Target: SCN9A; (-) strand; PAM type: YTN; PAM sequence: CTT
acattatttcttcttatttt

SEQ ID NO: 65412 - DNA, 20 bp, Artificial Sequence
  Description of Artificial Sequence: Synthetic oligonucleotide
  Target: SCN9A; (-) strand; PAM type: YTN; PAM sequence: TTG
cttacattatttcttcttat

SEQ ID NO: 65413 - DNA, 20 bp, Artificial Sequence
  Description of Artificial Sequence: Synthetic oligonucleotide
  Target: SCN9A; (-) strand; PAM type: YTN; PAM sequence: TTT
gcttacattatttcttctta

SEQ ID NO: 65414 - DNA, 20 bp, Artificial Sequence
  Description of Artificial Sequence: Synthetic oligonucleotide
  Target: SCN9A; (-) strand; PAM type: YTN; PAM sequence: CTT
tgcttacattatttcttctt

SEQ ID NO: 65415 - DNA, 20 bp, Artificial Sequence
  Description of Artificial Sequence: Synthetic oligonucleotide
  Target: SCN9A; (-) strand; PAM type: YTN; PAM sequence: TTA
ctttgcttacattatttctt

SEQ ID NO: 65416 - DNA, 20 bp, Artificial Sequence
  Description of Artificial Sequence: Synthetic oligonucleotide
  Target: SCN9A; (-) strand; PAM type: YTN; PAM sequence: CTT
actttgcttacattatttct

SEQ ID NO: 65417 - DNA, 20 bp, Artificial Sequence
  Description of Artificial Sequence: Synthetic oligonucleotide
  Target: SCN9A; (-) strand; PAM type: YTN; PAM sequence: TTC
aaatagaataaacaacttac

SEQ ID NO: 65418 - DNA, 20 bp, Artificial Sequence
  Description of Artificial Sequence: Synthetic oligonucleotide
  Target: SCN9A; (-) strand; PAM type: YTN; PAM sequence: CTA
ttcaaatagaataaacaact

SEQ ID NO: 65419 - DNA, 20 bp, Artificial Sequence
  Description of Artificial Sequence: Synthetic oligonucleotide
  Target: SCN9A; (-) strand; PAM type: YTN; PAM sequence: TTC
tattcaaatagaataaacaa

SEQ ID NO: 65420 - DNA, 20 bp, Artificial Sequence
  Description of Artificial Sequence: Synthetic oligonucleotide
  Target: SCN9A; (-) strand; PAM type: YTN; PAM sequence: TTT
ctattcaaatagaataaaca

SEQ ID NO: 65421 - DNA, 20 bp, Artificial Sequence
  Description of Artificial Sequence: Synthetic oligonucleotide
  Target: SCN9A; (-) strand; PAM type: YTN; PAM sequence: TTA
caaaagtgtgaaaagcatat

SEQ ID NO: 65422 - DNA, 20 bp, Artificial Sequence
  Description of Artificial Sequence: Synthetic oligonucleotide
  Target: SCN9A; (-) strand; PAM type: YTN; PAM sequence: TTG
attacaaaagtgtgaaaagc

SEQ ID NO: 65423 - DNA, 20 bp, Artificial Sequence
  Description of Artificial Sequence: Synthetic oligonucleotide
  Target: SCN9A; (-) strand; PAM type: YTN; PAM sequence: TTA
caaagcaattgattacaaaa

SEQ ID NO: 65424 - DNA, 20 bp, Artificial Sequence
  Description of Artificial Sequence: Synthetic oligonucleotide
  Target: SCN9A; (-) strand; PAM type: YTN; PAM sequence: TTA
ataaggaattacaaagcaat

SEQ ID NO: 65425 - DNA, 20 bp, Artificial Sequence
  Description of Artificial Sequence: Synthetic oligonucleotide
  Target: SCN9A; (-) strand; PAM type: YTN; PAM sequence: TTT
aataaggaattacaaagcaa

SEQ ID NO: 65426 - DNA, 20 bp, Artificial Sequence
  Description of Artificial Sequence: Synthetic oligonucleotide
  Target: SCN9A; (-) strand; PAM type: YTN; PAM sequence: TTA
gatttaataaggaattacaa

SEQ ID NO: 65427 - DNA, 20 bp, Artificial Sequence
  Description of Artificial Sequence: Synthetic oligonucleotide
  Target: SCN9A; (-) strand; PAM type: YTN; PAM sequence: TTT
agatttaataaggaattaca

SEQ ID NO: 65428 - DNA, 20 bp, Artificial Sequence
  Description of Artificial Sequence: Synthetic oligonucleotide
  Target: SCN9A; (-) strand; PAM type: YTN; PAM sequence: TTT
tagatttaataaggaattac

SEQ ID NO: 65429 - DNA, 20 bp, Artificial Sequence
  Description of Artificial Sequence: Synthetic oligonucleotide
  Target: SCN9A; (-) strand; PAM type: YTN; PAM sequence: TTT
ttagatttaataaggaatta

SEQ ID NO: 65430 - DNA, 20 bp, Artificial Sequence
  Description of Artificial Sequence: Synthetic oligonucleotide
  Target: SCN9A; (-) strand; PAM type: YTN; PAM sequence: TTA
aatttttagatttaataagg

SEQ ID NO: 65431 - DNA, 20 bp, Artificial Sequence
  Description of Artificial Sequence: Synthetic oligonucleotide
  Target: SCN9A; (-) strand; PAM type: YTN; PAM sequence: CTA
attaaatttttagatttaat

SEQ ID NO: 65432 - DNA, 20 bp, Artificial Sequence
  Description of Artificial Sequence: Synthetic oligonucleotide
  Target: SCN9A; (-) strand; PAM type: YTN; PAM sequence: TTC
taattaaatttttagattta

SEQ ID NO: 65433 - DNA, 20 bp, Artificial Sequence
  Description of Artificial Sequence: Synthetic oligonucleotide
  Target: SCN9A; (-) strand; PAM type: YTN; PAM sequence: TTG
ttctaattaaatttttagat

SEQ ID NO: 65434 - DNA, 20 bp, Artificial Sequence
  Description of Artificial Sequence: Synthetic oligonucleotide
  Target: SCN9A; (-) strand; PAM type: YTN; PAM sequence: TTC
accattgttctaattaaatt

SEQ ID NO: 65435 - DNA, 20 bp, Artificial Sequence
  Description of Artificial Sequence: Synthetic oligonucleotide
  Target: SCN9A; (-) strand; PAM type: YTN; PAM sequence: TTA
aaatgttcaccattgttcta

SEQ ID NO: 65436 - DNA, 20 bp, Artificial Sequence
  Description of Artificial Sequence: Synthetic oligonucleotide
  Target: SCN9A; (-) strand; PAM type: YTN; PAM sequence: TTA
taattaaaatgttcaccatt

SEQ ID NO: 65437 - DNA, 20 bp, Artificial Sequence
  Description of Artificial Sequence: Synthetic oligonucleotide
  Target: SCN9A; (-) strand; PAM type: YTN; PAM sequence: TTT
ataattaaaatgttcaccat

SEQ ID NO: 65438 - DNA, 20 bp, Artificial Sequence
  Description of Artificial Sequence: Synthetic oligonucleotide
  Target: SCN9A; (-) strand; PAM type: YTN; PAM sequence: TTT
tataattaaaatgttcacca

SEQ ID NO: 65439 - DNA, 20 bp, Artificial Sequence
  Description of Artificial Sequence: Synthetic oligonucleotide
  Target: SCN9A; (-) strand; PAM type: YTN; PAM sequence: CTG
agttttataattaaaatgtt

SEQ ID NO: 65440 - DNA, 20 bp, Artificial Sequence
  Description of Artificial Sequence: Synthetic oligonucleotide
  Target: SCN9A; (-) strand; PAM type: YTN; PAM sequence: TTG
acctgagttttataattaaa

SEQ ID NO: 65441 - DNA, 20 bp, Artificial Sequence
  Description of Artificial Sequence: Synthetic oligonucleotide
  Target: SCN9A; (-) strand; PAM type: YTN; PAM sequence: TTT
gacctgagttttataattaa

SEQ ID NO: 65442 - DNA, 20 bp, Artificial Sequence
  Description of Artificial Sequence: Synthetic oligonucleotide
  Target: SCN9A; (-) strand; PAM type: YTN; PAM sequence: TTT
tgacctgagttttataatta

SEQ ID NO: 65443 - DNA, 20 bp, Artificial Sequence
  Description of Artificial Sequence: Synthetic oligonucleotide
  Target: SCN9A; (-) strand; PAM type: YTN; PAM sequence: TTC
attttgacctgagttttata

SEQ ID NO: 65444 - DNA, 20 bp, Artificial Sequence
  Description of Artificial Sequence: Synthetic oligonucleotide
  Target: SCN9A; (-) strand; PAM type: YTN; PAM sequence: CTT
cattttgacctgagttttat

SEQ ID NO: 65445 - DNA, 20 bp, Artificial Sequence
  Description of Artificial Sequence: Synthetic oligonucleotide
  Target: SCN9A; (-) strand; PAM type: YTN; PAM sequence: TTC
agaatcacacacttcatttt

SEQ ID NO: 65446 - DNA, 20 bp, Artificial Sequence
  Description of Artificial Sequence: Synthetic oligonucleotide
  Target: SCN9A; (-) strand; PAM type: YTN; PAM sequence: CTT
cagaatcacacacttcattt

SEQ ID NO: 65447 - DNA, 20 bp, Artificial Sequence
  Description of Artificial Sequence: Synthetic oligonucleotide
  Target: SCN9A; (-) strand; PAM type: YTN; PAM sequence: TTA
gcttcagaatcacacacttc

SEQ ID NO: 65448 - DNA, 20 bp, Artificial Sequence
  Description of Artificial Sequence: Synthetic oligonucleotide
  Target: SCN9A; (-) strand; PAM type: YTN; PAM sequence: CTT
agcttcagaatcacacactt

SEQ ID NO: 65449 - DNA, 20 bp, Artificial Sequence
  Description of Artificial Sequence: Synthetic oligonucleotide
  Target: SCN9A; (-) strand; PAM type: YTN; PAM sequence: TTA
gggcttagcttcagaatcac

SEQ ID NO: 65450 - DNA, 20 bp, Artificial Sequence
  Description of Artificial Sequence: Synthetic oligonucleotide
  Target: SCN9A; (-) strand; PAM type: YTN; PAM sequence: TTT
agggcttagcttcagaatca

SEQ ID NO: 65451 - DNA, 20 bp, Artificial Sequence
  Description of Artificial Sequence: Synthetic oligonucleotide
  Target: SCN9A; (-) strand; PAM type: YTN; PAM sequence: TTT
tagggcttagcttcagaatc

SEQ ID NO: 65452 - DNA, 20 bp, Artificial Sequence
  Description of Artificial Sequence: Synthetic oligonucleotide
  Target: SCN9A; (-) strand; PAM type: YTN; PAM sequence: CTT
ttagggcttagcttcagaat

SEQ ID NO: 65453 - DNA, 20 bp, Artificial Sequence
  Description of Artificial Sequence: Synthetic oligonucleotide
  Target: SCN9A; (-) strand; PAM type: YTN; PAM sequence: TTG
agtgaataccacacttttag

SEQ ID NO: 65454 - DNA, 20 bp, Artificial Sequence
  Description of Artificial Sequence: Synthetic oligonucleotide
  Target: SCN9A; (-) strand; PAM type: YTN; PAM sequence: TTA
gttgagtgaataccacactt

SEQ ID NO: 65455 - DNA, 20 bp, Artificial Sequence
  Description of Artificial Sequence: Synthetic oligonucleotide
  Target: SCN9A; (-) strand; PAM type: YTN; PAM sequence: TTT
agttgagtgaataccacact

SEQ ID NO: 65456 - DNA, 20 bp, Artificial Sequence
  Description of Artificial Sequence: Synthetic oligonucleotide
  Target: SCN9A; (-) strand; PAM type: YTN; PAM sequence: CTA
agacatagatttagttgagt

SEQ ID NO: 65457 - DNA, 20 bp, Artificial Sequence
  Description of Artificial Sequence: Synthetic oligonucleotide
  Target: SCN9A; (-) strand; PAM type: YTN; PAM sequence: TTA
tactaagacatagatttagt

SEQ ID NO: 65458 - DNA, 20 bp, Artificial Sequence
  Description of Artificial Sequence: Synthetic oligonucleotide
  Target: SCN9A; (-) strand; PAM type: YTN; PAM sequence: TTT
atactaagacatagatttag

SEQ ID NO: 65459 - DNA, 20 bp, Artificial Sequence
  Description of Artificial Sequence: Synthetic oligonucleotide
  Target: SCN9A; (-) strand; PAM type: YTN; PAM sequence: TTA
ataagatttatactaagaca

SEQ ID NO: 65460 - DNA, 20 bp, Artificial Sequence
  Description of Artificial Sequence: Synthetic oligonucleotide
  Target: SCN9A; (-) strand; PAM type: YTN; PAM sequence: TTT
aataagatttatactaagac

SEQ ID NO: 65461 - DNA, 20 bp, Artificial Sequence
  Description of Artificial Sequence: Synthetic oligonucleotide
  Target: SCN9A; (-) strand; PAM type: YTN; PAM sequence: TTT
taataagatttatactaaga

SEQ ID NO: 65462 - DNA, 20 bp, Artificial Sequence
  Description of Artificial Sequence: Synthetic oligonucleotide
  Target: SCN9A; (-) strand; PAM type: YTN; PAM sequence: TTT
ttaataagatttatactaag

SEQ ID NO: 65463 - DNA, 20 bp, Artificial Sequence
  Description of Artificial Sequence: Synthetic oligonucleotide
  Target: SCN9A; (-) strand; PAM type: YTN; PAM sequence: TTT
tttaataagatttatactaa

SEQ ID NO: 65464 - DNA, 20 bp, Artificial Sequence
  Description of Artificial Sequence: Synthetic oligonucleotide
  Target: SCN9A; (-) strand; PAM type: YTN; PAM sequence: TTC
aaaatgttttttaataagat

SEQ ID NO: 65465 - DNA, 20 bp, Artificial Sequence
  Description of Artificial Sequence: Synthetic oligonucleotide
  Target: SCN9A; (-) strand; PAM type: YTN; PAM sequence: CTT
caaaatgttttttaataaga

SEQ ID NO: 65466 - DNA, 20 bp, Artificial Sequence
  Description of Artificial Sequence: Synthetic oligonucleotide
  Target: SCN9A; (-) strand; PAM type: YTN; PAM sequence: CTC
aaaatcatgagtcttcaaaa

SEQ ID NO: 65467 - DNA, 20 bp, Artificial Sequence
  Description of Artificial Sequence: Synthetic oligonucleotide
  Target: SCN9A; (-) strand; PAM type: YTN; PAM sequence: TTG
ccccaactcaaaatcatgag

SEQ ID NO: 65468 - DNA, 20 bp, Artificial Sequence
  Description of Artificial Sequence: Synthetic oligonucleotide
  Target: SCN9A; (-) strand; PAM type: YTN; PAM sequence: TTT
gccccaactcaaaatcatga

SEQ ID NO: 65469 - DNA, 20 bp, Artificial Sequence
  Description of Artificial Sequence: Synthetic oligonucleotide
  Target: SCN9A; (-) strand; PAM type: YTN; PAM sequence: TTG
agaatttgccccaactcaaa

SEQ ID NO: 65470 - DNA, 20 bp, Artificial Sequence
  Description of Artificial Sequence: Synthetic oligonucleotide
  Target: SCN9A; (-) strand; PAM type: YTN; PAM sequence: TTG
ttgagaatttgccccaactc

SEQ ID NO: 65471 - DNA, 20 bp, Artificial Sequence
  Description of Artificial Sequence: Synthetic oligonucleotide
  Target: SCN9A; (-) strand; PAM type: YTN; PAM sequence: CTT
gttgagaatttgccccaact

SEQ ID NO: 65472 - DNA, 20 bp, Artificial Sequence
  Description of Artificial Sequence: Synthetic oligonucleotide
  Target: SCN9A; (-) strand; PAM type: YTN; PAM sequence: TTG
tagggcagaagcaatcttgt

SEQ ID NO: 65473 - DNA, 20 bp, Artificial Sequence
  Description of Artificial Sequence: Synthetic oligonucleotide
  Target: SCN9A; (-) strand; PAM type: YTN; PAM sequence: TTA
gaaattgtagggcagaagca

SEQ ID NO: 65474 - DNA, 20 bp, Artificial Sequence
  Description of Artificial Sequence: Synthetic oligonucleotide
  Target: SCN9A; (-) strand; PAM type: YTN; PAM sequence: TTT
agaaattgtagggcagaagc

SEQ ID NO: 65475 - DNA, 20 bp, Artificial Sequence
  Description of Artificial Sequence: Synthetic oligonucleotide
  Target: SCN9A; (-) strand; PAM type: YTN; PAM sequence: CTT
tagaaattgtagggcagaag

SEQ ID NO: 65476 - DNA, 20 bp, Artificial Sequence
  Description of Artificial Sequence: Synthetic oligonucleotide
  Target: SCN9A; (-) strand; PAM type: YTN; PAM sequence: CTA
atctttagaaattgtagggc

SEQ ID NO: 65477 - DNA, 20 bp, Artificial Sequence
  Description of Artificial Sequence: Synthetic oligonucleotide
  Target: SCN9A; (-) strand; PAM type: YTN; PAM sequence: TTG
gtgctaatctttagaaattg

SEQ ID NO: 65478 - DNA, 20 bp, Artificial Sequence
  Description of Artificial Sequence: Synthetic oligonucleotide
  Target: SCN9A; (-) strand; PAM type: YTN; PAM sequence: TTT
ggtgctaatctttagaaatt

SEQ ID NO: 65479 - DNA, 20 bp, Artificial Sequence
  Description of Artificial Sequence: Synthetic oligonucleotide
  Target: SCN9A; (-) strand; PAM type: YTN; PAM sequence: CTT
tggtgctaatctttagaaat

SEQ ID NO: 65480 - DNA, 20 bp, Artificial Sequence
  Description of Artificial Sequence: Synthetic oligonucleotide
  Target: SCN9A; (-) strand; PAM type: YTN; PAM sequence: TTG
gtagatctttggtgctaatc

SEQ ID NO: 65481 - DNA, 20 bp, Artificial Sequence
  Description of Artificial Sequence: Synthetic oligonucleotide
  Target: SCN9A; (-) strand; PAM type: YTN; PAM sequence: TTT
ggtagatctttggtgctaat

SEQ ID NO: 65482 - DNA, 20 bp, Artificial Sequence
  Description of Artificial Sequence: Synthetic oligonucleotide
  Target: SCN9A; (-) strand; PAM type: YTN; PAM sequence: CTA
tttggtagatctttggtgct

SEQ ID NO: 65483 - DNA, 20 bp, Artificial Sequence
  Description of Artificial Sequence: Synthetic oligonucleotide
  Target: SCN9A; (-) strand; PAM type: YTN; PAM sequence: CTC
ccatgaaaaactatttggta

SEQ ID NO: 65484 - DNA, 20 bp, Artificial Sequence
  Description of Artificial Sequence: Synthetic oligonucleotide
  Target: SCN9A; (-) strand; PAM type: YTN; PAM sequence: TTC
tcccatgaaaaactatttgg

SEQ ID NO: 65485 - DNA, 20 bp, Artificial Sequence
  Description of Artificial Sequence: Synthetic oligonucleotide
  Target: SCN9A; (-) strand; PAM type: YTN; PAM sequence: TTT
ctcccatgaaaaactatttg

SEQ ID NO: 65486 - DNA, 20 bp, Artificial Sequence
  Description of Artificial Sequence: Synthetic oligonucleotide
  Target: SCN9A; (-) strand; PAM type: YTN; PAM sequence: TTT
tctcccatgaaaaactattt

SEQ ID NO: 65487 - DNA, 20 bp, Artificial Sequence
  Description of Artificial Sequence: Synthetic oligonucleotide
  Target: SCN9A; (-) strand; PAM type: YTN; PAM sequence: TTT
ttctcccatgaaaaactatt

SEQ ID NO: 65488 - DNA, 20 bp, Artificial Sequence
  Description of Artificial Sequence: Synthetic oligonucleotide
  Target: SCN9A; (-) strand; PAM type: YTN; PAM sequence: TTG
tgatttttctcccatgaaaa

SEQ ID NO: 65489 - DNA, 20 bp, Artificial Sequence
  Description of Artificial Sequence: Synthetic oligonucleotide
  Target: SCN9A; (-) strand; PAM type: YTN; PAM sequence: TTC
agtacaattgtgatttttct

SEQ ID NO: 65490 - DNA, 20 bp, Artificial Sequence
  Description of Artificial Sequence: Synthetic oligonucleotide
  Target: SCN9A; (-) strand; PAM type: YTN; PAM sequence: CTT
cagtacaattgtgatttttc

SEQ ID NO: 65491 - DNA, 20 bp, Artificial Sequence
  Description of Artificial Sequence: Synthetic oligonucleotide
  Target: SCN9A; (-) strand; PAM type: YTN; PAM sequence: CTC
ttcagtacaattgtgatttt

SEQ ID NO: 65492 - DNA, 20 bp, Artificial Sequence
  Description of Artificial Sequence: Synthetic oligonucleotide
  Target: SCN9A; (-) strand; PAM type: YTN; PAM sequence: CTC
tcttcagtacaattgtgatt

SEQ ID NO: 65493 - DNA, 20 bp, Artificial Sequence
  Description of Artificial Sequence: Synthetic oligonucleotide
  Target: SCN9A; (-) strand; PAM type: YTN; PAM sequence: TTC
tctcttcagtacaattgtga

SEQ ID NO: 65494 - DNA, 20 bp, Artificial Sequence
  Description of Artificial Sequence: Synthetic oligonucleotide
  Target: SCN9A; (-) strand; PAM type: YTN; PAM sequence: CTC
attctctcttcagtacaatt

SEQ ID NO: 65495 - DNA, 20 bp, Artificial Sequence
  Description of Artificial Sequence: Synthetic oligonucleotide
  Target: SCN9A; (-) strand; PAM type: YTN; PAM sequence: CTC
tcattctctcttcagtacaa

SEQ ID NO: 65496 - DNA, 20 bp, Artificial Sequence
  Description of Artificial Sequence: Synthetic oligonucleotide
  Target: SCN9A; (-) strand; PAM type: YTN; PAM sequence: CTA
ctctcattctctcttcagta

SEQ ID NO: 65497 - DNA, 20 bp, Artificial Sequence
  Description of Artificial Sequence: Synthetic oligonucleotide
  Target: SCN9A; (-) strand; PAM type: YTN; PAM sequence: TTG
tgaagccaatgagatcagct

SEQ ID NO: 65498 - DNA, 20 bp, Artificial Sequence
  Description of Artificial Sequence: Synthetic oligonucleotide
  Target: SCN9A; (-) strand; PAM type: YTN; PAM sequence: TTG
attgtgaagccaatgagatc

SEQ ID NO: 65499 - DNA, 20 bp, Artificial Sequence
  Description of Artificial Sequence: Synthetic oligonucleotide
  Target: SCN9A; (-) strand; PAM type: YTN; PAM sequence: CTA
tattgattgtgaagccaatg

SEQ ID NO: 65500 - DNA, 20 bp, Artificial Sequence
  Description of Artificial Sequence: Synthetic oligonucleotide
  Target: SCN9A; (-) strand; PAM type: YTN; PAM sequence: TTA
tatctatattgattgtgaag

SEQ ID NO: 65501 - DNA, 20 bp, Artificial Sequence
  Description of Artificial Sequence: Synthetic oligonucleotide
  Target: SCN9A; (-) strand; PAM type: YTN; PAM sequence: TTA
ttatatctatattgattgtg

SEQ ID NO: 65502 - DNA, 20 bp, Artificial Sequence
  Description of Artificial Sequence: Synthetic oligonucleotide
  Target: SCN9A; (-) strand; PAM type: YTN; PAM sequence: CTT
attatatctatattgattgt

SEQ ID NO: 65503 - DNA, 20 bp, Artificial Sequence
  Description of Artificial Sequence: Synthetic oligonucleotide
  Target: SCN9A; (-) strand; PAM type: YTN; PAM sequence: CTC
ttattatatctatattgatt

SEQ ID NO: 65504 - DNA, 20 bp, Artificial Sequence
  Description of Artificial Sequence: Synthetic oligonucleotide
  Target: SCN9A; (-) strand; PAM type: YTN; PAM sequence: CTA
acatgatgaagctcttatta

SEQ ID NO: 65505 - DNA, 20 bp, Artificial Sequence
  Description of Artificial Sequence: Synthetic oligonucleotide
  Target: SCN9A; (-) strand; PAM type: YTN; PAM sequence: CTA
tctaacatgatgaagctctt

SEQ ID NO: 65506 - DNA, 20 bp, Artificial Sequence
  Description of Artificial Sequence: Synthetic oligonucleotide
  Target: SCN9A; (-) strand; PAM type: YTN; PAM sequence: CTG
atctatctaacatgatgaag

SEQ ID NO: 65507 - DNA, 20 bp, Artificial Sequence
  Description of Artificial Sequence: Synthetic oligonucleotide
  Target: SCN9A; (-) strand; PAM type: YTN; PAM sequence: TTG
tggctgatctatctaacatg

SEQ ID NO: 65508 - DNA, 20 bp, Artificial Sequence
  Description of Artificial Sequence: Synthetic oligonucleotide
  Target: SCN9A; (-) strand; PAM type: YTN; PAM sequence: TTA
tggtaattgtggctgatcta

SEQ ID NO: 65509 - DNA, 20 bp, Artificial Sequence
  Description of Artificial Sequence: Synthetic oligonucleotide
  Target: SCN9A; (-) strand; PAM type: YTN; PAM sequence: CTG
gttatggtaattgtggctga

SEQ ID NO: 65510 - DNA, 20 bp, Artificial Sequence
  Description of Artificial Sequence: Synthetic oligonucleotide
  Target: SCN9A; (-) strand; PAM type: YTN; PAM sequence: TTG
gatactggttatggtaattg

SEQ ID NO: 65511 - DNA, 20 bp, Artificial Sequence
  Description of Artificial Sequence: Synthetic oligonucleotide
  Target: SCN9A; (-) strand; PAM type: YTN; PAM sequence: TTT
ggatactggttatggtaatt

SEQ ID NO: 65512 - DNA, 20 bp, Artificial Sequence
  Description of Artificial Sequence: Synthetic oligonucleotide
  Target: SCN9A; (-) strand; PAM type: YTN; PAM sequence: TTT
tggatactggttatggtaat

SEQ ID NO: 65513 - DNA, 20 bp, Artificial Sequence
  Description of Artificial Sequence: Synthetic oligonucleotide
  Target: SCN9A; (-) strand; PAM type: YTN; PAM sequence: CTT
ttggatactggttatggtaa

SEQ ID NO: 65514 - DNA, 20 bp, Artificial Sequence
  Description of Artificial Sequence: Synthetic oligonucleotide
  Target: SCN9A; (-) strand; PAM type: YTN; PAM sequence: TTC
ttttggatactggttatggt

SEQ ID NO: 65515 - DNA, 20 bp, Artificial Sequence
  Description of Artificial Sequence: Synthetic oligonucleotide
  Target: SCN9A; (-) strand; PAM type: YTN; PAM sequence: TTT
cttttggatactggttatgg

SEQ ID NO: 65516 - DNA, 20 bp, Artificial Sequence
  Description of Artificial Sequence: Synthetic oligonucleotide
  Target: SCN9A; (-) strand; PAM type: YTN; PAM sequence: CTC
aaatttcttttggatactgg

SEQ ID NO: 65517 - DNA, 20 bp, Artificial Sequence
  Description of Artificial Sequence: Synthetic oligonucleotide
  Target: SCN9A; (-) strand; PAM type: YTN; PAM sequence: TTA
cgataagaactcaaatttct

SEQ ID NO: 65518 - DNA, 20 bp, Artificial Sequence
  Description of Artificial Sequence: Synthetic oligonucleotide
  Target: SCN9A; (-) strand; PAM type: YTN; PAM sequence: TTT
acgataagaactcaaatttc

SEQ ID NO: 65519 - DNA, 20 bp, Artificial Sequence
  Description of Artificial Sequence: Synthetic oligonucleotide
  Target: SCN9A; (-) strand; PAM type: YTN; PAM sequence: TTA
agataatttacgataagaac

SEQ ID NO: 65520 - DNA, 20 bp, Artificial Sequence
  Description of Artificial Sequence: Synthetic oligonucleotide
  Target: SCN9A; (-) strand; PAM type: YTN; PAM sequence: CTT
aagataatttacgataagaa

SEQ ID NO: 65521 - DNA, 20 bp, Artificial Sequence
  Description of Artificial Sequence: Synthetic oligonucleotide
  Target: SCN9A; (-) strand; PAM type: YTN; PAM sequence: TTC
ttaagataatttacgataag

SEQ ID NO: 65522 - DNA, 20 bp, Artificial Sequence
  Description of Artificial Sequence: Synthetic oligonucleotide
  Target: SCN9A; (-) strand; PAM type: YTN; PAM sequence: TTT
cttaagataatttacgataa

SEQ ID NO: 65523 - DNA, 20 bp, Artificial Sequence
  Description of Artificial Sequence: Synthetic oligonucleotide
  Target: SCN9A; (-) strand; PAM type: YTN; PAM sequence: CTT
tcttaagataatttacgata

SEQ ID NO: 65524 - DNA, 20 bp, Artificial Sequence
  Description of Artificial Sequence: Synthetic oligonucleotide
  Target: SCN9A; (-) strand; PAM type: YTN; PAM sequence: TTC
tttcttaagataatttacga

SEQ ID NO: 65525 - DNA, 20 bp, Artificial Sequence
  Description of Artificial Sequence: Synthetic oligonucleotide
  Target: SCN9A; (-) strand; PAM type: YTN; PAM sequence: TTC
atgttctttcttaagataat

SEQ ID NO: 65526 - DNA, 20 bp, Artificial Sequence
  Description of Artificial Sequence: Synthetic oligonucleotide
  Target: SCN9A; (-) strand; PAM type: YTN; PAM sequence: CTG
ttcatgttctttcttaagat

SEQ ID NO: 65527 - DNA, 20 bp, Artificial Sequence
  Description of Artificial Sequence: Synthetic oligonucleotide
  Target: SCN9A; (-) strand; PAM type: YTN; PAM sequence: TTG
ctgttcatgttctttcttaa

SEQ ID NO: 65528 - DNA, 20 bp, Artificial Sequence
  Description of Artificial Sequence: Synthetic oligonucleotide
  Target: SCN9A; (-) strand; PAM type: YTN; PAM sequence: TTG
tattgctgttcatgttcttt

SEQ ID NO: 65529 - DNA, 20 bp, Artificial Sequence
  Description of Artificial Sequence: Synthetic oligonucleotide
  Target: SCN9A; (-) strand; PAM type: YTN; PAM sequence: TTG
attgtattgctgttcatgtt

SEQ ID NO: 65530 - DNA, 20 bp, Artificial Sequence
  Description of Artificial Sequence: Synthetic oligonucleotide
  Target: SCN9A; (-) strand; PAM type: YTN; PAM sequence: CTA
aaatgtgtattgattgtatt

SEQ ID NO: 65531 - DNA, 20 bp, Artificial Sequence
  Description of Artificial Sequence: Synthetic oligonucleotide
  Target: SCN9A; (-) strand; PAM type: YTN; PAM sequence: TTG
taactaaaatgtgtattgat

SEQ ID NO: 65532 - DNA, 20 bp, Artificial Sequence
  Description of Artificial Sequence: Synthetic oligonucleotide
  Target: SCN9A; (-) strand; PAM type: YTN; PAM sequence: TTT
gtaactaaaatgtgtattga

SEQ ID NO: 65533 - DNA, 20 bp, Artificial Sequence
  Description of Artificial Sequence: Synthetic oligonucleotide
  Target: SCN9A; (-) strand; PAM type: YTN; PAM sequence: CTT
tgtaactaaaatgtgtattg

SEQ ID NO: 65534 - DNA, 20 bp, Artificial Sequence
  Description of Artificial Sequence: Synthetic oligonucleotide
  Target: SCN9A; (-) strand; PAM type: YTN; PAM sequence: TTG
ctttgtaactaaaatgtgta

SEQ ID NO: 65535 - DNA, 20 bp, Artificial Sequence
  Description of Artificial Sequence: Synthetic oligonucleotide
  Target: SCN9A; (-) strand; PAM type: YTN; PAM sequence: CTC
attgctttgtaactaaaatg

SEQ ID NO: 65536 - DNA, 20 bp, Artificial Sequence
  Description of Artificial Sequence: Synthetic oligonucleotide
  Target: SCN9A; (-) strand; PAM type: YTN; PAM sequence: CTA
aggtcatggaggagctcatt

SEQ ID NO: 65537 - DNA, 20 bp, Artificial Sequence
  Description of Artificial Sequence: Synthetic oligonucleotide
  Target: SCN9A; (-) strand; PAM type: YTN; PAM sequence: TTA
tagatccagatctaaggtca

SEQ ID NO: 65538 - DNA, 20 bp, Artificial Sequence
  Description of Artificial Sequence: Synthetic oligonucleotide
  Target: SCN9A; (-) strand; PAM type: YTN; PAM sequence: TTT
atagatccagatctaaggtc

SEQ ID NO: 65539 - DNA, 20 bp, Artificial Sequence
  Description of Artificial Sequence: Synthetic oligonucleotide
  Target: SCN9A; (-) strand; PAM type: YTN; PAM sequence: TTC
agagagtaaacatatttata

SEQ ID NO: 65540 - DNA, 20 bp, Artificial Sequence
  Description of Artificial Sequence: Synthetic oligonucleotide
  Target: SCN9A; (-) strand; PAM type: YTN; PAM sequence: CTA
attcagagagtaaacatatt

SEQ ID NO: 65541 - DNA, 20 bp, Artificial Sequence
  Description of Artificial Sequence: Synthetic oligonucleotide
  Target: SCN9A; (-) strand; PAM type: YTN; PAM sequence: TTC
catggaactaattcagagag

SEQ ID NO: 65542 - DNA, 20 bp, Artificial Sequence
  Description of Artificial Sequence: Synthetic oligonucleotide
  Target: SCN9A; (-) strand; PAM type: YTN; PAM sequence: TTT
ccatggaactaattcagaga

SEQ ID NO: 65543 - DNA, 20 bp, Artificial Sequence
  Description of Artificial Sequence: Synthetic oligonucleotide
  Target: SCN9A; (-) strand; PAM type: YTN; PAM sequence: TTT
tccatggaactaattcagag

SEQ ID NO: 65544 - DNA, 20 bp, Artificial Sequence
  Description of Artificial Sequence: Synthetic oligonucleotide
  Target: SCN9A; (-) strand; PAM type: YTN; PAM sequence: CTA
cacaggatgtgaggcaaatg

SEQ ID NO: 65545 - DNA, 20 bp, Artificial Sequence
  Description of Artificial Sequence: Synthetic oligonucleotide
  Target: SCN9A; (-) strand; PAM type: YTN; PAM sequence: CTG
ctacacaggatgtgaggcaa

SEQ ID NO: 65546 - DNA, 20 bp, Artificial Sequence
  Description of Artificial Sequence: Synthetic oligonucleotide
  Target: SCN9A; (-) strand; PAM type: YTN; PAM sequence: CTC
ctgctacacaggatgtgagg

SEQ ID NO: 65547 - DNA, 20 bp, Artificial Sequence
  Description of Artificial Sequence: Synthetic oligonucleotide
  Target: SCN9A; (-) strand; PAM type: YTN; PAM sequence: TTA
gacatcgtctcctgctacac

SEQ ID NO: 65548 - DNA, 20 bp, Artificial Sequence
  Description of Artificial Sequence: Synthetic oligonucleotide
  Target: SCN9A; (-) strand; PAM type: YTN; PAM sequence: CTT
agacatcgtctcctgctaca

SEQ ID NO: 65549 - DNA, 20 bp, Artificial Sequence
  Description of Artificial Sequence: Synthetic oligonucleotide
  Target: SCN9A; (-) strand; PAM type: YTN; PAM sequence: TTC
ttagacatcgtctcctgcta

SEQ ID NO: 65550 - DNA, 20 bp, Artificial Sequence
  Description of Artificial Sequence: Synthetic oligonucleotide
  Target: SCN9A; (-) strand; PAM type: YTN; PAM sequence: TTT
cttagacatcgtctcctgct

SEQ ID NO: 65551 - DNA, 20 bp, Artificial Sequence
  Description of Artificial Sequence: Synthetic oligonucleotide
  Target: SCN9A; (-) strand; PAM type: YTN; PAM sequence: TTT
tcttagacatcgtctcctgc

SEQ ID NO: 65552 - DNA, 20 bp, Artificial Sequence
  Description of Artificial Sequence: Synthetic oligonucleotide
  Target: SCN9A; (-) strand; PAM type: YTN; PAM sequence: TTT
ttcttagacatcgtctcctg

SEQ ID NO: 65553 - DNA, 20 bp, Artificial Sequence
  Description of Artificial Sequence: Synthetic oligonucleotide
  Target: SCN9A; (-) strand; PAM type: YTN; PAM sequence: TTC
cagacatttttcttagacat

SEQ ID NO: 65554 - DNA, 20 bp, Artificial Sequence
  Description of Artificial Sequence: Synthetic oligonucleotide
  Target: SCN9A; (-) strand; PAM type: YTN; PAM sequence: CTG
cattccagacatttttctta

SEQ ID NO: 65555 - DNA, 20 bp, Artificial Sequence
  Description of Artificial Sequence: Synthetic oligonucleotide
  Target: SCN9A; (-) strand; PAM type: YTN; PAM sequence: TTC
gtaatgaagaactgcattcc

SEQ ID NO: 65556 - DNA, 20 bp, Artificial Sequence
  Description of Artificial Sequence: Synthetic oligonucleotide
  Target: SCN9A; (-) strand; PAM type: YTN; PAM sequence: TTA
ttcgtaatgaagaactgcat

SEQ ID NO: 65557 - DNA, 20 bp, Artificial Sequence
  Description of Artificial Sequence: Synthetic oligonucleotide
  Target: SCN9A; (-) strand; PAM type: YTN; PAM sequence: CTT
attcgtaatgaagaactgca

SEQ ID NO: 65558 - DNA, 20 bp, Artificial Sequence
  Description of Artificial Sequence: Synthetic oligonucleotide
  Target: SCN9A; (-) strand; PAM type: YTN; PAM sequence: CTA
acttattcgtaatgaagaac

SEQ ID NO: 65559 - DNA, 20 bp, Artificial Sequence
  Description of Artificial Sequence: Synthetic oligonucleotide
  Target: SCN9A; (-) strand; PAM type: YTN; PAM sequence: CTC
agtcactaacttattcgtaa

SEQ ID NO: 65560 - DNA, 20 bp, Artificial Sequence
  Description of Artificial Sequence: Synthetic oligonucleotide
  Target: SCN9A; (-) strand; PAM type: YTN; PAM sequence: CTC
tcagtcactaacttattcgt

SEQ ID NO: 65561 - DNA, 20 bp, Artificial Sequence
  Description of Artificial Sequence: Synthetic oligonucleotide
  Target: SCN9A; (-) strand; PAM type: YTN; PAM sequence: TTG
aatctctcagtcactaactt

SEQ ID NO: 65562 - DNA, 20 bp, Artificial Sequence
  Description of Artificial Sequence: Synthetic oligonucleotide
  Target: SCN9A; (-) strand; PAM type: YTN; PAM sequence: CTC
gaaaaattgaatctctcagt

SEQ ID NO: 65563 - DNA, 20 bp, Artificial Sequence
  Description of Artificial Sequence: Synthetic oligonucleotide
  Target: SCN9A; (-) strand; PAM type: YTN; PAM sequence: TTC
cctcgaaaaattgaatctct

SEQ ID NO: 65564 - DNA, 20 bp, Artificial Sequence
  Description of Artificial Sequence: Synthetic oligonucleotide
  Target: SCN9A; (-) strand; PAM type: YTN; PAM sequence: CTT
ccctcgaaaaattgaatctc

SEQ ID NO: 65565 - DNA, 20 bp, Artificial Sequence
  Description of Artificial Sequence: Synthetic oligonucleotide
  Target: SCN9A; (-) strand; PAM type: YTN; PAM sequence: TTC
ttccctcgaaaaattgaatc

SEQ ID NO: 65566 - DNA, 20 bp, Artificial Sequence
  Description of Artificial Sequence: Synthetic oligonucleotide
  Target: SCN9A; (-) strand; PAM type: YTN; PAM sequence: CTA
ttcttccctcgaaaaattga

SEQ ID NO: 65567 - DNA, 20 bp, Artificial Sequence
  Description of Artificial Sequence: Synthetic oligonucleotide
  Target: SCN9A; (-) strand; PAM type: YTN; PAM sequence: TTC
ctattcttccctcgaaaaat

SEQ ID NO: 65568 - DNA, 20 bp, Artificial Sequence
  Description of Artificial Sequence: Synthetic oligonucleotide
  Target: SCN9A; (-) strand; PAM type: YTN; PAM sequence: CTG
ttcctattcttccctcgaaa

SEQ ID NO: 65569 - DNA, 20 bp, Artificial Sequence
  Description of Artificial Sequence: Synthetic oligonucleotide
  Target: SCN9A; (-) strand; PAM type: YTN; PAM sequence: CTC
atctgttcctattcttccct

SEQ ID NO: 65570 - DNA, 20 bp, Artificial Sequence
  Description of Artificial Sequence: Synthetic oligonucleotide
  Target: SCN9A; (-) strand; PAM type: YTN; PAM sequence: CTC
tcatctgttcctattcttcc

SEQ ID NO: 65571 - DNA, 20 bp, Artificial Sequence
  Description of Artificial Sequence: Synthetic oligonucleotide
  Target: SCN9A; (-) strand; PAM type: YTN; PAM sequence: TTG
gctctcatctgttcctattc

SEQ ID NO: 65572 - DNA, 20 bp, Artificial Sequence
  Description of Artificial Sequence: Synthetic oligonucleotide
  Target: SCN9A; (-) strand; PAM type: YTN; PAM sequence: CTG
aaatagataaatatataaag

SEQ ID NO: 65573 - DNA, 20 bp, Artificial Sequence
  Description of Artificial Sequence: Synthetic oligonucleotide
  Target: SCN9A; (-) strand; PAM type: YTN; PAM sequence: CTA
cgcctgaaatagataaatat

SEQ ID NO: 65574 - DNA, 20 bp, Artificial Sequence
  Description of Artificial Sequence: Synthetic oligonucleotide
  Target: SCN9A; (-) strand; PAM type: YTN; PAM sequence: TTC
tacgcctgaaatagataaat

SEQ ID NO: 65575 - DNA, 20 bp, Artificial Sequence
  Description of Artificial Sequence: Synthetic oligonucleotide
  Target: SCN9A; (-) strand; PAM type: YTN; PAM sequence: TTT
ctacgcctgaaatagataaa

SEQ ID NO: 65576 - DNA, 20 bp, Artificial Sequence
  Description of Artificial Sequence: Synthetic oligonucleotide
  Target: SCN9A; (-) strand; PAM type: YTN; PAM sequence: TTT
tctacgcctgaaatagataa

SEQ ID NO: 65577 - DNA, 20 bp, Artificial Sequence
  Description of Artificial Sequence: Synthetic oligonucleotide
  Target: SCN9A; (-) strand; PAM type: YTN; PAM sequence: TTT
ttctacgcctgaaatagata

SEQ ID NO: 65578 - DNA, 20 bp, Artificial Sequence
  Description of Artificial Sequence: Synthetic oligonucleotide
  Target: SCN9A; (-) strand; PAM type: YTN; PAM sequence: CTT
tttctacgcctgaaatagat

SEQ ID NO: 65579 - DNA, 20 bp, Artificial Sequence
  Description of Artificial Sequence: Synthetic oligonucleotide
  Target: SCN9A; (-) strand; PAM type: YTN; PAM sequence: TTG
tgaacaatgactttttctac

SEQ ID NO: 65580 - DNA, 20 bp, Artificial Sequence
  Description of Artificial Sequence: Synthetic oligonucleotide
  Target: SCN9A; (-) strand; PAM type: YTN; PAM sequence: TTT
gtgaacaatgactttttcta

SEQ ID NO: 65581 - DNA, 20 bp, Artificial Sequence
  Description of Artificial Sequence: Synthetic oligonucleotide
  Target: SCN9A; (-) strand; PAM type: YTN; PAM sequence: TTT
tgtgaacaatgactttttct

SEQ ID NO: 65582 - DNA, 20 bp, Artificial Sequence
  Description of Artificial Sequence: Synthetic oligonucleotide
  Target: SCN9A; (-) strand; PAM type: YTN; PAM sequence: TTT
ttgtgaacaatgactttttc

SEQ ID NO: 65583 - DNA, 20 bp, Artificial Sequence
  Description of Artificial Sequence: Synthetic oligonucleotide
  Target: SCN9A; (-) strand; PAM type: YTN; PAM sequence: CTT
tttgtgaacaatgacttttt

SEQ ID NO: 65584 - DNA, 20 bp, Artificial Sequence
  Description of Artificial Sequence: Synthetic oligonucleotide
  Target: SCN9A; (-) strand; PAM type: YTN; PAM sequence: CTG
atggtaacagcaatgaactt

SEQ ID NO: 65585 - DNA, 20 bp, Artificial Sequence
  Description of Artificial Sequence: Synthetic oligonucleotide
  Target: SCN9A; (-) strand; PAM type: YTN; PAM sequence: CTC
tgatggtaacagcaatgaac

SEQ ID NO: 65586 - DNA, 20 bp, Artificial Sequence
  Description of Artificial Sequence: Synthetic oligonucleotide
  Target: SCN9A; (-) strand; PAM type: YTN; PAM sequence: CTG
tctctgatggtaacagcaat

SEQ ID NO: 65587 - DNA, 20 bp, Artificial Sequence
  Description of Artificial Sequence: Synthetic oligonucleotide
  Target: SCN9A; (-) strand; PAM type: YTN; PAM sequence: TTA
cctgtctctgatggtaacag

SEQ ID NO: 65588 - DNA, 20 bp, Artificial Sequence
  Description of Artificial Sequence: Synthetic oligonucleotide
  Target: SCN9A; (-) strand; PAM type: YTN; PAM sequence: TTT
acctgtctctgatggtaaca

SEQ ID NO: 65589 - DNA, 20 bp, Artificial Sequence
  Description of Artificial Sequence: Synthetic oligonucleotide
  Target: SCN9A; (-) strand; PAM type: YTN; PAM sequence: TTC
atcagtcagtttacctgtct

SEQ ID NO: 65590 - DNA, 20 bp, Artificial Sequence
  Description of Artificial Sequence: Synthetic oligonucleotide
  Target: SCN9A; (-) strand; PAM type: YTN; PAM sequence: CTT
catcagtcagtttacctgtc

SEQ ID NO: 65591 - DNA, 20 bp, Artificial Sequence
  Description of Artificial Sequence: Synthetic oligonucleotide
  Target: SCN9A; (-) strand; PAM type: YTN; PAM sequence: TTC
ccgcttcatcagtcagttta

SEQ ID NO: 65592 - DNA, 20 bp, Artificial Sequence
  Description of Artificial Sequence: Synthetic oligonucleotide
  Target: SCN9A; (-) strand; PAM type: YTN; PAM sequence: CTT
cccgcttcatcagtcagttt

SEQ ID NO: 65593 - DNA, 20 bp, Artificial Sequence
  Description of Artificial Sequence: Synthetic oligonucleotide
  Target: SCN9A; (-) strand; PAM type: YTN; PAM sequence: TTA
aaacacttcccgcttcatca

SEQ ID NO: 65594 - DNA, 20 bp, Artificial Sequence
  Description of Artificial Sequence: Synthetic oligonucleotide
  Target: SCN9A; (-) strand; PAM type: YTN; PAM sequence: TTT
aaaacacttcccgcttcatc

SEQ ID NO: 65595 - DNA, 20 bp, Artificial Sequence
  Description of Artificial Sequence: Synthetic oligonucleotide
  Target: SCN9A; (-) strand; PAM type: YTN; PAM sequence: CTT
taaaacacttcccgcttcat

SEQ ID NO: 65596 - DNA, 20 bp, Artificial Sequence
  Description of Artificial Sequence: Synthetic oligonucleotide
  Target: SCN9A; (-) strand; PAM type: YTN; PAM sequence: CTA
catgaggatgagcactttaa

SEQ ID NO: 65597 - DNA, 20 bp, Artificial Sequence
  Description of Artificial Sequence: Synthetic oligonucleotide
  Target: SCN9A; (-) strand; PAM type: YTN; PAM sequence: CTG
gaaatactacatgaggatga

SEQ ID NO: 65598 - DNA, 20 bp, Artificial Sequence
  Description of Artificial Sequence: Synthetic oligonucleotide
  Target: SCN9A; (-) strand; PAM type: YTN; PAM sequence: TTA
gtgagacatctggaaatact

SEQ ID NO: 65599 - DNA, 20 bp, Artificial Sequence
  Description of Artificial Sequence: Synthetic oligonucleotide
  Target: SCN9A; (-) strand; PAM type: YTN; PAM sequence: TTT
agtgagacatctggaaatac

SEQ ID NO: 65600 - DNA, 20 bp, Artificial Sequence
  Description of Artificial Sequence: Synthetic oligonucleotide
  Target: SCN9A; (-) strand; PAM type: YTN; PAM sequence: TTA
catttagtgagacatctgga

SEQ ID NO: 65601 - DNA, 20 bp, Artificial Sequence
  Description of Artificial Sequence: Synthetic oligonucleotide
  Target: SCN9A; (-) strand; PAM type: YTN; PAM sequence: TTA
aaaaaaaaagccatgttaca

SEQ ID NO: 65602 - DNA, 20 bp, Artificial Sequence
  Description of Artificial Sequence: Synthetic oligonucleotide
  Target: SCN9A; (-) strand; PAM type: YTN; PAM sequence: TTT
aaaaaaaaaagccatgttac

SEQ ID NO: 65603 - DNA, 20 bp, Artificial Sequence
  Description of Artificial Sequence: Synthetic oligonucleotide
  Target: SCN9A; (-) strand; PAM type: YTN; PAM sequence: TTA
ggaatttaaaaaaaaaagcc

SEQ ID NO: 65604 - DNA, 20 bp, Artificial Sequence
  Description of Artificial Sequence: Synthetic oligonucleotide
  Target: SCN9A; (-) strand; PAM type: YTN; PAM sequence: TTT
aggaatttaaaaaaaaaagc

SEQ ID NO: 65605 - DNA, 20 bp, Artificial Sequence
  Description of Artificial Sequence: Synthetic oligonucleotide
  Target: SCN9A; (-) strand; PAM type: YTN; PAM sequence: CTT
taggaatttaaaaaaaaaag

SEQ ID NO: 65606 - DNA, 20 bp, Artificial Sequence
  Description of Artificial Sequence: Synthetic oligonucleotide
  Target: SCN9A; (-) strand; PAM type: YTN; PAM sequence: CTA
aatacgtagctttaggaatt

SEQ ID NO: 65607 - DNA, 20 bp, Artificial Sequence
  Description of Artificial Sequence: Synthetic oligonucleotide
  Target: SCN9A; (-) strand; PAM type: YTN; PAM sequence: CTG
ctaaatacgtagctttagga

SEQ ID NO: 65608 - DNA, 20 bp, Artificial Sequence
  Description of Artificial Sequence: Synthetic oligonucleotide
  Target: SCN9A; (-) strand; PAM type: YTN; PAM sequence: TTC
tgctaaatacgtagctttag

SEQ ID NO: 65609 - DNA, 20 bp, Artificial Sequence
  Description of Artificial Sequence: Synthetic oligonucleotide
  Target: SCN9A; (-) strand; PAM type: YTN; PAM sequence: TTA
ttctgctaaatacgtagctt

SEQ ID NO: 65610 - DNA, 20 bp, Artificial Sequence
  Description of Artificial Sequence: Synthetic oligonucleotide
  Target: SCN9A; (-) strand; PAM type: YTN; PAM sequence: TTT
attctgctaaatacgtagct

SEQ ID NO: 65611 - DNA, 20 bp, Artificial Sequence
  Description of Artificial Sequence: Synthetic oligonucleotide
  Target: SCN9A; (-) strand; PAM type: YTN; PAM sequence: TTA
agagtggcatgaggagtaat

SEQ ID NO: 65612 - DNA, 20 bp, Artificial Sequence
  Description of Artificial Sequence: Synthetic oligonucleotide
  Target: SCN9A; (-) strand; PAM type: YTN; PAM sequence: TTT
aagagtggcatgaggagtaa

SEQ ID NO: 65613 - DNA, 20 bp, Artificial Sequence
  Description of Artificial Sequence: Synthetic oligonucleotide
  Target: SCN9A; (-) strand; PAM type: YTN; PAM sequence: CTG
ggcaaatttaagagtggcat

SEQ ID NO: 65614 - DNA, 20 bp, Artificial Sequence
  Description of Artificial Sequence: Synthetic oligonucleotide
  Target: SCN9A; (-) strand; PAM type: YTN; PAM sequence: TTA
agtggaaaataatggatgtg

SEQ ID NO: 65615 - DNA, 20 bp, Artificial Sequence
  Description of Artificial Sequence: Synthetic oligonucleotide
  Target: SCN9A; (-) strand; PAM type: YTN; PAM sequence: CTT
aagtggaaaataatggatgt

SEQ ID NO: 65616 - DNA, 20 bp, Artificial Sequence
  Description of Artificial Sequence: Synthetic oligonucleotide
  Target: SCN9A; (-) strand; PAM type: YTN; PAM sequence: TTC
ttaagtggaaaataatggat

SEQ ID NO: 65617 - DNA, 20 bp, Artificial Sequence
  Description of Artificial Sequence: Synthetic oligonucleotide
  Target: SCN9A; (-) strand; PAM type: YTN; PAM sequence: TTC
aagtgttcttaagtggaaaa

SEQ ID NO: 65618 - DNA, 20 bp, Artificial Sequence
  Description of Artificial Sequence: Synthetic oligonucleotide
  Target: SCN9A; (-) strand; PAM type: YTN; PAM sequence: TTT
caagtgttcttaagtggaaa

SEQ ID NO: 65619 - DNA, 20 bp, Artificial Sequence
  Description of Artificial Sequence: Synthetic oligonucleotide
  Target: SCN9A; (-) strand; PAM type: YTN; PAM sequence: TTT
tcaagtgttcttaagtggaa

SEQ ID NO: 65620 - DNA, 20 bp, Artificial Sequence
  Description of Artificial Sequence: Synthetic oligonucleotide
  Target: SCN9A; (-) strand; PAM type: YTN; PAM sequence: TTA
aagagggagcatacatattt

SEQ ID NO: 65621 - DNA, 20 bp, Artificial Sequence
  Description of Artificial Sequence: Synthetic oligonucleotide
  Target: SCN9A; (-) strand; PAM type: YTN; PAM sequence: CTG
attaaagagggagcatacat

SEQ ID NO: 65622 - DNA, 20 bp, Artificial Sequence
  Description of Artificial Sequence: Synthetic oligonucleotide
  Target: SCN9A; (-) strand; PAM type: YTN; PAM sequence: TTC
tgattaaagagggagcatac

SEQ ID NO: 65623 - DNA, 20 bp, Artificial Sequence
  Description of Artificial Sequence: Synthetic oligonucleotide
  Target: SCN9A; (-) strand; PAM type: YTN; PAM sequence: TTT
ctgattaaagagggagcata

SEQ ID NO: 65624 - DNA, 20 bp, Artificial Sequence
  Description of Artificial Sequence: Synthetic oligonucleotide
  Target: SCN9A; (-) strand; PAM type: YTN; PAM sequence: TTT
tctgattaaagagggagcat

SEQ ID NO: 65625 - DNA, 20 bp, Artificial Sequence
  Description of Artificial Sequence: Synthetic oligonucleotide
  Target: SCN9A; (-) strand; PAM type: YTN; PAM sequence: TTA
aaaaaaaaattttctgatta

SEQ ID NO: 65626 - DNA, 20 bp, Artificial Sequence
  Description of Artificial Sequence: Synthetic oligonucleotide
  Target: SCN9A; (-) strand; PAM type: YTN; PAM sequence: TTC
aaaccacagcaaaacattaa

SEQ ID NO: 65627 - DNA, 20 bp, Artificial Sequence
  Description of Artificial Sequence: Synthetic oligonucleotide
  Target: SCN9A; (-) strand; PAM type: YTN; PAM sequence: TTC
aaaagggacaaacattcaaa

SEQ ID NO: 65628 - DNA, 20 bp, Artificial Sequence
  Description of Artificial Sequence: Synthetic oligonucleotide
  Target: SCN9A; (-) strand; PAM type: YTN; PAM sequence: TTT
caaaagggacaaacattcaa

SEQ ID NO: 65629 - DNA, 20 bp, Artificial Sequence
  Description of Artificial Sequence: Synthetic oligonucleotide
  Target: SCN9A; (-) strand; PAM type: YTN; PAM sequence: TTC
caacatgagtttcaaaaggg

SEQ ID NO: 65630 - DNA, 20 bp, Artificial Sequence
  Description of Artificial Sequence: Synthetic oligonucleotide
  Target: SCN9A; (-) strand; PAM type: YTN; PAM sequence: TTA
agttccaacatgagtttcaa

SEQ ID NO: 65631 - DNA, 20 bp, Artificial Sequence
  Description of Artificial Sequence: Synthetic oligonucleotide
  Target: SCN9A; (-) strand; PAM type: YTN; PAM sequence: TTG
ggaattaagttccaacatga

SEQ ID NO: 65632 - DNA, 20 bp, Artificial Sequence
  Description of Artificial Sequence: Synthetic oligonucleotide
  Target: SCN9A; (-) strand; PAM type: YTN; PAM sequence: TTA
cattgggaattaagttccaa

SEQ ID NO: 65633 - DNA, 20 bp, Artificial Sequence
  Description of Artificial Sequence: Synthetic oligonucleotide
  Target: SCN9A; (-) strand; PAM type: YTN; PAM sequence: CTG
ttacattgggaattaagttc

SEQ ID NO: 65634 - DNA, 20 bp, Artificial Sequence
  Description of Artificial Sequence: Synthetic oligonucleotide
  Target: SCN9A; (-) strand; PAM type: YTN; PAM sequence: TTA
atactgttacattgggaatt

SEQ ID NO: 65635 - DNA, 20 bp, Artificial Sequence
  Description of Artificial Sequence: Synthetic oligonucleotide
  Target: SCN9A; (-) strand; PAM type: YTN; PAM sequence: CTT
aatactgttacattgggaat

SEQ ID NO: 65636 - DNA, 20 bp, Artificial Sequence
  Description of Artificial Sequence: Synthetic oligonucleotide
  Target: SCN9A; (-) strand; PAM type: YTN; PAM sequence: CTC
ttaatactgttacattggga

SEQ ID NO: 65637 - DNA, 20 bp, Artificial Sequence
  Description of Artificial Sequence: Synthetic oligonucleotide
  Target: SCN9A; (-) strand; PAM type: YTN; PAM sequence: CTG
cctcttaatactgttacatt

SEQ ID NO: 65638 - DNA, 20 bp, Artificial Sequence
  Description of Artificial Sequence: Synthetic oligonucleotide
  Target: SCN9A; (-) strand; PAM type: YTN; PAM sequence: CTC
tgcctcttaatactgttaca

SEQ ID NO: 65639 - DNA, 20 bp, Artificial Sequence
  Description of Artificial Sequence: Synthetic oligonucleotide
  Target: SCN9A; (-) strand; PAM type: YTN; PAM sequence: TTA
aaggctctgcctcttaatac

SEQ ID NO: 65640 - DNA, 20 bp, Artificial Sequence
  Description of Artificial Sequence: Synthetic oligonucleotide
  Target: SCN9A; (-) strand; PAM type: YTN; PAM sequence: TTT
aaaggctctgcctcttaata

SEQ ID NO: 65641 - DNA, 20 bp, Artificial Sequence
  Description of Artificial Sequence: Synthetic oligonucleotide
  Target: SCN9A; (-) strand; PAM type: YTN; PAM sequence: TTT
taaaggctctgcctcttaat

SEQ ID NO: 65642 - DNA, 20 bp, Artificial Sequence
  Description of Artificial Sequence: Synthetic oligonucleotide
  Target: SCN9A; (-) strand; PAM type: YTN; PAM sequence: CTT
ttaaaggctctgcctcttaa

SEQ ID NO: 65643 - DNA, 20 bp, Artificial Sequence
  Description of Artificial Sequence: Synthetic oligonucleotide
  Target: SCN9A; (-) strand; PAM type: YTN; PAM sequence: CTC
atcaccttttaaaggctctg

SEQ ID NO: 65644 - DNA, 20 bp, Artificial Sequence
  Description of Artificial Sequence: Synthetic oligonucleotide
  Target: SCN9A; (-) strand; PAM type: YTN; PAM sequence: TTC
atgacctcatcaccttttaa

SEQ ID NO: 65645 - DNA, 20 bp, Artificial Sequence
  Description of Artificial Sequence: Synthetic oligonucleotide
  Target: SCN9A; (-) strand; PAM type: YTN; PAM sequence: CTT
catgacctcatcacctttta

SEQ ID NO: 65646 - DNA, 20 bp, Artificial Sequence
  Description of Artificial Sequence: Synthetic oligonucleotide
  Target: SCN9A; (-) strand; PAM type: YTN; PAM sequence: TTC
atgaaggcagaaccttcatg

SEQ ID NO: 65647 - DNA, 20 bp, Artificial Sequence
  Description of Artificial Sequence: Synthetic oligonucleotide
  Target: SCN9A; (-) strand; PAM type: YTN; PAM sequence: TTC
cattcatgaaggcagaacct

SEQ ID NO: 65648 - DNA, 20 bp, Artificial Sequence
  Description of Artificial Sequence: Synthetic oligonucleotide
  Target: SCN9A; (-) strand; PAM type: YTN; PAM sequence: CTA
tattccattcatgaaggcag

SEQ ID NO: 65649 - DNA, 20 bp, Artificial Sequence
  Description of Artificial Sequence: Synthetic oligonucleotide
  Target: SCN9A; (-) strand; PAM type: YTN; PAM sequence: CTC
tatattccattcatgaaggc

SEQ ID NO: 65650 - DNA, 20 bp, Artificial Sequence
  Description of Artificial Sequence: Synthetic oligonucleotide
  Target: SCN9A; (-) strand; PAM type: YTN; PAM sequence: TTA
ctctatattccattcatgaa

SEQ ID NO: 65651 - DNA, 20 bp, Artificial Sequence
  Description of Artificial Sequence: Synthetic oligonucleotide
  Target: SCN9A; (-) strand; PAM type: YTN; PAM sequence: CTT
actctatattccattcatga

SEQ ID NO: 65652 - DNA, 20 bp, Artificial Sequence
  Description of Artificial Sequence: Synthetic oligonucleotide
  Target: SCN9A; (-) strand; PAM type: YTN; PAM sequence: TTA
agcccttactctatattcca

SEQ ID NO: 65653 - DNA, 20 bp, Artificial Sequence
  Description of Artificial Sequence: Synthetic oligonucleotide
  Target: SCN9A; (-) strand; PAM type: YTN; PAM sequence: CTC
ccatgataacccattaagcc

SEQ ID NO: 65654 - DNA, 20 bp, Artificial Sequence
  Description of Artificial Sequence: Synthetic oligonucleotide
  Target: SCN9A; (-) strand; PAM type: YTN; PAM sequence: CTC
actcccatgataacccatta

SEQ ID NO: 65655 - DNA, 20 bp, Artificial Sequence
  Description of Artificial Sequence: Synthetic oligonucleotide
  Target: SCN9A; (-) strand; PAM type: YTN; PAM sequence: CTA
actcactcccatgataaccc

SEQ ID NO: 65656 - DNA, 20 bp, Artificial Sequence
  Description of Artificial Sequence: Synthetic oligonucleotide
  Target: SCN9A; (-) strand; PAM type: YTN; PAM sequence: TTG
tgatatctaactcactccca

SEQ ID NO: 65657 - DNA, 20 bp, Artificial Sequence
  Description of Artificial Sequence: Synthetic oligonucleotide
  Target: SCN9A; (-) strand; PAM type: YTN; PAM sequence: CTT
gtgatatctaactcactccc

SEQ ID NO: 65658 - DNA, 20 bp, Artificial Sequence
  Description of Artificial Sequence: Synthetic oligonucleotide
  Target: SCN9A; (-) strand; PAM type: YTN; PAM sequence: CTC
ttgtgatatctaactcactc

SEQ ID NO: 65659 - DNA, 20 bp, Artificial Sequence
  Description of Artificial Sequence: Synthetic oligonucleotide
  Target: SCN9A; (-) strand; PAM type: YTN; PAM sequence: TTA
taataaacccactcttgtga

SEQ ID NO: 65660 - DNA, 20 bp, Artificial Sequence
  Description of Artificial Sequence: Synthetic oligonucleotide
  Target: SCN9A; (-) strand; PAM type: YTN; PAM sequence: TTT
ataataaacccactcttgtg

SEQ ID NO: 65661 - DNA, 20 bp, Artificial Sequence
  Description of Artificial Sequence: Synthetic oligonucleotide
  Target: SCN9A; (-) strand; PAM type: YTN; PAM sequence: TTT
tataataaacccactcttgt

SEQ ID NO: 65662 - DNA, 20 bp, Artificial Sequence
  Description of Artificial Sequence: Synthetic oligonucleotide
  Target: SCN9A; (-) strand; PAM type: YTN; PAM sequence: CTG
ggttttataataaacccact

SEQ ID NO: 65663 - DNA, 20 bp, Artificial Sequence
  Description of Artificial Sequence: Synthetic oligonucleotide
  Target: SCN9A; (-) strand; PAM type: YTN; PAM sequence: CTG
agagccaaactgggttttat

SEQ ID NO: 65664 - DNA, 20 bp, Artificial Sequence
  Description of Artificial Sequence: Synthetic oligonucleotide
  Target: SCN9A; (-) strand; PAM type: YTN; PAM sequence: TTC
actgagagccaaactgggtt

SEQ ID NO: 65665 - DNA, 20 bp, Artificial Sequence
  Description of Artificial Sequence: Synthetic oligonucleotide
  Target: SCN9A; (-) strand; PAM type: YTN; PAM sequence: CTC
atggcatcacatggcgaggg

SEQ ID NO: 65666 - DNA, 20 bp, Artificial Sequence
  Description of Artificial Sequence: Synthetic oligonucleotide
  Target: SCN9A; (-) strand; PAM type: YTN; PAM sequence: CTG
gtgggcacaccagagagtcc

SEQ ID NO: 65667 - DNA, 20 bp, Artificial Sequence
  Description of Artificial Sequence: Synthetic oligonucleotide
  Target: SCN9A; (-) strand; PAM type: YTN; PAM sequence: TTG
ctggtgggcacaccagagag

SEQ ID NO: 65668 - DNA, 20 bp, Artificial Sequence
  Description of Artificial Sequence: Synthetic oligonucleotide
  Target: SCN9A; (-) strand; PAM type: YTN; PAM sequence: CTT
gctggtgggcacaccagaga

SEQ ID NO: 65669 - DNA, 20 bp, Artificial Sequence
  Description of Artificial Sequence: Synthetic oligonucleotide
  Target: SCN9A; (-) strand; PAM type: YTN; PAM sequence: TTC
ttgctggtgggcacaccaga

SEQ ID NO: 65670 - DNA, 20 bp, Artificial Sequence
  Description of Artificial Sequence: Synthetic oligonucleotide
  Target: SCN9A; (-) strand; PAM type: YTN; PAM sequence: TTT
cttgctggtgggcacaccag

SEQ ID NO: 65671 - DNA, 20 bp, Artificial Sequence
  Description of Artificial Sequence: Synthetic oligonucleotide
  Target: SCN9A; (-) strand; PAM type: YTN; PAM sequence: CTT
tcttgctggtgggcacacca

SEQ ID NO: 65672 - DNA, 20 bp, Artificial Sequence
  Description of Artificial Sequence: Synthetic oligonucleotide
  Target: SCN9A; (-) strand; PAM type: YTN; PAM sequence: CTG
gtgggaactttcttgctggt

SEQ ID NO: 65673 - DNA, 20 bp, Artificial Sequence
  Description of Artificial Sequence: Synthetic oligonucleotide
  Target: SCN9A; (-) strand; PAM type: YTN; PAM sequence: CTA
aggtgaagggtccacatctg

SEQ ID NO: 65674 - DNA, 20 bp, Artificial Sequence
  Description of Artificial Sequence: Synthetic oligonucleotide
  Target: SCN9A; (-) strand; PAM type: YTN; PAM sequence: CTG
ggaagtctaaggtgaagggt

SEQ ID NO: 65675 - DNA, 20 bp, Artificial Sequence
  Description of Artificial Sequence: Synthetic oligonucleotide
  Target: SCN9A; (-) strand; PAM type: YTN; PAM sequence: CTG
gaagctgggaagtctaaggt

SEQ ID NO: 65676 - DNA, 20 bp, Artificial Sequence
  Description of Artificial Sequence: Synthetic oligonucleotide
  Target: SCN9A; (-) strand; PAM type: YTN; PAM sequence: TTC
tggaagctgggaagtctaag

SEQ ID NO: 65677 - DNA, 20 bp, Artificial Sequence
  Description of Artificial Sequence: Synthetic oligonucleotide
  Target: SCN9A; (-) strand; PAM type: YTN; PAM sequence: TTA
aagttctggaagctgggaag

SEQ ID NO: 65678 - DNA, 20 bp, Artificial Sequence
  Description of Artificial Sequence: Synthetic oligonucleotide
  Target: SCN9A; (-) strand; PAM type: YTN; PAM sequence: CTT
aaagttctggaagctgggaa

SEQ ID NO: 65679 - DNA, 20 bp, Artificial Sequence
  Description of Artificial Sequence: Synthetic oligonucleotide
  Target: SCN9A; (-) strand; PAM type: YTN; PAM sequence: TTC
ttaaagttctggaagctggg

SEQ ID NO: 65680 - DNA, 20 bp, Artificial Sequence
  Description of Artificial Sequence: Synthetic oligonucleotide
  Target: SCN9A; (-) strand; PAM type: YTN; PAM sequence: TTT
cttaaagttctggaagctgg

SEQ ID NO: 65681 - DNA, 20 bp, Artificial Sequence
  Description of Artificial Sequence: Synthetic oligonucleotide
  Target: SCN9A; (-) strand; PAM type: YTN; PAM sequence: TTA
tttcttaaagttctggaagc

SEQ ID NO: 65682 - DNA, 20 bp, Artificial Sequence
  Description of Artificial Sequence: Synthetic oligonucleotide
  Target: SCN9A; (-) strand; PAM type: YTN; PAM sequence: TTT
atttcttaaagttctggaag

SEQ ID NO: 65683 - DNA, 20 bp, Artificial Sequence
  Description of Artificial Sequence: Synthetic oligonucleotide
  Target: SCN9A; (-) strand; PAM type: YTN; PAM sequence: TTC
aataaagaaatttatttctt

SEQ ID NO: 65684 - DNA, 20 bp, Artificial Sequence
  Description of Artificial Sequence: Synthetic oligonucleotide
  Target: SCN9A; (-) strand; PAM type: YTN; PAM sequence: TTA
aagtattcaataaagaaatt

SEQ ID NO: 65685 - DNA, 20 bp, Artificial Sequence
  Description of Artificial Sequence: Synthetic oligonucleotide
  Target: SCN9A; (-) strand; PAM type: YTN; PAM sequence: CTG
gttaaagtattcaataaaga

SEQ ID NO: 65686 - DNA, 20 bp, Artificial Sequence
  Description of Artificial Sequence: Synthetic oligonucleotide
  Target: SCN9A; (-) strand; PAM type: YTN; PAM sequence: CTG
agactggttaaagtattcaa

SEQ ID NO: 65687 - DNA, 20 bp, Artificial Sequence
  Description of Artificial Sequence: Synthetic oligonucleotide
  Target: SCN9A; (-) strand; PAM type: YTN; PAM sequence: CTG
aatacctgagactggttaaa

SEQ ID NO: 65688 - DNA, 20 bp, Artificial Sequence
  Description of Artificial Sequence: Synthetic oligonucleotide
  Target: SCN9A; (-) strand; PAM type: YTN; PAM sequence: CTG
taactgaatacctgagactg

SEQ ID NO: 65689 - DNA, 20 bp, Artificial Sequence
  Description of Artificial Sequence: Synthetic oligonucleotide
  Target: SCN9A; (-) strand; PAM type: YTN; PAM sequence: TTG
ctgtaactgaatacctgaga

SEQ ID NO: 65690 - DNA, 20 bp, Artificial Sequence
  Description of Artificial Sequence: Synthetic oligonucleotide
  Target: SCN9A; (-) strand; PAM type: YTN; PAM sequence: TTA
ttgctgtaactgaatacctg

SEQ ID NO: 65691 - DNA, 20 bp, Artificial Sequence
  Description of Artificial Sequence: Synthetic oligonucleotide
  Target: SCN9A; (-) strand; PAM type: YTN; PAM sequence: TTT
attgctgtaactgaatacct

SEQ ID NO: 65692 - DNA, 20 bp, Artificial Sequence
  Description of Artificial Sequence: Synthetic oligonucleotide
  Target: SCN9A; (-) strand; PAM type: YTN; PAM sequence: TTT
tattgctgtaactgaatacc

SEQ ID NO: 65693 - DNA, 20 bp, Artificial Sequence
  Description of Artificial Sequence: Synthetic oligonucleotide
  Target: SCN9A; (-) strand; PAM type: YTN; PAM sequence: CTT
ttattgctgtaactgaatac

SEQ ID NO: 65694 - DNA, 20 bp, Artificial Sequence
  Description of Artificial Sequence: Synthetic oligonucleotide
  Target: SCN9A; (-) strand; PAM type: YTN; PAM sequence: CTA
ccttttattgctgtaactga

SEQ ID NO: 65695 - DNA, 20 bp, Artificial Sequence
  Description of Artificial Sequence: Synthetic oligonucleotide
  Target: SCN9A; (-) strand; PAM type: YTN; PAM sequence: TTA
gtctaccttttattgctgta

SEQ ID NO: 65696 - DNA, 20 bp, Artificial Sequence
  Description of Artificial Sequence: Synthetic oligonucleotide
  Target: SCN9A; (-) strand; PAM type: YTN; PAM sequence: CTT
agtctaccttttattgctgt

SEQ ID NO: 65697 - DNA, 20 bp, Artificial Sequence
  Description of Artificial Sequence: Synthetic oligonucleotide
  Target: SCN9A; (-) strand; PAM type: YTN; PAM sequence: TTA
taacagacatgtcttagtct

SEQ ID NO: 65698 - DNA, 20 bp, Artificial Sequence
  Description of Artificial Sequence: Synthetic oligonucleotide
  Target: SCN9A; (-) strand; PAM type: YTN; PAM sequence: CTG
tatcaattataacagacatg

SEQ ID NO: 65699 - DNA, 20 bp, Artificial Sequence
  Description of Artificial Sequence: Synthetic oligonucleotide
  Target: SCN9A; (-) strand; PAM type: YTN; PAM sequence: TTA
ggggctgtatcaattataac

SEQ ID NO: 65700 - DNA, 20 bp, Artificial Sequence
  Description of Artificial Sequence: Synthetic oligonucleotide
  Target: SCN9A; (-) strand; PAM type: YTN; PAM sequence: TTT
aggggctgtatcaattataa

SEQ ID NO: 65701 - DNA, 20 bp, Artificial Sequence
  Description of Artificial Sequence: Synthetic oligonucleotide
  Target: SCN9A; (-) strand; PAM type: YTN; PAM sequence: TTT
taggggctgtatcaattata

SEQ ID NO: 65702 - DNA, 20 bp, Artificial Sequence
  Description of Artificial Sequence: Synthetic oligonucleotide
  Target: SCN9A; (-) strand; PAM type: YTN; PAM sequence: TTA
gtattttaggggctgtatca

SEQ ID NO: 65703 - DNA, 20 bp, Artificial Sequence
  Description of Artificial Sequence: Synthetic oligonucleotide
  Target: SCN9A; (-) strand; PAM type: YTN; PAM sequence: CTA
ttagtattttaggggctgta

SEQ ID NO: 65704 - DNA, 20 bp, Artificial Sequence
  Description of Artificial Sequence: Synthetic oligonucleotide
  Target: SCN9A; (-) strand; PAM type: YTN; PAM sequence: TTG
gagaacagacctattagtat

SEQ ID NO: 65705 - DNA, 20 bp, Artificial Sequence
  Description of Artificial Sequence: Synthetic oligonucleotide
  Target: SCN9A; (-) strand; PAM type: YTN; PAM sequence: CTT
ggagaacagacctattagta

SEQ ID NO: 65706 - DNA, 20 bp, Artificial Sequence
  Description of Artificial Sequence: Synthetic oligonucleotide
  Target: SCN9A; (-) strand; PAM type: YTN; PAM sequence: TTA
acagtggcttggagaacaga

SEQ ID NO: 65707 - DNA, 20 bp, Artificial Sequence
  Description of Artificial Sequence: Synthetic oligonucleotide
  Target: SCN9A; (-) strand; PAM type: YTN; PAM sequence: CTT
aacagtggcttggagaacag

SEQ ID NO: 65708 - DNA, 20 bp, Artificial Sequence
  Description of Artificial Sequence: Synthetic oligonucleotide
  Target: SCN9A; (-) strand; PAM type: YTN; PAM sequence: CTC
acttaacagtggcttggaga

SEQ ID NO: 65709 - DNA, 20 bp, Artificial Sequence
  Description of Artificial Sequence: Synthetic oligonucleotide
  Target: SCN9A; (-) strand; PAM type: YTN; PAM sequence: TTC
cgtgtcataaaactcactta

SEQ ID NO: 65710 - DNA, 20 bp, Artificial Sequence
  Description of Artificial Sequence: Synthetic oligonucleotide
  Target: SCN9A; (-) strand; PAM type: YTN; PAM sequence: TTA
ataatatgcatatattccgt

SEQ ID NO: 65711 - DNA, 20 bp, Artificial Sequence
  Description of Artificial Sequence: Synthetic oligonucleotide
  Target: SCN9A; (-) strand; PAM type: YTN; PAM sequence: CTT
aataatatgcatatattccg

SEQ ID NO: 65712 - DNA, 20 bp, Artificial Sequence
  Description of Artificial Sequence: Synthetic oligonucleotide
  Target: SCN9A; (-) strand; PAM type: YTN; PAM sequence: CTA
taccatagtcttaataatat

SEQ ID NO: 65713 - DNA, 20 bp, Artificial Sequence
  Description of Artificial Sequence: Synthetic oligonucleotide
  Target: SCN9A; (-) strand; PAM type: YTN; PAM sequence: TTA
caaactataccatagtctta

SEQ ID NO: 65714 - DNA, 20 bp, Artificial Sequence
  Description of Artificial Sequence: Synthetic oligonucleotide
  Target: SCN9A; (-) strand; PAM type: YTN; PAM sequence: CTC
agttacaaactataccatag

SEQ ID NO: 65715 - DNA, 20 bp, Artificial Sequence
  Description of Artificial Sequence: Synthetic oligonucleotide
  Target: SCN9A; (-) strand; PAM type: YTN; PAM sequence: TTC
tcagttacaaactataccat

SEQ ID NO: 65716 - DNA, 20 bp, Artificial Sequence
  Description of Artificial Sequence: Synthetic oligonucleotide
  Target: SCN9A; (-) strand; PAM type: YTN; PAM sequence: TTA
tagaaagatgtgaatatata

SEQ ID NO: 65717 - DNA, 20 bp, Artificial Sequence
  Description of Artificial Sequence: Synthetic oligonucleotide
  Target: SCN9A; (-) strand; PAM type: YTN; PAM sequence: TTT
atagaaagatgtgaatatat

SEQ ID NO: 65718 - DNA, 20 bp, Artificial Sequence
  Description of Artificial Sequence: Synthetic oligonucleotide
  Target: SCN9A; (-) strand; PAM type: YTN; PAM sequence: TTG
tatatatacgtgtgtgttta

SEQ ID NO: 65719 - DNA, 20 bp, Artificial Sequence
  Description of Artificial Sequence: Synthetic oligonucleotide
  Target: SCN9A; (-) strand; PAM type: YTN; PAM sequence: TTT
gtatatatacgtgtgtgttt

SEQ ID NO: 65720 - DNA, 20 bp, Artificial Sequence
  Description of Artificial Sequence: Synthetic oligonucleotide
  Target: SCN9A; (-) strand; PAM type: YTN; PAM sequence: TTC
agtacaggcgtatatttgta

SEQ ID NO: 65721 - DNA, 20 bp, Artificial Sequence
  Description of Artificial Sequence: Synthetic oligonucleotide
  Target: SCN9A; (-) strand; PAM type: YTN; PAM sequence: CTT
cagtacaggcgtatatttgt

SEQ ID NO: 65722 - DNA, 20 bp, Artificial Sequence
  Description of Artificial Sequence: Synthetic oligonucleotide
  Target: SCN9A; (-) strand; PAM type: YTN; PAM sequence: TTC
ttcagtacaggcgtatattt

SEQ ID NO: 65723 - DNA, 20 bp, Artificial Sequence
  Description of Artificial Sequence: Synthetic oligonucleotide
  Target: SCN9A; (-) strand; PAM type: YTN; PAM sequence: TTA
aacagtgttcttcagtacag

SEQ ID NO: 65724 - DNA, 20 bp, Artificial Sequence
  Description of Artificial Sequence: Synthetic oligonucleotide
  Target: SCN9A; (-) strand; PAM type: YTN; PAM sequence: TTG
attaaacagtgttcttcagt

SEQ ID NO: 65725 - DNA, 20 bp, Artificial Sequence
  Description of Artificial Sequence: Synthetic oligonucleotide
  Target: SCN9A; (-) strand; PAM type: YTN; PAM sequence: CTT
gattaaacagtgttcttcag

SEQ ID NO: 65726 - DNA, 20 bp, Artificial Sequence
  Description of Artificial Sequence: Synthetic oligonucleotide
  Target: SCN9A; (-) strand; PAM type: YTN; PAM sequence: TTA
cttgattaaacagtgttctt

SEQ ID NO: 65727 - DNA, 20 bp, Artificial Sequence
  Description of Artificial Sequence: Synthetic oligonucleotide
  Target: SCN9A; (-) strand; PAM type: YTN; PAM sequence: CTT
acttgattaaacagtgttct

SEQ ID NO: 65728 - DNA, 20 bp, Artificial Sequence
  Description of Artificial Sequence: Synthetic oligonucleotide
  Target: SCN9A; (-) strand; PAM type: YTN; PAM sequence: TTG
aaacttacttgattaaacag

SEQ ID NO: 65729 - DNA, 20 bp, Artificial Sequence
  Description of Artificial Sequence: Synthetic oligonucleotide
  Target: SCN9A; (-) strand; PAM type: YTN; PAM sequence: TTT
gaaacttacttgattaaaca

SEQ ID NO: 65730 - DNA, 20 bp, Artificial Sequence
  Description of Artificial Sequence: Synthetic oligonucleotide
  Target: SCN9A; (-) strand; PAM type: YTN; PAM sequence: TTA
tttgaaacttacttgattaa

SEQ ID NO: 65731 - DNA, 20 bp, Artificial Sequence
  Description of Artificial Sequence: Synthetic oligonucleotide
  Target: SCN9A; (-) strand; PAM type: YTN; PAM sequence: CTG
ggttatttgaaacttacttg

SEQ ID NO: 65732 - DNA, 20 bp, Artificial Sequence
  Description of Artificial Sequence: Synthetic oligonucleotide
  Target: SCN9A; (-) strand; PAM type: YTN; PAM sequence: TTC
tgggttatttgaaacttact

SEQ ID NO: 65733 - DNA, 20 bp, Artificial Sequence
  Description of Artificial Sequence: Synthetic oligonucleotide
  Target: SCN9A; (-) strand; PAM type: YTN; PAM sequence: CTT
ctgggttatttgaaacttac

SEQ ID NO: 65734 - DNA, 20 bp, Artificial Sequence
  Description of Artificial Sequence: Synthetic oligonucleotide
  Target: SCN9A; (-) strand; PAM type: YTN; PAM sequence: CTG
caggcttctgggttatttga

SEQ ID NO: 65735 - DNA, 20 bp, Artificial Sequence
  Description of Artificial Sequence: Synthetic oligonucleotide
  Target: SCN9A; (-) strand; PAM type: YTN; PAM sequence: TTC
tgcaggcttctgggttattt

SEQ ID NO: 65736 - DNA, 20 bp, Artificial Sequence
  Description of Artificial Sequence: Synthetic oligonucleotide
  Target: SCN9A; (-) strand; PAM type: YTN; PAM sequence: TTT
ctgcaggcttctgggttatt

SEQ ID NO: 65737 - DNA, 20 bp, Artificial Sequence
  Description of Artificial Sequence: Synthetic oligonucleotide
  Target: SCN9A; (-) strand; PAM type: YTN; PAM sequence: CTG
atttctgcaggcttctgggt

SEQ ID NO: 65738 - DNA, 20 bp, Artificial Sequence
  Description of Artificial Sequence: Synthetic oligonucleotide
  Target: SCN9A; (-) strand; PAM type: YTN; PAM sequence: TTG
tctgatttctgcaggcttct

SEQ ID NO: 65739 - DNA, 20 bp, Artificial Sequence
  Description of Artificial Sequence: Synthetic oligonucleotide
  Target: SCN9A; (-) strand; PAM type: YTN; PAM sequence: CTT
gtctgatttctgcaggcttc

SEQ ID NO: 65740 - DNA, 20 bp, Artificial Sequence
  Description of Artificial Sequence: Synthetic oligonucleotide
  Target: SCN9A; (-) strand; PAM type: YTN; PAM sequence: CTC
agagaatggacttgtctgat

SEQ ID NO: 65741 - DNA, 20 bp, Artificial Sequence
  Description of Artificial Sequence: Synthetic oligonucleotide
  Target: SCN9A; (-) strand; PAM type: YTN; PAM sequence: CTA
ctcagagaatggacttgtct

SEQ ID NO: 65742 - DNA, 20 bp, Artificial Sequence
  Description of Artificial Sequence: Synthetic oligonucleotide
  Target: SCN9A; (-) strand; PAM type: YTN; PAM sequence: TTG
ctactcagagaatggacttg

SEQ ID NO: 65743 - DNA, 20 bp, Artificial Sequence
  Description of Artificial Sequence: Synthetic oligonucleotide
  Target: SCN9A; (-) strand; PAM type: YTN; PAM sequence: TTT
gctactcagagaatggactt

SEQ ID NO: 65744 - DNA, 20 bp, Artificial Sequence
  Description of Artificial Sequence: Synthetic oligonucleotide
  Target: SCN9A; (-) strand; PAM type: YTN; PAM sequence: TTA
tttgctactcagagaatgga

SEQ ID NO: 65745 - DNA, 20 bp, Artificial Sequence
  Description of Artificial Sequence: Synthetic oligonucleotide
  Target: SCN9A; (-) strand; PAM type: YTN; PAM sequence: TTA
tattatttgctactcagaga

SEQ ID NO: 65746 - DNA, 20 bp, Artificial Sequence
  Description of Artificial Sequence: Synthetic oligonucleotide
  Target: SCN9A; (-) strand; PAM type: YTN; PAM sequence: CTT
atattatttgctactcagag

SEQ ID NO: 65747 - DNA, 20 bp, Artificial Sequence
  Description of Artificial Sequence: Synthetic oligonucleotide
  Target: SCN9A; (-) strand; PAM type: YTN; PAM sequence: CTA
cttatattatttgctactca

SEQ ID NO: 65748 - DNA, 20 bp, Artificial Sequence
  Description of Artificial Sequence: Synthetic oligonucleotide
  Target: SCN9A; (-) strand; PAM type: YTN; PAM sequence: TTC
agaactacttatattatttg

SEQ ID NO: 65749 - DNA, 20 bp, Artificial Sequence
  Description of Artificial Sequence: Synthetic oligonucleotide
  Target: SCN9A; (-) strand; PAM type: YTN; PAM sequence: TTT
cagaactacttatattattt

SEQ ID NO: 65750 - DNA, 20 bp, Artificial Sequence
  Description of Artificial Sequence: Synthetic oligonucleotide
  Target: SCN9A; (-) strand; PAM type: YTN; PAM sequence: TTC
agatttcagaactacttata

SEQ ID NO: 65751 - DNA, 20 bp, Artificial Sequence
  Description of Artificial Sequence: Synthetic oligonucleotide
  Target: SCN9A; (-) strand; PAM type: YTN; PAM sequence: TTG
tatattcagatttcagaact

SEQ ID NO: 65752 - DNA, 20 bp, Artificial Sequence
  Description of Artificial Sequence: Synthetic oligonucleotide
  Target: SCN9A; (-) strand; PAM type: YTN; PAM sequence: CTG
ttgtatattcagatttcaga

SEQ ID NO: 65753 - DNA, 20 bp, Artificial Sequence
  Description of Artificial Sequence: Synthetic oligonucleotide
  Target: SCN9A; (-) strand; PAM type: YTN; PAM sequence: TTC
tgttgtatattcagatttca

SEQ ID NO: 65754 - DNA, 20 bp, Artificial Sequence
  Description of Artificial Sequence: Synthetic oligonucleotide
  Target: SCN9A; (-) strand; PAM type: YTN; PAM sequence: CTA
cagatgattctgttgtatat

SEQ ID NO: 65755 - DNA, 20 bp, Artificial Sequence
  Description of Artificial Sequence: Synthetic oligonucleotide
  Target: SCN9A; (-) strand; PAM type: YTN; PAM sequence: TTG
taacaagccctacagatgat

SEQ ID NO: 65756 - DNA, 20 bp, Artificial Sequence
  Description of Artificial Sequence: Synthetic oligonucleotide
  Target: SCN9A; (-) strand; PAM type: YTN; PAM sequence: TTG
gatgtggcaaatcattgtaa

SEQ ID NO: 65757 - DNA, 20 bp, Artificial Sequence
  Description of Artificial Sequence: Synthetic oligonucleotide
  Target: SCN9A; (-) strand; PAM type: YTN; PAM sequence: CTG
gggttggatgtggcaaatca

SEQ ID NO: 65758 - DNA, 20 bp, Artificial Sequence
  Description of Artificial Sequence: Synthetic oligonucleotide
  Target: SCN9A; (-) strand; PAM type: YTN; PAM sequence: CTC
tggggttggatgtggcaaat

SEQ ID NO: 65759 - DNA, 20 bp, Artificial Sequence
  Description of Artificial Sequence: Synthetic oligonucleotide
  Target: SCN9A; (-) strand; PAM type: YTN; PAM sequence: CTG
aatcagaaactctggggttg

SEQ ID NO: 65760 - DNA, 20 bp, Artificial Sequence
  Description of Artificial Sequence: Synthetic oligonucleotide
  Target: SCN9A; (-) strand; PAM type: YTN; PAM sequence: CTG
cccccaaccccaagacatac

SEQ ID NO: 65761 - DNA, 20 bp, Artificial Sequence
  Description of Artificial Sequence: Synthetic oligonucleotide
  Target: SCN9A; (-) strand; PAM type: YTN; PAM sequence: TTC
tgcccccaaccccaagacat

SEQ ID NO: 65762 - DNA, 20 bp, Artificial Sequence
  Description of Artificial Sequence: Synthetic oligonucleotide
  Target: SCN9A; (-) strand; PAM type: YTN; PAM sequence: CTC
ataagagatgcaaattctgc

SEQ ID NO: 65763 - DNA, 20 bp, Artificial Sequence
  Description of Artificial Sequence: Synthetic oligonucleotide
  Target: SCN9A; (-) strand; PAM type: YTN; PAM sequence: TTG
gcacatgtaggtgagaactc

SEQ ID NO: 65764 - DNA, 20 bp, Artificial Sequence
  Description of Artificial Sequence: Synthetic oligonucleotide
  Target: SCN9A; (-) strand; PAM type: YTN; PAM sequence: CTG
aaaacgttggcacatgtagg

SEQ ID NO: 65765 - DNA, 20 bp, Artificial Sequence
  Description of Artificial Sequence: Synthetic oligonucleotide
  Target: SCN9A; (-) strand; PAM type: YTN; PAM sequence: CTC
aaaactgaaaacgttggcac

SEQ ID NO: 65766 - DNA, 20 bp, Artificial Sequence
  Description of Artificial Sequence: Synthetic oligonucleotide
  Target: SCN9A; (-) strand; PAM type: YTN; PAM sequence: TTG
aaggatggtctcaaaactga

SEQ ID NO: 65767 - DNA, 20 bp, Artificial Sequence
  Description of Artificial Sequence: Synthetic oligonucleotide
  Target: SCN9A; (-) strand; PAM type: YTN; PAM sequence: CTT
gaaggatggtctcaaaactg

SEQ ID NO: 65768 - DNA, 20 bp, Artificial Sequence
  Description of Artificial Sequence: Synthetic oligonucleotide
  Target: SCN9A; (-) strand; PAM type: YTN; PAM sequence: TTC
ttgaaggatggtctcaaaac

SEQ ID NO: 65769 - DNA, 20 bp, Artificial Sequence
  Description of Artificial Sequence: Synthetic oligonucleotide
  Target: SCN9A; (-) strand; PAM type: YTN; PAM sequence: TTG
ttcttgaaggatggtctcaa

SEQ ID NO: 65770 - DNA, 20 bp, Artificial Sequence
  Description of Artificial Sequence: Synthetic oligonucleotide
  Target: SCN9A; (-) strand; PAM type: YTN; PAM sequence: CTA
cagcagttgttcttgaagga

SEQ ID NO: 65771 - DNA, 20 bp, Artificial Sequence
  Description of Artificial Sequence: Synthetic oligonucleotide
  Target: SCN9A; (-) strand; PAM type: YTN; PAM sequence: TTA
tctacagcagttgttcttga

SEQ ID NO: 65772 - DNA, 20 bp, Artificial Sequence
  Description of Artificial Sequence: Synthetic oligonucleotide
  Target: SCN9A; (-) strand; PAM type: YTN; PAM sequence: CTT
atctacagcagttgttcttg

SEQ ID NO: 65773 - DNA, 20 bp, Artificial Sequence
  Description of Artificial Sequence: Synthetic oligonucleotide
  Target: SCN9A; (-) strand; PAM type: YTN; PAM sequence: CTG
aaaagtatagaaacttatct

SEQ ID NO: 65774 - DNA, 20 bp, Artificial Sequence
  Description of Artificial Sequence: Synthetic oligonucleotide
  Target: SCN9A; (-) strand; PAM type: YTN; PAM sequence: TTC
tgaaaagtatagaaacttat

SEQ ID NO: 65775 - DNA, 20 bp, Artificial Sequence
  Description of Artificial Sequence: Synthetic oligonucleotide
  Target: SCN9A; (-) strand; PAM type: YTN; PAM sequence: TTT
ctgaaaagtatagaaactta

SEQ ID NO: 65776 - DNA, 20 bp, Artificial Sequence
  Description of Artificial Sequence: Synthetic oligonucleotide
  Target: SCN9A; (-) strand; PAM type: YTN; PAM sequence: TTT
tctgaaaagtatagaaactt

SEQ ID NO: 65777 - DNA, 20 bp, Artificial Sequence
  Description of Artificial Sequence: Synthetic oligonucleotide
  Target: SCN9A; (-) strand; PAM type: YTN; PAM sequence: TTT
ttctgaaaagtatagaaact

SEQ ID NO: 65778 - DNA, 20 bp, Artificial Sequence
  Description of Artificial Sequence: Synthetic oligonucleotide
  Target: SCN9A; (-) strand; PAM type: YTN; PAM sequence: TTT
tttctgaaaagtatagaaac

SEQ ID NO: 65779 - DNA, 20 bp, Artificial Sequence
  Description of Artificial Sequence: Synthetic oligonucleotide
  Target: SCN9A; (-) strand; PAM type: YTN; PAM sequence: TTT
ttttctgaaaagtatagaaa

SEQ ID NO: 65780 - DNA, 20 bp, Artificial Sequence
  Description of Artificial Sequence: Synthetic oligonucleotide
  Target: SCN9A; (-) strand; PAM type: YTN; PAM sequence: TTT
tttttctgaaaagtatagaa

SEQ ID NO: 65781 - DNA, 20 bp, Artificial Sequence
  Description of Artificial Sequence: Synthetic oligonucleotide
  Target: SCN9A; (-) strand; PAM type: YTN; PAM sequence: TTT
ttttttctgaaaagtataga

SEQ ID NO: 65782 - DNA, 20 bp, Artificial Sequence
  Description of Artificial Sequence: Synthetic oligonucleotide
  Target: SCN9A; (-) strand; PAM type: YTN; PAM sequence: TTT
tttttttctgaaaagtatag

SEQ ID NO: 65783 - DNA, 20 bp, Artificial Sequence
  Description of Artificial Sequence: Synthetic oligonucleotide
  Target: SCN9A; (-) strand; PAM type: YTN; PAM sequence: TTT
ttttttttctgaaaagtata

SEQ ID NO: 65784 - DNA, 20 bp, Artificial Sequence
  Description of Artificial Sequence: Synthetic oligonucleotide
  Target: SCN9A; (-) strand; PAM type: YTN; PAM sequence: TTT
tttttttttctgaaaagtat

SEQ ID NO: 65785 - DNA, 20 bp, Artificial Sequence
  Description of Artificial Sequence: Synthetic oligonucleotide
  Target: SCN9A; (-) strand; PAM type: YTN; PAM sequence: CTG
attttttttttttctgaaaa

SEQ ID NO: 65786 - DNA, 20 bp, Artificial Sequence
  Description of Artificial Sequence: Synthetic oligonucleotide
  Target: SCN9A; (-) strand; PAM type: YTN; PAM sequence: TTG
ggggagtggctgattttttt

SEQ ID NO: 65787 - DNA, 20 bp, Artificial Sequence
  Description of Artificial Sequence: Synthetic oligonucleotide
  Target: SCN9A; (-) strand; PAM type: YTN; PAM sequence: TTT
gggggagtggctgatttttt

SEQ ID NO: 65788 - DNA, 20 bp, Artificial Sequence
  Description of Artificial Sequence: Synthetic oligonucleotide
  Target: SCN9A; (-) strand; PAM type: YTN; PAM sequence: TTG
ggacacagatttgggggagt

SEQ ID NO: 65789 - DNA, 20 bp, Artificial Sequence
  Description of Artificial Sequence: Synthetic oligonucleotide
  Target: SCN9A; (-) strand; PAM type: YTN; PAM sequence: TTT
gggacacagatttgggggag

SEQ ID NO: 65790 - DNA, 20 bp, Artificial Sequence
  Description of Artificial Sequence: Synthetic oligonucleotide
  Target: SCN9A; (-) strand; PAM type: YTN; PAM sequence: TTT
tgggacacagatttggggga

SEQ ID NO: 65791 - DNA, 20 bp, Artificial Sequence
  Description of Artificial Sequence: Synthetic oligonucleotide
  Target: SCN9A; (-) strand; PAM type: YTN; PAM sequence: CTG
acagagatgcaaattttggg

SEQ ID NO: 65792 - DNA, 20 bp, Artificial Sequence
  Description of Artificial Sequence: Synthetic oligonucleotide
  Target: SCN9A; (-) strand; PAM type: YTN; PAM sequence: TTG
ctgacagagatgcaaatttt

SEQ ID NO: 65793 - DNA, 20 bp, Artificial Sequence
  Description of Artificial Sequence: Synthetic oligonucleotide
  Target: SCN9A; (-) strand; PAM type: YTN; PAM sequence: CTT
gctgacagagatgcaaattt

SEQ ID NO: 65794 - DNA, 20 bp, Artificial Sequence
  Description of Artificial Sequence: Synthetic oligonucleotide
  Target: SCN9A; (-) strand; PAM type: YTN; PAM sequence: TTC
ttgctgacagagatgcaaat

SEQ ID NO: 65795 - DNA, 20 bp, Artificial Sequence
  Description of Artificial Sequence: Synthetic oligonucleotide
  Target: SCN9A; (-) strand; PAM type: YTN; PAM sequence: CTC
cacacaatattcttgctgac

SEQ ID NO: 65796 - DNA, 20 bp, Artificial Sequence
  Description of Artificial Sequence: Synthetic oligonucleotide
  Target: SCN9A; (-) strand; PAM type: YTN; PAM sequence: TTG
gaaacgaacaaatataatgc

SEQ ID NO: 65797 - DNA, 20 bp, Artificial Sequence
  Description of Artificial Sequence: Synthetic oligonucleotide
  Target: SCN9A; (-) strand; PAM type: YTN; PAM sequence: TTT
ggaaacgaacaaatataatg

SEQ ID NO: 65798 - DNA, 20 bp, Artificial Sequence
  Description of Artificial Sequence: Synthetic oligonucleotide
  Target: SCN9A; (-) strand; PAM type: YTN; PAM sequence: TTT
tggaaacgaacaaatataat

SEQ ID NO: 65799 - DNA, 20 bp, Artificial Sequence
  Description of Artificial Sequence: Synthetic oligonucleotide
  Target: SCN9A; (-) strand; PAM type: YTN; PAM sequence: TTA
atattttggaaacgaacaaa

SEQ ID NO: 65800 - DNA, 20 bp, Artificial Sequence
  Description of Artificial Sequence: Synthetic oligonucleotide
  Target: SCN9A; (-) strand; PAM type: YTN; PAM sequence: TTT
aatattttggaaacgaacaa

SEQ ID NO: 65801 - DNA, 20 bp, Artificial Sequence
  Description of Artificial Sequence: Synthetic oligonucleotide
  Target: SCN9A; (-) strand; PAM type: YTN; PAM sequence: TTA
tttaatattttggaaacgaa

SEQ ID NO: 65802 - DNA, 20 bp, Artificial Sequence
  Description of Artificial Sequence: Synthetic oligonucleotide
  Target: SCN9A; (-) strand; PAM type: YTN; PAM sequence: TTG
aaatattatttaatattttg

SEQ ID NO: 65803 - DNA, 20 bp, Artificial Sequence
  Description of Artificial Sequence: Synthetic oligonucleotide
  Target: SCN9A; (-) strand; PAM type: YTN; PAM sequence: TTT
gaaatattatttaatatttt

SEQ ID NO: 65804 - DNA, 20 bp, Artificial Sequence
  Description of Artificial Sequence: Synthetic oligonucleotide
  Target: SCN9A; (-) strand; PAM type: YTN; PAM sequence: CTC
caatttgaaatattatttaa

SEQ ID NO: 65805 - DNA, 20 bp, Artificial Sequence
  Description of Artificial Sequence: Synthetic oligonucleotide
  Target: SCN9A; (-) strand; PAM type: YTN; PAM sequence: TTC
aggggtatgtaatgtgcaga

SEQ ID NO: 65806 - DNA, 20 bp, Artificial Sequence
  Description of Artificial Sequence: Synthetic oligonucleotide
  Target: SCN9A; (-) strand; PAM type: YTN; PAM sequence: CTG
ttcaggggtatgtaatgtgc

SEQ ID NO: 65807 - DNA, 20 bp, Artificial Sequence
  Description of Artificial Sequence: Synthetic oligonucleotide
  Target: SCN9A; (-) strand; PAM type: YTN; PAM sequence: CTC
ctgttcaggggtatgtaatg

SEQ ID NO: 65808 - DNA, 20 bp, Artificial Sequence
  Description of Artificial Sequence: Synthetic oligonucleotide
  Target: SCN9A; (-) strand; PAM type: YTN; PAM sequence: CTC
agtgagtataacctcctgtt

SEQ ID NO: 65809 - DNA, 20 bp, Artificial Sequence
  Description of Artificial Sequence: Synthetic oligonucleotide
  Target: SCN9A; (-) strand; PAM type: YTN; PAM sequence: TTC
tcagtgagtataacctcctg

SEQ ID NO: 65810 - DNA, 20 bp, Artificial Sequence
  Description of Artificial Sequence: Synthetic oligonucleotide
  Target: SCN9A; (-) strand; PAM type: YTN; PAM sequence: TTA
aagtgatgattctcagtgag

SEQ ID NO: 65811 - DNA, 20 bp, Artificial Sequence
  Description of Artificial Sequence: Synthetic oligonucleotide
  Target: SCN9A; (-) strand; PAM type: YTN; PAM sequence: TTT
aaagtgatgattctcagtga

SEQ ID NO: 65812 - DNA, 20 bp, Artificial Sequence
  Description of Artificial Sequence: Synthetic oligonucleotide
  Target: SCN9A; (-) strand; PAM type: YTN; PAM sequence: TTG
aaaatttaaagtgatgattc

SEQ ID NO: 65813 - DNA, 20 bp, Artificial Sequence
  Description of Artificial Sequence: Synthetic oligonucleotide
  Target: SCN9A; (-) strand; PAM type: YTN; PAM sequence: TTT
gaaaatttaaagtgatgatt

SEQ ID NO: 65814 - DNA, 20 bp, Artificial Sequence
  Description of Artificial Sequence: Synthetic oligonucleotide
  Target: SCN9A; (-) strand; PAM type: YTN; PAM sequence: TTA
tttgaaaatttaaagtgatg

SEQ ID NO: 65815 - DNA, 20 bp, Artificial Sequence
  Description of Artificial Sequence: Synthetic oligonucleotide
  Target: SCN9A; (-) strand; PAM type: YTN; PAM sequence: TTT
atttgaaaatttaaagtgat

SEQ ID NO: 65816 - DNA, 20 bp, Artificial Sequence
  Description of Artificial Sequence: Synthetic oligonucleotide
  Target: SCN9A; (-) strand; PAM type: YTN; PAM sequence: TTT
tatttgaaaatttaaagtga

SEQ ID NO: 65817 - DNA, 20 bp, Artificial Sequence
  Description of Artificial Sequence: Synthetic oligonucleotide
  Target: SCN9A; (-) strand; PAM type: YTN; PAM sequence: TTG
ttttatttgaaaatttaaag

SEQ ID NO: 65818 - DNA, 20 bp, Artificial Sequence
  Description of Artificial Sequence: Synthetic oligonucleotide
  Target: SCN9A; (-) strand; PAM type: YTN; PAM sequence: TTA
ataatggaaattgttttatt

SEQ ID NO: 65819 - DNA, 20 bp, Artificial Sequence
  Description of Artificial Sequence: Synthetic oligonucleotide
  Target: SCN9A; (-) strand; PAM type: YTN; PAM sequence: TTT
aataatggaaattgttttat

SEQ ID NO: 65820 - DNA, 20 bp, Artificial Sequence
  Description of Artificial Sequence: Synthetic oligonucleotide
  Target: SCN9A; (-) strand; PAM type: YTN; PAM sequence: CTG
tttaataatggaaattgttt

SEQ ID NO: 65821 - DNA, 20 bp, Artificial Sequence
  Description of Artificial Sequence: Synthetic oligonucleotide
  Target: SCN9A; (-) strand; PAM type: YTN; PAM sequence: TTA
agagatatggctgtttaata

SEQ ID NO: 65822 - DNA, 20 bp, Artificial Sequence
  Description of Artificial Sequence: Synthetic oligonucleotide
  Target: SCN9A; (-) strand; PAM type: YTN; PAM sequence: TTA
aattaagagatatggctgtt

SEQ ID NO: 65823 - DNA, 20 bp, Artificial Sequence
  Description of Artificial Sequence: Synthetic oligonucleotide
  Target: SCN9A; (-) strand; PAM type: YTN; PAM sequence: TTT
aaattaagagatatggctgt

SEQ ID NO: 65824 - DNA, 20 bp, Artificial Sequence
  Description of Artificial Sequence: Synthetic oligonucleotide
  Target: SCN9A; (-) strand; PAM type: YTN; PAM sequence: TTT
taaattaagagatatggctg

SEQ ID NO: 65825 - DNA, 20 bp, Artificial Sequence
  Description of Artificial Sequence: Synthetic oligonucleotide
  Target: SCN9A; (-) strand; PAM type: YTN; PAM sequence: TTA
ttttaaattaagagatatgg

SEQ ID NO: 65826 - DNA, 20 bp, Artificial Sequence
  Description of Artificial Sequence: Synthetic oligonucleotide
  Target: SCN9A; (-) strand; PAM type: YTN; PAM sequence: CTT
attttaaattaagagatatg

SEQ ID NO: 65827 - DNA, 20 bp, Artificial Sequence
  Description of Artificial Sequence: Synthetic oligonucleotide
  Target: SCN9A; (-) strand; PAM type: YTN; PAM sequence: TTG
aacttattttaaattaagag

SEQ ID NO: 65828 - DNA, 20 bp, Artificial Sequence
  Description of Artificial Sequence: Synthetic oligonucleotide
  Target: SCN9A; (-) strand; PAM type: YTN; PAM sequence: TTA
caagtaaaattgaacttatt

SEQ ID NO: 65829 - DNA, 20 bp, Artificial Sequence
  Description of Artificial Sequence: Synthetic oligonucleotide
  Target: SCN9A; (-) strand; PAM type: YTN; PAM sequence: TTT
acaagtaaaattgaacttat

SEQ ID NO: 65830 - DNA, 20 bp, Artificial Sequence
  Description of Artificial Sequence: Synthetic oligonucleotide
  Target: SCN9A; (-) strand; PAM type: YTN; PAM sequence: TTC
agtgtaagaaatgaaggttt

SEQ ID NO: 65831 - DNA, 20 bp, Artificial Sequence
  Description of Artificial Sequence: Synthetic oligonucleotide
  Target: SCN9A; (-) strand; PAM type: YTN; PAM sequence: TTC
atcattcagtgtaagaaatg

SEQ ID NO: 65832 - DNA, 20 bp, Artificial Sequence
  Description of Artificial Sequence: Synthetic oligonucleotide
  Target: SCN9A; (-) strand; PAM type: YTN; PAM sequence: TTT
catcattcagtgtaagaaat

SEQ ID NO: 65833 - DNA, 20 bp, Artificial Sequence
  Description of Artificial Sequence: Synthetic oligonucleotide
  Target: SCN9A; (-) strand; PAM type: YTN; PAM sequence: TTT
tcatcattcagtgtaagaaa

SEQ ID NO: 65834 - DNA, 20 bp, Artificial Sequence
  Description of Artificial Sequence: Synthetic oligonucleotide
  Target: SCN9A; (-) strand; PAM type: YTN; PAM sequence: CTC
attttcatcattcagtgtaa

SEQ ID NO: 65835 - DNA, 20 bp, Artificial Sequence
  Description of Artificial Sequence: Synthetic oligonucleotide
  Target: SCN9A; (-) strand; PAM type: YTN; PAM sequence: TTA
tcacaaatacactcattttc

SEQ ID NO: 65836 - DNA, 20 bp, Artificial Sequence
  Description of Artificial Sequence: Synthetic oligonucleotide
  Target: SCN9A; (-) strand; PAM type: YTN; PAM sequence: TTA
aaatattatcacaaatacac

SEQ ID NO: 65837 - DNA, 20 bp, Artificial Sequence
  Description of Artificial Sequence: Synthetic oligonucleotide
  Target: SCN9A; (-) strand; PAM type: YTN; PAM sequence: TTT
aaaatattatcacaaataca

SEQ ID NO: 65838 - DNA, 20 bp, Artificial Sequence
  Description of Artificial Sequence: Synthetic oligonucleotide
  Target: SCN9A; (-) strand; PAM type: YTN; PAM sequence: CTT
taaaatattatcacaaatac

SEQ ID NO: 65839 - DNA, 20 bp, Artificial Sequence
  Description of Artificial Sequence: Synthetic oligonucleotide
  Target: SCN9A; (-) strand; PAM type: YTN; PAM sequence: TTA
aaatctttaaaatattatca

SEQ ID NO: 65840 - DNA, 20 bp, Artificial Sequence
  Description of Artificial Sequence: Synthetic oligonucleotide
  Target: SCN9A; (-) strand; PAM type: YTN; PAM sequence: TTT
aaaatctttaaaatattatc

SEQ ID NO: 65841 - DNA, 20 bp, Artificial Sequence
  Description of Artificial Sequence: Synthetic oligonucleotide
  Target: SCN9A; (-) strand; PAM type: YTN; PAM sequence: TTT
taaaatctttaaaatattat

SEQ ID NO: 65842 - DNA, 20 bp, Artificial Sequence
  Description of Artificial Sequence: Synthetic oligonucleotide
  Target: SCN9A; (-) strand; PAM type: YTN; PAM sequence: TTA
gatattttaaaatctttaaa

SEQ ID NO: 65843 - DNA, 20 bp, Artificial Sequence
  Description of Artificial Sequence: Synthetic oligonucleotide
  Target: SCN9A; (-) strand; PAM type: YTN; PAM sequence: TTT
agatattttaaaatctttaa

SEQ ID NO: 65844 - DNA, 20 bp, Artificial Sequence
  Description of Artificial Sequence: Synthetic oligonucleotide
  Target: SCN9A; (-) strand; PAM type: YTN; PAM sequence: TTT
tagatattttaaaatcttta

SEQ ID NO: 65845 - DNA, 20 bp, Artificial Sequence
  Description of Artificial Sequence: Synthetic oligonucleotide
  Target: SCN9A; (-) strand; PAM type: YTN; PAM sequence: TTA
tacaatattttagatatttt

SEQ ID NO: 65846 - DNA, 20 bp, Artificial Sequence
  Description of Artificial Sequence: Synthetic oligonucleotide
  Target: SCN9A; (-) strand; PAM type: YTN; PAM sequence: TTA
aaaaattatacaatatttta

SEQ ID NO: 65847 - DNA, 20 bp, Artificial Sequence
  Description of Artificial Sequence: Synthetic oligonucleotide
  Target: SCN9A; (-) strand; PAM type: YTN; PAM sequence: CTT
aaaaaattatacaatatttt

SEQ ID NO: 65848 - DNA, 20 bp, Artificial Sequence
  Description of Artificial Sequence: Synthetic oligonucleotide
  Target: SCN9A; (-) strand; PAM type: YTN; PAM sequence: CTC
ttaaaaaattatacaatatt

SEQ ID NO: 65849 - DNA, 20 bp, Artificial Sequence
  Description of Artificial Sequence: Synthetic oligonucleotide
  Target: SCN9A; (-) strand; PAM type: YTN; PAM sequence: CTC
tcttaaaaaattatacaata

SEQ ID NO: 65850 - DNA, 20 bp, Artificial Sequence
  Description of Artificial Sequence: Synthetic oligonucleotide
  Target: SCN9A; (-) strand; PAM type: YTN; PAM sequence: CTC
tctcttaaaaaattatacaa

SEQ ID NO: 65851 - DNA, 20 bp, Artificial Sequence
  Description of Artificial Sequence: Synthetic oligonucleotide
  Target: SCN9A; (-) strand; PAM type: YTN; PAM sequence: CTG
taaatatgacggggtctctc

SEQ ID NO: 65852 - DNA, 20 bp, Artificial Sequence
  Description of Artificial Sequence: Synthetic oligonucleotide
  Target: SCN9A; (-) strand; PAM type: YTN; PAM sequence: TTA
aactgtaaatatgacggggt

SEQ ID NO: 65853 - DNA, 20 bp, Artificial Sequence
  Description of Artificial Sequence: Synthetic oligonucleotide
  Target: SCN9A; (-) strand; PAM type: YTN; PAM sequence: CTT
aaactgtaaatatgacgggg

SEQ ID NO: 65854 - DNA, 20 bp, Artificial Sequence
  Description of Artificial Sequence: Synthetic oligonucleotide
  Target: SCN9A; (-) strand; PAM type: YTN; PAM sequence: CTC
ttaaactgtaaatatgacgg

SEQ ID NO: 65855 - DNA, 20 bp, Artificial Sequence
  Description of Artificial Sequence: Synthetic oligonucleotide
  Target: SCN9A; (-) strand; PAM type: YTN; PAM sequence: TTC
tcttaaactgtaaatatgac

SEQ ID NO: 65856 - DNA, 20 bp, Artificial Sequence
  Description of Artificial Sequence: Synthetic oligonucleotide
  Target: SCN9A; (-) strand; PAM type: YTN; PAM sequence: TTT
ctcttaaactgtaaatatga

SEQ ID NO: 65857 - DNA, 20 bp, Artificial Sequence
  Description of Artificial Sequence: Synthetic oligonucleotide
  Target: SCN9A; (-) strand; PAM type: YTN; PAM sequence: TTT
tctcttaaactgtaaatatg

SEQ ID NO: 65858 - DNA, 20 bp, Artificial Sequence
  Description of Artificial Sequence: Synthetic oligonucleotide
  Target: SCN9A; (-) strand; PAM type: YTN; PAM sequence: CTT
ttctcttaaactgtaaatat

SEQ ID NO: 65859 - DNA, 20 bp, Artificial Sequence
  Description of Artificial Sequence: Synthetic oligonucleotide
  Target: SCN9A; (-) strand; PAM type: YTN; PAM sequence: TTC
ttttctcttaaactgtaaat

SEQ ID NO: 65860 - DNA, 20 bp, Artificial Sequence
  Description of Artificial Sequence: Synthetic oligonucleotide
  Target: SCN9A; (-) strand; PAM type: YTN; PAM sequence: TTT
cttttctcttaaactgtaaa

SEQ ID NO: 65861 - DNA, 20 bp, Artificial Sequence
  Description of Artificial Sequence: Synthetic oligonucleotide
  Target: SCN9A; (-) strand; PAM type: YTN; PAM sequence: TTT
tcttttctcttaaactgtaa

SEQ ID NO: 65862 - DNA, 20 bp, Artificial Sequence
  Description of Artificial Sequence: Synthetic oligonucleotide
  Target: SCN9A; (-) strand; PAM type: YTN; PAM sequence: TTA
tagaaggaatgtagattttc

SEQ ID NO: 65863 - DNA, 20 bp, Artificial Sequence
  Description of Artificial Sequence: Synthetic oligonucleotide
  Target: SCN9A; (-) strand; PAM type: YTN; PAM sequence: CTG
ccccaaataagaagaaatta

SEQ ID NO: 65864 - DNA, 20 bp, Artificial Sequence
  Description of Artificial Sequence: Synthetic oligonucleotide
  Target: SCN9A; (-) strand; PAM type: YTN; PAM sequence: TTG
aagaaaggctgccccaaata

SEQ ID NO: 65865 - DNA, 20 bp, Artificial Sequence
  Description of Artificial Sequence: Synthetic oligonucleotide
  Target: SCN9A; (-) strand; PAM type: YTN; PAM sequence: TTT
gaagaaaggctgccccaaat

SEQ ID NO: 65866 - DNA, 20 bp, Artificial Sequence
  Description of Artificial Sequence: Synthetic oligonucleotide
  Target: SCN9A; (-) strand; PAM type: YTN; PAM sequence: TTT
tgaagaaaggctgccccaaa

SEQ ID NO: 65867 - DNA, 20 bp, Artificial Sequence
  Description of Artificial Sequence: Synthetic oligonucleotide
  Target: SCN9A; (-) strand; PAM type: YTN; PAM sequence: TTG
taatatagtagttttgaaga

SEQ ID NO: 65868 - DNA, 20 bp, Artificial Sequence
  Description of Artificial Sequence: Synthetic oligonucleotide
  Target: SCN9A; (-) strand; PAM type: YTN; PAM sequence: TTT
gtaatatagtagttttgaag

SEQ ID NO: 65869 - DNA, 20 bp, Artificial Sequence
  Description of Artificial Sequence: Synthetic oligonucleotide
  Target: SCN9A; (-) strand; PAM type: YTN; PAM sequence: TTT
tgtaatatagtagttttgaa

SEQ ID NO: 65870 - DNA, 20 bp, Artificial Sequence
  Description of Artificial Sequence: Synthetic oligonucleotide
  Target: SCN9A; (-) strand; PAM type: YTN; PAM sequence: TTT
ttgtaatatagtagttttga

SEQ ID NO: 65871 - DNA, 20 bp, Artificial Sequence
  Description of Artificial Sequence: Synthetic oligonucleotide
  Target: SCN9A; (-) strand; PAM type: YTN; PAM sequence: CTA
aaaaatgaaaaatgataaaa

SEQ ID NO: 65872 - DNA, 20 bp, Artificial Sequence
  Description of Artificial Sequence: Synthetic oligonucleotide
  Target: SCN9A; (-) strand; PAM type: YTN; PAM sequence: CTG
cctaaaaaatgaaaaatgat

SEQ ID NO: 65873 - DNA, 20 bp, Artificial Sequence
  Description of Artificial Sequence: Synthetic oligonucleotide
  Target: SCN9A; (-) strand; PAM type: YTN; PAM sequence: TTA
ctgcctaaaaaatgaaaaat

SEQ ID NO: 65874 - DNA, 20 bp, Artificial Sequence
  Description of Artificial Sequence: Synthetic oligonucleotide
  Target: SCN9A; (-) strand; PAM type: YTN; PAM sequence: CTA
gttactgcctaaaaaatgaa

SEQ ID NO: 65875 - DNA, 20 bp, Artificial Sequence
  Description of Artificial Sequence: Synthetic oligonucleotide
  Target: SCN9A; (-) strand; PAM type: YTN; PAM sequence: TTA
tctagttactgcctaaaaaa

SEQ ID NO: 65876 - DNA, 20 bp, Artificial Sequence
  Description of Artificial Sequence: Synthetic oligonucleotide
  Target: SCN9A; (-) strand; PAM type: YTN; PAM sequence: TTC
atatatcaagttatctagtt

SEQ ID NO: 65877 - DNA, 20 bp, Artificial Sequence
  Description of Artificial Sequence: Synthetic oligonucleotide
  Target: SCN9A; (-) strand; PAM type: YTN; PAM sequence: TTA
atcattcatatatcaagtta

SEQ ID NO: 65878 - DNA, 20 bp, Artificial Sequence
  Description of Artificial Sequence: Synthetic oligonucleotide
  Target: SCN9A; (-) strand; PAM type: YTN; PAM sequence: TTC
aattaatcattcatatatca

SEQ ID NO: 65879 - DNA, 20 bp, Artificial Sequence
  Description of Artificial Sequence: Synthetic oligonucleotide
  Target: SCN9A; (-) strand; PAM type: YTN; PAM sequence: TTT
caattaatcattcatatatc

SEQ ID NO: 65880 - DNA, 20 bp, Artificial Sequence
  Description of Artificial Sequence: Synthetic oligonucleotide
  Target: SCN9A; (-) strand; PAM type: YTN; PAM sequence: TTT
tcaattaatcattcatatat

SEQ ID NO: 65881 - DNA, 20 bp, Artificial Sequence
  Description of Artificial Sequence: Synthetic oligonucleotide
  Target: SCN9A; (-) strand; PAM type: YTN; PAM sequence: TTT
ttcaattaatcattcatata

SEQ ID NO: 65882 - DNA, 20 bp, Artificial Sequence
  Description of Artificial Sequence: Synthetic oligonucleotide
  Target: SCN9A; (-) strand; PAM type: YTN; PAM sequence: CTA
tttttcaattaatcattcat

SEQ ID NO: 65883 - DNA, 20 bp, Artificial Sequence
  Description of Artificial Sequence: Synthetic oligonucleotide
  Target: SCN9A; (-) strand; PAM type: YTN; PAM sequence: TTG
ctatttttcaattaatcatt

SEQ ID NO: 65884 - DNA, 20 bp, Artificial Sequence
  Description of Artificial Sequence: Synthetic oligonucleotide
  Target: SCN9A; (-) strand; PAM type: YTN; PAM sequence: CTT
gctatttttcaattaatcat

SEQ ID NO: 65885 - DNA, 20 bp, Artificial Sequence
  Description of Artificial Sequence: Synthetic oligonucleotide
  Target: SCN9A; (-) strand; PAM type: YTN; PAM sequence: TTC
ttgctatttttcaattaatc

SEQ ID NO: 65886 - DNA, 20 bp, Artificial Sequence
  Description of Artificial Sequence: Synthetic oligonucleotide
  Target: SCN9A; (-) strand; PAM type: YTN; PAM sequence: TTT
cttgctatttttcaattaat

SEQ ID NO: 65887 - DNA, 20 bp, Artificial Sequence
  Description of Artificial Sequence: Synthetic oligonucleotide
  Target: SCN9A; (-) strand; PAM type: YTN; PAM sequence: TTC
ggatatagtaatgatttctt

SEQ ID NO: 65888 - DNA, 20 bp, Artificial Sequence
  Description of Artificial Sequence: Synthetic oligonucleotide
  Target: SCN9A; (-) strand; PAM type: YTN; PAM sequence: CTT
cggatatagtaatgatttct

SEQ ID NO: 65889 - DNA, 20 bp, Artificial Sequence
  Description of Artificial Sequence: Synthetic oligonucleotide
  Target: SCN9A; (-) strand; PAM type: YTN; PAM sequence: CTA
acttcggatatagtaatgat

SEQ ID NO: 65890 - DNA, 20 bp, Artificial Sequence
  Description of Artificial Sequence: Synthetic oligonucleotide
  Target: SCN9A; (-) strand; PAM type: YTN; PAM sequence: TTC
taacttcggatatagtaatg

SEQ ID NO: 65891 - DNA, 20 bp, Artificial Sequence
  Description of Artificial Sequence: Synthetic oligonucleotide
  Target: SCN9A; (-) strand; PAM type: YTN; PAM sequence: CTA
tgagaattctaacttcggat

SEQ ID NO: 65892 - DNA, 20 bp, Artificial Sequence
  Description of Artificial Sequence: Synthetic oligonucleotide
  Target: SCN9A; (-) strand; PAM type: YTN; PAM sequence: CTC
tatgagaattctaacttcgg

SEQ ID NO: 65893 - DNA, 20 bp, Artificial Sequence
  Description of Artificial Sequence: Synthetic oligonucleotide
  Target: SCN9A; (-) strand; PAM type: YTN; PAM sequence: TTC
ctctatgagaattctaactt

SEQ ID NO: 65894 - DNA, 20 bp, Artificial Sequence
  Description of Artificial Sequence: Synthetic oligonucleotide
  Target: SCN9A; (-) strand; PAM type: YTN; PAM sequence: TTT
cctctatgagaattctaact

SEQ ID NO: 65895 - DNA, 20 bp, Artificial Sequence
  Description of Artificial Sequence: Synthetic oligonucleotide
  Target: SCN9A; (-) strand; PAM type: YTN; PAM sequence: TTA
ggtttcctctatgagaattc

SEQ ID NO: 65896 - DNA, 20 bp, Artificial Sequence
  Description of Artificial Sequence: Synthetic oligonucleotide
  Target: SCN9A; (-) strand; PAM type: YTN; PAM sequence: CTT
aggtttcctctatgagaatt

SEQ ID NO: 65897 - DNA, 20 bp, Artificial Sequence
  Description of Artificial Sequence: Synthetic oligonucleotide
  Target: SCN9A; (-) strand; PAM type: YTN; PAM sequence: TTA
tcttaggtttcctctatgag

SEQ ID NO: 65898 - DNA, 20 bp, Artificial Sequence
  Description of Artificial Sequence: Synthetic oligonucleotide
  Target: SCN9A; (-) strand; PAM type: YTN; PAM sequence: TTA
tatgtgttatcttaggtttc

SEQ ID NO: 65899 - DNA, 20 bp, Artificial Sequence
  Description of Artificial Sequence: Synthetic oligonucleotide
  Target: SCN9A; (-) strand; PAM type: YTN; PAM sequence: CTT
atatgtgttatcttaggttt

SEQ ID NO: 65900 - DNA, 20 bp, Artificial Sequence
  Description of Artificial Sequence: Synthetic oligonucleotide
  Target: SCN9A; (-) strand; PAM type: YTN; PAM sequence: TTA
caccttatatgtgttatctt

SEQ ID NO: 65901 - DNA, 20 bp, Artificial Sequence
  Description of Artificial Sequence: Synthetic oligonucleotide
  Target: SCN9A; (-) strand; PAM type: YTN; PAM sequence: CTA
tatattacaccttatatgtg

SEQ ID NO: 65902 - DNA, 20 bp, Artificial Sequence
  Description of Artificial Sequence: Synthetic oligonucleotide
  Target: SCN9A; (-) strand; PAM type: YTN; PAM sequence: TTA
acatagctatatattacacc

SEQ ID NO: 65903 - DNA, 20 bp, Artificial Sequence
  Description of Artificial Sequence: Synthetic oligonucleotide
  Target: SCN9A; (-) strand; PAM type: YTN; PAM sequence: TTT
aacatagctatatattacac

SEQ ID NO: 65904 - DNA, 20 bp, Artificial Sequence
  Description of Artificial Sequence: Synthetic oligonucleotide
  Target: SCN9A; (-) strand; PAM type: YTN; PAM sequence: TTT
taacatagctatatattaca

SEQ ID NO: 65905 - DNA, 20 bp, Artificial Sequence
  Description of Artificial Sequence: Synthetic oligonucleotide
  Target: SCN9A; (-) strand; PAM type: YTN; PAM sequence: TTT
ttaacatagctatatattac

SEQ ID NO: 65906 - DNA, 20 bp, Artificial Sequence
  Description of Artificial Sequence: Synthetic oligonucleotide
  Target: SCN9A; (-) strand; PAM type: YTN; PAM sequence: CTA
taatatgtaatgtgaaaaaa

SEQ ID NO: 65907 - DNA, 20 bp, Artificial Sequence
  Description of Artificial Sequence: Synthetic oligonucleotide
  Target: SCN9A; (-) strand; PAM type: YTN; PAM sequence: TTC
tataatatgtaatgtgaaaa

SEQ ID NO: 65908 - DNA, 20 bp, Artificial Sequence
  Description of Artificial Sequence: Synthetic oligonucleotide
  Target: SCN9A; (-) strand; PAM type: YTN; PAM sequence: TTT
ctataatatgtaatgtgaaa

SEQ ID NO: 65909 - DNA, 20 bp, Artificial Sequence
  Description of Artificial Sequence: Synthetic oligonucleotide
  Target: SCN9A; (-) strand; PAM type: YTN; PAM sequence: TTT
tctataatatgtaatgtgaa

SEQ ID NO: 65910 - DNA, 20 bp, Artificial Sequence
  Description of Artificial Sequence: Synthetic oligonucleotide
  Target: SCN9A; (-) strand; PAM type: YTN; PAM sequence: TTT
ttctataatatgtaatgtga

SEQ ID NO: 65911 - DNA, 20 bp, Artificial Sequence
  Description of Artificial Sequence: Synthetic oligonucleotide
  Target: SCN9A; (-) strand; PAM type: YTN; PAM sequence: TTT
tttctataatatgtaatgtg

SEQ ID NO: 65912 - DNA, 20 bp, Artificial Sequence
  Description of Artificial Sequence: Synthetic oligonucleotide
  Target: SCN9A; (-) strand; PAM type: YTN; PAM sequence: CTT
ttttctataatatgtaatgt

SEQ ID NO: 65913 - DNA, 20 bp, Artificial Sequence
  Description of Artificial Sequence: Synthetic oligonucleotide
  Target: SCN9A; (-) strand; PAM type: YTN; PAM sequence: TTA
aaaacaataacttttttcta

SEQ ID NO: 65914 - DNA, 20 bp, Artificial Sequence
  Description of Artificial Sequence: Synthetic oligonucleotide
  Target: SCN9A; (-) strand; PAM type: YTN; PAM sequence: TTA
aatgttaaaaacaataactt

SEQ ID NO: 65915 - DNA, 20 bp, Artificial Sequence
  Description of Artificial Sequence: Synthetic oligonucleotide
  Target: SCN9A; (-) strand; PAM type: YTN; PAM sequence: TTA
atcacacaacatattaaatg

SEQ ID NO: 65916 - DNA, 20 bp, Artificial Sequence
  Description of Artificial Sequence: Synthetic oligonucleotide
  Target: SCN9A; (-) strand; PAM type: YTN; PAM sequence: CTT
aatcacacaacatattaaat

SEQ ID NO: 65917 - DNA, 20 bp, Artificial Sequence
  Description of Artificial Sequence: Synthetic oligonucleotide
  Target: SCN9A; (-) strand; PAM type: YTN; PAM sequence: TTC
ttaatcacacaacatattaa

SEQ ID NO: 65918 - DNA, 20 bp, Artificial Sequence
  Description of Artificial Sequence: Synthetic oligonucleotide
  Target: SCN9A; (-) strand; PAM type: YTN; PAM sequence: TTT
cttaatcacacaacatatta

SEQ ID NO: 65919 - DNA, 20 bp, Artificial Sequence
  Description of Artificial Sequence: Synthetic oligonucleotide
  Target: SCN9A; (-) strand; PAM type: YTN; PAM sequence: TTT
tcttaatcacacaacatatt

SEQ ID NO: 65920 - DNA, 20 bp, Artificial Sequence
  Description of Artificial Sequence: Synthetic oligonucleotide
  Target: SCN9A; (-) strand; PAM type: YTN; PAM sequence: TTC
gttttcttaatcacacaaca

SEQ ID NO: 65921 - DNA, 20 bp, Artificial Sequence
  Description of Artificial Sequence: Synthetic oligonucleotide
  Target: SCN9A; (-) strand; PAM type: YTN; PAM sequence: TTT
cgttttcttaatcacacaac

SEQ ID NO: 65922 - DNA, 20 bp, Artificial Sequence
  Description of Artificial Sequence: Synthetic oligonucleotide
  Target: SCN9A; (-) strand; PAM type: YTN; PAM sequence: TTT
tcgttttcttaatcacacaa

SEQ ID NO: 65923 - DNA, 20 bp, Artificial Sequence
  Description of Artificial Sequence: Synthetic oligonucleotide
  Target: SCN9A; (-) strand; PAM type: YTN; PAM sequence: CTC
aaaaaaaataataataattt

SEQ ID NO: 65924 - DNA, 20 bp, Artificial Sequence
  Description of Artificial Sequence: Synthetic oligonucleotide
  Target: SCN9A; (-) strand; PAM type: YTN; PAM sequence: CTC
catctcaaaaaaaataataa

SEQ ID NO: 65925 - DNA, 20 bp, Artificial Sequence
  Description of Artificial Sequence: Synthetic oligonucleotide
  Target: SCN9A; (-) strand; PAM type: YTN; PAM sequence: TTG
ggcgacagggtgagactcca

SEQ ID NO: 65926 - DNA, 20 bp, Artificial Sequence
  Description of Artificial Sequence: Synthetic oligonucleotide
  Target: SCN9A; (-) strand; PAM type: YTN; PAM sequence: CTT
gggcgacagggtgagactcc

SEQ ID NO: 65927 - DNA, 20 bp, Artificial Sequence
  Description of Artificial Sequence: Synthetic oligonucleotide
  Target: SCN9A; (-) strand; PAM type: YTN; PAM sequence: CTC
cagcttgggcgacagggtga

SEQ ID NO: 65928 - DNA, 20 bp, Artificial Sequence
  Description of Artificial Sequence: Synthetic oligonucleotide
  Target: SCN9A; (-) strand; PAM type: YTN; PAM sequence: CTG
cactccagcttgggcgacag

SEQ ID NO: 65929 - DNA, 20 bp, Artificial Sequence
  Description of Artificial Sequence: Synthetic oligonucleotide
  Target: SCN9A; (-) strand; PAM type: YTN; PAM sequence: TTC
agtgagtcgagatcgtgcca

SEQ ID NO: 65930 - DNA, 20 bp, Artificial Sequence
  Description of Artificial Sequence: Synthetic oligonucleotide
  Target: SCN9A; (-) strand; PAM type: YTN; PAM sequence: TTT
cagtgagtcgagatcgtgcc

SEQ ID NO: 65931 - DNA, 20 bp, Artificial Sequence
  Description of Artificial Sequence: Synthetic oligonucleotide
  Target: SCN9A; (-) strand; PAM type: YTN; PAM sequence: TTG
aacccggtaggcagaggttt

SEQ ID NO: 65932 - DNA, 20 bp, Artificial Sequence
  Description of Artificial Sequence: Synthetic oligonucleotide
  Target: SCN9A; (-) strand; PAM type: YTN; PAM sequence: CTT
gaacccggtaggcagaggtt

SEQ ID NO: 65933 - DNA, 20 bp, Artificial Sequence
  Description of Artificial Sequence: Synthetic oligonucleotide
  Target: SCN9A; (-) strand; PAM type: YTN; PAM sequence: CTG
aggcagaagaatcgcttgaa

SEQ ID NO: 65934 - DNA, 20 bp, Artificial Sequence
  Description of Artificial Sequence: Synthetic oligonucleotide
  Target: SCN9A; (-) strand; PAM type: YTN; PAM sequence: CTC
aggaggctgaggcagaagaa

SEQ ID NO: 65935 - DNA, 20 bp, Artificial Sequence
  Description of Artificial Sequence: Synthetic oligonucleotide
  Target: SCN9A; (-) strand; PAM type: YTN; PAM sequence: CTA
ctcaggaggctgaggcagaa

SEQ ID NO: 65936 - DNA, 20 bp, Artificial Sequence
  Description of Artificial Sequence: Synthetic oligonucleotide
  Target: SCN9A; (-) strand; PAM type: YTN; PAM sequence: CTG
taatcccagctactcaggag

SEQ ID NO: 65937 - DNA, 20 bp, Artificial Sequence
  Description of Artificial Sequence: Synthetic oligonucleotide
  Target: SCN9A; (-) strand; PAM type: YTN; PAM sequence: TTA
gccagacatggtggcaggtg

SEQ ID NO: 65938 - DNA, 20 bp, Artificial Sequence
  Description of Artificial Sequence: Synthetic oligonucleotide
  Target: SCN9A; (-) strand; PAM type: YTN; PAM sequence: CTA
aaaaatacaaaaaattagcc

SEQ ID NO: 65939 - DNA, 20 bp, Artificial Sequence
  Description of Artificial Sequence: Synthetic oligonucleotide
  Target: SCN9A; (-) strand; PAM type: YTN; PAM sequence: CTA
ctaaaaaatacaaaaaatta

SEQ ID NO: 65940 - DNA, 20 bp, Artificial Sequence
  Description of Artificial Sequence: Synthetic oligonucleotide
  Target: SCN9A; (-) strand; PAM type: YTN; PAM sequence: CTC
tactaaaaaatacaaaaaat

SEQ ID NO: 65941 - DNA, 20 bp, Artificial Sequence
  Description of Artificial Sequence: Synthetic oligonucleotide
  Target: SCN9A; (-) strand; PAM type: YTN; PAM sequence: CTG
gccaacatggtgaaaccccg

SEQ ID NO: 65942 - DNA, 20 bp, Artificial Sequence
  Description of Artificial Sequence: Synthetic oligonucleotide
  Target: SCN9A; (-) strand; PAM type: YTN; PAM sequence: TTG
agaccagcctggccaacatg

SEQ ID NO: 65943 - DNA, 20 bp, Artificial Sequence
  Description of Artificial Sequence: Synthetic oligonucleotide
  Target: SCN9A; (-) strand; PAM type: YTN; PAM sequence: TTT
gagaccagcctggccaacat

SEQ ID NO: 65944 - DNA, 20 bp, Artificial Sequence
  Description of Artificial Sequence: Synthetic oligonucleotide
  Target: SCN9A; (-) strand; PAM type: YTN; PAM sequence: CTG
aggtcaggagtttgagacca

SEQ ID NO: 65945 - DNA, 20 bp, Artificial Sequence
  Description of Artificial Sequence: Synthetic oligonucleotide
  Target: SCN9A; (-) strand; PAM type: YTN; PAM sequence: TTG
agagtccgaggcaggtggat

SEQ ID NO: 65946 - DNA, 20 bp, Artificial Sequence
  Description of Artificial Sequence: Synthetic oligonucleotide
  Target: SCN9A; (-) strand; PAM type: YTN; PAM sequence: TTT
gagagtccgaggcaggtgga

SEQ ID NO: 65947 - DNA, 20 bp, Artificial Sequence
  Description of Artificial Sequence: Synthetic oligonucleotide
  Target: SCN9A; (-) strand; PAM type: YTN; PAM sequence: CTT
tgagagtccgaggcaggtgg

SEQ ID NO: 65948 - DNA, 20 bp, Artificial Sequence
  Description of Artificial Sequence: Synthetic oligonucleotide
  Target: SCN9A; (-) strand; PAM type: YTN; PAM sequence: CTG
taatcccagcactttgagag

SEQ ID NO: 65949 - DNA, 20 bp, Artificial Sequence
  Description of Artificial Sequence: Synthetic oligonucleotide
  Target: SCN9A; (-) strand; PAM type: YTN; PAM sequence: CTC
acgcctgtaatcccagcact

SEQ ID NO: 65950 - DNA, 20 bp, Artificial Sequence
  Description of Artificial Sequence: Synthetic oligonucleotide
  Target: SCN9A; (-) strand; PAM type: YTN; PAM sequence: CTG
gccaggcgcggtagctcacg

SEQ ID NO: 65951 - DNA, 20 bp, Artificial Sequence
  Description of Artificial Sequence: Synthetic oligonucleotide
  Target: SCN9A; (-) strand; PAM type: YTN; PAM sequence: TTC
tggccaggcgcggtagctca

SEQ ID NO: 65952 - DNA, 20 bp, Artificial Sequence
  Description of Artificial Sequence: Synthetic oligonucleotide
  Target: SCN9A; (-) strand; PAM type: YTN; PAM sequence: CTT
ctggccaggcgcggtagctc

SEQ ID NO: 65953 - DNA, 20 bp, Artificial Sequence
  Description of Artificial Sequence: Synthetic oligonucleotide
  Target: SCN9A; (-) strand; PAM type: YTN; PAM sequence: TTG
gcttctggccaggcgcggta

SEQ ID NO: 65954 - DNA, 20 bp, Artificial Sequence
  Description of Artificial Sequence: Synthetic oligonucleotide
  Target: SCN9A; (-) strand; PAM type: YTN; PAM sequence: TTT
ggcttctggccaggcgcggt

SEQ ID NO: 65955 - DNA, 20 bp, Artificial Sequence
  Description of Artificial Sequence: Synthetic oligonucleotide
  Target: SCN9A; (-) strand; PAM type: YTN; PAM sequence: TTT
tggcttctggccaggcgcgg

SEQ ID NO: 65956 - DNA, 20 bp, Artificial Sequence
  Description of Artificial Sequence: Synthetic oligonucleotide
  Target: SCN9A; (-) strand; PAM type: YTN; PAM sequence: CTT
ttggcttctggccaggcgcg

SEQ ID NO: 65957 - DNA, 20 bp, Artificial Sequence
  Description of Artificial Sequence: Synthetic oligonucleotide
  Target: SCN9A; (-) strand; PAM type: YTN; PAM sequence: TTC
ataaacttttggcttctggc

SEQ ID NO: 65958 - DNA, 20 bp, Artificial Sequence
  Description of Artificial Sequence: Synthetic oligonucleotide
  Target: SCN9A; (-) strand; PAM type: YTN; PAM sequence: CTT
cataaacttttggcttctgg

SEQ ID NO: 65959 - DNA, 20 bp, Artificial Sequence
  Description of Artificial Sequence: Synthetic oligonucleotide
  Target: SCN9A; (-) strand; PAM type: YTN; PAM sequence: TTC
aaagcttcataaacttttgg

SEQ ID NO: 65960 - DNA, 20 bp, Artificial Sequence
  Description of Artificial Sequence: Synthetic oligonucleotide
  Target: SCN9A; (-) strand; PAM type: YTN; PAM sequence: TTA
ttcaaagcttcataaacttt

SEQ ID NO: 65961 - DNA, 20 bp, Artificial Sequence
  Description of Artificial Sequence: Synthetic oligonucleotide
  Target: SCN9A; (-) strand; PAM type: YTN; PAM sequence: CTG
ttattcaaagcttcataaac

SEQ ID NO: 65962 - DNA, 20 bp, Artificial Sequence
  Description of Artificial Sequence: Synthetic oligonucleotide
  Target: SCN9A; (-) strand; PAM type: YTN; PAM sequence: CTC
aactgttattcaaagcttca

SEQ ID NO: 65963 - DNA, 20 bp, Artificial Sequence
  Description of Artificial Sequence: Synthetic oligonucleotide
  Target: SCN9A; (-) strand; PAM type: YTN; PAM sequence: TTC
tcaactgttattcaaagctt

SEQ ID NO: 65964 - DNA, 20 bp, Artificial Sequence
  Description of Artificial Sequence: Synthetic oligonucleotide
  Target: SCN9A; (-) strand; PAM type: YTN; PAM sequence: TTT
ctcaactgttattcaaagct

SEQ ID NO: 65965 - DNA, 20 bp, Artificial Sequence
  Description of Artificial Sequence: Synthetic oligonucleotide
  Target: SCN9A; (-) strand; PAM type: YTN; PAM sequence: TTC
aatttctcaactgttattca

SEQ ID NO: 65966 - DNA, 20 bp, Artificial Sequence
  Description of Artificial Sequence: Synthetic oligonucleotide
  Target: SCN9A; (-) strand; PAM type: YTN; PAM sequence: CTC
aaaagttcaatttctcaact

SEQ ID NO: 65967 - DNA, 20 bp, Artificial Sequence
  Description of Artificial Sequence: Synthetic oligonucleotide
  Target: SCN9A; (-) strand; PAM type: YTN; PAM sequence: TTA
ctcaaaagttcaatttctca

SEQ ID NO: 65968 - DNA, 20 bp, Artificial Sequence
  Description of Artificial Sequence: Synthetic oligonucleotide
  Target: SCN9A; (-) strand; PAM type: YTN; PAM sequence: TTT
actcaaaagttcaatttctc

SEQ ID NO: 65969 - DNA, 20 bp, Artificial Sequence
  Description of Artificial Sequence: Synthetic oligonucleotide
  Target: SCN9A; (-) strand; PAM type: YTN; PAM sequence: TTA
gtcatatttactcaaaagtt

SEQ ID NO: 65970 - DNA, 20 bp, Artificial Sequence
  Description of Artificial Sequence: Synthetic oligonucleotide
  Target: SCN9A; (-) strand; PAM type: YTN; PAM sequence: TTA
ccaaattagtcatatttact

SEQ ID NO: 65971 - DNA, 20 bp, Artificial Sequence
  Description of Artificial Sequence: Synthetic oligonucleotide
  Target: SCN9A; (-) strand; PAM type: YTN; PAM sequence: CTG
caaaatgttaccaaattagt

SEQ ID NO: 65972 - DNA, 20 bp, Artificial Sequence
  Description of Artificial Sequence: Synthetic oligonucleotide
  Target: SCN9A; (-) strand; PAM type: YTN; PAM sequence: CTG
actgcaaaatgttaccaaat

SEQ ID NO: 65973 - DNA, 20 bp, Artificial Sequence
  Description of Artificial Sequence: Synthetic oligonucleotide
  Target: SCN9A; (-) strand; PAM type: YTN; PAM sequence: TTA
gaaaatcacaagtaagcatg

SEQ ID NO: 65974 - DNA, 20 bp, Artificial Sequence
  Description of Artificial Sequence: Synthetic oligonucleotide
  Target: SCN9A; (-) strand; PAM type: YTN; PAM sequence: TTC
atacagcatcatatgtggat

SEQ ID NO: 65975 - DNA, 20 bp, Artificial Sequence
  Description of Artificial Sequence: Synthetic oligonucleotide
  Target: SCN9A; (-) strand; PAM type: YTN; PAM sequence: TTG
aattcatacagcatcatatg

SEQ ID NO: 65976 - DNA, 20 bp, Artificial Sequence
  Description of Artificial Sequence: Synthetic oligonucleotide
  Target: SCN9A; (-) strand; PAM type: YTN; PAM sequence: TTA
agaaaagttgaattcataca

SEQ ID NO: 65977 - DNA, 20 bp, Artificial Sequence
  Description of Artificial Sequence: Synthetic oligonucleotide
  Target: SCN9A; (-) strand; PAM type: YTN; PAM sequence: TTT
aagaaaagttgaattcatac

SEQ ID NO: 65978 - DNA, 20 bp, Artificial Sequence
  Description of Artificial Sequence: Synthetic oligonucleotide
  Target: SCN9A; (-) strand; PAM type: YTN; PAM sequence: TTT
taagaaaagttgaattcata

SEQ ID NO: 65979 - DNA, 20 bp, Artificial Sequence
  Description of Artificial Sequence: Synthetic oligonucleotide
  Target: SCN9A; (-) strand; PAM type: YTN; PAM sequence: CTT
ttaagaaaagttgaattcat

SEQ ID NO: 65980 - DNA, 20 bp, Artificial Sequence
  Description of Artificial Sequence: Synthetic oligonucleotide
  Target: SCN9A; (-) strand; PAM type: YTN; PAM sequence: TTA
tcgagcttttaagaaaagtt

SEQ ID NO: 65981 - DNA, 20 bp, Artificial Sequence
  Description of Artificial Sequence: Synthetic oligonucleotide
  Target: SCN9A; (-) strand; PAM type: YTN; PAM sequence: TTG
cattatcgagcttttaagaa

SEQ ID NO: 65982 - DNA, 20 bp, Artificial Sequence
  Description of Artificial Sequence: Synthetic oligonucleotide
  Target: SCN9A; (-) strand; PAM type: YTN; PAM sequence: TTT
gcattatcgagcttttaaga

SEQ ID NO: 65983 - DNA, 20 bp, Artificial Sequence
  Description of Artificial Sequence: Synthetic oligonucleotide
  Target: SCN9A; (-) strand; PAM type: YTN; PAM sequence: TTA
accaagggtttgcattatcg

SEQ ID NO: 65984 - DNA, 20 bp, Artificial Sequence
  Description of Artificial Sequence: Synthetic oligonucleotide
  Target: SCN9A; (-) strand; PAM type: YTN; PAM sequence: TTT
aaccaagggtttgcattatc

SEQ ID NO: 65985 - DNA, 20 bp, Artificial Sequence
  Description of Artificial Sequence: Synthetic oligonucleotide
  Target: SCN9A; (-) strand; PAM type: YTN; PAM sequence: TTA
aaatttaaccaagggtttgc

SEQ ID NO: 65986 - DNA, 20 bp, Artificial Sequence
  Description of Artificial Sequence: Synthetic oligonucleotide
  Target: SCN9A; (-) strand; PAM type: YTN; PAM sequence: TTT
aaaatttaaccaagggtttg

SEQ ID NO: 65987 - DNA, 20 bp, Artificial Sequence
  Description of Artificial Sequence: Synthetic oligonucleotide
  Target: SCN9A; (-) strand; PAM type: YTN; PAM sequence: CTT
taaaatttaaccaagggttt

SEQ ID NO: 65988 - DNA, 20 bp, Artificial Sequence
  Description of Artificial Sequence: Synthetic oligonucleotide
  Target: SCN9A; (-) strand; PAM type: YTN; PAM sequence: TTG
tatatgccaataagtgcttt

SEQ ID NO: 65989 - DNA, 20 bp, Artificial Sequence
  Description of Artificial Sequence: Synthetic oligonucleotide
  Target: SCN9A; (-) strand; PAM type: YTN; PAM sequence: TTT
gtatatgccaataagtgctt

SEQ ID NO: 65990 - DNA, 20 bp, Artificial Sequence
  Description of Artificial Sequence: Synthetic oligonucleotide
  Target: SCN9A; (-) strand; PAM type: YTN; PAM sequence: TTA
gaggtcaacacgcaaatttg

SEQ ID NO: 65991 - DNA, 20 bp, Artificial Sequence
  Description of Artificial Sequence: Synthetic oligonucleotide
  Target: SCN9A; (-) strand; PAM type: YTN; PAM sequence: CTG
acataattagaggtcaacac

SEQ ID NO: 65992 - DNA, 20 bp, Artificial Sequence
  Description of Artificial Sequence: Synthetic oligonucleotide
  Target: SCN9A; (-) strand; PAM type: YTN; PAM sequence: TTC
catatgatgcctgacataat

SEQ ID NO: 65993 - DNA, 20 bp, Artificial Sequence
  Description of Artificial Sequence: Synthetic oligonucleotide
  Target: SCN9A; (-) strand; PAM type: YTN; PAM sequence: TTT
ccatatgatgcctgacataa

SEQ ID NO: 65994 - DNA, 20 bp, Artificial Sequence
  Description of Artificial Sequence: Synthetic oligonucleotide
  Target: SCN9A; (-) strand; PAM type: YTN; PAM sequence: TTT
tccatatgatgcctgacata

SEQ ID NO: 65995 - DNA, 20 bp, Artificial Sequence
  Description of Artificial Sequence: Synthetic oligonucleotide
  Target: SCN9A; (-) strand; PAM type: YTN; PAM sequence: TTG
ttttccatatgatgcctgac

SEQ ID NO: 65996 - DNA, 20 bp, Artificial Sequence
  Description of Artificial Sequence: Synthetic oligonucleotide
  Target: SCN9A; (-) strand; PAM type: YTN; PAM sequence: TTT
gttttccatatgatgcctga

SEQ ID NO: 65997 - DNA, 20 bp, Artificial Sequence
  Description of Artificial Sequence: Synthetic oligonucleotide
  Target: SCN9A; (-) strand; PAM type: YTN; PAM sequence: TTA
gagatttgttttccatatga

SEQ ID NO: 65998 - DNA, 20 bp, Artificial Sequence
  Description of Artificial Sequence: Synthetic oligonucleotide
  Target: SCN9A; (-) strand; PAM type: YTN; PAM sequence: TTT
agagatttgttttccatatg

SEQ ID NO: 65999 - DNA, 20 bp, Artificial Sequence
  Description of Artificial Sequence: Synthetic oligonucleotide
  Target: SCN9A; (-) strand; PAM type: YTN; PAM sequence: TTT
tagagatttgttttccatat

SEQ ID NO: 66000 - DNA, 20 bp, Artificial Sequence
  Description of Artificial Sequence: Synthetic oligonucleotide
  Target: SCN9A; (-) strand; PAM type: YTN; PAM sequence: TTT
ttagagatttgttttccata

SEQ ID NO: 66001 - DNA, 20 bp, Artificial Sequence
  Description of Artificial Sequence: Synthetic oligonucleotide
  Target: SCN9A; (-) strand; PAM type: YTN; PAM sequence: CTA
taatcagtcatagtttttag

SEQ ID NO: 66002 - DNA, 20 bp, Artificial Sequence
  Description of Artificial Sequence: Synthetic oligonucleotide
  Target: SCN9A; (-) strand; PAM type: YTN; PAM sequence: TTA
gggaagaaacatcctataat

SEQ ID NO: 66003 - DNA, 20 bp, Artificial Sequence
  Description of Artificial Sequence: Synthetic oligonucleotide
  Target: SCN9A; (-) strand; PAM type: YTN; PAM sequence: TTT
agggaagaaacatcctataa

SEQ ID NO: 66004 - DNA, 20 bp, Artificial Sequence
  Description of Artificial Sequence: Synthetic oligonucleotide
  Target: SCN9A; (-) strand; PAM type: YTN; PAM sequence: TTG
tgtttagggaagaaacatcc

SEQ ID NO: 66005 - DNA, 20 bp, Artificial Sequence
  Description of Artificial Sequence: Synthetic oligonucleotide
  Target: SCN9A; (-) strand; PAM type: YTN; PAM sequence: TTT
gtgtttagggaagaaacatc

SEQ ID NO: 66006 - DNA, 20 bp, Artificial Sequence
  Description of Artificial Sequence: Synthetic oligonucleotide
  Target: SCN9A; (-) strand; PAM type: YTN; PAM sequence: CTT
tgtgtttagggaagaaacat

SEQ ID NO: 66007 - DNA, 20 bp, Artificial Sequence
  Description of Artificial Sequence: Synthetic oligonucleotide
  Target: SCN9A; (-) strand; PAM type: YTN; PAM sequence: CTA
acctttgtgtttagggaaga

SEQ ID NO: 66008 - DNA, 20 bp, Artificial Sequence
  Description of Artificial Sequence: Synthetic oligonucleotide
  Target: SCN9A; (-) strand; PAM type: YTN; PAM sequence: TTC
agaaacctaacctttgtgtt

SEQ ID NO: 66009 - DNA, 20 bp, Artificial Sequence
  Description of Artificial Sequence: Synthetic oligonucleotide
  Target: SCN9A; (-) strand; PAM type: YTN; PAM sequence: TTT
cagaaacctaacctttgtgt

SEQ ID NO: 66010 - DNA, 20 bp, Artificial Sequence
  Description of Artificial Sequence: Synthetic oligonucleotide
  Target: SCN9A; (-) strand; PAM type: YTN; PAM sequence: TTT
tcagaaacctaacctttgtg

SEQ ID NO: 66011 - DNA, 20 bp, Artificial Sequence
  Description of Artificial Sequence: Synthetic oligonucleotide
  Target: SCN9A; (-) strand; PAM type: YTN; PAM sequence: CTA
gattttcagaaacctaacct

SEQ ID NO: 66012 - DNA, 20 bp, Artificial Sequence
  Description of Artificial Sequence: Synthetic oligonucleotide
  Target: SCN9A; (-) strand; PAM type: YTN; PAM sequence: TTC
tagattttcagaaacctaac

SEQ ID NO: 66013 - DNA, 20 bp, Artificial Sequence
  Description of Artificial Sequence: Synthetic oligonucleotide
  Target: SCN9A; (-) strand; PAM type: YTN; PAM sequence: CTT
ctagattttcagaaacctaa

SEQ ID NO: 66014 - DNA, 20 bp, Artificial Sequence
  Description of Artificial Sequence: Synthetic oligonucleotide
  Target: SCN9A; (-) strand; PAM type: YTN; PAM sequence: TTC
ttctagattttcagaaacct

SEQ ID NO: 66015 - DNA, 20 bp, Artificial Sequence
  Description of Artificial Sequence: Synthetic oligonucleotide
  Target: SCN9A; (-) strand; PAM type: YTN; PAM sequence: CTA
attcttctagattttcagaa

SEQ ID NO: 66016 - DNA, 20 bp, Artificial Sequence
  Description of Artificial Sequence: Synthetic oligonucleotide
  Target: SCN9A; (-) strand; PAM type: YTN; PAM sequence: TTA
ctaattcttctagattttca

SEQ ID NO: 66017 - DNA, 20 bp, Artificial Sequence
  Description of Artificial Sequence: Synthetic oligonucleotide
  Target: SCN9A; (-) strand; PAM type: YTN; PAM sequence: TTT
actaattcttctagattttc

SEQ ID NO: 66018 - DNA, 20 bp, Artificial Sequence
  Description of Artificial Sequence: Synthetic oligonucleotide
  Target: SCN9A; (-) strand; PAM type: YTN; PAM sequence: TTT
tactaattcttctagatttt

SEQ ID NO: 66019 - DNA, 20 bp, Artificial Sequence
  Description of Artificial Sequence: Synthetic oligonucleotide
  Target: SCN9A; (-) strand; PAM type: YTN; PAM sequence: CTT
ttactaattcttctagattt

SEQ ID NO: 66020 - DNA, 20 bp, Artificial Sequence
  Description of Artificial Sequence: Synthetic oligonucleotide
  Target: SCN9A; (-) strand; PAM type: YTN; PAM sequence: TTA
tcttttactaattcttctag

SEQ ID NO: 66021 - DNA, 20 bp, Artificial Sequence
  Description of Artificial Sequence: Synthetic oligonucleotide
  Target: SCN9A; (-) strand; PAM type: YTN; PAM sequence: TTT
atcttttactaattcttcta

SEQ ID NO: 66022 - DNA, 20 bp, Artificial Sequence
  Description of Artificial Sequence: Synthetic oligonucleotide
  Target: SCN9A; (-) strand; PAM type: YTN; PAM sequence: CTT
tatcttttactaattcttct

SEQ ID NO: 66023 - DNA, 20 bp, Artificial Sequence
  Description of Artificial Sequence: Synthetic oligonucleotide
  Target: SCN9A; (-) strand; PAM type: YTN; PAM sequence: TTC
tttatcttttactaattctt

SEQ ID NO: 66024 - DNA, 20 bp, Artificial Sequence
  Description of Artificial Sequence: Synthetic oligonucleotide
  Target: SCN9A; (-) strand; PAM type: YTN; PAM sequence: CTC
agaatgatatgttctttatc

SEQ ID NO: 66025 - DNA, 20 bp, Artificial Sequence
  Description of Artificial Sequence: Synthetic oligonucleotide
  Target: SCN9A; (-) strand; PAM type: YTN; PAM sequence: TTC
tcagaatgatatgttcttta

SEQ ID NO: 66026 - DNA, 20 bp, Artificial Sequence
  Description of Artificial Sequence: Synthetic oligonucleotide
  Target: SCN9A; (-) strand; PAM type: YTN; PAM sequence: TTT
ctcagaatgatatgttcttt

SEQ ID NO: 66027 - DNA, 20 bp, Artificial Sequence
  Description of Artificial Sequence: Synthetic oligonucleotide
  Target: SCN9A; (-) strand; PAM type: YTN; PAM sequence: TTT
tctcagaatgatatgttctt

SEQ ID NO: 66028 - DNA, 20 bp, Artificial Sequence
  Description of Artificial Sequence: Synthetic oligonucleotide
  Target: SCN9A; (-) strand; PAM type: YTN; PAM sequence: TTT
ttctcagaatgatatgttct

SEQ ID NO: 66029 - DNA, 20 bp, Artificial Sequence
  Description of Artificial Sequence: Synthetic oligonucleotide
  Target: SCN9A; (-) strand; PAM type: YTN; PAM sequence: TTA
tttttctcagaatgatatgt

SEQ ID NO: 66030 - DNA, 20 bp, Artificial Sequence
  Description of Artificial Sequence: Synthetic oligonucleotide
  Target: SCN9A; (-) strand; PAM type: YTN; PAM sequence: CTT
atttttctcagaatgatatg

SEQ ID NO: 66031 - DNA, 20 bp, Artificial Sequence
  Description of Artificial Sequence: Synthetic oligonucleotide
  Target: SCN9A; (-) strand; PAM type: YTN; PAM sequence: CTC
ccagtcttatttttctcaga

SEQ ID NO: 66032 - DNA, 20 bp, Artificial Sequence
  Description of Artificial Sequence: Synthetic oligonucleotide
  Target: SCN9A; (-) strand; PAM type: YTN; PAM sequence: CTC
aatctcccagtcttattttt

SEQ ID NO: 66033 - DNA, 20 bp, Artificial Sequence
  Description of Artificial Sequence: Synthetic oligonucleotide
  Target: SCN9A; (-) strand; PAM type: YTN; PAM sequence: TTA
taacctcaatctcccagtct

SEQ ID NO: 66034 - DNA, 20 bp, Artificial Sequence
  Description of Artificial Sequence: Synthetic oligonucleotide
  Target: SCN9A; (-) strand; PAM type: YTN; PAM sequence: TTT
ataacctcaatctcccagtc

SEQ ID NO: 66035 - DNA, 20 bp, Artificial Sequence
  Description of Artificial Sequence: Synthetic oligonucleotide
  Target: SCN9A; (-) strand; PAM type: YTN; PAM sequence: TTT
tataacctcaatctcccagt

SEQ ID NO: 66036 - DNA, 20 bp, Artificial Sequence
  Description of Artificial Sequence: Synthetic oligonucleotide
  Target: SCN9A; (-) strand; PAM type: YTN; PAM sequence: TTA
ttttataacctcaatctccc

SEQ ID NO: 66037 - DNA, 20 bp, Artificial Sequence
  Description of Artificial Sequence: Synthetic oligonucleotide
  Target: SCN9A; (-) strand; PAM type: YTN; PAM sequence: TTA
cattattttataacctcaat

SEQ ID NO: 66038 - DNA, 20 bp, Artificial Sequence
  Description of Artificial Sequence: Synthetic oligonucleotide
  Target: SCN9A; (-) strand; PAM type: YTN; PAM sequence: CTT
acattattttataacctcaa

SEQ ID NO: 66039 - DNA, 20 bp, Artificial Sequence
  Description of Artificial Sequence: Synthetic oligonucleotide
  Target: SCN9A; (-) strand; PAM type: YTN; PAM sequence: TTC
ttacattattttataacctc

SEQ ID NO: 66040 - DNA, 20 bp, Artificial Sequence
  Description of Artificial Sequence: Synthetic oligonucleotide
  Target: SCN9A; (-) strand; PAM type: YTN; PAM sequence: TTT
cttacattattttataacct

SEQ ID NO: 66041 - DNA, 20 bp, Artificial Sequence
  Description of Artificial Sequence: Synthetic oligonucleotide
  Target: SCN9A; (-) strand; PAM type: YTN; PAM sequence: CTT
tcttacattattttataacc

SEQ ID NO: 66042 - DNA, 20 bp, Artificial Sequence
  Description of Artificial Sequence: Synthetic oligonucleotide
  Target: SCN9A; (-) strand; PAM type: YTN; PAM sequence: TTA
aaatggctttcttacattat

SEQ ID NO: 66043 - DNA, 20 bp, Artificial Sequence
  Description of Artificial Sequence: Synthetic oligonucleotide
  Target: SCN9A; (-) strand; PAM type: YTN; PAM sequence: TTA
attaaaatggctttcttaca

SEQ ID NO: 66044 - DNA, 20 bp, Artificial Sequence
  Description of Artificial Sequence: Synthetic oligonucleotide
  Target: SCN9A; (-) strand; PAM type: YTN; PAM sequence: TTG
tattaattaaaatggctttc

SEQ ID NO: 66045 - DNA, 20 bp, Artificial Sequence
  Description of Artificial Sequence: Synthetic oligonucleotide
  Target: SCN9A; (-) strand; PAM type: YTN; PAM sequence: TTT
gtattaattaaaatggcttt

SEQ ID NO: 66046 - DNA, 20 bp, Artificial Sequence
  Description of Artificial Sequence: Synthetic oligonucleotide
  Target: SCN9A; (-) strand; PAM type: YTN; PAM sequence: TTT
tgtattaattaaaatggctt

SEQ ID NO: 66047 - DNA, 20 bp, Artificial Sequence
  Description of Artificial Sequence: Synthetic oligonucleotide
  Target: SCN9A; (-) strand; PAM type: YTN; PAM sequence: TTA
ataatatatatgacatattt

SEQ ID NO: 66048 - DNA, 20 bp, Artificial Sequence
  Description of Artificial Sequence: Synthetic oligonucleotide
  Target: SCN9A; (-) strand; PAM type: YTN; PAM sequence: CTT
aataatatatatgacatatt

SEQ ID NO: 66049 - DNA, 20 bp, Artificial Sequence
  Description of Artificial Sequence: Synthetic oligonucleotide
  Target: SCN9A; (-) strand; PAM type: YTN; PAM sequence: TTA
ataatataacttaataatat

SEQ ID NO: 66050 - DNA, 20 bp, Artificial Sequence
  Description of Artificial Sequence: Synthetic oligonucleotide
  Target: SCN9A; (-) strand; PAM type: YTN; PAM sequence: TTT
aataatataacttaataata

SEQ ID NO: 66051 - DNA, 20 bp, Artificial Sequence
  Description of Artificial Sequence: Synthetic oligonucleotide
  Target: SCN9A; (-) strand; PAM type: YTN; PAM sequence: TTT
taataatataacttaataat

SEQ ID NO: 66052 - DNA, 20 bp, Artificial Sequence
  Description of Artificial Sequence: Synthetic oligonucleotide
  Target: SCN9A; (-) strand; PAM type: YTN; PAM sequence: TTA
tattttaataatataactta

SEQ ID NO: 66053 - DNA, 20 bp, Artificial Sequence
  Description of Artificial Sequence: Synthetic oligonucleotide
  Target: SCN9A; (-) strand; PAM type: YTN; PAM sequence: TTT
atattttaataatataactt

SEQ ID NO: 66054 - DNA, 20 bp, Artificial Sequence
  Description of Artificial Sequence: Synthetic oligonucleotide
  Target: SCN9A; (-) strand; PAM type: YTN; PAM sequence: TTT
tatattttaataatataact

SEQ ID NO: 66055 - DNA, 20 bp, Artificial Sequence
  Description of Artificial Sequence: Synthetic oligonucleotide
  Target: SCN9A; (-) strand; PAM type: YTN; PAM sequence: TTA
ttttatattttaataatata

SEQ ID NO: 66056 - DNA, 20 bp, Artificial Sequence
  Description of Artificial Sequence: Synthetic oligonucleotide
  Target: SCN9A; (-) strand; PAM type: YTN; PAM sequence: CTA
attattttatattttaataa

SEQ ID NO: 66057 - DNA, 20 bp, Artificial Sequence
  Description of Artificial Sequence: Synthetic oligonucleotide
  Target: SCN9A; (-) strand; PAM type: YTN; PAM sequence: CTC
taattattttatattttaat

SEQ ID NO: 66058 - DNA, 20 bp, Artificial Sequence
  Description of Artificial Sequence: Synthetic oligonucleotide
  Target: SCN9A; (-) strand; PAM type: YTN; PAM sequence: TTG
aatgtactctaattatttta

SEQ ID NO: 66059 - DNA, 20 bp, Artificial Sequence
  Description of Artificial Sequence: Synthetic oligonucleotide
  Target: SCN9A; (-) strand; PAM type: YTN; PAM sequence: TTC
attgaatgtactctaattat

SEQ ID NO: 66060 - DNA, 20 bp, Artificial Sequence
  Description of Artificial Sequence: Synthetic oligonucleotide
  Target: SCN9A; (-) strand; PAM type: YTN; PAM sequence: TTT
cattgaatgtactctaatta

SEQ ID NO: 66061 - DNA, 20 bp, Artificial Sequence
  Description of Artificial Sequence: Synthetic oligonucleotide
  Target: SCN9A; (-) strand; PAM type: YTN; PAM sequence: TTA
tcatttcattgaatgtactc

SEQ ID NO: 66062 - DNA, 20 bp, Artificial Sequence
  Description of Artificial Sequence: Synthetic oligonucleotide
  Target: SCN9A; (-) strand; PAM type: YTN; PAM sequence: TTA
ttatcatttcattgaatgta

SEQ ID NO: 66063 - DNA, 20 bp, Artificial Sequence
  Description of Artificial Sequence: Synthetic oligonucleotide
  Target: SCN9A; (-) strand; PAM type: YTN; PAM sequence: CTA
acggtacaatacccattatt

SEQ ID NO: 66064 - DNA, 20 bp, Artificial Sequence
  Description of Artificial Sequence: Synthetic oligonucleotide
  Target: SCN9A; (-) strand; PAM type: YTN; PAM sequence: CTC
aaatagaaactaacggtaca

SEQ ID NO: 66065 - DNA, 20 bp, Artificial Sequence
  Description of Artificial Sequence: Synthetic oligonucleotide
  Target: SCN9A; (-) strand; PAM type: YTN; PAM sequence: CTC
tcaaatagaaactaacggta

SEQ ID NO: 66066 - DNA, 20 bp, Artificial Sequence
  Description of Artificial Sequence: Synthetic oligonucleotide
  Target: SCN9A; (-) strand; PAM type: YTN; PAM sequence: TTA
aaatagtcggtgagatcaag

SEQ ID NO: 66067 - DNA, 20 bp, Artificial Sequence
  Description of Artificial Sequence: Synthetic oligonucleotide
  Target: SCN9A; (-) strand; PAM type: YTN; PAM sequence: CTT
aaaatagtcggtgagatcaa

SEQ ID NO: 66068 - DNA, 20 bp, Artificial Sequence
  Description of Artificial Sequence: Synthetic oligonucleotide
  Target: SCN9A; (-) strand; PAM type: YTN; PAM sequence: TTG
agatagagaagaaatcttaa

SEQ ID NO: 66069 - DNA, 20 bp, Artificial Sequence
  Description of Artificial Sequence: Synthetic oligonucleotide
  Target: SCN9A; (-) strand; PAM type: YTN; PAM sequence: CTG
attgagatagagaagaaatc

SEQ ID NO: 66070 - DNA, 20 bp, Artificial Sequence
  Description of Artificial Sequence: Synthetic oligonucleotide
  Target: SCN9A; (-) strand; PAM type: YTN; PAM sequence: TTC
tgattgagatagagaagaaa

SEQ ID NO: 66071 - DNA, 20 bp, Artificial Sequence
  Description of Artificial Sequence: Synthetic oligonucleotide
  Target: SCN9A; (-) strand; PAM type: YTN; PAM sequence: CTT
ctgattgagatagagaagaa

SEQ ID NO: 66072 - DNA, 20 bp, Artificial Sequence
  Description of Artificial Sequence: Synthetic oligonucleotide
  Target: SCN9A; (-) strand; PAM type: YTN; PAM sequence: TTA
caggcttctgattgagatag

SEQ ID NO: 66073 - DNA, 20 bp, Artificial Sequence
  Description of Artificial Sequence: Synthetic oligonucleotide
  Target: SCN9A; (-) strand; PAM type: YTN; PAM sequence: TTT
acaggcttctgattgagata

SEQ ID NO: 66074 - DNA, 20 bp, Artificial Sequence
  Description of Artificial Sequence: Synthetic oligonucleotide
  Target: SCN9A; (-) strand; PAM type: YTN; PAM sequence: TTT
tacaggcttctgattgagat

SEQ ID NO: 66075 - DNA, 20 bp, Artificial Sequence
  Description of Artificial Sequence: Synthetic oligonucleotide
  Target: SCN9A; (-) strand; PAM type: YTN; PAM sequence: TTT
ttacaggcttctgattgaga

SEQ ID NO: 66076 - DNA, 20 bp, Artificial Sequence
  Description of Artificial Sequence: Synthetic oligonucleotide
  Target: SCN9A; (-) strand; PAM type: YTN; PAM sequence: TTA
acgaagtagaaatattttta

SEQ ID NO: 66077 - DNA, 20 bp, Artificial Sequence
  Description of Artificial Sequence: Synthetic oligonucleotide
  Target: SCN9A; (-) strand; PAM type: YTN; PAM sequence: TTT
aacgaagtagaaatattttt

SEQ ID NO: 66078 - DNA, 20 bp, Artificial Sequence
  Description of Artificial Sequence: Synthetic oligonucleotide
  Target: SCN9A; (-) strand; PAM type: YTN; PAM sequence: TTT
taacgaagtagaaatatttt

SEQ ID NO: 66079 - DNA, 20 bp, Artificial Sequence
  Description of Artificial Sequence: Synthetic oligonucleotide
  Target: SCN9A; (-) strand; PAM type: YTN; PAM sequence: TTA
ttttaacgaagtagaaatat

SEQ ID NO: 66080 - DNA, 20 bp, Artificial Sequence
  Description of Artificial Sequence: Synthetic oligonucleotide
  Target: SCN9A; (-) strand; PAM type: YTN; PAM sequence: TTA
catattattttaacgaagta

SEQ ID NO: 66081 - DNA, 20 bp, Artificial Sequence
  Description of Artificial Sequence: Synthetic oligonucleotide
  Target: SCN9A; (-) strand; PAM type: YTN; PAM sequence: TTT
acatattattttaacgaagt

SEQ ID NO: 66082 - DNA, 20 bp, Artificial Sequence
  Description of Artificial Sequence: Synthetic oligonucleotide
  Target: SCN9A; (-) strand; PAM type: YTN; PAM sequence: TTA
gtttacatattattttaacg

SEQ ID NO: 66083 - DNA, 20 bp, Artificial Sequence
  Description of Artificial Sequence: Synthetic oligonucleotide
  Target: SCN9A; (-) strand; PAM type: YTN; PAM sequence: TTT
agtttacatattattttaac

SEQ ID NO: 66084 - DNA, 20 bp, Artificial Sequence
  Description of Artificial Sequence: Synthetic oligonucleotide
  Target: SCN9A; (-) strand; PAM type: YTN; PAM sequence: CTT
tagtttacatattattttaa

SEQ ID NO: 66085 - DNA, 20 bp, Artificial Sequence
  Description of Artificial Sequence: Synthetic oligonucleotide
  Target: SCN9A; (-) strand; PAM type: YTN; PAM sequence: TTC
tttagtttacatattatttt

SEQ ID NO: 66086 - DNA, 20 bp, Artificial Sequence
  Description of Artificial Sequence: Synthetic oligonucleotide
  Target: SCN9A; (-) strand; PAM type: YTN; PAM sequence: TTG
gatgatggaaaatacataat

SEQ ID NO: 66087 - DNA, 20 bp, Artificial Sequence
  Description of Artificial Sequence: Synthetic oligonucleotide
  Target: SCN9A; (-) strand; PAM type: YTN; PAM sequence: CTT
ggatgatggaaaatacataa

SEQ ID NO: 66088 - DNA, 20 bp, Artificial Sequence
  Description of Artificial Sequence: Synthetic oligonucleotide
  Target: SCN9A; (-) strand; PAM type: YTN; PAM sequence: TTG
aatacttggatgatggaaaa

SEQ ID NO: 66089 - DNA, 20 bp, Artificial Sequence
  Description of Artificial Sequence: Synthetic oligonucleotide
  Target: SCN9A; (-) strand; PAM type: YTN; PAM sequence: CTG
ttgaatacttggatgatgga

SEQ ID NO: 66090 - DNA, 20 bp, Artificial Sequence
  Description of Artificial Sequence: Synthetic oligonucleotide
  Target: SCN9A; (-) strand; PAM type: YTN; PAM sequence: TTC
aaagaactgttgaatacttg

SEQ ID NO: 66091 - DNA, 20 bp, Artificial Sequence
  Description of Artificial Sequence: Synthetic oligonucleotide
  Target: SCN9A; (-) strand; PAM type: YTN; PAM sequence: TTA
gataataaattcaaagaact

SEQ ID NO: 66092 - DNA, 20 bp, Artificial Sequence
  Description of Artificial Sequence: Synthetic oligonucleotide
  Target: SCN9A; (-) strand; PAM type: YTN; PAM sequence: TTT
agataataaattcaaagaac

SEQ ID NO: 66093 - DNA, 20 bp, Artificial Sequence
  Description of Artificial Sequence: Synthetic oligonucleotide
  Target: SCN9A; (-) strand; PAM type: YTN; PAM sequence: TTT
tagataataaattcaaagaa

SEQ ID NO: 66094 - DNA, 20 bp, Artificial Sequence
  Description of Artificial Sequence: Synthetic oligonucleotide
  Target: SCN9A; (-) strand; PAM type: YTN; PAM sequence: TTA
atgtaataattttagataat

SEQ ID NO: 66095 - DNA, 20 bp, Artificial Sequence
  Description of Artificial Sequence: Synthetic oligonucleotide
  Target: SCN9A; (-) strand; PAM type: YTN; PAM sequence: TTA
ttaatgtaataattttagat

SEQ ID NO: 66096 - DNA, 20 bp, Artificial Sequence
  Description of Artificial Sequence: Synthetic oligonucleotide
  Target: SCN9A; (-) strand; PAM type: YTN; PAM sequence: TTA
ttattaatgtaataatttta

SEQ ID NO: 66097 - DNA, 20 bp, Artificial Sequence
  Description of Artificial Sequence: Synthetic oligonucleotide
  Target: SCN9A; (-) strand; PAM type: YTN; PAM sequence: CTC
cagaatggcagtggggcaga

SEQ ID NO: 66098 - DNA, 20 bp, Artificial Sequence
  Description of Artificial Sequence: Synthetic oligonucleotide
  Target: SCN9A; (-) strand; PAM type: YTN; PAM sequence: TTC
atctccagaatggcagtggg

SEQ ID NO: 66099 - DNA, 20 bp, Artificial Sequence
  Description of Artificial Sequence: Synthetic oligonucleotide
  Target: SCN9A; (-) strand; PAM type: YTN; PAM sequence: CTT
catctccagaatggcagtgg

SEQ ID NO: 66100 - DNA, 20 bp, Artificial Sequence
  Description of Artificial Sequence: Synthetic oligonucleotide
  Target: SCN9A; (-) strand; PAM type: YTN; PAM sequence: TTG
cccttcatctccagaatggc

SEQ ID NO: 66101 - DNA, 20 bp, Artificial Sequence
  Description of Artificial Sequence: Synthetic oligonucleotide
  Target: SCN9A; (-) strand; PAM type: YTN; PAM sequence: CTT
gcccttcatctccagaatgg

SEQ ID NO: 66102 - DNA, 20 bp, Artificial Sequence
  Description of Artificial Sequence: Synthetic oligonucleotide
  Target: SCN9A; (-) strand; PAM type: YTN; PAM sequence: CTC
aaatatgcgacttgcccttc

SEQ ID NO: 66103 - DNA, 20 bp, Artificial Sequence
  Description of Artificial Sequence: Synthetic oligonucleotide
  Target: SCN9A; (-) strand; PAM type: YTN; PAM sequence: CTA
tctcaaatatgcgacttgcc

SEQ ID NO: 66104 - DNA, 20 bp, Artificial Sequence
  Description of Artificial Sequence: Synthetic oligonucleotide
  Target: SCN9A; (-) strand; PAM type: YTN; PAM sequence: CTC
tatctcaaatatgcgacttg

SEQ ID NO: 66105 - DNA, 20 bp, Artificial Sequence
  Description of Artificial Sequence: Synthetic oligonucleotide
  Target: SCN9A; (-) strand; PAM type: YTN; PAM sequence: TTG
tctctatctcaaatatgcga

SEQ ID NO: 66106 - DNA, 20 bp, Artificial Sequence
  Description of Artificial Sequence: Synthetic oligonucleotide
  Target: SCN9A; (-) strand; PAM type: YTN; PAM sequence: TTA
taggaaaaaccaaaatgaga

SEQ ID NO: 66107 - DNA, 20 bp, Artificial Sequence
  Description of Artificial Sequence: Synthetic oligonucleotide
  Target: SCN9A; (-) strand; PAM type: YTN; PAM sequence: CTC
agacccaattataggaaaaa

SEQ ID NO: 66108 - DNA, 20 bp, Artificial Sequence
  Description of Artificial Sequence: Synthetic oligonucleotide
  Target: SCN9A; (-) strand; PAM type: YTN; PAM sequence: CTA
tctcagacccaattatagga

SEQ ID NO: 66109 - DNA, 20 bp, Artificial Sequence
  Description of Artificial Sequence: Synthetic oligonucleotide
  Target: SCN9A; (-) strand; PAM type: YTN; PAM sequence: TTA
aaatatctatctcagaccca

SEQ ID NO: 66110 - DNA, 20 bp, Artificial Sequence
  Description of Artificial Sequence: Synthetic oligonucleotide
  Target: SCN9A; (-) strand; PAM type: YTN; PAM sequence: TTT
aaaatatctatctcagaccc

SEQ ID NO: 66111 - DNA, 20 bp, Artificial Sequence
  Description of Artificial Sequence: Synthetic oligonucleotide
  Target: SCN9A; (-) strand; PAM type: YTN; PAM sequence: TTT
taaaatatctatctcagacc

SEQ ID NO: 66112 - DNA, 20 bp, Artificial Sequence
  Description of Artificial Sequence: Synthetic oligonucleotide
  Target: SCN9A; (-) strand; PAM type: YTN; PAM sequence: TTG
gggagagagaagtcatgaaa

SEQ ID NO: 66113 - DNA, 20 bp, Artificial Sequence
  Description of Artificial Sequence: Synthetic oligonucleotide
  Target: SCN9A; (-) strand; PAM type: YTN; PAM sequence: TTT
ggggagagagaagtcatgaa

SEQ ID NO: 66114 - DNA, 20 bp, Artificial Sequence
  Description of Artificial Sequence: Synthetic oligonucleotide
  Target: SCN9A; (-) strand; PAM type: YTN; PAM sequence: TTG
tatttggggagagagaagtc

SEQ ID NO: 66115 - DNA, 20 bp, Artificial Sequence
  Description of Artificial Sequence: Synthetic oligonucleotide
  Target: SCN9A; (-) strand; PAM type: YTN; PAM sequence: TTT
gtatttggggagagagaagt

SEQ ID NO: 66116 - DNA, 20 bp, Artificial Sequence
  Description of Artificial Sequence: Synthetic oligonucleotide
  Target: SCN9A; (-) strand; PAM type: YTN; PAM sequence: CTT
tgtatttggggagagagaag

SEQ ID NO: 66117 - DNA, 20 bp, Artificial Sequence
  Description of Artificial Sequence: Synthetic oligonucleotide
  Target: SCN9A; (-) strand; PAM type: YTN; PAM sequence: TTA
actttgtatttggggagaga

SEQ ID NO: 66118 - DNA, 20 bp, Artificial Sequence
  Description of Artificial Sequence: Synthetic oligonucleotide
  Target: SCN9A; (-) strand; PAM type: YTN; PAM sequence: TTA
tacaaatacaaagttaactt

SEQ ID NO: 66119 - DNA, 20 bp, Artificial Sequence
  Description of Artificial Sequence: Synthetic oligonucleotide
  Target: SCN9A; (-) strand; PAM type: YTN; PAM sequence: CTA
aaaatcattatacaaataca

SEQ ID NO: 66120 - DNA, 20 bp, Artificial Sequence
  Description of Artificial Sequence: Synthetic oligonucleotide
  Target: SCN9A; (-) strand; PAM type: YTN; PAM sequence: TTC
taaaaatcattatacaaata

SEQ ID NO: 66121 - DNA, 20 bp, Artificial Sequence
  Description of Artificial Sequence: Synthetic oligonucleotide
  Target: SCN9A; (-) strand; PAM type: YTN; PAM sequence: TTT
ctaaaaatcattatacaaat

SEQ ID NO: 66122 - DNA, 20 bp, Artificial Sequence
  Description of Artificial Sequence: Synthetic oligonucleotide
  Target: SCN9A; (-) strand; PAM type: YTN; PAM sequence: TTT
tctaaaaatcattatacaaa

SEQ ID NO: 66123 - DNA, 20 bp, Artificial Sequence
  Description of Artificial Sequence: Synthetic oligonucleotide
  Target: SCN9A; (-) strand; PAM type: YTN; PAM sequence: TTT
ttctaaaaatcattatacaa

SEQ ID NO: 66124 - DNA, 20 bp, Artificial Sequence
  Description of Artificial Sequence: Synthetic oligonucleotide
  Target: SCN9A; (-) strand; PAM type: YTN; PAM sequence: CTA
aaatttttctaaaaatcatt

SEQ ID NO: 66125 - DNA, 20 bp, Artificial Sequence
  Description of Artificial Sequence: Synthetic oligonucleotide
  Target: SCN9A; (-) strand; PAM type: YTN; PAM sequence: CTG
atatgtgagctaaaattttt

SEQ ID NO: 66126 - DNA, 20 bp, Artificial Sequence
  Description of Artificial Sequence: Synthetic oligonucleotide
  Target: SCN9A; (-) strand; PAM type: YTN; PAM sequence: TTG
gctgatatgtgagctaaaat

SEQ ID NO: 66127 - DNA, 20 bp, Artificial Sequence
  Description of Artificial Sequence: Synthetic oligonucleotide
  Target: SCN9A; (-) strand; PAM type: YTN; PAM sequence: TTG
gaagataagagaggatgagg

SEQ ID NO: 66128 - DNA, 20 bp, Artificial Sequence
  Description of Artificial Sequence: Synthetic oligonucleotide
  Target: SCN9A; (-) strand; PAM type: YTN; PAM sequence: TTC
ataatgtaaaattggaagat

SEQ ID NO: 66129 - DNA, 20 bp, Artificial Sequence
  Description of Artificial Sequence: Synthetic oligonucleotide
  Target: SCN9A; (-) strand; PAM type: YTN; PAM sequence: TTA
ttcataatgtaaaattggaa

SEQ ID NO: 66130 - DNA, 20 bp, Artificial Sequence
  Description of Artificial Sequence: Synthetic oligonucleotide
  Target: SCN9A; (-) strand; PAM type: YTN; PAM sequence: TTA
aagagaggaaatgatgatta

SEQ ID NO: 66131 - DNA, 20 bp, Artificial Sequence
  Description of Artificial Sequence: Synthetic oligonucleotide
  Target: SCN9A; (-) strand; PAM type: YTN; PAM sequence: TTA
gaagtaggagatgataaaag

SEQ ID NO: 66132 - DNA, 20 bp, Artificial Sequence
  Description of Artificial Sequence: Synthetic oligonucleotide
  Target: SCN9A; (-) strand; PAM type: YTN; PAM sequence: TTT
agaagtaggagatgataaaa

SEQ ID NO: 66133 - DNA, 20 bp, Artificial Sequence
  Description of Artificial Sequence: Synthetic oligonucleotide
  Target: SCN9A; (-) strand; PAM type: YTN; PAM sequence: TTA
agaataaaacaaaatttaga

SEQ ID NO: 66134 - DNA, 20 bp, Artificial Sequence
  Description of Artificial Sequence: Synthetic oligonucleotide
  Target: SCN9A; (-) strand; PAM type: YTN; PAM sequence: TTG
ttaagaataaaacaaaattt

SEQ ID NO: 66135 - DNA, 20 bp, Artificial Sequence
  Description of Artificial Sequence: Synthetic oligonucleotide
  Target: SCN9A; (-) strand; PAM type: YTN; PAM sequence: CTT
gttaagaataaaacaaaatt

SEQ ID NO: 66136 - DNA, 20 bp, Artificial Sequence
  Description of Artificial Sequence: Synthetic oligonucleotide
  Target: SCN9A; (-) strand; PAM type: YTN; PAM sequence: TTC
ttgttaagaataaaacaaaa

SEQ ID NO: 66137 - DNA, 20 bp, Artificial Sequence
  Description of Artificial Sequence: Synthetic oligonucleotide
  Target: SCN9A; (-) strand; PAM type: YTN; PAM sequence: TTG
aatgtcattcttgttaagaa

SEQ ID NO: 66138 - DNA, 20 bp, Artificial Sequence
  Description of Artificial Sequence: Synthetic oligonucleotide
  Target: SCN9A; (-) strand; PAM type: YTN; PAM sequence: TTT
gaatgtcattcttgttaaga

SEQ ID NO: 66139 - DNA, 20 bp, Artificial Sequence
  Description of Artificial Sequence: Synthetic oligonucleotide
  Target: SCN9A; (-) strand; PAM type: YTN; PAM sequence: TTA
aaaaatatgatttgaatgtc

SEQ ID NO: 66140 - DNA, 20 bp, Artificial Sequence
  Description of Artificial Sequence: Synthetic oligonucleotide
  Target: SCN9A; (-) strand; PAM type: YTN; PAM sequence: TTT
aaaaaatatgatttgaatgt

SEQ ID NO: 66141 - DNA, 20 bp, Artificial Sequence
  Description of Artificial Sequence: Synthetic oligonucleotide
  Target: SCN9A; (-) strand; PAM type: YTN; PAM sequence: TTT
taaaaaatatgatttgaatg

SEQ ID NO: 66142 - DNA, 20 bp, Artificial Sequence
  Description of Artificial Sequence: Synthetic oligonucleotide
  Target: SCN9A; (-) strand; PAM type: YTN; PAM sequence: TTT
ttaaaaaatatgatttgaat

SEQ ID NO: 66143 - DNA, 20 bp, Artificial Sequence
  Description of Artificial Sequence: Synthetic oligonucleotide
  Target: SCN9A; (-) strand; PAM type: YTN; PAM sequence: TTT
tttaaaaaatatgatttgaa

SEQ ID NO: 66144 - DNA, 20 bp, Artificial Sequence
  Description of Artificial Sequence: Synthetic oligonucleotide
  Target: SCN9A; (-) strand; PAM type: YTN; PAM sequence: CTG
caaaggagatgtgatttttt

SEQ ID NO: 66145 - DNA, 20 bp, Artificial Sequence
  Description of Artificial Sequence: Synthetic oligonucleotide
  Target: SCN9A; (-) strand; PAM type: YTN; PAM sequence: TTC
tgcaaaggagatgtgatttt

SEQ ID NO: 66146 - DNA, 20 bp, Artificial Sequence
  Description of Artificial Sequence: Synthetic oligonucleotide
  Target: SCN9A; (-) strand; PAM type: YTN; PAM sequence: TTT
ctgcaaaggagatgtgattt

SEQ ID NO: 66147 - DNA, 20 bp, Artificial Sequence
  Description of Artificial Sequence: Synthetic oligonucleotide
  Target: SCN9A; (-) strand; PAM type: YTN; PAM sequence: TTT
tctgcaaaggagatgtgatt

SEQ ID NO: 66148 - DNA, 20 bp, Artificial Sequence
  Description of Artificial Sequence: Synthetic oligonucleotide
  Target: SCN9A; (-) strand; PAM type: YTN; PAM sequence: TTA
tgttttctgcaaaggagatg

SEQ ID NO: 66149 - DNA, 20 bp, Artificial Sequence
  Description of Artificial Sequence: Synthetic oligonucleotide
  Target: SCN9A; (-) strand; PAM type: YTN; PAM sequence: TTT
atgttttctgcaaaggagat

SEQ ID NO: 66150 - DNA, 20 bp, Artificial Sequence
  Description of Artificial Sequence: Synthetic oligonucleotide
  Target: SCN9A; (-) strand; PAM type: YTN; PAM sequence: TTT
tatgttttctgcaaaggaga

SEQ ID NO: 66151 - DNA, 20 bp, Artificial Sequence
  Description of Artificial Sequence: Synthetic oligonucleotide
  Target: SCN9A; (-) strand; PAM type: YTN; PAM sequence: TTT
ttatgttttctgcaaaggag

SEQ ID NO: 66152 - DNA, 20 bp, Artificial Sequence
  Description of Artificial Sequence: Synthetic oligonucleotide
  Target: SCN9A; (-) strand; PAM type: YTN; PAM sequence: TTT
tttatgttttctgcaaagga

SEQ ID NO: 66153 - DNA, 20 bp, Artificial Sequence
  Description of Artificial Sequence: Synthetic oligonucleotide
  Target: SCN9A; (-) strand; PAM type: YTN; PAM sequence: TTG
agttttttatgttttctgca

SEQ ID NO: 66154 - DNA, 20 bp, Artificial Sequence
  Description of Artificial Sequence: Synthetic oligonucleotide
  Target: SCN9A; (-) strand; PAM type: YTN; PAM sequence: TTA
taattgagttttttatgttt

SEQ ID NO: 66155 - DNA, 20 bp, Artificial Sequence
  Description of Artificial Sequence: Synthetic oligonucleotide
  Target: SCN9A; (-) strand; PAM type: YTN; PAM sequence: TTT
ataattgagttttttatgtt

SEQ ID NO: 66156 - DNA, 20 bp, Artificial Sequence
  Description of Artificial Sequence: Synthetic oligonucleotide
  Target: SCN9A; (-) strand; PAM type: YTN; PAM sequence: TTG
taacatttataattgagttt

SEQ ID NO: 66157 - DNA, 20 bp, Artificial Sequence
  Description of Artificial Sequence: Synthetic oligonucleotide
  Target: SCN9A; (-) strand; PAM type: YTN; PAM sequence: CTG
tgacattgtaacatttataa

SEQ ID NO: 66158 - DNA, 20 bp, Artificial Sequence
  Description of Artificial Sequence: Synthetic oligonucleotide
  Target: SCN9A; (-) strand; PAM type: YTN; PAM sequence: TTC
tgtgacattgtaacatttat

SEQ ID NO: 66159 - DNA, 20 bp, Artificial Sequence
  Description of Artificial Sequence: Synthetic oligonucleotide
  Target: SCN9A; (-) strand; PAM type: YTN; PAM sequence: TTT
ctgtgacattgtaacattta

SEQ ID NO: 66160 - DNA, 20 bp, Artificial Sequence
  Description of Artificial Sequence: Synthetic oligonucleotide
  Target: SCN9A; (-) strand; PAM type: YTN; PAM sequence: TTA
tttctgtgacattgtaacat

SEQ ID NO: 66161 - DNA, 20 bp, Artificial Sequence
  Description of Artificial Sequence: Synthetic oligonucleotide
  Target: SCN9A; (-) strand; PAM type: YTN; PAM sequence: TTC
aacaaatgtaaattatttct

SEQ ID NO: 66162 - DNA, 20 bp, Artificial Sequence
  Description of Artificial Sequence: Synthetic oligonucleotide
  Target: SCN9A; (-) strand; PAM type: YTN; PAM sequence: TTA
gaacagaaatcgttcaacaa

SEQ ID NO: 66163 - DNA, 20 bp, Artificial Sequence
  Description of Artificial Sequence: Synthetic oligonucleotide
  Target: SCN9A; (-) strand; PAM type: YTN; PAM sequence: CTG
tgaggaatattagaacagaa

SEQ ID NO: 66164 - DNA, 20 bp, Artificial Sequence
  Description of Artificial Sequence: Synthetic oligonucleotide
  Target: SCN9A; (-) strand; PAM type: YTN; PAM sequence: TTA
acacagccagtggaaatata

SEQ ID NO: 66165 - DNA, 20 bp, Artificial Sequence
  Description of Artificial Sequence: Synthetic oligonucleotide
  Target: SCN9A; (-) strand; PAM type: YTN; PAM sequence: TTA
gaaatattaacacagccagt

SEQ ID NO: 66166 - DNA, 20 bp, Artificial Sequence
  Description of Artificial Sequence: Synthetic oligonucleotide
  Target: SCN9A; (-) strand; PAM type: YTN; PAM sequence: TTT
agaaatattaacacagccag

SEQ ID NO: 66167 - DNA, 20 bp, Artificial Sequence
  Description of Artificial Sequence: Synthetic oligonucleotide
  Target: SCN9A; (-) strand; PAM type: YTN; PAM sequence: TTT
tagaaatattaacacagcca

SEQ ID NO: 66168 - DNA, 20 bp, Artificial Sequence
  Description of Artificial Sequence: Synthetic oligonucleotide
  Target: SCN9A; (-) strand; PAM type: YTN; PAM sequence: CTT
ttagaaatattaacacagcc

SEQ ID NO: 66169 - DNA, 20 bp, Artificial Sequence
  Description of Artificial Sequence: Synthetic oligonucleotide
  Target: SCN9A; (-) strand; PAM type: YTN; PAM sequence: TTC
ttttagaaatattaacacag

SEQ ID NO: 66170 - DNA, 20 bp, Artificial Sequence
  Description of Artificial Sequence: Synthetic oligonucleotide
  Target: SCN9A; (-) strand; PAM type: YTN; PAM sequence: TTA
ttcttttagaaatattaaca

SEQ ID NO: 66171 - DNA, 20 bp, Artificial Sequence
  Description of Artificial Sequence: Synthetic oligonucleotide
  Target: SCN9A; (-) strand; PAM type: YTN; PAM sequence: TTT
attcttttagaaatattaac

SEQ ID NO: 66172 - DNA, 20 bp, Artificial Sequence
  Description of Artificial Sequence: Synthetic oligonucleotide
  Target: SCN9A; (-) strand; PAM type: YTN; PAM sequence: CTA
taggtttattcttttagaaa

SEQ ID NO: 66173 - DNA, 20 bp, Artificial Sequence
  Description of Artificial Sequence: Synthetic oligonucleotide
  Target: SCN9A; (-) strand; PAM type: YTN; PAM sequence: TTC
aggctataggtttattcttt

SEQ ID NO: 66174 - DNA, 20 bp, Artificial Sequence
  Description of Artificial Sequence: Synthetic oligonucleotide
  Target: SCN9A; (-) strand; PAM type: YTN; PAM sequence: TTT
caggctataggtttattctt

SEQ ID NO: 66175 - DNA, 20 bp, Artificial Sequence
  Description of Artificial Sequence: Synthetic oligonucleotide
  Target: SCN9A; (-) strand; PAM type: YTN; PAM sequence: TTT
tcaggctataggtttattct

SEQ ID NO: 66176 - DNA, 20 bp, Artificial Sequence
  Description of Artificial Sequence: Synthetic oligonucleotide
  Target: SCN9A; (-) strand; PAM type: YTN; PAM sequence: TTC
atatattttcaggctatagg

SEQ ID NO: 66177 - DNA, 20 bp, Artificial Sequence
  Description of Artificial Sequence: Synthetic oligonucleotide
  Target: SCN9A; (-) strand; PAM type: YTN; PAM sequence: CTT
catatattttcaggctatag

SEQ ID NO: 66178 - DNA, 20 bp, Artificial Sequence
  Description of Artificial Sequence: Synthetic oligonucleotide
  Target: SCN9A; (-) strand; PAM type: YTN; PAM sequence: TTA
agcttcatatattttcaggc

SEQ ID NO: 66179 - DNA, 20 bp, Artificial Sequence
  Description of Artificial Sequence: Synthetic oligonucleotide
  Target: SCN9A; (-) strand; PAM type: YTN; PAM sequence: TTG
ttaagcttcatatattttca

SEQ ID NO: 66180 - DNA, 20 bp, Artificial Sequence
  Description of Artificial Sequence: Synthetic oligonucleotide
  Target: SCN9A; (-) strand; PAM type: YTN; PAM sequence: TTT
gttaagcttcatatattttc

SEQ ID NO: 66181 - DNA, 20 bp, Artificial Sequence
  Description of Artificial Sequence: Synthetic oligonucleotide
  Target: SCN9A; (-) strand; PAM type: YTN; PAM sequence: TTT
tgttaagcttcatatatttt

SEQ ID NO: 66182 - DNA, 20 bp, Artificial Sequence
  Description of Artificial Sequence: Synthetic oligonucleotide
  Target: SCN9A; (-) strand; PAM type: YTN; PAM sequence: TTA
attttgttaagcttcatata

SEQ ID NO: 66183 - DNA, 20 bp, Artificial Sequence
  Description of Artificial Sequence: Synthetic oligonucleotide
  Target: SCN9A; (-) strand; PAM type: YTN; PAM sequence: TTT
aattttgttaagcttcatat

SEQ ID NO: 66184 - DNA, 20 bp, Artificial Sequence
  Description of Artificial Sequence: Synthetic oligonucleotide
  Target: SCN9A; (-) strand; PAM type: YTN; PAM sequence: TTT
taattttgttaagcttcata

SEQ ID NO: 66185 - DNA, 20 bp, Artificial Sequence
  Description of Artificial Sequence: Synthetic oligonucleotide
  Target: SCN9A; (-) strand; PAM type: YTN; PAM sequence: TTA
tcatattttaattttgttaa

SEQ ID NO: 66186 - DNA, 20 bp, Artificial Sequence
  Description of Artificial Sequence: Synthetic oligonucleotide
  Target: SCN9A; (-) strand; PAM type: YTN; PAM sequence: TTG
catattatcatattttaatt

SEQ ID NO: 66187 - DNA, 20 bp, Artificial Sequence
  Description of Artificial Sequence: Synthetic oligonucleotide
  Target: SCN9A; (-) strand; PAM type: YTN; PAM sequence: CTA
ttgcatattatcatatttta

SEQ ID NO: 66188 - DNA, 20 bp, Artificial Sequence
  Description of Artificial Sequence: Synthetic oligonucleotide
  Target: SCN9A; (-) strand; PAM type: YTN; PAM sequence: TTC
accactattgcatattatca

SEQ ID NO: 66189 - DNA, 20 bp, Artificial Sequence
  Description of Artificial Sequence: Synthetic oligonucleotide
  Target: SCN9A; (-) strand; PAM type: YTN; PAM sequence: CTT
caccactattgcatattatc

SEQ ID NO: 66190 - DNA, 20 bp, Artificial Sequence
  Description of Artificial Sequence: Synthetic oligonucleotide
  Target: SCN9A; (-) strand; PAM type: YTN; PAM sequence: TTG
tgaaaaaaccttcaccacta

SEQ ID NO: 66191 - DNA, 20 bp, Artificial Sequence
  Description of Artificial Sequence: Synthetic oligonucleotide
  Target: SCN9A; (-) strand; PAM type: YTN; PAM sequence: CTG
tgtgttgtgaaaaaaccttc

SEQ ID NO: 66192 - DNA, 20 bp, Artificial Sequence
  Description of Artificial Sequence: Synthetic oligonucleotide
  Target: SCN9A; (-) strand; PAM type: YTN; PAM sequence: TTA
ctgtgtgttgtgaaaaaacc

SEQ ID NO: 66193 - DNA, 20 bp, Artificial Sequence
  Description of Artificial Sequence: Synthetic oligonucleotide
  Target: SCN9A; (-) strand; PAM type: YTN; PAM sequence: CTT
actgtgtgttgtgaaaaaac

SEQ ID NO: 66194 - DNA, 20 bp, Artificial Sequence
  Description of Artificial Sequence: Synthetic oligonucleotide
  Target: SCN9A; (-) strand; PAM type: YTN; PAM sequence: TTC
ttactgtgtgttgtgaaaaa

SEQ ID NO: 66195 - DNA, 20 bp, Artificial Sequence
  Description of Artificial Sequence: Synthetic oligonucleotide
  Target: SCN9A; (-) strand; PAM type: YTN; PAM sequence: TTA
ttcttactgtgtgttgtgaa

SEQ ID NO: 66196 - DNA, 20 bp, Artificial Sequence
  Description of Artificial Sequence: Synthetic oligonucleotide
  Target: SCN9A; (-) strand; PAM type: YTN; PAM sequence: TTT
attcttactgtgtgttgtga

SEQ ID NO: 66197 - DNA, 20 bp, Artificial Sequence
  Description of Artificial Sequence: Synthetic oligonucleotide
  Target: SCN9A; (-) strand; PAM type: YTN; PAM sequence: TTA
aaagaggatttattcttact

SEQ ID NO: 66198 - DNA, 20 bp, Artificial Sequence
  Description of Artificial Sequence: Synthetic oligonucleotide
  Target: SCN9A; (-) strand; PAM type: YTN; PAM sequence: TTT
aaaagaggatttattcttac

SEQ ID NO: 66199 - DNA, 20 bp, Artificial Sequence
  Description of Artificial Sequence: Synthetic oligonucleotide
  Target: SCN9A; (-) strand; PAM type: YTN; PAM sequence: TTT
taaaagaggatttattctta

SEQ ID NO: 66200 - DNA, 20 bp, Artificial Sequence
  Description of Artificial Sequence: Synthetic oligonucleotide
  Target: SCN9A; (-) strand; PAM type: YTN; PAM sequence: TTG
agtacattttaaaagaggat

SEQ ID NO: 66201 - DNA, 20 bp, Artificial Sequence
  Description of Artificial Sequence: Synthetic oligonucleotide
  Target: SCN9A; (-) strand; PAM type: YTN; PAM sequence: TTT
gagtacattttaaaagagga

SEQ ID NO: 66202 - DNA, 20 bp, Artificial Sequence
  Description of Artificial Sequence: Synthetic oligonucleotide
  Target: SCN9A; (-) strand; PAM type: YTN; PAM sequence: TTT
tgagtacattttaaaagagg

SEQ ID NO: 66203 - DNA, 20 bp, Artificial Sequence
  Description of Artificial Sequence: Synthetic oligonucleotide
  Target: SCN9A; (-) strand; PAM type: YTN; PAM sequence: CTT
ttgagtacattttaaaagag

SEQ ID NO: 66204 - DNA, 20 bp, Artificial Sequence
  Description of Artificial Sequence: Synthetic oligonucleotide
  Target: SCN9A; (-) strand; PAM type: YTN; PAM sequence: TTG
atgtaggtacttttgagtac

SEQ ID NO: 66205 - DNA, 20 bp, Artificial Sequence
  Description of Artificial Sequence: Synthetic oligonucleotide
  Target: SCN9A; (-) strand; PAM type: YTN; PAM sequence: TTG
ttgatgtaggtacttttgag

SEQ ID NO: 66206 - DNA, 20 bp, Artificial Sequence
  Description of Artificial Sequence: Synthetic oligonucleotide
  Target: SCN9A; (-) strand; PAM type: YTN; PAM sequence: CTA
attgttgatgtaggtacttt

SEQ ID NO: 66207 - DNA, 20 bp, Artificial Sequence
  Description of Artificial Sequence: Synthetic oligonucleotide
  Target: SCN9A; (-) strand; PAM type: YTN; PAM sequence: TTC
ctaattgttgatgtaggtac

SEQ ID NO: 66208 - DNA, 20 bp, Artificial Sequence
  Description of Artificial Sequence: Synthetic oligonucleotide
  Target: SCN9A; (-) strand; PAM type: YTN; PAM sequence: TTT
cctaattgttgatgtaggta

SEQ ID NO: 66209 - DNA, 20 bp, Artificial Sequence
  Description of Artificial Sequence: Synthetic oligonucleotide
  Target: SCN9A; (-) strand; PAM type: YTN; PAM sequence: CTG
gatttcctaattgttgatgt

SEQ ID NO: 66210 - DNA, 20 bp, Artificial Sequence
  Description of Artificial Sequence: Synthetic oligonucleotide
  Target: SCN9A; (-) strand; PAM type: YTN; PAM sequence: TTG
gctggatttcctaattgttg

SEQ ID NO: 66211 - DNA, 20 bp, Artificial Sequence
  Description of Artificial Sequence: Synthetic oligonucleotide
  Target: SCN9A; (-) strand; PAM type: YTN; PAM sequence: CTG
gtgttggctggatttcctaa

SEQ ID NO: 66212 - DNA, 20 bp, Artificial Sequence
  Description of Artificial Sequence: Synthetic oligonucleotide
  Target: SCN9A; (-) strand; PAM type: YTN; PAM sequence: TTC
accaatgcctggtgttggct

SEQ ID NO: 66213 - DNA, 20 bp, Artificial Sequence
  Description of Artificial Sequence: Synthetic oligonucleotide
  Target: SCN9A; (-) strand; PAM type: YTN; PAM sequence: TTT
caccaatgcctggtgttggc

SEQ ID NO: 66214 - DNA, 20 bp, Artificial Sequence
  Description of Artificial Sequence: Synthetic oligonucleotide
  Target: SCN9A; (-) strand; PAM type: YTN; PAM sequence: TTA
taaaacatatttcaccaatg

SEQ ID NO: 66215 - DNA, 20 bp, Artificial Sequence
  Description of Artificial Sequence: Synthetic oligonucleotide
  Target: SCN9A; (-) strand; PAM type: YTN; PAM sequence: CTA
aaatggatagcatatggtta

SEQ ID NO: 66216 - DNA, 20 bp, Artificial Sequence
  Description of Artificial Sequence: Synthetic oligonucleotide
  Target: SCN9A; (-) strand; PAM type: YTN; PAM sequence: TTC
taaaatggatagcatatggt

SEQ ID NO: 66217 - DNA, 20 bp, Artificial Sequence
  Description of Artificial Sequence: Synthetic oligonucleotide
  Target: SCN9A; (-) strand; PAM type: YTN; PAM sequence: CTT
ctaaaatggatagcatatgg

SEQ ID NO: 66218 - DNA, 20 bp, Artificial Sequence
  Description of Artificial Sequence: Synthetic oligonucleotide
  Target: SCN9A; (-) strand; PAM type: YTN; PAM sequence: CTG
gaaatgcttctaaaatggat

SEQ ID NO: 66219 - DNA, 20 bp, Artificial Sequence
  Description of Artificial Sequence: Synthetic oligonucleotide
  Target: SCN9A; (-) strand; PAM type: YTN; PAM sequence: TTC
tggaaatgcttctaaaatgg

SEQ ID NO: 66220 - DNA, 20 bp, Artificial Sequence
  Description of Artificial Sequence: Synthetic oligonucleotide
  Target: SCN9A; (-) strand; PAM type: YTN; PAM sequence: TTC
attctggaaatgcttctaaa

SEQ ID NO: 66221 - DNA, 20 bp, Artificial Sequence
  Description of Artificial Sequence: Synthetic oligonucleotide
  Target: SCN9A; (-) strand; PAM type: YTN; PAM sequence: CTT
cattctggaaatgcttctaa

SEQ ID NO: 66222 - DNA, 20 bp, Artificial Sequence
  Description of Artificial Sequence: Synthetic oligonucleotide
  Target: SCN9A; (-) strand; PAM type: YTN; PAM sequence: TTA
catcttcattctggaaatgc

SEQ ID NO: 66223 - DNA, 20 bp, Artificial Sequence
  Description of Artificial Sequence: Synthetic oligonucleotide
  Target: SCN9A; (-) strand; PAM type: YTN; PAM sequence: CTT
acatcttcattctggaaatg

SEQ ID NO: 66224 - DNA, 20 bp, Artificial Sequence
  Description of Artificial Sequence: Synthetic oligonucleotide
  Target: SCN9A; (-) strand; PAM type: YTN; PAM sequence: TTC
acttacatcttcattctgga

SEQ ID NO: 66225 - DNA, 20 bp, Artificial Sequence
  Description of Artificial Sequence: Synthetic oligonucleotide
  Target: SCN9A; (-) strand; PAM type: YTN; PAM sequence: CTT
cacttacatcttcattctgg

SEQ ID NO: 66226 - DNA, 20 bp, Artificial Sequence
  Description of Artificial Sequence: Synthetic oligonucleotide
  Target: SCN9A; (-) strand; PAM type: YTN; PAM sequence: CTG
gagtatgcagacaagatctt

SEQ ID NO: 66227 - DNA, 20 bp, Artificial Sequence
  Description of Artificial Sequence: Synthetic oligonucleotide
  Target: SCN9A; (-) strand; PAM type: YTN; PAM sequence: TTA
tcctggagtatgcagacaag

SEQ ID NO: 66228 - DNA, 20 bp, Artificial Sequence
  Description of Artificial Sequence: Synthetic oligonucleotide
  Target: SCN9A; (-) strand; PAM type: YTN; PAM sequence: TTA
agattatcctggagtatgca

SEQ ID NO: 66229 - DNA, 20 bp, Artificial Sequence
  Description of Artificial Sequence: Synthetic oligonucleotide
  Target: SCN9A; (-) strand; PAM type: YTN; PAM sequence: TTG
aaaggaaaaagaccattaag

SEQ ID NO: 66230 - DNA, 20 bp, Artificial Sequence
  Description of Artificial Sequence: Synthetic oligonucleotide
  Target: SCN9A; (-) strand; PAM type: YTN; PAM sequence: TTA
tattgaaaggaaaaagacca

SEQ ID NO: 66231 - DNA, 20 bp, Artificial Sequence
  Description of Artificial Sequence: Synthetic oligonucleotide
  Target: SCN9A; (-) strand; PAM type: YTN; PAM sequence: TTT
atattgaaaggaaaaagacc

SEQ ID NO: 66232 - DNA, 20 bp, Artificial Sequence
  Description of Artificial Sequence: Synthetic oligonucleotide
  Target: SCN9A; (-) strand; PAM type: YTN; PAM sequence: TTG
aagatatttatattgaaagg

SEQ ID NO: 66233 - DNA, 20 bp, Artificial Sequence
  Description of Artificial Sequence: Synthetic oligonucleotide
  Target: SCN9A; (-) strand; PAM type: YTN; PAM sequence: TTT
gaagatatttatattgaaag

SEQ ID NO: 66234 - DNA, 20 bp, Artificial Sequence
  Description of Artificial Sequence: Synthetic oligonucleotide
  Target: SCN9A; (-) strand; PAM type: YTN; PAM sequence: TTT
tgaagatatttatattgaaa

SEQ ID NO: 66235 - DNA, 20 bp, Artificial Sequence
  Description of Artificial Sequence: Synthetic oligonucleotide
  Target: SCN9A; (-) strand; PAM type: YTN; PAM sequence: CTT
ttgaagatatttatattgaa

SEQ ID NO: 66236 - DNA, 20 bp, Artificial Sequence
  Description of Artificial Sequence: Synthetic oligonucleotide
  Target: SCN9A; (-) strand; PAM type: YTN; PAM sequence: TTC
cacaggcttttgaagatatt

SEQ ID NO: 66237 - DNA, 20 bp, Artificial Sequence
  Description of Artificial Sequence: Synthetic oligonucleotide
  Target: SCN9A; (-) strand; PAM type: YTN; PAM sequence: TTT
ccacaggcttttgaagatat

SEQ ID NO: 66238 - DNA, 20 bp, Artificial Sequence
  Description of Artificial Sequence: Synthetic oligonucleotide
  Target: SCN9A; (-) strand; PAM type: YTN; PAM sequence: TTA
tttccacaggcttttgaaga

SEQ ID NO: 66239 - DNA, 20 bp, Artificial Sequence
  Description of Artificial Sequence: Synthetic oligonucleotide
  Target: SCN9A; (-) strand; PAM type: YTN; PAM sequence: TTG
aatattatttccacaggctt

SEQ ID NO: 66240 - DNA, 20 bp, Artificial Sequence
  Description of Artificial Sequence: Synthetic oligonucleotide
  Target: SCN9A; (-) strand; PAM type: YTN; PAM sequence: CTT
gaatattatttccacaggct

SEQ ID NO: 66241 - DNA, 20 bp, Artificial Sequence
  Description of Artificial Sequence: Synthetic oligonucleotide
  Target: SCN9A; (-) strand; PAM type: YTN; PAM sequence: TTG
aaacttgaatattatttcca

SEQ ID NO: 66242 - DNA, 20 bp, Artificial Sequence
  Description of Artificial Sequence: Synthetic oligonucleotide
  Target: SCN9A; (-) strand; PAM type: YTN; PAM sequence: TTG
tgcatgattgaaacttgaat

SEQ ID NO: 66243 - DNA, 20 bp, Artificial Sequence
  Description of Artificial Sequence: Synthetic oligonucleotide
  Target: SCN9A; (-) strand; PAM type: YTN; PAM sequence: TTA
agttgtgcatgattgaaact

SEQ ID NO: 66244 - DNA, 20 bp, Artificial Sequence
  Description of Artificial Sequence: Synthetic oligonucleotide
  Target: SCN9A; (-) strand; PAM type: YTN; PAM sequence: CTT
aagttgtgcatgattgaaac

SEQ ID NO: 66245 - DNA, 20 bp, Artificial Sequence
  Description of Artificial Sequence: Synthetic oligonucleotide
  Target: SCN9A; (-) strand; PAM type: YTN; PAM sequence: TTA
aatgaatcatgaagcttaag

SEQ ID NO: 66246 - DNA, 20 bp, Artificial Sequence
  Description of Artificial Sequence: Synthetic oligonucleotide
  Target: SCN9A; (-) strand; PAM type: YTN; PAM sequence: TTT
aaatgaatcatgaagcttaa

SEQ ID NO: 66247 - DNA, 20 bp, Artificial Sequence
  Description of Artificial Sequence: Synthetic oligonucleotide
  Target: SCN9A; (-) strand; PAM type: YTN; PAM sequence: TTT
taaatgaatcatgaagctta

SEQ ID NO: 66248 - DNA, 20 bp, Artificial Sequence
  Description of Artificial Sequence: Synthetic oligonucleotide
  Target: SCN9A; (-) strand; PAM type: YTN; PAM sequence: TTT
ttaaatgaatcatgaagctt

SEQ ID NO: 66249 - DNA, 20 bp, Artificial Sequence
  Description of Artificial Sequence: Synthetic oligonucleotide
  Target: SCN9A; (-) strand; PAM type: YTN; PAM sequence: TTT
tttaaatgaatcatgaagct

SEQ ID NO: 66250 - DNA, 20 bp, Artificial Sequence
  Description of Artificial Sequence: Synthetic oligonucleotide
  Target: SCN9A; (-) strand; PAM type: YTN; PAM sequence: TTT
ttttaaatgaatcatgaagc

SEQ ID NO: 66251 - DNA, 20 bp, Artificial Sequence
  Description of Artificial Sequence: Synthetic oligonucleotide
  Target: SCN9A; (-) strand; PAM type: YTN; PAM sequence: TTT
tttttaaatgaatcatgaag

SEQ ID NO: 66252 - DNA, 20 bp, Artificial Sequence
  Description of Artificial Sequence: Synthetic oligonucleotide
  Target: SCN9A; (-) strand; PAM type: YTN; PAM sequence: CTG
ttttttttaaatgaatcatg

SEQ ID NO: 66253 - DNA, 20 bp, Artificial Sequence
  Description of Artificial Sequence: Synthetic oligonucleotide
  Target: SCN9A; (-) strand; PAM type: YTN; PAM sequence: TTC
ctgttttttttaaatgaatc

SEQ ID NO: 66254 - DNA, 20 bp, Artificial Sequence
  Description of Artificial Sequence: Synthetic oligonucleotide
  Target: SCN9A; (-) strand; PAM type: YTN; PAM sequence: TTT
cctgttttttttaaatgaat

SEQ ID NO: 66255 - DNA, 20 bp, Artificial Sequence
  Description of Artificial Sequence: Synthetic oligonucleotide
  Target: SCN9A; (-) strand; PAM type: YTN; PAM sequence: TTT
tcctgttttttttaaatgaa

SEQ ID NO: 66256 - DNA, 20 bp, Artificial Sequence
  Description of Artificial Sequence: Synthetic oligonucleotide
  Target: SCN9A; (-) strand; PAM type: YTN; PAM sequence: TTT
ttcctgttttttttaaatga

SEQ ID NO: 66257 - DNA, 20 bp, Artificial Sequence
  Description of Artificial Sequence: Synthetic oligonucleotide
  Target: SCN9A; (-) strand; PAM type: YTN; PAM sequence: TTG
tatttttcctgtttttttta

SEQ ID NO: 66258 - DNA, 20 bp, Artificial Sequence
  Description of Artificial Sequence: Synthetic oligonucleotide
  Target: SCN9A; (-) strand; PAM type: YTN; PAM sequence: TTA
gaattgtatttttcctgttt

SEQ ID NO: 66259 - DNA, 20 bp, Artificial Sequence
  Description of Artificial Sequence: Synthetic oligonucleotide
  Target: SCN9A; (-) strand; PAM type: YTN; PAM sequence: TTA
gcattagaattgtatttttc

SEQ ID NO: 66260 - DNA, 20 bp, Artificial Sequence
  Description of Artificial Sequence: Synthetic oligonucleotide
  Target: SCN9A; (-) strand; PAM type: YTN; PAM sequence: CTT
agcattagaattgtattttt

SEQ ID NO: 66261 - DNA, 20 bp, Artificial Sequence
  Description of Artificial Sequence: Synthetic oligonucleotide
  Target: SCN9A; (-) strand; PAM type: YTN; PAM sequence: TTC
agcagtcttagcattagaat

SEQ ID NO: 66262 - DNA, 20 bp, Artificial Sequence
  Description of Artificial Sequence: Synthetic oligonucleotide
  Target: SCN9A; (-) strand; PAM type: YTN; PAM sequence: TTT
cagcagtcttagcattagaa

SEQ ID NO: 66263 - DNA, 20 bp, Artificial Sequence
  Description of Artificial Sequence: Synthetic oligonucleotide
  Target: SCN9A; (-) strand; PAM type: YTN; PAM sequence: TTA
tgtttcagcagtcttagcat

SEQ ID NO: 66264 - DNA, 20 bp, Artificial Sequence
  Description of Artificial Sequence: Synthetic oligonucleotide
  Target: SCN9A; (-) strand; PAM type: YTN; PAM sequence: CTG
gcccatgtcaatattatgtt

SEQ ID NO: 66265 - DNA, 20 bp, Artificial Sequence
  Description of Artificial Sequence: Synthetic oligonucleotide
  Target: SCN9A; (-) strand; PAM type: YTN; PAM sequence: CTG
taaaccagaaaaaatgtcag

SEQ ID NO: 66266 - DNA, 20 bp, Artificial Sequence
  Description of Artificial Sequence: Synthetic oligonucleotide
  Target: SCN9A; (-) strand; PAM type: YTN; PAM sequence: TTA
tatgataactgtaaaccaga

SEQ ID NO: 66267 - DNA, 20 bp, Artificial Sequence
  Description of Artificial Sequence: Synthetic oligonucleotide
  Target: SCN9A; (-) strand; PAM type: YTN; PAM sequence: CTG
ttatatgataactgtaaacc

SEQ ID NO: 66268 - DNA, 20 bp, Artificial Sequence
  Description of Artificial Sequence: Synthetic oligonucleotide
  Target: SCN9A; (-) strand; PAM type: YTN; PAM sequence: CTA
actgttatatgataactgta

SEQ ID NO: 66269 - DNA, 20 bp, Artificial Sequence
  Description of Artificial Sequence: Synthetic oligonucleotide
  Target: SCN9A; (-) strand; PAM type: YTN; PAM sequence: CTA
gaactaactgttatatgata

SEQ ID NO: 66270 - DNA, 20 bp, Artificial Sequence
  Description of Artificial Sequence: Synthetic oligonucleotide
  Target: SCN9A; (-) strand; PAM type: YTN; PAM sequence: CTG
gtgagaaggctagaactaac

SEQ ID NO: 66271 - DNA, 20 bp, Artificial Sequence
  Description of Artificial Sequence: Synthetic oligonucleotide
  Target: SCN9A; (-) strand; PAM type: YTN; PAM sequence: CTG
aagaccagcagcagcactgg

SEQ ID NO: 66272 - DNA, 20 bp, Artificial Sequence
  Description of Artificial Sequence: Synthetic oligonucleotide
  Target: SCN9A; (-) strand; PAM type: YTN; PAM sequence: CTC
tgaagaccagcagcagcact

SEQ ID NO: 66273 - DNA, 20 bp, Artificial Sequence
  Description of Artificial Sequence: Synthetic oligonucleotide
  Target: SCN9A; (-) strand; PAM type: YTN; PAM sequence: TTG
acctctgaagaccagcagca

SEQ ID NO: 66274 - DNA, 20 bp, Artificial Sequence
  Description of Artificial Sequence: Synthetic oligonucleotide
  Target: SCN9A; (-) strand; PAM type: YTN; PAM sequence: CTT
gacctctgaagaccagcagc

SEQ ID NO: 66275 - DNA, 20 bp, Artificial Sequence
  Description of Artificial Sequence: Synthetic oligonucleotide
  Target: SCN9A; (-) strand; PAM type: YTN; PAM sequence: CTC
ttgacctctgaagaccagca

SEQ ID NO: 66276 - DNA, 20 bp, Artificial Sequence
  Description of Artificial Sequence: Synthetic oligonucleotide
  Target: SCN9A; (-) strand; PAM type: YTN; PAM sequence: TTC
tcttgacctctgaagaccag

SEQ ID NO: 66277 - DNA, 20 bp, Artificial Sequence
  Description of Artificial Sequence: Synthetic oligonucleotide
  Target: SCN9A; (-) strand; PAM type: YTN; PAM sequence: TTT
ctcttgacctctgaagacca

SEQ ID NO: 66278 - DNA, 20 bp, Artificial Sequence
  Description of Artificial Sequence: Synthetic oligonucleotide
  Target: SCN9A; (-) strand; PAM type: YTN; PAM sequence: CTT
tctcttgacctctgaagacc

SEQ ID NO: 66279 - DNA, 20 bp, Artificial Sequence
  Description of Artificial Sequence: Synthetic oligonucleotide
  Target: SCN9A; (-) strand; PAM type: YTN; PAM sequence: TTG
cactttctcttgacctctga

SEQ ID NO: 66280 - DNA, 20 bp, Artificial Sequence
  Description of Artificial Sequence: Synthetic oligonucleotide
  Target: SCN9A; (-) strand; PAM type: YTN; PAM sequence: TTT
gcactttctcttgacctctg

SEQ ID NO: 66281 - DNA, 20 bp, Artificial Sequence
  Description of Artificial Sequence: Synthetic oligonucleotide
  Target: SCN9A; (-) strand; PAM type: YTN; PAM sequence: TTT
tgcactttctcttgacctct

SEQ ID NO: 66282 - DNA, 20 bp, Artificial Sequence
  Description of Artificial Sequence: Synthetic oligonucleotide
  Target: SCN9A; (-) strand; PAM type: YTN; PAM sequence: CTT
ttgcactttctcttgacctc

SEQ ID NO: 66283 - DNA, 20 bp, Artificial Sequence
  Description of Artificial Sequence: Synthetic oligonucleotide
  Target: SCN9A; (-) strand; PAM type: YTN; PAM sequence: TTC
ttttgcactttctcttgacc

SEQ ID NO: 66284 - DNA, 20 bp, Artificial Sequence
  Description of Artificial Sequence: Synthetic oligonucleotide
  Target: SCN9A; (-) strand; PAM type: YTN; PAM sequence: TTC
attcttttgcactttctctt

SEQ ID NO: 66285 - DNA, 20 bp, Artificial Sequence
  Description of Artificial Sequence: Synthetic oligonucleotide
  Target: SCN9A; (-) strand; PAM type: YTN; PAM sequence: TTT
cattcttttgcactttctct

SEQ ID NO: 66286 - DNA, 20 bp, Artificial Sequence
  Description of Artificial Sequence: Synthetic oligonucleotide
  Target: SCN9A; (-) strand; PAM type: YTN; PAM sequence: TTA
taagtaatttcattcttttg

SEQ ID NO: 66287 - DNA, 20 bp, Artificial Sequence
  Description of Artificial Sequence: Synthetic oligonucleotide
  Target: SCN9A; (-) strand; PAM type: YTN; PAM sequence: TTG
tggattataagtaatttcat

SEQ ID NO: 66288 - DNA, 20 bp, Artificial Sequence
  Description of Artificial Sequence: Synthetic oligonucleotide
  Target: SCN9A; (-) strand; PAM type: YTN; PAM sequence: TTT
gtggattataagtaatttca

SEQ ID NO: 66289 - DNA, 20 bp, Artificial Sequence
  Description of Artificial Sequence: Synthetic oligonucleotide
  Target: SCN9A; (-) strand; PAM type: YTN; PAM sequence: TTT
tgtggattataagtaatttc

SEQ ID NO: 66290 - DNA, 20 bp, Artificial Sequence
  Description of Artificial Sequence: Synthetic oligonucleotide
  Target: SCN9A; (-) strand; PAM type: YTN; PAM sequence: TTT
ttgtggattataagtaattt

SEQ ID NO: 66291 - DNA, 20 bp, Artificial Sequence
  Description of Artificial Sequence: Synthetic oligonucleotide
  Target: SCN9A; (-) strand; PAM type: YTN; PAM sequence: CTT
tttgtggattataagtaatt

SEQ ID NO: 66292 - DNA, 20 bp, Artificial Sequence
  Description of Artificial Sequence: Synthetic oligonucleotide
  Target: SCN9A; (-) strand; PAM type: YTN; PAM sequence: TTA
atggagaaagaggaggaatc

SEQ ID NO: 66293 - DNA, 20 bp, Artificial Sequence
  Description of Artificial Sequence: Synthetic oligonucleotide
  Target: SCN9A; (-) strand; PAM type: YTN; PAM sequence: TTT
aatggagaaagaggaggaat

SEQ ID NO: 66294 - DNA, 20 bp, Artificial Sequence
  Description of Artificial Sequence: Synthetic oligonucleotide
  Target: SCN9A; (-) strand; PAM type: YTN; PAM sequence: TTT
taatggagaaagaggaggaa

SEQ ID NO: 66295 - DNA, 20 bp, Artificial Sequence
  Description of Artificial Sequence: Synthetic oligonucleotide
  Target: SCN9A; (-) strand; PAM type: YTN; PAM sequence: TTA
tccaattttaatggagaaag

SEQ ID NO: 66296 - DNA, 20 bp, Artificial Sequence
  Description of Artificial Sequence: Synthetic oligonucleotide
  Target: SCN9A; (-) strand; PAM type: YTN; PAM sequence: CTT
atccaattttaatggagaaa

SEQ ID NO: 66297 - DNA, 20 bp, Artificial Sequence
  Description of Artificial Sequence: Synthetic oligonucleotide
  Target: SCN9A; (-) strand; PAM type: YTN; PAM sequence: CTA
ggacttatccaattttaatg

SEQ ID NO: 66298 - DNA, 20 bp, Artificial Sequence
  Description of Artificial Sequence: Synthetic oligonucleotide
  Target: SCN9A; (-) strand; PAM type: YTN; PAM sequence: TTG
ctaggacttatccaatttta

SEQ ID NO: 66299 - DNA, 20 bp, Artificial Sequence
  Description of Artificial Sequence: Synthetic oligonucleotide
  Target: SCN9A; (-) strand; PAM type: YTN; PAM sequence: TTA
aattgctaggacttatccaa

SEQ ID NO: 66300 - DNA, 20 bp, Artificial Sequence
  Description of Artificial Sequence: Synthetic oligonucleotide
  Target: SCN9A; (-) strand; PAM type: YTN; PAM sequence: CTT
aaattgctaggacttatcca

SEQ ID NO: 66301 - DNA, 20 bp, Artificial Sequence
  Description of Artificial Sequence: Synthetic oligonucleotide
  Target: SCN9A; (-) strand; PAM type: YTN; PAM sequence: CTG
gccatgggatcatgtcttaa

SEQ ID NO: 66302 - DNA, 20 bp, Artificial Sequence
  Description of Artificial Sequence: Synthetic oligonucleotide
  Target: SCN9A; (-) strand; PAM type: YTN; PAM sequence: TTA
taacagtggctggccatggg

SEQ ID NO: 66303 - DNA, 20 bp, Artificial Sequence
  Description of Artificial Sequence: Synthetic oligonucleotide
  Target: SCN9A; (-) strand; PAM type: YTN; PAM sequence: TTT
ataacagtggctggccatgg

SEQ ID NO: 66304 - DNA, 20 bp, Artificial Sequence
  Description of Artificial Sequence: Synthetic oligonucleotide
  Target: SCN9A; (-) strand; PAM type: YTN; PAM sequence: CTG
gtggggaaaaaggggagtgt

SEQ ID NO: 66305 - DNA, 20 bp, Artificial Sequence
  Description of Artificial Sequence: Synthetic oligonucleotide
  Target: SCN9A; (-) strand; PAM type: YTN; PAM sequence: CTA
ctggtggggaaaaaggggag

SEQ ID NO: 66306 - DNA, 20 bp, Artificial Sequence
  Description of Artificial Sequence: Synthetic oligonucleotide
  Target: SCN9A; (-) strand; PAM type: YTN; PAM sequence: CTC
cacatcctactggtggggaa

SEQ ID NO: 66307 - DNA, 20 bp, Artificial Sequence
  Description of Artificial Sequence: Synthetic oligonucleotide
  Target: SCN9A; (-) strand; PAM type: YTN; PAM sequence: CTG
aaagacaggctccacatcct

SEQ ID NO: 66308 - DNA, 20 bp, Artificial Sequence
  Description of Artificial Sequence: Synthetic oligonucleotide
  Target: SCN9A; (-) strand; PAM type: YTN; PAM sequence: TTG
agagctgaaagacaggctcc

SEQ ID NO: 66309 - DNA, 20 bp, Artificial Sequence
  Description of Artificial Sequence: Synthetic oligonucleotide
  Target: SCN9A; (-) strand; PAM type: YTN; PAM sequence: TTT
gagagctgaaagacaggctc

SEQ ID NO: 66310 - DNA, 20 bp, Artificial Sequence
  Description of Artificial Sequence: Synthetic oligonucleotide
  Target: SCN9A; (-) strand; PAM type: YTN; PAM sequence: CTG
ggatgcacaagcatttgaga

SEQ ID NO: 66311 - DNA, 20 bp, Artificial Sequence
  Description of Artificial Sequence: Synthetic oligonucleotide
  Target: SCN9A; (-) strand; PAM type: YTN; PAM sequence: CTA
ggcactgggatgcacaagca

SEQ ID NO: 66312 - DNA, 20 bp, Artificial Sequence
  Description of Artificial Sequence: Synthetic oligonucleotide
  Target: SCN9A; (-) strand; PAM type: YTN; PAM sequence: TTA
acatggtactaggcactggg

SEQ ID NO: 66313 - DNA, 20 bp, Artificial Sequence
  Description of Artificial Sequence: Synthetic oligonucleotide
  Target: SCN9A; (-) strand; PAM type: YTN; PAM sequence: TTA
ttaacatggtactaggcact

SEQ ID NO: 66314 - DNA, 20 bp, Artificial Sequence
  Description of Artificial Sequence: Synthetic oligonucleotide
  Target: SCN9A; (-) strand; PAM type: YTN; PAM sequence: CTG
ttattaacatggtactaggc

SEQ ID NO: 66315 - DNA, 20 bp, Artificial Sequence
  Description of Artificial Sequence: Synthetic oligonucleotide
  Target: SCN9A; (-) strand; PAM type: YTN; PAM sequence: CTG
ctgttattaacatggtacta

SEQ ID NO: 66316 - DNA, 20 bp, Artificial Sequence
  Description of Artificial Sequence: Synthetic oligonucleotide
  Target: SCN9A; (-) strand; PAM type: YTN; PAM sequence: CTG
ctgctgttattaacatggta

SEQ ID NO: 66317 - DNA, 20 bp, Artificial Sequence
  Description of Artificial Sequence: Synthetic oligonucleotide
  Target: SCN9A; (-) strand; PAM type: YTN; PAM sequence: TTC
ctgctgctgttattaacatg

SEQ ID NO: 66318 - DNA, 20 bp, Artificial Sequence
  Description of Artificial Sequence: Synthetic oligonucleotide
  Target: SCN9A; (-) strand; PAM type: YTN; PAM sequence: TTT
cctgctgctgttattaacat

SEQ ID NO: 66319 - DNA, 20 bp, Artificial Sequence
  Description of Artificial Sequence: Synthetic oligonucleotide
  Target: SCN9A; (-) strand; PAM type: YTN; PAM sequence: CTT
tcctgctgctgttattaaca

SEQ ID NO: 66320 - DNA, 20 bp, Artificial Sequence
  Description of Artificial Sequence: Synthetic oligonucleotide
  Target: SCN9A; (-) strand; PAM type: YTN; PAM sequence: TTC
ctttcctgctgctgttatta

SEQ ID NO: 66321 - DNA, 20 bp, Artificial Sequence
  Description of Artificial Sequence: Synthetic oligonucleotide
  Target: SCN9A; (-) strand; PAM type: YTN; PAM sequence: TTT
cctttcctgctgctgttatt

SEQ ID NO: 66322 - DNA, 20 bp, Artificial Sequence
  Description of Artificial Sequence: Synthetic oligonucleotide
  Target: SCN9A; (-) strand; PAM type: YTN; PAM sequence: CTT
tcctttcctgctgctgttat

SEQ ID NO: 66323 - DNA, 20 bp, Artificial Sequence
  Description of Artificial Sequence: Synthetic oligonucleotide
  Target: SCN9A; (-) strand; PAM type: YTN; PAM sequence: TTA
gcaaatctttcctttcctgc

SEQ ID NO: 66324 - DNA, 20 bp, Artificial Sequence
  Description of Artificial Sequence: Synthetic oligonucleotide
  Target: SCN9A; (-) strand; PAM type: YTN; PAM sequence: TTT
agcaaatctttcctttcctg

SEQ ID NO: 66325 - DNA, 20 bp, Artificial Sequence
  Description of Artificial Sequence: Synthetic oligonucleotide
  Target: SCN9A; (-) strand; PAM type: YTN; PAM sequence: TTC
atttagcaaatctttccttt

SEQ ID NO: 66326 - DNA, 20 bp, Artificial Sequence
  Description of Artificial Sequence: Synthetic oligonucleotide
  Target: SCN9A; (-) strand; PAM type: YTN; PAM sequence: CTG
cagtcattcatttagcaaat

SEQ ID NO: 66327 - DNA, 20 bp, Artificial Sequence
  Description of Artificial Sequence: Synthetic oligonucleotide
  Target: SCN9A; (-) strand; PAM type: YTN; PAM sequence: CTA
ctgcagtcattcatttagca

SEQ ID NO: 66328 - DNA, 20 bp, Artificial Sequence
  Description of Artificial Sequence: Synthetic oligonucleotide
  Target: SCN9A; (-) strand; PAM type: YTN; PAM sequence: TTA
agctactgcagtcattcatt

SEQ ID NO: 66329 - DNA, 20 bp, Artificial Sequence
  Description of Artificial Sequence: Synthetic oligonucleotide
  Target: SCN9A; (-) strand; PAM type: YTN; PAM sequence: CTA
ttaagctactgcagtcattc

SEQ ID NO: 66330 - DNA, 20 bp, Artificial Sequence
  Description of Artificial Sequence: Synthetic oligonucleotide
  Target: SCN9A; (-) strand; PAM type: YTN; PAM sequence: CTA
taggcctattaagctactgc

SEQ ID NO: 66331 - DNA, 20 bp, Artificial Sequence
  Description of Artificial Sequence: Synthetic oligonucleotide
  Target: SCN9A; (-) strand; PAM type: YTN; PAM sequence: TTC
tataggcctattaagctact

SEQ ID NO: 66332 - DNA, 20 bp, Artificial Sequence
  Description of Artificial Sequence: Synthetic oligonucleotide
  Target: SCN9A; (-) strand; PAM type: YTN; PAM sequence: CTG
tgttctataggcctattaag

SEQ ID NO: 66333 - DNA, 20 bp, Artificial Sequence
  Description of Artificial Sequence: Synthetic oligonucleotide
  Target: SCN9A; (-) strand; PAM type: YTN; PAM sequence: CTC
tgtgttctataggcctatta

SEQ ID NO: 66334 - DNA, 20 bp, Artificial Sequence
  Description of Artificial Sequence: Synthetic oligonucleotide
  Target: SCN9A; (-) strand; PAM type: YTN; PAM sequence: TTG
aaggataatatatggatgaa

SEQ ID NO: 66335 - DNA, 20 bp, Artificial Sequence
  Description of Artificial Sequence: Synthetic oligonucleotide
  Target: SCN9A; (-) strand; PAM type: YTN; PAM sequence: TTT
gaaggataatatatggatga

SEQ ID NO: 66336 - DNA, 20 bp, Artificial Sequence
  Description of Artificial Sequence: Synthetic oligonucleotide
  Target: SCN9A; (-) strand; PAM type: YTN; PAM sequence: CTT
tgaaggataatatatggatg

SEQ ID NO: 66337 - DNA, 20 bp, Artificial Sequence
  Description of Artificial Sequence: Synthetic oligonucleotide
  Target: SCN9A; (-) strand; PAM type: YTN; PAM sequence: CTG
aagctttgaaggataatata

SEQ ID NO: 66338 - DNA, 20 bp, Artificial Sequence
  Description of Artificial Sequence: Synthetic oligonucleotide
  Target: SCN9A; (-) strand; PAM type: YTN; PAM sequence: TTA
gagctgaagctttgaaggat

SEQ ID NO: 66339 - DNA, 20 bp, Artificial Sequence
  Description of Artificial Sequence: Synthetic oligonucleotide
  Target: SCN9A; (-) strand; PAM type: YTN; PAM sequence: TTT
agagctgaagctttgaagga

SEQ ID NO: 66340 - DNA, 20 bp, Artificial Sequence
  Description of Artificial Sequence: Synthetic oligonucleotide
  Target: SCN9A; (-) strand; PAM type: YTN; PAM sequence: TTT
tagagctgaagctttgaagg

SEQ ID NO: 66341 - DNA, 20 bp, Artificial Sequence
  Description of Artificial Sequence: Synthetic oligonucleotide
  Target: SCN9A; (-) strand; PAM type: YTN; PAM sequence: TTT
ttagagctgaagctttgaag

SEQ ID NO: 66342 - DNA, 20 bp, Artificial Sequence
  Description of Artificial Sequence: Synthetic oligonucleotide
  Target: SCN9A; (-) strand; PAM type: YTN; PAM sequence: TTA
atggagagaatagaacagtg

SEQ ID NO: 66343 - DNA, 20 bp, Artificial Sequence
  Description of Artificial Sequence: Synthetic oligonucleotide
  Target: SCN9A; (-) strand; PAM type: YTN; PAM sequence: TTG
gaaagcataggaagcaccgc

SEQ ID NO: 66344 - DNA, 20 bp, Artificial Sequence
  Description of Artificial Sequence: Synthetic oligonucleotide
  Target: SCN9A; (-) strand; PAM type: YTN; PAM sequence: CTT
ggaaagcataggaagcaccg

SEQ ID NO: 66345 - DNA, 20 bp, Artificial Sequence
  Description of Artificial Sequence: Synthetic oligonucleotide
  Target: SCN9A; (-) strand; PAM type: YTN; PAM sequence: TTC
ttggaaagcataggaagcac

SEQ ID NO: 66346 - DNA, 20 bp, Artificial Sequence
  Description of Artificial Sequence: Synthetic oligonucleotide
  Target: SCN9A; (-) strand; PAM type: YTN; PAM sequence: TTT
cttggaaagcataggaagca

SEQ ID NO: 66347 - DNA, 20 bp, Artificial Sequence
  Description of Artificial Sequence: Synthetic oligonucleotide
  Target: SCN9A; (-) strand; PAM type: YTN; PAM sequence: CTA
aaatttcttggaaagcatag

SEQ ID NO: 66348 - DNA, 20 bp, Artificial Sequence
  Description of Artificial Sequence: Synthetic oligonucleotide
  Target: SCN9A; (-) strand; PAM type: YTN; PAM sequence: TTA
ctaaaatttcttggaaagca

SEQ ID NO: 66349 - DNA, 20 bp, Artificial Sequence
  Description of Artificial Sequence: Synthetic oligonucleotide
  Target: SCN9A; (-) strand; PAM type: YTN; PAM sequence: CTT
actaaaatttcttggaaagc

SEQ ID NO: 66350 - DNA, 20 bp, Artificial Sequence
  Description of Artificial Sequence: Synthetic oligonucleotide
  Target: SCN9A; (-) strand; PAM type: YTN; PAM sequence: TTG
tgtgtcacttactaaaattt

SEQ ID NO: 66351 - DNA, 20 bp, Artificial Sequence
  Description of Artificial Sequence: Synthetic oligonucleotide
  Target: SCN9A; (-) strand; PAM type: YTN; PAM sequence: TTG
tcacataatgttgtgtgtca

SEQ ID NO: 66352 - DNA, 20 bp, Artificial Sequence
  Description of Artificial Sequence: Synthetic oligonucleotide
  Target: SCN9A; (-) strand; PAM type: YTN; PAM sequence: CTA
atgttgtcacataatgttgt

SEQ ID NO: 66353 - DNA, 20 bp, Artificial Sequence
  Description of Artificial Sequence: Synthetic oligonucleotide
  Target: SCN9A; (-) strand; PAM type: YTN; PAM sequence: CTC
acctaatgttgtcacataat

SEQ ID NO: 66354 - DNA, 20 bp, Artificial Sequence
  Description of Artificial Sequence: Synthetic oligonucleotide
  Target: SCN9A; (-) strand; PAM type: YTN; PAM sequence: TTA
gatagagctcacctaatgtt

SEQ ID NO: 66355 - DNA, 20 bp, Artificial Sequence
  Description of Artificial Sequence: Synthetic oligonucleotide
  Target: SCN9A; (-) strand; PAM type: YTN; PAM sequence: CTA
cattagatagagctcaccta

SEQ ID NO: 66356 - DNA, 20 bp, Artificial Sequence
  Description of Artificial Sequence: Synthetic oligonucleotide
  Target: SCN9A; (-) strand; PAM type: YTN; PAM sequence: TTA
gtaacagtaaagcgtaagcc

SEQ ID NO: 66357 - DNA, 20 bp, Artificial Sequence
  Description of Artificial Sequence: Synthetic oligonucleotide
  Target: SCN9A; (-) strand; PAM type: YTN; PAM sequence: CTC
agacagaagagcatacacaa

SEQ ID NO: 66358 - DNA, 20 bp, Artificial Sequence
  Description of Artificial Sequence: Synthetic oligonucleotide
  Target: SCN9A; (-) strand; PAM type: YTN; PAM sequence: CTC
ctcagacagaagagcataca

SEQ ID NO: 66359 - DNA, 20 bp, Artificial Sequence
  Description of Artificial Sequence: Synthetic oligonucleotide
  Target: SCN9A; (-) strand; PAM type: YTN; PAM sequence: TTG
tggctcctcagacagaagag

SEQ ID NO: 66360 - DNA, 20 bp, Artificial Sequence
  Description of Artificial Sequence: Synthetic oligonucleotide
  Target: SCN9A; (-) strand; PAM type: YTN; PAM sequence: CTG
tgttgtggctcctcagacag

SEQ ID NO: 66361 - DNA, 20 bp, Artificial Sequence
  Description of Artificial Sequence: Synthetic oligonucleotide
  Target: SCN9A; (-) strand; PAM type: YTN; PAM sequence: TTC
actgtgttgtggctcctcag

SEQ ID NO: 66362 - DNA, 20 bp, Artificial Sequence
  Description of Artificial Sequence: Synthetic oligonucleotide
  Target: SCN9A; (-) strand; PAM type: YTN; PAM sequence: TTT
cactgtgttgtggctcctca

SEQ ID NO: 66363 - DNA, 20 bp, Artificial Sequence
  Description of Artificial Sequence: Synthetic oligonucleotide
  Target: SCN9A; (-) strand; PAM type: YTN; PAM sequence: CTT
tcactgtgttgtggctcctc

SEQ ID NO: 66364 - DNA, 20 bp, Artificial Sequence
  Description of Artificial Sequence: Synthetic oligonucleotide
  Target: SCN9A; (-) strand; PAM type: YTN; PAM sequence: CTG
tcctttcactgtgttgtggc

SEQ ID NO: 66365 - DNA, 20 bp, Artificial Sequence
  Description of Artificial Sequence: Synthetic oligonucleotide
  Target: SCN9A; (-) strand; PAM type: YTN; PAM sequence: CTA
aagtcaaagtcaccctgtcc

SEQ ID NO: 66366 - DNA, 20 bp, Artificial Sequence
  Description of Artificial Sequence: Synthetic oligonucleotide
  Target: SCN9A; (-) strand; PAM type: YTN; PAM sequence: CTG
aagtctaaagtcaaagtcac

SEQ ID NO: 66367 - DNA, 20 bp, Artificial Sequence
  Description of Artificial Sequence: Synthetic oligonucleotide
  Target: SCN9A; (-) strand; PAM type: YTN; PAM sequence: TTG
tcaagggacatgtggctgaa

SEQ ID NO: 66368 - DNA, 20 bp, Artificial Sequence
  Description of Artificial Sequence: Synthetic oligonucleotide
  Target: SCN9A; (-) strand; PAM type: YTN; PAM sequence: TTT
gtcaagggacatgtggctga

SEQ ID NO: 66369 - DNA, 20 bp, Artificial Sequence
  Description of Artificial Sequence: Synthetic oligonucleotide
  Target: SCN9A; (-) strand; PAM type: YTN; PAM sequence: CTT
tgtcaagggacatgtggctg

SEQ ID NO: 66370 - DNA, 20 bp, Artificial Sequence
  Description of Artificial Sequence: Synthetic oligonucleotide
  Target: SCN9A; (-) strand; PAM type: YTN; PAM sequence: TTC
tttgtcaagggacatgtggc

SEQ ID NO: 66371 - DNA, 20 bp, Artificial Sequence
  Description of Artificial Sequence: Synthetic oligonucleotide
  Target: SCN9A; (-) strand; PAM type: YTN; PAM sequence: TTC
aaattctttgtcaagggaca

SEQ ID NO: 66372 - DNA, 20 bp, Artificial Sequence
  Description of Artificial Sequence: Synthetic oligonucleotide
  Target: SCN9A; (-) strand; PAM type: YTN; PAM sequence: TTT
caaattctttgtcaagggac

SEQ ID NO: 66373 - DNA, 20 bp, Artificial Sequence
  Description of Artificial Sequence: Synthetic oligonucleotide
  Target: SCN9A; (-) strand; PAM type: YTN; PAM sequence: CTT
tcaaattctttgtcaaggga

SEQ ID NO: 66374 - DNA, 20 bp, Artificial Sequence
  Description of Artificial Sequence: Synthetic oligonucleotide
  Target: SCN9A; (-) strand; PAM type: YTN; PAM sequence: TTC
agtcctttcaaattctttgt

SEQ ID NO: 66375 - DNA, 20 bp, Artificial Sequence
  Description of Artificial Sequence: Synthetic oligonucleotide
  Target: SCN9A; (-) strand; PAM type: YTN; PAM sequence: TTT
cagtcctttcaaattctttg

SEQ ID NO: 66376 - DNA, 20 bp, Artificial Sequence
  Description of Artificial Sequence: Synthetic oligonucleotide
  Target: SCN9A; (-) strand; PAM type: YTN; PAM sequence: TTT
tcagtcctttcaaattcttt

SEQ ID NO: 66377 - DNA, 20 bp, Artificial Sequence
  Description of Artificial Sequence: Synthetic oligonucleotide
  Target: SCN9A; (-) strand; PAM type: YTN; PAM sequence: TTT
ttcagtcctttcaaattctt

SEQ ID NO: 66378 - DNA, 20 bp, Artificial Sequence
  Description of Artificial Sequence: Synthetic oligonucleotide
  Target: SCN9A; (-) strand; PAM type: YTN; PAM sequence: CTG
caacaatgagcccaattttt

SEQ ID NO: 66379 - DNA, 20 bp, Artificial Sequence
  Description of Artificial Sequence: Synthetic oligonucleotide
  Target: SCN9A; (-) strand; PAM type: YTN; PAM sequence: CTC
actgcaacaatgagcccaat

SEQ ID NO: 66380 - DNA, 20 bp, Artificial Sequence
  Description of Artificial Sequence: Synthetic oligonucleotide
  Target: SCN9A; (-) strand; PAM type: YTN; PAM sequence: TTG
gctcactgcaacaatgagcc

SEQ ID NO: 66381 - DNA, 20 bp, Artificial Sequence
  Description of Artificial Sequence: Synthetic oligonucleotide
  Target: SCN9A; (-) strand; PAM type: YTN; PAM sequence: CTT
ggctcactgcaacaatgagc

SEQ ID NO: 66382 - DNA, 20 bp, Artificial Sequence
  Description of Artificial Sequence: Synthetic oligonucleotide
  Target: SCN9A; (-) strand; PAM type: YTN; PAM sequence: CTG
gagtgcagtggcgtgatctt

SEQ ID NO: 66383 - DNA, 20 bp, Artificial Sequence
  Description of Artificial Sequence: Synthetic oligonucleotide
  Target: SCN9A; (-) strand; PAM type: YTN; PAM sequence: TTG
cccaggctggagtgcagtgg

SEQ ID NO: 66384 - DNA, 20 bp, Artificial Sequence
  Description of Artificial Sequence: Synthetic oligonucleotide
  Target: SCN9A; (-) strand; PAM type: YTN; PAM sequence: CTG
ttgcccaggctggagtgcag

SEQ ID NO: 66385 - DNA, 20 bp, Artificial Sequence
  Description of Artificial Sequence: Synthetic oligonucleotide
  Target: SCN9A; (-) strand; PAM type: YTN; PAM sequence: CTC
tgttgcccaggctggagtgc

SEQ ID NO: 66386 - DNA, 20 bp, Artificial Sequence
  Description of Artificial Sequence: Synthetic oligonucleotide
  Target: SCN9A; (-) strand; PAM type: YTN; PAM sequence: TTG
ctctgttgcccaggctggag

SEQ ID NO: 66387 - DNA, 20 bp, Artificial Sequence
  Description of Artificial Sequence: Synthetic oligonucleotide
  Target: SCN9A; (-) strand; PAM type: YTN; PAM sequence: CTT
gctctgttgcccaggctgga

SEQ ID NO: 66388 - DNA, 20 bp, Artificial Sequence
  Description of Artificial Sequence: Synthetic oligonucleotide
  Target: SCN9A; (-) strand; PAM type: YTN; PAM sequence: TTG
agacagagtcttgctctgtt

SEQ ID NO: 66389 - DNA, 20 bp, Artificial Sequence
  Description of Artificial Sequence: Synthetic oligonucleotide
  Target: SCN9A; (-) strand; PAM type: YTN; PAM sequence: TTT
gagacagagtcttgctctgt

SEQ ID NO: 66390 - DNA, 20 bp, Artificial Sequence
  Description of Artificial Sequence: Synthetic oligonucleotide
  Target: SCN9A; (-) strand; PAM type: YTN; PAM sequence: TTT
tgagacagagtcttgctctg

SEQ ID NO: 66391 - DNA, 20 bp, Artificial Sequence
  Description of Artificial Sequence: Synthetic oligonucleotide
  Target: SCN9A; (-) strand; PAM type: YTN; PAM sequence: TTT
ttgagacagagtcttgctct

SEQ ID NO: 66392 - DNA, 20 bp, Artificial Sequence
  Description of Artificial Sequence: Synthetic oligonucleotide
  Target: SCN9A; (-) strand; PAM type: YTN; PAM sequence: TTT
tttgagacagagtcttgctc

SEQ ID NO: 66393 - DNA, 20 bp, Artificial Sequence
  Description of Artificial Sequence: Synthetic oligonucleotide
  Target: SCN9A; (-) strand; PAM type: YTN; PAM sequence: TTT
ttttgagacagagtcttgct

SEQ ID NO: 66394 - DNA, 20 bp, Artificial Sequence
  Description of Artificial Sequence: Synthetic oligonucleotide
  Target: SCN9A; (-) strand; PAM type: YTN; PAM sequence: TTT
tttttgagacagagtcttgc

SEQ ID NO: 66395 - DNA, 20 bp, Artificial Sequence
  Description of Artificial Sequence: Synthetic oligonucleotide
  Target: SCN9A; (-) strand; PAM type: YTN; PAM sequence: TTT
ttttttgagacagagtcttg

SEQ ID NO: 66396 - DNA, 20 bp, Artificial Sequence
  Description of Artificial Sequence: Synthetic oligonucleotide
  Target: SCN9A; (-) strand; PAM type: YTN; PAM sequence: TTT
tttttttgagacagagtctt

SEQ ID NO: 66397 - DNA, 20 bp, Artificial Sequence
  Description of Artificial Sequence: Synthetic oligonucleotide
  Target: SCN9A; (-) strand; PAM type: YTN; PAM sequence: TTT
ttttttttgagacagagtct

SEQ ID NO: 66398 - DNA, 20 bp, Artificial Sequence
  Description of Artificial Sequence: Synthetic oligonucleotide
  Target: SCN9A; (-) strand; PAM type: YTN; PAM sequence: TTT
tttttttttgagacagagtc

SEQ ID NO: 66399 - DNA, 20 bp, Artificial Sequence
  Description of Artificial Sequence: Synthetic oligonucleotide
  Target: SCN9A; (-) strand; PAM type: YTN; PAM sequence: TTT
ttttttttttgagacagagt

SEQ ID NO: 66400 - DNA, 20 bp, Artificial Sequence
  Description of Artificial Sequence: Synthetic oligonucleotide
  Target: SCN9A; (-) strand; PAM type: YTN; PAM sequence: TTT
tttttttttttgagacagag

SEQ ID NO: 66401 - DNA, 20 bp, Artificial Sequence
  Description of Artificial Sequence: Synthetic oligonucleotide
  Target: SCN9A; (-) strand; PAM type: YTN; PAM sequence: TTT
ttttttttttttgagacaga

SEQ ID NO: 66402 - DNA, 20 bp, Artificial Sequence
  Description of Artificial Sequence: Synthetic oligonucleotide
  Target: SCN9A; (-) strand; PAM type: YTN; PAM sequence: TTT
tttttttttttttgagacag

SEQ ID NO: 66403 - DNA, 20 bp, Artificial Sequence
  Description of Artificial Sequence: Synthetic oligonucleotide
  Target: SCN9A; (-) strand; PAM type: YTN; PAM sequence: TTT
ttttttttttttttgagaca

SEQ ID NO: 66404 - DNA, 20 bp, Artificial Sequence
  Description of Artificial Sequence: Synthetic oligonucleotide
  Target: SCN9A; (-) strand; PAM type: YTN; PAM sequence: TTT
tttttttttttttttgagac

SEQ ID NO: 66405 - DNA, 20 bp, Artificial Sequence
  Description of Artificial Sequence: Synthetic oligonucleotide
  Target: SCN9A; (-) strand; PAM type: YTN; PAM sequence: TTT
ttttttttttttttttgaga

SEQ ID NO: 66406 - DNA, 20 bp, Artificial Sequence
  Description of Artificial Sequence: Synthetic oligonucleotide
  Target: SCN9A; (-) strand; PAM type: YTN; PAM sequence: TTT
tttttttttttttttttgag

SEQ ID NO: 66407 - DNA, 20 bp, Artificial Sequence
  Description of Artificial Sequence: Synthetic oligonucleotide
  Target: SCN9A; (-) strand; PAM type: YTN; PAM sequence: CTT
ttttttttttttttttttga

SEQ ID NO: 66408 - DNA, 20 bp, Artificial Sequence
  Description of Artificial Sequence: Synthetic oligonucleotide
  Target: SCN9A; (-) strand; PAM type: YTN; PAM sequence: CTC
aatgagcctttttttttttt

SEQ ID NO: 66409 - DNA, 20 bp, Artificial Sequence
  Description of Artificial Sequence: Synthetic oligonucleotide
  Target: SCN9A; (-) strand; PAM type: YTN; PAM sequence: TTC
agtgtctcaatgagcctttt

SEQ ID NO: 66410 - DNA, 20 bp, Artificial Sequence
  Description of Artificial Sequence: Synthetic oligonucleotide
  Target: SCN9A; (-) strand; PAM type: YTN; PAM sequence: TTT
cagtgtctcaatgagccttt

SEQ ID NO: 66411 - DNA, 20 bp, Artificial Sequence
  Description of Artificial Sequence: Synthetic oligonucleotide
  Target: SCN9A; (-) strand; PAM type: YTN; PAM sequence: TTT
tcagtgtctcaatgagcctt

SEQ ID NO: 66412 - DNA, 20 bp, Artificial Sequence
  Description of Artificial Sequence: Synthetic oligonucleotide
  Target: SCN9A; (-) strand; PAM type: YTN; PAM sequence: TTG
agatcagcaatcattttcag

SEQ ID NO: 66413 - DNA, 20 bp, Artificial Sequence
  Description of Artificial Sequence: Synthetic oligonucleotide
  Target: SCN9A; (-) strand; PAM type: YTN; PAM sequence: CTG
ttgagatcagcaatcatttt

SEQ ID NO: 66414 - DNA, 20 bp, Artificial Sequence
  Description of Artificial Sequence: Synthetic oligonucleotide
  Target: SCN9A; (-) strand; PAM type: YTN; PAM sequence: TTA
gacctgttgagatcagcaat

SEQ ID NO: 66415 - DNA, 20 bp, Artificial Sequence
  Description of Artificial Sequence: Synthetic oligonucleotide
  Target: SCN9A; (-) strand; PAM type: YTN; PAM sequence: TTT
agacctgttgagatcagcaa

SEQ ID NO: 66416 - DNA, 20 bp, Artificial Sequence
  Description of Artificial Sequence: Synthetic oligonucleotide
  Target: SCN9A; (-) strand; PAM type: YTN; PAM sequence: CTT
tagacctgttgagatcagca

SEQ ID NO: 66417 - DNA, 20 bp, Artificial Sequence
  Description of Artificial Sequence: Synthetic oligonucleotide
  Target: SCN9A; (-) strand; PAM type: YTN; PAM sequence: CTA
acactttagacctgttgaga

SEQ ID NO: 66418 - DNA, 20 bp, Artificial Sequence
  Description of Artificial Sequence: Synthetic oligonucleotide
  Target: SCN9A; (-) strand; PAM type: YTN; PAM sequence: TTC
taacactttagacctgttga

SEQ ID NO: 66419 - DNA, 20 bp, Artificial Sequence
  Description of Artificial Sequence: Synthetic oligonucleotide
  Target: SCN9A; (-) strand; PAM type: YTN; PAM sequence: CTG
aaagagaaagttctaacact

SEQ ID NO: 66420 - DNA, 20 bp, Artificial Sequence
  Description of Artificial Sequence: Synthetic oligonucleotide
  Target: SCN9A; (-) strand; PAM type: YTN; PAM sequence: TTC
gatctgaaagagaaagttct

SEQ ID NO: 66421 - DNA, 20 bp, Artificial Sequence
  Description of Artificial Sequence: Synthetic oligonucleotide
  Target: SCN9A; (-) strand; PAM type: YTN; PAM sequence: TTT
cgatctgaaagagaaagttc

SEQ ID NO: 66422 - DNA, 20 bp, Artificial Sequence
  Description of Artificial Sequence: Synthetic oligonucleotide
  Target: SCN9A; (-) strand; PAM type: YTN; PAM sequence: TTA
atagtgtttcgatctgaaag

SEQ ID NO: 66423 - DNA, 20 bp, Artificial Sequence
  Description of Artificial Sequence: Synthetic oligonucleotide
  Target: SCN9A; (-) strand; PAM type: YTN; PAM sequence: TTA
tccaacagggttaatagtgt

SEQ ID NO: 66424 - DNA, 20 bp, Artificial Sequence
  Description of Artificial Sequence: Synthetic oligonucleotide
  Target: SCN9A; (-) strand; PAM type: YTN; PAM sequence: TTT
atccaacagggttaatagtg

SEQ ID NO: 66425 - DNA, 20 bp, Artificial Sequence
  Description of Artificial Sequence: Synthetic oligonucleotide
  Target: SCN9A; (-) strand; PAM type: YTN; PAM sequence: TTT
tatccaacagggttaatagt

SEQ ID NO: 66426 - DNA, 20 bp, Artificial Sequence
  Description of Artificial Sequence: Synthetic oligonucleotide
  Target: SCN9A; (-) strand; PAM type: YTN; PAM sequence: TTC
attttatccaacagggttaa

SEQ ID NO: 66427 - DNA, 20 bp, Artificial Sequence
  Description of Artificial Sequence: Synthetic oligonucleotide
  Target: SCN9A; (-) strand; PAM type: YTN; PAM sequence: TTT
cattttatccaacagggtta

SEQ ID NO: 66428 - DNA, 20 bp, Artificial Sequence
  Description of Artificial Sequence: Synthetic oligonucleotide
  Target: SCN9A; (-) strand; PAM type: YTN; PAM sequence: CTT
tcattttatccaacagggtt

SEQ ID NO: 66429 - DNA, 20 bp, Artificial Sequence
  Description of Artificial Sequence: Synthetic oligonucleotide
  Target: SCN9A; (-) strand; PAM type: YTN; PAM sequence: TTG
actttcattttatccaacag

SEQ ID NO: 66430 - DNA, 20 bp, Artificial Sequence
  Description of Artificial Sequence: Synthetic oligonucleotide
  Target: SCN9A; (-) strand; PAM type: YTN; PAM sequence: TTT
gactttcattttatccaaca

SEQ ID NO: 66431 - DNA, 20 bp, Artificial Sequence
  Description of Artificial Sequence: Synthetic oligonucleotide
  Target: SCN9A; (-) strand; PAM type: YTN; PAM sequence: CTT
tgactttcattttatccaac

SEQ ID NO: 66432 - DNA, 20 bp, Artificial Sequence
  Description of Artificial Sequence: Synthetic oligonucleotide
  Target: SCN9A; (-) strand; PAM type: YTN; PAM sequence: TTA
accacgaaggatacaggtct

SEQ ID NO: 66433 - DNA, 20 bp, Artificial Sequence
  Description of Artificial Sequence: Synthetic oligonucleotide
  Target: SCN9A; (-) strand; PAM type: YTN; PAM sequence: CTG
tagacaggtaataaatataa

SEQ ID NO: 66434 - DNA, 20 bp, Artificial Sequence
  Description of Artificial Sequence: Synthetic oligonucleotide
  Target: SCN9A; (-) strand; PAM type: YTN; PAM sequence: TTC
atgactgtagacaggtaata

SEQ ID NO: 66435 - DNA, 20 bp, Artificial Sequence
  Description of Artificial Sequence: Synthetic oligonucleotide
  Target: SCN9A; (-) strand; PAM type: YTN; PAM sequence: CTG
aatggcacaagttcatgact

SEQ ID NO: 66436 - DNA, 20 bp, Artificial Sequence
  Description of Artificial Sequence: Synthetic oligonucleotide
  Target: SCN9A; (-) strand; PAM type: YTN; PAM sequence: TTG
aaagcagaacgtagaataag

SEQ ID NO: 66437 - DNA, 20 bp, Artificial Sequence
  Description of Artificial Sequence: Synthetic oligonucleotide
  Target: SCN9A; (-) strand; PAM type: YTN; PAM sequence: TTA
gagtattgaaagcagaacgt

SEQ ID NO: 66438 - DNA, 20 bp, Artificial Sequence
  Description of Artificial Sequence: Synthetic oligonucleotide
  Target: SCN9A; (-) strand; PAM type: YTN; PAM sequence: TTT
agagtattgaaagcagaacg

SEQ ID NO: 66439 - DNA, 20 bp, Artificial Sequence
  Description of Artificial Sequence: Synthetic oligonucleotide
  Target: SCN9A; (-) strand; PAM type: YTN; PAM sequence: TTT
tagagtattgaaagcagaac

SEQ ID NO: 66440 - DNA, 20 bp, Artificial Sequence
  Description of Artificial Sequence: Synthetic oligonucleotide
  Target: SCN9A; (-) strand; PAM type: YTN; PAM sequence: CTA
aggataattttagagtattg

SEQ ID NO: 66441 - DNA, 20 bp, Artificial Sequence
  Description of Artificial Sequence: Synthetic oligonucleotide
  Target: SCN9A; (-) strand; PAM type: YTN; PAM sequence: CTG
ctaaggataattttagagta

SEQ ID NO: 66442 - DNA, 20 bp, Artificial Sequence
  Description of Artificial Sequence: Synthetic oligonucleotide
  Target: SCN9A; (-) strand; PAM type: YTN; PAM sequence: TTC
ccaaaactgctaaggataat

SEQ ID NO: 66443 - DNA, 20 bp, Artificial Sequence
  Description of Artificial Sequence: Synthetic oligonucleotide
  Target: SCN9A; (-) strand; PAM type: YTN; PAM sequence: TTT
cccaaaactgctaaggataa

SEQ ID NO: 66444 - DNA, 20 bp, Artificial Sequence
  Description of Artificial Sequence: Synthetic oligonucleotide
  Target: SCN9A; (-) strand; PAM type: YTN; PAM sequence: TTG
ataccaacagtttcccaaaa

SEQ ID NO: 66445 - DNA, 20 bp, Artificial Sequence
  Description of Artificial Sequence: Synthetic oligonucleotide
  Target: SCN9A; (-) strand; PAM type: YTN; PAM sequence: TTC
aatattgataccaacagttt

SEQ ID NO: 66446 - DNA, 20 bp, Artificial Sequence
  Description of Artificial Sequence: Synthetic oligonucleotide
  Target: SCN9A; (-) strand; PAM type: YTN; PAM sequence: CTT
caatattgataccaacagtt

SEQ ID NO: 66447 - DNA, 20 bp, Artificial Sequence
  Description of Artificial Sequence: Synthetic oligonucleotide
  Target: SCN9A; (-) strand; PAM type: YTN; PAM sequence: TTC
ttcaatattgataccaacag

SEQ ID NO: 66448 - DNA, 20 bp, Artificial Sequence
  Description of Artificial Sequence: Synthetic oligonucleotide
  Target: SCN9A; (-) strand; PAM type: YTN; PAM sequence: TTT
cttcaatattgataccaaca

SEQ ID NO: 66449 - DNA, 20 bp, Artificial Sequence
  Description of Artificial Sequence: Synthetic oligonucleotide
  Target: SCN9A; (-) strand; PAM type: YTN; PAM sequence: TTT
tcttcaatattgataccaac

SEQ ID NO: 66450 - DNA, 20 bp, Artificial Sequence
  Description of Artificial Sequence: Synthetic oligonucleotide
  Target: SCN9A; (-) strand; PAM type: YTN; PAM sequence: CTT
ttcttcaatattgataccaa

SEQ ID NO: 66451 - DNA, 20 bp, Artificial Sequence
  Description of Artificial Sequence: Synthetic oligonucleotide
  Target: SCN9A; (-) strand; PAM type: YTN; PAM sequence: CTC
ttttcttcaatattgatacc

SEQ ID NO: 66452 - DNA, 20 bp, Artificial Sequence
  Description of Artificial Sequence: Synthetic oligonucleotide
  Target: SCN9A; (-) strand; PAM type: YTN; PAM sequence: TTG
tctcttttcttcaatattga

SEQ ID NO: 66453 - DNA, 20 bp, Artificial Sequence
  Description of Artificial Sequence: Synthetic oligonucleotide
  Target: SCN9A; (-) strand; PAM type: YTN; PAM sequence: CTT
gtctcttttcttcaatattg

SEQ ID NO: 66454 - DNA, 20 bp, Artificial Sequence
  Description of Artificial Sequence: Synthetic oligonucleotide
  Target: SCN9A; (-) strand; PAM type: YTN; PAM sequence: CTG
ccccaacttgtctcttttct

SEQ ID NO: 66455 - DNA, 20 bp, Artificial Sequence
  Description of Artificial Sequence: Synthetic oligonucleotide
  Target: SCN9A; (-) strand; PAM type: YTN; PAM sequence: TTC
tgccccaacttgtctctttt

SEQ ID NO: 66456 - DNA, 20 bp, Artificial Sequence
  Description of Artificial Sequence: Synthetic oligonucleotide
  Target: SCN9A; (-) strand; PAM type: YTN; PAM sequence: TTT
ctgccccaacttgtctcttt

SEQ ID NO: 66457 - DNA, 20 bp, Artificial Sequence
  Description of Artificial Sequence: Synthetic oligonucleotide
  Target: SCN9A; (-) strand; PAM type: YTN; PAM sequence: CTT
tctgccccaacttgtctctt

SEQ ID NO: 66458 - DNA, 20 bp, Artificial Sequence
  Description of Artificial Sequence: Synthetic oligonucleotide
  Target: SCN9A; (-) strand; PAM type: YTN; PAM sequence: TTC
agtctttctgccccaacttg

SEQ ID NO: 66459 - DNA, 20 bp, Artificial Sequence
  Description of Artificial Sequence: Synthetic oligonucleotide
  Target: SCN9A; (-) strand; PAM type: YTN; PAM sequence: TTA
gtaggtccattcagtctttc

SEQ ID NO: 66460 - DNA, 20 bp, Artificial Sequence
  Description of Artificial Sequence: Synthetic oligonucleotide
  Target: SCN9A; (-) strand; PAM type: YTN; PAM sequence: CTT
agtaggtccattcagtcttt

SEQ ID NO: 66461 - DNA, 20 bp, Artificial Sequence
  Description of Artificial Sequence: Synthetic oligonucleotide
  Target: SCN9A; (-) strand; PAM type: YTN; PAM sequence: TTG
catcttagtaggtccattca

SEQ ID NO: 66462 - DNA, 20 bp, Artificial Sequence
  Description of Artificial Sequence: Synthetic oligonucleotide
  Target: SCN9A; (-) strand; PAM type: YTN; PAM sequence: TTT
gcatcttagtaggtccattc

SEQ ID NO: 66463 - DNA, 20 bp, Artificial Sequence
  Description of Artificial Sequence: Synthetic oligonucleotide
  Target: SCN9A; (-) strand; PAM type: YTN; PAM sequence: TTT
tgcatcttagtaggtccatt

SEQ ID NO: 66464 - DNA, 20 bp, Artificial Sequence
  Description of Artificial Sequence: Synthetic oligonucleotide
  Target: SCN9A; (-) strand; PAM type: YTN; PAM sequence: TTT
ttgcatcttagtaggtccat

SEQ ID NO: 66465 - DNA, 20 bp, Artificial Sequence
  Description of Artificial Sequence: Synthetic oligonucleotide
  Target: SCN9A; (-) strand; PAM type: YTN; PAM sequence: CTT
tttgcatcttagtaggtcca

SEQ ID NO: 66466 - DNA, 20 bp, Artificial Sequence
  Description of Artificial Sequence: Synthetic oligonucleotide
  Target: SCN9A; (-) strand; PAM type: YTN; PAM sequence: TTC
tttttgcatcttagtaggtc

SEQ ID NO: 66467 - DNA, 20 bp, Artificial Sequence
  Description of Artificial Sequence: Synthetic oligonucleotide
  Target: SCN9A; (-) strand; PAM type: YTN; PAM sequence: CTT
ctttttgcatcttagtaggt

SEQ ID NO: 66468 - DNA, 20 bp, Artificial Sequence
  Description of Artificial Sequence: Synthetic oligonucleotide
  Target: SCN9A; (-) strand; PAM type: YTN; PAM sequence: CTG
ggaccttctttttgcatctt

SEQ ID NO: 66469 - DNA, 20 bp, Artificial Sequence
  Description of Artificial Sequence: Synthetic oligonucleotide
  Target: SCN9A; (-) strand; PAM type: YTN; PAM sequence: CTG
ctgggaccttctttttgcat

SEQ ID NO: 66470 - DNA, 20 bp, Artificial Sequence
  Description of Artificial Sequence: Synthetic oligonucleotide
  Target: SCN9A; (-) strand; PAM type: YTN; PAM sequence: CTG
ccaactgctgggaccttctt

SEQ ID NO: 66471 - DNA, 20 bp, Artificial Sequence
  Description of Artificial Sequence: Synthetic oligonucleotide
  Target: SCN9A; (-) strand; PAM type: YTN; PAM sequence: CTC
tgccaactgctgggaccttc

SEQ ID NO: 66472 - DNA, 20 bp, Artificial Sequence
  Description of Artificial Sequence: Synthetic oligonucleotide
  Target: SCN9A; (-) strand; PAM type: YTN; PAM sequence: TTC
agaacctctgccaactgctg

SEQ ID NO: 66473 - DNA, 20 bp, Artificial Sequence
  Description of Artificial Sequence: Synthetic oligonucleotide
  Target: SCN9A; (-) strand; PAM type: YTN; PAM sequence: TTT
cagaacctctgccaactgct

SEQ ID NO: 66474 - DNA, 20 bp, Artificial Sequence
  Description of Artificial Sequence: Synthetic oligonucleotide
  Target: SCN9A; (-) strand; PAM type: YTN; PAM sequence: TTG
aatttcagaacctctgccaa

SEQ ID NO: 66475 - DNA, 20 bp, Artificial Sequence
  Description of Artificial Sequence: Synthetic oligonucleotide
  Target: SCN9A; (-) strand; PAM type: YTN; PAM sequence: TTC
cattgaatttcagaacctct

SEQ ID NO: 66476 - DNA, 20 bp, Artificial Sequence
  Description of Artificial Sequence: Synthetic oligonucleotide
  Target: SCN9A; (-) strand; PAM type: YTN; PAM sequence: TTC
aattccattgaatttcagaa

SEQ ID NO: 66477 - DNA, 20 bp, Artificial Sequence
  Description of Artificial Sequence: Synthetic oligonucleotide
  Target: SCN9A; (-) strand; PAM type: YTN; PAM sequence: CTT
caattccattgaatttcaga

SEQ ID NO: 66478 - DNA, 20 bp, Artificial Sequence
  Description of Artificial Sequence: Synthetic oligonucleotide
  Target: SCN9A; (-) strand; PAM type: YTN; PAM sequence: CTG
cacttcaattccattgaatt

SEQ ID NO: 66479 - DNA, 20 bp, Artificial Sequence
  Description of Artificial Sequence: Synthetic oligonucleotide
  Target: SCN9A; (-) strand; PAM type: YTN; PAM sequence: CTC
tgcacttcaattccattgaa

SEQ ID NO: 66480 - DNA, 20 bp, Artificial Sequence
  Description of Artificial Sequence: Synthetic oligonucleotide
  Target: SCN9A; (-) strand; PAM type: YTN; PAM sequence: CTC
cctctgcacttcaattccat

SEQ ID NO: 66481 - DNA, 20 bp, Artificial Sequence
  Description of Artificial Sequence: Synthetic oligonucleotide
  Target: SCN9A; (-) strand; PAM type: YTN; PAM sequence: CTA
gaagcctccctctgcacttc

SEQ ID NO: 66482 - DNA, 20 bp, Artificial Sequence
  Description of Artificial Sequence: Synthetic oligonucleotide
  Target: SCN9A; (-) strand; PAM type: YTN; PAM sequence: CTG
agggctagaagcctccctct

SEQ ID NO: 66483 - DNA, 20 bp, Artificial Sequence
  Description of Artificial Sequence: Synthetic oligonucleotide
  Target: SCN9A; (-) strand; PAM type: YTN; PAM sequence: TTG
ggggtggagtggaggggagg

SEQ ID NO: 66484 - DNA, 20 bp, Artificial Sequence
  Description of Artificial Sequence: Synthetic oligonucleotide
  Target: SCN9A; (-) strand; PAM type: YTN; PAM sequence: TTT
gggggtggagtggaggggag

SEQ ID NO: 66485 - DNA, 20 bp, Artificial Sequence
  Description of Artificial Sequence: Synthetic oligonucleotide
  Target: SCN9A; (-) strand; PAM type: YTN; PAM sequence: CTC
cagaatttgggggtggagtg

SEQ ID NO: 66486 - DNA, 20 bp, Artificial Sequence
  Description of Artificial Sequence: Synthetic oligonucleotide
  Target: SCN9A; (-) strand; PAM type: YTN; PAM sequence: TTC
ctccagaatttgggggtgga

SEQ ID NO: 66487 - DNA, 20 bp, Artificial Sequence
  Description of Artificial Sequence: Synthetic oligonucleotide
  Target: SCN9A; (-) strand; PAM type: YTN; PAM sequence: CTG
attcctccagaatttggggg

SEQ ID NO: 66488 - DNA, 20 bp, Artificial Sequence
  Description of Artificial Sequence: Synthetic oligonucleotide
  Target: SCN9A; (-) strand; PAM type: YTN; PAM sequence: TTG
cctgattcctccagaatttg

SEQ ID NO: 66489 - DNA, 20 bp, Artificial Sequence
  Description of Artificial Sequence: Synthetic oligonucleotide
  Target: SCN9A; (-) strand; PAM type: YTN; PAM sequence: CTT
gcctgattcctccagaattt

SEQ ID NO: 66490 - DNA, 20 bp, Artificial Sequence
  Description of Artificial Sequence: Synthetic oligonucleotide
  Target: SCN9A; (-) strand; PAM type: YTN; PAM sequence: TTA
gatggcttgcctgattcctc

SEQ ID NO: 66491 - DNA, 20 bp, Artificial Sequence
  Description of Artificial Sequence: Synthetic oligonucleotide
  Target: SCN9A; (-) strand; PAM type: YTN; PAM sequence: TTT
agatggcttgcctgattcct

SEQ ID NO: 66492 - DNA, 20 bp, Artificial Sequence
  Description of Artificial Sequence: Synthetic oligonucleotide
  Target: SCN9A; (-) strand; PAM type: YTN; PAM sequence: TTC
ggtttagatggcttgcctga

SEQ ID NO: 66493 - DNA, 20 bp, Artificial Sequence
  Description of Artificial Sequence: Synthetic oligonucleotide
  Target: SCN9A; (-) strand; PAM type: YTN; PAM sequence: TTT
cggtttagatggcttgcctg

SEQ ID NO: 66494 - DNA, 20 bp, Artificial Sequence
  Description of Artificial Sequence: Synthetic oligonucleotide
  Target: SCN9A; (-) strand; PAM type: YTN; PAM sequence: TTG
ccatagtttcggtttagatg

SEQ ID NO: 66495 - DNA, 20 bp, Artificial Sequence
  Description of Artificial Sequence: Synthetic oligonucleotide
  Target: SCN9A; (-) strand; PAM type: YTN; PAM sequence: CTG
agtcattgccatagtttcgg

SEQ ID NO: 66496 - DNA, 20 bp, Artificial Sequence
  Description of Artificial Sequence: Synthetic oligonucleotide
  Target: SCN9A; (-) strand; PAM type: YTN; PAM sequence: TTC
aaggactgagtcattgccat

SEQ ID NO: 66497 - DNA, 20 bp, Artificial Sequence
  Description of Artificial Sequence: Synthetic oligonucleotide
  Target: SCN9A; (-) strand; PAM type: YTN; PAM sequence: TTT
caaggactgagtcattgcca

SEQ ID NO: 66498 - DNA, 20 bp, Artificial Sequence
  Description of Artificial Sequence: Synthetic oligonucleotide
  Target: SCN9A; (-) strand; PAM type: YTN; PAM sequence: TTG
tatttcaaggactgagtcat

SEQ ID NO: 66499 - DNA, 20 bp, Artificial Sequence
  Description of Artificial Sequence: Synthetic oligonucleotide
  Target: SCN9A; (-) strand; PAM type: YTN; PAM sequence: TTT
gtatttcaaggactgagtca

SEQ ID NO: 66500 - DNA, 20 bp, Artificial Sequence
  Description of Artificial Sequence: Synthetic oligonucleotide
  Target: SCN9A; (-) strand; PAM type: YTN; PAM sequence: CTT
tgtatttcaaggactgagtc

SEQ ID NO: 66501 - DNA, 20 bp, Artificial Sequence
  Description of Artificial Sequence: Synthetic oligonucleotide
  Target: SCN9A; (-) strand; PAM type: YTN; PAM sequence: TTG
tctttgtatttcaaggactg

SEQ ID NO: 66502 - DNA, 20 bp, Artificial Sequence
  Description of Artificial Sequence: Synthetic oligonucleotide
  Target: SCN9A; (-) strand; PAM type: YTN; PAM sequence: CTT
gtctttgtatttcaaggact

SEQ ID NO: 66503 - DNA, 20 bp, Artificial Sequence
  Description of Artificial Sequence: Synthetic oligonucleotide
  Target: SCN9A; (-) strand; PAM type: YTN; PAM sequence: TTC
cttgtctttgtatttcaagg

SEQ ID NO: 66504 - DNA, 20 bp, Artificial Sequence
  Description of Artificial Sequence: Synthetic oligonucleotide
  Target: SCN9A; (-) strand; PAM type: YTN; PAM sequence: CTT
ccttgtctttgtatttcaag

SEQ ID NO: 66505 - DNA, 20 bp, Artificial Sequence
  Description of Artificial Sequence: Synthetic oligonucleotide
  Target: SCN9A; (-) strand; PAM type: YTN; PAM sequence: CTA
agccccttccttgtctttgt

SEQ ID NO: 66506 - DNA, 20 bp, Artificial Sequence
  Description of Artificial Sequence: Synthetic oligonucleotide
  Target: SCN9A; (-) strand; PAM type: YTN; PAM sequence: TTG
tgactaagccccttccttgt

SEQ ID NO: 66507 - DNA, 20 bp, Artificial Sequence
  Description of Artificial Sequence: Synthetic oligonucleotide
  Target: SCN9A; (-) strand; PAM type: YTN; PAM sequence: CTT
gtgactaagccccttccttg

SEQ ID NO: 66508 - DNA, 20 bp, Artificial Sequence
  Description of Artificial Sequence: Synthetic oligonucleotide
  Target: SCN9A; (-) strand; PAM type: YTN; PAM sequence: TTC
cttgtgactaagccccttcc

SEQ ID NO: 66509 - DNA, 20 bp, Artificial Sequence
  Description of Artificial Sequence: Synthetic oligonucleotide
  Target: SCN9A; (-) strand; PAM type: YTN; PAM sequence: TTT
ccttgtgactaagccccttc

SEQ ID NO: 66510 - DNA, 20 bp, Artificial Sequence
  Description of Artificial Sequence: Synthetic oligonucleotide
  Target: SCN9A; (-) strand; PAM type: YTN; PAM sequence: TTT
tccttgtgactaagcccctt

SEQ ID NO: 66511 - DNA, 20 bp, Artificial Sequence
  Description of Artificial Sequence: Synthetic oligonucleotide
  Target: SCN9A; (-) strand; PAM type: YTN; PAM sequence: TTC
gttttccttgtgactaagcc

SEQ ID NO: 66512 - DNA, 20 bp, Artificial Sequence
  Description of Artificial Sequence: Synthetic oligonucleotide
  Target: SCN9A; (-) strand; PAM type: YTN; PAM sequence: CTT
cgttttccttgtgactaagc

SEQ ID NO: 66513 - DNA, 20 bp, Artificial Sequence
  Description of Artificial Sequence: Synthetic oligonucleotide
  Target: SCN9A; (-) strand; PAM type: YTN; PAM sequence: CTA
gaaacaggcttcgttttcct

SEQ ID NO: 66514 - DNA, 20 bp, Artificial Sequence
  Description of Artificial Sequence: Synthetic oligonucleotide
  Target: SCN9A; (-) strand; PAM type: YTN; PAM sequence: TTC
tagaaacaggcttcgttttc

SEQ ID NO: 66515 - DNA, 20 bp, Artificial Sequence
  Description of Artificial Sequence: Synthetic oligonucleotide
  Target: SCN9A; (-) strand; PAM type: YTN; PAM sequence: CTG
tacaccagttctagaaacag

SEQ ID NO: 66516 - DNA, 20 bp, Artificial Sequence
  Description of Artificial Sequence: Synthetic oligonucleotide
  Target: SCN9A; (-) strand; PAM type: YTN; PAM sequence: CTG
accctgtacaccagttctag

SEQ ID NO: 66517 - DNA, 20 bp, Artificial Sequence
  Description of Artificial Sequence: Synthetic oligonucleotide
  Target: SCN9A; (-) strand; PAM type: YTN; PAM sequence: CTC
tgaccctgtacaccagttct

SEQ ID NO: 66518 - DNA, 20 bp, Artificial Sequence
  Description of Artificial Sequence: Synthetic oligonucleotide
  Target: SCN9A; (-) strand; PAM type: YTN; PAM sequence: CTG
ctctgaccctgtacaccagt

SEQ ID NO: 66519 - DNA, 20 bp, Artificial Sequence
  Description of Artificial Sequence: Synthetic oligonucleotide
  Target: SCN9A; (-) strand; PAM type: YTN; PAM sequence: CTC
tgctctgaccctgtacacca

SEQ ID NO: 66520 - DNA, 20 bp, Artificial Sequence
  Description of Artificial Sequence: Synthetic oligonucleotide
  Target: SCN9A; (-) strand; PAM type: YTN; PAM sequence: CTG
cggctctgctctgaccctgt

SEQ ID NO: 66521 - DNA, 20 bp, Artificial Sequence
  Description of Artificial Sequence: Synthetic oligonucleotide
  Target: SCN9A; (-) strand; PAM type: YTN; PAM sequence: TTC
ctgcggctctgctctgaccc

SEQ ID NO: 66522 - DNA, 20 bp, Artificial Sequence
  Description of Artificial Sequence: Synthetic oligonucleotide
  Target: SCN9A; (-) strand; PAM type: YTN; PAM sequence: CTT
cctgcggctctgctctgacc

SEQ ID NO: 66523 - DNA, 20 bp, Artificial Sequence
  Description of Artificial Sequence: Synthetic oligonucleotide
  Target: SCN9A; (-) strand; PAM type: YTN; PAM sequence: CTC
atcatcaagacttcctgcgg

SEQ ID NO: 66524 - DNA, 20 bp, Artificial Sequence
  Description of Artificial Sequence: Synthetic oligonucleotide
  Target: SCN9A; (-) strand; PAM type: YTN; PAM sequence: TTC
tcatcatcaagacttcctgc

SEQ ID NO: 66525 - DNA, 20 bp, Artificial Sequence
  Description of Artificial Sequence: Synthetic oligonucleotide
  Target: SCN9A; (-) strand; PAM type: YTN; PAM sequence: CTG
ggaccagtcagagagaggtt

SEQ ID NO: 66526 - DNA, 20 bp, Artificial Sequence
  Description of Artificial Sequence: Synthetic oligonucleotide
  Target: SCN9A; (-) strand; PAM type: YTN; PAM sequence: CTC
tgggaccagtcagagagagg

SEQ ID NO: 66527 - DNA, 20 bp, Artificial Sequence
  Description of Artificial Sequence: Synthetic oligonucleotide
  Target: SCN9A; (-) strand; PAM type: YTN; PAM sequence: CTG
ctctgggaccagtcagagag

SEQ ID NO: 66528 - DNA, 20 bp, Artificial Sequence
  Description of Artificial Sequence: Synthetic oligonucleotide
  Target: SCN9A; (-) strand; PAM type: YTN; PAM sequence: TTC
ctgctctgggaccagtcaga

SEQ ID NO: 66529 - DNA, 20 bp, Artificial Sequence
  Description of Artificial Sequence: Synthetic oligonucleotide
  Target: SCN9A; (-) strand; PAM type: YTN; PAM sequence: CTA
attcctgctctgggaccagt

SEQ ID NO: 66530 - DNA, 20 bp, Artificial Sequence
  Description of Artificial Sequence: Synthetic oligonucleotide
  Target: SCN9A; (-) strand; PAM type: YTN; PAM sequence: TTC
taattcctgctctgggacca

SEQ ID NO: 66531 - DNA, 20 bp, Artificial Sequence
  Description of Artificial Sequence: Synthetic oligonucleotide
  Target: SCN9A; (-) strand; PAM type: YTN; PAM sequence: CTG
aattctaattcctgctctgg

SEQ ID NO: 66532 - DNA, 20 bp, Artificial Sequence
  Description of Artificial Sequence: Synthetic oligonucleotide
  Target: SCN9A; (-) strand; PAM type: YTN; PAM sequence: CTG
tgggctgaattctaattcct

SEQ ID NO: 66533 - DNA, 20 bp, Artificial Sequence
  Description of Artificial Sequence: Synthetic oligonucleotide
  Target: SCN9A; (-) strand; PAM type: YTN; PAM sequence: CTA
gaacccctgtgggctgaatt

SEQ ID NO: 66534 - DNA, 20 bp, Artificial Sequence
  Description of Artificial Sequence: Synthetic oligonucleotide
  Target: SCN9A; (-) strand; PAM type: YTN; PAM sequence: CTG
gaagctagaacccctgtggg

SEQ ID NO: 66535 - DNA, 20 bp, Artificial Sequence
  Description of Artificial Sequence: Synthetic oligonucleotide
  Target: SCN9A; (-) strand; PAM type: YTN; PAM sequence: TTC
tggaagctagaacccctgtg

SEQ ID NO: 66536 - DNA, 20 bp, Artificial Sequence
  Description of Artificial Sequence: Synthetic oligonucleotide
  Target: SCN9A; (-) strand; PAM type: YTN; PAM sequence: TTG
gttctggaagctagaacccc

SEQ ID NO: 66537 - DNA, 20 bp, Artificial Sequence
  Description of Artificial Sequence: Synthetic oligonucleotide
  Target: SCN9A; (-) strand; PAM type: YTN; PAM sequence: CTA
catccacaaaattggttctg

SEQ ID NO: 66538 - DNA, 20 bp, Artificial Sequence
  Description of Artificial Sequence: Synthetic oligonucleotide
  Target: SCN9A; (-) strand; PAM type: YTN; PAM sequence: CTC
ctacatccacaaaattggtt

SEQ ID NO: 66539 - DNA, 20 bp, Artificial Sequence
  Description of Artificial Sequence: Synthetic oligonucleotide
  Target: SCN9A; (-) strand; PAM type: YTN; PAM sequence: TTG
ctcctacatccacaaaattg

SEQ ID NO: 66540 - DNA, 20 bp, Artificial Sequence
  Description of Artificial Sequence: Synthetic oligonucleotide
  Target: SCN9A; (-) strand; PAM type: YTN; PAM sequence: CTT
gctcctacatccacaaaatt

SEQ ID NO: 66541 - DNA, 20 bp, Artificial Sequence
  Description of Artificial Sequence: Synthetic oligonucleotide
  Target: SCN9A; (-) strand; PAM type: YTN; PAM sequence: CTC
cttgctcctacatccacaaa

SEQ ID NO: 66542 - DNA, 20 bp, Artificial Sequence
  Description of Artificial Sequence: Synthetic oligonucleotide
  Target: SCN9A; (-) strand; PAM type: YTN; PAM sequence: TTG
cctccttgctcctacatcca

SEQ ID NO: 66543 - DNA, 20 bp, Artificial Sequence
  Description of Artificial Sequence: Synthetic oligonucleotide
  Target: SCN9A; (-) strand; PAM type: YTN; PAM sequence: CTT
gcctccttgctcctacatcc

SEQ ID NO: 66544 - DNA, 20 bp, Artificial Sequence
  Description of Artificial Sequence: Synthetic oligonucleotide
  Target: SCN9A; (-) strand; PAM type: YTN; PAM sequence: TTC
ttgcctccttgctcctacat

SEQ ID NO: 66545 - DNA, 20 bp, Artificial Sequence
  Description of Artificial Sequence: Synthetic oligonucleotide
  Target: SCN9A; (-) strand; PAM type: YTN; PAM sequence: CTC
acataaggtcattcttgcct

SEQ ID NO: 66546 - DNA, 20 bp, Artificial Sequence
  Description of Artificial Sequence: Synthetic oligonucleotide
  Target: SCN9A; (-) strand; PAM type: YTN; PAM sequence: CTA
aatcagatagagctcacata

SEQ ID NO: 66547 - DNA, 20 bp, Artificial Sequence
  Description of Artificial Sequence: Synthetic oligonucleotide
  Target: SCN9A; (-) strand; PAM type: YTN; PAM sequence: TTA
agtcctaaatcagatagagc

SEQ ID NO: 66548 - DNA, 20 bp, Artificial Sequence
  Description of Artificial Sequence: Synthetic oligonucleotide
  Target: SCN9A; (-) strand; PAM type: YTN; PAM sequence: TTA
gtaacagtaaagcgttaagt

SEQ ID NO: 66549 - DNA, 20 bp, Artificial Sequence
  Description of Artificial Sequence: Synthetic oligonucleotide
  Target: SCN9A; (-) strand; PAM type: YTN; PAM sequence: TTT
agtaacagtaaagcgttaag

SEQ ID NO: 66550 - DNA, 20 bp, Artificial Sequence
  Description of Artificial Sequence: Synthetic oligonucleotide
  Target: SCN9A; (-) strand; PAM type: YTN; PAM sequence: CTG
aatttagtaacagtaaagcg

SEQ ID NO: 66551 - DNA, 20 bp, Artificial Sequence
  Description of Artificial Sequence: Synthetic oligonucleotide
  Target: SCN9A; (-) strand; PAM type: YTN; PAM sequence: CTC
agaaagaagagtatacacaa

SEQ ID NO: 66552 - DNA, 20 bp, Artificial Sequence
  Description of Artificial Sequence: Synthetic oligonucleotide
  Target: SCN9A; (-) strand; PAM type: YTN; PAM sequence: CTC
ctcagaaagaagagtataca

SEQ ID NO: 66553 - DNA, 20 bp, Artificial Sequence
  Description of Artificial Sequence: Synthetic oligonucleotide
  Target: SCN9A; (-) strand; PAM type: YTN; PAM sequence: TTG
tggctcctcagaaagaagag

SEQ ID NO: 66554 - DNA, 20 bp, Artificial Sequence
  Description of Artificial Sequence: Synthetic oligonucleotide
  Target: SCN9A; (-) strand; PAM type: YTN; PAM sequence: CTG
tgttgtggctcctcagaaag

SEQ ID NO: 66555 - DNA, 20 bp, Artificial Sequence
  Description of Artificial Sequence: Synthetic oligonucleotide
  Target: SCN9A; (-) strand; PAM type: YTN; PAM sequence: TTC
actgtgttgtggctcctcag

SEQ ID NO: 66556 - DNA, 20 bp, Artificial Sequence
  Description of Artificial Sequence: Synthetic oligonucleotide
  Target: SCN9A; (-) strand; PAM type: YTN; PAM sequence: TTT
cactgtgttgtggctcctca

SEQ ID NO: 66557 - DNA, 20 bp, Artificial Sequence
  Description of Artificial Sequence: Synthetic oligonucleotide
  Target: SCN9A; (-) strand; PAM type: YTN; PAM sequence: TTT
tcactgtgttgtggctcctc

SEQ ID NO: 66558 - DNA, 20 bp, Artificial Sequence
  Description of Artificial Sequence: Synthetic oligonucleotide
  Target: SCN9A; (-) strand; PAM type: YTN; PAM sequence: CTT
ttcactgtgttgtggctcct

SEQ ID NO: 66559 - DNA, 20 bp, Artificial Sequence
  Description of Artificial Sequence: Synthetic oligonucleotide
  Target: SCN9A; (-) strand; PAM type: YTN; PAM sequence: CTA
aaatcaaagtcaccatatct

SEQ ID NO: 66560 - DNA, 20 bp, Artificial Sequence
  Description of Artificial Sequence: Synthetic oligonucleotide
  Target: SCN9A; (-) strand; PAM type: YTN; PAM sequence: TTG
acatctaaaatcaaagtcac

SEQ ID NO: 66561 - DNA, 20 bp, Artificial Sequence
  Description of Artificial Sequence: Synthetic oligonucleotide
  Target: SCN9A; (-) strand; PAM type: YTN; PAM sequence: CTG
aattgacatctaaaatcaaa

SEQ ID NO: 66562 - DNA, 20 bp, Artificial Sequence
  Description of Artificial Sequence: Synthetic oligonucleotide
  Target: SCN9A; (-) strand; PAM type: YTN; PAM sequence: CTA
tcactgaattgacatctaaa

SEQ ID NO: 66563 - DNA, 20 bp, Artificial Sequence
  Description of Artificial Sequence: Synthetic oligonucleotide
  Target: SCN9A; (-) strand; PAM type: YTN; PAM sequence: CTA
gtaaatgacagagctatcac

SEQ ID NO: 66564 - DNA, 20 bp, Artificial Sequence
  Description of Artificial Sequence: Synthetic oligonucleotide
  Target: SCN9A; (-) strand; PAM type: YTN; PAM sequence: TTA
atgtcccaaagctagtaaat

SEQ ID NO: 66565 - DNA, 20 bp, Artificial Sequence
  Description of Artificial Sequence: Synthetic oligonucleotide
  Target: SCN9A; (-) strand; PAM type: YTN; PAM sequence: CTT
aatgtcccaaagctagtaaa

SEQ ID NO: 66566 - DNA, 20 bp, Artificial Sequence
  Description of Artificial Sequence: Synthetic oligonucleotide
  Target: SCN9A; (-) strand; PAM type: YTN; PAM sequence: TTG
cttaatgtcccaaagctagt

SEQ ID NO: 66567 - DNA, 20 bp, Artificial Sequence
  Description of Artificial Sequence: Synthetic oligonucleotide
  Target: SCN9A; (-) strand; PAM type: YTN; PAM sequence: TTA
aaagttgcttaatgtcccaa

SEQ ID NO: 66568 - DNA, 20 bp, Artificial Sequence
  Description of Artificial Sequence: Synthetic oligonucleotide
  Target: SCN9A; (-) strand; PAM type: YTN; PAM sequence: TTT
aaaagttgcttaatgtccca

SEQ ID NO: 66569 - DNA, 20 bp, Artificial Sequence
  Description of Artificial Sequence: Synthetic oligonucleotide
  Target: SCN9A; (-) strand; PAM type: YTN; PAM sequence: TTT
taaaagttgcttaatgtccc

SEQ ID NO: 66570 - DNA, 20 bp, Artificial Sequence
  Description of Artificial Sequence: Synthetic oligonucleotide
  Target: SCN9A; (-) strand; PAM type: YTN; PAM sequence: CTG
ggtacagttttaaaagttgc

SEQ ID NO: 66571 - DNA, 20 bp, Artificial Sequence
  Description of Artificial Sequence: Synthetic oligonucleotide
  Target: SCN9A; (-) strand; PAM type: YTN; PAM sequence: TTA
ccaatgatgaagctgggtac

SEQ ID NO: 66572 - DNA, 20 bp, Artificial Sequence
  Description of Artificial Sequence: Synthetic oligonucleotide
  Target: SCN9A; (-) strand; PAM type: YTN; PAM sequence: TTT
accaatgatgaagctgggta

SEQ ID NO: 66573 - DNA, 20 bp, Artificial Sequence
  Description of Artificial Sequence: Synthetic oligonucleotide
  Target: SCN9A; (-) strand; PAM type: YTN; PAM sequence: TTT
taccaatgatgaagctgggt

SEQ ID NO: 66574 - DNA, 20 bp, Artificial Sequence
  Description of Artificial Sequence: Synthetic oligonucleotide
  Target: SCN9A; (-) strand; PAM type: YTN; PAM sequence: TTA
ttttaccaatgatgaagctg

SEQ ID NO: 66575 - DNA, 20 bp, Artificial Sequence
  Description of Artificial Sequence: Synthetic oligonucleotide
  Target: SCN9A; (-) strand; PAM type: YTN; PAM sequence: CTT
attttaccaatgatgaagct

SEQ ID NO: 66576 - DNA, 20 bp, Artificial Sequence
  Description of Artificial Sequence: Synthetic oligonucleotide
  Target: SCN9A; (-) strand; PAM type: YTN; PAM sequence: TTG
cttattttaccaatgatgaa

SEQ ID NO: 66577 - DNA, 20 bp, Artificial Sequence
  Description of Artificial Sequence: Synthetic oligonucleotide
  Target: SCN9A; (-) strand; PAM type: YTN; PAM sequence: TTT
gcttattttaccaatgatga

SEQ ID NO: 66578 - DNA, 20 bp, Artificial Sequence
  Description of Artificial Sequence: Synthetic oligonucleotide
  Target: SCN9A; (-) strand; PAM type: YTN; PAM sequence: TTT
tgcttattttaccaatgatg

SEQ ID NO: 66579 - DNA, 20 bp, Artificial Sequence
  Description of Artificial Sequence: Synthetic oligonucleotide
  Target: SCN9A; (-) strand; PAM type: YTN; PAM sequence: TTA
tgatattttgcttattttac

SEQ ID NO: 66580 - DNA, 20 bp, Artificial Sequence
  Description of Artificial Sequence: Synthetic oligonucleotide
  Target: SCN9A; (-) strand; PAM type: YTN; PAM sequence: CTG
tgagattatgatattttgct

SEQ ID NO: 66581 - DNA, 20 bp, Artificial Sequence
  Description of Artificial Sequence: Synthetic oligonucleotide
  Target: SCN9A; (-) strand; PAM type: YTN; PAM sequence: TTC
aaacaaccctgtgagattat

SEQ ID NO: 66582 - DNA, 20 bp, Artificial Sequence
  Description of Artificial Sequence: Synthetic oligonucleotide
  Target: SCN9A; (-) strand; PAM type: YTN; PAM sequence: TTT
caaacaaccctgtgagatta

SEQ ID NO: 66583 - DNA, 20 bp, Artificial Sequence
  Description of Artificial Sequence: Synthetic oligonucleotide
  Target: SCN9A; (-) strand; PAM type: YTN; PAM sequence: TTT
tcaaacaaccctgtgagatt

SEQ ID NO: 66584 - DNA, 20 bp, Artificial Sequence
  Description of Artificial Sequence: Synthetic oligonucleotide
  Target: SCN9A; (-) strand; PAM type: YTN; PAM sequence: TTA
attttcaaacaaccctgtga

SEQ ID NO: 66585 - DNA, 20 bp, Artificial Sequence
  Description of Artificial Sequence: Synthetic oligonucleotide
  Target: SCN9A; (-) strand; PAM type: YTN; PAM sequence: TTT
aattttcaaacaaccctgtg

SEQ ID NO: 66586 - DNA, 20 bp, Artificial Sequence
  Description of Artificial Sequence: Synthetic oligonucleotide
  Target: SCN9A; (-) strand; PAM type: YTN; PAM sequence: CTC
atttaattttcaaacaaccc

SEQ ID NO: 66587 - DNA, 20 bp, Artificial Sequence
  Description of Artificial Sequence: Synthetic oligonucleotide
  Target: SCN9A; (-) strand; PAM type: YTN; PAM sequence: TTC
tcatttaattttcaaacaac

SEQ ID NO: 66588 - DNA, 20 bp, Artificial Sequence
  Description of Artificial Sequence: Synthetic oligonucleotide
  Target: SCN9A; (-) strand; PAM type: YTN; PAM sequence: TTT
ctcatttaattttcaaacaa

SEQ ID NO: 66589 - DNA, 20 bp, Artificial Sequence
  Description of Artificial Sequence: Synthetic oligonucleotide
  Target: SCN9A; (-) strand; PAM type: YTN; PAM sequence: TTT
tctcatttaattttcaaaca

SEQ ID NO: 66590 - DNA, 20 bp, Artificial Sequence
  Description of Artificial Sequence: Synthetic oligonucleotide
  Target: SCN9A; (-) strand; PAM type: YTN; PAM sequence: TTA
gattttctcatttaattttc

SEQ ID NO: 66591 - DNA, 20 bp, Artificial Sequence
  Description of Artificial Sequence: Synthetic oligonucleotide
  Target: SCN9A; (-) strand; PAM type: YTN; PAM sequence: TTT
agattttctcatttaatttt

SEQ ID NO: 66592 - DNA, 20 bp, Artificial Sequence
  Description of Artificial Sequence: Synthetic oligonucleotide
  Target: SCN9A; (-) strand; PAM type: YTN; PAM sequence: TTT
tagattttctcatttaattt

SEQ ID NO: 66593 - DNA, 20 bp, Artificial Sequence
  Description of Artificial Sequence: Synthetic oligonucleotide
  Target: SCN9A; (-) strand; PAM type: YTN; PAM sequence: CTT
ttagattttctcatttaatt

SEQ ID NO: 66594 - DNA, 20 bp, Artificial Sequence
  Description of Artificial Sequence: Synthetic oligonucleotide
  Target: SCN9A; (-) strand; PAM type: YTN; PAM sequence: TTC
ttttagattttctcatttaa

SEQ ID NO: 66595 - DNA, 20 bp, Artificial Sequence
  Description of Artificial Sequence: Synthetic oligonucleotide
  Target: SCN9A; (-) strand; PAM type: YTN; PAM sequence: CTT
cttttagattttctcattta

SEQ ID NO: 66596 - DNA, 20 bp, Artificial Sequence
  Description of Artificial Sequence: Synthetic oligonucleotide
  Target: SCN9A; (-) strand; PAM type: YTN; PAM sequence: TTC
agaatcttcttttagatttt

SEQ ID NO: 66597 - DNA, 20 bp, Artificial Sequence
  Description of Artificial Sequence: Synthetic oligonucleotide
  Target: SCN9A; (-) strand; PAM type: YTN; PAM sequence: TTT
cagaatcttcttttagattt

SEQ ID NO: 66598 - DNA, 20 bp, Artificial Sequence
  Description of Artificial Sequence: Synthetic oligonucleotide
  Target: SCN9A; (-) strand; PAM type: YTN; PAM sequence: TTG
tgtttcagaatcttctttta

SEQ ID NO: 66599 - DNA, 20 bp, Artificial Sequence
  Description of Artificial Sequence: Synthetic oligonucleotide
  Target: SCN9A; (-) strand; PAM type: YTN; PAM sequence: TTA
ttgtgtttcagaatcttctt

SEQ ID NO: 66600 - DNA, 20 bp, Artificial Sequence
  Description of Artificial Sequence: Synthetic oligonucleotide
  Target: SCN9A; (-) strand; PAM type: YTN; PAM sequence: CTT
attgtgtttcagaatcttct

SEQ ID NO: 66601 - DNA, 20 bp, Artificial Sequence
  Description of Artificial Sequence: Synthetic oligonucleotide
  Target: SCN9A; (-) strand; PAM type: YTN; PAM sequence: TTA
tacttattgtgtttcagaat

SEQ ID NO: 66602 - DNA, 20 bp, Artificial Sequence
  Description of Artificial Sequence: Synthetic oligonucleotide
  Target: SCN9A; (-) strand; PAM type: YTN; PAM sequence: CTT
atacttattgtgtttcagaa

SEQ ID NO: 66603 - DNA, 20 bp, Artificial Sequence
  Description of Artificial Sequence: Synthetic oligonucleotide
  Target: SCN9A; (-) strand; PAM type: YTN; PAM sequence: TTA
gcttatacttattgtgtttc

SEQ ID NO: 66604 - DNA, 20 bp, Artificial Sequence
  Description of Artificial Sequence: Synthetic oligonucleotide
  Target: SCN9A; (-) strand; PAM type: YTN; PAM sequence: TTT
agcttatacttattgtgttt

SEQ ID NO: 66605 - DNA, 20 bp, Artificial Sequence
  Description of Artificial Sequence: Synthetic oligonucleotide
  Target: SCN9A; (-) strand; PAM type: YTN; PAM sequence: CTC
atttagcttatacttattgt

SEQ ID NO: 66606 - DNA, 20 bp, Artificial Sequence
  Description of Artificial Sequence: Synthetic oligonucleotide
  Target: SCN9A; (-) strand; PAM type: YTN; PAM sequence: CTC
tcatttagcttatacttatt

SEQ ID NO: 66607 - DNA, 20 bp, Artificial Sequence
  Description of Artificial Sequence: Synthetic oligonucleotide
  Target: SCN9A; (-) strand; PAM type: YTN; PAM sequence: TTA
aaaagaagtaatagctctca

SEQ ID NO: 66608 - DNA, 20 bp, Artificial Sequence
  Description of Artificial Sequence: Synthetic oligonucleotide
  Target: SCN9A; (-) strand; PAM type: YTN; PAM sequence: CTA
aaataaaagttaaaaagaag

SEQ ID NO: 66609 - DNA, 20 bp, Artificial Sequence
  Description of Artificial Sequence: Synthetic oligonucleotide
  Target: SCN9A; (-) strand; PAM type: YTN; PAM sequence: CTC
aaacctaaaataaaagttaa

SEQ ID NO: 66610 - DNA, 20 bp, Artificial Sequence
  Description of Artificial Sequence: Synthetic oligonucleotide
  Target: SCN9A; (-) strand; PAM type: YTN; PAM sequence: TTC
acatgtaccctcaaacctaa

SEQ ID NO: 66611 - DNA, 20 bp, Artificial Sequence
  Description of Artificial Sequence: Synthetic oligonucleotide
  Target: SCN9A; (-) strand; PAM type: YTN; PAM sequence: CTT
cacatgtaccctcaaaccta

SEQ ID NO: 66612 - DNA, 20 bp, Artificial Sequence
  Description of Artificial Sequence: Synthetic oligonucleotide
  Target: SCN9A; (-) strand; PAM type: YTN; PAM sequence: CTA
tgtaacaaaccttcacatgt

SEQ ID NO: 66613 - DNA, 20 bp, Artificial Sequence
  Description of Artificial Sequence: Synthetic oligonucleotide
  Target: SCN9A; (-) strand; PAM type: YTN; PAM sequence: TTA
cctatgtaacaaaccttcac

SEQ ID NO: 66614 - DNA, 20 bp, Artificial Sequence
  Description of Artificial Sequence: Synthetic oligonucleotide
  Target: SCN9A; (-) strand; PAM type: YTN; PAM sequence: TTT
acctatgtaacaaaccttca

SEQ ID NO: 66615 - DNA, 20 bp, Artificial Sequence
  Description of Artificial Sequence: Synthetic oligonucleotide
  Target: SCN9A; (-) strand; PAM type: YTN; PAM sequence: TTA
aaagtatagcaaacccccat

SEQ ID NO: 66616 - DNA, 20 bp, Artificial Sequence
  Description of Artificial Sequence: Synthetic oligonucleotide
  Target: SCN9A; (-) strand; PAM type: YTN; PAM sequence: TTT
aaaagtatagcaaaccccca

SEQ ID NO: 66617 - DNA, 20 bp, Artificial Sequence
  Description of Artificial Sequence: Synthetic oligonucleotide
  Target: SCN9A; (-) strand; PAM type: YTN; PAM sequence: TTT
taaaagtatagcaaaccccc

SEQ ID NO: 66618 - DNA, 20 bp, Artificial Sequence
  Description of Artificial Sequence: Synthetic oligonucleotide
  Target: SCN9A; (-) strand; PAM type: YTN; PAM sequence: TTT
ttaaaagtatagcaaacccc

SEQ ID NO: 66619 - DNA, 20 bp, Artificial Sequence
  Description of Artificial Sequence: Synthetic oligonucleotide
  Target: SCN9A; (-) strand; PAM type: YTN; PAM sequence: TTT
tttaaaagtatagcaaaccc

SEQ ID NO: 66620 - DNA, 20 bp, Artificial Sequence
  Description of Artificial Sequence: Synthetic oligonucleotide
  Target: SCN9A; (-) strand; PAM type: YTN; PAM sequence: CTA
gattttttaaaagtatagca

SEQ ID NO: 66621 - DNA, 20 bp, Artificial Sequence
  Description of Artificial Sequence: Synthetic oligonucleotide
  Target: SCN9A; (-) strand; PAM type: YTN; PAM sequence: TTA
aactagattttttaaaagta

SEQ ID NO: 66622 - DNA, 20 bp, Artificial Sequence
  Description of Artificial Sequence: Synthetic oligonucleotide
  Target: SCN9A; (-) strand; PAM type: YTN; PAM sequence: TTG
ccaattaaactagatttttt

SEQ ID NO: 66623 - DNA, 20 bp, Artificial Sequence
  Description of Artificial Sequence: Synthetic oligonucleotide
  Target: SCN9A; (-) strand; PAM type: YTN; PAM sequence: TTA
gacaggttgccaattaaact

SEQ ID NO: 66624 - DNA, 20 bp, Artificial Sequence
  Description of Artificial Sequence: Synthetic oligonucleotide
  Target: SCN9A; (-) strand; PAM type: YTN; PAM sequence: CTT
agacaggttgccaattaaac

SEQ ID NO: 66625 - DNA, 20 bp, Artificial Sequence
  Description of Artificial Sequence: Synthetic oligonucleotide
  Target: SCN9A; (-) strand; PAM type: YTN; PAM sequence: TTG
tacttagacaggttgccaat

SEQ ID NO: 66626 - DNA, 20 bp, Artificial Sequence
  Description of Artificial Sequence: Synthetic oligonucleotide
  Target: SCN9A; (-) strand; PAM type: YTN; PAM sequence: TTT
gtacttagacaggttgccaa

SEQ ID NO: 66627 - DNA, 20 bp, Artificial Sequence
  Description of Artificial Sequence: Synthetic oligonucleotide
  Target: SCN9A; (-) strand; PAM type: YTN; PAM sequence: CTG
gtgtttgtacttagacaggt

SEQ ID NO: 66628 - DNA, 20 bp, Artificial Sequence
  Description of Artificial Sequence: Synthetic oligonucleotide
  Target: SCN9A; (-) strand; PAM type: YTN; PAM sequence: TTC
aagaagctggtgtttgtact

SEQ ID NO: 66629 - DNA, 20 bp, Artificial Sequence
  Description of Artificial Sequence: Synthetic oligonucleotide
  Target: SCN9A; (-) strand; PAM type: YTN; PAM sequence: TTT
caagaagctggtgtttgtac

SEQ ID NO: 66630 - DNA, 20 bp, Artificial Sequence
  Description of Artificial Sequence: Synthetic oligonucleotide
  Target: SCN9A; (-) strand; PAM type: YTN; PAM sequence: TTA
aataaatcatatgaggaaga

SEQ ID NO: 66631 - DNA, 20 bp, Artificial Sequence
  Description of Artificial Sequence: Synthetic oligonucleotide
  Target: SCN9A; (-) strand; PAM type: YTN; PAM sequence: TTT
aaataaatcatatgaggaag

SEQ ID NO: 66632 - DNA, 20 bp, Artificial Sequence
  Description of Artificial Sequence: Synthetic oligonucleotide
  Target: SCN9A; (-) strand; PAM type: YTN; PAM sequence: TTT
taaataaatcatatgaggaa

SEQ ID NO: 66633 - DNA, 20 bp, Artificial Sequence
  Description of Artificial Sequence: Synthetic oligonucleotide
  Target: SCN9A; (-) strand; PAM type: YTN; PAM sequence: CTC
aaaagtgtattttaaataaa

SEQ ID NO: 66634 - DNA, 20 bp, Artificial Sequence
  Description of Artificial Sequence: Synthetic oligonucleotide
  Target: SCN9A; (-) strand; PAM type: YTN; PAM sequence: TTC
tcaaaagtgtattttaaata

SEQ ID NO: 66635 - DNA, 20 bp, Artificial Sequence
  Description of Artificial Sequence: Synthetic oligonucleotide
  Target: SCN9A; (-) strand; PAM type: YTN; PAM sequence: TTG
gggagggcattctcaaaagt

SEQ ID NO: 66636 - DNA, 20 bp, Artificial Sequence
  Description of Artificial Sequence: Synthetic oligonucleotide
  Target: SCN9A; (-) strand; PAM type: YTN; PAM sequence: TTT
ggggagggcattctcaaaag

SEQ ID NO: 66637 - DNA, 20 bp, Artificial Sequence
  Description of Artificial Sequence: Synthetic oligonucleotide
  Target: SCN9A; (-) strand; PAM type: YTN; PAM sequence: CTA
aaacagaggaagacatttgg

SEQ ID NO: 66638 - DNA, 20 bp, Artificial Sequence
  Description of Artificial Sequence: Synthetic oligonucleotide
  Target: SCN9A; (-) strand; PAM type: YTN; PAM sequence: TTC
aaaatgtctaaaacagagga

SEQ ID NO: 66639 - DNA, 20 bp, Artificial Sequence
  Description of Artificial Sequence: Synthetic oligonucleotide
  Target: SCN9A; (-) strand; PAM type: YTN; PAM sequence: TTG
ttcaaaatgtctaaaacaga

SEQ ID NO: 66640 - DNA, 20 bp, Artificial Sequence
  Description of Artificial Sequence: Synthetic oligonucleotide
  Target: SCN9A; (-) strand; PAM type: YTN; PAM sequence: CTT
gttcaaaatgtctaaaacag

SEQ ID NO: 66641 - DNA, 20 bp, Artificial Sequence
  Description of Artificial Sequence: Synthetic oligonucleotide
  Target: SCN9A; (-) strand; PAM type: YTN; PAM sequence: TTC
cttgttcaaaatgtctaaaa

SEQ ID NO: 66642 - DNA, 20 bp, Artificial Sequence
  Description of Artificial Sequence: Synthetic oligonucleotide
  Target: SCN9A; (-) strand; PAM type: YTN; PAM sequence: TTG
gagtaattccttgttcaaaa

SEQ ID NO: 66643 - DNA, 20 bp, Artificial Sequence
  Description of Artificial Sequence: Synthetic oligonucleotide
  Target: SCN9A; (-) strand; PAM type: YTN; PAM sequence: TTT
ggagtaattccttgttcaaa

SEQ ID NO: 66644 - DNA, 20 bp, Artificial Sequence
  Description of Artificial Sequence: Synthetic oligonucleotide
  Target: SCN9A; (-) strand; PAM type: YTN; PAM sequence: TTA
aagtttggagtaattccttg

SEQ ID NO: 66645 - DNA, 20 bp, Artificial Sequence
  Description of Artificial Sequence: Synthetic oligonucleotide
  Target: SCN9A; (-) strand; PAM type: YTN; PAM sequence: TTA
caaaaaaattaaagtttgga

SEQ ID NO: 66646 - DNA, 20 bp, Artificial Sequence
  Description of Artificial Sequence: Synthetic oligonucleotide
  Target: SCN9A; (-) strand; PAM type: YTN; PAM sequence: TTC
agagaggagattacaaaaaa

SEQ ID NO: 66647 - DNA, 20 bp, Artificial Sequence
  Description of Artificial Sequence: Synthetic oligonucleotide
  Target: SCN9A; (-) strand; PAM type: YTN; PAM sequence: TTT
cagagaggagattacaaaaa

SEQ ID NO: 66648 - DNA, 20 bp, Artificial Sequence
  Description of Artificial Sequence: Synthetic oligonucleotide
  Target: SCN9A; (-) strand; PAM type: YTN; PAM sequence: CTG
agaatttcagagaggagatt

SEQ ID NO: 66649 - DNA, 20 bp, Artificial Sequence
  Description of Artificial Sequence: Synthetic oligonucleotide
  Target: SCN9A; (-) strand; PAM type: YTN; PAM sequence: CTC
acatatgtgactgagaattt

SEQ ID NO: 66650 - DNA, 20 bp, Artificial Sequence
  Description of Artificial Sequence: Synthetic oligonucleotide
  Target: SCN9A; (-) strand; PAM type: YTN; PAM sequence: CTG
actcacatatgtgactgaga

SEQ ID NO: 66651 - DNA, 20 bp, Artificial Sequence
  Description of Artificial Sequence: Synthetic oligonucleotide
  Target: SCN9A; (-) strand; PAM type: YTN; PAM sequence: TTA
tcccatgctgactcacatat

SEQ ID NO: 66652 - DNA, 20 bp, Artificial Sequence
  Description of Artificial Sequence: Synthetic oligonucleotide
  Target: SCN9A; (-) strand; PAM type: YTN; PAM sequence: TTT
atcccatgctgactcacata

SEQ ID NO: 66653 - DNA, 20 bp, Artificial Sequence
  Description of Artificial Sequence: Synthetic oligonucleotide
  Target: SCN9A; (-) strand; PAM type: YTN; PAM sequence: CTA
aggaggtttatcccatgctg

SEQ ID NO: 66654 - DNA, 20 bp, Artificial Sequence
  Description of Artificial Sequence: Synthetic oligonucleotide
  Target: SCN9A; (-) strand; PAM type: YTN; PAM sequence: CTA
gtaactaaggaggtttatcc

SEQ ID NO: 66655 - DNA, 20 bp, Artificial Sequence
  Description of Artificial Sequence: Synthetic oligonucleotide
  Target: SCN9A; (-) strand; PAM type: YTN; PAM sequence: TTC
ctagtaactaaggaggttta

SEQ ID NO: 66656 - DNA, 20 bp, Artificial Sequence
  Description of Artificial Sequence: Synthetic oligonucleotide
  Target: SCN9A; (-) strand; PAM type: YTN; PAM sequence: CTA
ccatgcaatgtattcctagt

SEQ ID NO: 66657 - DNA, 20 bp, Artificial Sequence
  Description of Artificial Sequence: Synthetic oligonucleotide
  Target: SCN9A; (-) strand; PAM type: YTN; PAM sequence: CTG
gagtcatccaagtagaaatc

SEQ ID NO: 66658 - DNA, 20 bp, Artificial Sequence
  Description of Artificial Sequence: Synthetic oligonucleotide
  Target: SCN9A; (-) strand; PAM type: YTN; PAM sequence: TTA
cctggagtcatccaagtaga

SEQ ID NO: 66659 - DNA, 20 bp, Artificial Sequence
  Description of Artificial Sequence: Synthetic oligonucleotide
  Target: SCN9A; (-) strand; PAM type: YTN; PAM sequence: CTT
acctggagtcatccaagtag

SEQ ID NO: 66660 - DNA, 20 bp, Artificial Sequence
  Description of Artificial Sequence: Synthetic oligonucleotide
  Target: SCN9A; (-) strand; PAM type: YTN; PAM sequence: TTC
cttacctggagtcatccaag

SEQ ID NO: 66661 - DNA, 20 bp, Artificial Sequence
  Description of Artificial Sequence: Synthetic oligonucleotide
  Target: SCN9A; (-) strand; PAM type: YTN; PAM sequence: TTT
ccttacctggagtcatccaa

SEQ ID NO: 66662 - DNA, 20 bp, Artificial Sequence
  Description of Artificial Sequence: Synthetic oligonucleotide
  Target: SCN9A; (-) strand; PAM type: YTN; PAM sequence: TTT
tccttacctggagtcatcca

SEQ ID NO: 66663 - DNA, 20 bp, Artificial Sequence
  Description of Artificial Sequence: Synthetic oligonucleotide
  Target: SCN9A; (-) strand; PAM type: YTN; PAM sequence: CTA
ttttccttacctggagtcat

SEQ ID NO: 66664 - DNA, 20 bp, Artificial Sequence
  Description of Artificial Sequence: Synthetic oligonucleotide
  Target: SCN9A; (-) strand; PAM type: YTN; PAM sequence: CTC
tattttccttacctggagtc

SEQ ID NO: 66665 - DNA, 20 bp, Artificial Sequence
  Description of Artificial Sequence: Synthetic oligonucleotide
  Target: SCN9A; (-) strand; PAM type: YTN; PAM sequence: CTC
agaaacagaaaatgtgatca

SEQ ID NO: 66666 - DNA, 20 bp, Artificial Sequence
  Description of Artificial Sequence: Synthetic oligonucleotide
  Target: SCN9A; (-) strand; PAM type: YTN; PAM sequence: CTC
tcagaaacagaaaatgtgat

SEQ ID NO: 66667 - DNA, 20 bp, Artificial Sequence
  Description of Artificial Sequence: Synthetic oligonucleotide
  Target: SCN9A; (-) strand; PAM type: YTN; PAM sequence: CTC
aactctcagaaacagaaaat

SEQ ID NO: 66668 - DNA, 20 bp, Artificial Sequence
  Description of Artificial Sequence: Synthetic oligonucleotide
  Target: SCN9A; (-) strand; PAM type: YTN; PAM sequence: CTA
tcaagtctcaactctcagaa

SEQ ID NO: 66669 - DNA, 20 bp, Artificial Sequence
  Description of Artificial Sequence: Synthetic oligonucleotide
  Target: SCN9A; (-) strand; PAM type: YTN; PAM sequence: TTC
ctatcaagtctcaactctca

SEQ ID NO: 66670 - DNA, 20 bp, Artificial Sequence
  Description of Artificial Sequence: Synthetic oligonucleotide
  Target: SCN9A; (-) strand; PAM type: YTN; PAM sequence: TTT
cctatcaagtctcaactctc

SEQ ID NO: 66671 - DNA, 20 bp, Artificial Sequence
  Description of Artificial Sequence: Synthetic oligonucleotide
  Target: SCN9A; (-) strand; PAM type: YTN; PAM sequence: CTT
tcctatcaagtctcaactct

SEQ ID NO: 66672 - DNA, 20 bp, Artificial Sequence
  Description of Artificial Sequence: Synthetic oligonucleotide
  Target: SCN9A; (-) strand; PAM type: YTN; PAM sequence: TTC
ctttcctatcaagtctcaac

SEQ ID NO: 66673 - DNA, 20 bp, Artificial Sequence
  Description of Artificial Sequence: Synthetic oligonucleotide
  Target: SCN9A; (-) strand; PAM type: YTN; PAM sequence: TTT
cctttcctatcaagtctcaa

SEQ ID NO: 66674 - DNA, 20 bp, Artificial Sequence
  Description of Artificial Sequence: Synthetic oligonucleotide
  Target: SCN9A; (-) strand; PAM type: YTN; PAM sequence: CTT
tcctttcctatcaagtctca

SEQ ID NO: 66675 - DNA, 20 bp, Artificial Sequence
  Description of Artificial Sequence: Synthetic oligonucleotide
  Target: SCN9A; (-) strand; PAM type: YTN; PAM sequence: CTG
tggctttcctttcctatcaa

SEQ ID NO: 66676 - DNA, 20 bp, Artificial Sequence
  Description of Artificial Sequence: Synthetic oligonucleotide
  Target: SCN9A; (-) strand; PAM type: YTN; PAM sequence: CTG
cagggacccactgtggcttt

SEQ ID NO: 66677 - DNA, 20 bp, Artificial Sequence
  Description of Artificial Sequence: Synthetic oligonucleotide
  Target: SCN9A; (-) strand; PAM type: YTN; PAM sequence: CTC
cccaacaacctgcagggacc

SEQ ID NO: 66678 - DNA, 20 bp, Artificial Sequence
  Description of Artificial Sequence: Synthetic oligonucleotide
  Target: SCN9A; (-) strand; PAM type: YTN; PAM sequence: TTG
gcacactccccaacaacctg

SEQ ID NO: 66679 - DNA, 20 bp, Artificial Sequence
  Description of Artificial Sequence: Synthetic oligonucleotide
  Target: SCN9A; (-) strand; PAM type: YTN; PAM sequence: CTT
ggcacactccccaacaacct

SEQ ID NO: 66680 - DNA, 20 bp, Artificial Sequence
  Description of Artificial Sequence: Synthetic oligonucleotide
  Target: SCN9A; (-) strand; PAM type: YTN; PAM sequence: TTC
ttggcacactccccaacaac

SEQ ID NO: 66681 - DNA, 20 bp, Artificial Sequence
  Description of Artificial Sequence: Synthetic oligonucleotide
  Target: SCN9A; (-) strand; PAM type: YTN; PAM sequence: CTG
gcattcttggcacactcccc

SEQ ID NO: 66682 - DNA, 20 bp, Artificial Sequence
  Description of Artificial Sequence: Synthetic oligonucleotide
  Target: SCN9A; (-) strand; PAM type: YTN; PAM sequence: CTA
ggtaaggagcaggcagagcc

SEQ ID NO: 66683 - DNA, 20 bp, Artificial Sequence
  Description of Artificial Sequence: Synthetic oligonucleotide
  Target: SCN9A; (-) strand; PAM type: YTN; PAM sequence: CTG
aggaatgtcctaggtaagga

SEQ ID NO: 66684 - DNA, 20 bp, Artificial Sequence
  Description of Artificial Sequence: Synthetic oligonucleotide
  Target: SCN9A; (-) strand; PAM type: YTN; PAM sequence: CTG
caaacacaaccctgaggaat

SEQ ID NO: 66685 - DNA, 20 bp, Artificial Sequence
  Description of Artificial Sequence: Synthetic oligonucleotide
  Target: SCN9A; (-) strand; PAM type: YTN; PAM sequence: CTC
actgcaaacacaaccctgag

SEQ ID NO: 66686 - DNA, 20 bp, Artificial Sequence
  Description of Artificial Sequence: Synthetic oligonucleotide
  Target: SCN9A; (-) strand; PAM type: YTN; PAM sequence: TTG
ctcactgcaaacacaaccct

SEQ ID NO: 66687 - DNA, 20 bp, Artificial Sequence
  Description of Artificial Sequence: Synthetic oligonucleotide
  Target: SCN9A; (-) strand; PAM type: YTN; PAM sequence: CTC
aaggttgctcactgcaaaca

SEQ ID NO: 66688 - DNA, 20 bp, Artificial Sequence
  Description of Artificial Sequence: Synthetic oligonucleotide
  Target: SCN9A; (-) strand; PAM type: YTN; PAM sequence: CTC
atgtctcaaggttgctcact

SEQ ID NO: 66689 - DNA, 20 bp, Artificial Sequence
  Description of Artificial Sequence: Synthetic oligonucleotide
  Target: SCN9A; (-) strand; PAM type: YTN; PAM sequence: CTA
cctcatgtctcaaggttgct

SEQ ID NO: 66690 - DNA, 20 bp, Artificial Sequence
  Description of Artificial Sequence: Synthetic oligonucleotide
  Target: SCN9A; (-) strand; PAM type: YTN; PAM sequence: TTG
tcccagagaccctacctcat

SEQ ID NO: 66691 - DNA, 20 bp, Artificial Sequence
  Description of Artificial Sequence: Synthetic oligonucleotide
  Target: SCN9A; (-) strand; PAM type: YTN; PAM sequence: TTT
gtcccagagaccctacctca

SEQ ID NO: 66692 - DNA, 20 bp, Artificial Sequence
  Description of Artificial Sequence: Synthetic oligonucleotide
  Target: SCN9A; (-) strand; PAM type: YTN; PAM sequence: CTT
tgtcccagagaccctacctc

SEQ ID NO: 66693 - DNA, 20 bp, Artificial Sequence
  Description of Artificial Sequence: Synthetic oligonucleotide
  Target: SCN9A; (-) strand; PAM type: YTN; PAM sequence: CTC
tttgtcccagagaccctacc

SEQ ID NO: 66694 - DNA, 20 bp, Artificial Sequence
  Description of Artificial Sequence: Synthetic oligonucleotide
  Target: SCN9A; (-) strand; PAM type: YTN; PAM sequence: CTG
ctctttgtcccagagaccct

SEQ ID NO: 66695 - DNA, 20 bp, Artificial Sequence
  Description of Artificial Sequence: Synthetic oligonucleotide
  Target: SCN9A; (-) strand; PAM type: YTN; PAM sequence: TTA
taccaagcaacataagcaac

SEQ ID NO: 66696 - DNA, 20 bp, Artificial Sequence
  Description of Artificial Sequence: Synthetic oligonucleotide
  Target: SCN9A; (-) strand; PAM type: YTN; PAM sequence: TTT
ataccaagcaacataagcaa

SEQ ID NO: 66697 - DNA, 20 bp, Artificial Sequence
  Description of Artificial Sequence: Synthetic oligonucleotide
  Target: SCN9A; (-) strand; PAM type: YTN; PAM sequence: TTT
tataccaagcaacataagca

SEQ ID NO: 66698 - DNA, 20 bp, Artificial Sequence
  Description of Artificial Sequence: Synthetic oligonucleotide
  Target: SCN9A; (-) strand; PAM type: YTN; PAM sequence: CTT
ttataccaagcaacataagc

SEQ ID NO: 66699 - DNA, 20 bp, Artificial Sequence
  Description of Artificial Sequence: Synthetic oligonucleotide
  Target: SCN9A; (-) strand; PAM type: YTN; PAM sequence: TTA
gggaatgcatccttttatac

SEQ ID NO: 66700 - DNA, 20 bp, Artificial Sequence
  Description of Artificial Sequence: Synthetic oligonucleotide
  Target: SCN9A; (-) strand; PAM type: YTN; PAM sequence: CTT
agggaatgcatccttttata

SEQ ID NO: 66701 - DNA, 20 bp, Artificial Sequence
  Description of Artificial Sequence: Synthetic oligonucleotide
  Target: SCN9A; (-) strand; PAM type: YTN; PAM sequence: CTG
agcttagggaatgcatcctt

SEQ ID NO: 66702 - DNA, 20 bp, Artificial Sequence
  Description of Artificial Sequence: Synthetic oligonucleotide
  Target: SCN9A; (-) strand; PAM type: YTN; PAM sequence: CTG
aggaacactgagcttaggga

SEQ ID NO: 66703 - DNA, 20 bp, Artificial Sequence
  Description of Artificial Sequence: Synthetic oligonucleotide
  Target: SCN9A; (-) strand; PAM type: YTN; PAM sequence: TTG
atgtcacagctgaggaacac

SEQ ID NO: 66704 - DNA, 20 bp, Artificial Sequence
  Description of Artificial Sequence: Synthetic oligonucleotide
  Target: SCN9A; (-) strand; PAM type: YTN; PAM sequence: CTG
aatgagtgtgtacacatata

SEQ ID NO: 66705 - DNA, 20 bp, Artificial Sequence
  Description of Artificial Sequence: Synthetic oligonucleotide
  Target: SCN9A; (-) strand; PAM type: YTN; PAM sequence: TTA
tatgagcctgaatgagtgtg

SEQ ID NO: 66706 - DNA, 20 bp, Artificial Sequence
  Description of Artificial Sequence: Synthetic oligonucleotide
  Target: SCN9A; (-) strand; PAM type: YTN; PAM sequence: CTC
atgggggcattatatgagcc

SEQ ID NO: 66707 - DNA, 20 bp, Artificial Sequence
  Description of Artificial Sequence: Synthetic oligonucleotide
  Target: SCN9A; (-) strand; PAM type: YTN; PAM sequence: TTA
cccaggtctcatgggggcat

SEQ ID NO: 66708 - DNA, 20 bp, Artificial Sequence
  Description of Artificial Sequence: Synthetic oligonucleotide
  Target: SCN9A; (-) strand; PAM type: YTN; PAM sequence: TTT
acccaggtctcatgggggca

SEQ ID NO: 66709 - DNA, 20 bp, Artificial Sequence
  Description of Artificial Sequence: Synthetic oligonucleotide
  Target: SCN9A; (-) strand; PAM type: YTN; PAM sequence: CTT
tacccaggtctcatgggggc

SEQ ID NO: 66710 - DNA, 20 bp, Artificial Sequence
  Description of Artificial Sequence: Synthetic oligonucleotide
  Target: SCN9A; (-) strand; PAM type: YTN; PAM sequence: TTC
cccctttacccaggtctcat

SEQ ID NO: 66711 - DNA, 20 bp, Artificial Sequence
  Description of Artificial Sequence: Synthetic oligonucleotide
  Target: SCN9A; (-) strand; PAM type: YTN; PAM sequence: TTG
gttccccctttacccaggtc

SEQ ID NO: 66712 - DNA, 20 bp, Artificial Sequence
  Description of Artificial Sequence: Synthetic oligonucleotide
  Target: SCN9A; (-) strand; PAM type: YTN; PAM sequence: CTG
ttggttccccctttacccag

SEQ ID NO: 66713 - DNA, 20 bp, Artificial Sequence
  Description of Artificial Sequence: Synthetic oligonucleotide
  Target: SCN9A; (-) strand; PAM type: YTN; PAM sequence: TTC
tgttggttccccctttaccc

SEQ ID NO: 66714 - DNA, 20 bp, Artificial Sequence
  Description of Artificial Sequence: Synthetic oligonucleotide
  Target: SCN9A; (-) strand; PAM type: YTN; PAM sequence: TTT
ctgttggttccccctttacc

SEQ ID NO: 66715 - DNA, 20 bp, Artificial Sequence
  Description of Artificial Sequence: Synthetic oligonucleotide
  Target: SCN9A; (-) strand; PAM type: YTN; PAM sequence: TTC
aacatgtttctgttggttcc

SEQ ID NO: 66716 - DNA, 20 bp, Artificial Sequence
  Description of Artificial Sequence: Synthetic oligonucleotide
  Target: SCN9A; (-) strand; PAM type: YTN; PAM sequence: TTT
caacatgtttctgttggttc

SEQ ID NO: 66717 - DNA, 20 bp, Artificial Sequence
  Description of Artificial Sequence: Synthetic oligonucleotide
  Target: SCN9A; (-) strand; PAM type: YTN; PAM sequence: TTA
tgtgtggaaagtagcatgag

SEQ ID NO: 66718 - DNA, 20 bp, Artificial Sequence
  Description of Artificial Sequence: Synthetic oligonucleotide
  Target: SCN9A; (-) strand; PAM type: YTN; PAM sequence: CTT
atgtgtggaaagtagcatga

SEQ ID NO: 66719 - DNA, 20 bp, Artificial Sequence
  Description of Artificial Sequence: Synthetic oligonucleotide
  Target: SCN9A; (-) strand; PAM type: YTN; PAM sequence: TTA
cttatgtgtggaaagtagca

SEQ ID NO: 66720 - DNA, 20 bp, Artificial Sequence
  Description of Artificial Sequence: Synthetic oligonucleotide
  Target: SCN9A; (-) strand; PAM type: YTN; PAM sequence: TTG
ttacttatgtgtggaaagta

SEQ ID NO: 66721 - DNA, 20 bp, Artificial Sequence
  Description of Artificial Sequence: Synthetic oligonucleotide
  Target: SCN9A; (-) strand; PAM type: YTN; PAM sequence: TTT
gttacttatgtgtggaaagt

SEQ ID NO: 66722 - DNA, 20 bp, Artificial Sequence
  Description of Artificial Sequence: Synthetic oligonucleotide
  Target: SCN9A; (-) strand; PAM type: YTN; PAM sequence: CTT
tgttacttatgtgtggaaag

SEQ ID NO: 66723 - DNA, 20 bp, Artificial Sequence
  Description of Artificial Sequence: Synthetic oligonucleotide
  Target: SCN9A; (-) strand; PAM type: YTN; PAM sequence: TTG
ggtcagagataaaggacttt

SEQ ID NO: 66724 - DNA, 20 bp, Artificial Sequence
  Description of Artificial Sequence: Synthetic oligonucleotide
  Target: SCN9A; (-) strand; PAM type: YTN; PAM sequence: CTT
gggtcagagataaaggactt

SEQ ID NO: 66725 - DNA, 20 bp, Artificial Sequence
  Description of Artificial Sequence: Synthetic oligonucleotide
  Target: SCN9A; (-) strand; PAM type: YTN; PAM sequence: CTG
gcagaagatatgaggtgctt

SEQ ID NO: 66726 - DNA, 20 bp, Artificial Sequence
  Description of Artificial Sequence: Synthetic oligonucleotide
  Target: SCN9A; (-) strand; PAM type: YTN; PAM sequence: TTC
atggatgctggcagaagata

SEQ ID NO: 66727 - DNA, 20 bp, Artificial Sequence
  Description of Artificial Sequence: Synthetic oligonucleotide
  Target: SCN9A; (-) strand; PAM type: YTN; PAM sequence: TTT
catggatgctggcagaagat

SEQ ID NO: 66728 - DNA, 20 bp, Artificial Sequence
  Description of Artificial Sequence: Synthetic oligonucleotide
  Target: SCN9A; (-) strand; PAM type: YTN; PAM sequence: CTG
tttcatggatgctggcagaa

SEQ ID NO: 66729 - DNA, 20 bp, Artificial Sequence
  Description of Artificial Sequence: Synthetic oligonucleotide
  Target: SCN9A; (-) strand; PAM type: YTN; PAM sequence: CTG
atactgtttcatggatgctg

SEQ ID NO: 66730 - DNA, 20 bp, Artificial Sequence
  Description of Artificial Sequence: Synthetic oligonucleotide
  Target: SCN9A; (-) strand; PAM type: YTN; PAM sequence: TTG
atctgatactgtttcatgga

SEQ ID NO: 66731 - DNA, 20 bp, Artificial Sequence
  Description of Artificial Sequence: Synthetic oligonucleotide
  Target: SCN9A; (-) strand; PAM type: YTN; PAM sequence: CTA
ataggttgatctgatactgt

SEQ ID NO: 66732 - DNA, 20 bp, Artificial Sequence
  Description of Artificial Sequence: Synthetic oligonucleotide
  Target: SCN9A; (-) strand; PAM type: YTN; PAM sequence: TTA
tatgctaataggttgatctg

SEQ ID NO: 66733 - DNA, 20 bp, Artificial Sequence
  Description of Artificial Sequence: Synthetic oligonucleotide
  Target: SCN9A; (-) strand; PAM type: YTN; PAM sequence: CTT
atatgctaataggttgatct

SEQ ID NO: 66734 - DNA, 20 bp, Artificial Sequence
  Description of Artificial Sequence: Synthetic oligonucleotide
  Target: SCN9A; (-) strand; PAM type: YTN; PAM sequence: CTG
tacttatatgctaataggtt

SEQ ID NO: 66735 - DNA, 20 bp, Artificial Sequence
  Description of Artificial Sequence: Synthetic oligonucleotide
  Target: SCN9A; (-) strand; PAM type: YTN; PAM sequence: TTA
ctgtacttatatgctaatag

SEQ ID NO: 66736 - DNA, 20 bp, Artificial Sequence
  Description of Artificial Sequence: Synthetic oligonucleotide
  Target: SCN9A; (-) strand; PAM type: YTN; PAM sequence: TTT
actgtacttatatgctaata

SEQ ID NO: 66737 - DNA, 20 bp, Artificial Sequence
  Description of Artificial Sequence: Synthetic oligonucleotide
  Target: SCN9A; (-) strand; PAM type: YTN; PAM sequence: TTT
tactgtacttatatgctaat

SEQ ID NO: 66738 - DNA, 20 bp, Artificial Sequence
  Description of Artificial Sequence: Synthetic oligonucleotide
  Target: SCN9A; (-) strand; PAM type: YTN; PAM sequence: TTG
attttactgtacttatatgc

SEQ ID NO: 66739 - DNA, 20 bp, Artificial Sequence
  Description of Artificial Sequence: Synthetic oligonucleotide
  Target: SCN9A; (-) strand; PAM type: YTN; PAM sequence: TTT
gattttactgtacttatatg

SEQ ID NO: 66740 - DNA, 20 bp, Artificial Sequence
  Description of Artificial Sequence: Synthetic oligonucleotide
  Target: SCN9A; (-) strand; PAM type: YTN; PAM sequence: CTT
tgattttactgtacttatat

SEQ ID NO: 66741 - DNA, 20 bp, Artificial Sequence
  Description of Artificial Sequence: Synthetic oligonucleotide
  Target: SCN9A; (-) strand; PAM type: YTN; PAM sequence: TTG
gactttgattttactgtact

SEQ ID NO: 66742 - DNA, 20 bp, Artificial Sequence
  Description of Artificial Sequence: Synthetic oligonucleotide
  Target: SCN9A; (-) strand; PAM type: YTN; PAM sequence: TTT
ggactttgattttactgtac

SEQ ID NO: 66743 - DNA, 20 bp, Artificial Sequence
  Description of Artificial Sequence: Synthetic oligonucleotide
  Target: SCN9A; (-) strand; PAM type: YTN; PAM sequence: TTC
atgagtttggactttgattt

SEQ ID NO: 66744 - DNA, 20 bp, Artificial Sequence
  Description of Artificial Sequence: Synthetic oligonucleotide
  Target: SCN9A; (-) strand; PAM type: YTN; PAM sequence: CTT
catgagtttggactttgatt

SEQ ID NO: 66745 - DNA, 20 bp, Artificial Sequence
  Description of Artificial Sequence: Synthetic oligonucleotide
  Target: SCN9A; (-) strand; PAM type: YTN; PAM sequence: CTC
atagacagtcttcatgagtt

SEQ ID NO: 66746 - DNA, 20 bp, Artificial Sequence
  Description of Artificial Sequence: Synthetic oligonucleotide
  Target: SCN9A; (-) strand; PAM type: YTN; PAM sequence: TTG
cctcatagacagtcttcatg

SEQ ID NO: 66747 - DNA, 20 bp, Artificial Sequence
  Description of Artificial Sequence: Synthetic oligonucleotide
  Target: SCN9A; (-) strand; PAM type: YTN; PAM sequence: CTT
gcctcatagacagtcttcat

SEQ ID NO: 66748 - DNA, 20 bp, Artificial Sequence
  Description of Artificial Sequence: Synthetic oligonucleotide
  Target: SCN9A; (-) strand; PAM type: YTN; PAM sequence: TTG
taacttgcctcatagacagt

SEQ ID NO: 66749 - DNA, 20 bp, Artificial Sequence
  Description of Artificial Sequence: Synthetic oligonucleotide
  Target: SCN9A; (-) strand; PAM type: YTN; PAM sequence: TTT
gtaacttgcctcatagacag

SEQ ID NO: 66750 - DNA, 20 bp, Artificial Sequence
  Description of Artificial Sequence: Synthetic oligonucleotide
  Target: SCN9A; (-) strand; PAM type: YTN; PAM sequence: CTT
tgtaacttgcctcatagaca

SEQ ID NO: 66751 - DNA, 20 bp, Artificial Sequence
  Description of Artificial Sequence: Synthetic oligonucleotide
  Target: SCN9A; (-) strand; PAM type: YTN; PAM sequence: CTC
aagaactttgtaacttgcct

SEQ ID NO: 66752 - DNA, 20 bp, Artificial Sequence
  Description of Artificial Sequence: Synthetic oligonucleotide
  Target: SCN9A; (-) strand; PAM type: YTN; PAM sequence: CTA
aaaatagaatactcaagaac

SEQ ID NO: 66753 - DNA, 20 bp, Artificial Sequence
  Description of Artificial Sequence: Synthetic oligonucleotide
  Target: SCN9A; (-) strand; PAM type: YTN; PAM sequence: TTA
tactaaaaatagaatactca

SEQ ID NO: 66754 - DNA, 20 bp, Artificial Sequence
  Description of Artificial Sequence: Synthetic oligonucleotide
  Target: SCN9A; (-) strand; PAM type: YTN; PAM sequence: TTC
attatactaaaaatagaata

SEQ ID NO: 66755 - DNA, 20 bp, Artificial Sequence
  Description of Artificial Sequence: Synthetic oligonucleotide
  Target: SCN9A; (-) strand; PAM type: YTN; PAM sequence: TTT
cattatactaaaaatagaat

SEQ ID NO: 66756 - DNA, 20 bp, Artificial Sequence
  Description of Artificial Sequence: Synthetic oligonucleotide
  Target: SCN9A; (-) strand; PAM type: YTN; PAM sequence: CTG
gaagtttcattatactaaaa

SEQ ID NO: 66757 - DNA, 20 bp, Artificial Sequence
  Description of Artificial Sequence: Synthetic oligonucleotide
  Target: SCN9A; (-) strand; PAM type: YTN; PAM sequence: CTA
gatataccactggaagtttc

SEQ ID NO: 66758 - DNA, 20 bp, Artificial Sequence
  Description of Artificial Sequence: Synthetic oligonucleotide
  Target: SCN9A; (-) strand; PAM type: YTN; PAM sequence: CTA
gctagatataccactggaag

SEQ ID NO: 66759 - DNA, 20 bp, Artificial Sequence
  Description of Artificial Sequence: Synthetic oligonucleotide
  Target: SCN9A; (-) strand; PAM type: YTN; PAM sequence: TTA
ggagcccagatctagctaga

SEQ ID NO: 66760 - DNA, 20 bp, Artificial Sequence
  Description of Artificial Sequence: Synthetic oligonucleotide
  Target: SCN9A; (-) strand; PAM type: YTN; PAM sequence: TTA
gaagccattaggagcccaga

SEQ ID NO: 66761 - DNA, 20 bp, Artificial Sequence
  Description of Artificial Sequence: Synthetic oligonucleotide
  Target: SCN9A; (-) strand; PAM type: YTN; PAM sequence: CTG
acagagatgagccattagaa

SEQ ID NO: 66762 - DNA, 20 bp, Artificial Sequence
  Description of Artificial Sequence: Synthetic oligonucleotide
  Target: SCN9A; (-) strand; PAM type: YTN; PAM sequence: CTG
acgctgacagagatgagcca

SEQ ID NO: 66763 - DNA, 20 bp, Artificial Sequence
  Description of Artificial Sequence: Synthetic oligonucleotide
  Target: SCN9A; (-) strand; PAM type: YTN; PAM sequence: CTG
ctgacgctgacagagatgag

SEQ ID NO: 66764 - DNA, 20 bp, Artificial Sequence
  Description of Artificial Sequence: Synthetic oligonucleotide
  Target: SCN9A; (-) strand; PAM type: YTN; PAM sequence: TTC
ctgctgacgctgacagagat

SEQ ID NO: 66765 - DNA, 20 bp, Artificial Sequence
  Description of Artificial Sequence: Synthetic oligonucleotide
  Target: SCN9A; (-) strand; PAM type: YTN; PAM sequence: TTT
cctgctgacgctgacagaga

SEQ ID NO: 66766 - DNA, 20 bp, Artificial Sequence
  Description of Artificial Sequence: Synthetic oligonucleotide
  Target: SCN9A; (-) strand; PAM type: YTN; PAM sequence: TTT
tcctgctgacgctgacagag

SEQ ID NO: 66767 - DNA, 20 bp, Artificial Sequence
  Description of Artificial Sequence: Synthetic oligonucleotide
  Target: SCN9A; (-) strand; PAM type: YTN; PAM sequence: TTT
ttcctgctgacgctgacaga

SEQ ID NO: 66768 - DNA, 20 bp, Artificial Sequence
  Description of Artificial Sequence: Synthetic oligonucleotide
  Target: SCN9A; (-) strand; PAM type: YTN; PAM sequence: TTG
tcatttttcctgctgacgct

SEQ ID NO: 66769 - DNA, 20 bp, Artificial Sequence
  Description of Artificial Sequence: Synthetic oligonucleotide
  Target: SCN9A; (-) strand; PAM type: YTN; PAM sequence: TTA
attgtcatttttcctgctga

SEQ ID NO: 66770 - DNA, 20 bp, Artificial Sequence
  Description of Artificial Sequence: Synthetic oligonucleotide
  Target: SCN9A; (-) strand; PAM type: YTN; PAM sequence: CTT
aattgtcatttttcctgctg

SEQ ID NO: 66771 - DNA, 20 bp, Artificial Sequence
  Description of Artificial Sequence: Synthetic oligonucleotide
  Target: SCN9A; (-) strand; PAM type: YTN; PAM sequence: TTC
ttaattgtcatttttcctgc

SEQ ID NO: 66772 - DNA, 20 bp, Artificial Sequence
  Description of Artificial Sequence: Synthetic oligonucleotide
  Target: SCN9A; (-) strand; PAM type: YTN; PAM sequence: TTT
cttaattgtcatttttcctg

SEQ ID NO: 66773 - DNA, 20 bp, Artificial Sequence
  Description of Artificial Sequence: Synthetic oligonucleotide
  Target: SCN9A; (-) strand; PAM type: YTN; PAM sequence: TTT
tcttaattgtcatttttcct

SEQ ID NO: 66774 - DNA, 20 bp, Artificial Sequence
  Description of Artificial Sequence: Synthetic oligonucleotide
  Target: SCN9A; (-) strand; PAM type: YTN; PAM sequence: TTT
ttcttaattgtcatttttcc

SEQ ID NO: 66775 - DNA, 20 bp, Artificial Sequence
  Description of Artificial Sequence: Synthetic oligonucleotide
  Target: SCN9A; (-) strand; PAM type: YTN; PAM sequence: CTT
tttcttaattgtcatttttc

SEQ ID NO: 66776 - DNA, 20 bp, Artificial Sequence
  Description of Artificial Sequence: Synthetic oligonucleotide
  Target: SCN9A; (-) strand; PAM type: YTN; PAM sequence: CTG
aacctttttcttaattgtca

SEQ ID NO: 66777 - DNA, 20 bp, Artificial Sequence
  Description of Artificial Sequence: Synthetic oligonucleotide
  Target: SCN9A; (-) strand; PAM type: YTN; PAM sequence: CTA
cctgaacctttttcttaatt

SEQ ID NO: 66778 - DNA, 20 bp, Artificial Sequence
  Description of Artificial Sequence: Synthetic oligonucleotide
  Target: SCN9A; (-) strand; PAM type: YTN; PAM sequence: TTA
caagctacctgaaccttttt

SEQ ID NO: 66779 - DNA, 20 bp, Artificial Sequence
  Description of Artificial Sequence: Synthetic oligonucleotide
  Target: SCN9A; (-) strand; PAM type: YTN; PAM sequence: CTA
gtagaattacaagctacctg

SEQ ID NO: 66780 - DNA, 20 bp, Artificial Sequence
  Description of Artificial Sequence: Synthetic oligonucleotide
  Target: SCN9A; (-) strand; PAM type: YTN; PAM sequence: TTG
aaagagatctagtagaatta

SEQ ID NO: 66781 - DNA, 20 bp, Artificial Sequence
  Description of Artificial Sequence: Synthetic oligonucleotide
  Target: SCN9A; (-) strand; PAM type: YTN; PAM sequence: TTC
catgagagttgaaagagatc

SEQ ID NO: 66782 - DNA, 20 bp, Artificial Sequence
  Description of Artificial Sequence: Synthetic oligonucleotide
  Target: SCN9A; (-) strand; PAM type: YTN; PAM sequence: CTT
ccatgagagttgaaagagat

SEQ ID NO: 66783 - DNA, 20 bp, Artificial Sequence
  Description of Artificial Sequence: Synthetic oligonucleotide
  Target: SCN9A; (-) strand; PAM type: YTN; PAM sequence: TTG
tacacatacaagcagcttcc

SEQ ID NO: 66784 - DNA, 20 bp, Artificial Sequence
  Description of Artificial Sequence: Synthetic oligonucleotide
  Target: SCN9A; (-) strand; PAM type: YTN; PAM sequence: CTT
gtacacatacaagcagcttc

SEQ ID NO: 66785 - DNA, 20 bp, Artificial Sequence
  Description of Artificial Sequence: Synthetic oligonucleotide
  Target: SCN9A; (-) strand; PAM type: YTN; PAM sequence: TTC
ttgtacacatacaagcagct

SEQ ID NO: 66786 - DNA, 20 bp, Artificial Sequence
  Description of Artificial Sequence: Synthetic oligonucleotide
  Target: SCN9A; (-) strand; PAM type: YTN; PAM sequence: CTC
attcttgtacacatacaagc

SEQ ID NO: 66787 - DNA, 20 bp, Artificial Sequence
  Description of Artificial Sequence: Synthetic oligonucleotide
  Target: SCN9A; (-) strand; PAM type: YTN; PAM sequence: TTC
tcattcttgtacacatacaa

SEQ ID NO: 66788 - DNA, 20 bp, Artificial Sequence
  Description of Artificial Sequence: Synthetic oligonucleotide
  Target: SCN9A; (-) strand; PAM type: YTN; PAM sequence: TTT
ctcattcttgtacacataca

SEQ ID NO: 66789 - DNA, 20 bp, Artificial Sequence
  Description of Artificial Sequence: Synthetic oligonucleotide
  Target: SCN9A; (-) strand; PAM type: YTN; PAM sequence: TTA
ggataaaagtaggacaagtt

SEQ ID NO: 66790 - DNA, 20 bp, Artificial Sequence
  Description of Artificial Sequence: Synthetic oligonucleotide
  Target: SCN9A; (-) strand; PAM type: YTN; PAM sequence: TTT
aggataaaagtaggacaagt

SEQ ID NO: 66791 - DNA, 20 bp, Artificial Sequence
  Description of Artificial Sequence: Synthetic oligonucleotide
  Target: SCN9A; (-) strand; PAM type: YTN; PAM sequence: TTT
taggataaaagtaggacaag

SEQ ID NO: 66792 - DNA, 20 bp, Artificial Sequence
  Description of Artificial Sequence: Synthetic oligonucleotide
  Target: SCN9A; (-) strand; PAM type: YTN; PAM sequence: TTA
taaaaagggaaaacagatgg

SEQ ID NO: 66793 - DNA, 20 bp, Artificial Sequence
  Description of Artificial Sequence: Synthetic oligonucleotide
  Target: SCN9A; (-) strand; PAM type: YTN; PAM sequence: TTG
tgtgttataaaaagggaaaa

SEQ ID NO: 66794 - DNA, 20 bp, Artificial Sequence
  Description of Artificial Sequence: Synthetic oligonucleotide
  Target: SCN9A; (-) strand; PAM type: YTN; PAM sequence: CTT
gtgtgttataaaaagggaaa

SEQ ID NO: 66795 - DNA, 20 bp, Artificial Sequence
  Description of Artificial Sequence: Synthetic oligonucleotide
  Target: SCN9A; (-) strand; PAM type: YTN; PAM sequence: TTG
tgaagcatcttgtgtgttat

SEQ ID NO: 66796 - DNA, 20 bp, Artificial Sequence
  Description of Artificial Sequence: Synthetic oligonucleotide
  Target: SCN9A; (-) strand; PAM type: YTN; PAM sequence: CTT
gtgaagcatcttgtgtgtta

SEQ ID NO: 66797 - DNA, 20 bp, Artificial Sequence
  Description of Artificial Sequence: Synthetic oligonucleotide
  Target: SCN9A; (-) strand; PAM type: YTN; PAM sequence: CTA
tgagaaagcaaggtcagctt

SEQ ID NO: 66798 - DNA, 20 bp, Artificial Sequence
  Description of Artificial Sequence: Synthetic oligonucleotide
  Target: SCN9A; (-) strand; PAM type: YTN; PAM sequence: CTG
caagtgtggtgggaagaaga

SEQ ID NO: 66799 - DNA, 20 bp, Artificial Sequence
  Description of Artificial Sequence: Synthetic oligonucleotide
  Target: SCN9A; (-) strand; PAM type: YTN; PAM sequence: CTG
aactgcaagtgtggtgggaa

SEQ ID NO: 66800 - DNA, 20 bp, Artificial Sequence
  Description of Artificial Sequence: Synthetic oligonucleotide
  Target: SCN9A; (-) strand; PAM type: YTN; PAM sequence: CTG
ctgaactgcaagtgtggtgg

SEQ ID NO: 66801 - DNA, 20 bp, Artificial Sequence
  Description of Artificial Sequence: Synthetic oligonucleotide
  Target: SCN9A; (-) strand; PAM type: YTN; PAM sequence: TTA
aaaactgctgaactgcaagt

SEQ ID NO: 66802 - DNA, 20 bp, Artificial Sequence
  Description of Artificial Sequence: Synthetic oligonucleotide
  Target: SCN9A; (-) strand; PAM type: YTN; PAM sequence: TTC
aggaaattaaaaactgctga

SEQ ID NO: 66803 - DNA, 20 bp, Artificial Sequence
  Description of Artificial Sequence: Synthetic oligonucleotide
  Target: SCN9A; (-) strand; PAM type: YTN; PAM sequence: CTG
aggggaacaagtatacaatc

SEQ ID NO: 66804 - DNA, 20 bp, Artificial Sequence
  Description of Artificial Sequence: Synthetic oligonucleotide
  Target: SCN9A; (-) strand; PAM type: YTN; PAM sequence: TTA
ggcaaggcaggctgagggga

SEQ ID NO: 66805 - DNA, 20 bp, Artificial Sequence
  Description of Artificial Sequence: Synthetic oligonucleotide
  Target: SCN9A; (-) strand; PAM type: YTN; PAM sequence: CTA
gttaggcaaggcaggctgag

SEQ ID NO: 66806 - DNA, 20 bp, Artificial Sequence
  Description of Artificial Sequence: Synthetic oligonucleotide
  Target: SCN9A; (-) strand; PAM type: YTN; PAM sequence: TTC
tagttaggcaaggcaggctg

SEQ ID NO: 66807 - DNA, 20 bp, Artificial Sequence
  Description of Artificial Sequence: Synthetic oligonucleotide
  Target: SCN9A; (-) strand; PAM type: YTN; PAM sequence: TTT
ctagttaggcaaggcaggct

SEQ ID NO: 66808 - DNA, 20 bp, Artificial Sequence
  Description of Artificial Sequence: Synthetic oligonucleotide
  Target: SCN9A; (-) strand; PAM type: YTN; PAM sequence: TTT
tctagttaggcaaggcaggc

SEQ ID NO: 66809 - DNA, 20 bp, Artificial Sequence
  Description of Artificial Sequence: Synthetic oligonucleotide
  Target: SCN9A; (-) strand; PAM type: YTN; PAM sequence: CTA
gaaagacgaacaggaatttt

SEQ ID NO: 66810 - DNA, 20 bp, Artificial Sequence
  Description of Artificial Sequence: Synthetic oligonucleotide
  Target: SCN9A; (-) strand; PAM type: YTN; PAM sequence: TTC
agggtctagaaagacgaaca

SEQ ID NO: 66811 - DNA, 20 bp, Artificial Sequence
  Description of Artificial Sequence: Synthetic oligonucleotide
  Target: SCN9A; (-) strand; PAM type: YTN; PAM sequence: TTT
cagggtctagaaagacgaac

SEQ ID NO: 66812 - DNA, 20 bp, Artificial Sequence
  Description of Artificial Sequence: Synthetic oligonucleotide
  Target: SCN9A; (-) strand; PAM type: YTN; PAM sequence: TTT
tcagggtctagaaagacgaa

SEQ ID NO: 66813 - DNA, 20 bp, Artificial Sequence
  Description of Artificial Sequence: Synthetic oligonucleotide
  Target: SCN9A; (-) strand; PAM type: YTN; PAM sequence: CTT
ttcagggtctagaaagacga

SEQ ID NO: 66814 - DNA, 20 bp, Artificial Sequence
  Description of Artificial Sequence: Synthetic oligonucleotide
  Target: SCN9A; (-) strand; PAM type: YTN; PAM sequence: TTC
agaaacgtaaatggtgcttt

SEQ ID NO: 66815 - DNA, 20 bp, Artificial Sequence
  Description of Artificial Sequence: Synthetic oligonucleotide
  Target: SCN9A; (-) strand; PAM type: YTN; PAM sequence: TTT
cagaaacgtaaatggtgctt

SEQ ID NO: 66816 - DNA, 20 bp, Artificial Sequence
  Description of Artificial Sequence: Synthetic oligonucleotide
  Target: SCN9A; (-) strand; PAM type: YTN; PAM sequence: TTG
caatttcagaaacgtaaatg

SEQ ID NO: 66817 - DNA, 20 bp, Artificial Sequence
  Description of Artificial Sequence: Synthetic oligonucleotide
  Target: SCN9A; (-) strand; PAM type: YTN; PAM sequence: CTT
gcaatttcagaaacgtaaat

SEQ ID NO: 66818 - DNA, 20 bp, Artificial Sequence
  Description of Artificial Sequence: Synthetic oligonucleotide
  Target: SCN9A; (-) strand; PAM type: YTN; PAM sequence: CTG
cttgcaatttcagaaacgta

SEQ ID NO: 66819 - DNA, 20 bp, Artificial Sequence
  Description of Artificial Sequence: Synthetic oligonucleotide
  Target: SCN9A; (-) strand; PAM type: YTN; PAM sequence: CTG
tagcaaggagaacaactgct

SEQ ID NO: 66820 - DNA, 20 bp, Artificial Sequence
  Description of Artificial Sequence: Synthetic oligonucleotide
  Target: SCN9A; (-) strand; PAM type: YTN; PAM sequence: TTC
tgtagcaaggagaacaactg

SEQ ID NO: 66821 - DNA, 20 bp, Artificial Sequence
  Description of Artificial Sequence: Synthetic oligonucleotide
  Target: SCN9A; (-) strand; PAM type: YTN; PAM sequence: TTG
taagcaaagtgtaaatgtga

SEQ ID NO: 66822 - DNA, 20 bp, Artificial Sequence
  Description of Artificial Sequence: Synthetic oligonucleotide
  Target: SCN9A; (-) strand; PAM type: YTN; PAM sequence: TTT
gtaagcaaagtgtaaatgtg

SEQ ID NO: 66823 - DNA, 20 bp, Artificial Sequence
  Description of Artificial Sequence: Synthetic oligonucleotide
  Target: SCN9A; (-) strand; PAM type: YTN; PAM sequence: TTG
gatgtgtttgtaagcaaagt

SEQ ID NO: 66824 - DNA, 20 bp, Artificial Sequence
  Description of Artificial Sequence: Synthetic oligonucleotide
  Target: SCN9A; (-) strand; PAM type: YTN; PAM sequence: CTT
ggatgtgtttgtaagcaaag

SEQ ID NO: 66825 - DNA, 20 bp, Artificial Sequence
  Description of Artificial Sequence: Synthetic oligonucleotide
  Target: SCN9A; (-) strand; PAM type: YTN; PAM sequence: CTG
tagagcttggatgtgtttgt

SEQ ID NO: 66826 - DNA, 20 bp, Artificial Sequence
  Description of Artificial Sequence: Synthetic oligonucleotide
  Target: SCN9A; (-) strand; PAM type: YTN; PAM sequence: CTC
agagcaatggagaagagaag

SEQ ID NO: 66827 - DNA, 20 bp, Artificial Sequence
  Description of Artificial Sequence: Synthetic oligonucleotide
  Target: SCN9A; (-) strand; PAM type: YTN; PAM sequence: TTA
aggagctcagagcaatggag

SEQ ID NO: 66828 - DNA, 20 bp, Artificial Sequence
  Description of Artificial Sequence: Synthetic oligonucleotide
  Target: SCN9A; (-) strand; PAM type: YTN; PAM sequence: CTT
aaggagctcagagcaatgga

SEQ ID NO: 66829 - DNA, 20 bp, Artificial Sequence
  Description of Artificial Sequence: Synthetic oligonucleotide
  Target: SCN9A; (-) strand; PAM type: YTN; PAM sequence: TTC
ttaaggagctcagagcaatg

SEQ ID NO: 66830 - DNA, 20 bp, Artificial Sequence
  Description of Artificial Sequence: Synthetic oligonucleotide
  Target: SCN9A; (-) strand; PAM type: YTN; PAM sequence: TTA
ttcttaaggagctcagagca

SEQ ID NO: 66831 - DNA, 20 bp, Artificial Sequence
  Description of Artificial Sequence: Synthetic oligonucleotide
  Target: SCN9A; (-) strand; PAM type: YTN; PAM sequence: TTT
attcttaaggagctcagagc

SEQ ID NO: 66832 - DNA, 20 bp, Artificial Sequence
  Description of Artificial Sequence: Synthetic oligonucleotide
  Target: SCN9A; (-) strand; PAM type: YTN; PAM sequence: CTG
tttattcttaaggagctcag

SEQ ID NO: 66833 - DNA, 20 bp, Artificial Sequence
  Description of Artificial Sequence: Synthetic oligonucleotide
  Target: SCN9A; (-) strand; PAM type: YTN; PAM sequence: TTC
acaatgcaaagataaataag

SEQ ID NO: 66834 - DNA, 20 bp, Artificial Sequence
  Description of Artificial Sequence: Synthetic oligonucleotide
  Target: SCN9A; (-) strand; PAM type: YTN; PAM sequence: TTT
cacaatgcaaagataaataa

SEQ ID NO: 66835 - DNA, 20 bp, Artificial Sequence
  Description of Artificial Sequence: Synthetic oligonucleotide
  Target: SCN9A; (-) strand; PAM type: YTN; PAM sequence: CTT
tcacaatgcaaagataaata

SEQ ID NO: 66836 - DNA, 20 bp, Artificial Sequence
  Description of Artificial Sequence: Synthetic oligonucleotide
  Target: SCN9A; (-) strand; PAM type: YTN; PAM sequence: TTG
tatgatcaactttcacaatg

SEQ ID NO: 66837 - DNA, 20 bp, Artificial Sequence
  Description of Artificial Sequence: Synthetic oligonucleotide
  Target: SCN9A; (-) strand; PAM type: YTN; PAM sequence: TTT
gtatgatcaactttcacaat

SEQ ID NO: 66838 - DNA, 20 bp, Artificial Sequence
  Description of Artificial Sequence: Synthetic oligonucleotide
  Target: SCN9A; (-) strand; PAM type: YTN; PAM sequence: CTA
cccaatttgtatgatcaact

SEQ ID NO: 66839 - DNA, 20 bp, Artificial Sequence
  Description of Artificial Sequence: Synthetic oligonucleotide
  Target: SCN9A; (-) strand; PAM type: YTN; PAM sequence: TTG
agtaggacaagaactaccca

SEQ ID NO: 66840 - DNA, 20 bp, Artificial Sequence
  Description of Artificial Sequence: Synthetic oligonucleotide
  Target: SCN9A; (-) strand; PAM type: YTN; PAM sequence: TTA
gttgagtaggacaagaacta

SEQ ID NO: 66841 - DNA, 20 bp, Artificial Sequence
  Description of Artificial Sequence: Synthetic oligonucleotide
  Target: SCN9A; (-) strand; PAM type: YTN; PAM sequence: CTG
ttagttgagtaggacaagaa

SEQ ID NO: 66842 - DNA, 20 bp, Artificial Sequence
  Description of Artificial Sequence: Synthetic oligonucleotide
  Target: SCN9A; (-) strand; PAM type: YTN; PAM sequence: TTG
actgttagttgagtaggaca

SEQ ID NO: 66843 - DNA, 20 bp, Artificial Sequence
  Description of Artificial Sequence: Synthetic oligonucleotide
  Target: SCN9A; (-) strand; PAM type: YTN; PAM sequence: TTA
gttgactgttagttgagtag

SEQ ID NO: 66844 - DNA, 20 bp, Artificial Sequence
  Description of Artificial Sequence: Synthetic oligonucleotide
  Target: SCN9A; (-) strand; PAM type: YTN; PAM sequence: CTT
agttgactgttagttgagta

SEQ ID NO: 66845 - DNA, 20 bp, Artificial Sequence
  Description of Artificial Sequence: Synthetic oligonucleotide
  Target: SCN9A; (-) strand; PAM type: YTN; PAM sequence: CTC
ttagttgactgttagttgag

SEQ ID NO: 66846 - DNA, 20 bp, Artificial Sequence
  Description of Artificial Sequence: Synthetic oligonucleotide
  Target: SCN9A; (-) strand; PAM type: YTN; PAM sequence: TTG
actcttagttgactgttagt

SEQ ID NO: 66847 - DNA, 20 bp, Artificial Sequence
  Description of Artificial Sequence: Synthetic oligonucleotide
  Target: SCN9A; (-) strand; PAM type: YTN; PAM sequence: CTT
gactcttagttgactgttag

SEQ ID NO: 66848 - DNA, 20 bp, Artificial Sequence
  Description of Artificial Sequence: Synthetic oligonucleotide
  Target: SCN9A; (-) strand; PAM type: YTN; PAM sequence: TTC
ttgactcttagttgactgtt

SEQ ID NO: 66849 - DNA, 20 bp, Artificial Sequence
  Description of Artificial Sequence: Synthetic oligonucleotide
  Target: SCN9A; (-) strand; PAM type: YTN; PAM sequence: CTT
cttgactcttagttgactgt

SEQ ID NO: 66850 - DNA, 20 bp, Artificial Sequence
  Description of Artificial Sequence: Synthetic oligonucleotide
  Target: SCN9A; (-) strand; PAM type: YTN; PAM sequence: CTG
ccttcttgactcttagttga

SEQ ID NO: 66851 - DNA, 20 bp, Artificial Sequence
  Description of Artificial Sequence: Synthetic oligonucleotide
  Target: SCN9A; (-) strand; PAM type: YTN; PAM sequence: TTC
cccctgccttcttgactctt

SEQ ID NO: 66852 - DNA, 20 bp, Artificial Sequence
  Description of Artificial Sequence: Synthetic oligonucleotide
  Target: SCN9A; (-) strand; PAM type: YTN; PAM sequence: TTT
ccccctgccttcttgactct

SEQ ID NO: 66853 - DNA, 20 bp, Artificial Sequence
  Description of Artificial Sequence: Synthetic oligonucleotide
  Target: SCN9A; (-) strand; PAM type: YTN; PAM sequence: TTT
tccccctgccttcttgactc

SEQ ID NO: 66854 - DNA, 20 bp, Artificial Sequence
  Description of Artificial Sequence: Synthetic oligonucleotide
  Target: SCN9A; (-) strand; PAM type: YTN; PAM sequence: CTT
ttccccctgccttcttgact

SEQ ID NO: 66855 - DNA, 20 bp, Artificial Sequence
  Description of Artificial Sequence: Synthetic oligonucleotide
  Target: SCN9A; (-) strand; PAM type: YTN; PAM sequence: CTG
agagcttttccccctgcctt

SEQ ID NO: 66856 - DNA, 20 bp, Artificial Sequence
  Description of Artificial Sequence: Synthetic oligonucleotide
  Target: SCN9A; (-) strand; PAM type: YTN; PAM sequence: TTG
taccctgagagcttttcccc

SEQ ID NO: 66857 - DNA, 20 bp, Artificial Sequence
  Description of Artificial Sequence: Synthetic oligonucleotide
  Target: SCN9A; (-) strand; PAM type: YTN; PAM sequence: TTT
gtaccctgagagcttttccc

SEQ ID NO: 66858 - DNA, 20 bp, Artificial Sequence
  Description of Artificial Sequence: Synthetic oligonucleotide
  Target: SCN9A; (-) strand; PAM type: YTN; PAM sequence: TTT
tgtaccctgagagcttttcc

SEQ ID NO: 66859 - DNA, 20 bp, Artificial Sequence
  Description of Artificial Sequence: Synthetic oligonucleotide
  Target: SCN9A; (-) strand; PAM type: YTN; PAM sequence: TTG
gagtaatgttttgtaccctg

SEQ ID NO: 66860 - DNA, 20 bp, Artificial Sequence
  Description of Artificial Sequence: Synthetic oligonucleotide
  Target: SCN9A; (-) strand; PAM type: YTN; PAM sequence: CTT
ggagtaatgttttgtaccct

SEQ ID NO: 66861 - DNA, 20 bp, Artificial Sequence
  Description of Artificial Sequence: Synthetic oligonucleotide
  Target: SCN9A; (-) strand; PAM type: YTN; PAM sequence: TTC
ttggagtaatgttttgtacc

SEQ ID NO: 66862 - DNA, 20 bp, Artificial Sequence
  Description of Artificial Sequence: Synthetic oligonucleotide
  Target: SCN9A; (-) strand; PAM type: YTN; PAM sequence: TTA
taattcttggagtaatgttt

SEQ ID NO: 66863 - DNA, 20 bp, Artificial Sequence
  Description of Artificial Sequence: Synthetic oligonucleotide
  Target: SCN9A; (-) strand; PAM type: YTN; PAM sequence: TTG
cagagaattataattcttgg

SEQ ID NO: 66864 - DNA, 20 bp, Artificial Sequence
  Description of Artificial Sequence: Synthetic oligonucleotide
  Target: SCN9A; (-) strand; PAM type: YTN; PAM sequence: CTT
gcagagaattataattcttg

SEQ ID NO: 66865 - DNA, 20 bp, Artificial Sequence
  Description of Artificial Sequence: Synthetic oligonucleotide
  Target: SCN9A; (-) strand; PAM type: YTN; PAM sequence: TTC
aacagtcagtcttgcagaga

SEQ ID NO: 66866 - DNA, 20 bp, Artificial Sequence
  Description of Artificial Sequence: Synthetic oligonucleotide
  Target: SCN9A; (-) strand; PAM type: YTN; PAM sequence: CTT
caacagtcagtcttgcagag

SEQ ID NO: 66867 - DNA, 20 bp, Artificial Sequence
  Description of Artificial Sequence: Synthetic oligonucleotide
  Target: SCN9A; (-) strand; PAM type: YTN; PAM sequence: TTA
caacaagcagcttcaacagt

SEQ ID NO: 66868 - DNA, 20 bp, Artificial Sequence
  Description of Artificial Sequence: Synthetic oligonucleotide
  Target: SCN9A; (-) strand; PAM type: YTN; PAM sequence: TTC
aagttacaacaagcagcttc

SEQ ID NO: 66869 - DNA, 20 bp, Artificial Sequence
  Description of Artificial Sequence: Synthetic oligonucleotide
  Target: SCN9A; (-) strand; PAM type: YTN; PAM sequence: TTT
caagttacaacaagcagctt

SEQ ID NO: 66870 - DNA, 20 bp, Artificial Sequence
  Description of Artificial Sequence: Synthetic oligonucleotide
  Target: SCN9A; (-) strand; PAM type: YTN; PAM sequence: CTA
atttcaagttacaacaagca

SEQ ID NO: 66871 - DNA, 20 bp, Artificial Sequence
  Description of Artificial Sequence: Synthetic oligonucleotide
  Target: SCN9A; (-) strand; PAM type: YTN; PAM sequence: CTA
tagataaaactaatttcaag

SEQ ID NO: 66872 - DNA, 20 bp, Artificial Sequence
  Description of Artificial Sequence: Synthetic oligonucleotide
  Target: SCN9A; (-) strand; PAM type: YTN; PAM sequence: CTC
agaagctatagataaaacta

SEQ ID NO: 66873 - DNA, 20 bp, Artificial Sequence
  Description of Artificial Sequence: Synthetic oligonucleotide
  Target: SCN9A; (-) strand; PAM type: YTN; PAM sequence: TTC
ctcagaagctatagataaaa

SEQ ID NO: 66874 - DNA, 20 bp, Artificial Sequence
  Description of Artificial Sequence: Synthetic oligonucleotide
  Target: SCN9A; (-) strand; PAM type: YTN; PAM sequence: TTT
cctcagaagctatagataaa

SEQ ID NO: 66875 - DNA, 20 bp, Artificial Sequence
  Description of Artificial Sequence: Synthetic oligonucleotide
  Target: SCN9A; (-) strand; PAM type: YTN; PAM sequence: CTA
gagtgtaacaggtttcctca

SEQ ID NO: 66876 - DNA, 20 bp, Artificial Sequence
  Description of Artificial Sequence: Synthetic oligonucleotide
  Target: SCN9A; (-) strand; PAM type: YTN; PAM sequence: TTA
gtcctagagtgtaacaggtt

SEQ ID NO: 66877 - DNA, 20 bp, Artificial Sequence
  Description of Artificial Sequence: Synthetic oligonucleotide
  Target: SCN9A; (-) strand; PAM type: YTN; PAM sequence: TTG
gcacaattagtcctagagtg

SEQ ID NO: 66878 - DNA, 20 bp, Artificial Sequence
  Description of Artificial Sequence: Synthetic oligonucleotide
  Target: SCN9A; (-) strand; PAM type: YTN; PAM sequence: CTG
gcgagcaacagtcgttggca

SEQ ID NO: 66879 - DNA, 20 bp, Artificial Sequence
  Description of Artificial Sequence: Synthetic oligonucleotide
  Target: SCN9A; (-) strand; PAM type: YTN; PAM sequence: CTC
caactggcgagcaacagtcg

SEQ ID NO: 66880 - DNA, 20 bp, Artificial Sequence
  Description of Artificial Sequence: Synthetic oligonucleotide
  Target: SCN9A; (-) strand; PAM type: YTN; PAM sequence: CTG
gtaagctccaactggcgagc

SEQ ID NO: 66881 - DNA, 20 bp, Artificial Sequence
  Description of Artificial Sequence: Synthetic oligonucleotide
  Target: SCN9A; (-) strand; PAM type: YTN; PAM sequence: CTG
gggaactggtaagctccaac

SEQ ID NO: 66882 - DNA, 20 bp, Artificial Sequence
  Description of Artificial Sequence: Synthetic oligonucleotide
  Target: SCN9A; (-) strand; PAM type: YTN; PAM sequence: CTA
gtaaggatctggggaactgg

SEQ ID NO: 66883 - DNA, 20 bp, Artificial Sequence
  Description of Artificial Sequence: Synthetic oligonucleotide
  Target: SCN9A; (-) strand; PAM type: YTN; PAM sequence: TTG
gccctagtaaggatctgggg

SEQ ID NO: 66884 - DNA, 20 bp, Artificial Sequence
  Description of Artificial Sequence: Synthetic oligonucleotide
  Target: SCN9A; (-) strand; PAM type: YTN; PAM sequence: TTC
attggccctagtaaggatct

SEQ ID NO: 66885 - DNA, 20 bp, Artificial Sequence
  Description of Artificial Sequence: Synthetic oligonucleotide
  Target: SCN9A; (-) strand; PAM type: YTN; PAM sequence: TTG
agaaagttcattggccctag

SEQ ID NO: 66886 - DNA, 20 bp, Artificial Sequence
  Description of Artificial Sequence: Synthetic oligonucleotide
  Target: SCN9A; (-) strand; PAM type: YTN; PAM sequence: TTT
gagaaagttcattggcccta

SEQ ID NO: 66887 - DNA, 20 bp, Artificial Sequence
  Description of Artificial Sequence: Synthetic oligonucleotide
  Target: SCN9A; (-) strand; PAM type: YTN; PAM sequence: CTT
tgagaaagttcattggccct

SEQ ID NO: 66888 - DNA, 20 bp, Artificial Sequence
  Description of Artificial Sequence: Synthetic oligonucleotide
  Target: SCN9A; (-) strand; PAM type: YTN; PAM sequence: CTC
tttgagaaagttcattggcc

SEQ ID NO: 66889 - DNA, 20 bp, Artificial Sequence
  Description of Artificial Sequence: Synthetic oligonucleotide
  Target: SCN9A; (-) strand; PAM type: YTN; PAM sequence: TTG
ctctttgagaaagttcattg

SEQ ID NO: 66890 - DNA, 20 bp, Artificial Sequence
  Description of Artificial Sequence: Synthetic oligonucleotide
  Target: SCN9A; (-) strand; PAM type: YTN; PAM sequence: TTA
tatattgctctttgagaaag

SEQ ID NO: 66891 - DNA, 20 bp, Artificial Sequence
  Description of Artificial Sequence: Synthetic oligonucleotide
  Target: SCN9A; (-) strand; PAM type: YTN; PAM sequence: TTA
aaatgggaaaatgttatata

SEQ ID NO: 66892 - DNA, 20 bp, Artificial Sequence
  Description of Artificial Sequence: Synthetic oligonucleotide
  Target: SCN9A; (-) strand; PAM type: YTN; PAM sequence: TTA
ttaaaatgggaaaatgttat

SEQ ID NO: 66893 - DNA, 20 bp, Artificial Sequence
  Description of Artificial Sequence: Synthetic oligonucleotide
  Target: SCN9A; (-) strand; PAM type: YTN; PAM sequence: TTT
attaaaatgggaaaatgtta

SEQ ID NO: 66894 - DNA, 20 bp, Artificial Sequence
  Description of Artificial Sequence: Synthetic oligonucleotide
  Target: SCN9A; (-) strand; PAM type: YTN; PAM sequence: TTT
tattaaaatgggaaaatgtt

SEQ ID NO: 66895 - DNA, 20 bp, Artificial Sequence
  Description of Artificial Sequence: Synthetic oligonucleotide
  Target: SCN9A; (-) strand; PAM type: YTN; PAM sequence: TTA
gaggttttattaaaatggga

SEQ ID NO: 66896 - DNA, 20 bp, Artificial Sequence
  Description of Artificial Sequence: Synthetic oligonucleotide
  Target: SCN9A; (-) strand; PAM type: YTN; PAM sequence: CTG
tagaacaaagagagaaggtt

SEQ ID NO: 66897 - DNA, 20 bp, Artificial Sequence
  Description of Artificial Sequence: Synthetic oligonucleotide
  Target: SCN9A; (-) strand; PAM type: YTN; PAM sequence: TTC
cctgtagaacaaagagagaa

SEQ ID NO: 66898 - DNA, 20 bp, Artificial Sequence
  Description of Artificial Sequence: Synthetic oligonucleotide
  Target: SCN9A; (-) strand; PAM type: YTN; PAM sequence: TTT
ccctgtagaacaaagagaga

SEQ ID NO: 66899 - DNA, 20 bp, Artificial Sequence
  Description of Artificial Sequence: Synthetic oligonucleotide
  Target: SCN9A; (-) strand; PAM type: YTN; PAM sequence: CTT
tccctgtagaacaaagagag

SEQ ID NO: 66900 - DNA, 20 bp, Artificial Sequence
  Description of Artificial Sequence: Synthetic oligonucleotide
  Target: SCN9A; (-) strand; PAM type: YTN; PAM sequence: CTG
aaagcactttccctgtagaa

SEQ ID NO: 66901 - DNA, 20 bp, Artificial Sequence
  Description of Artificial Sequence: Synthetic oligonucleotide
  Target: SCN9A; (-) strand; PAM type: YTN; PAM sequence: CTG
tggcataaactgaaagcact

SEQ ID NO: 66902 - DNA, 20 bp, Artificial Sequence
  Description of Artificial Sequence: Synthetic oligonucleotide
  Target: SCN9A; (-) strand; PAM type: YTN; PAM sequence: TTG
caaaacagggagagagtctg

SEQ ID NO: 66903 - DNA, 20 bp, Artificial Sequence
  Description of Artificial Sequence: Synthetic oligonucleotide
  Target: SCN9A; (-) strand; PAM type: YTN; PAM sequence: TTT
gcaaaacagggagagagtct

SEQ ID NO: 66904 - DNA, 20 bp, Artificial Sequence
  Description of Artificial Sequence: Synthetic oligonucleotide
  Target: SCN9A; (-) strand; PAM type: YTN; PAM sequence: CTG
gcaatatcagtttgcaaaac

SEQ ID NO: 66905 - DNA, 20 bp, Artificial Sequence
  Description of Artificial Sequence: Synthetic oligonucleotide
  Target: SCN9A; (-) strand; PAM type: YTN; PAM sequence: TTA
ctggcaatatcagtttgcaa

SEQ ID NO: 66906 - DNA, 20 bp, Artificial Sequence
  Description of Artificial Sequence: Synthetic oligonucleotide
  Target: SCN9A; (-) strand; PAM type: YTN; PAM sequence: TTT
actggcaatatcagtttgca

SEQ ID NO: 66907 - DNA, 20 bp, Artificial Sequence
  Description of Artificial Sequence: Synthetic oligonucleotide
  Target: SCN9A; (-) strand; PAM type: YTN; PAM sequence: TTT
tactggcaatatcagtttgc

SEQ ID NO: 66908 - DNA, 20 bp, Artificial Sequence
  Description of Artificial Sequence: Synthetic oligonucleotide
  Target: SCN9A; (-) strand; PAM type: YTN; PAM sequence: CTA
taatagaaaagagaatttta

SEQ ID NO: 66909 - DNA, 20 bp, Artificial Sequence
  Description of Artificial Sequence: Synthetic oligonucleotide
  Target: SCN9A; (-) strand; PAM type: YTN; PAM sequence: TTG
tccaaaggaccacccagatg

SEQ ID NO: 66910 - DNA, 20 bp, Artificial Sequence
  Description of Artificial Sequence: Synthetic oligonucleotide
  Target: SCN9A; (-) strand; PAM type: YTN; PAM sequence: CTG
ttgtccaaaggaccacccag

SEQ ID NO: 66911 - DNA, 20 bp, Artificial Sequence
  Description of Artificial Sequence: Synthetic oligonucleotide
  Target: SCN9A; (-) strand; PAM type: YTN; PAM sequence: CTG
aatgctgttgtccaaaggac

SEQ ID NO: 66912 - DNA, 20 bp, Artificial Sequence
  Description of Artificial Sequence: Synthetic oligonucleotide
  Target: SCN9A; (-) strand; PAM type: YTN; PAM sequence: CTG
ccctgaatgctgttgtccaa

SEQ ID NO: 66913 - DNA, 20 bp, Artificial Sequence
  Description of Artificial Sequence: Synthetic oligonucleotide
  Target: SCN9A; (-) strand; PAM type: YTN; PAM sequence: TTG
ctgccctgaatgctgttgtc

SEQ ID NO: 66914 - DNA, 20 bp, Artificial Sequence
  Description of Artificial Sequence: Synthetic oligonucleotide
  Target: SCN9A; (-) strand; PAM type: YTN; PAM sequence: CTT
gctgccctgaatgctgttgt

SEQ ID NO: 66915 - DNA, 20 bp, Artificial Sequence
  Description of Artificial Sequence: Synthetic oligonucleotide
  Target: SCN9A; (-) strand; PAM type: YTN; PAM sequence: TTA
tccttgctgccctgaatgct

SEQ ID NO: 66916 - DNA, 20 bp, Artificial Sequence
  Description of Artificial Sequence: Synthetic oligonucleotide
  Target: SCN9A; (-) strand; PAM type: YTN; PAM sequence: CTA
catgccaggcattatccttg

SEQ ID NO: 66917 - DNA, 20 bp, Artificial Sequence
  Description of Artificial Sequence: Synthetic oligonucleotide
  Target: SCN9A; (-) strand; PAM type: YTN; PAM sequence: CTC
ctacatgccaggcattatcc

SEQ ID NO: 66918 - DNA, 20 bp, Artificial Sequence
  Description of Artificial Sequence: Synthetic oligonucleotide
  Target: SCN9A; (-) strand; PAM type: YTN; PAM sequence: CTG
agcactcctacatgccaggc

SEQ ID NO: 66919 - DNA, 20 bp, Artificial Sequence
  Description of Artificial Sequence: Synthetic oligonucleotide
  Target: SCN9A; (-) strand; PAM type: YTN; PAM sequence: TTA
ctgagcactcctacatgcca

SEQ ID NO: 66920 - DNA, 20 bp, Artificial Sequence
  Description of Artificial Sequence: Synthetic oligonucleotide
  Target: SCN9A; (-) strand; PAM type: YTN; PAM sequence: CTC
agtaaatagttactgagcac

SEQ ID NO: 66921 - DNA, 20 bp, Artificial Sequence
  Description of Artificial Sequence: Synthetic oligonucleotide
  Target: SCN9A; (-) strand; PAM type: YTN; PAM sequence: TTG
agctcagtaaatagttactg

SEQ ID NO: 66922 - DNA, 20 bp, Artificial Sequence
  Description of Artificial Sequence: Synthetic oligonucleotide
  Target: SCN9A; (-) strand; PAM type: YTN; PAM sequence: CTT
gagctcagtaaatagttact

SEQ ID NO: 66923 - DNA, 20 bp, Artificial Sequence
  Description of Artificial Sequence: Synthetic oligonucleotide
  Target: SCN9A; (-) strand; PAM type: YTN; PAM sequence: TTA
cttgagctcagtaaatagtt

SEQ ID NO: 66924 - DNA, 20 bp, Artificial Sequence
  Description of Artificial Sequence: Synthetic oligonucleotide
  Target: SCN9A; (-) strand; PAM type: YTN; PAM sequence: TTT
acttgagctcagtaaatagt

SEQ ID NO: 66925 - DNA, 20 bp, Artificial Sequence
  Description of Artificial Sequence: Synthetic oligonucleotide
  Target: SCN9A; (-) strand; PAM type: YTN; PAM sequence: TTT
tacttgagctcagtaaatag

SEQ ID NO: 66926 - DNA, 20 bp, Artificial Sequence
  Description of Artificial Sequence: Synthetic oligonucleotide
  Target: SCN9A; (-) strand; PAM type: YTN; PAM sequence: TTA
gtgccaatgacaaaatttta

SEQ ID NO: 66927 - DNA, 20 bp, Artificial Sequence
  Description of Artificial Sequence: Synthetic oligonucleotide
  Target: SCN9A; (-) strand; PAM type: YTN; PAM sequence: CTA
tgattagtgccaatgacaaa

SEQ ID NO: 66928 - DNA, 20 bp, Artificial Sequence
  Description of Artificial Sequence: Synthetic oligonucleotide
  Target: SCN9A; (-) strand; PAM type: YTN; PAM sequence: TTA
atccctatgattagtgccaa

SEQ ID NO: 66929 - DNA, 20 bp, Artificial Sequence
  Description of Artificial Sequence: Synthetic oligonucleotide
  Target: SCN9A; (-) strand; PAM type: YTN; PAM sequence: CTA
gaattaatccctatgattag

SEQ ID NO: 66930 - DNA, 20 bp, Artificial Sequence
  Description of Artificial Sequence: Synthetic oligonucleotide
  Target: SCN9A; (-) strand; PAM type: YTN; PAM sequence: TTA
cctagaattaatccctatga

SEQ ID NO: 66931 - DNA, 20 bp, Artificial Sequence
  Description of Artificial Sequence: Synthetic oligonucleotide
  Target: SCN9A; (-) strand; PAM type: YTN; PAM sequence: TTT
acctagaattaatccctatg

SEQ ID NO: 66932 - DNA, 20 bp, Artificial Sequence
  Description of Artificial Sequence: Synthetic oligonucleotide
  Target: SCN9A; (-) strand; PAM type: YTN; PAM sequence: TTT
tacctagaattaatccctat

SEQ ID NO: 66933 - DNA, 20 bp, Artificial Sequence
  Description of Artificial Sequence: Synthetic oligonucleotide
  Target: SCN9A; (-) strand; PAM type: YTN; PAM sequence: TTG
ttttacctagaattaatccc

SEQ ID NO: 66934 - DNA, 20 bp, Artificial Sequence
  Description of Artificial Sequence: Synthetic oligonucleotide
  Target: SCN9A; (-) strand; PAM type: YTN; PAM sequence: CTA
aaagataaaaatatcatggc

SEQ ID NO: 66935 - DNA, 20 bp, Artificial Sequence
  Description of Artificial Sequence: Synthetic oligonucleotide
  Target: SCN9A; (-) strand; PAM type: YTN; PAM sequence: TTA
aaatgagctaaaagataaaa

SEQ ID NO: 66936 - DNA, 20 bp, Artificial Sequence
  Description of Artificial Sequence: Synthetic oligonucleotide
  Target: SCN9A; (-) strand; PAM type: YTN; PAM sequence: TTT
aaaatgagctaaaagataaa

SEQ ID NO: 66937 - DNA, 20 bp, Artificial Sequence
  Description of Artificial Sequence: Synthetic oligonucleotide
  Target: SCN9A; (-) strand; PAM type: YTN; PAM sequence: CTT
taaaatgagctaaaagataa

SEQ ID NO: 66938 - DNA, 20 bp, Artificial Sequence
  Description of Artificial Sequence: Synthetic oligonucleotide
  Target: SCN9A; (-) strand; PAM type: YTN; PAM sequence: TTC
tttaaaatgagctaaaagat

SEQ ID NO: 66939 - DNA, 20 bp, Artificial Sequence
  Description of Artificial Sequence: Synthetic oligonucleotide
  Target: SCN9A; (-) strand; PAM type: YTN; PAM sequence: TTA
agtcaatattctttaaaatg

SEQ ID NO: 66940 - DNA, 20 bp, Artificial Sequence
  Description of Artificial Sequence: Synthetic oligonucleotide
  Target: SCN9A; (-) strand; PAM type: YTN; PAM sequence: TTG
attaagtcaatattctttaa

SEQ ID NO: 66941 - DNA, 20 bp, Artificial Sequence
  Description of Artificial Sequence: Synthetic oligonucleotide
  Target: SCN9A; (-) strand; PAM type: YTN; PAM sequence: CTA
agtcaatatattgattaagt

SEQ ID NO: 66942 - DNA, 20 bp, Artificial Sequence
  Description of Artificial Sequence: Synthetic oligonucleotide
  Target: SCN9A; (-) strand; PAM type: YTN; PAM sequence: CTG
acacctaagtcaatatattg

SEQ ID NO: 66943 - DNA, 20 bp, Artificial Sequence
  Description of Artificial Sequence: Synthetic oligonucleotide
  Target: SCN9A; (-) strand; PAM type: YTN; PAM sequence: CTG
gtaaatgatctgacacctaa

SEQ ID NO: 66944 - DNA, 20 bp, Artificial Sequence
  Description of Artificial Sequence: Synthetic oligonucleotide
  Target: SCN9A; (-) strand; PAM type: YTN; PAM sequence: CTC
agcagtggtgccctggtaaa

SEQ ID NO: 66945 - DNA, 20 bp, Artificial Sequence
  Description of Artificial Sequence: Synthetic oligonucleotide
  Target: SCN9A; (-) strand; PAM type: YTN; PAM sequence: CTG
ctcagcagtggtgccctggt

SEQ ID NO: 66946 - DNA, 20 bp, Artificial Sequence
  Description of Artificial Sequence: Synthetic oligonucleotide
  Target: SCN9A; (-) strand; PAM type: YTN; PAM sequence: CTC
atgatcctgctcagcagtgg

SEQ ID NO: 66947 - DNA, 20 bp, Artificial Sequence
  Description of Artificial Sequence: Synthetic oligonucleotide
  Target: SCN9A; (-) strand; PAM type: YTN; PAM sequence: TTG
tcctcatgatcctgctcagc

SEQ ID NO: 66948 - DNA, 20 bp, Artificial Sequence
  Description of Artificial Sequence: Synthetic oligonucleotide
  Target: SCN9A; (-) strand; PAM type: YTN; PAM sequence: TTC
attgtcctcatgatcctgct

SEQ ID NO: 66949 - DNA, 20 bp, Artificial Sequence
  Description of Artificial Sequence: Synthetic oligonucleotide
  Target: SCN9A; (-) strand; PAM type: YTN; PAM sequence: CTT
cattgtcctcatgatcctgc

SEQ ID NO: 66950 - DNA, 20 bp, Artificial Sequence
  Description of Artificial Sequence: Synthetic oligonucleotide
  Target: SCN9A; (-) strand; PAM type: YTN; PAM sequence: TTG
aaagcttcattgtcctcatg

SEQ ID NO: 66951 - DNA, 20 bp, Artificial Sequence
  Description of Artificial Sequence: Synthetic oligonucleotide
  Target: SCN9A; (-) strand; PAM type: YTN; PAM sequence: TTT
gaaagcttcattgtcctcat

SEQ ID NO: 66952 - DNA, 20 bp, Artificial Sequence
  Description of Artificial Sequence: Synthetic oligonucleotide
  Target: SCN9A; (-) strand; PAM type: YTN; PAM sequence: TTG
gtttgaaagcttcattgtcc

SEQ ID NO: 66953 - DNA, 20 bp, Artificial Sequence
  Description of Artificial Sequence: Synthetic oligonucleotide
  Target: SCN9A; (-) strand; PAM type: YTN; PAM sequence: TTG
aacacagttggtttgaaagc

SEQ ID NO: 66954 - DNA, 20 bp, Artificial Sequence
  Description of Artificial Sequence: Synthetic oligonucleotide
  Target: SCN9A; (-) strand; PAM type: YTN; PAM sequence: TTG
ttgaacacagttggtttgaa

SEQ ID NO: 66955 - DNA, 20 bp, Artificial Sequence
  Description of Artificial Sequence: Synthetic oligonucleotide
  Target: SCN9A; (-) strand; PAM type: YTN; PAM sequence: CTA
caagattgttgaacacagtt

SEQ ID NO: 66956 - DNA, 20 bp, Artificial Sequence
  Description of Artificial Sequence: Synthetic oligonucleotide
  Target: SCN9A; (-) strand; PAM type: YTN; PAM sequence: CTG
ctacaagattgttgaacaca

SEQ ID NO: 66957 - DNA, 20 bp, Artificial Sequence
  Description of Artificial Sequence: Synthetic oligonucleotide
  Target: SCN9A; (-) strand; PAM type: YTN; PAM sequence: CTG
gtggaacatcaggaaaacct

SEQ ID NO: 66958 - DNA, 20 bp, Artificial Sequence
  Description of Artificial Sequence: Synthetic oligonucleotide
  Target: SCN9A; (-) strand; PAM type: YTN; PAM sequence: TTA
acatagagtcagggaaagga

SEQ ID NO: 66959 - DNA, 20 bp, Artificial Sequence
  Description of Artificial Sequence: Synthetic oligonucleotide
  Target: SCN9A; (-) strand; PAM type: YTN; PAM sequence: CTG
ccaagttaacatagagtcag

SEQ ID NO: 66960 - DNA, 20 bp, Artificial Sequence
  Description of Artificial Sequence: Synthetic oligonucleotide
  Target: SCN9A; (-) strand; PAM type: YTN; PAM sequence: CTC
atgctgccaagttaacatag

SEQ ID NO: 66961 - DNA, 20 bp, Artificial Sequence
  Description of Artificial Sequence: Synthetic oligonucleotide
  Target: SCN9A; (-) strand; PAM type: YTN; PAM sequence: TTC
tcatgctgccaagttaacat

SEQ ID NO: 66962 - DNA, 20 bp, Artificial Sequence
  Description of Artificial Sequence: Synthetic oligonucleotide
  Target: SCN9A; (-) strand; PAM type: YTN; PAM sequence: TTG
tgtatggaggttctcatgct

SEQ ID NO: 66963 - DNA, 20 bp, Artificial Sequence
  Description of Artificial Sequence: Synthetic oligonucleotide
  Target: SCN9A; (-) strand; PAM type: YTN; PAM sequence: TTG
tcaggttgtgtatggaggtt

SEQ ID NO: 66964 - DNA, 20 bp, Artificial Sequence
  Description of Artificial Sequence: Synthetic oligonucleotide
  Target: SCN9A; (-) strand; PAM type: YTN; PAM sequence: CTT
gtcaggttgtgtatggaggt

SEQ ID NO: 66965 - DNA, 20 bp, Artificial Sequence
  Description of Artificial Sequence: Synthetic oligonucleotide
  Target: SCN9A; (-) strand; PAM type: YTN; PAM sequence: TTC
ttgtcaggttgtgtatggag

SEQ ID NO: 66966 - DNA, 20 bp, Artificial Sequence
  Description of Artificial Sequence: Synthetic oligonucleotide
  Target: SCN9A; (-) strand; PAM type: YTN; PAM sequence: TTT
cttgtcaggttgtgtatgga

SEQ ID NO: 66967 - DNA, 20 bp, Artificial Sequence
  Description of Artificial Sequence: Synthetic oligonucleotide
  Target: SCN9A; (-) strand; PAM type: YTN; PAM sequence: CTT
tcttgtcaggttgtgtatgg

SEQ ID NO: 66968 - DNA, 20 bp, Artificial Sequence
  Description of Artificial Sequence: Synthetic oligonucleotide
  Target: SCN9A; (-) strand; PAM type: YTN; PAM sequence: TTA
acatgcatgtctttcttgtc

SEQ ID NO: 66969 - DNA, 20 bp, Artificial Sequence
  Description of Artificial Sequence: Synthetic oligonucleotide
  Target: SCN9A; (-) strand; PAM type: YTN; PAM sequence: TTT
aacatgcatgtctttcttgt

SEQ ID NO: 66970 - DNA, 20 bp, Artificial Sequence
  Description of Artificial Sequence: Synthetic oligonucleotide
  Target: SCN9A; (-) strand; PAM type: YTN; PAM sequence: CTG
aatatcaagatttaacatgc

SEQ ID NO: 66971 - DNA, 20 bp, Artificial Sequence
  Description of Artificial Sequence: Synthetic oligonucleotide
  Target: SCN9A; (-) strand; PAM type: YTN; PAM sequence: TTC
tgaatatcaagatttaacat

SEQ ID NO: 66972 - DNA, 20 bp, Artificial Sequence
  Description of Artificial Sequence: Synthetic oligonucleotide
  Target: SCN9A; (-) strand; PAM type: YTN; PAM sequence: TTA
ttctgaatatcaagatttaa

SEQ ID NO: 66973 - DNA, 20 bp, Artificial Sequence
  Description of Artificial Sequence: Synthetic oligonucleotide
  Target: SCN9A; (-) strand; PAM type: YTN; PAM sequence: TTT
attctgaatatcaagattta

SEQ ID NO: 66974 - DNA, 20 bp, Artificial Sequence
  Description of Artificial Sequence: Synthetic oligonucleotide
  Target: SCN9A; (-) strand; PAM type: YTN; PAM sequence: TTA
tttattctgaatatcaagat

SEQ ID NO: 66975 - DNA, 20 bp, Artificial Sequence
  Description of Artificial Sequence: Synthetic oligonucleotide
  Target: SCN9A; (-) strand; PAM type: YTN; PAM sequence: TTT
atttattctgaatatcaaga

SEQ ID NO: 66976 - DNA, 20 bp, Artificial Sequence
  Description of Artificial Sequence: Synthetic oligonucleotide
  Target: SCN9A; (-) strand; PAM type: YTN; PAM sequence: TTT
tatttattctgaatatcaag

SEQ ID NO: 66977 - DNA, 20 bp, Artificial Sequence
  Description of Artificial Sequence: Synthetic oligonucleotide
  Target: SCN9A; (-) strand; PAM type: YTN; PAM sequence: TTA
aaaattttatttattctgaa

SEQ ID NO: 66978 - DNA, 20 bp, Artificial Sequence
  Description of Artificial Sequence: Synthetic oligonucleotide
  Target: SCN9A; (-) strand; PAM type: YTN; PAM sequence: TTA
aataatgtattaaaaatttt

SEQ ID NO: 66979 - DNA, 20 bp, Artificial Sequence
  Description of Artificial Sequence: Synthetic oligonucleotide
  Target: SCN9A; (-) strand; PAM type: YTN; PAM sequence: TTG
cattaaataatgtattaaaa

SEQ ID NO: 66980 - DNA, 20 bp, Artificial Sequence
  Description of Artificial Sequence: Synthetic oligonucleotide
  Target: SCN9A; (-) strand; PAM type: YTN; PAM sequence: TTT
gcattaaataatgtattaaa

SEQ ID NO: 66981 - DNA, 20 bp, Artificial Sequence
  Description of Artificial Sequence: Synthetic oligonucleotide
  Target: SCN9A; (-) strand; PAM type: YTN; PAM sequence: TTG
agggagtatcacagaaagca

SEQ ID NO: 66982 - DNA, 20 bp, Artificial Sequence
  Description of Artificial Sequence: Synthetic oligonucleotide
  Target: SCN9A; (-) strand; PAM type: YTN; PAM sequence: TTG
gttgagggagtatcacagaa

SEQ ID NO: 66983 - DNA, 20 bp, Artificial Sequence
  Description of Artificial Sequence: Synthetic oligonucleotide
  Target: SCN9A; (-) strand; PAM type: YTN; PAM sequence: TTT
ggttgagggagtatcacaga

SEQ ID NO: 66984 - DNA, 20 bp, Artificial Sequence
  Description of Artificial Sequence: Synthetic oligonucleotide
  Target: SCN9A; (-) strand; PAM type: YTN; PAM sequence: TTA
tttggttgagggagtatcac

SEQ ID NO: 66985 - DNA, 20 bp, Artificial Sequence
  Description of Artificial Sequence: Synthetic oligonucleotide
  Target: SCN9A; (-) strand; PAM type: YTN; PAM sequence: TTG
aaattatttggttgagggag

SEQ ID NO: 66986 - DNA, 20 bp, Artificial Sequence
  Description of Artificial Sequence: Synthetic oligonucleotide
  Target: SCN9A; (-) strand; PAM type: YTN; PAM sequence: TTG
caagtataggtgttgaaatt

SEQ ID NO: 66987 - DNA, 20 bp, Artificial Sequence
  Description of Artificial Sequence: Synthetic oligonucleotide
  Target: SCN9A; (-) strand; PAM type: YTN; PAM sequence: CTG
aaattgcaagtataggtgtt

SEQ ID NO: 66988 - DNA, 20 bp, Artificial Sequence
  Description of Artificial Sequence: Synthetic oligonucleotide
  Target: SCN9A; (-) strand; PAM type: YTN; PAM sequence: CTA
tctgaaattgcaagtatagg

SEQ ID NO: 66989 - DNA, 20 bp, Artificial Sequence
  Description of Artificial Sequence: Synthetic oligonucleotide
  Target: SCN9A; (-) strand; PAM type: YTN; PAM sequence: TTA
aatctatctgaaattgcaag

SEQ ID NO: 66990 - DNA, 20 bp, Artificial Sequence
  Description of Artificial Sequence: Synthetic oligonucleotide
  Target: SCN9A; (-) strand; PAM type: YTN; PAM sequence: TTA
gaagatgaaggaaggcagca

SEQ ID NO: 66991 - DNA, 20 bp, Artificial Sequence
  Description of Artificial Sequence: Synthetic oligonucleotide
  Target: SCN9A; (-) strand; PAM type: YTN; PAM sequence: TTA
gaaaacatcatgcaaagtta

SEQ ID NO: 66992 - DNA, 20 bp, Artificial Sequence
  Description of Artificial Sequence: Synthetic oligonucleotide
  Target: SCN9A; (-) strand; PAM type: YTN; PAM sequence: TTT
agaaaacatcatgcaaagtt

SEQ ID NO: 66993 - DNA, 20 bp, Artificial Sequence
  Description of Artificial Sequence: Synthetic oligonucleotide
  Target: SCN9A; (-) strand; PAM type: YTN; PAM sequence: CTA
tttagaaaacatcatgcaaa

SEQ ID NO: 66994 - DNA, 20 bp, Artificial Sequence
  Description of Artificial Sequence: Synthetic oligonucleotide
  Target: SCN9A; (-) strand; PAM type: YTN; PAM sequence: CTA
acaactatttagaaaacatc

SEQ ID NO: 66995 - DNA, 20 bp, Artificial Sequence
  Description of Artificial Sequence: Synthetic oligonucleotide
  Target: SCN9A; (-) strand; PAM type: YTN; PAM sequence: CTA
actaacaactatttagaaaa

SEQ ID NO: 66996 - DNA, 20 bp, Artificial Sequence
  Description of Artificial Sequence: Synthetic oligonucleotide
  Target: SCN9A; (-) strand; PAM type: YTN; PAM sequence: CTA
aaactaactaacaactattt

SEQ ID NO: 66997 - DNA, 20 bp, Artificial Sequence
  Description of Artificial Sequence: Synthetic oligonucleotide
  Target: SCN9A; (-) strand; PAM type: YTN; PAM sequence: TTG
taagctaaaactaactaaca

SEQ ID NO: 66998 - DNA, 20 bp, Artificial Sequence
  Description of Artificial Sequence: Synthetic oligonucleotide
  Target: SCN9A; (-) strand; PAM type: YTN; PAM sequence: TTA
cagaagacaagaatacattg

SEQ ID NO: 66999 - DNA, 20 bp, Artificial Sequence
  Description of Artificial Sequence: Synthetic oligonucleotide
  Target: SCN9A; (-) strand; PAM type: YTN; PAM sequence: TTG
gggattacagaagacaagaa

SEQ ID NO: 67000 - DNA, 20 bp, Artificial Sequence
  Description of Artificial Sequence: Synthetic oligonucleotide
  Target: SCN9A; (-) strand; PAM type: YTN; PAM sequence: CTG
aagagaaattggggattaca

SEQ ID NO: 67001 - DNA, 20 bp, Artificial Sequence
  Description of Artificial Sequence: Synthetic oligonucleotide
  Target: SCN9A; (-) strand; PAM type: YTN; PAM sequence: CTG
tggaggagactgaagagaaa

SEQ ID NO: 67002 - DNA, 20 bp, Artificial Sequence
  Description of Artificial Sequence: Synthetic oligonucleotide
  Target: SCN9A; (-) strand; PAM type: YTN; PAM sequence: TTA
aagactgtggaggagactga

SEQ ID NO: 67003 - DNA, 20 bp, Artificial Sequence
  Description of Artificial Sequence: Synthetic oligonucleotide
  Target: SCN9A; (-) strand; PAM type: YTN; PAM sequence: TTT
aaagactgtggaggagactg

SEQ ID NO: 67004 - DNA, 20 bp, Artificial Sequence
  Description of Artificial Sequence: Synthetic oligonucleotide
  Target: SCN9A; (-) strand; PAM type: YTN; PAM sequence: TTC
acacataaaatgaaagtggt

SEQ ID NO: 67005 - DNA, 20 bp, Artificial Sequence
  Description of Artificial Sequence: Synthetic oligonucleotide
  Target: SCN9A; (-) strand; PAM type: YTN; PAM sequence: TTC
attcacacataaaatgaaag

SEQ ID NO: 67006 - DNA, 20 bp, Artificial Sequence
  Description of Artificial Sequence: Synthetic oligonucleotide
  Target: SCN9A; (-) strand; PAM type: YTN; PAM sequence: TTC
attcattcacacataaaatg

SEQ ID NO: 67007 - DNA, 20 bp, Artificial Sequence
  Description of Artificial Sequence: Synthetic oligonucleotide
  Target: SCN9A; (-) strand; PAM type: YTN; PAM sequence: TTC
attcattcattcacacataa

SEQ ID NO: 67008 - DNA, 20 bp, Artificial Sequence
  Description of Artificial Sequence: Synthetic oligonucleotide
  Target: SCN9A; (-) strand; PAM type: YTN; PAM sequence: TTA
gttcattcattcattcacac

SEQ ID NO: 67009 - DNA, 20 bp, Artificial Sequence
  Description of Artificial Sequence: Synthetic oligonucleotide
  Target: SCN9A; (-) strand; PAM type: YTN; PAM sequence: TTT
agttcattcattcattcaca

SEQ ID NO: 67010 - DNA, 20 bp, Artificial Sequence
  Description of Artificial Sequence: Synthetic oligonucleotide
  Target: SCN9A; (-) strand; PAM type: YTN; PAM sequence: TTT
tagttcattcattcattcac

SEQ ID NO: 67011 - DNA, 20 bp, Artificial Sequence
  Description of Artificial Sequence: Synthetic oligonucleotide
  Target: SCN9A; (-) strand; PAM type: YTN; PAM sequence: TTC
agattttagttcattcattc

SEQ ID NO: 67012 - DNA, 20 bp, Artificial Sequence
  Description of Artificial Sequence: Synthetic oligonucleotide
  Target: SCN9A; (-) strand; PAM type: YTN; PAM sequence: CTT
cagattttagttcattcatt

SEQ ID NO: 67013 - DNA, 20 bp, Artificial Sequence
  Description of Artificial Sequence: Synthetic oligonucleotide
  Target: SCN9A; (-) strand; PAM type: YTN; PAM sequence: TTC
atgtcgtcttcagattttag

SEQ ID NO: 67014 - DNA, 20 bp, Artificial Sequence
  Description of Artificial Sequence: Synthetic oligonucleotide
  Target: SCN9A; (-) strand; PAM type: YTN; PAM sequence: CTA
aaattcatgtcgtcttcaga

SEQ ID NO: 67015 - DNA, 20 bp, Artificial Sequence
  Description of Artificial Sequence: Synthetic oligonucleotide
  Target: SCN9A; (-) strand; PAM type: YTN; PAM sequence: CTG
tcagaaaagaagaccctaaa

SEQ ID NO: 67016 - DNA, 20 bp, Artificial Sequence
  Description of Artificial Sequence: Synthetic oligonucleotide
  Target: SCN9A; (-) strand; PAM type: YTN; PAM sequence: TTA
tctgtcagaaaagaagaccc

SEQ ID NO: 67017 - DNA, 20 bp, Artificial Sequence
  Description of Artificial Sequence: Synthetic oligonucleotide
  Target: SCN9A; (-) strand; PAM type: YTN; PAM sequence: TTT
atctgtcagaaaagaagacc

SEQ ID NO: 67018 - DNA, 20 bp, Artificial Sequence
  Description of Artificial Sequence: Synthetic oligonucleotide
  Target: SCN9A; (-) strand; PAM type: YTN; PAM sequence: CTA
gaaaaatttatctgtcagaa

SEQ ID NO: 67019 - DNA, 20 bp, Artificial Sequence
  Description of Artificial Sequence: Synthetic oligonucleotide
  Target: SCN9A; (-) strand; PAM type: YTN; PAM sequence: TTA
tagactagaaaaatttatct

SEQ ID NO: 67020 - DNA, 20 bp, Artificial Sequence
  Description of Artificial Sequence: Synthetic oligonucleotide
  Target: SCN9A; (-) strand; PAM type: YTN; PAM sequence: CTA
aaattatagactagaaaaat

SEQ ID NO: 67021 - DNA, 20 bp, Artificial Sequence
  Description of Artificial Sequence: Synthetic oligonucleotide
  Target: SCN9A; (-) strand; PAM type: YTN; PAM sequence: TTA
ccatagaggagtggaagtat

SEQ ID NO: 67022 - DNA, 20 bp, Artificial Sequence
  Description of Artificial Sequence: Synthetic oligonucleotide
  Target: SCN9A; (-) strand; PAM type: YTN; PAM sequence: TTT
accatagaggagtggaagta

SEQ ID NO: 67023 - DNA, 20 bp, Artificial Sequence
  Description of Artificial Sequence: Synthetic oligonucleotide
  Target: SCN9A; (-) strand; PAM type: YTN; PAM sequence: TTT
taccatagaggagtggaagt

SEQ ID NO: 67024 - DNA, 20 bp, Artificial Sequence
  Description of Artificial Sequence: Synthetic oligonucleotide
  Target: SCN9A; (-) strand; PAM type: YTN; PAM sequence: TTT
ttaccatagaggagtggaag

SEQ ID NO: 67025 - DNA, 20 bp, Artificial Sequence
  Description of Artificial Sequence: Synthetic oligonucleotide
  Target: SCN9A; (-) strand; PAM type: YTN; PAM sequence: TTC
agagggtttttaccatagag

SEQ ID NO: 67026 - DNA, 20 bp, Artificial Sequence
  Description of Artificial Sequence: Synthetic oligonucleotide
  Target: SCN9A; (-) strand; PAM type: YTN; PAM sequence: TTT
cagagggtttttaccataga

SEQ ID NO: 67027 - DNA, 20 bp, Artificial Sequence
  Description of Artificial Sequence: Synthetic oligonucleotide
  Target: SCN9A; (-) strand; PAM type: YTN; PAM sequence: TTA
gaaaggtgtatttcagaggg

SEQ ID NO: 67028 - DNA, 20 bp, Artificial Sequence
  Description of Artificial Sequence: Synthetic oligonucleotide
  Target: SCN9A; (-) strand; PAM type: YTN; PAM sequence: TTT
agaaaggtgtatttcagagg

SEQ ID NO: 67029 - DNA, 20 bp, Artificial Sequence
  Description of Artificial Sequence: Synthetic oligonucleotide
  Target: SCN9A; (-) strand; PAM type: YTN; PAM sequence: TTG
tttagaaaggtgtatttcag

SEQ ID NO: 67030 - DNA, 20 bp, Artificial Sequence
  Description of Artificial Sequence: Synthetic oligonucleotide
  Target: SCN9A; (-) strand; PAM type: YTN; PAM sequence: CTC
aatattgtttagaaaggtgt

SEQ ID NO: 67031 - DNA, 20 bp, Artificial Sequence
  Description of Artificial Sequence: Synthetic oligonucleotide
  Target: SCN9A; (-) strand; PAM type: YTN; PAM sequence: TTC
tcaatattgtttagaaaggt

SEQ ID NO: 67032 - DNA, 20 bp, Artificial Sequence
  Description of Artificial Sequence: Synthetic oligonucleotide
  Target: SCN9A; (-) strand; PAM type: YTN; PAM sequence: TTT
ctcaatattgtttagaaagg

SEQ ID NO: 67033 - DNA, 20 bp, Artificial Sequence
  Description of Artificial Sequence: Synthetic oligonucleotide
  Target: SCN9A; (-) strand; PAM type: YTN; PAM sequence: TTT
tctcaatattgtttagaaag

SEQ ID NO: 67034 - DNA, 20 bp, Artificial Sequence
  Description of Artificial Sequence: Synthetic oligonucleotide
  Target: SCN9A; (-) strand; PAM type: YTN; PAM sequence: CTA
attttctcaatattgtttag

SEQ ID NO: 67035 - DNA, 20 bp, Artificial Sequence
  Description of Artificial Sequence: Synthetic oligonucleotide
  Target: SCN9A; (-) strand; PAM type: YTN; PAM sequence: TTC
cactaattttctcaatattg

SEQ ID NO: 67036 - DNA, 20 bp, Artificial Sequence
  Description of Artificial Sequence: Synthetic oligonucleotide
  Target: SCN9A; (-) strand; PAM type: YTN; PAM sequence: TTT
ccactaattttctcaatatt

SEQ ID NO: 67037 - DNA, 20 bp, Artificial Sequence
  Description of Artificial Sequence: Synthetic oligonucleotide
  Target: SCN9A; (-) strand; PAM type: YTN; PAM sequence: TTC
aggagtttccactaattttc

SEQ ID NO: 67038 - DNA, 20 bp, Artificial Sequence
  Description of Artificial Sequence: Synthetic oligonucleotide
  Target: SCN9A; (-) strand; PAM type: YTN; PAM sequence: TTT
caggagtttccactaatttt

SEQ ID NO: 67039 - DNA, 20 bp, Artificial Sequence
  Description of Artificial Sequence: Synthetic oligonucleotide
  Target: SCN9A; (-) strand; PAM type: YTN; PAM sequence: TTA
atttcaggagtttccactaa

SEQ ID NO: 67040 - DNA, 20 bp, Artificial Sequence
  Description of Artificial Sequence: Synthetic oligonucleotide
  Target: SCN9A; (-) strand; PAM type: YTN; PAM sequence: CTT
aatttcaggagtttccacta

SEQ ID NO: 67041 - DNA, 20 bp, Artificial Sequence
  Description of Artificial Sequence: Synthetic oligonucleotide
  Target: SCN9A; (-) strand; PAM type: YTN; PAM sequence: TTG
aacttaatttcaggagtttc

SEQ ID NO: 67042 - DNA, 20 bp, Artificial Sequence
  Description of Artificial Sequence: Synthetic oligonucleotide
  Target: SCN9A; (-) strand; PAM type: YTN; PAM sequence: TTT
gaacttaatttcaggagttt

SEQ ID NO: 67043 - DNA, 20 bp, Artificial Sequence
  Description of Artificial Sequence: Synthetic oligonucleotide
  Target: SCN9A; (-) strand; PAM type: YTN; PAM sequence: TTT
tgaacttaatttcaggagtt

SEQ ID NO: 67044 - DNA, 20 bp, Artificial Sequence
  Description of Artificial Sequence: Synthetic oligonucleotide
  Target: SCN9A; (-) strand; PAM type: YTN; PAM sequence: CTT
ttgaacttaatttcaggagt

SEQ ID NO: 67045 - DNA, 20 bp, Artificial Sequence
  Description of Artificial Sequence: Synthetic oligonucleotide
  Target: SCN9A; (-) strand; PAM type: YTN; PAM sequence: TTC
ttttgaacttaatttcagga

SEQ ID NO: 67046 - DNA, 20 bp, Artificial Sequence
  Description of Artificial Sequence: Synthetic oligonucleotide
  Target: SCN9A; (-) strand; PAM type: YTN; PAM sequence: TTT
cttttgaacttaatttcagg

SEQ ID NO: 67047 - DNA, 20 bp, Artificial Sequence
  Description of Artificial Sequence: Synthetic oligonucleotide
  Target: SCN9A; (-) strand; PAM type: YTN; PAM sequence: CTA
atcaagatgagtttcttttg

SEQ ID NO: 67048 - DNA, 20 bp, Artificial Sequence
  Description of Artificial Sequence: Synthetic oligonucleotide
  Target: SCN9A; (-) strand; PAM type: YTN; PAM sequence: TTC
taatcaagatgagtttcttt

SEQ ID NO: 67049 - DNA, 20 bp, Artificial Sequence
  Description of Artificial Sequence: Synthetic oligonucleotide
  Target: SCN9A; (-) strand; PAM type: YTN; PAM sequence: CTT
ctaatcaagatgagtttctt

SEQ ID NO: 67050 - DNA, 20 bp, Artificial Sequence
  Description of Artificial Sequence: Synthetic oligonucleotide
  Target: SCN9A; (-) strand; PAM type: YTN; PAM sequence: CTG
gatcttctaatcaagatgag

SEQ ID NO: 67051 - DNA, 20 bp, Artificial Sequence
  Description of Artificial Sequence: Synthetic oligonucleotide
  Target: SCN9A; (-) strand; PAM type: YTN; PAM sequence: TTC
atctggatcttctaatcaag

SEQ ID NO: 67052 - DNA, 20 bp, Artificial Sequence
  Description of Artificial Sequence: Synthetic oligonucleotide
  Target: SCN9A; (-) strand; PAM type: YTN; PAM sequence: TTT
catctggatcttctaatcaa

SEQ ID NO: 67053 - DNA, 20 bp, Artificial Sequence
  Description of Artificial Sequence: Synthetic oligonucleotide
  Target: SCN9A; (-) strand; PAM type: YTN; PAM sequence: TTG
aaacagtttcatctggatct

SEQ ID NO: 67054 - DNA, 20 bp, Artificial Sequence
  Description of Artificial Sequence: Synthetic oligonucleotide
  Target: SCN9A; (-) strand; PAM type: YTN; PAM sequence: CTT
gaaacagtttcatctggatc

SEQ ID NO: 67055 - DNA, 20 bp, Artificial Sequence
  Description of Artificial Sequence: Synthetic oligonucleotide
  Target: SCN9A; (-) strand; PAM type: YTN; PAM sequence: TTA
gaatacttgaaacagtttca

SEQ ID NO: 67056 - DNA, 20 bp, Artificial Sequence
  Description of Artificial Sequence: Synthetic oligonucleotide
  Target: SCN9A; (-) strand; PAM type: YTN; PAM sequence: CTT
agaatacttgaaacagtttc

SEQ ID NO: 67057 - DNA, 20 bp, Artificial Sequence
  Description of Artificial Sequence: Synthetic oligonucleotide
  Target: SCN9A; (-) strand; PAM type: YTN; PAM sequence: TTA
acttagaatacttgaaacag

SEQ ID NO: 67058 - DNA, 20 bp, Artificial Sequence
  Description of Artificial Sequence: Synthetic oligonucleotide
  Target: SCN9A; (-) strand; PAM type: YTN; PAM sequence: TTT
aacttagaatacttgaaaca

SEQ ID NO: 67059 - DNA, 20 bp, Artificial Sequence
  Description of Artificial Sequence: Synthetic oligonucleotide
  Target: SCN9A; (-) strand; PAM type: YTN; PAM sequence: TTT
taacttagaatacttgaaac

SEQ ID NO: 67060 - DNA, 20 bp, Artificial Sequence
  Description of Artificial Sequence: Synthetic oligonucleotide
  Target: SCN9A; (-) strand; PAM type: YTN; PAM sequence: TTT
ttaacttagaatacttgaaa

SEQ ID NO: 67061 - DNA, 20 bp, Artificial Sequence
  Description of Artificial Sequence: Synthetic oligonucleotide
  Target: SCN9A; (-) strand; PAM type: YTN; PAM sequence: TTG
tttttaacttagaatacttg

SEQ ID NO: 67062 - DNA, 20 bp, Artificial Sequence
  Description of Artificial Sequence: Synthetic oligonucleotide
  Target: SCN9A; (-) strand; PAM type: YTN; PAM sequence: TTT
gtttttaacttagaatactt

SEQ ID NO: 67063 - DNA, 20 bp, Artificial Sequence
  Description of Artificial Sequence: Synthetic oligonucleotide
  Target: SCN9A; (-) strand; PAM type: YTN; PAM sequence: TTA
aagtcacatttgtttttaac

SEQ ID NO: 67064 - DNA, 20 bp, Artificial Sequence
  Description of Artificial Sequence: Synthetic oligonucleotide
  Target: SCN9A; (-) strand; PAM type: YTN; PAM sequence: TTT
aaagtcacatttgtttttaa

SEQ ID NO: 67065 - DNA, 20 bp, Artificial Sequence
  Description of Artificial Sequence: Synthetic oligonucleotide
  Target: SCN9A; (-) strand; PAM type: YTN; PAM sequence: TTG
tacataaaaatttaaagtca

SEQ ID NO: 67066 - DNA, 20 bp, Artificial Sequence
  Description of Artificial Sequence: Synthetic oligonucleotide
  Target: SCN9A; (-) strand; PAM type: YTN; PAM sequence: TTT
gtacataaaaatttaaagtc

SEQ ID NO: 67067 - DNA, 20 bp, Artificial Sequence
  Description of Artificial Sequence: Synthetic oligonucleotide
  Target: SCN9A; (-) strand; PAM type: YTN; PAM sequence: TTT
tgtacataaaaatttaaagt

SEQ ID NO: 67068 - DNA, 20 bp, Artificial Sequence
  Description of Artificial Sequence: Synthetic oligonucleotide
  Target: SCN9A; (-) strand; PAM type: YTN; PAM sequence: TTG
tagcagtatattttgtacat

SEQ ID NO: 67069 - DNA, 20 bp, Artificial Sequence
  Description of Artificial Sequence: Synthetic oligonucleotide
  Target: SCN9A; (-) strand; PAM type: YTN; PAM sequence: TTT
gtagcagtatattttgtaca

SEQ ID NO: 67070 - DNA, 20 bp, Artificial Sequence
  Description of Artificial Sequence: Synthetic oligonucleotide
  Target: SCN9A; (-) strand; PAM type: YTN; PAM sequence: TTT
tgtagcagtatattttgtac

SEQ ID NO: 67071 - DNA, 20 bp, Artificial Sequence
  Description of Artificial Sequence: Synthetic oligonucleotide
  Target: SCN9A; (-) strand; PAM type: YTN; PAM sequence: TTT
ttgtagcagtatattttgta

SEQ ID NO: 67072 - DNA, 20 bp, Artificial Sequence
  Description of Artificial Sequence: Synthetic oligonucleotide
  Target: SCN9A; (-) strand; PAM type: YTN; PAM sequence: TTT
tttgtagcagtatattttgt

SEQ ID NO: 67073 - DNA, 20 bp, Artificial Sequence
  Description of Artificial Sequence: Synthetic oligonucleotide
  Target: SCN9A; (-) strand; PAM type: YTN; PAM sequence: TTC
aattttttgtagcagtatat

SEQ ID NO: 67074 - DNA, 20 bp, Artificial Sequence
  Description of Artificial Sequence: Synthetic oligonucleotide
  Target: SCN9A; (-) strand; PAM type: YTN; PAM sequence: TTT
caattttttgtagcagtata

SEQ ID NO: 67075 - DNA, 20 bp, Artificial Sequence
  Description of Artificial Sequence: Synthetic oligonucleotide
  Target: SCN9A; (-) strand; PAM type: YTN; PAM sequence: TTT
tcaattttttgtagcagtat

SEQ ID NO: 67076 - DNA, 20 bp, Artificial Sequence
  Description of Artificial Sequence: Synthetic oligonucleotide
  Target: SCN9A; (-) strand; PAM type: YTN; PAM sequence: TTA
agtacaattttcaatttttt

SEQ ID NO: 67077 - DNA, 20 bp, Artificial Sequence
  Description of Artificial Sequence: Synthetic oligonucleotide
  Target: SCN9A; (-) strand; PAM type: YTN; PAM sequence: TTT
aagtacaattttcaattttt

SEQ ID NO: 67078 - DNA, 20 bp, Artificial Sequence
  Description of Artificial Sequence: Synthetic oligonucleotide
  Target: SCN9A; (-) strand; PAM type: YTN; PAM sequence: TTT
taagtacaattttcaatttt

SEQ ID NO: 67079 - DNA, 20 bp, Artificial Sequence
  Description of Artificial Sequence: Synthetic oligonucleotide
  Target: SCN9A; (-) strand; PAM type: YTN; PAM sequence: TTT
ttaagtacaattttcaattt

SEQ ID NO: 67080 - DNA, 20 bp, Artificial Sequence
  Description of Artificial Sequence: Synthetic oligonucleotide
  Target: SCN9A; (-) strand; PAM type: YTN; PAM sequence: CTA
accatttttaagtacaattt

SEQ ID NO: 67081 - DNA, 20 bp, Artificial Sequence
  Description of Artificial Sequence: Synthetic oligonucleotide
  Target: SCN9A; (-) strand; PAM type: YTN; PAM sequence: TTA
atgaatgaataaacctaacc

SEQ ID NO: 67082 - DNA, 20 bp, Artificial Sequence
  Description of Artificial Sequence: Synthetic oligonucleotide
  Target: SCN9A; (-) strand; PAM type: YTN; PAM sequence: TTG
atggacaaaagaatgcgtta

SEQ ID NO: 67083 - DNA, 20 bp, Artificial Sequence
  Description of Artificial Sequence: Synthetic oligonucleotide
  Target: SCN9A; (-) strand; PAM type: YTN; PAM sequence: TTT
gatggacaaaagaatgcgtt

SEQ ID NO: 67084 - DNA, 20 bp, Artificial Sequence
  Description of Artificial Sequence: Synthetic oligonucleotide
  Target: SCN9A; (-) strand; PAM type: YTN; PAM sequence: CTG
aggaaaggaaatcatgtaca

SEQ ID NO: 67085 - DNA, 20 bp, Artificial Sequence
  Description of Artificial Sequence: Synthetic oligonucleotide
  Target: SCN9A; (-) strand; PAM type: YTN; PAM sequence: TTC
actgaggaaaggaaatcatg

SEQ ID NO: 67086 - DNA, 20 bp, Artificial Sequence
  Description of Artificial Sequence: Synthetic oligonucleotide
  Target: SCN9A; (-) strand; PAM type: YTN; PAM sequence: CTA
acataaattcactgaggaaa

SEQ ID NO: 67087 - DNA, 20 bp, Artificial Sequence
  Description of Artificial Sequence: Synthetic oligonucleotide
  Target: SCN9A; (-) strand; PAM type: YTN; PAM sequence: CTA
accaaaacctaacataaatt

SEQ ID NO: 67088 - DNA, 20 bp, Artificial Sequence
  Description of Artificial Sequence: Synthetic oligonucleotide
  Target: SCN9A; (-) strand; PAM type: YTN; PAM sequence: CTA
cctaaccaaaacctaacata

SEQ ID NO: 67089 - DNA, 20 bp, Artificial Sequence
  Description of Artificial Sequence: Synthetic oligonucleotide
  Target: SCN9A; (-) strand; PAM type: YTN; PAM sequence: TTA
tctacctaaccaaaacctaa

SEQ ID NO: 67090 - DNA, 20 bp, Artificial Sequence
  Description of Artificial Sequence: Synthetic oligonucleotide
  Target: SCN9A; (-) strand; PAM type: YTN; PAM sequence: TTT
atctacctaaccaaaaccta

SEQ ID NO: 67091 - DNA, 20 bp, Artificial Sequence
  Description of Artificial Sequence: Synthetic oligonucleotide
  Target: SCN9A; (-) strand; PAM type: YTN; PAM sequence: TTT
tatctacctaaccaaaacct

SEQ ID NO: 67092 - DNA, 20 bp, Artificial Sequence
  Description of Artificial Sequence: Synthetic oligonucleotide
  Target: SCN9A; (-) strand; PAM type: YTN; PAM sequence: TTT
ttatctacctaaccaaaacc

SEQ ID NO: 67093 - DNA, 20 bp, Artificial Sequence
  Description of Artificial Sequence: Synthetic oligonucleotide
  Target: SCN9A; (-) strand; PAM type: YTN; PAM sequence: CTG
tttttatctacctaaccaaa

SEQ ID NO: 67094 - DNA, 20 bp, Artificial Sequence
  Description of Artificial Sequence: Synthetic oligonucleotide
  Target: SCN9A; (-) strand; PAM type: YTN; PAM sequence: TTC
tgtttttatctacctaacca

SEQ ID NO: 67095 - DNA, 20 bp, Artificial Sequence
  Description of Artificial Sequence: Synthetic oligonucleotide
  Target: SCN9A; (-) strand; PAM type: YTN; PAM sequence: TTT
ctgtttttatctacctaacc

SEQ ID NO: 67096 - DNA, 20 bp, Artificial Sequence
  Description of Artificial Sequence: Synthetic oligonucleotide
  Target: SCN9A; (-) strand; PAM type: YTN; PAM sequence: TTA
tttctgtttttatctaccta

SEQ ID NO: 67097 - DNA, 20 bp, Artificial Sequence
  Description of Artificial Sequence: Synthetic oligonucleotide
  Target: SCN9A; (-) strand; PAM type: YTN; PAM sequence: TTT
atttctgtttttatctacct

SEQ ID NO: 67098 - DNA, 20 bp, Artificial Sequence
  Description of Artificial Sequence: Synthetic oligonucleotide
  Target: SCN9A; (-) strand; PAM type: YTN; PAM sequence: TTA
tagtcatttatttctgtttt

SEQ ID NO: 67099 - DNA, 20 bp, Artificial Sequence
  Description of Artificial Sequence: Synthetic oligonucleotide
  Target: SCN9A; (-) strand; PAM type: YTN; PAM sequence: CTA
gttatagtcatttatttctg

SEQ ID NO: 67100 - DNA, 20 bp, Artificial Sequence
  Description of Artificial Sequence: Synthetic oligonucleotide
  Target: SCN9A; (-) strand; PAM type: YTN; PAM sequence: TTG
ccatatctagttatagtcat

SEQ ID NO: 67101 - DNA, 20 bp, Artificial Sequence
  Description of Artificial Sequence: Synthetic oligonucleotide
  Target: SCN9A; (-) strand; PAM type: YTN; PAM sequence: TTA
gttgccatatctagttatag

SEQ ID NO: 67102 - DNA, 20 bp, Artificial Sequence
  Description of Artificial Sequence: Synthetic oligonucleotide
  Target: SCN9A; (-) strand; PAM type: YTN; PAM sequence: TTT
agttgccatatctagttata

SEQ ID NO: 67103 - DNA, 20 bp, Artificial Sequence
  Description of Artificial Sequence: Synthetic oligonucleotide
  Target: SCN9A; (-) strand; PAM type: YTN; PAM sequence: CTT
tagttgccatatctagttat

SEQ ID NO: 67104 - DNA, 20 bp, Artificial Sequence
  Description of Artificial Sequence: Synthetic oligonucleotide
  Target: SCN9A; (-) strand; PAM type: YTN; PAM sequence: CTG
tcactttagttgccatatct

SEQ ID NO: 67105 - DNA, 20 bp, Artificial Sequence
  Description of Artificial Sequence: Synthetic oligonucleotide
  Target: SCN9A; (-) strand; PAM type: YTN; PAM sequence: CTA
tctgtcactttagttgccat

SEQ ID NO: 67106 - DNA, 20 bp, Artificial Sequence
  Description of Artificial Sequence: Synthetic oligonucleotide
  Target: SCN9A; (-) strand; PAM type: YTN; PAM sequence: CTG
actatctgtcactttagttg

SEQ ID NO: 67107 - DNA, 20 bp, Artificial Sequence
  Description of Artificial Sequence: Synthetic oligonucleotide
  Target: SCN9A; (-) strand; PAM type: YTN; PAM sequence: CTA
tcaaaatgaaccctgactat

SEQ ID NO: 67108 - DNA, 20 bp, Artificial Sequence
  Description of Artificial Sequence: Synthetic oligonucleotide
  Target: SCN9A; (-) strand; PAM type: YTN; PAM sequence: TTC
catgctatcaaaatgaaccc

SEQ ID NO: 67109 - DNA, 20 bp, Artificial Sequence
  Description of Artificial Sequence: Synthetic oligonucleotide
  Target: SCN9A; (-) strand; PAM type: YTN; PAM sequence: CTT
ccatgctatcaaaatgaacc

SEQ ID NO: 67110 - DNA, 20 bp, Artificial Sequence
  Description of Artificial Sequence: Synthetic oligonucleotide
  Target: SCN9A; (-) strand; PAM type: YTN; PAM sequence: TTC
ttccatgctatcaaaatgaa

SEQ ID NO: 67111 - DNA, 20 bp, Artificial Sequence
  Description of Artificial Sequence: Synthetic oligonucleotide
  Target: SCN9A; (-) strand; PAM type: YTN; PAM sequence: TTT
cttccatgctatcaaaatga

SEQ ID NO: 67112 - DNA, 20 bp, Artificial Sequence
  Description of Artificial Sequence: Synthetic oligonucleotide
  Target: SCN9A; (-) strand; PAM type: YTN; PAM sequence: TTG
atttcttccatgctatcaaa

SEQ ID NO: 67113 - DNA, 20 bp, Artificial Sequence
  Description of Artificial Sequence: Synthetic oligonucleotide
  Target: SCN9A; (-) strand; PAM type: YTN; PAM sequence: CTC
aagaaataagccaggtgaga

SEQ ID NO: 67114 - DNA, 20 bp, Artificial Sequence
  Description of Artificial Sequence: Synthetic oligonucleotide
  Target: SCN9A; (-) strand; PAM type: YTN; PAM sequence: TTC
tcaagaaataagccaggtga

SEQ ID NO: 67115 - DNA, 20 bp, Artificial Sequence
  Description of Artificial Sequence: Synthetic oligonucleotide
  Target: SCN9A; (-) strand; PAM type: YTN; PAM sequence: TTT
ctcaagaaataagccaggtg

SEQ ID NO: 67116 - DNA, 20 bp, Artificial Sequence
  Description of Artificial Sequence: Synthetic oligonucleotide
  Target: SCN9A; (-) strand; PAM type: YTN; PAM sequence: CTT
tctcaagaaataagccaggt

SEQ ID NO: 67117 - DNA, 20 bp, Artificial Sequence
  Description of Artificial Sequence: Synthetic oligonucleotide
  Target: SCN9A; (-) strand; PAM type: YTN; PAM sequence: CTC
tttctcaagaaataagccag

SEQ ID NO: 67118 - DNA, 20 bp, Artificial Sequence
  Description of Artificial Sequence: Synthetic oligonucleotide
  Target: SCN9A; (-) strand; PAM type: YTN; PAM sequence: CTC
tctttctcaagaaataagcc

SEQ ID NO: 67119 - DNA, 20 bp, Artificial Sequence
  Description of Artificial Sequence: Synthetic oligonucleotide
  Target: SCN9A; (-) strand; PAM type: YTN; PAM sequence: CTG
atctctctttctcaagaaat

SEQ ID NO: 67120 - DNA, 20 bp, Artificial Sequence
  Description of Artificial Sequence: Synthetic oligonucleotide
  Target: SCN9A; (-) strand; PAM type: YTN; PAM sequence: CTA
ctgatctctctttctcaaga

SEQ ID NO: 67121 - DNA, 20 bp, Artificial Sequence
  Description of Artificial Sequence: Synthetic oligonucleotide
  Target: SCN9A; (-) strand; PAM type: YTN; PAM sequence: CTC
tactgatctctctttctcaa

SEQ ID NO: 67122 - DNA, 20 bp, Artificial Sequence
  Description of Artificial Sequence: Synthetic oligonucleotide
  Target: SCN9A; (-) strand; PAM type: YTN; PAM sequence: CTA
ggaagcctctactgatctct

SEQ ID NO: 67123 - DNA, 20 bp, Artificial Sequence
  Description of Artificial Sequence: Synthetic oligonucleotide
  Target: SCN9A; (-) strand; PAM type: YTN; PAM sequence: TTC
taggaagcctctactgatct

SEQ ID NO: 67124 - DNA, 20 bp, Artificial Sequence
  Description of Artificial Sequence: Synthetic oligonucleotide
  Target: SCN9A; (-) strand; PAM type: YTN; PAM sequence: CTT
ctaggaagcctctactgatc

SEQ ID NO: 67125 - DNA, 20 bp, Artificial Sequence
  Description of Artificial Sequence: Synthetic oligonucleotide
  Target: SCN9A; (-) strand; PAM type: YTN; PAM sequence: CTC
ttctaggaagcctctactga

SEQ ID NO: 67126 - DNA, 20 bp, Artificial Sequence
  Description of Artificial Sequence: Synthetic oligonucleotide
  Target: SCN9A; (-) strand; PAM type: YTN; PAM sequence: CTC
catctcttctaggaagcctc

SEQ ID NO: 67127 - DNA, 20 bp, Artificial Sequence
  Description of Artificial Sequence: Synthetic oligonucleotide
  Target: SCN9A; (-) strand; PAM type: YTN; PAM sequence: TTC
aacccaggctccatctcttc

SEQ ID NO: 67128 - DNA, 20 bp, Artificial Sequence
  Description of Artificial Sequence: Synthetic oligonucleotide
  Target: SCN9A; (-) strand; PAM type: YTN; PAM sequence: TTG
attcaacccaggctccatct

SEQ ID NO: 67129 - DNA, 20 bp, Artificial Sequence
  Description of Artificial Sequence: Synthetic oligonucleotide
  Target: SCN9A; (-) strand; PAM type: YTN; PAM sequence: TTT
gattcaacccaggctccatc

SEQ ID NO: 67130 - DNA, 20 bp, Artificial Sequence
  Description of Artificial Sequence: Synthetic oligonucleotide
  Target: SCN9A; (-) strand; PAM type: YTN; PAM sequence: TTT
tgattcaacccaggctccat

SEQ ID NO: 67131 - DNA, 20 bp, Artificial Sequence
  Description of Artificial Sequence: Synthetic oligonucleotide
  Target: SCN9A; (-) strand; PAM type: YTN; PAM sequence: CTG
atattttgattcaacccagg

SEQ ID NO: 67132 - DNA, 20 bp, Artificial Sequence
  Description of Artificial Sequence: Synthetic oligonucleotide
  Target: SCN9A; (-) strand; PAM type: YTN; PAM sequence: TTA
ctgatattttgattcaaccc

SEQ ID NO: 67133 - DNA, 20 bp, Artificial Sequence
  Description of Artificial Sequence: Synthetic oligonucleotide
  Target: SCN9A; (-) strand; PAM type: YTN; PAM sequence: TTT
actgatattttgattcaacc

SEQ ID NO: 67134 - DNA, 20 bp, Artificial Sequence
  Description of Artificial Sequence: Synthetic oligonucleotide
  Target: SCN9A; (-) strand; PAM type: YTN; PAM sequence: TTT
tactgatattttgattcaac

SEQ ID NO: 67135 - DNA, 20 bp, Artificial Sequence
  Description of Artificial Sequence: Synthetic oligonucleotide
  Target: SCN9A; (-) strand; PAM type: YTN; PAM sequence: TTT
ttactgatattttgattcaa

SEQ ID NO: 67136 - DNA, 20 bp, Artificial Sequence
  Description of Artificial Sequence: Synthetic oligonucleotide
  Target: SCN9A; (-) strand; PAM type: YTN; PAM sequence: TTT
tttactgatattttgattca

SEQ ID NO: 67137 - DNA, 20 bp, Artificial Sequence
  Description of Artificial Sequence: Synthetic oligonucleotide
  Target: SCN9A; (-) strand; PAM type: YTN; PAM sequence: CTT
ttttactgatattttgattc

SEQ ID NO: 67138 - DNA, 20 bp, Artificial Sequence
  Description of Artificial Sequence: Synthetic oligonucleotide
  Target: SCN9A; (-) strand; PAM type: YTN; PAM sequence: CTC
ttttttactgatattttgat

SEQ ID NO: 67139 - DNA, 20 bp, Artificial Sequence
  Description of Artificial Sequence: Synthetic oligonucleotide
  Target: SCN9A; (-) strand; PAM type: YTN; PAM sequence: TTC
cacccaaactcttttttact

SEQ ID NO: 67140 - DNA, 20 bp, Artificial Sequence
  Description of Artificial Sequence: Synthetic oligonucleotide
  Target: SCN9A; (-) strand; PAM type: YTN; PAM sequence: CTG
gaattccacccaaactcttt

SEQ ID NO: 67141 - DNA, 20 bp, Artificial Sequence
  Description of Artificial Sequence: Synthetic oligonucleotide
  Target: SCN9A; (-) strand; PAM type: YTN; PAM sequence: CTG
cctggaattccacccaaact

SEQ ID NO: 67142 - DNA, 20 bp, Artificial Sequence
  Description of Artificial Sequence: Synthetic oligonucleotide
  Target: SCN9A; (-) strand; PAM type: YTN; PAM sequence: TTG
ctgcctggaattccacccaa

SEQ ID NO: 67143 - DNA, 20 bp, Artificial Sequence
  Description of Artificial Sequence: Synthetic oligonucleotide
  Target: SCN9A; (-) strand; PAM type: YTN; PAM sequence: TTT
gctgcctggaattccaccca

SEQ ID NO: 67144 - DNA, 20 bp, Artificial Sequence
  Description of Artificial Sequence: Synthetic oligonucleotide
  Target: SCN9A; (-) strand; PAM type: YTN; PAM sequence: TTT
tgctgcctggaattccaccc

SEQ ID NO: 67145 - DNA, 20 bp, Artificial Sequence
  Description of Artificial Sequence: Synthetic oligonucleotide
  Target: SCN9A; (-) strand; PAM type: YTN; PAM sequence: TTT
ttgctgcctggaattccacc

SEQ ID NO: 67146 - DNA, 20 bp, Artificial Sequence
  Description of Artificial Sequence: Synthetic oligonucleotide
  Target: SCN9A; (-) strand; PAM type: YTN; PAM sequence: CTA
tgcataacaatttttgctgc

SEQ ID NO: 67147 - DNA, 20 bp, Artificial Sequence
  Description of Artificial Sequence: Synthetic oligonucleotide
  Target: SCN9A; (-) strand; PAM type: YTN; PAM sequence: TTC
tatgcataacaatttttgct

SEQ ID NO: 67148 - DNA, 20 bp, Artificial Sequence
  Description of Artificial Sequence: Synthetic oligonucleotide
  Target: SCN9A; (-) strand; PAM type: YTN; PAM sequence: TTT
ctatgcataacaatttttgc

SEQ ID NO: 67149 - DNA, 20 bp, Artificial Sequence
  Description of Artificial Sequence: Synthetic oligonucleotide
  Target: SCN9A; (-) strand; PAM type: YTN; PAM sequence: TTA
aatttctatgcataacaatt

SEQ ID NO: 67150 - DNA, 20 bp, Artificial Sequence
  Description of Artificial Sequence: Synthetic oligonucleotide
  Target: SCN9A; (-) strand; PAM type: YTN; PAM sequence: TTT
aaatttctatgcataacaat

SEQ ID NO: 67151 - DNA, 20 bp, Artificial Sequence
  Description of Artificial Sequence: Synthetic oligonucleotide
  Target: SCN9A; (-) strand; PAM type: YTN; PAM sequence: CTG
gtttaaatttctatgcataa

SEQ ID NO: 67152 - DNA, 20 bp, Artificial Sequence
  Description of Artificial Sequence: Synthetic oligonucleotide
  Target: SCN9A; (-) strand; PAM type: YTN; PAM sequence: CTA
aactggtttaaatttctatg

SEQ ID NO: 67153 - DNA, 20 bp, Artificial Sequence
  Description of Artificial Sequence: Synthetic oligonucleotide
  Target: SCN9A; (-) strand; PAM type: YTN; PAM sequence: TTC
taaactggtttaaatttcta

SEQ ID NO: 67154 - DNA, 20 bp, Artificial Sequence
  Description of Artificial Sequence: Synthetic oligonucleotide
  Target: SCN9A; (-) strand; PAM type: YTN; PAM sequence: TTG
catcacaattctaaactggt

SEQ ID NO: 67155 - DNA, 20 bp, Artificial Sequence
  Description of Artificial Sequence: Synthetic oligonucleotide
  Target: SCN9A; (-) strand; PAM type: YTN; PAM sequence: CTT
gcatcacaattctaaactgg

SEQ ID NO: 67156 - DNA, 20 bp, Artificial Sequence
  Description of Artificial Sequence: Synthetic oligonucleotide
  Target: SCN9A; (-) strand; PAM type: YTN; PAM sequence: CTG
cttgcatcacaattctaaac

SEQ ID NO: 67157 - DNA, 20 bp, Artificial Sequence
  Description of Artificial Sequence: Synthetic oligonucleotide
  Target: SCN9A; (-) strand; PAM type: YTN; PAM sequence: TTC
tgcttgcatcacaattctaa

SEQ ID NO: 67158 - DNA, 20 bp, Artificial Sequence
  Description of Artificial Sequence: Synthetic oligonucleotide
  Target: SCN9A; (-) strand; PAM type: YTN; PAM sequence: TTG
tgtacattctgcttgcatca

SEQ ID NO: 67159 - DNA, 20 bp, Artificial Sequence
  Description of Artificial Sequence: Synthetic oligonucleotide
  Target: SCN9A; (-) strand; PAM type: YTN; PAM sequence: CTT
gtgtacattctgcttgcatc

SEQ ID NO: 67160 - DNA, 20 bp, Artificial Sequence
  Description of Artificial Sequence: Synthetic oligonucleotide
  Target: SCN9A; (-) strand; PAM type: YTN; PAM sequence: CTC
ttgtgtacattctgcttgca

SEQ ID NO: 67161 - DNA, 20 bp, Artificial Sequence
  Description of Artificial Sequence: Synthetic oligonucleotide
  Target: SCN9A; (-) strand; PAM type: YTN; PAM sequence: TTG
cctcttgtgtacattctgct

SEQ ID NO: 67162 - DNA, 20 bp, Artificial Sequence
  Description of Artificial Sequence: Synthetic oligonucleotide
  Target: SCN9A; (-) strand; PAM type: YTN; PAM sequence: CTT
gcctcttgtgtacattctgc

SEQ ID NO: 67163 - DNA, 20 bp, Artificial Sequence
  Description of Artificial Sequence: Synthetic oligonucleotide
  Target: SCN9A; (-) strand; PAM type: YTN; PAM sequence: CTC
acccttgcctcttgtgtaca

SEQ ID NO: 67164 - DNA, 20 bp, Artificial Sequence
  Description of Artificial Sequence: Synthetic oligonucleotide
  Target: SCN9A; (-) strand; PAM type: YTN; PAM sequence: CTC
tcacccttgcctcttgtgta

SEQ ID NO: 67165 - DNA, 20 bp, Artificial Sequence
  Description of Artificial Sequence: Synthetic oligonucleotide
  Target: SCN9A; (-) strand; PAM type: YTN; PAM sequence: CTC
acctctcacccttgcctctt

SEQ ID NO: 67166 - DNA, 20 bp, Artificial Sequence
  Description of Artificial Sequence: Synthetic oligonucleotide
  Target: SCN9A; (-) strand; PAM type: YTN; PAM sequence: CTA
agctcacctctcacccttgc

SEQ ID NO: 67167 - DNA, 20 bp, Artificial Sequence
  Description of Artificial Sequence: Synthetic oligonucleotide
  Target: SCN9A; (-) strand; PAM type: YTN; PAM sequence: TTC
taagctcacctctcaccctt

SEQ ID NO: 67168 - DNA, 20 bp, Artificial Sequence
  Description of Artificial Sequence: Synthetic oligonucleotide
  Target: SCN9A; (-) strand; PAM type: YTN; PAM sequence: TTT
ctaagctcacctctcaccct

SEQ ID NO: 67169 - DNA, 20 bp, Artificial Sequence
  Description of Artificial Sequence: Synthetic oligonucleotide
  Target: SCN9A; (-) strand; PAM type: YTN; PAM sequence: TTT
tctaagctcacctctcaccc

SEQ ID NO: 67170 - DNA, 20 bp, Artificial Sequence
  Description of Artificial Sequence: Synthetic oligonucleotide
  Target: SCN9A; (-) strand; PAM type: YTN; PAM sequence: TTT
ttctaagctcacctctcacc

SEQ ID NO: 67171 - DNA, 20 bp, Artificial Sequence
  Description of Artificial Sequence: Synthetic oligonucleotide
  Target: SCN9A; (-) strand; PAM type: YTN; PAM sequence: CTG
accaatttttctaagctcac

SEQ ID NO: 67172 - DNA, 20 bp, Artificial Sequence
  Description of Artificial Sequence: Synthetic oligonucleotide
  Target: SCN9A; (-) strand; PAM type: YTN; PAM sequence: TTC
cataatctgaccaatttttc

SEQ ID NO: 67173 - DNA, 20 bp, Artificial Sequence
  Description of Artificial Sequence: Synthetic oligonucleotide
  Target: SCN9A; (-) strand; PAM type: YTN; PAM sequence: TTT
ccataatctgaccaattttt

SEQ ID NO: 67174 - DNA, 20 bp, Artificial Sequence
  Description of Artificial Sequence: Synthetic oligonucleotide
  Target: SCN9A; (-) strand; PAM type: YTN; PAM sequence: CTT
tccataatctgaccaatttt

SEQ ID NO: 67175 - DNA, 20 bp, Artificial Sequence
  Description of Artificial Sequence: Synthetic oligonucleotide
  Target: SCN9A; (-) strand; PAM type: YTN; PAM sequence: TTA
aggtaaaggccaatgctttc

SEQ ID NO: 67176 - DNA, 20 bp, Artificial Sequence
  Description of Artificial Sequence: Synthetic oligonucleotide
  Target: SCN9A; (-) strand; PAM type: YTN; PAM sequence: CTT
aaggtaaaggccaatgcttt

SEQ ID NO: 67177 - DNA, 20 bp, Artificial Sequence
  Description of Artificial Sequence: Synthetic oligonucleotide
  Target: SCN9A; (-) strand; PAM type: YTN; PAM sequence: CTC
cttaaggtaaaggccaatgc

SEQ ID NO: 67178 - DNA, 20 bp, Artificial Sequence
  Description of Artificial Sequence: Synthetic oligonucleotide
  Target: SCN9A; (-) strand; PAM type: YTN; PAM sequence: CTC
aataggatataagccaaact

SEQ ID NO: 67179 - DNA, 20 bp, Artificial Sequence
  Description of Artificial Sequence: Synthetic oligonucleotide
  Target: SCN9A; (-) strand; PAM type: YTN; PAM sequence: CTC
aacctcaataggatataagc

SEQ ID NO: 67180 - DNA, 20 bp, Artificial Sequence
  Description of Artificial Sequence: Synthetic oligonucleotide
  Target: SCN9A; (-) strand; PAM type: YTN; PAM sequence: CTC
ctcaacctcaataggatata

SEQ ID NO: 67181 - DNA, 20 bp, Artificial Sequence
  Description of Artificial Sequence: Synthetic oligonucleotide
  Target: SCN9A; (-) strand; PAM type: YTN; PAM sequence: TTA
ctcctcaacctcaataggat

SEQ ID NO: 67182 - DNA, 20 bp, Artificial Sequence
  Description of Artificial Sequence: Synthetic oligonucleotide
  Target: SCN9A; (-) strand; PAM type: YTN; PAM sequence: CTT
actcctcaacctcaatagga

SEQ ID NO: 67183 - DNA, 20 bp, Artificial Sequence
  Description of Artificial Sequence: Synthetic oligonucleotide
  Target: SCN9A; (-) strand; PAM type: YTN; PAM sequence: TTA
cttactcctcaacctcaata

SEQ ID NO: 67184 - DNA, 20 bp, Artificial Sequence
  Description of Artificial Sequence: Synthetic oligonucleotide
  Target: SCN9A; (-) strand; PAM type: YTN; PAM sequence: TTT
acttactcctcaacctcaat

SEQ ID NO: 67185 - DNA, 20 bp, Artificial Sequence
  Description of Artificial Sequence: Synthetic oligonucleotide
  Target: SCN9A; (-) strand; PAM type: YTN; PAM sequence: CTT
tacttactcctcaacctcaa

SEQ ID NO: 67186 - DNA, 20 bp, Artificial Sequence
  Description of Artificial Sequence: Synthetic oligonucleotide
  Target: SCN9A; (-) strand; PAM type: YTN; PAM sequence: TTA
taaccctttacttactcctc

SEQ ID NO: 67187 - DNA, 20 bp, Artificial Sequence
  Description of Artificial Sequence: Synthetic oligonucleotide
  Target: SCN9A; (-) strand; PAM type: YTN; PAM sequence: CTT
ataaccctttacttactcct

SEQ ID NO: 67188 - DNA, 20 bp, Artificial Sequence
  Description of Artificial Sequence: Synthetic oligonucleotide
  Target: SCN9A; (-) strand; PAM type: YTN; PAM sequence: CTG
cttataaccctttacttact

SEQ ID NO: 67189 - DNA, 20 bp, Artificial Sequence
  Description of Artificial Sequence: Synthetic oligonucleotide
  Target: SCN9A; (-) strand; PAM type: YTN; PAM sequence: TTC
cctgcttataaccctttact

SEQ ID NO: 67190 - DNA, 20 bp, Artificial Sequence
  Description of Artificial Sequence: Synthetic oligonucleotide
  Target: SCN9A; (-) strand; PAM type: YTN; PAM sequence: CTC
gttccctgcttataaccctt

SEQ ID NO: 67191 - DNA, 20 bp, Artificial Sequence
  Description of Artificial Sequence: Synthetic oligonucleotide
  Target: SCN9A; (-) strand; PAM type: YTN; PAM sequence: TTG
cgtatctcgttccctgctta

SEQ ID NO: 67192 - DNA, 20 bp, Artificial Sequence
  Description of Artificial Sequence: Synthetic oligonucleotide
  Target: SCN9A; (-) strand; PAM type: YTN; PAM sequence: TTT
gcgtatctcgttccctgctt

SEQ ID NO: 67193 - DNA, 20 bp, Artificial Sequence
  Description of Artificial Sequence: Synthetic oligonucleotide
  Target: SCN9A; (-) strand; PAM type: YTN; PAM sequence: TTG
caatttgcgtatctcgttcc

SEQ ID NO: 67194 - DNA, 20 bp, Artificial Sequence
  Description of Artificial Sequence: Synthetic oligonucleotide
  Target: SCN9A; (-) strand; PAM type: YTN; PAM sequence: TTA
cattgcaatttgcgtatctc

SEQ ID NO: 67195 - DNA, 20 bp, Artificial Sequence
  Description of Artificial Sequence: Synthetic oligonucleotide
  Target: SCN9A; (-) strand; PAM type: YTN; PAM sequence: TTT
acattgcaatttgcgtatct

SEQ ID NO: 67196 - DNA, 20 bp, Artificial Sequence
  Description of Artificial Sequence: Synthetic oligonucleotide
  Target: SCN9A; (-) strand; PAM type: YTN; PAM sequence: CTA
tttacattgcaatttgcgta

SEQ ID NO: 67197 - DNA, 20 bp, Artificial Sequence
  Description of Artificial Sequence: Synthetic oligonucleotide
  Target: SCN9A; (-) strand; PAM type: YTN; PAM sequence: CTC
catgtaccgtggagacatct

SEQ ID NO: 67198 - DNA, 20 bp, Artificial Sequence
  Description of Artificial Sequence: Synthetic oligonucleotide
  Target: SCN9A; (-) strand; PAM type: YTN; PAM sequence: TTA
tcctccatgtaccgtggaga

SEQ ID NO: 67199 - DNA, 20 bp, Artificial Sequence
  Description of Artificial Sequence: Synthetic oligonucleotide
  Target: SCN9A; (-) strand; PAM type: YTN; PAM sequence: CTT
atcctccatgtaccgtggag

SEQ ID NO: 67200 - DNA, 20 bp, Artificial Sequence
  Description of Artificial Sequence: Synthetic oligonucleotide
  Target: SCN9A; (-) strand; PAM type: YTN; PAM sequence: TTC
caacttatcctccatgtacc

SEQ ID NO: 67201 - DNA, 20 bp, Artificial Sequence
  Description of Artificial Sequence: Synthetic oligonucleotide
  Target: SCN9A; (-) strand; PAM type: YTN; PAM sequence: CTT
ccaacttatcctccatgtac

SEQ ID NO: 67202 - DNA, 20 bp, Artificial Sequence
  Description of Artificial Sequence: Synthetic oligonucleotide
  Target: SCN9A; (-) strand; PAM type: YTN; PAM sequence: TTC
acccttccaacttatcctcc

SEQ ID NO: 67203 - DNA, 20 bp, Artificial Sequence
  Description of Artificial Sequence: Synthetic oligonucleotide
  Target: SCN9A; (-) strand; PAM type: YTN; PAM sequence: CTA
ttcacccttccaacttatcc

SEQ ID NO: 67204 - DNA, 20 bp, Artificial Sequence
  Description of Artificial Sequence: Synthetic oligonucleotide
  Target: SCN9A; (-) strand; PAM type: YTN; PAM sequence: CTC
tattcacccttccaacttat

SEQ ID NO: 67205 - DNA, 20 bp, Artificial Sequence
  Description of Artificial Sequence: Synthetic oligonucleotide
  Target: SCN9A; (-) strand; PAM type: YTN; PAM sequence: CTC
tctattcacccttccaactt

SEQ ID NO: 67206 - DNA, 20 bp, Artificial Sequence
  Description of Artificial Sequence: Synthetic oligonucleotide
  Target: SCN9A; (-) strand; PAM type: YTN; PAM sequence: CTC
ctctctattcacccttccaa

SEQ ID NO: 67207 - DNA, 20 bp, Artificial Sequence
  Description of Artificial Sequence: Synthetic oligonucleotide
  Target: SCN9A; (-) strand; PAM type: YTN; PAM sequence: CTA
ctcctctctattcacccttc

SEQ ID NO: 67208 - DNA, 20 bp, Artificial Sequence
  Description of Artificial Sequence: Synthetic oligonucleotide
  Target: SCN9A; (-) strand; PAM type: YTN; PAM sequence: TTC
acccctactcctctctattc

SEQ ID NO: 67209 - DNA, 20 bp, Artificial Sequence
  Description of Artificial Sequence: Synthetic oligonucleotide
  Target: SCN9A; (-) strand; PAM type: YTN; PAM sequence: CTT
cacccctactcctctctatt

SEQ ID NO: 67210 - DNA, 20 bp, Artificial Sequence
  Description of Artificial Sequence: Synthetic oligonucleotide
  Target: SCN9A; (-) strand; PAM type: YTN; PAM sequence: TTC
ttcacccctactcctctcta

SEQ ID NO: 67211 - DNA, 20 bp, Artificial Sequence
  Description of Artificial Sequence: Synthetic oligonucleotide
  Target: SCN9A; (-) strand; PAM type: YTN; PAM sequence: TTT
cttcacccctactcctctct

SEQ ID NO: 67212 - DNA, 20 bp, Artificial Sequence
  Description of Artificial Sequence: Synthetic oligonucleotide
  Target: SCN9A; (-) strand; PAM type: YTN; PAM sequence: CTT
tcttcacccctactcctctc

SEQ ID NO: 67213 - DNA, 20 bp, Artificial Sequence
  Description of Artificial Sequence: Synthetic oligonucleotide
  Target: SCN9A; (-) strand; PAM type: YTN; PAM sequence: CTG
ggtatgaaactttcttcacc

SEQ ID NO: 67214 - DNA, 20 bp, Artificial Sequence
  Description of Artificial Sequence: Synthetic oligonucleotide
  Target: SCN9A; (-) strand; PAM type: YTN; PAM sequence: TTC
tgggtatgaaactttcttca

SEQ ID NO: 67215 - DNA, 20 bp, Artificial Sequence
  Description of Artificial Sequence: Synthetic oligonucleotide
  Target: SCN9A; (-) strand; PAM type: YTN; PAM sequence: TTT
ctgggtatgaaactttcttc

SEQ ID NO: 67216 - DNA, 20 bp, Artificial Sequence
  Description of Artificial Sequence: Synthetic oligonucleotide
  Target: SCN9A; (-) strand; PAM type: YTN; PAM sequence: TTT
tctgggtatgaaactttctt

SEQ ID NO: 67217 - DNA, 20 bp, Artificial Sequence
  Description of Artificial Sequence: Synthetic oligonucleotide
  Target: SCN9A; (-) strand; PAM type: YTN; PAM sequence: CTG
gaccagaatccaaatggttt

SEQ ID NO: 67218 - DNA, 20 bp, Artificial Sequence
  Description of Artificial Sequence: Synthetic oligonucleotide
  Target: SCN9A; (-) strand; PAM type: YTN; PAM sequence: CTC
cagacaggatactggaccag

SEQ ID NO: 67219 - DNA, 20 bp, Artificial Sequence
  Description of Artificial Sequence: Synthetic oligonucleotide
  Target: SCN9A; (-) strand; PAM type: YTN; PAM sequence: TTC
cctccagacaggatactgga

SEQ ID NO: 67220 - DNA, 20 bp, Artificial Sequence
  Description of Artificial Sequence: Synthetic oligonucleotide
  Target: SCN9A; (-) strand; PAM type: YTN; PAM sequence: TTT
ccctccagacaggatactgg

SEQ ID NO: 67221 - DNA, 20 bp, Artificial Sequence
  Description of Artificial Sequence: Synthetic oligonucleotide
  Target: SCN9A; (-) strand; PAM type: YTN; PAM sequence: CTT
tccctccagacaggatactg

SEQ ID NO: 67222 - DNA, 20 bp, Artificial Sequence
  Description of Artificial Sequence: Synthetic oligonucleotide
  Target: SCN9A; (-) strand; PAM type: YTN; PAM sequence: CTA
atctttccctccagacagga

SEQ ID NO: 67223 - DNA, 20 bp, Artificial Sequence
  Description of Artificial Sequence: Synthetic oligonucleotide
  Target: SCN9A; (-) strand; PAM type: YTN; PAM sequence: CTA
actaatctttccctccagac

SEQ ID NO: 67224 - DNA, 20 bp, Artificial Sequence
  Description of Artificial Sequence: Synthetic oligonucleotide
  Target: SCN9A; (-) strand; PAM type: YTN; PAM sequence: TTC
ctaactaatctttccctcca

SEQ ID NO: 67225 - DNA, 20 bp, Artificial Sequence
  Description of Artificial Sequence: Synthetic oligonucleotide
  Target: SCN9A; (-) strand; PAM type: YTN; PAM sequence: CTA
gttcctaactaatctttccc

SEQ ID NO: 67226 - DNA, 20 bp, Artificial Sequence
  Description of Artificial Sequence: Synthetic oligonucleotide
  Target: SCN9A; (-) strand; PAM type: YTN; PAM sequence: CTC
tagttcctaactaatctttc

SEQ ID NO: 67227 - DNA, 20 bp, Artificial Sequence
  Description of Artificial Sequence: Synthetic oligonucleotide
  Target: SCN9A; (-) strand; PAM type: YTN; PAM sequence: TTA
caactctagttcctaactaa

SEQ ID NO: 67228 - DNA, 20 bp, Artificial Sequence
  Description of Artificial Sequence: Synthetic oligonucleotide
  Target: SCN9A; (-) strand; PAM type: YTN; PAM sequence: CTG
ttacaactctagttcctaac

SEQ ID NO: 67229 - DNA, 20 bp, Artificial Sequence
  Description of Artificial Sequence: Synthetic oligonucleotide
  Target: SCN9A; (-) strand; PAM type: YTN; PAM sequence: TTG
aatctgttacaactctagtt

SEQ ID NO: 67230 - DNA, 20 bp, Artificial Sequence
  Description of Artificial Sequence: Synthetic oligonucleotide
  Target: SCN9A; (-) strand; PAM type: YTN; PAM sequence: CTT
gaatctgttacaactctagt

SEQ ID NO: 67231 - DNA, 20 bp, Artificial Sequence
  Description of Artificial Sequence: Synthetic oligonucleotide
  Target: SCN9A; (-) strand; PAM type: YTN; PAM sequence: CTG
ccaaatatgtcttgaatctg

SEQ ID NO: 67232 - DNA, 20 bp, Artificial Sequence
  Description of Artificial Sequence: Synthetic oligonucleotide
  Target: SCN9A; (-) strand; PAM type: YTN; PAM sequence: TTA
tctgccaaatatgtcttgaa

SEQ ID NO: 67233 - DNA, 20 bp, Artificial Sequence
  Description of Artificial Sequence: Synthetic oligonucleotide
  Target: SCN9A; (-) strand; PAM type: YTN; PAM sequence: TTT
atctgccaaatatgtcttga

SEQ ID NO: 67234 - DNA, 20 bp, Artificial Sequence
  Description of Artificial Sequence: Synthetic oligonucleotide
  Target: SCN9A; (-) strand; PAM type: YTN; PAM sequence: TTT
tatctgccaaatatgtcttg

SEQ ID NO: 67235 - DNA, 20 bp, Artificial Sequence
  Description of Artificial Sequence: Synthetic oligonucleotide
  Target: SCN9A; (-) strand; PAM type: YTN; PAM sequence: CTG
attttatctgccaaatatgt

SEQ ID NO: 67236 - DNA, 20 bp, Artificial Sequence
  Description of Artificial Sequence: Synthetic oligonucleotide
  Target: SCN9A; (-) strand; PAM type: YTN; PAM sequence: CTG
ctgattttatctgccaaata

SEQ ID NO: 67237 - DNA, 20 bp, Artificial Sequence
  Description of Artificial Sequence: Synthetic oligonucleotide
  Target: SCN9A; (-) strand; PAM type: YTN; PAM sequence: TTG
atatccaatcaatcaccaaa

SEQ ID NO: 67238 - DNA, 20 bp, Artificial Sequence
  Description of Artificial Sequence: Synthetic oligonucleotide
  Target: SCN9A; (-) strand; PAM type: YTN; PAM sequence: TTT
gatatccaatcaatcaccaa

SEQ ID NO: 67239 - DNA, 20 bp, Artificial Sequence
  Description of Artificial Sequence: Synthetic oligonucleotide
  Target: SCN9A; (-) strand; PAM type: YTN; PAM sequence: TTA
catttgatatccaatcaatc

SEQ ID NO: 67240 - DNA, 20 bp, Artificial Sequence
  Description of Artificial Sequence: Synthetic oligonucleotide
  Target: SCN9A; (-) strand; PAM type: YTN; PAM sequence: CTT
acatttgatatccaatcaat

SEQ ID NO: 67241 - DNA, 20 bp, Artificial Sequence
  Description of Artificial Sequence: Synthetic oligonucleotide
  Target: SCN9A; (-) strand; PAM type: YTN; PAM sequence: CTC
ttacatttgatatccaatca

SEQ ID NO: 67242 - DNA, 20 bp, Artificial Sequence
  Description of Artificial Sequence: Synthetic oligonucleotide
  Target: SCN9A; (-) strand; PAM type: YTN; PAM sequence: TTC
tcttacatttgatatccaat

SEQ ID NO: 67243 - DNA, 20 bp, Artificial Sequence
  Description of Artificial Sequence: Synthetic oligonucleotide
  Target: SCN9A; (-) strand; PAM type: YTN; PAM sequence: TTT
ctcttacatttgatatccaa

SEQ ID NO: 67244 - DNA, 20 bp, Artificial Sequence
  Description of Artificial Sequence: Synthetic oligonucleotide
  Target: SCN9A; (-) strand; PAM type: YTN; PAM sequence: CTT
tctcttacatttgatatcca

SEQ ID NO: 67245 - DNA, 20 bp, Artificial Sequence
  Description of Artificial Sequence: Synthetic oligonucleotide
  Target: SCN9A; (-) strand; PAM type: YTN; PAM sequence: TTC
ctttctcttacatttgatat

SEQ ID NO: 67246 - DNA, 20 bp, Artificial Sequence
  Description of Artificial Sequence: Synthetic oligonucleotide
  Target: SCN9A; (-) strand; PAM type: YTN; PAM sequence: CTT
cctttctcttacatttgata

SEQ ID NO: 67247 - DNA, 20 bp, Artificial Sequence
  Description of Artificial Sequence: Synthetic oligonucleotide
  Target: SCN9A; (-) strand; PAM type: YTN; PAM sequence: CTG
ggatccttcctttctcttac

SEQ ID NO: 67248 - DNA, 20 bp, Artificial Sequence
  Description of Artificial Sequence: Synthetic oligonucleotide
  Target: SCN9A; (-) strand; PAM type: YTN; PAM sequence: CTG
gtagtcctgggatccttcct

SEQ ID NO: 67249 - DNA, 20 bp, Artificial Sequence
  Description of Artificial Sequence: Synthetic oligonucleotide
  Target: SCN9A; (-) strand; PAM type: YTN; PAM sequence: CTA
acatccacctggtagtcctg

SEQ ID NO: 67250 - DNA, 20 bp, Artificial Sequence
  Description of Artificial Sequence: Synthetic oligonucleotide
  Target: SCN9A; (-) strand; PAM type: YTN; PAM sequence: CTG
ctaacatccacctggtagtc

SEQ ID NO: 67251 - DNA, 20 bp, Artificial Sequence
  Description of Artificial Sequence: Synthetic oligonucleotide
  Target: SCN9A; (-) strand; PAM type: YTN; PAM sequence: TTC
actgctaacatccacctggt

SEQ ID NO: 67252 - DNA, 20 bp, Artificial Sequence
  Description of Artificial Sequence: Synthetic oligonucleotide
  Target: SCN9A; (-) strand; PAM type: YTN; PAM sequence: TTC
aattcactgctaacatccac

SEQ ID NO: 67253 - DNA, 20 bp, Artificial Sequence
  Description of Artificial Sequence: Synthetic oligonucleotide
  Target: SCN9A; (-) strand; PAM type: YTN; PAM sequence: TTT
caattcactgctaacatcca

SEQ ID NO: 67254 - DNA, 20 bp, Artificial Sequence
  Description of Artificial Sequence: Synthetic oligonucleotide
  Target: SCN9A; (-) strand; PAM type: YTN; PAM sequence: TTT
tcaattcactgctaacatcc

SEQ ID NO: 67255 - DNA, 20 bp, Artificial Sequence
  Description of Artificial Sequence: Synthetic oligonucleotide
  Target: SCN9A; (-) strand; PAM type: YTN; PAM sequence: CTG
tggttttcaattcactgcta

SEQ ID NO: 67256 - DNA, 20 bp, Artificial Sequence
  Description of Artificial Sequence: Synthetic oligonucleotide
  Target: SCN9A; (-) strand; PAM type: YTN; PAM sequence: CTC
ctgtggttttcaattcactg

SEQ ID NO: 67257 - DNA, 20 bp, Artificial Sequence
  Description of Artificial Sequence: Synthetic oligonucleotide
  Target: SCN9A; (-) strand; PAM type: YTN; PAM sequence: CTC
ctcctgtggttttcaattca

SEQ ID NO: 67258 - DNA, 20 bp, Artificial Sequence
  Description of Artificial Sequence: Synthetic oligonucleotide
  Target: SCN9A; (-) strand; PAM type: YTN; PAM sequence: CTC
ctcctcctgtggttttcaat

SEQ ID NO: 67259 - DNA, 20 bp, Artificial Sequence
  Description of Artificial Sequence: Synthetic oligonucleotide
  Target: SCN9A; (-) strand; PAM type: YTN; PAM sequence: CTG
ccgagtcagctcctcctcct

SEQ ID NO: 67260 - DNA, 20 bp, Artificial Sequence
  Description of Artificial Sequence: Synthetic oligonucleotide
  Target: SCN9A; (-) strand; PAM type: YTN; PAM sequence: TTA
cctgccgagtcagctcctcc

SEQ ID NO: 67261 - DNA, 20 bp, Artificial Sequence
  Description of Artificial Sequence: Synthetic oligonucleotide
  Target: SCN9A; (-) strand; PAM type: YTN; PAM sequence: CTC
aaaatcattacctgccgagt

SEQ ID NO: 67262 - DNA, 20 bp, Artificial Sequence
  Description of Artificial Sequence: Synthetic oligonucleotide
  Target: SCN9A; (-) strand; PAM type: YTN; PAM sequence: TTC
acaggcatctcaaaatcatt

SEQ ID NO: 67263 - DNA, 20 bp, Artificial Sequence
  Description of Artificial Sequence: Synthetic oligonucleotide
  Target: SCN9A; (-) strand; PAM type: YTN; PAM sequence: TTA
aacaattcacaggcatctca

SEQ ID NO: 67264 - DNA, 20 bp, Artificial Sequence
  Description of Artificial Sequence: Synthetic oligonucleotide
  Target: SCN9A; (-) strand; PAM type: YTN; PAM sequence: TTT
aaacaattcacaggcatctc

SEQ ID NO: 67265 - DNA, 20 bp, Artificial Sequence
  Description of Artificial Sequence: Synthetic oligonucleotide
  Target: SCN9A; (-) strand; PAM type: YTN; PAM sequence: CTG
tatttaaacaattcacaggc

SEQ ID NO: 67266 - DNA, 20 bp, Artificial Sequence
  Description of Artificial Sequence: Synthetic oligonucleotide
  Target: SCN9A; (-) strand; PAM type: YTN; PAM sequence: CTA
taggatatctgtatttaaac

SEQ ID NO: 67267 - DNA, 20 bp, Artificial Sequence
  Description of Artificial Sequence: Synthetic oligonucleotide
  Target: SCN9A; (-) strand; PAM type: YTN; PAM sequence: TTA
aaatctataggatatctgta

SEQ ID NO: 67268 - DNA, 20 bp, Artificial Sequence
  Description of Artificial Sequence: Synthetic oligonucleotide
  Target: SCN9A; (-) strand; PAM type: YTN; PAM sequence: TTT
aaaatctataggatatctgt

SEQ ID NO: 67269 - DNA, 20 bp, Artificial Sequence
  Description of Artificial Sequence: Synthetic oligonucleotide
  Target: SCN9A; (-) strand; PAM type: YTN; PAM sequence: TTT
taaaatctataggatatctg

SEQ ID NO: 67270 - DNA, 20 bp, Artificial Sequence
  Description of Artificial Sequence: Synthetic oligonucleotide
  Target: SCN9A; (-) strand; PAM type: YTN; PAM sequence: TTT
ttaaaatctataggatatct

SEQ ID NO: 67271 - DNA, 20 bp, Artificial Sequence
  Description of Artificial Sequence: Synthetic oligonucleotide
  Target: SCN9A; (-) strand; PAM type: YTN; PAM sequence: TTC
ccacccccatttttaaaatc

SEQ ID NO: 67272 - DNA, 20 bp, Artificial Sequence
  Description of Artificial Sequence: Synthetic oligonucleotide
  Target: SCN9A; (-) strand; PAM type: YTN; PAM sequence: TTC
aggttcccacccccattttt

SEQ ID NO: 67273 - DNA, 20 bp, Artificial Sequence
  Description of Artificial Sequence: Synthetic oligonucleotide
  Target: SCN9A; (-) strand; PAM type: YTN; PAM sequence: TTT
caggttcccacccccatttt

SEQ ID NO: 67274 - DNA, 20 bp, Artificial Sequence
  Description of Artificial Sequence: Synthetic oligonucleotide
  Target: SCN9A; (-) strand; PAM type: YTN; PAM sequence: TTC
ccgtttcaggttcccacccc

SEQ ID NO: 67275 - DNA, 20 bp, Artificial Sequence
  Description of Artificial Sequence: Synthetic oligonucleotide
  Target: SCN9A; (-) strand; PAM type: YTN; PAM sequence: TTT
cccgtttcaggttcccaccc

SEQ ID NO: 67276 - DNA, 20 bp, Artificial Sequence
  Description of Artificial Sequence: Synthetic oligonucleotide
  Target: SCN9A; (-) strand; PAM type: YTN; PAM sequence: TTT
tcccgtttcaggttcccacc

SEQ ID NO: 67277 - DNA, 20 bp, Artificial Sequence
  Description of Artificial Sequence: Synthetic oligonucleotide
  Target: SCN9A; (-) strand; PAM type: YTN; PAM sequence: TTT
ttcccgtttcaggttcccac

SEQ ID NO: 67278 - DNA, 20 bp, Artificial Sequence
  Description of Artificial Sequence: Synthetic oligonucleotide
  Target: SCN9A; (-) strand; PAM type: YTN; PAM sequence: CTA
gacaggtttttcccgtttca

SEQ ID NO: 67279 - DNA, 20 bp, Artificial Sequence
  Description of Artificial Sequence: Synthetic oligonucleotide
  Target: SCN9A; (-) strand; PAM type: YTN; PAM sequence: TTC
tagacaggtttttcccgttt

SEQ ID NO: 67280 - DNA, 20 bp, Artificial Sequence
  Description of Artificial Sequence: Synthetic oligonucleotide
  Target: SCN9A; (-) strand; PAM type: YTN; PAM sequence: TTT
ctagacaggtttttcccgtt

SEQ ID NO: 67281 - DNA, 20 bp, Artificial Sequence
  Description of Artificial Sequence: Synthetic oligonucleotide
  Target: SCN9A; (-) strand; PAM type: YTN; PAM sequence: TTT
tctagacaggtttttcccgt

SEQ ID NO: 67282 - DNA, 20 bp, Artificial Sequence
  Description of Artificial Sequence: Synthetic oligonucleotide
  Target: SCN9A; (-) strand; PAM type: YTN; PAM sequence: CTT
ttctagacaggtttttcccg

SEQ ID NO: 67283 - DNA, 20 bp, Artificial Sequence
  Description of Artificial Sequence: Synthetic oligonucleotide
  Target: SCN9A; (-) strand; PAM type: YTN; PAM sequence: TTC
ttttctagacaggtttttcc

SEQ ID NO: 67284 - DNA, 20 bp, Artificial Sequence
  Description of Artificial Sequence: Synthetic oligonucleotide
  Target: SCN9A; (-) strand; PAM type: YTN; PAM sequence: CTA
agaattcttttctagacagg

SEQ ID NO: 67285 - DNA, 20 bp, Artificial Sequence
  Description of Artificial Sequence: Synthetic oligonucleotide
  Target: SCN9A; (-) strand; PAM type: YTN; PAM sequence: TTA
ctaagaattcttttctagac

SEQ ID NO: 67286 - DNA, 20 bp, Artificial Sequence
  Description of Artificial Sequence: Synthetic oligonucleotide
  Target: SCN9A; (-) strand; PAM type: YTN; PAM sequence: TTA
ttactaagaattcttttcta

SEQ ID NO: 67287 - DNA, 20 bp, Artificial Sequence
  Description of Artificial Sequence: Synthetic oligonucleotide
  Target: SCN9A; (-) strand; PAM type: YTN; PAM sequence: CTA
attattactaagaattcttt

SEQ ID NO: 67288 - DNA, 20 bp, Artificial Sequence
  Description of Artificial Sequence: Synthetic oligonucleotide
  Target: SCN9A; (-) strand; PAM type: YTN; PAM sequence: TTC
agcagatacatgtatgctaa

SEQ ID NO: 67289 - DNA, 20 bp, Artificial Sequence
  Description of Artificial Sequence: Synthetic oligonucleotide
  Target: SCN9A; (-) strand; PAM type: YTN; PAM sequence: CTT
cagcagatacatgtatgcta

SEQ ID NO: 67290 - DNA, 20 bp, Artificial Sequence
  Description of Artificial Sequence: Synthetic oligonucleotide
  Target: SCN9A; (-) strand; PAM type: YTN; PAM sequence: CTG
acttcagcagatacatgtat

SEQ ID NO: 67291 - DNA, 20 bp, Artificial Sequence
  Description of Artificial Sequence: Synthetic oligonucleotide
  Target: SCN9A; (-) strand; PAM type: YTN; PAM sequence: TTC
tgacttcagcagatacatgt

SEQ ID NO: 67292 - DNA, 20 bp, Artificial Sequence
  Description of Artificial Sequence: Synthetic oligonucleotide
  Target: SCN9A; (-) strand; PAM type: YTN; PAM sequence: CTG
ttctgacttcagcagataca

SEQ ID NO: 67293 - DNA, 20 bp, Artificial Sequence
  Description of Artificial Sequence: Synthetic oligonucleotide
  Target: SCN9A; (-) strand; PAM type: YTN; PAM sequence: CTC
aaaaactgttctgacttcag

SEQ ID NO: 67294 - DNA, 20 bp, Artificial Sequence
  Description of Artificial Sequence: Synthetic oligonucleotide
  Target: SCN9A; (-) strand; PAM type: YTN; PAM sequence: TTG
tgtgacctcaaaaactgttc

SEQ ID NO: 67295 - DNA, 20 bp, Artificial Sequence
  Description of Artificial Sequence: Synthetic oligonucleotide
  Target: SCN9A; (-) strand; PAM type: YTN; PAM sequence: TTT
gtgtgacctcaaaaactgtt

SEQ ID NO: 67296 - DNA, 20 bp, Artificial Sequence
  Description of Artificial Sequence: Synthetic oligonucleotide
  Target: SCN9A; (-) strand; PAM type: YTN; PAM sequence: TTT
tgtgtgacctcaaaaactgt

SEQ ID NO: 67297 - DNA, 20 bp, Artificial Sequence
  Description of Artificial Sequence: Synthetic oligonucleotide
  Target: SCN9A; (-) strand; PAM type: YTN; PAM sequence: TTT
ttgtgtgacctcaaaaactg

SEQ ID NO: 67298 - DNA, 20 bp, Artificial Sequence
  Description of Artificial Sequence: Synthetic oligonucleotide
  Target: SCN9A; (-) strand; PAM type: YTN; PAM sequence: CTT
tttgtgtgacctcaaaaact

SEQ ID NO: 67299 - DNA, 20 bp, Artificial Sequence
  Description of Artificial Sequence: Synthetic oligonucleotide
  Target: SCN9A; (-) strand; PAM type: YTN; PAM sequence: CTC
tttttgtgtgacctcaaaaa

SEQ ID NO: 67300 - DNA, 20 bp, Artificial Sequence
  Description of Artificial Sequence: Synthetic oligonucleotide
  Target: SCN9A; (-) strand; PAM type: YTN; PAM sequence: CTA
aatactctttttgtgtgacc

SEQ ID NO: 67301 - DNA, 20 bp, Artificial Sequence
  Description of Artificial Sequence: Synthetic oligonucleotide
  Target: SCN9A; (-) strand; PAM type: YTN; PAM sequence: CTC
accctaaatactctttttgt

SEQ ID NO: 67302 - DNA, 20 bp, Artificial Sequence
  Description of Artificial Sequence: Synthetic oligonucleotide
  Target: SCN9A; (-) strand; PAM type: YTN; PAM sequence: CTG
ctcaccctaaatactctttt

SEQ ID NO: 67303 - DNA, 20 bp, Artificial Sequence
  Description of Artificial Sequence: Synthetic oligonucleotide
  Target: SCN9A; (-) strand; PAM type: YTN; PAM sequence: TTC
tgctcaccctaaatactctt

SEQ ID NO: 67304 - DNA, 20 bp, Artificial Sequence
  Description of Artificial Sequence: Synthetic oligonucleotide
  Target: SCN9A; (-) strand; PAM type: YTN; PAM sequence: TTT
ctgctcaccctaaatactct

SEQ ID NO: 67305 - DNA, 20 bp, Artificial Sequence
  Description of Artificial Sequence: Synthetic oligonucleotide
  Target: SCN9A; (-) strand; PAM type: YTN; PAM sequence: TTT
tctgctcaccctaaatactc

SEQ ID NO: 67306 - DNA, 20 bp, Artificial Sequence
  Description of Artificial Sequence: Synthetic oligonucleotide
  Target: SCN9A; (-) strand; PAM type: YTN; PAM sequence: TTT
ttctgctcaccctaaatact

SEQ ID NO: 67307 - DNA, 20 bp, Artificial Sequence
  Description of Artificial Sequence: Synthetic oligonucleotide
  Target: SCN9A; (-) strand; PAM type: YTN; PAM sequence: CTT
tttctgctcaccctaaatac

SEQ ID NO: 67308 - DNA, 20 bp, Artificial Sequence
  Description of Artificial Sequence: Synthetic oligonucleotide
  Target: SCN9A; (-) strand; PAM type: YTN; PAM sequence: TTG
gccctttttctgctcaccct

SEQ ID NO: 67309 - DNA, 20 bp, Artificial Sequence
  Description of Artificial Sequence: Synthetic oligonucleotide
  Target: SCN9A; (-) strand; PAM type: YTN; PAM sequence: TTC
ggagttggccctttttctgc

SEQ ID NO: 67310 - DNA, 20 bp, Artificial Sequence
  Description of Artificial Sequence: Synthetic oligonucleotide
  Target: SCN9A; (-) strand; PAM type: YTN; PAM sequence: TTT
cggagttggccctttttctg

SEQ ID NO: 67311 - DNA, 20 bp, Artificial Sequence
  Description of Artificial Sequence: Synthetic oligonucleotide
  Target: SCN9A; (-) strand; PAM type: YTN; PAM sequence: TTC
agaatgtttcggagttggcc

SEQ ID NO: 67312 - DNA, 20 bp, Artificial Sequence
  Description of Artificial Sequence: Synthetic oligonucleotide
  Target: SCN9A; (-) strand; PAM type: YTN; PAM sequence: TTT
cagaatgtttcggagttggc

SEQ ID NO: 67313 - DNA, 20 bp, Artificial Sequence
  Description of Artificial Sequence: Synthetic oligonucleotide
  Target: SCN9A; (-) strand; PAM type: YTN; PAM sequence: TTG
tttcagaatgtttcggagtt

SEQ ID NO: 67314 - DNA, 20 bp, Artificial Sequence
  Description of Artificial Sequence: Synthetic oligonucleotide
  Target: SCN9A; (-) strand; PAM type: YTN; PAM sequence: TTG
ttgtttcagaatgtttcgga

SEQ ID NO: 67315 - DNA, 20 bp, Artificial Sequence
  Description of Artificial Sequence: Synthetic oligonucleotide
  Target: SCN9A; (-) strand; PAM type: YTN; PAM sequence: TTA
atattgttgtttcagaatgt

SEQ ID NO: 67316 - DNA, 20 bp, Artificial Sequence
  Description of Artificial Sequence: Synthetic oligonucleotide
  Target: SCN9A; (-) strand; PAM type: YTN; PAM sequence: CTT
aatattgttgtttcagaatg

SEQ ID NO: 67317 - DNA, 20 bp, Artificial Sequence
  Description of Artificial Sequence: Synthetic oligonucleotide
  Target: SCN9A; (-) strand; PAM type: YTN; PAM sequence: CTC
ccttaatattgttgtttcag

SEQ ID NO: 67318 - DNA, 20 bp, Artificial Sequence
  Description of Artificial Sequence: Synthetic oligonucleotide
  Target: SCN9A; (-) strand; PAM type: YTN; PAM sequence: CTC
tcccttaatattgttgtttc

SEQ ID NO: 67319 - DNA, 20 bp, Artificial Sequence
  Description of Artificial Sequence: Synthetic oligonucleotide
  Target: SCN9A; (-) strand; PAM type: YTN; PAM sequence: TTC
tctcccttaatattgttgtt

SEQ ID NO: 67320 - DNA, 20 bp, Artificial Sequence
  Description of Artificial Sequence: Synthetic oligonucleotide
  Target: SCN9A; (-) strand; PAM type: YTN; PAM sequence: TTG
aattctctcccttaatattg

SEQ ID NO: 67321 - DNA, 20 bp, Artificial Sequence
  Description of Artificial Sequence: Synthetic oligonucleotide
  Target: SCN9A; (-) strand; PAM type: YTN; PAM sequence: TTC
agcacaccattgaattctct

SEQ ID NO: 67322 - DNA, 20 bp, Artificial Sequence
  Description of Artificial Sequence: Synthetic oligonucleotide
  Target: SCN9A; (-) strand; PAM type: YTN; PAM sequence: TTT
cagcacaccattgaattctc

SEQ ID NO: 67323 - DNA, 20 bp, Artificial Sequence
  Description of Artificial Sequence: Synthetic oligonucleotide
  Target: SCN9A; (-) strand; PAM type: YTN; PAM sequence: CTT
tcagcacaccattgaattct

SEQ ID NO: 67324 - DNA, 20 bp, Artificial Sequence
  Description of Artificial Sequence: Synthetic oligonucleotide
  Target: SCN9A; (-) strand; PAM type: YTN; PAM sequence: CTG
ctttcagcacaccattgaat

SEQ ID NO: 67325 - DNA, 20 bp, Artificial Sequence
  Description of Artificial Sequence: Synthetic oligonucleotide
  Target: SCN9A; (-) strand; PAM type: YTN; PAM sequence: TTG
gtatggtctgctttcagcac

SEQ ID NO: 67326 - DNA, 20 bp, Artificial Sequence
  Description of Artificial Sequence: Synthetic oligonucleotide
  Target: SCN9A; (-) strand; PAM type: YTN; PAM sequence: TTA
acaacaagaattggtatggt

SEQ ID NO: 67327 - DNA, 20 bp, Artificial Sequence
  Description of Artificial Sequence: Synthetic oligonucleotide
  Target: SCN9A; (-) strand; PAM type: YTN; PAM sequence: TTT
aacaacaagaattggtatgg

SEQ ID NO: 67328 - DNA, 20 bp, Artificial Sequence
  Description of Artificial Sequence: Synthetic oligonucleotide
  Target: SCN9A; (-) strand; PAM type: YTN; PAM sequence: CTG
acagtttaacaacaagaatt

SEQ ID NO: 67329 - DNA, 20 bp, Artificial Sequence
  Description of Artificial Sequence: Synthetic oligonucleotide
  Target: SCN9A; (-) strand; PAM type: YTN; PAM sequence: TTC
tgacagtttaacaacaagaa

SEQ ID NO: 67330 - DNA, 20 bp, Artificial Sequence
  Description of Artificial Sequence: Synthetic oligonucleotide
  Target: SCN9A; (-) strand; PAM type: YTN; PAM sequence: TTT
ctgacagtttaacaacaaga

SEQ ID NO: 67331 - DNA, 20 bp, Artificial Sequence
  Description of Artificial Sequence: Synthetic oligonucleotide
  Target: SCN9A; (-) strand; PAM type: YTN; PAM sequence: TTA
acaacagacaagcaggaatt

SEQ ID NO: 67332 - DNA, 20 bp, Artificial Sequence
  Description of Artificial Sequence: Synthetic oligonucleotide
  Target: SCN9A; (-) strand; PAM type: YTN; PAM sequence: TTT
aacaacagacaagcaggaat

SEQ ID NO: 67333 - DNA, 20 bp, Artificial Sequence
  Description of Artificial Sequence: Synthetic oligonucleotide
  Target: SCN9A; (-) strand; PAM type: YTN; PAM sequence: TTT
taacaacagacaagcaggaa

SEQ ID NO: 67334 - DNA, 20 bp, Artificial Sequence
  Description of Artificial Sequence: Synthetic oligonucleotide
  Target: SCN9A; (-) strand; PAM type: YTN; PAM sequence: CTT
ttaacaacagacaagcagga

SEQ ID NO: 67335 - DNA, 20 bp, Artificial Sequence
  Description of Artificial Sequence: Synthetic oligonucleotide
  Target: SCN9A; (-) strand; PAM type: YTN; PAM sequence: CTG
cttttaacaacagacaagca

SEQ ID NO: 67336 - DNA, 20 bp, Artificial Sequence
  Description of Artificial Sequence: Synthetic oligonucleotide
  Target: SCN9A; (-) strand; PAM type: YTN; PAM sequence: TTA
ataatggctgcttttaacaa

SEQ ID NO: 67337 - DNA, 20 bp, Artificial Sequence
  Description of Artificial Sequence: Synthetic oligonucleotide
  Target: SCN9A; (-) strand; PAM type: YTN; PAM sequence: TTT
aataatggctgcttttaaca

SEQ ID NO: 67338 - DNA, 20 bp, Artificial Sequence
  Description of Artificial Sequence: Synthetic oligonucleotide
  Target: SCN9A; (-) strand; PAM type: YTN; PAM sequence: TTA
tatagtcaaatatttaataa

SEQ ID NO: 67339 - DNA, 20 bp, Artificial Sequence
  Description of Artificial Sequence: Synthetic oligonucleotide
  Target: SCN9A; (-) strand; PAM type: YTN; PAM sequence: TTT
atatagtcaaatatttaata

SEQ ID NO: 67340 - DNA, 20 bp, Artificial Sequence
  Description of Artificial Sequence: Synthetic oligonucleotide
  Target: SCN9A; (-) strand; PAM type: YTN; PAM sequence: CTA
agtttatatagtcaaatatt

SEQ ID NO: 67341 - DNA, 20 bp, Artificial Sequence
  Description of Artificial Sequence: Synthetic oligonucleotide
  Target: SCN9A; (-) strand; PAM type: YTN; PAM sequence: TTC
taagtttatatagtcaaata

SEQ ID NO: 67342 - DNA, 20 bp, Artificial Sequence
  Description of Artificial Sequence: Synthetic oligonucleotide
  Target: SCN9A; (-) strand; PAM type: YTN; PAM sequence: TTA
tagaattctaagtttatata

SEQ ID NO: 67343 - DNA, 20 bp, Artificial Sequence
  Description of Artificial Sequence: Synthetic oligonucleotide
  Target: SCN9A; (-) strand; PAM type: YTN; PAM sequence: TTA
aggtaagttatagaattcta

SEQ ID NO: 67344 - DNA, 20 bp, Artificial Sequence
  Description of Artificial Sequence: Synthetic oligonucleotide
  Target: SCN9A; (-) strand; PAM type: YTN; PAM sequence: CTT
aaggtaagttatagaattct

SEQ ID NO: 67345 - DNA, 20 bp, Artificial Sequence
  Description of Artificial Sequence: Synthetic oligonucleotide
  Target: SCN9A; (-) strand; PAM type: YTN; PAM sequence: TTC
cttaaggtaagttatagaat

SEQ ID NO: 67346 - DNA, 20 bp, Artificial Sequence
  Description of Artificial Sequence: Synthetic oligonucleotide
  Target: SCN9A; (-) strand; PAM type: YTN; PAM sequence: TTT
ccttaaggtaagttatagaa

SEQ ID NO: 67347 - DNA, 20 bp, Artificial Sequence
  Description of Artificial Sequence: Synthetic oligonucleotide
  Target: SCN9A; (-) strand; PAM type: YTN; PAM sequence: CTT
tccttaaggtaagttataga

SEQ ID NO: 67348 - DNA, 20 bp, Artificial Sequence
  Description of Artificial Sequence: Synthetic oligonucleotide
  Target: SCN9A; (-) strand; PAM type: YTN; PAM sequence: TTA
cctttccttaaggtaagtta

SEQ ID NO: 67349 - DNA, 20 bp, Artificial Sequence
  Description of Artificial Sequence: Synthetic oligonucleotide
  Target: SCN9A; (-) strand; PAM type: YTN; PAM sequence: TTA
ttacctttccttaaggtaag

SEQ ID NO: 67350 - DNA, 20 bp, Artificial Sequence
  Description of Artificial Sequence: Synthetic oligonucleotide
  Target: SCN9A; (-) strand; PAM type: YTN; PAM sequence: TTT
attacctttccttaaggtaa

SEQ ID NO: 67351 - DNA, 20 bp, Artificial Sequence
  Description of Artificial Sequence: Synthetic oligonucleotide
  Target: SCN9A; (-) strand; PAM type: YTN; PAM sequence: TTA
gtatttattacctttcctta

SEQ ID NO: 67352 - DNA, 20 bp, Artificial Sequence
  Description of Artificial Sequence: Synthetic oligonucleotide
  Target: SCN9A; (-) strand; PAM type: YTN; PAM sequence: CTT
agtatttattacctttcctt

SEQ ID NO: 67353 - DNA, 20 bp, Artificial Sequence
  Description of Artificial Sequence: Synthetic oligonucleotide
  Target: SCN9A; (-) strand; PAM type: YTN; PAM sequence: TTA
ggaagtgatatgtcttagta

SEQ ID NO: 67354 - DNA, 20 bp, Artificial Sequence
  Description of Artificial Sequence: Synthetic oligonucleotide
  Target: SCN9A; (-) strand; PAM type: YTN; PAM sequence: TTC
aaacggaatagacaaataaa

SEQ ID NO: 67355 - DNA, 20 bp, Artificial Sequence
  Description of Artificial Sequence: Synthetic oligonucleotide
  Target: SCN9A; (-) strand; PAM type: YTN; PAM sequence: CTA
ttcaaacggaatagacaaat

SEQ ID NO: 67356 - DNA, 20 bp, Artificial Sequence
  Description of Artificial Sequence: Synthetic oligonucleotide
  Target: SCN9A; (-) strand; PAM type: YTN; PAM sequence: CTG
ctattcaaacggaatagaca

SEQ ID NO: 67357 - DNA, 20 bp, Artificial Sequence
  Description of Artificial Sequence: Synthetic oligonucleotide
  Target: SCN9A; (-) strand; PAM type: YTN; PAM sequence: TTC
tgctattcaaacggaataga

SEQ ID NO: 67358 - DNA, 20 bp, Artificial Sequence
  Description of Artificial Sequence: Synthetic oligonucleotide
  Target: SCN9A; (-) strand; PAM type: YTN; PAM sequence: CTT
ctgctattcaaacggaatag

SEQ ID NO: 67359 - DNA, 20 bp, Artificial Sequence
  Description of Artificial Sequence: Synthetic oligonucleotide
  Target: SCN9A; (-) strand; PAM type: YTN; PAM sequence: CTG
tccagagagaataatccaga

SEQ ID NO: 67360 - DNA, 20 bp, Artificial Sequence
  Description of Artificial Sequence: Synthetic oligonucleotide
  Target: SCN9A; (-) strand; PAM type: YTN; PAM sequence: CTA
ctgtccagagagaataatcc

SEQ ID NO: 67361 - DNA, 20 bp, Artificial Sequence
  Description of Artificial Sequence: Synthetic oligonucleotide
  Target: SCN9A; (-) strand; PAM type: YTN; PAM sequence: TTA
ctactgtccagagagaataa

SEQ ID NO: 67362 - DNA, 20 bp, Artificial Sequence
  Description of Artificial Sequence: Synthetic oligonucleotide
  Target: SCN9A; (-) strand; PAM type: YTN; PAM sequence: TTG
cacagtagcccaatagtata

SEQ ID NO: 67363 - DNA, 20 bp, Artificial Sequence
  Description of Artificial Sequence: Synthetic oligonucleotide
  Target: SCN9A; (-) strand; PAM type: YTN; PAM sequence: TTC
caccatccagatagaatagg

SEQ ID NO: 67364 - DNA, 20 bp, Artificial Sequence
  Description of Artificial Sequence: Synthetic oligonucleotide
  Target: SCN9A; (-) strand; PAM type: YTN; PAM sequence: CTT
ccaccatccagatagaatag

SEQ ID NO: 67365 - DNA, 20 bp, Artificial Sequence
  Description of Artificial Sequence: Synthetic oligonucleotide
  Target: SCN9A; (-) strand; PAM type: YTN; PAM sequence: CTC
aacagtgtgacatacttcca

SEQ ID NO: 67366 - DNA, 20 bp, Artificial Sequence
  Description of Artificial Sequence: Synthetic oligonucleotide
  Target: SCN9A; (-) strand; PAM type: YTN; PAM sequence: TTC
acagtagctcaacagtgtga

SEQ ID NO: 67367 - DNA, 20 bp, Artificial Sequence
  Description of Artificial Sequence: Synthetic oligonucleotide
  Target: SCN9A; (-) strand; PAM type: YTN; PAM sequence: TTA
agaagagattcacagtagct

SEQ ID NO: 67368 - DNA, 20 bp, Artificial Sequence
  Description of Artificial Sequence: Synthetic oligonucleotide
  Target: SCN9A; (-) strand; PAM type: YTN; PAM sequence: CTA
aatgcagagttaagaagaga

SEQ ID NO: 67369 - DNA, 20 bp, Artificial Sequence
  Description of Artificial Sequence: Synthetic oligonucleotide
  Target: SCN9A; (-) strand; PAM type: YTN; PAM sequence: TTG
ctaaatgcagagttaagaag

SEQ ID NO: 67370 - DNA, 20 bp, Artificial Sequence
  Description of Artificial Sequence: Synthetic oligonucleotide
  Target: SCN9A; (-) strand; PAM type: YTN; PAM sequence: CTG
atgtgaaattgctaaatgca

SEQ ID NO: 67371 - DNA, 20 bp, Artificial Sequence
  Description of Artificial Sequence: Synthetic oligonucleotide
  Target: SCN9A; (-) strand; PAM type: YTN; PAM sequence: CTA
ctgatgtgaaattgctaaat

SEQ ID NO: 67372 - DNA, 20 bp, Artificial Sequence
  Description of Artificial Sequence: Synthetic oligonucleotide
  Target: SCN9A; (-) strand; PAM type: YTN; PAM sequence: TTC
aaactactgatgtgaaattg

SEQ ID NO: 67373 - DNA, 20 bp, Artificial Sequence
  Description of Artificial Sequence: Synthetic oligonucleotide
  Target: SCN9A; (-) strand; PAM type: YTN; PAM sequence: TTT
caaactactgatgtgaaatt

SEQ ID NO: 67374 - DNA, 20 bp, Artificial Sequence
  Description of Artificial Sequence: Synthetic oligonucleotide
  Target: SCN9A; (-) strand; PAM type: YTN; PAM sequence: CTG
atttcaaactactgatgtga

SEQ ID NO: 67375 - DNA, 20 bp, Artificial Sequence
  Description of Artificial Sequence: Synthetic oligonucleotide
  Target: SCN9A; (-) strand; PAM type: YTN; PAM sequence: TTC
ccaccatcactgatttcaaa

SEQ ID NO: 67376 - DNA, 20 bp, Artificial Sequence
  Description of Artificial Sequence: Synthetic oligonucleotide
  Target: SCN9A; (-) strand; PAM type: YTN; PAM sequence: TTG
taatgtaaagattcccacca

SEQ ID NO: 67377 - DNA, 20 bp, Artificial Sequence
  Description of Artificial Sequence: Synthetic oligonucleotide
  Target: SCN9A; (-) strand; PAM type: YTN; PAM sequence: TTT
gtaatgtaaagattcccacc

SEQ ID NO: 67378 - DNA, 20 bp, Artificial Sequence
  Description of Artificial Sequence: Synthetic oligonucleotide
  Target: SCN9A; (-) strand; PAM type: YTN; PAM sequence: TTT
tgtaatgtaaagattcccac

SEQ ID NO: 67379 - DNA, 20 bp, Artificial Sequence
  Description of Artificial Sequence: Synthetic oligonucleotide
  Target: SCN9A; (-) strand; PAM type: YTN; PAM sequence: TTT
ttgtaatgtaaagattccca

SEQ ID NO: 67380 - DNA, 20 bp, Artificial Sequence
  Description of Artificial Sequence: Synthetic oligonucleotide
  Target: SCN9A; (-) strand; PAM type: YTN; PAM sequence: TTG
gagatttttgtaatgtaaag

SEQ ID NO: 67381 - DNA, 20 bp, Artificial Sequence
  Description of Artificial Sequence: Synthetic oligonucleotide
  Target: SCN9A; (-) strand; PAM type: YTN; PAM sequence: CTT
ggagatttttgtaatgtaaa

SEQ ID NO: 67382 - DNA, 20 bp, Artificial Sequence
  Description of Artificial Sequence: Synthetic oligonucleotide
  Target: SCN9A; (-) strand; PAM type: YTN; PAM sequence: TTG
tagtgcttggagatttttgt

SEQ ID NO: 67383 - DNA, 20 bp, Artificial Sequence
  Description of Artificial Sequence: Synthetic oligonucleotide
  Target: SCN9A; (-) strand; PAM type: YTN; PAM sequence: TTT
gtagtgcttggagatttttg

SEQ ID NO: 67384 - DNA, 20 bp, Artificial Sequence
  Description of Artificial Sequence: Synthetic oligonucleotide
  Target: SCN9A; (-) strand; PAM type: YTN; PAM sequence: CTC
atttgtagtgcttggagatt

SEQ ID NO: 67385 - DNA, 20 bp, Artificial Sequence
  Description of Artificial Sequence: Synthetic oligonucleotide
  Target: SCN9A; (-) strand; PAM type: YTN; PAM sequence: CTC
tcatttgtagtgcttggaga

SEQ ID NO: 67386 - DNA, 20 bp, Artificial Sequence
  Description of Artificial Sequence: Synthetic oligonucleotide
  Target: SCN9A; (-) strand; PAM type: YTN; PAM sequence: CTA
gaaaatcaagaagctctcat

SEQ ID NO: 67387 - DNA, 20 bp, Artificial Sequence
  Description of Artificial Sequence: Synthetic oligonucleotide
  Target: SCN9A; (-) strand; PAM type: YTN; PAM sequence: CTC
tagaaaatcaagaagctctc

SEQ ID NO: 67388 - DNA, 20 bp, Artificial Sequence
  Description of Artificial Sequence: Synthetic oligonucleotide
  Target: SCN9A; (-) strand; PAM type: YTN; PAM sequence: CTA
ctctagaaaatcaagaagct

SEQ ID NO: 67389 - DNA, 20 bp, Artificial Sequence
  Description of Artificial Sequence: Synthetic oligonucleotide
  Target: SCN9A; (-) strand; PAM type: YTN; PAM sequence: TTC
tactctagaaaatcaagaag

SEQ ID NO: 67390 - DNA, 20 bp, Artificial Sequence
  Description of Artificial Sequence: Synthetic oligonucleotide
  Target: SCN9A; (-) strand; PAM type: YTN; PAM sequence: TTA
attctactctagaaaatcaa

SEQ ID NO: 67391 - DNA, 20 bp, Artificial Sequence
  Description of Artificial Sequence: Synthetic oligonucleotide
  Target: SCN9A; (-) strand; PAM type: YTN; PAM sequence: CTT
aattctactctagaaaatca

SEQ ID NO: 67392 - DNA, 20 bp, Artificial Sequence
  Description of Artificial Sequence: Synthetic oligonucleotide
  Target: SCN9A; (-) strand; PAM type: YTN; PAM sequence: TTC
ttaattctactctagaaaat

SEQ ID NO: 67393 - DNA, 20 bp, Artificial Sequence
  Description of Artificial Sequence: Synthetic oligonucleotide
  Target: SCN9A; (-) strand; PAM type: YTN; PAM sequence: CTT
cttaattctactctagaaaa

SEQ ID NO: 67394 - DNA, 20 bp, Artificial Sequence
  Description of Artificial Sequence: Synthetic oligonucleotide
  Target: SCN9A; (-) strand; PAM type: YTN; PAM sequence: CTC
catcaccttcttaattctac

SEQ ID NO: 67395 - DNA, 20 bp, Artificial Sequence
  Description of Artificial Sequence: Synthetic oligonucleotide
  Target: SCN9A; (-) strand; PAM type: YTN; PAM sequence: TTC
ctccatcaccttcttaattc

SEQ ID NO: 67396 - DNA, 20 bp, Artificial Sequence
  Description of Artificial Sequence: Synthetic oligonucleotide
  Target: SCN9A; (-) strand; PAM type: YTN; PAM sequence: TTT
cctccatcaccttcttaatt

SEQ ID NO: 67397 - DNA, 20 bp, Artificial Sequence
  Description of Artificial Sequence: Synthetic oligonucleotide
  Target: SCN9A; (-) strand; PAM type: YTN; PAM sequence: TTG
gcatttcctccatcaccttc

SEQ ID NO: 67398 - DNA, 20 bp, Artificial Sequence
  Description of Artificial Sequence: Synthetic oligonucleotide
  Target: SCN9A; (-) strand; PAM type: YTN; PAM sequence: TTA
ttggcatttcctccatcacc

SEQ ID NO: 67399 - DNA, 20 bp, Artificial Sequence
  Description of Artificial Sequence: Synthetic oligonucleotide
  Target: SCN9A; (-) strand; PAM type: YTN; PAM sequence: TTT
attggcatttcctccatcac

SEQ ID NO: 67400 - DNA, 20 bp, Artificial Sequence
  Description of Artificial Sequence: Synthetic oligonucleotide
  Target: SCN9A; (-) strand; PAM type: YTN; PAM sequence: TTT
tattggcatttcctccatca

SEQ ID NO: 67401 - DNA, 20 bp, Artificial Sequence
  Description of Artificial Sequence: Synthetic oligonucleotide
  Target: SCN9A; (-) strand; PAM type: YTN; PAM sequence: CTG
ttttattggcatttcctcca

SEQ ID NO: 67402 - DNA, 20 bp, Artificial Sequence
  Description of Artificial Sequence: Synthetic oligonucleotide
  Target: SCN9A; (-) strand; PAM type: YTN; PAM sequence: TTA
tctgttttattggcatttcc

SEQ ID NO: 67403 - DNA, 20 bp, Artificial Sequence
  Description of Artificial Sequence: Synthetic oligonucleotide
  Target: SCN9A; (-) strand; PAM type: YTN; PAM sequence: TTT
atctgttttattggcatttc

SEQ ID NO: 67404 - DNA, 20 bp, Artificial Sequence
  Description of Artificial Sequence: Synthetic oligonucleotide
  Target: SCN9A; (-) strand; PAM type: YTN; PAM sequence: CTG
tttatctgttttattggcat

SEQ ID NO: 67405 - DNA, 20 bp, Artificial Sequence
  Description of Artificial Sequence: Synthetic oligonucleotide
  Target: SCN9A; (-) strand; PAM type: YTN; PAM sequence: TTG
actgtttatctgttttattg

SEQ ID NO: 67406 - DNA, 20 bp, Artificial Sequence
  Description of Artificial Sequence: Synthetic oligonucleotide
  Target: SCN9A; (-) strand; PAM type: YTN; PAM sequence: CTT
gactgtttatctgttttatt

SEQ ID NO: 67407 - DNA, 20 bp, Artificial Sequence
  Description of Artificial Sequence: Synthetic oligonucleotide
  Target: SCN9A; (-) strand; PAM type: YTN; PAM sequence: CTA
caaacacaatacaccttgac

SEQ ID NO: 67408 - DNA, 20 bp, Artificial Sequence
  Description of Artificial Sequence: Synthetic oligonucleotide
  Target: SCN9A; (-) strand; PAM type: YTN; PAM sequence: TTC
agagtaatggctacaaacac

SEQ ID NO: 67409 - DNA, 20 bp, Artificial Sequence
  Description of Artificial Sequence: Synthetic oligonucleotide
  Target: SCN9A; (-) strand; PAM type: YTN; PAM sequence: CTA
ttcagagtaatggctacaaa

SEQ ID NO: 67410 - DNA, 20 bp, Artificial Sequence
  Description of Artificial Sequence: Synthetic oligonucleotide
  Target: SCN9A; (-) strand; PAM type: YTN; PAM sequence: TTG
tgctattcagagtaatggct

SEQ ID NO: 67411 - DNA, 20 bp, Artificial Sequence
  Description of Artificial Sequence: Synthetic oligonucleotide
  Target: SCN9A; (-) strand; PAM type: YTN; PAM sequence: TTT
gtgctattcagagtaatggc

SEQ ID NO: 67412 - DNA, 20 bp, Artificial Sequence
  Description of Artificial Sequence: Synthetic oligonucleotide
  Target: SCN9A; (-) strand; PAM type: YTN; PAM sequence: TTT
tgtgctattcagagtaatgg

SEQ ID NO: 67413 - DNA, 20 bp, Artificial Sequence
  Description of Artificial Sequence: Synthetic oligonucleotide
  Target: SCN9A; (-) strand; PAM type: YTN; PAM sequence: TTT
ttgtgctattcagagtaatg

SEQ ID NO: 67414 - DNA, 20 bp, Artificial Sequence
  Description of Artificial Sequence: Synthetic oligonucleotide
  Target: SCN9A; (-) strand; PAM type: YTN; PAM sequence: TTA
atttttgtgctattcagagt

SEQ ID NO: 67415 - DNA, 20 bp, Artificial Sequence
  Description of Artificial Sequence: Synthetic oligonucleotide
  Target: SCN9A; (-) strand; PAM type: YTN; PAM sequence: TTT
aatttttgtgctattcagag

SEQ ID NO: 67416 - DNA, 20 bp, Artificial Sequence
  Description of Artificial Sequence: Synthetic oligonucleotide
  Target: SCN9A; (-) strand; PAM type: YTN; PAM sequence: TTT
taatttttgtgctattcaga

SEQ ID NO: 67417 - DNA, 20 bp, Artificial Sequence
  Description of Artificial Sequence: Synthetic oligonucleotide
  Target: SCN9A; (-) strand; PAM type: YTN; PAM sequence: TTT
ttaatttttgtgctattcag

SEQ ID NO: 67418 - DNA, 20 bp, Artificial Sequence
  Description of Artificial Sequence: Synthetic oligonucleotide
  Target: SCN9A; (-) strand; PAM type: YTN; PAM sequence: TTT
tttaatttttgtgctattca

SEQ ID NO: 67419 - DNA, 20 bp, Artificial Sequence
  Description of Artificial Sequence: Synthetic oligonucleotide
  Target: SCN9A; (-) strand; PAM type: YTN; PAM sequence: TTC
aataatgaaaggatattttt

SEQ ID NO: 67420 - DNA, 20 bp, Artificial Sequence
  Description of Artificial Sequence: Synthetic oligonucleotide
  Target: SCN9A; (-) strand; PAM type: YTN; PAM sequence: TTT
caataatgaaaggatatttt

SEQ ID NO: 67421 - DNA, 20 bp, Artificial Sequence
  Description of Artificial Sequence: Synthetic oligonucleotide
  Target: SCN9A; (-) strand; PAM type: YTN; PAM sequence: TTG
caaatcaaaaaacagaattt

SEQ ID NO: 67422 - DNA, 20 bp, Artificial Sequence
  Description of Artificial Sequence: Synthetic oligonucleotide
  Target: SCN9A; (-) strand; PAM type: YTN; PAM sequence: TTT
gcaaatcaaaaaacagaatt

SEQ ID NO: 67423 - DNA, 20 bp, Artificial Sequence
  Description of Artificial Sequence: Synthetic oligonucleotide
  Target: SCN9A; (-) strand; PAM type: YTN; PAM sequence: TTA
tttgcaaatcaaaaaacaga

SEQ ID NO: 67424 - DNA, 20 bp, Artificial Sequence
  Description of Artificial Sequence: Synthetic oligonucleotide
  Target: SCN9A; (-) strand; PAM type: YTN; PAM sequence: TTC
atcagtgatgtaagcaatta

SEQ ID NO: 67425 - DNA, 20 bp, Artificial Sequence
  Description of Artificial Sequence: Synthetic oligonucleotide
  Target: SCN9A; (-) strand; PAM type: YTN; PAM sequence: CTC
attcatcagtgatgtaagca

SEQ ID NO: 67426 - DNA, 20 bp, Artificial Sequence
  Description of Artificial Sequence: Synthetic oligonucleotide
  Target: SCN9A; (-) strand; PAM type: YTN; PAM sequence: TTA
ctcattcatcagtgatgtaa

SEQ ID NO: 67427 - DNA, 20 bp, Artificial Sequence
  Description of Artificial Sequence: Synthetic oligonucleotide
  Target: SCN9A; (-) strand; PAM type: YTN; PAM sequence: TTT
actcattcatcagtgatgta

SEQ ID NO: 67428 - DNA, 20 bp, Artificial Sequence
  Description of Artificial Sequence: Synthetic oligonucleotide
  Target: SCN9A; (-) strand; PAM type: YTN; PAM sequence: CTT
tactcattcatcagtgatgt

SEQ ID NO: 67429 - DNA, 20 bp, Artificial Sequence
  Description of Artificial Sequence: Synthetic oligonucleotide
  Target: SCN9A; (-) strand; PAM type: YTN; PAM sequence: CTA
tatgtcagaactttactcat

SEQ ID NO: 67430 - DNA, 20 bp, Artificial Sequence
  Description of Artificial Sequence: Synthetic oligonucleotide
  Target: SCN9A; (-) strand; PAM type: YTN; PAM sequence: TTA
gtcagtgaaataaaaaagaa

SEQ ID NO: 67431 - DNA, 20 bp, Artificial Sequence
  Description of Artificial Sequence: Synthetic oligonucleotide
  Target: SCN9A; (-) strand; PAM type: YTN; PAM sequence: TTA
tgttagtcagtgaaataaaa

SEQ ID NO: 67432 - DNA, 20 bp, Artificial Sequence
  Description of Artificial Sequence: Synthetic oligonucleotide
  Target: SCN9A; (-) strand; PAM type: YTN; PAM sequence: TTT
atgttagtcagtgaaataaa

SEQ ID NO: 67433 - DNA, 20 bp, Artificial Sequence
  Description of Artificial Sequence: Synthetic oligonucleotide
  Target: SCN9A; (-) strand; PAM type: YTN; PAM sequence: TTG
atatttatgttagtcagtga

SEQ ID NO: 67434 - DNA, 20 bp, Artificial Sequence
  Description of Artificial Sequence: Synthetic oligonucleotide
  Target: SCN9A; (-) strand; PAM type: YTN; PAM sequence: CTT
gatatttatgttagtcagtg

SEQ ID NO: 67435 - DNA, 20 bp, Artificial Sequence
  Description of Artificial Sequence: Synthetic oligonucleotide
  Target: SCN9A; (-) strand; PAM type: YTN; PAM sequence: CTG
cttgatatttatgttagtca

SEQ ID NO: 67436 - DNA, 20 bp, Artificial Sequence
  Description of Artificial Sequence: Synthetic oligonucleotide
  Target: SCN9A; (-) strand; PAM type: YTN; PAM sequence: TTA
gcatgaagactgcttgatat

SEQ ID NO: 67437 - DNA, 20 bp, Artificial Sequence
  Description of Artificial Sequence: Synthetic oligonucleotide
  Target: SCN9A; (-) strand; PAM type: YTN; PAM sequence: TTT
agcatgaagactgcttgata

SEQ ID NO: 67438 - DNA, 20 bp, Artificial Sequence
  Description of Artificial Sequence: Synthetic oligonucleotide
  Target: SCN9A; (-) strand; PAM type: YTN; PAM sequence: TTT
tagcatgaagactgcttgat

SEQ ID NO: 67439 - DNA, 20 bp, Artificial Sequence
  Description of Artificial Sequence: Synthetic oligonucleotide
  Target: SCN9A; (-) strand; PAM type: YTN; PAM sequence: CTA
ataaacaagtatagttttag

SEQ ID NO: 67440 - DNA, 20 bp, Artificial Sequence
  Description of Artificial Sequence: Synthetic oligonucleotide
  Target: SCN9A; (-) strand; PAM type: YTN; PAM sequence: TTG
cagctaataaacaagtatag

SEQ ID NO: 67441 - DNA, 20 bp, Artificial Sequence
  Description of Artificial Sequence: Synthetic oligonucleotide
  Target: SCN9A; (-) strand; PAM type: YTN; PAM sequence: TTT
gcagctaataaacaagtata

SEQ ID NO: 67442 - DNA, 20 bp, Artificial Sequence
  Description of Artificial Sequence: Synthetic oligonucleotide
  Target: SCN9A; (-) strand; PAM type: YTN; PAM sequence: TTT
tgcagctaataaacaagtat

SEQ ID NO: 67443 - DNA, 20 bp, Artificial Sequence
  Description of Artificial Sequence: Synthetic oligonucleotide
  Target: SCN9A; (-) strand; PAM type: YTN; PAM sequence: TTT
ttgcagctaataaacaagta

SEQ ID NO: 67444 - DNA, 20 bp, Artificial Sequence
  Description of Artificial Sequence: Synthetic oligonucleotide
  Target: SCN9A; (-) strand; PAM type: YTN; PAM sequence: CTA
tttttgcagctaataaacaa

SEQ ID NO: 67445 - DNA, 20 bp, Artificial Sequence
  Description of Artificial Sequence: Synthetic oligonucleotide
  Target: SCN9A; (-) strand; PAM type: YTN; PAM sequence: TTG
catgtataggcaacctattt

SEQ ID NO: 67446 - DNA, 20 bp, Artificial Sequence
  Description of Artificial Sequence: Synthetic oligonucleotide
  Target: SCN9A; (-) strand; PAM type: YTN; PAM sequence: TTT
gcatgtataggcaacctatt

SEQ ID NO: 67447 - DNA, 20 bp, Artificial Sequence
  Description of Artificial Sequence: Synthetic oligonucleotide
  Target: SCN9A; (-) strand; PAM type: YTN; PAM sequence: TTT
tgcatgtataggcaacctat

SEQ ID NO: 67448 - DNA, 20 bp, Artificial Sequence
  Description of Artificial Sequence: Synthetic oligonucleotide
  Target: SCN9A; (-) strand; PAM type: YTN; PAM sequence: CTT
ttgcatgtataggcaaccta

SEQ ID NO: 67449 - DNA, 20 bp, Artificial Sequence
  Description of Artificial Sequence: Synthetic oligonucleotide
  Target: SCN9A; (-) strand; PAM type: YTN; PAM sequence: TTG
ccaaacttttgcatgtatag

SEQ ID NO: 67450 - DNA, 20 bp, Artificial Sequence
  Description of Artificial Sequence: Synthetic oligonucleotide
  Target: SCN9A; (-) strand; PAM type: YTN; PAM sequence: TTT
gccaaacttttgcatgtata

SEQ ID NO: 67451 - DNA, 20 bp, Artificial Sequence
  Description of Artificial Sequence: Synthetic oligonucleotide
  Target: SCN9A; (-) strand; PAM type: YTN; PAM sequence: CTT
tgccaaacttttgcatgtat

SEQ ID NO: 67452 - DNA, 20 bp, Artificial Sequence
  Description of Artificial Sequence: Synthetic oligonucleotide
  Target: SCN9A; (-) strand; PAM type: YTN; PAM sequence: TTG
aactttgccaaacttttgca

SEQ ID NO: 67453 - DNA, 20 bp, Artificial Sequence
  Description of Artificial Sequence: Synthetic oligonucleotide
  Target: SCN9A; (-) strand; PAM type: YTN; PAM sequence: TTT
gaactttgccaaacttttgc

SEQ ID NO: 67454 - DNA, 20 bp, Artificial Sequence
  Description of Artificial Sequence: Synthetic oligonucleotide
  Target: SCN9A; (-) strand; PAM type: YTN; PAM sequence: TTT
tgaactttgccaaacttttg

SEQ ID NO: 67455 - DNA, 20 bp, Artificial Sequence
  Description of Artificial Sequence: Synthetic oligonucleotide
  Target: SCN9A; (-) strand; PAM type: YTN; PAM sequence: TTT
ttgaactttgccaaactttt

SEQ ID NO: 67456 - DNA, 20 bp, Artificial Sequence
  Description of Artificial Sequence: Synthetic oligonucleotide
  Target: SCN9A; (-) strand; PAM type: YTN; PAM sequence: TTT
tttgaactttgccaaacttt

SEQ ID NO: 67457 - DNA, 20 bp, Artificial Sequence
  Description of Artificial Sequence: Synthetic oligonucleotide
  Target: SCN9A; (-) strand; PAM type: YTN; PAM sequence: TTT
ttttgaactttgccaaactt

SEQ ID NO: 67458 - DNA, 20 bp, Artificial Sequence
  Description of Artificial Sequence: Synthetic oligonucleotide
  Target: SCN9A; (-) strand; PAM type: YTN; PAM sequence: CTT
tttttgaactttgccaaact

SEQ ID NO: 67459 - DNA, 20 bp, Artificial Sequence
  Description of Artificial Sequence: Synthetic oligonucleotide
  Target: SCN9A; (-) strand; PAM type: YTN; PAM sequence: CTC
aaagaatgctttttttgaac

SEQ ID NO: 67460 - DNA, 20 bp, Artificial Sequence
  Description of Artificial Sequence: Synthetic oligonucleotide
  Target: SCN9A; (-) strand; PAM type: YTN; PAM sequence: TTC
tcaaagaatgctttttttga

SEQ ID NO: 67461 - DNA, 20 bp, Artificial Sequence
  Description of Artificial Sequence: Synthetic oligonucleotide
  Target: SCN9A; (-) strand; PAM type: YTN; PAM sequence: TTT
ctcaaagaatgctttttttg

SEQ ID NO: 67462 - DNA, 20 bp, Artificial Sequence
  Description of Artificial Sequence: Synthetic oligonucleotide
  Target: SCN9A; (-) strand; PAM type: YTN; PAM sequence: TTG
tttctcaaagaatgcttttt

SEQ ID NO: 67463 - DNA, 20 bp, Artificial Sequence
  Description of Artificial Sequence: Synthetic oligonucleotide
  Target: SCN9A; (-) strand; PAM type: YTN; PAM sequence: CTG
tatatcaaattgtttctcaa

SEQ ID NO: 67464 - DNA, 20 bp, Artificial Sequence
  Description of Artificial Sequence: Synthetic oligonucleotide
  Target: SCN9A; (-) strand; PAM type: YTN; PAM sequence: TTC
tgtatatcaaattgtttctc

SEQ ID NO: 67465 - DNA, 20 bp, Artificial Sequence
  Description of Artificial Sequence: Synthetic oligonucleotide
  Target: SCN9A; (-) strand; PAM type: YTN; PAM sequence: TTG
aacattctgtatatcaaatt

SEQ ID NO: 67466 - DNA, 20 bp, Artificial Sequence
  Description of Artificial Sequence: Synthetic oligonucleotide
  Target: SCN9A; (-) strand; PAM type: YTN; PAM sequence: TTA
ttgaacattctgtatatcaa

SEQ ID NO: 67467 - DNA, 20 bp, Artificial Sequence
  Description of Artificial Sequence: Synthetic oligonucleotide
  Target: SCN9A; (-) strand; PAM type: YTN; PAM sequence: TTT
attgaacattctgtatatca

SEQ ID NO: 67468 - DNA, 20 bp, Artificial Sequence
  Description of Artificial Sequence: Synthetic oligonucleotide
  Target: SCN9A; (-) strand; PAM type: YTN; PAM sequence: TTT
tattgaacattctgtatatc

SEQ ID NO: 67469 - DNA, 20 bp, Artificial Sequence
  Description of Artificial Sequence: Synthetic oligonucleotide
  Target: SCN9A; (-) strand; PAM type: YTN; PAM sequence: TTT
ttattgaacattctgtatat

SEQ ID NO: 67470 - DNA, 20 bp, Artificial Sequence
  Description of Artificial Sequence: Synthetic oligonucleotide
  Target: SCN9A; (-) strand; PAM type: YTN; PAM sequence: CTT
tttattgaacattctgtata

SEQ ID NO: 67471 - DNA, 20 bp, Artificial Sequence
  Description of Artificial Sequence: Synthetic oligonucleotide
  Target: SCN9A; (-) strand; PAM type: YTN; PAM sequence: TTA
caactttttattgaacattc

SEQ ID NO: 67472 - DNA, 20 bp, Artificial Sequence
  Description of Artificial Sequence: Synthetic oligonucleotide
  Target: SCN9A; (-) strand; PAM type: YTN; PAM sequence: TTA
caaataataaaatattacaa

SEQ ID NO: 67473 - DNA, 20 bp, Artificial Sequence
  Description of Artificial Sequence: Synthetic oligonucleotide
  Target: SCN9A; (-) strand; PAM type: YTN; PAM sequence: TTT
acaaataataaaatattaca

SEQ ID NO: 67474 - DNA, 20 bp, Artificial Sequence
  Description of Artificial Sequence: Synthetic oligonucleotide
  Target: SCN9A; (-) strand; PAM type: YTN; PAM sequence: TTA
ggatatatgacacacaattt

SEQ ID NO: 67475 - DNA, 20 bp, Artificial Sequence
  Description of Artificial Sequence: Synthetic oligonucleotide
  Target: SCN9A; (-) strand; PAM type: YTN; PAM sequence: CTG
atattaggatatatgacaca

SEQ ID NO: 67476 - DNA, 20 bp, Artificial Sequence
  Description of Artificial Sequence: Synthetic oligonucleotide
  Target: SCN9A; (-) strand; PAM type: YTN; PAM sequence: TTA
ctgatattaggatatatgac

SEQ ID NO: 67477 - DNA, 20 bp, Artificial Sequence
  Description of Artificial Sequence: Synthetic oligonucleotide
  Target: SCN9A; (-) strand; PAM type: YTN; PAM sequence: TTT
actgatattaggatatatga

SEQ ID NO: 67478 - DNA, 20 bp, Artificial Sequence
  Description of Artificial Sequence: Synthetic oligonucleotide
  Target: SCN9A; (-) strand; PAM type: YTN; PAM sequence: TTT
tactgatattaggatatatg

SEQ ID NO: 67479 - DNA, 20 bp, Artificial Sequence
  Description of Artificial Sequence: Synthetic oligonucleotide
  Target: SCN9A; (-) strand; PAM type: YTN; PAM sequence: CTA
taaattttactgatattagg

SEQ ID NO: 67480 - DNA, 20 bp, Artificial Sequence
  Description of Artificial Sequence: Synthetic oligonucleotide
  Target: SCN9A; (-) strand; PAM type: YTN; PAM sequence: TTA
ctataaattttactgatatt

SEQ ID NO: 67481 - DNA, 20 bp, Artificial Sequence
  Description of Artificial Sequence: Synthetic oligonucleotide
  Target: SCN9A; (-) strand; PAM type: YTN; PAM sequence: TTT
actataaattttactgatat

SEQ ID NO: 67482 - DNA, 20 bp, Artificial Sequence
  Description of Artificial Sequence: Synthetic oligonucleotide
  Target: SCN9A; (-) strand; PAM type: YTN; PAM sequence: TTA
tatcatttactataaatttt

SEQ ID NO: 67483 - DNA, 20 bp, Artificial Sequence
  Description of Artificial Sequence: Synthetic oligonucleotide
  Target: SCN9A; (-) strand; PAM type: YTN; PAM sequence: CTT
atatcatttactataaattt

SEQ ID NO: 67484 - DNA, 20 bp, Artificial Sequence
  Description of Artificial Sequence: Synthetic oligonucleotide
  Target: SCN9A; (-) strand; PAM type: YTN; PAM sequence: CTC
caaggaaaataaaaaatgtg

SEQ ID NO: 67485 - DNA, 20 bp, Artificial Sequence
  Description of Artificial Sequence: Synthetic oligonucleotide
  Target: SCN9A; (-) strand; PAM type: YTN; PAM sequence: TTC
tccaaggaaaataaaaaatg

SEQ ID NO: 67486 - DNA, 20 bp, Artificial Sequence
  Description of Artificial Sequence: Synthetic oligonucleotide
  Target: SCN9A; (-) strand; PAM type: YTN; PAM sequence: CTG
gttctccaaggaaaataaaa

SEQ ID NO: 67487 - DNA, 20 bp, Artificial Sequence
  Description of Artificial Sequence: Synthetic oligonucleotide
  Target: SCN9A; (-) strand; PAM type: YTN; PAM sequence: TTA
taaactggttctccaaggaa

SEQ ID NO: 67488 - DNA, 20 bp, Artificial Sequence
  Description of Artificial Sequence: Synthetic oligonucleotide
  Target: SCN9A; (-) strand; PAM type: YTN; PAM sequence: TTT
ataaactggttctccaagga

SEQ ID NO: 67489 - DNA, 20 bp, Artificial Sequence
  Description of Artificial Sequence: Synthetic oligonucleotide
  Target: SCN9A; (-) strand; PAM type: YTN; PAM sequence: TTT
tataaactggttctccaagg

SEQ ID NO: 67490 - DNA, 20 bp, Artificial Sequence
  Description of Artificial Sequence: Synthetic oligonucleotide
  Target: SCN9A; (-) strand; PAM type: YTN; PAM sequence: TTT
ttataaactggttctccaag

SEQ ID NO: 67491 - DNA, 20 bp, Artificial Sequence
  Description of Artificial Sequence: Synthetic oligonucleotide
  Target: SCN9A; (-) strand; PAM type: YTN; PAM sequence: CTA
gtgatgtgtaggtaaatatt

SEQ ID NO: 67492 - DNA, 20 bp, Artificial Sequence
  Description of Artificial Sequence: Synthetic oligonucleotide
  Target: SCN9A; (-) strand; PAM type: YTN; PAM sequence: CTG
tcctagtgatgtgtaggtaa

SEQ ID NO: 67493 - DNA, 20 bp, Artificial Sequence
  Description of Artificial Sequence: Synthetic oligonucleotide
  Target: SCN9A; (-) strand; PAM type: YTN; PAM sequence: CTA
cctgtcctagtgatgtgtag

SEQ ID NO: 67494 - DNA, 20 bp, Artificial Sequence
  Description of Artificial Sequence: Synthetic oligonucleotide
  Target: SCN9A; (-) strand; PAM type: YTN; PAM sequence: CTC
tacctgtcctagtgatgtgt

SEQ ID NO: 67495 - DNA, 20 bp, Artificial Sequence
  Description of Artificial Sequence: Synthetic oligonucleotide
  Target: SCN9A; (-) strand; PAM type: YTN; PAM sequence: CTC
ctctacctgtcctagtgatg

SEQ ID NO: 67496 - DNA, 20 bp, Artificial Sequence
  Description of Artificial Sequence: Synthetic oligonucleotide
  Target: SCN9A; (-) strand; PAM type: YTN; PAM sequence: TTC
tcctctacctgtcctagtga

SEQ ID NO: 67497 - DNA, 20 bp, Artificial Sequence
  Description of Artificial Sequence: Synthetic oligonucleotide
  Target: SCN9A; (-) strand; PAM type: YTN; PAM sequence: TTT
ctcctctacctgtcctagtg

SEQ ID NO: 67498 - DNA, 20 bp, Artificial Sequence
  Description of Artificial Sequence: Synthetic oligonucleotide
  Target: SCN9A; (-) strand; PAM type: YTN; PAM sequence: TTT
tctcctctacctgtcctagt

SEQ ID NO: 67499 - DNA, 20 bp, Artificial Sequence
  Description of Artificial Sequence: Synthetic oligonucleotide
  Target: SCN9A; (-) strand; PAM type: YTN; PAM sequence: TTC
aaagttttctcctctacctg

SEQ ID NO: 67500 - DNA, 20 bp, Artificial Sequence
  Description of Artificial Sequence: Synthetic oligonucleotide
  Target: SCN9A; (-) strand; PAM type: YTN; PAM sequence: CTT
caaagttttctcctctacct

SEQ ID NO: 67501 - DNA, 20 bp, Artificial Sequence
  Description of Artificial Sequence: Synthetic oligonucleotide
  Target: SCN9A; (-) strand; PAM type: YTN; PAM sequence: CTA
cttcaaagttttctcctcta

SEQ ID NO: 67502 - DNA, 20 bp, Artificial Sequence
  Description of Artificial Sequence: Synthetic oligonucleotide
  Target: SCN9A; (-) strand; PAM type: YTN; PAM sequence: TTC
atctacttcaaagttttctc

SEQ ID NO: 67503 - DNA, 20 bp, Artificial Sequence
  Description of Artificial Sequence: Synthetic oligonucleotide
  Target: SCN9A; (-) strand; PAM type: YTN; PAM sequence: TTT
catctacttcaaagttttct

SEQ ID NO: 67504 - DNA, 20 bp, Artificial Sequence
  Description of Artificial Sequence: Synthetic oligonucleotide
  Target: SCN9A; (-) strand; PAM type: YTN; PAM sequence: CTC
atttcatctacttcaaagtt

SEQ ID NO: 67505 - DNA, 20 bp, Artificial Sequence
  Description of Artificial Sequence: Synthetic oligonucleotide
  Target: SCN9A; (-) strand; PAM type: YTN; PAM sequence: CTC
tcatttcatctacttcaaag

SEQ ID NO: 67506 - DNA, 20 bp, Artificial Sequence
  Description of Artificial Sequence: Synthetic oligonucleotide
  Target: SCN9A; (-) strand; PAM type: YTN; PAM sequence: TTC
atctctcatttcatctactt

SEQ ID NO: 67507 - DNA, 20 bp, Artificial Sequence
  Description of Artificial Sequence: Synthetic oligonucleotide
  Target: SCN9A; (-) strand; PAM type: YTN; PAM sequence: TTG
ttcatctctcatttcatcta

SEQ ID NO: 67508 - DNA, 20 bp, Artificial Sequence
  Description of Artificial Sequence: Synthetic oligonucleotide
  Target: SCN9A; (-) strand; PAM type: YTN; PAM sequence: CTT
gttcatctctcatttcatct

SEQ ID NO: 67509 - DNA, 20 bp, Artificial Sequence
  Description of Artificial Sequence: Synthetic oligonucleotide
  Target: SCN9A; (-) strand; PAM type: YTN; PAM sequence: TTC
ttgttcatctctcatttcat

SEQ ID NO: 67510 - DNA, 20 bp, Artificial Sequence
  Description of Artificial Sequence: Synthetic oligonucleotide
  Target: SCN9A; (-) strand; PAM type: YTN; PAM sequence: CTT
cttgttcatctctcatttca

SEQ ID NO: 67511 - DNA, 20 bp, Artificial Sequence
  Description of Artificial Sequence: Synthetic oligonucleotide
  Target: SCN9A; (-) strand; PAM type: YTN; PAM sequence: TTG
gtccttcttgttcatctctc

SEQ ID NO: 67512 - DNA, 20 bp, Artificial Sequence
  Description of Artificial Sequence: Synthetic oligonucleotide
  Target: SCN9A; (-) strand; PAM type: YTN; PAM sequence: CTT
ggtccttcttgttcatctct

SEQ ID NO: 67513 - DNA, 20 bp, Artificial Sequence
  Description of Artificial Sequence: Synthetic oligonucleotide
  Target: SCN9A; (-) strand; PAM type: YTN; PAM sequence: CTC
ttggtccttcttgttcatct

SEQ ID NO: 67514 - DNA, 20 bp, Artificial Sequence
  Description of Artificial Sequence: Synthetic oligonucleotide
  Target: SCN9A; (-) strand; PAM type: YTN; PAM sequence: CTG
caccctcttggtccttcttg

SEQ ID NO: 67515 - DNA, 20 bp, Artificial Sequence
  Description of Artificial Sequence: Synthetic oligonucleotide
  Target: SCN9A; (-) strand; PAM type: YTN; PAM sequence: TTA
ctgcaccctcttggtccttc

SEQ ID NO: 67516 - DNA, 20 bp, Artificial Sequence
  Description of Artificial Sequence: Synthetic oligonucleotide
  Target: SCN9A; (-) strand; PAM type: YTN; PAM sequence: TTT
actgcaccctcttggtcctt

SEQ ID NO: 67517 - DNA, 20 bp, Artificial Sequence
  Description of Artificial Sequence: Synthetic oligonucleotide
  Target: SCN9A; (-) strand; PAM type: YTN; PAM sequence: TTT
tactgcaccctcttggtcct

SEQ ID NO: 67518 - DNA, 20 bp, Artificial Sequence
  Description of Artificial Sequence: Synthetic oligonucleotide
  Target: SCN9A; (-) strand; PAM type: YTN; PAM sequence: CTT
ttactgcaccctcttggtcc

SEQ ID NO: 67519 - DNA, 20 bp, Artificial Sequence
  Description of Artificial Sequence: Synthetic oligonucleotide
  Target: SCN9A; (-) strand; PAM type: YTN; PAM sequence: CTC
ttttactgcaccctcttggt

SEQ ID NO: 67520 - DNA, 20 bp, Artificial Sequence
  Description of Artificial Sequence: Synthetic oligonucleotide
  Target: SCN9A; (-) strand; PAM type: YTN; PAM sequence: TTC
tcttttactgcaccctcttg

SEQ ID NO: 67521 - DNA, 20 bp, Artificial Sequence
  Description of Artificial Sequence: Synthetic oligonucleotide
  Target: SCN9A; (-) strand; PAM type: YTN; PAM sequence: TTT
ctcttttactgcaccctctt

SEQ ID NO: 67522 - DNA, 20 bp, Artificial Sequence
  Description of Artificial Sequence: Synthetic oligonucleotide
  Target: SCN9A; (-) strand; PAM type: YTN; PAM sequence: TTG
gtttctcttttactgcaccc

SEQ ID NO: 67523 - DNA, 20 bp, Artificial Sequence
  Description of Artificial Sequence: Synthetic oligonucleotide
  Target: SCN9A; (-) strand; PAM type: YTN; PAM sequence: TTT
ggtttctcttttactgcacc

SEQ ID NO: 67524 - DNA, 20 bp, Artificial Sequence
  Description of Artificial Sequence: Synthetic oligonucleotide
  Target: SCN9A; (-) strand; PAM type: YTN; PAM sequence: CTT
tggtttctcttttactgcac

SEQ ID NO: 67525 - DNA, 20 bp, Artificial Sequence
  Description of Artificial Sequence: Synthetic oligonucleotide
  Target: SCN9A; (-) strand; PAM type: YTN; PAM sequence: CTC
tttggtttctcttttactgc

SEQ ID NO: 67526 - DNA, 20 bp, Artificial Sequence
  Description of Artificial Sequence: Synthetic oligonucleotide
  Target: SCN9A; (-) strand; PAM type: YTN; PAM sequence: TTA
ctctttggtttctcttttac

SEQ ID NO: 67527 - DNA, 20 bp, Artificial Sequence
  Description of Artificial Sequence: Synthetic oligonucleotide
  Target: SCN9A; (-) strand; PAM type: YTN; PAM sequence: TTT
actctttggtttctctttta

SEQ ID NO: 67528 - DNA, 20 bp, Artificial Sequence
  Description of Artificial Sequence: Synthetic oligonucleotide
  Target: SCN9A; (-) strand; PAM type: YTN; PAM sequence: TTT
tactctttggtttctctttt

SEQ ID NO: 67529 - DNA, 20 bp, Artificial Sequence
  Description of Artificial Sequence: Synthetic oligonucleotide
  Target: SCN9A; (-) strand; PAM type: YTN; PAM sequence: TTT
ttactctttggtttctcttt

SEQ ID NO: 67530 - DNA, 20 bp, Artificial Sequence
  Description of Artificial Sequence: Synthetic oligonucleotide
  Target: SCN9A; (-) strand; PAM type: YTN; PAM sequence: CTT
tttactctttggtttctctt

SEQ ID NO: 67531 - DNA, 20 bp, Artificial Sequence
  Description of Artificial Sequence: Synthetic oligonucleotide
  Target: SCN9A; (-) strand; PAM type: YTN; PAM sequence: TTA
taaaactttttactctttgg

SEQ ID NO: 67532 - DNA, 20 bp, Artificial Sequence
  Description of Artificial Sequence: Synthetic oligonucleotide
  Target: SCN9A; (-) strand; PAM type: YTN; PAM sequence: CTT
ataaaactttttactctttg

SEQ ID NO: 67533 - DNA, 20 bp, Artificial Sequence
  Description of Artificial Sequence: Synthetic oligonucleotide
  Target: SCN9A; (-) strand; PAM type: YTN; PAM sequence: TTC
ttataaaactttttactctt

SEQ ID NO: 67534 - DNA, 20 bp, Artificial Sequence
  Description of Artificial Sequence: Synthetic oligonucleotide
  Target: SCN9A; (-) strand; PAM type: YTN; PAM sequence: CTT
cttataaaactttttactct

SEQ ID NO: 67535 - DNA, 20 bp, Artificial Sequence
  Description of Artificial Sequence: Synthetic oligonucleotide
  Target: SCN9A; (-) strand; PAM type: YTN; PAM sequence: TTA
tcacttcttataaaactttt

SEQ ID NO: 67536 - DNA, 20 bp, Artificial Sequence
  Description of Artificial Sequence: Synthetic oligonucleotide
  Target: SCN9A; (-) strand; PAM type: YTN; PAM sequence: TTT
atcacttcttataaaacttt

SEQ ID NO: 67537 - DNA, 20 bp, Artificial Sequence
  Description of Artificial Sequence: Synthetic oligonucleotide
  Target: SCN9A; (-) strand; PAM type: YTN; PAM sequence: CTG
tttatcacttcttataaaac

SEQ ID NO: 67538 - DNA, 20 bp, Artificial Sequence
  Description of Artificial Sequence: Synthetic oligonucleotide
  Target: SCN9A; (-) strand; PAM type: YTN; PAM sequence: CTC
tgtttatcacttcttataaa

SEQ ID NO: 67539 - DNA, 20 bp, Artificial Sequence
  Description of Artificial Sequence: Synthetic oligonucleotide
  Target: SCN9A; (-) strand; PAM type: YTN; PAM sequence: TTC
atagctctgtttatcacttc

SEQ ID NO: 67540 - DNA, 20 bp, Artificial Sequence
  Description of Artificial Sequence: Synthetic oligonucleotide
  Target: SCN9A; (-) strand; PAM type: YTN; PAM sequence: TTA
tgttcatagctctgtttatc

SEQ ID NO: 67541 - DNA, 20 bp, Artificial Sequence
  Description of Artificial Sequence: Synthetic oligonucleotide
  Target: SCN9A; (-) strand; PAM type: YTN; PAM sequence: CTT
atgttcatagctctgtttat

SEQ ID NO: 67542 - DNA, 20 bp, Artificial Sequence
  Description of Artificial Sequence: Synthetic oligonucleotide
  Target: SCN9A; (-) strand; PAM type: YTN; PAM sequence: CTC
ttatgttcatagctctgttt

SEQ ID NO: 67543 - DNA, 20 bp, Artificial Sequence
  Description of Artificial Sequence: Synthetic oligonucleotide
  Target: SCN9A; (-) strand; PAM type: YTN; PAM sequence: CTG
ggcctcttatgttcatagct

SEQ ID NO: 67544 - DNA, 20 bp, Artificial Sequence
  Description of Artificial Sequence: Synthetic oligonucleotide
  Target: SCN9A; (-) strand; PAM type: YTN; PAM sequence: TTC
tgggcctcttatgttcatag

SEQ ID NO: 67545 - DNA, 20 bp, Artificial Sequence
  Description of Artificial Sequence: Synthetic oligonucleotide
  Target: SCN9A; (-) strand; PAM type: YTN; PAM sequence: TTT
ctgggcctcttatgttcata

SEQ ID NO: 67546 - DNA, 20 bp, Artificial Sequence
  Description of Artificial Sequence: Synthetic oligonucleotide
  Target: SCN9A; (-) strand; PAM type: YTN; PAM sequence: CTT
tctgggcctcttatgttcat

SEQ ID NO: 67547 - DNA, 20 bp, Artificial Sequence
  Description of Artificial Sequence: Synthetic oligonucleotide
  Target: SCN9A; (-) strand; PAM type: YTN; PAM sequence: CTC
tttctgggcctcttatgttc

SEQ ID NO: 67548 - DNA, 20 bp, Artificial Sequence
  Description of Artificial Sequence: Synthetic oligonucleotide
  Target: SCN9A; (-) strand; PAM type: YTN; PAM sequence: TTC
tctttctgggcctcttatgt

SEQ ID NO: 67549 - DNA, 20 bp, Artificial Sequence
  Description of Artificial Sequence: Synthetic oligonucleotide
  Target: SCN9A; (-) strand; PAM type: YTN; PAM sequence: TTC
aatcattctctttctgggcc

SEQ ID NO: 67550 - DNA, 20 bp, Artificial Sequence
  Description of Artificial Sequence: Synthetic oligonucleotide
  Target: SCN9A; (-) strand; PAM type: YTN; PAM sequence: TTT
caatcattctctttctgggc

SEQ ID NO: 67551 - DNA, 20 bp, Artificial Sequence
  Description of Artificial Sequence: Synthetic oligonucleotide
  Target: SCN9A; (-) strand; PAM type: YTN; PAM sequence: TTC
aatgtttcaatcattctctt

SEQ ID NO: 67552 - DNA, 20 bp, Artificial Sequence
  Description of Artificial Sequence: Synthetic oligonucleotide
  Target: SCN9A; (-) strand; PAM type: YTN; PAM sequence: TTT
caatgtttcaatcattctct

SEQ ID NO: 67553 - DNA, 20 bp, Artificial Sequence
  Description of Artificial Sequence: Synthetic oligonucleotide
  Target: SCN9A; (-) strand; PAM type: YTN; PAM sequence: TTT
tcaatgtttcaatcattctc

SEQ ID NO: 67554 - DNA, 20 bp, Artificial Sequence
  Description of Artificial Sequence: Synthetic oligonucleotide
  Target: SCN9A; (-) strand; PAM type: YTN; PAM sequence: TTT
ttcaatgtttcaatcattct

SEQ ID NO: 67555 - DNA, 20 bp, Artificial Sequence
  Description of Artificial Sequence: Synthetic oligonucleotide
  Target: SCN9A; (-) strand; PAM type: YTN; PAM sequence: TTA
aaatttttcaatgtttcaat

SEQ ID NO: 67556 - DNA, 20 bp, Artificial Sequence
  Description of Artificial Sequence: Synthetic oligonucleotide
  Target: SCN9A; (-) strand; PAM type: YTN; PAM sequence: TTG
attaaaatttttcaatgttt

SEQ ID NO: 67557 - DNA, 20 bp, Artificial Sequence
  Description of Artificial Sequence: Synthetic oligonucleotide
  Target: SCN9A; (-) strand; PAM type: YTN; PAM sequence: TTA
aattgattaaaatttttcaa

SEQ ID NO: 67558 - DNA, 20 bp, Artificial Sequence
  Description of Artificial Sequence: Synthetic oligonucleotide
  Target: SCN9A; (-) strand; PAM type: YTN; PAM sequence: TTT
aaattgattaaaatttttca

SEQ ID NO: 67559 - DNA, 20 bp, Artificial Sequence
  Description of Artificial Sequence: Synthetic oligonucleotide
  Target: SCN9A; (-) strand; PAM type: YTN; PAM sequence: CTT
taaattgattaaaatttttc

SEQ ID NO: 67560 - DNA, 20 bp, Artificial Sequence
  Description of Artificial Sequence: Synthetic oligonucleotide
  Target: SCN9A; (-) strand; PAM type: YTN; PAM sequence: TTA
ataaactttaaattgattaa

SEQ ID NO: 67561 - DNA, 20 bp, Artificial Sequence
  Description of Artificial Sequence: Synthetic oligonucleotide
  Target: SCN9A; (-) strand; PAM type: YTN; PAM sequence: TTT
aataaactttaaattgatta

SEQ ID NO: 67562 - DNA, 20 bp, Artificial Sequence
  Description of Artificial Sequence: Synthetic oligonucleotide
  Target: SCN9A; (-) strand; PAM type: YTN; PAM sequence: CTT
taataaactttaaattgatt

SEQ ID NO: 67563 - DNA, 20 bp, Artificial Sequence
  Description of Artificial Sequence: Synthetic oligonucleotide
  Target: SCN9A; (-) strand; PAM type: YTN; PAM sequence: TTG
ctttaataaactttaaattg

SEQ ID NO: 67564 - DNA, 20 bp, Artificial Sequence
  Description of Artificial Sequence: Synthetic oligonucleotide
  Target: SCN9A; (-) strand; PAM type: YTN; PAM sequence: CTA
gttgctttaataaactttaa

SEQ ID NO: 67565 - DNA, 20 bp, Artificial Sequence
  Description of Artificial Sequence: Synthetic oligonucleotide
  Target: SCN9A; (-) strand; PAM type: YTN; PAM sequence: TTC
tagttgctttaataaacttt

SEQ ID NO: 67566 - DNA, 20 bp, Artificial Sequence
  Description of Artificial Sequence: Synthetic oligonucleotide
  Target: SCN9A; (-) strand; PAM type: YTN; PAM sequence: TTC
agagtaattctagttgcttt

SEQ ID NO: 67567 - DNA, 20 bp, Artificial Sequence
  Description of Artificial Sequence: Synthetic oligonucleotide
  Target: SCN9A; (-) strand; PAM type: YTN; PAM sequence: CTT
cagagtaattctagttgctt

SEQ ID NO: 67568 - DNA, 20 bp, Artificial Sequence
  Description of Artificial Sequence: Synthetic oligonucleotide
  Target: SCN9A; (-) strand; PAM type: YTN; PAM sequence: TTC
ttcagagtaattctagttgc

SEQ ID NO: 67569 - DNA, 20 bp, Artificial Sequence
  Description of Artificial Sequence: Synthetic oligonucleotide
  Target: SCN9A; (-) strand; PAM type: YTN; PAM sequence: TTT
cttcagagtaattctagttg

SEQ ID NO: 67570 - DNA, 20 bp, Artificial Sequence
  Description of Artificial Sequence: Synthetic oligonucleotide
  Target: SCN9A; (-) strand; PAM type: YTN; PAM sequence: TTT
tcttcagagtaattctagtt

SEQ ID NO: 67571 - DNA, 20 bp, Artificial Sequence
  Description of Artificial Sequence: Synthetic oligonucleotide
  Target: SCN9A; (-) strand; PAM type: YTN; PAM sequence: CTT
ttcttcagagtaattctagt

SEQ ID NO: 67572 - DNA, 20 bp, Artificial Sequence
  Description of Artificial Sequence: Synthetic oligonucleotide
  Target: SCN9A; (-) strand; PAM type: YTN; PAM sequence: CTC
ttttcttcagagtaattcta

SEQ ID NO: 67573 - DNA, 20 bp, Artificial Sequence
  Description of Artificial Sequence: Synthetic oligonucleotide
  Target: SCN9A; (-) strand; PAM type: YTN; PAM sequence: CTC
tcttttcttcagagtaattc

SEQ ID NO: 67574 - DNA, 20 bp, Artificial Sequence
  Description of Artificial Sequence: Synthetic oligonucleotide
  Target: SCN9A; (-) strand; PAM type: YTN; PAM sequence: TTA
aagagtctctcttttcttca

SEQ ID NO: 67575 - DNA, 20 bp, Artificial Sequence
  Description of Artificial Sequence: Synthetic oligonucleotide
  Target: SCN9A; (-) strand; PAM type: YTN; PAM sequence: TTT
aaagagtctctcttttcttc

SEQ ID NO: 67576 - DNA, 20 bp, Artificial Sequence
  Description of Artificial Sequence: Synthetic oligonucleotide
  Target: SCN9A; (-) strand; PAM type: YTN; PAM sequence: TTT
taaagagtctctcttttctt

SEQ ID NO: 67577 - DNA, 20 bp, Artificial Sequence
  Description of Artificial Sequence: Synthetic oligonucleotide
  Target: SCN9A; (-) strand; PAM type: YTN; PAM sequence: TTT
ttaaagagtctctcttttct

SEQ ID NO: 67578 - DNA, 20 bp, Artificial Sequence
  Description of Artificial Sequence: Synthetic oligonucleotide
  Target: SCN9A; (-) strand; PAM type: YTN; PAM sequence: CTT
tttaaagagtctctcttttc

SEQ ID NO: 67579 - DNA, 20 bp, Artificial Sequence
  Description of Artificial Sequence: Synthetic oligonucleotide
  Target: SCN9A; (-) strand; PAM type: YTN; PAM sequence: TTA
ctttttaaagagtctctctt

SEQ ID NO: 67580 - DNA, 20 bp, Artificial Sequence
  Description of Artificial Sequence: Synthetic oligonucleotide
  Target: SCN9A; (-) strand; PAM type: YTN; PAM sequence: CTG
tagttactttttaaagagtc

SEQ ID NO: 67581 - DNA, 20 bp, Artificial Sequence
  Description of Artificial Sequence: Synthetic oligonucleotide
  Target: SCN9A; (-) strand; PAM type: YTN; PAM sequence: TTC
actgtagttactttttaaag

SEQ ID NO: 67582 - DNA, 20 bp, Artificial Sequence
  Description of Artificial Sequence: Synthetic oligonucleotide
  Target: SCN9A; (-) strand; PAM type: YTN; PAM sequence: TTA
tgaggaagaattcactgtag

SEQ ID NO: 67583 - DNA, 20 bp, Artificial Sequence
  Description of Artificial Sequence: Synthetic oligonucleotide
  Target: SCN9A; (-) strand; PAM type: YTN; PAM sequence: TTT
atgaggaagaattcactgta

SEQ ID NO: 67584 - DNA, 20 bp, Artificial Sequence
  Description of Artificial Sequence: Synthetic oligonucleotide
  Target: SCN9A; (-) strand; PAM type: YTN; PAM sequence: TTT
tatgaggaagaattcactgt

SEQ ID NO: 67585 - DNA, 20 bp, Artificial Sequence
  Description of Artificial Sequence: Synthetic oligonucleotide
  Target: SCN9A; (-) strand; PAM type: YTN; PAM sequence: CTA
aaattttatgaggaagaatt

SEQ ID NO: 67586 - DNA, 20 bp, Artificial Sequence
  Description of Artificial Sequence: Synthetic oligonucleotide
  Target: SCN9A; (-) strand; PAM type: YTN; PAM sequence: TTC
atctaaaattttatgaggaa

SEQ ID NO: 67587 - DNA, 20 bp, Artificial Sequence
  Description of Artificial Sequence: Synthetic oligonucleotide
  Target: SCN9A; (-) strand; PAM type: YTN; PAM sequence: TTT
catctaaaattttatgagga

SEQ ID NO: 67588 - DNA, 20 bp, Artificial Sequence
  Description of Artificial Sequence: Synthetic oligonucleotide
  Target: SCN9A; (-) strand; PAM type: YTN; PAM sequence: TTT
tcatctaaaattttatgagg

SEQ ID NO: 67589 - DNA, 20 bp, Artificial Sequence
  Description of Artificial Sequence: Synthetic oligonucleotide
  Target: SCN9A; (-) strand; PAM type: YTN; PAM sequence: TTT
ttcatctaaaattttatgag

SEQ ID NO: 67590 - DNA, 20 bp, Artificial Sequence
  Description of Artificial Sequence: Synthetic oligonucleotide
  Target: SCN9A; (-) strand; PAM type: YTN; PAM sequence: CTA
aaatgaggtttttcatctaa

SEQ ID NO: 67591 - DNA, 20 bp, Artificial Sequence
  Description of Artificial Sequence: Synthetic oligonucleotide
  Target: SCN9A; (-) strand; PAM type: YTN; PAM sequence: TTC
atctaaaatgaggtttttca

SEQ ID NO: 67592 - DNA, 20 bp, Artificial Sequence
  Description of Artificial Sequence: Synthetic oligonucleotide
  Target: SCN9A; (-) strand; PAM type: YTN; PAM sequence: CTT
catctaaaatgaggtttttc

SEQ ID NO: 67593 - DNA, 20 bp, Artificial Sequence
  Description of Artificial Sequence: Synthetic oligonucleotide
  Target: SCN9A; (-) strand; PAM type: YTN; PAM sequence: CTG
ccttcatctaaaatgaggtt

SEQ ID NO: 67594 - DNA, 20 bp, Artificial Sequence
  Description of Artificial Sequence: Synthetic oligonucleotide
  Target: SCN9A; (-) strand; PAM type: YTN; PAM sequence: CTC
ctgccttcatctaaaatgag

SEQ ID NO: 67595 - DNA, 20 bp, Artificial Sequence
  Description of Artificial Sequence: Synthetic oligonucleotide
  Target: SCN9A; (-) strand; PAM type: YTN; PAM sequence: TTC
ccacctcctgccttcatcta

SEQ ID NO: 67596 - DNA, 20 bp, Artificial Sequence
  Description of Artificial Sequence: Synthetic oligonucleotide
  Target: SCN9A; (-) strand; PAM type: YTN; PAM sequence: TTT
cccacctcctgccttcatct

SEQ ID NO: 67597 - DNA, 20 bp, Artificial Sequence
  Description of Artificial Sequence: Synthetic oligonucleotide
  Target: SCN9A; (-) strand; PAM type: YTN; PAM sequence: CTT
tcccacctcctgccttcatc

SEQ ID NO: 67598 - DNA, 20 bp, Artificial Sequence
  Description of Artificial Sequence: Synthetic oligonucleotide
  Target: SCN9A; (-) strand; PAM type: YTN; PAM sequence: TTA
ctttcccacctcctgccttc

SEQ ID NO: 67599 - DNA, 20 bp, Artificial Sequence
  Description of Artificial Sequence: Synthetic oligonucleotide
  Target: SCN9A; (-) strand; PAM type: YTN; PAM sequence: CTT
actttcccacctcctgcctt

SEQ ID NO: 67600 - DNA, 20 bp, Artificial Sequence
  Description of Artificial Sequence: Synthetic oligonucleotide
  Target: SCN9A; (-) strand; PAM type: YTN; PAM sequence: TTC
ttactttcccacctcctgcc

SEQ ID NO: 67601 - DNA, 20 bp, Artificial Sequence
  Description of Artificial Sequence: Synthetic oligonucleotide
  Target: SCN9A; (-) strand; PAM type: YTN; PAM sequence: CTG
cccattcttactttcccacc

SEQ ID NO: 67602 - DNA, 20 bp, Artificial Sequence
  Description of Artificial Sequence: Synthetic oligonucleotide
  Target: SCN9A; (-) strand; PAM type: YTN; PAM sequence: CTG
aaacaggtatcaaaaaagtg

SEQ ID NO: 67603 - DNA, 20 bp, Artificial Sequence
  Description of Artificial Sequence: Synthetic oligonucleotide
  Target: SCN9A; (-) strand; PAM type: YTN; PAM sequence: TTC
tgaaacaggtatcaaaaaag

SEQ ID NO: 67604 - DNA, 20 bp, Artificial Sequence
  Description of Artificial Sequence: Synthetic oligonucleotide
  Target: SCN9A; (-) strand; PAM type: YTN; PAM sequence: CTT
ctgaaacaggtatcaaaaaa

SEQ ID NO: 67605 - DNA, 20 bp, Artificial Sequence
  Description of Artificial Sequence: Synthetic oligonucleotide
  Target: SCN9A; (-) strand; PAM type: YTN; PAM sequence: TTC
aaacttctgaaacaggtatc

SEQ ID NO: 67606 - DNA, 20 bp, Artificial Sequence
  Description of Artificial Sequence: Synthetic oligonucleotide
  Target: SCN9A; (-) strand; PAM type: YTN; PAM sequence: CTA
aaattcaaacttctgaaaca

SEQ ID NO: 67607 - DNA, 20 bp, Artificial Sequence
  Description of Artificial Sequence: Synthetic oligonucleotide
  Target: SCN9A; (-) strand; PAM type: YTN; PAM sequence: TTA
gaaatatctaaaattcaaac

SEQ ID NO: 67608 - DNA, 20 bp, Artificial Sequence
  Description of Artificial Sequence: Synthetic oligonucleotide
  Target: SCN9A; (-) strand; PAM type: YTN; PAM sequence: TTT
agaaatatctaaaattcaaa

SEQ ID NO: 67609 - DNA, 20 bp, Artificial Sequence
  Description of Artificial Sequence: Synthetic oligonucleotide
  Target: SCN9A; (-) strand; PAM type: YTN; PAM sequence: TTT
tagaaatatctaaaattcaa

SEQ ID NO: 67610 - DNA, 20 bp, Artificial Sequence
  Description of Artificial Sequence: Synthetic oligonucleotide
  Target: SCN9A; (-) strand; PAM type: YTN; PAM sequence: CTT
ttagaaatatctaaaattca

SEQ ID NO: 67611 - DNA, 20 bp, Artificial Sequence
  Description of Artificial Sequence: Synthetic oligonucleotide
  Target: SCN9A; (-) strand; PAM type: YTN; PAM sequence: TTA
cagaaaaggagatcaatctt

SEQ ID NO: 67612 - DNA, 20 bp, Artificial Sequence
  Description of Artificial Sequence: Synthetic oligonucleotide
  Target: SCN9A; (-) strand; PAM type: YTN; PAM sequence: TTT
acagaaaaggagatcaatct

SEQ ID NO: 67613 - DNA, 20 bp, Artificial Sequence
  Description of Artificial Sequence: Synthetic oligonucleotide
  Target: SCN9A; (-) strand; PAM type: YTN; PAM sequence: TTT
tacagaaaaggagatcaatc

SEQ ID NO: 67614 - DNA, 20 bp, Artificial Sequence
  Description of Artificial Sequence: Synthetic oligonucleotide
  Target: SCN9A; (-) strand; PAM type: YTN; PAM sequence: TTG
ttttacagaaaaggagatca

SEQ ID NO: 67615 - DNA, 20 bp, Artificial Sequence
  Description of Artificial Sequence: Synthetic oligonucleotide
  Target: SCN9A; (-) strand; PAM type: YTN; PAM sequence: TTA
tattgttttacagaaaagga

SEQ ID NO: 67616 - DNA, 20 bp, Artificial Sequence
  Description of Artificial Sequence: Synthetic oligonucleotide
  Target: SCN9A; (-) strand; PAM type: YTN; PAM sequence: TTA
atgaattatattgttttaca

SEQ ID NO: 67617 - DNA, 20 bp, Artificial Sequence
  Description of Artificial Sequence: Synthetic oligonucleotide
  Target: SCN9A; (-) strand; PAM type: YTN; PAM sequence: TTG
ttaatgaattatattgtttt

SEQ ID NO: 67618 - DNA, 20 bp, Artificial Sequence
  Description of Artificial Sequence: Synthetic oligonucleotide
  Target: SCN9A; (-) strand; PAM type: YTN; PAM sequence: CTT
gttaatgaattatattgttt

SEQ ID NO: 67619 - DNA, 20 bp, Artificial Sequence
  Description of Artificial Sequence: Synthetic oligonucleotide
  Target: SCN9A; (-) strand; PAM type: YTN; PAM sequence: CTC
aatacttgttaatgaattat

SEQ ID NO: 67620 - DNA, 20 bp, Artificial Sequence
  Description of Artificial Sequence: Synthetic oligonucleotide
  Target: SCN9A; (-) strand; PAM type: YTN; PAM sequence: TTG
aaaactcaatacttgttaat

SEQ ID NO: 67621 - DNA, 20 bp, Artificial Sequence
  Description of Artificial Sequence: Synthetic oligonucleotide
  Target: SCN9A; (-) strand; PAM type: YTN; PAM sequence: CTT
gaaaactcaatacttgttaa

SEQ ID NO: 67622 - DNA, 20 bp, Artificial Sequence
  Description of Artificial Sequence: Synthetic oligonucleotide
  Target: SCN9A; (-) strand; PAM type: YTN; PAM sequence: TTA
cttgaaaactcaatacttgt

SEQ ID NO: 67623 - DNA, 20 bp, Artificial Sequence
  Description of Artificial Sequence: Synthetic oligonucleotide
  Target: SCN9A; (-) strand; PAM type: YTN; PAM sequence: TTG
ttacttgaaaactcaatact

SEQ ID NO: 67624 - DNA, 20 bp, Artificial Sequence
  Description of Artificial Sequence: Synthetic oligonucleotide
  Target: SCN9A; (-) strand; PAM type: YTN; PAM sequence: CTG
aagttgttacttgaaaactc

SEQ ID NO: 67625 - DNA, 20 bp, Artificial Sequence
  Description of Artificial Sequence: Synthetic oligonucleotide
  Target: SCN9A; (-) strand; PAM type: YTN; PAM sequence: TTA
tctgaagttgttacttgaaa

SEQ ID NO: 67626 - DNA, 20 bp, Artificial Sequence
  Description of Artificial Sequence: Synthetic oligonucleotide
  Target: SCN9A; (-) strand; PAM type: YTN; PAM sequence: TTA
tgattatctgaagttgttac

SEQ ID NO: 67627 - DNA, 20 bp, Artificial Sequence
  Description of Artificial Sequence: Synthetic oligonucleotide
  Target: SCN9A; (-) strand; PAM type: YTN; PAM sequence: CTT
atgattatctgaagttgtta

SEQ ID NO: 67628 - DNA, 20 bp, Artificial Sequence
  Description of Artificial Sequence: Synthetic oligonucleotide
  Target: SCN9A; (-) strand; PAM type: YTN; PAM sequence: TTA
gaacatacaacttatgatta

SEQ ID NO: 67629 - DNA, 20 bp, Artificial Sequence
  Description of Artificial Sequence: Synthetic oligonucleotide
  Target: SCN9A; (-) strand; PAM type: YTN; PAM sequence: TTT
agaacatacaacttatgatt

SEQ ID NO: 67630 - DNA, 20 bp, Artificial Sequence
  Description of Artificial Sequence: Synthetic oligonucleotide
  Target: SCN9A; (-) strand; PAM type: YTN; PAM sequence: TTT
tagaacatacaacttatgat

SEQ ID NO: 67631 - DNA, 20 bp, Artificial Sequence
  Description of Artificial Sequence: Synthetic oligonucleotide
  Target: SCN9A; (-) strand; PAM type: YTN; PAM sequence: TTG
ttttagaacatacaacttat

SEQ ID NO: 67632 - DNA, 20 bp, Artificial Sequence
  Description of Artificial Sequence: Synthetic oligonucleotide
  Target: SCN9A; (-) strand; PAM type: YTN; PAM sequence: TTG
ttgttttagaacatacaact

SEQ ID NO: 67633 - DNA, 20 bp, Artificial Sequence
  Description of Artificial Sequence: Synthetic oligonucleotide
  Target: SCN9A; (-) strand; PAM type: YTN; PAM sequence: TTT
gttgttttagaacatacaac

SEQ ID NO: 67634 - DNA, 20 bp, Artificial Sequence
  Description of Artificial Sequence: Synthetic oligonucleotide
  Target: SCN9A; (-) strand; PAM type: YTN; PAM sequence: TTT
tgttgttttagaacatacaa

SEQ ID NO: 67635 - DNA, 20 bp, Artificial Sequence
  Description of Artificial Sequence: Synthetic oligonucleotide
  Target: SCN9A; (-) strand; PAM type: YTN; PAM sequence: CTA
gttttgttgttttagaacat

SEQ ID NO: 67636 - DNA, 20 bp, Artificial Sequence
  Description of Artificial Sequence: Synthetic oligonucleotide
  Target: SCN9A; (-) strand; PAM type: YTN; PAM sequence: TTC
tagttttgttgttttagaac

SEQ ID NO: 67637 - DNA, 20 bp, Artificial Sequence
  Description of Artificial Sequence: Synthetic oligonucleotide
  Target: SCN9A; (-) strand; PAM type: YTN; PAM sequence: TTG
tcaagaggattctagttttg

SEQ ID NO: 67638 - DNA, 20 bp, Artificial Sequence
  Description of Artificial Sequence: Synthetic oligonucleotide
  Target: SCN9A; (-) strand; PAM type: YTN; PAM sequence: CTT
gtcaagaggattctagtttt

SEQ ID NO: 67639 - DNA, 20 bp, Artificial Sequence
  Description of Artificial Sequence: Synthetic oligonucleotide
  Target: SCN9A; (-) strand; PAM type: YTN; PAM sequence: CTA
ccaggtgcatcttgtcaaga

SEQ ID NO: 67640 - DNA, 20 bp, Artificial Sequence
  Description of Artificial Sequence: Synthetic oligonucleotide
  Target: SCN9A; (-) strand; PAM type: YTN; PAM sequence: TTC
taccaggtgcatcttgtcaa

SEQ ID NO: 67641 - DNA, 20 bp, Artificial Sequence
  Description of Artificial Sequence: Synthetic oligonucleotide
  Target: SCN9A; (-) strand; PAM type: YTN; PAM sequence: TTT
ctaccaggtgcatcttgtca

SEQ ID NO: 67642 - DNA, 20 bp, Artificial Sequence
  Description of Artificial Sequence: Synthetic oligonucleotide
  Target: SCN9A; (-) strand; PAM type: YTN; PAM sequence: TTT
tctaccaggtgcatcttgtc

SEQ ID NO: 67643 - DNA, 20 bp, Artificial Sequence
  Description of Artificial Sequence: Synthetic oligonucleotide
  Target: SCN9A; (-) strand; PAM type: YTN; PAM sequence: TTA
caaaacattttctaccaggt

SEQ ID NO: 67644 - DNA, 20 bp, Artificial Sequence
  Description of Artificial Sequence: Synthetic oligonucleotide
  Target: SCN9A; (-) strand; PAM type: YTN; PAM sequence: TTC
attacaaaacattttctacc

SEQ ID NO: 67645 - DNA, 20 bp, Artificial Sequence
  Description of Artificial Sequence: Synthetic oligonucleotide
  Target: SCN9A; (-) strand; PAM type: YTN; PAM sequence: TTC
agaaacatgaaaagattcat

SEQ ID NO: 67646 - DNA, 20 bp, Artificial Sequence
  Description of Artificial Sequence: Synthetic oligonucleotide
  Target: SCN9A; (-) strand; PAM type: YTN; PAM sequence: CTT
cagaaacatgaaaagattca

SEQ ID NO: 67647 - DNA, 20 bp, Artificial Sequence
  Description of Artificial Sequence: Synthetic oligonucleotide
  Target: SCN9A; (-) strand; PAM type: YTN; PAM sequence: TTA
gacttcagaaacatgaaaag

SEQ ID NO: 67648 - DNA, 20 bp, Artificial Sequence
  Description of Artificial Sequence: Synthetic oligonucleotide
  Target: SCN9A; (-) strand; PAM type: YTN; PAM sequence: CTA
attagacttcagaaacatga

SEQ ID NO: 67649 - DNA, 20 bp, Artificial Sequence
  Description of Artificial Sequence: Synthetic oligonucleotide
  Target: SCN9A; (-) strand; PAM type: YTN; PAM sequence: CTG
gatcaatgcactaattagac

SEQ ID NO: 67650 - DNA, 20 bp, Artificial Sequence
  Description of Artificial Sequence: Synthetic oligonucleotide
  Target: SCN9A; (-) strand; PAM type: YTN; PAM sequence: TTA
tatcaactggatcaatgcac

SEQ ID NO: 67651 - DNA, 20 bp, Artificial Sequence
  Description of Artificial Sequence: Synthetic oligonucleotide
  Target: SCN9A; (-) strand; PAM type: YTN; PAM sequence: CTT
atatcaactggatcaatgca

SEQ ID NO: 67652 - DNA, 20 bp, Artificial Sequence
  Description of Artificial Sequence: Synthetic oligonucleotide
  Target: SCN9A; (-) strand; PAM type: YTN; PAM sequence: CTA
gaaaataaccttatatcaac

SEQ ID NO: 67653 - DNA, 20 bp, Artificial Sequence
  Description of Artificial Sequence: Synthetic oligonucleotide
  Target: SCN9A; (-) strand; PAM type: YTN; PAM sequence: TTA
aagtgctagaaaataacctt

SEQ ID NO: 67654 - DNA, 20 bp, Artificial Sequence
  Description of Artificial Sequence: Synthetic oligonucleotide
  Target: SCN9A; (-) strand; PAM type: YTN; PAM sequence: CTG
gaaattaaagtgctagaaaa

SEQ ID NO: 67655 - DNA, 20 bp, Artificial Sequence
  Description of Artificial Sequence: Synthetic oligonucleotide
  Target: SCN9A; (-) strand; PAM type: YTN; PAM sequence: CTA
tagagctggaaattaaagtg

SEQ ID NO: 67656 - DNA, 20 bp, Artificial Sequence
  Description of Artificial Sequence: Synthetic oligonucleotide
  Target: SCN9A; (-) strand; PAM type: YTN; PAM sequence: TTC
tatagagctggaaattaaag

SEQ ID NO: 67657 - DNA, 20 bp, Artificial Sequence
  Description of Artificial Sequence: Synthetic oligonucleotide
  Target: SCN9A; (-) strand; PAM type: YTN; PAM sequence: TTT
ctatagagctggaaattaaa

SEQ ID NO: 67658 - DNA, 20 bp, Artificial Sequence
  Description of Artificial Sequence: Synthetic oligonucleotide
  Target: SCN9A; (-) strand; PAM type: YTN; PAM sequence: CTG
tatttctatagagctggaaa

SEQ ID NO: 67659 - DNA, 20 bp, Artificial Sequence
  Description of Artificial Sequence: Synthetic oligonucleotide
  Target: SCN9A; (-) strand; PAM type: YTN; PAM sequence: TTG
ctgtatttctatagagctgg

SEQ ID NO: 67660 - DNA, 20 bp, Artificial Sequence
  Description of Artificial Sequence: Synthetic oligonucleotide
  Target: SCN9A; (-) strand; PAM type: YTN; PAM sequence: TTT
gctgtatttctatagagctg

SEQ ID NO: 67661 - DNA, 20 bp, Artificial Sequence
  Description of Artificial Sequence: Synthetic oligonucleotide
  Target: SCN9A; (-) strand; PAM type: YTN; PAM sequence: TTG
tttgctgtatttctatagag

SEQ ID NO: 67662 - DNA, 20 bp, Artificial Sequence
  Description of Artificial Sequence: Synthetic oligonucleotide
  Target: SCN9A; (-) strand; PAM type: YTN; PAM sequence: CTT
gtttgctgtatttctataga

SEQ ID NO: 67663 - DNA, 20 bp, Artificial Sequence
  Description of Artificial Sequence: Synthetic oligonucleotide
  Target: SCN9A; (-) strand; PAM type: YTN; PAM sequence: TTC
cagagagaaaaaacaggaac

SEQ ID NO: 67664 - DNA, 20 bp, Artificial Sequence
  Description of Artificial Sequence: Synthetic oligonucleotide
  Target: SCN9A; (-) strand; PAM type: YTN; PAM sequence: CTT
ccagagagaaaaaacaggaa

SEQ ID NO: 67665 - DNA, 20 bp, Artificial Sequence
  Description of Artificial Sequence: Synthetic oligonucleotide
  Target: SCN9A; (-) strand; PAM type: YTN; PAM sequence: TTA
gaaacttccagagagaaaaa

SEQ ID NO: 67666 - DNA, 20 bp, Artificial Sequence
  Description of Artificial Sequence: Synthetic oligonucleotide
  Target: SCN9A; (-) strand; PAM type: YTN; PAM sequence: CTT
agaaacttccagagagaaaa

SEQ ID NO: 67667 - DNA, 20 bp, Artificial Sequence
  Description of Artificial Sequence: Synthetic oligonucleotide
  Target: SCN9A; (-) strand; PAM type: YTN; PAM sequence: CTG
ggaacttagaaacttccaga

SEQ ID NO: 67668 - DNA, 20 bp, Artificial Sequence
  Description of Artificial Sequence: Synthetic oligonucleotide
  Target: SCN9A; (-) strand; PAM type: YTN; PAM sequence: TTC
tgggaacttagaaacttcca

SEQ ID NO: 67669 - DNA, 20 bp, Artificial Sequence
  Description of Artificial Sequence: Synthetic oligonucleotide
  Target: SCN9A; (-) strand; PAM type: YTN; PAM sequence: CTT
ctgggaacttagaaacttcc

SEQ ID NO: 67670 - DNA, 20 bp, Artificial Sequence
  Description of Artificial Sequence: Synthetic oligonucleotide
  Target: SCN9A; (-) strand; PAM type: YTN; PAM sequence: TTG
agtcttctgggaacttagaa

SEQ ID NO: 67671 - DNA, 20 bp, Artificial Sequence
  Description of Artificial Sequence: Synthetic oligonucleotide
  Target: SCN9A; (-) strand; PAM type: YTN; PAM sequence: TTT
gagtcttctgggaacttaga

SEQ ID NO: 67672 - DNA, 20 bp, Artificial Sequence
  Description of Artificial Sequence: Synthetic oligonucleotide
  Target: SCN9A; (-) strand; PAM type: YTN; PAM sequence: CTC
agtttgagtcttctgggaac

SEQ ID NO: 67673 - DNA, 20 bp, Artificial Sequence
  Description of Artificial Sequence: Synthetic oligonucleotide
  Target: SCN9A; (-) strand; PAM type: YTN; PAM sequence: TTA
cagactcagtttgagtcttc

SEQ ID NO: 67674 - DNA, 20 bp, Artificial Sequence
  Description of Artificial Sequence: Synthetic oligonucleotide
  Target: SCN9A; (-) strand; PAM type: YTN; PAM sequence: CTA
taagcacaaagagcaagcat

SEQ ID NO: 67675 - DNA, 20 bp, Artificial Sequence
  Description of Artificial Sequence: Synthetic oligonucleotide
  Target: SCN9A; (-) strand; PAM type: YTN; PAM sequence: CTA
tgatgagtactataagcaca

SEQ ID NO: 67676 - DNA, 20 bp, Artificial Sequence
  Description of Artificial Sequence: Synthetic oligonucleotide
  Target: SCN9A; (-) strand; PAM type: YTN; PAM sequence: TTA
agccaagtagaggactatga

SEQ ID NO: 67677 - DNA, 20 bp, Artificial Sequence
  Description of Artificial Sequence: Synthetic oligonucleotide
  Target: SCN9A; (-) strand; PAM type: YTN; PAM sequence: CTA
ttaagccaagtagaggacta

SEQ ID NO: 67678 - DNA, 20 bp, Artificial Sequence
  Description of Artificial Sequence: Synthetic oligonucleotide
  Target: SCN9A; (-) strand; PAM type: YTN; PAM sequence: CTA
taaatgacctattaagccaa

SEQ ID NO: 67679 - DNA, 20 bp, Artificial Sequence
  Description of Artificial Sequence: Synthetic oligonucleotide
  Target: SCN9A; (-) strand; PAM type: YTN; PAM sequence: TTA
aaaatcaactataaatgacc

SEQ ID NO: 67680 - DNA, 20 bp, Artificial Sequence
  Description of Artificial Sequence: Synthetic oligonucleotide
  Target: SCN9A; (-) strand; PAM type: YTN; PAM sequence: TTT
aaaaatcaactataaatgac

SEQ ID NO: 67681 - DNA, 20 bp, Artificial Sequence
  Description of Artificial Sequence: Synthetic oligonucleotide
  Target: SCN9A; (-) strand; PAM type: YTN; PAM sequence: TTT
taaaaatcaactataaatga

SEQ ID NO: 67682 - DNA, 20 bp, Artificial Sequence
  Description of Artificial Sequence: Synthetic oligonucleotide
  Target: SCN9A; (-) strand; PAM type: YTN; PAM sequence: CTT
ttaaaaatcaactataaatg

SEQ ID NO: 67683 - DNA, 20 bp, Artificial Sequence
  Description of Artificial Sequence: Synthetic oligonucleotide
  Target: SCN9A; (-) strand; PAM type: YTN; PAM sequence: TTG
gggaatcaagtcttttaaaa

SEQ ID NO: 67684 - DNA, 20 bp, Artificial Sequence
  Description of Artificial Sequence: Synthetic oligonucleotide
  Target: SCN9A; (-) strand; PAM type: YTN; PAM sequence: TTT
ggggaatcaagtcttttaaa

SEQ ID NO: 67685 - DNA, 20 bp, Artificial Sequence
  Description of Artificial Sequence: Synthetic oligonucleotide
  Target: SCN9A; (-) strand; PAM type: YTN; PAM sequence: TTT
tggggaatcaagtcttttaa

SEQ ID NO: 67686 - DNA, 20 bp, Artificial Sequence
  Description of Artificial Sequence: Synthetic oligonucleotide
  Target: SCN9A; (-) strand; PAM type: YTN; PAM sequence: TTT
ttggggaatcaagtctttta

SEQ ID NO: 67687 - DNA, 20 bp, Artificial Sequence
  Description of Artificial Sequence: Synthetic oligonucleotide
  Target: SCN9A; (-) strand; PAM type: YTN; PAM sequence: CTT
tttggggaatcaagtctttt

SEQ ID NO: 67688 - DNA, 20 bp, Artificial Sequence
  Description of Artificial Sequence: Synthetic oligonucleotide
  Target: SCN9A; (-) strand; PAM type: YTN; PAM sequence: CTC
tttttggggaatcaagtctt

SEQ ID NO: 67689 - DNA, 20 bp, Artificial Sequence
  Description of Artificial Sequence: Synthetic oligonucleotide
  Target: SCN9A; (-) strand; PAM type: YTN; PAM sequence: TTA
tataactctttttggggaat

SEQ ID NO: 67690 - DNA, 20 bp, Artificial Sequence
  Description of Artificial Sequence: Synthetic oligonucleotide
  Target: SCN9A; (-) strand; PAM type: YTN; PAM sequence: TTA
gaagattatataactctttt

SEQ ID NO: 67691 - DNA, 20 bp, Artificial Sequence
  Description of Artificial Sequence: Synthetic oligonucleotide
  Target: SCN9A; (-) strand; PAM type: YTN; PAM sequence: CTT
agaagattatataactcttt

SEQ ID NO: 67692 - DNA, 20 bp, Artificial Sequence
  Description of Artificial Sequence: Synthetic oligonucleotide
  Target: SCN9A; (-) strand; PAM type: YTN; PAM sequence: CTG
cttagaagattatataactc

SEQ ID NO: 67693 - DNA, 20 bp, Artificial Sequence
  Description of Artificial Sequence: Synthetic oligonucleotide
  Target: SCN9A; (-) strand; PAM type: YTN; PAM sequence: CTA
actgcttagaagattatata

SEQ ID NO: 67694 - DNA, 20 bp, Artificial Sequence
  Description of Artificial Sequence: Synthetic oligonucleotide
  Target: SCN9A; (-) strand; PAM type: YTN; PAM sequence: TTA
tgactaactgcttagaagat

SEQ ID NO: 67695 - DNA, 20 bp, Artificial Sequence
  Description of Artificial Sequence: Synthetic oligonucleotide
  Target: SCN9A; (-) strand; PAM type: YTN; PAM sequence: TTC
aaattatgactaactgctta

SEQ ID NO: 67696 - DNA, 20 bp, Artificial Sequence
  Description of Artificial Sequence: Synthetic oligonucleotide
  Target: SCN9A; (-) strand; PAM type: YTN; PAM sequence: TTT
caaattatgactaactgctt

SEQ ID NO: 67697 - DNA, 20 bp, Artificial Sequence
  Description of Artificial Sequence: Synthetic oligonucleotide
  Target: SCN9A; (-) strand; PAM type: YTN; PAM sequence: CTT
tcaaattatgactaactgct

SEQ ID NO: 67698 - DNA, 20 bp, Artificial Sequence
  Description of Artificial Sequence: Synthetic oligonucleotide
  Target: SCN9A; (-) strand; PAM type: YTN; PAM sequence: TTC
acagagatgtaacctttcaa

SEQ ID NO: 67699 - DNA, 20 bp, Artificial Sequence
  Description of Artificial Sequence: Synthetic oligonucleotide
  Target: SCN9A; (-) strand; PAM type: YTN; PAM sequence: TTA
tgtaaagtatagaattcaca

SEQ ID NO: 67700 - DNA, 20 bp, Artificial Sequence
  Description of Artificial Sequence: Synthetic oligonucleotide
  Target: SCN9A; (-) strand; PAM type: YTN; PAM sequence: TTT
atgtaaagtatagaattcac

SEQ ID NO: 67701 - DNA, 20 bp, Artificial Sequence
  Description of Artificial Sequence: Synthetic oligonucleotide
  Target: SCN9A; (-) strand; PAM type: YTN; PAM sequence: TTC
atccaatgtttatgtaaagt

SEQ ID NO: 67702 - DNA, 20 bp, Artificial Sequence
  Description of Artificial Sequence: Synthetic oligonucleotide
  Target: SCN9A; (-) strand; PAM type: YTN; PAM sequence: TTT
catccaatgtttatgtaaag

SEQ ID NO: 67703 - DNA, 20 bp, Artificial Sequence
  Description of Artificial Sequence: Synthetic oligonucleotide
  Target: SCN9A; (-) strand; PAM type: YTN; PAM sequence: TTT
tcatccaatgtttatgtaaa

SEQ ID NO: 67704 - DNA, 20 bp, Artificial Sequence
  Description of Artificial Sequence: Synthetic oligonucleotide
  Target: SCN9A; (-) strand; PAM type: YTN; PAM sequence: TTT
ttcatccaatgtttatgtaa

SEQ ID NO: 67705 - DNA, 20 bp, Artificial Sequence
  Description of Artificial Sequence: Synthetic oligonucleotide
  Target: SCN9A; (-) strand; PAM type: YTN; PAM sequence: CTT
tttcatccaatgtttatgta

SEQ ID NO: 67706 - DNA, 20 bp, Artificial Sequence
  Description of Artificial Sequence: Synthetic oligonucleotide
  Target: SCN9A; (-) strand; PAM type: YTN; PAM sequence: TTC
tttttcatccaatgtttatg

SEQ ID NO: 67707 - DNA, 20 bp, Artificial Sequence
  Description of Artificial Sequence: Synthetic oligonucleotide
  Target: SCN9A; (-) strand; PAM type: YTN; PAM sequence: TTT
ctttttcatccaatgtttat

SEQ ID NO: 67708 - DNA, 20 bp, Artificial Sequence
  Description of Artificial Sequence: Synthetic oligonucleotide
  Target: SCN9A; (-) strand; PAM type: YTN; PAM sequence: TTT
tctttttcatccaatgttta

SEQ ID NO: 67709 - DNA, 20 bp, Artificial Sequence
  Description of Artificial Sequence: Synthetic oligonucleotide
  Target: SCN9A; (-) strand; PAM type: YTN; PAM sequence: TTT
ttctttttcatccaatgttt

SEQ ID NO: 67710 - DNA, 20 bp, Artificial Sequence
  Description of Artificial Sequence: Synthetic oligonucleotide
  Target: SCN9A; (-) strand; PAM type: YTN; PAM sequence: TTT
tttctttttcatccaatgtt

SEQ ID NO: 67711 - DNA, 20 bp, Artificial Sequence
  Description of Artificial Sequence: Synthetic oligonucleotide
  Target: SCN9A; (-) strand; PAM type: YTN; PAM sequence: TTT
ttttctttttcatccaatgt

SEQ ID NO: 67712 - DNA, 20 bp, Artificial Sequence
  Description of Artificial Sequence: Synthetic oligonucleotide
  Target: SCN9A; (-) strand; PAM type: YTN; PAM sequence: TTT
tttttctttttcatccaatg

SEQ ID NO: 67713 - DNA, 20 bp, Artificial Sequence
  Description of Artificial Sequence: Synthetic oligonucleotide
  Target: SCN9A; (-) strand; PAM type: YTN; PAM sequence: TTT
ttttttctttttcatccaat

SEQ ID NO: 67714 - DNA, 20 bp, Artificial Sequence
  Description of Artificial Sequence: Synthetic oligonucleotide
  Target: SCN9A; (-) strand; PAM type: YTN; PAM sequence: CTT
tttttttctttttcatccaa

SEQ ID NO: 67715 - DNA, 20 bp, Artificial Sequence
  Description of Artificial Sequence: Synthetic oligonucleotide
  Target: SCN9A; (-) strand; PAM type: YTN; PAM sequence: TTC
acctttttttttctttttca

SEQ ID NO: 67716 - DNA, 20 bp, Artificial Sequence
  Description of Artificial Sequence: Synthetic oligonucleotide
  Target: SCN9A; (-) strand; PAM type: YTN; PAM sequence: TTC
cattcacctttttttttctt

SEQ ID NO: 67717 - DNA, 20 bp, Artificial Sequence
  Description of Artificial Sequence: Synthetic oligonucleotide
  Target: SCN9A; (-) strand; PAM type: YTN; PAM sequence: TTT
ccattcacctttttttttct

SEQ ID NO: 67718 - DNA, 20 bp, Artificial Sequence
  Description of Artificial Sequence: Synthetic oligonucleotide
  Target: SCN9A; (-) strand; PAM type: YTN; PAM sequence: TTT
tccattcacctttttttttc

SEQ ID NO: 67719 - DNA, 20 bp, Artificial Sequence
  Description of Artificial Sequence: Synthetic oligonucleotide
  Target: SCN9A; (-) strand; PAM type: YTN; PAM sequence: CTA
tgtgtagattttccattcac

SEQ ID NO: 67720 - DNA, 20 bp, Artificial Sequence
  Description of Artificial Sequence: Synthetic oligonucleotide
  Target: SCN9A; (-) strand; PAM type: YTN; PAM sequence: TTG
tataaatgaagctatgtgta

SEQ ID NO: 67721 - DNA, 20 bp, Artificial Sequence
  Description of Artificial Sequence: Synthetic oligonucleotide
  Target: SCN9A; (-) strand; PAM type: YTN; PAM sequence: TTA
acattgtataaatgaagcta

SEQ ID NO: 67722 - DNA, 20 bp, Artificial Sequence
  Description of Artificial Sequence: Synthetic oligonucleotide
  Target: SCN9A; (-) strand; PAM type: YTN; PAM sequence: CTG
taattaacattgtataaatg

SEQ ID NO: 67723 - DNA, 20 bp, Artificial Sequence
  Description of Artificial Sequence: Synthetic oligonucleotide
  Target: SCN9A; (-) strand; PAM type: YTN; PAM sequence: TTC
actgtaattaacattgtata

SEQ ID NO: 67724 - DNA, 20 bp, Artificial Sequence
  Description of Artificial Sequence: Synthetic oligonucleotide
  Target: SCN9A; (-) strand; PAM type: YTN; PAM sequence: CTG
agatcatgttcactgtaatt

SEQ ID NO: 67725 - DNA, 20 bp, Artificial Sequence
  Description of Artificial Sequence: Synthetic oligonucleotide
  Target: SCN9A; (-) strand; PAM type: YTN; PAM sequence: TTC
agatctgagatcatgttcac

SEQ ID NO: 67726 - DNA, 20 bp, Artificial Sequence
  Description of Artificial Sequence: Synthetic oligonucleotide
  Target: SCN9A; (-) strand; PAM type: YTN; PAM sequence: TTT
cagatctgagatcatgttca

SEQ ID NO: 67727 - DNA, 20 bp, Artificial Sequence
  Description of Artificial Sequence: Synthetic oligonucleotide
  Target: SCN9A; (-) strand; PAM type: YTN; PAM sequence: TTA
agtataggatgatacataat

SEQ ID NO: 67728 - DNA, 20 bp, Artificial Sequence
  Description of Artificial Sequence: Synthetic oligonucleotide
  Target: SCN9A; (-) strand; PAM type: YTN; PAM sequence: TTT
aagtataggatgatacataa

SEQ ID NO: 67729 - DNA, 20 bp, Artificial Sequence
  Description of Artificial Sequence: Synthetic oligonucleotide
  Target: SCN9A; (-) strand; PAM type: YTN; PAM sequence: TTA
tttaagtataggatgataca

SEQ ID NO: 67730 - DNA, 20 bp, Artificial Sequence
  Description of Artificial Sequence: Synthetic oligonucleotide
  Target: SCN9A; (-) strand; PAM type: YTN; PAM sequence: CTA
aatgcatgtagataataatt

SEQ ID NO: 67731 - DNA, 20 bp, Artificial Sequence
  Description of Artificial Sequence: Synthetic oligonucleotide
  Target: SCN9A; (-) strand; PAM type: YTN; PAM sequence: TTA
actaaatgcatgtagataat

SEQ ID NO: 67732 - DNA, 20 bp, Artificial Sequence
  Description of Artificial Sequence: Synthetic oligonucleotide
  Target: SCN9A; (-) strand; PAM type: YTN; PAM sequence: CTT
aactaaatgcatgtagataa

SEQ ID NO: 67733 - DNA, 20 bp, Artificial Sequence
  Description of Artificial Sequence: Synthetic oligonucleotide
  Target: SCN9A; (-) strand; PAM type: YTN; PAM sequence: CTC
ttaactaaatgcatgtagat

SEQ ID NO: 67734 - DNA, 20 bp, Artificial Sequence
  Description of Artificial Sequence: Synthetic oligonucleotide
  Target: SCN9A; (-) strand; PAM type: YTN; PAM sequence: CTC
tcttaactaaatgcatgtag

SEQ ID NO: 67735 - DNA, 20 bp, Artificial Sequence
  Description of Artificial Sequence: Synthetic oligonucleotide
  Target: SCN9A; (-) strand; PAM type: YTN; PAM sequence: TTC
tctcttaactaaatgcatgt

SEQ ID NO: 67736 - DNA, 20 bp, Artificial Sequence
  Description of Artificial Sequence: Synthetic oligonucleotide
  Target: SCN9A; (-) strand; PAM type: YTN; PAM sequence: TTA
tcgaatgttctctcttaact

SEQ ID NO: 67737 - DNA, 20 bp, Artificial Sequence
  Description of Artificial Sequence: Synthetic oligonucleotide
  Target: SCN9A; (-) strand; PAM type: YTN; PAM sequence: TTT
atcgaatgttctctcttaac

SEQ ID NO: 67738 - DNA, 20 bp, Artificial Sequence
  Description of Artificial Sequence: Synthetic oligonucleotide
  Target: SCN9A; (-) strand; PAM type: YTN; PAM sequence: TTT
tatcgaatgttctctcttaa

SEQ ID NO: 67739 - DNA, 20 bp, Artificial Sequence
  Description of Artificial Sequence: Synthetic oligonucleotide
  Target: SCN9A; (-) strand; PAM type: YTN; PAM sequence: TTA
tatcattttatcgaatgttc

SEQ ID NO: 67740 - DNA, 20 bp, Artificial Sequence
  Description of Artificial Sequence: Synthetic oligonucleotide
  Target: SCN9A; (-) strand; PAM type: YTN; PAM sequence: TTT
atatcattttatcgaatgtt

SEQ ID NO: 67741 - DNA, 20 bp, Artificial Sequence
  Description of Artificial Sequence: Synthetic oligonucleotide
  Target: SCN9A; (-) strand; PAM type: YTN; PAM sequence: TTT
tatatcattttatcgaatgt

SEQ ID NO: 67742 - DNA, 20 bp, Artificial Sequence
  Description of Artificial Sequence: Synthetic oligonucleotide
  Target: SCN9A; (-) strand; PAM type: YTN; PAM sequence: TTT
ttatatcattttatcgaatg

SEQ ID NO: 67743 - DNA, 20 bp, Artificial Sequence
  Description of Artificial Sequence: Synthetic oligonucleotide
  Target: SCN9A; (-) strand; PAM type: YTN; PAM sequence: CTG
tttttatatcattttatcga

SEQ ID NO: 67744 - DNA, 20 bp, Artificial Sequence
  Description of Artificial Sequence: Synthetic oligonucleotide
  Target: SCN9A; (-) strand; PAM type: YTN; PAM sequence: CTC
tgtttttatatcattttatc

SEQ ID NO: 67745 - DNA, 20 bp, Artificial Sequence
  Description of Artificial Sequence: Synthetic oligonucleotide
  Target: SCN9A; (-) strand; PAM type: YTN; PAM sequence: TTA
ctctgtttttatatcatttt

SEQ ID NO: 67746 - DNA, 20 bp, Artificial Sequence
  Description of Artificial Sequence: Synthetic oligonucleotide
  Target: SCN9A; (-) strand; PAM type: YTN; PAM sequence: TTT
actctgtttttatatcattt

SEQ ID NO: 67747 - DNA, 20 bp, Artificial Sequence
  Description of Artificial Sequence: Synthetic oligonucleotide
  Target: SCN9A; (-) strand; PAM type: YTN; PAM sequence: TTT
tactctgtttttatatcatt

SEQ ID NO: 67748 - DNA, 20 bp, Artificial Sequence
  Description of Artificial Sequence: Synthetic oligonucleotide
  Target: SCN9A; (-) strand; PAM type: YTN; PAM sequence: CTT
ttactctgtttttatatcat

SEQ ID NO: 67749 - DNA, 20 bp, Artificial Sequence
  Description of Artificial Sequence: Synthetic oligonucleotide
  Target: SCN9A; (-) strand; PAM type: YTN; PAM sequence: CTA
cccttttactctgtttttat

SEQ ID NO: 67750 - DNA, 20 bp, Artificial Sequence
  Description of Artificial Sequence: Synthetic oligonucleotide
  Target: SCN9A; (-) strand; PAM type: YTN; PAM sequence: TTG
accctacccttttactctgt

SEQ ID NO: 67751 - DNA, 20 bp, Artificial Sequence
  Description of Artificial Sequence: Synthetic oligonucleotide
  Target: SCN9A; (-) strand; PAM type: YTN; PAM sequence: TTT
gaccctacccttttactctg

SEQ ID NO: 67752 - DNA, 20 bp, Artificial Sequence
  Description of Artificial Sequence: Synthetic oligonucleotide
  Target: SCN9A; (-) strand; PAM type: YTN; PAM sequence: TTT
tgaccctacccttttactct

SEQ ID NO: 67753 - DNA, 20 bp, Artificial Sequence
  Description of Artificial Sequence: Synthetic oligonucleotide
  Target: SCN9A; (-) strand; PAM type: YTN; PAM sequence: TTT
ttgaccctacccttttactc

SEQ ID NO: 67754 - DNA, 20 bp, Artificial Sequence
  Description of Artificial Sequence: Synthetic oligonucleotide
  Target: SCN9A; (-) strand; PAM type: YTN; PAM sequence: TTA
atttttgaccctaccctttt

SEQ ID NO: 67755 - DNA, 20 bp, Artificial Sequence
  Description of Artificial Sequence: Synthetic oligonucleotide
  Target: SCN9A; (-) strand; PAM type: YTN; PAM sequence: TTA
gagttaatttttgaccctac

SEQ ID NO: 67756 - DNA, 20 bp, Artificial Sequence
  Description of Artificial Sequence: Synthetic oligonucleotide
  Target: SCN9A; (-) strand; PAM type: YTN; PAM sequence: CTT
agagttaatttttgacccta

SEQ ID NO: 67757 - DNA, 20 bp, Artificial Sequence
  Description of Artificial Sequence: Synthetic oligonucleotide
  Target: SCN9A; (-) strand; PAM type: YTN; PAM sequence: TTA
acttagagttaatttttgac

SEQ ID NO: 67758 - DNA, 20 bp, Artificial Sequence
  Description of Artificial Sequence: Synthetic oligonucleotide
  Target: SCN9A; (-) strand; PAM type: YTN; PAM sequence: CTG
aaaaagattaacttagagtt

SEQ ID NO: 67759 - DNA, 20 bp, Artificial Sequence
  Description of Artificial Sequence: Synthetic oligonucleotide
  Target: SCN9A; (-) strand; PAM type: YTN; PAM sequence: TTC
cctgaaaaagattaacttag

SEQ ID NO: 67760 - DNA, 20 bp, Artificial Sequence
  Description of Artificial Sequence: Synthetic oligonucleotide
  Target: SCN9A; (-) strand; PAM type: YTN; PAM sequence: TTT
ccctgaaaaagattaactta

SEQ ID NO: 67761 - DNA, 20 bp, Artificial Sequence
  Description of Artificial Sequence: Synthetic oligonucleotide
  Target: SCN9A; (-) strand; PAM type: YTN; PAM sequence: TTT
tccctgaaaaagattaactt

SEQ ID NO: 67762 - DNA, 20 bp, Artificial Sequence
  Description of Artificial Sequence: Synthetic oligonucleotide
  Target: SCN9A; (-) strand; PAM type: YTN; PAM sequence: TTA
ttttccctgaaaaagattaa

SEQ ID NO: 67763 - DNA, 20 bp, Artificial Sequence
  Description of Artificial Sequence: Synthetic oligonucleotide
  Target: SCN9A; (-) strand; PAM type: YTN; PAM sequence: TTT
attttccctgaaaaagatta

SEQ ID NO: 67764 - DNA, 20 bp, Artificial Sequence
  Description of Artificial Sequence: Synthetic oligonucleotide
  Target: SCN9A; (-) strand; PAM type: YTN; PAM sequence: TTT
tattttccctgaaaaagatt

SEQ ID NO: 67765 - DNA, 20 bp, Artificial Sequence
  Description of Artificial Sequence: Synthetic oligonucleotide
  Target: SCN9A; (-) strand; PAM type: YTN; PAM sequence: TTT
ttattttccctgaaaaagat

SEQ ID NO: 67766 - DNA, 20 bp, Artificial Sequence
  Description of Artificial Sequence: Synthetic oligonucleotide
  Target: SCN9A; (-) strand; PAM type: YTN; PAM sequence: CTG
gtatttttattttccctgaa

SEQ ID NO: 67767 - DNA, 20 bp, Artificial Sequence
  Description of Artificial Sequence: Synthetic oligonucleotide
  Target: SCN9A; (-) strand; PAM type: YTN; PAM sequence: CTC
tggtatttttattttccctg

SEQ ID NO: 67768 - DNA, 20 bp, Artificial Sequence
  Description of Artificial Sequence: Synthetic oligonucleotide
  Target: SCN9A; (-) strand; PAM type: YTN; PAM sequence: CTC
tctggtatttttattttccc

SEQ ID NO: 67769 - DNA, 20 bp, Artificial Sequence
  Description of Artificial Sequence: Synthetic oligonucleotide
  Target: SCN9A; (-) strand; PAM type: YTN; PAM sequence: CTC
tctctggtatttttattttc

SEQ ID NO: 67770 - DNA, 20 bp, Artificial Sequence
  Description of Artificial Sequence: Synthetic oligonucleotide
  Target: SCN9A; (-) strand; PAM type: YTN; PAM sequence: TTC
gctctctctggtatttttat

SEQ ID NO: 67771 - DNA, 20 bp, Artificial Sequence
  Description of Artificial Sequence: Synthetic oligonucleotide
  Target: SCN9A; (-) strand; PAM type: YTN; PAM sequence: TTT
cgctctctctggtattttta

SEQ ID NO: 67772 - DNA, 20 bp, Artificial Sequence
  Description of Artificial Sequence: Synthetic oligonucleotide
  Target: SCN9A; (-) strand; PAM type: YTN; PAM sequence: TTT
tcgctctctctggtattttt

SEQ ID NO: 67773 - DNA, 20 bp, Artificial Sequence
  Description of Artificial Sequence: Synthetic oligonucleotide
  Target: SCN9A; (-) strand; PAM type: YTN; PAM sequence: TTT
ttcgctctctctggtatttt

SEQ ID NO: 67774 - DNA, 20 bp, Artificial Sequence
  Description of Artificial Sequence: Synthetic oligonucleotide
  Target: SCN9A; (-) strand; PAM type: YTN; PAM sequence: TTT
tttcgctctctctggtattt

SEQ ID NO: 67775 - DNA, 20 bp, Artificial Sequence
  Description of Artificial Sequence: Synthetic oligonucleotide
  Target: SCN9A; (-) strand; PAM type: YTN; PAM sequence: TTT
ttttcgctctctctggtatt

SEQ ID NO: 67776 - DNA, 20 bp, Artificial Sequence
  Description of Artificial Sequence: Synthetic oligonucleotide
  Target: SCN9A; (-) strand; PAM type: YTN; PAM sequence: CTC
atttttttcgctctctctgg

SEQ ID NO: 67777 - DNA, 20 bp, Artificial Sequence
  Description of Artificial Sequence: Synthetic oligonucleotide
  Target: SCN9A; (-) strand; PAM type: YTN; PAM sequence: TTC
atctcatttttttcgctctc

SEQ ID NO: 67778 - DNA, 20 bp, Artificial Sequence
  Description of Artificial Sequence: Synthetic oligonucleotide
  Target: SCN9A; (-) strand; PAM type: YTN; PAM sequence: TTA
aaaaattcatctcatttttt

SEQ ID NO: 67779 - DNA, 20 bp, Artificial Sequence
  Description of Artificial Sequence: Synthetic oligonucleotide
  Target: SCN9A; (-) strand; PAM type: YTN; PAM sequence: TTA
atattaaaaaattcatctca

SEQ ID NO: 67780 - DNA, 20 bp, Artificial Sequence
  Description of Artificial Sequence: Synthetic oligonucleotide
  Target: SCN9A; (-) strand; PAM type: YTN; PAM sequence: CTA
agttaatattaaaaaattca

SEQ ID NO: 67781 - DNA, 20 bp, Artificial Sequence
  Description of Artificial Sequence: Synthetic oligonucleotide
  Target: SCN9A; (-) strand; PAM type: YTN; PAM sequence: CTA
aagcactaagttaatattaa

SEQ ID NO: 67782 - DNA, 20 bp, Artificial Sequence
  Description of Artificial Sequence: Synthetic oligonucleotide
  Target: SCN9A; (-) strand; PAM type: YTN; PAM sequence: TTC
taaagcactaagttaatatt

SEQ ID NO: 67783 - DNA, 20 bp, Artificial Sequence
  Description of Artificial Sequence: Synthetic oligonucleotide
  Target: SCN9A; (-) strand; PAM type: YTN; PAM sequence: TTA
agacaaattctaaagcacta

SEQ ID NO: 67784 - DNA, 20 bp, Artificial Sequence
  Description of Artificial Sequence: Synthetic oligonucleotide
  Target: SCN9A; (-) strand; PAM type: YTN; PAM sequence: TTT
aagacaaattctaaagcact

SEQ ID NO: 67785 - DNA, 20 bp, Artificial Sequence
  Description of Artificial Sequence: Synthetic oligonucleotide
  Target: SCN9A; (-) strand; PAM type: YTN; PAM sequence: TTA
agtttaagacaaattctaaa

SEQ ID NO: 67786 - DNA, 20 bp, Artificial Sequence
  Description of Artificial Sequence: Synthetic oligonucleotide
  Target: SCN9A; (-) strand; PAM type: YTN; PAM sequence: TTT
aagtttaagacaaattctaa

SEQ ID NO: 67787 - DNA, 20 bp, Artificial Sequence
  Description of Artificial Sequence: Synthetic oligonucleotide
  Target: SCN9A; (-) strand; PAM type: YTN; PAM sequence: TTT
taagtttaagacaaattcta

SEQ ID NO: 67788 - DNA, 20 bp, Artificial Sequence
  Description of Artificial Sequence: Synthetic oligonucleotide
  Target: SCN9A; (-) strand; PAM type: YTN; PAM sequence: TTT
ttaagtttaagacaaattct

SEQ ID NO: 67789 - DNA, 20 bp, Artificial Sequence
  Description of Artificial Sequence: Synthetic oligonucleotide
  Target: SCN9A; (-) strand; PAM type: YTN; PAM sequence: TTG
tttttaagtttaagacaaat

SEQ ID NO: 67790 - DNA, 20 bp, Artificial Sequence
  Description of Artificial Sequence: Synthetic oligonucleotide
  Target: SCN9A; (-) strand; PAM type: YTN; PAM sequence: TTA
tatgtgatcattgtttttaa

SEQ ID NO: 67791 - DNA, 20 bp, Artificial Sequence
  Description of Artificial Sequence: Synthetic oligonucleotide
  Target: SCN9A; (-) strand; PAM type: YTN; PAM sequence: CTT
atatgtgatcattgttttta

SEQ ID NO: 67792 - DNA, 20 bp, Artificial Sequence
  Description of Artificial Sequence: Synthetic oligonucleotide
  Target: SCN9A; (-) strand; PAM type: YTN; PAM sequence: TTC
ttatatgtgatcattgtttt

SEQ ID NO: 67793 - DNA, 20 bp, Artificial Sequence
  Description of Artificial Sequence: Synthetic oligonucleotide
  Target: SCN9A; (-) strand; PAM type: YTN; PAM sequence: TTT
cttatatgtgatcattgttt

SEQ ID NO: 67794 - DNA, 20 bp, Artificial Sequence
  Description of Artificial Sequence: Synthetic oligonucleotide
  Target: SCN9A; (-) strand; PAM type: YTN; PAM sequence: CTT
tcttatatgtgatcattgtt

SEQ ID NO: 67795 - DNA, 20 bp, Artificial Sequence
  Description of Artificial Sequence: Synthetic oligonucleotide
  Target: SCN9A; (-) strand; PAM type: YTN; PAM sequence: TTC
tttcttatatgtgatcattg

SEQ ID NO: 67796 - DNA, 20 bp, Artificial Sequence
  Description of Artificial Sequence: Synthetic oligonucleotide
  Target: SCN9A; (-) strand; PAM type: YTN; PAM sequence: CTG
agaaagataaattctttctt

SEQ ID NO: 67797 - DNA, 20 bp, Artificial Sequence
  Description of Artificial Sequence: Synthetic oligonucleotide
  Target: SCN9A; (-) strand; PAM type: YTN; PAM sequence: TTG
cccctgagaaagataaattc

SEQ ID NO: 67798 - DNA, 20 bp, Artificial Sequence
  Description of Artificial Sequence: Synthetic oligonucleotide
  Target: SCN9A; (-) strand; PAM type: YTN; PAM sequence: TTT
gcccctgagaaagataaatt

SEQ ID NO: 67799 - DNA, 20 bp, Artificial Sequence
  Description of Artificial Sequence: Synthetic oligonucleotide
  Target: SCN9A; (-) strand; PAM type: YTN; PAM sequence: TTA
tccaataatttgcccctgag

SEQ ID NO: 67800 - DNA, 20 bp, Artificial Sequence
  Description of Artificial Sequence: Synthetic oligonucleotide
  Target: SCN9A; (-) strand; PAM type: YTN; PAM sequence: CTT
atccaataatttgcccctga

SEQ ID NO: 67801 - DNA, 20 bp, Artificial Sequence
  Description of Artificial Sequence: Synthetic oligonucleotide
  Target: SCN9A; (-) strand; PAM type: YTN; PAM sequence: TTC
ttatccaataatttgcccct

SEQ ID NO: 67802 - DNA, 20 bp, Artificial Sequence
  Description of Artificial Sequence: Synthetic oligonucleotide
  Target: SCN9A; (-) strand; PAM type: YTN; PAM sequence: TTT
cttatccaataatttgcccc

SEQ ID NO: 67803 - DNA, 20 bp, Artificial Sequence
  Description of Artificial Sequence: Synthetic oligonucleotide
  Target: SCN9A; (-) strand; PAM type: YTN; PAM sequence: TTT
tcttatccaataatttgccc

SEQ ID NO: 67804 - DNA, 20 bp, Artificial Sequence
  Description of Artificial Sequence: Synthetic oligonucleotide
  Target: SCN9A; (-) strand; PAM type: YTN; PAM sequence: TTA
accaaagggataattttctt

SEQ ID NO: 67805 - DNA, 20 bp, Artificial Sequence
  Description of Artificial Sequence: Synthetic oligonucleotide
  Target: SCN9A; (-) strand; PAM type: YTN; PAM sequence: CTT
aaccaaagggataattttct

SEQ ID NO: 67806 - DNA, 20 bp, Artificial Sequence
  Description of Artificial Sequence: Synthetic oligonucleotide
  Target: SCN9A; (-) strand; PAM type: YTN; PAM sequence: TTC
ttaaccaaagggataatttt

SEQ ID NO: 67807 - DNA, 20 bp, Artificial Sequence
  Description of Artificial Sequence: Synthetic oligonucleotide
  Target: SCN9A; (-) strand; PAM type: YTN; PAM sequence: CTT
cttaaccaaagggataattt

SEQ ID NO: 67808 - DNA, 20 bp, Artificial Sequence
  Description of Artificial Sequence: Synthetic oligonucleotide
  Target: SCN9A; (-) strand; PAM type: YTN; PAM sequence: TTG
acaaaagtaaatcccagaga

SEQ ID NO: 67809 - DNA, 20 bp, Artificial Sequence
  Description of Artificial Sequence: Synthetic oligonucleotide
  Target: SCN9A; (-) strand; PAM type: YTN; PAM sequence: TTA
agattgacaaaagtaaatcc

SEQ ID NO: 67810 - DNA, 20 bp, Artificial Sequence
  Description of Artificial Sequence: Synthetic oligonucleotide
  Target: SCN9A; (-) strand; PAM type: YTN; PAM sequence: TTT
aagattgacaaaagtaaatc

SEQ ID NO: 67811 - DNA, 20 bp, Artificial Sequence
  Description of Artificial Sequence: Synthetic oligonucleotide
  Target: SCN9A; (-) strand; PAM type: YTN; PAM sequence: TTT
taagattgacaaaagtaaat

SEQ ID NO: 67812 - DNA, 20 bp, Artificial Sequence
  Description of Artificial Sequence: Synthetic oligonucleotide
  Target: SCN9A; (-) strand; PAM type: YTN; PAM sequence: TTC
aattttaagattgacaaaag

SEQ ID NO: 67813 - DNA, 20 bp, Artificial Sequence
  Description of Artificial Sequence: Synthetic oligonucleotide
  Target: SCN9A; (-) strand; PAM type: YTN; PAM sequence: CTT
caattttaagattgacaaaa

SEQ ID NO: 67814 - DNA, 20 bp, Artificial Sequence
  Description of Artificial Sequence: Synthetic oligonucleotide
  Target: SCN9A; (-) strand; PAM type: YTN; PAM sequence: TTC
ccttcaattttaagattgac

SEQ ID NO: 67815 - DNA, 20 bp, Artificial Sequence
  Description of Artificial Sequence: Synthetic oligonucleotide
  Target: SCN9A; (-) strand; PAM type: YTN; PAM sequence: TTT
cccttcaattttaagattga

SEQ ID NO: 67816 - DNA, 20 bp, Artificial Sequence
  Description of Artificial Sequence: Synthetic oligonucleotide
  Target: SCN9A; (-) strand; PAM type: YTN; PAM sequence: CTC
aatcataagaataatgtttc

SEQ ID NO: 67817 - DNA, 20 bp, Artificial Sequence
  Description of Artificial Sequence: Synthetic oligonucleotide
  Target: SCN9A; (-) strand; PAM type: YTN; PAM sequence: TTC
ctcaatcataagaataatgt

SEQ ID NO: 67818 - DNA, 20 bp, Artificial Sequence
  Description of Artificial Sequence: Synthetic oligonucleotide
  Target: SCN9A; (-) strand; PAM type: YTN; PAM sequence: TTT
cctcaatcataagaataatg

SEQ ID NO: 67819 - DNA, 20 bp, Artificial Sequence
  Description of Artificial Sequence: Synthetic oligonucleotide
  Target: SCN9A; (-) strand; PAM type: YTN; PAM sequence: TTA
tttcctcaatcataagaata

SEQ ID NO: 67820 - DNA, 20 bp, Artificial Sequence
  Description of Artificial Sequence: Synthetic oligonucleotide
  Target: SCN9A; (-) strand; PAM type: YTN; PAM sequence: TTT
atttcctcaatcataagaat

SEQ ID NO: 67821 - DNA, 20 bp, Artificial Sequence
  Description of Artificial Sequence: Synthetic oligonucleotide
  Target: SCN9A; (-) strand; PAM type: YTN; PAM sequence: TTT
tatttcctcaatcataagaa

SEQ ID NO: 67822 - DNA, 20 bp, Artificial Sequence
  Description of Artificial Sequence: Synthetic oligonucleotide
  Target: SCN9A; (-) strand; PAM type: YTN; PAM sequence: TTT
ttatttcctcaatcataaga

SEQ ID NO: 67823 - DNA, 20 bp, Artificial Sequence
  Description of Artificial Sequence: Synthetic oligonucleotide
  Target: SCN9A; (-) strand; PAM type: YTN; PAM sequence: TTA
gtgtttttatttcctcaatc

SEQ ID NO: 67824 - DNA, 20 bp, Artificial Sequence
  Description of Artificial Sequence: Synthetic oligonucleotide
  Target: SCN9A; (-) strand; PAM type: YTN; PAM sequence: TTT
agtgtttttatttcctcaat

SEQ ID NO: 67825 - DNA, 20 bp, Artificial Sequence
  Description of Artificial Sequence: Synthetic oligonucleotide
  Target: SCN9A; (-) strand; PAM type: YTN; PAM sequence: TTT
tagtgtttttatttcctcaa

SEQ ID NO: 67826 - DNA, 20 bp, Artificial Sequence
  Description of Artificial Sequence: Synthetic oligonucleotide
  Target: SCN9A; (-) strand; PAM type: YTN; PAM sequence: TTT
ttagtgtttttatttcctca

SEQ ID NO: 67827 - DNA, 20 bp, Artificial Sequence
  Description of Artificial Sequence: Synthetic oligonucleotide
  Target: SCN9A; (-) strand; PAM type: YTN; PAM sequence: TTA
ggatttttagtgtttttatt

SEQ ID NO: 67828 - DNA, 20 bp, Artificial Sequence
  Description of Artificial Sequence: Synthetic oligonucleotide
  Target: SCN9A; (-) strand; PAM type: YTN; PAM sequence: CTA
attaggatttttagtgtttt

SEQ ID NO: 67829 - DNA, 20 bp, Artificial Sequence
  Description of Artificial Sequence: Synthetic oligonucleotide
  Target: SCN9A; (-) strand; PAM type: YTN; PAM sequence: TTC
taattaggatttttagtgtt

SEQ ID NO: 67830 - DNA, 20 bp, Artificial Sequence
  Description of Artificial Sequence: Synthetic oligonucleotide
  Target: SCN9A; (-) strand; PAM type: YTN; PAM sequence: TTT
ctaattaggatttttagtgt

SEQ ID NO: 67831 - DNA, 20 bp, Artificial Sequence
  Description of Artificial Sequence: Synthetic oligonucleotide
  Target: SCN9A; (-) strand; PAM type: YTN; PAM sequence: TTT
tctaattaggatttttagtg

SEQ ID NO: 67832 - DNA, 20 bp, Artificial Sequence
  Description of Artificial Sequence: Synthetic oligonucleotide
  Target: SCN9A; (-) strand; PAM type: YTN; PAM sequence: CTT
ttctaattaggatttttagt

SEQ ID NO: 67833 - DNA, 20 bp, Artificial Sequence
  Description of Artificial Sequence: Synthetic oligonucleotide
  Target: SCN9A; (-) strand; PAM type: YTN; PAM sequence: CTA
acttttctaattaggatttt

SEQ ID NO: 67834 - DNA, 20 bp, Artificial Sequence
  Description of Artificial Sequence: Synthetic oligonucleotide
  Target: SCN9A; (-) strand; PAM type: YTN; PAM sequence: TTA
ctaacttttctaattaggat

SEQ ID NO: 67835 - DNA, 20 bp, Artificial Sequence
  Description of Artificial Sequence: Synthetic oligonucleotide
  Target: SCN9A; (-) strand; PAM type: YTN; PAM sequence: TTT
actaacttttctaattagga

SEQ ID NO: 67836 - DNA, 20 bp, Artificial Sequence
  Description of Artificial Sequence: Synthetic oligonucleotide
  Target: SCN9A; (-) strand; PAM type: YTN; PAM sequence: TTG
aaagtttactaacttttcta

SEQ ID NO: 67837 - DNA, 20 bp, Artificial Sequence
  Description of Artificial Sequence: Synthetic oligonucleotide
  Target: SCN9A; (-) strand; PAM type: YTN; PAM sequence: TTC
agattgaaagtttactaact

SEQ ID NO: 67838 - DNA, 20 bp, Artificial Sequence
  Description of Artificial Sequence: Synthetic oligonucleotide
  Target: SCN9A; (-) strand; PAM type: YTN; PAM sequence: TTT
cagattgaaagtttactaac

SEQ ID NO: 67839 - DNA, 20 bp, Artificial Sequence
  Description of Artificial Sequence: Synthetic oligonucleotide
  Target: SCN9A; (-) strand; PAM type: YTN; PAM sequence: TTC
atttcagattgaaagtttac

SEQ ID NO: 67840 - DNA, 20 bp, Artificial Sequence
  Description of Artificial Sequence: Synthetic oligonucleotide
  Target: SCN9A; (-) strand; PAM type: YTN; PAM sequence: CTT
catttcagattgaaagttta

SEQ ID NO: 67841 - DNA, 20 bp, Artificial Sequence
  Description of Artificial Sequence: Synthetic oligonucleotide
  Target: SCN9A; (-) strand; PAM type: YTN; PAM sequence: TTA
tgaaacttcatttcagattg

SEQ ID NO: 67842 - DNA, 20 bp, Artificial Sequence
  Description of Artificial Sequence: Synthetic oligonucleotide
  Target: SCN9A; (-) strand; PAM type: YTN; PAM sequence: TTT
atgaaacttcatttcagatt

SEQ ID NO: 67843 - DNA, 20 bp, Artificial Sequence
  Description of Artificial Sequence: Synthetic oligonucleotide
  Target: SCN9A; (-) strand; PAM type: YTN; PAM sequence: CTG
agggcaatatttatgaaact

SEQ ID NO: 67844 - DNA, 20 bp, Artificial Sequence
  Description of Artificial Sequence: Synthetic oligonucleotide
  Target: SCN9A; (-) strand; PAM type: YTN; PAM sequence: CTG
aggtgtaataaaccctgagg

SEQ ID NO: 67845 - DNA, 20 bp, Artificial Sequence
  Description of Artificial Sequence: Synthetic oligonucleotide
  Target: SCN9A; (-) strand; PAM type: YTN; PAM sequence: CTC
tgaggtgtaataaaccctga

SEQ ID NO: 67846 - DNA, 20 bp, Artificial Sequence
  Description of Artificial Sequence: Synthetic oligonucleotide
  Target: SCN9A; (-) strand; PAM type: YTN; PAM sequence: CTC
tctgaggtgtaataaaccct

SEQ ID NO: 67847 - DNA, 20 bp, Artificial Sequence
  Description of Artificial Sequence: Synthetic oligonucleotide
  Target: SCN9A; (-) strand; PAM type: YTN; PAM sequence: CTC
aaaataagagaaagaaactc

SEQ ID NO: 67848 - DNA, 20 bp, Artificial Sequence
  Description of Artificial Sequence: Synthetic oligonucleotide
  Target: SCN9A; (-) strand; PAM type: YTN; PAM sequence: TTG
cctcaaaataagagaaagaa

SEQ ID NO: 67849 - DNA, 20 bp, Artificial Sequence
  Description of Artificial Sequence: Synthetic oligonucleotide
  Target: SCN9A; (-) strand; PAM type: YTN; PAM sequence: CTT
gcctcaaaataagagaaaga

SEQ ID NO: 67850 - DNA, 20 bp, Artificial Sequence
  Description of Artificial Sequence: Synthetic oligonucleotide
  Target: SCN9A; (-) strand; PAM type: YTN; PAM sequence: CTC
ttgcctcaaaataagagaaa

SEQ ID NO: 67851 - DNA, 20 bp, Artificial Sequence
  Description of Artificial Sequence: Synthetic oligonucleotide
  Target: SCN9A; (-) strand; PAM type: YTN; PAM sequence: CTC
catcactcttgcctcaaaat

SEQ ID NO: 67852 - DNA, 20 bp, Artificial Sequence
  Description of Artificial Sequence: Synthetic oligonucleotide
  Target: SCN9A; (-) strand; PAM type: YTN; PAM sequence: TTG
cacaaaaaccagacaggcgc

SEQ ID NO: 67853 - DNA, 20 bp, Artificial Sequence
  Description of Artificial Sequence: Synthetic oligonucleotide
  Target: SCN9A; (-) strand; PAM type: YTN; PAM sequence: TTT
gcacaaaaaccagacaggcg

SEQ ID NO: 67854 - DNA, 20 bp, Artificial Sequence
  Description of Artificial Sequence: Synthetic oligonucleotide
  Target: SCN9A; (-) strand; PAM type: YTN; PAM sequence: CTT
tgcacaaaaaccagacaggc

SEQ ID NO: 67855 - DNA, 20 bp, Artificial Sequence
  Description of Artificial Sequence: Synthetic oligonucleotide
  Target: SCN9A; (-) strand; PAM type: YTN; PAM sequence: TTG
ggatatacctttgcacaaaa

SEQ ID NO: 67856 - DNA, 20 bp, Artificial Sequence
  Description of Artificial Sequence: Synthetic oligonucleotide
  Target: SCN9A; (-) strand; PAM type: YTN; PAM sequence: CTT
gggatatacctttgcacaaa

SEQ ID NO: 67857 - DNA, 20 bp, Artificial Sequence
  Description of Artificial Sequence: Synthetic oligonucleotide
  Target: SCN9A; (-) strand; PAM type: YTN; PAM sequence: CTC
ttgggatatacctttgcaca

SEQ ID NO: 67858 - DNA, 20 bp, Artificial Sequence
  Description of Artificial Sequence: Synthetic oligonucleotide
  Target: SCN9A; (-) strand; PAM type: YTN; PAM sequence: TTG
gaaatctcttgggatatacc

SEQ ID NO: 67859 - DNA, 20 bp, Artificial Sequence
  Description of Artificial Sequence: Synthetic oligonucleotide
  Target: SCN9A; (-) strand; PAM type: YTN; PAM sequence: TTA
gttggaaatctcttgggata

SEQ ID NO: 67860 - DNA, 20 bp, Artificial Sequence
  Description of Artificial Sequence: Synthetic oligonucleotide
  Target: SCN9A; (-) strand; PAM type: YTN; PAM sequence: CTT
agttggaaatctcttgggat

SEQ ID NO: 67861 - DNA, 20 bp, Artificial Sequence
  Description of Artificial Sequence: Synthetic oligonucleotide
  Target: SCN9A; (-) strand; PAM type: YTN; PAM sequence: CTA
accagcttagttggaaatct

SEQ ID NO: 67862 - DNA, 20 bp, Artificial Sequence
  Description of Artificial Sequence: Synthetic oligonucleotide
  Target: SCN9A; (-) strand; PAM type: YTN; PAM sequence: TTG
ctaaccagcttagttggaaa

SEQ ID NO: 67863 - DNA, 20 bp, Artificial Sequence
  Description of Artificial Sequence: Synthetic oligonucleotide
  Target: SCN9A; (-) strand; PAM type: YTN; PAM sequence: TTA
aagagaaggtatgataacat

SEQ ID NO: 67864 - DNA, 20 bp, Artificial Sequence
  Description of Artificial Sequence: Synthetic oligonucleotide
  Target: SCN9A; (-) strand; PAM type: YTN; PAM sequence: TTT
aaagagaaggtatgataaca

SEQ ID NO: 67865 - DNA, 20 bp, Artificial Sequence
  Description of Artificial Sequence: Synthetic oligonucleotide
  Target: SCN9A; (-) strand; PAM type: YTN; PAM sequence: TTT
taaagagaaggtatgataac

SEQ ID NO: 67866 - DNA, 20 bp, Artificial Sequence
  Description of Artificial Sequence: Synthetic oligonucleotide
  Target: SCN9A; (-) strand; PAM type: YTN; PAM sequence: CTT
ttaaagagaaggtatgataa

SEQ ID NO: 67867 - DNA, 20 bp, Artificial Sequence
  Description of Artificial Sequence: Synthetic oligonucleotide
  Target: SCN9A; (-) strand; PAM type: YTN; PAM sequence: TTA
atagtccttttaaagagaag

SEQ ID NO: 67868 - DNA, 20 bp, Artificial Sequence
  Description of Artificial Sequence: Synthetic oligonucleotide
  Target: SCN9A; (-) strand; PAM type: YTN; PAM sequence: TTC
aattaatagtccttttaaag

SEQ ID NO: 67869 - DNA, 20 bp, Artificial Sequence
  Description of Artificial Sequence: Synthetic oligonucleotide
  Target: SCN9A; (-) strand; PAM type: YTN; PAM sequence: TTA
cattcaattaatagtccttt

SEQ ID NO: 67870 - DNA, 20 bp, Artificial Sequence
  Description of Artificial Sequence: Synthetic oligonucleotide
  Target: SCN9A; (-) strand; PAM type: YTN; PAM sequence: TTT
acattcaattaatagtcctt

SEQ ID NO: 67871 - DNA, 20 bp, Artificial Sequence
  Description of Artificial Sequence: Synthetic oligonucleotide
  Target: SCN9A; (-) strand; PAM type: YTN; PAM sequence: TTA
tgtttacattcaattaatag

SEQ ID NO: 67872 - DNA, 20 bp, Artificial Sequence
  Description of Artificial Sequence: Synthetic oligonucleotide
  Target: SCN9A; (-) strand; PAM type: YTN; PAM sequence: CTG
ttatgtttacattcaattaa

SEQ ID NO: 67873 - DNA, 20 bp, Artificial Sequence
  Description of Artificial Sequence: Synthetic oligonucleotide
  Target: SCN9A; (-) strand; PAM type: YTN; PAM sequence: CTC
tgttatgtttacattcaatt

SEQ ID NO: 67874 - DNA, 20 bp, Artificial Sequence
  Description of Artificial Sequence: Synthetic oligonucleotide
  Target: SCN9A; (-) strand; PAM type: YTN; PAM sequence: TTC
tctgttatgtttacattcaa

SEQ ID NO: 67875 - DNA, 20 bp, Artificial Sequence
  Description of Artificial Sequence: Synthetic oligonucleotide
  Target: SCN9A; (-) strand; PAM type: YTN; PAM sequence: TTG
agagattctctgttatgttt

SEQ ID NO: 67876 - DNA, 20 bp, Artificial Sequence
  Description of Artificial Sequence: Synthetic oligonucleotide
  Target: SCN9A; (-) strand; PAM type: YTN; PAM sequence: TTT
gagagattctctgttatgtt

SEQ ID NO: 67877 - DNA, 20 bp, Artificial Sequence
  Description of Artificial Sequence: Synthetic oligonucleotide
  Target: SCN9A; (-) strand; PAM type: YTN; PAM sequence: TTA
aaatgtttgagagattctct

SEQ ID NO: 67878 - DNA, 20 bp, Artificial Sequence
  Description of Artificial Sequence: Synthetic oligonucleotide
  Target: SCN9A; (-) strand; PAM type: YTN; PAM sequence: CTG
ggacccattaaaatgtttga

SEQ ID NO: 67879 - DNA, 20 bp, Artificial Sequence
  Description of Artificial Sequence: Synthetic oligonucleotide
  Target: SCN9A; (-) strand; PAM type: YTN; PAM sequence: CTC
actgggacccattaaaatgt

SEQ ID NO: 67880 - DNA, 20 bp, Artificial Sequence
  Description of Artificial Sequence: Synthetic oligonucleotide
  Target: SCN9A; (-) strand; PAM type: YTN; PAM sequence: TTA
ctcactgggacccattaaaa

SEQ ID NO: 67881 - DNA, 20 bp, Artificial Sequence
  Description of Artificial Sequence: Synthetic oligonucleotide
  Target: SCN9A; (-) strand; PAM type: YTN; PAM sequence: TTT
actcactgggacccattaaa

SEQ ID NO: 67882 - DNA, 20 bp, Artificial Sequence
  Description of Artificial Sequence: Synthetic oligonucleotide
  Target: SCN9A; (-) strand; PAM type: YTN; PAM sequence: TTA
gtgaaaccacccaaaagaaa

SEQ ID NO: 67883 - DNA, 20 bp, Artificial Sequence
  Description of Artificial Sequence: Synthetic oligonucleotide
  Target: SCN9A; (-) strand; PAM type: YTN; PAM sequence: TTA
tgtaatgcaccatgagagca

SEQ ID NO: 67884 - DNA, 20 bp, Artificial Sequence
  Description of Artificial Sequence: Synthetic oligonucleotide
  Target: SCN9A; (-) strand; PAM type: YTN; PAM sequence: TTT
atgtaatgcaccatgagagc

SEQ ID NO: 67885 - DNA, 20 bp, Artificial Sequence
  Description of Artificial Sequence: Synthetic oligonucleotide
  Target: SCN9A; (-) strand; PAM type: YTN; PAM sequence: CTT
tatgtaatgcaccatgagag

SEQ ID NO: 67886 - DNA, 20 bp, Artificial Sequence
  Description of Artificial Sequence: Synthetic oligonucleotide
  Target: SCN9A; (-) strand; PAM type: YTN; PAM sequence: CTC
agcatagactttatgtaatg

SEQ ID NO: 67887 - DNA, 20 bp, Artificial Sequence
  Description of Artificial Sequence: Synthetic oligonucleotide
  Target: SCN9A; (-) strand; PAM type: YTN; PAM sequence: TTA
acatgatgaaactcagcata

SEQ ID NO: 67888 - DNA, 20 bp, Artificial Sequence
  Description of Artificial Sequence: Synthetic oligonucleotide
  Target: SCN9A; (-) strand; PAM type: YTN; PAM sequence: TTT
aacatgatgaaactcagcat

SEQ ID NO: 67889 - DNA, 20 bp, Artificial Sequence
  Description of Artificial Sequence: Synthetic oligonucleotide
  Target: SCN9A; (-) strand; PAM type: YTN; PAM sequence: TTG
gtttaacatgatgaaactca

SEQ ID NO: 67890 - DNA, 20 bp, Artificial Sequence
  Description of Artificial Sequence: Synthetic oligonucleotide
  Target: SCN9A; (-) strand; PAM type: YTN; PAM sequence: TTT
ggtttaacatgatgaaactc

SEQ ID NO: 67891 - DNA, 20 bp, Artificial Sequence
  Description of Artificial Sequence: Synthetic oligonucleotide
  Target: SCN9A; (-) strand; PAM type: YTN; PAM sequence: CTT
tggtttaacatgatgaaact

SEQ ID NO: 67892 - DNA, 20 bp, Artificial Sequence
  Description of Artificial Sequence: Synthetic oligonucleotide
  Target: SCN9A; (-) strand; PAM type: YTN; PAM sequence: TTG
agagctttggtttaacatga

SEQ ID NO: 67893 - DNA, 20 bp, Artificial Sequence
  Description of Artificial Sequence: Synthetic oligonucleotide
  Target: SCN9A; (-) strand; PAM type: YTN; PAM sequence: TTT
gagagctttggtttaacatg

SEQ ID NO: 67894 - DNA, 20 bp, Artificial Sequence
  Description of Artificial Sequence: Synthetic oligonucleotide
  Target: SCN9A; (-) strand; PAM type: YTN; PAM sequence: TTT
tgagagctttggtttaacat

SEQ ID NO: 67895 - DNA, 20 bp, Artificial Sequence
  Description of Artificial Sequence: Synthetic oligonucleotide
  Target: SCN9A; (-) strand; PAM type: YTN; PAM sequence: TTT
ttgagagctttggtttaaca

SEQ ID NO: 67896 - DNA, 20 bp, Artificial Sequence
  Description of Artificial Sequence: Synthetic oligonucleotide
  Target: SCN9A; (-) strand; PAM type: YTN; PAM sequence: TTT
tttgagagctttggtttaac

SEQ ID NO: 67897 - DNA, 20 bp, Artificial Sequence
  Description of Artificial Sequence: Synthetic oligonucleotide
  Target: SCN9A; (-) strand; PAM type: YTN; PAM sequence: TTT
ttttgagagctttggtttaa

SEQ ID NO: 67898 - DNA, 20 bp, Artificial Sequence
  Description of Artificial Sequence: Synthetic oligonucleotide
  Target: SCN9A; (-) strand; PAM type: YTN; PAM sequence: TTT
tttttgagagctttggttta

SEQ ID NO: 67899 - DNA, 20 bp, Artificial Sequence
  Description of Artificial Sequence: Synthetic oligonucleotide
  Target: SCN9A; (-) strand; PAM type: YTN; PAM sequence: TTT
ttttttgagagctttggttt

SEQ ID NO: 67900 - DNA, 20 bp, Artificial Sequence
  Description of Artificial Sequence: Synthetic oligonucleotide
  Target: SCN9A; (-) strand; PAM type: YTN; PAM sequence: TTT
tttttttgagagctttggtt

SEQ ID NO: 67901 - DNA, 20 bp, Artificial Sequence
  Description of Artificial Sequence: Synthetic oligonucleotide
  Target: SCN9A; (-) strand; PAM type: YTN; PAM sequence: TTT
ttttttttgagagctttggt

SEQ ID NO: 67902 - DNA, 20 bp, Artificial Sequence
  Description of Artificial Sequence: Synthetic oligonucleotide
  Target: SCN9A; (-) strand; PAM type: YTN; PAM sequence: TTT
tttttttttgagagctttgg

SEQ ID NO: 67903 - DNA, 20 bp, Artificial Sequence
  Description of Artificial Sequence: Synthetic oligonucleotide
  Target: SCN9A; (-) strand; PAM type: YTN; PAM sequence: TTT
ttttttttttgagagctttg

SEQ ID NO: 67904 - DNA, 20 bp, Artificial Sequence
  Description of Artificial Sequence: Synthetic oligonucleotide
  Target: SCN9A; (-) strand; PAM type: YTN; PAM sequence: TTT
tttttttttttgagagcttt

SEQ ID NO: 67905 - DNA, 20 bp, Artificial Sequence
  Description of Artificial Sequence: Synthetic oligonucleotide
  Target: SCN9A; (-) strand; PAM type: YTN; PAM sequence: TTT
ttttttttttttgagagctt

SEQ ID NO: 67906 - DNA, 20 bp, Artificial Sequence
  Description of Artificial Sequence: Synthetic oligonucleotide
  Target: SCN9A; (-) strand; PAM type: YTN; PAM sequence: TTT
tttttttttttttgagagct

SEQ ID NO: 67907 - DNA, 20 bp, Artificial Sequence
  Description of Artificial Sequence: Synthetic oligonucleotide
  Target: SCN9A; (-) strand; PAM type: YTN; PAM sequence: TTT
ttttttttttttttgagagc

SEQ ID NO: 67908 - DNA, 20 bp, Artificial Sequence
  Description of Artificial Sequence: Synthetic oligonucleotide
  Target: SCN9A; (-) strand; PAM type: YTN; PAM sequence: TTT
tttttttttttttttgagag

SEQ ID NO: 67909 - DNA, 20 bp, Artificial Sequence
  Description of Artificial Sequence: Synthetic oligonucleotide
  Target: SCN9A; (-) strand; PAM type: YTN; PAM sequence: TTT
ttttttttttttttttgaga

SEQ ID NO: 67910 - DNA, 20 bp, Artificial Sequence
  Description of Artificial Sequence: Synthetic oligonucleotide
  Target: SCN9A; (-) strand; PAM type: YTN; PAM sequence: TTT
tttttttttttttttttgag

SEQ ID NO: 67911 - DNA, 20 bp, Artificial Sequence
  Description of Artificial Sequence: Synthetic oligonucleotide
  Target: SCN9A; (-) strand; PAM type: YTN; PAM sequence: TTT
ttttttttttttttttttga

SEQ ID NO: 67912 - DNA, 20 bp, Artificial Sequence
  Description of Artificial Sequence: Synthetic oligonucleotide
  Target: SCN9A; (-) strand; PAM type: YTN; PAM sequence: TTT
tttttttttttttttttttg

SEQ ID NO: 67913 - DNA, 20 bp, Artificial Sequence
  Description of Artificial Sequence: Synthetic oligonucleotide
  Target: SCN9A; (-) strand; PAM type: YTN; PAM sequence: CTT
tttttttttttttttttttt

SEQ ID NO: 67914 - DNA, 20 bp, Artificial Sequence
  Description of Artificial Sequence: Synthetic oligonucleotide
  Target: SCN9A; (-) strand; PAM type: YTN; PAM sequence: TTC
cttttttttttttttttttt

SEQ ID NO: 67915 - DNA, 20 bp, Artificial Sequence
  Description of Artificial Sequence: Synthetic oligonucleotide
  Target: SCN9A; (-) strand; PAM type: YTN; PAM sequence: TTT
cctttttttttttttttttt

SEQ ID NO: 67916 - DNA, 20 bp, Artificial Sequence
  Description of Artificial Sequence: Synthetic oligonucleotide
  Target: SCN9A; (-) strand; PAM type: YTN; PAM sequence: CTT
tccttttttttttttttttt

SEQ ID NO: 67917 - DNA, 20 bp, Artificial Sequence
  Description of Artificial Sequence: Synthetic oligonucleotide
  Target: SCN9A; (-) strand; PAM type: YTN; PAM sequence: TTC
ctttcctttttttttttttt

SEQ ID NO: 67918 - DNA, 20 bp, Artificial Sequence
  Description of Artificial Sequence: Synthetic oligonucleotide
  Target: SCN9A; (-) strand; PAM type: YTN; PAM sequence: TTT
cctttccttttttttttttt

SEQ ID NO: 67919 - DNA, 20 bp, Artificial Sequence
  Description of Artificial Sequence: Synthetic oligonucleotide
  Target: SCN9A; (-) strand; PAM type: YTN; PAM sequence: CTT
tcctttcctttttttttttt

SEQ ID NO: 67920 - DNA, 20 bp, Artificial Sequence
  Description of Artificial Sequence: Synthetic oligonucleotide
  Target: SCN9A; (-) strand; PAM type: YTN; PAM sequence: TTC
tttcctttcctttttttttt

SEQ ID NO: 67921 - DNA, 20 bp, Artificial Sequence
  Description of Artificial Sequence: Synthetic oligonucleotide
  Target: SCN9A; (-) strand; PAM type: YTN; PAM sequence: TTT
ctttcctttccttttttttt

SEQ ID NO: 67922 - DNA, 20 bp, Artificial Sequence
  Description of Artificial Sequence: Synthetic oligonucleotide
  Target: SCN9A; (-) strand; PAM type: YTN; PAM sequence: TTT
tctttcctttcctttttttt

SEQ ID NO: 67923 - DNA, 20 bp, Artificial Sequence
  Description of Artificial Sequence: Synthetic oligonucleotide
  Target: SCN9A; (-) strand; PAM type: YTN; PAM sequence: TTT
ttctttcctttccttttttt

SEQ ID NO: 67924 - DNA, 20 bp, Artificial Sequence
  Description of Artificial Sequence: Synthetic oligonucleotide
  Target: SCN9A; (-) strand; PAM type: YTN; PAM sequence: TTT
tttctttcctttcctttttt

SEQ ID NO: 67925 - DNA, 20 bp, Artificial Sequence
  Description of Artificial Sequence: Synthetic oligonucleotide
  Target: SCN9A; (-) strand; PAM type: YTN; PAM sequence: CTT
ttttctttcctttccttttt

SEQ ID NO: 67926 - DNA, 20 bp, Artificial Sequence
  Description of Artificial Sequence: Synthetic oligonucleotide
  Target: SCN9A; (-) strand; PAM type: YTN; PAM sequence: TTC
ttttttctttcctttccttt

SEQ ID NO: 67927 - DNA, 20 bp, Artificial Sequence
  Description of Artificial Sequence: Synthetic oligonucleotide
  Target: SCN9A; (-) strand; PAM type: YTN; PAM sequence: TTT
cttttttctttcctttcctt

SEQ ID NO: 67928 - DNA, 20 bp, Artificial Sequence
  Description of Artificial Sequence: Synthetic oligonucleotide
  Target: SCN9A; (-) strand; PAM type: YTN; PAM sequence: TTG
aagtggtcagtggtttcttt

SEQ ID NO: 67929 - DNA, 20 bp, Artificial Sequence
  Description of Artificial Sequence: Synthetic oligonucleotide
  Target: SCN9A; (-) strand; PAM type: YTN; PAM sequence: TTT
gaagtggtcagtggtttctt

SEQ ID NO: 67930 - DNA, 20 bp, Artificial Sequence
  Description of Artificial Sequence: Synthetic oligonucleotide
  Target: SCN9A; (-) strand; PAM type: YTN; PAM sequence: TTT
tgaagtggtcagtggtttct

SEQ ID NO: 67931 - DNA, 20 bp, Artificial Sequence
  Description of Artificial Sequence: Synthetic oligonucleotide
  Target: SCN9A; (-) strand; PAM type: YTN; PAM sequence: CTT
ttgaagtggtcagtggtttc

SEQ ID NO: 67932 - DNA, 20 bp, Artificial Sequence
  Description of Artificial Sequence: Synthetic oligonucleotide
  Target: SCN9A; (-) strand; PAM type: YTN; PAM sequence: CTG
tcttttgaagtggtcagtgg

SEQ ID NO: 67933 - DNA, 20 bp, Artificial Sequence
  Description of Artificial Sequence: Synthetic oligonucleotide
  Target: SCN9A; (-) strand; PAM type: YTN; PAM sequence: TTA
atgaatagtctgtcttttga

SEQ ID NO: 67934 - DNA, 20 bp, Artificial Sequence
  Description of Artificial Sequence: Synthetic oligonucleotide
  Target: SCN9A; (-) strand; PAM type: YTN; PAM sequence: TTT
aatgaatagtctgtcttttg

SEQ ID NO: 67935 - DNA, 20 bp, Artificial Sequence
  Description of Artificial Sequence: Synthetic oligonucleotide
  Target: SCN9A; (-) strand; PAM type: YTN; PAM sequence: TTT
taatgaatagtctgtctttt

SEQ ID NO: 67936 - DNA, 20 bp, Artificial Sequence
  Description of Artificial Sequence: Synthetic oligonucleotide
  Target: SCN9A; (-) strand; PAM type: YTN; PAM sequence: TTT
ttaatgaatagtctgtcttt

SEQ ID NO: 67937 - DNA, 20 bp, Artificial Sequence
  Description of Artificial Sequence: Synthetic oligonucleotide
  Target: SCN9A; (-) strand; PAM type: YTN; PAM sequence: TTA
tggtttttaatgaatagtct

SEQ ID NO: 67938 - DNA, 20 bp, Artificial Sequence
  Description of Artificial Sequence: Synthetic oligonucleotide
  Target: SCN9A; (-) strand; PAM type: YTN; PAM sequence: CTG
ttatggtttttaatgaatag

SEQ ID NO: 67939 - DNA, 20 bp, Artificial Sequence
  Description of Artificial Sequence: Synthetic oligonucleotide
  Target: SCN9A; (-) strand; PAM type: YTN; PAM sequence: TTG
atcatgctgttatggttttt

SEQ ID NO: 67940 - DNA, 20 bp, Artificial Sequence
  Description of Artificial Sequence: Synthetic oligonucleotide
  Target: SCN9A; (-) strand; PAM type: YTN; PAM sequence: TTA
tattgatcatgctgttatgg

SEQ ID NO: 67941 - DNA, 20 bp, Artificial Sequence
  Description of Artificial Sequence: Synthetic oligonucleotide
  Target: SCN9A; (-) strand; PAM type: YTN; PAM sequence: TTA
attatattgatcatgctgtt

SEQ ID NO: 67942 - DNA, 20 bp, Artificial Sequence
  Description of Artificial Sequence: Synthetic oligonucleotide
  Target: SCN9A; (-) strand; PAM type: YTN; PAM sequence: TTA
aattaattatattgatcatg

SEQ ID NO: 67943 - DNA, 20 bp, Artificial Sequence
  Description of Artificial Sequence: Synthetic oligonucleotide
  Target: SCN9A; (-) strand; PAM type: YTN; PAM sequence: TTT
aaattaattatattgatcat

SEQ ID NO: 67944 - DNA, 20 bp, Artificial Sequence
  Description of Artificial Sequence: Synthetic oligonucleotide
  Target: SCN9A; (-) strand; PAM type: YTN; PAM sequence: TTT
taaattaattatattgatca

SEQ ID NO: 67945 - DNA, 20 bp, Artificial Sequence
  Description of Artificial Sequence: Synthetic oligonucleotide
  Target: SCN9A; (-) strand; PAM type: YTN; PAM sequence: TTT
ttaaattaattatattgatc

SEQ ID NO: 67946 - DNA, 20 bp, Artificial Sequence
  Description of Artificial Sequence: Synthetic oligonucleotide
  Target: SCN9A; (-) strand; PAM type: YTN; PAM sequence: TTC
ataatcaatttttaaattaa

SEQ ID NO: 67947 - DNA, 20 bp, Artificial Sequence
  Description of Artificial Sequence: Synthetic oligonucleotide
  Target: SCN9A; (-) strand; PAM type: YTN; PAM sequence: TTT
cataatcaatttttaaatta

SEQ ID NO: 67948 - DNA, 20 bp, Artificial Sequence
  Description of Artificial Sequence: Synthetic oligonucleotide
  Target: SCN9A; (-) strand; PAM type: YTN; PAM sequence: TTT
tcataatcaatttttaaatt

SEQ ID NO: 67949 - DNA, 20 bp, Artificial Sequence
  Description of Artificial Sequence: Synthetic oligonucleotide
  Target: SCN9A; (-) strand; PAM type: YTN; PAM sequence: TTG
ttttcataatcaatttttaa

SEQ ID NO: 67950 - DNA, 20 bp, Artificial Sequence
  Description of Artificial Sequence: Synthetic oligonucleotide
  Target: SCN9A; (-) strand; PAM type: YTN; PAM sequence: CTT
gttttcataatcaattttta

SEQ ID NO: 67951 - DNA, 20 bp, Artificial Sequence
  Description of Artificial Sequence: Synthetic oligonucleotide
  Target: SCN9A; (-) strand; PAM type: YTN; PAM sequence: TTA
agaaatggtgaaaaaagctt

SEQ ID NO: 67952 - DNA, 20 bp, Artificial Sequence
  Description of Artificial Sequence: Synthetic oligonucleotide
  Target: SCN9A; (-) strand; PAM type: YTN; PAM sequence: TTG
atgttaagaaatggtgaaaa

SEQ ID NO: 67953 - DNA, 20 bp, Artificial Sequence
  Description of Artificial Sequence: Synthetic oligonucleotide
  Target: SCN9A; (-) strand; PAM type: YTN; PAM sequence: TTT
gatgttaagaaatggtgaaa

SEQ ID NO: 67954 - DNA, 20 bp, Artificial Sequence
  Description of Artificial Sequence: Synthetic oligonucleotide
  Target: SCN9A; (-) strand; PAM type: YTN; PAM sequence: TTA
tatttgatgttaagaaatgg

SEQ ID NO: 67955 - DNA, 20 bp, Artificial Sequence
  Description of Artificial Sequence: Synthetic oligonucleotide
  Target: SCN9A; (-) strand; PAM type: YTN; PAM sequence: TTA
gttatatttgatgttaagaa

SEQ ID NO: 67956 - DNA, 20 bp, Artificial Sequence
  Description of Artificial Sequence: Synthetic oligonucleotide
  Target: SCN9A; (-) strand; PAM type: YTN; PAM sequence: TTT
agttatatttgatgttaaga

SEQ ID NO: 67957 - DNA, 20 bp, Artificial Sequence
  Description of Artificial Sequence: Synthetic oligonucleotide
  Target: SCN9A; (-) strand; PAM type: YTN; PAM sequence: TTT
tagttatatttgatgttaag

SEQ ID NO: 67958 - DNA, 20 bp, Artificial Sequence
  Description of Artificial Sequence: Synthetic oligonucleotide
  Target: SCN9A; (-) strand; PAM type: YTN; PAM sequence: TTG
ttttagttatatttgatgtt

SEQ ID NO: 67959 - DNA, 20 bp, Artificial Sequence
  Description of Artificial Sequence: Synthetic oligonucleotide
  Target: SCN9A; (-) strand; PAM type: YTN; PAM sequence: TTT
gttttagttatatttgatgt

SEQ ID NO: 67960 - DNA, 20 bp, Artificial Sequence
  Description of Artificial Sequence: Synthetic oligonucleotide
  Target: SCN9A; (-) strand; PAM type: YTN; PAM sequence: TTA
acaaatatttgttttagtta

SEQ ID NO: 67961 - DNA, 20 bp, Artificial Sequence
  Description of Artificial Sequence: Synthetic oligonucleotide
  Target: SCN9A; (-) strand; PAM type: YTN; PAM sequence: TTG
gaaagataatgttaacaaat

SEQ ID NO: 67962 - DNA, 20 bp, Artificial Sequence
  Description of Artificial Sequence: Synthetic oligonucleotide
  Target: SCN9A; (-) strand; PAM type: YTN; PAM sequence: TTT
ggaaagataatgttaacaaa

SEQ ID NO: 67963 - DNA, 20 bp, Artificial Sequence
  Description of Artificial Sequence: Synthetic oligonucleotide
  Target: SCN9A; (-) strand; PAM type: YTN; PAM sequence: TTT
tggaaagataatgttaacaa

SEQ ID NO: 67964 - DNA, 20 bp, Artificial Sequence
  Description of Artificial Sequence: Synthetic oligonucleotide
  Target: SCN9A; (-) strand; PAM type: YTN; PAM sequence: CTT
ttggaaagataatgttaaca

SEQ ID NO: 67965 - DNA, 20 bp, Artificial Sequence
  Description of Artificial Sequence: Synthetic oligonucleotide
  Target: SCN9A; (-) strand; PAM type: YTN; PAM sequence: TTC
ttttggaaagataatgttaa

SEQ ID NO: 67966 - DNA, 20 bp, Artificial Sequence
  Description of Artificial Sequence: Synthetic oligonucleotide
  Target: SCN9A; (-) strand; PAM type: YTN; PAM sequence: TTT
cttttggaaagataatgtta

SEQ ID NO: 67967 - DNA, 20 bp, Artificial Sequence
  Description of Artificial Sequence: Synthetic oligonucleotide
  Target: SCN9A; (-) strand; PAM type: YTN; PAM sequence: CTT
tcttttggaaagataatgtt

SEQ ID NO: 67968 - DNA, 20 bp, Artificial Sequence
  Description of Artificial Sequence: Synthetic oligonucleotide
  Target: SCN9A; (-) strand; PAM type: YTN; PAM sequence: TTC
tttcttttggaaagataatg

SEQ ID NO: 67969 - DNA, 20 bp, Artificial Sequence
  Description of Artificial Sequence: Synthetic oligonucleotide
  Target: SCN9A; (-) strand; PAM type: YTN; PAM sequence: TTT
ctttcttttggaaagataat

SEQ ID NO: 67970 - DNA, 20 bp, Artificial Sequence
  Description of Artificial Sequence: Synthetic oligonucleotide
  Target: SCN9A; (-) strand; PAM type: YTN; PAM sequence: TTT
tctttcttttggaaagataa

SEQ ID NO: 67971 - DNA, 20 bp, Artificial Sequence
  Description of Artificial Sequence: Synthetic oligonucleotide
  Target: SCN9A; (-) strand; PAM type: YTN; PAM sequence: TTT
ttctttcttttggaaagata

SEQ ID NO: 67972 - DNA, 20 bp, Artificial Sequence
  Description of Artificial Sequence: Synthetic oligonucleotide
  Target: SCN9A; (-) strand; PAM type: YTN; PAM sequence: TTT
tttctttcttttggaaagat

SEQ ID NO: 67973 - DNA, 20 bp, Artificial Sequence
  Description of Artificial Sequence: Synthetic oligonucleotide
  Target: SCN9A; (-) strand; PAM type: YTN; PAM sequence: TTA
ttttttctttcttttggaaa

SEQ ID NO: 67974 - DNA, 20 bp, Artificial Sequence
  Description of Artificial Sequence: Synthetic oligonucleotide
  Target: SCN9A; (-) strand; PAM type: YTN; PAM sequence: TTT
attttttctttcttttggaa

SEQ ID NO: 67975 - DNA, 20 bp, Artificial Sequence
  Description of Artificial Sequence: Synthetic oligonucleotide
  Target: SCN9A; (-) strand; PAM type: YTN; PAM sequence: TTT
tattttttctttcttttgga

SEQ ID NO: 67976 - DNA, 20 bp, Artificial Sequence
  Description of Artificial Sequence: Synthetic oligonucleotide
  Target: SCN9A; (-) strand; PAM type: YTN; PAM sequence: CTT
ttattttttctttcttttgg

SEQ ID NO: 67977 - DNA, 20 bp, Artificial Sequence
  Description of Artificial Sequence: Synthetic oligonucleotide
  Target: SCN9A; (-) strand; PAM type: YTN; PAM sequence: TTG
tgacttttattttttctttc

SEQ ID NO: 67978 - DNA, 20 bp, Artificial Sequence
  Description of Artificial Sequence: Synthetic oligonucleotide
  Target: SCN9A; (-) strand; PAM type: YTN; PAM sequence: TTT
gtgacttttattttttcttt

SEQ ID NO: 67979 - DNA, 20 bp, Artificial Sequence
  Description of Artificial Sequence: Synthetic oligonucleotide
  Target: SCN9A; (-) strand; PAM type: YTN; PAM sequence: CTT
tgtgacttttattttttctt

SEQ ID NO: 67980 - DNA, 20 bp, Artificial Sequence
  Description of Artificial Sequence: Synthetic oligonucleotide
  Target: SCN9A; (-) strand; PAM type: YTN; PAM sequence: CTC
ctttgtgacttttatttttt

SEQ ID NO: 67981 - DNA, 20 bp, Artificial Sequence
  Description of Artificial Sequence: Synthetic oligonucleotide
  Target: SCN9A; (-) strand; PAM type: YTN; PAM sequence: TTA
gtaacacaataaccaactcc

SEQ ID NO: 67982 - DNA, 20 bp, Artificial Sequence
  Description of Artificial Sequence: Synthetic oligonucleotide
  Target: SCN9A; (-) strand; PAM type: YTN; PAM sequence: TTT
agtaacacaataaccaactc

SEQ ID NO: 67983 - DNA, 20 bp, Artificial Sequence
  Description of Artificial Sequence: Synthetic oligonucleotide
  Target: SCN9A; (-) strand; PAM type: YTN; PAM sequence: CTT
tagtaacacaataaccaact

SEQ ID NO: 67984 - DNA, 20 bp, Artificial Sequence
  Description of Artificial Sequence: Synthetic oligonucleotide
  Target: SCN9A; (-) strand; PAM type: YTN; PAM sequence: CTA
actttagtaacacaataacc

SEQ ID NO: 67985 - DNA, 20 bp, Artificial Sequence
  Description of Artificial Sequence: Synthetic oligonucleotide
  Target: SCN9A; (-) strand; PAM type: YTN; PAM sequence: TTC
taactttagtaacacaataa

SEQ ID NO: 67986 - DNA, 20 bp, Artificial Sequence
  Description of Artificial Sequence: Synthetic oligonucleotide
  Target: SCN9A; (-) strand; PAM type: YTN; PAM sequence: TTA
attctaactttagtaacaca

SEQ ID NO: 67987 - DNA, 20 bp, Artificial Sequence
  Description of Artificial Sequence: Synthetic oligonucleotide
  Target: SCN9A; (-) strand; PAM type: YTN; PAM sequence: CTA
ataattaattctaactttag

SEQ ID NO: 67988 - DNA, 20 bp, Artificial Sequence
  Description of Artificial Sequence: Synthetic oligonucleotide
  Target: SCN9A; (-) strand; PAM type: YTN; PAM sequence: CTA
taaaataactaataattaat

SEQ ID NO: 67989 - DNA, 20 bp, Artificial Sequence
  Description of Artificial Sequence: Synthetic oligonucleotide
  Target: SCN9A; (-) strand; PAM type: YTN; PAM sequence: TTC
ctataaaataactaataatt

SEQ ID NO: 67990 - DNA, 20 bp, Artificial Sequence
  Description of Artificial Sequence: Synthetic oligonucleotide
  Target: SCN9A; (-) strand; PAM type: YTN; PAM sequence: CTT
cctataaaataactaataat

SEQ ID NO: 67991 - DNA, 20 bp, Artificial Sequence
  Description of Artificial Sequence: Synthetic oligonucleotide
  Target: SCN9A; (-) strand; PAM type: YTN; PAM sequence: TTC
acccccttcctataaaataa

SEQ ID NO: 67992 - DNA, 20 bp, Artificial Sequence
  Description of Artificial Sequence: Synthetic oligonucleotide
  Target: SCN9A; (-) strand; PAM type: YTN; PAM sequence: TTG
tattcacccccttcctataa

SEQ ID NO: 67993 - DNA, 20 bp, Artificial Sequence
  Description of Artificial Sequence: Synthetic oligonucleotide
  Target: SCN9A; (-) strand; PAM type: YTN; PAM sequence: TTT
gtattcacccccttcctata

SEQ ID NO: 67994 - DNA, 20 bp, Artificial Sequence
  Description of Artificial Sequence: Synthetic oligonucleotide
  Target: SCN9A; (-) strand; PAM type: YTN; PAM sequence: TTT
tgtattcacccccttcctat

SEQ ID NO: 67995 - DNA, 20 bp, Artificial Sequence
  Description of Artificial Sequence: Synthetic oligonucleotide
  Target: SCN9A; (-) strand; PAM type: YTN; PAM sequence: TTC
aaaatgttttgtattcaccc

SEQ ID NO: 67996 - DNA, 20 bp, Artificial Sequence
  Description of Artificial Sequence: Synthetic oligonucleotide
  Target: SCN9A; (-) strand; PAM type: YTN; PAM sequence: TTT
caaaatgttttgtattcacc

SEQ ID NO: 67997 - DNA, 20 bp, Artificial Sequence
  Description of Artificial Sequence: Synthetic oligonucleotide
  Target: SCN9A; (-) strand; PAM type: YTN; PAM sequence: CTT
tcaaaatgttttgtattcac

SEQ ID NO: 67998 - DNA, 20 bp, Artificial Sequence
  Description of Artificial Sequence: Synthetic oligonucleotide
  Target: SCN9A; (-) strand; PAM type: YTN; PAM sequence: TTC
ctttcaaaatgttttgtatt

SEQ ID NO: 67999 - DNA, 20 bp, Artificial Sequence
  Description of Artificial Sequence: Synthetic oligonucleotide
  Target: SCN9A; (-) strand; PAM type: YTN; PAM sequence: CTT
cctttcaaaatgttttgtat

SEQ ID NO: 68000 - DNA, 20 bp, Artificial Sequence
  Description of Artificial Sequence: Synthetic oligonucleotide
  Target: SCN9A; (-) strand; PAM type: YTN; PAM sequence: TTG
gtaggagaagccaaatcatc

SEQ ID NO: 68001 - DNA, 20 bp, Artificial Sequence
  Description of Artificial Sequence: Synthetic oligonucleotide
  Target: SCN9A; (-) strand; PAM type: YTN; PAM sequence: CTT
ggtaggagaagccaaatcat

SEQ ID NO: 68002 - DNA, 20 bp, Artificial Sequence
  Description of Artificial Sequence: Synthetic oligonucleotide
  Target: SCN9A; (-) strand; PAM type: YTN; PAM sequence: TTA
acttggtaggagaagccaaa

SEQ ID NO: 68003 - DNA, 20 bp, Artificial Sequence
  Description of Artificial Sequence: Synthetic oligonucleotide
  Target: SCN9A; (-) strand; PAM type: YTN; PAM sequence: CTG
ttaacttggtaggagaagcc

SEQ ID NO: 68004 - DNA, 20 bp, Artificial Sequence
  Description of Artificial Sequence: Synthetic oligonucleotide
  Target: SCN9A; (-) strand; PAM type: YTN; PAM sequence: TTC
tgttaacttggtaggagaag

SEQ ID NO: 68005 - DNA, 20 bp, Artificial Sequence
  Description of Artificial Sequence: Synthetic oligonucleotide
  Target: SCN9A; (-) strand; PAM type: YTN; PAM sequence: TTT
ctgttaacttggtaggagaa

SEQ ID NO: 68006 - DNA, 20 bp, Artificial Sequence
  Description of Artificial Sequence: Synthetic oligonucleotide
  Target: SCN9A; (-) strand; PAM type: YTN; PAM sequence: TTT
tctgttaacttggtaggaga

SEQ ID NO: 68007 - DNA, 20 bp, Artificial Sequence
  Description of Artificial Sequence: Synthetic oligonucleotide
  Target: SCN9A; (-) strand; PAM type: YTN; PAM sequence: TTT
ttctgttaacttggtaggag

SEQ ID NO: 68008 - DNA, 20 bp, Artificial Sequence
  Description of Artificial Sequence: Synthetic oligonucleotide
  Target: SCN9A; (-) strand; PAM type: YTN; PAM sequence: CTC
aaaaaataataatggtaata

SEQ ID NO: 68009 - DNA, 20 bp, Artificial Sequence
  Description of Artificial Sequence: Synthetic oligonucleotide
  Target: SCN9A; (-) strand; PAM type: YTN; PAM sequence: CTG
tctcaaaaaataataatggt

SEQ ID NO: 68010 - DNA, 20 bp, Artificial Sequence
  Description of Artificial Sequence: Synthetic oligonucleotide
  Target: SCN9A; (-) strand; PAM type: YTN; PAM sequence: CTC
tgtctcaaaaaataataatg

SEQ ID NO: 68011 - DNA, 20 bp, Artificial Sequence
  Description of Artificial Sequence: Synthetic oligonucleotide
  Target: SCN9A; (-) strand; PAM type: YTN; PAM sequence: CTG
gcaacaaagtgagactctgt

SEQ ID NO: 68012 - DNA, 20 bp, Artificial Sequence
  Description of Artificial Sequence: Synthetic oligonucleotide
  Target: SCN9A; (-) strand; PAM type: YTN; PAM sequence: CTC
cagcctggcaacaaagtgag

SEQ ID NO: 68013 - DNA, 20 bp, Artificial Sequence
  Description of Artificial Sequence: Synthetic oligonucleotide
  Target: SCN9A; (-) strand; PAM type: YTN; PAM sequence: CTG
cactccagcctggcaacaaa

SEQ ID NO: 68014 - DNA, 20 bp, Artificial Sequence
  Description of Artificial Sequence: Synthetic oligonucleotide
  Target: SCN9A; (-) strand; PAM type: YTN; PAM sequence: CTA
ctgcactccagcctggcaac

SEQ ID NO: 68015 - DNA, 20 bp, Artificial Sequence
  Description of Artificial Sequence: Synthetic oligonucleotide
  Target: SCN9A; (-) strand; PAM type: YTN; PAM sequence: CTG
ctactgcactccagcctggc

SEQ ID NO: 68016 - DNA, 20 bp, Artificial Sequence
  Description of Artificial Sequence: Synthetic oligonucleotide
  Target: SCN9A; (-) strand; PAM type: YTN; PAM sequence: CTG
agatcctgctactgcactcc

SEQ ID NO: 68017 - DNA, 20 bp, Artificial Sequence
  Description of Artificial Sequence: Synthetic oligonucleotide
  Target: SCN9A; (-) strand; PAM type: YTN; PAM sequence: TTG
cagtgagctgagatcctgct

SEQ ID NO: 68018 - DNA, 20 bp, Artificial Sequence
  Description of Artificial Sequence: Synthetic oligonucleotide
  Target: SCN9A; (-) strand; PAM type: YTN; PAM sequence: TTG
aacccaggaggcagaggttg

SEQ ID NO: 68019 - DNA, 20 bp, Artificial Sequence
  Description of Artificial Sequence: Synthetic oligonucleotide
  Target: SCN9A; (-) strand; PAM type: YTN; PAM sequence: CTT
gaacccaggaggcagaggtt

SEQ ID NO: 68020 - DNA, 20 bp, Artificial Sequence
  Description of Artificial Sequence: Synthetic oligonucleotide
  Target: SCN9A; (-) strand; PAM type: YTN; PAM sequence: CTG
aggcaggagaatcgcttgaa

SEQ ID NO: 68021 - DNA, 20 bp, Artificial Sequence
  Description of Artificial Sequence: Synthetic oligonucleotide
  Target: SCN9A; (-) strand; PAM type: YTN; PAM sequence: CTC
aagaggctgaggcaggagaa

SEQ ID NO: 68022 - DNA, 20 bp, Artificial Sequence
  Description of Artificial Sequence: Synthetic oligonucleotide
  Target: SCN9A; (-) strand; PAM type: YTN; PAM sequence: CTA
ctcaagaggctgaggcagga

SEQ ID NO: 68023 - DNA, 20 bp, Artificial Sequence
  Description of Artificial Sequence: Synthetic oligonucleotide
  Target: SCN9A; (-) strand; PAM type: YTN; PAM sequence: CTG
tagtcccagctactcaagag

SEQ ID NO: 68024 - DNA, 20 bp, Artificial Sequence
  Description of Artificial Sequence: Synthetic oligonucleotide
  Target: SCN9A; (-) strand; PAM type: YTN; PAM sequence: CTG
gtggtgagcgcctgtagtcc

SEQ ID NO: 68025 - DNA, 20 bp, Artificial Sequence
  Description of Artificial Sequence: Synthetic oligonucleotide
  Target: SCN9A; (-) strand; PAM type: YTN; PAM sequence: CTG
agcctggtggtgagcgcctg

SEQ ID NO: 68026 - DNA, 20 bp, Artificial Sequence
  Description of Artificial Sequence: Synthetic oligonucleotide
  Target: SCN9A; (-) strand; PAM type: YTN; PAM sequence: TTA
gctgagcctggtggtgagcg

SEQ ID NO: 68027 - DNA, 20 bp, Artificial Sequence
  Description of Artificial Sequence: Synthetic oligonucleotide
  Target: SCN9A; (-) strand; PAM type: YTN; PAM sequence: CTA
aaaatacaaaaattagctga

SEQ ID NO: 68028 - DNA, 20 bp, Artificial Sequence
  Description of Artificial Sequence: Synthetic oligonucleotide
  Target: SCN9A; (-) strand; PAM type: YTN; PAM sequence: CTA
ctaaaaatacaaaaattagc

SEQ ID NO: 68029 - DNA, 20 bp, Artificial Sequence
  Description of Artificial Sequence: Synthetic oligonucleotide
  Target: SCN9A; (-) strand; PAM type: YTN; PAM sequence: TTC
tactaaaaatacaaaaatta

SEQ ID NO: 68030 - DNA, 20 bp, Artificial Sequence
  Description of Artificial Sequence: Synthetic oligonucleotide
  Target: SCN9A; (-) strand; PAM type: YTN; PAM sequence: TTT
ctactaaaaatacaaaaatt

SEQ ID NO: 68031 - DNA, 20 bp, Artificial Sequence
  Description of Artificial Sequence: Synthetic oligonucleotide
  Target: SCN9A; (-) strand; PAM type: YTN; PAM sequence: CTA
acatggtgaaatcccgtttc

SEQ ID NO: 68032 - DNA, 20 bp, Artificial Sequence
  Description of Artificial Sequence: Synthetic oligonucleotide
  Target: SCN9A; (-) strand; PAM type: YTN; PAM sequence: CTG
gctaacatggtgaaatcccg

SEQ ID NO: 68033 - DNA, 20 bp, Artificial Sequence
  Description of Artificial Sequence: Synthetic oligonucleotide
  Target: SCN9A; (-) strand; PAM type: YTN; PAM sequence: TTC
acaaggtcaagagatcgaga

SEQ ID NO: 68034 - DNA, 20 bp, Artificial Sequence
  Description of Artificial Sequence: Synthetic oligonucleotide
  Target: SCN9A; (-) strand; PAM type: YTN; PAM sequence: TTT
cacaaggtcaagagatcgag

SEQ ID NO: 68035 - DNA, 20 bp, Artificial Sequence
  Description of Artificial Sequence: Synthetic oligonucleotide
  Target: SCN9A; (-) strand; PAM type: YTN; PAM sequence: TTT
tcacaaggtcaagagatcga

SEQ ID NO: 68036 - DNA, 20 bp, Artificial Sequence
  Description of Artificial Sequence: Synthetic oligonucleotide
  Target: SCN9A; (-) strand; PAM type: YTN; PAM sequence: TTT
ttcacaaggtcaagagatcg

SEQ ID NO: 68037 - DNA, 20 bp, Artificial Sequence
  Description of Artificial Sequence: Synthetic oligonucleotide
  Target: SCN9A; (-) strand; PAM type: YTN; PAM sequence: CTT
tttcacaaggtcaagagatc

SEQ ID NO: 68038 - DNA, 20 bp, Artificial Sequence
  Description of Artificial Sequence: Synthetic oligonucleotide
  Target: SCN9A; (-) strand; PAM type: YTN; PAM sequence: TTA
gcgaaaaataacctttttca

SEQ ID NO: 68039 - DNA, 20 bp, Artificial Sequence
  Description of Artificial Sequence: Synthetic oligonucleotide
  Target: SCN9A; (-) strand; PAM type: YTN; PAM sequence: TTA
gagttagcgaaaaataacct

SEQ ID NO: 68040 - DNA, 20 bp, Artificial Sequence
  Description of Artificial Sequence: Synthetic oligonucleotide
  Target: SCN9A; (-) strand; PAM type: YTN; PAM sequence: TTA
cataatcaggattagagtta

SEQ ID NO: 68041 - DNA, 20 bp, Artificial Sequence
  Description of Artificial Sequence: Synthetic oligonucleotide
  Target: SCN9A; (-) strand; PAM type: YTN; PAM sequence: TTA
gtaaattacataatcaggat

SEQ ID NO: 68042 - DNA, 20 bp, Artificial Sequence
  Description of Artificial Sequence: Synthetic oligonucleotide
  Target: SCN9A; (-) strand; PAM type: YTN; PAM sequence: TTA
tcaaattagtaaattacata

SEQ ID NO: 68043 - DNA, 20 bp, Artificial Sequence
  Description of Artificial Sequence: Synthetic oligonucleotide
  Target: SCN9A; (-) strand; PAM type: YTN; PAM sequence: TTA
gattatcaaattagtaaatt

SEQ ID NO: 68044 - DNA, 20 bp, Artificial Sequence
  Description of Artificial Sequence: Synthetic oligonucleotide
  Target: SCN9A; (-) strand; PAM type: YTN; PAM sequence: TTT
agattatcaaattagtaaat

SEQ ID NO: 68045 - DNA, 20 bp, Artificial Sequence
  Description of Artificial Sequence: Synthetic oligonucleotide
  Target: SCN9A; (-) strand; PAM type: YTN; PAM sequence: TTT
tagattatcaaattagtaaa

SEQ ID NO: 68046 - DNA, 20 bp, Artificial Sequence
  Description of Artificial Sequence: Synthetic oligonucleotide
  Target: SCN9A; (-) strand; PAM type: YTN; PAM sequence: CTT
ttagattatcaaattagtaa

SEQ ID NO: 68047 - DNA, 20 bp, Artificial Sequence
  Description of Artificial Sequence: Synthetic oligonucleotide
  Target: SCN9A; (-) strand; PAM type: YTN; PAM sequence: CTG
cttttagattatcaaattag

SEQ ID NO: 68048 - DNA, 20 bp, Artificial Sequence
  Description of Artificial Sequence: Synthetic oligonucleotide
  Target: SCN9A; (-) strand; PAM type: YTN; PAM sequence: TTG
tgctgcttttagattatcaa

SEQ ID NO: 68049 - DNA, 20 bp, Artificial Sequence
  Description of Artificial Sequence: Synthetic oligonucleotide
  Target: SCN9A; (-) strand; PAM type: YTN; PAM sequence: TTA
tattgtgctgcttttagatt

SEQ ID NO: 68050 - DNA, 20 bp, Artificial Sequence
  Description of Artificial Sequence: Synthetic oligonucleotide
  Target: SCN9A; (-) strand; PAM type: YTN; PAM sequence: TTT
atattgtgctgcttttagat

SEQ ID NO: 68051 - DNA, 20 bp, Artificial Sequence
  Description of Artificial Sequence: Synthetic oligonucleotide
  Target: SCN9A; (-) strand; PAM type: YTN; PAM sequence: TTT
tatattgtgctgcttttaga

SEQ ID NO: 68052 - DNA, 20 bp, Artificial Sequence
  Description of Artificial Sequence: Synthetic oligonucleotide
  Target: SCN9A; (-) strand; PAM type: YTN; PAM sequence: CTA
tgtggttttatattgtgctg

SEQ ID NO: 68053 - DNA, 20 bp, Artificial Sequence
  Description of Artificial Sequence: Synthetic oligonucleotide
  Target: SCN9A; (-) strand; PAM type: YTN; PAM sequence: TTG
ggtctatgtggttttatatt

SEQ ID NO: 68054 - DNA, 20 bp, Artificial Sequence
  Description of Artificial Sequence: Synthetic oligonucleotide
  Target: SCN9A; (-) strand; PAM type: YTN; PAM sequence: TTT
gggtctatgtggttttatat

SEQ ID NO: 68055 - DNA, 20 bp, Artificial Sequence
  Description of Artificial Sequence: Synthetic oligonucleotide
  Target: SCN9A; (-) strand; PAM type: YTN; PAM sequence: CTT
tgggtctatgtggttttata

SEQ ID NO: 68056 - DNA, 20 bp, Artificial Sequence
  Description of Artificial Sequence: Synthetic oligonucleotide
  Target: SCN9A; (-) strand; PAM type: YTN; PAM sequence: CTC
tttgggtctatgtggtttta

SEQ ID NO: 68057 - DNA, 20 bp, Artificial Sequence
  Description of Artificial Sequence: Synthetic oligonucleotide
  Target: SCN9A; (-) strand; PAM type: YTN; PAM sequence: TTA
tgaacatgacatgactcttt

SEQ ID NO: 68058 - DNA, 20 bp, Artificial Sequence
  Description of Artificial Sequence: Synthetic oligonucleotide
  Target: SCN9A; (-) strand; PAM type: YTN; PAM sequence: CTA
tataattatgaacatgacat

SEQ ID NO: 68059 - DNA, 20 bp, Artificial Sequence
  Description of Artificial Sequence: Synthetic oligonucleotide
  Target: SCN9A; (-) strand; PAM type: YTN; PAM sequence: TTG
gcaacctatataattatgaa

SEQ ID NO: 68060 - DNA, 20 bp, Artificial Sequence
  Description of Artificial Sequence: Synthetic oligonucleotide
  Target: SCN9A; (-) strand; PAM type: YTN; PAM sequence: CTT
ggcaacctatataattatga

SEQ ID NO: 68061 - DNA, 20 bp, Artificial Sequence
  Description of Artificial Sequence: Synthetic oligonucleotide
  Target: SCN9A; (-) strand; PAM type: YTN; PAM sequence: CTA
catgacttggcaacctatat

SEQ ID NO: 68062 - DNA, 20 bp, Artificial Sequence
  Description of Artificial Sequence: Synthetic oligonucleotide
  Target: SCN9A; (-) strand; PAM type: YTN; PAM sequence: TTC
tacatgacttggcaacctat

SEQ ID NO: 68063 - DNA, 20 bp, Artificial Sequence
  Description of Artificial Sequence: Synthetic oligonucleotide
  Target: SCN9A; (-) strand; PAM type: YTN; PAM sequence: TTA
gttctacatgacttggcaac

SEQ ID NO: 68064 - DNA, 20 bp, Artificial Sequence
  Description of Artificial Sequence: Synthetic oligonucleotide
  Target: SCN9A; (-) strand; PAM type: YTN; PAM sequence: CTT
agttctacatgacttggcaa

SEQ ID NO: 68065 - DNA, 20 bp, Artificial Sequence
  Description of Artificial Sequence: Synthetic oligonucleotide
  Target: SCN9A; (-) strand; PAM type: YTN; PAM sequence: CTA
tccttagttctacatgactt

SEQ ID NO: 68066 - DNA, 20 bp, Artificial Sequence
  Description of Artificial Sequence: Synthetic oligonucleotide
  Target: SCN9A; (-) strand; PAM type: YTN; PAM sequence: TTA
ctatccttagttctacatga

SEQ ID NO: 68067 - DNA, 20 bp, Artificial Sequence
  Description of Artificial Sequence: Synthetic oligonucleotide
  Target: SCN9A; (-) strand; PAM type: YTN; PAM sequence: TTT
actatccttagttctacatg

SEQ ID NO: 68068 - DNA, 20 bp, Artificial Sequence
  Description of Artificial Sequence: Synthetic oligonucleotide
  Target: SCN9A; (-) strand; PAM type: YTN; PAM sequence: CTT
tactatccttagttctacat

SEQ ID NO: 68069 - DNA, 20 bp, Artificial Sequence
  Description of Artificial Sequence: Synthetic oligonucleotide
  Target: SCN9A; (-) strand; PAM type: YTN; PAM sequence: TTC
tttactatccttagttctac

SEQ ID NO: 68070 - DNA, 20 bp, Artificial Sequence
  Description of Artificial Sequence: Synthetic oligonucleotide
  Target: SCN9A; (-) strand; PAM type: YTN; PAM sequence: CTG
ttctttactatccttagttc

SEQ ID NO: 68071 - DNA, 20 bp, Artificial Sequence
  Description of Artificial Sequence: Synthetic oligonucleotide
  Target: SCN9A; (-) strand; PAM type: YTN; PAM sequence: TTG
ccctgttctttactatcctt

SEQ ID NO: 68072 - DNA, 20 bp, Artificial Sequence
  Description of Artificial Sequence: Synthetic oligonucleotide
  Target: SCN9A; (-) strand; PAM type: YTN; PAM sequence: CTT
gccctgttctttactatcct

SEQ ID NO: 68073 - DNA, 20 bp, Artificial Sequence
  Description of Artificial Sequence: Synthetic oligonucleotide
  Target: SCN9A; (-) strand; PAM type: YTN; PAM sequence: TTC
cgtatatcttgccctgttct

SEQ ID NO: 68074 - DNA, 20 bp, Artificial Sequence
  Description of Artificial Sequence: Synthetic oligonucleotide
  Target: SCN9A; (-) strand; PAM type: YTN; PAM sequence: CTT
ccgtatatcttgccctgttc

SEQ ID NO: 68075 - DNA, 20 bp, Artificial Sequence
  Description of Artificial Sequence: Synthetic oligonucleotide
  Target: SCN9A; (-) strand; PAM type: YTN; PAM sequence: CTG
cttccgtatatcttgccctg

SEQ ID NO: 68076 - DNA, 20 bp, Artificial Sequence
  Description of Artificial Sequence: Synthetic oligonucleotide
  Target: SCN9A; (-) strand; PAM type: YTN; PAM sequence: TTC
agactgcttccgtatatctt

SEQ ID NO: 68077 - DNA, 20 bp, Artificial Sequence
  Description of Artificial Sequence: Synthetic oligonucleotide
  Target: SCN9A; (-) strand; PAM type: YTN; PAM sequence: CTT
cagactgcttccgtatatct

SEQ ID NO: 68078 - DNA, 20 bp, Artificial Sequence
  Description of Artificial Sequence: Synthetic oligonucleotide
  Target: SCN9A; (-) strand; PAM type: YTN; PAM sequence: TTG
aagacttcagactgcttccg

SEQ ID NO: 68079 - DNA, 20 bp, Artificial Sequence
  Description of Artificial Sequence: Synthetic oligonucleotide
  Target: SCN9A; (-) strand; PAM type: YTN; PAM sequence: TTT
gaagacttcagactgcttcc

SEQ ID NO: 68080 - DNA, 20 bp, Artificial Sequence
  Description of Artificial Sequence: Synthetic oligonucleotide
  Target: SCN9A; (-) strand; PAM type: YTN; PAM sequence: TTG
tatttgaagacttcagactg

SEQ ID NO: 68081 - DNA, 20 bp, Artificial Sequence
  Description of Artificial Sequence: Synthetic oligonucleotide
  Target: SCN9A; (-) strand; PAM type: YTN; PAM sequence: TTT
gtatttgaagacttcagact

SEQ ID NO: 68082 - DNA, 20 bp, Artificial Sequence
  Description of Artificial Sequence: Synthetic oligonucleotide
  Target: SCN9A; (-) strand; PAM type: YTN; PAM sequence: CTT
tgtatttgaagacttcagac

SEQ ID NO: 68083 - DNA, 20 bp, Artificial Sequence
  Description of Artificial Sequence: Synthetic oligonucleotide
  Target: SCN9A; (-) strand; PAM type: YTN; PAM sequence: TTA
ctttgtatttgaagacttca

SEQ ID NO: 68084 - DNA, 20 bp, Artificial Sequence
  Description of Artificial Sequence: Synthetic oligonucleotide
  Target: SCN9A; (-) strand; PAM type: YTN; PAM sequence: CTA
ttactttgtatttgaagact

SEQ ID NO: 68085 - DNA, 20 bp, Artificial Sequence
  Description of Artificial Sequence: Synthetic oligonucleotide
  Target: SCN9A; (-) strand; PAM type: YTN; PAM sequence: CTG
tgtctattactttgtatttg

SEQ ID NO: 68086 - DNA, 20 bp, Artificial Sequence
  Description of Artificial Sequence: Synthetic oligonucleotide
  Target: SCN9A; (-) strand; PAM type: YTN; PAM sequence: CTC
tgtgtctattactttgtatt

SEQ ID NO: 68087 - DNA, 20 bp, Artificial Sequence
  Description of Artificial Sequence: Synthetic oligonucleotide
  Target: SCN9A; (-) strand; PAM type: YTN; PAM sequence: TTA
gctctgtgtctattactttg

SEQ ID NO: 68088 - DNA, 20 bp, Artificial Sequence
  Description of Artificial Sequence: Synthetic oligonucleotide
  Target: SCN9A; (-) strand; PAM type: YTN; PAM sequence: CTT
agctctgtgtctattacttt

SEQ ID NO: 68089 - DNA, 20 bp, Artificial Sequence
  Description of Artificial Sequence: Synthetic oligonucleotide
  Target: SCN9A; (-) strand; PAM type: YTN; PAM sequence: TTC
cttagctctgtgtctattac

SEQ ID NO: 68090 - DNA, 20 bp, Artificial Sequence
  Description of Artificial Sequence: Synthetic oligonucleotide
  Target: SCN9A; (-) strand; PAM type: YTN; PAM sequence: TTG
ttccttagctctgtgtctat

SEQ ID NO: 68091 - DNA, 20 bp, Artificial Sequence
  Description of Artificial Sequence: Synthetic oligonucleotide
  Target: SCN9A; (-) strand; PAM type: YTN; PAM sequence: TTA
tgcaaggttgttccttagct

SEQ ID NO: 68092 - DNA, 20 bp, Artificial Sequence
  Description of Artificial Sequence: Synthetic oligonucleotide
  Target: SCN9A; (-) strand; PAM type: YTN; PAM sequence: CTT
atgcaaggttgttccttagc

SEQ ID NO: 68093 - DNA, 20 bp, Artificial Sequence
  Description of Artificial Sequence: Synthetic oligonucleotide
  Target: SCN9A; (-) strand; PAM type: YTN; PAM sequence: CTC
ttatgcaaggttgttcctta

SEQ ID NO: 68094 - DNA, 20 bp, Artificial Sequence
  Description of Artificial Sequence: Synthetic oligonucleotide
  Target: SCN9A; (-) strand; PAM type: YTN; PAM sequence: CTC
cctcttatgcaaggttgttc

SEQ ID NO: 68095 - DNA, 20 bp, Artificial Sequence
  Description of Artificial Sequence: Synthetic oligonucleotide
  Target: SCN9A; (-) strand; PAM type: YTN; PAM sequence: CTC
tccctcttatgcaaggttgt

SEQ ID NO: 68096 - DNA, 20 bp, Artificial Sequence
  Description of Artificial Sequence: Synthetic oligonucleotide
  Target: SCN9A; (-) strand; PAM type: YTN; PAM sequence: TTC
tctccctcttatgcaaggtt

SEQ ID NO: 68097 - DNA, 20 bp, Artificial Sequence
  Description of Artificial Sequence: Synthetic oligonucleotide
  Target: SCN9A; (-) strand; PAM type: YTN; PAM sequence: TTT
ctctccctcttatgcaaggt

SEQ ID NO: 68098 - DNA, 20 bp, Artificial Sequence
  Description of Artificial Sequence: Synthetic oligonucleotide
  Target: SCN9A; (-) strand; PAM type: YTN; PAM sequence: TTT
tctctccctcttatgcaagg

SEQ ID NO: 68099 - DNA, 20 bp, Artificial Sequence
  Description of Artificial Sequence: Synthetic oligonucleotide
  Target: SCN9A; (-) strand; PAM type: YTN; PAM sequence: CTT
ttctctccctcttatgcaag

SEQ ID NO: 68100 - DNA, 20 bp, Artificial Sequence
  Description of Artificial Sequence: Synthetic oligonucleotide
  Target: SCN9A; (-) strand; PAM type: YTN; PAM sequence: TTC
accttttctctccctcttat

SEQ ID NO: 68101 - DNA, 20 bp, Artificial Sequence
  Description of Artificial Sequence: Synthetic oligonucleotide
  Target: SCN9A; (-) strand; PAM type: YTN; PAM sequence: TTA
ttcaccttttctctccctct

SEQ ID NO: 68102 - DNA, 20 bp, Artificial Sequence
  Description of Artificial Sequence: Synthetic oligonucleotide
  Target: SCN9A; (-) strand; PAM type: YTN; PAM sequence: CTT
attcaccttttctctccctc

SEQ ID NO: 68103 - DNA, 20 bp, Artificial Sequence
  Description of Artificial Sequence: Synthetic oligonucleotide
  Target: SCN9A; (-) strand; PAM type: YTN; PAM sequence: CTC
ttattcaccttttctctccc

SEQ ID NO: 68104 - DNA, 20 bp, Artificial Sequence
  Description of Artificial Sequence: Synthetic oligonucleotide
  Target: SCN9A; (-) strand; PAM type: YTN; PAM sequence: TTC
ctcttattcaccttttctct

SEQ ID NO: 68105 - DNA, 20 bp, Artificial Sequence
  Description of Artificial Sequence: Synthetic oligonucleotide
  Target: SCN9A; (-) strand; PAM type: YTN; PAM sequence: CTG
gttcctcttattcacctttt

SEQ ID NO: 68106 - DNA, 20 bp, Artificial Sequence
  Description of Artificial Sequence: Synthetic oligonucleotide
  Target: SCN9A; (-) strand; PAM type: YTN; PAM sequence: TTG
catctggttcctcttattca

SEQ ID NO: 68107 - DNA, 20 bp, Artificial Sequence
  Description of Artificial Sequence: Synthetic oligonucleotide
  Target: SCN9A; (-) strand; PAM type: YTN; PAM sequence: TTG
attgcatctggttcctctta

SEQ ID NO: 68108 - DNA, 20 bp, Artificial Sequence
  Description of Artificial Sequence: Synthetic oligonucleotide
  Target: SCN9A; (-) strand; PAM type: YTN; PAM sequence: TTC
attgattgcatctggttcct

SEQ ID NO: 68109 - DNA, 20 bp, Artificial Sequence
  Description of Artificial Sequence: Synthetic oligonucleotide
  Target: SCN9A; (-) strand; PAM type: YTN; PAM sequence: TTT
cattgattgcatctggttcc

SEQ ID NO: 68110 - DNA, 20 bp, Artificial Sequence
  Description of Artificial Sequence: Synthetic oligonucleotide
  Target: SCN9A; (-) strand; PAM type: YTN; PAM sequence: CTA
atgtatttcattgattgcat

SEQ ID NO: 68111 - DNA, 20 bp, Artificial Sequence
  Description of Artificial Sequence: Synthetic oligonucleotide
  Target: SCN9A; (-) strand; PAM type: YTN; PAM sequence: TTA
ctaatgtatttcattgattg

SEQ ID NO: 68112 - DNA, 20 bp, Artificial Sequence
  Description of Artificial Sequence: Synthetic oligonucleotide
  Target: SCN9A; (-) strand; PAM type: YTN; PAM sequence: TTT
actaatgtatttcattgatt

SEQ ID NO: 68113 - DNA, 20 bp, Artificial Sequence
  Description of Artificial Sequence: Synthetic oligonucleotide
  Target: SCN9A; (-) strand; PAM type: YTN; PAM sequence: CTT
tactaatgtatttcattgat

SEQ ID NO: 68114 - DNA, 20 bp, Artificial Sequence
  Description of Artificial Sequence: Synthetic oligonucleotide
  Target: SCN9A; (-) strand; PAM type: YTN; PAM sequence: TTA
tcactttactaatgtatttc

SEQ ID NO: 68115 - DNA, 20 bp, Artificial Sequence
  Description of Artificial Sequence: Synthetic oligonucleotide
  Target: SCN9A; (-) strand; PAM type: YTN; PAM sequence: TTC
ataattatcactttactaat

SEQ ID NO: 68116 - DNA, 20 bp, Artificial Sequence
  Description of Artificial Sequence: Synthetic oligonucleotide
  Target: SCN9A; (-) strand; PAM type: YTN; PAM sequence: CTT
cataattatcactttactaa

SEQ ID NO: 68117 - DNA, 20 bp, Artificial Sequence
  Description of Artificial Sequence: Synthetic oligonucleotide
  Target: SCN9A; (-) strand; PAM type: YTN; PAM sequence: TTC
agcttcataattatcacttt

SEQ ID NO: 68118 - DNA, 20 bp, Artificial Sequence
  Description of Artificial Sequence: Synthetic oligonucleotide
  Target: SCN9A; (-) strand; PAM type: YTN; PAM sequence: TTT
cagcttcataattatcactt

SEQ ID NO: 68119 - DNA, 20 bp, Artificial Sequence
  Description of Artificial Sequence: Synthetic oligonucleotide
  Target: SCN9A; (-) strand; PAM type: YTN; PAM sequence: TTC
atttcagcttcataattatc

SEQ ID NO: 68120 - DNA, 20 bp, Artificial Sequence
  Description of Artificial Sequence: Synthetic oligonucleotide
  Target: SCN9A; (-) strand; PAM type: YTN; PAM sequence: TTG
attcatttcagcttcataat

SEQ ID NO: 68121 - DNA, 20 bp, Artificial Sequence
  Description of Artificial Sequence: Synthetic oligonucleotide
  Target: SCN9A; (-) strand; PAM type: YTN; PAM sequence: TTG
ttgattcatttcagcttcat

SEQ ID NO: 68122 - DNA, 20 bp, Artificial Sequence
  Description of Artificial Sequence: Synthetic oligonucleotide
  Target: SCN9A; (-) strand; PAM type: YTN; PAM sequence: TTT
gttgattcatttcagcttca

SEQ ID NO: 68123 - DNA, 20 bp, Artificial Sequence
  Description of Artificial Sequence: Synthetic oligonucleotide
  Target: SCN9A; (-) strand; PAM type: YTN; PAM sequence: CTC
acatttgttgattcatttca

SEQ ID NO: 68124 - DNA, 20 bp, Artificial Sequence
  Description of Artificial Sequence: Synthetic oligonucleotide
  Target: SCN9A; (-) strand; PAM type: YTN; PAM sequence: TTC
atagtctcacatttgttgat

SEQ ID NO: 68125 - DNA, 20 bp, Artificial Sequence
  Description of Artificial Sequence: Synthetic oligonucleotide
  Target: SCN9A; (-) strand; PAM type: YTN; PAM sequence: TTG
ttcatagtctcacatttgtt

SEQ ID NO: 68126 - DNA, 20 bp, Artificial Sequence
  Description of Artificial Sequence: Synthetic oligonucleotide
  Target: SCN9A; (-) strand; PAM type: YTN; PAM sequence: TTG
ttgttcatagtctcacattt

SEQ ID NO: 68127 - DNA, 20 bp, Artificial Sequence
  Description of Artificial Sequence: Synthetic oligonucleotide
  Target: SCN9A; (-) strand; PAM type: YTN; PAM sequence: TTT
gttgttcatagtctcacatt

SEQ ID NO: 68128 - DNA, 20 bp, Artificial Sequence
  Description of Artificial Sequence: Synthetic oligonucleotide
  Target: SCN9A; (-) strand; PAM type: YTN; PAM sequence: TTT
tgttgttcatagtctcacat

SEQ ID NO: 68129 - DNA, 20 bp, Artificial Sequence
  Description of Artificial Sequence: Synthetic oligonucleotide
  Target: SCN9A; (-) strand; PAM type: YTN; PAM sequence: TTA
aaacgattttgttgttcata

SEQ ID NO: 68130 - DNA, 20 bp, Artificial Sequence
  Description of Artificial Sequence: Synthetic oligonucleotide
  Target: SCN9A; (-) strand; PAM type: YTN; PAM sequence: CTG
aagataaatgttaaaacgat

SEQ ID NO: 68131 - DNA, 20 bp, Artificial Sequence
  Description of Artificial Sequence: Synthetic oligonucleotide
  Target: SCN9A; (-) strand; PAM type: YTN; PAM sequence: TTA
ctgaagataaatgttaaaac

SEQ ID NO: 68132 - DNA, 20 bp, Artificial Sequence
  Description of Artificial Sequence: Synthetic oligonucleotide
  Target: SCN9A; (-) strand; PAM type: YTN; PAM sequence: TTT
actgaagataaatgttaaaa

SEQ ID NO: 68133 - DNA, 20 bp, Artificial Sequence
  Description of Artificial Sequence: Synthetic oligonucleotide
  Target: SCN9A; (-) strand; PAM type: YTN; PAM sequence: TTT
tactgaagataaatgttaaa

SEQ ID NO: 68134 - DNA, 20 bp, Artificial Sequence
  Description of Artificial Sequence: Synthetic oligonucleotide
  Target: SCN9A; (-) strand; PAM type: YTN; PAM sequence: TTT
ttactgaagataaatgttaa

SEQ ID NO: 68135 - DNA, 20 bp, Artificial Sequence
  Description of Artificial Sequence: Synthetic oligonucleotide
  Target: SCN9A; (-) strand; PAM type: YTN; PAM sequence: TTA
aatccaagtagcatgttttt

SEQ ID NO: 68136 - DNA, 20 bp, Artificial Sequence
  Description of Artificial Sequence: Synthetic oligonucleotide
  Target: SCN9A; (-) strand; PAM type: YTN; PAM sequence: TTA
aatgaagtatgaaaaagaat

SEQ ID NO: 68137 - DNA, 20 bp, Artificial Sequence
  Description of Artificial Sequence: Synthetic oligonucleotide
  Target: SCN9A; (-) strand; PAM type: YTN; PAM sequence: CTG
aaaggtaacagaaaaaatta

SEQ ID NO: 68138 - DNA, 20 bp, Artificial Sequence
  Description of Artificial Sequence: Synthetic oligonucleotide
  Target: SCN9A; (-) strand; PAM type: YTN; PAM sequence: CTA
cctgaaaggtaacagaaaaa

SEQ ID NO: 68139 - DNA, 20 bp, Artificial Sequence
  Description of Artificial Sequence: Synthetic oligonucleotide
  Target: SCN9A; (-) strand; PAM type: YTN; PAM sequence: CTG
ctacctgaaaggtaacagaa

SEQ ID NO: 68140 - DNA, 20 bp, Artificial Sequence
  Description of Artificial Sequence: Synthetic oligonucleotide
  Target: SCN9A; (-) strand; PAM type: YTN; PAM sequence: CTC
tgctacctgaaaggtaacag

SEQ ID NO: 68141 - DNA, 20 bp, Artificial Sequence
  Description of Artificial Sequence: Synthetic oligonucleotide
  Target: SCN9A; (-) strand; PAM type: YTN; PAM sequence: CTC
cagagatctctgctacctga

SEQ ID NO: 68142 - DNA, 20 bp, Artificial Sequence
  Description of Artificial Sequence: Synthetic oligonucleotide
  Target: SCN9A; (-) strand; PAM type: YTN; PAM sequence: TTC
acctccagagatctctgcta

SEQ ID NO: 68143 - DNA, 20 bp, Artificial Sequence
  Description of Artificial Sequence: Synthetic oligonucleotide
  Target: SCN9A; (-) strand; PAM type: YTN; PAM sequence: TTT
cacctccagagatctctgct

SEQ ID NO: 68144 - DNA, 20 bp, Artificial Sequence
  Description of Artificial Sequence: Synthetic oligonucleotide
  Target: SCN9A; (-) strand; PAM type: YTN; PAM sequence: TTC
agagcaatgtttcacctcca

SEQ ID NO: 68145 - DNA, 20 bp, Artificial Sequence
  Description of Artificial Sequence: Synthetic oligonucleotide
  Target: SCN9A; (-) strand; PAM type: YTN; PAM sequence: CTA
gaatcaatgccagttcagag

SEQ ID NO: 68146 - DNA, 20 bp, Artificial Sequence
  Description of Artificial Sequence: Synthetic oligonucleotide
  Target: SCN9A; (-) strand; PAM type: YTN; PAM sequence: CTG
ggctagaatcaatgccagtt

SEQ ID NO: 68147 - DNA, 20 bp, Artificial Sequence
  Description of Artificial Sequence: Synthetic oligonucleotide
  Target: SCN9A; (-) strand; PAM type: YTN; PAM sequence: CTA
caagagctgggctagaatca

SEQ ID NO: 68148 - DNA, 20 bp, Artificial Sequence
  Description of Artificial Sequence: Synthetic oligonucleotide
  Target: SCN9A; (-) strand; PAM type: YTN; PAM sequence: TTG
gtctacaagagctgggctag

SEQ ID NO: 68149 - DNA, 20 bp, Artificial Sequence
  Description of Artificial Sequence: Synthetic oligonucleotide
  Target: SCN9A; (-) strand; PAM type: YTN; PAM sequence: TTG
gtaattggtctacaagagct

SEQ ID NO: 68150 - DNA, 20 bp, Artificial Sequence
  Description of Artificial Sequence: Synthetic oligonucleotide
  Target: SCN9A; (-) strand; PAM type: YTN; PAM sequence: TTA
caagttggtaattggtctac

SEQ ID NO: 68151 - DNA, 20 bp, Artificial Sequence
  Description of Artificial Sequence: Synthetic oligonucleotide
  Target: SCN9A; (-) strand; PAM type: YTN; PAM sequence: CTT
acaagttggtaattggtcta

SEQ ID NO: 68152 - DNA, 20 bp, Artificial Sequence
  Description of Artificial Sequence: Synthetic oligonucleotide
  Target: SCN9A; (-) strand; PAM type: YTN; PAM sequence: TTA
cttacaagttggtaattggt

SEQ ID NO: 68153 - DNA, 20 bp, Artificial Sequence
  Description of Artificial Sequence: Synthetic oligonucleotide
  Target: SCN9A; (-) strand; PAM type: YTN; PAM sequence: TTT
acttacaagttggtaattgg

SEQ ID NO: 68154 - DNA, 20 bp, Artificial Sequence
  Description of Artificial Sequence: Synthetic oligonucleotide
  Target: SCN9A; (-) strand; PAM type: YTN; PAM sequence: TTG
tcagaatgaagaatcatgaa

SEQ ID NO: 68155 - DNA, 20 bp, Artificial Sequence
  Description of Artificial Sequence: Synthetic oligonucleotide
  Target: SCN9A; (-) strand; PAM type: YTN; PAM sequence: CTT
gtcagaatgaagaatcatga

SEQ ID NO: 68156 - DNA, 20 bp, Artificial Sequence
  Description of Artificial Sequence: Synthetic oligonucleotide
  Target: SCN9A; (-) strand; PAM type: YTN; PAM sequence: CTG
agaagcatgggcttgtcaga

SEQ ID NO: 68157 - DNA, 20 bp, Artificial Sequence
  Description of Artificial Sequence: Synthetic oligonucleotide
  Target: SCN9A; (-) strand; PAM type: YTN; PAM sequence: TTC
cacatgaagactgagaagca

SEQ ID NO: 68158 - DNA, 20 bp, Artificial Sequence
  Description of Artificial Sequence: Synthetic oligonucleotide
  Target: SCN9A; (-) strand; PAM type: YTN; PAM sequence: TTT
ccacatgaagactgagaagc

SEQ ID NO: 68159 - DNA, 20 bp, Artificial Sequence
  Description of Artificial Sequence: Synthetic oligonucleotide
  Target: SCN9A; (-) strand; PAM type: YTN; PAM sequence: CTG
gaaatgcatagtttccacat

SEQ ID NO: 68160 - DNA, 20 bp, Artificial Sequence
  Description of Artificial Sequence: Synthetic oligonucleotide
  Target: SCN9A; (-) strand; PAM type: YTN; PAM sequence: TTA
aaaactggaaatgcatagtt

SEQ ID NO: 68161 - DNA, 20 bp, Artificial Sequence
  Description of Artificial Sequence: Synthetic oligonucleotide
  Target: SCN9A; (-) strand; PAM type: YTN; PAM sequence: CTT
aaaaactggaaatgcatagt

SEQ ID NO: 68162 - DNA, 20 bp, Artificial Sequence
  Description of Artificial Sequence: Synthetic oligonucleotide
  Target: SCN9A; (-) strand; PAM type: YTN; PAM sequence: TTG
ggtgcttaaaaactggaaat

SEQ ID NO: 68163 - DNA, 20 bp, Artificial Sequence
  Description of Artificial Sequence: Synthetic oligonucleotide
  Target: SCN9A; (-) strand; PAM type: YTN; PAM sequence: TTG
aacattgggtgcttaaaaac

SEQ ID NO: 68164 - DNA, 20 bp, Artificial Sequence
  Description of Artificial Sequence: Synthetic oligonucleotide
  Target: SCN9A; (-) strand; PAM type: YTN; PAM sequence: TTG
atggattgaacattgggtgc

SEQ ID NO: 68165 - DNA, 20 bp, Artificial Sequence
  Description of Artificial Sequence: Synthetic oligonucleotide
  Target: SCN9A; (-) strand; PAM type: YTN; PAM sequence: TTG
ttgatggattgaacattggg

SEQ ID NO: 68166 - DNA, 20 bp, Artificial Sequence
  Description of Artificial Sequence: Synthetic oligonucleotide
  Target: SCN9A; (-) strand; PAM type: YTN; PAM sequence: TTT
gttgatggattgaacattgg

SEQ ID NO: 68167 - DNA, 20 bp, Artificial Sequence
  Description of Artificial Sequence: Synthetic oligonucleotide
  Target: SCN9A; (-) strand; PAM type: YTN; PAM sequence: CTG
aagggatttgttgatggatt

SEQ ID NO: 68168 - DNA, 20 bp, Artificial Sequence
  Description of Artificial Sequence: Synthetic oligonucleotide
  Target: SCN9A; (-) strand; PAM type: YTN; PAM sequence: TTA
gagctgaagggatttgttga

SEQ ID NO: 68169 - DNA, 20 bp, Artificial Sequence
  Description of Artificial Sequence: Synthetic oligonucleotide
  Target: SCN9A; (-) strand; PAM type: YTN; PAM sequence: TTG
aagttagagctgaagggatt

SEQ ID NO: 68170 - DNA, 20 bp, Artificial Sequence
  Description of Artificial Sequence: Synthetic oligonucleotide
  Target: SCN9A; (-) strand; PAM type: YTN; PAM sequence: TTT
gaagttagagctgaagggat

SEQ ID NO: 68171 - DNA, 20 bp, Artificial Sequence
  Description of Artificial Sequence: Synthetic oligonucleotide
  Target: SCN9A; (-) strand; PAM type: YTN; PAM sequence: TTT
tgaagttagagctgaaggga

SEQ ID NO: 68172 - DNA, 20 bp, Artificial Sequence
  Description of Artificial Sequence: Synthetic oligonucleotide
  Target: SCN9A; (-) strand; PAM type: YTN; PAM sequence: CTG
agtatattttgaagttagag

SEQ ID NO: 68173 - DNA, 20 bp, Artificial Sequence
  Description of Artificial Sequence: Synthetic oligonucleotide
  Target: SCN9A; (-) strand; PAM type: YTN; PAM sequence: TTG
tatagtgagggtgtgacatg

SEQ ID NO: 68174 - DNA, 20 bp, Artificial Sequence
  Description of Artificial Sequence: Synthetic oligonucleotide
  Target: SCN9A; (-) strand; PAM type: YTN; PAM sequence: TTT
gtatagtgagggtgtgacat

SEQ ID NO: 68175 - DNA, 20 bp, Artificial Sequence
  Description of Artificial Sequence: Synthetic oligonucleotide
  Target: SCN9A; (-) strand; PAM type: YTN; PAM sequence: TTT
tgtatagtgagggtgtgaca

SEQ ID NO: 68176 - DNA, 20 bp, Artificial Sequence
  Description of Artificial Sequence: Synthetic oligonucleotide
  Target: SCN9A; (-) strand; PAM type: YTN; PAM sequence: CTA
gtatggtagagttttgtata

SEQ ID NO: 68177 - DNA, 20 bp, Artificial Sequence
  Description of Artificial Sequence: Synthetic oligonucleotide
  Target: SCN9A; (-) strand; PAM type: YTN; PAM sequence: TTA
gactagtatggtagagtttt

SEQ ID NO: 68178 - DNA, 20 bp, Artificial Sequence
  Description of Artificial Sequence: Synthetic oligonucleotide
  Target: SCN9A; (-) strand; PAM type: YTN; PAM sequence: CTT
agactagtatggtagagttt

SEQ ID NO: 68179 - DNA, 20 bp, Artificial Sequence
  Description of Artificial Sequence: Synthetic oligonucleotide
  Target: SCN9A; (-) strand; PAM type: YTN; PAM sequence: CTG
cataaatccaggtgagaggt

SEQ ID NO: 68180 - DNA, 20 bp, Artificial Sequence
  Description of Artificial Sequence: Synthetic oligonucleotide
  Target: SCN9A; (-) strand; PAM type: YTN; PAM sequence: TTC
tgcataaatccaggtgagag

SEQ ID NO: 68181 - DNA, 20 bp, Artificial Sequence
  Description of Artificial Sequence: Synthetic oligonucleotide
  Target: SCN9A; (-) strand; PAM type: YTN; PAM sequence: TTT
ctgcataaatccaggtgaga

SEQ ID NO: 68182 - DNA, 20 bp, Artificial Sequence
  Description of Artificial Sequence: Synthetic oligonucleotide
  Target: SCN9A; (-) strand; PAM type: YTN; PAM sequence: TTG
gagtttctgcataaatccag

SEQ ID NO: 68183 - DNA, 20 bp, Artificial Sequence
  Description of Artificial Sequence: Synthetic oligonucleotide
  Target: SCN9A; (-) strand; PAM type: YTN; PAM sequence: CTT
ggagtttctgcataaatcca

SEQ ID NO: 68184 - DNA, 20 bp, Artificial Sequence
  Description of Artificial Sequence: Synthetic oligonucleotide
  Target: SCN9A; (-) strand; PAM type: YTN; PAM sequence: TTC
ttggagtttctgcataaatc

SEQ ID NO: 68185 - DNA, 20 bp, Artificial Sequence
  Description of Artificial Sequence: Synthetic oligonucleotide
  Target: SCN9A; (-) strand; PAM type: YTN; PAM sequence: TTT
cttggagtttctgcataaat

SEQ ID NO: 68186 - DNA, 20 bp, Artificial Sequence
  Description of Artificial Sequence: Synthetic oligonucleotide
  Target: SCN9A; (-) strand; PAM type: YTN; PAM sequence: CTG
gaagatttcttggagtttct

SEQ ID NO: 68187 - DNA, 20 bp, Artificial Sequence
  Description of Artificial Sequence: Synthetic oligonucleotide
  Target: SCN9A; (-) strand; PAM type: YTN; PAM sequence: TTA
agagtggaagggcgaatagc

SEQ ID NO: 68188 - DNA, 20 bp, Artificial Sequence
  Description of Artificial Sequence: Synthetic oligonucleotide
  Target: SCN9A; (-) strand; PAM type: YTN; PAM sequence: CTT
aagagtggaagggcgaatag

SEQ ID NO: 68189 - DNA, 20 bp, Artificial Sequence
  Description of Artificial Sequence: Synthetic oligonucleotide
  Target: SCN9A; (-) strand; PAM type: YTN; PAM sequence: CTC
acaatgtgcaatcttaagag

SEQ ID NO: 68190 - DNA, 20 bp, Artificial Sequence
  Description of Artificial Sequence: Synthetic oligonucleotide
  Target: SCN9A; (-) strand; PAM type: YTN; PAM sequence: TTA
aaatctcacaatgtgcaatc

SEQ ID NO: 68191 - DNA, 20 bp, Artificial Sequence
  Description of Artificial Sequence: Synthetic oligonucleotide
  Target: SCN9A; (-) strand; PAM type: YTN; PAM sequence: TTT
aaaatctcacaatgtgcaat

SEQ ID NO: 68192 - DNA, 20 bp, Artificial Sequence
  Description of Artificial Sequence: Synthetic oligonucleotide
  Target: SCN9A; (-) strand; PAM type: YTN; PAM sequence: TTT
taaaatctcacaatgtgcaa

SEQ ID NO: 68193 - DNA, 20 bp, Artificial Sequence
  Description of Artificial Sequence: Synthetic oligonucleotide
  Target: SCN9A; (-) strand; PAM type: YTN; PAM sequence: TTA
taaggatgtgattttaaaat

SEQ ID NO: 68194 - DNA, 20 bp, Artificial Sequence
  Description of Artificial Sequence: Synthetic oligonucleotide
  Target: SCN9A; (-) strand; PAM type: YTN; PAM sequence: TTG
aagaacattataaggatgtg

SEQ ID NO: 68195 - DNA, 20 bp, Artificial Sequence
  Description of Artificial Sequence: Synthetic oligonucleotide
  Target: SCN9A; (-) strand; PAM type: YTN; PAM sequence: TTT
gaagaacattataaggatgt

SEQ ID NO: 68196 - DNA, 20 bp, Artificial Sequence
  Description of Artificial Sequence: Synthetic oligonucleotide
  Target: SCN9A; (-) strand; PAM type: YTN; PAM sequence: TTA
taagacatttgaagaacatt

SEQ ID NO: 68197 - DNA, 20 bp, Artificial Sequence
  Description of Artificial Sequence: Synthetic oligonucleotide
  Target: SCN9A; (-) strand; PAM type: YTN; PAM sequence: TTA
aaaagtgtagatcagagatg

SEQ ID NO: 68198 - DNA, 20 bp, Artificial Sequence
  Description of Artificial Sequence: Synthetic oligonucleotide
  Target: SCN9A; (-) strand; PAM type: YTN; PAM sequence: TTT
aaaaagtgtagatcagagat

SEQ ID NO: 68199 - DNA, 20 bp, Artificial Sequence
  Description of Artificial Sequence: Synthetic oligonucleotide
  Target: SCN9A; (-) strand; PAM type: YTN; PAM sequence: TTT
taaaaagtgtagatcagaga

SEQ ID NO: 68200 - DNA, 20 bp, Artificial Sequence
  Description of Artificial Sequence: Synthetic oligonucleotide
  Target: SCN9A; (-) strand; PAM type: YTN; PAM sequence: TTT
ttaaaaagtgtagatcagag

SEQ ID NO: 68201 - DNA, 20 bp, Artificial Sequence
  Description of Artificial Sequence: Synthetic oligonucleotide
  Target: SCN9A; (-) strand; PAM type: YTN; PAM sequence: TTA
tttttaaaaagtgtagatca

SEQ ID NO: 68202 - DNA, 20 bp, Artificial Sequence
  Description of Artificial Sequence: Synthetic oligonucleotide
  Target: SCN9A; (-) strand; PAM type: YTN; PAM sequence: CTC
caacaaacaaacaaataaaa

SEQ ID NO: 68203 - DNA, 20 bp, Artificial Sequence
  Description of Artificial Sequence: Synthetic oligonucleotide
  Target: SCN9A; (-) strand; PAM type: YTN; PAM sequence: CTG
tctccaacaaacaaacaaat

SEQ ID NO: 68204 - DNA, 20 bp, Artificial Sequence
  Description of Artificial Sequence: Synthetic oligonucleotide
  Target: SCN9A; (-) strand; PAM type: YTN; PAM sequence: CTC
tgtctccaacaaacaaacaa

SEQ ID NO: 68205 - DNA, 20 bp, Artificial Sequence
  Description of Artificial Sequence: Synthetic oligonucleotide
  Target: SCN9A; (-) strand; PAM type: YTN; PAM sequence: CTG
gacgacagaggaagactctg

SEQ ID NO: 68206 - DNA, 20 bp, Artificial Sequence
  Description of Artificial Sequence: Synthetic oligonucleotide
  Target: SCN9A; (-) strand; PAM type: YTN; PAM sequence: CTC
cagcctggacgacagaggaa

SEQ ID NO: 68207 - DNA, 20 bp, Artificial Sequence
  Description of Artificial Sequence: Synthetic oligonucleotide
  Target: SCN9A; (-) strand; PAM type: YTN; PAM sequence: CTG
cactccagcctggacgacag

SEQ ID NO: 68208 - DNA, 20 bp, Artificial Sequence
  Description of Artificial Sequence: Synthetic oligonucleotide
  Target: SCN9A; (-) strand; PAM type: YTN; PAM sequence: TTG
tgccactgcactccagcctg

SEQ ID NO: 68209 - DNA, 20 bp, Artificial Sequence
  Description of Artificial Sequence: Synthetic oligonucleotide
  Target: SCN9A; (-) strand; PAM type: YTN; PAM sequence: TTG
cagtgagccaagattgtgcc

SEQ ID NO: 68210 - DNA, 20 bp, Artificial Sequence
  Description of Artificial Sequence: Synthetic oligonucleotide
  Target: SCN9A; (-) strand; PAM type: YTN; PAM sequence: TTG
aatccaggaggcagaggttg

SEQ ID NO: 68211 - DNA, 20 bp, Artificial Sequence
  Description of Artificial Sequence: Synthetic oligonucleotide
  Target: SCN9A; (-) strand; PAM type: YTN; PAM sequence: CTT
gaatccaggaggcagaggtt

SEQ ID NO: 68212 - DNA, 20 bp, Artificial Sequence
  Description of Artificial Sequence: Synthetic oligonucleotide
  Target: SCN9A; (-) strand; PAM type: YTN; PAM sequence: TTA
cttgaatccaggaggcagag

SEQ ID NO: 68213 - DNA, 20 bp, Artificial Sequence
  Description of Artificial Sequence: Synthetic oligonucleotide
  Target: SCN9A; (-) strand; PAM type: YTN; PAM sequence: CTG
aggcacgagaattacttgaa

SEQ ID NO: 68214 - DNA, 20 bp, Artificial Sequence
  Description of Artificial Sequence: Synthetic oligonucleotide
  Target: SCN9A; (-) strand; PAM type: YTN; PAM sequence: TTG
tgaggctgaggcacgagaat

SEQ ID NO: 68215 - DNA, 20 bp, Artificial Sequence
  Description of Artificial Sequence: Synthetic oligonucleotide
  Target: SCN9A; (-) strand; PAM type: YTN; PAM sequence: CTT
gtgaggctgaggcacgagaa

SEQ ID NO: 68216 - DNA, 20 bp, Artificial Sequence
  Description of Artificial Sequence: Synthetic oligonucleotide
  Target: SCN9A; (-) strand; PAM type: YTN; PAM sequence: CTA
cttgtgaggctgaggcacga

SEQ ID NO: 68217 - DNA, 20 bp, Artificial Sequence
  Description of Artificial Sequence: Synthetic oligonucleotide
  Target: SCN9A; (-) strand; PAM type: YTN; PAM sequence: CTA
taatcccagctacttgtgag

SEQ ID NO: 68218 - DNA, 20 bp, Artificial Sequence
  Description of Artificial Sequence: Synthetic oligonucleotide
  Target: SCN9A; (-) strand; PAM type: YTN; PAM sequence: TTG
gtgatacatgcctataatcc

SEQ ID NO: 68219 - DNA, 20 bp, Artificial Sequence
  Description of Artificial Sequence: Synthetic oligonucleotide
  Target: SCN9A; (-) strand; PAM type: YTN; PAM sequence: CTT
ggtgatacatgcctataatc

SEQ ID NO: 68220 - DNA, 20 bp, Artificial Sequence
  Description of Artificial Sequence: Synthetic oligonucleotide
  Target: SCN9A; (-) strand; PAM type: YTN; PAM sequence: TTG
atcttggtgatacatgccta

SEQ ID NO: 68221 - DNA, 20 bp, Artificial Sequence
  Description of Artificial Sequence: Synthetic oligonucleotide
  Target: SCN9A; (-) strand; PAM type: YTN; PAM sequence: TTA
attgatcttggtgatacatg

SEQ ID NO: 68222 - DNA, 20 bp, Artificial Sequence
  Description of Artificial Sequence: Synthetic oligonucleotide
  Target: SCN9A; (-) strand; PAM type: YTN; PAM sequence: CTG
aaaatgaaaaaaaaattaat

SEQ ID NO: 68223 - DNA, 20 bp, Artificial Sequence
  Description of Artificial Sequence: Synthetic oligonucleotide
  Target: SCN9A; (-) strand; PAM type: YTN; PAM sequence: TTA
ctgaaaatgaaaaaaaaatt

SEQ ID NO: 68224 - DNA, 20 bp, Artificial Sequence
  Description of Artificial Sequence: Synthetic oligonucleotide
  Target: SCN9A; (-) strand; PAM type: YTN; PAM sequence: TTT
actgaaaatgaaaaaaaaat

SEQ ID NO: 68225 - DNA, 20 bp, Artificial Sequence
  Description of Artificial Sequence: Synthetic oligonucleotide
  Target: SCN9A; (-) strand; PAM type: YTN; PAM sequence: TTT
tactgaaaatgaaaaaaaaa

SEQ ID NO: 68226 - DNA, 20 bp, Artificial Sequence
  Description of Artificial Sequence: Synthetic oligonucleotide
  Target: SCN9A; (-) strand; PAM type: YTN; PAM sequence: TTT
ttactgaaaatgaaaaaaaa

SEQ ID NO: 68227 - DNA, 20 bp, Artificial Sequence
  Description of Artificial Sequence: Synthetic oligonucleotide
  Target: SCN9A; (-) strand; PAM type: YTN; PAM sequence: CTG
gccaacgtagcgaaacccca

SEQ ID NO: 68228 - DNA, 20 bp, Artificial Sequence
  Description of Artificial Sequence: Synthetic oligonucleotide
  Target: SCN9A; (-) strand; PAM type: YTN; PAM sequence: TTC
aagaccagcctggccaacgt

SEQ ID NO: 68229 - DNA, 20 bp, Artificial Sequence
  Description of Artificial Sequence: Synthetic oligonucleotide
  Target: SCN9A; (-) strand; PAM type: YTN; PAM sequence: TTG
aggccaggagttcaagacca

SEQ ID NO: 68230 - DNA, 20 bp, Artificial Sequence
  Description of Artificial Sequence: Synthetic oligonucleotide
  Target: SCN9A; (-) strand; PAM type: YTN; PAM sequence: CTT
gaggccaggagttcaagacc

SEQ ID NO: 68231 - DNA, 20 bp, Artificial Sequence
  Description of Artificial Sequence: Synthetic oligonucleotide
  Target: SCN9A; (-) strand; PAM type: YTN; PAM sequence: TTG
ggaggccgaggtgggcgatc

SEQ ID NO: 68232 - DNA, 20 bp, Artificial Sequence
  Description of Artificial Sequence: Synthetic oligonucleotide
  Target: SCN9A; (-) strand; PAM type: YTN; PAM sequence: TTT
gggaggccgaggtgggcgat

SEQ ID NO: 68233 - DNA, 20 bp, Artificial Sequence
  Description of Artificial Sequence: Synthetic oligonucleotide
  Target: SCN9A; (-) strand; PAM type: YTN; PAM sequence: CTT
tgggaggccgaggtgggcga

SEQ ID NO: 68234 - DNA, 20 bp, Artificial Sequence
  Description of Artificial Sequence: Synthetic oligonucleotide
  Target: SCN9A; (-) strand; PAM type: YTN; PAM sequence: TTC
cagtactttgggaggccgag

SEQ ID NO: 68235 - DNA, 20 bp, Artificial Sequence
  Description of Artificial Sequence: Synthetic oligonucleotide
  Target: SCN9A; (-) strand; PAM type: YTN; PAM sequence: CTA
taattccagtactttgggag

SEQ ID NO: 68236 - DNA, 20 bp, Artificial Sequence
  Description of Artificial Sequence: Synthetic oligonucleotide
  Target: SCN9A; (-) strand; PAM type: YTN; PAM sequence: CTC
acacctataattccagtact

SEQ ID NO: 68237 - DNA, 20 bp, Artificial Sequence
  Description of Artificial Sequence: Synthetic oligonucleotide
  Target: SCN9A; (-) strand; PAM type: YTN; PAM sequence: CTG
ggtgaagtggctcacaccta

SEQ ID NO: 68238 - DNA, 20 bp, Artificial Sequence
  Description of Artificial Sequence: Synthetic oligonucleotide
  Target: SCN9A; (-) strand; PAM type: YTN; PAM sequence: TTA
aggtcagaggctgggtgaag

SEQ ID NO: 68239 - DNA, 20 bp, Artificial Sequence
  Description of Artificial Sequence: Synthetic oligonucleotide
  Target: SCN9A; (-) strand; PAM type: YTN; PAM sequence: TTA
aaagttaaggtcagaggctg

SEQ ID NO: 68240 - DNA, 20 bp, Artificial Sequence
  Description of Artificial Sequence: Synthetic oligonucleotide
  Target: SCN9A; (-) strand; PAM type: YTN; PAM sequence: TTG
ggaaaaaccaagaggccaaa

SEQ ID NO: 68241 - DNA, 20 bp, Artificial Sequence
  Description of Artificial Sequence: Synthetic oligonucleotide
  Target: SCN9A; (-) strand; PAM type: YTN; PAM sequence: TTT
gggaaaaaccaagaggccaa

SEQ ID NO: 68242 - DNA, 20 bp, Artificial Sequence
  Description of Artificial Sequence: Synthetic oligonucleotide
  Target: SCN9A; (-) strand; PAM type: YTN; PAM sequence: TTA
ggcagagtaatgaaggcaca

SEQ ID NO: 68243 - DNA, 20 bp, Artificial Sequence
  Description of Artificial Sequence: Synthetic oligonucleotide
  Target: SCN9A; (-) strand; PAM type: YTN; PAM sequence: TTT
aggcagagtaatgaaggcac

SEQ ID NO: 68244 - DNA, 20 bp, Artificial Sequence
  Description of Artificial Sequence: Synthetic oligonucleotide
  Target: SCN9A; (-) strand; PAM type: YTN; PAM sequence: TTT
taggcagagtaatgaaggca

SEQ ID NO: 68245 - DNA, 20 bp, Artificial Sequence
  Description of Artificial Sequence: Synthetic oligonucleotide
  Target: SCN9A; (-) strand; PAM type: YTN; PAM sequence: TTG
aagggggccgtgcaaatata

SEQ ID NO: 68246 - DNA, 20 bp, Artificial Sequence
  Description of Artificial Sequence: Synthetic oligonucleotide
  Target: SCN9A; (-) strand; PAM type: YTN; PAM sequence: TTC
cgtgatgtaaagaaaattga

SEQ ID NO: 68247 - DNA, 20 bp, Artificial Sequence
  Description of Artificial Sequence: Synthetic oligonucleotide
  Target: SCN9A; (-) strand; PAM type: YTN; PAM sequence: CTT
ccgtgatgtaaagaaaattg

SEQ ID NO: 68248 - DNA, 20 bp, Artificial Sequence
  Description of Artificial Sequence: Synthetic oligonucleotide
  Target: SCN9A; (-) strand; PAM type: YTN; PAM sequence: TTC
ttccgtgatgtaaagaaaat

SEQ ID NO: 68249 - DNA, 20 bp, Artificial Sequence
  Description of Artificial Sequence: Synthetic oligonucleotide
  Target: SCN9A; (-) strand; PAM type: YTN; PAM sequence: TTT
cttccgtgatgtaaagaaaa

SEQ ID NO: 68250 - DNA, 20 bp, Artificial Sequence
  Description of Artificial Sequence: Synthetic oligonucleotide
  Target: SCN9A; (-) strand; PAM type: YTN; PAM sequence: CTA
taaaggtggcgtttcttccg

SEQ ID NO: 68251 - DNA, 20 bp, Artificial Sequence
  Description of Artificial Sequence: Synthetic oligonucleotide
  Target: SCN9A; (-) strand; PAM type: YTN; PAM sequence: CTG
cctataaaggtggcgtttct

SEQ ID NO: 68252 - DNA, 20 bp, Artificial Sequence
  Description of Artificial Sequence: Synthetic oligonucleotide
  Target: SCN9A; (-) strand; PAM type: YTN; PAM sequence: TTG
gtcagagaaagcctgcctat

SEQ ID NO: 68253 - DNA, 20 bp, Artificial Sequence
  Description of Artificial Sequence: Synthetic oligonucleotide
  Target: SCN9A; (-) strand; PAM type: YTN; PAM sequence: CTA
tcaatgaatgattggtcaga

SEQ ID NO: 68254 - DNA, 20 bp, Artificial Sequence
  Description of Artificial Sequence: Synthetic oligonucleotide
  Target: SCN9A; (-) strand; PAM type: YTN; PAM sequence: CTA
gcacataaatatgctatcaa

SEQ ID NO: 68255 - DNA, 20 bp, Artificial Sequence
  Description of Artificial Sequence: Synthetic oligonucleotide
  Target: SCN9A; (-) strand; PAM type: YTN; PAM sequence: TTA
ctagcacataaatatgctat

SEQ ID NO: 68256 - DNA, 20 bp, Artificial Sequence
  Description of Artificial Sequence: Synthetic oligonucleotide
  Target: SCN9A; (-) strand; PAM type: YTN; PAM sequence: CTT
actagcacataaatatgcta

SEQ ID NO: 68257 - DNA, 20 bp, Artificial Sequence
  Description of Artificial Sequence: Synthetic oligonucleotide
  Target: SCN9A; (-) strand; PAM type: YTN; PAM sequence: CTA
tggagaaggtatatggaaaa

SEQ ID NO: 68258 - DNA, 20 bp, Artificial Sequence
  Description of Artificial Sequence: Synthetic oligonucleotide
  Target: SCN9A; (-) strand; PAM type: YTN; PAM sequence: CTG
aagaaacatatcaagatgta

SEQ ID NO: 68259 - DNA, 20 bp, Artificial Sequence
  Description of Artificial Sequence: Synthetic oligonucleotide
  Target: SCN9A; (-) strand; PAM type: YTN; PAM sequence: TTG
ctgaagaaacatatcaagat

SEQ ID NO: 68260 - DNA, 20 bp, Artificial Sequence
  Description of Artificial Sequence: Synthetic oligonucleotide
  Target: SCN9A; (-) strand; PAM type: YTN; PAM sequence: CTT
gctgaagaaacatatcaaga

SEQ ID NO: 68261 - DNA, 20 bp, Artificial Sequence
  Description of Artificial Sequence: Synthetic oligonucleotide
  Target: SCN9A; (-) strand; PAM type: YTN; PAM sequence: CTG
tgaacaaaacaatacccctt

SEQ ID NO: 68262 - DNA, 20 bp, Artificial Sequence
  Description of Artificial Sequence: Synthetic oligonucleotide
  Target: SCN9A; (-) strand; PAM type: YTN; PAM sequence: CTG
gagggagatggagctgtgaa

SEQ ID NO: 68263 - DNA, 20 bp, Artificial Sequence
  Description of Artificial Sequence: Synthetic oligonucleotide
  Target: SCN9A; (-) strand; PAM type: YTN; PAM sequence: TTC
caggcactggagggagatgg

SEQ ID NO: 68264 - DNA, 20 bp, Artificial Sequence
  Description of Artificial Sequence: Synthetic oligonucleotide
  Target: SCN9A; (-) strand; PAM type: YTN; PAM sequence: CTG
tgtgccaggtccagttccag

SEQ ID NO: 68265 - DNA, 20 bp, Artificial Sequence
  Description of Artificial Sequence: Synthetic oligonucleotide
  Target: SCN9A; (-) strand; PAM type: YTN; PAM sequence: TTA
aatacctgtgtgccaggtcc

SEQ ID NO: 68266 - DNA, 20 bp, Artificial Sequence
  Description of Artificial Sequence: Synthetic oligonucleotide
  Target: SCN9A; (-) strand; PAM type: YTN; PAM sequence: TTA
ttaaatacctgtgtgccagg

SEQ ID NO: 68267 - DNA, 20 bp, Artificial Sequence
  Description of Artificial Sequence: Synthetic oligonucleotide
  Target: SCN9A; (-) strand; PAM type: YTN; PAM sequence: TTC
cagtaaacaaataattatta

SEQ ID NO: 68268 - DNA, 20 bp, Artificial Sequence
  Description of Artificial Sequence: Synthetic oligonucleotide
  Target: SCN9A; (-) strand; PAM type: YTN; PAM sequence: TTA
ttccagtaaacaaataatta

SEQ ID NO: 68269 - DNA, 20 bp, Artificial Sequence
  Description of Artificial Sequence: Synthetic oligonucleotide
  Target: SCN9A; (-) strand; PAM type: YTN; PAM sequence: TTT
attccagtaaacaaataatt

SEQ ID NO: 68270 - DNA, 20 bp, Artificial Sequence
  Description of Artificial Sequence: Synthetic oligonucleotide
  Target: SCN9A; (-) strand; PAM type: YTN; PAM sequence: CTT
tattccagtaaacaaataat

SEQ ID NO: 68271 - DNA, 20 bp, Artificial Sequence
  Description of Artificial Sequence: Synthetic oligonucleotide
  Target: SCN9A; (-) strand; PAM type: YTN; PAM sequence: TTC
tttattccagtaaacaaata

SEQ ID NO: 68272 - DNA, 20 bp, Artificial Sequence
  Description of Artificial Sequence: Synthetic oligonucleotide
  Target: SCN9A; (-) strand; PAM type: YTN; PAM sequence: TTC
acataatcattctttattcc

SEQ ID NO: 68273 - DNA, 20 bp, Artificial Sequence
  Description of Artificial Sequence: Synthetic oligonucleotide
  Target: SCN9A; (-) strand; PAM type: YTN; PAM sequence: TTC
aaccgtgtattcacataatc

SEQ ID NO: 68274 - DNA, 20 bp, Artificial Sequence
  Description of Artificial Sequence: Synthetic oligonucleotide
  Target: SCN9A; (-) strand; PAM type: YTN; PAM sequence: TTT
caaccgtgtattcacataat

SEQ ID NO: 68275 - DNA, 20 bp, Artificial Sequence
  Description of Artificial Sequence: Synthetic oligonucleotide
  Target: SCN9A; (-) strand; PAM type: YTN; PAM sequence: CTT
tcaaccgtgtattcacataa

SEQ ID NO: 68276 - DNA, 20 bp, Artificial Sequence
  Description of Artificial Sequence: Synthetic oligonucleotide
  Target: SCN9A; (-) strand; PAM type: YTN; PAM sequence: TTA
gcctttcaaccgtgtattca

SEQ ID NO: 68277 - DNA, 20 bp, Artificial Sequence
  Description of Artificial Sequence: Synthetic oligonucleotide
  Target: SCN9A; (-) strand; PAM type: YTN; PAM sequence: CTT
agcctttcaaccgtgtattc

SEQ ID NO: 68278 - DNA, 20 bp, Artificial Sequence
  Description of Artificial Sequence: Synthetic oligonucleotide
  Target: SCN9A; (-) strand; PAM type: YTN; PAM sequence: TTG
cttagcctttcaaccgtgta

SEQ ID NO: 68279 - DNA, 20 bp, Artificial Sequence
  Description of Artificial Sequence: Synthetic oligonucleotide
  Target: SCN9A; (-) strand; PAM type: YTN; PAM sequence: TTT
gcttagcctttcaaccgtgt

SEQ ID NO: 68280 - DNA, 20 bp, Artificial Sequence
  Description of Artificial Sequence: Synthetic oligonucleotide
  Target: SCN9A; (-) strand; PAM type: YTN; PAM sequence: TTC
agtgaagcagccaatttgct

SEQ ID NO: 68281 - DNA, 20 bp, Artificial Sequence
  Description of Artificial Sequence: Synthetic oligonucleotide
  Target: SCN9A; (-) strand; PAM type: YTN; PAM sequence: CTA
ataaattcagtgaagcagcc

SEQ ID NO: 68282 - DNA, 20 bp, Artificial Sequence
  Description of Artificial Sequence: Synthetic oligonucleotide
  Target: SCN9A; (-) strand; PAM type: YTN; PAM sequence: CTG
tagcctaataaattcagtga

SEQ ID NO: 68283 - DNA, 20 bp, Artificial Sequence
  Description of Artificial Sequence: Synthetic oligonucleotide
  Target: SCN9A; (-) strand; PAM type: YTN; PAM sequence: CTG
gatctgtagcctaataaatt

SEQ ID NO: 68284 - DNA, 20 bp, Artificial Sequence
  Description of Artificial Sequence: Synthetic oligonucleotide
  Target: SCN9A; (-) strand; PAM type: YTN; PAM sequence: CTC
tggatctgtagcctaataaa

SEQ ID NO: 68285 - DNA, 20 bp, Artificial Sequence
  Description of Artificial Sequence: Synthetic oligonucleotide
  Target: SCN9A; (-) strand; PAM type: YTN; PAM sequence: TTC
atacagtctctggatctgta

SEQ ID NO: 68286 - DNA, 20 bp, Artificial Sequence
  Description of Artificial Sequence: Synthetic oligonucleotide
  Target: SCN9A; (-) strand; PAM type: YTN; PAM sequence: CTT
catacagtctctggatctgt

SEQ ID NO: 68287 - DNA, 20 bp, Artificial Sequence
  Description of Artificial Sequence: Synthetic oligonucleotide
  Target: SCN9A; (-) strand; PAM type: YTN; PAM sequence: CTC
cagcagagacttcatacagt

SEQ ID NO: 68288 - DNA, 20 bp, Artificial Sequence
  Description of Artificial Sequence: Synthetic oligonucleotide
  Target: SCN9A; (-) strand; PAM type: YTN; PAM sequence: TTA
tgtgctccagcagagacttc

SEQ ID NO: 68289 - DNA, 20 bp, Artificial Sequence
  Description of Artificial Sequence: Synthetic oligonucleotide
  Target: SCN9A; (-) strand; PAM type: YTN; PAM sequence: TTT
atgtgctccagcagagactt

SEQ ID NO: 68290 - DNA, 20 bp, Artificial Sequence
  Description of Artificial Sequence: Synthetic oligonucleotide
  Target: SCN9A; (-) strand; PAM type: YTN; PAM sequence: TTT
tatgtgctccagcagagact

SEQ ID NO: 68291 - DNA, 20 bp, Artificial Sequence
  Description of Artificial Sequence: Synthetic oligonucleotide
  Target: SCN9A; (-) strand; PAM type: YTN; PAM sequence: CTT
ttatgtgctccagcagagac

SEQ ID NO: 68292 - DNA, 20 bp, Artificial Sequence
  Description of Artificial Sequence: Synthetic oligonucleotide
  Target: SCN9A; (-) strand; PAM type: YTN; PAM sequence: CTG
agtcacatcccttttatgtg

SEQ ID NO: 68293 - DNA, 20 bp, Artificial Sequence
  Description of Artificial Sequence: Synthetic oligonucleotide
  Target: SCN9A; (-) strand; PAM type: YTN; PAM sequence: CTC
tgagtcacatcccttttatg

SEQ ID NO: 68294 - DNA, 20 bp, Artificial Sequence
  Description of Artificial Sequence: Synthetic oligonucleotide
  Target: SCN9A; (-) strand; PAM type: YTN; PAM sequence: CTG
agggagcatatatctctgag

SEQ ID NO: 68295 - DNA, 20 bp, Artificial Sequence
  Description of Artificial Sequence: Synthetic oligonucleotide
  Target: SCN9A; (-) strand; PAM type: YTN; PAM sequence: TTA
ctgagggagcatatatctct

SEQ ID NO: 68296 - DNA, 20 bp, Artificial Sequence
  Description of Artificial Sequence: Synthetic oligonucleotide
  Target: SCN9A; (-) strand; PAM type: YTN; PAM sequence: TTT
actgagggagcatatatctc

SEQ ID NO: 68297 - DNA, 20 bp, Artificial Sequence
  Description of Artificial Sequence: Synthetic oligonucleotide
  Target: SCN9A; (-) strand; PAM type: YTN; PAM sequence: TTG
aaatttactgagggagcata

SEQ ID NO: 68298 - DNA, 20 bp, Artificial Sequence
  Description of Artificial Sequence: Synthetic oligonucleotide
  Target: SCN9A; (-) strand; PAM type: YTN; PAM sequence: TTG
gaccattgaaatttactgag

SEQ ID NO: 68299 - DNA, 20 bp, Artificial Sequence
  Description of Artificial Sequence: Synthetic oligonucleotide
  Target: SCN9A; (-) strand; PAM type: YTN; PAM sequence: CTT
ggaccattgaaatttactga

SEQ ID NO: 68300 - DNA, 20 bp, Artificial Sequence
  Description of Artificial Sequence: Synthetic oligonucleotide
  Target: SCN9A; (-) strand; PAM type: YTN; PAM sequence: CTG
ggcttggaccattgaaattt

SEQ ID NO: 68301 - DNA, 20 bp, Artificial Sequence
  Description of Artificial Sequence: Synthetic oligonucleotide
  Target: SCN9A; (-) strand; PAM type: YTN; PAM sequence: TTC
caatgaacctgggcttggac

SEQ ID NO: 68302 - DNA, 20 bp, Artificial Sequence
  Description of Artificial Sequence: Synthetic oligonucleotide
  Target: SCN9A; (-) strand; PAM type: YTN; PAM sequence: TTT
ccaatgaacctgggcttgga

SEQ ID NO: 68303 - DNA, 20 bp, Artificial Sequence
  Description of Artificial Sequence: Synthetic oligonucleotide
  Target: SCN9A; (-) strand; PAM type: YTN; PAM sequence: TTT
tccaatgaacctgggcttgg

SEQ ID NO: 68304 - DNA, 20 bp, Artificial Sequence
  Description of Artificial Sequence: Synthetic oligonucleotide
  Target: SCN9A; (-) strand; PAM type: YTN; PAM sequence: TTA
tggaaacacattttccaatg

SEQ ID NO: 68305 - DNA, 20 bp, Artificial Sequence
  Description of Artificial Sequence: Synthetic oligonucleotide
  Target: SCN9A; (-) strand; PAM type: YTN; PAM sequence: CTG
aggccagtatagaagaaata

SEQ ID NO: 68306 - DNA, 20 bp, Artificial Sequence
  Description of Artificial Sequence: Synthetic oligonucleotide
  Target: SCN9A; (-) strand; PAM type: YTN; PAM sequence: TTC
caaactgaggccagtataga

SEQ ID NO: 68307 - DNA, 20 bp, Artificial Sequence
  Description of Artificial Sequence: Synthetic oligonucleotide
  Target: SCN9A; (-) strand; PAM type: YTN; PAM sequence: CTT
ccaaactgaggccagtatag

SEQ ID NO: 68308 - DNA, 20 bp, Artificial Sequence
  Description of Artificial Sequence: Synthetic oligonucleotide
  Target: SCN9A; (-) strand; PAM type: YTN; PAM sequence: TTG
cttccaaactgaggccagta

SEQ ID NO: 68309 - DNA, 20 bp, Artificial Sequence
  Description of Artificial Sequence: Synthetic oligonucleotide
  Target: SCN9A; (-) strand; PAM type: YTN; PAM sequence: TTC
attgcttccaaactgaggcc

SEQ ID NO: 68310 - DNA, 20 bp, Artificial Sequence
  Description of Artificial Sequence: Synthetic oligonucleotide
  Target: SCN9A; (-) strand; PAM type: YTN; PAM sequence: TTA
ttcattgcttccaaactgag

SEQ ID NO: 68311 - DNA, 20 bp, Artificial Sequence
  Description of Artificial Sequence: Synthetic oligonucleotide
  Target: SCN9A; (-) strand; PAM type: YTN; PAM sequence: CTG
agattattcattgcttccaa

SEQ ID NO: 68312 - DNA, 20 bp, Artificial Sequence
  Description of Artificial Sequence: Synthetic oligonucleotide
  Target: SCN9A; (-) strand; PAM type: YTN; PAM sequence: CTC
tgagattattcattgcttcc

SEQ ID NO: 68313 - DNA, 20 bp, Artificial Sequence
  Description of Artificial Sequence: Synthetic oligonucleotide
  Target: SCN9A; (-) strand; PAM type: YTN; PAM sequence: TTG
tgaatactctgagattattc

SEQ ID NO: 68314 - DNA, 20 bp, Artificial Sequence
  Description of Artificial Sequence: Synthetic oligonucleotide
  Target: SCN9A; (-) strand; PAM type: YTN; PAM sequence: TTT
gtgaatactctgagattatt

SEQ ID NO: 68315 - DNA, 20 bp, Artificial Sequence
  Description of Artificial Sequence: Synthetic oligonucleotide
  Target: SCN9A; (-) strand; PAM type: YTN; PAM sequence: TTT
tgtgaatactctgagattat

SEQ ID NO: 68316 - DNA, 20 bp, Artificial Sequence
  Description of Artificial Sequence: Synthetic oligonucleotide
  Target: SCN9A; (-) strand; PAM type: YTN; PAM sequence: CTT
ttgtgaatactctgagatta

SEQ ID NO: 68317 - DNA, 20 bp, Artificial Sequence
  Description of Artificial Sequence: Synthetic oligonucleotide
  Target: SCN9A; (-) strand; PAM type: YTN; PAM sequence: CTA
taaacatcaatgaaaatact

SEQ ID NO: 68318 - DNA, 20 bp, Artificial Sequence
  Description of Artificial Sequence: Synthetic oligonucleotide
  Target: SCN9A; (-) strand; PAM type: YTN; PAM sequence: TTA
atcctataaacatcaatgaa

SEQ ID NO: 68319 - DNA, 20 bp, Artificial Sequence
  Description of Artificial Sequence: Synthetic oligonucleotide
  Target: SCN9A; (-) strand; PAM type: YTN; PAM sequence: TTT
aatcctataaacatcaatga

SEQ ID NO: 68320 - DNA, 20 bp, Artificial Sequence
  Description of Artificial Sequence: Synthetic oligonucleotide
  Target: SCN9A; (-) strand; PAM type: YTN; PAM sequence: TTT
taatcctataaacatcaatg

SEQ ID NO: 68321 - DNA, 20 bp, Artificial Sequence
  Description of Artificial Sequence: Synthetic oligonucleotide
  Target: SCN9A; (-) strand; PAM type: YTN; PAM sequence: TTT
ttaatcctataaacatcaat

SEQ ID NO: 68322 - DNA, 20 bp, Artificial Sequence
  Description of Artificial Sequence: Synthetic oligonucleotide
  Target: SCN9A; (-) strand; PAM type: YTN; PAM sequence: TTT
tttaatcctataaacatcaa

SEQ ID NO: 68323 - DNA, 20 bp, Artificial Sequence
  Description of Artificial Sequence: Synthetic oligonucleotide
  Target: SCN9A; (-) strand; PAM type: YTN; PAM sequence: TTT
ttttaatcctataaacatca

SEQ ID NO: 68324 - DNA, 20 bp, Artificial Sequence
  Description of Artificial Sequence: Synthetic oligonucleotide
  Target: SCN9A; (-) strand; PAM type: YTN; PAM sequence: TTA
taataagatataatacaaag

SEQ ID NO: 68325 - DNA, 20 bp, Artificial Sequence
  Description of Artificial Sequence: Synthetic oligonucleotide
  Target: SCN9A; (-) strand; PAM type: YTN; PAM sequence: CTG
ttataataagatataataca

SEQ ID NO: 68326 - DNA, 20 bp, Artificial Sequence
  Description of Artificial Sequence: Synthetic oligonucleotide
  Target: SCN9A; (-) strand; PAM type: YTN; PAM sequence: CTG
taggtgctgttataataaga

SEQ ID NO: 68327 - DNA, 20 bp, Artificial Sequence
  Description of Artificial Sequence: Synthetic oligonucleotide
  Target: SCN9A; (-) strand; PAM type: YTN; PAM sequence: TTC
agactgtaggtgctgttata

SEQ ID NO: 68328 - DNA, 20 bp, Artificial Sequence
  Description of Artificial Sequence: Synthetic oligonucleotide
  Target: SCN9A; (-) strand; PAM type: YTN; PAM sequence: TTT
cagactgtaggtgctgttat

SEQ ID NO: 68329 - DNA, 20 bp, Artificial Sequence
  Description of Artificial Sequence: Synthetic oligonucleotide
  Target: SCN9A; (-) strand; PAM type: YTN; PAM sequence: CTA
tttcagactgtaggtgctgt

SEQ ID NO: 68330 - DNA, 20 bp, Artificial Sequence
  Description of Artificial Sequence: Synthetic oligonucleotide
  Target: SCN9A; (-) strand; PAM type: YTN; PAM sequence: CTA
tgctatttcagactgtaggt

SEQ ID NO: 68331 - DNA, 20 bp, Artificial Sequence
  Description of Artificial Sequence: Synthetic oligonucleotide
  Target: SCN9A; (-) strand; PAM type: YTN; PAM sequence: TTA
atactatgctatttcagact

SEQ ID NO: 68332 - DNA, 20 bp, Artificial Sequence
  Description of Artificial Sequence: Synthetic oligonucleotide
  Target: SCN9A; (-) strand; PAM type: YTN; PAM sequence: TTA
cagaaagtattaatactatg

SEQ ID NO: 68333 - DNA, 20 bp, Artificial Sequence
  Description of Artificial Sequence: Synthetic oligonucleotide
  Target: SCN9A; (-) strand; PAM type: YTN; PAM sequence: CTT
acagaaagtattaatactat

SEQ ID NO: 68334 - DNA, 20 bp, Artificial Sequence
  Description of Artificial Sequence: Synthetic oligonucleotide
  Target: SCN9A; (-) strand; PAM type: YTN; PAM sequence: CTC
ttacagaaagtattaatact

SEQ ID NO: 68335 - DNA, 20 bp, Artificial Sequence
  Description of Artificial Sequence: Synthetic oligonucleotide
  Target: SCN9A; (-) strand; PAM type: YTN; PAM sequence: TTA
aactcttacagaaagtatta

SEQ ID NO: 68336 - DNA, 20 bp, Artificial Sequence
  Description of Artificial Sequence: Synthetic oligonucleotide
  Target: SCN9A; (-) strand; PAM type: YTN; PAM sequence: CTT
aaactcttacagaaagtatt

SEQ ID NO: 68337 - DNA, 20 bp, Artificial Sequence
  Description of Artificial Sequence: Synthetic oligonucleotide
  Target: SCN9A; (-) strand; PAM type: YTN; PAM sequence: TTC
aaaaaacttaaactcttaca

SEQ ID NO: 68338 - DNA, 20 bp, Artificial Sequence
  Description of Artificial Sequence: Synthetic oligonucleotide
  Target: SCN9A; (-) strand; PAM type: YTN; PAM sequence: CTT
caaaaaacttaaactcttac

SEQ ID NO: 68339 - DNA, 20 bp, Artificial Sequence
  Description of Artificial Sequence: Synthetic oligonucleotide
  Target: SCN9A; (-) strand; PAM type: YTN; PAM sequence: TTC
aaaccaaaaaatgacttcaa

SEQ ID NO: 68340 - DNA, 20 bp, Artificial Sequence
  Description of Artificial Sequence: Synthetic oligonucleotide
  Target: SCN9A; (-) strand; PAM type: YTN; PAM sequence: TTT
caaaccaaaaaatgacttca

SEQ ID NO: 68341 - DNA, 20 bp, Artificial Sequence
  Description of Artificial Sequence: Synthetic oligonucleotide
  Target: SCN9A; (-) strand; PAM type: YTN; PAM sequence: TTA
aagtttcaaaccaaaaaatg

SEQ ID NO: 68342 - DNA, 20 bp, Artificial Sequence
  Description of Artificial Sequence: Synthetic oligonucleotide
  Target: SCN9A; (-) strand; PAM type: YTN; PAM sequence: CTT
aaagtttcaaaccaaaaaat

SEQ ID NO: 68343 - DNA, 20 bp, Artificial Sequence
  Description of Artificial Sequence: Synthetic oligonucleotide
  Target: SCN9A; (-) strand; PAM type: YTN; PAM sequence: TTA
tcaatcaacttaaagtttca

SEQ ID NO: 68344 - DNA, 20 bp, Artificial Sequence
  Description of Artificial Sequence: Synthetic oligonucleotide
  Target: SCN9A; (-) strand; PAM type: YTN; PAM sequence: CTT
atcaatcaacttaaagtttc

SEQ ID NO: 68345 - DNA, 20 bp, Artificial Sequence
  Description of Artificial Sequence: Synthetic oligonucleotide
  Target: SCN9A; (-) strand; PAM type: YTN; PAM sequence: TTG
ggcttatcaatcaacttaaa

SEQ ID NO: 68346 - DNA, 20 bp, Artificial Sequence
  Description of Artificial Sequence: Synthetic oligonucleotide
  Target: SCN9A; (-) strand; PAM type: YTN; PAM sequence: CTA
gaaagaagttgggcttatca

SEQ ID NO: 68347 - DNA, 20 bp, Artificial Sequence
  Description of Artificial Sequence: Synthetic oligonucleotide
  Target: SCN9A; (-) strand; PAM type: YTN; PAM sequence: CTA
ggataactagaaagaagttg

SEQ ID NO: 68348 - DNA, 20 bp, Artificial Sequence
  Description of Artificial Sequence: Synthetic oligonucleotide
  Target: SCN9A; (-) strand; PAM type: YTN; PAM sequence: TTC
taggataactagaaagaagt

SEQ ID NO: 68349 - DNA, 20 bp, Artificial Sequence
  Description of Artificial Sequence: Synthetic oligonucleotide
  Target: SCN9A; (-) strand; PAM type: YTN; PAM sequence: TTA
aaattctaggataactagaa

SEQ ID NO: 68350 - DNA, 20 bp, Artificial Sequence
  Description of Artificial Sequence: Synthetic oligonucleotide
  Target: SCN9A; (-) strand; PAM type: YTN; PAM sequence: CTT
aaaattctaggataactaga

SEQ ID NO: 68351 - DNA, 20 bp, Artificial Sequence
  Description of Artificial Sequence: Synthetic oligonucleotide
  Target: SCN9A; (-) strand; PAM type: YTN; PAM sequence: TTA
tgaatgatcatgacttaaaa

SEQ ID NO: 68352 - DNA, 20 bp, Artificial Sequence
  Description of Artificial Sequence: Synthetic oligonucleotide
  Target: SCN9A; (-) strand; PAM type: YTN; PAM sequence: TTT
atgaatgatcatgacttaaa

SEQ ID NO: 68353 - DNA, 20 bp, Artificial Sequence
  Description of Artificial Sequence: Synthetic oligonucleotide
  Target: SCN9A; (-) strand; PAM type: YTN; PAM sequence: TTT
tatgaatgatcatgacttaa

SEQ ID NO: 68354 - DNA, 20 bp, Artificial Sequence
  Description of Artificial Sequence: Synthetic oligonucleotide
  Target: SCN9A; (-) strand; PAM type: YTN; PAM sequence: TTC
attttatgaatgatcatgac

SEQ ID NO: 68355 - DNA, 20 bp, Artificial Sequence
  Description of Artificial Sequence: Synthetic oligonucleotide
  Target: SCN9A; (-) strand; PAM type: YTN; PAM sequence: CTA
ttcattttatgaatgatcat

SEQ ID NO: 68356 - DNA, 20 bp, Artificial Sequence
  Description of Artificial Sequence: Synthetic oligonucleotide
  Target: SCN9A; (-) strand; PAM type: YTN; PAM sequence: TTC
cctattcattttatgaatga

SEQ ID NO: 68357 - DNA, 20 bp, Artificial Sequence
  Description of Artificial Sequence: Synthetic oligonucleotide
  Target: SCN9A; (-) strand; PAM type: YTN; PAM sequence: TTT
ccctattcattttatgaatg

SEQ ID NO: 68358 - DNA, 20 bp, Artificial Sequence
  Description of Artificial Sequence: Synthetic oligonucleotide
  Target: SCN9A; (-) strand; PAM type: YTN; PAM sequence: TTT
tccctattcattttatgaat

SEQ ID NO: 68359 - DNA, 20 bp, Artificial Sequence
  Description of Artificial Sequence: Synthetic oligonucleotide
  Target: SCN9A; (-) strand; PAM type: YTN; PAM sequence: CTA
ccaagattttccctattcat

SEQ ID NO: 68360 - DNA, 20 bp, Artificial Sequence
  Description of Artificial Sequence: Synthetic oligonucleotide
  Target: SCN9A; (-) strand; PAM type: YTN; PAM sequence: TTG
atgctaccaagattttccct

SEQ ID NO: 68361 - DNA, 20 bp, Artificial Sequence
  Description of Artificial Sequence: Synthetic oligonucleotide
  Target: SCN9A; (-) strand; PAM type: YTN; PAM sequence: TTG
tattgatgctaccaagattt

SEQ ID NO: 68362 - DNA, 20 bp, Artificial Sequence
  Description of Artificial Sequence: Synthetic oligonucleotide
  Target: SCN9A; (-) strand; PAM type: YTN; PAM sequence: TTT
gtattgatgctaccaagatt

SEQ ID NO: 68363 - DNA, 20 bp, Artificial Sequence
  Description of Artificial Sequence: Synthetic oligonucleotide
  Target: SCN9A; (-) strand; PAM type: YTN; PAM sequence: TTA
aatttgtattgatgctacca

SEQ ID NO: 68364 - DNA, 20 bp, Artificial Sequence
  Description of Artificial Sequence: Synthetic oligonucleotide
  Target: SCN9A; (-) strand; PAM type: YTN; PAM sequence: CTT
aaatttgtattgatgctacc

SEQ ID NO: 68365 - DNA, 20 bp, Artificial Sequence
  Description of Artificial Sequence: Synthetic oligonucleotide
  Target: SCN9A; (-) strand; PAM type: YTN; PAM sequence: TTA
gcagtatatagacttaaatt

SEQ ID NO: 68366 - DNA, 20 bp, Artificial Sequence
  Description of Artificial Sequence: Synthetic oligonucleotide
  Target: SCN9A; (-) strand; PAM type: YTN; PAM sequence: TTA
ttagcagtatatagacttaa

SEQ ID NO: 68367 - DNA, 20 bp, Artificial Sequence
  Description of Artificial Sequence: Synthetic oligonucleotide
  Target: SCN9A; (-) strand; PAM type: YTN; PAM sequence: TTT
attagcagtatatagactta

SEQ ID NO: 68368 - DNA, 20 bp, Artificial Sequence
  Description of Artificial Sequence: Synthetic oligonucleotide
  Target: SCN9A; (-) strand; PAM type: YTN; PAM sequence: CTC
aagaaatttattagcagtat

SEQ ID NO: 68369 - DNA, 20 bp, Artificial Sequence
  Description of Artificial Sequence: Synthetic oligonucleotide
  Target: SCN9A; (-) strand; PAM type: YTN; PAM sequence: CTC
ctcaagaaatttattagcag

SEQ ID NO: 68370 - DNA, 20 bp, Artificial Sequence
  Description of Artificial Sequence: Synthetic oligonucleotide
  Target: SCN9A; (-) strand; PAM type: YTN; PAM sequence: CTG
ctcctcaagaaatttattag

SEQ ID NO: 68371 - DNA, 20 bp, Artificial Sequence
  Description of Artificial Sequence: Synthetic oligonucleotide
  Target: SCN9A; (-) strand; PAM type: YTN; PAM sequence: TTC
atcaacatgtatggcctgct

SEQ ID NO: 68372 - DNA, 20 bp, Artificial Sequence
  Description of Artificial Sequence: Synthetic oligonucleotide
  Target: SCN9A; (-) strand; PAM type: YTN; PAM sequence: TTT
catcaacatgtatggcctgc

SEQ ID NO: 68373 - DNA, 20 bp, Artificial Sequence
  Description of Artificial Sequence: Synthetic oligonucleotide
  Target: SCN9A; (-) strand; PAM type: YTN; PAM sequence: TTA
agaatttcatcaacatgtat

SEQ ID NO: 68374 - DNA, 20 bp, Artificial Sequence
  Description of Artificial Sequence: Synthetic oligonucleotide
  Target: SCN9A; (-) strand; PAM type: YTN; PAM sequence: TTT
aagaatttcatcaacatgta

SEQ ID NO: 68375 - DNA, 20 bp, Artificial Sequence
  Description of Artificial Sequence: Synthetic oligonucleotide
  Target: SCN9A; (-) strand; PAM type: YTN; PAM sequence: TTA
cagagatttaagaatttcat

SEQ ID NO: 68376 - DNA, 20 bp, Artificial Sequence
  Description of Artificial Sequence: Synthetic oligonucleotide
  Target: SCN9A; (-) strand; PAM type: YTN; PAM sequence: TTA
aaagtgtccatgttacagag

SEQ ID NO: 68377 - DNA, 20 bp, Artificial Sequence
  Description of Artificial Sequence: Synthetic oligonucleotide
  Target: SCN9A; (-) strand; PAM type: YTN; PAM sequence: TTT
aaaagtgtccatgttacaga

SEQ ID NO: 68378 - DNA, 20 bp, Artificial Sequence
  Description of Artificial Sequence: Synthetic oligonucleotide
  Target: SCN9A; (-) strand; PAM type: YTN; PAM sequence: CTT
taaaagtgtccatgttacag

SEQ ID NO: 68379 - DNA, 20 bp, Artificial Sequence
  Description of Artificial Sequence: Synthetic oligonucleotide
  Target: SCN9A; (-) strand; PAM type: YTN; PAM sequence: TTC
ctttaaaagtgtccatgtta

SEQ ID NO: 68380 - DNA, 20 bp, Artificial Sequence
  Description of Artificial Sequence: Synthetic oligonucleotide
  Target: SCN9A; (-) strand; PAM type: YTN; PAM sequence: TTT
cctttaaaagtgtccatgtt

SEQ ID NO: 68381 - DNA, 20 bp, Artificial Sequence
  Description of Artificial Sequence: Synthetic oligonucleotide
  Target: SCN9A; (-) strand; PAM type: YTN; PAM sequence: CTA
taagcaaatgcacagtttcc

SEQ ID NO: 68382 - DNA, 20 bp, Artificial Sequence
  Description of Artificial Sequence: Synthetic oligonucleotide
  Target: SCN9A; (-) strand; PAM type: YTN; PAM sequence: TTA
gtgctataagcaaatgcaca

SEQ ID NO: 68383 - DNA, 20 bp, Artificial Sequence
  Description of Artificial Sequence: Synthetic oligonucleotide
  Target: SCN9A; (-) strand; PAM type: YTN; PAM sequence: CTG
aaattagtgctataagcaaa

SEQ ID NO: 68384 - DNA, 20 bp, Artificial Sequence
  Description of Artificial Sequence: Synthetic oligonucleotide
  Target: SCN9A; (-) strand; PAM type: YTN; PAM sequence: TTG
ctgaaattagtgctataagc

SEQ ID NO: 68385 - DNA, 20 bp, Artificial Sequence
  Description of Artificial Sequence: Synthetic oligonucleotide
  Target: SCN9A; (-) strand; PAM type: YTN; PAM sequence: CTT
gctgaaattagtgctataag

SEQ ID NO: 68386 - DNA, 20 bp, Artificial Sequence
  Description of Artificial Sequence: Synthetic oligonucleotide
  Target: SCN9A; (-) strand; PAM type: YTN; PAM sequence: TTG
tgcttgctgaaattagtgct

SEQ ID NO: 68387 - DNA, 20 bp, Artificial Sequence
  Description of Artificial Sequence: Synthetic oligonucleotide
  Target: SCN9A; (-) strand; PAM type: YTN; PAM sequence: TTT
gtgcttgctgaaattagtgc

SEQ ID NO: 68388 - DNA, 20 bp, Artificial Sequence
  Description of Artificial Sequence: Synthetic oligonucleotide
  Target: SCN9A; (-) strand; PAM type: YTN; PAM sequence: TTT
tgtgcttgctgaaattagtg

SEQ ID NO: 68389 - DNA, 20 bp, Artificial Sequence
  Description of Artificial Sequence: Synthetic oligonucleotide
  Target: SCN9A; (-) strand; PAM type: YTN; PAM sequence: TTA
tgtaagaagcaaaggtgtac

SEQ ID NO: 68390 - DNA, 20 bp, Artificial Sequence
  Description of Artificial Sequence: Synthetic oligonucleotide
  Target: SCN9A; (-) strand; PAM type: YTN; PAM sequence: TTT
atgtaagaagcaaaggtgta

SEQ ID NO: 68391 - DNA, 20 bp, Artificial Sequence
  Description of Artificial Sequence: Synthetic oligonucleotide
  Target: SCN9A; (-) strand; PAM type: YTN; PAM sequence: TTT
tatgtaagaagcaaaggtgt

SEQ ID NO: 68392 - DNA, 20 bp, Artificial Sequence
  Description of Artificial Sequence: Synthetic oligonucleotide
  Target: SCN9A; (-) strand; PAM type: YTN; PAM sequence: TTA
aatacacaccaaatatcatt

SEQ ID NO: 68393 - DNA, 20 bp, Artificial Sequence
  Description of Artificial Sequence: Synthetic oligonucleotide
  Target: SCN9A; (-) strand; PAM type: YTN; PAM sequence: TTT
aaatacacaccaaatatcat

SEQ ID NO: 68394 - DNA, 20 bp, Artificial Sequence
  Description of Artificial Sequence: Synthetic oligonucleotide
  Target: SCN9A; (-) strand; PAM type: YTN; PAM sequence: CTT
taaatacacaccaaatatca

SEQ ID NO: 68395 - DNA, 20 bp, Artificial Sequence
  Description of Artificial Sequence: Synthetic oligonucleotide
  Target: SCN9A; (-) strand; PAM type: YTN; PAM sequence: TTC
tttaaatacacaccaaatat

SEQ ID NO: 68396 - DNA, 20 bp, Artificial Sequence
  Description of Artificial Sequence: Synthetic oligonucleotide
  Target: SCN9A; (-) strand; PAM type: YTN; PAM sequence: TTT
ctttaaatacacaccaaata

SEQ ID NO: 68397 - DNA, 20 bp, Artificial Sequence
  Description of Artificial Sequence: Synthetic oligonucleotide
  Target: SCN9A; (-) strand; PAM type: YTN; PAM sequence: TTT
tctttaaatacacaccaaat

SEQ ID NO: 68398 - DNA, 20 bp, Artificial Sequence
  Description of Artificial Sequence: Synthetic oligonucleotide
  Target: SCN9A; (-) strand; PAM type: YTN; PAM sequence: CTA
caaagagtgcatggattttc

SEQ ID NO: 68399 - DNA, 20 bp, Artificial Sequence
  Description of Artificial Sequence: Synthetic oligonucleotide
  Target: SCN9A; (-) strand; PAM type: YTN; PAM sequence: TTG
gaaaataaagacatcagcaa

SEQ ID NO: 68400 - DNA, 20 bp, Artificial Sequence
  Description of Artificial Sequence: Synthetic oligonucleotide
  Target: SCN9A; (-) strand; PAM type: YTN; PAM sequence: TTA
agcaaaatgattggaaaata

SEQ ID NO: 68401 - DNA, 20 bp, Artificial Sequence
  Description of Artificial Sequence: Synthetic oligonucleotide
  Target: SCN9A; (-) strand; PAM type: YTN; PAM sequence: TTC
atgggttaagcaaaatgatt

SEQ ID NO: 68402 - DNA, 20 bp, Artificial Sequence
  Description of Artificial Sequence: Synthetic oligonucleotide
  Target: SCN9A; (-) strand; PAM type: YTN; PAM sequence: TTA
taacattcatgggttaagca

SEQ ID NO: 68403 - DNA, 20 bp, Artificial Sequence
  Description of Artificial Sequence: Synthetic oligonucleotide
  Target: SCN9A; (-) strand; PAM type: YTN; PAM sequence: CTT
ataacattcatgggttaagc

SEQ ID NO: 68404 - DNA, 20 bp, Artificial Sequence
  Description of Artificial Sequence: Synthetic oligonucleotide
  Target: SCN9A; (-) strand; PAM type: YTN; PAM sequence: TTC
ttataacattcatgggttaa

SEQ ID NO: 68405 - DNA, 20 bp, Artificial Sequence
  Description of Artificial Sequence: Synthetic oligonucleotide
  Target: SCN9A; (-) strand; PAM type: YTN; PAM sequence: TTT
cttataacattcatgggtta

SEQ ID NO: 68406 - DNA, 20 bp, Artificial Sequence
  Description of Artificial Sequence: Synthetic oligonucleotide
  Target: SCN9A; (-) strand; PAM type: YTN; PAM sequence: CTG
gtttcttataacattcatgg

SEQ ID NO: 68407 - DNA, 20 bp, Artificial Sequence
  Description of Artificial Sequence: Synthetic oligonucleotide
  Target: SCN9A; (-) strand; PAM type: YTN; PAM sequence: CTC
aactggtttcttataacatt

SEQ ID NO: 68408 - DNA, 20 bp, Artificial Sequence
  Description of Artificial Sequence: Synthetic oligonucleotide
  Target: SCN9A; (-) strand; PAM type: YTN; PAM sequence: TTC
tcaactggtttcttataaca

SEQ ID NO: 68409 - DNA, 20 bp, Artificial Sequence
  Description of Artificial Sequence: Synthetic oligonucleotide
  Target: SCN9A; (-) strand; PAM type: YTN; PAM sequence: TTT
ctcaactggtttcttataac

SEQ ID NO: 68410 - DNA, 20 bp, Artificial Sequence
  Description of Artificial Sequence: Synthetic oligonucleotide
  Target: SCN9A; (-) strand; PAM type: YTN; PAM sequence: TTT
tctcaactggtttcttataa

SEQ ID NO: 68411 - DNA, 20 bp, Artificial Sequence
  Description of Artificial Sequence: Synthetic oligonucleotide
  Target: SCN9A; (-) strand; PAM type: YTN; PAM sequence: TTC
agtgtccaagattttctcaa

SEQ ID NO: 68412 - DNA, 20 bp, Artificial Sequence
  Description of Artificial Sequence: Synthetic oligonucleotide
  Target: SCN9A; (-) strand; PAM type: YTN; PAM sequence: TTT
cagtgtccaagattttctca

SEQ ID NO: 68413 - DNA, 20 bp, Artificial Sequence
  Description of Artificial Sequence: Synthetic oligonucleotide
  Target: SCN9A; (-) strand; PAM type: YTN; PAM sequence: CTT
tcagtgtccaagattttctc

SEQ ID NO: 68414 - DNA, 20 bp, Artificial Sequence
  Description of Artificial Sequence: Synthetic oligonucleotide
  Target: SCN9A; (-) strand; PAM type: YTN; PAM sequence: TTG
ctttcagtgtccaagatttt

SEQ ID NO: 68415 - DNA, 20 bp, Artificial Sequence
  Description of Artificial Sequence: Synthetic oligonucleotide
  Target: SCN9A; (-) strand; PAM type: YTN; PAM sequence: CTT
gctttcagtgtccaagattt

SEQ ID NO: 68416 - DNA, 20 bp, Artificial Sequence
  Description of Artificial Sequence: Synthetic oligonucleotide
  Target: SCN9A; (-) strand; PAM type: YTN; PAM sequence: TTG
aaaaatcatcgacttgcttt

SEQ ID NO: 68417 - DNA, 20 bp, Artificial Sequence
  Description of Artificial Sequence: Synthetic oligonucleotide
  Target: SCN9A; (-) strand; PAM type: YTN; PAM sequence: TTT
gaaaaatcatcgacttgctt

SEQ ID NO: 68418 - DNA, 20 bp, Artificial Sequence
  Description of Artificial Sequence: Synthetic oligonucleotide
  Target: SCN9A; (-) strand; PAM type: YTN; PAM sequence: TTT
tgaaaaatcatcgacttgct

SEQ ID NO: 68419 - DNA, 20 bp, Artificial Sequence
  Description of Artificial Sequence: Synthetic oligonucleotide
  Target: SCN9A; (-) strand; PAM type: YTN; PAM sequence: TTT
ttgaaaaatcatcgacttgc

SEQ ID NO: 68420 - DNA, 20 bp, Artificial Sequence
  Description of Artificial Sequence: Synthetic oligonucleotide
  Target: SCN9A; (-) strand; PAM type: YTN; PAM sequence: TTT
tttgaaaaatcatcgacttg

SEQ ID NO: 68421 - DNA, 20 bp, Artificial Sequence
  Description of Artificial Sequence: Synthetic oligonucleotide
  Target: SCN9A; (-) strand; PAM type: YTN; PAM sequence: TTA
gtattttttgaaaaatcatc

SEQ ID NO: 68422 - DNA, 20 bp, Artificial Sequence
  Description of Artificial Sequence: Synthetic oligonucleotide
  Target: SCN9A; (-) strand; PAM type: YTN; PAM sequence: CTC
agcattagtattttttgaaa

SEQ ID NO: 68423 - DNA, 20 bp, Artificial Sequence
  Description of Artificial Sequence: Synthetic oligonucleotide
  Target: SCN9A; (-) strand; PAM type: YTN; PAM sequence: TTA
ccctcagcattagtattttt

SEQ ID NO: 68424 - DNA, 20 bp, Artificial Sequence
  Description of Artificial Sequence: Synthetic oligonucleotide
  Target: SCN9A; (-) strand; PAM type: YTN; PAM sequence: CTT
accctcagcattagtatttt

SEQ ID NO: 68425 - DNA, 20 bp, Artificial Sequence
  Description of Artificial Sequence: Synthetic oligonucleotide
  Target: SCN9A; (-) strand; PAM type: YTN; PAM sequence: CTA
gtcatgggcttaccctcagc

SEQ ID NO: 68426 - DNA, 20 bp, Artificial Sequence
  Description of Artificial Sequence: Synthetic oligonucleotide
  Target: SCN9A; (-) strand; PAM type: YTN; PAM sequence: TTA
tctagtcatgggcttaccct

SEQ ID NO: 68427 - DNA, 20 bp, Artificial Sequence
  Description of Artificial Sequence: Synthetic oligonucleotide
  Target: SCN9A; (-) strand; PAM type: YTN; PAM sequence: CTT
atctagtcatgggcttaccc

SEQ ID NO: 68428 - DNA, 20 bp, Artificial Sequence
  Description of Artificial Sequence: Synthetic oligonucleotide
  Target: SCN9A; (-) strand; PAM type: YTN; PAM sequence: CTA
atgacttatctagtcatggg

SEQ ID NO: 68429 - DNA, 20 bp, Artificial Sequence
  Description of Artificial Sequence: Synthetic oligonucleotide
  Target: SCN9A; (-) strand; PAM type: YTN; PAM sequence: TTA
tgatagcacagatgctaatg

SEQ ID NO: 68430 - DNA, 20 bp, Artificial Sequence
  Description of Artificial Sequence: Synthetic oligonucleotide
  Target: SCN9A; (-) strand; PAM type: YTN; PAM sequence: TTA
tacagaagttatgatagcac

SEQ ID NO: 68431 - DNA, 20 bp, Artificial Sequence
  Description of Artificial Sequence: Synthetic oligonucleotide
  Target: SCN9A; (-) strand; PAM type: YTN; PAM sequence: CTT
atacagaagttatgatagca

SEQ ID NO: 68432 - DNA, 20 bp, Artificial Sequence
  Description of Artificial Sequence: Synthetic oligonucleotide
  Target: SCN9A; (-) strand; PAM type: YTN; PAM sequence: TTA
acaatcttatacagaagtta

SEQ ID NO: 68433 - DNA, 20 bp, Artificial Sequence
  Description of Artificial Sequence: Synthetic oligonucleotide
  Target: SCN9A; (-) strand; PAM type: YTN; PAM sequence: CTG
ttaacaatcttatacagaag

SEQ ID NO: 68434 - DNA, 20 bp, Artificial Sequence
  Description of Artificial Sequence: Synthetic oligonucleotide
  Target: SCN9A; (-) strand; PAM type: YTN; PAM sequence: TTC
tgttaacaatcttatacaga

SEQ ID NO: 68435 - DNA, 20 bp, Artificial Sequence
  Description of Artificial Sequence: Synthetic oligonucleotide
  Target: SCN9A; (-) strand; PAM type: YTN; PAM sequence: TTC
aaggattctgttaacaatct

SEQ ID NO: 68436 - DNA, 20 bp, Artificial Sequence
  Description of Artificial Sequence: Synthetic oligonucleotide
  Target: SCN9A; (-) strand; PAM type: YTN; PAM sequence: CTT
caaggattctgttaacaatc

SEQ ID NO: 68437 - DNA, 20 bp, Artificial Sequence
  Description of Artificial Sequence: Synthetic oligonucleotide
  Target: SCN9A; (-) strand; PAM type: YTN; PAM sequence: TTC
ttcaaggattctgttaacaa

SEQ ID NO: 68438 - DNA, 20 bp, Artificial Sequence
  Description of Artificial Sequence: Synthetic oligonucleotide
  Target: SCN9A; (-) strand; PAM type: YTN; PAM sequence: TTA
ttcttcaaggattctgttaa

SEQ ID NO: 68439 - DNA, 20 bp, Artificial Sequence
  Description of Artificial Sequence: Synthetic oligonucleotide
  Target: SCN9A; (-) strand; PAM type: YTN; PAM sequence: CTT
attcttcaaggattctgtta

SEQ ID NO: 68440 - DNA, 20 bp, Artificial Sequence
  Description of Artificial Sequence: Synthetic oligonucleotide
  Target: SCN9A; (-) strand; PAM type: YTN; PAM sequence: TTC
ttattcttcaaggattctgt

SEQ ID NO: 68441 - DNA, 20 bp, Artificial Sequence
  Description of Artificial Sequence: Synthetic oligonucleotide
  Target: SCN9A; (-) strand; PAM type: YTN; PAM sequence: TTT
cttattcttcaaggattctg

SEQ ID NO: 68442 - DNA, 20 bp, Artificial Sequence
  Description of Artificial Sequence: Synthetic oligonucleotide
  Target: SCN9A; (-) strand; PAM type: YTN; PAM sequence: TTT
tcttattcttcaaggattct

SEQ ID NO: 68443 - DNA, 20 bp, Artificial Sequence
  Description of Artificial Sequence: Synthetic oligonucleotide
  Target: SCN9A; (-) strand; PAM type: YTN; PAM sequence: CTT
ttcttattcttcaaggattc

SEQ ID NO: 68444 - DNA, 20 bp, Artificial Sequence
  Description of Artificial Sequence: Synthetic oligonucleotide
  Target: SCN9A; (-) strand; PAM type: YTN; PAM sequence: CTA
cttttcttattcttcaagga

SEQ ID NO: 68445 - DNA, 20 bp, Artificial Sequence
  Description of Artificial Sequence: Synthetic oligonucleotide
  Target: SCN9A; (-) strand; PAM type: YTN; PAM sequence: TTC
tacttttcttattcttcaag

SEQ ID NO: 68446 - DNA, 20 bp, Artificial Sequence
  Description of Artificial Sequence: Synthetic oligonucleotide
  Target: SCN9A; (-) strand; PAM type: YTN; PAM sequence: CTT
ctacttttcttattcttcaa

SEQ ID NO: 68447 - DNA, 20 bp, Artificial Sequence
  Description of Artificial Sequence: Synthetic oligonucleotide
  Target: SCN9A; (-) strand; PAM type: YTN; PAM sequence: TTC
ttctacttttcttattcttc

SEQ ID NO: 68448 - DNA, 20 bp, Artificial Sequence
  Description of Artificial Sequence: Synthetic oligonucleotide
  Target: SCN9A; (-) strand; PAM type: YTN; PAM sequence: CTT
cttctacttttcttattctt

SEQ ID NO: 68449 - DNA, 20 bp, Artificial Sequence
  Description of Artificial Sequence: Synthetic oligonucleotide
  Target: SCN9A; (-) strand; PAM type: YTN; PAM sequence: TTC
cttcttctacttttcttatt

SEQ ID NO: 68450 - DNA, 20 bp, Artificial Sequence
  Description of Artificial Sequence: Synthetic oligonucleotide
  Target: SCN9A; (-) strand; PAM type: YTN; PAM sequence: CTT
ccttcttctacttttcttat

SEQ ID NO: 68451 - DNA, 20 bp, Artificial Sequence
  Description of Artificial Sequence: Synthetic oligonucleotide
  Target: SCN9A; (-) strand; PAM type: YTN; PAM sequence: CTA
tcttccttcttctacttttc

SEQ ID NO: 68452 - DNA, 20 bp, Artificial Sequence
  Description of Artificial Sequence: Synthetic oligonucleotide
  Target: SCN9A; (-) strand; PAM type: YTN; PAM sequence: CTA
gcacagtgcctatcttcctt

SEQ ID NO: 68453 - DNA, 20 bp, Artificial Sequence
  Description of Artificial Sequence: Synthetic oligonucleotide
  Target: SCN9A; (-) strand; PAM type: YTN; PAM sequence: TTA
ctagcacagtgcctatcttc

SEQ ID NO: 68454 - DNA, 20 bp, Artificial Sequence
  Description of Artificial Sequence: Synthetic oligonucleotide
  Target: SCN9A; (-) strand; PAM type: YTN; PAM sequence: CTT
actagcacagtgcctatctt

SEQ ID NO: 68455 - DNA, 20 bp, Artificial Sequence
  Description of Artificial Sequence: Synthetic oligonucleotide
  Target: SCN9A; (-) strand; PAM type: YTN; PAM sequence: TTA
taaacttactagcacagtgc

SEQ ID NO: 68456 - DNA, 20 bp, Artificial Sequence
  Description of Artificial Sequence: Synthetic oligonucleotide
  Target: SCN9A; (-) strand; PAM type: YTN; PAM sequence: CTA
agaggatcaaataagataat

SEQ ID NO: 68457 - DNA, 20 bp, Artificial Sequence
  Description of Artificial Sequence: Synthetic oligonucleotide
  Target: SCN9A; (-) strand; PAM type: YTN; PAM sequence: CTG
taaaatggggatatcagcat

SEQ ID NO: 68458 - DNA, 20 bp, Artificial Sequence
  Description of Artificial Sequence: Synthetic oligonucleotide
  Target: SCN9A; (-) strand; PAM type: YTN; PAM sequence: CTC
atctgtaaaatggggatatc

SEQ ID NO: 68459 - DNA, 20 bp, Artificial Sequence
  Description of Artificial Sequence: Synthetic oligonucleotide
  Target: SCN9A; (-) strand; PAM type: YTN; PAM sequence: TTC
agatatctcatctgtaaaat

SEQ ID NO: 68460 - DNA, 20 bp, Artificial Sequence
  Description of Artificial Sequence: Synthetic oligonucleotide
  Target: SCN9A; (-) strand; PAM type: YTN; PAM sequence: CTT
cagatatctcatctgtaaaa

SEQ ID NO: 68461 - DNA, 20 bp, Artificial Sequence
  Description of Artificial Sequence: Synthetic oligonucleotide
  Target: SCN9A; (-) strand; PAM type: YTN; PAM sequence: TTC
ttcagatatctcatctgtaa

SEQ ID NO: 68462 - DNA, 20 bp, Artificial Sequence
  Description of Artificial Sequence: Synthetic oligonucleotide
  Target: SCN9A; (-) strand; PAM type: YTN; PAM sequence: TTG
ttcttcagatatctcatctg

SEQ ID NO: 68463 - DNA, 20 bp, Artificial Sequence
  Description of Artificial Sequence: Synthetic oligonucleotide
  Target: SCN9A; (-) strand; PAM type: YTN; PAM sequence: CTT
gttcttcagatatctcatct

SEQ ID NO: 68464 - DNA, 20 bp, Artificial Sequence
  Description of Artificial Sequence: Synthetic oligonucleotide
  Target: SCN9A; (-) strand; PAM type: YTN; PAM sequence: TTA
aaatcttgttcttcagatat

SEQ ID NO: 68465 - DNA, 20 bp, Artificial Sequence
  Description of Artificial Sequence: Synthetic oligonucleotide
  Target: SCN9A; (-) strand; PAM type: YTN; PAM sequence: TTT
aaaatcttgttcttcagata

SEQ ID NO: 68466 - DNA, 20 bp, Artificial Sequence
  Description of Artificial Sequence: Synthetic oligonucleotide
  Target: SCN9A; (-) strand; PAM type: YTN; PAM sequence: TTG
tgcacaatttaaaatcttgt

SEQ ID NO: 68467 - DNA, 20 bp, Artificial Sequence
  Description of Artificial Sequence: Synthetic oligonucleotide
  Target: SCN9A; (-) strand; PAM type: YTN; PAM sequence: CTT
gtgcacaatttaaaatcttg

SEQ ID NO: 68468 - DNA, 20 bp, Artificial Sequence
  Description of Artificial Sequence: Synthetic oligonucleotide
  Target: SCN9A; (-) strand; PAM type: YTN; PAM sequence: CTG
tgagaacttgtgcacaattt

SEQ ID NO: 68469 - DNA, 20 bp, Artificial Sequence
  Description of Artificial Sequence: Synthetic oligonucleotide
  Target: SCN9A; (-) strand; PAM type: YTN; PAM sequence: CTG
cctgtgagaacttgtgcaca

SEQ ID NO: 68470 - DNA, 20 bp, Artificial Sequence
  Description of Artificial Sequence: Synthetic oligonucleotide
  Target: SCN9A; (-) strand; PAM type: YTN; PAM sequence: TTA
tctgcctgtgagaacttgtg

SEQ ID NO: 68471 - DNA, 20 bp, Artificial Sequence
  Description of Artificial Sequence: Synthetic oligonucleotide
  Target: SCN9A; (-) strand; PAM type: YTN; PAM sequence: CTT
atctgcctgtgagaacttgt

SEQ ID NO: 68472 - DNA, 20 bp, Artificial Sequence
  Description of Artificial Sequence: Synthetic oligonucleotide
  Target: SCN9A; (-) strand; PAM type: YTN; PAM sequence: TTG
ccgacttatctgcctgtgag

SEQ ID NO: 68473 - DNA, 20 bp, Artificial Sequence
  Description of Artificial Sequence: Synthetic oligonucleotide
  Target: SCN9A; (-) strand; PAM type: YTN; PAM sequence: TTT
gccgacttatctgcctgtga

SEQ ID NO: 68474 - DNA, 20 bp, Artificial Sequence
  Description of Artificial Sequence: Synthetic oligonucleotide
  Target: SCN9A; (-) strand; PAM type: YTN; PAM sequence: CTA
atttgccgacttatctgcct

SEQ ID NO: 68475 - DNA, 20 bp, Artificial Sequence
  Description of Artificial Sequence: Synthetic oligonucleotide
  Target: SCN9A; (-) strand; PAM type: YTN; PAM sequence: TTC
taatttgccgacttatctgc

SEQ ID NO: 68476 - DNA, 20 bp, Artificial Sequence
  Description of Artificial Sequence: Synthetic oligonucleotide
  Target: SCN9A; (-) strand; PAM type: YTN; PAM sequence: CTG
ataaacatatgttctaattt

SEQ ID NO: 68477 - DNA, 20 bp, Artificial Sequence
  Description of Artificial Sequence: Synthetic oligonucleotide
  Target: SCN9A; (-) strand; PAM type: YTN; PAM sequence: TTG
gagcctgataaacatatgtt

SEQ ID NO: 68478 - DNA, 20 bp, Artificial Sequence
  Description of Artificial Sequence: Synthetic oligonucleotide
  Target: SCN9A; (-) strand; PAM type: YTN; PAM sequence: TTT
ggagcctgataaacatatgt

SEQ ID NO: 68479 - DNA, 20 bp, Artificial Sequence
  Description of Artificial Sequence: Synthetic oligonucleotide
  Target: SCN9A; (-) strand; PAM type: YTN; PAM sequence: CTT
tggagcctgataaacatatg

SEQ ID NO: 68480 - DNA, 20 bp, Artificial Sequence
  Description of Artificial Sequence: Synthetic oligonucleotide
  Target: SCN9A; (-) strand; PAM type: YTN; PAM sequence: TTC
aaactttggagcctgataaa

SEQ ID NO: 68481 - DNA, 20 bp, Artificial Sequence
  Description of Artificial Sequence: Synthetic oligonucleotide
  Target: SCN9A; (-) strand; PAM type: YTN; PAM sequence: CTG
caatgtaatacagtaataca

SEQ ID NO: 68482 - DNA, 20 bp, Artificial Sequence
  Description of Artificial Sequence: Synthetic oligonucleotide
  Target: SCN9A; (-) strand; PAM type: YTN; PAM sequence: CTA
ggtaaaaatacaagcccaga

SEQ ID NO: 68483 - DNA, 20 bp, Artificial Sequence
  Description of Artificial Sequence: Synthetic oligonucleotide
  Target: SCN9A; (-) strand; PAM type: YTN; PAM sequence: TTG
tatcatctaggtaaaaatac

SEQ ID NO: 68484 - DNA, 20 bp, Artificial Sequence
  Description of Artificial Sequence: Synthetic oligonucleotide
  Target: SCN9A; (-) strand; PAM type: YTN; PAM sequence: CTG
aacaagtattgtatcatcta

SEQ ID NO: 68485 - DNA, 20 bp, Artificial Sequence
  Description of Artificial Sequence: Synthetic oligonucleotide
  Target: SCN9A; (-) strand; PAM type: YTN; PAM sequence: TTG
tctgaacaagtattgtatca

SEQ ID NO: 68486 - DNA, 20 bp, Artificial Sequence
  Description of Artificial Sequence: Synthetic oligonucleotide
  Target: SCN9A; (-) strand; PAM type: YTN; PAM sequence: TTG
tcagggataatgcagtattg

SEQ ID NO: 68487 - DNA, 20 bp, Artificial Sequence
  Description of Artificial Sequence: Synthetic oligonucleotide
  Target: SCN9A; (-) strand; PAM type: YTN; PAM sequence: TTT
gtcagggataatgcagtatt

SEQ ID NO: 68488 - DNA, 20 bp, Artificial Sequence
  Description of Artificial Sequence: Synthetic oligonucleotide
  Target: SCN9A; (-) strand; PAM type: YTN; PAM sequence: CTG
gaatttgtcagggataatgc

SEQ ID NO: 68489 - DNA, 20 bp, Artificial Sequence
  Description of Artificial Sequence: Synthetic oligonucleotide
  Target: SCN9A; (-) strand; PAM type: YTN; PAM sequence: TTC
tggaatttgtcagggataat

SEQ ID NO: 68490 - DNA, 20 bp, Artificial Sequence
  Description of Artificial Sequence: Synthetic oligonucleotide
  Target: SCN9A; (-) strand; PAM type: YTN; PAM sequence: CTT
ctggaatttgtcagggataa

SEQ ID NO: 68491 - DNA, 20 bp, Artificial Sequence
  Description of Artificial Sequence: Synthetic oligonucleotide
  Target: SCN9A; (-) strand; PAM type: YTN; PAM sequence: CTA
cttctggaatttgtcaggga

SEQ ID NO: 68492 - DNA, 20 bp, Artificial Sequence
  Description of Artificial Sequence: Synthetic oligonucleotide
  Target: SCN9A; (-) strand; PAM type: YTN; PAM sequence: TTA
ctacttctggaatttgtcag

SEQ ID NO: 68493 - DNA, 20 bp, Artificial Sequence
  Description of Artificial Sequence: Synthetic oligonucleotide
  Target: SCN9A; (-) strand; PAM type: YTN; PAM sequence: CTT
actacttctggaatttgtca

SEQ ID NO: 68494 - DNA, 20 bp, Artificial Sequence
  Description of Artificial Sequence: Synthetic oligonucleotide
  Target: SCN9A; (-) strand; PAM type: YTN; PAM sequence: TTC
ttactacttctggaatttgt

SEQ ID NO: 68495 - DNA, 20 bp, Artificial Sequence
  Description of Artificial Sequence: Synthetic oligonucleotide
  Target: SCN9A; (-) strand; PAM type: YTN; PAM sequence: TTT
cttactacttctggaatttg

SEQ ID NO: 68496 - DNA, 20 bp, Artificial Sequence
  Description of Artificial Sequence: Synthetic oligonucleotide
  Target: SCN9A; (-) strand; PAM type: YTN; PAM sequence: CTG
aatttcttactacttctgga

SEQ ID NO: 68497 - DNA, 20 bp, Artificial Sequence
  Description of Artificial Sequence: Synthetic oligonucleotide
  Target: SCN9A; (-) strand; PAM type: YTN; PAM sequence: CTG
atatgctgaatttcttacta

SEQ ID NO: 68498 - DNA, 20 bp, Artificial Sequence
  Description of Artificial Sequence: Synthetic oligonucleotide
  Target: SCN9A; (-) strand; PAM type: YTN; PAM sequence: TTC
tgatatgctgaatttcttac

SEQ ID NO: 68499 - DNA, 20 bp, Artificial Sequence
  Description of Artificial Sequence: Synthetic oligonucleotide
  Target: SCN9A; (-) strand; PAM type: YTN; PAM sequence: TTT
ctgatatgctgaatttctta

SEQ ID NO: 68500 - DNA, 20 bp, Artificial Sequence
  Description of Artificial Sequence: Synthetic oligonucleotide
  Target: SCN9A; (-) strand; PAM type: YTN; PAM sequence: CTT
tctgatatgctgaatttctt

SEQ ID NO: 68501 - DNA, 20 bp, Artificial Sequence
  Description of Artificial Sequence: Synthetic oligonucleotide
  Target: SCN9A; (-) strand; PAM type: YTN; PAM sequence: CTG
tatgctttctgatatgctga

SEQ ID NO: 68502 - DNA, 20 bp, Artificial Sequence
  Description of Artificial Sequence: Synthetic oligonucleotide
  Target: SCN9A; (-) strand; PAM type: YTN; PAM sequence: CTC
ctgtatgctttctgatatgc

SEQ ID NO: 68503 - DNA, 20 bp, Artificial Sequence
  Description of Artificial Sequence: Synthetic oligonucleotide
  Target: SCN9A; (-) strand; PAM type: YTN; PAM sequence: CTA
ctcctgtatgctttctgata

SEQ ID NO: 68504 - DNA, 20 bp, Artificial Sequence
  Description of Artificial Sequence: Synthetic oligonucleotide
  Target: SCN9A; (-) strand; PAM type: YTN; PAM sequence: TTC
tactcctgtatgctttctga

SEQ ID NO: 68505 - DNA, 20 bp, Artificial Sequence
  Description of Artificial Sequence: Synthetic oligonucleotide
  Target: SCN9A; (-) strand; PAM type: YTN; PAM sequence: CTT
ctactcctgtatgctttctg

SEQ ID NO: 68506 - DNA, 20 bp, Artificial Sequence
  Description of Artificial Sequence: Synthetic oligonucleotide
  Target: SCN9A; (-) strand; PAM type: YTN; PAM sequence: CTC
cttctactcctgtatgcttt

SEQ ID NO: 68507 - DNA, 20 bp, Artificial Sequence
  Description of Artificial Sequence: Synthetic oligonucleotide
  Target: SCN9A; (-) strand; PAM type: YTN; PAM sequence: TTG
taacagtacctccttctact

SEQ ID NO: 68508 - DNA, 20 bp, Artificial Sequence
  Description of Artificial Sequence: Synthetic oligonucleotide
  Target: SCN9A; (-) strand; PAM type: YTN; PAM sequence: TTT
gtaacagtacctccttctac

SEQ ID NO: 68509 - DNA, 20 bp, Artificial Sequence
  Description of Artificial Sequence: Synthetic oligonucleotide
  Target: SCN9A; (-) strand; PAM type: YTN; PAM sequence: TTT
tgtaacagtacctccttcta

SEQ ID NO: 68510 - DNA, 20 bp, Artificial Sequence
  Description of Artificial Sequence: Synthetic oligonucleotide
  Target: SCN9A; (-) strand; PAM type: YTN; PAM sequence: TTG
ttttgtaacagtacctcctt

SEQ ID NO: 68511 - DNA, 20 bp, Artificial Sequence
  Description of Artificial Sequence: Synthetic oligonucleotide
  Target: SCN9A; (-) strand; PAM type: YTN; PAM sequence: CTT
gttttgtaacagtacctcct

SEQ ID NO: 68512 - DNA, 20 bp, Artificial Sequence
  Description of Artificial Sequence: Synthetic oligonucleotide
  Target: SCN9A; (-) strand; PAM type: YTN; PAM sequence: CTC
ttgttttgtaacagtacctc

SEQ ID NO: 68513 - DNA, 20 bp, Artificial Sequence
  Description of Artificial Sequence: Synthetic oligonucleotide
  Target: SCN9A; (-) strand; PAM type: YTN; PAM sequence: TTA
gtctcttgttttgtaacagt

SEQ ID NO: 68514 - DNA, 20 bp, Artificial Sequence
  Description of Artificial Sequence: Synthetic oligonucleotide
  Target: SCN9A; (-) strand; PAM type: YTN; PAM sequence: CTT
agtctcttgttttgtaacag

SEQ ID NO: 68515 - DNA, 20 bp, Artificial Sequence
  Description of Artificial Sequence: Synthetic oligonucleotide
  Target: SCN9A; (-) strand; PAM type: YTN; PAM sequence: TTG
gccttagtctcttgttttgt

SEQ ID NO: 68516 - DNA, 20 bp, Artificial Sequence
  Description of Artificial Sequence: Synthetic oligonucleotide
  Target: SCN9A; (-) strand; PAM type: YTN; PAM sequence: TTT
ggccttagtctcttgttttg

SEQ ID NO: 68517 - DNA, 20 bp, Artificial Sequence
  Description of Artificial Sequence: Synthetic oligonucleotide
  Target: SCN9A; (-) strand; PAM type: YTN; PAM sequence: TTA
catttggccttagtctcttg

SEQ ID NO: 68518 - DNA, 20 bp, Artificial Sequence
  Description of Artificial Sequence: Synthetic oligonucleotide
  Target: SCN9A; (-) strand; PAM type: YTN; PAM sequence: TTT
acatttggccttagtctctt

SEQ ID NO: 68519 - DNA, 20 bp, Artificial Sequence
  Description of Artificial Sequence: Synthetic oligonucleotide
  Target: SCN9A; (-) strand; PAM type: YTN; PAM sequence: CTT
tacatttggccttagtctct

SEQ ID NO: 68520 - DNA, 20 bp, Artificial Sequence
  Description of Artificial Sequence: Synthetic oligonucleotide
  Target: SCN9A; (-) strand; PAM type: YTN; PAM sequence: TTC
tttacatttggccttagtct

SEQ ID NO: 68521 - DNA, 20 bp, Artificial Sequence
  Description of Artificial Sequence: Synthetic oligonucleotide
  Target: SCN9A; (-) strand; PAM type: YTN; PAM sequence: TTG
acatgtaaagttctttacat

SEQ ID NO: 68522 - DNA, 20 bp, Artificial Sequence
  Description of Artificial Sequence: Synthetic oligonucleotide
  Target: SCN9A; (-) strand; PAM type: YTN; PAM sequence: CTT
gacatgtaaagttctttaca

SEQ ID NO: 68523 - DNA, 20 bp, Artificial Sequence
  Description of Artificial Sequence: Synthetic oligonucleotide
  Target: SCN9A; (-) strand; PAM type: YTN; PAM sequence: TTA
acttgacatgtaaagttctt

SEQ ID NO: 68524 - DNA, 20 bp, Artificial Sequence
  Description of Artificial Sequence: Synthetic oligonucleotide
  Target: SCN9A; (-) strand; PAM type: YTN; PAM sequence: CTT
aacttgacatgtaaagttct

SEQ ID NO: 68525 - DNA, 20 bp, Artificial Sequence
  Description of Artificial Sequence: Synthetic oligonucleotide
  Target: SCN9A; (-) strand; PAM type: YTN; PAM sequence: CTG
aagtccttaacttgacatgt

SEQ ID NO: 68526 - DNA, 20 bp, Artificial Sequence
  Description of Artificial Sequence: Synthetic oligonucleotide
  Target: SCN9A; (-) strand; PAM type: YTN; PAM sequence: CTA
gggtaaagtctgaagtcctt

SEQ ID NO: 68527 - DNA, 20 bp, Artificial Sequence
  Description of Artificial Sequence: Synthetic oligonucleotide
  Target: SCN9A; (-) strand; PAM type: YTN; PAM sequence: CTC
tagggtaaagtctgaagtcc

SEQ ID NO: 68528 - DNA, 20 bp, Artificial Sequence
  Description of Artificial Sequence: Synthetic oligonucleotide
  Target: SCN9A; (-) strand; PAM type: YTN; PAM sequence: TTG
gcctctagggtaaagtctga

SEQ ID NO: 68529 - DNA, 20 bp, Artificial Sequence
  Description of Artificial Sequence: Synthetic oligonucleotide
  Target: SCN9A; (-) strand; PAM type: YTN; PAM sequence: CTT
ggcctctagggtaaagtctg

SEQ ID NO: 68530 - DNA, 20 bp, Artificial Sequence
  Description of Artificial Sequence: Synthetic oligonucleotide
  Target: SCN9A; (-) strand; PAM type: YTN; PAM sequence: CTA
aaatgtgagaatccttggcc

SEQ ID NO: 68531 - DNA, 20 bp, Artificial Sequence
  Description of Artificial Sequence: Synthetic oligonucleotide
  Target: SCN9A; (-) strand; PAM type: YTN; PAM sequence: TTG
catgcacactaaaatgtgag

SEQ ID NO: 68532 - DNA, 20 bp, Artificial Sequence
  Description of Artificial Sequence: Synthetic oligonucleotide
  Target: SCN9A; (-) strand; PAM type: YTN; PAM sequence: TTT
gcatgcacactaaaatgtga

SEQ ID NO: 68533 - DNA, 20 bp, Artificial Sequence
  Description of Artificial Sequence: Synthetic oligonucleotide
  Target: SCN9A; (-) strand; PAM type: YTN; PAM sequence: TTA
agaggatttgcatgcacact

SEQ ID NO: 68534 - DNA, 20 bp, Artificial Sequence
  Description of Artificial Sequence: Synthetic oligonucleotide
  Target: SCN9A; (-) strand; PAM type: YTN; PAM sequence: CTT
aagaggatttgcatgcacac

SEQ ID NO: 68535 - DNA, 20 bp, Artificial Sequence
  Description of Artificial Sequence: Synthetic oligonucleotide
  Target: SCN9A; (-) strand; PAM type: YTN; PAM sequence: CTG
gagatagggcccaagccctt

SEQ ID NO: 68536 - DNA, 20 bp, Artificial Sequence
  Description of Artificial Sequence: Synthetic oligonucleotide
  Target: SCN9A; (-) strand; PAM type: YTN; PAM sequence: CTC
tggagatagggcccaagccc

SEQ ID NO: 68537 - DNA, 20 bp, Artificial Sequence
  Description of Artificial Sequence: Synthetic oligonucleotide
  Target: SCN9A; (-) strand; PAM type: YTN; PAM sequence: TTC
atcaggaactctggagatag

SEQ ID NO: 68538 - DNA, 20 bp, Artificial Sequence
  Description of Artificial Sequence: Synthetic oligonucleotide
  Target: SCN9A; (-) strand; PAM type: YTN; PAM sequence: CTA
gtcacaagttcatcaggaac

SEQ ID NO: 68539 - DNA, 20 bp, Artificial Sequence
  Description of Artificial Sequence: Synthetic oligonucleotide
  Target: SCN9A; (-) strand; PAM type: YTN; PAM sequence: TTG
ctagtcacaagttcatcagg

SEQ ID NO: 68540 - DNA, 20 bp, Artificial Sequence
  Description of Artificial Sequence: Synthetic oligonucleotide
  Target: SCN9A; (-) strand; PAM type: YTN; PAM sequence: CTT
gctagtcacaagttcatcag

SEQ ID NO: 68541 - DNA, 20 bp, Artificial Sequence
  Description of Artificial Sequence: Synthetic oligonucleotide
  Target: SCN9A; (-) strand; PAM type: YTN; PAM sequence: TTC
cttgctagtcacaagttcat

SEQ ID NO: 68542 - DNA, 20 bp, Artificial Sequence
  Description of Artificial Sequence: Synthetic oligonucleotide
  Target: SCN9A; (-) strand; PAM type: YTN; PAM sequence: TTT
ccttgctagtcacaagttca

SEQ ID NO: 68543 - DNA, 20 bp, Artificial Sequence
  Description of Artificial Sequence: Synthetic oligonucleotide
  Target: SCN9A; (-) strand; PAM type: YTN; PAM sequence: TTT
tccttgctagtcacaagttc

SEQ ID NO: 68544 - DNA, 20 bp, Artificial Sequence
  Description of Artificial Sequence: Synthetic oligonucleotide
  Target: SCN9A; (-) strand; PAM type: YTN; PAM sequence: TTA
aagttttccttgctagtcac

SEQ ID NO: 68545 - DNA, 20 bp, Artificial Sequence
  Description of Artificial Sequence: Synthetic oligonucleotide
  Target: SCN9A; (-) strand; PAM type: YTN; PAM sequence: CTT
aaagttttccttgctagtca

SEQ ID NO: 68546 - DNA, 20 bp, Artificial Sequence
  Description of Artificial Sequence: Synthetic oligonucleotide
  Target: SCN9A; (-) strand; PAM type: YTN; PAM sequence: TTG
agagacccttaaagttttcc

SEQ ID NO: 68547 - DNA, 20 bp, Artificial Sequence
  Description of Artificial Sequence: Synthetic oligonucleotide
  Target: SCN9A; (-) strand; PAM type: YTN; PAM sequence: TTT
gagagacccttaaagttttc

SEQ ID NO: 68548 - DNA, 20 bp, Artificial Sequence
  Description of Artificial Sequence: Synthetic oligonucleotide
  Target: SCN9A; (-) strand; PAM type: YTN; PAM sequence: CTT
tgagagacccttaaagtttt

SEQ ID NO: 68549 - DNA, 20 bp, Artificial Sequence
  Description of Artificial Sequence: Synthetic oligonucleotide
  Target: SCN9A; (-) strand; PAM type: YTN; PAM sequence: CTA
aagactttgagagaccctta

SEQ ID NO: 68550 - DNA, 20 bp, Artificial Sequence
  Description of Artificial Sequence: Synthetic oligonucleotide
  Target: SCN9A; (-) strand; PAM type: YTN; PAM sequence: CTC
aagctaaagactttgagaga

SEQ ID NO: 68551 - DNA, 20 bp, Artificial Sequence
  Description of Artificial Sequence: Synthetic oligonucleotide
  Target: SCN9A; (-) strand; PAM type: YTN; PAM sequence: TTA
ccctcaagctaaagactttg

SEQ ID NO: 68552 - DNA, 20 bp, Artificial Sequence
  Description of Artificial Sequence: Synthetic oligonucleotide
  Target: SCN9A; (-) strand; PAM type: YTN; PAM sequence: CTT
accctcaagctaaagacttt

SEQ ID NO: 68553 - DNA, 20 bp, Artificial Sequence
  Description of Artificial Sequence: Synthetic oligonucleotide
  Target: SCN9A; (-) strand; PAM type: YTN; PAM sequence: CTA
ccttaccctcaagctaaaga

SEQ ID NO: 68554 - DNA, 20 bp, Artificial Sequence
  Description of Artificial Sequence: Synthetic oligonucleotide
  Target: SCN9A; (-) strand; PAM type: YTN; PAM sequence: TTC
atgatctaccttaccctcaa

SEQ ID NO: 68555 - DNA, 20 bp, Artificial Sequence
  Description of Artificial Sequence: Synthetic oligonucleotide
  Target: SCN9A; (-) strand; PAM type: YTN; PAM sequence: CTT
catgatctaccttaccctca

SEQ ID NO: 68556 - DNA, 20 bp, Artificial Sequence
  Description of Artificial Sequence: Synthetic oligonucleotide
  Target: SCN9A; (-) strand; PAM type: YTN; PAM sequence: TTA
gtaacttcatgatctacctt

SEQ ID NO: 68557 - DNA, 20 bp, Artificial Sequence
  Description of Artificial Sequence: Synthetic oligonucleotide
  Target: SCN9A; (-) strand; PAM type: YTN; PAM sequence: TTA
ttagtaacttcatgatctac

SEQ ID NO: 68558 - DNA, 20 bp, Artificial Sequence
  Description of Artificial Sequence: Synthetic oligonucleotide
  Target: SCN9A; (-) strand; PAM type: YTN; PAM sequence: TTT
attagtaacttcatgatcta

SEQ ID NO: 68559 - DNA, 20 bp, Artificial Sequence
  Description of Artificial Sequence: Synthetic oligonucleotide
  Target: SCN9A; (-) strand; PAM type: YTN; PAM sequence: CTT
tattagtaacttcatgatct

SEQ ID NO: 68560 - DNA, 20 bp, Artificial Sequence
  Description of Artificial Sequence: Synthetic oligonucleotide
  Target: SCN9A; (-) strand; PAM type: YTN; PAM sequence: CTC
cagtctttattagtaacttc

SEQ ID NO: 68561 - DNA, 20 bp, Artificial Sequence
  Description of Artificial Sequence: Synthetic oligonucleotide
  Target: SCN9A; (-) strand; PAM type: YTN; PAM sequence: TTC
ctccagtctttattagtaac

SEQ ID NO: 68562 - DNA, 20 bp, Artificial Sequence
  Description of Artificial Sequence: Synthetic oligonucleotide
  Target: SCN9A; (-) strand; PAM type: YTN; PAM sequence: CTT
cctccagtctttattagtaa

SEQ ID NO: 68563 - DNA, 20 bp, Artificial Sequence
  Description of Artificial Sequence: Synthetic oligonucleotide
  Target: SCN9A; (-) strand; PAM type: YTN; PAM sequence: TTA
cagcttcctccagtctttat

SEQ ID NO: 68564 - DNA, 20 bp, Artificial Sequence
  Description of Artificial Sequence: Synthetic oligonucleotide
  Target: SCN9A; (-) strand; PAM type: YTN; PAM sequence: TTT
acagcttcctccagtcttta

SEQ ID NO: 68565 - DNA, 20 bp, Artificial Sequence
  Description of Artificial Sequence: Synthetic oligonucleotide
  Target: SCN9A; (-) strand; PAM type: YTN; PAM sequence: TTA
gtatggtttacagcttcctc

SEQ ID NO: 68566 - DNA, 20 bp, Artificial Sequence
  Description of Artificial Sequence: Synthetic oligonucleotide
  Target: SCN9A; (-) strand; PAM type: YTN; PAM sequence: TTT
agtatggtttacagcttcct

SEQ ID NO: 68567 - DNA, 20 bp, Artificial Sequence
  Description of Artificial Sequence: Synthetic oligonucleotide
  Target: SCN9A; (-) strand; PAM type: YTN; PAM sequence: CTT
tagtatggtttacagcttcc

SEQ ID NO: 68568 - DNA, 20 bp, Artificial Sequence
  Description of Artificial Sequence: Synthetic oligonucleotide
  Target: SCN9A; (-) strand; PAM type: YTN; PAM sequence: TTG
aaaagcaaaaacaaaaacaa

SEQ ID NO: 68569 - DNA, 20 bp, Artificial Sequence
  Description of Artificial Sequence: Synthetic oligonucleotide
  Target: SCN9A; (-) strand; PAM type: YTN; PAM sequence: TTT
gaaaagcaaaaacaaaaaca

SEQ ID NO: 68570 - DNA, 20 bp, Artificial Sequence
  Description of Artificial Sequence: Synthetic oligonucleotide
  Target: SCN9A; (-) strand; PAM type: YTN; PAM sequence: TTT
tgaaaagcaaaaacaaaaac

SEQ ID NO: 68571 - DNA, 20 bp, Artificial Sequence
  Description of Artificial Sequence: Synthetic oligonucleotide
  Target: SCN9A; (-) strand; PAM type: YTN; PAM sequence: TTT
ttgaaaagcaaaaacaaaaa

SEQ ID NO: 68572 - DNA, 20 bp, Artificial Sequence
  Description of Artificial Sequence: Synthetic oligonucleotide
  Target: SCN9A; (-) strand; PAM type: YTN; PAM sequence: TTT
tttgaaaagcaaaaacaaaa

SEQ ID NO: 68573 - DNA, 20 bp, Artificial Sequence
  Description of Artificial Sequence: Synthetic oligonucleotide
  Target: SCN9A; (-) strand; PAM type: YTN; PAM sequence: TTT
ttttgaaaagcaaaaacaaa

SEQ ID NO: 68574 - DNA, 20 bp, Artificial Sequence
  Description of Artificial Sequence: Synthetic oligonucleotide
  Target: SCN9A; (-) strand; PAM type: YTN; PAM sequence: TTT
tttttgaaaagcaaaaacaa

SEQ ID NO: 68575 - DNA, 20 bp, Artificial Sequence
  Description of Artificial Sequence: Synthetic oligonucleotide
  Target: SCN9A; (-) strand; PAM type: YTN; PAM sequence: TTT
ttttttgaaaagcaaaaaca

SEQ ID NO: 68576 - DNA, 20 bp, Artificial Sequence
  Description of Artificial Sequence: Synthetic oligonucleotide
  Target: SCN9A; (-) strand; PAM type: YTN; PAM sequence: TTT
tttttttgaaaagcaaaaac

SEQ ID NO: 68577 - DNA, 20 bp, Artificial Sequence
  Description of Artificial Sequence: Synthetic oligonucleotide
  Target: SCN9A; (-) strand; PAM type: YTN; PAM sequence: TTT
ttttttttgaaaagcaaaaa

SEQ ID NO: 68578 - DNA, 20 bp, Artificial Sequence
  Description of Artificial Sequence: Synthetic oligonucleotide
  Target: SCN9A; (-) strand; PAM type: YTN; PAM sequence: TTT
tttttttttgaaaagcaaaa

SEQ ID NO: 68579 - DNA, 20 bp, Artificial Sequence
  Description of Artificial Sequence: Synthetic oligonucleotide
  Target: SCN9A; (-) strand; PAM type: YTN; PAM sequence: TTT
ttttttttttgaaaagcaaa

SEQ ID NO: 68580 - DNA, 20 bp, Artificial Sequence
  Description of Artificial Sequence: Synthetic oligonucleotide
  Target: SCN9A; (-) strand; PAM type: YTN; PAM sequence: TTA
ataagtttttttttttttga

SEQ ID NO: 68581 - DNA, 20 bp, Artificial Sequence
  Description of Artificial Sequence: Synthetic oligonucleotide
  Target: SCN9A; (-) strand; PAM type: YTN; PAM sequence: TTT
aataagtttttttttttttg

SEQ ID NO: 68582 - DNA, 20 bp, Artificial Sequence
  Description of Artificial Sequence: Synthetic oligonucleotide
  Target: SCN9A; (-) strand; PAM type: YTN; PAM sequence: TTC
caagtttaataagttttttt

SEQ ID NO: 68583 - DNA, 20 bp, Artificial Sequence
  Description of Artificial Sequence: Synthetic oligonucleotide
  Target: SCN9A; (-) strand; PAM type: YTN; PAM sequence: TTG
taaaacattccaagtttaat

SEQ ID NO: 68584 - DNA, 20 bp, Artificial Sequence
  Description of Artificial Sequence: Synthetic oligonucleotide
  Target: SCN9A; (-) strand; PAM type: YTN; PAM sequence: TTT
gtaaaacattccaagtttaa

SEQ ID NO: 68585 - DNA, 20 bp, Artificial Sequence
  Description of Artificial Sequence: Synthetic oligonucleotide
  Target: SCN9A; (-) strand; PAM type: YTN; PAM sequence: TTG
tttgtaaaacattccaagtt

SEQ ID NO: 68586 - DNA, 20 bp, Artificial Sequence
  Description of Artificial Sequence: Synthetic oligonucleotide
  Target: SCN9A; (-) strand; PAM type: YTN; PAM sequence: CTG
ttgtttgtaaaacattccaa

SEQ ID NO: 68587 - DNA, 20 bp, Artificial Sequence
  Description of Artificial Sequence: Synthetic oligonucleotide
  Target: SCN9A; (-) strand; PAM type: YTN; PAM sequence: TTG
gtcatcaccatctgttgttt

SEQ ID NO: 68588 - DNA, 20 bp, Artificial Sequence
  Description of Artificial Sequence: Synthetic oligonucleotide
  Target: SCN9A; (-) strand; PAM type: YTN; PAM sequence: TTC
cccattggtcatcaccatct

SEQ ID NO: 68589 - DNA, 20 bp, Artificial Sequence
  Description of Artificial Sequence: Synthetic oligonucleotide
  Target: SCN9A; (-) strand; PAM type: YTN; PAM sequence: TTA
caattccccattggtcatca

SEQ ID NO: 68590 - DNA, 20 bp, Artificial Sequence
  Description of Artificial Sequence: Synthetic oligonucleotide
  Target: SCN9A; (-) strand; PAM type: YTN; PAM sequence: CTT
acaattccccattggtcatc

SEQ ID NO: 68591 - DNA, 20 bp, Artificial Sequence
  Description of Artificial Sequence: Synthetic oligonucleotide
  Target: SCN9A; (-) strand; PAM type: YTN; PAM sequence: CTG
cttacaattccccattggtc

SEQ ID NO: 68592 - DNA, 20 bp, Artificial Sequence
  Description of Artificial Sequence: Synthetic oligonucleotide
  Target: SCN9A; (-) strand; PAM type: YTN; PAM sequence: TTG
agtcccagatctgcttacaa

SEQ ID NO: 68593 - DNA, 20 bp, Artificial Sequence
  Description of Artificial Sequence: Synthetic oligonucleotide
  Target: SCN9A; (-) strand; PAM type: YTN; PAM sequence: CTT
gagtcccagatctgcttaca

SEQ ID NO: 68594 - DNA, 20 bp, Artificial Sequence
  Description of Artificial Sequence: Synthetic oligonucleotide
  Target: SCN9A; (-) strand; PAM type: YTN; PAM sequence: CTC
ttgagtcccagatctgctta

SEQ ID NO: 68595 - DNA, 20 bp, Artificial Sequence
  Description of Artificial Sequence: Synthetic oligonucleotide
  Target: SCN9A; (-) strand; PAM type: YTN; PAM sequence: CTC
actcttgagtcccagatctg

SEQ ID NO: 68596 - DNA, 20 bp, Artificial Sequence
  Description of Artificial Sequence: Synthetic oligonucleotide
  Target: SCN9A; (-) strand; PAM type: YTN; PAM sequence: CTA
acctcactcttgagtcccag

SEQ ID NO: 68597 - DNA, 20 bp, Artificial Sequence
  Description of Artificial Sequence: Synthetic oligonucleotide
  Target: SCN9A; (-) strand; PAM type: YTN; PAM sequence: CTC
taacctcactcttgagtccc

SEQ ID NO: 68598 - DNA, 20 bp, Artificial Sequence
  Description of Artificial Sequence: Synthetic oligonucleotide
  Target: SCN9A; (-) strand; PAM type: YTN; PAM sequence: TTA
cctctaacctcactcttgag

SEQ ID NO: 68599 - DNA, 20 bp, Artificial Sequence
  Description of Artificial Sequence: Synthetic oligonucleotide
  Target: SCN9A; (-) strand; PAM type: YTN; PAM sequence: TTT
acctctaacctcactcttga

SEQ ID NO: 68600 - DNA, 20 bp, Artificial Sequence
  Description of Artificial Sequence: Synthetic oligonucleotide
  Target: SCN9A; (-) strand; PAM type: YTN; PAM sequence: CTT
tacctctaacctcactcttg

SEQ ID NO: 68601 - DNA, 20 bp, Artificial Sequence
  Description of Artificial Sequence: Synthetic oligonucleotide
  Target: SCN9A; (-) strand; PAM type: YTN; PAM sequence: TTA
acatcaatgtctttacctct

SEQ ID NO: 68602 - DNA, 20 bp, Artificial Sequence
  Description of Artificial Sequence: Synthetic oligonucleotide
  Target: SCN9A; (-) strand; PAM type: YTN; PAM sequence: CTT
aacatcaatgtctttacctc

SEQ ID NO: 68603 - DNA, 20 bp, Artificial Sequence
  Description of Artificial Sequence: Synthetic oligonucleotide
  Target: SCN9A; (-) strand; PAM type: YTN; PAM sequence: CTC
ttaacatcaatgtctttacc

SEQ ID NO: 68604 - DNA, 20 bp, Artificial Sequence
  Description of Artificial Sequence: Synthetic oligonucleotide
  Target: SCN9A; (-) strand; PAM type: YTN; PAM sequence: TTG
actcttaacatcaatgtctt

SEQ ID NO: 68605 - DNA, 20 bp, Artificial Sequence
  Description of Artificial Sequence: Synthetic oligonucleotide
  Target: SCN9A; (-) strand; PAM type: YTN; PAM sequence: CTA
ttgactcttaacatcaatgt

SEQ ID NO: 68606 - DNA, 20 bp, Artificial Sequence
  Description of Artificial Sequence: Synthetic oligonucleotide
  Target: SCN9A; (-) strand; PAM type: YTN; PAM sequence: CTG
tgctattgactcttaacatc

SEQ ID NO: 68607 - DNA, 20 bp, Artificial Sequence
  Description of Artificial Sequence: Synthetic oligonucleotide
  Target: SCN9A; (-) strand; PAM type: YTN; PAM sequence: TTC
tgtgctattgactcttaaca

SEQ ID NO: 68608 - DNA, 20 bp, Artificial Sequence
  Description of Artificial Sequence: Synthetic oligonucleotide
  Target: SCN9A; (-) strand; PAM type: YTN; PAM sequence: TTT
ctgtgctattgactcttaac

SEQ ID NO: 68609 - DNA, 20 bp, Artificial Sequence
  Description of Artificial Sequence: Synthetic oligonucleotide
  Target: SCN9A; (-) strand; PAM type: YTN; PAM sequence: TTG
aaaagccatttctgtgctat

SEQ ID NO: 68610 - DNA, 20 bp, Artificial Sequence
  Description of Artificial Sequence: Synthetic oligonucleotide
  Target: SCN9A; (-) strand; PAM type: YTN; PAM sequence: CTT
gaaaagccatttctgtgcta

SEQ ID NO: 68611 - DNA, 20 bp, Artificial Sequence
  Description of Artificial Sequence: Synthetic oligonucleotide
  Target: SCN9A; (-) strand; PAM type: YTN; PAM sequence: CTG
tggcttgaaaagccatttct

SEQ ID NO: 68612 - DNA, 20 bp, Artificial Sequence
  Description of Artificial Sequence: Synthetic oligonucleotide
  Target: SCN9A; (-) strand; PAM type: YTN; PAM sequence: TTC
atgcatgcctgtggcttgaa

SEQ ID NO: 68613 - DNA, 20 bp, Artificial Sequence
  Description of Artificial Sequence: Synthetic oligonucleotide
  Target: SCN9A; (-) strand; PAM type: YTN; PAM sequence: TTT
catgcatgcctgtggcttga

SEQ ID NO: 68614 - DNA, 20 bp, Artificial Sequence
  Description of Artificial Sequence: Synthetic oligonucleotide
  Target: SCN9A; (-) strand; PAM type: YTN; PAM sequence: CTG
aggtgtttcatgcatgcctg

SEQ ID NO: 68615 - DNA, 20 bp, Artificial Sequence
  Description of Artificial Sequence: Synthetic oligonucleotide
  Target: SCN9A; (-) strand; PAM type: YTN; PAM sequence: CTC
tgaggtgtttcatgcatgcc

SEQ ID NO: 68616 - DNA, 20 bp, Artificial Sequence
  Description of Artificial Sequence: Synthetic oligonucleotide
  Target: SCN9A; (-) strand; PAM type: YTN; PAM sequence: CTG
aagctctgaggtgtttcatg

SEQ ID NO: 68617 - DNA, 20 bp, Artificial Sequence
  Description of Artificial Sequence: Synthetic oligonucleotide
  Target: SCN9A; (-) strand; PAM type: YTN; PAM sequence: TTC
tgaagctctgaggtgtttca

SEQ ID NO: 68618 - DNA, 20 bp, Artificial Sequence
  Description of Artificial Sequence: Synthetic oligonucleotide
  Target: SCN9A; (-) strand; PAM type: YTN; PAM sequence: TTA
ttctgaagctctgaggtgtt

SEQ ID NO: 68619 - DNA, 20 bp, Artificial Sequence
  Description of Artificial Sequence: Synthetic oligonucleotide
  Target: SCN9A; (-) strand; PAM type: YTN; PAM sequence: CTT
attctgaagctctgaggtgt

SEQ ID NO: 68620 - DNA, 20 bp, Artificial Sequence
  Description of Artificial Sequence: Synthetic oligonucleotide
  Target: SCN9A; (-) strand; PAM type: YTN; PAM sequence: TTC
ttattctgaagctctgaggt

SEQ ID NO: 68621 - DNA, 20 bp, Artificial Sequence
  Description of Artificial Sequence: Synthetic oligonucleotide
  Target: SCN9A; (-) strand; PAM type: YTN; PAM sequence: TTT
cttattctgaagctctgagg

SEQ ID NO: 68622 - DNA, 20 bp, Artificial Sequence
  Description of Artificial Sequence: Synthetic oligonucleotide
  Target: SCN9A; (-) strand; PAM type: YTN; PAM sequence: TTT
tcttattctgaagctctgag

SEQ ID NO: 68623 - DNA, 20 bp, Artificial Sequence
  Description of Artificial Sequence: Synthetic oligonucleotide
  Target: SCN9A; (-) strand; PAM type: YTN; PAM sequence: CTT
ttcttattctgaagctctga

SEQ ID NO: 68624 - DNA, 20 bp, Artificial Sequence
  Description of Artificial Sequence: Synthetic oligonucleotide
  Target: SCN9A; (-) strand; PAM type: YTN; PAM sequence: TTA
tcttttcttattctgaagct

SEQ ID NO: 68625 - DNA, 20 bp, Artificial Sequence
  Description of Artificial Sequence: Synthetic oligonucleotide
  Target: SCN9A; (-) strand; PAM type: YTN; PAM sequence: TTC
agttatcttttcttattctg

SEQ ID NO: 68626 - DNA, 20 bp, Artificial Sequence
  Description of Artificial Sequence: Synthetic oligonucleotide
  Target: SCN9A; (-) strand; PAM type: YTN; PAM sequence: CTT
cagttatcttttcttattct

SEQ ID NO: 68627 - DNA, 20 bp, Artificial Sequence
  Description of Artificial Sequence: Synthetic oligonucleotide
  Target: SCN9A; (-) strand; PAM type: YTN; PAM sequence: TTC
aatcttcagttatcttttct

SEQ ID NO: 68628 - DNA, 20 bp, Artificial Sequence
  Description of Artificial Sequence: Synthetic oligonucleotide
  Target: SCN9A; (-) strand; PAM type: YTN; PAM sequence: CTC
cccacatgttcaatcttcag

SEQ ID NO: 68629 - DNA, 20 bp, Artificial Sequence
  Description of Artificial Sequence: Synthetic oligonucleotide
  Target: SCN9A; (-) strand; PAM type: YTN; PAM sequence: TTC
tccccacatgttcaatcttc

SEQ ID NO: 68630 - DNA, 20 bp, Artificial Sequence
  Description of Artificial Sequence: Synthetic oligonucleotide
  Target: SCN9A; (-) strand; PAM type: YTN; PAM sequence: TTT
ctccccacatgttcaatctt

SEQ ID NO: 68631 - DNA, 20 bp, Artificial Sequence
  Description of Artificial Sequence: Synthetic oligonucleotide
  Target: SCN9A; (-) strand; PAM type: YTN; PAM sequence: CTG
taaataatgatttctcccca

SEQ ID NO: 68632 - DNA, 20 bp, Artificial Sequence
  Description of Artificial Sequence: Synthetic oligonucleotide
  Target: SCN9A; (-) strand; PAM type: YTN; PAM sequence: CTG
cacatcctgtaaataatgat

SEQ ID NO: 68633 - DNA, 20 bp, Artificial Sequence
  Description of Artificial Sequence: Synthetic oligonucleotide
  Target: SCN9A; (-) strand; PAM type: YTN; PAM sequence: TTC
tgcacatcctgtaaataatg

SEQ ID NO: 68634 - DNA, 20 bp, Artificial Sequence
  Description of Artificial Sequence: Synthetic oligonucleotide
  Target: SCN9A; (-) strand; PAM type: YTN; PAM sequence: TTT
ctgcacatcctgtaaataat

SEQ ID NO: 68635 - DNA, 20 bp, Artificial Sequence
  Description of Artificial Sequence: Synthetic oligonucleotide
  Target: SCN9A; (-) strand; PAM type: YTN; PAM sequence: TTT
tctgcacatcctgtaaataa

SEQ ID NO: 68636 - DNA, 20 bp, Artificial Sequence
  Description of Artificial Sequence: Synthetic oligonucleotide
  Target: SCN9A; (-) strand; PAM type: YTN; PAM sequence: TTT
ttctgcacatcctgtaaata

SEQ ID NO: 68637 - DNA, 20 bp, Artificial Sequence
  Description of Artificial Sequence: Synthetic oligonucleotide
  Target: SCN9A; (-) strand; PAM type: YTN; PAM sequence: TTT
tttctgcacatcctgtaaat

SEQ ID NO: 68638 - DNA, 20 bp, Artificial Sequence
  Description of Artificial Sequence: Synthetic oligonucleotide
  Target: SCN9A; (-) strand; PAM type: YTN; PAM sequence: TTA
atgagtattttttctgcaca

SEQ ID NO: 68639 - DNA, 20 bp, Artificial Sequence
  Description of Artificial Sequence: Synthetic oligonucleotide
  Target: SCN9A; (-) strand; PAM type: YTN; PAM sequence: TTT
aatgagtattttttctgcac

SEQ ID NO: 68640 - DNA, 20 bp, Artificial Sequence
  Description of Artificial Sequence: Synthetic oligonucleotide
  Target: SCN9A; (-) strand; PAM type: YTN; PAM sequence: CTT
taatgagtattttttctgca

SEQ ID NO: 68641 - DNA, 20 bp, Artificial Sequence
  Description of Artificial Sequence: Synthetic oligonucleotide
  Target: SCN9A; (-) strand; PAM type: YTN; PAM sequence: TTC
tttaatgagtattttttctg

SEQ ID NO: 68642 - DNA, 20 bp, Artificial Sequence
  Description of Artificial Sequence: Synthetic oligonucleotide
  Target: SCN9A; (-) strand; PAM type: YTN; PAM sequence: TTT
ctttaatgagtattttttct

SEQ ID NO: 68643 - DNA, 20 bp, Artificial Sequence
  Description of Artificial Sequence: Synthetic oligonucleotide
  Target: SCN9A; (-) strand; PAM type: YTN; PAM sequence: CTA
tttctttaatgagtattttt

SEQ ID NO: 68644 - DNA, 20 bp, Artificial Sequence
  Description of Artificial Sequence: Synthetic oligonucleotide
  Target: SCN9A; (-) strand; PAM type: YTN; PAM sequence: CTC
tatttctttaatgagtattt

SEQ ID NO: 68645 - DNA, 20 bp, Artificial Sequence
  Description of Artificial Sequence: Synthetic oligonucleotide
  Target: SCN9A; (-) strand; PAM type: YTN; PAM sequence: CTC
tctatttctttaatgagtat

SEQ ID NO: 68646 - DNA, 20 bp, Artificial Sequence
  Description of Artificial Sequence: Synthetic oligonucleotide
  Target: SCN9A; (-) strand; PAM type: YTN; PAM sequence: CTC
tctctatttctttaatgagt

SEQ ID NO: 68647 - DNA, 20 bp, Artificial Sequence
  Description of Artificial Sequence: Synthetic oligonucleotide
  Target: SCN9A; (-) strand; PAM type: YTN; PAM sequence: TTC
ctctctctatttctttaatg

SEQ ID NO: 68648 - DNA, 20 bp, Artificial Sequence
  Description of Artificial Sequence: Synthetic oligonucleotide
  Target: SCN9A; (-) strand; PAM type: YTN; PAM sequence: CTG
agttcctctctctatttctt

SEQ ID NO: 68649 - DNA, 20 bp, Artificial Sequence
  Description of Artificial Sequence: Synthetic oligonucleotide
  Target: SCN9A; (-) strand; PAM type: YTN; PAM sequence: TTC
tgagttcctctctctatttc

SEQ ID NO: 68650 - DNA, 20 bp, Artificial Sequence
  Description of Artificial Sequence: Synthetic oligonucleotide
  Target: SCN9A; (-) strand; PAM type: YTN; PAM sequence: TTA
gagttctgagttcctctctc

SEQ ID NO: 68651 - DNA, 20 bp, Artificial Sequence
  Description of Artificial Sequence: Synthetic oligonucleotide
  Target: SCN9A; (-) strand; PAM type: YTN; PAM sequence: CTT
agagttctgagttcctctct

SEQ ID NO: 68652 - DNA, 20 bp, Artificial Sequence
  Description of Artificial Sequence: Synthetic oligonucleotide
  Target: SCN9A; (-) strand; PAM type: YTN; PAM sequence: TTG
tcttagagttctgagttcct

SEQ ID NO: 68653 - DNA, 20 bp, Artificial Sequence
  Description of Artificial Sequence: Synthetic oligonucleotide
  Target: SCN9A; (-) strand; PAM type: YTN; PAM sequence: TTT
gtcttagagttctgagttcc

SEQ ID NO: 68654 - DNA, 20 bp, Artificial Sequence
  Description of Artificial Sequence: Synthetic oligonucleotide
  Target: SCN9A; (-) strand; PAM type: YTN; PAM sequence: TTA
tttgtcttagagttctgagt

SEQ ID NO: 68655 - DNA, 20 bp, Artificial Sequence
  Description of Artificial Sequence: Synthetic oligonucleotide
  Target: SCN9A; (-) strand; PAM type: YTN; PAM sequence: TTT
atttgtcttagagttctgag

SEQ ID NO: 68656 - DNA, 20 bp, Artificial Sequence
  Description of Artificial Sequence: Synthetic oligonucleotide
  Target: SCN9A; (-) strand; PAM type: YTN; PAM sequence: TTT
tatttgtcttagagttctga

SEQ ID NO: 68657 - DNA, 20 bp, Artificial Sequence
  Description of Artificial Sequence: Synthetic oligonucleotide
  Target: SCN9A; (-) strand; PAM type: YTN; PAM sequence: CTT
ttatttgtcttagagttctg

SEQ ID NO: 68658 - DNA, 20 bp, Artificial Sequence
  Description of Artificial Sequence: Synthetic oligonucleotide
  Target: SCN9A; (-) strand; PAM type: YTN; PAM sequence: TTG
gtcttttatttgtcttagag

SEQ ID NO: 68659 - DNA, 20 bp, Artificial Sequence
  Description of Artificial Sequence: Synthetic oligonucleotide
  Target: SCN9A; (-) strand; PAM type: YTN; PAM sequence: TTT
ggtcttttatttgtcttaga

SEQ ID NO: 68660 - DNA, 20 bp, Artificial Sequence
  Description of Artificial Sequence: Synthetic oligonucleotide
  Target: SCN9A; (-) strand; PAM type: YTN; PAM sequence: CTT
tggtcttttatttgtcttag

SEQ ID NO: 68661 - DNA, 20 bp, Artificial Sequence
  Description of Artificial Sequence: Synthetic oligonucleotide
  Target: SCN9A; (-) strand; PAM type: YTN; PAM sequence: CTA
cctttggtcttttatttgtc

SEQ ID NO: 68662 - DNA, 20 bp, Artificial Sequence
  Description of Artificial Sequence: Synthetic oligonucleotide
  Target: SCN9A; (-) strand; PAM type: YTN; PAM sequence: TTC
agaggccatagtctaccttt

SEQ ID NO: 68663 - DNA, 20 bp, Artificial Sequence
  Description of Artificial Sequence: Synthetic oligonucleotide
  Target: SCN9A; (-) strand; PAM type: YTN; PAM sequence: TTT
cagaggccatagtctacctt

SEQ ID NO: 68664 - DNA, 20 bp, Artificial Sequence
  Description of Artificial Sequence: Synthetic oligonucleotide
  Target: SCN9A; (-) strand; PAM type: YTN; PAM sequence: TTA
gtttcagaggccatagtcta

SEQ ID NO: 68665 - DNA, 20 bp, Artificial Sequence
  Description of Artificial Sequence: Synthetic oligonucleotide
  Target: SCN9A; (-) strand; PAM type: YTN; PAM sequence: CTT
agtttcagaggccatagtct

SEQ ID NO: 68666 - DNA, 20 bp, Artificial Sequence
  Description of Artificial Sequence: Synthetic oligonucleotide
  Target: SCN9A; (-) strand; PAM type: YTN; PAM sequence: TTC
cttagtttcagaggccatag

SEQ ID NO: 68667 - DNA, 20 bp, Artificial Sequence
  Description of Artificial Sequence: Synthetic oligonucleotide
  Target: SCN9A; (-) strand; PAM type: YTN; PAM sequence: TTT
ccttagtttcagaggccata

SEQ ID NO: 68668 - DNA, 20 bp, Artificial Sequence
  Description of Artificial Sequence: Synthetic oligonucleotide
  Target: SCN9A; (-) strand; PAM type: YTN; PAM sequence: CTT
tccttagtttcagaggccat

SEQ ID NO: 68669 - DNA, 20 bp, Artificial Sequence
  Description of Artificial Sequence: Synthetic oligonucleotide
  Target: SCN9A; (-) strand; PAM type: YTN; PAM sequence: TTC
ctttccttagtttcagaggc

SEQ ID NO: 68670 - DNA, 20 bp, Artificial Sequence
  Description of Artificial Sequence: Synthetic oligonucleotide
  Target: SCN9A; (-) strand; PAM type: YTN; PAM sequence: CTT
cctttccttagtttcagagg

SEQ ID NO: 68671 - DNA, 20 bp, Artificial Sequence
  Description of Artificial Sequence: Synthetic oligonucleotide
  Target: SCN9A; (-) strand; PAM type: YTN; PAM sequence: TTC
ttcctttccttagtttcaga

SEQ ID NO: 68672 - DNA, 20 bp, Artificial Sequence
  Description of Artificial Sequence: Synthetic oligonucleotide
  Target: SCN9A; (-) strand; PAM type: YTN; PAM sequence: CTC
aaaattcttcctttccttag

SEQ ID NO: 68673 - DNA, 20 bp, Artificial Sequence
  Description of Artificial Sequence: Synthetic oligonucleotide
  Target: SCN9A; (-) strand; PAM type: YTN; PAM sequence: CTC
tcaaaattcttcctttcctt

SEQ ID NO: 68674 - DNA, 20 bp, Artificial Sequence
  Description of Artificial Sequence: Synthetic oligonucleotide
  Target: SCN9A; (-) strand; PAM type: YTN; PAM sequence: CTC
tctcaaaattcttcctttcc

SEQ ID NO: 68675 - DNA, 20 bp, Artificial Sequence
  Description of Artificial Sequence: Synthetic oligonucleotide
  Target: SCN9A; (-) strand; PAM type: YTN; PAM sequence: CTA
cagtctctctcaaaattctt

SEQ ID NO: 68676 - DNA, 20 bp, Artificial Sequence
  Description of Artificial Sequence: Synthetic oligonucleotide
  Target: SCN9A; (-) strand; PAM type: YTN; PAM sequence: TTG
actacagtctctctcaaaat

SEQ ID NO: 68677 - DNA, 20 bp, Artificial Sequence
  Description of Artificial Sequence: Synthetic oligonucleotide
  Target: SCN9A; (-) strand; PAM type: YTN; PAM sequence: CTG
ttgactacagtctctctcaa

SEQ ID NO: 68678 - DNA, 20 bp, Artificial Sequence
  Description of Artificial Sequence: Synthetic oligonucleotide
  Target: SCN9A; (-) strand; PAM type: YTN; PAM sequence: TTG
atactgttgactacagtctc

SEQ ID NO: 68679 - DNA, 20 bp, Artificial Sequence
  Description of Artificial Sequence: Synthetic oligonucleotide
  Target: SCN9A; (-) strand; PAM type: YTN; PAM sequence: TTT
gatactgttgactacagtct

SEQ ID NO: 68680 - DNA, 20 bp, Artificial Sequence
  Description of Artificial Sequence: Synthetic oligonucleotide
  Target: SCN9A; (-) strand; PAM type: YTN; PAM sequence: CTG
tttgatactgttgactacag

SEQ ID NO: 68681 - DNA, 20 bp, Artificial Sequence
  Description of Artificial Sequence: Synthetic oligonucleotide
  Target: SCN9A; (-) strand; PAM type: YTN; PAM sequence: CTC
agaaaactgtttgatactgt

SEQ ID NO: 68682 - DNA, 20 bp, Artificial Sequence
  Description of Artificial Sequence: Synthetic oligonucleotide
  Target: SCN9A; (-) strand; PAM type: YTN; PAM sequence: CTC
tcagaaaactgtttgatact

SEQ ID NO: 68683 - DNA, 20 bp, Artificial Sequence
  Description of Artificial Sequence: Synthetic oligonucleotide
  Target: SCN9A; (-) strand; PAM type: YTN; PAM sequence: CTA
actctcagaaaactgtttga

SEQ ID NO: 68684 - DNA, 20 bp, Artificial Sequence
  Description of Artificial Sequence: Synthetic oligonucleotide
  Target: SCN9A; (-) strand; PAM type: YTN; PAM sequence: CTC
actaactctcagaaaactgt

SEQ ID NO: 68685 - DNA, 20 bp, Artificial Sequence
  Description of Artificial Sequence: Synthetic oligonucleotide
  Target: SCN9A; (-) strand; PAM type: YTN; PAM sequence: CTA
ctcactaactctcagaaaac

SEQ ID NO: 68686 - DNA, 20 bp, Artificial Sequence
  Description of Artificial Sequence: Synthetic oligonucleotide
  Target: SCN9A; (-) strand; PAM type: YTN; PAM sequence: TTA
atcaaaaatggaatctactc

SEQ ID NO: 68687 - DNA, 20 bp, Artificial Sequence
  Description of Artificial Sequence: Synthetic oligonucleotide
  Target: SCN9A; (-) strand; PAM type: YTN; PAM sequence: TTT
aatcaaaaatggaatctact

SEQ ID NO: 68688 - DNA, 20 bp, Artificial Sequence
  Description of Artificial Sequence: Synthetic oligonucleotide
  Target: SCN9A; (-) strand; PAM type: YTN; PAM sequence: TTT
taatcaaaaatggaatctac

SEQ ID NO: 68689 - DNA, 20 bp, Artificial Sequence
  Description of Artificial Sequence: Synthetic oligonucleotide
  Target: SCN9A; (-) strand; PAM type: YTN; PAM sequence: CTT
ttaatcaaaaatggaatcta

SEQ ID NO: 68690 - DNA, 20 bp, Artificial Sequence
  Description of Artificial Sequence: Synthetic oligonucleotide
  Target: SCN9A; (-) strand; PAM type: YTN; PAM sequence: CTG
gtccttttaatcaaaaatgg

SEQ ID NO: 68691 - DNA, 20 bp, Artificial Sequence
  Description of Artificial Sequence: Synthetic oligonucleotide
  Target: SCN9A; (-) strand; PAM type: YTN; PAM sequence: CTC
tggtccttttaatcaaaaat

SEQ ID NO: 68692 - DNA, 20 bp, Artificial Sequence
  Description of Artificial Sequence: Synthetic oligonucleotide
  Target: SCN9A; (-) strand; PAM type: YTN; PAM sequence: CTG
tactctggtccttttaatca

SEQ ID NO: 68693 - DNA, 20 bp, Artificial Sequence
  Description of Artificial Sequence: Synthetic oligonucleotide
  Target: SCN9A; (-) strand; PAM type: YTN; PAM sequence: TTA
atgaaagagtctgtactctg

SEQ ID NO: 68694 - DNA, 20 bp, Artificial Sequence
  Description of Artificial Sequence: Synthetic oligonucleotide
  Target: SCN9A; (-) strand; PAM type: YTN; PAM sequence: TTC
ccagatcaatggaaccacca

SEQ ID NO: 68695 - DNA, 20 bp, Artificial Sequence
  Description of Artificial Sequence: Synthetic oligonucleotide
  Target: SCN9A; (-) strand; PAM type: YTN; PAM sequence: TTC
gtattcccagatcaatggaa

SEQ ID NO: 68696 - DNA, 20 bp, Artificial Sequence
  Description of Artificial Sequence: Synthetic oligonucleotide
  Target: SCN9A; (-) strand; PAM type: YTN; PAM sequence: TTA
attcgtattcccagatcaat

SEQ ID NO: 68697 - DNA, 20 bp, Artificial Sequence
  Description of Artificial Sequence: Synthetic oligonucleotide
  Target: SCN9A; (-) strand; PAM type: YTN; PAM sequence: CTT
aattcgtattcccagatcaa

SEQ ID NO: 68698 - DNA, 20 bp, Artificial Sequence
  Description of Artificial Sequence: Synthetic oligonucleotide
  Target: SCN9A; (-) strand; PAM type: YTN; PAM sequence: TTA
gagccttaattcgtattccc

SEQ ID NO: 68699 - DNA, 20 bp, Artificial Sequence
  Description of Artificial Sequence: Synthetic oligonucleotide
  Target: SCN9A; (-) strand; PAM type: YTN; PAM sequence: TTT
agagccttaattcgtattcc

SEQ ID NO: 68700 - DNA, 20 bp, Artificial Sequence
  Description of Artificial Sequence: Synthetic oligonucleotide
  Target: SCN9A; (-) strand; PAM type: YTN; PAM sequence: TTT
tagagccttaattcgtattc

SEQ ID NO: 68701 - DNA, 20 bp, Artificial Sequence
  Description of Artificial Sequence: Synthetic oligonucleotide
  Target: SCN9A; (-) strand; PAM type: YTN; PAM sequence: TTA
ttttagagccttaattcgta

SEQ ID NO: 68702 - DNA, 20 bp, Artificial Sequence
  Description of Artificial Sequence: Synthetic oligonucleotide
  Target: SCN9A; (-) strand; PAM type: YTN; PAM sequence: CTT
attttagagccttaattcgt

SEQ ID NO: 68703 - DNA, 20 bp, Artificial Sequence
  Description of Artificial Sequence: Synthetic oligonucleotide
  Target: SCN9A; (-) strand; PAM type: YTN; PAM sequence: TTC
ttattttagagccttaattc

SEQ ID NO: 68704 - DNA, 20 bp, Artificial Sequence
  Description of Artificial Sequence: Synthetic oligonucleotide
  Target: SCN9A; (-) strand; PAM type: YTN; PAM sequence: CTT
cttattttagagccttaatt

SEQ ID NO: 68705 - DNA, 20 bp, Artificial Sequence
  Description of Artificial Sequence: Synthetic oligonucleotide
  Target: SCN9A; (-) strand; PAM type: YTN; PAM sequence: CTA
cttcttattttagagcctta

SEQ ID NO: 68706 - DNA, 20 bp, Artificial Sequence
  Description of Artificial Sequence: Synthetic oligonucleotide
  Target: SCN9A; (-) strand; PAM type: YTN; PAM sequence: CTA
ctacttcttattttagagcc

SEQ ID NO: 68707 - DNA, 20 bp, Artificial Sequence
  Description of Artificial Sequence: Synthetic oligonucleotide
  Target: SCN9A; (-) strand; PAM type: YTN; PAM sequence: CTG
taagcatgctactacttctt

SEQ ID NO: 68708 - DNA, 20 bp, Artificial Sequence
  Description of Artificial Sequence: Synthetic oligonucleotide
  Target: SCN9A; (-) strand; PAM type: YTN; PAM sequence: TTA
gactgtaagcatgctactac

SEQ ID NO: 68709 - DNA, 20 bp, Artificial Sequence
  Description of Artificial Sequence: Synthetic oligonucleotide
  Target: SCN9A; (-) strand; PAM type: YTN; PAM sequence: CTG
tatgttagactgtaagcatg

SEQ ID NO: 68710 - DNA, 20 bp, Artificial Sequence
  Description of Artificial Sequence: Synthetic oligonucleotide
  Target: SCN9A; (-) strand; PAM type: YTN; PAM sequence: CTA
tcactgtatgttagactgta

SEQ ID NO: 68711 - DNA, 20 bp, Artificial Sequence
  Description of Artificial Sequence: Synthetic oligonucleotide
  Target: SCN9A; (-) strand; PAM type: YTN; PAM sequence: TTC
ctatcactgtatgttagact

SEQ ID NO: 68712 - DNA, 20 bp, Artificial Sequence
  Description of Artificial Sequence: Synthetic oligonucleotide
  Target: SCN9A; (-) strand; PAM type: YTN; PAM sequence: TTT
cctatcactgtatgttagac

SEQ ID NO: 68713 - DNA, 20 bp, Artificial Sequence
  Description of Artificial Sequence: Synthetic oligonucleotide
  Target: SCN9A; (-) strand; PAM type: YTN; PAM sequence: CTA
acagtaatttcctatcactg

SEQ ID NO: 68714 - DNA, 20 bp, Artificial Sequence
  Description of Artificial Sequence: Synthetic oligonucleotide
  Target: SCN9A; (-) strand; PAM type: YTN; PAM sequence: TTG
actaacagtaatttcctatc

SEQ ID NO: 68715 - DNA, 20 bp, Artificial Sequence
  Description of Artificial Sequence: Synthetic oligonucleotide
  Target: SCN9A; (-) strand; PAM type: YTN; PAM sequence: CTT
gactaacagtaatttcctat

SEQ ID NO: 68716 - DNA, 20 bp, Artificial Sequence
  Description of Artificial Sequence: Synthetic oligonucleotide
  Target: SCN9A; (-) strand; PAM type: YTN; PAM sequence: CTA
tggcacttgactaacagtaa

SEQ ID NO: 68717 - DNA, 20 bp, Artificial Sequence
  Description of Artificial Sequence: Synthetic oligonucleotide
  Target: SCN9A; (-) strand; PAM type: YTN; PAM sequence: TTC
cacatctatggcacttgact

SEQ ID NO: 68718 - DNA, 20 bp, Artificial Sequence
  Description of Artificial Sequence: Synthetic oligonucleotide
  Target: SCN9A; (-) strand; PAM type: YTN; PAM sequence: TTT
ccacatctatggcacttgac

SEQ ID NO: 68719 - DNA, 20 bp, Artificial Sequence
  Description of Artificial Sequence: Synthetic oligonucleotide
  Target: SCN9A; (-) strand; PAM type: YTN; PAM sequence: TTG
agtttccacatctatggcac

SEQ ID NO: 68720 - DNA, 20 bp, Artificial Sequence
  Description of Artificial Sequence: Synthetic oligonucleotide
  Target: SCN9A; (-) strand; PAM type: YTN; PAM sequence: CTT
gagtttccacatctatggca

SEQ ID NO: 68721 - DNA, 20 bp, Artificial Sequence
  Description of Artificial Sequence: Synthetic oligonucleotide
  Target: SCN9A; (-) strand; PAM type: YTN; PAM sequence: CTA
agcttgagtttccacatcta

SEQ ID NO: 68722 - DNA, 20 bp, Artificial Sequence
  Description of Artificial Sequence: Synthetic oligonucleotide
  Target: SCN9A; (-) strand; PAM type: YTN; PAM sequence: CTC
taagcttgagtttccacatc

SEQ ID NO: 68723 - DNA, 20 bp, Artificial Sequence
  Description of Artificial Sequence: Synthetic oligonucleotide
  Target: SCN9A; (-) strand; PAM type: YTN; PAM sequence: CTC
tctaagcttgagtttccaca

SEQ ID NO: 68724 - DNA, 20 bp, Artificial Sequence
  Description of Artificial Sequence: Synthetic oligonucleotide
  Target: SCN9A; (-) strand; PAM type: YTN; PAM sequence: CTA
gagctctctaagcttgagtt

SEQ ID NO: 68725 - DNA, 20 bp, Artificial Sequence
  Description of Artificial Sequence: Synthetic oligonucleotide
  Target: SCN9A; (-) strand; PAM type: YTN; PAM sequence: TTA
agggcaagtcactagagctc

SEQ ID NO: 68726 - DNA, 20 bp, Artificial Sequence
  Description of Artificial Sequence: Synthetic oligonucleotide
  Target: SCN9A; (-) strand; PAM type: YTN; PAM sequence: CTG
tatgatgattaagggcaagt

SEQ ID NO: 68727 - DNA, 20 bp, Artificial Sequence
  Description of Artificial Sequence: Synthetic oligonucleotide
  Target: SCN9A; (-) strand; PAM type: YTN; PAM sequence: CTA
tagctgtatgatgattaagg

SEQ ID NO: 68728 - DNA, 20 bp, Artificial Sequence
  Description of Artificial Sequence: Synthetic oligonucleotide
  Target: SCN9A; (-) strand; PAM type: YTN; PAM sequence: TTC
agctatagctgtatgatgat

SEQ ID NO: 68729 - DNA, 20 bp, Artificial Sequence
  Description of Artificial Sequence: Synthetic oligonucleotide
  Target: SCN9A; (-) strand; PAM type: YTN; PAM sequence: CTG
attcagctatagctgtatga

SEQ ID NO: 68730 - DNA, 20 bp, Artificial Sequence
  Description of Artificial Sequence: Synthetic oligonucleotide
  Target: SCN9A; (-) strand; PAM type: YTN; PAM sequence: TTC
catgctgattcagctatagc

SEQ ID NO: 68731 - DNA, 20 bp, Artificial Sequence
  Description of Artificial Sequence: Synthetic oligonucleotide
  Target: SCN9A; (-) strand; PAM type: YTN; PAM sequence: CTC
cattccatgctgattcagct

SEQ ID NO: 68732 - DNA, 20 bp, Artificial Sequence
  Description of Artificial Sequence: Synthetic oligonucleotide
  Target: SCN9A; (-) strand; PAM type: YTN; PAM sequence: TTG
tcggtaagtcagaagactcc

SEQ ID NO: 68733 - DNA, 20 bp, Artificial Sequence
  Description of Artificial Sequence: Synthetic oligonucleotide
  Target: SCN9A; (-) strand; PAM type: YTN; PAM sequence: TTA
ccagaggttgtcggtaagtc

SEQ ID NO: 68734 - DNA, 20 bp, Artificial Sequence
  Description of Artificial Sequence: Synthetic oligonucleotide
  Target: SCN9A; (-) strand; PAM type: YTN; PAM sequence: CTT
accagaggttgtcggtaagt

SEQ ID NO: 68735 - DNA, 20 bp, Artificial Sequence
  Description of Artificial Sequence: Synthetic oligonucleotide
  Target: SCN9A; (-) strand; PAM type: YTN; PAM sequence: CTA
atacttaccagaggttgtcg

SEQ ID NO: 68736 - DNA, 20 bp, Artificial Sequence
  Description of Artificial Sequence: Synthetic oligonucleotide
  Target: SCN9A; (-) strand; PAM type: YTN; PAM sequence: TTA
acgcctaatacttaccagag

SEQ ID NO: 68737 - DNA, 20 bp, Artificial Sequence
  Description of Artificial Sequence: Synthetic oligonucleotide
  Target: SCN9A; (-) strand; PAM type: YTN; PAM sequence: CTT
aacgcctaatacttaccaga

SEQ ID NO: 68738 - DNA, 20 bp, Artificial Sequence
  Description of Artificial Sequence: Synthetic oligonucleotide
  Target: SCN9A; (-) strand; PAM type: YTN; PAM sequence: TTG
tcttaacgcctaatacttac

SEQ ID NO: 68739 - DNA, 20 bp, Artificial Sequence
  Description of Artificial Sequence: Synthetic oligonucleotide
  Target: SCN9A; (-) strand; PAM type: YTN; PAM sequence: TTT
gtcttaacgcctaatactta

SEQ ID NO: 68740 - DNA, 20 bp, Artificial Sequence
  Description of Artificial Sequence: Synthetic oligonucleotide
  Target: SCN9A; (-) strand; PAM type: YTN; PAM sequence: CTG
gggtttgtcttaacgcctaa

SEQ ID NO: 68741 - DNA, 20 bp, Artificial Sequence
  Description of Artificial Sequence: Synthetic oligonucleotide
  Target: SCN9A; (-) strand; PAM type: YTN; PAM sequence: TTC
tggggtttgtcttaacgcct

SEQ ID NO: 68742 - DNA, 20 bp, Artificial Sequence
  Description of Artificial Sequence: Synthetic oligonucleotide
  Target: SCN9A; (-) strand; PAM type: YTN; PAM sequence: TTA
gtgttctggggtttgtctta

SEQ ID NO: 68743 - DNA, 20 bp, Artificial Sequence
  Description of Artificial Sequence: Synthetic oligonucleotide
  Target: SCN9A; (-) strand; PAM type: YTN; PAM sequence: TTA
attagtgttctggggtttgt

SEQ ID NO: 68744 - DNA, 20 bp, Artificial Sequence
  Description of Artificial Sequence: Synthetic oligonucleotide
  Target: SCN9A; (-) strand; PAM type: YTN; PAM sequence: CTT
aattagtgttctggggtttg

SEQ ID NO: 68745 - DNA, 20 bp, Artificial Sequence
  Description of Artificial Sequence: Synthetic oligonucleotide
  Target: SCN9A; (-) strand; PAM type: YTN; PAM sequence: TTC
cttaattagtgttctggggt

SEQ ID NO: 68746 - DNA, 20 bp, Artificial Sequence
  Description of Artificial Sequence: Synthetic oligonucleotide
  Target: SCN9A; (-) strand; PAM type: YTN; PAM sequence: TTA
gcattccttaattagtgttc

SEQ ID NO: 68747 - DNA, 20 bp, Artificial Sequence
  Description of Artificial Sequence: Synthetic oligonucleotide
  Target: SCN9A; (-) strand; PAM type: YTN; PAM sequence: TTG
gttagcattccttaattagt

SEQ ID NO: 68748 - DNA, 20 bp, Artificial Sequence
  Description of Artificial Sequence: Synthetic oligonucleotide
  Target: SCN9A; (-) strand; PAM type: YTN; PAM sequence: CTT
ggttagcattccttaattag

SEQ ID NO: 68749 - DNA, 20 bp, Artificial Sequence
  Description of Artificial Sequence: Synthetic oligonucleotide
  Target: SCN9A; (-) strand; PAM type: YTN; PAM sequence: TTG
agaccttggttagcattcct

SEQ ID NO: 68750 - DNA, 20 bp, Artificial Sequence
  Description of Artificial Sequence: Synthetic oligonucleotide
  Target: SCN9A; (-) strand; PAM type: YTN; PAM sequence: TTC
acagatggtaagacaaaaat

SEQ ID NO: 68751 - DNA, 20 bp, Artificial Sequence
  Description of Artificial Sequence: Synthetic oligonucleotide
  Target: SCN9A; (-) strand; PAM type: YTN; PAM sequence: TTT
cacagatggtaagacaaaaa

SEQ ID NO: 68752 - DNA, 20 bp, Artificial Sequence
  Description of Artificial Sequence: Synthetic oligonucleotide
  Target: SCN9A; (-) strand; PAM type: YTN; PAM sequence: CTG
tttcacagatggtaagacaa

SEQ ID NO: 68753 - DNA, 20 bp, Artificial Sequence
  Description of Artificial Sequence: Synthetic oligonucleotide
  Target: SCN9A; (-) strand; PAM type: YTN; PAM sequence: TTC
cgatgagccagaggcctgtt

SEQ ID NO: 68754 - DNA, 20 bp, Artificial Sequence
  Description of Artificial Sequence: Synthetic oligonucleotide
  Target: SCN9A; (-) strand; PAM type: YTN; PAM sequence: CTA
tgaattccgatgagccagag

SEQ ID NO: 68755 - DNA, 20 bp, Artificial Sequence
  Description of Artificial Sequence: Synthetic oligonucleotide
  Target: SCN9A; (-) strand; PAM type: YTN; PAM sequence: CTG
aacctatgaattccgatgag

SEQ ID NO: 68756 - DNA, 20 bp, Artificial Sequence
  Description of Artificial Sequence: Synthetic oligonucleotide
  Target: SCN9A; (-) strand; PAM type: YTN; PAM sequence: CTG
gagaaggagaagaagcagag

SEQ ID NO: 68757 - DNA, 20 bp, Artificial Sequence
  Description of Artificial Sequence: Synthetic oligonucleotide
  Target: SCN9A; (-) strand; PAM type: YTN; PAM sequence: TTG
cctggagaaggagaagaagc

SEQ ID NO: 68758 - DNA, 20 bp, Artificial Sequence
  Description of Artificial Sequence: Synthetic oligonucleotide
  Target: SCN9A; (-) strand; PAM type: YTN; PAM sequence: TTT
gcctggagaaggagaagaag

SEQ ID NO: 68759 - DNA, 20 bp, Artificial Sequence
  Description of Artificial Sequence: Synthetic oligonucleotide
  Target: SCN9A; (-) strand; PAM type: YTN; PAM sequence: CTT
tgcctggagaaggagaagaa

SEQ ID NO: 68760 - DNA, 20 bp, Artificial Sequence
  Description of Artificial Sequence: Synthetic oligonucleotide
  Target: SCN9A; (-) strand; PAM type: YTN; PAM sequence: TTG
ataaccctttgcctggagaa

SEQ ID NO: 68761 - DNA, 20 bp, Artificial Sequence
  Description of Artificial Sequence: Synthetic oligonucleotide
  Target: SCN9A; (-) strand; PAM type: YTN; PAM sequence: CTC
agagtgcagcacagttgata

SEQ ID NO: 68762 - DNA, 20 bp, Artificial Sequence
  Description of Artificial Sequence: Synthetic oligonucleotide
  Target: SCN9A; (-) strand; PAM type: YTN; PAM sequence: CTC
ctcagagtgcagcacagttg

SEQ ID NO: 68763 - DNA, 20 bp, Artificial Sequence
  Description of Artificial Sequence: Synthetic oligonucleotide
  Target: SCN9A; (-) strand; PAM type: YTN; PAM sequence: TTA
aaccggtcaagctcctcaga

SEQ ID NO: 68764 - DNA, 20 bp, Artificial Sequence
  Description of Artificial Sequence: Synthetic oligonucleotide
  Target: SCN9A; (-) strand; PAM type: YTN; PAM sequence: CTA
gagattaaaccggtcaagct

SEQ ID NO: 68765 - DNA, 20 bp, Artificial Sequence
  Description of Artificial Sequence: Synthetic oligonucleotide
  Target: SCN9A; (-) strand; PAM type: YTN; PAM sequence: TTC
tagagattaaaccggtcaag

SEQ ID NO: 68766 - DNA, 20 bp, Artificial Sequence
  Description of Artificial Sequence: Synthetic oligonucleotide
  Target: SCN9A; (-) strand; PAM type: YTN; PAM sequence: TTT
ctagagattaaaccggtcaa

SEQ ID NO: 68767 - DNA, 20 bp, Artificial Sequence
  Description of Artificial Sequence: Synthetic oligonucleotide
  Target: SCN9A; (-) strand; PAM type: YTN; PAM sequence: CTT
tctagagattaaaccggtca

SEQ ID NO: 68768 - DNA, 20 bp, Artificial Sequence
  Description of Artificial Sequence: Synthetic oligonucleotide
  Target: SCN9A; (-) strand; PAM type: YTN; PAM sequence: TTC
ctttctagagattaaaccgg

SEQ ID NO: 68769 - DNA, 20 bp, Artificial Sequence
  Description of Artificial Sequence: Synthetic oligonucleotide
  Target: SCN9A; (-) strand; PAM type: YTN; PAM sequence: CTG
gtggggtggtgaattccttt

SEQ ID NO: 68770 - DNA, 20 bp, Artificial Sequence
  Description of Artificial Sequence: Synthetic oligonucleotide
  Target: SCN9A; (-) strand; PAM type: YTN; PAM sequence: CTA
cctggtggggtggtgaattc

SEQ ID NO: 68771 - DNA, 20 bp, Artificial Sequence
  Description of Artificial Sequence: Synthetic oligonucleotide
  Target: SCN9A; (-) strand; PAM type: YTN; PAM sequence: CTA
aatgaactacctggtggggt

SEQ ID NO: 68772 - DNA, 20 bp, Artificial Sequence
  Description of Artificial Sequence: Synthetic oligonucleotide
  Target: SCN9A; (-) strand; PAM type: YTN; PAM sequence: CTC
taaatgaactacctggtggg

SEQ ID NO: 68773 - DNA, 20 bp, Artificial Sequence
  Description of Artificial Sequence: Synthetic oligonucleotide
  Target: SCN9A; (-) strand; PAM type: YTN; PAM sequence: TTG
aatgaactctaaatgaacta

SEQ ID NO: 68774 - DNA, 20 bp, Artificial Sequence
  Description of Artificial Sequence: Synthetic oligonucleotide
  Target: SCN9A; (-) strand; PAM type: YTN; PAM sequence: TTT
gaatgaactctaaatgaact

SEQ ID NO: 68775 - DNA, 20 bp, Artificial Sequence
  Description of Artificial Sequence: Synthetic oligonucleotide
  Target: SCN9A; (-) strand; PAM type: YTN; PAM sequence: TTA
aatatcatatttgaatgaac

SEQ ID NO: 68776 - DNA, 20 bp, Artificial Sequence
  Description of Artificial Sequence: Synthetic oligonucleotide
  Target: SCN9A; (-) strand; PAM type: YTN; PAM sequence: CTT
aaatatcatatttgaatgaa

SEQ ID NO: 68777 - DNA, 20 bp, Artificial Sequence
  Description of Artificial Sequence: Synthetic oligonucleotide
  Target: SCN9A; (-) strand; PAM type: YTN; PAM sequence: TTA
aataaggcttaaatatcata

SEQ ID NO: 68778 - DNA, 20 bp, Artificial Sequence
  Description of Artificial Sequence: Synthetic oligonucleotide
  Target: SCN9A; (-) strand; PAM type: YTN; PAM sequence: TTA
ttaaataaggcttaaatatc

SEQ ID NO: 68779 - DNA, 20 bp, Artificial Sequence
  Description of Artificial Sequence: Synthetic oligonucleotide
  Target: SCN9A; (-) strand; PAM type: YTN; PAM sequence: CTG
attattaaataaggcttaaa

SEQ ID NO: 68780 - DNA, 20 bp, Artificial Sequence
  Description of Artificial Sequence: Synthetic oligonucleotide
  Target: SCN9A; (-) strand; PAM type: YTN; PAM sequence: TTG
catgagtctgattattaaat

SEQ ID NO: 68781 - DNA, 20 bp, Artificial Sequence
  Description of Artificial Sequence: Synthetic oligonucleotide
  Target: SCN9A; (-) strand; PAM type: YTN; PAM sequence: TTT
gcatgagtctgattattaaa

SEQ ID NO: 68782 - DNA, 20 bp, Artificial Sequence
  Description of Artificial Sequence: Synthetic oligonucleotide
  Target: SCN9A; (-) strand; PAM type: YTN; PAM sequence: CTT
tgcatgagtctgattattaa

SEQ ID NO: 68783 - DNA, 20 bp, Artificial Sequence
  Description of Artificial Sequence: Synthetic oligonucleotide
  Target: SCN9A; (-) strand; PAM type: YTN; PAM sequence: TTC
ataatactttgcatgagtct

SEQ ID NO: 68784 - DNA, 20 bp, Artificial Sequence
  Description of Artificial Sequence: Synthetic oligonucleotide
  Target: SCN9A; (-) strand; PAM type: YTN; PAM sequence: TTT
cataatactttgcatgagtc

SEQ ID NO: 68785 - DNA, 20 bp, Artificial Sequence
  Description of Artificial Sequence: Synthetic oligonucleotide
  Target: SCN9A; (-) strand; PAM type: YTN; PAM sequence: TTT
tcataatactttgcatgagt

SEQ ID NO: 68786 - DNA, 20 bp, Artificial Sequence
  Description of Artificial Sequence: Synthetic oligonucleotide
  Target: SCN9A; (-) strand; PAM type: YTN; PAM sequence: TTT
ttcataatactttgcatgag

SEQ ID NO: 68787 - DNA, 20 bp, Artificial Sequence
  Description of Artificial Sequence: Synthetic oligonucleotide
  Target: SCN9A; (-) strand; PAM type: YTN; PAM sequence: TTT
tttcataatactttgcatga

SEQ ID NO: 68788 - DNA, 20 bp, Artificial Sequence
  Description of Artificial Sequence: Synthetic oligonucleotide
  Target: SCN9A; (-) strand; PAM type: YTN; PAM sequence: CTT
ttttcataatactttgcatg

SEQ ID NO: 68789 - DNA, 20 bp, Artificial Sequence
  Description of Artificial Sequence: Synthetic oligonucleotide
  Target: SCN9A; (-) strand; PAM type: YTN; PAM sequence: TTA
atcttttttcataatacttt

SEQ ID NO: 68790 - DNA, 20 bp, Artificial Sequence
  Description of Artificial Sequence: Synthetic oligonucleotide
  Target: SCN9A; (-) strand; PAM type: YTN; PAM sequence: CTA
ttaatcttttttcataatac

SEQ ID NO: 68791 - DNA, 20 bp, Artificial Sequence
  Description of Artificial Sequence: Synthetic oligonucleotide
  Target: SCN9A; (-) strand; PAM type: YTN; PAM sequence: TTA
tggccatcatactattaatc

SEQ ID NO: 68792 - DNA, 20 bp, Artificial Sequence
  Description of Artificial Sequence: Synthetic oligonucleotide
  Target: SCN9A; (-) strand; PAM type: YTN; PAM sequence: TTT
atggccatcatactattaat

SEQ ID NO: 68793 - DNA, 20 bp, Artificial Sequence
  Description of Artificial Sequence: Synthetic oligonucleotide
  Target: SCN9A; (-) strand; PAM type: YTN; PAM sequence: TTT
tatggccatcatactattaa

SEQ ID NO: 68794 - DNA, 20 bp, Artificial Sequence
  Description of Artificial Sequence: Synthetic oligonucleotide
  Target: SCN9A; (-) strand; PAM type: YTN; PAM sequence: TTT
ttatggccatcatactatta

SEQ ID NO: 68795 - DNA, 20 bp, Artificial Sequence
  Description of Artificial Sequence: Synthetic oligonucleotide
  Target: SCN9A; (-) strand; PAM type: YTN; PAM sequence: TTT
tttatggccatcatactatt

SEQ ID NO: 68796 - DNA, 20 bp, Artificial Sequence
  Description of Artificial Sequence: Synthetic oligonucleotide
  Target: SCN9A; (-) strand; PAM type: YTN; PAM sequence: TTA
tacattttttatggccatca

SEQ ID NO: 68797 - DNA, 20 bp, Artificial Sequence
  Description of Artificial Sequence: Synthetic oligonucleotide
  Target: SCN9A; (-) strand; PAM type: YTN; PAM sequence: TTT
atacattttttatggccatc

SEQ ID NO: 68798 - DNA, 20 bp, Artificial Sequence
  Description of Artificial Sequence: Synthetic oligonucleotide
  Target: SCN9A; (-) strand; PAM type: YTN; PAM sequence: CTC
aatatgtgtttatacatttt

SEQ ID NO: 68799 - DNA, 20 bp, Artificial Sequence
  Description of Artificial Sequence: Synthetic oligonucleotide
  Target: SCN9A; (-) strand; PAM type: YTN; PAM sequence: TTG
acctcaatatgtgtttatac

SEQ ID NO: 68800 - DNA, 20 bp, Artificial Sequence
  Description of Artificial Sequence: Synthetic oligonucleotide
  Target: SCN9A; (-) strand; PAM type: YTN; PAM sequence: CTT
gacctcaatatgtgtttata

SEQ ID NO: 68801 - DNA, 20 bp, Artificial Sequence
  Description of Artificial Sequence: Synthetic oligonucleotide
  Target: SCN9A; (-) strand; PAM type: YTN; PAM sequence: TTA
cttgacctcaatatgtgttt

SEQ ID NO: 68802 - DNA, 20 bp, Artificial Sequence
  Description of Artificial Sequence: Synthetic oligonucleotide
  Target: SCN9A; (-) strand; PAM type: YTN; PAM sequence: TTA
aggttacttgacctcaatat

SEQ ID NO: 68803 - DNA, 20 bp, Artificial Sequence
  Description of Artificial Sequence: Synthetic oligonucleotide
  Target: SCN9A; (-) strand; PAM type: YTN; PAM sequence: TTT
aaggttacttgacctcaata

SEQ ID NO: 68804 - DNA, 20 bp, Artificial Sequence
  Description of Artificial Sequence: Synthetic oligonucleotide
  Target: SCN9A; (-) strand; PAM type: YTN; PAM sequence: TTA
caggatggtgtagatagaaa

SEQ ID NO: 68805 - DNA, 20 bp, Artificial Sequence
  Description of Artificial Sequence: Synthetic oligonucleotide
  Target: SCN9A; (-) strand; PAM type: YTN; PAM sequence: TTT
acaggatggtgtagatagaa

SEQ ID NO: 68806 - DNA, 20 bp, Artificial Sequence
  Description of Artificial Sequence: Synthetic oligonucleotide
  Target: SCN9A; (-) strand; PAM type: YTN; PAM sequence: TTT
tacaggatggtgtagataga

SEQ ID NO: 68807 - DNA, 20 bp, Artificial Sequence
  Description of Artificial Sequence: Synthetic oligonucleotide
  Target: SCN9A; (-) strand; PAM type: YTN; PAM sequence: TTA
ttttacaggatggtgtagat

SEQ ID NO: 68808 - DNA, 20 bp, Artificial Sequence
  Description of Artificial Sequence: Synthetic oligonucleotide
  Target: SCN9A; (-) strand; PAM type: YTN; PAM sequence: TTA
ttattttacaggatggtgta

SEQ ID NO: 68809 - DNA, 20 bp, Artificial Sequence
  Description of Artificial Sequence: Synthetic oligonucleotide
  Target: SCN9A; (-) strand; PAM type: YTN; PAM sequence: TTT
attattttacaggatggtgt

SEQ ID NO: 68810 - DNA, 20 bp, Artificial Sequence
  Description of Artificial Sequence: Synthetic oligonucleotide
  Target: SCN9A; (-) strand; PAM type: YTN; PAM sequence: TTA
gtataataaacataataaag

SEQ ID NO: 68811 - DNA, 20 bp, Artificial Sequence
  Description of Artificial Sequence: Synthetic oligonucleotide
  Target: SCN9A; (-) strand; PAM type: YTN; PAM sequence: TTG
ttagtataataaacataata

SEQ ID NO: 68812 - DNA, 20 bp, Artificial Sequence
  Description of Artificial Sequence: Synthetic oligonucleotide
  Target: SCN9A; (-) strand; PAM type: YTN; PAM sequence: CTT
gttagtataataaacataat

SEQ ID NO: 68813 - DNA, 20 bp, Artificial Sequence
  Description of Artificial Sequence: Synthetic oligonucleotide
  Target: SCN9A; (-) strand; PAM type: YTN; PAM sequence: TTG
gccacgtacttgttagtata

SEQ ID NO: 68814 - DNA, 20 bp, Artificial Sequence
  Description of Artificial Sequence: Synthetic oligonucleotide
  Target: SCN9A; (-) strand; PAM type: YTN; PAM sequence: TTT
ggccacgtacttgttagtat

SEQ ID NO: 68815 - DNA, 20 bp, Artificial Sequence
  Description of Artificial Sequence: Synthetic oligonucleotide
  Target: SCN9A; (-) strand; PAM type: YTN; PAM sequence: TTT
tggccacgtacttgttagta

SEQ ID NO: 68816 - DNA, 20 bp, Artificial Sequence
  Description of Artificial Sequence: Synthetic oligonucleotide
  Target: SCN9A; (-) strand; PAM type: YTN; PAM sequence: CTA
attttggccacgtacttgtt

SEQ ID NO: 68817 - DNA, 20 bp, Artificial Sequence
  Description of Artificial Sequence: Synthetic oligonucleotide
  Target: SCN9A; (-) strand; PAM type: YTN; PAM sequence: TTA
tctaattttggccacgtact

SEQ ID NO: 68818 - DNA, 20 bp, Artificial Sequence
  Description of Artificial Sequence: Synthetic oligonucleotide
  Target: SCN9A; (-) strand; PAM type: YTN; PAM sequence: CTT
atctaattttggccacgtac

SEQ ID NO: 68819 - DNA, 20 bp, Artificial Sequence
  Description of Artificial Sequence: Synthetic oligonucleotide
  Target: SCN9A; (-) strand; PAM type: YTN; PAM sequence: TTA
ccttatctaattttggccac

SEQ ID NO: 68820 - DNA, 20 bp, Artificial Sequence
  Description of Artificial Sequence: Synthetic oligonucleotide
  Target: SCN9A; (-) strand; PAM type: YTN; PAM sequence: TTA
acatcaatatattaccttat

SEQ ID NO: 68821 - DNA, 20 bp, Artificial Sequence
  Description of Artificial Sequence: Synthetic oligonucleotide
  Target: SCN9A; (-) strand; PAM type: YTN; PAM sequence: TTC
caaaagtgatagttaacatc

SEQ ID NO: 68822 - DNA, 20 bp, Artificial Sequence
  Description of Artificial Sequence: Synthetic oligonucleotide
  Target: SCN9A; (-) strand; PAM type: YTN; PAM sequence: TTT
ccaaaagtgatagttaacat

SEQ ID NO: 68823 - DNA, 20 bp, Artificial Sequence
  Description of Artificial Sequence: Synthetic oligonucleotide
  Target: SCN9A; (-) strand; PAM type: YTN; PAM sequence: CTT
tccaaaagtgatagttaaca

SEQ ID NO: 68824 - DNA, 20 bp, Artificial Sequence
  Description of Artificial Sequence: Synthetic oligonucleotide
  Target: SCN9A; (-) strand; PAM type: YTN; PAM sequence: TTA
aaaaataagatgtggtcaat

SEQ ID NO: 68825 - DNA, 20 bp, Artificial Sequence
  Description of Artificial Sequence: Synthetic oligonucleotide
  Target: SCN9A; (-) strand; PAM type: YTN; PAM sequence: TTT
aaaaaataagatgtggtcaa

SEQ ID NO: 68826 - DNA, 20 bp, Artificial Sequence
  Description of Artificial Sequence: Synthetic oligonucleotide
  Target: SCN9A; (-) strand; PAM type: YTN; PAM sequence: TTA
aaaatttaaaaaataagatg

SEQ ID NO: 68827 - DNA, 20 bp, Artificial Sequence
  Description of Artificial Sequence: Synthetic oligonucleotide
  Target: SCN9A; (-) strand; PAM type: YTN; PAM sequence: TTA
tattaaaaatttaaaaaata

SEQ ID NO: 68828 - DNA, 20 bp, Artificial Sequence
  Description of Artificial Sequence: Synthetic oligonucleotide
  Target: SCN9A; (-) strand; PAM type: YTN; PAM sequence: TTT
atattaaaaatttaaaaaat

SEQ ID NO: 68829 - DNA, 20 bp, Artificial Sequence
  Description of Artificial Sequence: Synthetic oligonucleotide
  Target: SCN9A; (-) strand; PAM type: YTN; PAM sequence: TTG
tcagtgtccataaatttata

SEQ ID NO: 68830 - DNA, 20 bp, Artificial Sequence
  Description of Artificial Sequence: Synthetic oligonucleotide
  Target: SCN9A; (-) strand; PAM type: YTN; PAM sequence: CTC
aaataatgattgtcagtgtc

SEQ ID NO: 68831 - DNA, 20 bp, Artificial Sequence
  Description of Artificial Sequence: Synthetic oligonucleotide
  Target: SCN9A; (-) strand; PAM type: YTN; PAM sequence: TTG
tcctcaaataatgattgtca

SEQ ID NO: 68832 - DNA, 20 bp, Artificial Sequence
  Description of Artificial Sequence: Synthetic oligonucleotide
  Target: SCN9A; (-) strand; PAM type: YTN; PAM sequence: TTG
caaatagggtataggttgtc

SEQ ID NO: 68833 - DNA, 20 bp, Artificial Sequence
  Description of Artificial Sequence: Synthetic oligonucleotide
  Target: SCN9A; (-) strand; PAM type: YTN; PAM sequence: TTA
tattgcaaatagggtatagg

SEQ ID NO: 68834 - DNA, 20 bp, Artificial Sequence
  Description of Artificial Sequence: Synthetic oligonucleotide
  Target: SCN9A; (-) strand; PAM type: YTN; PAM sequence: TTG
tattatattgcaaatagggt

SEQ ID NO: 68835 - DNA, 20 bp, Artificial Sequence
  Description of Artificial Sequence: Synthetic oligonucleotide
  Target: SCN9A; (-) strand; PAM type: YTN; PAM sequence: CTT
gtattatattgcaaataggg

SEQ ID NO: 68836 - DNA, 20 bp, Artificial Sequence
  Description of Artificial Sequence: Synthetic oligonucleotide
  Target: SCN9A; (-) strand; PAM type: YTN; PAM sequence: TTG
acacttgtattatattgcaa

SEQ ID NO: 68837 - DNA, 20 bp, Artificial Sequence
  Description of Artificial Sequence: Synthetic oligonucleotide
  Target: SCN9A; (-) strand; PAM type: YTN; PAM sequence: TTT
gacacttgtattatattgca

SEQ ID NO: 68838 - DNA, 20 bp, Artificial Sequence
  Description of Artificial Sequence: Synthetic oligonucleotide
  Target: SCN9A; (-) strand; PAM type: YTN; PAM sequence: TTA
gtaatttgacacttgtatta

SEQ ID NO: 68839 - DNA, 20 bp, Artificial Sequence
  Description of Artificial Sequence: Synthetic oligonucleotide
  Target: SCN9A; (-) strand; PAM type: YTN; PAM sequence: TTC
aatgatcaggcattagtaat

SEQ ID NO: 68840 - DNA, 20 bp, Artificial Sequence
  Description of Artificial Sequence: Synthetic oligonucleotide
  Target: SCN9A; (-) strand; PAM type: YTN; PAM sequence: TTT
caatgatcaggcattagtaa

SEQ ID NO: 68841 - DNA, 20 bp, Artificial Sequence
  Description of Artificial Sequence: Synthetic oligonucleotide
  Target: SCN9A; (-) strand; PAM type: YTN; PAM sequence: CTT
tcaatgatcaggcattagta

SEQ ID NO: 68842 - DNA, 20 bp, Artificial Sequence
  Description of Artificial Sequence: Synthetic oligonucleotide
  Target: SCN9A; (-) strand; PAM type: YTN; PAM sequence: CTG
agctttcaatgatcaggcat

SEQ ID NO: 68843 - DNA, 20 bp, Artificial Sequence
  Description of Artificial Sequence: Synthetic oligonucleotide
  Target: SCN9A; (-) strand; PAM type: YTN; PAM sequence: TTG
atctgagctttcaatgatca

SEQ ID NO: 68844 - DNA, 20 bp, Artificial Sequence
  Description of Artificial Sequence: Synthetic oligonucleotide
  Target: SCN9A; (-) strand; PAM type: YTN; PAM sequence: TTT
gatctgagctttcaatgatc

SEQ ID NO: 68845 - DNA, 20 bp, Artificial Sequence
  Description of Artificial Sequence: Synthetic oligonucleotide
  Target: SCN9A; (-) strand; PAM type: YTN; PAM sequence: CTA
tttgatctgagctttcaatg

SEQ ID NO: 68846 - DNA, 20 bp, Artificial Sequence
  Description of Artificial Sequence: Synthetic oligonucleotide
  Target: SCN9A; (-) strand; PAM type: YTN; PAM sequence: TTG
ccaactatttgatctgagct

SEQ ID NO: 68847 - DNA, 20 bp, Artificial Sequence
  Description of Artificial Sequence: Synthetic oligonucleotide
  Target: SCN9A; (-) strand; PAM type: YTN; PAM sequence: TTT
gccaactatttgatctgagc

SEQ ID NO: 68848 - DNA, 20 bp, Artificial Sequence
  Description of Artificial Sequence: Synthetic oligonucleotide
  Target: SCN9A; (-) strand; PAM type: YTN; PAM sequence: TTT
tgccaactatttgatctgag

SEQ ID NO: 68849 - DNA, 20 bp, Artificial Sequence
  Description of Artificial Sequence: Synthetic oligonucleotide
  Target: SCN9A; (-) strand; PAM type: YTN; PAM sequence: TTT
ttgccaactatttgatctga

SEQ ID NO: 68850 - DNA, 20 bp, Artificial Sequence
  Description of Artificial Sequence: Synthetic oligonucleotide
  Target: SCN9A; (-) strand; PAM type: YTN; PAM sequence: TTT
tttgccaactatttgatctg

SEQ ID NO: 68851 - DNA, 20 bp, Artificial Sequence
  Description of Artificial Sequence: Synthetic oligonucleotide
  Target: SCN9A; (-) strand; PAM type: YTN; PAM sequence: CTA
tcaataagttttttgccaac

SEQ ID NO: 68852 - DNA, 20 bp, Artificial Sequence
  Description of Artificial Sequence: Synthetic oligonucleotide
  Target: SCN9A; (-) strand; PAM type: YTN; PAM sequence: TTA
actatcaataagttttttgc

SEQ ID NO: 68853 - DNA, 20 bp, Artificial Sequence
  Description of Artificial Sequence: Synthetic oligonucleotide
  Target: SCN9A; (-) strand; PAM type: YTN; PAM sequence: TTT
aactatcaataagttttttg

SEQ ID NO: 68854 - DNA, 20 bp, Artificial Sequence
  Description of Artificial Sequence: Synthetic oligonucleotide
  Target: SCN9A; (-) strand; PAM type: YTN; PAM sequence: TTT
taactatcaataagtttttt

SEQ ID NO: 68855 - DNA, 20 bp, Artificial Sequence
  Description of Artificial Sequence: Synthetic oligonucleotide
  Target: SCN9A; (-) strand; PAM type: YTN; PAM sequence: TTA
aaaaattttaactatcaata

SEQ ID NO: 68856 - DNA, 20 bp, Artificial Sequence
  Description of Artificial Sequence: Synthetic oligonucleotide
  Target: SCN9A; (-) strand; PAM type: YTN; PAM sequence: TTT
aaaaaattttaactatcaat

SEQ ID NO: 68857 - DNA, 20 bp, Artificial Sequence
  Description of Artificial Sequence: Synthetic oligonucleotide
  Target: SCN9A; (-) strand; PAM type: YTN; PAM sequence: TTT
taaaaaattttaactatcaa

SEQ ID NO: 68858 - DNA, 20 bp, Artificial Sequence
  Description of Artificial Sequence: Synthetic oligonucleotide
  Target: SCN9A; (-) strand; PAM type: YTN; PAM sequence: TTT
ttaaaaaattttaactatca

SEQ ID NO: 68859 - DNA, 20 bp, Artificial Sequence
  Description of Artificial Sequence: Synthetic oligonucleotide
  Target: SCN9A; (-) strand; PAM type: YTN; PAM sequence: CTT
tttaaaaaattttaactatc

SEQ ID NO: 68860 - DNA, 20 bp, Artificial Sequence
  Description of Artificial Sequence: Synthetic oligonucleotide
  Target: SCN9A; (-) strand; PAM type: YTN; PAM sequence: TTA
tctttttaaaaaattttaac

SEQ ID NO: 68861 - DNA, 20 bp, Artificial Sequence
  Description of Artificial Sequence: Synthetic oligonucleotide
  Target: SCN9A; (-) strand; PAM type: YTN; PAM sequence: CTT
atctttttaaaaaattttaa

SEQ ID NO: 68862 - DNA, 20 bp, Artificial Sequence
  Description of Artificial Sequence: Synthetic oligonucleotide
  Target: SCN9A; (-) strand; PAM type: YTN; PAM sequence: TTG
cacttatctttttaaaaaat

SEQ ID NO: 68863 - DNA, 20 bp, Artificial Sequence
  Description of Artificial Sequence: Synthetic oligonucleotide
  Target: SCN9A; (-) strand; PAM type: YTN; PAM sequence: CTT
gcacttatctttttaaaaaa

SEQ ID NO: 68864 - DNA, 20 bp, Artificial Sequence
  Description of Artificial Sequence: Synthetic oligonucleotide
  Target: SCN9A; (-) strand; PAM type: YTN; PAM sequence: TTA
tcttgcacttatctttttaa

SEQ ID NO: 68865 - DNA, 20 bp, Artificial Sequence
  Description of Artificial Sequence: Synthetic oligonucleotide
  Target: SCN9A; (-) strand; PAM type: YTN; PAM sequence: TTT
atcttgcacttatcttttta

SEQ ID NO: 68866 - DNA, 20 bp, Artificial Sequence
  Description of Artificial Sequence: Synthetic oligonucleotide
  Target: SCN9A; (-) strand; PAM type: YTN; PAM sequence: CTT
tatcttgcacttatcttttt

SEQ ID NO: 68867 - DNA, 20 bp, Artificial Sequence
  Description of Artificial Sequence: Synthetic oligonucleotide
  Target: SCN9A; (-) strand; PAM type: YTN; PAM sequence: TTG
gactttatcttgcacttatc

SEQ ID NO: 68868 - DNA, 20 bp, Artificial Sequence
  Description of Artificial Sequence: Synthetic oligonucleotide
  Target: SCN9A; (-) strand; PAM type: YTN; PAM sequence: TTT
ggactttatcttgcacttat

SEQ ID NO: 68869 - DNA, 20 bp, Artificial Sequence
  Description of Artificial Sequence: Synthetic oligonucleotide
  Target: SCN9A; (-) strand; PAM type: YTN; PAM sequence: TTC
aagagataataaaaaataca

SEQ ID NO: 68870 - DNA, 20 bp, Artificial Sequence
  Description of Artificial Sequence: Synthetic oligonucleotide
  Target: SCN9A; (-) strand; PAM type: YTN; PAM sequence: TTA
aattcaagagataataaaaa

SEQ ID NO: 68871 - DNA, 20 bp, Artificial Sequence
  Description of Artificial Sequence: Synthetic oligonucleotide
  Target: SCN9A; (-) strand; PAM type: YTN; PAM sequence: TTT
aaattcaagagataataaaa

SEQ ID NO: 68872 - DNA, 20 bp, Artificial Sequence
  Description of Artificial Sequence: Synthetic oligonucleotide
  Target: SCN9A; (-) strand; PAM type: YTN; PAM sequence: CTA
catatatttaaattcaagag

SEQ ID NO: 68873 - DNA, 20 bp, Artificial Sequence
  Description of Artificial Sequence: Synthetic oligonucleotide
  Target: SCN9A; (-) strand; PAM type: YTN; PAM sequence: CTG
ctacatatatttaaattcaa

SEQ ID NO: 68874 - DNA, 20 bp, Artificial Sequence
  Description of Artificial Sequence: Synthetic oligonucleotide
  Target: SCN9A; (-) strand; PAM type: YTN; PAM sequence: CTA
tatcatcctgctacatatat

SEQ ID NO: 68875 - DNA, 20 bp, Artificial Sequence
  Description of Artificial Sequence: Synthetic oligonucleotide
  Target: SCN9A; (-) strand; PAM type: YTN; PAM sequence: CTA
tctatatcatcctgctacat

SEQ ID NO: 68876 - DNA, 20 bp, Artificial Sequence
  Description of Artificial Sequence: Synthetic oligonucleotide
  Target: SCN9A; (-) strand; PAM type: YTN; PAM sequence: TTC
tatctatatcatcctgctac

SEQ ID NO: 68877 - DNA, 20 bp, Artificial Sequence
  Description of Artificial Sequence: Synthetic oligonucleotide
  Target: SCN9A; (-) strand; PAM type: YTN; PAM sequence: CTT
ctatctatatcatcctgcta

SEQ ID NO: 68878 - DNA, 20 bp, Artificial Sequence
  Description of Artificial Sequence: Synthetic oligonucleotide
  Target: SCN9A; (-) strand; PAM type: YTN; PAM sequence: TTG
atcaaagaacttctatctat

SEQ ID NO: 68879 - DNA, 20 bp, Artificial Sequence
  Description of Artificial Sequence: Synthetic oligonucleotide
  Target: SCN9A; (-) strand; PAM type: YTN; PAM sequence: CTT
gatcaaagaacttctatcta

SEQ ID NO: 68880 - DNA, 20 bp, Artificial Sequence
  Description of Artificial Sequence: Synthetic oligonucleotide
  Target: SCN9A; (-) strand; PAM type: YTN; PAM sequence: TTG
tggtcttgatcaaagaactt

SEQ ID NO: 68881 - DNA, 20 bp, Artificial Sequence
  Description of Artificial Sequence: Synthetic oligonucleotide
  Target: SCN9A; (-) strand; PAM type: YTN; PAM sequence: TTT
gtggtcttgatcaaagaact

SEQ ID NO: 68882 - DNA, 20 bp, Artificial Sequence
  Description of Artificial Sequence: Synthetic oligonucleotide
  Target: SCN9A; (-) strand; PAM type: YTN; PAM sequence: TTT
tgtggtcttgatcaaagaac

SEQ ID NO: 68883 - DNA, 20 bp, Artificial Sequence
  Description of Artificial Sequence: Synthetic oligonucleotide
  Target: SCN9A; (-) strand; PAM type: YTN; PAM sequence: TTG
attttgtggtcttgatcaaa

SEQ ID NO: 68884 - DNA, 20 bp, Artificial Sequence
  Description of Artificial Sequence: Synthetic oligonucleotide
  Target: SCN9A; (-) strand; PAM type: YTN; PAM sequence: TTT
gattttgtggtcttgatcaa

SEQ ID NO: 68885 - DNA, 20 bp, Artificial Sequence
  Description of Artificial Sequence: Synthetic oligonucleotide
  Target: SCN9A; (-) strand; PAM type: YTN; PAM sequence: TTC
aaaaccgtatttgattttgt

SEQ ID NO: 68886 - DNA, 20 bp, Artificial Sequence
  Description of Artificial Sequence: Synthetic oligonucleotide
  Target: SCN9A; (-) strand; PAM type: YTN; PAM sequence: TTT
caaaaccgtatttgattttg

SEQ ID NO: 68887 - DNA, 20 bp, Artificial Sequence
  Description of Artificial Sequence: Synthetic oligonucleotide
  Target: SCN9A; (-) strand; PAM type: YTN; PAM sequence: TTG
atttcaaaaccgtatttgat

SEQ ID NO: 68888 - DNA, 20 bp, Artificial Sequence
  Description of Artificial Sequence: Synthetic oligonucleotide
  Target: SCN9A; (-) strand; PAM type: YTN; PAM sequence: TTT
gatttcaaaaccgtatttga

SEQ ID NO: 68889 - DNA, 20 bp, Artificial Sequence
  Description of Artificial Sequence: Synthetic oligonucleotide
  Target: SCN9A; (-) strand; PAM type: YTN; PAM sequence: TTT
tgatttcaaaaccgtatttg

SEQ ID NO: 68890 - DNA, 20 bp, Artificial Sequence
  Description of Artificial Sequence: Synthetic oligonucleotide
  Target: SCN9A; (-) strand; PAM type: YTN; PAM sequence: TTG
gcattttgatttcaaaaccg

SEQ ID NO: 68891 - DNA, 20 bp, Artificial Sequence
  Description of Artificial Sequence: Synthetic oligonucleotide
  Target: SCN9A; (-) strand; PAM type: YTN; PAM sequence: TTG
gtatggtcattggcattttg

SEQ ID NO: 68892 - DNA, 20 bp, Artificial Sequence
  Description of Artificial Sequence: Synthetic oligonucleotide
  Target: SCN9A; (-) strand; PAM type: YTN; PAM sequence: TTA
tatacaaaatgggtggtgtt

SEQ ID NO: 68893 - DNA, 20 bp, Artificial Sequence
  Description of Artificial Sequence: Synthetic oligonucleotide
  Target: SCN9A; (-) strand; PAM type: YTN; PAM sequence: CTA
aaatgttatatacaaaatgg

SEQ ID NO: 68894 - DNA, 20 bp, Artificial Sequence
  Description of Artificial Sequence: Synthetic oligonucleotide
  Target: SCN9A; (-) strand; PAM type: YTN; PAM sequence: CTA
tatactaaaatgttatatac

SEQ ID NO: 68895 - DNA, 20 bp, Artificial Sequence
  Description of Artificial Sequence: Synthetic oligonucleotide
  Target: SCN9A; (-) strand; PAM type: YTN; PAM sequence: CTA
ctatatactaaaatgttata

SEQ ID NO: 68896 - DNA, 20 bp, Artificial Sequence
  Description of Artificial Sequence: Synthetic oligonucleotide
  Target: SCN9A; (-) strand; PAM type: YTN; PAM sequence: TTC
tactatatactaaaatgtta

SEQ ID NO: 68897 - DNA, 20 bp, Artificial Sequence
  Description of Artificial Sequence: Synthetic oligonucleotide
  Target: SCN9A; (-) strand; PAM type: YTN; PAM sequence: TTT
ctactatatactaaaatgtt

SEQ ID NO: 68898 - DNA, 20 bp, Artificial Sequence
  Description of Artificial Sequence: Synthetic oligonucleotide
  Target: SCN9A; (-) strand; PAM type: YTN; PAM sequence: TTT
tctactatatactaaaatgt

SEQ ID NO: 68899 - DNA, 20 bp, Artificial Sequence
  Description of Artificial Sequence: Synthetic oligonucleotide
  Target: SCN9A; (-) strand; PAM type: YTN; PAM sequence: CTT
ttctactatatactaaaatg

SEQ ID NO: 68900 - DNA, 20 bp, Artificial Sequence
  Description of Artificial Sequence: Synthetic oligonucleotide
  Target: SCN9A; (-) strand; PAM type: YTN; PAM sequence: TTG
atcttttctactatatacta

SEQ ID NO: 68901 - DNA, 20 bp, Artificial Sequence
  Description of Artificial Sequence: Synthetic oligonucleotide
  Target: SCN9A; (-) strand; PAM type: YTN; PAM sequence: TTT
gatcttttctactatatact

SEQ ID NO: 68902 - DNA, 20 bp, Artificial Sequence
  Description of Artificial Sequence: Synthetic oligonucleotide
  Target: SCN9A; (-) strand; PAM type: YTN; PAM sequence: CTG
tttgatcttttctactatat

SEQ ID NO: 68903 - DNA, 20 bp, Artificial Sequence
  Description of Artificial Sequence: Synthetic oligonucleotide
  Target: SCN9A; (-) strand; PAM type: YTN; PAM sequence: TTA
taaataatactgtttgatct

SEQ ID NO: 68904 - DNA, 20 bp, Artificial Sequence
  Description of Artificial Sequence: Synthetic oligonucleotide
  Target: SCN9A; (-) strand; PAM type: YTN; PAM sequence: TTG
acattataaataatactgtt

SEQ ID NO: 68905 - DNA, 20 bp, Artificial Sequence
  Description of Artificial Sequence: Synthetic oligonucleotide
  Target: SCN9A; (-) strand; PAM type: YTN; PAM sequence: CTT
gacattataaataatactgt

SEQ ID NO: 68906 - DNA, 20 bp, Artificial Sequence
  Description of Artificial Sequence: Synthetic oligonucleotide
  Target: SCN9A; (-) strand; PAM type: YTN; PAM sequence: TTC
ttgacattataaataatact

SEQ ID NO: 68907 - DNA, 20 bp, Artificial Sequence
  Description of Artificial Sequence: Synthetic oligonucleotide
  Target: SCN9A; (-) strand; PAM type: YTN; PAM sequence: TTT
cttgacattataaataatac

SEQ ID NO: 68908 - DNA, 20 bp, Artificial Sequence
  Description of Artificial Sequence: Synthetic oligonucleotide
  Target: SCN9A; (-) strand; PAM type: YTN; PAM sequence: CTT
tcttgacattataaataata

SEQ ID NO: 68909 - DNA, 20 bp, Artificial Sequence
  Description of Artificial Sequence: Synthetic oligonucleotide
  Target: SCN9A; (-) strand; PAM type: YTN; PAM sequence: TTA
gtagccactttcttgacatt

SEQ ID NO: 68910 - DNA, 20 bp, Artificial Sequence
  Description of Artificial Sequence: Synthetic oligonucleotide
  Target: SCN9A; (-) strand; PAM type: YTN; PAM sequence: TTT
agtagccactttcttgacat

SEQ ID NO: 68911 - DNA, 20 bp, Artificial Sequence
  Description of Artificial Sequence: Synthetic oligonucleotide
  Target: SCN9A; (-) strand; PAM type: YTN; PAM sequence: CTT
tagtagccactttcttgaca

SEQ ID NO: 68912 - DNA, 20 bp, Artificial Sequence
  Description of Artificial Sequence: Synthetic oligonucleotide
  Target: SCN9A; (-) strand; PAM type: YTN; PAM sequence: TTA
ctttagtagccactttcttg

SEQ ID NO: 68913 - DNA, 20 bp, Artificial Sequence
  Description of Artificial Sequence: Synthetic oligonucleotide
  Target: SCN9A; (-) strand; PAM type: YTN; PAM sequence: CTT
actttagtagccactttctt

SEQ ID NO: 68914 - DNA, 20 bp, Artificial Sequence
  Description of Artificial Sequence: Synthetic oligonucleotide
  Target: SCN9A; (-) strand; PAM type: YTN; PAM sequence: TTG
catgtggtgcttactttagt

SEQ ID NO: 68915 - DNA, 20 bp, Artificial Sequence
  Description of Artificial Sequence: Synthetic oligonucleotide
  Target: SCN9A; (-) strand; PAM type: YTN; PAM sequence: TTT
gcatgtggtgcttactttag

SEQ ID NO: 68916 - DNA, 20 bp, Artificial Sequence
  Description of Artificial Sequence: Synthetic oligonucleotide
  Target: SCN9A; (-) strand; PAM type: YTN; PAM sequence: TTC
agagtttgcatgtggtgctt

SEQ ID NO: 68917 - DNA, 20 bp, Artificial Sequence
  Description of Artificial Sequence: Synthetic oligonucleotide
  Target: SCN9A; (-) strand; PAM type: YTN; PAM sequence: TTT
cagagtttgcatgtggtgct

SEQ ID NO: 68918 - DNA, 20 bp, Artificial Sequence
  Description of Artificial Sequence: Synthetic oligonucleotide
  Target: SCN9A; (-) strand; PAM type: YTN; PAM sequence: TTG
tttcagagtttgcatgtggt

SEQ ID NO: 68919 - DNA, 20 bp, Artificial Sequence
  Description of Artificial Sequence: Synthetic oligonucleotide
  Target: SCN9A; (-) strand; PAM type: YTN; PAM sequence: TTT
gtttcagagtttgcatgtgg

SEQ ID NO: 68920 - DNA, 20 bp, Artificial Sequence
  Description of Artificial Sequence: Synthetic oligonucleotide
  Target: SCN9A; (-) strand; PAM type: YTN; PAM sequence: CTT
tgtttcagagtttgcatgtg

SEQ ID NO: 68921 - DNA, 20 bp, Artificial Sequence
  Description of Artificial Sequence: Synthetic oligonucleotide
  Target: SCN9A; (-) strand; PAM type: YTN; PAM sequence: TTC
gatctttgtttcagagtttg

SEQ ID NO: 68922 - DNA, 20 bp, Artificial Sequence
  Description of Artificial Sequence: Synthetic oligonucleotide
  Target: SCN9A; (-) strand; PAM type: YTN; PAM sequence: CTT
cgatctttgtttcagagttt

SEQ ID NO: 68923 - DNA, 20 bp, Artificial Sequence
  Description of Artificial Sequence: Synthetic oligonucleotide
  Target: SCN9A; (-) strand; PAM type: YTN; PAM sequence: TTC
ttcgatctttgtttcagagt

SEQ ID NO: 68924 - DNA, 20 bp, Artificial Sequence
  Description of Artificial Sequence: Synthetic oligonucleotide
  Target: SCN9A; (-) strand; PAM type: YTN; PAM sequence: TTT
cttcgatctttgtttcagag

SEQ ID NO: 68925 - DNA, 20 bp, Artificial Sequence
  Description of Artificial Sequence: Synthetic oligonucleotide
  Target: SCN9A; (-) strand; PAM type: YTN; PAM sequence: TTT
tcttcgatctttgtttcaga

SEQ ID NO: 68926 - DNA, 20 bp, Artificial Sequence
  Description of Artificial Sequence: Synthetic oligonucleotide
  Target: SCN9A; (-) strand; PAM type: YTN; PAM sequence: TTA
attttcttcgatctttgttt

SEQ ID NO: 68927 - DNA, 20 bp, Artificial Sequence
  Description of Artificial Sequence: Synthetic oligonucleotide
  Target: SCN9A; (-) strand; PAM type: YTN; PAM sequence: TTT
aattttcttcgatctttgtt

SEQ ID NO: 68928 - DNA, 20 bp, Artificial Sequence
  Description of Artificial Sequence: Synthetic oligonucleotide
  Target: SCN9A; (-) strand; PAM type: YTN; PAM sequence: CTG
ccatgtttaattttcttcga

SEQ ID NO: 68929 - DNA, 20 bp, Artificial Sequence
  Description of Artificial Sequence: Synthetic oligonucleotide
  Target: SCN9A; (-) strand; PAM type: YTN; PAM sequence: TTC
catgtgtaagtctgccatgt

SEQ ID NO: 68930 - DNA, 20 bp, Artificial Sequence
  Description of Artificial Sequence: Synthetic oligonucleotide
  Target: SCN9A; (-) strand; PAM type: YTN; PAM sequence: TTA
ttccatgtgtaagtctgcca

SEQ ID NO: 68931 - DNA, 20 bp, Artificial Sequence
  Description of Artificial Sequence: Synthetic oligonucleotide
  Target: SCN9A; (-) strand; PAM type: YTN; PAM sequence: TTC
attattccatgtgtaagtct

SEQ ID NO: 68932 - DNA, 20 bp, Artificial Sequence
  Description of Artificial Sequence: Synthetic oligonucleotide
  Target: SCN9A; (-) strand; PAM type: YTN; PAM sequence: TTA
tatgatcataatgacaatga

SEQ ID NO: 68933 - DNA, 20 bp, Artificial Sequence
  Description of Artificial Sequence: Synthetic oligonucleotide
  Target: SCN9A; (-) strand; PAM type: YTN; PAM sequence: CTT
atatgatcataatgacaatg

SEQ ID NO: 68934 - DNA, 20 bp, Artificial Sequence
  Description of Artificial Sequence: Synthetic oligonucleotide
  Target: SCN9A; (-) strand; PAM type: YTN; PAM sequence: TTA
tgatcacttatatgatcata

SEQ ID NO: 68935 - DNA, 20 bp, Artificial Sequence
  Description of Artificial Sequence: Synthetic oligonucleotide
  Target: SCN9A; (-) strand; PAM type: YTN; PAM sequence: TTG
cgttatgatcacttatatga

SEQ ID NO: 68936 - DNA, 20 bp, Artificial Sequence
  Description of Artificial Sequence: Synthetic oligonucleotide
  Target: SCN9A; (-) strand; PAM type: YTN; PAM sequence: TTT
gcgttatgatcacttatatg

SEQ ID NO: 68937 - DNA, 20 bp, Artificial Sequence
  Description of Artificial Sequence: Synthetic oligonucleotide
  Target: SCN9A; (-) strand; PAM type: YTN; PAM sequence: CTA
tttgcgttatgatcacttat

SEQ ID NO: 68938 - DNA, 20 bp, Artificial Sequence
  Description of Artificial Sequence: Synthetic oligonucleotide
  Target: SCN9A; (-) strand; PAM type: YTN; PAM sequence: CTG
ggtgagaaaaacctatttgc

SEQ ID NO: 68939 - DNA, 20 bp, Artificial Sequence
  Description of Artificial Sequence: Synthetic oligonucleotide
  Target: SCN9A; (-) strand; PAM type: YTN; PAM sequence: CTC
tgggtgagaaaaacctattt

SEQ ID NO: 68940 - DNA, 20 bp, Artificial Sequence
  Description of Artificial Sequence: Synthetic oligonucleotide
  Target: SCN9A; (-) strand; PAM type: YTN; PAM sequence: CTC
ataaagctctgggtgagaaa

SEQ ID NO: 68941 - DNA, 20 bp, Artificial Sequence
  Description of Artificial Sequence: Synthetic oligonucleotide
  Target: SCN9A; (-) strand; PAM type: YTN; PAM sequence: TTA
ctcataaagctctgggtgag

SEQ ID NO: 68942 - DNA, 20 bp, Artificial Sequence
  Description of Artificial Sequence: Synthetic oligonucleotide
  Target: SCN9A; (-) strand; PAM type: YTN; PAM sequence: TTC
gtgtgtgtgtgtgtatgtgt

SEQ ID NO: 68943 - DNA, 20 bp, Artificial Sequence
  Description of Artificial Sequence: Synthetic oligonucleotide
  Target: SCN9A; (-) strand; PAM type: YTN; PAM sequence: CTT
cgtgtgtgtgtgtgtatgtg

SEQ ID NO: 68944 - DNA, 20 bp, Artificial Sequence
  Description of Artificial Sequence: Synthetic oligonucleotide
  Target: SCN9A; (-) strand; PAM type: YTN; PAM sequence: TTC
ttcgtgtgtgtgtgtgtatg

SEQ ID NO: 68945 - DNA, 20 bp, Artificial Sequence
  Description of Artificial Sequence: Synthetic oligonucleotide
  Target: SCN9A; (-) strand; PAM type: YTN; PAM sequence: TTT
cttcgtgtgtgtgtgtgtat

SEQ ID NO: 68946 - DNA, 20 bp, Artificial Sequence
  Description of Artificial Sequence: Synthetic oligonucleotide
  Target: SCN9A; (-) strand; PAM type: YTN; PAM sequence: TTG
taaagatttcttcgtgtgtg

SEQ ID NO: 68947 - DNA, 20 bp, Artificial Sequence
  Description of Artificial Sequence: Synthetic oligonucleotide
  Target: SCN9A; (-) strand; PAM type: YTN; PAM sequence: TTT
gtaaagatttcttcgtgtgt

SEQ ID NO: 68948 - DNA, 20 bp, Artificial Sequence
  Description of Artificial Sequence: Synthetic oligonucleotide
  Target: SCN9A; (-) strand; PAM type: YTN; PAM sequence: TTT
tgtaaagatttcttcgtgtg

SEQ ID NO: 68949 - DNA, 20 bp, Artificial Sequence
  Description of Artificial Sequence: Synthetic oligonucleotide
  Target: SCN9A; (-) strand; PAM type: YTN; PAM sequence: TTT
ttgtaaagatttcttcgtgt

SEQ ID NO: 68950 - DNA, 20 bp, Artificial Sequence
  Description of Artificial Sequence: Synthetic oligonucleotide
  Target: SCN9A; (-) strand; PAM type: YTN; PAM sequence: TTT
tttgtaaagatttcttcgtg

SEQ ID NO: 68951 - DNA, 20 bp, Artificial Sequence
  Description of Artificial Sequence: Synthetic oligonucleotide
  Target: SCN9A; (-) strand; PAM type: YTN; PAM sequence: CTG
tatgtattttttgtaaagat

SEQ ID NO: 68952 - DNA, 20 bp, Artificial Sequence
  Description of Artificial Sequence: Synthetic oligonucleotide
  Target: SCN9A; (-) strand; PAM type: YTN; PAM sequence: TTG
ctgtatgtattttttgtaaa

SEQ ID NO: 68953 - DNA, 20 bp, Artificial Sequence
  Description of Artificial Sequence: Synthetic oligonucleotide
  Target: SCN9A; (-) strand; PAM type: YTN; PAM sequence: CTA
cagttgctgtatgtattttt

SEQ ID NO: 68954 - DNA, 20 bp, Artificial Sequence
  Description of Artificial Sequence: Synthetic oligonucleotide
  Target: SCN9A; (-) strand; PAM type: YTN; PAM sequence: TTG
ctacagttgctgtatgtatt

SEQ ID NO: 68955 - DNA, 20 bp, Artificial Sequence
  Description of Artificial Sequence: Synthetic oligonucleotide
  Target: SCN9A; (-) strand; PAM type: YTN; PAM sequence: TTT
gctacagttgctgtatgtat

SEQ ID NO: 68956 - DNA, 20 bp, Artificial Sequence
  Description of Artificial Sequence: Synthetic oligonucleotide
  Target: SCN9A; (-) strand; PAM type: YTN; PAM sequence: TTT
tgctacagttgctgtatgta

SEQ ID NO: 68957 - DNA, 20 bp, Artificial Sequence
  Description of Artificial Sequence: Synthetic oligonucleotide
  Target: SCN9A; (-) strand; PAM type: YTN; PAM sequence: TTG
acagagttttgctacagttg

SEQ ID NO: 68958 - DNA, 20 bp, Artificial Sequence
  Description of Artificial Sequence: Synthetic oligonucleotide
  Target: SCN9A; (-) strand; PAM type: YTN; PAM sequence: TTT
gacagagttttgctacagtt

SEQ ID NO: 68959 - DNA, 20 bp, Artificial Sequence
  Description of Artificial Sequence: Synthetic oligonucleotide
  Target: SCN9A; (-) strand; PAM type: YTN; PAM sequence: TTG
ggaaatttgacagagttttg

SEQ ID NO: 68960 - DNA, 20 bp, Artificial Sequence
  Description of Artificial Sequence: Synthetic oligonucleotide
  Target: SCN9A; (-) strand; PAM type: YTN; PAM sequence: TTT
gggaaatttgacagagtttt

SEQ ID NO: 68961 - DNA, 20 bp, Artificial Sequence
  Description of Artificial Sequence: Synthetic oligonucleotide
  Target: SCN9A; (-) strand; PAM type: YTN; PAM sequence: TTA
taaaacaatatttgggaaat

SEQ ID NO: 68962 - DNA, 20 bp, Artificial Sequence
  Description of Artificial Sequence: Synthetic oligonucleotide
  Target: SCN9A; (-) strand; PAM type: YTN; PAM sequence: TTT
ataaaacaatatttgggaaa

SEQ ID NO: 68963 - DNA, 20 bp, Artificial Sequence
  Description of Artificial Sequence: Synthetic oligonucleotide
  Target: SCN9A; (-) strand; PAM type: YTN; PAM sequence: CTT
tataaaacaatatttgggaa

SEQ ID NO: 68964 - DNA, 20 bp, Artificial Sequence
  Description of Artificial Sequence: Synthetic oligonucleotide
  Target: SCN9A; (-) strand; PAM type: YTN; PAM sequence: CTC
ctttataaaacaatatttgg

SEQ ID NO: 68965 - DNA, 20 bp, Artificial Sequence
  Description of Artificial Sequence: Synthetic oligonucleotide
  Target: SCN9A; (-) strand; PAM type: YTN; PAM sequence: TTA
ctcctttataaaacaatatt

SEQ ID NO: 68966 - DNA, 20 bp, Artificial Sequence
  Description of Artificial Sequence: Synthetic oligonucleotide
  Target: SCN9A; (-) strand; PAM type: YTN; PAM sequence: TTT
actcctttataaaacaatat

SEQ ID NO: 68967 - DNA, 20 bp, Artificial Sequence
  Description of Artificial Sequence: Synthetic oligonucleotide
  Target: SCN9A; (-) strand; PAM type: YTN; PAM sequence: CTT
tactcctttataaaacaata

SEQ ID NO: 68968 - DNA, 20 bp, Artificial Sequence
  Description of Artificial Sequence: Synthetic oligonucleotide
  Target: SCN9A; (-) strand; PAM type: YTN; PAM sequence: CTG
ctttactcctttataaaaca

SEQ ID NO: 68969 - DNA, 20 bp, Artificial Sequence
  Description of Artificial Sequence: Synthetic oligonucleotide
  Target: SCN9A; (-) strand; PAM type: YTN; PAM sequence: TTG
atatgctgctttactccttt

SEQ ID NO: 68970 - DNA, 20 bp, Artificial Sequence
  Description of Artificial Sequence: Synthetic oligonucleotide
  Target: SCN9A; (-) strand; PAM type: YTN; PAM sequence: TTC
cattgatatgctgctttact

SEQ ID NO: 68971 - DNA, 20 bp, Artificial Sequence
  Description of Artificial Sequence: Synthetic oligonucleotide
  Target: SCN9A; (-) strand; PAM type: YTN; PAM sequence: CTT
ccattgatatgctgctttac

SEQ ID NO: 68972 - DNA, 20 bp, Artificial Sequence
  Description of Artificial Sequence: Synthetic oligonucleotide
  Target: SCN9A; (-) strand; PAM type: YTN; PAM sequence: CTC
ttccattgatatgctgcttt

SEQ ID NO: 68973 - DNA, 20 bp, Artificial Sequence
  Description of Artificial Sequence: Synthetic oligonucleotide
  Target: SCN9A; (-) strand; PAM type: YTN; PAM sequence: TTA
actcttccattgatatgctg

SEQ ID NO: 68974 - DNA, 20 bp, Artificial Sequence
  Description of Artificial Sequence: Synthetic oligonucleotide
  Target: SCN9A; (-) strand; PAM type: YTN; PAM sequence: TTA
gcaaatgagaatgaaaaatt

SEQ ID NO: 68975 - DNA, 20 bp, Artificial Sequence
  Description of Artificial Sequence: Synthetic oligonucleotide
  Target: SCN9A; (-) strand; PAM type: YTN; PAM sequence: TTT
agcaaatgagaatgaaaaat

SEQ ID NO: 68976 - DNA, 20 bp, Artificial Sequence
  Description of Artificial Sequence: Synthetic oligonucleotide
  Target: SCN9A; (-) strand; PAM type: YTN; PAM sequence: TTC
acatgtcatttagcaaatga

SEQ ID NO: 68977 - DNA, 20 bp, Artificial Sequence
  Description of Artificial Sequence: Synthetic oligonucleotide
  Target: SCN9A; (-) strand; PAM type: YTN; PAM sequence: TTC
aatattcacatgtcatttag

SEQ ID NO: 68978 - DNA, 20 bp, Artificial Sequence
  Description of Artificial Sequence: Synthetic oligonucleotide
  Target: SCN9A; (-) strand; PAM type: YTN; PAM sequence: TTT
caatattcacatgtcattta

SEQ ID NO: 68979 - DNA, 20 bp, Artificial Sequence
  Description of Artificial Sequence: Synthetic oligonucleotide
  Target: SCN9A; (-) strand; PAM type: YTN; PAM sequence: CTT
tcaatattcacatgtcattt

SEQ ID NO: 68980 - DNA, 20 bp, Artificial Sequence
  Description of Artificial Sequence: Synthetic oligonucleotide
  Target: SCN9A; (-) strand; PAM type: YTN; PAM sequence: CTA
gtagctttcaatattcacat

SEQ ID NO: 68981 - DNA, 20 bp, Artificial Sequence
  Description of Artificial Sequence: Synthetic oligonucleotide
  Target: SCN9A; (-) strand; PAM type: YTN; PAM sequence: TTG
tagtaactagtagctttcaa

SEQ ID NO: 68982 - DNA, 20 bp, Artificial Sequence
  Description of Artificial Sequence: Synthetic oligonucleotide
  Target: SCN9A; (-) strand; PAM type: YTN; PAM sequence: TTG
tgttgtagtaactagtagct

SEQ ID NO: 68983 - DNA, 20 bp, Artificial Sequence
  Description of Artificial Sequence: Synthetic oligonucleotide
  Target: SCN9A; (-) strand; PAM type: YTN; PAM sequence: TTA
ataagagaattgtgttgtag

SEQ ID NO: 68984 - DNA, 20 bp, Artificial Sequence
  Description of Artificial Sequence: Synthetic oligonucleotide
  Target: SCN9A; (-) strand; PAM type: YTN; PAM sequence: CTT
aataagagaattgtgttgta

SEQ ID NO: 68985 - DNA, 20 bp, Artificial Sequence
  Description of Artificial Sequence: Synthetic oligonucleotide
  Target: SCN9A; (-) strand; PAM type: YTN; PAM sequence: TTG
taacttaataagagaattgt

SEQ ID NO: 68986 - DNA, 20 bp, Artificial Sequence
  Description of Artificial Sequence: Synthetic oligonucleotide
  Target: SCN9A; (-) strand; PAM type: YTN; PAM sequence: CTA
aaaaagataaagttgtaact

SEQ ID NO: 68987 - DNA, 20 bp, Artificial Sequence
  Description of Artificial Sequence: Synthetic oligonucleotide
  Target: SCN9A; (-) strand; PAM type: YTN; PAM sequence: CTC
taaaaaagataaagttgtaa

SEQ ID NO: 68988 - DNA, 20 bp, Artificial Sequence
  Description of Artificial Sequence: Synthetic oligonucleotide
  Target: SCN9A; (-) strand; PAM type: YTN; PAM sequence: CTA
ctctaaaaaagataaagttg

SEQ ID NO: 68989 - DNA, 20 bp, Artificial Sequence
  Description of Artificial Sequence: Synthetic oligonucleotide
  Target: SCN9A; (-) strand; PAM type: YTN; PAM sequence: TTG
aactactctaaaaaagataa

SEQ ID NO: 68990 - DNA, 20 bp, Artificial Sequence
  Description of Artificial Sequence: Synthetic oligonucleotide
  Target: SCN9A; (-) strand; PAM type: YTN; PAM sequence: CTT
gaactactctaaaaaagata

SEQ ID NO: 68991 - DNA, 20 bp, Artificial Sequence
  Description of Artificial Sequence: Synthetic oligonucleotide
  Target: SCN9A; (-) strand; PAM type: YTN; PAM sequence: TTG
cttgaactactctaaaaaag

SEQ ID NO: 68992 - DNA, 20 bp, Artificial Sequence
  Description of Artificial Sequence: Synthetic oligonucleotide
  Target: SCN9A; (-) strand; PAM type: YTN; PAM sequence: CTT
gcttgaactactctaaaaaa

SEQ ID NO: 68993 - DNA, 20 bp, Artificial Sequence
  Description of Artificial Sequence: Synthetic oligonucleotide
  Target: SCN9A; (-) strand; PAM type: YTN; PAM sequence: TTG
cacttgcttgaactactcta

SEQ ID NO: 68994 - DNA, 20 bp, Artificial Sequence
  Description of Artificial Sequence: Synthetic oligonucleotide
  Target: SCN9A; (-) strand; PAM type: YTN; PAM sequence: CTT
gcacttgcttgaactactct

SEQ ID NO: 68995 - DNA, 20 bp, Artificial Sequence
  Description of Artificial Sequence: Synthetic oligonucleotide
  Target: SCN9A; (-) strand; PAM type: YTN; PAM sequence: TTA
gcacttgcacttgcttgaac

SEQ ID NO: 68996 - DNA, 20 bp, Artificial Sequence
  Description of Artificial Sequence: Synthetic oligonucleotide
  Target: SCN9A; (-) strand; PAM type: YTN; PAM sequence: TTT
agcacttgcacttgcttgaa

SEQ ID NO: 68997 - DNA, 20 bp, Artificial Sequence
  Description of Artificial Sequence: Synthetic oligonucleotide
  Target: SCN9A; (-) strand; PAM type: YTN; PAM sequence: TTT
tagcacttgcacttgcttga

SEQ ID NO: 68998 - DNA, 20 bp, Artificial Sequence
  Description of Artificial Sequence: Synthetic oligonucleotide
  Target: SCN9A; (-) strand; PAM type: YTN; PAM sequence: TTT
ttagcacttgcacttgcttg

SEQ ID NO: 68999 - DNA, 20 bp, Artificial Sequence
  Description of Artificial Sequence: Synthetic oligonucleotide
  Target: SCN9A; (-) strand; PAM type: YTN; PAM sequence: TTA
tttttagcacttgcacttgc

SEQ ID NO: 69000 - DNA, 20 bp, Artificial Sequence
  Description of Artificial Sequence: Synthetic oligonucleotide
  Target: SCN9A; (-) strand; PAM type: YTN; PAM sequence: TTA
ttatttttagcacttgcact

SEQ ID NO: 69001 - DNA, 20 bp, Artificial Sequence
  Description of Artificial Sequence: Synthetic oligonucleotide
  Target: SCN9A; (-) strand; PAM type: YTN; PAM sequence: TTT
attatttttagcacttgcac

SEQ ID NO: 69002 - DNA, 20 bp, Artificial Sequence
  Description of Artificial Sequence: Synthetic oligonucleotide
  Target: SCN9A; (-) strand; PAM type: YTN; PAM sequence: TTT
tattatttttagcacttgca

SEQ ID NO: 69003 - DNA, 20 bp, Artificial Sequence
  Description of Artificial Sequence: Synthetic oligonucleotide
  Target: SCN9A; (-) strand; PAM type: YTN; PAM sequence: CTG
aaataagtattttattattt

SEQ ID NO: 69004 - DNA, 20 bp, Artificial Sequence
  Description of Artificial Sequence: Synthetic oligonucleotide
  Target: SCN9A; (-) strand; PAM type: YTN; PAM sequence: TTA
tctgaaataagtattttatt

SEQ ID NO: 69005 - DNA, 20 bp, Artificial Sequence
  Description of Artificial Sequence: Synthetic oligonucleotide
  Target: SCN9A; (-) strand; PAM type: YTN; PAM sequence: TTT
atctgaaataagtattttat

SEQ ID NO: 69006 - DNA, 20 bp, Artificial Sequence
  Description of Artificial Sequence: Synthetic oligonucleotide
  Target: SCN9A; (-) strand; PAM type: YTN; PAM sequence: TTG
agaatcaatttatctgaaat

SEQ ID NO: 69007 - DNA, 20 bp, Artificial Sequence
  Description of Artificial Sequence: Synthetic oligonucleotide
  Target: SCN9A; (-) strand; PAM type: YTN; PAM sequence: TTC
atagattgagaatcaattta

SEQ ID NO: 69008 - DNA, 20 bp, Artificial Sequence
  Description of Artificial Sequence: Synthetic oligonucleotide
  Target: SCN9A; (-) strand; PAM type: YTN; PAM sequence: TTA
atacaaattcatagattgag

SEQ ID NO: 69009 - DNA, 20 bp, Artificial Sequence
  Description of Artificial Sequence: Synthetic oligonucleotide
  Target: SCN9A; (-) strand; PAM type: YTN; PAM sequence: CTA
tcatattaatacaaattcat

SEQ ID NO: 69010 - DNA, 20 bp, Artificial Sequence
  Description of Artificial Sequence: Synthetic oligonucleotide
  Target: SCN9A; (-) strand; PAM type: YTN; PAM sequence: TTG
ggctatcatattaatacaaa

SEQ ID NO: 69011 - DNA, 20 bp, Artificial Sequence
  Description of Artificial Sequence: Synthetic oligonucleotide
  Target: SCN9A; (-) strand; PAM type: YTN; PAM sequence: TTA
gattgggctatcatattaat

SEQ ID NO: 69012 - DNA, 20 bp, Artificial Sequence
  Description of Artificial Sequence: Synthetic oligonucleotide
  Target: SCN9A; (-) strand; PAM type: YTN; PAM sequence: TTT
agattgggctatcatattaa

SEQ ID NO: 69013 - DNA, 20 bp, Artificial Sequence
  Description of Artificial Sequence: Synthetic oligonucleotide
  Target: SCN9A; (-) strand; PAM type: YTN; PAM sequence: CTT
tagattgggctatcatatta

SEQ ID NO: 69014 - DNA, 20 bp, Artificial Sequence
  Description of Artificial Sequence: Synthetic oligonucleotide
  Target: SCN9A; (-) strand; PAM type: YTN; PAM sequence: CTA
aaagtcaaacctttagattg

SEQ ID NO: 69015 - DNA, 20 bp, Artificial Sequence
  Description of Artificial Sequence: Synthetic oligonucleotide
  Target: SCN9A; (-) strand; PAM type: YTN; PAM sequence: CTC
taaaagtcaaacctttagat

SEQ ID NO: 69016 - DNA, 20 bp, Artificial Sequence
  Description of Artificial Sequence: Synthetic oligonucleotide
  Target: SCN9A; (-) strand; PAM type: YTN; PAM sequence: TTC
caagtcaatctctaaaagtc

SEQ ID NO: 69017 - DNA, 20 bp, Artificial Sequence
  Description of Artificial Sequence: Synthetic oligonucleotide
  Target: SCN9A; (-) strand; PAM type: YTN; PAM sequence: CTT
ccaagtcaatctctaaaagt

SEQ ID NO: 69018 - DNA, 20 bp, Artificial Sequence
  Description of Artificial Sequence: Synthetic oligonucleotide
  Target: SCN9A; (-) strand; PAM type: YTN; PAM sequence: CTA
gcttccaagtcaatctctaa

SEQ ID NO: 69019 - DNA, 20 bp, Artificial Sequence
  Description of Artificial Sequence: Synthetic oligonucleotide
  Target: SCN9A; (-) strand; PAM type: YTN; PAM sequence: TTC
tagcttccaagtcaatctct

SEQ ID NO: 69020 - DNA, 20 bp, Artificial Sequence
  Description of Artificial Sequence: Synthetic oligonucleotide
  Target: SCN9A; (-) strand; PAM type: YTN; PAM sequence: CTT
ctagcttccaagtcaatctc

SEQ ID NO: 69021 - DNA, 20 bp, Artificial Sequence
  Description of Artificial Sequence: Synthetic oligonucleotide
  Target: SCN9A; (-) strand; PAM type: YTN; PAM sequence: TTA
atgtggtacccatcaagaat

SEQ ID NO: 69022 - DNA, 20 bp, Artificial Sequence
  Description of Artificial Sequence: Synthetic oligonucleotide
  Target: SCN9A; (-) strand; PAM type: YTN; PAM sequence: TTT
aatgtggtacccatcaagaa

SEQ ID NO: 69023 - DNA, 20 bp, Artificial Sequence
  Description of Artificial Sequence: Synthetic oligonucleotide
  Target: SCN9A; (-) strand; PAM type: YTN; PAM sequence: TTG
agaatttaatgtggtaccca

SEQ ID NO: 69024 - DNA, 20 bp, Artificial Sequence
  Description of Artificial Sequence: Synthetic oligonucleotide
  Target: SCN9A; (-) strand; PAM type: YTN; PAM sequence: CTA
ggtgataataatagcattga

SEQ ID NO: 69025 - DNA, 20 bp, Artificial Sequence
  Description of Artificial Sequence: Synthetic oligonucleotide
  Target: SCN9A; (-) strand; PAM type: YTN; PAM sequence: TTG
tatactaggtgataataata

SEQ ID NO: 69026 - DNA, 20 bp, Artificial Sequence
  Description of Artificial Sequence: Synthetic oligonucleotide
  Target: SCN9A; (-) strand; PAM type: YTN; PAM sequence: TTA
tgatgttgtatactaggtga

SEQ ID NO: 69027 - DNA, 20 bp, Artificial Sequence
  Description of Artificial Sequence: Synthetic oligonucleotide
  Target: SCN9A; (-) strand; PAM type: YTN; PAM sequence: TTT
atgatgttgtatactaggtg

SEQ ID NO: 69028 - DNA, 20 bp, Artificial Sequence
  Description of Artificial Sequence: Synthetic oligonucleotide
  Target: SCN9A; (-) strand; PAM type: YTN; PAM sequence: TTT
tatgatgttgtatactaggt

SEQ ID NO: 69029 - DNA, 20 bp, Artificial Sequence
  Description of Artificial Sequence: Synthetic oligonucleotide
  Target: SCN9A; (-) strand; PAM type: YTN; PAM sequence: TTT
ttatgatgttgtatactagg

SEQ ID NO: 69030 - DNA, 20 bp, Artificial Sequence
  Description of Artificial Sequence: Synthetic oligonucleotide
  Target: SCN9A; (-) strand; PAM type: YTN; PAM sequence: TTA
tccatgccatttttatgatg

SEQ ID NO: 69031 - DNA, 20 bp, Artificial Sequence
  Description of Artificial Sequence: Synthetic oligonucleotide
  Target: SCN9A; (-) strand; PAM type: YTN; PAM sequence: TTT
atccatgccatttttatgat

SEQ ID NO: 69032 - DNA, 20 bp, Artificial Sequence
  Description of Artificial Sequence: Synthetic oligonucleotide
  Target: SCN9A; (-) strand; PAM type: YTN; PAM sequence: CTT
tatccatgccatttttatga

SEQ ID NO: 69033 - DNA, 20 bp, Artificial Sequence
  Description of Artificial Sequence: Synthetic oligonucleotide
  Target: SCN9A; (-) strand; PAM type: YTN; PAM sequence: TTA
tgtacaatactttatccatg

SEQ ID NO: 69034 - DNA, 20 bp, Artificial Sequence
  Description of Artificial Sequence: Synthetic oligonucleotide
  Target: SCN9A; (-) strand; PAM type: YTN; PAM sequence: CTT
atgtacaatactttatccat

SEQ ID NO: 69035 - DNA, 20 bp, Artificial Sequence
  Description of Artificial Sequence: Synthetic oligonucleotide
  Target: SCN9A; (-) strand; PAM type: YTN; PAM sequence: TTC
cttatgtacaatactttatc

SEQ ID NO: 69036 - DNA, 20 bp, Artificial Sequence
  Description of Artificial Sequence: Synthetic oligonucleotide
  Target: SCN9A; (-) strand; PAM type: YTN; PAM sequence: TTA
catcattccttatgtacaat

SEQ ID NO: 69037 - DNA, 20 bp, Artificial Sequence
  Description of Artificial Sequence: Synthetic oligonucleotide
  Target: SCN9A; (-) strand; PAM type: YTN; PAM sequence: CTT
acatcattccttatgtacaa

SEQ ID NO: 69038 - DNA, 20 bp, Artificial Sequence
  Description of Artificial Sequence: Synthetic oligonucleotide
  Target: SCN9A; (-) strand; PAM type: YTN; PAM sequence: CTG
cttacatcattccttatgta

SEQ ID NO: 69039 - DNA, 20 bp, Artificial Sequence
  Description of Artificial Sequence: Synthetic oligonucleotide
  Target: SCN9A; (-) strand; PAM type: YTN; PAM sequence: TTG
tctgcttacatcattcctta

SEQ ID NO: 69040 - DNA, 20 bp, Artificial Sequence
  Description of Artificial Sequence: Synthetic oligonucleotide
  Target: SCN9A; (-) strand; PAM type: YTN; PAM sequence: TTA
taagaaagacattgtctgct

SEQ ID NO: 69041 - DNA, 20 bp, Artificial Sequence
  Description of Artificial Sequence: Synthetic oligonucleotide
  Target: SCN9A; (-) strand; PAM type: YTN; PAM sequence: CTC
cagttataagaaagacattg

SEQ ID NO: 69042 - DNA, 20 bp, Artificial Sequence
  Description of Artificial Sequence: Synthetic oligonucleotide
  Target: SCN9A; (-) strand; PAM type: YTN; PAM sequence: TTA
ctccagttataagaaagaca

SEQ ID NO: 69043 - DNA, 20 bp, Artificial Sequence
  Description of Artificial Sequence: Synthetic oligonucleotide
  Target: SCN9A; (-) strand; PAM type: YTN; PAM sequence: TTT
actccagttataagaaagac

SEQ ID NO: 69044 - DNA, 20 bp, Artificial Sequence
  Description of Artificial Sequence: Synthetic oligonucleotide
  Target: SCN9A; (-) strand; PAM type: YTN; PAM sequence: TTA
tttactccagttataagaaa

SEQ ID NO: 69045 - DNA, 20 bp, Artificial Sequence
  Description of Artificial Sequence: Synthetic oligonucleotide
  Target: SCN9A; (-) strand; PAM type: YTN; PAM sequence: TTC
ataattatttactccagtta

SEQ ID NO: 69046 - DNA, 20 bp, Artificial Sequence
  Description of Artificial Sequence: Synthetic oligonucleotide
  Target: SCN9A; (-) strand; PAM type: YTN; PAM sequence: TTG
ttcataattatttactccag

SEQ ID NO: 69047 - DNA, 20 bp, Artificial Sequence
  Description of Artificial Sequence: Synthetic oligonucleotide
  Target: SCN9A; (-) strand; PAM type: YTN; PAM sequence: TTA
ataggttgttcataattatt

SEQ ID NO: 69048 - DNA, 20 bp, Artificial Sequence
  Description of Artificial Sequence: Synthetic oligonucleotide
  Target: SCN9A; (-) strand; PAM type: YTN; PAM sequence: CTT
aataggttgttcataattat

SEQ ID NO: 69049 - DNA, 20 bp, Artificial Sequence
  Description of Artificial Sequence: Synthetic oligonucleotide
  Target: SCN9A; (-) strand; PAM type: YTN; PAM sequence: CTC
ttaataggttgttcataatt

SEQ ID NO: 69050 - DNA, 20 bp, Artificial Sequence
  Description of Artificial Sequence: Synthetic oligonucleotide
  Target: SCN9A; (-) strand; PAM type: YTN; PAM sequence: TTC
tcttaataggttgttcataa

SEQ ID NO: 69051 - DNA, 20 bp, Artificial Sequence
  Description of Artificial Sequence: Synthetic oligonucleotide
  Target: SCN9A; (-) strand; PAM type: YTN; PAM sequence: TTG
gaggagttctcttaataggt

SEQ ID NO: 69052 - DNA, 20 bp, Artificial Sequence
  Description of Artificial Sequence: Synthetic oligonucleotide
  Target: SCN9A; (-) strand; PAM type: YTN; PAM sequence: CTA
ggccaacatagattggagga

SEQ ID NO: 69053 - DNA, 20 bp, Artificial Sequence
  Description of Artificial Sequence: Synthetic oligonucleotide
  Target: SCN9A; (-) strand; PAM type: YTN; PAM sequence: CTC
taggccaacatagattggag

SEQ ID NO: 69054 - DNA, 20 bp, Artificial Sequence
  Description of Artificial Sequence: Synthetic oligonucleotide
  Target: SCN9A; (-) strand; PAM type: YTN; PAM sequence: CTG
gtgggaataatgcctctagg

SEQ ID NO: 69055 - DNA, 20 bp, Artificial Sequence
  Description of Artificial Sequence: Synthetic oligonucleotide
  Target: SCN9A; (-) strand; PAM type: YTN; PAM sequence: CTG
gacctggtgggaataatgcc

SEQ ID NO: 69056 - DNA, 20 bp, Artificial Sequence
  Description of Artificial Sequence: Synthetic oligonucleotide
  Target: SCN9A; (-) strand; PAM type: YTN; PAM sequence: CTC
ctggacctggtgggaataat

SEQ ID NO: 69057 - DNA, 20 bp, Artificial Sequence
  Description of Artificial Sequence: Synthetic oligonucleotide
  Target: SCN9A; (-) strand; PAM type: YTN; PAM sequence: TTA
tcaaactcctggacctggtg

SEQ ID NO: 69058 - DNA, 20 bp, Artificial Sequence
  Description of Artificial Sequence: Synthetic oligonucleotide
  Target: SCN9A; (-) strand; PAM type: YTN; PAM sequence: CTG
ttatcaaactcctggacctg

SEQ ID NO: 69059 - DNA, 20 bp, Artificial Sequence
  Description of Artificial Sequence: Synthetic oligonucleotide
  Target: SCN9A; (-) strand; PAM type: YTN; PAM sequence: CTG
aaactgttatcaaactcctg

SEQ ID NO: 69060 - DNA, 20 bp, Artificial Sequence
  Description of Artificial Sequence: Synthetic oligonucleotide
  Target: SCN9A; (-) strand; PAM type: YTN; PAM sequence: TTC
ataactgaaactgttatcaa

SEQ ID NO: 69061 - DNA, 20 bp, Artificial Sequence
  Description of Artificial Sequence: Synthetic oligonucleotide
  Target: SCN9A; (-) strand; PAM type: YTN; PAM sequence: TTT
cataactgaaactgttatca

SEQ ID NO: 69062 - DNA, 20 bp, Artificial Sequence
  Description of Artificial Sequence: Synthetic oligonucleotide
  Target: SCN9A; (-) strand; PAM type: YTN; PAM sequence: CTT
tcataactgaaactgttatc

SEQ ID NO: 69063 - DNA, 20 bp, Artificial Sequence
  Description of Artificial Sequence: Synthetic oligonucleotide
  Target: SCN9A; (-) strand; PAM type: YTN; PAM sequence: CTG
atactttcataactgaaact

SEQ ID NO: 69064 - DNA, 20 bp, Artificial Sequence
  Description of Artificial Sequence: Synthetic oligonucleotide
  Target: SCN9A; (-) strand; PAM type: YTN; PAM sequence: TTG
tactgatactttcataactg

SEQ ID NO: 69065 - DNA, 20 bp, Artificial Sequence
  Description of Artificial Sequence: Synthetic oligonucleotide
  Target: SCN9A; (-) strand; PAM type: YTN; PAM sequence: TTT
gtactgatactttcataact

SEQ ID NO: 69066 - DNA, 20 bp, Artificial Sequence
  Description of Artificial Sequence: Synthetic oligonucleotide
  Target: SCN9A; (-) strand; PAM type: YTN; PAM sequence: TTT
tgtactgatactttcataac

SEQ ID NO: 69067 - DNA, 20 bp, Artificial Sequence
  Description of Artificial Sequence: Synthetic oligonucleotide
  Target: SCN9A; (-) strand; PAM type: YTN; PAM sequence: TTG
agtgaaattttgtactgata

SEQ ID NO: 69068 - DNA, 20 bp, Artificial Sequence
  Description of Artificial Sequence: Synthetic oligonucleotide
  Target: SCN9A; (-) strand; PAM type: YTN; PAM sequence: TTT
gagtgaaattttgtactgat

SEQ ID NO: 69069 - DNA, 20 bp, Artificial Sequence
  Description of Artificial Sequence: Synthetic oligonucleotide
  Target: SCN9A; (-) strand; PAM type: YTN; PAM sequence: TTT
tgagtgaaattttgtactga

SEQ ID NO: 69070 - DNA, 20 bp, Artificial Sequence
  Description of Artificial Sequence: Synthetic oligonucleotide
  Target: SCN9A; (-) strand; PAM type: YTN; PAM sequence: TTT
ttgagtgaaattttgtactg

SEQ ID NO: 69071 - DNA, 20 bp, Artificial Sequence
  Description of Artificial Sequence: Synthetic oligonucleotide
  Target: SCN9A; (-) strand; PAM type: YTN; PAM sequence: TTA
aataacatgtttttgagtga

SEQ ID NO: 69072 - DNA, 20 bp, Artificial Sequence
  Description of Artificial Sequence: Synthetic oligonucleotide
  Target: SCN9A; (-) strand; PAM type: YTN; PAM sequence: TTT
aaataacatgtttttgagtg

SEQ ID NO: 69073 - DNA, 20 bp, Artificial Sequence
  Description of Artificial Sequence: Synthetic oligonucleotide
  Target: SCN9A; (-) strand; PAM type: YTN; PAM sequence: TTC
aatcagtttaaataacatgt

SEQ ID NO: 69074 - DNA, 20 bp, Artificial Sequence
  Description of Artificial Sequence: Synthetic oligonucleotide
  Target: SCN9A; (-) strand; PAM type: YTN; PAM sequence: TTA
gatgaattcaatcagtttaa

SEQ ID NO: 69075 - DNA, 20 bp, Artificial Sequence
  Description of Artificial Sequence: Synthetic oligonucleotide
  Target: SCN9A; (-) strand; PAM type: YTN; PAM sequence: TTT
agatgaattcaatcagttta

SEQ ID NO: 69076 - DNA, 20 bp, Artificial Sequence
  Description of Artificial Sequence: Synthetic oligonucleotide
  Target: SCN9A; (-) strand; PAM type: YTN; PAM sequence: CTA
atttagatgaattcaatcag

SEQ ID NO: 69077 - DNA, 20 bp, Artificial Sequence
  Description of Artificial Sequence: Synthetic oligonucleotide
  Target: SCN9A; (-) strand; PAM type: YTN; PAM sequence: TTA
aactaatttagatgaattca

SEQ ID NO: 69078 - DNA, 20 bp, Artificial Sequence
  Description of Artificial Sequence: Synthetic oligonucleotide
  Target: SCN9A; (-) strand; PAM type: YTN; PAM sequence: TTA
aattaaactaatttagatga

SEQ ID NO: 69079 - DNA, 20 bp, Artificial Sequence
  Description of Artificial Sequence: Synthetic oligonucleotide
  Target: SCN9A; (-) strand; PAM type: YTN; PAM sequence: TTT
aaattaaactaatttagatg

SEQ ID NO: 69080 - DNA, 20 bp, Artificial Sequence
  Description of Artificial Sequence: Synthetic oligonucleotide
  Target: SCN9A; (-) strand; PAM type: YTN; PAM sequence: TTT
taaattaaactaatttagat

SEQ ID NO: 69081 - DNA, 20 bp, Artificial Sequence
  Description of Artificial Sequence: Synthetic oligonucleotide
  Target: SCN9A; (-) strand; PAM type: YTN; PAM sequence: TTA
ttttaaattaaactaattta

SEQ ID NO: 69082 - DNA, 20 bp, Artificial Sequence
  Description of Artificial Sequence: Synthetic oligonucleotide
  Target: SCN9A; (-) strand; PAM type: YTN; PAM sequence: CTT
attttaaattaaactaattt

SEQ ID NO: 69083 - DNA, 20 bp, Artificial Sequence
  Description of Artificial Sequence: Synthetic oligonucleotide
  Target: SCN9A; (-) strand; PAM type: YTN; PAM sequence: TTA
tcttattttaaattaaacta

SEQ ID NO: 69084 - DNA, 20 bp, Artificial Sequence
  Description of Artificial Sequence: Synthetic oligonucleotide
  Target: SCN9A; (-) strand; PAM type: YTN; PAM sequence: CTA
ttatcttattttaaattaaa

SEQ ID NO: 69085 - DNA, 20 bp, Artificial Sequence
  Description of Artificial Sequence: Synthetic oligonucleotide
  Target: SCN9A; (-) strand; PAM type: YTN; PAM sequence: TTC
tattatcttattttaaatta

SEQ ID NO: 69086 - DNA, 20 bp, Artificial Sequence
  Description of Artificial Sequence: Synthetic oligonucleotide
  Target: SCN9A; (-) strand; PAM type: YTN; PAM sequence: TTT
ctattatcttattttaaatt

SEQ ID NO: 69087 - DNA, 20 bp, Artificial Sequence
  Description of Artificial Sequence: Synthetic oligonucleotide
  Target: SCN9A; (-) strand; PAM type: YTN; PAM sequence: TTA
atttctattatcttatttta

SEQ ID NO: 69088 - DNA, 20 bp, Artificial Sequence
  Description of Artificial Sequence: Synthetic oligonucleotide
  Target: SCN9A; (-) strand; PAM type: YTN; PAM sequence: TTA
taattaatttctattatctt

SEQ ID NO: 69089 - DNA, 20 bp, Artificial Sequence
  Description of Artificial Sequence: Synthetic oligonucleotide
  Target: SCN9A; (-) strand; PAM type: YTN; PAM sequence: TTC
agttataattaatttctatt

SEQ ID NO: 69090 - DNA, 20 bp, Artificial Sequence
  Description of Artificial Sequence: Synthetic oligonucleotide
  Target: SCN9A; (-) strand; PAM type: YTN; PAM sequence: TTA
tagaatattcagttataatt

SEQ ID NO: 69091 - DNA, 20 bp, Artificial Sequence
  Description of Artificial Sequence: Synthetic oligonucleotide
  Target: SCN9A; (-) strand; PAM type: YTN; PAM sequence: TTT
atagaatattcagttataat

SEQ ID NO: 69092 - DNA, 20 bp, Artificial Sequence
  Description of Artificial Sequence: Synthetic oligonucleotide
  Target: SCN9A; (-) strand; PAM type: YTN; PAM sequence: TTT
tatagaatattcagttataa

SEQ ID NO: 69093 - DNA, 20 bp, Artificial Sequence
  Description of Artificial Sequence: Synthetic oligonucleotide
  Target: SCN9A; (-) strand; PAM type: YTN; PAM sequence: CTA
tagttttatagaatattcag

SEQ ID NO: 69094 - DNA, 20 bp, Artificial Sequence
  Description of Artificial Sequence: Synthetic oligonucleotide
  Target: SCN9A; (-) strand; PAM type: YTN; PAM sequence: TTC
tatagttttatagaatattc

SEQ ID NO: 69095 - DNA, 20 bp, Artificial Sequence
  Description of Artificial Sequence: Synthetic oligonucleotide
  Target: SCN9A; (-) strand; PAM type: YTN; PAM sequence: CTA
ttctatagttttatagaata

SEQ ID NO: 69096 - DNA, 20 bp, Artificial Sequence
  Description of Artificial Sequence: Synthetic oligonucleotide
  Target: SCN9A; (-) strand; PAM type: YTN; PAM sequence: TTA
aagcctattctatagtttta

SEQ ID NO: 69097 - DNA, 20 bp, Artificial Sequence
  Description of Artificial Sequence: Synthetic oligonucleotide
  Target: SCN9A; (-) strand; PAM type: YTN; PAM sequence: TTT
aaagcctattctatagtttt

SEQ ID NO: 69098 - DNA, 20 bp, Artificial Sequence
  Description of Artificial Sequence: Synthetic oligonucleotide
  Target: SCN9A; (-) strand; PAM type: YTN; PAM sequence: CTT
taaagcctattctatagttt

SEQ ID NO: 69099 - DNA, 20 bp, Artificial Sequence
  Description of Artificial Sequence: Synthetic oligonucleotide
  Target: SCN9A; (-) strand; PAM type: YTN; PAM sequence: TTA
tactttaaagcctattctat

SEQ ID NO: 69100 - DNA, 20 bp, Artificial Sequence
  Description of Artificial Sequence: Synthetic oligonucleotide
  Target: SCN9A; (-) strand; PAM type: YTN; PAM sequence: TTT
atactttaaagcctattcta

SEQ ID NO: 69101 - DNA, 20 bp, Artificial Sequence
  Description of Artificial Sequence: Synthetic oligonucleotide
  Target: SCN9A; (-) strand; PAM type: YTN; PAM sequence: CTA
tagtttatactttaaagcct

SEQ ID NO: 69102 - DNA, 20 bp, Artificial Sequence
  Description of Artificial Sequence: Synthetic oligonucleotide
  Target: SCN9A; (-) strand; PAM type: YTN; PAM sequence: TTC
tatagtttatactttaaagc

SEQ ID NO: 69103 - DNA, 20 bp, Artificial Sequence
  Description of Artificial Sequence: Synthetic oligonucleotide
  Target: SCN9A; (-) strand; PAM type: YTN; PAM sequence: CTC
attctatagtttatacttta

SEQ ID NO: 69104 - DNA, 20 bp, Artificial Sequence
  Description of Artificial Sequence: Synthetic oligonucleotide
  Target: SCN9A; (-) strand; PAM type: YTN; PAM sequence: TTA
aaactcattctatagtttat

SEQ ID NO: 69105 - DNA, 20 bp, Artificial Sequence
  Description of Artificial Sequence: Synthetic oligonucleotide
  Target: SCN9A; (-) strand; PAM type: YTN; PAM sequence: TTT
aaaactcattctatagttta

SEQ ID NO: 69106 - DNA, 20 bp, Artificial Sequence
  Description of Artificial Sequence: Synthetic oligonucleotide
  Target: SCN9A; (-) strand; PAM type: YTN; PAM sequence: TTT
taaaactcattctatagttt

SEQ ID NO: 69107 - DNA, 20 bp, Artificial Sequence
  Description of Artificial Sequence: Synthetic oligonucleotide
  Target: SCN9A; (-) strand; PAM type: YTN; PAM sequence: TTA
tatattttaaaactcattct

SEQ ID NO: 69108 - DNA, 20 bp, Artificial Sequence
  Description of Artificial Sequence: Synthetic oligonucleotide
  Target: SCN9A; (-) strand; PAM type: YTN; PAM sequence: CTT
atatattttaaaactcattc

SEQ ID NO: 69109 - DNA, 20 bp, Artificial Sequence
  Description of Artificial Sequence: Synthetic oligonucleotide
  Target: SCN9A; (-) strand; PAM type: YTN; PAM sequence: TTA
aaacttatatattttaaaac

SEQ ID NO: 69110 - DNA, 20 bp, Artificial Sequence
  Description of Artificial Sequence: Synthetic oligonucleotide
  Target: SCN9A; (-) strand; PAM type: YTN; PAM sequence: TTT
aaaacttatatattttaaaa

SEQ ID NO: 69111 - DNA, 20 bp, Artificial Sequence
  Description of Artificial Sequence: Synthetic oligonucleotide
  Target: SCN9A; (-) strand; PAM type: YTN; PAM sequence: TTT
taaaacttatatattttaaa

SEQ ID NO: 69112 - DNA, 20 bp, Artificial Sequence
  Description of Artificial Sequence: Synthetic oligonucleotide
  Target: SCN9A; (-) strand; PAM type: YTN; PAM sequence: CTG
tattttaaaacttatatatt

SEQ ID NO: 69113 - DNA, 20 bp, Artificial Sequence
  Description of Artificial Sequence: Synthetic oligonucleotide
  Target: SCN9A; (-) strand; PAM type: YTN; PAM sequence: TTA
atctgtattttaaaacttat

SEQ ID NO: 69114 - DNA, 20 bp, Artificial Sequence
  Description of Artificial Sequence: Synthetic oligonucleotide
  Target: SCN9A; (-) strand; PAM type: YTN; PAM sequence: CTG
gattaatctgtattttaaaa

SEQ ID NO: 69115 - DNA, 20 bp, Artificial Sequence
  Description of Artificial Sequence: Synthetic oligonucleotide
  Target: SCN9A; (-) strand; PAM type: YTN; PAM sequence: TTC
ctggattaatctgtatttta

SEQ ID NO: 69116 - DNA, 20 bp, Artificial Sequence
  Description of Artificial Sequence: Synthetic oligonucleotide
  Target: SCN9A; (-) strand; PAM type: YTN; PAM sequence: TTT
cctggattaatctgtatttt

SEQ ID NO: 69117 - DNA, 20 bp, Artificial Sequence
  Description of Artificial Sequence: Synthetic oligonucleotide
  Target: SCN9A; (-) strand; PAM type: YTN; PAM sequence: TTA
tccaacatcgtttcctggat

SEQ ID NO: 69118 - DNA, 20 bp, Artificial Sequence
  Description of Artificial Sequence: Synthetic oligonucleotide
  Target: SCN9A; (-) strand; PAM type: YTN; PAM sequence: TTT
atccaacatcgtttcctgga

SEQ ID NO: 69119 - DNA, 20 bp, Artificial Sequence
  Description of Artificial Sequence: Synthetic oligonucleotide
  Target: SCN9A; (-) strand; PAM type: YTN; PAM sequence: TTA
taagtttatccaacatcgtt

SEQ ID NO: 69120 - DNA, 20 bp, Artificial Sequence
  Description of Artificial Sequence: Synthetic oligonucleotide
  Target: SCN9A; (-) strand; PAM type: YTN; PAM sequence: TTA
gtaattataagtttatccaa

SEQ ID NO: 69121 - DNA, 20 bp, Artificial Sequence
  Description of Artificial Sequence: Synthetic oligonucleotide
  Target: SCN9A; (-) strand; PAM type: YTN; PAM sequence: TTG
gcacaaaatacatattagta

SEQ ID NO: 69122 - DNA, 20 bp, Artificial Sequence
  Description of Artificial Sequence: Synthetic oligonucleotide
  Target: SCN9A; (-) strand; PAM type: YTN; PAM sequence: TTG
tggcaattggcacaaaatac

SEQ ID NO: 69123 - DNA, 20 bp, Artificial Sequence
  Description of Artificial Sequence: Synthetic oligonucleotide
  Target: SCN9A; (-) strand; PAM type: YTN; PAM sequence: TTT
gtggcaattggcacaaaata

SEQ ID NO: 69124 - DNA, 20 bp, Artificial Sequence
  Description of Artificial Sequence: Synthetic oligonucleotide
  Target: SCN9A; (-) strand; PAM type: YTN; PAM sequence: TTT
tgtggcaattggcacaaaat

SEQ ID NO: 69125 - DNA, 20 bp, Artificial Sequence
  Description of Artificial Sequence: Synthetic oligonucleotide
  Target: SCN9A; (-) strand; PAM type: YTN; PAM sequence: TTG
gattttgtggcaattggcac

SEQ ID NO: 69126 - DNA, 20 bp, Artificial Sequence
  Description of Artificial Sequence: Synthetic oligonucleotide
  Target: SCN9A; (-) strand; PAM type: YTN; PAM sequence: TTT
ggattttgtggcaattggca

SEQ ID NO: 69127 - DNA, 20 bp, Artificial Sequence
  Description of Artificial Sequence: Synthetic oligonucleotide
  Target: SCN9A; (-) strand; PAM type: YTN; PAM sequence: CTT
tggattttgtggcaattggc

SEQ ID NO: 69128 - DNA, 20 bp, Artificial Sequence
  Description of Artificial Sequence: Synthetic oligonucleotide
  Target: SCN9A; (-) strand; PAM type: YTN; PAM sequence: CTA
aatatggtactttggatttt

SEQ ID NO: 69129 - DNA, 20 bp, Artificial Sequence
  Description of Artificial Sequence: Synthetic oligonucleotide
  Target: SCN9A; (-) strand; PAM type: YTN; PAM sequence: TTC
taaatatggtactttggatt

SEQ ID NO: 69130 - DNA, 20 bp, Artificial Sequence
  Description of Artificial Sequence: Synthetic oligonucleotide
  Target: SCN9A; (-) strand; PAM type: YTN; PAM sequence: CTT
ctaaatatggtactttggat

SEQ ID NO: 69131 - DNA, 20 bp, Artificial Sequence
  Description of Artificial Sequence: Synthetic oligonucleotide
  Target: SCN9A; (-) strand; PAM type: YTN; PAM sequence: CTG
tagtcttctaaatatggtac

SEQ ID NO: 69132 - DNA, 20 bp, Artificial Sequence
  Description of Artificial Sequence: Synthetic oligonucleotide
  Target: SCN9A; (-) strand; PAM type: YTN; PAM sequence: TTA
aaactgtagtcttctaaata

SEQ ID NO: 69133 - DNA, 20 bp, Artificial Sequence
  Description of Artificial Sequence: Synthetic oligonucleotide
  Target: SCN9A; (-) strand; PAM type: YTN; PAM sequence: TTG
aagccattaaaactgtagtc

SEQ ID NO: 69134 - DNA, 20 bp, Artificial Sequence
  Description of Artificial Sequence: Synthetic oligonucleotide
  Target: SCN9A; (-) strand; PAM type: YTN; PAM sequence: TTC
acgtgcagccgagaggtcag

SEQ ID NO: 69135 - DNA, 20 bp, Artificial Sequence
  Description of Artificial Sequence: Synthetic oligonucleotide
  Target: SCN9A; (-) strand; PAM type: YTN; PAM sequence: CTG
gtgatagttcacgtgcagcc

SEQ ID NO: 69136 - DNA, 20 bp, Artificial Sequence
  Description of Artificial Sequence: Synthetic oligonucleotide
  Target: SCN9A; (-) strand; PAM type: YTN; PAM sequence: CTC
tggtgatagttcacgtgcag

SEQ ID NO: 69137 - DNA, 20 bp, Artificial Sequence
  Description of Artificial Sequence: Synthetic oligonucleotide
  Target: SCN9A; (-) strand; PAM type: YTN; PAM sequence: TTC
tctggtgatagttcacgtgc

SEQ ID NO: 69138 - DNA, 20 bp, Artificial Sequence
  Description of Artificial Sequence: Synthetic oligonucleotide
  Target: SCN9A; (-) strand; PAM type: YTN; PAM sequence: CTT
ctctggtgatagttcacgtg

SEQ ID NO: 69139 - DNA, 20 bp, Artificial Sequence
  Description of Artificial Sequence: Synthetic oligonucleotide
  Target: SCN9A; (-) strand; PAM type: YTN; PAM sequence: TTC
acttctctggtgatagttca

SEQ ID NO: 69140 - DNA, 20 bp, Artificial Sequence
  Description of Artificial Sequence: Synthetic oligonucleotide
  Target: SCN9A; (-) strand; PAM type: YTN; PAM sequence: TTT
cacttctctggtgatagttc

SEQ ID NO: 69141 - DNA, 20 bp, Artificial Sequence
  Description of Artificial Sequence: Synthetic oligonucleotide
  Target: SCN9A; (-) strand; PAM type: YTN; PAM sequence: CTT
tcacttctctggtgatagtt

SEQ ID NO: 69142 - DNA, 20 bp, Artificial Sequence
  Description of Artificial Sequence: Synthetic oligonucleotide
  Target: SCN9A; (-) strand; PAM type: YTN; PAM sequence: TTG
tctttcacttctctggtgat

SEQ ID NO: 69143 - DNA, 20 bp, Artificial Sequence
  Description of Artificial Sequence: Synthetic oligonucleotide
  Target: SCN9A; (-) strand; PAM type: YTN; PAM sequence: CTT
gtctttcacttctctggtga

SEQ ID NO: 69144 - DNA, 20 bp, Artificial Sequence
  Description of Artificial Sequence: Synthetic oligonucleotide
  Target: SCN9A; (-) strand; PAM type: YTN; PAM sequence: TTC
acagaataatagggccttgt

SEQ ID NO: 69145 - DNA, 20 bp, Artificial Sequence
  Description of Artificial Sequence: Synthetic oligonucleotide
  Target: SCN9A; (-) strand; PAM type: YTN; PAM sequence: CTT
cacagaataatagggccttg

SEQ ID NO: 69146 - DNA, 20 bp, Artificial Sequence
  Description of Artificial Sequence: Synthetic oligonucleotide
  Target: SCN9A; (-) strand; PAM type: YTN; PAM sequence: TTA
acttcacagaataatagggc

SEQ ID NO: 69147 - DNA, 20 bp, Artificial Sequence
  Description of Artificial Sequence: Synthetic oligonucleotide
  Target: SCN9A; (-) strand; PAM type: YTN; PAM sequence: CTT
aacttcacagaataataggg

SEQ ID NO: 69148 - DNA, 20 bp, Artificial Sequence
  Description of Artificial Sequence: Synthetic oligonucleotide
  Target: SCN9A; (-) strand; PAM type: YTN; PAM sequence: CTG
gtcttaacttcacagaataa

SEQ ID NO: 69149 - DNA, 20 bp, Artificial Sequence
  Description of Artificial Sequence: Synthetic oligonucleotide
  Target: SCN9A; (-) strand; PAM type: YTN; PAM sequence: TTC
agaaatgaagggcctggtct

SEQ ID NO: 69150 - DNA, 20 bp, Artificial Sequence
  Description of Artificial Sequence: Synthetic oligonucleotide
  Target: SCN9A; (-) strand; PAM type: YTN; PAM sequence: TTT
cagaaatgaagggcctggtc

SEQ ID NO: 69151 - DNA, 20 bp, Artificial Sequence
  Description of Artificial Sequence: Synthetic oligonucleotide
  Target: SCN9A; (-) strand; PAM type: YTN; PAM sequence: TTT
tcagaaatgaagggcctggt

SEQ ID NO: 69152 - DNA, 20 bp, Artificial Sequence
  Description of Artificial Sequence: Synthetic oligonucleotide
  Target: SCN9A; (-) strand; PAM type: YTN; PAM sequence: TTT
ttcagaaatgaagggcctgg

SEQ ID NO: 69153 - DNA, 20 bp, Artificial Sequence
  Description of Artificial Sequence: Synthetic oligonucleotide
  Target: SCN9A; (-) strand; PAM type: YTN; PAM sequence: TTT
tttcagaaatgaagggcctg

SEQ ID NO: 69154 - DNA, 20 bp, Artificial Sequence
  Description of Artificial Sequence: Synthetic oligonucleotide
  Target: SCN9A; (-) strand; PAM type: YTN; PAM sequence: CTT
ttttcagaaatgaagggcct

SEQ ID NO: 69155 - DNA, 20 bp, Artificial Sequence
  Description of Artificial Sequence: Synthetic oligonucleotide
  Target: SCN9A; (-) strand; PAM type: YTN; PAM sequence: TTC
ttttttcagaaatgaagggc

SEQ ID NO: 69156 - DNA, 20 bp, Artificial Sequence
  Description of Artificial Sequence: Synthetic oligonucleotide
  Target: SCN9A; (-) strand; PAM type: YTN; PAM sequence: CTC
aaaacccaggccaataattc

SEQ ID NO: 69157 - DNA, 20 bp, Artificial Sequence
  Description of Artificial Sequence: Synthetic oligonucleotide
  Target: SCN9A; (-) strand; PAM type: YTN; PAM sequence: TTA
cctcaaaacccaggccaata

SEQ ID NO: 69158 - DNA, 20 bp, Artificial Sequence
  Description of Artificial Sequence: Synthetic oligonucleotide
  Target: SCN9A; (-) strand; PAM type: YTN; PAM sequence: TTT
acctcaaaacccaggccaat

SEQ ID NO: 69159 - DNA, 20 bp, Artificial Sequence
  Description of Artificial Sequence: Synthetic oligonucleotide
  Target: SCN9A; (-) strand; PAM type: YTN; PAM sequence: CTT
tacctcaaaacccaggccaa

SEQ ID NO: 69160 - DNA, 20 bp, Artificial Sequence
  Description of Artificial Sequence: Synthetic oligonucleotide
  Target: SCN9A; (-) strand; PAM type: YTN; PAM sequence: CTG
ctttacctcaaaacccaggc

SEQ ID NO: 69161 - DNA, 20 bp, Artificial Sequence
  Description of Artificial Sequence: Synthetic oligonucleotide
  Target: SCN9A; (-) strand; PAM type: YTN; PAM sequence: CTC
actgctttacctcaaaaccc

SEQ ID NO: 69162 - DNA, 20 bp, Artificial Sequence
  Description of Artificial Sequence: Synthetic oligonucleotide
  Target: SCN9A; (-) strand; PAM type: YTN; PAM sequence: CTC
tcactgctttacctcaaaac

SEQ ID NO: 69163 - DNA, 20 bp, Artificial Sequence
  Description of Artificial Sequence: Synthetic oligonucleotide
  Target: SCN9A; (-) strand; PAM type: YTN; PAM sequence: TTC
ctctcactgctttacctcaa

SEQ ID NO: 69164 - DNA, 20 bp, Artificial Sequence
  Description of Artificial Sequence: Synthetic oligonucleotide
  Target: SCN9A; (-) strand; PAM type: YTN; PAM sequence: CTA
tcagcaattcctctcactgc

SEQ ID NO: 69165 - DNA, 20 bp, Artificial Sequence
  Description of Artificial Sequence: Synthetic oligonucleotide
  Target: SCN9A; (-) strand; PAM type: YTN; PAM sequence: TTC
tatcagcaattcctctcact

SEQ ID NO: 69166 - DNA, 20 bp, Artificial Sequence
  Description of Artificial Sequence: Synthetic oligonucleotide
  Target: SCN9A; (-) strand; PAM type: YTN; PAM sequence: TTT
ctatcagcaattcctctcac

SEQ ID NO: 69167 - DNA, 20 bp, Artificial Sequence
  Description of Artificial Sequence: Synthetic oligonucleotide
  Target: SCN9A; (-) strand; PAM type: YTN; PAM sequence: CTT
tctatcagcaattcctctca

SEQ ID NO: 69168 - DNA, 20 bp, Artificial Sequence
  Description of Artificial Sequence: Synthetic oligonucleotide
  Target: SCN9A; (-) strand; PAM type: YTN; PAM sequence: TTC
tttctatcagcaattcctct

SEQ ID NO: 69169 - DNA, 20 bp, Artificial Sequence
  Description of Artificial Sequence: Synthetic oligonucleotide
  Target: SCN9A; (-) strand; PAM type: YTN; PAM sequence: TTG
tattctttctatcagcaatt

SEQ ID NO: 69170 - DNA, 20 bp, Artificial Sequence
  Description of Artificial Sequence: Synthetic oligonucleotide
  Target: SCN9A; (-) strand; PAM type: YTN; PAM sequence: TTT
gtattctttctatcagcaat

SEQ ID NO: 69171 - DNA, 20 bp, Artificial Sequence
  Description of Artificial Sequence: Synthetic oligonucleotide
  Target: SCN9A; (-) strand; PAM type: YTN; PAM sequence: CTT
tgtattctttctatcagcaa

SEQ ID NO: 69172 - DNA, 20 bp, Artificial Sequence
  Description of Artificial Sequence: Synthetic oligonucleotide
  Target: SCN9A; (-) strand; PAM type: YTN; PAM sequence: CTA
atagcaggggggtgctttgt

SEQ ID NO: 69173 - DNA, 20 bp, Artificial Sequence
  Description of Artificial Sequence: Synthetic oligonucleotide
  Target: SCN9A; (-) strand; PAM type: YTN; PAM sequence: TTG
tgtctaatagcaggggggtg

SEQ ID NO: 69174 - DNA, 20 bp, Artificial Sequence
  Description of Artificial Sequence: Synthetic oligonucleotide
  Target: SCN9A; (-) strand; PAM type: YTN; PAM sequence: TTA
atattgtgtctaatagcagg

SEQ ID NO: 69175 - DNA, 20 bp, Artificial Sequence
  Description of Artificial Sequence: Synthetic oligonucleotide
  Target: SCN9A; (-) strand; PAM type: YTN; PAM sequence: TTG
ttaatattgtgtctaatagc

SEQ ID NO: 69176 - DNA, 20 bp, Artificial Sequence
  Description of Artificial Sequence: Synthetic oligonucleotide
  Target: SCN9A; (-) strand; PAM type: YTN; PAM sequence: CTA
ttgttaatattgtgtctaat

SEQ ID NO: 69177 - DNA, 20 bp, Artificial Sequence
  Description of Artificial Sequence: Synthetic oligonucleotide
  Target: SCN9A; (-) strand; PAM type: YTN; PAM sequence: TTC
ctattgttaatattgtgtct

SEQ ID NO: 69178 - DNA, 20 bp, Artificial Sequence
  Description of Artificial Sequence: Synthetic oligonucleotide
  Target: SCN9A; (-) strand; PAM type: YTN; PAM sequence: TTT
cctattgttaatattgtgtc

SEQ ID NO: 69179 - DNA, 20 bp, Artificial Sequence
  Description of Artificial Sequence: Synthetic oligonucleotide
  Target: SCN9A; (-) strand; PAM type: YTN; PAM sequence: CTA
tttcctattgttaatattgt

SEQ ID NO: 69180 - DNA, 20 bp, Artificial Sequence
  Description of Artificial Sequence: Synthetic oligonucleotide
  Target: SCN9A; (-) strand; PAM type: YTN; PAM sequence: TTA
taactatttcctattgttaa

SEQ ID NO: 69181 - DNA, 20 bp, Artificial Sequence
  Description of Artificial Sequence: Synthetic oligonucleotide
  Target: SCN9A; (-) strand; PAM type: YTN; PAM sequence: CTC
agagaaaaaccattataact

SEQ ID NO: 69182 - DNA, 20 bp, Artificial Sequence
  Description of Artificial Sequence: Synthetic oligonucleotide
  Target: SCN9A; (-) strand; PAM type: YTN; PAM sequence: TTA
ccagctcagagaaaaaccat

SEQ ID NO: 69183 - DNA, 20 bp, Artificial Sequence
  Description of Artificial Sequence: Synthetic oligonucleotide
  Target: SCN9A; (-) strand; PAM type: YTN; PAM sequence: TTG
ttaccagctcagagaaaaac

SEQ ID NO: 69184 - DNA, 20 bp, Artificial Sequence
  Description of Artificial Sequence: Synthetic oligonucleotide
  Target: SCN9A; (-) strand; PAM type: YTN; PAM sequence: TTA
aaagttgttaccagctcaga

SEQ ID NO: 69185 - DNA, 20 bp, Artificial Sequence
  Description of Artificial Sequence: Synthetic oligonucleotide
  Target: SCN9A; (-) strand; PAM type: YTN; PAM sequence: TTT
aaaagttgttaccagctcag

SEQ ID NO: 69186 - DNA, 20 bp, Artificial Sequence
  Description of Artificial Sequence: Synthetic oligonucleotide
  Target: SCN9A; (-) strand; PAM type: YTN; PAM sequence: TTA
tttaaaagttgttaccagct

SEQ ID NO: 69187 - DNA, 20 bp, Artificial Sequence
  Description of Artificial Sequence: Synthetic oligonucleotide
  Target: SCN9A; (-) strand; PAM type: YTN; PAM sequence: TTT
atttaaaagttgttaccagc

SEQ ID NO: 69188 - DNA, 20 bp, Artificial Sequence
  Description of Artificial Sequence: Synthetic oligonucleotide
  Target: SCN9A; (-) strand; PAM type: YTN; PAM sequence: TTT
tatttaaaagttgttaccag

SEQ ID NO: 69189 - DNA, 20 bp, Artificial Sequence
  Description of Artificial Sequence: Synthetic oligonucleotide
  Target: SCN9A; (-) strand; PAM type: YTN; PAM sequence: CTG
caaataagaatcattttatt

SEQ ID NO: 69190 - DNA, 20 bp, Artificial Sequence
  Description of Artificial Sequence: Synthetic oligonucleotide
  Target: SCN9A; (-) strand; PAM type: YTN; PAM sequence: TTC
tgcaaataagaatcatttta

SEQ ID NO: 69191 - DNA, 20 bp, Artificial Sequence
  Description of Artificial Sequence: Synthetic oligonucleotide
  Target: SCN9A; (-) strand; PAM type: YTN; PAM sequence: CTA
aagtcagaattctgcaaata

SEQ ID NO: 69192 - DNA, 20 bp, Artificial Sequence
  Description of Artificial Sequence: Synthetic oligonucleotide
  Target: SCN9A; (-) strand; PAM type: YTN; PAM sequence: TTA
gctaaagtcagaattctgca

SEQ ID NO: 69193 - DNA, 20 bp, Artificial Sequence
  Description of Artificial Sequence: Synthetic oligonucleotide
  Target: SCN9A; (-) strand; PAM type: YTN; PAM sequence: TTT
agctaaagtcagaattctgc

SEQ ID NO: 69194 - DNA, 20 bp, Artificial Sequence
  Description of Artificial Sequence: Synthetic oligonucleotide
  Target: SCN9A; (-) strand; PAM type: YTN; PAM sequence: TTC
atgaatttagctaaagtcag

SEQ ID NO: 69195 - DNA, 20 bp, Artificial Sequence
  Description of Artificial Sequence: Synthetic oligonucleotide
  Target: SCN9A; (-) strand; PAM type: YTN; PAM sequence: TTT
catgaatttagctaaagtca

SEQ ID NO: 69196 - DNA, 20 bp, Artificial Sequence
  Description of Artificial Sequence: Synthetic oligonucleotide
  Target: SCN9A; (-) strand; PAM type: YTN; PAM sequence: CTT
tcatgaatttagctaaagtc

SEQ ID NO: 69197 - DNA, 20 bp, Artificial Sequence
  Description of Artificial Sequence: Synthetic oligonucleotide
  Target: SCN9A; (-) strand; PAM type: YTN; PAM sequence: TTG
aagatgctttcatgaattta

SEQ ID NO: 69198 - DNA, 20 bp, Artificial Sequence
  Description of Artificial Sequence: Synthetic oligonucleotide
  Target: SCN9A; (-) strand; PAM type: YTN; PAM sequence: TTT
gaagatgctttcatgaattt

SEQ ID NO: 69199 - DNA, 20 bp, Artificial Sequence
  Description of Artificial Sequence: Synthetic oligonucleotide
  Target: SCN9A; (-) strand; PAM type: YTN; PAM sequence: TTG
atgtttgaagatgctttcat

SEQ ID NO: 69200 - DNA, 20 bp, Artificial Sequence
  Description of Artificial Sequence: Synthetic oligonucleotide
  Target: SCN9A; (-) strand; PAM type: YTN; PAM sequence: TTA
ttgatgtttgaagatgcttt

SEQ ID NO: 69201 - DNA, 20 bp, Artificial Sequence
  Description of Artificial Sequence: Synthetic oligonucleotide
  Target: SCN9A; (-) strand; PAM type: YTN; PAM sequence: TTA
aacagtgagaaaaccaatta

SEQ ID NO: 69202 - DNA, 20 bp, Artificial Sequence
  Description of Artificial Sequence: Synthetic oligonucleotide
  Target: SCN9A; (-) strand; PAM type: YTN; PAM sequence: CTT
aaacagtgagaaaaccaatt

SEQ ID NO: 69203 - DNA, 20 bp, Artificial Sequence
  Description of Artificial Sequence: Synthetic oligonucleotide
  Target: SCN9A; (-) strand; PAM type: YTN; PAM sequence: CTC
ttaaacagtgagaaaaccaa

SEQ ID NO: 69204 - DNA, 20 bp, Artificial Sequence
  Description of Artificial Sequence: Synthetic oligonucleotide
  Target: SCN9A; (-) strand; PAM type: YTN; PAM sequence: CTC
tcttaaacagtgagaaaacc

SEQ ID NO: 69205 - DNA, 20 bp, Artificial Sequence
  Description of Artificial Sequence: Synthetic oligonucleotide
  Target: SCN9A; (-) strand; PAM type: YTN; PAM sequence: TTA
atgctctcttaaacagtgag

SEQ ID NO: 69206 - DNA, 20 bp, Artificial Sequence
  Description of Artificial Sequence: Synthetic oligonucleotide
  Target: SCN9A; (-) strand; PAM type: YTN; PAM sequence: TTG
ttaatgctctcttaaacagt

SEQ ID NO: 69207 - DNA, 20 bp, Artificial Sequence
  Description of Artificial Sequence: Synthetic oligonucleotide
  Target: SCN9A; (-) strand; PAM type: YTN; PAM sequence: TTT
gttaatgctctcttaaacag

SEQ ID NO: 69208 - DNA, 20 bp, Artificial Sequence
  Description of Artificial Sequence: Synthetic oligonucleotide
  Target: SCN9A; (-) strand; PAM type: YTN; PAM sequence: CTT
tgttaatgctctcttaaaca

SEQ ID NO: 69209 - DNA, 20 bp, Artificial Sequence
  Description of Artificial Sequence: Synthetic oligonucleotide
  Target: SCN9A; (-) strand; PAM type: YTN; PAM sequence: TTG
gcataaatctttgttaatgc

SEQ ID NO: 69210 - DNA, 20 bp, Artificial Sequence
  Description of Artificial Sequence: Synthetic oligonucleotide
  Target: SCN9A; (-) strand; PAM type: YTN; PAM sequence: TTT
ggcataaatctttgttaatg

SEQ ID NO: 69211 - DNA, 20 bp, Artificial Sequence
  Description of Artificial Sequence: Synthetic oligonucleotide
  Target: SCN9A; (-) strand; PAM type: YTN; PAM sequence: CTA
atttggcataaatctttgtt

SEQ ID NO: 69212 - DNA, 20 bp, Artificial Sequence
  Description of Artificial Sequence: Synthetic oligonucleotide
  Target: SCN9A; (-) strand; PAM type: YTN; PAM sequence: CTC
ataatctaatttggcataaa

SEQ ID NO: 69213 - DNA, 20 bp, Artificial Sequence
  Description of Artificial Sequence: Synthetic oligonucleotide
  Target: SCN9A; (-) strand; PAM type: YTN; PAM sequence: TTG
ctcataatctaatttggcat

SEQ ID NO: 69214 - DNA, 20 bp, Artificial Sequence
  Description of Artificial Sequence: Synthetic oligonucleotide
  Target: SCN9A; (-) strand; PAM type: YTN; PAM sequence: CTT
gctcataatctaatttggca

SEQ ID NO: 69215 - DNA, 20 bp, Artificial Sequence
  Description of Artificial Sequence: Synthetic oligonucleotide
  Target: SCN9A; (-) strand; PAM type: YTN; PAM sequence: TTA
cttgctcataatctaatttg

SEQ ID NO: 69216 - DNA, 20 bp, Artificial Sequence
  Description of Artificial Sequence: Synthetic oligonucleotide
  Target: SCN9A; (-) strand; PAM type: YTN; PAM sequence: TTT
acttgctcataatctaattt

SEQ ID NO: 69217 - DNA, 20 bp, Artificial Sequence
  Description of Artificial Sequence: Synthetic oligonucleotide
  Target: SCN9A; (-) strand; PAM type: YTN; PAM sequence: TTT
tacttgctcataatctaatt

SEQ ID NO: 69218 - DNA, 20 bp, Artificial Sequence
  Description of Artificial Sequence: Synthetic oligonucleotide
  Target: SCN9A; (-) strand; PAM type: YTN; PAM sequence: TTT
ttacttgctcataatctaat

SEQ ID NO: 69219 - DNA, 20 bp, Artificial Sequence
  Description of Artificial Sequence: Synthetic oligonucleotide
  Target: SCN9A; (-) strand; PAM type: YTN; PAM sequence: CTA
tataaaatcacgtgaatttt

SEQ ID NO: 69220 - DNA, 20 bp, Artificial Sequence
  Description of Artificial Sequence: Synthetic oligonucleotide
  Target: SCN9A; (-) strand; PAM type: YTN; PAM sequence: TTC
aacaacaagatacactatat

SEQ ID NO: 69221 - DNA, 20 bp, Artificial Sequence
  Description of Artificial Sequence: Synthetic oligonucleotide
  Target: SCN9A; (-) strand; PAM type: YTN; PAM sequence: TTT
caacaacaagatacactata

SEQ ID NO: 69222 - DNA, 20 bp, Artificial Sequence
  Description of Artificial Sequence: Synthetic oligonucleotide
  Target: SCN9A; (-) strand; PAM type: YTN; PAM sequence: CTG
catatgaaaaaaagtttcaa

SEQ ID NO: 69223 - DNA, 20 bp, Artificial Sequence
  Description of Artificial Sequence: Synthetic oligonucleotide
  Target: SCN9A; (-) strand; PAM type: YTN; PAM sequence: TTA
aaaaaacataaaacctgcat

SEQ ID NO: 69224 - DNA, 20 bp, Artificial Sequence
  Description of Artificial Sequence: Synthetic oligonucleotide
  Target: SCN9A; (-) strand; PAM type: YTN; PAM sequence: TTG
accattaaaaaaacataaaa

SEQ ID NO: 69225 - DNA, 20 bp, Artificial Sequence
  Description of Artificial Sequence: Synthetic oligonucleotide
  Target: SCN9A; (-) strand; PAM type: YTN; PAM sequence: TTC
aattgaccattaaaaaaaca

SEQ ID NO: 69226 - DNA, 20 bp, Artificial Sequence
  Description of Artificial Sequence: Synthetic oligonucleotide
  Target: SCN9A; (-) strand; PAM type: YTN; PAM sequence: CTG
aattcaattgaccattaaaa

SEQ ID NO: 69227 - DNA, 20 bp, Artificial Sequence
  Description of Artificial Sequence: Synthetic oligonucleotide
  Target: SCN9A; (-) strand; PAM type: YTN; PAM sequence: CTG
tgccaagctgaattcaattg

SEQ ID NO: 69228 - DNA, 20 bp, Artificial Sequence
  Description of Artificial Sequence: Synthetic oligonucleotide
  Target: SCN9A; (-) strand; PAM type: YTN; PAM sequence: TTC
tgtgccaagctgaattcaat

SEQ ID NO: 69229 - DNA, 20 bp, Artificial Sequence
  Description of Artificial Sequence: Synthetic oligonucleotide
  Target: SCN9A; (-) strand; PAM type: YTN; PAM sequence: TTA
tgatgtaaaattctgtgcca

SEQ ID NO: 69230 - DNA, 20 bp, Artificial Sequence
  Description of Artificial Sequence: Synthetic oligonucleotide
  Target: SCN9A; (-) strand; PAM type: YTN; PAM sequence: TTT
atgatgtaaaattctgtgcc

SEQ ID NO: 69231 - DNA, 20 bp, Artificial Sequence
  Description of Artificial Sequence: Synthetic oligonucleotide
  Target: SCN9A; (-) strand; PAM type: YTN; PAM sequence: CTT
tatgatgtaaaattctgtgc

SEQ ID NO: 69232 - DNA, 20 bp, Artificial Sequence
  Description of Artificial Sequence: Synthetic oligonucleotide
  Target: SCN9A; (-) strand; PAM type: YTN; PAM sequence: TTG
aataactttatgatgtaaaa

SEQ ID NO: 69233 - DNA, 20 bp, Artificial Sequence
  Description of Artificial Sequence: Synthetic oligonucleotide
  Target: SCN9A; (-) strand; PAM type: YTN; PAM sequence: TTG
aacaataatattgaataact

SEQ ID NO: 69234 - DNA, 20 bp, Artificial Sequence
  Description of Artificial Sequence: Synthetic oligonucleotide
  Target: SCN9A; (-) strand; PAM type: YTN; PAM sequence: CTG
tcccattgaacaataatatt

SEQ ID NO: 69235 - DNA, 20 bp, Artificial Sequence
  Description of Artificial Sequence: Synthetic oligonucleotide
  Target: SCN9A; (-) strand; PAM type: YTN; PAM sequence: TTC
tgtcccattgaacaataata

SEQ ID NO: 69236 - DNA, 20 bp, Artificial Sequence
  Description of Artificial Sequence: Synthetic oligonucleotide
  Target: SCN9A; (-) strand; PAM type: YTN; PAM sequence: TTT
ctgtcccattgaacaataat

SEQ ID NO: 69237 - DNA, 20 bp, Artificial Sequence
  Description of Artificial Sequence: Synthetic oligonucleotide
  Target: SCN9A; (-) strand; PAM type: YTN; PAM sequence: TTG
ataatttctgtcccattgaa

SEQ ID NO: 69238 - DNA, 20 bp, Artificial Sequence
  Description of Artificial Sequence: Synthetic oligonucleotide
  Target: SCN9A; (-) strand; PAM type: YTN; PAM sequence: TTT
gataatttctgtcccattga

SEQ ID NO: 69239 - DNA, 20 bp, Artificial Sequence
  Description of Artificial Sequence: Synthetic oligonucleotide
  Target: SCN9A; (-) strand; PAM type: YTN; PAM sequence: TTT
tgataatttctgtcccattg

SEQ ID NO: 69240 - DNA, 20 bp, Artificial Sequence
  Description of Artificial Sequence: Synthetic oligonucleotide
  Target: SCN9A; (-) strand; PAM type: YTN; PAM sequence: TTA
aatattttgataatttctgt

SEQ ID NO: 69241 - DNA, 20 bp, Artificial Sequence
  Description of Artificial Sequence: Synthetic oligonucleotide
  Target: SCN9A; (-) strand; PAM type: YTN; PAM sequence: TTC
atgttaaatattttgataat

SEQ ID NO: 69242 - DNA, 20 bp, Artificial Sequence
  Description of Artificial Sequence: Synthetic oligonucleotide
  Target: SCN9A; (-) strand; PAM type: YTN; PAM sequence: TTA
ataatagttcatgttaaata

SEQ ID NO: 69243 - DNA, 20 bp, Artificial Sequence
  Description of Artificial Sequence: Synthetic oligonucleotide
  Target: SCN9A; (-) strand; PAM type: YTN; PAM sequence: TTA
attaataatagttcatgtta

SEQ ID NO: 69244 - DNA, 20 bp, Artificial Sequence
  Description of Artificial Sequence: Synthetic oligonucleotide
  Target: SCN9A; (-) strand; PAM type: YTN; PAM sequence: CTG
taaatacaaattaattaata

SEQ ID NO: 69245 - DNA, 20 bp, Artificial Sequence
  Description of Artificial Sequence: Synthetic oligonucleotide
  Target: SCN9A; (-) strand; PAM type: YTN; PAM sequence: TTG
tctgtaaatacaaattaatt

SEQ ID NO: 69246 - DNA, 20 bp, Artificial Sequence
  Description of Artificial Sequence: Synthetic oligonucleotide
  Target: SCN9A; (-) strand; PAM type: YTN; PAM sequence: TTT
gtctgtaaatacaaattaat

SEQ ID NO: 69247 - DNA, 20 bp, Artificial Sequence
  Description of Artificial Sequence: Synthetic oligonucleotide
  Target: SCN9A; (-) strand; PAM type: YTN; PAM sequence: TTA
gccataataatttgtctgta

SEQ ID NO: 69248 - DNA, 20 bp, Artificial Sequence
  Description of Artificial Sequence: Synthetic oligonucleotide
  Target: SCN9A; (-) strand; PAM type: YTN; PAM sequence: CTA
ttagccataataatttgtct

SEQ ID NO: 69249 - DNA, 20 bp, Artificial Sequence
  Description of Artificial Sequence: Synthetic oligonucleotide
  Target: SCN9A; (-) strand; PAM type: YTN; PAM sequence: CTA
agaatctattagccataata

SEQ ID NO: 69250 - DNA, 20 bp, Artificial Sequence
  Description of Artificial Sequence: Synthetic oligonucleotide
  Target: SCN9A; (-) strand; PAM type: YTN; PAM sequence: TTG
aatgtctaagaatctattag

SEQ ID NO: 69251 - DNA, 20 bp, Artificial Sequence
  Description of Artificial Sequence: Synthetic oligonucleotide
  Target: SCN9A; (-) strand; PAM type: YTN; PAM sequence: TTC
ccaagaaaacattgaatgtc

SEQ ID NO: 69252 - DNA, 20 bp, Artificial Sequence
  Description of Artificial Sequence: Synthetic oligonucleotide
  Target: SCN9A; (-) strand; PAM type: YTN; PAM sequence: TTA
atgcattcccaagaaaacat

SEQ ID NO: 69253 - DNA, 20 bp, Artificial Sequence
  Description of Artificial Sequence: Synthetic oligonucleotide
  Target: SCN9A; (-) strand; PAM type: YTN; PAM sequence: CTT
aatgcattcccaagaaaaca

SEQ ID NO: 69254 - DNA, 20 bp, Artificial Sequence
  Description of Artificial Sequence: Synthetic oligonucleotide
  Target: SCN9A; (-) strand; PAM type: YTN; PAM sequence: TTG
aatacttaatgcattcccaa

SEQ ID NO: 69255 - DNA, 20 bp, Artificial Sequence
  Description of Artificial Sequence: Synthetic oligonucleotide
  Target: SCN9A; (-) strand; PAM type: YTN; PAM sequence: TTT
gaatacttaatgcattccca

SEQ ID NO: 69256 - DNA, 20 bp, Artificial Sequence
  Description of Artificial Sequence: Synthetic oligonucleotide
  Target: SCN9A; (-) strand; PAM type: YTN; PAM sequence: CTG
tttgaatacttaatgcattc

SEQ ID NO: 69257 - DNA, 20 bp, Artificial Sequence
  Description of Artificial Sequence: Synthetic oligonucleotide
  Target: SCN9A; (-) strand; PAM type: YTN; PAM sequence: TTA
ctgtttgaatacttaatgca

SEQ ID NO: 69258 - DNA, 20 bp, Artificial Sequence
  Description of Artificial Sequence: Synthetic oligonucleotide
  Target: SCN9A; (-) strand; PAM type: YTN; PAM sequence: TTA
tatacagtatggaaatagtt

SEQ ID NO: 69259 - DNA, 20 bp, Artificial Sequence
  Description of Artificial Sequence: Synthetic oligonucleotide
  Target: SCN9A; (-) strand; PAM type: YTN; PAM sequence: TTT
atatacagtatggaaatagt

SEQ ID NO: 69260 - DNA, 20 bp, Artificial Sequence
  Description of Artificial Sequence: Synthetic oligonucleotide
  Target: SCN9A; (-) strand; PAM type: YTN; PAM sequence: TTT
tatatacagtatggaaatag

SEQ ID NO: 69261 - DNA, 20 bp, Artificial Sequence
  Description of Artificial Sequence: Synthetic oligonucleotide
  Target: SCN9A; (-) strand; PAM type: YTN; PAM sequence: TTA
attttatatacagtatggaa

SEQ ID NO: 69262 - DNA, 20 bp, Artificial Sequence
  Description of Artificial Sequence: Synthetic oligonucleotide
  Target: SCN9A; (-) strand; PAM type: YTN; PAM sequence: TTT
aattttatatacagtatgga

SEQ ID NO: 69263 - DNA, 20 bp, Artificial Sequence
  Description of Artificial Sequence: Synthetic oligonucleotide
  Target: SCN9A; (-) strand; PAM type: YTN; PAM sequence: TTA
taaacatttaattttatata

SEQ ID NO: 69264 - DNA, 20 bp, Artificial Sequence
  Description of Artificial Sequence: Synthetic oligonucleotide
  Target: SCN9A; (-) strand; PAM type: YTN; PAM sequence: CTT
ataaacatttaattttatat

SEQ ID NO: 69265 - DNA, 20 bp, Artificial Sequence
  Description of Artificial Sequence: Synthetic oligonucleotide
  Target: SCN9A; (-) strand; PAM type: YTN; PAM sequence: CTA
aagcatgcttataaacattt

SEQ ID NO: 69266 - DNA, 20 bp, Artificial Sequence
  Description of Artificial Sequence: Synthetic oligonucleotide
  Target: SCN9A; (-) strand; PAM type: YTN; PAM sequence: TTG
ctaaagcatgcttataaaca

SEQ ID NO: 69267 - DNA, 20 bp, Artificial Sequence
  Description of Artificial Sequence: Synthetic oligonucleotide
  Target: SCN9A; (-) strand; PAM type: YTN; PAM sequence: CTA
tattgctaaagcatgcttat

SEQ ID NO: 69268 - DNA, 20 bp, Artificial Sequence
  Description of Artificial Sequence: Synthetic oligonucleotide
  Target: SCN9A; (-) strand; PAM type: YTN; PAM sequence: CTG
tctatattgctaaagcatgc

SEQ ID NO: 69269 - DNA, 20 bp, Artificial Sequence
  Description of Artificial Sequence: Synthetic oligonucleotide
  Target: SCN9A; (-) strand; PAM type: YTN; PAM sequence: CTA
gaactgtctatattgctaaa

SEQ ID NO: 69270 - DNA, 20 bp, Artificial Sequence
  Description of Artificial Sequence: Synthetic oligonucleotide
  Target: SCN9A; (-) strand; PAM type: YTN; PAM sequence: TTG
actagaactgtctatattgc

SEQ ID NO: 69271 - DNA, 20 bp, Artificial Sequence
  Description of Artificial Sequence: Synthetic oligonucleotide
  Target: SCN9A; (-) strand; PAM type: YTN; PAM sequence: CTG
aattgactagaactgtctat

SEQ ID NO: 69272 - DNA, 20 bp, Artificial Sequence
  Description of Artificial Sequence: Synthetic oligonucleotide
  Target: SCN9A; (-) strand; PAM type: YTN; PAM sequence: TTC
aaaggctgaattgactagaa

SEQ ID NO: 69273 - DNA, 20 bp, Artificial Sequence
  Description of Artificial Sequence: Synthetic oligonucleotide
  Target: SCN9A; (-) strand; PAM type: YTN; PAM sequence: TTT
caaaggctgaattgactaga

SEQ ID NO: 69274 - DNA, 20 bp, Artificial Sequence
  Description of Artificial Sequence: Synthetic oligonucleotide
  Target: SCN9A; (-) strand; PAM type: YTN; PAM sequence: CTG
tagcaagtatagatttcaaa

SEQ ID NO: 69275 - DNA, 20 bp, Artificial Sequence
  Description of Artificial Sequence: Synthetic oligonucleotide
  Target: SCN9A; (-) strand; PAM type: YTN; PAM sequence: TTA
tactgtagcaagtatagatt

SEQ ID NO: 69276 - DNA, 20 bp, Artificial Sequence
  Description of Artificial Sequence: Synthetic oligonucleotide
  Target: SCN9A; (-) strand; PAM type: YTN; PAM sequence: CTT
atactgtagcaagtatagat

SEQ ID NO: 69277 - DNA, 20 bp, Artificial Sequence
  Description of Artificial Sequence: Synthetic oligonucleotide
  Target: SCN9A; (-) strand; PAM type: YTN; PAM sequence: CTA
aagaagcttatactgtagca

SEQ ID NO: 69278 - DNA, 20 bp, Artificial Sequence
  Description of Artificial Sequence: Synthetic oligonucleotide
  Target: SCN9A; (-) strand; PAM type: YTN; PAM sequence: CTG
ctaaagaagcttatactgta

SEQ ID NO: 69279 - DNA, 20 bp, Artificial Sequence
  Description of Artificial Sequence: Synthetic oligonucleotide
  Target: SCN9A; (-) strand; PAM type: YTN; PAM sequence: TTA
gaaatctgctaaagaagctt

SEQ ID NO: 69280 - DNA, 20 bp, Artificial Sequence
  Description of Artificial Sequence: Synthetic oligonucleotide
  Target: SCN9A; (-) strand; PAM type: YTN; PAM sequence: CTT
agaaatctgctaaagaagct

SEQ ID NO: 69281 - DNA, 20 bp, Artificial Sequence
  Description of Artificial Sequence: Synthetic oligonucleotide
  Target: SCN9A; (-) strand; PAM type: YTN; PAM sequence: CTC
ttagaaatctgctaaagaag

SEQ ID NO: 69282 - DNA, 20 bp, Artificial Sequence
  Description of Artificial Sequence: Synthetic oligonucleotide
  Target: SCN9A; (-) strand; PAM type: YTN; PAM sequence: TTC
tcttagaaatctgctaaaga

SEQ ID NO: 69283 - DNA, 20 bp, Artificial Sequence
  Description of Artificial Sequence: Synthetic oligonucleotide
  Target: SCN9A; (-) strand; PAM type: YTN; PAM sequence: CTA
tataaaggtattctcttaga

SEQ ID NO: 69284 - DNA, 20 bp, Artificial Sequence
  Description of Artificial Sequence: Synthetic oligonucleotide
  Target: SCN9A; (-) strand; PAM type: YTN; PAM sequence: TTC
tatataaaggtattctctta

SEQ ID NO: 69285 - DNA, 20 bp, Artificial Sequence
  Description of Artificial Sequence: Synthetic oligonucleotide
  Target: SCN9A; (-) strand; PAM type: YTN; PAM sequence: TTT
ctatataaaggtattctctt

SEQ ID NO: 69286 - DNA, 20 bp, Artificial Sequence
  Description of Artificial Sequence: Synthetic oligonucleotide
  Target: SCN9A; (-) strand; PAM type: YTN; PAM sequence: CTT
tctatataaaggtattctct

SEQ ID NO: 69287 - DNA, 20 bp, Artificial Sequence
  Description of Artificial Sequence: Synthetic oligonucleotide
  Target: SCN9A; (-) strand; PAM type: YTN; PAM sequence: TTA
tatatatcagcctttctata

SEQ ID NO: 69288 - DNA, 20 bp, Artificial Sequence
  Description of Artificial Sequence: Synthetic oligonucleotide
  Target: SCN9A; (-) strand; PAM type: YTN; PAM sequence: TTA
ttatatatatcagcctttct

SEQ ID NO: 69289 - DNA, 20 bp, Artificial Sequence
  Description of Artificial Sequence: Synthetic oligonucleotide
  Target: SCN9A; (-) strand; PAM type: YTN; PAM sequence: TTT
attatatatatcagcctttc

SEQ ID NO: 69290 - DNA, 20 bp, Artificial Sequence
  Description of Artificial Sequence: Synthetic oligonucleotide
  Target: SCN9A; (-) strand; PAM type: YTN; PAM sequence: CTT
tattatatatatcagccttt

SEQ ID NO: 69291 - DNA, 20 bp, Artificial Sequence
  Description of Artificial Sequence: Synthetic oligonucleotide
  Target: SCN9A; (-) strand; PAM type: YTN; PAM sequence: TTC
accgcaggaaaaaaaaactt

SEQ ID NO: 69292 - DNA, 20 bp, Artificial Sequence
  Description of Artificial Sequence: Synthetic oligonucleotide
  Target: SCN9A; (-) strand; PAM type: YTN; PAM sequence: TTT
caccgcaggaaaaaaaaact

SEQ ID NO: 69293 - DNA, 20 bp, Artificial Sequence
  Description of Artificial Sequence: Synthetic oligonucleotide
  Target: SCN9A; (-) strand; PAM type: YTN; PAM sequence: TTC
aatatatttcaccgcaggaa

SEQ ID NO: 69294 - DNA, 20 bp, Artificial Sequence
  Description of Artificial Sequence: Synthetic oligonucleotide
  Target: SCN9A; (-) strand; PAM type: YTN; PAM sequence: CTG
tgagaattcaatatatttca

SEQ ID NO: 69295 - DNA, 20 bp, Artificial Sequence
  Description of Artificial Sequence: Synthetic oligonucleotide
  Target: SCN9A; (-) strand; PAM type: YTN; PAM sequence: CTA
ctgtgagaattcaatatatt

SEQ ID NO: 69296 - DNA, 20 bp, Artificial Sequence
  Description of Artificial Sequence: Synthetic oligonucleotide
  Target: SCN9A; (-) strand; PAM type: YTN; PAM sequence: TTA
aatatggtgatgcctactgt

SEQ ID NO: 69297 - DNA, 20 bp, Artificial Sequence
  Description of Artificial Sequence: Synthetic oligonucleotide
  Target: SCN9A; (-) strand; PAM type: YTN; PAM sequence: CTT
aaatatggtgatgcctactg

SEQ ID NO: 69298 - DNA, 20 bp, Artificial Sequence
  Description of Artificial Sequence: Synthetic oligonucleotide
  Target: SCN9A; (-) strand; PAM type: YTN; PAM sequence: TTC
aaagtacttaaatatggtga

SEQ ID NO: 69299 - DNA, 20 bp, Artificial Sequence
  Description of Artificial Sequence: Synthetic oligonucleotide
  Target: SCN9A; (-) strand; PAM type: YTN; PAM sequence: TTG
tatagtaaaaaacatatatt

SEQ ID NO: 69300 - DNA, 20 bp, Artificial Sequence
  Description of Artificial Sequence: Synthetic oligonucleotide
  Target: SCN9A; (-) strand; PAM type: YTN; PAM sequence: CTT
gtatagtaaaaaacatatat

SEQ ID NO: 69301 - DNA, 20 bp, Artificial Sequence
  Description of Artificial Sequence: Synthetic oligonucleotide
  Target: SCN9A; (-) strand; PAM type: YTN; PAM sequence: TTC
cttgtatagtaaaaaacata

SEQ ID NO: 69302 - DNA, 20 bp, Artificial Sequence
  Description of Artificial Sequence: Synthetic oligonucleotide
  Target: SCN9A; (-) strand; PAM type: YTN; PAM sequence: CTT
ccttgtatagtaaaaaacat

SEQ ID NO: 69303 - DNA, 20 bp, Artificial Sequence
  Description of Artificial Sequence: Synthetic oligonucleotide
  Target: SCN9A; (-) strand; PAM type: YTN; PAM sequence: TTG
atatgatcttccttgtatag

SEQ ID NO: 69304 - DNA, 20 bp, Artificial Sequence
  Description of Artificial Sequence: Synthetic oligonucleotide
  Target: SCN9A; (-) strand; PAM type: YTN; PAM sequence: TTA
atcatataaaataatacaaa

SEQ ID NO: 69305 - DNA, 20 bp, Artificial Sequence
  Description of Artificial Sequence: Synthetic oligonucleotide
  Target: SCN9A; (-) strand; PAM type: YTN; PAM sequence: TTA
aagaaatgaagataatatag

SEQ ID NO: 69306 - DNA, 20 bp, Artificial Sequence
  Description of Artificial Sequence: Synthetic oligonucleotide
  Target: SCN9A; (-) strand; PAM type: YTN; PAM sequence: TTT
aaagaaatgaagataatata

SEQ ID NO: 69307 - DNA, 20 bp, Artificial Sequence
  Description of Artificial Sequence: Synthetic oligonucleotide
  Target: SCN9A; (-) strand; PAM type: YTN; PAM sequence: TTG
agtttaaagaaatgaagata

SEQ ID NO: 69308 - DNA, 20 bp, Artificial Sequence
  Description of Artificial Sequence: Synthetic oligonucleotide
  Target: SCN9A; (-) strand; PAM type: YTN; PAM sequence: CTA
aacaacagatgattgagttt

SEQ ID NO: 69309 - DNA, 20 bp, Artificial Sequence
  Description of Artificial Sequence: Synthetic oligonucleotide
  Target: SCN9A; (-) strand; PAM type: YTN; PAM sequence: TTA
catggaaaactaaacaacag

SEQ ID NO: 69310 - DNA, 20 bp, Artificial Sequence
  Description of Artificial Sequence: Synthetic oligonucleotide
  Target: SCN9A; (-) strand; PAM type: YTN; PAM sequence: TTC
caaaattacatggaaaacta

SEQ ID NO: 69311 - DNA, 20 bp, Artificial Sequence
  Description of Artificial Sequence: Synthetic oligonucleotide
  Target: SCN9A; (-) strand; PAM type: YTN; PAM sequence: TTT
ccaaaattacatggaaaact

SEQ ID NO: 69312 - DNA, 20 bp, Artificial Sequence
  Description of Artificial Sequence: Synthetic oligonucleotide
  Target: SCN9A; (-) strand; PAM type: YTN; PAM sequence: TTC
atttccaaaattacatggaa

SEQ ID NO: 69313 - DNA, 20 bp, Artificial Sequence
  Description of Artificial Sequence: Synthetic oligonucleotide
  Target: SCN9A; (-) strand; PAM type: YTN; PAM sequence: TTT
catttccaaaattacatgga

SEQ ID NO: 69314 - DNA, 20 bp, Artificial Sequence
  Description of Artificial Sequence: Synthetic oligonucleotide
  Target: SCN9A; (-) strand; PAM type: YTN; PAM sequence: CTT
tcatttccaaaattacatgg

SEQ ID NO: 69315 - DNA, 20 bp, Artificial Sequence
  Description of Artificial Sequence: Synthetic oligonucleotide
  Target: SCN9A; (-) strand; PAM type: YTN; PAM sequence: TTC
tttcatttccaaaattacat

SEQ ID NO: 69316 - DNA, 20 bp, Artificial Sequence
  Description of Artificial Sequence: Synthetic oligonucleotide
  Target: SCN9A; (-) strand; PAM type: YTN; PAM sequence: CTA
atatagtcattctttcattt

SEQ ID NO: 69317 - DNA, 20 bp, Artificial Sequence
  Description of Artificial Sequence: Synthetic oligonucleotide
  Target: SCN9A; (-) strand; PAM type: YTN; PAM sequence: CTC
taatatagtcattctttcat

SEQ ID NO: 69318 - DNA, 20 bp, Artificial Sequence
  Description of Artificial Sequence: Synthetic oligonucleotide
  Target: SCN9A; (-) strand; PAM type: YTN; PAM sequence: TTC
tctaatatagtcattctttc

SEQ ID NO: 69319 - DNA, 20 bp, Artificial Sequence
  Description of Artificial Sequence: Synthetic oligonucleotide
  Target: SCN9A; (-) strand; PAM type: YTN; PAM sequence: CTT
ctctaatatagtcattcttt

SEQ ID NO: 69320 - DNA, 20 bp, Artificial Sequence
  Description of Artificial Sequence: Synthetic oligonucleotide
  Target: SCN9A; (-) strand; PAM type: YTN; PAM sequence: TTC
acttctctaatatagtcatt

SEQ ID NO: 69321 - DNA, 20 bp, Artificial Sequence
  Description of Artificial Sequence: Synthetic oligonucleotide
  Target: SCN9A; (-) strand; PAM type: YTN; PAM sequence: TTT
cacttctctaatatagtcat

SEQ ID NO: 69322 - DNA, 20 bp, Artificial Sequence
  Description of Artificial Sequence: Synthetic oligonucleotide
  Target: SCN9A; (-) strand; PAM type: YTN; PAM sequence: TTA
tttcacttctctaatatagt

SEQ ID NO: 69323 - DNA, 20 bp, Artificial Sequence
  Description of Artificial Sequence: Synthetic oligonucleotide
  Target: SCN9A; (-) strand; PAM type: YTN; PAM sequence: TTT
atttcacttctctaatatag

SEQ ID NO: 69324 - DNA, 20 bp, Artificial Sequence
  Description of Artificial Sequence: Synthetic oligonucleotide
  Target: SCN9A; (-) strand; PAM type: YTN; PAM sequence: CTA
aagcatttatttcacttctc

SEQ ID NO: 69325 - DNA, 20 bp, Artificial Sequence
  Description of Artificial Sequence: Synthetic oligonucleotide
  Target: SCN9A; (-) strand; PAM type: YTN; PAM sequence: TTC
atactaaagcatttatttca

SEQ ID NO: 69326 - DNA, 20 bp, Artificial Sequence
  Description of Artificial Sequence: Synthetic oligonucleotide
  Target: SCN9A; (-) strand; PAM type: YTN; PAM sequence: TTT
catactaaagcatttatttc

SEQ ID NO: 69327 - DNA, 20 bp, Artificial Sequence
  Description of Artificial Sequence: Synthetic oligonucleotide
  Target: SCN9A; (-) strand; PAM type: YTN; PAM sequence: CTT
tcatactaaagcatttattt

SEQ ID NO: 69328 - DNA, 20 bp, Artificial Sequence
  Description of Artificial Sequence: Synthetic oligonucleotide
  Target: SCN9A; (-) strand; PAM type: YTN; PAM sequence: TTC
tttcatactaaagcatttat

SEQ ID NO: 69329 - DNA, 20 bp, Artificial Sequence
  Description of Artificial Sequence: Synthetic oligonucleotide
  Target: SCN9A; (-) strand; PAM type: YTN; PAM sequence: TTT
ctttcatactaaagcattta

SEQ ID NO: 69330 - DNA, 20 bp, Artificial Sequence
  Description of Artificial Sequence: Synthetic oligonucleotide
  Target: SCN9A; (-) strand; PAM type: YTN; PAM sequence: TTA
taatagcaaaagaaatttct

SEQ ID NO: 69331 - DNA, 20 bp, Artificial Sequence
  Description of Artificial Sequence: Synthetic oligonucleotide
  Target: SCN9A; (-) strand; PAM type: YTN; PAM sequence: TTT
ataatagcaaaagaaatttc

SEQ ID NO: 69332 - DNA, 20 bp, Artificial Sequence
  Description of Artificial Sequence: Synthetic oligonucleotide
  Target: SCN9A; (-) strand; PAM type: YTN; PAM sequence: CTA
tttataatagcaaaagaaat

SEQ ID NO: 69333 - DNA, 20 bp, Artificial Sequence
  Description of Artificial Sequence: Synthetic oligonucleotide
  Target: SCN9A; (-) strand; PAM type: YTN; PAM sequence: TTA
cagaaggtcctatttataat

SEQ ID NO: 69334 - DNA, 20 bp, Artificial Sequence
  Description of Artificial Sequence: Synthetic oligonucleotide
  Target: SCN9A; (-) strand; PAM type: YTN; PAM sequence: TTA
gaaatcaaatccatgtgaaa

SEQ ID NO: 69335 - DNA, 20 bp, Artificial Sequence
  Description of Artificial Sequence: Synthetic oligonucleotide
  Target: SCN9A; (-) strand; PAM type: YTN; PAM sequence: TTA
ttagaaatcaaatccatgtg

SEQ ID NO: 69336 - DNA, 20 bp, Artificial Sequence
  Description of Artificial Sequence: Synthetic oligonucleotide
  Target: SCN9A; (-) strand; PAM type: YTN; PAM sequence: TTT
attagaaatcaaatccatgt

SEQ ID NO: 69337 - DNA, 20 bp, Artificial Sequence
  Description of Artificial Sequence: Synthetic oligonucleotide
  Target: SCN9A; (-) strand; PAM type: YTN; PAM sequence: TTT
tattagaaatcaaatccatg

SEQ ID NO: 69338 - DNA, 20 bp, Artificial Sequence
  Description of Artificial Sequence: Synthetic oligonucleotide
  Target: SCN9A; (-) strand; PAM type: YTN; PAM sequence: CTT
ttattagaaatcaaatccat

SEQ ID NO: 69339 - DNA, 20 bp, Artificial Sequence
  Description of Artificial Sequence: Synthetic oligonucleotide
  Target: SCN9A; (-) strand; PAM type: YTN; PAM sequence: TTC
ccttttattagaaatcaaat

SEQ ID NO: 69340 - DNA, 20 bp, Artificial Sequence
  Description of Artificial Sequence: Synthetic oligonucleotide
  Target: SCN9A; (-) strand; PAM type: YTN; PAM sequence: CTT
cccttttattagaaatcaaa

SEQ ID NO: 69341 - DNA, 20 bp, Artificial Sequence
  Description of Artificial Sequence: Synthetic oligonucleotide
  Target: SCN9A; (-) strand; PAM type: YTN; PAM sequence: TTG
atacttcccttttattagaa

SEQ ID NO: 69342 - DNA, 20 bp, Artificial Sequence
  Description of Artificial Sequence: Synthetic oligonucleotide
  Target: SCN9A; (-) strand; PAM type: YTN; PAM sequence: CTG
ccaatgatgaaaaaaattga

SEQ ID NO: 69343 - DNA, 20 bp, Artificial Sequence
  Description of Artificial Sequence: Synthetic oligonucleotide
  Target: SCN9A; (-) strand; PAM type: YTN; PAM sequence: CTA
gactgccaatgatgaaaaaa

SEQ ID NO: 69344 - DNA, 20 bp, Artificial Sequence
  Description of Artificial Sequence: Synthetic oligonucleotide
  Target: SCN9A; (-) strand; PAM type: YTN; PAM sequence: TTA
taactagactgccaatgatg

SEQ ID NO: 69345 - DNA, 20 bp, Artificial Sequence
  Description of Artificial Sequence: Synthetic oligonucleotide
  Target: SCN9A; (-) strand; PAM type: YTN; PAM sequence: TTT
ataactagactgccaatgat

SEQ ID NO: 69346 - DNA, 20 bp, Artificial Sequence
  Description of Artificial Sequence: Synthetic oligonucleotide
  Target: SCN9A; (-) strand; PAM type: YTN; PAM sequence: TTA
tttataactagactgccaat

SEQ ID NO: 69347 - DNA, 20 bp, Artificial Sequence
  Description of Artificial Sequence: Synthetic oligonucleotide
  Target: SCN9A; (-) strand; PAM type: YTN; PAM sequence: TTT
atttataactagactgccaa

SEQ ID NO: 69348 - DNA, 20 bp, Artificial Sequence
  Description of Artificial Sequence: Synthetic oligonucleotide
  Target: SCN9A; (-) strand; PAM type: YTN; PAM sequence: CTT
tatttataactagactgcca

SEQ ID NO: 69349 - DNA, 20 bp, Artificial Sequence
  Description of Artificial Sequence: Synthetic oligonucleotide
  Target: SCN9A; (-) strand; PAM type: YTN; PAM sequence: TTA
ctttatttataactagactg

SEQ ID NO: 69350 - DNA, 20 bp, Artificial Sequence
  Description of Artificial Sequence: Synthetic oligonucleotide
  Target: SCN9A; (-) strand; PAM type: YTN; PAM sequence: TTT
actttatttataactagact

SEQ ID NO: 69351 - DNA, 20 bp, Artificial Sequence
  Description of Artificial Sequence: Synthetic oligonucleotide
  Target: SCN9A; (-) strand; PAM type: YTN; PAM sequence: TTA
tatttactttatttataact

SEQ ID NO: 69352 - DNA, 20 bp, Artificial Sequence
  Description of Artificial Sequence: Synthetic oligonucleotide
  Target: SCN9A; (-) strand; PAM type: YTN; PAM sequence: TTT
atatttactttatttataac

SEQ ID NO: 69353 - DNA, 20 bp, Artificial Sequence
  Description of Artificial Sequence: Synthetic oligonucleotide
  Target: SCN9A; (-) strand; PAM type: YTN; PAM sequence: TTA
tatttatatttactttattt

SEQ ID NO: 69354 - DNA, 20 bp, Artificial Sequence
  Description of Artificial Sequence: Synthetic oligonucleotide
  Target: SCN9A; (-) strand; PAM type: YTN; PAM sequence: CTT
atatttatatttactttatt

SEQ ID NO: 69355 - DNA, 20 bp, Artificial Sequence
  Description of Artificial Sequence: Synthetic oligonucleotide
  Target: SCN9A; (-) strand; PAM type: YTN; PAM sequence: CTA
tgcttatatttatatttact

SEQ ID NO: 69356 - DNA, 20 bp, Artificial Sequence
  Description of Artificial Sequence: Synthetic oligonucleotide
  Target: SCN9A; (-) strand; PAM type: YTN; PAM sequence: TTG
atcctatgcttatatttata

SEQ ID NO: 69357 - DNA, 20 bp, Artificial Sequence
  Description of Artificial Sequence: Synthetic oligonucleotide
  Target: SCN9A; (-) strand; PAM type: YTN; PAM sequence: CTT
gatcctatgcttatatttat

SEQ ID NO: 69358 - DNA, 20 bp, Artificial Sequence
  Description of Artificial Sequence: Synthetic oligonucleotide
  Target: SCN9A; (-) strand; PAM type: YTN; PAM sequence: TTC
ttgatcctatgcttatattt

SEQ ID NO: 69359 - DNA, 20 bp, Artificial Sequence
  Description of Artificial Sequence: Synthetic oligonucleotide
  Target: SCN9A; (-) strand; PAM type: YTN; PAM sequence: CTT
cttgatcctatgcttatatt

SEQ ID NO: 69360 - DNA, 20 bp, Artificial Sequence
  Description of Artificial Sequence: Synthetic oligonucleotide
  Target: SCN9A; (-) strand; PAM type: YTN; PAM sequence: CTA
gtgagtccaccttcttgatc

SEQ ID NO: 69361 - DNA, 20 bp, Artificial Sequence
  Description of Artificial Sequence: Synthetic oligonucleotide
  Target: SCN9A; (-) strand; PAM type: YTN; PAM sequence: CTA
atactagtgagtccaccttc

SEQ ID NO: 69362 - DNA, 20 bp, Artificial Sequence
  Description of Artificial Sequence: Synthetic oligonucleotide
  Target: SCN9A; (-) strand; PAM type: YTN; PAM sequence: TTC
ctaatactagtgagtccacc

SEQ ID NO: 69363 - DNA, 20 bp, Artificial Sequence
  Description of Artificial Sequence: Synthetic oligonucleotide
  Target: SCN9A; (-) strand; PAM type: YTN; PAM sequence: CTG
attcctaatactagtgagtc

SEQ ID NO: 69364 - DNA, 20 bp, Artificial Sequence
  Description of Artificial Sequence: Synthetic oligonucleotide
  Target: SCN9A; (-) strand; PAM type: YTN; PAM sequence: TTC
tgattcctaatactagtgag

SEQ ID NO: 69365 - DNA, 20 bp, Artificial Sequence
  Description of Artificial Sequence: Synthetic oligonucleotide
  Target: SCN9A; (-) strand; PAM type: YTN; PAM sequence: CTT
ctgattcctaatactagtga

SEQ ID NO: 69366 - DNA, 20 bp, Artificial Sequence
  Description of Artificial Sequence: Synthetic oligonucleotide
  Target: SCN9A; (-) strand; PAM type: YTN; PAM sequence: TTA
tggtacacttctgattccta

SEQ ID NO: 69367 - DNA, 20 bp, Artificial Sequence
  Description of Artificial Sequence: Synthetic oligonucleotide
  Target: SCN9A; (-) strand; PAM type: YTN; PAM sequence: CTA
attatggtacacttctgatt

SEQ ID NO: 69368 - DNA, 20 bp, Artificial Sequence
  Description of Artificial Sequence: Synthetic oligonucleotide
  Target: SCN9A; (-) strand; PAM type: YTN; PAM sequence: TTC
aataaaaaggcaggaatgct

SEQ ID NO: 69369 - DNA, 20 bp, Artificial Sequence
  Description of Artificial Sequence: Synthetic oligonucleotide
  Target: SCN9A; (-) strand; PAM type: YTN; PAM sequence: TTA
ttcaataaaaaggcaggaat

SEQ ID NO: 69370 - DNA, 20 bp, Artificial Sequence
  Description of Artificial Sequence: Synthetic oligonucleotide
  Target: SCN9A; (-) strand; PAM type: YTN; PAM sequence: TTA
gaaggcacagtcaatatcat

SEQ ID NO: 69371 - DNA, 20 bp, Artificial Sequence
  Description of Artificial Sequence: Synthetic oligonucleotide
  Target: SCN9A; (-) strand; PAM type: YTN; PAM sequence: TTT
agaaggcacagtcaatatca

SEQ ID NO: 69372 - DNA, 20 bp, Artificial Sequence
  Description of Artificial Sequence: Synthetic oligonucleotide
  Target: SCN9A; (-) strand; PAM type: YTN; PAM sequence: TTT
tagaaggcacagtcaatatc

SEQ ID NO: 69373 - DNA, 20 bp, Artificial Sequence
  Description of Artificial Sequence: Synthetic oligonucleotide
  Target: SCN9A; (-) strand; PAM type: YTN; PAM sequence: CTT
ttagaaggcacagtcaatat

SEQ ID NO: 69374 - DNA, 20 bp, Artificial Sequence
  Description of Artificial Sequence: Synthetic oligonucleotide
  Target: SCN9A; (-) strand; PAM type: YTN; PAM sequence: TTA
aaacacttttagaaggcaca

SEQ ID NO: 69375 - DNA, 20 bp, Artificial Sequence
  Description of Artificial Sequence: Synthetic oligonucleotide
  Target: SCN9A; (-) strand; PAM type: YTN; PAM sequence: TTT
aaaacacttttagaaggcac

SEQ ID NO: 69376 - DNA, 20 bp, Artificial Sequence
  Description of Artificial Sequence: Synthetic oligonucleotide
  Target: SCN9A; (-) strand; PAM type: YTN; PAM sequence: TTT
taaaacacttttagaaggca

SEQ ID NO: 69377 - DNA, 20 bp, Artificial Sequence
  Description of Artificial Sequence: Synthetic oligonucleotide
  Target: SCN9A; (-) strand; PAM type: YTN; PAM sequence: TTT
ttaaaacacttttagaaggc

SEQ ID NO: 69378 - DNA, 20 bp, Artificial Sequence
  Description of Artificial Sequence: Synthetic oligonucleotide
  Target: SCN9A; (-) strand; PAM type: YTN; PAM sequence: TTC
atatttttaaaacactttta

SEQ ID NO: 69379 - DNA, 20 bp, Artificial Sequence
  Description of Artificial Sequence: Synthetic oligonucleotide
  Target: SCN9A; (-) strand; PAM type: YTN; PAM sequence: TTT
catatttttaaaacactttt

SEQ ID NO: 69380 - DNA, 20 bp, Artificial Sequence
  Description of Artificial Sequence: Synthetic oligonucleotide
  Target: SCN9A; (-) strand; PAM type: YTN; PAM sequence: CTT
tcatatttttaaaacacttt

SEQ ID NO: 69381 - DNA, 20 bp, Artificial Sequence
  Description of Artificial Sequence: Synthetic oligonucleotide
  Target: SCN9A; (-) strand; PAM type: YTN; PAM sequence: CTA
tatcactttcatatttttaa

SEQ ID NO: 69382 - DNA, 20 bp, Artificial Sequence
  Description of Artificial Sequence: Synthetic oligonucleotide
  Target: SCN9A; (-) strand; PAM type: YTN; PAM sequence: TTG
agtcaactatatcactttca

SEQ ID NO: 69383 - DNA, 20 bp, Artificial Sequence
  Description of Artificial Sequence: Synthetic oligonucleotide
  Target: SCN9A; (-) strand; PAM type: YTN; PAM sequence: TTT
gagtcaactatatcactttc

SEQ ID NO: 69384 - DNA, 20 bp, Artificial Sequence
  Description of Artificial Sequence: Synthetic oligonucleotide
  Target: SCN9A; (-) strand; PAM type: YTN; PAM sequence: TTA
aaatgtttgagtcaactata

SEQ ID NO: 69385 - DNA, 20 bp, Artificial Sequence
  Description of Artificial Sequence: Synthetic oligonucleotide
  Target: SCN9A; (-) strand; PAM type: YTN; PAM sequence: TTT
aaaatgtttgagtcaactat

SEQ ID NO: 69386 - DNA, 20 bp, Artificial Sequence
  Description of Artificial Sequence: Synthetic oligonucleotide
  Target: SCN9A; (-) strand; PAM type: YTN; PAM sequence: TTA
tacatttaaaatgtttgagt

SEQ ID NO: 69387 - DNA, 20 bp, Artificial Sequence
  Description of Artificial Sequence: Synthetic oligonucleotide
  Target: SCN9A; (-) strand; PAM type: YTN; PAM sequence: CTA
ttatacatttaaaatgtttg

SEQ ID NO: 69388 - DNA, 20 bp, Artificial Sequence
  Description of Artificial Sequence: Synthetic oligonucleotide
  Target: SCN9A; (-) strand; PAM type: YTN; PAM sequence: CTG
taaatactattatacattta

SEQ ID NO: 69389 - DNA, 20 bp, Artificial Sequence
  Description of Artificial Sequence: Synthetic oligonucleotide
  Target: SCN9A; (-) strand; PAM type: YTN; PAM sequence: TTG
cactgtaaatactattatac

SEQ ID NO: 69390 - DNA, 20 bp, Artificial Sequence
  Description of Artificial Sequence: Synthetic oligonucleotide
  Target: SCN9A; (-) strand; PAM type: YTN; PAM sequence: TTT
gcactgtaaatactattata

SEQ ID NO: 69391 - DNA, 20 bp, Artificial Sequence
  Description of Artificial Sequence: Synthetic oligonucleotide
  Target: SCN9A; (-) strand; PAM type: YTN; PAM sequence: TTT
tgcactgtaaatactattat

SEQ ID NO: 69392 - DNA, 20 bp, Artificial Sequence
  Description of Artificial Sequence: Synthetic oligonucleotide
  Target: SCN9A; (-) strand; PAM type: YTN; PAM sequence: TTA
ttttgcactgtaaatactat

SEQ ID NO: 69393 - DNA, 20 bp, Artificial Sequence
  Description of Artificial Sequence: Synthetic oligonucleotide
  Target: SCN9A; (-) strand; PAM type: YTN; PAM sequence: TTT
attttgcactgtaaatacta

SEQ ID NO: 69394 - DNA, 20 bp, Artificial Sequence
  Description of Artificial Sequence: Synthetic oligonucleotide
  Target: SCN9A; (-) strand; PAM type: YTN; PAM sequence: TTT
tattttgcactgtaaatact

SEQ ID NO: 69395 - DNA, 20 bp, Artificial Sequence
  Description of Artificial Sequence: Synthetic oligonucleotide
  Target: SCN9A; (-) strand; PAM type: YTN; PAM sequence: CTT
ttattttgcactgtaaatac

SEQ ID NO: 69396 - DNA, 20 bp, Artificial Sequence
  Description of Artificial Sequence: Synthetic oligonucleotide
  Target: SCN9A; (-) strand; PAM type: YTN; PAM sequence: TTG
aatcaaggagatagtggagg

SEQ ID NO: 69397 - DNA, 20 bp, Artificial Sequence
  Description of Artificial Sequence: Synthetic oligonucleotide
  Target: SCN9A; (-) strand; PAM type: YTN; PAM sequence: CTC
aagggggttgaatcaaggag

SEQ ID NO: 69398 - DNA, 20 bp, Artificial Sequence
  Description of Artificial Sequence: Synthetic oligonucleotide
  Target: SCN9A; (-) strand; PAM type: YTN; PAM sequence: TTA
cctcaagggggttgaatcaa

SEQ ID NO: 69399 - DNA, 20 bp, Artificial Sequence
  Description of Artificial Sequence: Synthetic oligonucleotide
  Target: SCN9A; (-) strand; PAM type: YTN; PAM sequence: CTC
gattacctcaagggggttga

SEQ ID NO: 69400 - DNA, 20 bp, Artificial Sequence
  Description of Artificial Sequence: Synthetic oligonucleotide
  Target: SCN9A; (-) strand; PAM type: YTN; PAM sequence: CTC
tcgattacctcaagggggtt

SEQ ID NO: 69401 - DNA, 20 bp, Artificial Sequence
  Description of Artificial Sequence: Synthetic oligonucleotide
  Target: SCN9A; (-) strand; PAM type: YTN; PAM sequence: CTC
tctcgattacctcaaggggg

SEQ ID NO: 69402 - DNA, 20 bp, Artificial Sequence
  Description of Artificial Sequence: Synthetic oligonucleotide
  Target: SCN9A; (-) strand; PAM type: YTN; PAM sequence: CTC
tctctcgattacctcaaggg

SEQ ID NO: 69403 - DNA, 20 bp, Artificial Sequence
  Description of Artificial Sequence: Synthetic oligonucleotide
  Target: SCN9A; (-) strand; PAM type: YTN; PAM sequence: TTC
tctctctcgattacctcaag

SEQ ID NO: 69404 - DNA, 20 bp, Artificial Sequence
  Description of Artificial Sequence: Synthetic oligonucleotide
  Target: SCN9A; (-) strand; PAM type: YTN; PAM sequence: TTT
ctctctctcgattacctcaa

SEQ ID NO: 69405 - DNA, 20 bp, Artificial Sequence
  Description of Artificial Sequence: Synthetic oligonucleotide
  Target: SCN9A; (-) strand; PAM type: YTN; PAM sequence: TTT
tctctctctcgattacctca

SEQ ID NO: 69406 - DNA, 20 bp, Artificial Sequence
  Description of Artificial Sequence: Synthetic oligonucleotide
  Target: SCN9A; (-) strand; PAM type: YTN; PAM sequence: TTT
ttctctctctcgattacctc

SEQ ID NO: 69407 - DNA, 20 bp, Artificial Sequence
  Description of Artificial Sequence: Synthetic oligonucleotide
  Target: SCN9A; (-) strand; PAM type: YTN; PAM sequence: CTT
tttctctctctcgattacct

SEQ ID NO: 69408 - DNA, 20 bp, Artificial Sequence
  Description of Artificial Sequence: Synthetic oligonucleotide
  Target: SCN9A; (-) strand; PAM type: YTN; PAM sequence: CTC
tttttctctctctcgattac

SEQ ID NO: 69409 - DNA, 20 bp, Artificial Sequence
  Description of Artificial Sequence: Synthetic oligonucleotide
  Target: SCN9A; (-) strand; PAM type: YTN; PAM sequence: CTC
tctttttctctctctcgatt

SEQ ID NO: 69410 - DNA, 20 bp, Artificial Sequence
  Description of Artificial Sequence: Synthetic oligonucleotide
  Target: SCN9A; (-) strand; PAM type: YTN; PAM sequence: CTC
tctctttttctctctctcga

SEQ ID NO: 69411 - DNA, 20 bp, Artificial Sequence
  Description of Artificial Sequence: Synthetic oligonucleotide
  Target: SCN9A; (-) strand; PAM type: YTN; PAM sequence: CTC
tctctctttttctctctctc

SEQ ID NO: 69412 - DNA, 20 bp, Artificial Sequence
  Description of Artificial Sequence: Synthetic oligonucleotide
  Target: SCN9A; (-) strand; PAM type: YTN; PAM sequence: CTC
ctctctctctttttctctct

SEQ ID NO: 69413 - DNA, 20 bp, Artificial Sequence
  Description of Artificial Sequence: Synthetic oligonucleotide
  Target: SCN9A; (-) strand; PAM type: YTN; PAM sequence: CTC
tcctctctctctttttctct

SEQ ID NO: 69414 - DNA, 20 bp, Artificial Sequence
  Description of Artificial Sequence: Synthetic oligonucleotide
  Target: SCN9A; (-) strand; PAM type: YTN; PAM sequence: CTC
tctcctctctctctttttct

SEQ ID NO: 69415 - DNA, 20 bp, Artificial Sequence
  Description of Artificial Sequence: Synthetic oligonucleotide
  Target: SCN9A; (-) strand; PAM type: YTN; PAM sequence: CTC
tctctcctctctctcttttt

SEQ ID NO: 69416 - DNA, 20 bp, Artificial Sequence
  Description of Artificial Sequence: Synthetic oligonucleotide
  Target: SCN9A; (-) strand; PAM type: YTN; PAM sequence: CTC
tctctctcctctctctcttt

SEQ ID NO: 69417 - DNA, 20 bp, Artificial Sequence
  Description of Artificial Sequence: Synthetic oligonucleotide
  Target: SCN9A; (-) strand; PAM type: YTN; PAM sequence: CTC
tctctctctcctctctctct

SEQ ID NO: 69418 - DNA, 20 bp, Artificial Sequence
  Description of Artificial Sequence: Synthetic oligonucleotide
  Target: SCN9A; (-) strand; PAM type: YTN; PAM sequence: CTC
tctctctctctcctctctct

SEQ ID NO: 69419 - DNA, 20 bp, Artificial Sequence
  Description of Artificial Sequence: Synthetic oligonucleotide
  Target: SCN9A; (-) strand; PAM type: YTN; PAM sequence: CTC
tctctctctctctcctctct

SEQ ID NO: 69420 - DNA, 20 bp, Artificial Sequence
  Description of Artificial Sequence: Synthetic oligonucleotide
  Target: SCN9A; (-) strand; PAM type: YTN; PAM sequence: CTC
tctctctctctctctcctct

SEQ ID NO: 69421 - DNA, 20 bp, Artificial Sequence
  Description of Artificial Sequence: Synthetic oligonucleotide
  Target: SCN9A; (-) strand; PAM type: YTN; PAM sequence: CTC
tctctctctctctctctcct

SEQ ID NO: 69422 - DNA, 20 bp, Artificial Sequence
  Description of Artificial Sequence: Synthetic oligonucleotide
  Target: SCN9A; (-) strand; PAM type: YTN; PAM sequence: CTC
tctctctctctctctctctc

SEQ ID NO: 69423 - DNA, 20 bp, Artificial Sequence
  Description of Artificial Sequence: Synthetic oligonucleotide
  Target: SCN9A; (-) strand; PAM type: YTN; PAM sequence: CTC
tctctctctctctctctctc

SEQ ID NO: 69424 - DNA, 20 bp, Artificial Sequence
  Description of Artificial Sequence: Synthetic oligonucleotide
  Target: SCN9A; (-) strand; PAM type: YTN; PAM sequence: CTG
aaaaatatggaaagatatgt

SEQ ID NO: 69425 - DNA, 20 bp, Artificial Sequence
  Description of Artificial Sequence: Synthetic oligonucleotide
  Target: SCN9A; (-) strand; PAM type: YTN; PAM sequence: TTG
tatggatgcacactgaaaaa

SEQ ID NO: 69426 - DNA, 20 bp, Artificial Sequence
  Description of Artificial Sequence: Synthetic oligonucleotide
  Target: SCN9A; (-) strand; PAM type: YTN; PAM sequence: CTA
tagtgttgtatggatgcaca

SEQ ID NO: 69427 - DNA, 20 bp, Artificial Sequence
  Description of Artificial Sequence: Synthetic oligonucleotide
  Target: SCN9A; (-) strand; PAM type: YTN; PAM sequence: TTC
acagctatagtgttgtatgg

SEQ ID NO: 69428 - DNA, 20 bp, Artificial Sequence
  Description of Artificial Sequence: Synthetic oligonucleotide
  Target: SCN9A; (-) strand; PAM type: YTN; PAM sequence: TTT
cacagctatagtgttgtatg

SEQ ID NO: 69429 - DNA, 20 bp, Artificial Sequence
  Description of Artificial Sequence: Synthetic oligonucleotide
  Target: SCN9A; (-) strand; PAM type: YTN; PAM sequence: TTG
tttcacagctatagtgttgt

SEQ ID NO: 69430 - DNA, 20 bp, Artificial Sequence
  Description of Artificial Sequence: Synthetic oligonucleotide
  Target: SCN9A; (-) strand; PAM type: YTN; PAM sequence: TTA
caatcaagataaggattgtt

SEQ ID NO: 69431 - DNA, 20 bp, Artificial Sequence
  Description of Artificial Sequence: Synthetic oligonucleotide
  Target: SCN9A; (-) strand; PAM type: YTN; PAM sequence: TTT
acaatcaagataaggattgt

SEQ ID NO: 69432 - DNA, 20 bp, Artificial Sequence
  Description of Artificial Sequence: Synthetic oligonucleotide
  Target: SCN9A; (-) strand; PAM type: YTN; PAM sequence: CTA
cataagtttacaatcaagat

SEQ ID NO: 69433 - DNA, 20 bp, Artificial Sequence
  Description of Artificial Sequence: Synthetic oligonucleotide
  Target: SCN9A; (-) strand; PAM type: YTN; PAM sequence: TTA
aatagctacataagtttaca

SEQ ID NO: 69434 - DNA, 20 bp, Artificial Sequence
  Description of Artificial Sequence: Synthetic oligonucleotide
  Target: SCN9A; (-) strand; PAM type: YTN; PAM sequence: CTT
aaatagctacataagtttac

SEQ ID NO: 69435 - DNA, 20 bp, Artificial Sequence
  Description of Artificial Sequence: Synthetic oligonucleotide
  Target: SCN9A; (-) strand; PAM type: YTN; PAM sequence: TTG
aaaaggagcatcttaaatag

SEQ ID NO: 69436 - DNA, 20 bp, Artificial Sequence
  Description of Artificial Sequence: Synthetic oligonucleotide
  Target: SCN9A; (-) strand; PAM type: YTN; PAM sequence: TTC
agtaattgaaaaggagcatc

SEQ ID NO: 69437 - DNA, 20 bp, Artificial Sequence
  Description of Artificial Sequence: Synthetic oligonucleotide
  Target: SCN9A; (-) strand; PAM type: YTN; PAM sequence: TTT
cagtaattgaaaaggagcat

SEQ ID NO: 69438 - DNA, 20 bp, Artificial Sequence
  Description of Artificial Sequence: Synthetic oligonucleotide
  Target: SCN9A; (-) strand; PAM type: YTN; PAM sequence: TTT
tcagtaattgaaaaggagca

SEQ ID NO: 69439 - DNA, 20 bp, Artificial Sequence
  Description of Artificial Sequence: Synthetic oligonucleotide
  Target: SCN9A; (-) strand; PAM type: YTN; PAM sequence: TTG
gacatattttcagtaattga

SEQ ID NO: 69440 - DNA, 20 bp, Artificial Sequence
  Description of Artificial Sequence: Synthetic oligonucleotide
  Target: SCN9A; (-) strand; PAM type: YTN; PAM sequence: TTT
ggacatattttcagtaattg

SEQ ID NO: 69441 - DNA, 20 bp, Artificial Sequence
  Description of Artificial Sequence: Synthetic oligonucleotide
  Target: SCN9A; (-) strand; PAM type: YTN; PAM sequence: TTA
atttggacatattttcagta

SEQ ID NO: 69442 - DNA, 20 bp, Artificial Sequence
  Description of Artificial Sequence: Synthetic oligonucleotide
  Target: SCN9A; (-) strand; PAM type: YTN; PAM sequence: TTT
aatttggacatattttcagt

SEQ ID NO: 69443 - DNA, 20 bp, Artificial Sequence
  Description of Artificial Sequence: Synthetic oligonucleotide
  Target: SCN9A; (-) strand; PAM type: YTN; PAM sequence: TTT
taatttggacatattttcag

SEQ ID NO: 69444 - DNA, 20 bp, Artificial Sequence
  Description of Artificial Sequence: Synthetic oligonucleotide
  Target: SCN9A; (-) strand; PAM type: YTN; PAM sequence: CTT
ttaatttggacatattttca

SEQ ID NO: 69445 - DNA, 20 bp, Artificial Sequence
  Description of Artificial Sequence: Synthetic oligonucleotide
  Target: SCN9A; (-) strand; PAM type: YTN; PAM sequence: TTC
aaggcaatcaaagggaaaac

SEQ ID NO: 69446 - DNA, 20 bp, Artificial Sequence
  Description of Artificial Sequence: Synthetic oligonucleotide
  Target: SCN9A; (-) strand; PAM type: YTN; PAM sequence: CTT
caaggcaatcaaagggaaaa

SEQ ID NO: 69447 - DNA, 20 bp, Artificial Sequence
  Description of Artificial Sequence: Synthetic oligonucleotide
  Target: SCN9A; (-) strand; PAM type: YTN; PAM sequence: CTC
aagcagtatagtagaaaaca

SEQ ID NO: 69448 - DNA, 20 bp, Artificial Sequence
  Description of Artificial Sequence: Synthetic oligonucleotide
  Target: SCN9A; (-) strand; PAM type: YTN; PAM sequence: CTA
ctcaagcagtatagtagaaa

SEQ ID NO: 69449 - DNA, 20 bp, Artificial Sequence
  Description of Artificial Sequence: Synthetic oligonucleotide
  Target: SCN9A; (-) strand; PAM type: YTN; PAM sequence: TTC
tactcaagcagtatagtaga

SEQ ID NO: 69450 - DNA, 20 bp, Artificial Sequence
  Description of Artificial Sequence: Synthetic oligonucleotide
  Target: SCN9A; (-) strand; PAM type: YTN; PAM sequence: TTT
ctactcaagcagtatagtag

SEQ ID NO: 69451 - DNA, 20 bp, Artificial Sequence
  Description of Artificial Sequence: Synthetic oligonucleotide
  Target: SCN9A; (-) strand; PAM type: YTN; PAM sequence: TTA
acacaatttctactcaagca

SEQ ID NO: 69452 - DNA, 20 bp, Artificial Sequence
  Description of Artificial Sequence: Synthetic oligonucleotide
  Target: SCN9A; (-) strand; PAM type: YTN; PAM sequence: TTT
aacacaatttctactcaagc

SEQ ID NO: 69453 - DNA, 20 bp, Artificial Sequence
  Description of Artificial Sequence: Synthetic oligonucleotide
  Target: SCN9A; (-) strand; PAM type: YTN; PAM sequence: CTA
atatgatacatatatttaac

SEQ ID NO: 69454 - DNA, 20 bp, Artificial Sequence
  Description of Artificial Sequence: Synthetic oligonucleotide
  Target: SCN9A; (-) strand; PAM type: YTN; PAM sequence: TTC
taatatgatacatatattta

SEQ ID NO: 69455 - DNA, 20 bp, Artificial Sequence
  Description of Artificial Sequence: Synthetic oligonucleotide
  Target: SCN9A; (-) strand; PAM type: YTN; PAM sequence: TTA
ggacatgttctaatatgata

SEQ ID NO: 69456 - DNA, 20 bp, Artificial Sequence
  Description of Artificial Sequence: Synthetic oligonucleotide
  Target: SCN9A; (-) strand; PAM type: YTN; PAM sequence: CTT
aggacatgttctaatatgat

SEQ ID NO: 69457 - DNA, 20 bp, Artificial Sequence
  Description of Artificial Sequence: Synthetic oligonucleotide
  Target: SCN9A; (-) strand; PAM type: YTN; PAM sequence: TTG
taagtgaacaacttaggaca

SEQ ID NO: 69458 - DNA, 20 bp, Artificial Sequence
  Description of Artificial Sequence: Synthetic oligonucleotide
  Target: SCN9A; (-) strand; PAM type: YTN; PAM sequence: TTT
gtaagtgaacaacttaggac

SEQ ID NO: 69459 - DNA, 20 bp, Artificial Sequence
  Description of Artificial Sequence: Synthetic oligonucleotide
  Target: SCN9A; (-) strand; PAM type: YTN; PAM sequence: TTA
ggaaatgccagtgataaatt

SEQ ID NO: 69460 - DNA, 20 bp, Artificial Sequence
  Description of Artificial Sequence: Synthetic oligonucleotide
  Target: SCN9A; (-) strand; PAM type: YTN; PAM sequence: CTT
aggaaatgccagtgataaat

SEQ ID NO: 69461 - DNA, 20 bp, Artificial Sequence
  Description of Artificial Sequence: Synthetic oligonucleotide
  Target: SCN9A; (-) strand; PAM type: YTN; PAM sequence: TTA
tcttaggaaatgccagtgat

SEQ ID NO: 69462 - DNA, 20 bp, Artificial Sequence
  Description of Artificial Sequence: Synthetic oligonucleotide
  Target: SCN9A; (-) strand; PAM type: YTN; PAM sequence: TTT
atcttaggaaatgccagtga

SEQ ID NO: 69463 - DNA, 20 bp, Artificial Sequence
  Description of Artificial Sequence: Synthetic oligonucleotide
  Target: SCN9A; (-) strand; PAM type: YTN; PAM sequence: TTA
atgtttatcttaggaaatgc

SEQ ID NO: 69464 - DNA, 20 bp, Artificial Sequence
  Description of Artificial Sequence: Synthetic oligonucleotide
  Target: SCN9A; (-) strand; PAM type: YTN; PAM sequence: TTA
catcgttaatgtttatctta

SEQ ID NO: 69465 - DNA, 20 bp, Artificial Sequence
  Description of Artificial Sequence: Synthetic oligonucleotide
  Target: SCN9A; (-) strand; PAM type: YTN; PAM sequence: CTT
acatcgttaatgtttatctt

SEQ ID NO: 69466 - DNA, 20 bp, Artificial Sequence
  Description of Artificial Sequence: Synthetic oligonucleotide
  Target: SCN9A; (-) strand; PAM type: YTN; PAM sequence: TTA
accatcatccatgatagcat

SEQ ID NO: 69467 - DNA, 20 bp, Artificial Sequence
  Description of Artificial Sequence: Synthetic oligonucleotide
  Target: SCN9A; (-) strand; PAM type: YTN; PAM sequence: CTA
gcattaaccatcatccatga

SEQ ID NO: 69468 - DNA, 20 bp, Artificial Sequence
  Description of Artificial Sequence: Synthetic oligonucleotide
  Target: SCN9A; (-) strand; PAM type: YTN; PAM sequence: TTG
gaacaataaataactagcat

SEQ ID NO: 69469 - DNA, 20 bp, Artificial Sequence
  Description of Artificial Sequence: Synthetic oligonucleotide
  Target: SCN9A; (-) strand; PAM type: YTN; PAM sequence: CTT
ggaacaataaataactagca

SEQ ID NO: 69470 - DNA, 20 bp, Artificial Sequence
  Description of Artificial Sequence: Synthetic oligonucleotide
  Target: SCN9A; (-) strand; PAM type: YTN; PAM sequence: CTC
ttggaacaataaataactag

SEQ ID NO: 69471 - DNA, 20 bp, Artificial Sequence
  Description of Artificial Sequence: Synthetic oligonucleotide
  Target: SCN9A; (-) strand; PAM type: YTN; PAM sequence: CTC
acacctcttggaacaataaa

SEQ ID NO: 69472 - DNA, 20 bp, Artificial Sequence
  Description of Artificial Sequence: Synthetic oligonucleotide
  Target: SCN9A; (-) strand; PAM type: YTN; PAM sequence: CTA
cctcacacctcttggaacaa

SEQ ID NO: 69473 - DNA, 20 bp, Artificial Sequence
  Description of Artificial Sequence: Synthetic oligonucleotide
  Target: SCN9A; (-) strand; PAM type: YTN; PAM sequence: CTC
ctacctcacacctcttggaa

SEQ ID NO: 69474 - DNA, 20 bp, Artificial Sequence
  Description of Artificial Sequence: Synthetic oligonucleotide
  Target: SCN9A; (-) strand; PAM type: YTN; PAM sequence: TTA
gacactcctacctcacacct

SEQ ID NO: 69475 - DNA, 20 bp, Artificial Sequence
  Description of Artificial Sequence: Synthetic oligonucleotide
  Target: SCN9A; (-) strand; PAM type: YTN; PAM sequence: TTA
tcaagtcattagacactcct

SEQ ID NO: 69476 - DNA, 20 bp, Artificial Sequence
  Description of Artificial Sequence: Synthetic oligonucleotide
  Target: SCN9A; (-) strand; PAM type: YTN; PAM sequence: TTA
gattatcaagtcattagaca

SEQ ID NO: 69477 - DNA, 20 bp, Artificial Sequence
  Description of Artificial Sequence: Synthetic oligonucleotide
  Target: SCN9A; (-) strand; PAM type: YTN; PAM sequence: TTG
agcgttagattatcaagtca

SEQ ID NO: 69478 - DNA, 20 bp, Artificial Sequence
  Description of Artificial Sequence: Synthetic oligonucleotide
  Target: SCN9A; (-) strand; PAM type: YTN; PAM sequence: TTT
gagcgttagattatcaagtc

SEQ ID NO: 69479 - DNA, 20 bp, Artificial Sequence
  Description of Artificial Sequence: Synthetic oligonucleotide
  Target: SCN9A; (-) strand; PAM type: YTN; PAM sequence: TTT
tgagcgttagattatcaagt

SEQ ID NO: 69480 - DNA, 20 bp, Artificial Sequence
  Description of Artificial Sequence: Synthetic oligonucleotide
  Target: SCN9A; (-) strand; PAM type: YTN; PAM sequence: CTT
ttgagcgttagattatcaag

SEQ ID NO: 69481 - DNA, 20 bp, Artificial Sequence
  Description of Artificial Sequence: Synthetic oligonucleotide
  Target: SCN9A; (-) strand; PAM type: YTN; PAM sequence: TTC
ttttgagcgttagattatca

SEQ ID NO: 69482 - DNA, 20 bp, Artificial Sequence
  Description of Artificial Sequence: Synthetic oligonucleotide
  Target: SCN9A; (-) strand; PAM type: YTN; PAM sequence: CTT
cttttgagcgttagattatc

SEQ ID NO: 69483 - DNA, 20 bp, Artificial Sequence
  Description of Artificial Sequence: Synthetic oligonucleotide
  Target: SCN9A; (-) strand; PAM type: YTN; PAM sequence: TTC
ttcttttgagcgttagatta

SEQ ID NO: 69484 - DNA, 20 bp, Artificial Sequence
  Description of Artificial Sequence: Synthetic oligonucleotide
  Target: SCN9A; (-) strand; PAM type: YTN; PAM sequence: TTT
cttcttttgagcgttagatt

SEQ ID NO: 69485 - DNA, 20 bp, Artificial Sequence
  Description of Artificial Sequence: Synthetic oligonucleotide
  Target: SCN9A; (-) strand; PAM type: YTN; PAM sequence: TTG
atagtttcttcttttgagcg

SEQ ID NO: 69486 - DNA, 20 bp, Artificial Sequence
  Description of Artificial Sequence: Synthetic oligonucleotide
  Target: SCN9A; (-) strand; PAM type: YTN; PAM sequence: TTT
gatagtttcttcttttgagc

SEQ ID NO: 69487 - DNA, 20 bp, Artificial Sequence
  Description of Artificial Sequence: Synthetic oligonucleotide
  Target: SCN9A; (-) strand; PAM type: YTN; PAM sequence: CTG
tgtttgatagtttcttcttt

SEQ ID NO: 69488 - DNA, 20 bp, Artificial Sequence
  Description of Artificial Sequence: Synthetic oligonucleotide
  Target: SCN9A; (-) strand; PAM type: YTN; PAM sequence: CTG
ctgtgtttgatagtttcttc

SEQ ID NO: 69489 - DNA, 20 bp, Artificial Sequence
  Description of Artificial Sequence: Synthetic oligonucleotide
  Target: SCN9A; (-) strand; PAM type: YTN; PAM sequence: TTG
tacagtgctgctgtgtttga

SEQ ID NO: 69490 - DNA, 20 bp, Artificial Sequence
  Description of Artificial Sequence: Synthetic oligonucleotide
  Target: SCN9A; (-) strand; PAM type: YTN; PAM sequence: TTT
gtacagtgctgctgtgtttg

SEQ ID NO: 69491 - DNA, 20 bp, Artificial Sequence
  Description of Artificial Sequence: Synthetic oligonucleotide
  Target: SCN9A; (-) strand; PAM type: YTN; PAM sequence: TTT
tgtacagtgctgctgtgttt

SEQ ID NO: 69492 - DNA, 20 bp, Artificial Sequence
  Description of Artificial Sequence: Synthetic oligonucleotide
  Target: SCN9A; (-) strand; PAM type: YTN; PAM sequence: CTG
tgttttgtacagtgctgctg

SEQ ID NO: 69493 - DNA, 20 bp, Artificial Sequence
  Description of Artificial Sequence: Synthetic oligonucleotide
  Target: SCN9A; (-) strand; PAM type: YTN; PAM sequence: TTC
tgtgttttgtacagtgctgc

SEQ ID NO: 69494 - DNA, 20 bp, Artificial Sequence
  Description of Artificial Sequence: Synthetic oligonucleotide
  Target: SCN9A; (-) strand; PAM type: YTN; PAM sequence: TTG
agttctgtgttttgtacagt

SEQ ID NO: 69495 - DNA, 20 bp, Artificial Sequence
  Description of Artificial Sequence: Synthetic oligonucleotide
  Target: SCN9A; (-) strand; PAM type: YTN; PAM sequence: TTG
ttgagttctgtgttttgtac

SEQ ID NO: 69496 - DNA, 20 bp, Artificial Sequence
  Description of Artificial Sequence: Synthetic oligonucleotide
  Target: SCN9A; (-) strand; PAM type: YTN; PAM sequence: TTT
gttgagttctgtgttttgta

SEQ ID NO: 69497 - DNA, 20 bp, Artificial Sequence
  Description of Artificial Sequence: Synthetic oligonucleotide
  Target: SCN9A; (-) strand; PAM type: YTN; PAM sequence: TTT
tgttgagttctgtgttttgt

SEQ ID NO: 69498 - DNA, 20 bp, Artificial Sequence
  Description of Artificial Sequence: Synthetic oligonucleotide
  Target: SCN9A; (-) strand; PAM type: YTN; PAM sequence: TTT
ttgttgagttctgtgttttg

SEQ ID NO: 69499 - DNA, 20 bp, Artificial Sequence
  Description of Artificial Sequence: Synthetic oligonucleotide
  Target: SCN9A; (-) strand; PAM type: YTN; PAM sequence: TTG
agtaaggtttttgttgagtt

SEQ ID NO: 69500 - DNA, 20 bp, Artificial Sequence
  Description of Artificial Sequence: Synthetic oligonucleotide
  Target: SCN9A; (-) strand; PAM type: YTN; PAM sequence: TTT
gagtaaggtttttgttgagt

SEQ ID NO: 69501 - DNA, 20 bp, Artificial Sequence
  Description of Artificial Sequence: Synthetic oligonucleotide
  Target: SCN9A; (-) strand; PAM type: YTN; PAM sequence: CTT
tgagtaaggtttttgttgag

SEQ ID NO: 69502 - DNA, 20 bp, Artificial Sequence
  Description of Artificial Sequence: Synthetic oligonucleotide
  Target: SCN9A; (-) strand; PAM type: YTN; PAM sequence: CTC
tttgagtaaggtttttgttg

SEQ ID NO: 69503 - DNA, 20 bp, Artificial Sequence
  Description of Artificial Sequence: Synthetic oligonucleotide
  Target: SCN9A; (-) strand; PAM type: YTN; PAM sequence: TTC
tctttgagtaaggtttttgt

SEQ ID NO: 69504 - DNA, 20 bp, Artificial Sequence
  Description of Artificial Sequence: Synthetic oligonucleotide
  Target: SCN9A; (-) strand; PAM type: YTN; PAM sequence: TTC
agcatcaatcattctctttg

SEQ ID NO: 69505 - DNA, 20 bp, Artificial Sequence
  Description of Artificial Sequence: Synthetic oligonucleotide
  Target: SCN9A; (-) strand; PAM type: YTN; PAM sequence: TTT
cagcatcaatcattctcttt

SEQ ID NO: 69506 - DNA, 20 bp, Artificial Sequence
  Description of Artificial Sequence: Synthetic oligonucleotide
  Target: SCN9A; (-) strand; PAM type: YTN; PAM sequence: TTT
tcagcatcaatcattctctt

SEQ ID NO: 69507 - DNA, 20 bp, Artificial Sequence
  Description of Artificial Sequence: Synthetic oligonucleotide
  Target: SCN9A; (-) strand; PAM type: YTN; PAM sequence: CTT
ttcagcatcaatcattctct

SEQ ID NO: 69508 - DNA, 20 bp, Artificial Sequence
  Description of Artificial Sequence: Synthetic oligonucleotide
  Target: SCN9A; (-) strand; PAM type: YTN; PAM sequence: TTC
ttttcagcatcaatcattct

SEQ ID NO: 69509 - DNA, 20 bp, Artificial Sequence
  Description of Artificial Sequence: Synthetic oligonucleotide
  Target: SCN9A; (-) strand; PAM type: YTN; PAM sequence: TTC
agttcttttcagcatcaatc

SEQ ID NO: 69510 - DNA, 20 bp, Artificial Sequence
  Description of Artificial Sequence: Synthetic oligonucleotide
  Target: SCN9A; (-) strand; PAM type: YTN; PAM sequence: TTT
cagttcttttcagcatcaat

SEQ ID NO: 69511 - DNA, 20 bp, Artificial Sequence
  Description of Artificial Sequence: Synthetic oligonucleotide
  Target: SCN9A; (-) strand; PAM type: YTN; PAM sequence: TTT
tcagttcttttcagcatcaa

SEQ ID NO: 69512 - DNA, 20 bp, Artificial Sequence
  Description of Artificial Sequence: Synthetic oligonucleotide
  Target: SCN9A; (-) strand; PAM type: YTN; PAM sequence: TTT
ttcagttcttttcagcatca

SEQ ID NO: 69513 - DNA, 20 bp, Artificial Sequence
  Description of Artificial Sequence: Synthetic oligonucleotide
  Target: SCN9A; (-) strand; PAM type: YTN; PAM sequence: TTG
aaatgtaacatttttcagtt

SEQ ID NO: 69514 - DNA, 20 bp, Artificial Sequence
  Description of Artificial Sequence: Synthetic oligonucleotide
  Target: SCN9A; (-) strand; PAM type: YTN; PAM sequence: CTT
gaaatgtaacatttttcagt

SEQ ID NO: 69515 - DNA, 20 bp, Artificial Sequence
  Description of Artificial Sequence: Synthetic oligonucleotide
  Target: SCN9A; (-) strand; PAM type: YTN; PAM sequence: TTA
tagtatgtacttgaaatgta

SEQ ID NO: 69516 - DNA, 20 bp, Artificial Sequence
  Description of Artificial Sequence: Synthetic oligonucleotide
  Target: SCN9A; (-) strand; PAM type: YTN; PAM sequence: TTT
atagtatgtacttgaaatgt

SEQ ID NO: 69517 - DNA, 20 bp, Artificial Sequence
  Description of Artificial Sequence: Synthetic oligonucleotide
  Target: SCN9A; (-) strand; PAM type: YTN; PAM sequence: TTG
tgtgaagcaaacagtttata

SEQ ID NO: 69518 - DNA, 20 bp, Artificial Sequence
  Description of Artificial Sequence: Synthetic oligonucleotide
  Target: SCN9A; (-) strand; PAM type: YTN; PAM sequence: TTG
ttgtgtgaagcaaacagttt

SEQ ID NO: 69519 - DNA, 20 bp, Artificial Sequence
  Description of Artificial Sequence: Synthetic oligonucleotide
  Target: SCN9A; (-) strand; PAM type: YTN; PAM sequence: TTT
gttgtgtgaagcaaacagtt

SEQ ID NO: 69520 - DNA, 20 bp, Artificial Sequence
  Description of Artificial Sequence: Synthetic oligonucleotide
  Target: SCN9A; (-) strand; PAM type: YTN; PAM sequence: TTT
tgttgtgtgaagcaaacagt

SEQ ID NO: 69521 - DNA, 20 bp, Artificial Sequence
  Description of Artificial Sequence: Synthetic oligonucleotide
  Target: SCN9A; (-) strand; PAM type: YTN; PAM sequence: TTT
ttgttgtgtgaagcaaacag

SEQ ID NO: 69522 - DNA, 20 bp, Artificial Sequence
  Description of Artificial Sequence: Synthetic oligonucleotide
  Target: SCN9A; (-) strand; PAM type: YTN; PAM sequence: TTT
tttgttgtgtgaagcaaaca

SEQ ID NO: 69523 - DNA, 20 bp, Artificial Sequence
  Description of Artificial Sequence: Synthetic oligonucleotide
  Target: SCN9A; (-) strand; PAM type: YTN; PAM sequence: TTT
ttttgttgtgtgaagcaaac

SEQ ID NO: 69524 - DNA, 20 bp, Artificial Sequence
  Description of Artificial Sequence: Synthetic oligonucleotide
  Target: SCN9A; (-) strand; PAM type: YTN; PAM sequence: TTT
tttttgttgtgtgaagcaaa

SEQ ID NO: 69525 - DNA, 20 bp, Artificial Sequence
  Description of Artificial Sequence: Synthetic oligonucleotide
  Target: SCN9A; (-) strand; PAM type: YTN; PAM sequence: TTT
ttttttgttgtgtgaagcaa

SEQ ID NO: 69526 - DNA, 20 bp, Artificial Sequence
  Description of Artificial Sequence: Synthetic oligonucleotide
  Target: SCN9A; (-) strand; PAM type: YTN; PAM sequence: CTT
tttttttgttgtgtgaagca

SEQ ID NO: 69527 - DNA, 20 bp, Artificial Sequence
  Description of Artificial Sequence: Synthetic oligonucleotide
  Target: SCN9A; (-) strand; PAM type: YTN; PAM sequence: TTA
aagaatatctttttttttgt

SEQ ID NO: 69528 - DNA, 20 bp, Artificial Sequence
  Description of Artificial Sequence: Synthetic oligonucleotide
  Target: SCN9A; (-) strand; PAM type: YTN; PAM sequence: CTT
aaagaatatctttttttttg

SEQ ID NO: 69529 - DNA, 20 bp, Artificial Sequence
  Description of Artificial Sequence: Synthetic oligonucleotide
  Target: SCN9A; (-) strand; PAM type: YTN; PAM sequence: CTC
cttaaagaatatcttttttt

SEQ ID NO: 69530 - DNA, 20 bp, Artificial Sequence
  Description of Artificial Sequence: Synthetic oligonucleotide
  Target: SCN9A; (-) strand; PAM type: YTN; PAM sequence: CTG
ctccttaaagaatatctttt

SEQ ID NO: 69531 - DNA, 20 bp, Artificial Sequence
  Description of Artificial Sequence: Synthetic oligonucleotide
  Target: SCN9A; (-) strand; PAM type: YTN; PAM sequence: CTC
tgctccttaaagaatatctt

SEQ ID NO: 69532 - DNA, 20 bp, Artificial Sequence
  Description of Artificial Sequence: Synthetic oligonucleotide
  Target: SCN9A; (-) strand; PAM type: YTN; PAM sequence: CTA
ggctctgctccttaaagaat

SEQ ID NO: 69533 - DNA, 20 bp, Artificial Sequence
  Description of Artificial Sequence: Synthetic oligonucleotide
  Target: SCN9A; (-) strand; PAM type: YTN; PAM sequence: TTC
taggctctgctccttaaaga

SEQ ID NO: 69534 - DNA, 20 bp, Artificial Sequence
  Description of Artificial Sequence: Synthetic oligonucleotide
  Target: SCN9A; (-) strand; PAM type: YTN; PAM sequence: CTC
aggtgaaataaccattctag

SEQ ID NO: 69535 - DNA, 20 bp, Artificial Sequence
  Description of Artificial Sequence: Synthetic oligonucleotide
  Target: SCN9A; (-) strand; PAM type: YTN; PAM sequence: TTA
aggctcaggtgaaataacca

SEQ ID NO: 69536 - DNA, 20 bp, Artificial Sequence
  Description of Artificial Sequence: Synthetic oligonucleotide
  Target: SCN9A; (-) strand; PAM type: YTN; PAM sequence: TTT
aaggctcaggtgaaataacc

SEQ ID NO: 69537 - DNA, 20 bp, Artificial Sequence
  Description of Artificial Sequence: Synthetic oligonucleotide
  Target: SCN9A; (-) strand; PAM type: YTN; PAM sequence: TTT
taaggctcaggtgaaataac

SEQ ID NO: 69538 - DNA, 20 bp, Artificial Sequence
  Description of Artificial Sequence: Synthetic oligonucleotide
  Target: SCN9A; (-) strand; PAM type: YTN; PAM sequence: TTG
tgagtattttaaggctcagg

SEQ ID NO: 69539 - DNA, 20 bp, Artificial Sequence
  Description of Artificial Sequence: Synthetic oligonucleotide
  Target: SCN9A; (-) strand; PAM type: YTN; PAM sequence: TTT
gtgagtattttaaggctcag

SEQ ID NO: 69540 - DNA, 20 bp, Artificial Sequence
  Description of Artificial Sequence: Synthetic oligonucleotide
  Target: SCN9A; (-) strand; PAM type: YTN; PAM sequence: TTT
tgtgagtattttaaggctca

SEQ ID NO: 69541 - DNA, 20 bp, Artificial Sequence
  Description of Artificial Sequence: Synthetic oligonucleotide
  Target: SCN9A; (-) strand; PAM type: YTN; PAM sequence: CTT
ttgtgagtattttaaggctc

SEQ ID NO: 69542 - DNA, 20 bp, Artificial Sequence
  Description of Artificial Sequence: Synthetic oligonucleotide
  Target: SCN9A; (-) strand; PAM type: YTN; PAM sequence: CTG
tcttttgtgagtattttaag

SEQ ID NO: 69543 - DNA, 20 bp, Artificial Sequence
  Description of Artificial Sequence: Synthetic oligonucleotide
  Target: SCN9A; (-) strand; PAM type: YTN; PAM sequence: TTA
ctgtcttttgtgagtatttt

SEQ ID NO: 69544 - DNA, 20 bp, Artificial Sequence
  Description of Artificial Sequence: Synthetic oligonucleotide
  Target: SCN9A; (-) strand; PAM type: YTN; PAM sequence: CTT
actgtcttttgtgagtattt

SEQ ID NO: 69545 - DNA, 20 bp, Artificial Sequence
  Description of Artificial Sequence: Synthetic oligonucleotide
  Target: SCN9A; (-) strand; PAM type: YTN; PAM sequence: TTC
ttactgtcttttgtgagtat

SEQ ID NO: 69546 - DNA, 20 bp, Artificial Sequence
  Description of Artificial Sequence: Synthetic oligonucleotide
  Target: SCN9A; (-) strand; PAM type: YTN; PAM sequence: TTT
cttactgtcttttgtgagta

SEQ ID NO: 69547 - DNA, 20 bp, Artificial Sequence
  Description of Artificial Sequence: Synthetic oligonucleotide
  Target: SCN9A; (-) strand; PAM type: YTN; PAM sequence: CTT
tcttactgtcttttgtgagt

SEQ ID NO: 69548 - DNA, 20 bp, Artificial Sequence
  Description of Artificial Sequence: Synthetic oligonucleotide
  Target: SCN9A; (-) strand; PAM type: YTN; PAM sequence: CTC
aactttcttactgtcttttg

SEQ ID NO: 69549 - DNA, 20 bp, Artificial Sequence
  Description of Artificial Sequence: Synthetic oligonucleotide
  Target: SCN9A; (-) strand; PAM type: YTN; PAM sequence: CTC
tcaactttcttactgtcttt

SEQ ID NO: 69550 - DNA, 20 bp, Artificial Sequence
  Description of Artificial Sequence: Synthetic oligonucleotide
  Target: SCN9A; (-) strand; PAM type: YTN; PAM sequence: TTC
tctcaactttcttactgtct

SEQ ID NO: 69551 - DNA, 20 bp, Artificial Sequence
  Description of Artificial Sequence: Synthetic oligonucleotide
  Target: SCN9A; (-) strand; PAM type: YTN; PAM sequence: CTT
ctctcaactttcttactgtc

SEQ ID NO: 69552 - DNA, 20 bp, Artificial Sequence
  Description of Artificial Sequence: Synthetic oligonucleotide
  Target: SCN9A; (-) strand; PAM type: YTN; PAM sequence: TTG
cttctctcaactttcttact

SEQ ID NO: 69553 - DNA, 20 bp, Artificial Sequence
  Description of Artificial Sequence: Synthetic oligonucleotide
  Target: SCN9A; (-) strand; PAM type: YTN; PAM sequence: TTT
gcttctctcaactttcttac

SEQ ID NO: 69554 - DNA, 20 bp, Artificial Sequence
  Description of Artificial Sequence: Synthetic oligonucleotide
  Target: SCN9A; (-) strand; PAM type: YTN; PAM sequence: TTG
atttgcttctctcaactttc

SEQ ID NO: 69555 - DNA, 20 bp, Artificial Sequence
  Description of Artificial Sequence: Synthetic oligonucleotide
  Target: SCN9A; (-) strand; PAM type: YTN; PAM sequence: TTT
gatttgcttctctcaacttt

SEQ ID NO: 69556 - DNA, 20 bp, Artificial Sequence
  Description of Artificial Sequence: Synthetic oligonucleotide
  Target: SCN9A; (-) strand; PAM type: YTN; PAM sequence: TTT
tgatttgcttctctcaactt

SEQ ID NO: 69557 - DNA, 20 bp, Artificial Sequence
  Description of Artificial Sequence: Synthetic oligonucleotide
  Target: SCN9A; (-) strand; PAM type: YTN; PAM sequence: CTT
ttgatttgcttctctcaact

SEQ ID NO: 69558 - DNA, 20 bp, Artificial Sequence
  Description of Artificial Sequence: Synthetic oligonucleotide
  Target: SCN9A; (-) strand; PAM type: YTN; PAM sequence: CTC
cttttgatttgcttctctca

SEQ ID NO: 69559 - DNA, 20 bp, Artificial Sequence
  Description of Artificial Sequence: Synthetic oligonucleotide
  Target: SCN9A; (-) strand; PAM type: YTN; PAM sequence: CTC
ctccttttgatttgcttctc

SEQ ID NO: 69560 - DNA, 20 bp, Artificial Sequence
  Description of Artificial Sequence: Synthetic oligonucleotide
  Target: SCN9A; (-) strand; PAM type: YTN; PAM sequence: TTA
tacccatctcctccttttga

SEQ ID NO: 69561 - DNA, 20 bp, Artificial Sequence
  Description of Artificial Sequence: Synthetic oligonucleotide
  Target: SCN9A; (-) strand; PAM type: YTN; PAM sequence: TTT
atacccatctcctccttttg

SEQ ID NO: 69562 - DNA, 20 bp, Artificial Sequence
  Description of Artificial Sequence: Synthetic oligonucleotide
  Target: SCN9A; (-) strand; PAM type: YTN; PAM sequence: TTT
tatacccatctcctcctttt

SEQ ID NO: 69563 - DNA, 20 bp, Artificial Sequence
  Description of Artificial Sequence: Synthetic oligonucleotide
  Target: SCN9A; (-) strand; PAM type: YTN; PAM sequence: CTT
ttatacccatctcctccttt

SEQ ID NO: 69564 - DNA, 20 bp, Artificial Sequence
  Description of Artificial Sequence: Synthetic oligonucleotide
  Target: SCN9A; (-) strand; PAM type: YTN; PAM sequence: CTC
ttttatacccatctcctcct

SEQ ID NO: 69565 - DNA, 20 bp, Artificial Sequence
  Description of Artificial Sequence: Synthetic oligonucleotide
  Target: SCN9A; (-) strand; PAM type: YTN; PAM sequence: TTC
tcttttatacccatctcctc

SEQ ID NO: 69566 - DNA, 20 bp, Artificial Sequence
  Description of Artificial Sequence: Synthetic oligonucleotide
  Target: SCN9A; (-) strand; PAM type: YTN; PAM sequence: CTT
ctcttttatacccatctcct

SEQ ID NO: 69567 - DNA, 20 bp, Artificial Sequence
  Description of Artificial Sequence: Synthetic oligonucleotide
  Target: SCN9A; (-) strand; PAM type: YTN; PAM sequence: TTC
ttctcttttatacccatctc

SEQ ID NO: 69568 - DNA, 20 bp, Artificial Sequence
  Description of Artificial Sequence: Synthetic oligonucleotide
  Target: SCN9A; (-) strand; PAM type: YTN; PAM sequence: TTT
cttctcttttatacccatct

SEQ ID NO: 69569 - DNA, 20 bp, Artificial Sequence
  Description of Artificial Sequence: Synthetic oligonucleotide
  Target: SCN9A; (-) strand; PAM type: YTN; PAM sequence: TTT
tcttctcttttatacccatc

SEQ ID NO: 69570 - DNA, 20 bp, Artificial Sequence
  Description of Artificial Sequence: Synthetic oligonucleotide
  Target: SCN9A; (-) strand; PAM type: YTN; PAM sequence: TTT
ttcttctcttttatacccat

SEQ ID NO: 69571 - DNA, 20 bp, Artificial Sequence
  Description of Artificial Sequence: Synthetic oligonucleotide
  Target: SCN9A; (-) strand; PAM type: YTN; PAM sequence: CTG
ccataatttttcttctcttt

SEQ ID NO: 69572 - DNA, 20 bp, Artificial Sequence
  Description of Artificial Sequence: Synthetic oligonucleotide
  Target: SCN9A; (-) strand; PAM type: YTN; PAM sequence: CTG
tctgccataatttttcttct

SEQ ID NO: 69573 - DNA, 20 bp, Artificial Sequence
  Description of Artificial Sequence: Synthetic oligonucleotide
  Target: SCN9A; (-) strand; PAM type: YTN; PAM sequence: TTA
ccactgtctgccataatttt

SEQ ID NO: 69574 - DNA, 20 bp, Artificial Sequence
  Description of Artificial Sequence: Synthetic oligonucleotide
  Target: SCN9A; (-) strand; PAM type: YTN; PAM sequence: TTT
accactgtctgccataattt

SEQ ID NO: 69575 - DNA, 20 bp, Artificial Sequence
  Description of Artificial Sequence: Synthetic oligonucleotide
  Target: SCN9A; (-) strand; PAM type: YTN; PAM sequence: TTA
gtttaccactgtctgccata

SEQ ID NO: 69576 - DNA, 20 bp, Artificial Sequence
  Description of Artificial Sequence: Synthetic oligonucleotide
  Target: SCN9A; (-) strand; PAM type: YTN; PAM sequence: CTT
agtttaccactgtctgccat

SEQ ID NO: 69577 - DNA, 20 bp, Artificial Sequence
  Description of Artificial Sequence: Synthetic oligonucleotide
  Target: SCN9A; (-) strand; PAM type: YTN; PAM sequence: TTA
acagataatggagcttagtt

SEQ ID NO: 69578 - DNA, 20 bp, Artificial Sequence
  Description of Artificial Sequence: Synthetic oligonucleotide
  Target: SCN9A; (-) strand; PAM type: YTN; PAM sequence: TTA
ttaacagataatggagctta

SEQ ID NO: 69579 - DNA, 20 bp, Artificial Sequence
  Description of Artificial Sequence: Synthetic oligonucleotide
  Target: SCN9A; (-) strand; PAM type: YTN; PAM sequence: CTT
attaacagataatggagctt

SEQ ID NO: 69580 - DNA, 20 bp, Artificial Sequence
  Description of Artificial Sequence: Synthetic oligonucleotide
  Target: SCN9A; (-) strand; PAM type: YTN; PAM sequence: TTG
cttattaacagataatggag

SEQ ID NO: 69581 - DNA, 20 bp, Artificial Sequence
  Description of Artificial Sequence: Synthetic oligonucleotide
  Target: SCN9A; (-) strand; PAM type: YTN; PAM sequence: CTT
gcttattaacagataatgga

SEQ ID NO: 69582 - DNA, 20 bp, Artificial Sequence
  Description of Artificial Sequence: Synthetic oligonucleotide
  Target: SCN9A; (-) strand; PAM type: YTN; PAM sequence: TTC
ttgcttattaacagataatg

SEQ ID NO: 69583 - DNA, 20 bp, Artificial Sequence
  Description of Artificial Sequence: Synthetic oligonucleotide
  Target: SCN9A; (-) strand; PAM type: YTN; PAM sequence: TTT
cttgcttattaacagataat

SEQ ID NO: 69584 - DNA, 20 bp, Artificial Sequence
  Description of Artificial Sequence: Synthetic oligonucleotide
  Target: SCN9A; (-) strand; PAM type: YTN; PAM sequence: CTT
tcttgcttattaacagataa

SEQ ID NO: 69585 - DNA, 20 bp, Artificial Sequence
  Description of Artificial Sequence: Synthetic oligonucleotide
  Target: SCN9A; (-) strand; PAM type: YTN; PAM sequence: TTA
aaatgtctttcttgcttatt

SEQ ID NO: 69586 - DNA, 20 bp, Artificial Sequence
  Description of Artificial Sequence: Synthetic oligonucleotide
  Target: SCN9A; (-) strand; PAM type: YTN; PAM sequence: TTT
aaaatgtctttcttgcttat

SEQ ID NO: 69587 - DNA, 20 bp, Artificial Sequence
  Description of Artificial Sequence: Synthetic oligonucleotide
  Target: SCN9A; (-) strand; PAM type: YTN; PAM sequence: TTT
taaaatgtctttcttgctta

SEQ ID NO: 69588 - DNA, 20 bp, Artificial Sequence
  Description of Artificial Sequence: Synthetic oligonucleotide
  Target: SCN9A; (-) strand; PAM type: YTN; PAM sequence: CTA
attttaaaatgtctttcttg

SEQ ID NO: 69589 - DNA, 20 bp, Artificial Sequence
  Description of Artificial Sequence: Synthetic oligonucleotide
  Target: SCN9A; (-) strand; PAM type: YTN; PAM sequence: TTG
aaactaattttaaaatgtct

SEQ ID NO: 69590 - DNA, 20 bp, Artificial Sequence
  Description of Artificial Sequence: Synthetic oligonucleotide
  Target: SCN9A; (-) strand; PAM type: YTN; PAM sequence: CTT
gaaactaattttaaaatgtc

SEQ ID NO: 69591 - DNA, 20 bp, Artificial Sequence
  Description of Artificial Sequence: Synthetic oligonucleotide
  Target: SCN9A; (-) strand; PAM type: YTN; PAM sequence: TTA
aaagatggataatagtaact

SEQ ID NO: 69592 - DNA, 20 bp, Artificial Sequence
  Description of Artificial Sequence: Synthetic oligonucleotide
  Target: SCN9A; (-) strand; PAM type: YTN; PAM sequence: TTA
aattaaaagatggataatag

SEQ ID NO: 69593 - DNA, 20 bp, Artificial Sequence
  Description of Artificial Sequence: Synthetic oligonucleotide
  Target: SCN9A; (-) strand; PAM type: YTN; PAM sequence: CTA
cacaattaaattaaaagatg

SEQ ID NO: 69594 - DNA, 20 bp, Artificial Sequence
  Description of Artificial Sequence: Synthetic oligonucleotide
  Target: SCN9A; (-) strand; PAM type: YTN; PAM sequence: TTG
accgtaaaactacacaatta

SEQ ID NO: 69595 - DNA, 20 bp, Artificial Sequence
  Description of Artificial Sequence: Synthetic oligonucleotide
  Target: SCN9A; (-) strand; PAM type: YTN; PAM sequence: TTA
tagatattgaccgtaaaact

SEQ ID NO: 69596 - DNA, 20 bp, Artificial Sequence
  Description of Artificial Sequence: Synthetic oligonucleotide
  Target: SCN9A; (-) strand; PAM type: YTN; PAM sequence: TTC
aagaacacaattatagatat

SEQ ID NO: 69597 - DNA, 20 bp, Artificial Sequence
  Description of Artificial Sequence: Synthetic oligonucleotide
  Target: SCN9A; (-) strand; PAM type: YTN; PAM sequence: TTA
atgattcaagaacacaatta

SEQ ID NO: 69598 - DNA, 20 bp, Artificial Sequence
  Description of Artificial Sequence: Synthetic oligonucleotide
  Target: SCN9A; (-) strand; PAM type: YTN; PAM sequence: CTT
aatgattcaagaacacaatt

SEQ ID NO: 69599 - DNA, 20 bp, Artificial Sequence
  Description of Artificial Sequence: Synthetic oligonucleotide
  Target: SCN9A; (-) strand; PAM type: YTN; PAM sequence: CTC
cttaatgattcaagaacaca

SEQ ID NO: 69600 - DNA, 20 bp, Artificial Sequence
  Description of Artificial Sequence: Synthetic oligonucleotide
  Target: SCN9A; (-) strand; PAM type: YTN; PAM sequence: TTA
ctccttaatgattcaagaac

SEQ ID NO: 69601 - DNA, 20 bp, Artificial Sequence
  Description of Artificial Sequence: Synthetic oligonucleotide
  Target: SCN9A; (-) strand; PAM type: YTN; PAM sequence: TTT
actccttaatgattcaagaa

SEQ ID NO: 69602 - DNA, 20 bp, Artificial Sequence
  Description of Artificial Sequence: Synthetic oligonucleotide
  Target: SCN9A; (-) strand; PAM type: YTN; PAM sequence: TTT
tactccttaatgattcaaga

SEQ ID NO: 69603 - DNA, 20 bp, Artificial Sequence
  Description of Artificial Sequence: Synthetic oligonucleotide
  Target: SCN9A; (-) strand; PAM type: YTN; PAM sequence: CTA
ttttactccttaatgattca

SEQ ID NO: 69604 - DNA, 20 bp, Artificial Sequence
  Description of Artificial Sequence: Synthetic oligonucleotide
  Target: SCN9A; (-) strand; PAM type: YTN; PAM sequence: TTA
ctattttactccttaatgat

SEQ ID NO: 69605 - DNA, 20 bp, Artificial Sequence
  Description of Artificial Sequence: Synthetic oligonucleotide
  Target: SCN9A; (-) strand; PAM type: YTN; PAM sequence: TTT
actattttactccttaatga

SEQ ID NO: 69606 - DNA, 20 bp, Artificial Sequence
  Description of Artificial Sequence: Synthetic oligonucleotide
  Target: SCN9A; (-) strand; PAM type: YTN; PAM sequence: TTG
aaatttactattttactcct

SEQ ID NO: 69607 - DNA, 20 bp, Artificial Sequence
  Description of Artificial Sequence: Synthetic oligonucleotide
  Target: SCN9A; (-) strand; PAM type: YTN; PAM sequence: TTA
attgaaatttactattttac

SEQ ID NO: 69608 - DNA, 20 bp, Artificial Sequence
  Description of Artificial Sequence: Synthetic oligonucleotide
  Target: SCN9A; (-) strand; PAM type: YTN; PAM sequence: TTT
aattgaaatttactatttta

SEQ ID NO: 69609 - DNA, 20 bp, Artificial Sequence
  Description of Artificial Sequence: Synthetic oligonucleotide
  Target: SCN9A; (-) strand; PAM type: YTN; PAM sequence: CTT
taattgaaatttactatttt

SEQ ID NO: 69610 - DNA, 20 bp, Artificial Sequence
  Description of Artificial Sequence: Synthetic oligonucleotide
  Target: SCN9A; (-) strand; PAM type: YTN; PAM sequence: TTG
atcctttaattgaaatttac

SEQ ID NO: 69611 - DNA, 20 bp, Artificial Sequence
  Description of Artificial Sequence: Synthetic oligonucleotide
  Target: SCN9A; (-) strand; PAM type: YTN; PAM sequence: TTT
gatcctttaattgaaattta

SEQ ID NO: 69612 - DNA, 20 bp, Artificial Sequence
  Description of Artificial Sequence: Synthetic oligonucleotide
  Target: SCN9A; (-) strand; PAM type: YTN; PAM sequence: CTT
tgatcctttaattgaaattt

SEQ ID NO: 69613 - DNA, 20 bp, Artificial Sequence
  Description of Artificial Sequence: Synthetic oligonucleotide
  Target: SCN9A; (-) strand; PAM type: YTN; PAM sequence: CTC
aaaggatcctttgatccttt

SEQ ID NO: 69614 - DNA, 20 bp, Artificial Sequence
  Description of Artificial Sequence: Synthetic oligonucleotide
  Target: SCN9A; (-) strand; PAM type: YTN; PAM sequence: TTC
tcaaaggatcctttgatcct

SEQ ID NO: 69615 - DNA, 20 bp, Artificial Sequence
  Description of Artificial Sequence: Synthetic oligonucleotide
  Target: SCN9A; (-) strand; PAM type: YTN; PAM sequence: CTT
ctcaaaggatcctttgatcc

SEQ ID NO: 69616 - DNA, 20 bp, Artificial Sequence
  Description of Artificial Sequence: Synthetic oligonucleotide
  Target: SCN9A; (-) strand; PAM type: YTN; PAM sequence: TTC
ttctcaaaggatcctttgat

SEQ ID NO: 69617 - DNA, 20 bp, Artificial Sequence
  Description of Artificial Sequence: Synthetic oligonucleotide
  Target: SCN9A; (-) strand; PAM type: YTN; PAM sequence: TTT
cttctcaaaggatcctttga

SEQ ID NO: 69618 - DNA, 20 bp, Artificial Sequence
  Description of Artificial Sequence: Synthetic oligonucleotide
  Target: SCN9A; (-) strand; PAM type: YTN; PAM sequence: CTA
tgtgtggatttcttctcaaa

SEQ ID NO: 69619 - DNA, 20 bp, Artificial Sequence
  Description of Artificial Sequence: Synthetic oligonucleotide
  Target: SCN9A; (-) strand; PAM type: YTN; PAM sequence: TTA
tgccacatagtaactatgtg

SEQ ID NO: 69620 - DNA, 20 bp, Artificial Sequence
  Description of Artificial Sequence: Synthetic oligonucleotide
  Target: SCN9A; (-) strand; PAM type: YTN; PAM sequence: CTT
atgccacatagtaactatgt

SEQ ID NO: 69621 - DNA, 20 bp, Artificial Sequence
  Description of Artificial Sequence: Synthetic oligonucleotide
  Target: SCN9A; (-) strand; PAM type: YTN; PAM sequence: CTC
ttatgccacatagtaactat

SEQ ID NO: 69622 - DNA, 20 bp, Artificial Sequence
  Description of Artificial Sequence: Synthetic oligonucleotide
  Target: SCN9A; (-) strand; PAM type: YTN; PAM sequence: TTG
gactcttatgccacatagta

SEQ ID NO: 69623 - DNA, 20 bp, Artificial Sequence
  Description of Artificial Sequence: Synthetic oligonucleotide
  Target: SCN9A; (-) strand; PAM type: YTN; PAM sequence: TTG
gaaaatattggactcttatg

SEQ ID NO: 69624 - DNA, 20 bp, Artificial Sequence
  Description of Artificial Sequence: Synthetic oligonucleotide
  Target: SCN9A; (-) strand; PAM type: YTN; PAM sequence: CTT
ggaaaatattggactcttat

SEQ ID NO: 69625 - DNA, 20 bp, Artificial Sequence
  Description of Artificial Sequence: Synthetic oligonucleotide
  Target: SCN9A; (-) strand; PAM type: YTN; PAM sequence: CTG
taacataatgggaaacttgg

SEQ ID NO: 69626 - DNA, 20 bp, Artificial Sequence
  Description of Artificial Sequence: Synthetic oligonucleotide
  Target: SCN9A; (-) strand; PAM type: YTN; PAM sequence: TTG
tcctgtaacataatgggaaa

SEQ ID NO: 69627 - DNA, 20 bp, Artificial Sequence
  Description of Artificial Sequence: Synthetic oligonucleotide
  Target: SCN9A; (-) strand; PAM type: YTN; PAM sequence: CTA
gttgtcctgtaacataatgg

SEQ ID NO: 69628 - DNA, 20 bp, Artificial Sequence
  Description of Artificial Sequence: Synthetic oligonucleotide
  Target: SCN9A; (-) strand; PAM type: YTN; PAM sequence: TTA
aacatctagttgtcctgtaa

SEQ ID NO: 69629 - DNA, 20 bp, Artificial Sequence
  Description of Artificial Sequence: Synthetic oligonucleotide
  Target: SCN9A; (-) strand; PAM type: YTN; PAM sequence: TTT
aaacatctagttgtcctgta

SEQ ID NO: 69630 - DNA, 20 bp, Artificial Sequence
  Description of Artificial Sequence: Synthetic oligonucleotide
  Target: SCN9A; (-) strand; PAM type: YTN; PAM sequence: CTA
caccagaagagagtatttaa

SEQ ID NO: 69631 - DNA, 20 bp, Artificial Sequence
  Description of Artificial Sequence: Synthetic oligonucleotide
  Target: SCN9A; (-) strand; PAM type: YTN; PAM sequence: TTC
tacaccagaagagagtattt

SEQ ID NO: 69632 - DNA, 20 bp, Artificial Sequence
  Description of Artificial Sequence: Synthetic oligonucleotide
  Target: SCN9A; (-) strand; PAM type: YTN; PAM sequence: TTG
ttctacaccagaagagagta

SEQ ID NO: 69633 - DNA, 20 bp, Artificial Sequence
  Description of Artificial Sequence: Synthetic oligonucleotide
  Target: SCN9A; (-) strand; PAM type: YTN; PAM sequence: TTT
gttctacaccagaagagagt

SEQ ID NO: 69634 - DNA, 20 bp, Artificial Sequence
  Description of Artificial Sequence: Synthetic oligonucleotide
  Target: SCN9A; (-) strand; PAM type: YTN; PAM sequence: TTT
tgttctacaccagaagagag

SEQ ID NO: 69635 - DNA, 20 bp, Artificial Sequence
  Description of Artificial Sequence: Synthetic oligonucleotide
  Target: SCN9A; (-) strand; PAM type: YTN; PAM sequence: TTT
ttgttctacaccagaagaga

SEQ ID NO: 69636 - DNA, 20 bp, Artificial Sequence
  Description of Artificial Sequence: Synthetic oligonucleotide
  Target: SCN9A; (-) strand; PAM type: YTN; PAM sequence: TTA
tttttgttctacaccagaag

SEQ ID NO: 69637 - DNA, 20 bp, Artificial Sequence
  Description of Artificial Sequence: Synthetic oligonucleotide
  Target: SCN9A; (-) strand; PAM type: YTN; PAM sequence: TTG
caagagagaagaaaggttat

SEQ ID NO: 69638 - DNA, 20 bp, Artificial Sequence
  Description of Artificial Sequence: Synthetic oligonucleotide
  Target: SCN9A; (-) strand; PAM type: YTN; PAM sequence: CTG
aatgattgcaagagagaaga

SEQ ID NO: 69639 - DNA, 20 bp, Artificial Sequence
  Description of Artificial Sequence: Synthetic oligonucleotide
  Target: SCN9A; (-) strand; PAM type: YTN; PAM sequence: CTC
cagaaggaaaaaaataaagg

SEQ ID NO: 69640 - DNA, 20 bp, Artificial Sequence
  Description of Artificial Sequence: Synthetic oligonucleotide
  Target: SCN9A; (-) strand; PAM type: YTN; PAM sequence: TTC
tccagaaggaaaaaaataaa

SEQ ID NO: 69641 - DNA, 20 bp, Artificial Sequence
  Description of Artificial Sequence: Synthetic oligonucleotide
  Target: SCN9A; (-) strand; PAM type: YTN; PAM sequence: TTT
ctccagaaggaaaaaaataa

SEQ ID NO: 69642 - DNA, 20 bp, Artificial Sequence
  Description of Artificial Sequence: Synthetic oligonucleotide
  Target: SCN9A; (-) strand; PAM type: YTN; PAM sequence: TTC
acatttctccagaaggaaaa

SEQ ID NO: 69643 - DNA, 20 bp, Artificial Sequence
  Description of Artificial Sequence: Synthetic oligonucleotide
  Target: SCN9A; (-) strand; PAM type: YTN; PAM sequence: CTA
taagaggataatgttcacat

SEQ ID NO: 69644 - DNA, 20 bp, Artificial Sequence
  Description of Artificial Sequence: Synthetic oligonucleotide
  Target: SCN9A; (-) strand; PAM type: YTN; PAM sequence: CTC
tataagaggataatgttcac

SEQ ID NO: 69645 - DNA, 20 bp, Artificial Sequence
  Description of Artificial Sequence: Synthetic oligonucleotide
  Target: SCN9A; (-) strand; PAM type: YTN; PAM sequence: TTA
aaaactctataagaggataa

SEQ ID NO: 69646 - DNA, 20 bp, Artificial Sequence
  Description of Artificial Sequence: Synthetic oligonucleotide
  Target: SCN9A; (-) strand; PAM type: YTN; PAM sequence: TTT
aaaaactctataagaggata

SEQ ID NO: 69647 - DNA, 20 bp, Artificial Sequence
  Description of Artificial Sequence: Synthetic oligonucleotide
  Target: SCN9A; (-) strand; PAM type: YTN; PAM sequence: TTT
taaaaactctataagaggat

SEQ ID NO: 69648 - DNA, 20 bp, Artificial Sequence
  Description of Artificial Sequence: Synthetic oligonucleotide
  Target: SCN9A; (-) strand; PAM type: YTN; PAM sequence: CTC
caattttaaaaactctataa

SEQ ID NO: 69649 - DNA, 20 bp, Artificial Sequence
  Description of Artificial Sequence: Synthetic oligonucleotide
  Target: SCN9A; (-) strand; PAM type: YTN; PAM sequence: TTA
atgacctccaattttaaaaa

SEQ ID NO: 69650 - DNA, 20 bp, Artificial Sequence
  Description of Artificial Sequence: Synthetic oligonucleotide
  Target: SCN9A; (-) strand; PAM type: YTN; PAM sequence: CTA
atagtaatatcaataatatt

SEQ ID NO: 69651 - DNA, 20 bp, Artificial Sequence
  Description of Artificial Sequence: Synthetic oligonucleotide
  Target: SCN9A; (-) strand; PAM type: YTN; PAM sequence: CTC
aagatgaaaagcactaatag

SEQ ID NO: 69652 - DNA, 20 bp, Artificial Sequence
  Description of Artificial Sequence: Synthetic oligonucleotide
  Target: SCN9A; (-) strand; PAM type: YTN; PAM sequence: TTA
cactcaagatgaaaagcact

SEQ ID NO: 69653 - DNA, 20 bp, Artificial Sequence
  Description of Artificial Sequence: Synthetic oligonucleotide
  Target: SCN9A; (-) strand; PAM type: YTN; PAM sequence: TTA
agaaatgtgattacactcaa

SEQ ID NO: 69654 - DNA, 20 bp, Artificial Sequence
  Description of Artificial Sequence: Synthetic oligonucleotide
  Target: SCN9A; (-) strand; PAM type: YTN; PAM sequence: CTA
aatcatgttaagaaatgtga

SEQ ID NO: 69655 - DNA, 20 bp, Artificial Sequence
  Description of Artificial Sequence: Synthetic oligonucleotide
  Target: SCN9A; (-) strand; PAM type: YTN; PAM sequence: CTC
aaggggcccagaaatctaaa

SEQ ID NO: 69656 - DNA, 20 bp, Artificial Sequence
  Description of Artificial Sequence: Synthetic oligonucleotide
  Target: SCN9A; (-) strand; PAM type: YTN; PAM sequence: TTG
tagagacctcaaggggccca

SEQ ID NO: 69657 - DNA, 20 bp, Artificial Sequence
  Description of Artificial Sequence: Synthetic oligonucleotide
  Target: SCN9A; (-) strand; PAM type: YTN; PAM sequence: TTC
atatcaaaaaaaaaagattg

SEQ ID NO: 69658 - DNA, 20 bp, Artificial Sequence
  Description of Artificial Sequence: Synthetic oligonucleotide
  Target: SCN9A; (-) strand; PAM type: YTN; PAM sequence: TTT
catatcaaaaaaaaaagatt

SEQ ID NO: 69659 - DNA, 20 bp, Artificial Sequence
  Description of Artificial Sequence: Synthetic oligonucleotide
  Target: SCN9A; (-) strand; PAM type: YTN; PAM sequence: TTG
agaaatttcatatcaaaaaa

SEQ ID NO: 69660 - DNA, 20 bp, Artificial Sequence
  Description of Artificial Sequence: Synthetic oligonucleotide
  Target: SCN9A; (-) strand; PAM type: YTN; PAM sequence: CTT
gagaaatttcatatcaaaaa

SEQ ID NO: 69661 - DNA, 20 bp, Artificial Sequence
  Description of Artificial Sequence: Synthetic oligonucleotide
  Target: SCN9A; (-) strand; PAM type: YTN; PAM sequence: TTA
aaaagaatcttgagaaattt

SEQ ID NO: 69662 - DNA, 20 bp, Artificial Sequence
  Description of Artificial Sequence: Synthetic oligonucleotide
  Target: SCN9A; (-) strand; PAM type: YTN; PAM sequence: TTT
aaaaagaatcttgagaaatt

SEQ ID NO: 69663 - DNA, 20 bp, Artificial Sequence
  Description of Artificial Sequence: Synthetic oligonucleotide
  Target: SCN9A; (-) strand; PAM type: YTN; PAM sequence: TTT
taaaaagaatcttgagaaat

SEQ ID NO: 69664 - DNA, 20 bp, Artificial Sequence
  Description of Artificial Sequence: Synthetic oligonucleotide
  Target: SCN9A; (-) strand; PAM type: YTN; PAM sequence: CTT
ttaaaaagaatcttgagaaa

SEQ ID NO: 69665 - DNA, 20 bp, Artificial Sequence
  Description of Artificial Sequence: Synthetic oligonucleotide
  Target: SCN9A; (-) strand; PAM type: YTN; PAM sequence: TTA
ccttttaaaaagaatcttga

SEQ ID NO: 69666 - DNA, 20 bp, Artificial Sequence
  Description of Artificial Sequence: Synthetic oligonucleotide
  Target: SCN9A; (-) strand; PAM type: YTN; PAM sequence: TTG
aggcattaccttttaaaaag

SEQ ID NO: 69667 - DNA, 20 bp, Artificial Sequence
  Description of Artificial Sequence: Synthetic oligonucleotide
  Target: SCN9A; (-) strand; PAM type: YTN; PAM sequence: CTT
gaggcattaccttttaaaaa

SEQ ID NO: 69668 - DNA, 20 bp, Artificial Sequence
  Description of Artificial Sequence: Synthetic oligonucleotide
  Target: SCN9A; (-) strand; PAM type: YTN; PAM sequence: TTA
acttgaggcattacctttta

SEQ ID NO: 69669 - DNA, 20 bp, Artificial Sequence
  Description of Artificial Sequence: Synthetic oligonucleotide
  Target: SCN9A; (-) strand; PAM type: YTN; PAM sequence: TTT
aacttgaggcattacctttt

SEQ ID NO: 69670 - DNA, 20 bp, Artificial Sequence
  Description of Artificial Sequence: Synthetic oligonucleotide
  Target: SCN9A; (-) strand; PAM type: YTN; PAM sequence: TTT
taacttgaggcattaccttt

SEQ ID NO: 69671 - DNA, 20 bp, Artificial Sequence
  Description of Artificial Sequence: Synthetic oligonucleotide
  Target: SCN9A; (-) strand; PAM type: YTN; PAM sequence: TTT
ttaacttgaggcattacctt

SEQ ID NO: 69672 - DNA, 20 bp, Artificial Sequence
  Description of Artificial Sequence: Synthetic oligonucleotide
  Target: SCN9A; (-) strand; PAM type: YTN; PAM sequence: TTT
tttaacttgaggcattacct

SEQ ID NO: 69673 - DNA, 20 bp, Artificial Sequence
  Description of Artificial Sequence: Synthetic oligonucleotide
  Target: SCN9A; (-) strand; PAM type: YTN; PAM sequence: TTC
agtgattttttaacttgagg

SEQ ID NO: 69674 - DNA, 20 bp, Artificial Sequence
  Description of Artificial Sequence: Synthetic oligonucleotide
  Target: SCN9A; (-) strand; PAM type: YTN; PAM sequence: CTT
cagtgattttttaacttgag

SEQ ID NO: 69675 - DNA, 20 bp, Artificial Sequence
  Description of Artificial Sequence: Synthetic oligonucleotide
  Target: SCN9A; (-) strand; PAM type: YTN; PAM sequence: CTG
agcttcagtgattttttaac

SEQ ID NO: 69676 - DNA, 20 bp, Artificial Sequence
  Description of Artificial Sequence: Synthetic oligonucleotide
  Target: SCN9A; (-) strand; PAM type: YTN; PAM sequence: TTC
ctgagcttcagtgatttttt

SEQ ID NO: 69677 - DNA, 20 bp, Artificial Sequence
  Description of Artificial Sequence: Synthetic oligonucleotide
  Target: SCN9A; (-) strand; PAM type: YTN; PAM sequence: CTG
aaattcctgagcttcagtga

SEQ ID NO: 69678 - DNA, 20 bp, Artificial Sequence
  Description of Artificial Sequence: Synthetic oligonucleotide
  Target: SCN9A; (-) strand; PAM type: YTN; PAM sequence: TTC
ctgaaattcctgagcttcag

SEQ ID NO: 69679 - DNA, 20 bp, Artificial Sequence
  Description of Artificial Sequence: Synthetic oligonucleotide
  Target: SCN9A; (-) strand; PAM type: YTN; PAM sequence: TTT
cctgaaattcctgagcttca

SEQ ID NO: 69680 - DNA, 20 bp, Artificial Sequence
  Description of Artificial Sequence: Synthetic oligonucleotide
  Target: SCN9A; (-) strand; PAM type: YTN; PAM sequence: TTT
tcctgaaattcctgagcttc

SEQ ID NO: 69681 - DNA, 20 bp, Artificial Sequence
  Description of Artificial Sequence: Synthetic oligonucleotide
  Target: SCN9A; (-) strand; PAM type: YTN; PAM sequence: TTT
ttcctgaaattcctgagctt

SEQ ID NO: 69682 - DNA, 20 bp, Artificial Sequence
  Description of Artificial Sequence: Synthetic oligonucleotide
  Target: SCN9A; (-) strand; PAM type: YTN; PAM sequence: TTT
tttcctgaaattcctgagct

SEQ ID NO: 69683 - DNA, 20 bp, Artificial Sequence
  Description of Artificial Sequence: Synthetic oligonucleotide
  Target: SCN9A; (-) strand; PAM type: YTN; PAM sequence: TTT
ttttcctgaaattcctgagc

SEQ ID NO: 69684 - DNA, 20 bp, Artificial Sequence
  Description of Artificial Sequence: Synthetic oligonucleotide
  Target: SCN9A; (-) strand; PAM type: YTN; PAM sequence: TTC
catttttttcctgaaattcc

SEQ ID NO: 69685 - DNA, 20 bp, Artificial Sequence
  Description of Artificial Sequence: Synthetic oligonucleotide
  Target: SCN9A; (-) strand; PAM type: YTN; PAM sequence: TTT
ccatttttttcctgaaattc

SEQ ID NO: 69686 - DNA, 20 bp, Artificial Sequence
  Description of Artificial Sequence: Synthetic oligonucleotide
  Target: SCN9A; (-) strand; PAM type: YTN; PAM sequence: TTA
tttccatttttttcctgaaa

SEQ ID NO: 69687 - DNA, 20 bp, Artificial Sequence
  Description of Artificial Sequence: Synthetic oligonucleotide
  Target: SCN9A; (-) strand; PAM type: YTN; PAM sequence: TTA
attatttccatttttttcct

SEQ ID NO: 69688 - DNA, 20 bp, Artificial Sequence
  Description of Artificial Sequence: Synthetic oligonucleotide
  Target: SCN9A; (-) strand; PAM type: YTN; PAM sequence: TTT
aattatttccatttttttcc

SEQ ID NO: 69689 - DNA, 20 bp, Artificial Sequence
  Description of Artificial Sequence: Synthetic oligonucleotide
  Target: SCN9A; (-) strand; PAM type: YTN; PAM sequence: TTT
taattatttccatttttttc

SEQ ID NO: 69690 - DNA, 20 bp, Artificial Sequence
  Description of Artificial Sequence: Synthetic oligonucleotide
  Target: SCN9A; (-) strand; PAM type: YTN; PAM sequence: TTT
ttaattatttccattttttt

SEQ ID NO: 69691 - DNA, 20 bp, Artificial Sequence
  Description of Artificial Sequence: Synthetic oligonucleotide
  Target: SCN9A; (-) strand; PAM type: YTN; PAM sequence: TTT
tttaattatttccatttttt

SEQ ID NO: 69692 - DNA, 20 bp, Artificial Sequence
  Description of Artificial Sequence: Synthetic oligonucleotide
  Target: SCN9A; (-) strand; PAM type: YTN; PAM sequence: CTG
gagtattttttaattatttc

SEQ ID NO: 69693 - DNA, 20 bp, Artificial Sequence
  Description of Artificial Sequence: Synthetic oligonucleotide
  Target: SCN9A; (-) strand; PAM type: YTN; PAM sequence: CTG
atcaataatatctggagtat

SEQ ID NO: 69694 - DNA, 20 bp, Artificial Sequence
  Description of Artificial Sequence: Synthetic oligonucleotide
  Target: SCN9A; (-) strand; PAM type: YTN; PAM sequence: TTC
cactgatcaataatatctgg

SEQ ID NO: 69695 - DNA, 20 bp, Artificial Sequence
  Description of Artificial Sequence: Synthetic oligonucleotide
  Target: SCN9A; (-) strand; PAM type: YTN; PAM sequence: TTT
ccactgatcaataatatctg

SEQ ID NO: 69696 - DNA, 20 bp, Artificial Sequence
  Description of Artificial Sequence: Synthetic oligonucleotide
  Target: SCN9A; (-) strand; PAM type: YTN; PAM sequence: TTT
tccactgatcaataatatct

SEQ ID NO: 69697 - DNA, 20 bp, Artificial Sequence
  Description of Artificial Sequence: Synthetic oligonucleotide
  Target: SCN9A; (-) strand; PAM type: YTN; PAM sequence: TTG
agttttccactgatcaataa

SEQ ID NO: 69698 - DNA, 20 bp, Artificial Sequence
  Description of Artificial Sequence: Synthetic oligonucleotide
  Target: SCN9A; (-) strand; PAM type: YTN; PAM sequence: TTA
gacaacagaagaaaatacag

SEQ ID NO: 69699 - DNA, 20 bp, Artificial Sequence
  Description of Artificial Sequence: Synthetic oligonucleotide
  Target: SCN9A; (-) strand; PAM type: YTN; PAM sequence: CTT
agacaacagaagaaaataca

SEQ ID NO: 69700 - DNA, 20 bp, Artificial Sequence
  Description of Artificial Sequence: Synthetic oligonucleotide
  Target: SCN9A; (-) strand; PAM type: YTN; PAM sequence: TTA
aaacttagacaacagaagaa

SEQ ID NO: 69701 - DNA, 20 bp, Artificial Sequence
  Description of Artificial Sequence: Synthetic oligonucleotide
  Target: SCN9A; (-) strand; PAM type: YTN; PAM sequence: TTA
gtggaagtaacattaaaact

SEQ ID NO: 69702 - DNA, 20 bp, Artificial Sequence
  Description of Artificial Sequence: Synthetic oligonucleotide
  Target: SCN9A; (-) strand; PAM type: YTN; PAM sequence: CTA
aattagtggaagtaacatta

SEQ ID NO: 69703 - DNA, 20 bp, Artificial Sequence
  Description of Artificial Sequence: Synthetic oligonucleotide
  Target: SCN9A; (-) strand; PAM type: YTN; PAM sequence: CTG
ctaaattagtggaagtaaca

SEQ ID NO: 69704 - DNA, 20 bp, Artificial Sequence
  Description of Artificial Sequence: Synthetic oligonucleotide
  Target: SCN9A; (-) strand; PAM type: YTN; PAM sequence: TTC
tgctaaattagtggaagtaa

SEQ ID NO: 69705 - DNA, 20 bp, Artificial Sequence
  Description of Artificial Sequence: Synthetic oligonucleotide
  Target: SCN9A; (-) strand; PAM type: YTN; PAM sequence: TTT
ctgctaaattagtggaagta

SEQ ID NO: 69706 - DNA, 20 bp, Artificial Sequence
  Description of Artificial Sequence: Synthetic oligonucleotide
  Target: SCN9A; (-) strand; PAM type: YTN; PAM sequence: TTT
tctgctaaattagtggaagt

SEQ ID NO: 69707 - DNA, 20 bp, Artificial Sequence
  Description of Artificial Sequence: Synthetic oligonucleotide
  Target: SCN9A; (-) strand; PAM type: YTN; PAM sequence: CTG
acaattttctgctaaattag

SEQ ID NO: 69708 - DNA, 20 bp, Artificial Sequence
  Description of Artificial Sequence: Synthetic oligonucleotide
  Target: SCN9A; (-) strand; PAM type: YTN; PAM sequence: TTA
ataaactgacaattttctgc

SEQ ID NO: 69709 - DNA, 20 bp, Artificial Sequence
  Description of Artificial Sequence: Synthetic oligonucleotide
  Target: SCN9A; (-) strand; PAM type: YTN; PAM sequence: CTA
gttaataaactgacaatttt

SEQ ID NO: 69710 - DNA, 20 bp, Artificial Sequence
  Description of Artificial Sequence: Synthetic oligonucleotide
  Target: SCN9A; (-) strand; PAM type: YTN; PAM sequence: TTG
caactagttaataaactgac

SEQ ID NO: 69711 - DNA, 20 bp, Artificial Sequence
  Description of Artificial Sequence: Synthetic oligonucleotide
  Target: SCN9A; (-) strand; PAM type: YTN; PAM sequence: TTA
ttgcaactagttaataaact

SEQ ID NO: 69712 - DNA, 20 bp, Artificial Sequence
  Description of Artificial Sequence: Synthetic oligonucleotide
  Target: SCN9A; (-) strand; PAM type: YTN; PAM sequence: TTT
attgcaactagttaataaac

SEQ ID NO: 69713 - DNA, 20 bp, Artificial Sequence
  Description of Artificial Sequence: Synthetic oligonucleotide
  Target: SCN9A; (-) strand; PAM type: YTN; PAM sequence: TTA
gaatgtgagcccagaattta

SEQ ID NO: 69714 - DNA, 20 bp, Artificial Sequence
  Description of Artificial Sequence: Synthetic oligonucleotide
  Target: SCN9A; (-) strand; PAM type: YTN; PAM sequence: TTG
cccataattagaatgtgagc

SEQ ID NO: 69715 - DNA, 20 bp, Artificial Sequence
  Description of Artificial Sequence: Synthetic oligonucleotide
  Target: SCN9A; (-) strand; PAM type: YTN; PAM sequence: TTA
gttgcccataattagaatgt

SEQ ID NO: 69716 - DNA, 20 bp, Artificial Sequence
  Description of Artificial Sequence: Synthetic oligonucleotide
  Target: SCN9A; (-) strand; PAM type: YTN; PAM sequence: TTT
agttgcccataattagaatg

SEQ ID NO: 69717 - DNA, 20 bp, Artificial Sequence
  Description of Artificial Sequence: Synthetic oligonucleotide
  Target: SCN9A; (-) strand; PAM type: YTN; PAM sequence: TTT
tagttgcccataattagaat

SEQ ID NO: 69718 - DNA, 20 bp, Artificial Sequence
  Description of Artificial Sequence: Synthetic oligonucleotide
  Target: SCN9A; (-) strand; PAM type: YTN; PAM sequence: CTA
aagttttagttgcccataat

SEQ ID NO: 69719 - DNA, 20 bp, Artificial Sequence
  Description of Artificial Sequence: Synthetic oligonucleotide
  Target: SCN9A; (-) strand; PAM type: YTN; PAM sequence: TTA
aaaaaagagctaaagtttta

SEQ ID NO: 69720 - DNA, 20 bp, Artificial Sequence
  Description of Artificial Sequence: Synthetic oligonucleotide
  Target: SCN9A; (-) strand; PAM type: YTN; PAM sequence: TTT
aaaaaaagagctaaagtttt

SEQ ID NO: 69721 - DNA, 20 bp, Artificial Sequence
  Description of Artificial Sequence: Synthetic oligonucleotide
  Target: SCN9A; (-) strand; PAM type: YTN; PAM sequence: TTT
taaaaaaagagctaaagttt

SEQ ID NO: 69722 - DNA, 20 bp, Artificial Sequence
  Description of Artificial Sequence: Synthetic oligonucleotide
  Target: SCN9A; (-) strand; PAM type: YTN; PAM sequence: TTT
ttaaaaaaagagctaaagtt

SEQ ID NO: 69723 - DNA, 20 bp, Artificial Sequence
  Description of Artificial Sequence: Synthetic oligonucleotide
  Target: SCN9A; (-) strand; PAM type: YTN; PAM sequence: TTT
tttaaaaaaagagctaaagt

SEQ ID NO: 69724 - DNA, 20 bp, Artificial Sequence
  Description of Artificial Sequence: Synthetic oligonucleotide
  Target: SCN9A; (-) strand; PAM type: YTN; PAM sequence: TTT
ttttaaaaaaagagctaaag

SEQ ID NO: 69725 - DNA, 20 bp, Artificial Sequence
  Description of Artificial Sequence: Synthetic oligonucleotide
  Target: SCN9A; (-) strand; PAM type: YTN; PAM sequence: CTT
tttttaaaaaaagagctaaa

SEQ ID NO: 69726 - DNA, 20 bp, Artificial Sequence
  Description of Artificial Sequence: Synthetic oligonucleotide
  Target: SCN9A; (-) strand; PAM type: YTN; PAM sequence: TTG
ccctttttttaaaaaaagag

SEQ ID NO: 69727 - DNA, 20 bp, Artificial Sequence
  Description of Artificial Sequence: Synthetic oligonucleotide
  Target: SCN9A; (-) strand; PAM type: YTN; PAM sequence: CTT
gccctttttttaaaaaaaga

SEQ ID NO: 69728 - DNA, 20 bp, Artificial Sequence
  Description of Artificial Sequence: Synthetic oligonucleotide
  Target: SCN9A; (-) strand; PAM type: YTN; PAM sequence: TTC
ttgccctttttttaaaaaaa

SEQ ID NO: 69729 - DNA, 20 bp, Artificial Sequence
  Description of Artificial Sequence: Synthetic oligonucleotide
  Target: SCN9A; (-) strand; PAM type: YTN; PAM sequence: TTT
cttgccctttttttaaaaaa

SEQ ID NO: 69730 - DNA, 20 bp, Artificial Sequence
  Description of Artificial Sequence: Synthetic oligonucleotide
  Target: SCN9A; (-) strand; PAM type: YTN; PAM sequence: TTT
tcttgccctttttttaaaaa

SEQ ID NO: 69731 - DNA, 20 bp, Artificial Sequence
  Description of Artificial Sequence: Synthetic oligonucleotide
  Target: SCN9A; (-) strand; PAM type: YTN; PAM sequence: TTG
gttttcttgcccttttttta

SEQ ID NO: 69732 - DNA, 20 bp, Artificial Sequence
  Description of Artificial Sequence: Synthetic oligonucleotide
  Target: SCN9A; (-) strand; PAM type: YTN; PAM sequence: CTA
gcaatagacaaagaaaaata

SEQ ID NO: 69733 - DNA, 20 bp, Artificial Sequence
  Description of Artificial Sequence: Synthetic oligonucleotide
  Target: SCN9A; (-) strand; PAM type: YTN; PAM sequence: CTG
ctagcaatagacaaagaaaa

SEQ ID NO: 69734 - DNA, 20 bp, Artificial Sequence
  Description of Artificial Sequence: Synthetic oligonucleotide
  Target: SCN9A; (-) strand; PAM type: YTN; PAM sequence: CTC
tgctagcaatagacaaagaa

SEQ ID NO: 69735 - DNA, 20 bp, Artificial Sequence
  Description of Artificial Sequence: Synthetic oligonucleotide
  Target: SCN9A; (-) strand; PAM type: YTN; PAM sequence: TTC
tctgctagcaatagacaaag

SEQ ID NO: 69736 - DNA, 20 bp, Artificial Sequence
  Description of Artificial Sequence: Synthetic oligonucleotide
  Target: SCN9A; (-) strand; PAM type: YTN; PAM sequence: TTT
ctctgctagcaatagacaaa

SEQ ID NO: 69737 - DNA, 20 bp, Artificial Sequence
  Description of Artificial Sequence: Synthetic oligonucleotide
  Target: SCN9A; (-) strand; PAM type: YTN; PAM sequence: CTA
cacaatatttctctgctagc

SEQ ID NO: 69738 - DNA, 20 bp, Artificial Sequence
  Description of Artificial Sequence: Synthetic oligonucleotide
  Target: SCN9A; (-) strand; PAM type: YTN; PAM sequence: CTC
ccagagcctacacaatattt

SEQ ID NO: 69739 - DNA, 20 bp, Artificial Sequence
  Description of Artificial Sequence: Synthetic oligonucleotide
  Target: SCN9A; (-) strand; PAM type: YTN; PAM sequence: TTC
ctcccagagcctacacaata

SEQ ID NO: 69740 - DNA, 20 bp, Artificial Sequence
  Description of Artificial Sequence: Synthetic oligonucleotide
  Target: SCN9A; (-) strand; PAM type: YTN; PAM sequence: CTA
ttcctcccagagcctacaca

SEQ ID NO: 69741 - DNA, 20 bp, Artificial Sequence
  Description of Artificial Sequence: Synthetic oligonucleotide
  Target: SCN9A; (-) strand; PAM type: YTN; PAM sequence: CTG
aataagtagctattcctccc

SEQ ID NO: 69742 - DNA, 20 bp, Artificial Sequence
  Description of Artificial Sequence: Synthetic oligonucleotide
  Target: SCN9A; (-) strand; PAM type: YTN; PAM sequence: TTC
acgctgaataagtagctatt

SEQ ID NO: 69743 - DNA, 20 bp, Artificial Sequence
  Description of Artificial Sequence: Synthetic oligonucleotide
  Target: SCN9A; (-) strand; PAM type: YTN; PAM sequence: TTT
cacgctgaataagtagctat

SEQ ID NO: 69744 - DNA, 20 bp, Artificial Sequence
  Description of Artificial Sequence: Synthetic oligonucleotide
  Target: SCN9A; (-) strand; PAM type: YTN; PAM sequence: CTG
tgtgtttcacgctgaataag

SEQ ID NO: 69745 - DNA, 20 bp, Artificial Sequence
  Description of Artificial Sequence: Synthetic oligonucleotide
  Target: SCN9A; (-) strand; PAM type: YTN; PAM sequence: TTG
tgatggaactgtgtgtttca

SEQ ID NO: 69746 - DNA, 20 bp, Artificial Sequence
  Description of Artificial Sequence: Synthetic oligonucleotide
  Target: SCN9A; (-) strand; PAM type: YTN; PAM sequence: CTT
gtgatggaactgtgtgtttc

SEQ ID NO: 69747 - DNA, 20 bp, Artificial Sequence
  Description of Artificial Sequence: Synthetic oligonucleotide
  Target: SCN9A; (-) strand; PAM type: YTN; PAM sequence: TTG
accttgtgatggaactgtgt

SEQ ID NO: 69748 - DNA, 20 bp, Artificial Sequence
  Description of Artificial Sequence: Synthetic oligonucleotide
  Target: SCN9A; (-) strand; PAM type: YTN; PAM sequence: CTA
tatatcatgttgaccttgtg

SEQ ID NO: 69749 - DNA, 20 bp, Artificial Sequence
  Description of Artificial Sequence: Synthetic oligonucleotide
  Target: SCN9A; (-) strand; PAM type: YTN; PAM sequence: TTC
accaacagaatactatatat

SEQ ID NO: 69750 - DNA, 20 bp, Artificial Sequence
  Description of Artificial Sequence: Synthetic oligonucleotide
  Target: SCN9A; (-) strand; PAM type: YTN; PAM sequence: TTT
caccaacagaatactatata

SEQ ID NO: 69751 - DNA, 20 bp, Artificial Sequence
  Description of Artificial Sequence: Synthetic oligonucleotide
  Target: SCN9A; (-) strand; PAM type: YTN; PAM sequence: TTA
tttcaccaacagaatactat

SEQ ID NO: 69752 - DNA, 20 bp, Artificial Sequence
  Description of Artificial Sequence: Synthetic oligonucleotide
  Target: SCN9A; (-) strand; PAM type: YTN; PAM sequence: CTC
attatttcaccaacagaata

SEQ ID NO: 69753 - DNA, 20 bp, Artificial Sequence
  Description of Artificial Sequence: Synthetic oligonucleotide
  Target: SCN9A; (-) strand; PAM type: YTN; PAM sequence: TTG
acctcattatttcaccaaca

SEQ ID NO: 69754 - DNA, 20 bp, Artificial Sequence
  Description of Artificial Sequence: Synthetic oligonucleotide
  Target: SCN9A; (-) strand; PAM type: YTN; PAM sequence: TTT
gacctcattatttcaccaac

SEQ ID NO: 69755 - DNA, 20 bp, Artificial Sequence
  Description of Artificial Sequence: Synthetic oligonucleotide
  Target: SCN9A; (-) strand; PAM type: YTN; PAM sequence: CTG
agatttgacctcattatttc

SEQ ID NO: 69756 - DNA, 20 bp, Artificial Sequence
  Description of Artificial Sequence: Synthetic oligonucleotide
  Target: SCN9A; (-) strand; PAM type: YTN; PAM sequence: CTG
gtggtggctgagatttgacc

SEQ ID NO: 69757 - DNA, 20 bp, Artificial Sequence
  Description of Artificial Sequence: Synthetic oligonucleotide
  Target: SCN9A; (-) strand; PAM type: YTN; PAM sequence: CTC
tggtggtggctgagatttga

SEQ ID NO: 69758 - DNA, 20 bp, Artificial Sequence
  Description of Artificial Sequence: Synthetic oligonucleotide
  Target: SCN9A; (-) strand; PAM type: YTN; PAM sequence: TTC
tctggtggtggctgagattt

SEQ ID NO: 69759 - DNA, 20 bp, Artificial Sequence
  Description of Artificial Sequence: Synthetic oligonucleotide
  Target: SCN9A; (-) strand; PAM type: YTN; PAM sequence: TTT
ctctggtggtggctgagatt

SEQ ID NO: 69760 - DNA, 20 bp, Artificial Sequence
  Description of Artificial Sequence: Synthetic oligonucleotide
  Target: SCN9A; (-) strand; PAM type: YTN; PAM sequence: CTG
aatttctctggtggtggctg

SEQ ID NO: 69761 - DNA, 20 bp, Artificial Sequence
  Description of Artificial Sequence: Synthetic oligonucleotide
  Target: SCN9A; (-) strand; PAM type: YTN; PAM sequence: TTC
tgaatttctctggtggtggc

SEQ ID NO: 69762 - DNA, 20 bp, Artificial Sequence
  Description of Artificial Sequence: Synthetic oligonucleotide
  Target: SCN9A; (-) strand; PAM type: YTN; PAM sequence: TTA
ttctgaatttctctggtggt

SEQ ID NO: 69763 - DNA, 20 bp, Artificial Sequence
  Description of Artificial Sequence: Synthetic oligonucleotide
  Target: SCN9A; (-) strand; PAM type: YTN; PAM sequence: TTT
attctgaatttctctggtgg

SEQ ID NO: 69764 - DNA, 20 bp, Artificial Sequence
  Description of Artificial Sequence: Synthetic oligonucleotide
  Target: SCN9A; (-) strand; PAM type: YTN; PAM sequence: TTT
tattctgaatttctctggtg

SEQ ID NO: 69765 - DNA, 20 bp, Artificial Sequence
  Description of Artificial Sequence: Synthetic oligonucleotide
  Target: SCN9A; (-) strand; PAM type: YTN; PAM sequence: CTG
gttttattctgaatttctct

SEQ ID NO: 69766 - DNA, 20 bp, Artificial Sequence
  Description of Artificial Sequence: Synthetic oligonucleotide
  Target: SCN9A; (-) strand; PAM type: YTN; PAM sequence: CTC
cgtgaaatcactggttttat

SEQ ID NO: 69767 - DNA, 20 bp, Artificial Sequence
  Description of Artificial Sequence: Synthetic oligonucleotide
  Target: SCN9A; (-) strand; PAM type: YTN; PAM sequence: CTG
agaaaaagaagaggtctccg

SEQ ID NO: 69768 - DNA, 20 bp, Artificial Sequence
  Description of Artificial Sequence: Synthetic oligonucleotide
  Target: SCN9A; (-) strand; PAM type: YTN; PAM sequence: TTC
tgagaaaaagaagaggtctc

SEQ ID NO: 69769 - DNA, 20 bp, Artificial Sequence
  Description of Artificial Sequence: Synthetic oligonucleotide
  Target: SCN9A; (-) strand; PAM type: YTN; PAM sequence: CTA
ggtagaagattctgagaaaa

SEQ ID NO: 69770 - DNA, 20 bp, Artificial Sequence
  Description of Artificial Sequence: Synthetic oligonucleotide
  Target: SCN9A; (-) strand; PAM type: YTN; PAM sequence: TTG
gatagaaagtgccctaggta

SEQ ID NO: 69771 - DNA, 20 bp, Artificial Sequence
  Description of Artificial Sequence: Synthetic oligonucleotide
  Target: SCN9A; (-) strand; PAM type: YTN; PAM sequence: TTA
ttggatagaaagtgccctag

SEQ ID NO: 69772 - DNA, 20 bp, Artificial Sequence
  Description of Artificial Sequence: Synthetic oligonucleotide
  Target: SCN9A; (-) strand; PAM type: YTN; PAM sequence: TTC
atgttattggatagaaagtg

SEQ ID NO: 69773 - DNA, 20 bp, Artificial Sequence
  Description of Artificial Sequence: Synthetic oligonucleotide
  Target: SCN9A; (-) strand; PAM type: YTN; PAM sequence: TTT
catgttattggatagaaagt

SEQ ID NO: 69774 - DNA, 20 bp, Artificial Sequence
  Description of Artificial Sequence: Synthetic oligonucleotide
  Target: SCN9A; (-) strand; PAM type: YTN; PAM sequence: TTT
tcatgttattggatagaaag

SEQ ID NO: 69775 - DNA, 20 bp, Artificial Sequence
  Description of Artificial Sequence: Synthetic oligonucleotide
  Target: SCN9A; (-) strand; PAM type: YTN; PAM sequence: TTA
gtcacgtaagttttcatgtt

SEQ ID NO: 69776 - DNA, 20 bp, Artificial Sequence
  Description of Artificial Sequence: Synthetic oligonucleotide
  Target: SCN9A; (-) strand; PAM type: YTN; PAM sequence: TTT
agtcacgtaagttttcatgt

SEQ ID NO: 69777 - DNA, 20 bp, Artificial Sequence
  Description of Artificial Sequence: Synthetic oligonucleotide
  Target: SCN9A; (-) strand; PAM type: YTN; PAM sequence: TTA
tcatttagtcacgtaagttt

SEQ ID NO: 69778 - DNA, 20 bp, Artificial Sequence
  Description of Artificial Sequence: Synthetic oligonucleotide
  Target: SCN9A; (-) strand; PAM type: YTN; PAM sequence: CTT
atcatttagtcacgtaagtt

SEQ ID NO: 69779 - DNA, 20 bp, Artificial Sequence
  Description of Artificial Sequence: Synthetic oligonucleotide
  Target: SCN9A; (-) strand; PAM type: YTN; PAM sequence: TTC
atatcttatcatttagtcac

SEQ ID NO: 69780 - DNA, 20 bp, Artificial Sequence
  Description of Artificial Sequence: Synthetic oligonucleotide
  Target: SCN9A; (-) strand; PAM type: YTN; PAM sequence: TTA
tattcatatcttatcattta

SEQ ID NO: 69781 - DNA, 20 bp, Artificial Sequence
  Description of Artificial Sequence: Synthetic oligonucleotide
  Target: SCN9A; (-) strand; PAM type: YTN; PAM sequence: TTT
atattcatatcttatcattt

SEQ ID NO: 69782 - DNA, 20 bp, Artificial Sequence
  Description of Artificial Sequence: Synthetic oligonucleotide
  Target: SCN9A; (-) strand; PAM type: YTN; PAM sequence: CTT
tatattcatatcttatcatt

SEQ ID NO: 69783 - DNA, 20 bp, Artificial Sequence
  Description of Artificial Sequence: Synthetic oligonucleotide
  Target: SCN9A; (-) strand; PAM type: YTN; PAM sequence: TTC
tttatattcatatcttatca

SEQ ID NO: 69784 - DNA, 20 bp, Artificial Sequence
  Description of Artificial Sequence: Synthetic oligonucleotide
  Target: SCN9A; (-) strand; PAM type: YTN; PAM sequence: TTT
ctttatattcatatcttatc

SEQ ID NO: 69785 - DNA, 20 bp, Artificial Sequence
  Description of Artificial Sequence: Synthetic oligonucleotide
  Target: SCN9A; (-) strand; PAM type: YTN; PAM sequence: TTA
tatgatttctttatattcat

SEQ ID NO: 69786 - DNA, 20 bp, Artificial Sequence
  Description of Artificial Sequence: Synthetic oligonucleotide
  Target: SCN9A; (-) strand; PAM type: YTN; PAM sequence: TTT
atatgatttctttatattca

SEQ ID NO: 69787 - DNA, 20 bp, Artificial Sequence
  Description of Artificial Sequence: Synthetic oligonucleotide
  Target: SCN9A; (-) strand; PAM type: YTN; PAM sequence: TTT
tatatgatttctttatattc

SEQ ID NO: 69788 - DNA, 20 bp, Artificial Sequence
  Description of Artificial Sequence: Synthetic oligonucleotide
  Target: SCN9A; (-) strand; PAM type: YTN; PAM sequence: CTT
ttatatgatttctttatatt

SEQ ID NO: 69789 - DNA, 20 bp, Artificial Sequence
  Description of Artificial Sequence: Synthetic oligonucleotide
  Target: SCN9A; (-) strand; PAM type: YTN; PAM sequence: TTG
cttttatatgatttctttat

SEQ ID NO: 69790 - DNA, 20 bp, Artificial Sequence
  Description of Artificial Sequence: Synthetic oligonucleotide
  Target: SCN9A; (-) strand; PAM type: YTN; PAM sequence: TTG
ttgcttttatatgatttctt

SEQ ID NO: 69791 - DNA, 20 bp, Artificial Sequence
  Description of Artificial Sequence: Synthetic oligonucleotide
  Target: SCN9A; (-) strand; PAM type: YTN; PAM sequence: CTG
ttgttgcttttatatgattt

SEQ ID NO: 69792 - DNA, 20 bp, Artificial Sequence
  Description of Artificial Sequence: Synthetic oligonucleotide
  Target: SCN9A; (-) strand; PAM type: YTN; PAM sequence: TTA
catggccaactgttgttgct

SEQ ID NO: 69793 - DNA, 20 bp, Artificial Sequence
  Description of Artificial Sequence: Synthetic oligonucleotide
  Target: SCN9A; (-) strand; PAM type: YTN; PAM sequence: CTT
acatggccaactgttgttgc

SEQ ID NO: 69794 - DNA, 20 bp, Artificial Sequence
  Description of Artificial Sequence: Synthetic oligonucleotide
  Target: SCN9A; (-) strand; PAM type: YTN; PAM sequence: TTC
ttacatggccaactgttgtt

SEQ ID NO: 69795 - DNA, 20 bp, Artificial Sequence
  Description of Artificial Sequence: Synthetic oligonucleotide
  Target: SCN9A; (-) strand; PAM type: YTN; PAM sequence: CTT
cttacatggccaactgttgt

SEQ ID NO: 69796 - DNA, 20 bp, Artificial Sequence
  Description of Artificial Sequence: Synthetic oligonucleotide
  Target: SCN9A; (-) strand; PAM type: YTN; PAM sequence: CTA
gccttcttacatggccaact

SEQ ID NO: 69797 - DNA, 20 bp, Artificial Sequence
  Description of Artificial Sequence: Synthetic oligonucleotide
  Target: SCN9A; (-) strand; PAM type: YTN; PAM sequence: CTG
tagccagtctagccttctta

SEQ ID NO: 69798 - DNA, 20 bp, Artificial Sequence
  Description of Artificial Sequence: Synthetic oligonucleotide
  Target: SCN9A; (-) strand; PAM type: YTN; PAM sequence: CTG
agaaatctgtagccagtcta

SEQ ID NO: 69799 - DNA, 20 bp, Artificial Sequence
  Description of Artificial Sequence: Synthetic oligonucleotide
  Target: SCN9A; (-) strand; PAM type: YTN; PAM sequence: CTG
gctgagaaatctgtagccag

SEQ ID NO: 69800 - DNA, 20 bp, Artificial Sequence
  Description of Artificial Sequence: Synthetic oligonucleotide
  Target: SCN9A; (-) strand; PAM type: YTN; PAM sequence: CTA
taggacctggctgagaaatc

SEQ ID NO: 69801 - DNA, 20 bp, Artificial Sequence
  Description of Artificial Sequence: Synthetic oligonucleotide
  Target: SCN9A; (-) strand; PAM type: YTN; PAM sequence: TTC
aagatgatactataggacct

SEQ ID NO: 69802 - DNA, 20 bp, Artificial Sequence
  Description of Artificial Sequence: Synthetic oligonucleotide
  Target: SCN9A; (-) strand; PAM type: YTN; PAM sequence: CTT
caagatgatactataggacc

SEQ ID NO: 69803 - DNA, 20 bp, Artificial Sequence
  Description of Artificial Sequence: Synthetic oligonucleotide
  Target: SCN9A; (-) strand; PAM type: YTN; PAM sequence: TTA
gaaagatgcttcaagatgat

SEQ ID NO: 69804 - DNA, 20 bp, Artificial Sequence
  Description of Artificial Sequence: Synthetic oligonucleotide
  Target: SCN9A; (-) strand; PAM type: YTN; PAM sequence: TTC
attagaaagatgcttcaaga

SEQ ID NO: 69805 - DNA, 20 bp, Artificial Sequence
  Description of Artificial Sequence: Synthetic oligonucleotide
  Target: SCN9A; (-) strand; PAM type: YTN; PAM sequence: TTT
cattagaaagatgcttcaag

SEQ ID NO: 69806 - DNA, 20 bp, Artificial Sequence
  Description of Artificial Sequence: Synthetic oligonucleotide
  Target: SCN9A; (-) strand; PAM type: YTN; PAM sequence: TTT
tcattagaaagatgcttcaa

SEQ ID NO: 69807 - DNA, 20 bp, Artificial Sequence
  Description of Artificial Sequence: Synthetic oligonucleotide
  Target: SCN9A; (-) strand; PAM type: YTN; PAM sequence: CTT
ttcattagaaagatgcttca

SEQ ID NO: 69808 - DNA, 20 bp, Artificial Sequence
  Description of Artificial Sequence: Synthetic oligonucleotide
  Target: SCN9A; (-) strand; PAM type: YTN; PAM sequence: TTC
ttttcattagaaagatgctt

SEQ ID NO: 69809 - DNA, 20 bp, Artificial Sequence
  Description of Artificial Sequence: Synthetic oligonucleotide
  Target: SCN9A; (-) strand; PAM type: YTN; PAM sequence: CTT
cttttcattagaaagatgct

SEQ ID NO: 69810 - DNA, 20 bp, Artificial Sequence
  Description of Artificial Sequence: Synthetic oligonucleotide
  Target: SCN9A; (-) strand; PAM type: YTN; PAM sequence: CTC
ttcttttcattagaaagatg

SEQ ID NO: 69811 - DNA, 20 bp, Artificial Sequence
  Description of Artificial Sequence: Synthetic oligonucleotide
  Target: SCN9A; (-) strand; PAM type: YTN; PAM sequence: TTC
tcttcttttcattagaaaga

SEQ ID NO: 69812 - DNA, 20 bp, Artificial Sequence
  Description of Artificial Sequence: Synthetic oligonucleotide
  Target: SCN9A; (-) strand; PAM type: YTN; PAM sequence: CTT
ctcttcttttcattagaaag

SEQ ID NO: 69813 - DNA, 20 bp, Artificial Sequence
  Description of Artificial Sequence: Synthetic oligonucleotide
  Target: SCN9A; (-) strand; PAM type: YTN; PAM sequence: TTG
cttctcttcttttcattaga

SEQ ID NO: 69814 - DNA, 20 bp, Artificial Sequence
  Description of Artificial Sequence: Synthetic oligonucleotide
  Target: SCN9A; (-) strand; PAM type: YTN; PAM sequence: TTT
gcttctcttcttttcattag

SEQ ID NO: 69815 - DNA, 20 bp, Artificial Sequence
  Description of Artificial Sequence: Synthetic oligonucleotide
  Target: SCN9A; (-) strand; PAM type: YTN; PAM sequence: CTT
tgcttctcttcttttcatta

SEQ ID NO: 69816 - DNA, 20 bp, Artificial Sequence
  Description of Artificial Sequence: Synthetic oligonucleotide
  Target: SCN9A; (-) strand; PAM type: YTN; PAM sequence: CTC
tttgcttctcttcttttcat

SEQ ID NO: 69817 - DNA, 20 bp, Artificial Sequence
  Description of Artificial Sequence: Synthetic oligonucleotide
  Target: SCN9A; (-) strand; PAM type: YTN; PAM sequence: CTA
gctctttgcttctcttcttt

SEQ ID NO: 69818 - DNA, 20 bp, Artificial Sequence
  Description of Artificial Sequence: Synthetic oligonucleotide
  Target: SCN9A; (-) strand; PAM type: YTN; PAM sequence: CTC
ctagctctttgcttctcttc

SEQ ID NO: 69819 - DNA, 20 bp, Artificial Sequence
  Description of Artificial Sequence: Synthetic oligonucleotide
  Target: SCN9A; (-) strand; PAM type: YTN; PAM sequence: TTA
cactcctagctctttgcttc

SEQ ID NO: 69820 - DNA, 20 bp, Artificial Sequence
  Description of Artificial Sequence: Synthetic oligonucleotide
  Target: SCN9A; (-) strand; PAM type: YTN; PAM sequence: TTT
acactcctagctctttgctt

SEQ ID NO: 69821 - DNA, 20 bp, Artificial Sequence
  Description of Artificial Sequence: Synthetic oligonucleotide
  Target: SCN9A; (-) strand; PAM type: YTN; PAM sequence: CTT
tacactcctagctctttgct

SEQ ID NO: 69822 - DNA, 20 bp, Artificial Sequence
  Description of Artificial Sequence: Synthetic oligonucleotide
  Target: SCN9A; (-) strand; PAM type: YTN; PAM sequence: TTG
aatatcaatggccactttac

SEQ ID NO: 69823 - DNA, 20 bp, Artificial Sequence
  Description of Artificial Sequence: Synthetic oligonucleotide
  Target: SCN9A; (-) strand; PAM type: YTN; PAM sequence: CTT
gaatatcaatggccacttta

SEQ ID NO: 69824 - DNA, 20 bp, Artificial Sequence
  Description of Artificial Sequence: Synthetic oligonucleotide
  Target: SCN9A; (-) strand; PAM type: YTN; PAM sequence: CTG
tgacagagcacagagagagc

SEQ ID NO: 69825 - DNA, 20 bp, Artificial Sequence
  Description of Artificial Sequence: Synthetic oligonucleotide
  Target: SCN9A; (-) strand; PAM type: YTN; PAM sequence: TTC
tgtgacagagcacagagaga

SEQ ID NO: 69826 - DNA, 20 bp, Artificial Sequence
  Description of Artificial Sequence: Synthetic oligonucleotide
  Target: SCN9A; (-) strand; PAM type: YTN; PAM sequence: CTG
caaacagtgtagcagttctg

SEQ ID NO: 69827 - DNA, 20 bp, Artificial Sequence
  Description of Artificial Sequence: Synthetic oligonucleotide
  Target: SCN9A; (-) strand; PAM type: YTN; PAM sequence: CTC
tgcaaacagtgtagcagttc

SEQ ID NO: 69828 - DNA, 20 bp, Artificial Sequence
  Description of Artificial Sequence: Synthetic oligonucleotide
  Target: SCN9A; (-) strand; PAM type: YTN; PAM sequence: TTC
tctgcaaacagtgtagcagt

SEQ ID NO: 69829 - DNA, 20 bp, Artificial Sequence
  Description of Artificial Sequence: Synthetic oligonucleotide
  Target: SCN9A; (-) strand; PAM type: YTN; PAM sequence: TTT
ctctgcaaacagtgtagcag

SEQ ID NO: 69830 - DNA, 20 bp, Artificial Sequence
  Description of Artificial Sequence: Synthetic oligonucleotide
  Target: SCN9A; (-) strand; PAM type: YTN; PAM sequence: CTT
tctctgcaaacagtgtagca

SEQ ID NO: 69831 - DNA, 20 bp, Artificial Sequence
  Description of Artificial Sequence: Synthetic oligonucleotide
  Target: SCN9A; (-) strand; PAM type: YTN; PAM sequence: CTG
ctttctctgcaaacagtgta

SEQ ID NO: 69832 - DNA, 20 bp, Artificial Sequence
  Description of Artificial Sequence: Synthetic oligonucleotide
  Target: SCN9A; (-) strand; PAM type: YTN; PAM sequence: TTC
cagctgctttctctgcaaac

SEQ ID NO: 69833 - DNA, 20 bp, Artificial Sequence
  Description of Artificial Sequence: Synthetic oligonucleotide
  Target: SCN9A; (-) strand; PAM type: YTN; PAM sequence: CTG
tattccagctgctttctctg

SEQ ID NO: 69834 - DNA, 20 bp, Artificial Sequence
  Description of Artificial Sequence: Synthetic oligonucleotide
  Target: SCN9A; (-) strand; PAM type: YTN; PAM sequence: TTG
acccactgtattccagctgc

SEQ ID NO: 69835 - DNA, 20 bp, Artificial Sequence
  Description of Artificial Sequence: Synthetic oligonucleotide
  Target: SCN9A; (-) strand; PAM type: YTN; PAM sequence: CTT
gacccactgtattccagctg

SEQ ID NO: 69836 - DNA, 20 bp, Artificial Sequence
  Description of Artificial Sequence: Synthetic oligonucleotide
  Target: SCN9A; (-) strand; PAM type: YTN; PAM sequence: CTG
acttgacccactgtattcca

SEQ ID NO: 69837 - DNA, 20 bp, Artificial Sequence
  Description of Artificial Sequence: Synthetic oligonucleotide
  Target: SCN9A; (-) strand; PAM type: YTN; PAM sequence: CTC
tgacttgacccactgtattc

SEQ ID NO: 69838 - DNA, 20 bp, Artificial Sequence
  Description of Artificial Sequence: Synthetic oligonucleotide
  Target: SCN9A; (-) strand; PAM type: YTN; PAM sequence: TTA
agacactctgacttgaccca

SEQ ID NO: 69839 - DNA, 20 bp, Artificial Sequence
  Description of Artificial Sequence: Synthetic oligonucleotide
  Target: SCN9A; (-) strand; PAM type: YTN; PAM sequence: TTT
aagacactctgacttgaccc

SEQ ID NO: 69840 - DNA, 20 bp, Artificial Sequence
  Description of Artificial Sequence: Synthetic oligonucleotide
  Target: SCN9A; (-) strand; PAM type: YTN; PAM sequence: CTT
taagacactctgacttgacc

SEQ ID NO: 69841 - DNA, 20 bp, Artificial Sequence
  Description of Artificial Sequence: Synthetic oligonucleotide
  Target: SCN9A; (-) strand; PAM type: YTN; PAM sequence: CTA
aagactttaagacactctga

SEQ ID NO: 69842 - DNA, 20 bp, Artificial Sequence
  Description of Artificial Sequence: Synthetic oligonucleotide
  Target: SCN9A; (-) strand; PAM type: YTN; PAM sequence: TTC
taaagactttaagacactct

SEQ ID NO: 69843 - DNA, 20 bp, Artificial Sequence
  Description of Artificial Sequence: Synthetic oligonucleotide
  Target: SCN9A; (-) strand; PAM type: YTN; PAM sequence: CTT
ctaaagactttaagacactc

SEQ ID NO: 69844 - DNA, 20 bp, Artificial Sequence
  Description of Artificial Sequence: Synthetic oligonucleotide
  Target: SCN9A; (-) strand; PAM type: YTN; PAM sequence: TTG
cttctaaagactttaagaca

SEQ ID NO: 69845 - DNA, 20 bp, Artificial Sequence
  Description of Artificial Sequence: Synthetic oligonucleotide
  Target: SCN9A; (-) strand; PAM type: YTN; PAM sequence: TTT
gcttctaaagactttaagac

SEQ ID NO: 69846 - DNA, 20 bp, Artificial Sequence
  Description of Artificial Sequence: Synthetic oligonucleotide
  Target: SCN9A; (-) strand; PAM type: YTN; PAM sequence: TTA
aatgtttgcttctaaagact

SEQ ID NO: 69847 - DNA, 20 bp, Artificial Sequence
  Description of Artificial Sequence: Synthetic oligonucleotide
  Target: SCN9A; (-) strand; PAM type: YTN; PAM sequence: TTT
aaatgtttgcttctaaagac

SEQ ID NO: 69848 - DNA, 20 bp, Artificial Sequence
  Description of Artificial Sequence: Synthetic oligonucleotide
  Target: SCN9A; (-) strand; PAM type: YTN; PAM sequence: TTG
tttaaatgtttgcttctaaa

SEQ ID NO: 69849 - DNA, 20 bp, Artificial Sequence
  Description of Artificial Sequence: Synthetic oligonucleotide
  Target: SCN9A; (-) strand; PAM type: YTN; PAM sequence: CTG
gcataaatagcaaaattgtt

SEQ ID NO: 69850 - DNA, 20 bp, Artificial Sequence
  Description of Artificial Sequence: Synthetic oligonucleotide
  Target: SCN9A; (-) strand; PAM type: YTN; PAM sequence: TTA
agctggcataaatagcaaaa

SEQ ID NO: 69851 - DNA, 20 bp, Artificial Sequence
  Description of Artificial Sequence: Synthetic oligonucleotide
  Target: SCN9A; (-) strand; PAM type: YTN; PAM sequence: TTT
aagctggcataaatagcaaa

SEQ ID NO: 69852 - DNA, 20 bp, Artificial Sequence
  Description of Artificial Sequence: Synthetic oligonucleotide
  Target: SCN9A; (-) strand; PAM type: YTN; PAM sequence: TTT
taagctggcataaatagcaa

SEQ ID NO: 69853 - DNA, 20 bp, Artificial Sequence
  Description of Artificial Sequence: Synthetic oligonucleotide
  Target: SCN9A; (-) strand; PAM type: YTN; PAM sequence: TTT
ttaagctggcataaatagca

SEQ ID NO: 69854 - DNA, 20 bp, Artificial Sequence
  Description of Artificial Sequence: Synthetic oligonucleotide
  Target: SCN9A; (-) strand; PAM type: YTN; PAM sequence: TTT
tttaagctggcataaatagc

SEQ ID NO: 69855 - DNA, 20 bp, Artificial Sequence
  Description of Artificial Sequence: Synthetic oligonucleotide
  Target: SCN9A; (-) strand; PAM type: YTN; PAM sequence: TTT
ttttaagctggcataaatag

SEQ ID NO: 69856 - DNA, 20 bp, Artificial Sequence
  Description of Artificial Sequence: Synthetic oligonucleotide
  Target: SCN9A; (-) strand; PAM type: YTN; PAM sequence: TTG
catttttttaagctggcata

SEQ ID NO: 69857 - DNA, 20 bp, Artificial Sequence
  Description of Artificial Sequence: Synthetic oligonucleotide
  Target: SCN9A; (-) strand; PAM type: YTN; PAM sequence: TTG
ttgcatttttttaagctggc

SEQ ID NO: 69858 - DNA, 20 bp, Artificial Sequence
  Description of Artificial Sequence: Synthetic oligonucleotide
  Target: SCN9A; (-) strand; PAM type: YTN; PAM sequence: CTT
gttgcatttttttaagctgg

SEQ ID NO: 69859 - DNA, 20 bp, Artificial Sequence
  Description of Artificial Sequence: Synthetic oligonucleotide
  Target: SCN9A; (-) strand; PAM type: YTN; PAM sequence: CTA
cttgttgcatttttttaagc

SEQ ID NO: 69860 - DNA, 20 bp, Artificial Sequence
  Description of Artificial Sequence: Synthetic oligonucleotide
  Target: SCN9A; (-) strand; PAM type: YTN; PAM sequence: TTA
cctacttgttgcattttttt

SEQ ID NO: 69861 - DNA, 20 bp, Artificial Sequence
  Description of Artificial Sequence: Synthetic oligonucleotide
  Target: SCN9A; (-) strand; PAM type: YTN; PAM sequence: TTT
acctacttgttgcatttttt

SEQ ID NO: 69862 - DNA, 20 bp, Artificial Sequence
  Description of Artificial Sequence: Synthetic oligonucleotide
  Target: SCN9A; (-) strand; PAM type: YTN; PAM sequence: CTT
tacctacttgttgcattttt

SEQ ID NO: 69863 - DNA, 20 bp, Artificial Sequence
  Description of Artificial Sequence: Synthetic oligonucleotide
  Target: SCN9A; (-) strand; PAM type: YTN; PAM sequence: TTC
tttacctacttgttgcattt

SEQ ID NO: 69864 - DNA, 20 bp, Artificial Sequence
  Description of Artificial Sequence: Synthetic oligonucleotide
  Target: SCN9A; (-) strand; PAM type: YTN; PAM sequence: CTT
ctttacctacttgttgcatt

SEQ ID NO: 69865 - DNA, 20 bp, Artificial Sequence
  Description of Artificial Sequence: Synthetic oligonucleotide
  Target: SCN9A; (-) strand; PAM type: YTN; PAM sequence: TTC
caatccttctttacctactt

SEQ ID NO: 69866 - DNA, 20 bp, Artificial Sequence
  Description of Artificial Sequence: Synthetic oligonucleotide
  Target: SCN9A; (-) strand; PAM type: YTN; PAM sequence: CTA
aggttccaatccttctttac

SEQ ID NO: 69867 - DNA, 20 bp, Artificial Sequence
  Description of Artificial Sequence: Synthetic oligonucleotide
  Target: SCN9A; (-) strand; PAM type: YTN; PAM sequence: TTG
ctaaggttccaatccttctt

SEQ ID NO: 69868 - DNA, 20 bp, Artificial Sequence
  Description of Artificial Sequence: Synthetic oligonucleotide
  Target: SCN9A; (-) strand; PAM type: YTN; PAM sequence: TTT
gctaaggttccaatccttct

SEQ ID NO: 69869 - DNA, 20 bp, Artificial Sequence
  Description of Artificial Sequence: Synthetic oligonucleotide
  Target: SCN9A; (-) strand; PAM type: YTN; PAM sequence: TTA
tgtttgctaaggttccaatc

SEQ ID NO: 69870 - DNA, 20 bp, Artificial Sequence
  Description of Artificial Sequence: Synthetic oligonucleotide
  Target: SCN9A; (-) strand; PAM type: YTN; PAM sequence: TTT
atgtttgctaaggttccaat

SEQ ID NO: 69871 - DNA, 20 bp, Artificial Sequence
  Description of Artificial Sequence: Synthetic oligonucleotide
  Target: SCN9A; (-) strand; PAM type: YTN; PAM sequence: CTT
tatgtttgctaaggttccaa

SEQ ID NO: 69872 - DNA, 20 bp, Artificial Sequence
  Description of Artificial Sequence: Synthetic oligonucleotide
  Target: SCN9A; (-) strand; PAM type: YTN; PAM sequence: TTG
cctttatgtttgctaaggtt

SEQ ID NO: 69873 - DNA, 20 bp, Artificial Sequence
  Description of Artificial Sequence: Synthetic oligonucleotide
  Target: SCN9A; (-) strand; PAM type: YTN; PAM sequence: TTT
gcctttatgtttgctaaggt

SEQ ID NO: 69874 - DNA, 20 bp, Artificial Sequence
  Description of Artificial Sequence: Synthetic oligonucleotide
  Target: SCN9A; (-) strand; PAM type: YTN; PAM sequence: CTT
tgcctttatgtttgctaagg

SEQ ID NO: 69875 - DNA, 20 bp, Artificial Sequence
  Description of Artificial Sequence: Synthetic oligonucleotide
  Target: SCN9A; (-) strand; PAM type: YTN; PAM sequence: CTA
cactttgcctttatgtttgc

SEQ ID NO: 69876 - DNA, 20 bp, Artificial Sequence
  Description of Artificial Sequence: Synthetic oligonucleotide
  Target: SCN9A; (-) strand; PAM type: YTN; PAM sequence: CTG
cgtatctacactttgccttt

SEQ ID NO: 69877 - DNA, 20 bp, Artificial Sequence
  Description of Artificial Sequence: Synthetic oligonucleotide
  Target: SCN9A; (-) strand; PAM type: YTN; PAM sequence: TTG
agtctgcgtatctacacttt

SEQ ID NO: 69878 - DNA, 20 bp, Artificial Sequence
  Description of Artificial Sequence: Synthetic oligonucleotide
  Target: SCN9A; (-) strand; PAM type: YTN; PAM sequence: CTT
gagtctgcgtatctacactt

SEQ ID NO: 69879 - DNA, 20 bp, Artificial Sequence
  Description of Artificial Sequence: Synthetic oligonucleotide
  Target: SCN9A; (-) strand; PAM type: YTN; PAM sequence: TTA
cgaagcttgagtctgcgtat

SEQ ID NO: 69880 - DNA, 20 bp, Artificial Sequence
  Description of Artificial Sequence: Synthetic oligonucleotide
  Target: SCN9A; (-) strand; PAM type: YTN; PAM sequence: TTT
acgaagcttgagtctgcgta

SEQ ID NO: 69881 - DNA, 20 bp, Artificial Sequence
  Description of Artificial Sequence: Synthetic oligonucleotide
  Target: SCN9A; (-) strand; PAM type: YTN; PAM sequence: TTA
tagataatatttacgaagct

SEQ ID NO: 69882 - DNA, 20 bp, Artificial Sequence
  Description of Artificial Sequence: Synthetic oligonucleotide
  Target: SCN9A; (-) strand; PAM type: YTN; PAM sequence: TTC
aaaattatagataatattta

SEQ ID NO: 69883 - DNA, 20 bp, Artificial Sequence
  Description of Artificial Sequence: Synthetic oligonucleotide
  Target: SCN9A; (-) strand; PAM type: YTN; PAM sequence: TTT
caaaattatagataatattt

SEQ ID NO: 69884 - DNA, 20 bp, Artificial Sequence
  Description of Artificial Sequence: Synthetic oligonucleotide
  Target: SCN9A; (-) strand; PAM type: YTN; PAM sequence: TTG
tttcaaaattatagataata

SEQ ID NO: 69885 - DNA, 20 bp, Artificial Sequence
  Description of Artificial Sequence: Synthetic oligonucleotide
  Target: SCN9A; (-) strand; PAM type: YTN; PAM sequence: TTT
gtttcaaaattatagataat

SEQ ID NO: 69886 - DNA, 20 bp, Artificial Sequence
  Description of Artificial Sequence: Synthetic oligonucleotide
  Target: SCN9A; (-) strand; PAM type: YTN; PAM sequence: TTG
tttgtttcaaaattatagat

SEQ ID NO: 69887 - DNA, 20 bp, Artificial Sequence
  Description of Artificial Sequence: Synthetic oligonucleotide
  Target: SCN9A; (-) strand; PAM type: YTN; PAM sequence: CTT
gtttgtttcaaaattataga

SEQ ID NO: 69888 - DNA, 20 bp, Artificial Sequence
  Description of Artificial Sequence: Synthetic oligonucleotide
  Target: SCN9A; (-) strand; PAM type: YTN; PAM sequence: TTC
ttgtttgtttcaaaattata

SEQ ID NO: 69889 - DNA, 20 bp, Artificial Sequence
  Description of Artificial Sequence: Synthetic oligonucleotide
  Target: SCN9A; (-) strand; PAM type: YTN; PAM sequence: TTG
tcattcttgtttgtttcaaa

SEQ ID NO: 69890 - DNA, 20 bp, Artificial Sequence
  Description of Artificial Sequence: Synthetic oligonucleotide
  Target: SCN9A; (-) strand; PAM type: YTN; PAM sequence: TTT
gtcattcttgtttgtttcaa

SEQ ID NO: 69891 - DNA, 20 bp, Artificial Sequence
  Description of Artificial Sequence: Synthetic oligonucleotide
  Target: SCN9A; (-) strand; PAM type: YTN; PAM sequence: TTG
tgtttgtcattcttgtttgt

SEQ ID NO: 69892 - DNA, 20 bp, Artificial Sequence
  Description of Artificial Sequence: Synthetic oligonucleotide
  Target: SCN9A; (-) strand; PAM type: YTN; PAM sequence: TTT
gtgtttgtcattcttgtttg

SEQ ID NO: 69893 - DNA, 20 bp, Artificial Sequence
  Description of Artificial Sequence: Synthetic oligonucleotide
  Target: SCN9A; (-) strand; PAM type: YTN; PAM sequence: CTT
tgtgtttgtcattcttgttt

SEQ ID NO: 69894 - DNA, 20 bp, Artificial Sequence
  Description of Artificial Sequence: Synthetic oligonucleotide
  Target: SCN9A; (-) strand; PAM type: YTN; PAM sequence: TTA
ctttgtgtttgtcattcttg

SEQ ID NO: 69895 - DNA, 20 bp, Artificial Sequence
  Description of Artificial Sequence: Synthetic oligonucleotide
  Target: SCN9A; (-) strand; PAM type: YTN; PAM sequence: CTT
actttgtgtttgtcattctt

SEQ ID NO: 69896 - DNA, 20 bp, Artificial Sequence
  Description of Artificial Sequence: Synthetic oligonucleotide
  Target: SCN9A; (-) strand; PAM type: YTN; PAM sequence: CTA
ggtagcttactttgtgtttg

SEQ ID NO: 69897 - DNA, 20 bp, Artificial Sequence
  Description of Artificial Sequence: Synthetic oligonucleotide
  Target: SCN9A; (-) strand; PAM type: YTN; PAM sequence: TTC
agatatctaggtagcttact

SEQ ID NO: 69898 - DNA, 20 bp, Artificial Sequence
  Description of Artificial Sequence: Synthetic oligonucleotide
  Target: SCN9A; (-) strand; PAM type: YTN; PAM sequence: TTA
acagaaatgattcagatatc

SEQ ID NO: 69899 - DNA, 20 bp, Artificial Sequence
  Description of Artificial Sequence: Synthetic oligonucleotide
  Target: SCN9A; (-) strand; PAM type: YTN; PAM sequence: TTA
gtagttaacagaaatgattc

SEQ ID NO: 69900 - DNA, 20 bp, Artificial Sequence
  Description of Artificial Sequence: Synthetic oligonucleotide
  Target: SCN9A; (-) strand; PAM type: YTN; PAM sequence: TTG
tgggtagtattagtagttaa

SEQ ID NO: 69901 - DNA, 20 bp, Artificial Sequence
  Description of Artificial Sequence: Synthetic oligonucleotide
  Target: SCN9A; (-) strand; PAM type: YTN; PAM sequence: TTC
attgtgggtagtattagtag

SEQ ID NO: 69902 - DNA, 20 bp, Artificial Sequence
  Description of Artificial Sequence: Synthetic oligonucleotide
  Target: SCN9A; (-) strand; PAM type: YTN; PAM sequence: CTT
cattgtgggtagtattagta

SEQ ID NO: 69903 - DNA, 20 bp, Artificial Sequence
  Description of Artificial Sequence: Synthetic oligonucleotide
  Target: SCN9A; (-) strand; PAM type: YTN; PAM sequence: CTC
cttcattgtgggtagtatta

SEQ ID NO: 69904 - DNA, 20 bp, Artificial Sequence
  Description of Artificial Sequence: Synthetic oligonucleotide
  Target: SCN9A; (-) strand; PAM type: YTN; PAM sequence: TTG
ccctccttcattgtgggtag

SEQ ID NO: 69905 - DNA, 20 bp, Artificial Sequence
  Description of Artificial Sequence: Synthetic oligonucleotide
  Target: SCN9A; (-) strand; PAM type: YTN; PAM sequence: CTT
gccctccttcattgtgggta

SEQ ID NO: 69906 - DNA, 20 bp, Artificial Sequence
  Description of Artificial Sequence: Synthetic oligonucleotide
  Target: SCN9A; (-) strand; PAM type: YTN; PAM sequence: TTC
cttgccctccttcattgtgg

SEQ ID NO: 69907 - DNA, 20 bp, Artificial Sequence
  Description of Artificial Sequence: Synthetic oligonucleotide
  Target: SCN9A; (-) strand; PAM type: YTN; PAM sequence: TTT
ccttgccctccttcattgtg

SEQ ID NO: 69908 - DNA, 20 bp, Artificial Sequence
  Description of Artificial Sequence: Synthetic oligonucleotide
  Target: SCN9A; (-) strand; PAM type: YTN; PAM sequence: TTT
tccttgccctccttcattgt

SEQ ID NO: 69909 - DNA, 20 bp, Artificial Sequence
  Description of Artificial Sequence: Synthetic oligonucleotide
  Target: SCN9A; (-) strand; PAM type: YTN; PAM sequence: CTT
ttccttgccctccttcattg

SEQ ID NO: 69910 - DNA, 20 bp, Artificial Sequence
  Description of Artificial Sequence: Synthetic oligonucleotide
  Target: SCN9A; (-) strand; PAM type: YTN; PAM sequence: TTC
acttttccttgccctccttc

SEQ ID NO: 69911 - DNA, 20 bp, Artificial Sequence
  Description of Artificial Sequence: Synthetic oligonucleotide
  Target: SCN9A; (-) strand; PAM type: YTN; PAM sequence: TTA
aaattcacttttccttgccc

SEQ ID NO: 69912 - DNA, 20 bp, Artificial Sequence
  Description of Artificial Sequence: Synthetic oligonucleotide
  Target: SCN9A; (-) strand; PAM type: YTN; PAM sequence: TTC
attaaaattcacttttcctt

SEQ ID NO: 69913 - DNA, 20 bp, Artificial Sequence
  Description of Artificial Sequence: Synthetic oligonucleotide
  Target: SCN9A; (-) strand; PAM type: YTN; PAM sequence: TTC
cattcattaaaattcacttt

SEQ ID NO: 69914 - DNA, 20 bp, Artificial Sequence
  Description of Artificial Sequence: Synthetic oligonucleotide
  Target: SCN9A; (-) strand; PAM type: YTN; PAM sequence: TTA
ttccattcattaaaattcac

SEQ ID NO: 69915 - DNA, 20 bp, Artificial Sequence
  Description of Artificial Sequence: Synthetic oligonucleotide
  Target: SCN9A; (-) strand; PAM type: YTN; PAM sequence: CTA
gtaattattccattcattaa

SEQ ID NO: 69916 - DNA, 20 bp, Artificial Sequence
  Description of Artificial Sequence: Synthetic oligonucleotide
  Target: SCN9A; (-) strand; PAM type: YTN; PAM sequence: TTA
aaaagctagtaattattcca

SEQ ID NO: 69917 - DNA, 20 bp, Artificial Sequence
  Description of Artificial Sequence: Synthetic oligonucleotide
  Target: SCN9A; (-) strand; PAM type: YTN; PAM sequence: TTT
aaaaagctagtaattattcc

SEQ ID NO: 69918 - DNA, 20 bp, Artificial Sequence
  Description of Artificial Sequence: Synthetic oligonucleotide
  Target: SCN9A; (-) strand; PAM type: YTN; PAM sequence: TTA
gaaatccacatgtttaaaaa

SEQ ID NO: 69919 - DNA, 20 bp, Artificial Sequence
  Description of Artificial Sequence: Synthetic oligonucleotide
  Target: SCN9A; (-) strand; PAM type: YTN; PAM sequence: TTC
aatattagaaatccacatgt

SEQ ID NO: 69920 - DNA, 20 bp, Artificial Sequence
  Description of Artificial Sequence: Synthetic oligonucleotide
  Target: SCN9A; (-) strand; PAM type: YTN; PAM sequence: TTT
caatattagaaatccacatg

SEQ ID NO: 69921 - DNA, 20 bp, Artificial Sequence
  Description of Artificial Sequence: Synthetic oligonucleotide
  Target: SCN9A; (-) strand; PAM type: YTN; PAM sequence: TTT
tcaatattagaaatccacat

SEQ ID NO: 69922 - DNA, 20 bp, Artificial Sequence
  Description of Artificial Sequence: Synthetic oligonucleotide
  Target: SCN9A; (-) strand; PAM type: YTN; PAM sequence: TTA
tattttcaatattagaaatc

SEQ ID NO: 69923 - DNA, 20 bp, Artificial Sequence
  Description of Artificial Sequence: Synthetic oligonucleotide
  Target: SCN9A; (-) strand; PAM type: YTN; PAM sequence: TTT
atattttcaatattagaaat

SEQ ID NO: 69924 - DNA, 20 bp, Artificial Sequence
  Description of Artificial Sequence: Synthetic oligonucleotide
  Target: SCN9A; (-) strand; PAM type: YTN; PAM sequence: CTA
tttatattttcaatattaga

SEQ ID NO: 69925 - DNA, 20 bp, Artificial Sequence
  Description of Artificial Sequence: Synthetic oligonucleotide
  Target: SCN9A; (-) strand; PAM type: YTN; PAM sequence: TTC
tatttatattttcaatatta

SEQ ID NO: 69926 - DNA, 20 bp, Artificial Sequence
  Description of Artificial Sequence: Synthetic oligonucleotide
  Target: SCN9A; (-) strand; PAM type: YTN; PAM sequence: TTT
ctatttatattttcaatatt

SEQ ID NO: 69927 - DNA, 20 bp, Artificial Sequence
  Description of Artificial Sequence: Synthetic oligonucleotide
  Target: SCN9A; (-) strand; PAM type: YTN; PAM sequence: TTA
tccatgtaaaatttctattt

SEQ ID NO: 69928 - DNA, 20 bp, Artificial Sequence
  Description of Artificial Sequence: Synthetic oligonucleotide
  Target: SCN9A; (-) strand; PAM type: YTN; PAM sequence: TTT
atccatgtaaaatttctatt

SEQ ID NO: 69929 - DNA, 20 bp, Artificial Sequence
  Description of Artificial Sequence: Synthetic oligonucleotide
  Target: SCN9A; (-) strand; PAM type: YTN; PAM sequence: TTT
tatccatgtaaaatttctat

SEQ ID NO: 69930 - DNA, 20 bp, Artificial Sequence
  Description of Artificial Sequence: Synthetic oligonucleotide
  Target: SCN9A; (-) strand; PAM type: YTN; PAM sequence: TTA
ttttatccatgtaaaatttc

SEQ ID NO: 69931 - DNA, 20 bp, Artificial Sequence
  Description of Artificial Sequence: Synthetic oligonucleotide
  Target: SCN9A; (-) strand; PAM type: YTN; PAM sequence: CTA
cataaaggatatagttattt

SEQ ID NO: 69932 - DNA, 20 bp, Artificial Sequence
  Description of Artificial Sequence: Synthetic oligonucleotide
  Target: SCN9A; (-) strand; PAM type: YTN; PAM sequence: CTG
cctacataaaggatatagtt

SEQ ID NO: 69933 - DNA, 20 bp, Artificial Sequence
  Description of Artificial Sequence: Synthetic oligonucleotide
  Target: SCN9A; (-) strand; PAM type: YTN; PAM sequence: TTA
gcaaaagctgcctacataaa

SEQ ID NO: 69934 - DNA, 20 bp, Artificial Sequence
  Description of Artificial Sequence: Synthetic oligonucleotide
  Target: SCN9A; (-) strand; PAM type: YTN; PAM sequence: TTT
agcaaaagctgcctacataa

SEQ ID NO: 69935 - DNA, 20 bp, Artificial Sequence
  Description of Artificial Sequence: Synthetic oligonucleotide
  Target: SCN9A; (-) strand; PAM type: YTN; PAM sequence: CTT
tagcaaaagctgcctacata

SEQ ID NO: 69936 - DNA, 20 bp, Artificial Sequence
  Description of Artificial Sequence: Synthetic oligonucleotide
  Target: SCN9A; (-) strand; PAM type: YTN; PAM sequence: TTG
aaatatggcactttagcaaa

SEQ ID NO: 69937 - DNA, 20 bp, Artificial Sequence
  Description of Artificial Sequence: Synthetic oligonucleotide
  Target: SCN9A; (-) strand; PAM type: YTN; PAM sequence: CTT
gaaatatggcactttagcaa

SEQ ID NO: 69938 - DNA, 20 bp, Artificial Sequence
  Description of Artificial Sequence: Synthetic oligonucleotide
  Target: SCN9A; (-) strand; PAM type: YTN; PAM sequence: TTA
agaatgacttgaaatatggc

SEQ ID NO: 69939 - DNA, 20 bp, Artificial Sequence
  Description of Artificial Sequence: Synthetic oligonucleotide
  Target: SCN9A; (-) strand; PAM type: YTN; PAM sequence: TTC
agttaagaatgacttgaaat

SEQ ID NO: 69940 - DNA, 20 bp, Artificial Sequence
  Description of Artificial Sequence: Synthetic oligonucleotide
  Target: SCN9A; (-) strand; PAM type: YTN; PAM sequence: CTG
aatattcagttaagaatgac

SEQ ID NO: 69941 - DNA, 20 bp, Artificial Sequence
  Description of Artificial Sequence: Synthetic oligonucleotide
  Target: SCN9A; (-) strand; PAM type: YTN; PAM sequence: TTA
agaaaaaaactgaatattca

SEQ ID NO: 69942 - DNA, 20 bp, Artificial Sequence
  Description of Artificial Sequence: Synthetic oligonucleotide
  Target: SCN9A; (-) strand; PAM type: YTN; PAM sequence: CTT
aagaaaaaaactgaatattc

SEQ ID NO: 69943 - DNA, 20 bp, Artificial Sequence
  Description of Artificial Sequence: Synthetic oligonucleotide
  Target: SCN9A; (-) strand; PAM type: YTN; PAM sequence: CTC
ttaagaaaaaaactgaatat

SEQ ID NO: 69944 - DNA, 20 bp, Artificial Sequence
  Description of Artificial Sequence: Synthetic oligonucleotide
  Target: SCN9A; (-) strand; PAM type: YTN; PAM sequence: TTA
atgaatggtcatcctcttaa

SEQ ID NO: 69945 - DNA, 20 bp, Artificial Sequence
  Description of Artificial Sequence: Synthetic oligonucleotide
  Target: SCN9A; (-) strand; PAM type: YTN; PAM sequence: TTA
gaaaagatgaggtacatgtt

SEQ ID NO: 69946 - DNA, 20 bp, Artificial Sequence
  Description of Artificial Sequence: Synthetic oligonucleotide
  Target: SCN9A; (-) strand; PAM type: YTN; PAM sequence: CTG
ttagaaaagatgaggtacat

SEQ ID NO: 69947 - DNA, 20 bp, Artificial Sequence
  Description of Artificial Sequence: Synthetic oligonucleotide
  Target: SCN9A; (-) strand; PAM type: YTN; PAM sequence: TTA
ccaagctgttagaaaagatg

SEQ ID NO: 69948 - DNA, 20 bp, Artificial Sequence
  Description of Artificial Sequence: Synthetic oligonucleotide
  Target: SCN9A; (-) strand; PAM type: YTN; PAM sequence: TTT
accaagctgttagaaaagat

SEQ ID NO: 69949 - DNA, 20 bp, Artificial Sequence
  Description of Artificial Sequence: Synthetic oligonucleotide
  Target: SCN9A; (-) strand; PAM type: YTN; PAM sequence: TTT
taccaagctgttagaaaaga

SEQ ID NO: 69950 - DNA, 20 bp, Artificial Sequence
  Description of Artificial Sequence: Synthetic oligonucleotide
  Target: SCN9A; (-) strand; PAM type: YTN; PAM sequence: TTT
ttaccaagctgttagaaaag

SEQ ID NO: 69951 - DNA, 20 bp, Artificial Sequence
  Description of Artificial Sequence: Synthetic oligonucleotide
  Target: SCN9A; (-) strand; PAM type: YTN; PAM sequence: TTT
tttaccaagctgttagaaaa

SEQ ID NO: 69952 - DNA, 20 bp, Artificial Sequence
  Description of Artificial Sequence: Synthetic oligonucleotide
  Target: SCN9A; (-) strand; PAM type: YTN; PAM sequence: CTT
ttttaccaagctgttagaaa

SEQ ID NO: 69953 - DNA, 20 bp, Artificial Sequence
  Description of Artificial Sequence: Synthetic oligonucleotide
  Target: SCN9A; (-) strand; PAM type: YTN; PAM sequence: TTA
cttttttaccaagctgttag

SEQ ID NO: 69954 - DNA, 20 bp, Artificial Sequence
  Description of Artificial Sequence: Synthetic oligonucleotide
  Target: SCN9A; (-) strand; PAM type: YTN; PAM sequence: TTA
ttacttttttaccaagctgt

SEQ ID NO: 69955 - DNA, 20 bp, Artificial Sequence
  Description of Artificial Sequence: Synthetic oligonucleotide
  Target: SCN9A; (-) strand; PAM type: YTN; PAM sequence: CTT
attacttttttaccaagctg

SEQ ID NO: 69956 - DNA, 20 bp, Artificial Sequence
  Description of Artificial Sequence: Synthetic oligonucleotide
  Target: SCN9A; (-) strand; PAM type: YTN; PAM sequence: TTC
ttattacttttttaccaagc

SEQ ID NO: 69957 - DNA, 20 bp, Artificial Sequence
  Description of Artificial Sequence: Synthetic oligonucleotide
  Target: SCN9A; (-) strand; PAM type: YTN; PAM sequence: TTC
ataaattcttattacttttt

SEQ ID NO: 69958 - DNA, 20 bp, Artificial Sequence
  Description of Artificial Sequence: Synthetic oligonucleotide
  Target: SCN9A; (-) strand; PAM type: YTN; PAM sequence: TTG
aattcataaattcttattac

SEQ ID NO: 69959 - DNA, 20 bp, Artificial Sequence
  Description of Artificial Sequence: Synthetic oligonucleotide
  Target: SCN9A; (-) strand; PAM type: YTN; PAM sequence: TTT
gaattcataaattcttatta

SEQ ID NO: 69960 - DNA, 20 bp, Artificial Sequence
  Description of Artificial Sequence: Synthetic oligonucleotide
  Target: SCN9A; (-) strand; PAM type: YTN; PAM sequence: TTT
tgaattcataaattcttatt

SEQ ID NO: 69961 - DNA, 20 bp, Artificial Sequence
  Description of Artificial Sequence: Synthetic oligonucleotide
  Target: SCN9A; (-) strand; PAM type: YTN; PAM sequence: CTA
gaaatatatatacatgcata

SEQ ID NO: 69962 - DNA, 20 bp, Artificial Sequence
  Description of Artificial Sequence: Synthetic oligonucleotide
  Target: SCN9A; (-) strand; PAM type: YTN; PAM sequence: TTC
tagaaatatatatacatgca

SEQ ID NO: 69963 - DNA, 20 bp, Artificial Sequence
  Description of Artificial Sequence: Synthetic oligonucleotide
  Target: SCN9A; (-) strand; PAM type: YTN; PAM sequence: TTT
ctagaaatatatatacatgc

SEQ ID NO: 69964 - DNA, 20 bp, Artificial Sequence
  Description of Artificial Sequence: Synthetic oligonucleotide
  Target: SCN9A; (-) strand; PAM type: YTN; PAM sequence: CTA
tttctagaaatatatataca

SEQ ID NO: 69965 - DNA, 20 bp, Artificial Sequence
  Description of Artificial Sequence: Synthetic oligonucleotide
  Target: SCN9A; (-) strand; PAM type: YTN; PAM sequence: TTG
agaaagctatttctagaaat

SEQ ID NO: 69966 - DNA, 20 bp, Artificial Sequence
  Description of Artificial Sequence: Synthetic oligonucleotide
  Target: SCN9A; (-) strand; PAM type: YTN; PAM sequence: TTT
gagaaagctatttctagaaa

SEQ ID NO: 69967 - DNA, 20 bp, Artificial Sequence
  Description of Artificial Sequence: Synthetic oligonucleotide
  Target: SCN9A; (-) strand; PAM type: YTN; PAM sequence: TTT
tgagaaagctatttctagaa

SEQ ID NO: 69968 - DNA, 20 bp, Artificial Sequence
  Description of Artificial Sequence: Synthetic oligonucleotide
  Target: SCN9A; (-) strand; PAM type: YTN; PAM sequence: TTT
ttgagaaagctatttctaga

SEQ ID NO: 69969 - DNA, 20 bp, Artificial Sequence
  Description of Artificial Sequence: Synthetic oligonucleotide
  Target: SCN9A; (-) strand; PAM type: YTN; PAM sequence: CTA
tataggtatagataaaacat

SEQ ID NO: 69970 - DNA, 20 bp, Artificial Sequence
  Description of Artificial Sequence: Synthetic oligonucleotide
  Target: SCN9A; (-) strand; PAM type: YTN; PAM sequence: TTA
tctatataggtatagataaa

SEQ ID NO: 69971 - DNA, 20 bp, Artificial Sequence
  Description of Artificial Sequence: Synthetic oligonucleotide
  Target: SCN9A; (-) strand; PAM type: YTN; PAM sequence: CTA
aataaggatgcatatacacc

SEQ ID NO: 69972 - DNA, 20 bp, Artificial Sequence
  Description of Artificial Sequence: Synthetic oligonucleotide
  Target: SCN9A; (-) strand; PAM type: YTN; PAM sequence: CTA
gagcctaaataaggatgcat

SEQ ID NO: 69973 - DNA, 20 bp, Artificial Sequence
  Description of Artificial Sequence: Synthetic oligonucleotide
  Target: SCN9A; (-) strand; PAM type: YTN; PAM sequence: TTC
aactagagcctaaataagga

SEQ ID NO: 69974 - DNA, 20 bp, Artificial Sequence
  Description of Artificial Sequence: Synthetic oligonucleotide
  Target: SCN9A; (-) strand; PAM type: YTN; PAM sequence: CTT
caactagagcctaaataagg

SEQ ID NO: 69975 - DNA, 20 bp, Artificial Sequence
  Description of Artificial Sequence: Synthetic oligonucleotide
  Target: SCN9A; (-) strand; PAM type: YTN; PAM sequence: TTC
ttcaactagagcctaaataa

SEQ ID NO: 69976 - DNA, 20 bp, Artificial Sequence
  Description of Artificial Sequence: Synthetic oligonucleotide
  Target: SCN9A; (-) strand; PAM type: YTN; PAM sequence: TTT
cttcaactagagcctaaata

SEQ ID NO: 69977 - DNA, 20 bp, Artificial Sequence
  Description of Artificial Sequence: Synthetic oligonucleotide
  Target: SCN9A; (-) strand; PAM type: YTN; PAM sequence: TTT
tcttcaactagagcctaaat

SEQ ID NO: 69978 - DNA, 20 bp, Artificial Sequence
  Description of Artificial Sequence: Synthetic oligonucleotide
  Target: SCN9A; (-) strand; PAM type: YTN; PAM sequence: TTC
cagaatatggtgaattttct

SEQ ID NO: 69979 - DNA, 20 bp, Artificial Sequence
  Description of Artificial Sequence: Synthetic oligonucleotide
  Target: SCN9A; (-) strand; PAM type: YTN; PAM sequence: TTA
ttccagaatatggtgaattt

SEQ ID NO: 69980 - DNA, 20 bp, Artificial Sequence
  Description of Artificial Sequence: Synthetic oligonucleotide
  Target: SCN9A; (-) strand; PAM type: YTN; PAM sequence: TTT
attccagaatatggtgaatt

SEQ ID NO: 69981 - DNA, 20 bp, Artificial Sequence
  Description of Artificial Sequence: Synthetic oligonucleotide
  Target: SCN9A; (-) strand; PAM type: YTN; PAM sequence: TTT
tattccagaatatggtgaat

SEQ ID NO: 69982 - DNA, 20 bp, Artificial Sequence
  Description of Artificial Sequence: Synthetic oligonucleotide
  Target: SCN9A; (-) strand; PAM type: YTN; PAM sequence: CTA
ttttattccagaatatggtg

SEQ ID NO: 69983 - DNA, 20 bp, Artificial Sequence
  Description of Artificial Sequence: Synthetic oligonucleotide
  Target: SCN9A; (-) strand; PAM type: YTN; PAM sequence: CTC
atagaaaactattttattcc

SEQ ID NO: 69984 - DNA, 20 bp, Artificial Sequence
  Description of Artificial Sequence: Synthetic oligonucleotide
  Target: SCN9A; (-) strand; PAM type: YTN; PAM sequence: TTC
tcatagaaaactattttatt

SEQ ID NO: 69985 - DNA, 20 bp, Artificial Sequence
  Description of Artificial Sequence: Synthetic oligonucleotide
  Target: SCN9A; (-) strand; PAM type: YTN; PAM sequence: TTA
gaggcaatattctcatagaa

SEQ ID NO: 69986 - DNA, 20 bp, Artificial Sequence
  Description of Artificial Sequence: Synthetic oligonucleotide
  Target: SCN9A; (-) strand; PAM type: YTN; PAM sequence: TTT
agaggcaatattctcataga

SEQ ID NO: 69987 - DNA, 20 bp, Artificial Sequence
  Description of Artificial Sequence: Synthetic oligonucleotide
  Target: SCN9A; (-) strand; PAM type: YTN; PAM sequence: TTG
gtggggatttagaggcaata

SEQ ID NO: 69988 - DNA, 20 bp, Artificial Sequence
  Description of Artificial Sequence: Synthetic oligonucleotide
  Target: SCN9A; (-) strand; PAM type: YTN; PAM sequence: TTT
ggtggggatttagaggcaat

SEQ ID NO: 69989 - DNA, 20 bp, Artificial Sequence
  Description of Artificial Sequence: Synthetic oligonucleotide
  Target: SCN9A; (-) strand; PAM type: YTN; PAM sequence: TTC
aaatttggtggggatttaga

SEQ ID NO: 69990 - DNA, 20 bp, Artificial Sequence
  Description of Artificial Sequence: Synthetic oligonucleotide
  Target: SCN9A; (-) strand; PAM type: YTN; PAM sequence: TTT
caaatttggtggggatttag

SEQ ID NO: 69991 - DNA, 20 bp, Artificial Sequence
  Description of Artificial Sequence: Synthetic oligonucleotide
  Target: SCN9A; (-) strand; PAM type: YTN; PAM sequence: CTA
tttcaaatttggtggggatt

SEQ ID NO: 69992 - DNA, 20 bp, Artificial Sequence
  Description of Artificial Sequence: Synthetic oligonucleotide
  Target: SCN9A; (-) strand; PAM type: YTN; PAM sequence: TTC
tatttcaaatttggtgggga

SEQ ID NO: 69993 - DNA, 20 bp, Artificial Sequence
  Description of Artificial Sequence: Synthetic oligonucleotide
  Target: SCN9A; (-) strand; PAM type: YTN; PAM sequence: TTT
ctatttcaaatttggtgggg

SEQ ID NO: 69994 - DNA, 20 bp, Artificial Sequence
  Description of Artificial Sequence: Synthetic oligonucleotide
  Target: SCN9A; (-) strand; PAM type: YTN; PAM sequence: TTT
tctatttcaaatttggtggg

SEQ ID NO: 69995 - DNA, 20 bp, Artificial Sequence
  Description of Artificial Sequence: Synthetic oligonucleotide
  Target: SCN9A; (-) strand; PAM type: YTN; PAM sequence: TTT
ttctatttcaaatttggtgg

SEQ ID NO: 69996 - DNA, 20 bp, Artificial Sequence
  Description of Artificial Sequence: Synthetic oligonucleotide
  Target: SCN9A; (-) strand; PAM type: YTN; PAM sequence: CTA
agtaaaagatatatttttct

SEQ ID NO: 69997 - DNA, 20 bp, Artificial Sequence
  Description of Artificial Sequence: Synthetic oligonucleotide
  Target: SCN9A; (-) strand; PAM type: YTN; PAM sequence: TTA
aaggtggcctaagtaaaaga

SEQ ID NO: 69998 - DNA, 20 bp, Artificial Sequence
  Description of Artificial Sequence: Synthetic oligonucleotide
  Target: SCN9A; (-) strand; PAM type: YTN; PAM sequence: TTT
aaaggtggcctaagtaaaag

SEQ ID NO: 69999 - DNA, 20 bp, Artificial Sequence
  Description of Artificial Sequence: Synthetic oligonucleotide
  Target: SCN9A; (-) strand; PAM type: YTN; PAM sequence: TTT
taaaggtggcctaagtaaaa

SEQ ID NO: 70000 - DNA, 20 bp, Artificial Sequence
  Description of Artificial Sequence: Synthetic oligonucleotide
  Target: SCN9A; (-) strand; PAM type: YTN; PAM sequence: TTG
aagataattttaaaggtggc

SEQ ID NO: 70001 - DNA, 20 bp, Artificial Sequence
  Description of Artificial Sequence: Synthetic oligonucleotide
  Target: SCN9A; (-) strand; PAM type: YTN; PAM sequence: TTT
gaagataattttaaaggtgg

SEQ ID NO: 70002 - DNA, 20 bp, Artificial Sequence
  Description of Artificial Sequence: Synthetic oligonucleotide
  Target: SCN9A; (-) strand; PAM type: YTN; PAM sequence: TTA
tttgaagataattttaaagg

SEQ ID NO: 70003 - DNA, 20 bp, Artificial Sequence
  Description of Artificial Sequence: Synthetic oligonucleotide
  Target: SCN9A; (-) strand; PAM type: YTN; PAM sequence: TTT
atttgaagataattttaaag

SEQ ID NO: 70004 - DNA, 20 bp, Artificial Sequence
  Description of Artificial Sequence: Synthetic oligonucleotide
  Target: SCN9A; (-) strand; PAM type: YTN; PAM sequence: TTC
cagtttatttgaagataatt

SEQ ID NO: 70005 - DNA, 20 bp, Artificial Sequence
  Description of Artificial Sequence: Synthetic oligonucleotide
  Target: SCN9A; (-) strand; PAM type: YTN; PAM sequence: TTA
gtgttccagtttatttgaag

SEQ ID NO: 70006 - DNA, 20 bp, Artificial Sequence
  Description of Artificial Sequence: Synthetic oligonucleotide
  Target: SCN9A; (-) strand; PAM type: YTN; PAM sequence: TTT
agtgttccagtttatttgaa

SEQ ID NO: 70007 - DNA, 20 bp, Artificial Sequence
  Description of Artificial Sequence: Synthetic oligonucleotide
  Target: SCN9A; (-) strand; PAM type: YTN; PAM sequence: TTT
tagtgttccagtttatttga

SEQ ID NO: 70008 - DNA, 20 bp, Artificial Sequence
  Description of Artificial Sequence: Synthetic oligonucleotide
  Target: SCN9A; (-) strand; PAM type: YTN; PAM sequence: TTA
ttttagtgttccagtttatt

SEQ ID NO: 70009 - DNA, 20 bp, Artificial Sequence
  Description of Artificial Sequence: Synthetic oligonucleotide
  Target: SCN9A; (-) strand; PAM type: YTN; PAM sequence: TTA
gttattttagtgttccagtt

SEQ ID NO: 70010 - DNA, 20 bp, Artificial Sequence
  Description of Artificial Sequence: Synthetic oligonucleotide
  Target: SCN9A; (-) strand; PAM type: YTN; PAM sequence: TTC
aaatgaaaaattagttattt

SEQ ID NO: 70011 - DNA, 20 bp, Artificial Sequence
  Description of Artificial Sequence: Synthetic oligonucleotide
  Target: SCN9A; (-) strand; PAM type: YTN; PAM sequence: TTT
caaatgaaaaattagttatt

SEQ ID NO: 70012 - DNA, 20 bp, Artificial Sequence
  Description of Artificial Sequence: Synthetic oligonucleotide
  Target: SCN9A; (-) strand; PAM type: YTN; PAM sequence: CTA
acagtttcaaatgaaaaatt

SEQ ID NO: 70013 - DNA, 20 bp, Artificial Sequence
  Description of Artificial Sequence: Synthetic oligonucleotide
  Target: SCN9A; (-) strand; PAM type: YTN; PAM sequence: TTG
ctaacagtttcaaatgaaaa

SEQ ID NO: 70014 - DNA, 20 bp, Artificial Sequence
  Description of Artificial Sequence: Synthetic oligonucleotide
  Target: SCN9A; (-) strand; PAM type: YTN; PAM sequence: TTA
gagataatattgctaacagt

SEQ ID NO: 70015 - DNA, 20 bp, Artificial Sequence
  Description of Artificial Sequence: Synthetic oligonucleotide
  Target: SCN9A; (-) strand; PAM type: YTN; PAM sequence: CTT
agagataatattgctaacag

SEQ ID NO: 70016 - DNA, 20 bp, Artificial Sequence
  Description of Artificial Sequence: Synthetic oligonucleotide
  Target: SCN9A; (-) strand; PAM type: YTN; PAM sequence: TTG
acacaccttagagataatat

SEQ ID NO: 70017 - DNA, 20 bp, Artificial Sequence
  Description of Artificial Sequence: Synthetic oligonucleotide
  Target: SCN9A; (-) strand; PAM type: YTN; PAM sequence: CTG
aaattgacacaccttagaga

SEQ ID NO: 70018 - DNA, 20 bp, Artificial Sequence
  Description of Artificial Sequence: Synthetic oligonucleotide
  Target: SCN9A; (-) strand; PAM type: YTN; PAM sequence: TTA
tcctgaaattgacacacctt

SEQ ID NO: 70019 - DNA, 20 bp, Artificial Sequence
  Description of Artificial Sequence: Synthetic oligonucleotide
  Target: SCN9A; (-) strand; PAM type: YTN; PAM sequence: TTT
atcctgaaattgacacacct

SEQ ID NO: 70020 - DNA, 20 bp, Artificial Sequence
  Description of Artificial Sequence: Synthetic oligonucleotide
  Target: SCN9A; (-) strand; PAM type: YTN; PAM sequence: CTT
tatcctgaaattgacacacc

SEQ ID NO: 70021 - DNA, 20 bp, Artificial Sequence
  Description of Artificial Sequence: Synthetic oligonucleotide
  Target: SCN9A; (-) strand; PAM type: YTN; PAM sequence: TTG
tgcaatgatgaaagcaaaac

SEQ ID NO: 70022 - DNA, 20 bp, Artificial Sequence
  Description of Artificial Sequence: Synthetic oligonucleotide
  Target: SCN9A; (-) strand; PAM type: YTN; PAM sequence: CTA
ttgtgcaatgatgaaagcaa

SEQ ID NO: 70023 - DNA, 20 bp, Artificial Sequence
  Description of Artificial Sequence: Synthetic oligonucleotide
  Target: SCN9A; (-) strand; PAM type: YTN; PAM sequence: TTA
tctattgtgcaatgatgaaa

SEQ ID NO: 70024 - DNA, 20 bp, Artificial Sequence
  Description of Artificial Sequence: Synthetic oligonucleotide
  Target: SCN9A; (-) strand; PAM type: YTN; PAM sequence: TTG
ttatctattgtgcaatgatg

SEQ ID NO: 70025 - DNA, 20 bp, Artificial Sequence
  Description of Artificial Sequence: Synthetic oligonucleotide
  Target: SCN9A; (-) strand; PAM type: YTN; PAM sequence: TTA
ttgttatctattgtgcaatg

SEQ ID NO: 70026 - DNA, 20 bp, Artificial Sequence
  Description of Artificial Sequence: Synthetic oligonucleotide
  Target: SCN9A; (-) strand; PAM type: YTN; PAM sequence: TTG
tattattgttatctattgtg

SEQ ID NO: 70027 - DNA, 20 bp, Artificial Sequence
  Description of Artificial Sequence: Synthetic oligonucleotide
  Target: SCN9A; (-) strand; PAM type: YTN; PAM sequence: TTT
gtattattgttatctattgt

SEQ ID NO: 70028 - DNA, 20 bp, Artificial Sequence
  Description of Artificial Sequence: Synthetic oligonucleotide
  Target: SCN9A; (-) strand; PAM type: YTN; PAM sequence: TTG
agatgtttgtattattgtta

SEQ ID NO: 70029 - DNA, 20 bp, Artificial Sequence
  Description of Artificial Sequence: Synthetic oligonucleotide
  Target: SCN9A; (-) strand; PAM type: YTN; PAM sequence: TTG
ttgagatgtttgtattattg

SEQ ID NO: 70030 - DNA, 20 bp, Artificial Sequence
  Description of Artificial Sequence: Synthetic oligonucleotide
  Target: SCN9A; (-) strand; PAM type: YTN; PAM sequence: CTG
tcattgttgagatgtttgta

SEQ ID NO: 70031 - DNA, 20 bp, Artificial Sequence
  Description of Artificial Sequence: Synthetic oligonucleotide
  Target: SCN9A; (-) strand; PAM type: YTN; PAM sequence: CTC
tgtcattgttgagatgtttg

SEQ ID NO: 70032 - DNA, 20 bp, Artificial Sequence
  Description of Artificial Sequence: Synthetic oligonucleotide
  Target: SCN9A; (-) strand; PAM type: YTN; PAM sequence: TTC
tctgtcattgttgagatgtt

SEQ ID NO: 70033 - DNA, 20 bp, Artificial Sequence
  Description of Artificial Sequence: Synthetic oligonucleotide
  Target: SCN9A; (-) strand; PAM type: YTN; PAM sequence: TTT
ctctgtcattgttgagatgt

SEQ ID NO: 70034 - DNA, 20 bp, Artificial Sequence
  Description of Artificial Sequence: Synthetic oligonucleotide
  Target: SCN9A; (-) strand; PAM type: YTN; PAM sequence: TTG
aatttctctgtcattgttga

SEQ ID NO: 70035 - DNA, 20 bp, Artificial Sequence
  Description of Artificial Sequence: Synthetic oligonucleotide
  Target: SCN9A; (-) strand; PAM type: YTN; PAM sequence: TTT
gaatttctctgtcattgttg

SEQ ID NO: 70036 - DNA, 20 bp, Artificial Sequence
  Description of Artificial Sequence: Synthetic oligonucleotide
  Target: SCN9A; (-) strand; PAM type: YTN; PAM sequence: TTT
tgaatttctctgtcattgtt

SEQ ID NO: 70037 - DNA, 20 bp, Artificial Sequence
  Description of Artificial Sequence: Synthetic oligonucleotide
  Target: SCN9A; (-) strand; PAM type: YTN; PAM sequence: TTC
atattttgaatttctctgtc

SEQ ID NO: 70038 - DNA, 20 bp, Artificial Sequence
  Description of Artificial Sequence: Synthetic oligonucleotide
  Target: SCN9A; (-) strand; PAM type: YTN; PAM sequence: CTA
gttcatattttgaatttctc

SEQ ID NO: 70039 - DNA, 20 bp, Artificial Sequence
  Description of Artificial Sequence: Synthetic oligonucleotide
  Target: SCN9A; (-) strand; PAM type: YTN; PAM sequence: TTA
taatctagttcatattttga

SEQ ID NO: 70040 - DNA, 20 bp, Artificial Sequence
  Description of Artificial Sequence: Synthetic oligonucleotide
  Target: SCN9A; (-) strand; PAM type: YTN; PAM sequence: TTT
ataatctagttcatattttg

SEQ ID NO: 70041 - DNA, 20 bp, Artificial Sequence
  Description of Artificial Sequence: Synthetic oligonucleotide
  Target: SCN9A; (-) strand; PAM type: YTN; PAM sequence: TTT
tataatctagttcatatttt

SEQ ID NO: 70042 - DNA, 20 bp, Artificial Sequence
  Description of Artificial Sequence: Synthetic oligonucleotide
  Target: SCN9A; (-) strand; PAM type: YTN; PAM sequence: TTT
ttataatctagttcatattt

SEQ ID NO: 70043 - DNA, 20 bp, Artificial Sequence
  Description of Artificial Sequence: Synthetic oligonucleotide
  Target: SCN9A; (-) strand; PAM type: YTN; PAM sequence: CTT
tttataatctagttcatatt

SEQ ID NO: 70044 - DNA, 20 bp, Artificial Sequence
  Description of Artificial Sequence: Synthetic oligonucleotide
  Target: SCN9A; (-) strand; PAM type: YTN; PAM sequence: CTC
ctttttataatctagttcat

SEQ ID NO: 70045 - DNA, 20 bp, Artificial Sequence
  Description of Artificial Sequence: Synthetic oligonucleotide
  Target: SCN9A; (-) strand; PAM type: YTN; PAM sequence: TTG
actcctttttataatctagt

SEQ ID NO: 70046 - DNA, 20 bp, Artificial Sequence
  Description of Artificial Sequence: Synthetic oligonucleotide
  Target: SCN9A; (-) strand; PAM type: YTN; PAM sequence: CTT
gactcctttttataatctag

SEQ ID NO: 70047 - DNA, 20 bp, Artificial Sequence
  Description of Artificial Sequence: Synthetic oligonucleotide
  Target: SCN9A; (-) strand; PAM type: YTN; PAM sequence: CTG
ccaataagaatcttgactcc

SEQ ID NO: 70048 - DNA, 20 bp, Artificial Sequence
  Description of Artificial Sequence: Synthetic oligonucleotide
  Target: SCN9A; (-) strand; PAM type: YTN; PAM sequence: CTC
tgccaataagaatcttgact

SEQ ID NO: 70049 - DNA, 20 bp, Artificial Sequence
  Description of Artificial Sequence: Synthetic oligonucleotide
  Target: SCN9A; (-) strand; PAM type: YTN; PAM sequence: CTA
ggatgggggcaggaatctct

SEQ ID NO: 70050 - DNA, 20 bp, Artificial Sequence
  Description of Artificial Sequence: Synthetic oligonucleotide
  Target: SCN9A; (-) strand; PAM type: YTN; PAM sequence: TTC
taggatgggggcaggaatct

SEQ ID NO: 70051 - DNA, 20 bp, Artificial Sequence
  Description of Artificial Sequence: Synthetic oligonucleotide
  Target: SCN9A; (-) strand; PAM type: YTN; PAM sequence: TTA
atagttctaggatgggggca

SEQ ID NO: 70052 - DNA, 20 bp, Artificial Sequence
  Description of Artificial Sequence: Synthetic oligonucleotide
  Target: SCN9A; (-) strand; PAM type: YTN; PAM sequence: TTT
aatagttctaggatgggggc

SEQ ID NO: 70053 - DNA, 20 bp, Artificial Sequence
  Description of Artificial Sequence: Synthetic oligonucleotide
  Target: SCN9A; (-) strand; PAM type: YTN; PAM sequence: CTT
taatagttctaggatggggg

SEQ ID NO: 70054 - DNA, 20 bp, Artificial Sequence
  Description of Artificial Sequence: Synthetic oligonucleotide
  Target: SCN9A; (-) strand; PAM type: YTN; PAM sequence: CTG
aactttaatagttctaggat

SEQ ID NO: 70055 - DNA, 20 bp, Artificial Sequence
  Description of Artificial Sequence: Synthetic oligonucleotide
  Target: SCN9A; (-) strand; PAM type: YTN; PAM sequence: TTG
aatgactgaactttaatagt

SEQ ID NO: 70056 - DNA, 20 bp, Artificial Sequence
  Description of Artificial Sequence: Synthetic oligonucleotide
  Target: SCN9A; (-) strand; PAM type: YTN; PAM sequence: TTG
ttgaatgactgaactttaat

SEQ ID NO: 70057 - DNA, 20 bp, Artificial Sequence
  Description of Artificial Sequence: Synthetic oligonucleotide
  Target: SCN9A; (-) strand; PAM type: YTN; PAM sequence: TTT
gttgaatgactgaactttaa

SEQ ID NO: 70058 - DNA, 20 bp, Artificial Sequence
  Description of Artificial Sequence: Synthetic oligonucleotide
  Target: SCN9A; (-) strand; PAM type: YTN; PAM sequence: CTT
tgttgaatgactgaacttta

SEQ ID NO: 70059 - DNA, 20 bp, Artificial Sequence
  Description of Artificial Sequence: Synthetic oligonucleotide
  Target: SCN9A; (-) strand; PAM type: YTN; PAM sequence: TTA
gcatactttgttgaatgact

SEQ ID NO: 70060 - DNA, 20 bp, Artificial Sequence
  Description of Artificial Sequence: Synthetic oligonucleotide
  Target: SCN9A; (-) strand; PAM type: YTN; PAM sequence: TTT
agcatactttgttgaatgac

SEQ ID NO: 70061 - DNA, 20 bp, Artificial Sequence
  Description of Artificial Sequence: Synthetic oligonucleotide
  Target: SCN9A; (-) strand; PAM type: YTN; PAM sequence: TTT
tagcatactttgttgaatga

SEQ ID NO: 70062 - DNA, 20 bp, Artificial Sequence
  Description of Artificial Sequence: Synthetic oligonucleotide
  Target: SCN9A; (-) strand; PAM type: YTN; PAM sequence: TTA
attttagcatactttgttga

SEQ ID NO: 70063 - DNA, 20 bp, Artificial Sequence
  Description of Artificial Sequence: Synthetic oligonucleotide
  Target: SCN9A; (-) strand; PAM type: YTN; PAM sequence: TTT
aattttagcatactttgttg

SEQ ID NO: 70064 - DNA, 20 bp, Artificial Sequence
  Description of Artificial Sequence: Synthetic oligonucleotide
  Target: SCN9A; (-) strand; PAM type: YTN; PAM sequence: TTT
taattttagcatactttgtt

SEQ ID NO: 70065 - DNA, 20 bp, Artificial Sequence
  Description of Artificial Sequence: Synthetic oligonucleotide
  Target: SCN9A; (-) strand; PAM type: YTN; PAM sequence: CTA
agatatattttaattttagc

SEQ ID NO: 70066 - DNA, 20 bp, Artificial Sequence
  Description of Artificial Sequence: Synthetic oligonucleotide
  Target: SCN9A; (-) strand; PAM type: YTN; PAM sequence: TTA
aaatacatactaagatatat

SEQ ID NO: 70067 - DNA, 20 bp, Artificial Sequence
  Description of Artificial Sequence: Synthetic oligonucleotide
  Target: SCN9A; (-) strand; PAM type: YTN; PAM sequence: CTA
aaatgtattaaaatacatac

SEQ ID NO: 70068 - DNA, 20 bp, Artificial Sequence
  Description of Artificial Sequence: Synthetic oligonucleotide
  Target: SCN9A; (-) strand; PAM type: YTN; PAM sequence: TTC
taaaatgtattaaaatacat

SEQ ID NO: 70069 - DNA, 20 bp, Artificial Sequence
  Description of Artificial Sequence: Synthetic oligonucleotide
  Target: SCN9A; (-) strand; PAM type: YTN; PAM sequence: TTT
ctaaaatgtattaaaataca

SEQ ID NO: 70070 - DNA, 20 bp, Artificial Sequence
  Description of Artificial Sequence: Synthetic oligonucleotide
  Target: SCN9A; (-) strand; PAM type: YTN; PAM sequence: TTG
aatatttctaaaatgtatta

SEQ ID NO: 70071 - DNA, 20 bp, Artificial Sequence
  Description of Artificial Sequence: Synthetic oligonucleotide
  Target: SCN9A; (-) strand; PAM type: YTN; PAM sequence: TTA
ttgaatatttctaaaatgta

SEQ ID NO: 70072 - DNA, 20 bp, Artificial Sequence
  Description of Artificial Sequence: Synthetic oligonucleotide
  Target: SCN9A; (-) strand; PAM type: YTN; PAM sequence: CTT
attgaatatttctaaaatgt

SEQ ID NO: 70073 - DNA, 20 bp, Artificial Sequence
  Description of Artificial Sequence: Synthetic oligonucleotide
  Target: SCN9A; (-) strand; PAM type: YTN; PAM sequence: TTG
ccttattgaatatttctaaa

SEQ ID NO: 70074 - DNA, 20 bp, Artificial Sequence
  Description of Artificial Sequence: Synthetic oligonucleotide
  Target: SCN9A; (-) strand; PAM type: YTN; PAM sequence: TTA
atatgtattgccttattgaa

SEQ ID NO: 70075 - DNA, 20 bp, Artificial Sequence
  Description of Artificial Sequence: Synthetic oligonucleotide
  Target: SCN9A; (-) strand; PAM type: YTN; PAM sequence: TTA
gatacagattaatatgtatt

SEQ ID NO: 70076 - DNA, 20 bp, Artificial Sequence
  Description of Artificial Sequence: Synthetic oligonucleotide
  Target: SCN9A; (-) strand; PAM type: YTN; PAM sequence: CTG
aaattagatacagattaata

SEQ ID NO: 70077 - DNA, 20 bp, Artificial Sequence
  Description of Artificial Sequence: Synthetic oligonucleotide
  Target: SCN9A; (-) strand; PAM type: YTN; PAM sequence: TTA
ctgaaattagatacagatta

SEQ ID NO: 70078 - DNA, 20 bp, Artificial Sequence
  Description of Artificial Sequence: Synthetic oligonucleotide
  Target: SCN9A; (-) strand; PAM type: YTN; PAM sequence: TTT
actgaaattagatacagatt

SEQ ID NO: 70079 - DNA, 20 bp, Artificial Sequence
  Description of Artificial Sequence: Synthetic oligonucleotide
  Target: SCN9A; (-) strand; PAM type: YTN; PAM sequence: TTT
tactgaaattagatacagat

SEQ ID NO: 70080 - DNA, 20 bp, Artificial Sequence
  Description of Artificial Sequence: Synthetic oligonucleotide
  Target: SCN9A; (-) strand; PAM type: YTN; PAM sequence: CTT
ttactgaaattagatacaga

SEQ ID NO: 70081 - DNA, 20 bp, Artificial Sequence
  Description of Artificial Sequence: Synthetic oligonucleotide
  Target: SCN9A; (-) strand; PAM type: YTN; PAM sequence: CTA
tcaataacacatagaacact

SEQ ID NO: 70082 - DNA, 20 bp, Artificial Sequence
  Description of Artificial Sequence: Synthetic oligonucleotide
  Target: SCN9A; (-) strand; PAM type: YTN; PAM sequence: CTA
tctatcaataacacatagaa

SEQ ID NO: 70083 - DNA, 20 bp, Artificial Sequence
  Description of Artificial Sequence: Synthetic oligonucleotide
  Target: SCN9A; (-) strand; PAM type: YTN; PAM sequence: TTA
taaatcctatctatcaataa

SEQ ID NO: 70084 - DNA, 20 bp, Artificial Sequence
  Description of Artificial Sequence: Synthetic oligonucleotide
  Target: SCN9A; (-) strand; PAM type: YTN; PAM sequence: TTA
gatagagcatattataaatc

SEQ ID NO: 70085 - DNA, 20 bp, Artificial Sequence
  Description of Artificial Sequence: Synthetic oligonucleotide
  Target: SCN9A; (-) strand; PAM type: YTN; PAM sequence: TTT
agatagagcatattataaat

SEQ ID NO: 70086 - DNA, 20 bp, Artificial Sequence
  Description of Artificial Sequence: Synthetic oligonucleotide
  Target: SCN9A; (-) strand; PAM type: YTN; PAM sequence: CTA
agaggtttagatagagcata

SEQ ID NO: 70087 - DNA, 20 bp, Artificial Sequence
  Description of Artificial Sequence: Synthetic oligonucleotide
  Target: SCN9A; (-) strand; PAM type: YTN; PAM sequence: CTA
gaaactaagaggtttagata

SEQ ID NO: 70088 - DNA, 20 bp, Artificial Sequence
  Description of Artificial Sequence: Synthetic oligonucleotide
  Target: SCN9A; (-) strand; PAM type: YTN; PAM sequence: CTC
tagaaactaagaggtttaga

SEQ ID NO: 70089 - DNA, 20 bp, Artificial Sequence
  Description of Artificial Sequence: Synthetic oligonucleotide
  Target: SCN9A; (-) strand; PAM type: YTN; PAM sequence: TTA
tatacataatcagatcagtc

SEQ ID NO: 70090 - DNA, 20 bp, Artificial Sequence
  Description of Artificial Sequence: Synthetic oligonucleotide
  Target: SCN9A; (-) strand; PAM type: YTN; PAM sequence: CTG
attatatacataatcagatc

SEQ ID NO: 70091 - DNA, 20 bp, Artificial Sequence
  Description of Artificial Sequence: Synthetic oligonucleotide
  Target: SCN9A; (-) strand; PAM type: YTN; PAM sequence: TTC
tgattatatacataatcaga

SEQ ID NO: 70092 - DNA, 20 bp, Artificial Sequence
  Description of Artificial Sequence: Synthetic oligonucleotide
  Target: SCN9A; (-) strand; PAM type: YTN; PAM sequence: TTT
ctgattatatacataatcag

SEQ ID NO: 70093 - DNA, 20 bp, Artificial Sequence
  Description of Artificial Sequence: Synthetic oligonucleotide
  Target: SCN9A; (-) strand; PAM type: YTN; PAM sequence: TTG
ataagaataagtttctgatt

SEQ ID NO: 70094 - DNA, 20 bp, Artificial Sequence
  Description of Artificial Sequence: Synthetic oligonucleotide
  Target: SCN9A; (-) strand; PAM type: YTN; PAM sequence: CTC
attgataagaataagtttct

SEQ ID NO: 70095 - DNA, 20 bp, Artificial Sequence
  Description of Artificial Sequence: Synthetic oligonucleotide
  Target: SCN9A; (-) strand; PAM type: YTN; PAM sequence: TTA
ctcattgataagaataagtt

SEQ ID NO: 70096 - DNA, 20 bp, Artificial Sequence
  Description of Artificial Sequence: Synthetic oligonucleotide
  Target: SCN9A; (-) strand; PAM type: YTN; PAM sequence: TTC
cagaagtaatattactcatt

SEQ ID NO: 70097 - DNA, 20 bp, Artificial Sequence
  Description of Artificial Sequence: Synthetic oligonucleotide
  Target: SCN9A; (-) strand; PAM type: YTN; PAM sequence: TTA
ttccagaagtaatattactc

SEQ ID NO: 70098 - DNA, 20 bp, Artificial Sequence
  Description of Artificial Sequence: Synthetic oligonucleotide
  Target: SCN9A; (-) strand; PAM type: YTN; PAM sequence: TTT
attccagaagtaatattact

SEQ ID NO: 70099 - DNA, 20 bp, Artificial Sequence
  Description of Artificial Sequence: Synthetic oligonucleotide
  Target: SCN9A; (-) strand; PAM type: YTN; PAM sequence: TTT
tattccagaagtaatattac

SEQ ID NO: 70100 - DNA, 20 bp, Artificial Sequence
  Description of Artificial Sequence: Synthetic oligonucleotide
  Target: SCN9A; (-) strand; PAM type: YTN; PAM sequence: TTA
attttattccagaagtaata

SEQ ID NO: 70101 - DNA, 20 bp, Artificial Sequence
  Description of Artificial Sequence: Synthetic oligonucleotide
  Target: SCN9A; (-) strand; PAM type: YTN; PAM sequence: TTT
aattttattccagaagtaat

SEQ ID NO: 70102 - DNA, 20 bp, Artificial Sequence
  Description of Artificial Sequence: Synthetic oligonucleotide
  Target: SCN9A; (-) strand; PAM type: YTN; PAM sequence: TTC
aaaatgtttaattttattcc

SEQ ID NO: 70103 - DNA, 20 bp, Artificial Sequence
  Description of Artificial Sequence: Synthetic oligonucleotide
  Target: SCN9A; (-) strand; PAM type: YTN; PAM sequence: CTA
tgaatgaataagtgataagt

SEQ ID NO: 70104 - DNA, 20 bp, Artificial Sequence
  Description of Artificial Sequence: Synthetic oligonucleotide
  Target: SCN9A; (-) strand; PAM type: YTN; PAM sequence: TTG
cctatgaatgaataagtgat

SEQ ID NO: 70105 - DNA, 20 bp, Artificial Sequence
  Description of Artificial Sequence: Synthetic oligonucleotide
  Target: SCN9A; (-) strand; PAM type: YTN; PAM sequence: CTT
gcctatgaatgaataagtga

SEQ ID NO: 70106 - DNA, 20 bp, Artificial Sequence
  Description of Artificial Sequence: Synthetic oligonucleotide
  Target: SCN9A; (-) strand; PAM type: YTN; PAM sequence: TTG
ataggccttgcctatgaatg

SEQ ID NO: 70107 - DNA, 20 bp, Artificial Sequence
  Description of Artificial Sequence: Synthetic oligonucleotide
  Target: SCN9A; (-) strand; PAM type: YTN; PAM sequence: TTA
aaagttgataggccttgcct

SEQ ID NO: 70108 - DNA, 20 bp, Artificial Sequence
  Description of Artificial Sequence: Synthetic oligonucleotide
  Target: SCN9A; (-) strand; PAM type: YTN; PAM sequence: CTA
tataaaatgcatcagttaaa

SEQ ID NO: 70109 - DNA, 20 bp, Artificial Sequence
  Description of Artificial Sequence: Synthetic oligonucleotide
  Target: SCN9A; (-) strand; PAM type: YTN; PAM sequence: CTC
ctatataaaatgcatcagtt

SEQ ID NO: 70110 - DNA, 20 bp, Artificial Sequence
  Description of Artificial Sequence: Synthetic oligonucleotide
  Target: SCN9A; (-) strand; PAM type: YTN; PAM sequence: TTG
ctcctatataaaatgcatca

SEQ ID NO: 70111 - DNA, 20 bp, Artificial Sequence
  Description of Artificial Sequence: Synthetic oligonucleotide
  Target: SCN9A; (-) strand; PAM type: YTN; PAM sequence: TTT
gctcctatataaaatgcatc

SEQ ID NO: 70112 - DNA, 20 bp, Artificial Sequence
  Description of Artificial Sequence: Synthetic oligonucleotide
  Target: SCN9A; (-) strand; PAM type: YTN; PAM sequence: TTA
tttgctcctatataaaatgc

SEQ ID NO: 70113 - DNA, 20 bp, Artificial Sequence
  Description of Artificial Sequence: Synthetic oligonucleotide
  Target: SCN9A; (-) strand; PAM type: YTN; PAM sequence: TTT
atttgctcctatataaaatg

SEQ ID NO: 70114 - DNA, 20 bp, Artificial Sequence
  Description of Artificial Sequence: Synthetic oligonucleotide
  Target: SCN9A; (-) strand; PAM type: YTN; PAM sequence: TTT
tatttgctcctatataaaat

SEQ ID NO: 70115 - DNA, 20 bp, Artificial Sequence
  Description of Artificial Sequence: Synthetic oligonucleotide
  Target: SCN9A; (-) strand; PAM type: YTN; PAM sequence: TTG
attttatttgctcctatata

SEQ ID NO: 70116 - DNA, 20 bp, Artificial Sequence
  Description of Artificial Sequence: Synthetic oligonucleotide
  Target: SCN9A; (-) strand; PAM type: YTN; PAM sequence: TTT
gattttatttgctcctatat

SEQ ID NO: 70117 - DNA, 20 bp, Artificial Sequence
  Description of Artificial Sequence: Synthetic oligonucleotide
  Target: SCN9A; (-) strand; PAM type: YTN; PAM sequence: TTA
acatttgattttatttgctc

SEQ ID NO: 70118 - DNA, 20 bp, Artificial Sequence
  Description of Artificial Sequence: Synthetic oligonucleotide
  Target: SCN9A; (-) strand; PAM type: YTN; PAM sequence: CTC
agtaattaacatttgatttt

SEQ ID NO: 70119 - DNA, 20 bp, Artificial Sequence
  Description of Artificial Sequence: Synthetic oligonucleotide
  Target: SCN9A; (-) strand; PAM type: YTN; PAM sequence: TTA
aatcaactcagtaattaaca

SEQ ID NO: 70120 - DNA, 20 bp, Artificial Sequence
  Description of Artificial Sequence: Synthetic oligonucleotide
  Target: SCN9A; (-) strand; PAM type: YTN; PAM sequence: TTT
aaatcaactcagtaattaac

SEQ ID NO: 70121 - DNA, 20 bp, Artificial Sequence
  Description of Artificial Sequence: Synthetic oligonucleotide
  Target: SCN9A; (-) strand; PAM type: YTN; PAM sequence: TTT
taaatcaactcagtaattaa

SEQ ID NO: 70122 - DNA, 20 bp, Artificial Sequence
  Description of Artificial Sequence: Synthetic oligonucleotide
  Target: SCN9A; (-) strand; PAM type: YTN; PAM sequence: TTT
ttaaatcaactcagtaatta

SEQ ID NO: 70123 - DNA, 20 bp, Artificial Sequence
  Description of Artificial Sequence: Synthetic oligonucleotide
  Target: SCN9A; (-) strand; PAM type: YTN; PAM sequence: TTT
tttaaatcaactcagtaatt

SEQ ID NO: 70124 - DNA, 20 bp, Artificial Sequence
  Description of Artificial Sequence: Synthetic oligonucleotide
  Target: SCN9A; (-) strand; PAM type: YTN; PAM sequence: TTT
ttttaaatcaactcagtaat

SEQ ID NO: 70125 - DNA, 20 bp, Artificial Sequence
  Description of Artificial Sequence: Synthetic oligonucleotide
  Target: SCN9A; (-) strand; PAM type: YTN; PAM sequence: TTA
tttttttaaatcaactcagt

SEQ ID NO: 70126 - DNA, 20 bp, Artificial Sequence
  Description of Artificial Sequence: Synthetic oligonucleotide
  Target: SCN9A; (-) strand; PAM type: YTN; PAM sequence: TTT
atttttttaaatcaactcag

SEQ ID NO: 70127 - DNA, 20 bp, Artificial Sequence
  Description of Artificial Sequence: Synthetic oligonucleotide
  Target: SCN9A; (-) strand; PAM type: YTN; PAM sequence: CTT
tatttttttaaatcaactca

SEQ ID NO: 70128 - DNA, 20 bp, Artificial Sequence
  Description of Artificial Sequence: Synthetic oligonucleotide
  Target: SCN9A; (-) strand; PAM type: YTN; PAM sequence: TTA
tgggactttatttttttaaa

SEQ ID NO: 70129 - DNA, 20 bp, Artificial Sequence
  Description of Artificial Sequence: Synthetic oligonucleotide
  Target: SCN9A; (-) strand; PAM type: YTN; PAM sequence: TTA
gttatgggactttatttttt

SEQ ID NO: 70130 - DNA, 20 bp, Artificial Sequence
  Description of Artificial Sequence: Synthetic oligonucleotide
  Target: SCN9A; (-) strand; PAM type: YTN; PAM sequence: CTG
ttagttatgggactttattt

SEQ ID NO: 70131 - DNA, 20 bp, Artificial Sequence
  Description of Artificial Sequence: Synthetic oligonucleotide
  Target: SCN9A; (-) strand; PAM type: YTN; PAM sequence: TTA
tgcactgttagttatgggac

SEQ ID NO: 70132 - DNA, 20 bp, Artificial Sequence
  Description of Artificial Sequence: Synthetic oligonucleotide
  Target: SCN9A; (-) strand; PAM type: YTN; PAM sequence: TTT
atgcactgttagttatggga

SEQ ID NO: 70133 - DNA, 20 bp, Artificial Sequence
  Description of Artificial Sequence: Synthetic oligonucleotide
  Target: SCN9A; (-) strand; PAM type: YTN; PAM sequence: TTT
tatgcactgttagttatggg

SEQ ID NO: 70134 - DNA, 20 bp, Artificial Sequence
  Description of Artificial Sequence: Synthetic oligonucleotide
  Target: SCN9A; (-) strand; PAM type: YTN; PAM sequence: TTG
aaatggttttatgcactgtt

SEQ ID NO: 70135 - DNA, 20 bp, Artificial Sequence
  Description of Artificial Sequence: Synthetic oligonucleotide
  Target: SCN9A; (-) strand; PAM type: YTN; PAM sequence: TTT
gaaatggttttatgcactgt

SEQ ID NO: 70136 - DNA, 20 bp, Artificial Sequence
  Description of Artificial Sequence: Synthetic oligonucleotide
  Target: SCN9A; (-) strand; PAM type: YTN; PAM sequence: TTT
tgaaatggttttatgcactg

SEQ ID NO: 70137 - DNA, 20 bp, Artificial Sequence
  Description of Artificial Sequence: Synthetic oligonucleotide
  Target: SCN9A; (-) strand; PAM type: YTN; PAM sequence: TTG
aatacattttgaaatggttt

SEQ ID NO: 70138 - DNA, 20 bp, Artificial Sequence
  Description of Artificial Sequence: Synthetic oligonucleotide
  Target: SCN9A; (-) strand; PAM type: YTN; PAM sequence: TTT
gaatacattttgaaatggtt

SEQ ID NO: 70139 - DNA, 20 bp, Artificial Sequence
  Description of Artificial Sequence: Synthetic oligonucleotide
  Target: SCN9A; (-) strand; PAM type: YTN; PAM sequence: CTT
tgaatacattttgaaatggt

SEQ ID NO: 70140 - DNA, 20 bp, Artificial Sequence
  Description of Artificial Sequence: Synthetic oligonucleotide
  Target: SCN9A; (-) strand; PAM type: YTN; PAM sequence: CTA
gtataaactttgaatacatt

SEQ ID NO: 70141 - DNA, 20 bp, Artificial Sequence
  Description of Artificial Sequence: Synthetic oligonucleotide
  Target: SCN9A; (-) strand; PAM type: YTN; PAM sequence: TTC
tagtataaactttgaataca

SEQ ID NO: 70142 - DNA, 20 bp, Artificial Sequence
  Description of Artificial Sequence: Synthetic oligonucleotide
  Target: SCN9A; (-) strand; PAM type: YTN; PAM sequence: CTT
ctagtataaactttgaatac

SEQ ID NO: 70143 - DNA, 20 bp, Artificial Sequence
  Description of Artificial Sequence: Synthetic oligonucleotide
  Target: SCN9A; (-) strand; PAM type: YTN; PAM sequence: CTG
cttctagtataaactttgaa

SEQ ID NO: 70144 - DNA, 20 bp, Artificial Sequence
  Description of Artificial Sequence: Synthetic oligonucleotide
  Target: SCN9A; (-) strand; PAM type: YTN; PAM sequence: TTG
gggtcaaagccaaagtaccc

SEQ ID NO: 70145 - DNA, 20 bp, Artificial Sequence
  Description of Artificial Sequence: Synthetic oligonucleotide
  Target: SCN9A; (-) strand; PAM type: YTN; PAM sequence: CTA
gaaagttggggtcaaagcca

SEQ ID NO: 70146 - DNA, 20 bp, Artificial Sequence
  Description of Artificial Sequence: Synthetic oligonucleotide
  Target: SCN9A; (-) strand; PAM type: YTN; PAM sequence: TTA
gtacacatctagaaagttgg

SEQ ID NO: 70147 - DNA, 20 bp, Artificial Sequence
  Description of Artificial Sequence: Synthetic oligonucleotide
  Target: SCN9A; (-) strand; PAM type: YTN; PAM sequence: CTT
agtacacatctagaaagttg

SEQ ID NO: 70148 - DNA, 20 bp, Artificial Sequence
  Description of Artificial Sequence: Synthetic oligonucleotide
  Target: SCN9A; (-) strand; PAM type: YTN; PAM sequence: TTC
ttagtacacatctagaaagt

SEQ ID NO: 70149 - DNA, 20 bp, Artificial Sequence
  Description of Artificial Sequence: Synthetic oligonucleotide
  Target: SCN9A; (-) strand; PAM type: YTN; PAM sequence: TTT
cttagtacacatctagaaag

SEQ ID NO: 70150 - DNA, 20 bp, Artificial Sequence
  Description of Artificial Sequence: Synthetic oligonucleotide
  Target: SCN9A; (-) strand; PAM type: YTN; PAM sequence: CTT
tcttagtacacatctagaaa

SEQ ID NO: 70151 - DNA, 20 bp, Artificial Sequence
  Description of Artificial Sequence: Synthetic oligonucleotide
  Target: SCN9A; (-) strand; PAM type: YTN; PAM sequence: CTC
atgctttcttagtacacatc

SEQ ID NO: 70152 - DNA, 20 bp, Artificial Sequence
  Description of Artificial Sequence: Synthetic oligonucleotide
  Target: SCN9A; (-) strand; PAM type: YTN; PAM sequence: TTG
agactcatgctttcttagta

SEQ ID NO: 70153 - DNA, 20 bp, Artificial Sequence
  Description of Artificial Sequence: Synthetic oligonucleotide
  Target: SCN9A; (-) strand; PAM type: YTN; PAM sequence: TTA
tggataagcaaattgagact

SEQ ID NO: 70154 - DNA, 20 bp, Artificial Sequence
  Description of Artificial Sequence: Synthetic oligonucleotide
  Target: SCN9A; (-) strand; PAM type: YTN; PAM sequence: TTT
atggataagcaaattgagac

SEQ ID NO: 70155 - DNA, 20 bp, Artificial Sequence
  Description of Artificial Sequence: Synthetic oligonucleotide
  Target: SCN9A; (-) strand; PAM type: YTN; PAM sequence: TTA
tgtatttatggataagcaaa

SEQ ID NO: 70156 - DNA, 20 bp, Artificial Sequence
  Description of Artificial Sequence: Synthetic oligonucleotide
  Target: SCN9A; (-) strand; PAM type: YTN; PAM sequence: CTG
gttatgtatttatggataag

SEQ ID NO: 70157 - DNA, 20 bp, Artificial Sequence
  Description of Artificial Sequence: Synthetic oligonucleotide
  Target: SCN9A; (-) strand; PAM type: YTN; PAM sequence: TTC
tggttatgtatttatggata

SEQ ID NO: 70158 - DNA, 20 bp, Artificial Sequence
  Description of Artificial Sequence: Synthetic oligonucleotide
  Target: SCN9A; (-) strand; PAM type: YTN; PAM sequence: TTA
ataattctggttatgtattt

SEQ ID NO: 70159 - DNA, 20 bp, Artificial Sequence
  Description of Artificial Sequence: Synthetic oligonucleotide
  Target: SCN9A; (-) strand; PAM type: YTN; PAM sequence: TTT
aataattctggttatgtatt

SEQ ID NO: 70160 - DNA, 20 bp, Artificial Sequence
  Description of Artificial Sequence: Synthetic oligonucleotide
  Target: SCN9A; (-) strand; PAM type: YTN; PAM sequence: TTG
tatttaataattctggttat

SEQ ID NO: 70161 - DNA, 20 bp, Artificial Sequence
  Description of Artificial Sequence: Synthetic oligonucleotide
  Target: SCN9A; (-) strand; PAM type: YTN; PAM sequence: TTT
gtatttaataattctggtta

SEQ ID NO: 70162 - DNA, 20 bp, Artificial Sequence
  Description of Artificial Sequence: Synthetic oligonucleotide
  Target: SCN9A; (-) strand; PAM type: YTN; PAM sequence: CTT
tgtatttaataattctggtt

SEQ ID NO: 70163 - DNA, 20 bp, Artificial Sequence
  Description of Artificial Sequence: Synthetic oligonucleotide
  Target: SCN9A; (-) strand; PAM type: YTN; PAM sequence: CTA
gctttgtatttaataattct

SEQ ID NO: 70164 - DNA, 20 bp, Artificial Sequence
  Description of Artificial Sequence: Synthetic oligonucleotide
  Target: SCN9A; (-) strand; PAM type: YTN; PAM sequence: TTC
tagctttgtatttaataatt

SEQ ID NO: 70165 - DNA, 20 bp, Artificial Sequence
  Description of Artificial Sequence: Synthetic oligonucleotide
  Target: SCN9A; (-) strand; PAM type: YTN; PAM sequence: TTG
taattctagctttgtattta

SEQ ID NO: 70166 - DNA, 20 bp, Artificial Sequence
  Description of Artificial Sequence: Synthetic oligonucleotide
  Target: SCN9A; (-) strand; PAM type: YTN; PAM sequence: CTC
agagcaggaaaagatcattg

SEQ ID NO: 70167 - DNA, 20 bp, Artificial Sequence
  Description of Artificial Sequence: Synthetic oligonucleotide
  Target: SCN9A; (-) strand; PAM type: YTN; PAM sequence: CTG
gcataaatataaaatctcag

SEQ ID NO: 70168 - DNA, 20 bp, Artificial Sequence
  Description of Artificial Sequence: Synthetic oligonucleotide
  Target: SCN9A; (-) strand; PAM type: YTN; PAM sequence: TTC
tggcataaatataaaatctc

SEQ ID NO: 70169 - DNA, 20 bp, Artificial Sequence
  Description of Artificial Sequence: Synthetic oligonucleotide
  Target: SCN9A; (-) strand; PAM type: YTN; PAM sequence: TTT
ctggcataaatataaaatct

SEQ ID NO: 70170 - DNA, 20 bp, Artificial Sequence
  Description of Artificial Sequence: Synthetic oligonucleotide
  Target: SCN9A; (-) strand; PAM type: YTN; PAM sequence: TTG
tggaagaagtgtttctggca

SEQ ID NO: 70171 - DNA, 20 bp, Artificial Sequence
  Description of Artificial Sequence: Synthetic oligonucleotide
  Target: SCN9A; (-) strand; PAM type: YTN; PAM sequence: CTA
aaaaattgtggaagaagtgt

SEQ ID NO: 70172 - DNA, 20 bp, Artificial Sequence
  Description of Artificial Sequence: Synthetic oligonucleotide
  Target: SCN9A; (-) strand; PAM type: YTN; PAM sequence: CTC
taaaaaattgtggaagaagt

SEQ ID NO: 70173 - DNA, 20 bp, Artificial Sequence
  Description of Artificial Sequence: Synthetic oligonucleotide
  Target: SCN9A; (-) strand; PAM type: YTN; PAM sequence: TTA
agtagatcaaaactctaaaa

SEQ ID NO: 70174 - DNA, 20 bp, Artificial Sequence
  Description of Artificial Sequence: Synthetic oligonucleotide
  Target: SCN9A; (-) strand; PAM type: YTN; PAM sequence: TTA
aattaagtagatcaaaactc

SEQ ID NO: 70175 - DNA, 20 bp, Artificial Sequence
  Description of Artificial Sequence: Synthetic oligonucleotide
  Target: SCN9A; (-) strand; PAM type: YTN; PAM sequence: TTT
aaattaagtagatcaaaact

SEQ ID NO: 70176 - DNA, 20 bp, Artificial Sequence
  Description of Artificial Sequence: Synthetic oligonucleotide
  Target: SCN9A; (-) strand; PAM type: YTN; PAM sequence: TTG
tcacatttaaattaagtaga

SEQ ID NO: 70177 - DNA, 20 bp, Artificial Sequence
  Description of Artificial Sequence: Synthetic oligonucleotide
  Target: SCN9A; (-) strand; PAM type: YTN; PAM sequence: TTA
aattgtcacatttaaattaa

SEQ ID NO: 70178 - DNA, 20 bp, Artificial Sequence
  Description of Artificial Sequence: Synthetic oligonucleotide
  Target: SCN9A; (-) strand; PAM type: YTN; PAM sequence: CTA
cataaaaatatggagagatg

SEQ ID NO: 70179 - DNA, 20 bp, Artificial Sequence
  Description of Artificial Sequence: Synthetic oligonucleotide
  Target: SCN9A; (-) strand; PAM type: YTN; PAM sequence: TTA
atctacataaaaatatggag

SEQ ID NO: 70180 - DNA, 20 bp, Artificial Sequence
  Description of Artificial Sequence: Synthetic oligonucleotide
  Target: SCN9A; (-) strand; PAM type: YTN; PAM sequence: TTT
aatctacataaaaatatgga

SEQ ID NO: 70181 - DNA, 20 bp, Artificial Sequence
  Description of Artificial Sequence: Synthetic oligonucleotide
  Target: SCN9A; (-) strand; PAM type: YTN; PAM sequence: CTG
atttaatctacataaaaata

SEQ ID NO: 70182 - DNA, 20 bp, Artificial Sequence
  Description of Artificial Sequence: Synthetic oligonucleotide
  Target: SCN9A; (-) strand; PAM type: YTN; PAM sequence: TTC
ctgatttaatctacataaaa

SEQ ID NO: 70183 - DNA, 20 bp, Artificial Sequence
  Description of Artificial Sequence: Synthetic oligonucleotide
  Target: SCN9A; (-) strand; PAM type: YTN; PAM sequence: CTT
cctgatttaatctacataaa

SEQ ID NO: 70184 - DNA, 20 bp, Artificial Sequence
  Description of Artificial Sequence: Synthetic oligonucleotide
  Target: SCN9A; (-) strand; PAM type: YTN; PAM sequence: TTC
ccttcctgatttaatctaca

SEQ ID NO: 70185 - DNA, 20 bp, Artificial Sequence
  Description of Artificial Sequence: Synthetic oligonucleotide
  Target: SCN9A; (-) strand; PAM type: YTN; PAM sequence: CTT
cccttcctgatttaatctac

SEQ ID NO: 70186 - DNA, 20 bp, Artificial Sequence
  Description of Artificial Sequence: Synthetic oligonucleotide
  Target: SCN9A; (-) strand; PAM type: YTN; PAM sequence: CTA
tcaacttcccttcctgattt

SEQ ID NO: 70187 - DNA, 20 bp, Artificial Sequence
  Description of Artificial Sequence: Synthetic oligonucleotide
  Target: SCN9A; (-) strand; PAM type: YTN; PAM sequence: CTC
tatcaacttcccttcctgat

SEQ ID NO: 70188 - DNA, 20 bp, Artificial Sequence
  Description of Artificial Sequence: Synthetic oligonucleotide
  Target: SCN9A; (-) strand; PAM type: YTN; PAM sequence: TTG
aaaacctctatcaacttccc

SEQ ID NO: 70189 - DNA, 20 bp, Artificial Sequence
  Description of Artificial Sequence: Synthetic oligonucleotide
  Target: SCN9A; (-) strand; PAM type: YTN; PAM sequence: TTT
gaaaacctctatcaacttcc

SEQ ID NO: 70190 - DNA, 20 bp, Artificial Sequence
  Description of Artificial Sequence: Synthetic oligonucleotide
  Target: SCN9A; (-) strand; PAM type: YTN; PAM sequence: TTA
atttgaaaacctctatcaac

SEQ ID NO: 70191 - DNA, 20 bp, Artificial Sequence
  Description of Artificial Sequence: Synthetic oligonucleotide
  Target: SCN9A; (-) strand; PAM type: YTN; PAM sequence: TTT
aatttgaaaacctctatcaa

SEQ ID NO: 70192 - DNA, 20 bp, Artificial Sequence
  Description of Artificial Sequence: Synthetic oligonucleotide
  Target: SCN9A; (-) strand; PAM type: YTN; PAM sequence: CTA
catttaatttgaaaacctct

SEQ ID NO: 70193 - DNA, 20 bp, Artificial Sequence
  Description of Artificial Sequence: Synthetic oligonucleotide
  Target: SCN9A; (-) strand; PAM type: YTN; PAM sequence: TTG
aagctacatttaatttgaaa

SEQ ID NO: 70194 - DNA, 20 bp, Artificial Sequence
  Description of Artificial Sequence: Synthetic oligonucleotide
  Target: SCN9A; (-) strand; PAM type: YTN; PAM sequence: TTA
taaaagtaaaatgcagaatg

SEQ ID NO: 70195 - DNA, 20 bp, Artificial Sequence
  Description of Artificial Sequence: Synthetic oligonucleotide
  Target: SCN9A; (-) strand; PAM type: YTN; PAM sequence: TTG
attataaaagtaaaatgcag

SEQ ID NO: 70196 - DNA, 20 bp, Artificial Sequence
  Description of Artificial Sequence: Synthetic oligonucleotide
  Target: SCN9A; (-) strand; PAM type: YTN; PAM sequence: TTG
aattgattataaaagtaaaa

SEQ ID NO: 70197 - DNA, 20 bp, Artificial Sequence
  Description of Artificial Sequence: Synthetic oligonucleotide
  Target: SCN9A; (-) strand; PAM type: YTN; PAM sequence: TTA
ttgaattgattataaaagta

SEQ ID NO: 70198 - DNA, 20 bp, Artificial Sequence
  Description of Artificial Sequence: Synthetic oligonucleotide
  Target: SCN9A; (-) strand; PAM type: YTN; PAM sequence: TTT
attgaattgattataaaagt

SEQ ID NO: 70199 - DNA, 20 bp, Artificial Sequence
  Description of Artificial Sequence: Synthetic oligonucleotide
  Target: SCN9A; (-) strand; PAM type: YTN; PAM sequence: TTT
tattgaattgattataaaag

SEQ ID NO: 70200 - DNA, 20 bp, Artificial Sequence
  Description of Artificial Sequence: Synthetic oligonucleotide
  Target: SCN9A; (-) strand; PAM type: YTN; PAM sequence: TTT
ttattgaattgattataaaa

SEQ ID NO: 70201 - DNA, 20 bp, Artificial Sequence
  Description of Artificial Sequence: Synthetic oligonucleotide
  Target: SCN9A; (-) strand; PAM type: YTN; PAM sequence: CTG
tagatttttattgaattgat

SEQ ID NO: 70202 - DNA, 20 bp, Artificial Sequence
  Description of Artificial Sequence: Synthetic oligonucleotide
  Target: SCN9A; (-) strand; PAM type: YTN; PAM sequence: TTC
aagtgcatgatctgtagatt

SEQ ID NO: 70203 - DNA, 20 bp, Artificial Sequence
  Description of Artificial Sequence: Synthetic oligonucleotide
  Target: SCN9A; (-) strand; PAM type: YTN; PAM sequence: TTT
caagtgcatgatctgtagat

SEQ ID NO: 70204 - DNA, 20 bp, Artificial Sequence
  Description of Artificial Sequence: Synthetic oligonucleotide
  Target: SCN9A; (-) strand; PAM type: YTN; PAM sequence: TTA
agtgatttcaagtgcatgat

SEQ ID NO: 70205 - DNA, 20 bp, Artificial Sequence
  Description of Artificial Sequence: Synthetic oligonucleotide
  Target: SCN9A; (-) strand; PAM type: YTN; PAM sequence: CTT
aagtgatttcaagtgcatga

SEQ ID NO: 70206 - DNA, 20 bp, Artificial Sequence
  Description of Artificial Sequence: Synthetic oligonucleotide
  Target: SCN9A; (-) strand; PAM type: YTN; PAM sequence: TTC
atgtgcttaagtgatttcaa

SEQ ID NO: 70207 - DNA, 20 bp, Artificial Sequence
  Description of Artificial Sequence: Synthetic oligonucleotide
  Target: SCN9A; (-) strand; PAM type: YTN; PAM sequence: CTT
catgtgcttaagtgatttca

SEQ ID NO: 70208 - DNA, 20 bp, Artificial Sequence
  Description of Artificial Sequence: Synthetic oligonucleotide
  Target: SCN9A; (-) strand; PAM type: YTN; PAM sequence: TTG
atgtaaccttcatgtgctta

SEQ ID NO: 70209 - DNA, 20 bp, Artificial Sequence
  Description of Artificial Sequence: Synthetic oligonucleotide
  Target: SCN9A; (-) strand; PAM type: YTN; PAM sequence: CTT
gatgtaaccttcatgtgctt

SEQ ID NO: 70210 - DNA, 20 bp, Artificial Sequence
  Description of Artificial Sequence: Synthetic oligonucleotide
  Target: SCN9A; (-) strand; PAM type: YTN; PAM sequence: TTC
ttgatgtaaccttcatgtgc

SEQ ID NO: 70211 - DNA, 20 bp, Artificial Sequence
  Description of Artificial Sequence: Synthetic oligonucleotide
  Target: SCN9A; (-) strand; PAM type: YTN; PAM sequence: CTT
cttgatgtaaccttcatgtg

SEQ ID NO: 70212 - DNA, 20 bp, Artificial Sequence
  Description of Artificial Sequence: Synthetic oligonucleotide
  Target: SCN9A; (-) strand; PAM type: YTN; PAM sequence: TTG
atgacttcttgatgtaacct

SEQ ID NO: 70213 - DNA, 20 bp, Artificial Sequence
  Description of Artificial Sequence: Synthetic oligonucleotide
  Target: SCN9A; (-) strand; PAM type: YTN; PAM sequence: CTT
gatgacttcttgatgtaacc

SEQ ID NO: 70214 - DNA, 20 bp, Artificial Sequence
  Description of Artificial Sequence: Synthetic oligonucleotide
  Target: SCN9A; (-) strand; PAM type: YTN; PAM sequence: CTC
ttgatgacttcttgatgtaa

SEQ ID NO: 70215 - DNA, 20 bp, Artificial Sequence
  Description of Artificial Sequence: Synthetic oligonucleotide
  Target: SCN9A; (-) strand; PAM type: YTN; PAM sequence: TTC
tcttgatgacttcttgatgt

SEQ ID NO: 70216 - DNA, 20 bp, Artificial Sequence
  Description of Artificial Sequence: Synthetic oligonucleotide
  Target: SCN9A; (-) strand; PAM type: YTN; PAM sequence: TTG
tgattctcttgatgacttct

SEQ ID NO: 70217 - DNA, 20 bp, Artificial Sequence
  Description of Artificial Sequence: Synthetic oligonucleotide
  Target: SCN9A; (-) strand; PAM type: YTN; PAM sequence: TTT
gtgattctcttgatgacttc

SEQ ID NO: 70218 - DNA, 20 bp, Artificial Sequence
  Description of Artificial Sequence: Synthetic oligonucleotide
  Target: SCN9A; (-) strand; PAM type: YTN; PAM sequence: TTT
tgtgattctcttgatgactt

SEQ ID NO: 70219 - DNA, 20 bp, Artificial Sequence
  Description of Artificial Sequence: Synthetic oligonucleotide
  Target: SCN9A; (-) strand; PAM type: YTN; PAM sequence: TTT
ttgtgattctcttgatgact

SEQ ID NO: 70220 - DNA, 20 bp, Artificial Sequence
  Description of Artificial Sequence: Synthetic oligonucleotide
  Target: SCN9A; (-) strand; PAM type: YTN; PAM sequence: TTT
tttgtgattctcttgatgac

SEQ ID NO: 70221 - DNA, 20 bp, Artificial Sequence
  Description of Artificial Sequence: Synthetic oligonucleotide
  Target: SCN9A; (-) strand; PAM type: YTN; PAM sequence: TTT
ttttgtgattctcttgatga

SEQ ID NO: 70222 - DNA, 20 bp, Artificial Sequence
  Description of Artificial Sequence: Synthetic oligonucleotide
  Target: SCN9A; (-) strand; PAM type: YTN; PAM sequence: TTA
tttttttgtgattctcttga

SEQ ID NO: 70223 - DNA, 20 bp, Artificial Sequence
  Description of Artificial Sequence: Synthetic oligonucleotide
  Target: SCN9A; (-) strand; PAM type: YTN; PAM sequence: TTG
attatttttttgtgattctc

SEQ ID NO: 70224 - DNA, 20 bp, Artificial Sequence
  Description of Artificial Sequence: Synthetic oligonucleotide
  Target: SCN9A; (-) strand; PAM type: YTN; PAM sequence: TTT
gattatttttttgtgattct

SEQ ID NO: 70225 - DNA, 20 bp, Artificial Sequence
  Description of Artificial Sequence: Synthetic oligonucleotide
  Target: SCN9A; (-) strand; PAM type: YTN; PAM sequence: TTC
aatagataaagtgacatcac

SEQ ID NO: 70226 - DNA, 20 bp, Artificial Sequence
  Description of Artificial Sequence: Synthetic oligonucleotide
  Target: SCN9A; (-) strand; PAM type: YTN; PAM sequence: TTG
ttcaatagataaagtgacat

SEQ ID NO: 70227 - DNA, 20 bp, Artificial Sequence
  Description of Artificial Sequence: Synthetic oligonucleotide
  Target: SCN9A; (-) strand; PAM type: YTN; PAM sequence: CTG
caagaaagtagaaacatata

SEQ ID NO: 70228 - DNA, 20 bp, Artificial Sequence
  Description of Artificial Sequence: Synthetic oligonucleotide
  Target: SCN9A; (-) strand; PAM type: YTN; PAM sequence: CTG
acccactgcaagaaagtaga

SEQ ID NO: 70229 - DNA, 20 bp, Artificial Sequence
  Description of Artificial Sequence: Synthetic oligonucleotide
  Target: SCN9A; (-) strand; PAM type: YTN; PAM sequence: CTG
cctgacccactgcaagaaag

SEQ ID NO: 70230 - DNA, 20 bp, Artificial Sequence
  Description of Artificial Sequence: Synthetic oligonucleotide
  Target: SCN9A; (-) strand; PAM type: YTN; PAM sequence: TTC
tgcctgacccactgcaagaa

SEQ ID NO: 70231 - DNA, 20 bp, Artificial Sequence
  Description of Artificial Sequence: Synthetic oligonucleotide
  Target: SCN9A; (-) strand; PAM type: YTN; PAM sequence: TTT
ctgcctgacccactgcaaga

SEQ ID NO: 70232 - DNA, 20 bp, Artificial Sequence
  Description of Artificial Sequence: Synthetic oligonucleotide
  Target: SCN9A; (-) strand; PAM type: YTN; PAM sequence: CTT
tctgcctgacccactgcaag

SEQ ID NO: 70233 - DNA, 20 bp, Artificial Sequence
  Description of Artificial Sequence: Synthetic oligonucleotide
  Target: SCN9A; (-) strand; PAM type: YTN; PAM sequence: CTA
caaaacctttctgcctgacc

SEQ ID NO: 70234 - DNA, 20 bp, Artificial Sequence
  Description of Artificial Sequence: Synthetic oligonucleotide
  Target: SCN9A; (-) strand; PAM type: YTN; PAM sequence: TTC
agctacaaaacctttctgcc

SEQ ID NO: 70235 - DNA, 20 bp, Artificial Sequence
  Description of Artificial Sequence: Synthetic oligonucleotide
  Target: SCN9A; (-) strand; PAM type: YTN; PAM sequence: CTG
ttcagctacaaaacctttct

SEQ ID NO: 70236 - DNA, 20 bp, Artificial Sequence
  Description of Artificial Sequence: Synthetic oligonucleotide
  Target: SCN9A; (-) strand; PAM type: YTN; PAM sequence: TTG
catgctgttcagctacaaaa

SEQ ID NO: 70237 - DNA, 20 bp, Artificial Sequence
  Description of Artificial Sequence: Synthetic oligonucleotide
  Target: SCN9A; (-) strand; PAM type: YTN; PAM sequence: CTT
gcatgctgttcagctacaaa

SEQ ID NO: 70238 - DNA, 20 bp, Artificial Sequence
  Description of Artificial Sequence: Synthetic oligonucleotide
  Target: SCN9A; (-) strand; PAM type: YTN; PAM sequence: TTC
aatgtcttgcatgctgttca

SEQ ID NO: 70239 - DNA, 20 bp, Artificial Sequence
  Description of Artificial Sequence: Synthetic oligonucleotide
  Target: SCN9A; (-) strand; PAM type: YTN; PAM sequence: TTT
caatgtcttgcatgctgttc

SEQ ID NO: 70240 - DNA, 20 bp, Artificial Sequence
  Description of Artificial Sequence: Synthetic oligonucleotide
  Target: SCN9A; (-) strand; PAM type: YTN; PAM sequence: TTT
tcaatgtcttgcatgctgtt

SEQ ID NO: 70241 - DNA, 20 bp, Artificial Sequence
  Description of Artificial Sequence: Synthetic oligonucleotide
  Target: SCN9A; (-) strand; PAM type: YTN; PAM sequence: TTT
ttcaatgtcttgcatgctgt

SEQ ID NO: 70242 - DNA, 20 bp, Artificial Sequence
  Description of Artificial Sequence: Synthetic oligonucleotide
  Target: SCN9A; (-) strand; PAM type: YTN; PAM sequence: TTT
tttcaatgtcttgcatgctg

SEQ ID NO: 70243 - DNA, 20 bp, Artificial Sequence
  Description of Artificial Sequence: Synthetic oligonucleotide
  Target: SCN9A; (-) strand; PAM type: YTN; PAM sequence: CTA
aaaaaatcatacatacgata

SEQ ID NO: 70244 - DNA, 20 bp, Artificial Sequence
  Description of Artificial Sequence: Synthetic oligonucleotide
  Target: SCN9A; (-) strand; PAM type: YTN; PAM sequence: TTA
cctaaaaaaatcatacatac

SEQ ID NO: 70245 - DNA, 20 bp, Artificial Sequence
  Description of Artificial Sequence: Synthetic oligonucleotide
  Target: SCN9A; (-) strand; PAM type: YTN; PAM sequence: TTA
cacaggttacctaaaaaaat

SEQ ID NO: 70246 - DNA, 20 bp, Artificial Sequence
  Description of Artificial Sequence: Synthetic oligonucleotide
  Target: SCN9A; (-) strand; PAM type: YTN; PAM sequence: TTT
acacaggttacctaaaaaaa

SEQ ID NO: 70247 - DNA, 20 bp, Artificial Sequence
  Description of Artificial Sequence: Synthetic oligonucleotide
  Target: SCN9A; (-) strand; PAM type: YTN; PAM sequence: TTT
tacacaggttacctaaaaaa

SEQ ID NO: 70248 - DNA, 20 bp, Artificial Sequence
  Description of Artificial Sequence: Synthetic oligonucleotide
  Target: SCN9A; (-) strand; PAM type: YTN; PAM sequence: CTT
ttacacaggttacctaaaaa

SEQ ID NO: 70249 - DNA, 20 bp, Artificial Sequence
  Description of Artificial Sequence: Synthetic oligonucleotide
  Target: SCN9A; (-) strand; PAM type: YTN; PAM sequence: TTA
accaggcagagacatatgtc

SEQ ID NO: 70250 - DNA, 20 bp, Artificial Sequence
  Description of Artificial Sequence: Synthetic oligonucleotide
  Target: SCN9A; (-) strand; PAM type: YTN; PAM sequence: TTT
aaccaggcagagacatatgt

SEQ ID NO: 70251 - DNA, 20 bp, Artificial Sequence
  Description of Artificial Sequence: Synthetic oligonucleotide
  Target: SCN9A; (-) strand; PAM type: YTN; PAM sequence: TTT
taaccaggcagagacatatg

SEQ ID NO: 70252 - DNA, 20 bp, Artificial Sequence
  Description of Artificial Sequence: Synthetic oligonucleotide
  Target: SCN9A; (-) strand; PAM type: YTN; PAM sequence: CTT
ttaaccaggcagagacatat

SEQ ID NO: 70253 - DNA, 20 bp, Artificial Sequence
  Description of Artificial Sequence: Synthetic oligonucleotide
  Target: SCN9A; (-) strand; PAM type: YTN; PAM sequence: CTG
tgcttttaaccaggcagaga

SEQ ID NO: 70254 - DNA, 20 bp, Artificial Sequence
  Description of Artificial Sequence: Synthetic oligonucleotide
  Target: SCN9A; (-) strand; PAM type: YTN; PAM sequence: CTC
tgtgcttttaaccaggcaga

SEQ ID NO: 70255 - DNA, 20 bp, Artificial Sequence
  Description of Artificial Sequence: Synthetic oligonucleotide
  Target: SCN9A; (-) strand; PAM type: YTN; PAM sequence: CTG
gatcagtcaaggatgcagct

SEQ ID NO: 70256 - DNA, 20 bp, Artificial Sequence
  Description of Artificial Sequence: Synthetic oligonucleotide
  Target: SCN9A; (-) strand; PAM type: YTN; PAM sequence: CTC
acaggggtaatatcaaactg

SEQ ID NO: 70257 - DNA, 20 bp, Artificial Sequence
  Description of Artificial Sequence: Synthetic oligonucleotide
  Target: SCN9A; (-) strand; PAM type: YTN; PAM sequence: TTC
tcacaggggtaatatcaaac

SEQ ID NO: 70258 - DNA, 20 bp, Artificial Sequence
  Description of Artificial Sequence: Synthetic oligonucleotide
  Target: SCN9A; (-) strand; PAM type: YTN; PAM sequence: CTT
ctcacaggggtaatatcaaa

SEQ ID NO: 70259 - DNA, 20 bp, Artificial Sequence
  Description of Artificial Sequence: Synthetic oligonucleotide
  Target: SCN9A; (-) strand; PAM type: YTN; PAM sequence: TTC
ttctcacaggggtaatatca

SEQ ID NO: 70260 - DNA, 20 bp, Artificial Sequence
  Description of Artificial Sequence: Synthetic oligonucleotide
  Target: SCN9A; (-) strand; PAM type: YTN; PAM sequence: CTT
cttctcacaggggtaatatc

SEQ ID NO: 70261 - DNA, 20 bp, Artificial Sequence
  Description of Artificial Sequence: Synthetic oligonucleotide
  Target: SCN9A; (-) strand; PAM type: YTN; PAM sequence: CTA
accttcttctcacaggggta

SEQ ID NO: 70262 - DNA, 20 bp, Artificial Sequence
  Description of Artificial Sequence: Synthetic oligonucleotide
  Target: SCN9A; (-) strand; PAM type: YTN; PAM sequence: TTC
agtacctaaccttcttctca

SEQ ID NO: 70263 - DNA, 20 bp, Artificial Sequence
  Description of Artificial Sequence: Synthetic oligonucleotide
  Target: SCN9A; (-) strand; PAM type: YTN; PAM sequence: CTA
aaattcagtacctaaccttc

SEQ ID NO: 70264 - DNA, 20 bp, Artificial Sequence
  Description of Artificial Sequence: Synthetic oligonucleotide
  Target: SCN9A; (-) strand; PAM type: YTN; PAM sequence: TTC
taaaattcagtacctaacct

SEQ ID NO: 70265 - DNA, 20 bp, Artificial Sequence
  Description of Artificial Sequence: Synthetic oligonucleotide
  Target: SCN9A; (-) strand; PAM type: YTN; PAM sequence: TTT
ctaaaattcagtacctaacc

SEQ ID NO: 70266 - DNA, 20 bp, Artificial Sequence
  Description of Artificial Sequence: Synthetic oligonucleotide
  Target: SCN9A; (-) strand; PAM type: YTN; PAM sequence: CTG
catttctaaaattcagtacc

SEQ ID NO: 70267 - DNA, 20 bp, Artificial Sequence
  Description of Artificial Sequence: Synthetic oligonucleotide
  Target: SCN9A; (-) strand; PAM type: YTN; PAM sequence: TTC
atcatgctgcatttctaaaa

SEQ ID NO: 70268 - DNA, 20 bp, Artificial Sequence
  Description of Artificial Sequence: Synthetic oligonucleotide
  Target: SCN9A; (-) strand; PAM type: YTN; PAM sequence: TTT
catcatgctgcatttctaaa

SEQ ID NO: 70269 - DNA, 20 bp, Artificial Sequence
  Description of Artificial Sequence: Synthetic oligonucleotide
  Target: SCN9A; (-) strand; PAM type: YTN; PAM sequence: CTT
tcatcatgctgcatttctaa

SEQ ID NO: 70270 - DNA, 20 bp, Artificial Sequence
  Description of Artificial Sequence: Synthetic oligonucleotide
  Target: SCN9A; (-) strand; PAM type: YTN; PAM sequence: CTC
tttcatcatgctgcatttct

SEQ ID NO: 70271 - DNA, 20 bp, Artificial Sequence
  Description of Artificial Sequence: Synthetic oligonucleotide
  Target: SCN9A; (-) strand; PAM type: YTN; PAM sequence: CTA
aactctttcatcatgctgca

SEQ ID NO: 70272 - DNA, 20 bp, Artificial Sequence
  Description of Artificial Sequence: Synthetic oligonucleotide
  Target: SCN9A; (-) strand; PAM type: YTN; PAM sequence: TTG
actaaactctttcatcatgc

SEQ ID NO: 70273 - DNA, 20 bp, Artificial Sequence
  Description of Artificial Sequence: Synthetic oligonucleotide
  Target: SCN9A; (-) strand; PAM type: YTN; PAM sequence: TTA
aaacacagttgactaaactc

SEQ ID NO: 70274 - DNA, 20 bp, Artificial Sequence
  Description of Artificial Sequence: Synthetic oligonucleotide
  Target: SCN9A; (-) strand; PAM type: YTN; PAM sequence: TTT
aaaacacagttgactaaact

SEQ ID NO: 70275 - DNA, 20 bp, Artificial Sequence
  Description of Artificial Sequence: Synthetic oligonucleotide
  Target: SCN9A; (-) strand; PAM type: YTN; PAM sequence: TTT
taaaacacagttgactaaac

SEQ ID NO: 70276 - DNA, 20 bp, Artificial Sequence
  Description of Artificial Sequence: Synthetic oligonucleotide
  Target: SCN9A; (-) strand; PAM type: YTN; PAM sequence: TTA
aacattttaaaacacagttg

SEQ ID NO: 70277 - DNA, 20 bp, Artificial Sequence
  Description of Artificial Sequence: Synthetic oligonucleotide
  Target: SCN9A; (-) strand; PAM type: YTN; PAM sequence: TTT
aaacattttaaaacacagtt

SEQ ID NO: 70278 - DNA, 20 bp, Artificial Sequence
  Description of Artificial Sequence: Synthetic oligonucleotide
  Target: SCN9A; (-) strand; PAM type: YTN; PAM sequence: CTT
taaacattttaaaacacagt

SEQ ID NO: 70279 - DNA, 20 bp, Artificial Sequence
  Description of Artificial Sequence: Synthetic oligonucleotide
  Target: SCN9A; (-) strand; PAM type: YTN; PAM sequence: TTA
caggtatatgactttaaaca

SEQ ID NO: 70280 - DNA, 20 bp, Artificial Sequence
  Description of Artificial Sequence: Synthetic oligonucleotide
  Target: SCN9A; (-) strand; PAM type: YTN; PAM sequence: CTT
acaggtatatgactttaaac

SEQ ID NO: 70281 - DNA, 20 bp, Artificial Sequence
  Description of Artificial Sequence: Synthetic oligonucleotide
  Target: SCN9A; (-) strand; PAM type: YTN; PAM sequence: CTA
cttacaggtatatgacttta

SEQ ID NO: 70282 - DNA, 20 bp, Artificial Sequence
  Description of Artificial Sequence: Synthetic oligonucleotide
  Target: SCN9A; (-) strand; PAM type: YTN; PAM sequence: TTC
tacttacaggtatatgactt

SEQ ID NO: 70283 - DNA, 20 bp, Artificial Sequence
  Description of Artificial Sequence: Synthetic oligonucleotide
  Target: SCN9A; (-) strand; PAM type: YTN; PAM sequence: TTT
ctacttacaggtatatgact

SEQ ID NO: 70284 - DNA, 20 bp, Artificial Sequence
  Description of Artificial Sequence: Synthetic oligonucleotide
  Target: SCN9A; (-) strand; PAM type: YTN; PAM sequence: CTA
atttctacttacaggtatat

SEQ ID NO: 70285 - DNA, 20 bp, Artificial Sequence
  Description of Artificial Sequence: Synthetic oligonucleotide
  Target: SCN9A; (-) strand; PAM type: YTN; PAM sequence: TTC
aaatatgtaactaatttcta

SEQ ID NO: 70286 - DNA, 20 bp, Artificial Sequence
  Description of Artificial Sequence: Synthetic oligonucleotide
  Target: SCN9A; (-) strand; PAM type: YTN; PAM sequence: TTT
caaatatgtaactaatttct

SEQ ID NO: 70287 - DNA, 20 bp, Artificial Sequence
  Description of Artificial Sequence: Synthetic oligonucleotide
  Target: SCN9A; (-) strand; PAM type: YTN; PAM sequence: CTT
tcaaatatgtaactaatttc

SEQ ID NO: 70288 - DNA, 20 bp, Artificial Sequence
  Description of Artificial Sequence: Synthetic oligonucleotide
  Target: SCN9A; (-) strand; PAM type: YTN; PAM sequence: TTG
agtatatagcatgtactttc

SEQ ID NO: 70289 - DNA, 20 bp, Artificial Sequence
  Description of Artificial Sequence: Synthetic oligonucleotide
  Target: SCN9A; (-) strand; PAM type: YTN; PAM sequence: TTA
acgttgagtatatagcatgt

SEQ ID NO: 70290 - DNA, 20 bp, Artificial Sequence
  Description of Artificial Sequence: Synthetic oligonucleotide
  Target: SCN9A; (-) strand; PAM type: YTN; PAM sequence: CTT
aacgttgagtatatagcatg

SEQ ID NO: 70291 - DNA, 20 bp, Artificial Sequence
  Description of Artificial Sequence: Synthetic oligonucleotide
  Target: SCN9A; (-) strand; PAM type: YTN; PAM sequence: TTG
cttaacgttgagtatatagc

SEQ ID NO: 70292 - DNA, 20 bp, Artificial Sequence
  Description of Artificial Sequence: Synthetic oligonucleotide
  Target: SCN9A; (-) strand; PAM type: YTN; PAM sequence: TTC
aaatatattgcttaacgttg

SEQ ID NO: 70293 - DNA, 20 bp, Artificial Sequence
  Description of Artificial Sequence: Synthetic oligonucleotide
  Target: SCN9A; (-) strand; PAM type: YTN; PAM sequence: CTG
tgattcaaatatattgctta

SEQ ID NO: 70294 - DNA, 20 bp, Artificial Sequence
  Description of Artificial Sequence: Synthetic oligonucleotide
  Target: SCN9A; (-) strand; PAM type: YTN; PAM sequence: TTA
gtactgtgattcaaatatat

SEQ ID NO: 70295 - DNA, 20 bp, Artificial Sequence
  Description of Artificial Sequence: Synthetic oligonucleotide
  Target: SCN9A; (-) strand; PAM type: YTN; PAM sequence: CTT
agtactgtgattcaaatata

SEQ ID NO: 70296 - DNA, 20 bp, Artificial Sequence
  Description of Artificial Sequence: Synthetic oligonucleotide
  Target: SCN9A; (-) strand; PAM type: YTN; PAM sequence: TTA
atcttagtactgtgattcaa

SEQ ID NO: 70297 - DNA, 20 bp, Artificial Sequence
  Description of Artificial Sequence: Synthetic oligonucleotide
  Target: SCN9A; (-) strand; PAM type: YTN; PAM sequence: TTT
aatcttagtactgtgattca

SEQ ID NO: 70298 - DNA, 20 bp, Artificial Sequence
  Description of Artificial Sequence: Synthetic oligonucleotide
  Target: SCN9A; (-) strand; PAM type: YTN; PAM sequence: TTG
aatgacatttaatcttagta

SEQ ID NO: 70299 - DNA, 20 bp, Artificial Sequence
  Description of Artificial Sequence: Synthetic oligonucleotide
  Target: SCN9A; (-) strand; PAM type: YTN; PAM sequence: CTG
ttgaatgacatttaatctta

SEQ ID NO: 70300 - DNA, 20 bp, Artificial Sequence
  Description of Artificial Sequence: Synthetic oligonucleotide
  Target: SCN9A; (-) strand; PAM type: YTN; PAM sequence: CTC
tgttgaatgacatttaatct

SEQ ID NO: 70301 - DNA, 20 bp, Artificial Sequence
  Description of Artificial Sequence: Synthetic oligonucleotide
  Target: SCN9A; (-) strand; PAM type: YTN; PAM sequence: TTA
agtctctgttgaatgacatt

SEQ ID NO: 70302 - DNA, 20 bp, Artificial Sequence
  Description of Artificial Sequence: Synthetic oligonucleotide
  Target: SCN9A; (-) strand; PAM type: YTN; PAM sequence: TTT
aagtctctgttgaatgacat

SEQ ID NO: 70303 - DNA, 20 bp, Artificial Sequence
  Description of Artificial Sequence: Synthetic oligonucleotide
  Target: SCN9A; (-) strand; PAM type: YTN; PAM sequence: TTT
taagtctctgttgaatgaca

SEQ ID NO: 70304 - DNA, 20 bp, Artificial Sequence
  Description of Artificial Sequence: Synthetic oligonucleotide
  Target: SCN9A; (-) strand; PAM type: YTN; PAM sequence: TTT
ttaagtctctgttgaatgac

SEQ ID NO: 70305 - DNA, 20 bp, Artificial Sequence
  Description of Artificial Sequence: Synthetic oligonucleotide
  Target: SCN9A; (-) strand; PAM type: YTN; PAM sequence: TTG
tttttaagtctctgttgaat

SEQ ID NO: 70306 - DNA, 20 bp, Artificial Sequence
  Description of Artificial Sequence: Synthetic oligonucleotide
  Target: SCN9A; (-) strand; PAM type: YTN; PAM sequence: TTG
attgtttttaagtctctgtt

SEQ ID NO: 70307 - DNA, 20 bp, Artificial Sequence
  Description of Artificial Sequence: Synthetic oligonucleotide
  Target: SCN9A; (-) strand; PAM type: YTN; PAM sequence: TTA
attgattgtttttaagtctc

SEQ ID NO: 70308 - DNA, 20 bp, Artificial Sequence
  Description of Artificial Sequence: Synthetic oligonucleotide
  Target: SCN9A; (-) strand; PAM type: YTN; PAM sequence: TTT
aattgattgtttttaagtct

SEQ ID NO: 70309 - DNA, 20 bp, Artificial Sequence
  Description of Artificial Sequence: Synthetic oligonucleotide
  Target: SCN9A; (-) strand; PAM type: YTN; PAM sequence: CTG
tttaattgattgtttttaag

SEQ ID NO: 70310 - DNA, 20 bp, Artificial Sequence
  Description of Artificial Sequence: Synthetic oligonucleotide
  Target: SCN9A; (-) strand; PAM type: YTN; PAM sequence: TTA
tgtaactgtttaattgattg

SEQ ID NO: 70311 - DNA, 20 bp, Artificial Sequence
  Description of Artificial Sequence: Synthetic oligonucleotide
  Target: SCN9A; (-) strand; PAM type: YTN; PAM sequence: TTA
aatagtagagtagaattatg

SEQ ID NO: 70312 - DNA, 20 bp, Artificial Sequence
  Description of Artificial Sequence: Synthetic oligonucleotide
  Target: SCN9A; (-) strand; PAM type: YTN; PAM sequence: TTT
aaatagtagagtagaattat

SEQ ID NO: 70313 - DNA, 20 bp, Artificial Sequence
  Description of Artificial Sequence: Synthetic oligonucleotide
  Target: SCN9A; (-) strand; PAM type: YTN; PAM sequence: TTT
taaatagtagagtagaatta

SEQ ID NO: 70314 - DNA, 20 bp, Artificial Sequence
  Description of Artificial Sequence: Synthetic oligonucleotide
  Target: SCN9A; (-) strand; PAM type: YTN; PAM sequence: TTT
ttaaatagtagagtagaatt

SEQ ID NO: 70315 - DNA, 20 bp, Artificial Sequence
  Description of Artificial Sequence: Synthetic oligonucleotide
  Target: SCN9A; (-) strand; PAM type: YTN; PAM sequence: TTC
aatttttaaatagtagagta

SEQ ID NO: 70316 - DNA, 20 bp, Artificial Sequence
  Description of Artificial Sequence: Synthetic oligonucleotide
  Target: SCN9A; (-) strand; PAM type: YTN; PAM sequence: TTA
aattcaatttttaaatagta

SEQ ID NO: 70317 - DNA, 20 bp, Artificial Sequence
  Description of Artificial Sequence: Synthetic oligonucleotide
  Target: SCN9A; (-) strand; PAM type: YTN; PAM sequence: TTT
aaattcaatttttaaatagt

SEQ ID NO: 70318 - DNA, 20 bp, Artificial Sequence
  Description of Artificial Sequence: Synthetic oligonucleotide
  Target: SCN9A; (-) strand; PAM type: YTN; PAM sequence: TTA
tagtatttaaattcaatttt

SEQ ID NO: 70319 - DNA, 20 bp, Artificial Sequence
  Description of Artificial Sequence: Synthetic oligonucleotide
  Target: SCN9A; (-) strand; PAM type: YTN; PAM sequence: TTA
gcacattatagtatttaaat

SEQ ID NO: 70320 - DNA, 20 bp, Artificial Sequence
  Description of Artificial Sequence: Synthetic oligonucleotide
  Target: SCN9A; (-) strand; PAM type: YTN; PAM sequence: TTG
cattagcacattatagtatt

SEQ ID NO: 70321 - DNA, 20 bp, Artificial Sequence
  Description of Artificial Sequence: Synthetic oligonucleotide
  Target: SCN9A; (-) strand; PAM type: YTN; PAM sequence: TTA
aggaaaaatagaatgcaaaa

SEQ ID NO: 70322 - DNA, 20 bp, Artificial Sequence
  Description of Artificial Sequence: Synthetic oligonucleotide
  Target: SCN9A; (-) strand; PAM type: YTN; PAM sequence: TTT
aaggaaaaatagaatgcaaa

SEQ ID NO: 70323 - DNA, 20 bp, Artificial Sequence
  Description of Artificial Sequence: Synthetic oligonucleotide
  Target: SCN9A; (-) strand; PAM type: YTN; PAM sequence: TTG
catttaaggaaaaatagaat

SEQ ID NO: 70324 - DNA, 20 bp, Artificial Sequence
  Description of Artificial Sequence: Synthetic oligonucleotide
  Target: SCN9A; (-) strand; PAM type: YTN; PAM sequence: CTT
gcatttaaggaaaaatagaa

SEQ ID NO: 70325 - DNA, 20 bp, Artificial Sequence
  Description of Artificial Sequence: Synthetic oligonucleotide
  Target: SCN9A; (-) strand; PAM type: YTN; PAM sequence: TTG
cttgcatttaaggaaaaata

SEQ ID NO: 70326 - DNA, 20 bp, Artificial Sequence
  Description of Artificial Sequence: Synthetic oligonucleotide
  Target: SCN9A; (-) strand; PAM type: YTN; PAM sequence: TTA
aatgttgcttgcatttaagg

SEQ ID NO: 70327 - DNA, 20 bp, Artificial Sequence
  Description of Artificial Sequence: Synthetic oligonucleotide
  Target: SCN9A; (-) strand; PAM type: YTN; PAM sequence: TTT
aaatgttgcttgcatttaag

SEQ ID NO: 70328 - DNA, 20 bp, Artificial Sequence
  Description of Artificial Sequence: Synthetic oligonucleotide
  Target: SCN9A; (-) strand; PAM type: YTN; PAM sequence: TTA
tatttaaatgttgcttgcat

SEQ ID NO: 70329 - DNA, 20 bp, Artificial Sequence
  Description of Artificial Sequence: Synthetic oligonucleotide
  Target: SCN9A; (-) strand; PAM type: YTN; PAM sequence: CTT
atatttaaatgttgcttgca

SEQ ID NO: 70330 - DNA, 20 bp, Artificial Sequence
  Description of Artificial Sequence: Synthetic oligonucleotide
  Target: SCN9A; (-) strand; PAM type: YTN; PAM sequence: CTG
agaatcacttatatttaaat

SEQ ID NO: 70331 - DNA, 20 bp, Artificial Sequence
  Description of Artificial Sequence: Synthetic oligonucleotide
  Target: SCN9A; (-) strand; PAM type: YTN; PAM sequence: CTA
tactgagaatcacttatatt

SEQ ID NO: 70332 - DNA, 20 bp, Artificial Sequence
  Description of Artificial Sequence: Synthetic oligonucleotide
  Target: SCN9A; (-) strand; PAM type: YTN; PAM sequence: CTC
accccctatactgagaatca

SEQ ID NO: 70333 - DNA, 20 bp, Artificial Sequence
  Description of Artificial Sequence: Synthetic oligonucleotide
  Target: SCN9A; (-) strand; PAM type: YTN; PAM sequence: CTG
ccacctcaccccctatactg

SEQ ID NO: 70334 - DNA, 20 bp, Artificial Sequence
  Description of Artificial Sequence: Synthetic oligonucleotide
  Target: SCN9A; (-) strand; PAM type: YTN; PAM sequence: TTA
ctgccacctcaccccctata

SEQ ID NO: 70335 - DNA, 20 bp, Artificial Sequence
  Description of Artificial Sequence: Synthetic oligonucleotide
  Target: SCN9A; (-) strand; PAM type: YTN; PAM sequence: CTT
actgccacctcaccccctat

SEQ ID NO: 70336 - DNA, 20 bp, Artificial Sequence
  Description of Artificial Sequence: Synthetic oligonucleotide
  Target: SCN9A; (-) strand; PAM type: YTN; PAM sequence: CTC
ttactgccacctcaccccct

SEQ ID NO: 70337 - DNA, 20 bp, Artificial Sequence
  Description of Artificial Sequence: Synthetic oligonucleotide
  Target: SCN9A; (-) strand; PAM type: YTN; PAM sequence: CTG
catactcttactgccacctc

SEQ ID NO: 70338 - DNA, 20 bp, Artificial Sequence
  Description of Artificial Sequence: Synthetic oligonucleotide
  Target: SCN9A; (-) strand; PAM type: YTN; PAM sequence: TTA
aagctgcatactcttactgc

SEQ ID NO: 70339 - DNA, 20 bp, Artificial Sequence
  Description of Artificial Sequence: Synthetic oligonucleotide
  Target: SCN9A; (-) strand; PAM type: YTN; PAM sequence: TTT
aaagctgcatactcttactg

SEQ ID NO: 70340 - DNA, 20 bp, Artificial Sequence
  Description of Artificial Sequence: Synthetic oligonucleotide
  Target: SCN9A; (-) strand; PAM type: YTN; PAM sequence: TTT
taaagctgcatactcttact

SEQ ID NO: 70341 - DNA, 20 bp, Artificial Sequence
  Description of Artificial Sequence: Synthetic oligonucleotide
  Target: SCN9A; (-) strand; PAM type: YTN; PAM sequence: TTT
ttaaagctgcatactcttac

SEQ ID NO: 70342 - DNA, 20 bp, Artificial Sequence
  Description of Artificial Sequence: Synthetic oligonucleotide
  Target: SCN9A; (-) strand; PAM type: YTN; PAM sequence: CTT
tttaaagctgcatactctta

SEQ ID NO: 70343 - DNA, 20 bp, Artificial Sequence
  Description of Artificial Sequence: Synthetic oligonucleotide
  Target: SCN9A; (-) strand; PAM type: YTN; PAM sequence: TTA
gaatatgctttttaaagctg

SEQ ID NO: 70344 - DNA, 20 bp, Artificial Sequence
  Description of Artificial Sequence: Synthetic oligonucleotide
  Target: SCN9A; (-) strand; PAM type: YTN; PAM sequence: TTT
agaatatgctttttaaagct

SEQ ID NO: 70345 - DNA, 20 bp, Artificial Sequence
  Description of Artificial Sequence: Synthetic oligonucleotide
  Target: SCN9A; (-) strand; PAM type: YTN; PAM sequence: TTT
tagaatatgctttttaaagc

SEQ ID NO: 70346 - DNA, 20 bp, Artificial Sequence
  Description of Artificial Sequence: Synthetic oligonucleotide
  Target: SCN9A; (-) strand; PAM type: YTN; PAM sequence: CTA
attttagaatatgcttttta

SEQ ID NO: 70347 - DNA, 20 bp, Artificial Sequence
  Description of Artificial Sequence: Synthetic oligonucleotide
  Target: SCN9A; (-) strand; PAM type: YTN; PAM sequence: TTA
aataaaaataagtcaatcaa

SEQ ID NO: 70348 - DNA, 20 bp, Artificial Sequence
  Description of Artificial Sequence: Synthetic oligonucleotide
  Target: SCN9A; (-) strand; PAM type: YTN; PAM sequence: TTA
attaaataaaaataagtcaa

SEQ ID NO: 70349 - DNA, 20 bp, Artificial Sequence
  Description of Artificial Sequence: Synthetic oligonucleotide
  Target: SCN9A; (-) strand; PAM type: YTN; PAM sequence: TTA
aaatgtcaaaattaattaaa

SEQ ID NO: 70350 - DNA, 20 bp, Artificial Sequence
  Description of Artificial Sequence: Synthetic oligonucleotide
  Target: SCN9A; (-) strand; PAM type: YTN; PAM sequence: TTT
aaaatgtcaaaattaattaa

SEQ ID NO: 70351 - DNA, 20 bp, Artificial Sequence
  Description of Artificial Sequence: Synthetic oligonucleotide
  Target: SCN9A; (-) strand; PAM type: YTN; PAM sequence: CTG
tttaaaatgtcaaaattaat

SEQ ID NO: 70352 - DNA, 20 bp, Artificial Sequence
  Description of Artificial Sequence: Synthetic oligonucleotide
  Target: SCN9A; (-) strand; PAM type: YTN; PAM sequence: TTG
caatgctgtttaaaatgtca

SEQ ID NO: 70353 - DNA, 20 bp, Artificial Sequence
  Description of Artificial Sequence: Synthetic oligonucleotide
  Target: SCN9A; (-) strand; PAM type: YTN; PAM sequence: TTT
gcaatgctgtttaaaatgtc

SEQ ID NO: 70354 - DNA, 20 bp, Artificial Sequence
  Description of Artificial Sequence: Synthetic oligonucleotide
  Target: SCN9A; (-) strand; PAM type: YTN; PAM sequence: TTT
tgcaatgctgtttaaaatgt

SEQ ID NO: 70355 - DNA, 20 bp, Artificial Sequence
  Description of Artificial Sequence: Synthetic oligonucleotide
  Target: SCN9A; (-) strand; PAM type: YTN; PAM sequence: TTT
ttgcaatgctgtttaaaatg

SEQ ID NO: 70356 - DNA, 20 bp, Artificial Sequence
  Description of Artificial Sequence: Synthetic oligonucleotide
  Target: SCN9A; (-) strand; PAM type: YTN; PAM sequence: TTT
tttgcaatgctgtttaaaat

SEQ ID NO: 70357 - DNA, 20 bp, Artificial Sequence
  Description of Artificial Sequence: Synthetic oligonucleotide
  Target: SCN9A; (-) strand; PAM type: YTN; PAM sequence: CTT
ttttgcaatgctgtttaaaa

SEQ ID NO: 70358 - DNA, 20 bp, Artificial Sequence
  Description of Artificial Sequence: Synthetic oligonucleotide
  Target: SCN9A; (-) strand; PAM type: YTN; PAM sequence: TTC
acttttttgcaatgctgttt

SEQ ID NO: 70359 - DNA, 20 bp, Artificial Sequence
  Description of Artificial Sequence: Synthetic oligonucleotide
  Target: SCN9A; (-) strand; PAM type: YTN; PAM sequence: CTT
cacttttttgcaatgctgtt

SEQ ID NO: 70360 - DNA, 20 bp, Artificial Sequence
  Description of Artificial Sequence: Synthetic oligonucleotide
  Target: SCN9A; (-) strand; PAM type: YTN; PAM sequence: TTG
gaaacttcacttttttgcaa

SEQ ID NO: 70361 - DNA, 20 bp, Artificial Sequence
  Description of Artificial Sequence: Synthetic oligonucleotide
  Target: SCN9A; (-) strand; PAM type: YTN; PAM sequence: TTT
ggaaacttcacttttttgca

SEQ ID NO: 70362 - DNA, 20 bp, Artificial Sequence
  Description of Artificial Sequence: Synthetic oligonucleotide
  Target: SCN9A; (-) strand; PAM type: YTN; PAM sequence: TTG
ataaatttggaaacttcact

SEQ ID NO: 70363 - DNA, 20 bp, Artificial Sequence
  Description of Artificial Sequence: Synthetic oligonucleotide
  Target: SCN9A; (-) strand; PAM type: YTN; PAM sequence: TTT
gataaatttggaaacttcac

SEQ ID NO: 70364 - DNA, 20 bp, Artificial Sequence
  Description of Artificial Sequence: Synthetic oligonucleotide
  Target: SCN9A; (-) strand; PAM type: YTN; PAM sequence: TTT
tgataaatttggaaacttca

SEQ ID NO: 70365 - DNA, 20 bp, Artificial Sequence
  Description of Artificial Sequence: Synthetic oligonucleotide
  Target: SCN9A; (-) strand; PAM type: YTN; PAM sequence: TTA
tattttgataaatttggaaa

SEQ ID NO: 70366 - DNA, 20 bp, Artificial Sequence
  Description of Artificial Sequence: Synthetic oligonucleotide
  Target: SCN9A; (-) strand; PAM type: YTN; PAM sequence: TTT
atattttgataaatttggaa

SEQ ID NO: 70367 - DNA, 20 bp, Artificial Sequence
  Description of Artificial Sequence: Synthetic oligonucleotide
  Target: SCN9A; (-) strand; PAM type: YTN; PAM sequence: CTT
tatattttgataaatttgga

SEQ ID NO: 70368 - DNA, 20 bp, Artificial Sequence
  Description of Artificial Sequence: Synthetic oligonucleotide
  Target: SCN9A; (-) strand; PAM type: YTN; PAM sequence: TTC
tttatattttgataaatttg

SEQ ID NO: 70369 - DNA, 20 bp, Artificial Sequence
  Description of Artificial Sequence: Synthetic oligonucleotide
  Target: SCN9A; (-) strand; PAM type: YTN; PAM sequence: TTA
ttctttatattttgataaat

SEQ ID NO: 70370 - DNA, 20 bp, Artificial Sequence
  Description of Artificial Sequence: Synthetic oligonucleotide
  Target: SCN9A; (-) strand; PAM type: YTN; PAM sequence: CTT
attctttatattttgataaa

SEQ ID NO: 70371 - DNA, 20 bp, Artificial Sequence
  Description of Artificial Sequence: Synthetic oligonucleotide
  Target: SCN9A; (-) strand; PAM type: YTN; PAM sequence: TTC
aaatcaatgtgtcttattct

SEQ ID NO: 70372 - DNA, 20 bp, Artificial Sequence
  Description of Artificial Sequence: Synthetic oligonucleotide
  Target: SCN9A; (-) strand; PAM type: YTN; PAM sequence: CTG
acatattcaaatcaatgtgt

SEQ ID NO: 70373 - DNA, 20 bp, Artificial Sequence
  Description of Artificial Sequence: Synthetic oligonucleotide
  Target: SCN9A; (-) strand; PAM type: YTN; PAM sequence: TTG
tctgacatattcaaatcaat

SEQ ID NO: 70374 - DNA, 20 bp, Artificial Sequence
  Description of Artificial Sequence: Synthetic oligonucleotide
  Target: SCN9A; (-) strand; PAM type: YTN; PAM sequence: TTT
gtctgacatattcaaatcaa

SEQ ID NO: 70375 - DNA, 20 bp, Artificial Sequence
  Description of Artificial Sequence: Synthetic oligonucleotide
  Target: SCN9A; (-) strand; PAM type: YTN; PAM sequence: CTA
aaaacaatgaaatatttgtc

SEQ ID NO: 70376 - DNA, 20 bp, Artificial Sequence
  Description of Artificial Sequence: Synthetic oligonucleotide
  Target: SCN9A; (-) strand; PAM type: YTN; PAM sequence: TTA
cgtgcctaaaaacaatgaaa

SEQ ID NO: 70377 - DNA, 20 bp, Artificial Sequence
  Description of Artificial Sequence: Synthetic oligonucleotide
  Target: SCN9A; (-) strand; PAM type: YTN; PAM sequence: TTT
acgtgcctaaaaacaatgaa

SEQ ID NO: 70378 - DNA, 20 bp, Artificial Sequence
  Description of Artificial Sequence: Synthetic oligonucleotide
  Target: SCN9A; (-) strand; PAM type: YTN; PAM sequence: TTG
tttacgtgcctaaaaacaat

SEQ ID NO: 70379 - DNA, 20 bp, Artificial Sequence
  Description of Artificial Sequence: Synthetic oligonucleotide
  Target: SCN9A; (-) strand; PAM type: YTN; PAM sequence: TTT
gtttacgtgcctaaaaacaa

SEQ ID NO: 70380 - DNA, 20 bp, Artificial Sequence
  Description of Artificial Sequence: Synthetic oligonucleotide
  Target: SCN9A; (-) strand; PAM type: YTN; PAM sequence: TTG
gatttgtttacgtgcctaaa

SEQ ID NO: 70381 - DNA, 20 bp, Artificial Sequence
  Description of Artificial Sequence: Synthetic oligonucleotide
  Target: SCN9A; (-) strand; PAM type: YTN; PAM sequence: TTC
attggatttgtttacgtgcc

SEQ ID NO: 70382 - DNA, 20 bp, Artificial Sequence
  Description of Artificial Sequence: Synthetic oligonucleotide
  Target: SCN9A; (-) strand; PAM type: YTN; PAM sequence: CTT
cattggatttgtttacgtgc

SEQ ID NO: 70383 - DNA, 20 bp, Artificial Sequence
  Description of Artificial Sequence: Synthetic oligonucleotide
  Target: SCN9A; (-) strand; PAM type: YTN; PAM sequence: TTC
catcttcattggatttgttt

SEQ ID NO: 70384 - DNA, 20 bp, Artificial Sequence
  Description of Artificial Sequence: Synthetic oligonucleotide
  Target: SCN9A; (-) strand; PAM type: YTN; PAM sequence: TTT
ccatcttcattggatttgtt

SEQ ID NO: 70385 - DNA, 20 bp, Artificial Sequence
  Description of Artificial Sequence: Synthetic oligonucleotide
  Target: SCN9A; (-) strand; PAM type: YTN; PAM sequence: CTT
tccatcttcattggatttgt

SEQ ID NO: 70386 - DNA, 20 bp, Artificial Sequence
  Description of Artificial Sequence: Synthetic oligonucleotide
  Target: SCN9A; (-) strand; PAM type: YTN; PAM sequence: TTG
aaaaatctttccatcttcat

SEQ ID NO: 70387 - DNA, 20 bp, Artificial Sequence
  Description of Artificial Sequence: Synthetic oligonucleotide
  Target: SCN9A; (-) strand; PAM type: YTN; PAM sequence: TTT
gaaaaatctttccatcttca

SEQ ID NO: 70388 - DNA, 20 bp, Artificial Sequence
  Description of Artificial Sequence: Synthetic oligonucleotide
  Target: SCN9A; (-) strand; PAM type: YTN; PAM sequence: TTC
caaagaatttgaaaaatctt

SEQ ID NO: 70389 - DNA, 20 bp, Artificial Sequence
  Description of Artificial Sequence: Synthetic oligonucleotide
  Target: SCN9A; (-) strand; PAM type: YTN; PAM sequence: TTT
ccaaagaatttgaaaaatct

SEQ ID NO: 70390 - DNA, 20 bp, Artificial Sequence
  Description of Artificial Sequence: Synthetic oligonucleotide
  Target: SCN9A; (-) strand; PAM type: YTN; PAM sequence: TTG
tttccaaagaatttgaaaaa

SEQ ID NO: 70391 - DNA, 20 bp, Artificial Sequence
  Description of Artificial Sequence: Synthetic oligonucleotide
  Target: SCN9A; (-) strand; PAM type: YTN; PAM sequence: TTC
aggttgtttccaaagaattt

SEQ ID NO: 70392 - DNA, 20 bp, Artificial Sequence
  Description of Artificial Sequence: Synthetic oligonucleotide
  Target: SCN9A; (-) strand; PAM type: YTN; PAM sequence: TTT
caggttgtttccaaagaatt

SEQ ID NO: 70393 - DNA, 20 bp, Artificial Sequence
  Description of Artificial Sequence: Synthetic oligonucleotide
  Target: SCN9A; (-) strand; PAM type: YTN; PAM sequence: TTT
tcaggttgtttccaaagaat

SEQ ID NO: 70394 - DNA, 20 bp, Artificial Sequence
  Description of Artificial Sequence: Synthetic oligonucleotide
  Target: SCN9A; (-) strand; PAM type: YTN; PAM sequence: TTT
ttcaggttgtttccaaagaa

SEQ ID NO: 70395 - DNA, 20 bp, Artificial Sequence
  Description of Artificial Sequence: Synthetic oligonucleotide
  Target: SCN9A; (-) strand; PAM type: YTN; PAM sequence: TTT
tttcaggttgtttccaaaga

SEQ ID NO: 70396 - DNA, 20 bp, Artificial Sequence
  Description of Artificial Sequence: Synthetic oligonucleotide
  Target: SCN9A; (-) strand; PAM type: YTN; PAM sequence: TTT
ttttcaggttgtttccaaag

SEQ ID NO: 70397 - DNA, 20 bp, Artificial Sequence
  Description of Artificial Sequence: Synthetic oligonucleotide
  Target: SCN9A; (-) strand; PAM type: YTN; PAM sequence: TTG
tttttttcaggttgtttcca

SEQ ID NO: 70398 - DNA, 20 bp, Artificial Sequence
  Description of Artificial Sequence: Synthetic oligonucleotide
  Target: SCN9A; (-) strand; PAM type: YTN; PAM sequence: TTT
gtttttttcaggttgtttcc

SEQ ID NO: 70399 - DNA, 20 bp, Artificial Sequence
  Description of Artificial Sequence: Synthetic oligonucleotide
  Target: SCN9A; (-) strand; PAM type: YTN; PAM sequence: TTA
gaccatttgtttttttcagg

SEQ ID NO: 70400 - DNA, 20 bp, Artificial Sequence
  Description of Artificial Sequence: Synthetic oligonucleotide
  Target: SCN9A; (-) strand; PAM type: YTN; PAM sequence: CTT
agaccatttgtttttttcag

SEQ ID NO: 70401 - DNA, 20 bp, Artificial Sequence
  Description of Artificial Sequence: Synthetic oligonucleotide
  Target: SCN9A; (-) strand; PAM type: YTN; PAM sequence: TTG
cacttagaccatttgttttt

SEQ ID NO: 70402 - DNA, 20 bp, Artificial Sequence
  Description of Artificial Sequence: Synthetic oligonucleotide
  Target: SCN9A; (-) strand; PAM type: YTN; PAM sequence: CTG
tagaattgcacttagaccat

SEQ ID NO: 70403 - DNA, 20 bp, Artificial Sequence
  Description of Artificial Sequence: Synthetic oligonucleotide
  Target: SCN9A; (-) strand; PAM type: YTN; PAM sequence: TTC
tgtagaattgcacttagacc

SEQ ID NO: 70404 - DNA, 20 bp, Artificial Sequence
  Description of Artificial Sequence: Synthetic oligonucleotide
  Target: SCN9A; (-) strand; PAM type: YTN; PAM sequence: CTT
ctgtagaattgcacttagac

SEQ ID NO: 70405 - DNA, 20 bp, Artificial Sequence
  Description of Artificial Sequence: Synthetic oligonucleotide
  Target: SCN9A; (-) strand; PAM type: YTN; PAM sequence: CTC
ttctgtagaattgcacttag

SEQ ID NO: 70406 - DNA, 20 bp, Artificial Sequence
  Description of Artificial Sequence: Synthetic oligonucleotide
  Target: SCN9A; (-) strand; PAM type: YTN; PAM sequence: TTA
aaagcactcttctgtagaat

SEQ ID NO: 70407 - DNA, 20 bp, Artificial Sequence
  Description of Artificial Sequence: Synthetic oligonucleotide
  Target: SCN9A; (-) strand; PAM type: YTN; PAM sequence: TTT
aaaagcactcttctgtagaa

SEQ ID NO: 70408 - DNA, 20 bp, Artificial Sequence
  Description of Artificial Sequence: Synthetic oligonucleotide
  Target: SCN9A; (-) strand; PAM type: YTN; PAM sequence: TTT
taaaagcactcttctgtaga

SEQ ID NO: 70409 - DNA, 20 bp, Artificial Sequence
  Description of Artificial Sequence: Synthetic oligonucleotide
  Target: SCN9A; (-) strand; PAM type: YTN; PAM sequence: TTT
ttaaaagcactcttctgtag

SEQ ID NO: 70410 - DNA, 20 bp, Artificial Sequence
  Description of Artificial Sequence: Synthetic oligonucleotide
  Target: SCN9A; (-) strand; PAM type: YTN; PAM sequence: TTT
tttaaaagcactcttctgta

SEQ ID NO: 70411 - DNA, 20 bp, Artificial Sequence
  Description of Artificial Sequence: Synthetic oligonucleotide
  Target: SCN9A; (-) strand; PAM type: YTN; PAM sequence: TTT
ttttaaaagcactcttctgt

SEQ ID NO: 70412 - DNA, 20 bp, Artificial Sequence
  Description of Artificial Sequence: Synthetic oligonucleotide
  Target: SCN9A; (-) strand; PAM type: YTN; PAM sequence: TTT
tttttaaaagcactcttctg

SEQ ID NO: 70413 - DNA, 20 bp, Artificial Sequence
  Description of Artificial Sequence: Synthetic oligonucleotide
  Target: SCN9A; (-) strand; PAM type: YTN; PAM sequence: TTA
tgcatagattttttttaaaa

SEQ ID NO: 70414 - DNA, 20 bp, Artificial Sequence
  Description of Artificial Sequence: Synthetic oligonucleotide
  Target: SCN9A; (-) strand; PAM type: YTN; PAM sequence: TTT
atgcatagattttttttaaa

SEQ ID NO: 70415 - DNA, 20 bp, Artificial Sequence
  Description of Artificial Sequence: Synthetic oligonucleotide
  Target: SCN9A; (-) strand; PAM type: YTN; PAM sequence: TTT
tatgcatagattttttttaa

SEQ ID NO: 70416 - DNA, 20 bp, Artificial Sequence
  Description of Artificial Sequence: Synthetic oligonucleotide
  Target: SCN9A; (-) strand; PAM type: YTN; PAM sequence: CTA
tattttatgcatagattttt

SEQ ID NO: 70417 - DNA, 20 bp, Artificial Sequence
  Description of Artificial Sequence: Synthetic oligonucleotide
  Target: SCN9A; (-) strand; PAM type: YTN; PAM sequence: TTC
tatattttatgcatagattt

SEQ ID NO: 70418 - DNA, 20 bp, Artificial Sequence
  Description of Artificial Sequence: Synthetic oligonucleotide
  Target: SCN9A; (-) strand; PAM type: YTN; PAM sequence: TTG
attctatattttatgcatag

SEQ ID NO: 70419 - DNA, 20 bp, Artificial Sequence
  Description of Artificial Sequence: Synthetic oligonucleotide
  Target: SCN9A; (-) strand; PAM type: YTN; PAM sequence: TTT
gattctatattttatgcata

SEQ ID NO: 70420 - DNA, 20 bp, Artificial Sequence
  Description of Artificial Sequence: Synthetic oligonucleotide
  Target: SCN9A; (-) strand; PAM type: YTN; PAM sequence: TTG
gcatttgattctatatttta

SEQ ID NO: 70421 - DNA, 20 bp, Artificial Sequence
  Description of Artificial Sequence: Synthetic oligonucleotide
  Target: SCN9A; (-) strand; PAM type: YTN; PAM sequence: TTC
gtaaaattggcatttgattc

SEQ ID NO: 70422 - DNA, 20 bp, Artificial Sequence
  Description of Artificial Sequence: Synthetic oligonucleotide
  Target: SCN9A; (-) strand; PAM type: YTN; PAM sequence: TTT
cgtaaaattggcatttgatt

SEQ ID NO: 70423 - DNA, 20 bp, Artificial Sequence
  Description of Artificial Sequence: Synthetic oligonucleotide
  Target: SCN9A; (-) strand; PAM type: YTN; PAM sequence: CTG
tttcgtaaaattggcatttg

SEQ ID NO: 70424 - DNA, 20 bp, Artificial Sequence
  Description of Artificial Sequence: Synthetic oligonucleotide
  Target: SCN9A; (-) strand; PAM type: YTN; PAM sequence: TTA
tgctgtttcgtaaaattggc

SEQ ID NO: 70425 - DNA, 20 bp, Artificial Sequence
  Description of Artificial Sequence: Synthetic oligonucleotide
  Target: SCN9A; (-) strand; PAM type: YTN; PAM sequence: TTA
cagttatgctgtttcgtaaa

SEQ ID NO: 70426 - DNA, 20 bp, Artificial Sequence
  Description of Artificial Sequence: Synthetic oligonucleotide
  Target: SCN9A; (-) strand; PAM type: YTN; PAM sequence: TTA
gttacagttatgctgtttcg

SEQ ID NO: 70427 - DNA, 20 bp, Artificial Sequence
  Description of Artificial Sequence: Synthetic oligonucleotide
  Target: SCN9A; (-) strand; PAM type: YTN; PAM sequence: TTA
gggattagttacagttatgc

SEQ ID NO: 70428 - DNA, 20 bp, Artificial Sequence
  Description of Artificial Sequence: Synthetic oligonucleotide
  Target: SCN9A; (-) strand; PAM type: YTN; PAM sequence: TTT
agggattagttacagttatg

SEQ ID NO: 70429 - DNA, 20 bp, Artificial Sequence
  Description of Artificial Sequence: Synthetic oligonucleotide
  Target: SCN9A; (-) strand; PAM type: YTN; PAM sequence: TTG
aaagatttagggattagtta

SEQ ID NO: 70430 - DNA, 20 bp, Artificial Sequence
  Description of Artificial Sequence: Synthetic oligonucleotide
  Target: SCN9A; (-) strand; PAM type: YTN; PAM sequence: TTT
gaaagatttagggattagtt

SEQ ID NO: 70431 - DNA, 20 bp, Artificial Sequence
  Description of Artificial Sequence: Synthetic oligonucleotide
  Target: SCN9A; (-) strand; PAM type: YTN; PAM sequence: CTT
tgaaagatttagggattagt

SEQ ID NO: 70432 - DNA, 20 bp, Artificial Sequence
  Description of Artificial Sequence: Synthetic oligonucleotide
  Target: SCN9A; (-) strand; PAM type: YTN; PAM sequence: TTG
actttgaaagatttagggat

SEQ ID NO: 70433 - DNA, 20 bp, Artificial Sequence
  Description of Artificial Sequence: Synthetic oligonucleotide
  Target: SCN9A; (-) strand; PAM type: YTN; PAM sequence: TTT
gactttgaaagatttaggga

SEQ ID NO: 70434 - DNA, 20 bp, Artificial Sequence
  Description of Artificial Sequence: Synthetic oligonucleotide
  Target: SCN9A; (-) strand; PAM type: YTN; PAM sequence: TTA
aaaatgcatttgactttgaa

SEQ ID NO: 70435 - DNA, 20 bp, Artificial Sequence
  Description of Artificial Sequence: Synthetic oligonucleotide
  Target: SCN9A; (-) strand; PAM type: YTN; PAM sequence: TTT
aaaaatgcatttgactttga

SEQ ID NO: 70436 - DNA, 20 bp, Artificial Sequence
  Description of Artificial Sequence: Synthetic oligonucleotide
  Target: SCN9A; (-) strand; PAM type: YTN; PAM sequence: TTT
taaaaatgcatttgactttg

SEQ ID NO: 70437 - DNA, 20 bp, Artificial Sequence
  Description of Artificial Sequence: Synthetic oligonucleotide
  Target: SCN9A; (-) strand; PAM type: YTN; PAM sequence: CTT
ttaaaaatgcatttgacttt

SEQ ID NO: 70438 - DNA, 20 bp, Artificial Sequence
  Description of Artificial Sequence: Synthetic oligonucleotide
  Target: SCN9A; (-) strand; PAM type: YTN; PAM sequence: TTA
gaaaatataataatctttta

SEQ ID NO: 70439 - DNA, 20 bp, Artificial Sequence
  Description of Artificial Sequence: Synthetic oligonucleotide
  Target: SCN9A; (-) strand; PAM type: YTN; PAM sequence: TTT
agaaaatataataatctttt

SEQ ID NO: 70440 - DNA, 20 bp, Artificial Sequence
  Description of Artificial Sequence: Synthetic oligonucleotide
  Target: SCN9A; (-) strand; PAM type: YTN; PAM sequence: CTT
tagaaaatataataatcttt

SEQ ID NO: 70441 - DNA, 20 bp, Artificial Sequence
  Description of Artificial Sequence: Synthetic oligonucleotide
  Target: SCN9A; (-) strand; PAM type: YTN; PAM sequence: CTA
cactttagaaaatataataa

SEQ ID NO: 70442 - DNA, 20 bp, Artificial Sequence
  Description of Artificial Sequence: Synthetic oligonucleotide
  Target: SCN9A; (-) strand; PAM type: YTN; PAM sequence: TTA
ctacactttagaaaatataa

SEQ ID NO: 70443 - DNA, 20 bp, Artificial Sequence
  Description of Artificial Sequence: Synthetic oligonucleotide
  Target: SCN9A; (-) strand; PAM type: YTN; PAM sequence: TTA
ttactacactttagaaaata

SEQ ID NO: 70444 - DNA, 20 bp, Artificial Sequence
  Description of Artificial Sequence: Synthetic oligonucleotide
  Target: SCN9A; (-) strand; PAM type: YTN; PAM sequence: CTT
attactacactttagaaaat

SEQ ID NO: 70445 - DNA, 20 bp, Artificial Sequence
  Description of Artificial Sequence: Synthetic oligonucleotide
  Target: SCN9A; (-) strand; PAM type: YTN; PAM sequence: CTG
cttattactacactttagaa

SEQ ID NO: 70446 - DNA, 20 bp, Artificial Sequence
  Description of Artificial Sequence: Synthetic oligonucleotide
  Target: SCN9A; (-) strand; PAM type: YTN; PAM sequence: TTC
tgcttattactacactttag

SEQ ID NO: 70447 - DNA, 20 bp, Artificial Sequence
  Description of Artificial Sequence: Synthetic oligonucleotide
  Target: SCN9A; (-) strand; PAM type: YTN; PAM sequence: CTT
ctgcttattactacacttta

SEQ ID NO: 70448 - DNA, 20 bp, Artificial Sequence
  Description of Artificial Sequence: Synthetic oligonucleotide
  Target: SCN9A; (-) strand; PAM type: YTN; PAM sequence: TTA
ccttctgcttattactacac

SEQ ID NO: 70449 - DNA, 20 bp, Artificial Sequence
  Description of Artificial Sequence: Synthetic oligonucleotide
  Target: SCN9A; (-) strand; PAM type: YTN; PAM sequence: TTT
accttctgcttattactaca

SEQ ID NO: 70450 - DNA, 20 bp, Artificial Sequence
  Description of Artificial Sequence: Synthetic oligonucleotide
  Target: SCN9A; (-) strand; PAM type: YTN; PAM sequence: TTA
gatttaccttctgcttatta

SEQ ID NO: 70451 - DNA, 20 bp, Artificial Sequence
  Description of Artificial Sequence: Synthetic oligonucleotide
  Target: SCN9A; (-) strand; PAM type: YTN; PAM sequence: TTT
agatttaccttctgcttatt

SEQ ID NO: 70452 - DNA, 20 bp, Artificial Sequence
  Description of Artificial Sequence: Synthetic oligonucleotide
  Target: SCN9A; (-) strand; PAM type: YTN; PAM sequence: TTT
tagatttaccttctgcttat

SEQ ID NO: 70453 - DNA, 20 bp, Artificial Sequence
  Description of Artificial Sequence: Synthetic oligonucleotide
  Target: SCN9A; (-) strand; PAM type: YTN; PAM sequence: TTA
atcaaagttttagatttacc

SEQ ID NO: 70454 - DNA, 20 bp, Artificial Sequence
  Description of Artificial Sequence: Synthetic oligonucleotide
  Target: SCN9A; (-) strand; PAM type: YTN; PAM sequence: TTT
aatcaaagttttagatttac

SEQ ID NO: 70455 - DNA, 20 bp, Artificial Sequence
  Description of Artificial Sequence: Synthetic oligonucleotide
  Target: SCN9A; (-) strand; PAM type: YTN; PAM sequence: TTT
taatcaaagttttagattta

SEQ ID NO: 70456 - DNA, 20 bp, Artificial Sequence
  Description of Artificial Sequence: Synthetic oligonucleotide
  Target: SCN9A; (-) strand; PAM type: YTN; PAM sequence: TTT
ttaatcaaagttttagattt

SEQ ID NO: 70457 - DNA, 20 bp, Artificial Sequence
  Description of Artificial Sequence: Synthetic oligonucleotide
  Target: SCN9A; (-) strand; PAM type: YTN; PAM sequence: TTA
gatttttaatcaaagtttta

SEQ ID NO: 70458 - DNA, 20 bp, Artificial Sequence
  Description of Artificial Sequence: Synthetic oligonucleotide
  Target: SCN9A; (-) strand; PAM type: YTN; PAM sequence: TTT
agatttttaatcaaagtttt

SEQ ID NO: 70459 - DNA, 20 bp, Artificial Sequence
  Description of Artificial Sequence: Synthetic oligonucleotide
  Target: SCN9A; (-) strand; PAM type: YTN; PAM sequence: CTT
tagatttttaatcaaagttt

SEQ ID NO: 70460 - DNA, 20 bp, Artificial Sequence
  Description of Artificial Sequence: Synthetic oligonucleotide
  Target: SCN9A; (-) strand; PAM type: YTN; PAM sequence: CTC
tttagatttttaatcaaagt

SEQ ID NO: 70461 - DNA, 20 bp, Artificial Sequence
  Description of Artificial Sequence: Synthetic oligonucleotide
  Target: SCN9A; (-) strand; PAM type: YTN; PAM sequence: CTC
tctttagatttttaatcaaa

SEQ ID NO: 70462 - DNA, 20 bp, Artificial Sequence
  Description of Artificial Sequence: Synthetic oligonucleotide
  Target: SCN9A; (-) strand; PAM type: YTN; PAM sequence: TTC
tctctttagatttttaatca

SEQ ID NO: 70463 - DNA, 20 bp, Artificial Sequence
  Description of Artificial Sequence: Synthetic oligonucleotide
  Target: SCN9A; (-) strand; PAM type: YTN; PAM sequence: TTT
ctctctttagatttttaatc

SEQ ID NO: 70464 - DNA, 20 bp, Artificial Sequence
  Description of Artificial Sequence: Synthetic oligonucleotide
  Target: SCN9A; (-) strand; PAM type: YTN; PAM sequence: CTT
tctctctttagatttttaat

SEQ ID NO: 70465 - DNA, 20 bp, Artificial Sequence
  Description of Artificial Sequence: Synthetic oligonucleotide
  Target: SCN9A; (-) strand; PAM type: YTN; PAM sequence: TTA
tcaagactttctctctttag

SEQ ID NO: 70466 - DNA, 20 bp, Artificial Sequence
  Description of Artificial Sequence: Synthetic oligonucleotide
  Target: SCN9A; (-) strand; PAM type: YTN; PAM sequence: CTG
ttatcaagactttctctctt

SEQ ID NO: 70467 - DNA, 20 bp, Artificial Sequence
  Description of Artificial Sequence: Synthetic oligonucleotide
  Target: SCN9A; (-) strand; PAM type: YTN; PAM sequence: TTA
cactgttatcaagactttct

SEQ ID NO: 70468 - DNA, 20 bp, Artificial Sequence
  Description of Artificial Sequence: Synthetic oligonucleotide
  Target: SCN9A; (-) strand; PAM type: YTN; PAM sequence: TTA
attacactgttatcaagact

SEQ ID NO: 70469 - DNA, 20 bp, Artificial Sequence
  Description of Artificial Sequence: Synthetic oligonucleotide
  Target: SCN9A; (-) strand; PAM type: YTN; PAM sequence: TTT
aattacactgttatcaagac

SEQ ID NO: 70470 - DNA, 20 bp, Artificial Sequence
  Description of Artificial Sequence: Synthetic oligonucleotide
  Target: SCN9A; (-) strand; PAM type: YTN; PAM sequence: TTT
taattacactgttatcaaga

SEQ ID NO: 70471 - DNA, 20 bp, Artificial Sequence
  Description of Artificial Sequence: Synthetic oligonucleotide
  Target: SCN9A; (-) strand; PAM type: YTN; PAM sequence: CTA
tgtggtggttttaattacac

SEQ ID NO: 70472 - DNA, 20 bp, Artificial Sequence
  Description of Artificial Sequence: Synthetic oligonucleotide
  Target: SCN9A; (-) strand; PAM type: YTN; PAM sequence: TTA
ctatgtggtggttttaatta

SEQ ID NO: 70473 - DNA, 20 bp, Artificial Sequence
  Description of Artificial Sequence: Synthetic oligonucleotide
  Target: SCN9A; (-) strand; PAM type: YTN; PAM sequence: TTT
actatgtggtggttttaatt

SEQ ID NO: 70474 - DNA, 20 bp, Artificial Sequence
  Description of Artificial Sequence: Synthetic oligonucleotide
  Target: SCN9A; (-) strand; PAM type: YTN; PAM sequence: TTT
tactatgtggtggttttaat

SEQ ID NO: 70475 - DNA, 20 bp, Artificial Sequence
  Description of Artificial Sequence: Synthetic oligonucleotide
  Target: SCN9A; (-) strand; PAM type: YTN; PAM sequence: CTT
ttactatgtggtggttttaa

SEQ ID NO: 70476 - DNA, 20 bp, Artificial Sequence
  Description of Artificial Sequence: Synthetic oligonucleotide
  Target: SCN9A; (-) strand; PAM type: YTN; PAM sequence: TTA
atgtccttttactatgtggt

SEQ ID NO: 70477 - DNA, 20 bp, Artificial Sequence
  Description of Artificial Sequence: Synthetic oligonucleotide
  Target: SCN9A; (-) strand; PAM type: YTN; PAM sequence: TTT
aatgtccttttactatgtgg

SEQ ID NO: 70478 - DNA, 20 bp, Artificial Sequence
  Description of Artificial Sequence: Synthetic oligonucleotide
  Target: SCN9A; (-) strand; PAM type: YTN; PAM sequence: TTA
aatatttaatgtccttttac

SEQ ID NO: 70479 - DNA, 20 bp, Artificial Sequence
  Description of Artificial Sequence: Synthetic oligonucleotide
  Target: SCN9A; (-) strand; PAM type: YTN; PAM sequence: TTC
ccaaattaaatatttaatgt

SEQ ID NO: 70480 - DNA, 20 bp, Artificial Sequence
  Description of Artificial Sequence: Synthetic oligonucleotide
  Target: SCN9A; (-) strand; PAM type: YTN; PAM sequence: TTG
cagttcccaaattaaatatt

SEQ ID NO: 70481 - DNA, 20 bp, Artificial Sequence
  Description of Artificial Sequence: Synthetic oligonucleotide
  Target: SCN9A; (-) strand; PAM type: YTN; PAM sequence: TTT
gcagttcccaaattaaatat

SEQ ID NO: 70482 - DNA, 20 bp, Artificial Sequence
  Description of Artificial Sequence: Synthetic oligonucleotide
  Target: SCN9A; (-) strand; PAM type: YTN; PAM sequence: TTC
aatatttgcagttcccaaat

SEQ ID NO: 70483 - DNA, 20 bp, Artificial Sequence
  Description of Artificial Sequence: Synthetic oligonucleotide
  Target: SCN9A; (-) strand; PAM type: YTN; PAM sequence: TTT
caatatttgcagttcccaaa

SEQ ID NO: 70484 - DNA, 20 bp, Artificial Sequence
  Description of Artificial Sequence: Synthetic oligonucleotide
  Target: SCN9A; (-) strand; PAM type: YTN; PAM sequence: TTG
tttcaatatttgcagttccc

SEQ ID NO: 70485 - DNA, 20 bp, Artificial Sequence
  Description of Artificial Sequence: Synthetic oligonucleotide
  Target: SCN9A; (-) strand; PAM type: YTN; PAM sequence: CTG
ataaaaagttgtttcaatat

SEQ ID NO: 70486 - DNA, 20 bp, Artificial Sequence
  Description of Artificial Sequence: Synthetic oligonucleotide
  Target: SCN9A; (-) strand; PAM type: YTN; PAM sequence: TTG
acctgataaaaagttgtttc

SEQ ID NO: 70487 - DNA, 20 bp, Artificial Sequence
  Description of Artificial Sequence: Synthetic oligonucleotide
  Target: SCN9A; (-) strand; PAM type: YTN; PAM sequence: TTG
ttgacctgataaaaagttgt

SEQ ID NO: 70488 - DNA, 20 bp, Artificial Sequence
  Description of Artificial Sequence: Synthetic oligonucleotide
  Target: SCN9A; (-) strand; PAM type: YTN; PAM sequence: TTT
gttgacctgataaaaagttg

SEQ ID NO: 70489 - DNA, 20 bp, Artificial Sequence
  Description of Artificial Sequence: Synthetic oligonucleotide
  Target: SCN9A; (-) strand; PAM type: YTN; PAM sequence: TTT
tgttgacctgataaaaagtt

SEQ ID NO: 70490 - DNA, 20 bp, Artificial Sequence
  Description of Artificial Sequence: Synthetic oligonucleotide
  Target: SCN9A; (-) strand; PAM type: YTN; PAM sequence: TTA
tgaaatgtagtcattttgtt

SEQ ID NO: 70491 - DNA, 20 bp, Artificial Sequence
  Description of Artificial Sequence: Synthetic oligonucleotide
  Target: SCN9A; (-) strand; PAM type: YTN; PAM sequence: TTA
ttatgaaatgtagtcatttt

SEQ ID NO: 70492 - DNA, 20 bp, Artificial Sequence
  Description of Artificial Sequence: Synthetic oligonucleotide
  Target: SCN9A; (-) strand; PAM type: YTN; PAM sequence: TTA
ttattatgaaatgtagtcat

SEQ ID NO: 70493 - DNA, 20 bp, Artificial Sequence
  Description of Artificial Sequence: Synthetic oligonucleotide
  Target: SCN9A; (-) strand; PAM type: YTN; PAM sequence: CTT
attattatgaaatgtagtca

SEQ ID NO: 70494 - DNA, 20 bp, Artificial Sequence
  Description of Artificial Sequence: Synthetic oligonucleotide
  Target: SCN9A; (-) strand; PAM type: YTN; PAM sequence: TTA
aatatgcttattattatgaa

SEQ ID NO: 70495 - DNA, 20 bp, Artificial Sequence
  Description of Artificial Sequence: Synthetic oligonucleotide
  Target: SCN9A; (-) strand; PAM type: YTN; PAM sequence: CTT
aaatatgcttattattatga

SEQ ID NO: 70496 - DNA, 20 bp, Artificial Sequence
  Description of Artificial Sequence: Synthetic oligonucleotide
  Target: SCN9A; (-) strand; PAM type: YTN; PAM sequence: TTG
gagatacttaaatatgctta

SEQ ID NO: 70497 - DNA, 20 bp, Artificial Sequence
  Description of Artificial Sequence: Synthetic oligonucleotide
  Target: SCN9A; (-) strand; PAM type: YTN; PAM sequence: TTT
ggagatacttaaatatgctt

SEQ ID NO: 70498 - DNA, 20 bp, Artificial Sequence
  Description of Artificial Sequence: Synthetic oligonucleotide
  Target: SCN9A; (-) strand; PAM type: YTN; PAM sequence: CTT
tggagatacttaaatatgct

SEQ ID NO: 70499 - DNA, 20 bp, Artificial Sequence
  Description of Artificial Sequence: Synthetic oligonucleotide
  Target: SCN9A; (-) strand; PAM type: YTN; PAM sequence: TTA
tctttggagatacttaaata

SEQ ID NO: 70500 - DNA, 20 bp, Artificial Sequence
  Description of Artificial Sequence: Synthetic oligonucleotide
  Target: SCN9A; (-) strand; PAM type: YTN; PAM sequence: TTA
caaagtcattatctttggag

SEQ ID NO: 70501 - DNA, 20 bp, Artificial Sequence
  Description of Artificial Sequence: Synthetic oligonucleotide
  Target: SCN9A; (-) strand; PAM type: YTN; PAM sequence: TTT
acaaagtcattatctttgga

SEQ ID NO: 70502 - DNA, 20 bp, Artificial Sequence
  Description of Artificial Sequence: Synthetic oligonucleotide
  Target: SCN9A; (-) strand; PAM type: YTN; PAM sequence: TTC
agtttacaaagtcattatct

SEQ ID NO: 70503 - DNA, 20 bp, Artificial Sequence
  Description of Artificial Sequence: Synthetic oligonucleotide
  Target: SCN9A; (-) strand; PAM type: YTN; PAM sequence: TTC
agtgttcagtttacaaagtc

SEQ ID NO: 70504 - DNA, 20 bp, Artificial Sequence
  Description of Artificial Sequence: Synthetic oligonucleotide
  Target: SCN9A; (-) strand; PAM type: YTN; PAM sequence: CTA
ttcagtgttcagtttacaaa

SEQ ID NO: 70505 - DNA, 20 bp, Artificial Sequence
  Description of Artificial Sequence: Synthetic oligonucleotide
  Target: SCN9A; (-) strand; PAM type: YTN; PAM sequence: TTC
atctattcagtgttcagttt

SEQ ID NO: 70506 - DNA, 20 bp, Artificial Sequence
  Description of Artificial Sequence: Synthetic oligonucleotide
  Target: SCN9A; (-) strand; PAM type: YTN; PAM sequence: CTA
tccacccattcatctattca

SEQ ID NO: 70507 - DNA, 20 bp, Artificial Sequence
  Description of Artificial Sequence: Synthetic oligonucleotide
  Target: SCN9A; (-) strand; PAM type: YTN; PAM sequence: TTC
atctatccacccattcatct

SEQ ID NO: 70508 - DNA, 20 bp, Artificial Sequence
  Description of Artificial Sequence: Synthetic oligonucleotide
  Target: SCN9A; (-) strand; PAM type: YTN; PAM sequence: TTC
attcatctatccacccattc

SEQ ID NO: 70509 - DNA, 20 bp, Artificial Sequence
  Description of Artificial Sequence: Synthetic oligonucleotide
  Target: SCN9A; (-) strand; PAM type: YTN; PAM sequence: CTC
attcattcatctatccaccc

SEQ ID NO: 70510 - DNA, 20 bp, Artificial Sequence
  Description of Artificial Sequence: Synthetic oligonucleotide
  Target: SCN9A; (-) strand; PAM type: YTN; PAM sequence: TTC
actcattcattcatctatcc

SEQ ID NO: 70511 - DNA, 20 bp, Artificial Sequence
  Description of Artificial Sequence: Synthetic oligonucleotide
  Target: SCN9A; (-) strand; PAM type: YTN; PAM sequence: CTG
attcactcattcattcatct

SEQ ID NO: 70512 - DNA, 20 bp, Artificial Sequence
  Description of Artificial Sequence: Synthetic oligonucleotide
  Target: SCN9A; (-) strand; PAM type: YTN; PAM sequence: TTC
acctgattcactcattcatt

SEQ ID NO: 70513 - DNA, 20 bp, Artificial Sequence
  Description of Artificial Sequence: Synthetic oligonucleotide
  Target: SCN9A; (-) strand; PAM type: YTN; PAM sequence: TTG
ttcacctgattcactcattc

SEQ ID NO: 70514 - DNA, 20 bp, Artificial Sequence
  Description of Artificial Sequence: Synthetic oligonucleotide
  Target: SCN9A; (-) strand; PAM type: YTN; PAM sequence: TTC
atattgttcacctgattcac

SEQ ID NO: 70515 - DNA, 20 bp, Artificial Sequence
  Description of Artificial Sequence: Synthetic oligonucleotide
  Target: SCN9A; (-) strand; PAM type: YTN; PAM sequence: CTC
aggcagaggaacaagcattc

SEQ ID NO: 70516 - DNA, 20 bp, Artificial Sequence
  Description of Artificial Sequence: Synthetic oligonucleotide
  Target: SCN9A; (-) strand; PAM type: YTN; PAM sequence: CTG
ggcagatgtggtacagaagg

SEQ ID NO: 70517 - DNA, 20 bp, Artificial Sequence
  Description of Artificial Sequence: Synthetic oligonucleotide
  Target: SCN9A; (-) strand; PAM type: YTN; PAM sequence: TTC
actgggcagatgtggtacag

SEQ ID NO: 70518 - DNA, 20 bp, Artificial Sequence
  Description of Artificial Sequence: Synthetic oligonucleotide
  Target: SCN9A; (-) strand; PAM type: YTN; PAM sequence: TTT
cactgggcagatgtggtaca

SEQ ID NO: 70519 - DNA, 20 bp, Artificial Sequence
  Description of Artificial Sequence: Synthetic oligonucleotide
  Target: SCN9A; (-) strand; PAM type: YTN; PAM sequence: TTA
cagtatggagaaaatttcac

SEQ ID NO: 70520 - DNA, 20 bp, Artificial Sequence
  Description of Artificial Sequence: Synthetic oligonucleotide
  Target: SCN9A; (-) strand; PAM type: YTN; PAM sequence: CTT
acagtatggagaaaatttca

SEQ ID NO: 70521 - DNA, 20 bp, Artificial Sequence
  Description of Artificial Sequence: Synthetic oligonucleotide
  Target: SCN9A; (-) strand; PAM type: YTN; PAM sequence: TTA
gaccagaccttacagtatgg

SEQ ID NO: 70522 - DNA, 20 bp, Artificial Sequence
  Description of Artificial Sequence: Synthetic oligonucleotide
  Target: SCN9A; (-) strand; PAM type: YTN; PAM sequence: CTT
agaccagaccttacagtatg

SEQ ID NO: 70523 - DNA, 20 bp, Artificial Sequence
  Description of Artificial Sequence: Synthetic oligonucleotide
  Target: SCN9A; (-) strand; PAM type: YTN; PAM sequence: TTC
acatgaaaggaggtggcact

SEQ ID NO: 70524 - DNA, 20 bp, Artificial Sequence
  Description of Artificial Sequence: Synthetic oligonucleotide
  Target: SCN9A; (-) strand; PAM type: YTN; PAM sequence: CTT
cacatgaaaggaggtggcac

SEQ ID NO: 70525 - DNA, 20 bp, Artificial Sequence
  Description of Artificial Sequence: Synthetic oligonucleotide
  Target: SCN9A; (-) strand; PAM type: YTN; PAM sequence: CTG
acttcacatgaaaggaggtg

SEQ ID NO: 70526 - DNA, 20 bp, Artificial Sequence
  Description of Artificial Sequence: Synthetic oligonucleotide
  Target: SCN9A; (-) strand; PAM type: YTN; PAM sequence: CTG
gctgacttcacatgaaagga

SEQ ID NO: 70527 - DNA, 20 bp, Artificial Sequence
  Description of Artificial Sequence: Synthetic oligonucleotide
  Target: SCN9A; (-) strand; PAM type: YTN; PAM sequence: CTG
tatctggctgacttcacatg

SEQ ID NO: 70528 - DNA, 20 bp, Artificial Sequence
  Description of Artificial Sequence: Synthetic oligonucleotide
  Target: SCN9A; (-) strand; PAM type: YTN; PAM sequence: TTG
agtaaggggctgtatctggc

SEQ ID NO: 70529 - DNA, 20 bp, Artificial Sequence
  Description of Artificial Sequence: Synthetic oligonucleotide
  Target: SCN9A; (-) strand; PAM type: YTN; PAM sequence: TTG
aggatgcattgagtaagggg

SEQ ID NO: 70530 - DNA, 20 bp, Artificial Sequence
  Description of Artificial Sequence: Synthetic oligonucleotide
  Target: SCN9A; (-) strand; PAM type: YTN; PAM sequence: CTA
gtccattgaggatgcattga

SEQ ID NO: 70531 - DNA, 20 bp, Artificial Sequence
  Description of Artificial Sequence: Synthetic oligonucleotide
  Target: SCN9A; (-) strand; PAM type: YTN; PAM sequence: CTA
aactagtccattgaggatgc

SEQ ID NO: 70532 - DNA, 20 bp, Artificial Sequence
  Description of Artificial Sequence: Synthetic oligonucleotide
  Target: SCN9A; (-) strand; PAM type: YTN; PAM sequence: TTA
taacacagaacaaagcaaag

SEQ ID NO: 70533 - DNA, 20 bp, Artificial Sequence
  Description of Artificial Sequence: Synthetic oligonucleotide
  Target: SCN9A; (-) strand; PAM type: YTN; PAM sequence: TTA
ggtaaatatacaaaaaatta

SEQ ID NO: 70534 - DNA, 20 bp, Artificial Sequence
  Description of Artificial Sequence: Synthetic oligonucleotide
  Target: SCN9A; (-) strand; PAM type: YTN; PAM sequence: CTT
aggtaaatatacaaaaaatt

SEQ ID NO: 70535 - DNA, 20 bp, Artificial Sequence
  Description of Artificial Sequence: Synthetic oligonucleotide
  Target: SCN9A; (-) strand; PAM type: YTN; PAM sequence: TTG
caccttaggtaaatatacaa

SEQ ID NO: 70536 - DNA, 20 bp, Artificial Sequence
  Description of Artificial Sequence: Synthetic oligonucleotide
  Target: SCN9A; (-) strand; PAM type: YTN; PAM sequence: CTT
gcaccttaggtaaatataca

SEQ ID NO: 70537 - DNA, 20 bp, Artificial Sequence
  Description of Artificial Sequence: Synthetic oligonucleotide
  Target: SCN9A; (-) strand; PAM type: YTN; PAM sequence: CTA
atagcttgcaccttaggtaa

SEQ ID NO: 70538 - DNA, 20 bp, Artificial Sequence
  Description of Artificial Sequence: Synthetic oligonucleotide
  Target: SCN9A; (-) strand; PAM type: YTN; PAM sequence: CTC
taatagcttgcaccttaggt

SEQ ID NO: 70539 - DNA, 20 bp, Artificial Sequence
  Description of Artificial Sequence: Synthetic oligonucleotide
  Target: SCN9A; (-) strand; PAM type: YTN; PAM sequence: TTG
acaacaaaaagtatacactc

SEQ ID NO: 70540 - DNA, 20 bp, Artificial Sequence
  Description of Artificial Sequence: Synthetic oligonucleotide
  Target: SCN9A; (-) strand; PAM type: YTN; PAM sequence: TTG
atcattgacaacaaaaagta

SEQ ID NO: 70541 - DNA, 20 bp, Artificial Sequence
  Description of Artificial Sequence: Synthetic oligonucleotide
  Target: SCN9A; (-) strand; PAM type: YTN; PAM sequence: TTC
aaaggtaaagggtgattgat

SEQ ID NO: 70542 - DNA, 20 bp, Artificial Sequence
  Description of Artificial Sequence: Synthetic oligonucleotide
  Target: SCN9A; (-) strand; PAM type: YTN; PAM sequence: CTT
caaaggtaaagggtgattga

SEQ ID NO: 70543 - DNA, 20 bp, Artificial Sequence
  Description of Artificial Sequence: Synthetic oligonucleotide
  Target: SCN9A; (-) strand; PAM type: YTN; PAM sequence: TTC
atgtacttcaaaggtaaagg

SEQ ID NO: 70544 - DNA, 20 bp, Artificial Sequence
  Description of Artificial Sequence: Synthetic oligonucleotide
  Target: SCN9A; (-) strand; PAM type: YTN; PAM sequence: CTT
catgtacttcaaaggtaaag

SEQ ID NO: 70545 - DNA, 20 bp, Artificial Sequence
  Description of Artificial Sequence: Synthetic oligonucleotide
  Target: SCN9A; (-) strand; PAM type: YTN; PAM sequence: CTA
aaaacttcatgtacttcaaa

SEQ ID NO: 70546 - DNA, 20 bp, Artificial Sequence
  Description of Artificial Sequence: Synthetic oligonucleotide
  Target: SCN9A; (-) strand; PAM type: YTN; PAM sequence: TTG
agtcccccaaaaaccacact

SEQ ID NO: 70547 - DNA, 20 bp, Artificial Sequence
  Description of Artificial Sequence: Synthetic oligonucleotide
  Target: SCN9A; (-) strand; PAM type: YTN; PAM sequence: CTA
taaatattgagtcccccaaa

SEQ ID NO: 70548 - DNA, 20 bp, Artificial Sequence
  Description of Artificial Sequence: Synthetic oligonucleotide
  Target: SCN9A; (-) strand; PAM type: YTN; PAM sequence: TTG
gccccctataaatattgagt

SEQ ID NO: 70549 - DNA, 20 bp, Artificial Sequence
  Description of Artificial Sequence: Synthetic oligonucleotide
  Target: SCN9A; (-) strand; PAM type: YTN; PAM sequence: TTT
ggccccctataaatattgag

SEQ ID NO: 70550 - DNA, 20 bp, Artificial Sequence
  Description of Artificial Sequence: Synthetic oligonucleotide
  Target: SCN9A; (-) strand; PAM type: YTN; PAM sequence: TTT
tggccccctataaatattga

SEQ ID NO: 70551 - DNA, 20 bp, Artificial Sequence
  Description of Artificial Sequence: Synthetic oligonucleotide
  Target: SCN9A; (-) strand; PAM type: YTN; PAM sequence: TTT
ttggccccctataaatattg

SEQ ID NO: 70552 - DNA, 20 bp, Artificial Sequence
  Description of Artificial Sequence: Synthetic oligonucleotide
  Target: SCN9A; (-) strand; PAM type: YTN; PAM sequence: CTC
atgaaatatttttggccccc

SEQ ID NO: 70553 - DNA, 20 bp, Artificial Sequence
  Description of Artificial Sequence: Synthetic oligonucleotide
  Target: SCN9A; (-) strand; PAM type: YTN; PAM sequence: TTA
cactcatgaaatatttttgg

SEQ ID NO: 70554 - DNA, 20 bp, Artificial Sequence
  Description of Artificial Sequence: Synthetic oligonucleotide
  Target: SCN9A; (-) strand; PAM type: YTN; PAM sequence: CTA
aattacactcatgaaatatt

SEQ ID NO: 70555 - DNA, 20 bp, Artificial Sequence
  Description of Artificial Sequence: Synthetic oligonucleotide
  Target: SCN9A; (-) strand; PAM type: YTN; PAM sequence: CTC
ctaaattacactcatgaaat

SEQ ID NO: 70556 - DNA, 20 bp, Artificial Sequence
  Description of Artificial Sequence: Synthetic oligonucleotide
  Target: SCN9A; (-) strand; PAM type: YTN; PAM sequence: CTC
tcctaaattacactcatgaa

SEQ ID NO: 70557 - DNA, 20 bp, Artificial Sequence
  Description of Artificial Sequence: Synthetic oligonucleotide
  Target: SCN9A; (-) strand; PAM type: YTN; PAM sequence: TTC
tctcctaaattacactcatg

SEQ ID NO: 70558 - DNA, 20 bp, Artificial Sequence
  Description of Artificial Sequence: Synthetic oligonucleotide
  Target: SCN9A; (-) strand; PAM type: YTN; PAM sequence: TTT
ctctcctaaattacactcat

SEQ ID NO: 70559 - DNA, 20 bp, Artificial Sequence
  Description of Artificial Sequence: Synthetic oligonucleotide
  Target: SCN9A; (-) strand; PAM type: YTN; PAM sequence: TTT
tctctcctaaattacactca

SEQ ID NO: 70560 - DNA, 20 bp, Artificial Sequence
  Description of Artificial Sequence: Synthetic oligonucleotide
  Target: SCN9A; (-) strand; PAM type: YTN; PAM sequence: TTT
ttctctcctaaattacactc

SEQ ID NO: 70561 - DNA, 20 bp, Artificial Sequence
  Description of Artificial Sequence: Synthetic oligonucleotide
  Target: SCN9A; (-) strand; PAM type: YTN; PAM sequence: TTA
taataggcatagagtttttc

SEQ ID NO: 70562 - DNA, 20 bp, Artificial Sequence
  Description of Artificial Sequence: Synthetic oligonucleotide
  Target: SCN9A; (-) strand; PAM type: YTN; PAM sequence: CTG
cccagaattataataggcat

SEQ ID NO: 70563 - DNA, 20 bp, Artificial Sequence
  Description of Artificial Sequence: Synthetic oligonucleotide
  Target: SCN9A; (-) strand; PAM type: YTN; PAM sequence: CTC
tgcccagaattataataggc

SEQ ID NO: 70564 - DNA, 20 bp, Artificial Sequence
  Description of Artificial Sequence: Synthetic oligonucleotide
  Target: SCN9A; (-) strand; PAM type: YTN; PAM sequence: CTC
tctgcccagaattataatag

SEQ ID NO: 70565 - DNA, 20 bp, Artificial Sequence
  Description of Artificial Sequence: Synthetic oligonucleotide
  Target: SCN9A; (-) strand; PAM type: YTN; PAM sequence: CTA
tgactctctgcccagaatta

SEQ ID NO: 70566 - DNA, 20 bp, Artificial Sequence
  Description of Artificial Sequence: Synthetic oligonucleotide
  Target: SCN9A; (-) strand; PAM type: YTN; PAM sequence: TTC
tatgactctctgcccagaat

SEQ ID NO: 70567 - DNA, 20 bp, Artificial Sequence
  Description of Artificial Sequence: Synthetic oligonucleotide
  Target: SCN9A; (-) strand; PAM type: YTN; PAM sequence: TTT
ctatgactctctgcccagaa

SEQ ID NO: 70568 - DNA, 20 bp, Artificial Sequence
  Description of Artificial Sequence: Synthetic oligonucleotide
  Target: SCN9A; (-) strand; PAM type: YTN; PAM sequence: TTT
tctatgactctctgcccaga

SEQ ID NO: 70569 - DNA, 20 bp, Artificial Sequence
  Description of Artificial Sequence: Synthetic oligonucleotide
  Target: SCN9A; (-) strand; PAM type: YTN; PAM sequence: TTA
aaattttctatgactctctg

SEQ ID NO: 70570 - DNA, 20 bp, Artificial Sequence
  Description of Artificial Sequence: Synthetic oligonucleotide
  Target: SCN9A; (-) strand; PAM type: YTN; PAM sequence: TTG
tgcatagtagagaacacatt

SEQ ID NO: 70571 - DNA, 20 bp, Artificial Sequence
  Description of Artificial Sequence: Synthetic oligonucleotide
  Target: SCN9A; (-) strand; PAM type: YTN; PAM sequence: TTT
gtgcatagtagagaacacat

SEQ ID NO: 70572 - DNA, 20 bp, Artificial Sequence
  Description of Artificial Sequence: Synthetic oligonucleotide
  Target: SCN9A; (-) strand; PAM type: YTN; PAM sequence: TTA
tttgtgcatagtagagaaca

SEQ ID NO: 70573 - DNA, 20 bp, Artificial Sequence
  Description of Artificial Sequence: Synthetic oligonucleotide
  Target: SCN9A; (-) strand; PAM type: YTN; PAM sequence: TTT
atttgtgcatagtagagaac

SEQ ID NO: 70574 - DNA, 20 bp, Artificial Sequence
  Description of Artificial Sequence: Synthetic oligonucleotide
  Target: SCN9A; (-) strand; PAM type: YTN; PAM sequence: TTT
tatttgtgcatagtagagaa

SEQ ID NO: 70575 - DNA, 20 bp, Artificial Sequence
  Description of Artificial Sequence: Synthetic oligonucleotide
  Target: SCN9A; (-) strand; PAM type: YTN; PAM sequence: CTT
ttatttgtgcatagtagaga

SEQ ID NO: 70576 - DNA, 20 bp, Artificial Sequence
  Description of Artificial Sequence: Synthetic oligonucleotide
  Target: SCN9A; (-) strand; PAM type: YTN; PAM sequence: TTC
ttttatttgtgcatagtaga

SEQ ID NO: 70577 - DNA, 20 bp, Artificial Sequence
  Description of Artificial Sequence: Synthetic oligonucleotide
  Target: SCN9A; (-) strand; PAM type: YTN; PAM sequence: TTT
cttttatttgtgcatagtag

SEQ ID NO: 70578 - DNA, 20 bp, Artificial Sequence
  Description of Artificial Sequence: Synthetic oligonucleotide
  Target: SCN9A; (-) strand; PAM type: YTN; PAM sequence: TTC
atttcttttatttgtgcata

SEQ ID NO: 70579 - DNA, 20 bp, Artificial Sequence
  Description of Artificial Sequence: Synthetic oligonucleotide
  Target: SCN9A; (-) strand; PAM type: YTN; PAM sequence: TTA
ttcatttcttttatttgtgc

SEQ ID NO: 70580 - DNA, 20 bp, Artificial Sequence
  Description of Artificial Sequence: Synthetic oligonucleotide
  Target: SCN9A; (-) strand; PAM type: YTN; PAM sequence: TTT
attcatttcttttatttgtg

SEQ ID NO: 70581 - DNA, 20 bp, Artificial Sequence
  Description of Artificial Sequence: Synthetic oligonucleotide
  Target: SCN9A; (-) strand; PAM type: YTN; PAM sequence: TTT
tattcatttcttttatttgt

SEQ ID NO: 70582 - DNA, 20 bp, Artificial Sequence
  Description of Artificial Sequence: Synthetic oligonucleotide
  Target: SCN9A; (-) strand; PAM type: YTN; PAM sequence: CTG
aacacagatattttattcat

SEQ ID NO: 70583 - DNA, 20 bp, Artificial Sequence
  Description of Artificial Sequence: Synthetic oligonucleotide
  Target: SCN9A; (-) strand; PAM type: YTN; PAM sequence: TTA
ctgaacacagatattttatt

SEQ ID NO: 70584 - DNA, 20 bp, Artificial Sequence
  Description of Artificial Sequence: Synthetic oligonucleotide
  Target: SCN9A; (-) strand; PAM type: YTN; PAM sequence: TTA
tgttactgaacacagatatt

SEQ ID NO: 70585 - DNA, 20 bp, Artificial Sequence
  Description of Artificial Sequence: Synthetic oligonucleotide
  Target: SCN9A; (-) strand; PAM type: YTN; PAM sequence: TTA
cataaatattatgttactga

SEQ ID NO: 70586 - DNA, 20 bp, Artificial Sequence
  Description of Artificial Sequence: Synthetic oligonucleotide
  Target: SCN9A; (-) strand; PAM type: YTN; PAM sequence: TTA
attacataaatattatgtta

SEQ ID NO: 70587 - DNA, 20 bp, Artificial Sequence
  Description of Artificial Sequence: Synthetic oligonucleotide
  Target: SCN9A; (-) strand; PAM type: YTN; PAM sequence: CTT
aattacataaatattatgtt

SEQ ID NO: 70588 - DNA, 20 bp, Artificial Sequence
  Description of Artificial Sequence: Synthetic oligonucleotide
  Target: SCN9A; (-) strand; PAM type: YTN; PAM sequence: TTC
ttaattacataaatattatg

SEQ ID NO: 70589 - DNA, 20 bp, Artificial Sequence
  Description of Artificial Sequence: Synthetic oligonucleotide
  Target: SCN9A; (-) strand; PAM type: YTN; PAM sequence: TTT
cttaattacataaatattat

SEQ ID NO: 70590 - DNA, 20 bp, Artificial Sequence
  Description of Artificial Sequence: Synthetic oligonucleotide
  Target: SCN9A; (-) strand; PAM type: YTN; PAM sequence: TTA
tttcttaattacataaatat

SEQ ID NO: 70591 - DNA, 20 bp, Artificial Sequence
  Description of Artificial Sequence: Synthetic oligonucleotide
  Target: SCN9A; (-) strand; PAM type: YTN; PAM sequence: CTT
atttcttaattacataaata

SEQ ID NO: 70592 - DNA, 20 bp, Artificial Sequence
  Description of Artificial Sequence: Synthetic oligonucleotide
  Target: SCN9A; (-) strand; PAM type: YTN; PAM sequence: CTG
tataatcttatttcttaatt

SEQ ID NO: 70593 - DNA, 20 bp, Artificial Sequence
  Description of Artificial Sequence: Synthetic oligonucleotide
  Target: SCN9A; (-) strand; PAM type: YTN; PAM sequence: CTA
cctgtataatcttatttctt

SEQ ID NO: 70594 - DNA, 20 bp, Artificial Sequence
  Description of Artificial Sequence: Synthetic oligonucleotide
  Target: SCN9A; (-) strand; PAM type: YTN; PAM sequence: TTC
tacctgtataatcttatttc

SEQ ID NO: 70595 - DNA, 20 bp, Artificial Sequence
  Description of Artificial Sequence: Synthetic oligonucleotide
  Target: SCN9A; (-) strand; PAM type: YTN; PAM sequence: TTC
attctacctgtataatctta

SEQ ID NO: 70596 - DNA, 20 bp, Artificial Sequence
  Description of Artificial Sequence: Synthetic oligonucleotide
  Target: SCN9A; (-) strand; PAM type: YTN; PAM sequence: CTT
cattctacctgtataatctt

SEQ ID NO: 70597 - DNA, 20 bp, Artificial Sequence
  Description of Artificial Sequence: Synthetic oligonucleotide
  Target: SCN9A; (-) strand; PAM type: YTN; PAM sequence: CTC
aacataatacaaaggcataa

SEQ ID NO: 70598 - DNA, 20 bp, Artificial Sequence
  Description of Artificial Sequence: Synthetic oligonucleotide
  Target: SCN9A; (-) strand; PAM type: YTN; PAM sequence: TTC
atgtggctcaacataataca

SEQ ID NO: 70599 - DNA, 20 bp, Artificial Sequence
  Description of Artificial Sequence: Synthetic oligonucleotide
  Target: SCN9A; (-) strand; PAM type: YTN; PAM sequence: TTT
catgtggctcaacataatac

SEQ ID NO: 70600 - DNA, 20 bp, Artificial Sequence
  Description of Artificial Sequence: Synthetic oligonucleotide
  Target: SCN9A; (-) strand; PAM type: YTN; PAM sequence: CTA
gaaatttcatgtggctcaac

SEQ ID NO: 70601 - DNA, 20 bp, Artificial Sequence
  Description of Artificial Sequence: Synthetic oligonucleotide
  Target: SCN9A; (-) strand; PAM type: YTN; PAM sequence: CTG
caaaaactagaaatttcatg

SEQ ID NO: 70602 - DNA, 20 bp, Artificial Sequence
  Description of Artificial Sequence: Synthetic oligonucleotide
  Target: SCN9A; (-) strand; PAM type: YTN; PAM sequence: TTA
atctgcaaaaactagaaatt

SEQ ID NO: 70603 - DNA, 20 bp, Artificial Sequence
  Description of Artificial Sequence: Synthetic oligonucleotide
  Target: SCN9A; (-) strand; PAM type: YTN; PAM sequence: TTT
aatctgcaaaaactagaaat

SEQ ID NO: 70604 - DNA, 20 bp, Artificial Sequence
  Description of Artificial Sequence: Synthetic oligonucleotide
  Target: SCN9A; (-) strand; PAM type: YTN; PAM sequence: TTT
taatctgcaaaaactagaaa

SEQ ID NO: 70605 - DNA, 20 bp, Artificial Sequence
  Description of Artificial Sequence: Synthetic oligonucleotide
  Target: SCN9A; (-) strand; PAM type: YTN; PAM sequence: TTT
ttaatctgcaaaaactagaa

SEQ ID NO: 70606 - DNA, 20 bp, Artificial Sequence
  Description of Artificial Sequence: Synthetic oligonucleotide
  Target: SCN9A; (-) strand; PAM type: YTN; PAM sequence: CTA
aatatccaaccatttttaat

SEQ ID NO: 70607 - DNA, 20 bp, Artificial Sequence
  Description of Artificial Sequence: Synthetic oligonucleotide
  Target: SCN9A; (-) strand; PAM type: YTN; PAM sequence: TTA
aataataaaaaactaaatat

SEQ ID NO: 70608 - DNA, 20 bp, Artificial Sequence
  Description of Artificial Sequence: Synthetic oligonucleotide
  Target: SCN9A; (-) strand; PAM type: YTN; PAM sequence: TTA
agttaaataataaaaaacta

SEQ ID NO: 70609 - DNA, 20 bp, Artificial Sequence
  Description of Artificial Sequence: Synthetic oligonucleotide
  Target: SCN9A; (-) strand; PAM type: YTN; PAM sequence: TTT
aagttaaataataaaaaact

SEQ ID NO: 70610 - DNA, 20 bp, Artificial Sequence
  Description of Artificial Sequence: Synthetic oligonucleotide
  Target: SCN9A; (-) strand; PAM type: YTN; PAM sequence: TTT
taagttaaataataaaaaac

SEQ ID NO: 70611 - DNA, 20 bp, Artificial Sequence
  Description of Artificial Sequence: Synthetic oligonucleotide
  Target: SCN9A; (-) strand; PAM type: YTN; PAM sequence: TTA
gaaaatatatatgaaaataa

SEQ ID NO: 70612 - DNA, 20 bp, Artificial Sequence
  Description of Artificial Sequence: Synthetic oligonucleotide
  Target: SCN9A; (-) strand; PAM type: YTN; PAM sequence: TTG
aattagaaaatatatatgaa

SEQ ID NO: 70613 - DNA, 20 bp, Artificial Sequence
  Description of Artificial Sequence: Synthetic oligonucleotide
  Target: SCN9A; (-) strand; PAM type: YTN; PAM sequence: TTA
ttgaattagaaaatatatat

SEQ ID NO: 70614 - DNA, 20 bp, Artificial Sequence
  Description of Artificial Sequence: Synthetic oligonucleotide
  Target: SCN9A; (-) strand; PAM type: YTN; PAM sequence: CTT
attgaattagaaaatatata

SEQ ID NO: 70615 - DNA, 20 bp, Artificial Sequence
  Description of Artificial Sequence: Synthetic oligonucleotide
  Target: SCN9A; (-) strand; PAM type: YTN; PAM sequence: TTA
cttattgaattagaaaatat

SEQ ID NO: 70616 - DNA, 20 bp, Artificial Sequence
  Description of Artificial Sequence: Synthetic oligonucleotide
  Target: SCN9A; (-) strand; PAM type: YTN; PAM sequence: TTT
acttattgaattagaaaata

SEQ ID NO: 70617 - DNA, 20 bp, Artificial Sequence
  Description of Artificial Sequence: Synthetic oligonucleotide
  Target: SCN9A; (-) strand; PAM type: YTN; PAM sequence: TTT
tacttattgaattagaaaat

SEQ ID NO: 70618 - DNA, 20 bp, Artificial Sequence
  Description of Artificial Sequence: Synthetic oligonucleotide
  Target: SCN9A; (-) strand; PAM type: YTN; PAM sequence: TTT
ttacttattgaattagaaaa

SEQ ID NO: 70619 - DNA, 20 bp, Artificial Sequence
  Description of Artificial Sequence: Synthetic oligonucleotide
  Target: SCN9A; (-) strand; PAM type: YTN; PAM sequence: TTA
atttttacttattgaattag

SEQ ID NO: 70620 - DNA, 20 bp, Artificial Sequence
  Description of Artificial Sequence: Synthetic oligonucleotide
  Target: SCN9A; (-) strand; PAM type: YTN; PAM sequence: TTA
ccaaaaaacaaaagttaatt

SEQ ID NO: 70621 - DNA, 20 bp, Artificial Sequence
  Description of Artificial Sequence: Synthetic oligonucleotide
  Target: SCN9A; (-) strand; PAM type: YTN; PAM sequence: TTG
tataaaattaccaaaaaaca

SEQ ID NO: 70622 - DNA, 20 bp, Artificial Sequence
  Description of Artificial Sequence: Synthetic oligonucleotide
  Target: SCN9A; (-) strand; PAM type: YTN; PAM sequence: TTG
aaacatattgtataaaatta

SEQ ID NO: 70623 - DNA, 20 bp, Artificial Sequence
  Description of Artificial Sequence: Synthetic oligonucleotide
  Target: SCN9A; (-) strand; PAM type: YTN; PAM sequence: TTT
gaaacatattgtataaaatt

SEQ ID NO: 70624 - DNA, 20 bp, Artificial Sequence
  Description of Artificial Sequence: Synthetic oligonucleotide
  Target: SCN9A; (-) strand; PAM type: YTN; PAM sequence: CTT
tgaaacatattgtataaaat

SEQ ID NO: 70625 - DNA, 20 bp, Artificial Sequence
  Description of Artificial Sequence: Synthetic oligonucleotide
  Target: SCN9A; (-) strand; PAM type: YTN; PAM sequence: TTA
tactttgaaacatattgtat

SEQ ID NO: 70626 - DNA, 20 bp, Artificial Sequence
  Description of Artificial Sequence: Synthetic oligonucleotide
  Target: SCN9A; (-) strand; PAM type: YTN; PAM sequence: TTG
taatgttatactttgaaaca

SEQ ID NO: 70627 - DNA, 20 bp, Artificial Sequence
  Description of Artificial Sequence: Synthetic oligonucleotide
  Target: SCN9A; (-) strand; PAM type: YTN; PAM sequence: TTG
gaataatatgcatcaattgt

SEQ ID NO: 70628 - DNA, 20 bp, Artificial Sequence
  Description of Artificial Sequence: Synthetic oligonucleotide
  Target: SCN9A; (-) strand; PAM type: YTN; PAM sequence: TTT
ggaataatatgcatcaattg

SEQ ID NO: 70629 - DNA, 20 bp, Artificial Sequence
  Description of Artificial Sequence: Synthetic oligonucleotide
  Target: SCN9A; (-) strand; PAM type: YTN; PAM sequence: CTA
ggcataatttggaataatat

SEQ ID NO: 70630 - DNA, 20 bp, Artificial Sequence
  Description of Artificial Sequence: Synthetic oligonucleotide
  Target: SCN9A; (-) strand; PAM type: YTN; PAM sequence: TTA
ctaggcataatttggaataa

SEQ ID NO: 70631 - DNA, 20 bp, Artificial Sequence
  Description of Artificial Sequence: Synthetic oligonucleotide
  Target: SCN9A; (-) strand; PAM type: YTN; PAM sequence: TTA
agagatgcagttactaggca

SEQ ID NO: 70632 - DNA, 20 bp, Artificial Sequence
  Description of Artificial Sequence: Synthetic oligonucleotide
  Target: SCN9A; (-) strand; PAM type: YTN; PAM sequence: TTT
aagagatgcagttactaggc

SEQ ID NO: 70633 - DNA, 20 bp, Artificial Sequence
  Description of Artificial Sequence: Synthetic oligonucleotide
  Target: SCN9A; (-) strand; PAM type: YTN; PAM sequence: TTT
taagagatgcagttactagg

SEQ ID NO: 70634 - DNA, 20 bp, Artificial Sequence
  Description of Artificial Sequence: Synthetic oligonucleotide
  Target: SCN9A; (-) strand; PAM type: YTN; PAM sequence: CTA
ttttaagagatgcagttact

SEQ ID NO: 70635 - DNA, 20 bp, Artificial Sequence
  Description of Artificial Sequence: Synthetic oligonucleotide
  Target: SCN9A; (-) strand; PAM type: YTN; PAM sequence: TTC
tattttaagagatgcagtta

SEQ ID NO: 70636 - DNA, 20 bp, Artificial Sequence
  Description of Artificial Sequence: Synthetic oligonucleotide
  Target: SCN9A; (-) strand; PAM type: YTN; PAM sequence: TTT
ctattttaagagatgcagtt

SEQ ID NO: 70637 - DNA, 20 bp, Artificial Sequence
  Description of Artificial Sequence: Synthetic oligonucleotide
  Target: SCN9A; (-) strand; PAM type: YTN; PAM sequence: TTT
tctattttaagagatgcagt

SEQ ID NO: 70638 - DNA, 20 bp, Artificial Sequence
  Description of Artificial Sequence: Synthetic oligonucleotide
  Target: SCN9A; (-) strand; PAM type: YTN; PAM sequence: TTG
aaggatggtaattttctatt

SEQ ID NO: 70639 - DNA, 20 bp, Artificial Sequence
  Description of Artificial Sequence: Synthetic oligonucleotide
  Target: SCN9A; (-) strand; PAM type: YTN; PAM sequence: TTA
tgaaaatgtcaaaagaattg

SEQ ID NO: 70640 - DNA, 20 bp, Artificial Sequence
  Description of Artificial Sequence: Synthetic oligonucleotide
  Target: SCN9A; (-) strand; PAM type: YTN; PAM sequence: TTT
atgaaaatgtcaaaagaatt

SEQ ID NO: 70641 - DNA, 20 bp, Artificial Sequence
  Description of Artificial Sequence: Synthetic oligonucleotide
  Target: SCN9A; (-) strand; PAM type: YTN; PAM sequence: CTT
tatgaaaatgtcaaaagaat

SEQ ID NO: 70642 - DNA, 20 bp, Artificial Sequence
  Description of Artificial Sequence: Synthetic oligonucleotide
  Target: SCN9A; (-) strand; PAM type: YTN; PAM sequence: TTC
ctttatgaaaatgtcaaaag

SEQ ID NO: 70643 - DNA, 20 bp, Artificial Sequence
  Description of Artificial Sequence: Synthetic oligonucleotide
  Target: SCN9A; (-) strand; PAM type: YTN; PAM sequence: TTA
ttcctttatgaaaatgtcaa

SEQ ID NO: 70644 - DNA, 20 bp, Artificial Sequence
  Description of Artificial Sequence: Synthetic oligonucleotide
  Target: SCN9A; (-) strand; PAM type: YTN; PAM sequence: TTA
ttattcctttatgaaaatgt

SEQ ID NO: 70645 - DNA, 20 bp, Artificial Sequence
  Description of Artificial Sequence: Synthetic oligonucleotide
  Target: SCN9A; (-) strand; PAM type: YTN; PAM sequence: TTA
ttattattcctttatgaaaa

SEQ ID NO: 70646 - DNA, 20 bp, Artificial Sequence
  Description of Artificial Sequence: Synthetic oligonucleotide
  Target: SCN9A; (-) strand; PAM type: YTN; PAM sequence: CTA
attattattattcctttatg

SEQ ID NO: 70647 - DNA, 20 bp, Artificial Sequence
  Description of Artificial Sequence: Synthetic oligonucleotide
  Target: SCN9A; (-) strand; PAM type: YTN; PAM sequence: CTA
ctaattattattattccttt

SEQ ID NO: 70648 - DNA, 20 bp, Artificial Sequence
  Description of Artificial Sequence: Synthetic oligonucleotide
  Target: SCN9A; (-) strand; PAM type: YTN; PAM sequence: CTG
ctactaattattattattcc

SEQ ID NO: 70649 - DNA, 20 bp, Artificial Sequence
  Description of Artificial Sequence: Synthetic oligonucleotide
  Target: SCN9A; (-) strand; PAM type: YTN; PAM sequence: CTA
ctgctactaattattattat

SEQ ID NO: 70650 - DNA, 20 bp, Artificial Sequence
  Description of Artificial Sequence: Synthetic oligonucleotide
  Target: SCN9A; (-) strand; PAM type: YTN; PAM sequence: TTA
ctactgctactaattattat

SEQ ID NO: 70651 - DNA, 20 bp, Artificial Sequence
  Description of Artificial Sequence: Synthetic oligonucleotide
  Target: SCN9A; (-) strand; PAM type: YTN; PAM sequence: CTC
caatattactactgctacta

SEQ ID NO: 70652 - DNA, 20 bp, Artificial Sequence
  Description of Artificial Sequence: Synthetic oligonucleotide
  Target: SCN9A; (-) strand; PAM type: YTN; PAM sequence: TTC
tccaatattactactgctac

SEQ ID NO: 70653 - DNA, 20 bp, Artificial Sequence
  Description of Artificial Sequence: Synthetic oligonucleotide
  Target: SCN9A; (-) strand; PAM type: YTN; PAM sequence: CTT
ctccaatattactactgcta

SEQ ID NO: 70654 - DNA, 20 bp, Artificial Sequence
  Description of Artificial Sequence: Synthetic oligonucleotide
  Target: SCN9A; (-) strand; PAM type: YTN; PAM sequence: TTA
acaaggtcaggcatgcttct

SEQ ID NO: 70655 - DNA, 20 bp, Artificial Sequence
  Description of Artificial Sequence: Synthetic oligonucleotide
  Target: SCN9A; (-) strand; PAM type: YTN; PAM sequence: TTG
gaaggtattaacaaggtcag

SEQ ID NO: 70656 - DNA, 20 bp, Artificial Sequence
  Description of Artificial Sequence: Synthetic oligonucleotide
  Target: SCN9A; (-) strand; PAM type: YTN; PAM sequence: CTT
ggaaggtattaacaaggtca

SEQ ID NO: 70657 - DNA, 20 bp, Artificial Sequence
  Description of Artificial Sequence: Synthetic oligonucleotide
  Target: SCN9A; (-) strand; PAM type: YTN; PAM sequence: TTG
gtaagataccttggaaggta

SEQ ID NO: 70658 - DNA, 20 bp, Artificial Sequence
  Description of Artificial Sequence: Synthetic oligonucleotide
  Target: SCN9A; (-) strand; PAM type: YTN; PAM sequence: CTT
ggtaagataccttggaaggt

SEQ ID NO: 70659 - DNA, 20 bp, Artificial Sequence
  Description of Artificial Sequence: Synthetic oligonucleotide
  Target: SCN9A; (-) strand; PAM type: YTN; PAM sequence: CTC
ttggtaagataccttggaag

SEQ ID NO: 70660 - DNA, 20 bp, Artificial Sequence
  Description of Artificial Sequence: Synthetic oligonucleotide
  Target: SCN9A; (-) strand; PAM type: YTN; PAM sequence: TTC
tcttggtaagataccttgga

SEQ ID NO: 70661 - DNA, 20 bp, Artificial Sequence
  Description of Artificial Sequence: Synthetic oligonucleotide
  Target: SCN9A; (-) strand; PAM type: YTN; PAM sequence: CTG
gattctcttggtaagatacc

SEQ ID NO: 70662 - DNA, 20 bp, Artificial Sequence
  Description of Artificial Sequence: Synthetic oligonucleotide
  Target: SCN9A; (-) strand; PAM type: YTN; PAM sequence: CTG
aataaaatctggattctctt

SEQ ID NO: 70663 - DNA, 20 bp, Artificial Sequence
  Description of Artificial Sequence: Synthetic oligonucleotide
  Target: SCN9A; (-) strand; PAM type: YTN; PAM sequence: CTA
ccctgaataaaatctggatt

SEQ ID NO: 70664 - DNA, 20 bp, Artificial Sequence
  Description of Artificial Sequence: Synthetic oligonucleotide
  Target: SCN9A; (-) strand; PAM type: YTN; PAM sequence: TTG
ctaccctgaataaaatctgg

SEQ ID NO: 70665 - DNA, 20 bp, Artificial Sequence
  Description of Artificial Sequence: Synthetic oligonucleotide
  Target: SCN9A; (-) strand; PAM type: YTN; PAM sequence: CTG
ggcatattgctaccctgaat

SEQ ID NO: 70666 - DNA, 20 bp, Artificial Sequence
  Description of Artificial Sequence: Synthetic oligonucleotide
  Target: SCN9A; (-) strand; PAM type: YTN; PAM sequence: TTA
tctgggcatattgctaccct

SEQ ID NO: 70667 - DNA, 20 bp, Artificial Sequence
  Description of Artificial Sequence: Synthetic oligonucleotide
  Target: SCN9A; (-) strand; PAM type: YTN; PAM sequence: TTT
atctgggcatattgctaccc

SEQ ID NO: 70668 - DNA, 20 bp, Artificial Sequence
  Description of Artificial Sequence: Synthetic oligonucleotide
  Target: SCN9A; (-) strand; PAM type: YTN; PAM sequence: CTG
aggcaggacatttatctggg

SEQ ID NO: 70669 - DNA, 20 bp, Artificial Sequence
  Description of Artificial Sequence: Synthetic oligonucleotide
  Target: SCN9A; (-) strand; PAM type: YTN; PAM sequence: CTG
gctgaggcaggacatttatc

SEQ ID NO: 70670 - DNA, 20 bp, Artificial Sequence
  Description of Artificial Sequence: Synthetic oligonucleotide
  Target: SCN9A; (-) strand; PAM type: YTN; PAM sequence: CTA
acaacaaggtagcctggctg

SEQ ID NO: 70671 - DNA, 20 bp, Artificial Sequence
  Description of Artificial Sequence: Synthetic oligonucleotide
  Target: SCN9A; (-) strand; PAM type: YTN; PAM sequence: TTG
gcaagaacagtgtgacatgg

SEQ ID NO: 70672 - DNA, 20 bp, Artificial Sequence
  Description of Artificial Sequence: Synthetic oligonucleotide
  Target: SCN9A; (-) strand; PAM type: YTN; PAM sequence: TTA
ttggcaagaacagtgtgaca

SEQ ID NO: 70673 - DNA, 20 bp, Artificial Sequence
  Description of Artificial Sequence: Synthetic oligonucleotide
  Target: SCN9A; (-) strand; PAM type: YTN; PAM sequence: CTT
attggcaagaacagtgtgac

SEQ ID NO: 70674 - DNA, 20 bp, Artificial Sequence
  Description of Artificial Sequence: Synthetic oligonucleotide
  Target: SCN9A; (-) strand; PAM type: YTN; PAM sequence: TTA
tgtcttattggcaagaacag

SEQ ID NO: 70675 - DNA, 20 bp, Artificial Sequence
  Description of Artificial Sequence: Synthetic oligonucleotide
  Target: SCN9A; (-) strand; PAM type: YTN; PAM sequence: CTT
atgtcttattggcaagaaca

SEQ ID NO: 70676 - DNA, 20 bp, Artificial Sequence
  Description of Artificial Sequence: Synthetic oligonucleotide
  Target: SCN9A; (-) strand; PAM type: YTN; PAM sequence: TTG
gcttatgtcttattggcaag

SEQ ID NO: 70677 - DNA, 20 bp, Artificial Sequence
  Description of Artificial Sequence: Synthetic oligonucleotide
  Target: SCN9A; (-) strand; PAM type: YTN; PAM sequence: TTT
ggcttatgtcttattggcaa

SEQ ID NO: 70678 - DNA, 20 bp, Artificial Sequence
  Description of Artificial Sequence: Synthetic oligonucleotide
  Target: SCN9A; (-) strand; PAM type: YTN; PAM sequence: CTT
tggcttatgtcttattggca

SEQ ID NO: 70679 - DNA, 20 bp, Artificial Sequence
  Description of Artificial Sequence: Synthetic oligonucleotide
  Target: SCN9A; (-) strand; PAM type: YTN; PAM sequence: TTA
tccaactttggcttatgtct

SEQ ID NO: 70680 - DNA, 20 bp, Artificial Sequence
  Description of Artificial Sequence: Synthetic oligonucleotide
  Target: SCN9A; (-) strand; PAM type: YTN; PAM sequence: CTT
atccaactttggcttatgtc

SEQ ID NO: 70681 - DNA, 20 bp, Artificial Sequence
  Description of Artificial Sequence: Synthetic oligonucleotide
  Target: SCN9A; (-) strand; PAM type: YTN; PAM sequence: TTC
ccagagatccttatccaact

SEQ ID NO: 70682 - DNA, 20 bp, Artificial Sequence
  Description of Artificial Sequence: Synthetic oligonucleotide
  Target: SCN9A; (-) strand; PAM type: YTN; PAM sequence: TTT
cccagagatccttatccaac

SEQ ID NO: 70683 - DNA, 20 bp, Artificial Sequence
  Description of Artificial Sequence: Synthetic oligonucleotide
  Target: SCN9A; (-) strand; PAM type: YTN; PAM sequence: CTT
tcccagagatccttatccaa

SEQ ID NO: 70684 - DNA, 20 bp, Artificial Sequence
  Description of Artificial Sequence: Synthetic oligonucleotide
  Target: SCN9A; (-) strand; PAM type: YTN; PAM sequence: CTG
aggaagggcaaaactttccc

SEQ ID NO: 70685 - DNA, 20 bp, Artificial Sequence
  Description of Artificial Sequence: Synthetic oligonucleotide
  Target: SCN9A; (-) strand; PAM type: YTN; PAM sequence: TTG
cctgaggaagggcaaaactt

SEQ ID NO: 70686 - DNA, 20 bp, Artificial Sequence
  Description of Artificial Sequence: Synthetic oligonucleotide
  Target: SCN9A; (-) strand; PAM type: YTN; PAM sequence: CTT
gcctgaggaagggcaaaact

SEQ ID NO: 70687 - DNA, 20 bp, Artificial Sequence
  Description of Artificial Sequence: Synthetic oligonucleotide
  Target: SCN9A; (-) strand; PAM type: YTN; PAM sequence: CTA
tcccacttgcctgaggaagg

SEQ ID NO: 70688 - DNA, 20 bp, Artificial Sequence
  Description of Artificial Sequence: Synthetic oligonucleotide
  Target: SCN9A; (-) strand; PAM type: YTN; PAM sequence: TTA
tatccaatacccaggtagag

SEQ ID NO: 70689 - DNA, 20 bp, Artificial Sequence
  Description of Artificial Sequence: Synthetic oligonucleotide
  Target: SCN9A; (-) strand; PAM type: YTN; PAM sequence: TTT
atatccaatacccaggtaga

SEQ ID NO: 70690 - DNA, 20 bp, Artificial Sequence
  Description of Artificial Sequence: Synthetic oligonucleotide
  Target: SCN9A; (-) strand; PAM type: YTN; PAM sequence: CTT
tatatccaatacccaggtag

SEQ ID NO: 70691 - DNA, 20 bp, Artificial Sequence
  Description of Artificial Sequence: Synthetic oligonucleotide
  Target: SCN9A; (-) strand; PAM type: YTN; PAM sequence: CTA
cagctttatatccaataccc

SEQ ID NO: 70692 - DNA, 20 bp, Artificial Sequence
  Description of Artificial Sequence: Synthetic oligonucleotide
  Target: SCN9A; (-) strand; PAM type: YTN; PAM sequence: TTC
cacctacagctttatatcca

SEQ ID NO: 70693 - DNA, 20 bp, Artificial Sequence
  Description of Artificial Sequence: Synthetic oligonucleotide
  Target: SCN9A; (-) strand; PAM type: YTN; PAM sequence: CTG
ttccacctacagctttatat

SEQ ID NO: 70694 - DNA, 20 bp, Artificial Sequence
  Description of Artificial Sequence: Synthetic oligonucleotide
  Target: SCN9A; (-) strand; PAM type: YTN; PAM sequence: TTA
gaggtgactgttccacctac

SEQ ID NO: 70695 - DNA, 20 bp, Artificial Sequence
  Description of Artificial Sequence: Synthetic oligonucleotide
  Target: SCN9A; (-) strand; PAM type: YTN; PAM sequence: CTA
tgattagaggtgactgttcc

SEQ ID NO: 70696 - DNA, 20 bp, Artificial Sequence
  Description of Artificial Sequence: Synthetic oligonucleotide
  Target: SCN9A; (-) strand; PAM type: YTN; PAM sequence: TTA
atgcctatgattagaggtga

SEQ ID NO: 70697 - DNA, 20 bp, Artificial Sequence
  Description of Artificial Sequence: Synthetic oligonucleotide
  Target: SCN9A; (-) strand; PAM type: YTN; PAM sequence: CTA
tattaatgcctatgattaga

SEQ ID NO: 70698 - DNA, 20 bp, Artificial Sequence
  Description of Artificial Sequence: Synthetic oligonucleotide
  Target: SCN9A; (-) strand; PAM type: YTN; PAM sequence: TTC
tatattaatgcctatgatta

SEQ ID NO: 70699 - DNA, 20 bp, Artificial Sequence
  Description of Artificial Sequence: Synthetic oligonucleotide
  Target: SCN9A; (-) strand; PAM type: YTN; PAM sequence: CTT
ctatattaatgcctatgatt

SEQ ID NO: 70700 - DNA, 20 bp, Artificial Sequence
  Description of Artificial Sequence: Synthetic oligonucleotide
  Target: SCN9A; (-) strand; PAM type: YTN; PAM sequence: TTC
ttctatattaatgcctatga

SEQ ID NO: 70701 - DNA, 20 bp, Artificial Sequence
  Description of Artificial Sequence: Synthetic oligonucleotide
  Target: SCN9A; (-) strand; PAM type: YTN; PAM sequence: TTT
cttctatattaatgcctatg

SEQ ID NO: 70702 - DNA, 20 bp, Artificial Sequence
  Description of Artificial Sequence: Synthetic oligonucleotide
  Target: SCN9A; (-) strand; PAM type: YTN; PAM sequence: TTT
tcttctatattaatgcctat

SEQ ID NO: 70703 - DNA, 20 bp, Artificial Sequence
  Description of Artificial Sequence: Synthetic oligonucleotide
  Target: SCN9A; (-) strand; PAM type: YTN; PAM sequence: TTT
ttcttctatattaatgccta

SEQ ID NO: 70704 - DNA, 20 bp, Artificial Sequence
  Description of Artificial Sequence: Synthetic oligonucleotide
  Target: SCN9A; (-) strand; PAM type: YTN; PAM sequence: TTT
tttcttctatattaatgcct

SEQ ID NO: 70705 - DNA, 20 bp, Artificial Sequence
  Description of Artificial Sequence: Synthetic oligonucleotide
  Target: SCN9A; (-) strand; PAM type: YTN; PAM sequence: TTC
acatgtgttttttcttctat

SEQ ID NO: 70706 - DNA, 20 bp, Artificial Sequence
  Description of Artificial Sequence: Synthetic oligonucleotide
  Target: SCN9A; (-) strand; PAM type: YTN; PAM sequence: CTT
cacatgtgttttttcttcta

SEQ ID NO: 70707 - DNA, 20 bp, Artificial Sequence
  Description of Artificial Sequence: Synthetic oligonucleotide
  Target: SCN9A; (-) strand; PAM type: YTN; PAM sequence: CTG
ccaatcttcacatgtgtttt

SEQ ID NO: 70708 - DNA, 20 bp, Artificial Sequence
  Description of Artificial Sequence: Synthetic oligonucleotide
  Target: SCN9A; (-) strand; PAM type: YTN; PAM sequence: TTC
tgccaatcttcacatgtgtt

SEQ ID NO: 70709 - DNA, 20 bp, Artificial Sequence
  Description of Artificial Sequence: Synthetic oligonucleotide
  Target: SCN9A; (-) strand; PAM type: YTN; PAM sequence: CTT
ctgccaatcttcacatgtgt

SEQ ID NO: 70710 - DNA, 20 bp, Artificial Sequence
  Description of Artificial Sequence: Synthetic oligonucleotide
  Target: SCN9A; (-) strand; PAM type: YTN; PAM sequence: CTC
ccttctgccaatcttcacat

SEQ ID NO: 70711 - DNA, 20 bp, Artificial Sequence
  Description of Artificial Sequence: Synthetic oligonucleotide
  Target: SCN9A; (-) strand; PAM type: YTN; PAM sequence: TTC
tcccttctgccaatcttcac

SEQ ID NO: 70712 - DNA, 20 bp, Artificial Sequence
  Description of Artificial Sequence: Synthetic oligonucleotide
  Target: SCN9A; (-) strand; PAM type: YTN; PAM sequence: CTT
ctcccttctgccaatcttca

SEQ ID NO: 70713 - DNA, 20 bp, Artificial Sequence
  Description of Artificial Sequence: Synthetic oligonucleotide
  Target: SCN9A; (-) strand; PAM type: YTN; PAM sequence: CTC
ttctcccttctgccaatctt

SEQ ID NO: 70714 - DNA, 20 bp, Artificial Sequence
  Description of Artificial Sequence: Synthetic oligonucleotide
  Target: SCN9A; (-) strand; PAM type: YTN; PAM sequence: CTC
catctcttctcccttctgcc

SEQ ID NO: 70715 - DNA, 20 bp, Artificial Sequence
  Description of Artificial Sequence: Synthetic oligonucleotide
  Target: SCN9A; (-) strand; PAM type: YTN; PAM sequence: CTA
ggctccatctcttctccctt

SEQ ID NO: 70716 - DNA, 20 bp, Artificial Sequence
  Description of Artificial Sequence: Synthetic oligonucleotide
  Target: SCN9A; (-) strand; PAM type: YTN; PAM sequence: CTC
catgtcctaggctccatctc

SEQ ID NO: 70717 - DNA, 20 bp, Artificial Sequence
  Description of Artificial Sequence: Synthetic oligonucleotide
  Target: SCN9A; (-) strand; PAM type: YTN; PAM sequence: TTA
aaacatccacagatcagcag

SEQ ID NO: 70718 - DNA, 20 bp, Artificial Sequence
  Description of Artificial Sequence: Synthetic oligonucleotide
  Target: SCN9A; (-) strand; PAM type: YTN; PAM sequence: TTT
aaaacatccacagatcagca

SEQ ID NO: 70719 - DNA, 20 bp, Artificial Sequence
  Description of Artificial Sequence: Synthetic oligonucleotide
  Target: SCN9A; (-) strand; PAM type: YTN; PAM sequence: TTT
taaaacatccacagatcagc

SEQ ID NO: 70720 - DNA, 20 bp, Artificial Sequence
  Description of Artificial Sequence: Synthetic oligonucleotide
  Target: SCN9A; (-) strand; PAM type: YTN; PAM sequence: TTC
atattttaaaacatccacag

SEQ ID NO: 70721 - DNA, 20 bp, Artificial Sequence
  Description of Artificial Sequence: Synthetic oligonucleotide
  Target: SCN9A; (-) strand; PAM type: YTN; PAM sequence: TTT
catattttaaaacatccaca

SEQ ID NO: 70722 - DNA, 20 bp, Artificial Sequence
  Description of Artificial Sequence: Synthetic oligonucleotide
  Target: SCN9A; (-) strand; PAM type: YTN; PAM sequence: TTT
tcatattttaaaacatccac

SEQ ID NO: 70723 - DNA, 20 bp, Artificial Sequence
  Description of Artificial Sequence: Synthetic oligonucleotide
  Target: SCN9A; (-) strand; PAM type: YTN; PAM sequence: CTG
ttttcatattttaaaacatc

SEQ ID NO: 70724 - DNA, 20 bp, Artificial Sequence
  Description of Artificial Sequence: Synthetic oligonucleotide
  Target: SCN9A; (-) strand; PAM type: YTN; PAM sequence: TTC
tgttttcatattttaaaaca

SEQ ID NO: 70725 - DNA, 20 bp, Artificial Sequence
  Description of Artificial Sequence: Synthetic oligonucleotide
  Target: SCN9A; (-) strand; PAM type: YTN; PAM sequence: CTG
gatagaacattctgttttca

SEQ ID NO: 70726 - DNA, 20 bp, Artificial Sequence
  Description of Artificial Sequence: Synthetic oligonucleotide
  Target: SCN9A; (-) strand; PAM type: YTN; PAM sequence: TTG
gcataactggatagaacatt

SEQ ID NO: 70727 - DNA, 20 bp, Artificial Sequence
  Description of Artificial Sequence: Synthetic oligonucleotide
  Target: SCN9A; (-) strand; PAM type: YTN; PAM sequence: CTA
cattggcataactggataga

SEQ ID NO: 70728 - DNA, 20 bp, Artificial Sequence
  Description of Artificial Sequence: Synthetic oligonucleotide
  Target: SCN9A; (-) strand; PAM type: YTN; PAM sequence: TTA
actacattggcataactgga

SEQ ID NO: 70729 - DNA, 20 bp, Artificial Sequence
  Description of Artificial Sequence: Synthetic oligonucleotide
  Target: SCN9A; (-) strand; PAM type: YTN; PAM sequence: CTT
aactacattggcataactgg

SEQ ID NO: 70730 - DNA, 20 bp, Artificial Sequence
  Description of Artificial Sequence: Synthetic oligonucleotide
  Target: SCN9A; (-) strand; PAM type: YTN; PAM sequence: CTG
catgcaacagagacttaact

SEQ ID NO: 70731 - DNA, 20 bp, Artificial Sequence
  Description of Artificial Sequence: Synthetic oligonucleotide
  Target: SCN9A; (-) strand; PAM type: YTN; PAM sequence: TTA
actgcatgcaacagagactt

SEQ ID NO: 70732 - DNA, 20 bp, Artificial Sequence
  Description of Artificial Sequence: Synthetic oligonucleotide
  Target: SCN9A; (-) strand; PAM type: YTN; PAM sequence: TTT
aactgcatgcaacagagact

SEQ ID NO: 70733 - DNA, 20 bp, Artificial Sequence
  Description of Artificial Sequence: Synthetic oligonucleotide
  Target: SCN9A; (-) strand; PAM type: YTN; PAM sequence: CTG
tttaactgcatgcaacagag

SEQ ID NO: 70734 - DNA, 20 bp, Artificial Sequence
  Description of Artificial Sequence: Synthetic oligonucleotide
  Target: SCN9A; (-) strand; PAM type: YTN; PAM sequence: CTC
tgtttaactgcatgcaacag

SEQ ID NO: 70735 - DNA, 20 bp, Artificial Sequence
  Description of Artificial Sequence: Synthetic oligonucleotide
  Target: SCN9A; (-) strand; PAM type: YTN; PAM sequence: CTG
agtcaggactctgtttaact

SEQ ID NO: 70736 - DNA, 20 bp, Artificial Sequence
  Description of Artificial Sequence: Synthetic oligonucleotide
  Target: SCN9A; (-) strand; PAM type: YTN; PAM sequence: TTC
tgagtcaggactctgtttaa

SEQ ID NO: 70737 - DNA, 20 bp, Artificial Sequence
  Description of Artificial Sequence: Synthetic oligonucleotide
  Target: SCN9A; (-) strand; PAM type: YTN; PAM sequence: TTT
ctgagtcaggactctgttta

SEQ ID NO: 70738 - DNA, 20 bp, Artificial Sequence
  Description of Artificial Sequence: Synthetic oligonucleotide
  Target: SCN9A; (-) strand; PAM type: YTN; PAM sequence: CTA
tttctgagtcaggactctgt

SEQ ID NO: 70739 - DNA, 20 bp, Artificial Sequence
  Description of Artificial Sequence: Synthetic oligonucleotide
  Target: SCN9A; (-) strand; PAM type: YTN; PAM sequence: TTG
gctatttctgagtcaggact

SEQ ID NO: 70740 - DNA, 20 bp, Artificial Sequence
  Description of Artificial Sequence: Synthetic oligonucleotide
  Target: SCN9A; (-) strand; PAM type: YTN; PAM sequence: TTT
ggctatttctgagtcaggac

SEQ ID NO: 70741 - DNA, 20 bp, Artificial Sequence
  Description of Artificial Sequence: Synthetic oligonucleotide
  Target: SCN9A; (-) strand; PAM type: YTN; PAM sequence: TTT
tggctatttctgagtcagga

SEQ ID NO: 70742 - DNA, 20 bp, Artificial Sequence
  Description of Artificial Sequence: Synthetic oligonucleotide
  Target: SCN9A; (-) strand; PAM type: YTN; PAM sequence: TTT
ttggctatttctgagtcagg

SEQ ID NO: 70743 - DNA, 20 bp, Artificial Sequence
  Description of Artificial Sequence: Synthetic oligonucleotide
  Target: SCN9A; (-) strand; PAM type: YTN; PAM sequence: TTA
tttttggctatttctgagtc

SEQ ID NO: 70744 - DNA, 20 bp, Artificial Sequence
  Description of Artificial Sequence: Synthetic oligonucleotide
  Target: SCN9A; (-) strand; PAM type: YTN; PAM sequence: TTG
ttatttttggctatttctga

SEQ ID NO: 70745 - DNA, 20 bp, Artificial Sequence
  Description of Artificial Sequence: Synthetic oligonucleotide
  Target: SCN9A; (-) strand; PAM type: YTN; PAM sequence: TTT
gttatttttggctatttctg

SEQ ID NO: 70746 - DNA, 20 bp, Artificial Sequence
  Description of Artificial Sequence: Synthetic oligonucleotide
  Target: SCN9A; (-) strand; PAM type: YTN; PAM sequence: TTT
tgttatttttggctatttct

SEQ ID NO: 70747 - DNA, 20 bp, Artificial Sequence
  Description of Artificial Sequence: Synthetic oligonucleotide
  Target: SCN9A; (-) strand; PAM type: YTN; PAM sequence: TTG
tgtgtgtgttttgttatttt

SEQ ID NO: 70748 - DNA, 20 bp, Artificial Sequence
  Description of Artificial Sequence: Synthetic oligonucleotide
  Target: SCN9A; (-) strand; PAM type: YTN; PAM sequence: TTT
gtgtgtgtgttttgttattt

SEQ ID NO: 70749 - DNA, 20 bp, Artificial Sequence
  Description of Artificial Sequence: Synthetic oligonucleotide
  Target: SCN9A; (-) strand; PAM type: YTN; PAM sequence: TTT
tgtgtgtgtgttttgttatt

SEQ ID NO: 70750 - DNA, 20 bp, Artificial Sequence
  Description of Artificial Sequence: Synthetic oligonucleotide
  Target: SCN9A; (-) strand; PAM type: YTN; PAM sequence: TTT
ttgtgtgtgtgttttgttat

SEQ ID NO: 70751 - DNA, 20 bp, Artificial Sequence
  Description of Artificial Sequence: Synthetic oligonucleotide
  Target: SCN9A; (-) strand; PAM type: YTN; PAM sequence: TTT
tttgtgtgtgtgttttgtta

SEQ ID NO: 70752 - DNA, 20 bp, Artificial Sequence
  Description of Artificial Sequence: Synthetic oligonucleotide
  Target: SCN9A; (-) strand; PAM type: YTN; PAM sequence: TTT
ttttgtgtgtgtgttttgtt

SEQ ID NO: 70753 - DNA, 20 bp, Artificial Sequence
  Description of Artificial Sequence: Synthetic oligonucleotide
  Target: SCN9A; (-) strand; PAM type: YTN; PAM sequence: CTA
tttttttgtgtgtgtgtttt

SEQ ID NO: 70754 - DNA, 20 bp, Artificial Sequence
  Description of Artificial Sequence: Synthetic oligonucleotide
  Target: SCN9A; (-) strand; PAM type: YTN; PAM sequence: TTA
agggtacatgggtaatccct

SEQ ID NO: 70755 - DNA, 20 bp, Artificial Sequence
  Description of Artificial Sequence: Synthetic oligonucleotide
  Target: SCN9A; (-) strand; PAM type: YTN; PAM sequence: CTT
aagggtacatgggtaatccc

SEQ ID NO: 70756 - DNA, 20 bp, Artificial Sequence
  Description of Artificial Sequence: Synthetic oligonucleotide
  Target: SCN9A; (-) strand; PAM type: YTN; PAM sequence: TTA
cttaagggtacatgggtaat

SEQ ID NO: 70757 - DNA, 20 bp, Artificial Sequence
  Description of Artificial Sequence: Synthetic oligonucleotide
  Target: SCN9A; (-) strand; PAM type: YTN; PAM sequence: TTT
acttaagggtacatgggtaa

SEQ ID NO: 70758 - DNA, 20 bp, Artificial Sequence
  Description of Artificial Sequence: Synthetic oligonucleotide
  Target: SCN9A; (-) strand; PAM type: YTN; PAM sequence: TTT
tacttaagggtacatgggta

SEQ ID NO: 70759 - DNA, 20 bp, Artificial Sequence
  Description of Artificial Sequence: Synthetic oligonucleotide
  Target: SCN9A; (-) strand; PAM type: YTN; PAM sequence: CTA
ttttacttaagggtacatgg

SEQ ID NO: 70760 - DNA, 20 bp, Artificial Sequence
  Description of Artificial Sequence: Synthetic oligonucleotide
  Target: SCN9A; (-) strand; PAM type: YTN; PAM sequence: TTG
aataaacctattttacttaa

SEQ ID NO: 70761 - DNA, 20 bp, Artificial Sequence
  Description of Artificial Sequence: Synthetic oligonucleotide
  Target: SCN9A; (-) strand; PAM type: YTN; PAM sequence: TTT
gaataaacctattttactta

SEQ ID NO: 70762 - DNA, 20 bp, Artificial Sequence
  Description of Artificial Sequence: Synthetic oligonucleotide
  Target: SCN9A; (-) strand; PAM type: YTN; PAM sequence: CTA
tttgaataaacctattttac

SEQ ID NO: 70763 - DNA, 20 bp, Artificial Sequence
  Description of Artificial Sequence: Synthetic oligonucleotide
  Target: SCN9A; (-) strand; PAM type: YTN; PAM sequence: TTA
actatttgaataaacctatt

SEQ ID NO: 70764 - DNA, 20 bp, Artificial Sequence
  Description of Artificial Sequence: Synthetic oligonucleotide
  Target: SCN9A; (-) strand; PAM type: YTN; PAM sequence: CTT
aactatttgaataaacctat

SEQ ID NO: 70765 - DNA, 20 bp, Artificial Sequence
  Description of Artificial Sequence: Synthetic oligonucleotide
  Target: SCN9A; (-) strand; PAM type: YTN; PAM sequence: TTA
agatcttaactatttgaata

SEQ ID NO: 70766 - DNA, 20 bp, Artificial Sequence
  Description of Artificial Sequence: Synthetic oligonucleotide
  Target: SCN9A; (-) strand; PAM type: YTN; PAM sequence: CTG
ccacaccaaggtacacatgt

SEQ ID NO: 70767 - DNA, 20 bp, Artificial Sequence
  Description of Artificial Sequence: Synthetic oligonucleotide
  Target: SCN9A; (-) strand; PAM type: YTN; PAM sequence: TTA
ctgccacaccaaggtacaca

SEQ ID NO: 70768 - DNA, 20 bp, Artificial Sequence
  Description of Artificial Sequence: Synthetic oligonucleotide
  Target: SCN9A; (-) strand; PAM type: YTN; PAM sequence: CTT
actgccacaccaaggtacac

SEQ ID NO: 70769 - DNA, 20 bp, Artificial Sequence
  Description of Artificial Sequence: Synthetic oligonucleotide
  Target: SCN9A; (-) strand; PAM type: YTN; PAM sequence: CTA
gggagtacacttactgccac

SEQ ID NO: 70770 - DNA, 20 bp, Artificial Sequence
  Description of Artificial Sequence: Synthetic oligonucleotide
  Target: SCN9A; (-) strand; PAM type: YTN; PAM sequence: TTA
ggggctagggagtacactta

SEQ ID NO: 70771 - DNA, 20 bp, Artificial Sequence
  Description of Artificial Sequence: Synthetic oligonucleotide
  Target: SCN9A; (-) strand; PAM type: YTN; PAM sequence: CTA
tattaggggctagggagtac

SEQ ID NO: 70772 - DNA, 20 bp, Artificial Sequence
  Description of Artificial Sequence: Synthetic oligonucleotide
  Target: SCN9A; (-) strand; PAM type: YTN; PAM sequence: TTA
aggctatattaggggctagg

SEQ ID NO: 70773 - DNA, 20 bp, Artificial Sequence
  Description of Artificial Sequence: Synthetic oligonucleotide
  Target: SCN9A; (-) strand; PAM type: YTN; PAM sequence: TTC
acattaaggctatattaggg

SEQ ID NO: 70774 - DNA, 20 bp, Artificial Sequence
  Description of Artificial Sequence: Synthetic oligonucleotide
  Target: SCN9A; (-) strand; PAM type: YTN; PAM sequence: TTT
cacattaaggctatattagg

SEQ ID NO: 70775 - DNA, 20 bp, Artificial Sequence
  Description of Artificial Sequence: Synthetic oligonucleotide
  Target: SCN9A; (-) strand; PAM type: YTN; PAM sequence: CTT
tcacattaaggctatattag

SEQ ID NO: 70776 - DNA, 20 bp, Artificial Sequence
  Description of Artificial Sequence: Synthetic oligonucleotide
  Target: SCN9A; (-) strand; PAM type: YTN; PAM sequence: TTA
tctttcacattaaggctata

SEQ ID NO: 70777 - DNA, 20 bp, Artificial Sequence
  Description of Artificial Sequence: Synthetic oligonucleotide
  Target: SCN9A; (-) strand; PAM type: YTN; PAM sequence: TTA
tattatctttcacattaagg

SEQ ID NO: 70778 - DNA, 20 bp, Artificial Sequence
  Description of Artificial Sequence: Synthetic oligonucleotide
  Target: SCN9A; (-) strand; PAM type: YTN; PAM sequence: TTA
ttatattatctttcacatta

SEQ ID NO: 70779 - DNA, 20 bp, Artificial Sequence
  Description of Artificial Sequence: Synthetic oligonucleotide
  Target: SCN9A; (-) strand; PAM type: YTN; PAM sequence: TTA
ttattatattatctttcaca

SEQ ID NO: 70780 - DNA, 20 bp, Artificial Sequence
  Description of Artificial Sequence: Synthetic oligonucleotide
  Target: SCN9A; (-) strand; PAM type: YTN; PAM sequence: TTT
attattatattatctttcac

SEQ ID NO: 70781 - DNA, 20 bp, Artificial Sequence
  Description of Artificial Sequence: Synthetic oligonucleotide
  Target: SCN9A; (-) strand; PAM type: YTN; PAM sequence: TTG
atttattattatattatctt

SEQ ID NO: 70782 - DNA, 20 bp, Artificial Sequence
  Description of Artificial Sequence: Synthetic oligonucleotide
  Target: SCN9A; (-) strand; PAM type: YTN; PAM sequence: TTA
agtagaattgatttattatt

SEQ ID NO: 70783 - DNA, 20 bp, Artificial Sequence
  Description of Artificial Sequence: Synthetic oligonucleotide
  Target: SCN9A; (-) strand; PAM type: YTN; PAM sequence: CTC
aggacaatgtattaagtaga

SEQ ID NO: 70784 - DNA, 20 bp, Artificial Sequence
  Description of Artificial Sequence: Synthetic oligonucleotide
  Target: SCN9A; (-) strand; PAM type: YTN; PAM sequence: CTC
tcaggacaatgtattaagta

SEQ ID NO: 70785 - DNA, 20 bp, Artificial Sequence
  Description of Artificial Sequence: Synthetic oligonucleotide
  Target: SCN9A; (-) strand; PAM type: YTN; PAM sequence: TTC
tctcaggacaatgtattaag

SEQ ID NO: 70786 - DNA, 20 bp, Artificial Sequence
  Description of Artificial Sequence: Synthetic oligonucleotide
  Target: SCN9A; (-) strand; PAM type: YTN; PAM sequence: TTG
tgttctctcaggacaatgta

SEQ ID NO: 70787 - DNA, 20 bp, Artificial Sequence
  Description of Artificial Sequence: Synthetic oligonucleotide
  Target: SCN9A; (-) strand; PAM type: YTN; PAM sequence: TTT
gtgttctctcaggacaatgt

SEQ ID NO: 70788 - DNA, 20 bp, Artificial Sequence
  Description of Artificial Sequence: Synthetic oligonucleotide
  Target: SCN9A; (-) strand; PAM type: YTN; PAM sequence: CTT
tgtgttctctcaggacaatg

SEQ ID NO: 70789 - DNA, 20 bp, Artificial Sequence
  Description of Artificial Sequence: Synthetic oligonucleotide
  Target: SCN9A; (-) strand; PAM type: YTN; PAM sequence: TTG
aacctttgtgttctctcagg

SEQ ID NO: 70790 - DNA, 20 bp, Artificial Sequence
  Description of Artificial Sequence: Synthetic oligonucleotide
  Target: SCN9A; (-) strand; PAM type: YTN; PAM sequence: TTT
gaacctttgtgttctctcag

SEQ ID NO: 70791 - DNA, 20 bp, Artificial Sequence
  Description of Artificial Sequence: Synthetic oligonucleotide
  Target: SCN9A; (-) strand; PAM type: YTN; PAM sequence: CTT
tgaacctttgtgttctctca

SEQ ID NO: 70792 - DNA, 20 bp, Artificial Sequence
  Description of Artificial Sequence: Synthetic oligonucleotide
  Target: SCN9A; (-) strand; PAM type: YTN; PAM sequence: CTC
tttgaacctttgtgttctct

SEQ ID NO: 70793 - DNA, 20 bp, Artificial Sequence
  Description of Artificial Sequence: Synthetic oligonucleotide
  Target: SCN9A; (-) strand; PAM type: YTN; PAM sequence: CTC
tctttgaacctttgtgttct

SEQ ID NO: 70794 - DNA, 20 bp, Artificial Sequence
  Description of Artificial Sequence: Synthetic oligonucleotide
  Target: SCN9A; (-) strand; PAM type: YTN; PAM sequence: TTG
ctctctttgaacctttgtgt

SEQ ID NO: 70795 - DNA, 20 bp, Artificial Sequence
  Description of Artificial Sequence: Synthetic oligonucleotide
  Target: SCN9A; (-) strand; PAM type: YTN; PAM sequence: TTT
gctctctttgaacctttgtg

SEQ ID NO: 70796 - DNA, 20 bp, Artificial Sequence
  Description of Artificial Sequence: Synthetic oligonucleotide
  Target: SCN9A; (-) strand; PAM type: YTN; PAM sequence: CTT
tgctctctttgaacctttgt

SEQ ID NO: 70797 - DNA, 20 bp, Artificial Sequence
  Description of Artificial Sequence: Synthetic oligonucleotide
  Target: SCN9A; (-) strand; PAM type: YTN; PAM sequence: CTA
cacatcactttgctctcttt

SEQ ID NO: 70798 - DNA, 20 bp, Artificial Sequence
  Description of Artificial Sequence: Synthetic oligonucleotide
  Target: SCN9A; (-) strand; PAM type: YTN; PAM sequence: TTC
tacacatcactttgctctct

SEQ ID NO: 70799 - DNA, 20 bp, Artificial Sequence
  Description of Artificial Sequence: Synthetic oligonucleotide
  Target: SCN9A; (-) strand; PAM type: YTN; PAM sequence: TTT
ctacacatcactttgctctc

SEQ ID NO: 70800 - DNA, 20 bp, Artificial Sequence
  Description of Artificial Sequence: Synthetic oligonucleotide
  Target: SCN9A; (-) strand; PAM type: YTN; PAM sequence: TTT
tctacacatcactttgctct

SEQ ID NO: 70801 - DNA, 20 bp, Artificial Sequence
  Description of Artificial Sequence: Synthetic oligonucleotide
  Target: SCN9A; (-) strand; PAM type: YTN; PAM sequence: TTT
ttctacacatcactttgctc

SEQ ID NO: 70802 - DNA, 20 bp, Artificial Sequence
  Description of Artificial Sequence: Synthetic oligonucleotide
  Target: SCN9A; (-) strand; PAM type: YTN; PAM sequence: TTT
tttctacacatcactttgct

SEQ ID NO: 70803 - DNA, 20 bp, Artificial Sequence
  Description of Artificial Sequence: Synthetic oligonucleotide
  Target: SCN9A; (-) strand; PAM type: YTN; PAM sequence: TTG
gcataattttttctacacat

SEQ ID NO: 70804 - DNA, 20 bp, Artificial Sequence
  Description of Artificial Sequence: Synthetic oligonucleotide
  Target: SCN9A; (-) strand; PAM type: YTN; PAM sequence: TTT
ggcataattttttctacaca

SEQ ID NO: 70805 - DNA, 20 bp, Artificial Sequence
  Description of Artificial Sequence: Synthetic oligonucleotide
  Target: SCN9A; (-) strand; PAM type: YTN; PAM sequence: TTA
aatcaatttggcataatttt

SEQ ID NO: 70806 - DNA, 20 bp, Artificial Sequence
  Description of Artificial Sequence: Synthetic oligonucleotide
  Target: SCN9A; (-) strand; PAM type: YTN; PAM sequence: TTA
cagaaaagtattaaatcaat

SEQ ID NO: 70807 - DNA, 20 bp, Artificial Sequence
  Description of Artificial Sequence: Synthetic oligonucleotide
  Target: SCN9A; (-) strand; PAM type: YTN; PAM sequence: TTA
ttacagaaaagtattaaatc

SEQ ID NO: 70808 - DNA, 20 bp, Artificial Sequence
  Description of Artificial Sequence: Synthetic oligonucleotide
  Target: SCN9A; (-) strand; PAM type: YTN; PAM sequence: TTA
tgttattacagaaaagtatt

SEQ ID NO: 70809 - DNA, 20 bp, Artificial Sequence
  Description of Artificial Sequence: Synthetic oligonucleotide
  Target: SCN9A; (-) strand; PAM type: YTN; PAM sequence: TTA
ttatgttattacagaaaagt

SEQ ID NO: 70810 - DNA, 20 bp, Artificial Sequence
  Description of Artificial Sequence: Synthetic oligonucleotide
  Target: SCN9A; (-) strand; PAM type: YTN; PAM sequence: CTT
attatgttattacagaaaag

SEQ ID NO: 70811 - DNA, 20 bp, Artificial Sequence
  Description of Artificial Sequence: Synthetic oligonucleotide
  Target: SCN9A; (-) strand; PAM type: YTN; PAM sequence: TTG
tcatgacttattatgttatt

SEQ ID NO: 70812 - DNA, 20 bp, Artificial Sequence
  Description of Artificial Sequence: Synthetic oligonucleotide
  Target: SCN9A; (-) strand; PAM type: YTN; PAM sequence: TTT
gtcatgacttattatgttat

SEQ ID NO: 70813 - DNA, 20 bp, Artificial Sequence
  Description of Artificial Sequence: Synthetic oligonucleotide
  Target: SCN9A; (-) strand; PAM type: YTN; PAM sequence: CTT
tgtcatgacttattatgtta

SEQ ID NO: 70814 - DNA, 20 bp, Artificial Sequence
  Description of Artificial Sequence: Synthetic oligonucleotide
  Target: SCN9A; (-) strand; PAM type: YTN; PAM sequence: CTC
ctttgtcatgacttattatg

SEQ ID NO: 70815 - DNA, 20 bp, Artificial Sequence
  Description of Artificial Sequence: Synthetic oligonucleotide
  Target: SCN9A; (-) strand; PAM type: YTN; PAM sequence: TTA
aagcatctcctttgtcatga

SEQ ID NO: 70816 - DNA, 20 bp, Artificial Sequence
  Description of Artificial Sequence: Synthetic oligonucleotide
  Target: SCN9A; (-) strand; PAM type: YTN; PAM sequence: TTT
aaagcatctcctttgtcatg

SEQ ID NO: 70817 - DNA, 20 bp, Artificial Sequence
  Description of Artificial Sequence: Synthetic oligonucleotide
  Target: SCN9A; (-) strand; PAM type: YTN; PAM sequence: CTT
taaagcatctcctttgtcat

SEQ ID NO: 70818 - DNA, 20 bp, Artificial Sequence
  Description of Artificial Sequence: Synthetic oligonucleotide
  Target: SCN9A; (-) strand; PAM type: YTN; PAM sequence: TTG
cctttaaagcatctcctttg

SEQ ID NO: 70819 - DNA, 20 bp, Artificial Sequence
  Description of Artificial Sequence: Synthetic oligonucleotide
  Target: SCN9A; (-) strand; PAM type: YTN; PAM sequence: CTA
aagtccagatcattgccttt

SEQ ID NO: 70820 - DNA, 20 bp, Artificial Sequence
  Description of Artificial Sequence: Synthetic oligonucleotide
  Target: SCN9A; (-) strand; PAM type: YTN; PAM sequence: CTC
agaaatatcactaaagtcca

SEQ ID NO: 70821 - DNA, 20 bp, Artificial Sequence
  Description of Artificial Sequence: Synthetic oligonucleotide
  Target: SCN9A; (-) strand; PAM type: YTN; PAM sequence: TTG
gcaagtgactcagaaatatc

SEQ ID NO: 70822 - DNA, 20 bp, Artificial Sequence
  Description of Artificial Sequence: Synthetic oligonucleotide
  Target: SCN9A; (-) strand; PAM type: YTN; PAM sequence: TTG
atgaaattggcaagtgactc

SEQ ID NO: 70823 - DNA, 20 bp, Artificial Sequence
  Description of Artificial Sequence: Synthetic oligonucleotide
  Target: SCN9A; (-) strand; PAM type: YTN; PAM sequence: TTG
ttgatgaaattggcaagtga

SEQ ID NO: 70824 - DNA, 20 bp, Artificial Sequence
  Description of Artificial Sequence: Synthetic oligonucleotide
  Target: SCN9A; (-) strand; PAM type: YTN; PAM sequence: CTT
gttgatgaaattggcaagtg

SEQ ID NO: 70825 - DNA, 20 bp, Artificial Sequence
  Description of Artificial Sequence: Synthetic oligonucleotide
  Target: SCN9A; (-) strand; PAM type: YTN; PAM sequence: CTG
gcttgttgatgaaattggca

SEQ ID NO: 70826 - DNA, 20 bp, Artificial Sequence
  Description of Artificial Sequence: Synthetic oligonucleotide
  Target: SCN9A; (-) strand; PAM type: YTN; PAM sequence: CTC
cctggcttgttgatgaaatt

SEQ ID NO: 70827 - DNA, 20 bp, Artificial Sequence
  Description of Artificial Sequence: Synthetic oligonucleotide
  Target: SCN9A; (-) strand; PAM type: YTN; PAM sequence: CTC
tccctggcttgttgatgaaa

SEQ ID NO: 70828 - DNA, 20 bp, Artificial Sequence
  Description of Artificial Sequence: Synthetic oligonucleotide
  Target: SCN9A; (-) strand; PAM type: YTN; PAM sequence: TTA
tccagctctccctggcttgt

SEQ ID NO: 70829 - DNA, 20 bp, Artificial Sequence
  Description of Artificial Sequence: Synthetic oligonucleotide
  Target: SCN9A; (-) strand; PAM type: YTN; PAM sequence: CTT
atccagctctccctggcttg

SEQ ID NO: 70830 - DNA, 20 bp, Artificial Sequence
  Description of Artificial Sequence: Synthetic oligonucleotide
  Target: SCN9A; (-) strand; PAM type: YTN; PAM sequence: CTA
agacttatccagctctccct

SEQ ID NO: 70831 - DNA, 20 bp, Artificial Sequence
  Description of Artificial Sequence: Synthetic oligonucleotide
  Target: SCN9A; (-) strand; PAM type: YTN; PAM sequence: CTA
ctaagacttatccagctctc

SEQ ID NO: 70832 - DNA, 20 bp, Artificial Sequence
  Description of Artificial Sequence: Synthetic oligonucleotide
  Target: SCN9A; (-) strand; PAM type: YTN; PAM sequence: TTA
gtgctactaagacttatcca

SEQ ID NO: 70833 - DNA, 20 bp, Artificial Sequence
  Description of Artificial Sequence: Synthetic oligonucleotide
  Target: SCN9A; (-) strand; PAM type: YTN; PAM sequence: CTT
agtgctactaagacttatcc

SEQ ID NO: 70834 - DNA, 20 bp, Artificial Sequence
  Description of Artificial Sequence: Synthetic oligonucleotide
  Target: SCN9A; (-) strand; PAM type: YTN; PAM sequence: TTC
ttagtgctactaagacttat

SEQ ID NO: 70835 - DNA, 20 bp, Artificial Sequence
  Description of Artificial Sequence: Synthetic oligonucleotide
  Target: SCN9A; (-) strand; PAM type: YTN; PAM sequence: CTA
tgaggttcttagtgctacta

SEQ ID NO: 70836 - DNA, 20 bp, Artificial Sequence
  Description of Artificial Sequence: Synthetic oligonucleotide
  Target: SCN9A; (-) strand; PAM type: YTN; PAM sequence: CTG
aggtaactatgaggttctta

SEQ ID NO: 70837 - DNA, 20 bp, Artificial Sequence
  Description of Artificial Sequence: Synthetic oligonucleotide
  Target: SCN9A; (-) strand; PAM type: YTN; PAM sequence: TTG
ctgaggtaactatgaggttc

SEQ ID NO: 70838 - DNA, 20 bp, Artificial Sequence
  Description of Artificial Sequence: Synthetic oligonucleotide
  Target: SCN9A; (-) strand; PAM type: YTN; PAM sequence: CTT
gctgaggtaactatgaggtt

SEQ ID NO: 70839 - DNA, 20 bp, Artificial Sequence
  Description of Artificial Sequence: Synthetic oligonucleotide
  Target: SCN9A; (-) strand; PAM type: YTN; PAM sequence: CTA
ggtgaaaaccttgctgaggt

SEQ ID NO: 70840 - DNA, 20 bp, Artificial Sequence
  Description of Artificial Sequence: Synthetic oligonucleotide
  Target: SCN9A; (-) strand; PAM type: YTN; PAM sequence: CTC
taggtgaaaaccttgctgag

SEQ ID NO: 70841 - DNA, 20 bp, Artificial Sequence
  Description of Artificial Sequence: Synthetic oligonucleotide
  Target: SCN9A; (-) strand; PAM type: YTN; PAM sequence: TTC
tctaggtgaaaaccttgctg

SEQ ID NO: 70842 - DNA, 20 bp, Artificial Sequence
  Description of Artificial Sequence: Synthetic oligonucleotide
  Target: SCN9A; (-) strand; PAM type: YTN; PAM sequence: CTT
ctctaggtgaaaaccttgct

SEQ ID NO: 70843 - DNA, 20 bp, Artificial Sequence
  Description of Artificial Sequence: Synthetic oligonucleotide
  Target: SCN9A; (-) strand; PAM type: YTN; PAM sequence: TTC
ttctctaggtgaaaaccttg

SEQ ID NO: 70844 - DNA, 20 bp, Artificial Sequence
  Description of Artificial Sequence: Synthetic oligonucleotide
  Target: SCN9A; (-) strand; PAM type: YTN; PAM sequence: TTC
attcttctctaggtgaaaac

SEQ ID NO: 70845 - DNA, 20 bp, Artificial Sequence
  Description of Artificial Sequence: Synthetic oligonucleotide
  Target: SCN9A; (-) strand; PAM type: YTN; PAM sequence: CTG
atacattcattcttctctag

SEQ ID NO: 70846 - DNA, 20 bp, Artificial Sequence
  Description of Artificial Sequence: Synthetic oligonucleotide
  Target: SCN9A; (-) strand; PAM type: YTN; PAM sequence: CTG
cctgatacattcattcttct

SEQ ID NO: 70847 - DNA, 20 bp, Artificial Sequence
  Description of Artificial Sequence: Synthetic oligonucleotide
  Target: SCN9A; (-) strand; PAM type: YTN; PAM sequence: TTC
tgcctgatacattcattctt

SEQ ID NO: 70848 - DNA, 20 bp, Artificial Sequence
  Description of Artificial Sequence: Synthetic oligonucleotide
  Target: SCN9A; (-) strand; PAM type: YTN; PAM sequence: CTT
ctgcctgatacattcattct

SEQ ID NO: 70849 - DNA, 20 bp, Artificial Sequence
  Description of Artificial Sequence: Synthetic oligonucleotide
  Target: SCN9A; (-) strand; PAM type: YTN; PAM sequence: TTG
tagcttctgcctgatacatt

SEQ ID NO: 70850 - DNA, 20 bp, Artificial Sequence
  Description of Artificial Sequence: Synthetic oligonucleotide
  Target: SCN9A; (-) strand; PAM type: YTN; PAM sequence: CTT
gtagcttctgcctgatacat

SEQ ID NO: 70851 - DNA, 20 bp, Artificial Sequence
  Description of Artificial Sequence: Synthetic oligonucleotide
  Target: SCN9A; (-) strand; PAM type: YTN; PAM sequence: TTC
ttgtagcttctgcctgatac

SEQ ID NO: 70852 - DNA, 20 bp, Artificial Sequence
  Description of Artificial Sequence: Synthetic oligonucleotide
  Target: SCN9A; (-) strand; PAM type: YTN; PAM sequence: TTC
aagttcttgtagcttctgcc

SEQ ID NO: 70853 - DNA, 20 bp, Artificial Sequence
  Description of Artificial Sequence: Synthetic oligonucleotide
  Target: SCN9A; (-) strand; PAM type: YTN; PAM sequence: CTA
gaccaaattcaagttcttgt

SEQ ID NO: 70854 - DNA, 20 bp, Artificial Sequence
  Description of Artificial Sequence: Synthetic oligonucleotide
  Target: SCN9A; (-) strand; PAM type: YTN; PAM sequence: CTC
atctagaccaaattcaagtt

SEQ ID NO: 70855 - DNA, 20 bp, Artificial Sequence
  Description of Artificial Sequence: Synthetic oligonucleotide
  Target: SCN9A; (-) strand; PAM type: YTN; PAM sequence: TTG
ataaatatgacaaactcatc

SEQ ID NO: 70856 - DNA, 20 bp, Artificial Sequence
  Description of Artificial Sequence: Synthetic oligonucleotide
  Target: SCN9A; (-) strand; PAM type: YTN; PAM sequence: TTA
ttgataaatatgacaaactc

SEQ ID NO: 70857 - DNA, 20 bp, Artificial Sequence
  Description of Artificial Sequence: Synthetic oligonucleotide
  Target: SCN9A; (-) strand; PAM type: YTN; PAM sequence: TTC
atgcaaattattgataaata

SEQ ID NO: 70858 - DNA, 20 bp, Artificial Sequence
  Description of Artificial Sequence: Synthetic oligonucleotide
  Target: SCN9A; (-) strand; PAM type: YTN; PAM sequence: TTT
catgcaaattattgataaat

SEQ ID NO: 70859 - DNA, 20 bp, Artificial Sequence
  Description of Artificial Sequence: Synthetic oligonucleotide
  Target: SCN9A; (-) strand; PAM type: YTN; PAM sequence: TTT
tcatgcaaattattgataaa

SEQ ID NO: 70860 - DNA, 20 bp, Artificial Sequence
  Description of Artificial Sequence: Synthetic oligonucleotide
  Target: SCN9A; (-) strand; PAM type: YTN; PAM sequence: TTT
ttcatgcaaattattgataa

SEQ ID NO: 70861 - DNA, 20 bp, Artificial Sequence
  Description of Artificial Sequence: Synthetic oligonucleotide
  Target: SCN9A; (-) strand; PAM type: YTN; PAM sequence: TTT
tttcatgcaaattattgata

SEQ ID NO: 70862 - DNA, 20 bp, Artificial Sequence
  Description of Artificial Sequence: Synthetic oligonucleotide
  Target: SCN9A; (-) strand; PAM type: YTN; PAM sequence: CTA
ttttttcatgcaaattattg

SEQ ID NO: 70863 - DNA, 20 bp, Artificial Sequence
  Description of Artificial Sequence: Synthetic oligonucleotide
  Target: SCN9A; (-) strand; PAM type: YTN; PAM sequence: TTA
atgtgtctattttttcatgc

SEQ ID NO: 70864 - DNA, 20 bp, Artificial Sequence
  Description of Artificial Sequence: Synthetic oligonucleotide
  Target: SCN9A; (-) strand; PAM type: YTN; PAM sequence: TTG
catatattaatgtgtctatt

SEQ ID NO: 70865 - DNA, 20 bp, Artificial Sequence
  Description of Artificial Sequence: Synthetic oligonucleotide
  Target: SCN9A; (-) strand; PAM type: YTN; PAM sequence: TTT
gcatatattaatgtgtctat

SEQ ID NO: 70866 - DNA, 20 bp, Artificial Sequence
  Description of Artificial Sequence: Synthetic oligonucleotide
  Target: SCN9A; (-) strand; PAM type: YTN; PAM sequence: TTT
tgcatatattaatgtgtcta

SEQ ID NO: 70867 - DNA, 20 bp, Artificial Sequence
  Description of Artificial Sequence: Synthetic oligonucleotide
  Target: SCN9A; (-) strand; PAM type: YTN; PAM sequence: TTT
ttgcatatattaatgtgtct

SEQ ID NO: 70868 - DNA, 20 bp, Artificial Sequence
  Description of Artificial Sequence: Synthetic oligonucleotide
  Target: SCN9A; (-) strand; PAM type: YTN; PAM sequence: TTA
tttttgcatatattaatgtg

SEQ ID NO: 70869 - DNA, 20 bp, Artificial Sequence
  Description of Artificial Sequence: Synthetic oligonucleotide
  Target: SCN9A; (-) strand; PAM type: YTN; PAM sequence: TTT
atttttgcatatattaatgt

SEQ ID NO: 70870 - DNA, 20 bp, Artificial Sequence
  Description of Artificial Sequence: Synthetic oligonucleotide
  Target: SCN9A; (-) strand; PAM type: YTN; PAM sequence: CTG
tatatttatttttgcatata

SEQ ID NO: 70871 - DNA, 20 bp, Artificial Sequence
  Description of Artificial Sequence: Synthetic oligonucleotide
  Target: SCN9A; (-) strand; PAM type: YTN; PAM sequence: TTC
atgtgtatctgtatatttat

SEQ ID NO: 70872 - DNA, 20 bp, Artificial Sequence
  Description of Artificial Sequence: Synthetic oligonucleotide
  Target: SCN9A; (-) strand; PAM type: YTN; PAM sequence: TTT
catgtgtatctgtatattta

SEQ ID NO: 70873 - DNA, 20 bp, Artificial Sequence
  Description of Artificial Sequence: Synthetic oligonucleotide
  Target: SCN9A; (-) strand; PAM type: YTN; PAM sequence: TTA
tggtatttcatgtgtatctg

SEQ ID NO: 70874 - DNA, 20 bp, Artificial Sequence
  Description of Artificial Sequence: Synthetic oligonucleotide
  Target: SCN9A; (-) strand; PAM type: YTN; PAM sequence: TTA
tacattatggtatttcatgt

SEQ ID NO: 70875 - DNA, 20 bp, Artificial Sequence
  Description of Artificial Sequence: Synthetic oligonucleotide
  Target: SCN9A; (-) strand; PAM type: YTN; PAM sequence: TTT
atacattatggtatttcatg

SEQ ID NO: 70876 - DNA, 20 bp, Artificial Sequence
  Description of Artificial Sequence: Synthetic oligonucleotide
  Target: SCN9A; (-) strand; PAM type: YTN; PAM sequence: TTT
tatacattatggtatttcat

SEQ ID NO: 70877 - DNA, 20 bp, Artificial Sequence
  Description of Artificial Sequence: Synthetic oligonucleotide
  Target: SCN9A; (-) strand; PAM type: YTN; PAM sequence: TTA
aatgcatattttatacatta

SEQ ID NO: 70878 - DNA, 20 bp, Artificial Sequence
  Description of Artificial Sequence: Synthetic oligonucleotide
  Target: SCN9A; (-) strand; PAM type: YTN; PAM sequence: TTC
agtattaaatgcatatttta

SEQ ID NO: 70879 - DNA, 20 bp, Artificial Sequence
  Description of Artificial Sequence: Synthetic oligonucleotide
  Target: SCN9A; (-) strand; PAM type: YTN; PAM sequence: TTA
ttcagtattaaatgcatatt

SEQ ID NO: 70880 - DNA, 20 bp, Artificial Sequence
  Description of Artificial Sequence: Synthetic oligonucleotide
  Target: SCN9A; (-) strand; PAM type: YTN; PAM sequence: TTT
attcagtattaaatgcatat

SEQ ID NO: 70881 - DNA, 20 bp, Artificial Sequence
  Description of Artificial Sequence: Synthetic oligonucleotide
  Target: SCN9A; (-) strand; PAM type: YTN; PAM sequence: TTC
catttattcagtattaaatg

SEQ ID NO: 70882 - DNA, 20 bp, Artificial Sequence
  Description of Artificial Sequence: Synthetic oligonucleotide
  Target: SCN9A; (-) strand; PAM type: YTN; PAM sequence: TTT
ccatttattcagtattaaat

SEQ ID NO: 70883 - DNA, 20 bp, Artificial Sequence
  Description of Artificial Sequence: Synthetic oligonucleotide
  Target: SCN9A; (-) strand; PAM type: YTN; PAM sequence: CTT
tccatttattcagtattaaa

SEQ ID NO: 70884 - DNA, 20 bp, Artificial Sequence
  Description of Artificial Sequence: Synthetic oligonucleotide
  Target: SCN9A; (-) strand; PAM type: YTN; PAM sequence: TTC
ctttccatttattcagtatt

SEQ ID NO: 70885 - DNA, 20 bp, Artificial Sequence
  Description of Artificial Sequence: Synthetic oligonucleotide
  Target: SCN9A; (-) strand; PAM type: YTN; PAM sequence: TTT
cctttccatttattcagtat

SEQ ID NO: 70886 - DNA, 20 bp, Artificial Sequence
  Description of Artificial Sequence: Synthetic oligonucleotide
  Target: SCN9A; (-) strand; PAM type: YTN; PAM sequence: CTT
tcctttccatttattcagta

SEQ ID NO: 70887 - DNA, 20 bp, Artificial Sequence
  Description of Artificial Sequence: Synthetic oligonucleotide
  Target: SCN9A; (-) strand; PAM type: YTN; PAM sequence: CTA
cataaccctttcctttccat

SEQ ID NO: 70888 - DNA, 20 bp, Artificial Sequence
  Description of Artificial Sequence: Synthetic oligonucleotide
  Target: SCN9A; (-) strand; PAM type: YTN; PAM sequence: CTC
aagactacataaccctttcc

SEQ ID NO: 70889 - DNA, 20 bp, Artificial Sequence
  Description of Artificial Sequence: Synthetic oligonucleotide
  Target: SCN9A; (-) strand; PAM type: YTN; PAM sequence: TTC
tcaagactacataacccttt

SEQ ID NO: 70890 - DNA, 20 bp, Artificial Sequence
  Description of Artificial Sequence: Synthetic oligonucleotide
  Target: SCN9A; (-) strand; PAM type: YTN; PAM sequence: TTT
ctcaagactacataaccctt

SEQ ID NO: 70891 - DNA, 20 bp, Artificial Sequence
  Description of Artificial Sequence: Synthetic oligonucleotide
  Target: SCN9A; (-) strand; PAM type: YTN; PAM sequence: CTT
tctcaagactacataaccct

SEQ ID NO: 70892 - DNA, 20 bp, Artificial Sequence
  Description of Artificial Sequence: Synthetic oligonucleotide
  Target: SCN9A; (-) strand; PAM type: YTN; PAM sequence: TTC
tttctcaagactacataacc

SEQ ID NO: 70893 - DNA, 20 bp, Artificial Sequence
  Description of Artificial Sequence: Synthetic oligonucleotide
  Target: SCN9A; (-) strand; PAM type: YTN; PAM sequence: TTT
ctttctcaagactacataac

SEQ ID NO: 70894 - DNA, 20 bp, Artificial Sequence
  Description of Artificial Sequence: Synthetic oligonucleotide
  Target: SCN9A; (-) strand; PAM type: YTN; PAM sequence: CTA
gaatatatttctttctcaag

SEQ ID NO: 70895 - DNA, 20 bp, Artificial Sequence
  Description of Artificial Sequence: Synthetic oligonucleotide
  Target: SCN9A; (-) strand; PAM type: YTN; PAM sequence: TTC
tagaatatatttctttctca

SEQ ID NO: 70896 - DNA, 20 bp, Artificial Sequence
  Description of Artificial Sequence: Synthetic oligonucleotide
  Target: SCN9A; (-) strand; PAM type: YTN; PAM sequence: CTT
ctagaatatatttctttctc

SEQ ID NO: 70897 - DNA, 20 bp, Artificial Sequence
  Description of Artificial Sequence: Synthetic oligonucleotide
  Target: SCN9A; (-) strand; PAM type: YTN; PAM sequence: TTA
cttctagaatatatttcttt

SEQ ID NO: 70898 - DNA, 20 bp, Artificial Sequence
  Description of Artificial Sequence: Synthetic oligonucleotide
  Target: SCN9A; (-) strand; PAM type: YTN; PAM sequence: TTT
acttctagaatatatttctt

SEQ ID NO: 70899 - DNA, 20 bp, Artificial Sequence
  Description of Artificial Sequence: Synthetic oligonucleotide
  Target: SCN9A; (-) strand; PAM type: YTN; PAM sequence: TTT
tacttctagaatatatttct

SEQ ID NO: 70900 - DNA, 20 bp, Artificial Sequence
  Description of Artificial Sequence: Synthetic oligonucleotide
  Target: SCN9A; (-) strand; PAM type: YTN; PAM sequence: CTG
attttacttctagaatatat

SEQ ID NO: 70901 - DNA, 20 bp, Artificial Sequence
  Description of Artificial Sequence: Synthetic oligonucleotide
  Target: SCN9A; (-) strand; PAM type: YTN; PAM sequence: TTG
aaaagtaaaactgattttac

SEQ ID NO: 70902 - DNA, 20 bp, Artificial Sequence
  Description of Artificial Sequence: Synthetic oligonucleotide
  Target: SCN9A; (-) strand; PAM type: YTN; PAM sequence: TTA
ttgaaaagtaaaactgattt

SEQ ID NO: 70903 - DNA, 20 bp, Artificial Sequence
  Description of Artificial Sequence: Synthetic oligonucleotide
  Target: SCN9A; (-) strand; PAM type: YTN; PAM sequence: TTT
attgaaaagtaaaactgatt

SEQ ID NO: 70904 - DNA, 20 bp, Artificial Sequence
  Description of Artificial Sequence: Synthetic oligonucleotide
  Target: SCN9A; (-) strand; PAM type: YTN; PAM sequence: CTT
tattgaaaagtaaaactgat

SEQ ID NO: 70905 - DNA, 20 bp, Artificial Sequence
  Description of Artificial Sequence: Synthetic oligonucleotide
  Target: SCN9A; (-) strand; PAM type: YTN; PAM sequence: TTC
tttattgaaaagtaaaactg

SEQ ID NO: 70906 - DNA, 20 bp, Artificial Sequence
  Description of Artificial Sequence: Synthetic oligonucleotide
  Target: SCN9A; (-) strand; PAM type: YTN; PAM sequence: CTT
ctttattgaaaagtaaaact

SEQ ID NO: 70907 - DNA, 20 bp, Artificial Sequence
  Description of Artificial Sequence: Synthetic oligonucleotide
  Target: SCN9A; (-) strand; PAM type: YTN; PAM sequence: TTC
ccttctttattgaaaagtaa

SEQ ID NO: 70908 - DNA, 20 bp, Artificial Sequence
  Description of Artificial Sequence: Synthetic oligonucleotide
  Target: SCN9A; (-) strand; PAM type: YTN; PAM sequence: TTA
ttcccttctttattgaaaag

SEQ ID NO: 70909 - DNA, 20 bp, Artificial Sequence
  Description of Artificial Sequence: Synthetic oligonucleotide
  Target: SCN9A; (-) strand; PAM type: YTN; PAM sequence: CTT
attcccttctttattgaaaa

SEQ ID NO: 70910 - DNA, 20 bp, Artificial Sequence
  Description of Artificial Sequence: Synthetic oligonucleotide
  Target: SCN9A; (-) strand; PAM type: YTN; PAM sequence: CTA
tcttattcccttctttattg

SEQ ID NO: 70911 - DNA, 20 bp, Artificial Sequence
  Description of Artificial Sequence: Synthetic oligonucleotide
  Target: SCN9A; (-) strand; PAM type: YTN; PAM sequence: TTC
aaaactatcttattcccttc

SEQ ID NO: 70912 - DNA, 20 bp, Artificial Sequence
  Description of Artificial Sequence: Synthetic oligonucleotide
  Target: SCN9A; (-) strand; PAM type: YTN; PAM sequence: CTT
caaaactatcttattccctt

SEQ ID NO: 70913 - DNA, 20 bp, Artificial Sequence
  Description of Artificial Sequence: Synthetic oligonucleotide
  Target: SCN9A; (-) strand; PAM type: YTN; PAM sequence: TTC
ttcaaaactatcttattccc

SEQ ID NO: 70914 - DNA, 20 bp, Artificial Sequence
  Description of Artificial Sequence: Synthetic oligonucleotide
  Target: SCN9A; (-) strand; PAM type: YTN; PAM sequence: TTT
cttcaaaactatcttattcc

SEQ ID NO: 70915 - DNA, 20 bp, Artificial Sequence
  Description of Artificial Sequence: Synthetic oligonucleotide
  Target: SCN9A; (-) strand; PAM type: YTN; PAM sequence: TTG
tttcttcaaaactatcttat

SEQ ID NO: 70916 - DNA, 20 bp, Artificial Sequence
  Description of Artificial Sequence: Synthetic oligonucleotide
  Target: SCN9A; (-) strand; PAM type: YTN; PAM sequence: TTT
gtttcttcaaaactatctta

SEQ ID NO: 70917 - DNA, 20 bp, Artificial Sequence
  Description of Artificial Sequence: Synthetic oligonucleotide
  Target: SCN9A; (-) strand; PAM type: YTN; PAM sequence: TTA
aatttgtttcttcaaaacta

SEQ ID NO: 70918 - DNA, 20 bp, Artificial Sequence
  Description of Artificial Sequence: Synthetic oligonucleotide
  Target: SCN9A; (-) strand; PAM type: YTN; PAM sequence: TTT
aaatttgtttcttcaaaact

SEQ ID NO: 70919 - DNA, 20 bp, Artificial Sequence
  Description of Artificial Sequence: Synthetic oligonucleotide
  Target: SCN9A; (-) strand; PAM type: YTN; PAM sequence: TTA
ggtgtttaaatttgtttctt

SEQ ID NO: 70920 - DNA, 20 bp, Artificial Sequence
  Description of Artificial Sequence: Synthetic oligonucleotide
  Target: SCN9A; (-) strand; PAM type: YTN; PAM sequence: TTT
aggtgtttaaatttgtttct

SEQ ID NO: 70921 - DNA, 20 bp, Artificial Sequence
  Description of Artificial Sequence: Synthetic oligonucleotide
  Target: SCN9A; (-) strand; PAM type: YTN; PAM sequence: TTT
taggtgtttaaatttgtttc

SEQ ID NO: 70922 - DNA, 20 bp, Artificial Sequence
  Description of Artificial Sequence: Synthetic oligonucleotide
  Target: SCN9A; (-) strand; PAM type: YTN; PAM sequence: TTA
tattttaggtgtttaaattt

SEQ ID NO: 70923 - DNA, 20 bp, Artificial Sequence
  Description of Artificial Sequence: Synthetic oligonucleotide
  Target: SCN9A; (-) strand; PAM type: YTN; PAM sequence: TTT
atattttaggtgtttaaatt

SEQ ID NO: 70924 - DNA, 20 bp, Artificial Sequence
  Description of Artificial Sequence: Synthetic oligonucleotide
  Target: SCN9A; (-) strand; PAM type: YTN; PAM sequence: TTT
tatattttaggtgtttaaat

SEQ ID NO: 70925 - DNA, 20 bp, Artificial Sequence
  Description of Artificial Sequence: Synthetic oligonucleotide
  Target: SCN9A; (-) strand; PAM type: YTN; PAM sequence: TTT
ttatattttaggtgtttaaa

SEQ ID NO: 70926 - DNA, 20 bp, Artificial Sequence
  Description of Artificial Sequence: Synthetic oligonucleotide
  Target: SCN9A; (-) strand; PAM type: YTN; PAM sequence: TTG
gtaataatgtgtgattttta

SEQ ID NO: 70927 - DNA, 20 bp, Artificial Sequence
  Description of Artificial Sequence: Synthetic oligonucleotide
  Target: SCN9A; (-) strand; PAM type: YTN; PAM sequence: CTT
ggtaataatgtgtgattttt

SEQ ID NO: 70928 - DNA, 20 bp, Artificial Sequence
  Description of Artificial Sequence: Synthetic oligonucleotide
  Target: SCN9A; (-) strand; PAM type: YTN; PAM sequence: CTA
ccttggtaataatgtgtgat

SEQ ID NO: 70929 - DNA, 20 bp, Artificial Sequence
  Description of Artificial Sequence: Synthetic oligonucleotide
  Target: SCN9A; (-) strand; PAM type: YTN; PAM sequence: TTA
tagtctaccttggtaataat

SEQ ID NO: 70930 - DNA, 20 bp, Artificial Sequence
  Description of Artificial Sequence: Synthetic oligonucleotide
  Target: SCN9A; (-) strand; PAM type: YTN; PAM sequence: TTA
ggttatagtctaccttggta

SEQ ID NO: 70931 - DNA, 20 bp, Artificial Sequence
  Description of Artificial Sequence: Synthetic oligonucleotide
  Target: SCN9A; (-) strand; PAM type: YTN; PAM sequence: CTG
attaggttatagtctacctt

SEQ ID NO: 70932 - DNA, 20 bp, Artificial Sequence
  Description of Artificial Sequence: Synthetic oligonucleotide
  Target: SCN9A; (-) strand; PAM type: YTN; PAM sequence: CTG
actgattaggttatagtcta

SEQ ID NO: 70933 - DNA, 20 bp, Artificial Sequence
  Description of Artificial Sequence: Synthetic oligonucleotide
  Target: SCN9A; (-) strand; PAM type: YTN; PAM sequence: TTA
atgctgactgattaggttat

SEQ ID NO: 70934 - DNA, 20 bp, Artificial Sequence
  Description of Artificial Sequence: Synthetic oligonucleotide
  Target: SCN9A; (-) strand; PAM type: YTN; PAM sequence: CTT
aatgctgactgattaggtta

SEQ ID NO: 70935 - DNA, 20 bp, Artificial Sequence
  Description of Artificial Sequence: Synthetic oligonucleotide
  Target: SCN9A; (-) strand; PAM type: YTN; PAM sequence: CTA
atccaccttaatgctgactg

SEQ ID NO: 70936 - DNA, 20 bp, Artificial Sequence
  Description of Artificial Sequence: Synthetic oligonucleotide
  Target: SCN9A; (-) strand; PAM type: YTN; PAM sequence: TTC
taatccaccttaatgctgac

SEQ ID NO: 70937 - DNA, 20 bp, Artificial Sequence
  Description of Artificial Sequence: Synthetic oligonucleotide
  Target: SCN9A; (-) strand; PAM type: YTN; PAM sequence: CTT
ctaatccaccttaatgctga

SEQ ID NO: 70938 - DNA, 20 bp, Artificial Sequence
  Description of Artificial Sequence: Synthetic oligonucleotide
  Target: SCN9A; (-) strand; PAM type: YTN; PAM sequence: TTG
tgcttctaatccaccttaat

SEQ ID NO: 70939 - DNA, 20 bp, Artificial Sequence
  Description of Artificial Sequence: Synthetic oligonucleotide
  Target: SCN9A; (-) strand; PAM type: YTN; PAM sequence: CTG
atattgtgcttctaatccac

SEQ ID NO: 70940 - DNA, 20 bp, Artificial Sequence
  Description of Artificial Sequence: Synthetic oligonucleotide
  Target: SCN9A; (-) strand; PAM type: YTN; PAM sequence: TTC
tgatattgtgcttctaatcc

SEQ ID NO: 70941 - DNA, 20 bp, Artificial Sequence
  Description of Artificial Sequence: Synthetic oligonucleotide
  Target: SCN9A; (-) strand; PAM type: YTN; PAM sequence: TTG
ggattctgatattgtgcttc

SEQ ID NO: 70942 - DNA, 20 bp, Artificial Sequence
  Description of Artificial Sequence: Synthetic oligonucleotide
  Target: SCN9A; (-) strand; PAM type: YTN; PAM sequence: TTC
attgggattctgatattgtg

SEQ ID NO: 70943 - DNA, 20 bp, Artificial Sequence
  Description of Artificial Sequence: Synthetic oligonucleotide
  Target: SCN9A; (-) strand; PAM type: YTN; PAM sequence: CTG
attcattgggattctgatat

SEQ ID NO: 70944 - DNA, 20 bp, Artificial Sequence
  Description of Artificial Sequence: Synthetic oligonucleotide
  Target: SCN9A; (-) strand; PAM type: YTN; PAM sequence: TTG
ctgattcattgggattctga

SEQ ID NO: 70945 - DNA, 20 bp, Artificial Sequence
  Description of Artificial Sequence: Synthetic oligonucleotide
  Target: SCN9A; (-) strand; PAM type: YTN; PAM sequence: TTT
gctgattcattgggattctg

SEQ ID NO: 70946 - DNA, 20 bp, Artificial Sequence
  Description of Artificial Sequence: Synthetic oligonucleotide
  Target: SCN9A; (-) strand; PAM type: YTN; PAM sequence: TTG
tacatttgctgattcattgg

SEQ ID NO: 70947 - DNA, 20 bp, Artificial Sequence
  Description of Artificial Sequence: Synthetic oligonucleotide
  Target: SCN9A; (-) strand; PAM type: YTN; PAM sequence: TTG
taatggtattgtacatttgc

SEQ ID NO: 70948 - DNA, 20 bp, Artificial Sequence
  Description of Artificial Sequence: Synthetic oligonucleotide
  Target: SCN9A; (-) strand; PAM type: YTN; PAM sequence: CTG
ttgtaatggtattgtacatt

SEQ ID NO: 70949 - DNA, 20 bp, Artificial Sequence
  Description of Artificial Sequence: Synthetic oligonucleotide
  Target: SCN9A; (-) strand; PAM type: YTN; PAM sequence: TTC
tgttgtaatggtattgtaca

SEQ ID NO: 70950 - DNA, 20 bp, Artificial Sequence
  Description of Artificial Sequence: Synthetic oligonucleotide
  Target: SCN9A; (-) strand; PAM type: YTN; PAM sequence: TTT
ctgttgtaatggtattgtac

SEQ ID NO: 70951 - DNA, 20 bp, Artificial Sequence
  Description of Artificial Sequence: Synthetic oligonucleotide
  Target: SCN9A; (-) strand; PAM type: YTN; PAM sequence: TTT
tctgttgtaatggtattgta

SEQ ID NO: 70952 - DNA, 20 bp, Artificial Sequence
  Description of Artificial Sequence: Synthetic oligonucleotide
  Target: SCN9A; (-) strand; PAM type: YTN; PAM sequence: TTC
agggtgaaattttctgttgt

SEQ ID NO: 70953 - DNA, 20 bp, Artificial Sequence
  Description of Artificial Sequence: Synthetic oligonucleotide
  Target: SCN9A; (-) strand; PAM type: YTN; PAM sequence: CTG
taatggtgtaattcagggtg

SEQ ID NO: 70954 - DNA, 20 bp, Artificial Sequence
  Description of Artificial Sequence: Synthetic oligonucleotide
  Target: SCN9A; (-) strand; PAM type: YTN; PAM sequence: CTC
tgtaatggtgtaattcaggg

SEQ ID NO: 70955 - DNA, 20 bp, Artificial Sequence
  Description of Artificial Sequence: Synthetic oligonucleotide
  Target: SCN9A; (-) strand; PAM type: YTN; PAM sequence: CTA
tacctctgtaatggtgtaat

SEQ ID NO: 70956 - DNA, 20 bp, Artificial Sequence
  Description of Artificial Sequence: Synthetic oligonucleotide
  Target: SCN9A; (-) strand; PAM type: YTN; PAM sequence: CTG
ctatacctctgtaatggtgt

SEQ ID NO: 70957 - DNA, 20 bp, Artificial Sequence
  Description of Artificial Sequence: Synthetic oligonucleotide
  Target: SCN9A; (-) strand; PAM type: YTN; PAM sequence: TTC
tgctatacctctgtaatggt

SEQ ID NO: 70958 - DNA, 20 bp, Artificial Sequence
  Description of Artificial Sequence: Synthetic oligonucleotide
  Target: SCN9A; (-) strand; PAM type: YTN; PAM sequence: TTT
ctgctatacctctgtaatgg

SEQ ID NO: 70959 - DNA, 20 bp, Artificial Sequence
  Description of Artificial Sequence: Synthetic oligonucleotide
  Target: SCN9A; (-) strand; PAM type: YTN; PAM sequence: TTT
tctgctatacctctgtaatg

SEQ ID NO: 70960 - DNA, 20 bp, Artificial Sequence
  Description of Artificial Sequence: Synthetic oligonucleotide
  Target: SCN9A; (-) strand; PAM type: YTN; PAM sequence: TTG
ttttctgctatacctctgta

SEQ ID NO: 70961 - DNA, 20 bp, Artificial Sequence
  Description of Artificial Sequence: Synthetic oligonucleotide
  Target: SCN9A; (-) strand; PAM type: YTN; PAM sequence: CTA
catgccatagaaaggcaaga

SEQ ID NO: 70962 - DNA, 20 bp, Artificial Sequence
  Description of Artificial Sequence: Synthetic oligonucleotide
  Target: SCN9A; (-) strand; PAM type: YTN; PAM sequence: TTA
tactacatgccatagaaagg

SEQ ID NO: 70963 - DNA, 20 bp, Artificial Sequence
  Description of Artificial Sequence: Synthetic oligonucleotide
  Target: SCN9A; (-) strand; PAM type: YTN; PAM sequence: CTG
taatcattatactacatgcc

SEQ ID NO: 70964 - DNA, 20 bp, Artificial Sequence
  Description of Artificial Sequence: Synthetic oligonucleotide
  Target: SCN9A; (-) strand; PAM type: YTN; PAM sequence: TTA
aaccccaagctgtaatcatt

SEQ ID NO: 70965 - DNA, 20 bp, Artificial Sequence
  Description of Artificial Sequence: Synthetic oligonucleotide
  Target: SCN9A; (-) strand; PAM type: YTN; PAM sequence: TTT
aaaccccaagctgtaatcat

SEQ ID NO: 70966 - DNA, 20 bp, Artificial Sequence
  Description of Artificial Sequence: Synthetic oligonucleotide
  Target: SCN9A; (-) strand; PAM type: YTN; PAM sequence: TTA
aatttaaaccccaagctgta

SEQ ID NO: 70967 - DNA, 20 bp, Artificial Sequence
  Description of Artificial Sequence: Synthetic oligonucleotide
  Target: SCN9A; (-) strand; PAM type: YTN; PAM sequence: TTT
aaatttaaaccccaagctgt

SEQ ID NO: 70968 - DNA, 20 bp, Artificial Sequence
  Description of Artificial Sequence: Synthetic oligonucleotide
  Target: SCN9A; (-) strand; PAM type: YTN; PAM sequence: TTT
taaatttaaaccccaagctg

SEQ ID NO: 70969 - DNA, 20 bp, Artificial Sequence
  Description of Artificial Sequence: Synthetic oligonucleotide
  Target: SCN9A; (-) strand; PAM type: YTN; PAM sequence: TTT
ttaaatttaaaccccaagct

SEQ ID NO: 70970 - DNA, 20 bp, Artificial Sequence
  Description of Artificial Sequence: Synthetic oligonucleotide
  Target: SCN9A; (-) strand; PAM type: YTN; PAM sequence: CTT
tttaaatttaaaccccaagc

SEQ ID NO: 70971 - DNA, 20 bp, Artificial Sequence
  Description of Artificial Sequence: Synthetic oligonucleotide
  Target: SCN9A; (-) strand; PAM type: YTN; PAM sequence: CTG
ggggtctttttaaatttaaa

SEQ ID NO: 70972 - DNA, 20 bp, Artificial Sequence
  Description of Artificial Sequence: Synthetic oligonucleotide
  Target: SCN9A; (-) strand; PAM type: YTN; PAM sequence: TTA
gtcatggacgtatctggggg

SEQ ID NO: 70973 - DNA, 20 bp, Artificial Sequence
  Description of Artificial Sequence: Synthetic oligonucleotide
  Target: SCN9A; (-) strand; PAM type: YTN; PAM sequence: TTG
gttagtcatggacgtatctg

SEQ ID NO: 70974 - DNA, 20 bp, Artificial Sequence
  Description of Artificial Sequence: Synthetic oligonucleotide
  Target: SCN9A; (-) strand; PAM type: YTN; PAM sequence: TTT
ggttagtcatggacgtatct

SEQ ID NO: 70975 - DNA, 20 bp, Artificial Sequence
  Description of Artificial Sequence: Synthetic oligonucleotide
  Target: SCN9A; (-) strand; PAM type: YTN; PAM sequence: TTA
agaaaagatttggttagtca

SEQ ID NO: 70976 - DNA, 20 bp, Artificial Sequence
  Description of Artificial Sequence: Synthetic oligonucleotide
  Target: SCN9A; (-) strand; PAM type: YTN; PAM sequence: CTA
aaagattaagaaaagatttg

SEQ ID NO: 70977 - DNA, 20 bp, Artificial Sequence
  Description of Artificial Sequence: Synthetic oligonucleotide
  Target: SCN9A; (-) strand; PAM type: YTN; PAM sequence: TTC
taaaagattaagaaaagatt

SEQ ID NO: 70978 - DNA, 20 bp, Artificial Sequence
  Description of Artificial Sequence: Synthetic oligonucleotide
  Target: SCN9A; (-) strand; PAM type: YTN; PAM sequence: CTG
cgattctaaaagattaagaa

SEQ ID NO: 70979 - DNA, 20 bp, Artificial Sequence
  Description of Artificial Sequence: Synthetic oligonucleotide
  Target: SCN9A; (-) strand; PAM type: YTN; PAM sequence: TTG
cagatgactgcgattctaaa

SEQ ID NO: 70980 - DNA, 20 bp, Artificial Sequence
  Description of Artificial Sequence: Synthetic oligonucleotide
  Target: SCN9A; (-) strand; PAM type: YTN; PAM sequence: TTT
gcagatgactgcgattctaa

SEQ ID NO: 70981 - DNA, 20 bp, Artificial Sequence
  Description of Artificial Sequence: Synthetic oligonucleotide
  Target: SCN9A; (-) strand; PAM type: YTN; PAM sequence: CTA
tatttgcagatgactgcgat

SEQ ID NO: 70982 - DNA, 20 bp, Artificial Sequence
  Description of Artificial Sequence: Synthetic oligonucleotide
  Target: SCN9A; (-) strand; PAM type: YTN; PAM sequence: TTA
ggaagtaaatataatgcatc

SEQ ID NO: 70983 - DNA, 20 bp, Artificial Sequence
  Description of Artificial Sequence: Synthetic oligonucleotide
  Target: SCN9A; (-) strand; PAM type: YTN; PAM sequence: CTT
aggaagtaaatataatgcat

SEQ ID NO: 70984 - DNA, 20 bp, Artificial Sequence
  Description of Artificial Sequence: Synthetic oligonucleotide
  Target: SCN9A; (-) strand; PAM type: YTN; PAM sequence: CTC
cttaggaagtaaatataatg

SEQ ID NO: 70985 - DNA, 20 bp, Artificial Sequence
  Description of Artificial Sequence: Synthetic oligonucleotide
  Target: SCN9A; (-) strand; PAM type: YTN; PAM sequence: TTG
tgacctccttaggaagtaaa

SEQ ID NO: 70986 - DNA, 20 bp, Artificial Sequence
  Description of Artificial Sequence: Synthetic oligonucleotide
  Target: SCN9A; (-) strand; PAM type: YTN; PAM sequence: TTT
gtgacctccttaggaagtaa

SEQ ID NO: 70987 - DNA, 20 bp, Artificial Sequence
  Description of Artificial Sequence: Synthetic oligonucleotide
  Target: SCN9A; (-) strand; PAM type: YTN; PAM sequence: CTT
tgtgacctccttaggaagta

SEQ ID NO: 70988 - DNA, 20 bp, Artificial Sequence
  Description of Artificial Sequence: Synthetic oligonucleotide
  Target: SCN9A; (-) strand; PAM type: YTN; PAM sequence: TTC
gtctttgtgacctccttagg

SEQ ID NO: 70989 - DNA, 20 bp, Artificial Sequence
  Description of Artificial Sequence: Synthetic oligonucleotide
  Target: SCN9A; (-) strand; PAM type: YTN; PAM sequence: TTT
cgtctttgtgacctccttag

SEQ ID NO: 70990 - DNA, 20 bp, Artificial Sequence
  Description of Artificial Sequence: Synthetic oligonucleotide
  Target: SCN9A; (-) strand; PAM type: YTN; PAM sequence: TTT
tcgtctttgtgacctcctta

SEQ ID NO: 70991 - DNA, 20 bp, Artificial Sequence
  Description of Artificial Sequence: Synthetic oligonucleotide
  Target: SCN9A; (-) strand; PAM type: YTN; PAM sequence: TTA
tataattttcgtctttgtga

SEQ ID NO: 70992 - DNA, 20 bp, Artificial Sequence
  Description of Artificial Sequence: Synthetic oligonucleotide
  Target: SCN9A; (-) strand; PAM type: YTN; PAM sequence: TTA
cacacattatataattttcg

SEQ ID NO: 70993 - DNA, 20 bp, Artificial Sequence
  Description of Artificial Sequence: Synthetic oligonucleotide
  Target: SCN9A; (-) strand; PAM type: YTN; PAM sequence: TTT
acacacattatataattttc

SEQ ID NO: 70994 - DNA, 20 bp, Artificial Sequence
  Description of Artificial Sequence: Synthetic oligonucleotide
  Target: SCN9A; (-) strand; PAM type: YTN; PAM sequence: CTT
tacacacattatataatttt

SEQ ID NO: 70995 - DNA, 20 bp, Artificial Sequence
  Description of Artificial Sequence: Synthetic oligonucleotide
  Target: SCN9A; (-) strand; PAM type: YTN; PAM sequence: TTG
agaggtggatgcaaaagaag

SEQ ID NO: 70996 - DNA, 20 bp, Artificial Sequence
  Description of Artificial Sequence: Synthetic oligonucleotide
  Target: SCN9A; (-) strand; PAM type: YTN; PAM sequence: TTT
gagaggtggatgcaaaagaa

SEQ ID NO: 70997 - DNA, 20 bp, Artificial Sequence
  Description of Artificial Sequence: Synthetic oligonucleotide
  Target: SCN9A; (-) strand; PAM type: YTN; PAM sequence: CTG
agaacagcggatcaaacaca

SEQ ID NO: 70998 - DNA, 20 bp, Artificial Sequence
  Description of Artificial Sequence: Synthetic oligonucleotide
  Target: SCN9A; (-) strand; PAM type: YTN; PAM sequence: TTC
atgacagaaccacagacagc

SEQ ID NO: 70999 - DNA, 20 bp, Artificial Sequence
  Description of Artificial Sequence: Synthetic oligonucleotide
  Target: SCN9A; (-) strand; PAM type: YTN; PAM sequence: CTT
catgacagaaccacagacag

SEQ ID NO: 71000 - DNA, 20 bp, Artificial Sequence
  Description of Artificial Sequence: Synthetic oligonucleotide
  Target: SCN9A; (-) strand; PAM type: YTN; PAM sequence: CTA
cttcatgacagaaccacaga

SEQ ID NO: 71001 - DNA, 20 bp, Artificial Sequence
  Description of Artificial Sequence: Synthetic oligonucleotide
  Target: SCN9A; (-) strand; PAM type: YTN; PAM sequence: TTA
gagcatctacttcatgacag

SEQ ID NO: 71002 - DNA, 20 bp, Artificial Sequence
  Description of Artificial Sequence: Synthetic oligonucleotide
  Target: SCN9A; (-) strand; PAM type: YTN; PAM sequence: CTT
agagcatctacttcatgaca

SEQ ID NO: 71003 - DNA, 20 bp, Artificial Sequence
  Description of Artificial Sequence: Synthetic oligonucleotide
  Target: SCN9A; (-) strand; PAM type: YTN; PAM sequence: CTG
gaaagcaggatgtggacagt

SEQ ID NO: 71004 - DNA, 20 bp, Artificial Sequence
  Description of Artificial Sequence: Synthetic oligonucleotide
  Target: SCN9A; (-) strand; PAM type: YTN; PAM sequence: TTG
ctggaaagcaggatgtggac

SEQ ID NO: 71005 - DNA, 20 bp, Artificial Sequence
  Description of Artificial Sequence: Synthetic oligonucleotide
  Target: SCN9A; (-) strand; PAM type: YTN; PAM sequence: CTT
gctggaaagcaggatgtgga

SEQ ID NO: 71006 - DNA, 20 bp, Artificial Sequence
  Description of Artificial Sequence: Synthetic oligonucleotide
  Target: SCN9A; (-) strand; PAM type: YTN; PAM sequence: CTG
ggggaatgagcagcttgctg

SEQ ID NO: 71007 - DNA, 20 bp, Artificial Sequence
  Description of Artificial Sequence: Synthetic oligonucleotide
  Target: SCN9A; (-) strand; PAM type: YTN; PAM sequence: TTG
gcagctgggggaatgagcag

SEQ ID NO: 71008 - DNA, 20 bp, Artificial Sequence
  Description of Artificial Sequence: Synthetic oligonucleotide
  Target: SCN9A; (-) strand; PAM type: YTN; PAM sequence: TTT
ggcagctgggggaatgagca

SEQ ID NO: 71009 - DNA, 20 bp, Artificial Sequence
  Description of Artificial Sequence: Synthetic oligonucleotide
  Target: SCN9A; (-) strand; PAM type: YTN; PAM sequence: TTT
tggcagctgggggaatgagc

SEQ ID NO: 71010 - DNA, 20 bp, Artificial Sequence
  Description of Artificial Sequence: Synthetic oligonucleotide
  Target: SCN9A; (-) strand; PAM type: YTN; PAM sequence: CTT
ttggcagctgggggaatgag

SEQ ID NO: 71011 - DNA, 20 bp, Artificial Sequence
  Description of Artificial Sequence: Synthetic oligonucleotide
  Target: SCN9A; (-) strand; PAM type: YTN; PAM sequence: TTC
agcatccaacacttttggca

SEQ ID NO: 71012 - DNA, 20 bp, Artificial Sequence
  Description of Artificial Sequence: Synthetic oligonucleotide
  Target: SCN9A; (-) strand; PAM type: YTN; PAM sequence: CTT
cagcatccaacacttttggc

SEQ ID NO: 71013 - DNA, 20 bp, Artificial Sequence
  Description of Artificial Sequence: Synthetic oligonucleotide
  Target: SCN9A; (-) strand; PAM type: YTN; PAM sequence: TTC
agatgtgagccttcagcatc

SEQ ID NO: 71014 - DNA, 20 bp, Artificial Sequence
  Description of Artificial Sequence: Synthetic oligonucleotide
  Target: SCN9A; (-) strand; PAM type: YTN; PAM sequence: CTG
ccacgataaggcccaaagag

SEQ ID NO: 71015 - DNA, 20 bp, Artificial Sequence
  Description of Artificial Sequence: Synthetic oligonucleotide
  Target: SCN9A; (-) strand; PAM type: YTN; PAM sequence: TTC
tgccacgataaggcccaaag

SEQ ID NO: 71016 - DNA, 20 bp, Artificial Sequence
  Description of Artificial Sequence: Synthetic oligonucleotide
  Target: SCN9A; (-) strand; PAM type: YTN; PAM sequence: CTT
ctgccacgataaggcccaaa

SEQ ID NO: 71017 - DNA, 20 bp, Artificial Sequence
  Description of Artificial Sequence: Synthetic oligonucleotide
  Target: SCN9A; (-) strand; PAM type: YTN; PAM sequence: CTC
ccttctgccacgataaggcc

SEQ ID NO: 71018 - DNA, 20 bp, Artificial Sequence
  Description of Artificial Sequence: Synthetic oligonucleotide
  Target: SCN9A; (-) strand; PAM type: YTN; PAM sequence: TTG
ggggaagcacctcccttctg

SEQ ID NO: 71019 - DNA, 20 bp, Artificial Sequence
  Description of Artificial Sequence: Synthetic oligonucleotide
  Target: SCN9A; (-) strand; PAM type: YTN; PAM sequence: CTT
gggggaagcacctcccttct

SEQ ID NO: 71020 - DNA, 20 bp, Artificial Sequence
  Description of Artificial Sequence: Synthetic oligonucleotide
  Target: SCN9A; (-) strand; PAM type: YTN; PAM sequence: TTC
caggggagaagggtataacc

SEQ ID NO: 71021 - DNA, 20 bp, Artificial Sequence
  Description of Artificial Sequence: Synthetic oligonucleotide
  Target: SCN9A; (-) strand; PAM type: YTN; PAM sequence: TTT
ccaggggagaagggtataac

SEQ ID NO: 71022 - DNA, 20 bp, Artificial Sequence
  Description of Artificial Sequence: Synthetic oligonucleotide
  Target: SCN9A; (-) strand; PAM type: YTN; PAM sequence: CTT
tccaggggagaagggtataa

SEQ ID NO: 71023 - DNA, 20 bp, Artificial Sequence
  Description of Artificial Sequence: Synthetic oligonucleotide
  Target: SCN9A; (-) strand; PAM type: YTN; PAM sequence: TTA
cctttccaggggagaagggt

SEQ ID NO: 71024 - DNA, 20 bp, Artificial Sequence
  Description of Artificial Sequence: Synthetic oligonucleotide
  Target: SCN9A; (-) strand; PAM type: YTN; PAM sequence: TTT
acctttccaggggagaaggg

SEQ ID NO: 71025 - DNA, 20 bp, Artificial Sequence
  Description of Artificial Sequence: Synthetic oligonucleotide
  Target: SCN9A; (-) strand; PAM type: YTN; PAM sequence: CTT
tacctttccaggggagaagg

SEQ ID NO: 71026 - DNA, 20 bp, Artificial Sequence
  Description of Artificial Sequence: Synthetic oligonucleotide
  Target: SCN9A; (-) strand; PAM type: YTN; PAM sequence: CTC
cctttacctttccaggggag

SEQ ID NO: 71027 - DNA, 20 bp, Artificial Sequence
  Description of Artificial Sequence: Synthetic oligonucleotide
  Target: SCN9A; (-) strand; PAM type: YTN; PAM sequence: CTC
tccctttacctttccagggg

SEQ ID NO: 71028 - DNA, 20 bp, Artificial Sequence
  Description of Artificial Sequence: Synthetic oligonucleotide
  Target: SCN9A; (-) strand; PAM type: YTN; PAM sequence: TTG
gatgcaggctctccctttac

SEQ ID NO: 71029 - DNA, 20 bp, Artificial Sequence
  Description of Artificial Sequence: Synthetic oligonucleotide
  Target: SCN9A; (-) strand; PAM type: YTN; PAM sequence: TTC
attggatgcaggctctccct

SEQ ID NO: 71030 - DNA, 20 bp, Artificial Sequence
  Description of Artificial Sequence: Synthetic oligonucleotide
  Target: SCN9A; (-) strand; PAM type: YTN; PAM sequence: CTC
cacaccattcattggatgca

SEQ ID NO: 71031 - DNA, 20 bp, Artificial Sequence
  Description of Artificial Sequence: Synthetic oligonucleotide
  Target: SCN9A; (-) strand; PAM type: YTN; PAM sequence: TTC
tccacaccattcattggatg

SEQ ID NO: 71032 - DNA, 20 bp, Artificial Sequence
  Description of Artificial Sequence: Synthetic oligonucleotide
  Target: SCN9A; (-) strand; PAM type: YTN; PAM sequence: CTT
ctccacaccattcattggat

SEQ ID NO: 71033 - DNA, 20 bp, Artificial Sequence
  Description of Artificial Sequence: Synthetic oligonucleotide
  Target: SCN9A; (-) strand; PAM type: YTN; PAM sequence: TTC
ttctccacaccattcattgg

SEQ ID NO: 71034 - DNA, 20 bp, Artificial Sequence
  Description of Artificial Sequence: Synthetic oligonucleotide
  Target: SCN9A; (-) strand; PAM type: YTN; PAM sequence: TTT
cttctccacaccattcattg

SEQ ID NO: 71035 - DNA, 20 bp, Artificial Sequence
  Description of Artificial Sequence: Synthetic oligonucleotide
  Target: SCN9A; (-) strand; PAM type: YTN; PAM sequence: CTT
tcttctccacaccattcatt

SEQ ID NO: 71036 - DNA, 20 bp, Artificial Sequence
  Description of Artificial Sequence: Synthetic oligonucleotide
  Target: SCN9A; (-) strand; PAM type: YTN; PAM sequence: TTC
caaaacaaagcaagagggtc

SEQ ID NO: 71037 - DNA, 20 bp, Artificial Sequence
  Description of Artificial Sequence: Synthetic oligonucleotide
  Target: SCN9A; (-) strand; PAM type: YTN; PAM sequence: CTG
gagtagttccaaaacaaagc

SEQ ID NO: 71038 - DNA, 20 bp, Artificial Sequence
  Description of Artificial Sequence: Synthetic oligonucleotide
  Target: SCN9A; (-) strand; PAM type: YTN; PAM sequence: CTC
tggagtagttccaaaacaaa

SEQ ID NO: 71039 - DNA, 20 bp, Artificial Sequence
  Description of Artificial Sequence: Synthetic oligonucleotide
  Target: SCN9A; (-) strand; PAM type: YTN; PAM sequence: CTG
tgacaaccctctggagtagt

SEQ ID NO: 71040 - DNA, 20 bp, Artificial Sequence
  Description of Artificial Sequence: Synthetic oligonucleotide
  Target: SCN9A; (-) strand; PAM type: YTN; PAM sequence: CTG
atgctgtgacaaccctctgg

SEQ ID NO: 71041 - DNA, 20 bp, Artificial Sequence
  Description of Artificial Sequence: Synthetic oligonucleotide
  Target: SCN9A; (-) strand; PAM type: YTN; PAM sequence: CTC
tgatgctgtgacaaccctct

SEQ ID NO: 71042 - DNA, 20 bp, Artificial Sequence
  Description of Artificial Sequence: Synthetic oligonucleotide
  Target: SCN9A; (-) strand; PAM type: YTN; PAM sequence: TTG
gcatctctgatgctgtgaca

SEQ ID NO: 71043 - DNA, 20 bp, Artificial Sequence
  Description of Artificial Sequence: Synthetic oligonucleotide
  Target: SCN9A; (-) strand; PAM type: YTN; PAM sequence: CTA
ttggcatctctgatgctgtg

SEQ ID NO: 71044 - DNA, 20 bp, Artificial Sequence
  Description of Artificial Sequence: Synthetic oligonucleotide
  Target: SCN9A; (-) strand; PAM type: YTN; PAM sequence: CTG
atcctattggcatctctgat

SEQ ID NO: 71045 - DNA, 20 bp, Artificial Sequence
  Description of Artificial Sequence: Synthetic oligonucleotide
  Target: SCN9A; (-) strand; PAM type: YTN; PAM sequence: TTC
ggctgatcctattggcatct

SEQ ID NO: 71046 - DNA, 20 bp, Artificial Sequence
  Description of Artificial Sequence: Synthetic oligonucleotide
  Target: SCN9A; (-) strand; PAM type: YTN; PAM sequence: TTT
cggctgatcctattggcatc

SEQ ID NO: 71047 - DNA, 20 bp, Artificial Sequence
  Description of Artificial Sequence: Synthetic oligonucleotide
  Target: SCN9A; (-) strand; PAM type: YTN; PAM sequence: TTG
caacagagatttcggctgat

SEQ ID NO: 71048 - DNA, 20 bp, Artificial Sequence
  Description of Artificial Sequence: Synthetic oligonucleotide
  Target: SCN9A; (-) strand; PAM type: YTN; PAM sequence: TTA
aaattgcaacagagatttcg

SEQ ID NO: 71049 - DNA, 20 bp, Artificial Sequence
  Description of Artificial Sequence: Synthetic oligonucleotide
  Target: SCN9A; (-) strand; PAM type: YTN; PAM sequence: CTG
ttaaaattgcaacagagatt

SEQ ID NO: 71050 - DNA, 20 bp, Artificial Sequence
  Description of Artificial Sequence: Synthetic oligonucleotide
  Target: SCN9A; (-) strand; PAM type: YTN; PAM sequence: TTG
aactgttaaaattgcaacag

SEQ ID NO: 71051 - DNA, 20 bp, Artificial Sequence
  Description of Artificial Sequence: Synthetic oligonucleotide
  Target: SCN9A; (-) strand; PAM type: YTN; PAM sequence: TTG
ggcagagagagaagttgaac

SEQ ID NO: 71052 - DNA, 20 bp, Artificial Sequence
  Description of Artificial Sequence: Synthetic oligonucleotide
  Target: SCN9A; (-) strand; PAM type: YTN; PAM sequence: TTA
ttgggcagagagagaagttg

SEQ ID NO: 71053 - DNA, 20 bp, Artificial Sequence
  Description of Artificial Sequence: Synthetic oligonucleotide
  Target: SCN9A; (-) strand; PAM type: YTN; PAM sequence: CTG
taaaaagtgaggcatgcaaa

SEQ ID NO: 71054 - DNA, 20 bp, Artificial Sequence
  Description of Artificial Sequence: Synthetic oligonucleotide
  Target: SCN9A; (-) strand; PAM type: YTN; PAM sequence: TTC
aggaacgaaacgtaacatct

SEQ ID NO: 71055 - DNA, 20 bp, Artificial Sequence
  Description of Artificial Sequence: Synthetic oligonucleotide
  Target: SCN9A; (-) strand; PAM type: YTN; PAM sequence: TTT
caggaacgaaacgtaacatc

SEQ ID NO: 71056 - DNA, 20 bp, Artificial Sequence
  Description of Artificial Sequence: Synthetic oligonucleotide
  Target: SCN9A; (-) strand; PAM type: YTN; PAM sequence: TTT
tcaggaacgaaacgtaacat

SEQ ID NO: 71057 - DNA, 20 bp, Artificial Sequence
  Description of Artificial Sequence: Synthetic oligonucleotide
  Target: SCN9A; (-) strand; PAM type: YTN; PAM sequence: CTG
agaagtgttttcaggaacga

SEQ ID NO: 71058 - DNA, 20 bp, Artificial Sequence
  Description of Artificial Sequence: Synthetic oligonucleotide
  Target: SCN9A; (-) strand; PAM type: YTN; PAM sequence: TTA
ctgagaagtgttttcaggaa

SEQ ID NO: 71059 - DNA, 20 bp, Artificial Sequence
  Description of Artificial Sequence: Synthetic oligonucleotide
  Target: SCN9A; (-) strand; PAM type: YTN; PAM sequence: TTT
actgagaagtgttttcagga

SEQ ID NO: 71060 - DNA, 20 bp, Artificial Sequence
  Description of Artificial Sequence: Synthetic oligonucleotide
  Target: SCN9A; (-) strand; PAM type: YTN; PAM sequence: CTG
agatttactgagaagtgttt

SEQ ID NO: 71061 - DNA, 20 bp, Artificial Sequence
  Description of Artificial Sequence: Synthetic oligonucleotide
  Target: SCN9A; (-) strand; PAM type: YTN; PAM sequence: CTG
agagagaaatctgagattta

SEQ ID NO: 71062 - DNA, 20 bp, Artificial Sequence
  Description of Artificial Sequence: Synthetic oligonucleotide
  Target: SCN9A; (-) strand; PAM type: YTN; PAM sequence: CTG
ggaaaccaatcctgagagag

SEQ ID NO: 71063 - DNA, 20 bp, Artificial Sequence
  Description of Artificial Sequence: Synthetic oligonucleotide
  Target: SCN9A; (-) strand; PAM type: YTN; PAM sequence: TTC
cctgggaaaccaatcctgag

SEQ ID NO: 71064 - DNA, 20 bp, Artificial Sequence
  Description of Artificial Sequence: Synthetic oligonucleotide
  Target: SCN9A; (-) strand; PAM type: YTN; PAM sequence: TTG
tgtaggggtcagttccctgg

SEQ ID NO: 71065 - DNA, 20 bp, Artificial Sequence
  Description of Artificial Sequence: Synthetic oligonucleotide
  Target: SCN9A; (-) strand; PAM type: YTN; PAM sequence: TTA
atcacgggattgtgtagggg

SEQ ID NO: 71066 - DNA, 20 bp, Artificial Sequence
  Description of Artificial Sequence: Synthetic oligonucleotide
  Target: SCN9A; (-) strand; PAM type: YTN; PAM sequence: TTC
attaatcacgggattgtgta

SEQ ID NO: 71067 - DNA, 20 bp, Artificial Sequence
  Description of Artificial Sequence: Synthetic oligonucleotide
  Target: SCN9A; (-) strand; PAM type: YTN; PAM sequence: TTT
cattaatcacgggattgtgt

SEQ ID NO: 71068 - DNA, 20 bp, Artificial Sequence
  Description of Artificial Sequence: Synthetic oligonucleotide
  Target: SCN9A; (-) strand; PAM type: YTN; PAM sequence: CTT
tcattaatcacgggattgtg

SEQ ID NO: 71069 - DNA, 20 bp, Artificial Sequence
  Description of Artificial Sequence: Synthetic oligonucleotide
  Target: SCN9A; (-) strand; PAM type: YTN; PAM sequence: CTA
actttcattaatcacgggat

SEQ ID NO: 71070 - DNA, 20 bp, Artificial Sequence
  Description of Artificial Sequence: Synthetic oligonucleotide
  Target: SCN9A; (-) strand; PAM type: YTN; PAM sequence: TTG
tatgctaactttcattaatc

SEQ ID NO: 71071 - DNA, 20 bp, Artificial Sequence
  Description of Artificial Sequence: Synthetic oligonucleotide
  Target: SCN9A; (-) strand; PAM type: YTN; PAM sequence: TTT
gtatgctaactttcattaat

SEQ ID NO: 71072 - DNA, 20 bp, Artificial Sequence
  Description of Artificial Sequence: Synthetic oligonucleotide
  Target: SCN9A; (-) strand; PAM type: YTN; PAM sequence: TTT
tgtatgctaactttcattaa

SEQ ID NO: 71073 - DNA, 20 bp, Artificial Sequence
  Description of Artificial Sequence: Synthetic oligonucleotide
  Target: SCN9A; (-) strand; PAM type: YTN; PAM sequence: TTG
ggattttgtatgctaacttt

SEQ ID NO: 71074 - DNA, 20 bp, Artificial Sequence
  Description of Artificial Sequence: Synthetic oligonucleotide
  Target: SCN9A; (-) strand; PAM type: YTN; PAM sequence: TTG
tagataggttgggattttgt

SEQ ID NO: 71075 - DNA, 20 bp, Artificial Sequence
  Description of Artificial Sequence: Synthetic oligonucleotide
  Target: SCN9A; (-) strand; PAM type: YTN; PAM sequence: TTA
aggaaagaagaaaagtcaga

SEQ ID NO: 71076 - DNA, 20 bp, Artificial Sequence
  Description of Artificial Sequence: Synthetic oligonucleotide
  Target: SCN9A; (-) strand; PAM type: YTN; PAM sequence: CTT
aaggaaagaagaaaagtcag

SEQ ID NO: 71077 - DNA, 20 bp, Artificial Sequence
  Description of Artificial Sequence: Synthetic oligonucleotide
  Target: SCN9A; (-) strand; PAM type: YTN; PAM sequence: CTG
aacaggaggtatatggaaag

SEQ ID NO: 71078 - DNA, 20 bp, Artificial Sequence
  Description of Artificial Sequence: Synthetic oligonucleotide
  Target: SCN9A; (-) strand; PAM type: YTN; PAM sequence: TTG
cagtacaggcagtgaacctg

SEQ ID NO: 71079 - DNA, 20 bp, Artificial Sequence
  Description of Artificial Sequence: Synthetic oligonucleotide
  Target: SCN9A; (-) strand; PAM type: YTN; PAM sequence: CTT
gcagtacaggcagtgaacct

SEQ ID NO: 71080 - DNA, 20 bp, Artificial Sequence
  Description of Artificial Sequence: Synthetic oligonucleotide
  Target: SCN9A; (-) strand; PAM type: YTN; PAM sequence: CTA
cttgcagtacaggcagtgaa

SEQ ID NO: 71081 - DNA, 20 bp, Artificial Sequence
  Description of Artificial Sequence: Synthetic oligonucleotide
  Target: SCN9A; (-) strand; PAM type: YTN; PAM sequence: TTG
aactacttgcagtacaggca

SEQ ID NO: 71082 - DNA, 20 bp, Artificial Sequence
  Description of Artificial Sequence: Synthetic oligonucleotide
  Target: SCN9A; (-) strand; PAM type: YTN; PAM sequence: TTT
gaactacttgcagtacaggc

SEQ ID NO: 71083 - DNA, 20 bp, Artificial Sequence
  Description of Artificial Sequence: Synthetic oligonucleotide
  Target: SCN9A; (-) strand; PAM type: YTN; PAM sequence: TTG
gtggcatcataaatttgaac

SEQ ID NO: 71084 - DNA, 20 bp, Artificial Sequence
  Description of Artificial Sequence: Synthetic oligonucleotide
  Target: SCN9A; (-) strand; PAM type: YTN; PAM sequence: TTT
ggtggcatcataaatttgaa

SEQ ID NO: 71085 - DNA, 20 bp, Artificial Sequence
  Description of Artificial Sequence: Synthetic oligonucleotide
  Target: SCN9A; (-) strand; PAM type: YTN; PAM sequence: TTA
atttggtggcatcataaatt

SEQ ID NO: 71086 - DNA, 20 bp, Artificial Sequence
  Description of Artificial Sequence: Synthetic oligonucleotide
  Target: SCN9A; (-) strand; PAM type: YTN; PAM sequence: TTT
aatttggtggcatcataaat

SEQ ID NO: 71087 - DNA, 20 bp, Artificial Sequence
  Description of Artificial Sequence: Synthetic oligonucleotide
  Target: SCN9A; (-) strand; PAM type: YTN; PAM sequence: TTG
aggaggtaggggaaatacag

SEQ ID NO: 71088 - DNA, 20 bp, Artificial Sequence
  Description of Artificial Sequence: Synthetic oligonucleotide
  Target: SCN9A; (-) strand; PAM type: YTN; PAM sequence: CTG
atggaggagaaaattgagga

SEQ ID NO: 71089 - DNA, 20 bp, Artificial Sequence
  Description of Artificial Sequence: Synthetic oligonucleotide
  Target: SCN9A; (-) strand; PAM type: YTN; PAM sequence: TTA
agaatacactgatggaggag

SEQ ID NO: 71090 - DNA, 20 bp, Artificial Sequence
  Description of Artificial Sequence: Synthetic oligonucleotide
  Target: SCN9A; (-) strand; PAM type: YTN; PAM sequence: TTG
atacaattaagaatacactg

SEQ ID NO: 71091 - DNA, 20 bp, Artificial Sequence
  Description of Artificial Sequence: Synthetic oligonucleotide
  Target: SCN9A; (-) strand; PAM type: YTN; PAM sequence: TTA
ttgatacaattaagaataca

SEQ ID NO: 71092 - DNA, 20 bp, Artificial Sequence
  Description of Artificial Sequence: Synthetic oligonucleotide
  Target: SCN9A; (-) strand; PAM type: YTN; PAM sequence: CTA
gatggttattgatacaatta

SEQ ID NO: 71093 - DNA, 20 bp, Artificial Sequence
  Description of Artificial Sequence: Synthetic oligonucleotide
  Target: SCN9A; (-) strand; PAM type: YTN; PAM sequence: TTA
gaagactagatggttattga

SEQ ID NO: 71094 - DNA, 20 bp, Artificial Sequence
  Description of Artificial Sequence: Synthetic oligonucleotide
  Target: SCN9A; (-) strand; PAM type: YTN; PAM sequence: CTT
agaagactagatggttattg

SEQ ID NO: 71095 - DNA, 20 bp, Artificial Sequence
  Description of Artificial Sequence: Synthetic oligonucleotide
  Target: SCN9A; (-) strand; PAM type: YTN; PAM sequence: TTG
acttagaagactagatggtt

SEQ ID NO: 71096 - DNA, 20 bp, Artificial Sequence
  Description of Artificial Sequence: Synthetic oligonucleotide
  Target: SCN9A; (-) strand; PAM type: YTN; PAM sequence: TTT
gacttagaagactagatggt

SEQ ID NO: 71097 - DNA, 20 bp, Artificial Sequence
  Description of Artificial Sequence: Synthetic oligonucleotide
  Target: SCN9A; (-) strand; PAM type: YTN; PAM sequence: TTT
tgacttagaagactagatgg

SEQ ID NO: 71098 - DNA, 20 bp, Artificial Sequence
  Description of Artificial Sequence: Synthetic oligonucleotide
  Target: SCN9A; (-) strand; PAM type: YTN; PAM sequence: TTC
aacccacaacaaagaatttt

SEQ ID NO: 71099 - DNA, 20 bp, Artificial Sequence
  Description of Artificial Sequence: Synthetic oligonucleotide
  Target: SCN9A; (-) strand; PAM type: YTN; PAM sequence: TTA
caattcaacccacaacaaag

SEQ ID NO: 71100 - DNA, 20 bp, Artificial Sequence
  Description of Artificial Sequence: Synthetic oligonucleotide
  Target: SCN9A; (-) strand; PAM type: YTN; PAM sequence: TTG
gaggattacaattcaaccca

SEQ ID NO: 71101 - DNA, 20 bp, Artificial Sequence
  Description of Artificial Sequence: Synthetic oligonucleotide
  Target: SCN9A; (-) strand; PAM type: YTN; PAM sequence: TTT
ggaggattacaattcaaccc

SEQ ID NO: 71102 - DNA, 20 bp, Artificial Sequence
  Description of Artificial Sequence: Synthetic oligonucleotide
  Target: SCN9A; (-) strand; PAM type: YTN; PAM sequence: TTT
tggaggattacaattcaacc

SEQ ID NO: 71103 - DNA, 20 bp, Artificial Sequence
  Description of Artificial Sequence: Synthetic oligonucleotide
  Target: SCN9A; (-) strand; PAM type: YTN; PAM sequence: CTT
ttggaggattacaattcaac

SEQ ID NO: 71104 - DNA, 20 bp, Artificial Sequence
  Description of Artificial Sequence: Synthetic oligonucleotide
  Target: SCN9A; (-) strand; PAM type: YTN; PAM sequence: TTC
aacataacttttggaggatt

SEQ ID NO: 71105 - DNA, 20 bp, Artificial Sequence
  Description of Artificial Sequence: Synthetic oligonucleotide
  Target: SCN9A; (-) strand; PAM type: YTN; PAM sequence: CTT
caacataacttttggaggat

SEQ ID NO: 71106 - DNA, 20 bp, Artificial Sequence
  Description of Artificial Sequence: Synthetic oligonucleotide
  Target: SCN9A; (-) strand; PAM type: YTN; PAM sequence: TTA
ggacttcaacataacttttg

SEQ ID NO: 71107 - DNA, 20 bp, Artificial Sequence
  Description of Artificial Sequence: Synthetic oligonucleotide
  Target: SCN9A; (-) strand; PAM type: YTN; PAM sequence: CTC
aaacatgccagggttaggac

SEQ ID NO: 71108 - DNA, 20 bp, Artificial Sequence
  Description of Artificial Sequence: Synthetic oligonucleotide
  Target: SCN9A; (-) strand; PAM type: YTN; PAM sequence: TTC
caaataagatcacactcaaa

SEQ ID NO: 71109 - DNA, 20 bp, Artificial Sequence
  Description of Artificial Sequence: Synthetic oligonucleotide
  Target: SCN9A; (-) strand; PAM type: YTN; PAM sequence: TTT
ccaaataagatcacactcaa

SEQ ID NO: 71110 - DNA, 20 bp, Artificial Sequence
  Description of Artificial Sequence: Synthetic oligonucleotide
  Target: SCN9A; (-) strand; PAM type: YTN; PAM sequence: CTG
caaagaccatatttccaaat

SEQ ID NO: 71111 - DNA, 20 bp, Artificial Sequence
  Description of Artificial Sequence: Synthetic oligonucleotide
  Target: SCN9A; (-) strand; PAM type: YTN; PAM sequence: TTG
tgtctgcaaagaccatattt

SEQ ID NO: 71112 - DNA, 20 bp, Artificial Sequence
  Description of Artificial Sequence: Synthetic oligonucleotide
  Target: SCN9A; (-) strand; PAM type: YTN; PAM sequence: TTC
attgtgtctgcaaagaccat

SEQ ID NO: 71113 - DNA, 20 bp, Artificial Sequence
  Description of Artificial Sequence: Synthetic oligonucleotide
  Target: SCN9A; (-) strand; PAM type: YTN; PAM sequence: CTT
cattgtgtctgcaaagacca

SEQ ID NO: 71114 - DNA, 20 bp, Artificial Sequence
  Description of Artificial Sequence: Synthetic oligonucleotide
  Target: SCN9A; (-) strand; PAM type: YTN; PAM sequence: CTC
atcttcattgtgtctgcaaa

SEQ ID NO: 71115 - DNA, 20 bp, Artificial Sequence
  Description of Artificial Sequence: Synthetic oligonucleotide
  Target: SCN9A; (-) strand; PAM type: YTN; PAM sequence: TTG
gacccacacaatgacctcat

SEQ ID NO: 71116 - DNA, 20 bp, Artificial Sequence
  Description of Artificial Sequence: Synthetic oligonucleotide
  Target: SCN9A; (-) strand; PAM type: YTN; PAM sequence: TTT
ggacccacacaatgacctca

SEQ ID NO: 71117 - DNA, 20 bp, Artificial Sequence
  Description of Artificial Sequence: Synthetic oligonucleotide
  Target: SCN9A; (-) strand; PAM type: YTN; PAM sequence: TTG
gatttggacccacacaatga

SEQ ID NO: 71118 - DNA, 20 bp, Artificial Sequence
  Description of Artificial Sequence: Synthetic oligonucleotide
  Target: SCN9A; (-) strand; PAM type: YTN; PAM sequence: TTA
tattggatttggacccacac

SEQ ID NO: 71119 - DNA, 20 bp, Artificial Sequence
  Description of Artificial Sequence: Synthetic oligonucleotide
  Target: SCN9A; (-) strand; PAM type: YTN; PAM sequence: TTA
taaggaccccagttatattg

SEQ ID NO: 71120 - DNA, 20 bp, Artificial Sequence
  Description of Artificial Sequence: Synthetic oligonucleotide
  Target: SCN9A; (-) strand; PAM type: YTN; PAM sequence: CTT
ataaggaccccagttatatt

SEQ ID NO: 71121 - DNA, 20 bp, Artificial Sequence
  Description of Artificial Sequence: Synthetic oligonucleotide
  Target: SCN9A; (-) strand; PAM type: YTN; PAM sequence: TTC
ttataaggaccccagttata

SEQ ID NO: 71122 - DNA, 20 bp, Artificial Sequence
  Description of Artificial Sequence: Synthetic oligonucleotide
  Target: SCN9A; (-) strand; PAM type: YTN; PAM sequence: CTT
cttataaggaccccagttat

SEQ ID NO: 71123 - DNA, 20 bp, Artificial Sequence
  Description of Artificial Sequence: Synthetic oligonucleotide
  Target: SCN9A; (-) strand; PAM type: YTN; PAM sequence: TTC
ttcttataaggaccccagtt

SEQ ID NO: 71124 - DNA, 20 bp, Artificial Sequence
  Description of Artificial Sequence: Synthetic oligonucleotide
  Target: SCN9A; (-) strand; PAM type: YTN; PAM sequence: TTT
cttcttataaggaccccagt

SEQ ID NO: 71125 - DNA, 20 bp, Artificial Sequence
  Description of Artificial Sequence: Synthetic oligonucleotide
  Target: SCN9A; (-) strand; PAM type: YTN; PAM sequence: TTT
tcttcttataaggaccccag

SEQ ID NO: 71126 - DNA, 20 bp, Artificial Sequence
  Description of Artificial Sequence: Synthetic oligonucleotide
  Target: SCN9A; (-) strand; PAM type: YTN; PAM sequence: CTT
ttcttcttataaggacccca

SEQ ID NO: 71127 - DNA, 20 bp, Artificial Sequence
  Description of Artificial Sequence: Synthetic oligonucleotide
  Target: SCN9A; (-) strand; PAM type: YTN; PAM sequence: CTC
ggtcttttcttcttataagg

SEQ ID NO: 71128 - DNA, 20 bp, Artificial Sequence
  Description of Artificial Sequence: Synthetic oligonucleotide
  Target: SCN9A; (-) strand; PAM type: YTN; PAM sequence: CTG
tgtgtctcggtcttttcttc

SEQ ID NO: 71129 - DNA, 20 bp, Artificial Sequence
  Description of Artificial Sequence: Synthetic oligonucleotide
  Target: SCN9A; (-) strand; PAM type: YTN; PAM sequence: CTC
cctgtgtgtctcggtctttt

SEQ ID NO: 71130 - DNA, 20 bp, Artificial Sequence
  Description of Artificial Sequence: Synthetic oligonucleotide
  Target: SCN9A; (-) strand; PAM type: YTN; PAM sequence: TTC
tccctgtgtgtctcggtctt

SEQ ID NO: 71131 - DNA, 20 bp, Artificial Sequence
  Description of Artificial Sequence: Synthetic oligonucleotide
  Target: SCN9A; (-) strand; PAM type: YTN; PAM sequence: TTT
ctccctgtgtgtctcggtct

SEQ ID NO: 71132 - DNA, 20 bp, Artificial Sequence
  Description of Artificial Sequence: Synthetic oligonucleotide
  Target: SCN9A; (-) strand; PAM type: YTN; PAM sequence: TTT
tctccctgtgtgtctcggtc

SEQ ID NO: 71133 - DNA, 20 bp, Artificial Sequence
  Description of Artificial Sequence: Synthetic oligonucleotide
  Target: SCN9A; (-) strand; PAM type: YTN; PAM sequence: CTC
acgtagttttctccctgtgt

SEQ ID NO: 71134 - DNA, 20 bp, Artificial Sequence
  Description of Artificial Sequence: Synthetic oligonucleotide
  Target: SCN9A; (-) strand; PAM type: YTN; PAM sequence: CTG
gcccggtactcacgtagttt

SEQ ID NO: 71135 - DNA, 20 bp, Artificial Sequence
  Description of Artificial Sequence: Synthetic oligonucleotide
  Target: SCN9A; (-) strand; PAM type: YTN; PAM sequence: CTC
tggcccggtactcacgtagt

SEQ ID NO: 71136 - DNA, 20 bp, Artificial Sequence
  Description of Artificial Sequence: Synthetic oligonucleotide
  Target: SCN9A; (-) strand; PAM type: YTN; PAM sequence: CTG
catcatcccaatctctggcc

SEQ ID NO: 71137 - DNA, 20 bp, Artificial Sequence
  Description of Artificial Sequence: Synthetic oligonucleotide
  Target: SCN9A; (-) strand; PAM type: YTN; PAM sequence: TTG
cagctgcatcatcccaatct

SEQ ID NO: 71138 - DNA, 20 bp, Artificial Sequence
  Description of Artificial Sequence: Synthetic oligonucleotide
  Target: SCN9A; (-) strand; PAM type: YTN; PAM sequence: CTT
gcagctgcatcatcccaatc

SEQ ID NO: 71139 - DNA, 20 bp, Artificial Sequence
  Description of Artificial Sequence: Synthetic oligonucleotide
  Target: SCN9A; (-) strand; PAM type: YTN; PAM sequence: TTG
cagcttgcagctgcatcatc

SEQ ID NO: 71140 - DNA, 20 bp, Artificial Sequence
  Description of Artificial Sequence: Synthetic oligonucleotide
  Target: SCN9A; (-) strand; PAM type: YTN; PAM sequence: CTT
gcagcttgcagctgcatcat

SEQ ID NO: 71141 - DNA, 20 bp, Artificial Sequence
  Description of Artificial Sequence: Synthetic oligonucleotide
  Target: SCN9A; (-) strand; PAM type: YTN; PAM sequence: TTG
gcaatccttgcagcttgcag

SEQ ID NO: 71142 - DNA, 20 bp, Artificial Sequence
  Description of Artificial Sequence: Synthetic oligonucleotide
  Target: SCN9A; (-) strand; PAM type: YTN; PAM sequence: TTG
ttggcaatccttgcagcttg

SEQ ID NO: 71143 - DNA, 20 bp, Artificial Sequence
  Description of Artificial Sequence: Synthetic oligonucleotide
  Target: SCN9A; (-) strand; PAM type: YTN; PAM sequence: TTG
gaggttgttggcaatccttg

SEQ ID NO: 71144 - DNA, 20 bp, Artificial Sequence
  Description of Artificial Sequence: Synthetic oligonucleotide
  Target: SCN9A; (-) strand; PAM type: YTN; PAM sequence: TTT
ggaggttgttggcaatcctt

SEQ ID NO: 71145 - DNA, 20 bp, Artificial Sequence
  Description of Artificial Sequence: Synthetic oligonucleotide
  Target: SCN9A; (-) strand; PAM type: YTN; PAM sequence: CTT
tggaggttgttggcaatcct

SEQ ID NO: 71146 - DNA, 20 bp, Artificial Sequence
  Description of Artificial Sequence: Synthetic oligonucleotide
  Target: SCN9A; (-) strand; PAM type: YTN; PAM sequence: CTA
actttggaggttgttggcaa

SEQ ID NO: 71147 - DNA, 20 bp, Artificial Sequence
  Description of Artificial Sequence: Synthetic oligonucleotide
  Target: SCN9A; (-) strand; PAM type: YTN; PAM sequence: TTC
taactttggaggttgttggc

SEQ ID NO: 71148 - DNA, 20 bp, Artificial Sequence
  Description of Artificial Sequence: Synthetic oligonucleotide
  Target: SCN9A; (-) strand; PAM type: YTN; PAM sequence: TTT
ctaactttggaggttgttgg

SEQ ID NO: 71149 - DNA, 20 bp, Artificial Sequence
  Description of Artificial Sequence: Synthetic oligonucleotide
  Target: SCN9A; (-) strand; PAM type: YTN; PAM sequence: CTT
tctaactttggaggttgttg

SEQ ID NO: 71150 - DNA, 20 bp, Artificial Sequence
  Description of Artificial Sequence: Synthetic oligonucleotide
  Target: SCN9A; (-) strand; PAM type: YTN; PAM sequence: CTG
ctttctaactttggaggttg

SEQ ID NO: 71151 - DNA, 20 bp, Artificial Sequence
  Description of Artificial Sequence: Synthetic oligonucleotide
  Target: SCN9A; (-) strand; PAM type: YTN; PAM sequence: TTG
ctgctttctaactttggagg

SEQ ID NO: 71152 - DNA, 20 bp, Artificial Sequence
  Description of Artificial Sequence: Synthetic oligonucleotide
  Target: SCN9A; (-) strand; PAM type: YTN; PAM sequence: CTT
gctgctttctaactttggag

SEQ ID NO: 71153 - DNA, 20 bp, Artificial Sequence
  Description of Artificial Sequence: Synthetic oligonucleotide
  Target: SCN9A; (-) strand; PAM type: YTN; PAM sequence: CTG
ccttgctgctttctaacttt

SEQ ID NO: 71154 - DNA, 20 bp, Artificial Sequence
  Description of Artificial Sequence: Synthetic oligonucleotide
  Target: SCN9A; (-) strand; PAM type: YTN; PAM sequence: CTA
gtaagtatcctgccttgctg

SEQ ID NO: 71155 - DNA, 20 bp, Artificial Sequence
  Description of Artificial Sequence: Synthetic oligonucleotide
  Target: SCN9A; (-) strand; PAM type: YTN; PAM sequence: CTC
tagtaagtatcctgccttgc

SEQ ID NO: 71156 - DNA, 20 bp, Artificial Sequence
  Description of Artificial Sequence: Synthetic oligonucleotide
  Target: SCN9A; (-) strand; PAM type: YTN; PAM sequence: CTA
aaggctctagtaagtatcct

SEQ ID NO: 71157 - DNA, 20 bp, Artificial Sequence
  Description of Artificial Sequence: Synthetic oligonucleotide
  Target: SCN9A; (-) strand; PAM type: YTN; PAM sequence: CTC
taaaggctctagtaagtatc

SEQ ID NO: 71158 - DNA, 20 bp, Artificial Sequence
  Description of Artificial Sequence: Synthetic oligonucleotide
  Target: SCN9A; (-) strand; PAM type: YTN; PAM sequence: TTC
tctaaaggctctagtaagta

SEQ ID NO: 71159 - DNA, 20 bp, Artificial Sequence
  Description of Artificial Sequence: Synthetic oligonucleotide
  Target: SCN9A; (-) strand; PAM type: YTN; PAM sequence: TTT
ctctaaaggctctagtaagt

SEQ ID NO: 71160 - DNA, 20 bp, Artificial Sequence
  Description of Artificial Sequence: Synthetic oligonucleotide
  Target: SCN9A; (-) strand; PAM type: YTN; PAM sequence: CTG
agcaaggccatgatttctct

SEQ ID NO: 71161 - DNA, 20 bp, Artificial Sequence
  Description of Artificial Sequence: Synthetic oligonucleotide
  Target: SCN9A; (-) strand; PAM type: YTN; PAM sequence: CTG
aaatcaaggtctgagcaagg

SEQ ID NO: 71162 - DNA, 20 bp, Artificial Sequence
  Description of Artificial Sequence: Synthetic oligonucleotide
  Target: SCN9A; (-) strand; PAM type: YTN; PAM sequence: CTA
gaagtctgaaatcaaggtct

SEQ ID NO: 71163 - DNA, 20 bp, Artificial Sequence
  Description of Artificial Sequence: Synthetic oligonucleotide
  Target: SCN9A; (-) strand; PAM type: YTN; PAM sequence: CTG
gaggctagaagtctgaaatc

SEQ ID NO: 71164 - DNA, 20 bp, Artificial Sequence
  Description of Artificial Sequence: Synthetic oligonucleotide
  Target: SCN9A; (-) strand; PAM type: YTN; PAM sequence: TTC
tggaggctagaagtctgaaa

SEQ ID NO: 71165 - DNA, 20 bp, Artificial Sequence
  Description of Artificial Sequence: Synthetic oligonucleotide
  Target: SCN9A; (-) strand; PAM type: YTN; PAM sequence: TTG
ccagttctggaggctagaag

SEQ ID NO: 71166 - DNA, 20 bp, Artificial Sequence
  Description of Artificial Sequence: Synthetic oligonucleotide
  Target: SCN9A; (-) strand; PAM type: YTN; PAM sequence: TTT
gccagttctggaggctagaa

SEQ ID NO: 71167 - DNA, 20 bp, Artificial Sequence
  Description of Artificial Sequence: Synthetic oligonucleotide
  Target: SCN9A; (-) strand; PAM type: YTN; PAM sequence: TTT
tgccagttctggaggctaga

SEQ ID NO: 71168 - DNA, 20 bp, Artificial Sequence
  Description of Artificial Sequence: Synthetic oligonucleotide
  Target: SCN9A; (-) strand; PAM type: YTN; PAM sequence: CTT
ttgccagttctggaggctag

SEQ ID NO: 71169 - DNA, 20 bp, Artificial Sequence
  Description of Artificial Sequence: Synthetic oligonucleotide
  Target: SCN9A; (-) strand; PAM type: YTN; PAM sequence: TTC
ttttgccagttctggaggct

SEQ ID NO: 71170 - DNA, 20 bp, Artificial Sequence
  Description of Artificial Sequence: Synthetic oligonucleotide
  Target: SCN9A; (-) strand; PAM type: YTN; PAM sequence: TTA
ttcttttgccagttctggag

SEQ ID NO: 71171 - DNA, 20 bp, Artificial Sequence
  Description of Artificial Sequence: Synthetic oligonucleotide
  Target: SCN9A; (-) strand; PAM type: YTN; PAM sequence: TTT
attcttttgccagttctgga

SEQ ID NO: 71172 - DNA, 20 bp, Artificial Sequence
  Description of Artificial Sequence: Synthetic oligonucleotide
  Target: SCN9A; (-) strand; PAM type: YTN; PAM sequence: TTA
caacaacagaaatttattct

SEQ ID NO: 71173 - DNA, 20 bp, Artificial Sequence
  Description of Artificial Sequence: Synthetic oligonucleotide
  Target: SCN9A; (-) strand; PAM type: YTN; PAM sequence: CTT
acaacaacagaaatttattc

SEQ ID NO: 71174 - DNA, 20 bp, Artificial Sequence
  Description of Artificial Sequence: Synthetic oligonucleotide
  Target: SCN9A; (-) strand; PAM type: YTN; PAM sequence: CTC
agtggcttacaacaacagaa

SEQ ID NO: 71175 - DNA, 20 bp, Artificial Sequence
  Description of Artificial Sequence: Synthetic oligonucleotide
  Target: SCN9A; (-) strand; PAM type: YTN; PAM sequence: TTA
gcaaaactcagtggcttaca

SEQ ID NO: 71176 - DNA, 20 bp, Artificial Sequence
  Description of Artificial Sequence: Synthetic oligonucleotide
  Target: SCN9A; (-) strand; PAM type: YTN; PAM sequence: TTG
taacaaattagcaaaactca

SEQ ID NO: 71177 - DNA, 20 bp, Artificial Sequence
  Description of Artificial Sequence: Synthetic oligonucleotide
  Target: SCN9A; (-) strand; PAM type: YTN; PAM sequence: CTG
ttgtaacaaattagcaaaac

SEQ ID NO: 71178 - DNA, 20 bp, Artificial Sequence
  Description of Artificial Sequence: Synthetic oligonucleotide
  Target: SCN9A; (-) strand; PAM type: YTN; PAM sequence: TTA
cggctgttgtaacaaattag

SEQ ID NO: 71179 - DNA, 20 bp, Artificial Sequence
  Description of Artificial Sequence: Synthetic oligonucleotide
  Target: SCN9A; (-) strand; PAM type: YTN; PAM sequence: CTT
acggctgttgtaacaaatta

SEQ ID NO: 71180 - DNA, 20 bp, Artificial Sequence
  Description of Artificial Sequence: Synthetic oligonucleotide
  Target: SCN9A; (-) strand; PAM type: YTN; PAM sequence: TTC
ttacggctgttgtaacaaat

SEQ ID NO: 71181 - DNA, 20 bp, Artificial Sequence
  Description of Artificial Sequence: Synthetic oligonucleotide
  Target: SCN9A; (-) strand; PAM type: YTN; PAM sequence: TTT
cttacggctgttgtaacaaa

SEQ ID NO: 71182 - DNA, 20 bp, Artificial Sequence
  Description of Artificial Sequence: Synthetic oligonucleotide
  Target: SCN9A; (-) strand; PAM type: YTN; PAM sequence: TTA
gtttcttacggctgttgtaa

SEQ ID NO: 71183 - DNA, 20 bp, Artificial Sequence
  Description of Artificial Sequence: Synthetic oligonucleotide
  Target: SCN9A; (-) strand; PAM type: YTN; PAM sequence: CTG
atccaaggatgtattagttt

SEQ ID NO: 71184 - DNA, 20 bp, Artificial Sequence
  Description of Artificial Sequence: Synthetic oligonucleotide
  Target: SCN9A; (-) strand; PAM type: YTN; PAM sequence: TTG
tgagctgatccaaggatgta

SEQ ID NO: 71185 - DNA, 20 bp, Artificial Sequence
  Description of Artificial Sequence: Synthetic oligonucleotide
  Target: SCN9A; (-) strand; PAM type: YTN; PAM sequence: CTA
gatatataagattgtgagct

SEQ ID NO: 71186 - DNA, 20 bp, Artificial Sequence
  Description of Artificial Sequence: Synthetic oligonucleotide
  Target: SCN9A; (-) strand; PAM type: YTN; PAM sequence: CTC
agggtctagatatataagat

SEQ ID NO: 71187 - DNA, 20 bp, Artificial Sequence
  Description of Artificial Sequence: Synthetic oligonucleotide
  Target: SCN9A; (-) strand; PAM type: YTN; PAM sequence: TTA
aaatataagggctcagggtc

SEQ ID NO: 71188 - DNA, 20 bp, Artificial Sequence
  Description of Artificial Sequence: Synthetic oligonucleotide
  Target: SCN9A; (-) strand; PAM type: YTN; PAM sequence: TTG
aaagttaaaatataagggct

SEQ ID NO: 71189 - DNA, 20 bp, Artificial Sequence
  Description of Artificial Sequence: Synthetic oligonucleotide
  Target: SCN9A; (-) strand; PAM type: YTN; PAM sequence: CTT
gaaagttaaaatataagggc

SEQ ID NO: 71190 - DNA, 20 bp, Artificial Sequence
  Description of Artificial Sequence: Synthetic oligonucleotide
  Target: SCN9A; (-) strand; PAM type: YTN; PAM sequence: TTA
acttgaaagttaaaatataa

SEQ ID NO: 71191 - DNA, 20 bp, Artificial Sequence
  Description of Artificial Sequence: Synthetic oligonucleotide
  Target: SCN9A; (-) strand; PAM type: YTN; PAM sequence: TTA
atatcgggattaacttgaaa

SEQ ID NO: 71192 - DNA, 20 bp, Artificial Sequence
  Description of Artificial Sequence: Synthetic oligonucleotide
  Target: SCN9A; (-) strand; PAM type: YTN; PAM sequence: TTT
aatatcgggattaacttgaa

SEQ ID NO: 71193 - DNA, 20 bp, Artificial Sequence
  Description of Artificial Sequence: Synthetic oligonucleotide
  Target: SCN9A; (-) strand; PAM type: YTN; PAM sequence: CTG
caacaatttaatatcgggat

SEQ ID NO: 71194 - DNA, 20 bp, Artificial Sequence
  Description of Artificial Sequence: Synthetic oligonucleotide
  Target: SCN9A; (-) strand; PAM type: YTN; PAM sequence: CTC
acacagctgcaacaatttaa

SEQ ID NO: 71195 - DNA, 20 bp, Artificial Sequence
  Description of Artificial Sequence: Synthetic oligonucleotide
  Target: SCN9A; (-) strand; PAM type: YTN; PAM sequence: TTC
tcacacagctgcaacaattt

SEQ ID NO: 71196 - DNA, 20 bp, Artificial Sequence
  Description of Artificial Sequence: Synthetic oligonucleotide
  Target: SCN9A; (-) strand; PAM type: YTN; PAM sequence: CTG
agggaaaaaagatcatgttc

SEQ ID NO: 71197 - DNA, 20 bp, Artificial Sequence
  Description of Artificial Sequence: Synthetic oligonucleotide
  Target: SCN9A; (-) strand; PAM type: YTN; PAM sequence: TTG
ctgagggaaaaaagatcatg

SEQ ID NO: 71198 - DNA, 20 bp, Artificial Sequence
  Description of Artificial Sequence: Synthetic oligonucleotide
  Target: SCN9A; (-) strand; PAM type: YTN; PAM sequence: CTA
agaattgctgagggaaaaaa

SEQ ID NO: 71199 - DNA, 20 bp, Artificial Sequence
  Description of Artificial Sequence: Synthetic oligonucleotide
  Target: SCN9A; (-) strand; PAM type: YTN; PAM sequence: CTG
tgctaagaattgctgaggga

SEQ ID NO: 71200 - DNA, 20 bp, Artificial Sequence
  Description of Artificial Sequence: Synthetic oligonucleotide
  Target: SCN9A; (-) strand; PAM type: YTN; PAM sequence: CTA
agcactgtgctaagaattgc

SEQ ID NO: 71201 - DNA, 20 bp, Artificial Sequence
  Description of Artificial Sequence: Synthetic oligonucleotide
  Target: SCN9A; (-) strand; PAM type: YTN; PAM sequence: CTC
taagcactgtgctaagaatt

SEQ ID NO: 71202 - DNA, 20 bp, Artificial Sequence
  Description of Artificial Sequence: Synthetic oligonucleotide
  Target: SCN9A; (-) strand; PAM type: YTN; PAM sequence: CTA
tgctctaagcactgtgctaa

SEQ ID NO: 71203 - DNA, 20 bp, Artificial Sequence
  Description of Artificial Sequence: Synthetic oligonucleotide
  Target: SCN9A; (-) strand; PAM type: YTN; PAM sequence: TTA
ctatgctctaagcactgtgc

SEQ ID NO: 71204 - DNA, 20 bp, Artificial Sequence
  Description of Artificial Sequence: Synthetic oligonucleotide
  Target: SCN9A; (-) strand; PAM type: YTN; PAM sequence: CTT
actatgctctaagcactgtg

SEQ ID NO: 71205 - DNA, 20 bp, Artificial Sequence
  Description of Artificial Sequence: Synthetic oligonucleotide
  Target: SCN9A; (-) strand; PAM type: YTN; PAM sequence: TTA
caccttactatgctctaagc

SEQ ID NO: 71206 - DNA, 20 bp, Artificial Sequence
  Description of Artificial Sequence: Synthetic oligonucleotide
  Target: SCN9A; (-) strand; PAM type: YTN; PAM sequence: TTA
ttacaccttactatgctcta

SEQ ID NO: 71207 - DNA, 20 bp, Artificial Sequence
  Description of Artificial Sequence: Synthetic oligonucleotide
  Target: SCN9A; (-) strand; PAM type: YTN; PAM sequence: TTT
attacaccttactatgctct

SEQ ID NO: 71208 - DNA, 20 bp, Artificial Sequence
  Description of Artificial Sequence: Synthetic oligonucleotide
  Target: SCN9A; (-) strand; PAM type: YTN; PAM sequence: TTG
tcaataaatatttattacac

SEQ ID NO: 71209 - DNA, 20 bp, Artificial Sequence
  Description of Artificial Sequence: Synthetic oligonucleotide
  Target: SCN9A; (-) strand; PAM type: YTN; PAM sequence: TTT
gtcaataaatatttattaca

SEQ ID NO: 71210 - DNA, 20 bp, Artificial Sequence
  Description of Artificial Sequence: Synthetic oligonucleotide
  Target: SCN9A; (-) strand; PAM type: YTN; PAM sequence: TTA
aaggaagtatgaaatgcacc

SEQ ID NO: 71211 - DNA, 20 bp, Artificial Sequence
  Description of Artificial Sequence: Synthetic oligonucleotide
  Target: SCN9A; (-) strand; PAM type: YTN; PAM sequence: CTT
aaaggaagtatgaaatgcac

SEQ ID NO: 71212 - DNA, 20 bp, Artificial Sequence
  Description of Artificial Sequence: Synthetic oligonucleotide
  Target: SCN9A; (-) strand; PAM type: YTN; PAM sequence: TTA
gaagccttaaaggaagtatg

SEQ ID NO: 71213 - DNA, 20 bp, Artificial Sequence
  Description of Artificial Sequence: Synthetic oligonucleotide
  Target: SCN9A; (-) strand; PAM type: YTN; PAM sequence: CTC
attagaagccttaaaggaag

SEQ ID NO: 71214 - DNA, 20 bp, Artificial Sequence
  Description of Artificial Sequence: Synthetic oligonucleotide
  Target: SCN9A; (-) strand; PAM type: YTN; PAM sequence: TTC
ctcattagaagccttaaagg

SEQ ID NO: 71215 - DNA, 20 bp, Artificial Sequence
  Description of Artificial Sequence: Synthetic oligonucleotide
  Target: SCN9A; (-) strand; PAM type: YTN; PAM sequence: CTT
cctcattagaagccttaaag

SEQ ID NO: 71216 - DNA, 20 bp, Artificial Sequence
  Description of Artificial Sequence: Synthetic oligonucleotide
  Target: SCN9A; (-) strand; PAM type: YTN; PAM sequence: CTG
gcagtgaagtgcttcctcat

SEQ ID NO: 71217 - DNA, 20 bp, Artificial Sequence
  Description of Artificial Sequence: Synthetic oligonucleotide
  Target: SCN9A; (-) strand; PAM type: YTN; PAM sequence: TTA
ccactggcagtgaagtgctt

SEQ ID NO: 71218 - DNA, 20 bp, Artificial Sequence
  Description of Artificial Sequence: Synthetic oligonucleotide
  Target: SCN9A; (-) strand; PAM type: YTN; PAM sequence: TTT
accactggcagtgaagtgct

SEQ ID NO: 71219 - DNA, 20 bp, Artificial Sequence
  Description of Artificial Sequence: Synthetic oligonucleotide
  Target: SCN9A; (-) strand; PAM type: YTN; PAM sequence: TTT
taccactggcagtgaagtgc

SEQ ID NO: 71220 - DNA, 20 bp, Artificial Sequence
  Description of Artificial Sequence: Synthetic oligonucleotide
  Target: SCN9A; (-) strand; PAM type: YTN; PAM sequence: TTT
ttaccactggcagtgaagtg

SEQ ID NO: 71221 - DNA, 20 bp, Artificial Sequence
  Description of Artificial Sequence: Synthetic oligonucleotide
  Target: SCN9A; (-) strand; PAM type: YTN; PAM sequence: TTT
tttaccactggcagtgaagt

SEQ ID NO: 71222 - DNA, 20 bp, Artificial Sequence
  Description of Artificial Sequence: Synthetic oligonucleotide
  Target: SCN9A; (-) strand; PAM type: YTN; PAM sequence: CTT
ttttaccactggcagtgaag

SEQ ID NO: 71223 - DNA, 20 bp, Artificial Sequence
  Description of Artificial Sequence: Synthetic oligonucleotide
  Target: SCN9A; (-) strand; PAM type: YTN; PAM sequence: CTA
cacaggcttttttaccactg

SEQ ID NO: 71224 - DNA, 20 bp, Artificial Sequence
  Description of Artificial Sequence: Synthetic oligonucleotide
  Target: SCN9A; (-) strand; PAM type: YTN; PAM sequence: TTA
acaacacactacacaggctt

SEQ ID NO: 71225 - DNA, 20 bp, Artificial Sequence
  Description of Artificial Sequence: Synthetic oligonucleotide
  Target: SCN9A; (-) strand; PAM type: YTN; PAM sequence: CTC
caaacattaacaacacacta

SEQ ID NO: 71226 - DNA, 20 bp, Artificial Sequence
  Description of Artificial Sequence: Synthetic oligonucleotide
  Target: SCN9A; (-) strand; PAM type: YTN; PAM sequence: CTC
caagcacactccaaacatta

SEQ ID NO: 71227 - DNA, 20 bp, Artificial Sequence
  Description of Artificial Sequence: Synthetic oligonucleotide
  Target: SCN9A; (-) strand; PAM type: YTN; PAM sequence: CTG
aagtgcaatgaagccctcca

SEQ ID NO: 71228 - DNA, 20 bp, Artificial Sequence
  Description of Artificial Sequence: Synthetic oligonucleotide
  Target: SCN9A; (-) strand; PAM type: YTN; PAM sequence: CTC
ctgaagtgcaatgaagccct

SEQ ID NO: 71229 - DNA, 20 bp, Artificial Sequence
  Description of Artificial Sequence: Synthetic oligonucleotide
  Target: SCN9A; (-) strand; PAM type: YTN; PAM sequence: TTC
tcctgaagtgcaatgaagcc

SEQ ID NO: 71230 - DNA, 20 bp, Artificial Sequence
  Description of Artificial Sequence: Synthetic oligonucleotide
  Target: SCN9A; (-) strand; PAM type: YTN; PAM sequence: CTT
ctcctgaagtgcaatgaagc

SEQ ID NO: 71231 - DNA, 20 bp, Artificial Sequence
  Description of Artificial Sequence: Synthetic oligonucleotide
  Target: SCN9A; (-) strand; PAM type: YTN; PAM sequence: CTC
agagtcagccttctcctgaa

SEQ ID NO: 71232 - DNA, 20 bp, Artificial Sequence
  Description of Artificial Sequence: Synthetic oligonucleotide
  Target: SCN9A; (-) strand; PAM type: YTN; PAM sequence: TTC
tcagagtcagccttctcctg

SEQ ID NO: 71233 - DNA, 20 bp, Artificial Sequence
  Description of Artificial Sequence: Synthetic oligonucleotide
  Target: SCN9A; (-) strand; PAM type: YTN; PAM sequence: CTT
ctcagagtcagccttctcct

SEQ ID NO: 71234 - DNA, 20 bp, Artificial Sequence
  Description of Artificial Sequence: Synthetic oligonucleotide
  Target: SCN9A; (-) strand; PAM type: YTN; PAM sequence: CTC
ttctcagagtcagccttctc

SEQ ID NO: 71235 - DNA, 20 bp, Artificial Sequence
  Description of Artificial Sequence: Synthetic oligonucleotide
  Target: SCN9A; (-) strand; PAM type: YTN; PAM sequence: CTG
atggctcttctcagagtcag

SEQ ID NO: 71236 - DNA, 20 bp, Artificial Sequence
  Description of Artificial Sequence: Synthetic oligonucleotide
  Target: SCN9A; (-) strand; PAM type: YTN; PAM sequence: CTG
aactgatggctcttctcaga

SEQ ID NO: 71237 - DNA, 20 bp, Artificial Sequence
  Description of Artificial Sequence: Synthetic oligonucleotide
  Target: SCN9A; (-) strand; PAM type: YTN; PAM sequence: CTA
agaatgcaggcactgaactg

SEQ ID NO: 71238 - DNA, 20 bp, Artificial Sequence
  Description of Artificial Sequence: Synthetic oligonucleotide
  Target: SCN9A; (-) strand; PAM type: YTN; PAM sequence: TTC
taagaatgcaggcactgaac

SEQ ID NO: 71239 - DNA, 20 bp, Artificial Sequence
  Description of Artificial Sequence: Synthetic oligonucleotide
  Target: SCN9A; (-) strand; PAM type: YTN; PAM sequence: TTT
ctaagaatgcaggcactgaa

SEQ ID NO: 71240 - DNA, 20 bp, Artificial Sequence
  Description of Artificial Sequence: Synthetic oligonucleotide
  Target: SCN9A; (-) strand; PAM type: YTN; PAM sequence: CTG
tttctaagaatgcaggcact

SEQ ID NO: 71241 - DNA, 20 bp, Artificial Sequence
  Description of Artificial Sequence: Synthetic oligonucleotide
  Target: SCN9A; (-) strand; PAM type: YTN; PAM sequence: TTC
actgtttctaagaatgcagg

SEQ ID NO: 71242 - DNA, 20 bp, Artificial Sequence
  Description of Artificial Sequence: Synthetic oligonucleotide
  Target: SCN9A; (-) strand; PAM type: YTN; PAM sequence: TTT
cactgtttctaagaatgcag

SEQ ID NO: 71243 - DNA, 20 bp, Artificial Sequence
  Description of Artificial Sequence: Synthetic oligonucleotide
  Target: SCN9A; (-) strand; PAM type: YTN; PAM sequence: TTT
tcactgtttctaagaatgca

SEQ ID NO: 71244 - DNA, 20 bp, Artificial Sequence
  Description of Artificial Sequence: Synthetic oligonucleotide
  Target: SCN9A; (-) strand; PAM type: YTN; PAM sequence: CTT
ttcactgtttctaagaatgc

SEQ ID NO: 71245 - DNA, 20 bp, Artificial Sequence
  Description of Artificial Sequence: Synthetic oligonucleotide
  Target: SCN9A; (-) strand; PAM type: YTN; PAM sequence: CTC
ttttcactgtttctaagaat

SEQ ID NO: 71246 - DNA, 20 bp, Artificial Sequence
  Description of Artificial Sequence: Synthetic oligonucleotide
  Target: SCN9A; (-) strand; PAM type: YTN; PAM sequence: CTC
aaaggtacccatgagaataa

SEQ ID NO: 71247 - DNA, 20 bp, Artificial Sequence
  Description of Artificial Sequence: Synthetic oligonucleotide
  Target: SCN9A; (-) strand; PAM type: YTN; PAM sequence: TTA
tctcaaaggtacccatgaga

SEQ ID NO: 71248 - DNA, 20 bp, Artificial Sequence
  Description of Artificial Sequence: Synthetic oligonucleotide
  Target: SCN9A; (-) strand; PAM type: YTN; PAM sequence: CTG
ttatctcaaaggtacccatg

SEQ ID NO: 71249 - DNA, 20 bp, Artificial Sequence
  Description of Artificial Sequence: Synthetic oligonucleotide
  Target: SCN9A; (-) strand; PAM type: YTN; PAM sequence: CTG
aagagatagtcagtgtcaga

SEQ ID NO: 71250 - DNA, 20 bp, Artificial Sequence
  Description of Artificial Sequence: Synthetic oligonucleotide
  Target: SCN9A; (-) strand; PAM type: YTN; PAM sequence: CTC
tgaagagatagtcagtgtca

SEQ ID NO: 71251 - DNA, 20 bp, Artificial Sequence
  Description of Artificial Sequence: Synthetic oligonucleotide
  Target: SCN9A; (-) strand; PAM type: YTN; PAM sequence: TTC
tctgaagagatagtcagtgt

SEQ ID NO: 71252 - DNA, 20 bp, Artificial Sequence
  Description of Artificial Sequence: Synthetic oligonucleotide
  Target: SCN9A; (-) strand; PAM type: YTN; PAM sequence: CTT
ctctgaagagatagtcagtg

SEQ ID NO: 71253 - DNA, 20 bp, Artificial Sequence
  Description of Artificial Sequence: Synthetic oligonucleotide
  Target: SCN9A; (-) strand; PAM type: YTN; PAM sequence: CTG
aggaaacaaatggaaataga

SEQ ID NO: 71254 - DNA, 20 bp, Artificial Sequence
  Description of Artificial Sequence: Synthetic oligonucleotide
  Target: SCN9A; (-) strand; PAM type: YTN; PAM sequence: TTC
tgaggaaacaaatggaaata

SEQ ID NO: 71255 - DNA, 20 bp, Artificial Sequence
  Description of Artificial Sequence: Synthetic oligonucleotide
  Target: SCN9A; (-) strand; PAM type: YTN; PAM sequence: TTA
aacagttctgaggaaacaaa

SEQ ID NO: 71256 - DNA, 20 bp, Artificial Sequence
  Description of Artificial Sequence: Synthetic oligonucleotide
  Target: SCN9A; (-) strand; PAM type: YTN; PAM sequence: CTT
aaacagttctgaggaaacaa

SEQ ID NO: 71257 - DNA, 20 bp, Artificial Sequence
  Description of Artificial Sequence: Synthetic oligonucleotide
  Target: SCN9A; (-) strand; PAM type: YTN; PAM sequence: TTA
gtcaaatatcttaaacagtt

SEQ ID NO: 71258 - DNA, 20 bp, Artificial Sequence
  Description of Artificial Sequence: Synthetic oligonucleotide
  Target: SCN9A; (-) strand; PAM type: YTN; PAM sequence: TTT
agtcaaatatcttaaacagt

SEQ ID NO: 71259 - DNA, 20 bp, Artificial Sequence
  Description of Artificial Sequence: Synthetic oligonucleotide
  Target: SCN9A; (-) strand; PAM type: YTN; PAM sequence: TTA
aaacaaacggtttagtcaaa

SEQ ID NO: 71260 - DNA, 20 bp, Artificial Sequence
  Description of Artificial Sequence: Synthetic oligonucleotide
  Target: SCN9A; (-) strand; PAM type: YTN; PAM sequence: TTA
tcagaaaataaccaaagaga

SEQ ID NO: 71261 - DNA, 20 bp, Artificial Sequence
  Description of Artificial Sequence: Synthetic oligonucleotide
  Target: SCN9A; (-) strand; PAM type: YTN; PAM sequence: CTT
atcagaaaataaccaaagag

SEQ ID NO: 71262 - DNA, 20 bp, Artificial Sequence
  Description of Artificial Sequence: Synthetic oligonucleotide
  Target: SCN9A; (-) strand; PAM type: YTN; PAM sequence: CTC
ttatcagaaaataaccaaag

SEQ ID NO: 71263 - DNA, 20 bp, Artificial Sequence
  Description of Artificial Sequence: Synthetic oligonucleotide
  Target: SCN9A; (-) strand; PAM type: YTN; PAM sequence: TTA
cagtaaaacctcttatcaga

SEQ ID NO: 71264 - DNA, 20 bp, Artificial Sequence
  Description of Artificial Sequence: Synthetic oligonucleotide
  Target: SCN9A; (-) strand; PAM type: YTN; PAM sequence: TTT
acagtaaaacctcttatcag

SEQ ID NO: 71265 - DNA, 20 bp, Artificial Sequence
  Description of Artificial Sequence: Synthetic oligonucleotide
  Target: SCN9A; (-) strand; PAM type: YTN; PAM sequence: TTT
tacagtaaaacctcttatca

SEQ ID NO: 71266 - DNA, 20 bp, Artificial Sequence
  Description of Artificial Sequence: Synthetic oligonucleotide
  Target: SCN9A; (-) strand; PAM type: YTN; PAM sequence: CTC
cagaatcaaatcaaaatatt

SEQ ID NO: 71267 - DNA, 20 bp, Artificial Sequence
  Description of Artificial Sequence: Synthetic oligonucleotide
  Target: SCN9A; (-) strand; PAM type: YTN; PAM sequence: TTA
aaaatacactccagaatcaa

SEQ ID NO: 71268 - DNA, 20 bp, Artificial Sequence
  Description of Artificial Sequence: Synthetic oligonucleotide
  Target: SCN9A; (-) strand; PAM type: YTN; PAM sequence: CTG
atagacagttaaaaatacac

SEQ ID NO: 71269 - DNA, 20 bp, Artificial Sequence
  Description of Artificial Sequence: Synthetic oligonucleotide
  Target: SCN9A; (-) strand; PAM type: YTN; PAM sequence: CTC
aacctgatagacagttaaaa

SEQ ID NO: 71270 - DNA, 20 bp, Artificial Sequence
  Description of Artificial Sequence: Synthetic oligonucleotide
  Target: SCN9A; (-) strand; PAM type: YTN; PAM sequence: TTC
ctcaacctgatagacagtta

SEQ ID NO: 71271 - DNA, 20 bp, Artificial Sequence
  Description of Artificial Sequence: Synthetic oligonucleotide
  Target: SCN9A; (-) strand; PAM type: YTN; PAM sequence: TTT
cctcaacctgatagacagtt

SEQ ID NO: 71272 - DNA, 20 bp, Artificial Sequence
  Description of Artificial Sequence: Synthetic oligonucleotide
  Target: SCN9A; (-) strand; PAM type: YTN; PAM sequence: TTG
acagatttcctcaacctgat

SEQ ID NO: 71273 - DNA, 20 bp, Artificial Sequence
  Description of Artificial Sequence: Synthetic oligonucleotide
  Target: SCN9A; (-) strand; PAM type: YTN; PAM sequence: TTC
aggttgacagatttcctcaa

SEQ ID NO: 71274 - DNA, 20 bp, Artificial Sequence
  Description of Artificial Sequence: Synthetic oligonucleotide
  Target: SCN9A; (-) strand; PAM type: YTN; PAM sequence: TTT
caggttgacagatttcctca

SEQ ID NO: 71275 - DNA, 20 bp, Artificial Sequence
  Description of Artificial Sequence: Synthetic oligonucleotide
  Target: SCN9A; (-) strand; PAM type: YTN; PAM sequence: TTT
tcaggttgacagatttcctc

SEQ ID NO: 71276 - DNA, 20 bp, Artificial Sequence
  Description of Artificial Sequence: Synthetic oligonucleotide
  Target: SCN9A; (-) strand; PAM type: YTN; PAM sequence: CTA
gtataagttttcaggttgac

SEQ ID NO: 71277 - DNA, 20 bp, Artificial Sequence
  Description of Artificial Sequence: Synthetic oligonucleotide
  Target: SCN9A; (-) strand; PAM type: YTN; PAM sequence: CTC
ctagtataagttttcaggtt

SEQ ID NO: 71278 - DNA, 20 bp, Artificial Sequence
  Description of Artificial Sequence: Synthetic oligonucleotide
  Target: SCN9A; (-) strand; PAM type: YTN; PAM sequence: CTC
tcctagtataagttttcagg

SEQ ID NO: 71279 - DNA, 20 bp, Artificial Sequence
  Description of Artificial Sequence: Synthetic oligonucleotide
  Target: SCN9A; (-) strand; PAM type: YTN; PAM sequence: TTC
agtgctctcctagtataagt

SEQ ID NO: 71280 - DNA, 20 bp, Artificial Sequence
  Description of Artificial Sequence: Synthetic oligonucleotide
  Target: SCN9A; (-) strand; PAM type: YTN; PAM sequence: TTT
cagtgctctcctagtataag

SEQ ID NO: 71281 - DNA, 20 bp, Artificial Sequence
  Description of Artificial Sequence: Synthetic oligonucleotide
  Target: SCN9A; (-) strand; PAM type: YTN; PAM sequence: TTT
tcagtgctctcctagtataa

SEQ ID NO: 71282 - DNA, 20 bp, Artificial Sequence
  Description of Artificial Sequence: Synthetic oligonucleotide
  Target: SCN9A; (-) strand; PAM type: YTN; PAM sequence: TTA
tggagaattttcagtgctct

SEQ ID NO: 71283 - DNA, 20 bp, Artificial Sequence
  Description of Artificial Sequence: Synthetic oligonucleotide
  Target: SCN9A; (-) strand; PAM type: YTN; PAM sequence: TTT
atggagaattttcagtgctc

SEQ ID NO: 71284 - DNA, 20 bp, Artificial Sequence
  Description of Artificial Sequence: Synthetic oligonucleotide
  Target: SCN9A; (-) strand; PAM type: YTN; PAM sequence: CTC
aacagagtttatggagaatt

SEQ ID NO: 71285 - DNA, 20 bp, Artificial Sequence
  Description of Artificial Sequence: Synthetic oligonucleotide
  Target: SCN9A; (-) strand; PAM type: YTN; PAM sequence: TTC
tcaacagagtttatggagaa

SEQ ID NO: 71286 - DNA, 20 bp, Artificial Sequence
  Description of Artificial Sequence: Synthetic oligonucleotide
  Target: SCN9A; (-) strand; PAM type: YTN; PAM sequence: TTT
ctcaacagagtttatggaga

SEQ ID NO: 71287 - DNA, 20 bp, Artificial Sequence
  Description of Artificial Sequence: Synthetic oligonucleotide
  Target: SCN9A; (-) strand; PAM type: YTN; PAM sequence: CTG
gtttctcaacagagtttatg

SEQ ID NO: 71288 - DNA, 20 bp, Artificial Sequence
  Description of Artificial Sequence: Synthetic oligonucleotide
  Target: SCN9A; (-) strand; PAM type: YTN; PAM sequence: CTA
gcatcctggtttctcaacag

SEQ ID NO: 71289 - DNA, 20 bp, Artificial Sequence
  Description of Artificial Sequence: Synthetic oligonucleotide
  Target: SCN9A; (-) strand; PAM type: YTN; PAM sequence: TTA
tgacctagcatcctggtttc

SEQ ID NO: 71290 - DNA, 20 bp, Artificial Sequence
  Description of Artificial Sequence: Synthetic oligonucleotide
  Target: SCN9A; (-) strand; PAM type: YTN; PAM sequence: TTT
atgacctagcatcctggttt

SEQ ID NO: 71291 - DNA, 20 bp, Artificial Sequence
  Description of Artificial Sequence: Synthetic oligonucleotide
  Target: SCN9A; (-) strand; PAM type: YTN; PAM sequence: TTT
tatgacctagcatcctggtt

SEQ ID NO: 71292 - DNA, 20 bp, Artificial Sequence
  Description of Artificial Sequence: Synthetic oligonucleotide
  Target: SCN9A; (-) strand; PAM type: YTN; PAM sequence: CTT
ttatgacctagcatcctggt

SEQ ID NO: 71293 - DNA, 20 bp, Artificial Sequence
  Description of Artificial Sequence: Synthetic oligonucleotide
  Target: SCN9A; (-) strand; PAM type: YTN; PAM sequence: CTC
ttttatgacctagcatcctg

SEQ ID NO: 71294 - DNA, 20 bp, Artificial Sequence
  Description of Artificial Sequence: Synthetic oligonucleotide
  Target: SCN9A; (-) strand; PAM type: YTN; PAM sequence: CTC
tcttttatgacctagcatcc

SEQ ID NO: 71295 - DNA, 20 bp, Artificial Sequence
  Description of Artificial Sequence: Synthetic oligonucleotide
  Target: SCN9A; (-) strand; PAM type: YTN; PAM sequence: CTA
cccaaaaaccctctctttta

SEQ ID NO: 71296 - DNA, 20 bp, Artificial Sequence
  Description of Artificial Sequence: Synthetic oligonucleotide
  Target: SCN9A; (-) strand; PAM type: YTN; PAM sequence: CTC
cctacccaaaaaccctctct

SEQ ID NO: 71297 - DNA, 20 bp, Artificial Sequence
  Description of Artificial Sequence: Synthetic oligonucleotide
  Target: SCN9A; (-) strand; PAM type: YTN; PAM sequence: TTC
tccctacccaaaaaccctct

SEQ ID NO: 71298 - DNA, 20 bp, Artificial Sequence
  Description of Artificial Sequence: Synthetic oligonucleotide
  Target: SCN9A; (-) strand; PAM type: YTN; PAM sequence: CTT
ctccctacccaaaaaccctc

SEQ ID NO: 71299 - DNA, 20 bp, Artificial Sequence
  Description of Artificial Sequence: Synthetic oligonucleotide
  Target: SCN9A; (-) strand; PAM type: YTN; PAM sequence: CTC
ttctccctacccaaaaaccc

SEQ ID NO: 71300 - DNA, 20 bp, Artificial Sequence
  Description of Artificial Sequence: Synthetic oligonucleotide
  Target: SCN9A; (-) strand; PAM type: YTN; PAM sequence: CTC
tcttctccctacccaaaaac

SEQ ID NO: 71301 - DNA, 20 bp, Artificial Sequence
  Description of Artificial Sequence: Synthetic oligonucleotide
  Target: SCN9A; (-) strand; PAM type: YTN; PAM sequence: CTC
cctctcttctccctacccaa

SEQ ID NO: 71302 - DNA, 20 bp, Artificial Sequence
  Description of Artificial Sequence: Synthetic oligonucleotide
  Target: SCN9A; (-) strand; PAM type: YTN; PAM sequence: CTC
tccctctcttctccctaccc

SEQ ID NO: 71303 - DNA, 20 bp, Artificial Sequence
  Description of Artificial Sequence: Synthetic oligonucleotide
  Target: SCN9A; (-) strand; PAM type: YTN; PAM sequence: TTG
atatctctccctctcttctc

SEQ ID NO: 71304 - DNA, 20 bp, Artificial Sequence
  Description of Artificial Sequence: Synthetic oligonucleotide
  Target: SCN9A; (-) strand; PAM type: YTN; PAM sequence: TTT
gatatctctccctctcttct

SEQ ID NO: 71305 - DNA, 20 bp, Artificial Sequence
  Description of Artificial Sequence: Synthetic oligonucleotide
  Target: SCN9A; (-) strand; PAM type: YTN; PAM sequence: CTT
tgatatctctccctctcttc

SEQ ID NO: 71306 - DNA, 20 bp, Artificial Sequence
  Description of Artificial Sequence: Synthetic oligonucleotide
  Target: SCN9A; (-) strand; PAM type: YTN; PAM sequence: CTG
acctttgatatctctccctc

SEQ ID NO: 71307 - DNA, 20 bp, Artificial Sequence
  Description of Artificial Sequence: Synthetic oligonucleotide
  Target: SCN9A; (-) strand; PAM type: YTN; PAM sequence: TTG
agcaaggggaaaaaacatca

SEQ ID NO: 71308 - DNA, 20 bp, Artificial Sequence
  Description of Artificial Sequence: Synthetic oligonucleotide
  Target: SCN9A; (-) strand; PAM type: YTN; PAM sequence: TTT
gagcaaggggaaaaaacatc

SEQ ID NO: 71309 - DNA, 20 bp, Artificial Sequence
  Description of Artificial Sequence: Synthetic oligonucleotide
  Target: SCN9A; (-) strand; PAM type: YTN; PAM sequence: TTT
tgagcaaggggaaaaaacat

SEQ ID NO: 71310 - DNA, 20 bp, Artificial Sequence
  Description of Artificial Sequence: Synthetic oligonucleotide
  Target: SCN9A; (-) strand; PAM type: YTN; PAM sequence: CTG
cattttgagcaaggggaaaa

SEQ ID NO: 71311 - DNA, 20 bp, Artificial Sequence
  Description of Artificial Sequence: Synthetic oligonucleotide
  Target: SCN9A; (-) strand; PAM type: YTN; PAM sequence: TTA
agaacctgcattttgagcaa

SEQ ID NO: 71312 - DNA, 20 bp, Artificial Sequence
  Description of Artificial Sequence: Synthetic oligonucleotide
  Target: SCN9A; (-) strand; PAM type: YTN; PAM sequence: TTT
aagaacctgcattttgagca

SEQ ID NO: 71313 - DNA, 20 bp, Artificial Sequence
  Description of Artificial Sequence: Synthetic oligonucleotide
  Target: SCN9A; (-) strand; PAM type: YTN; PAM sequence: TTG
tttaagaacctgcattttga

SEQ ID NO: 71314 - DNA, 20 bp, Artificial Sequence
  Description of Artificial Sequence: Synthetic oligonucleotide
  Target: SCN9A; (-) strand; PAM type: YTN; PAM sequence: CTT
gtttaagaacctgcattttg

SEQ ID NO: 71315 - DNA, 20 bp, Artificial Sequence
  Description of Artificial Sequence: Synthetic oligonucleotide
  Target: SCN9A; (-) strand; PAM type: YTN; PAM sequence: TTG
cttgtttaagaacctgcatt

SEQ ID NO: 71316 - DNA, 20 bp, Artificial Sequence
  Description of Artificial Sequence: Synthetic oligonucleotide
  Target: SCN9A; (-) strand; PAM type: YTN; PAM sequence: TTT
gcttgtttaagaacctgcat

SEQ ID NO: 71317 - DNA, 20 bp, Artificial Sequence
  Description of Artificial Sequence: Synthetic oligonucleotide
  Target: SCN9A; (-) strand; PAM type: YTN; PAM sequence: TTT
tgcttgtttaagaacctgca

SEQ ID NO: 71318 - DNA, 20 bp, Artificial Sequence
  Description of Artificial Sequence: Synthetic oligonucleotide
  Target: SCN9A; (-) strand; PAM type: YTN; PAM sequence: CTT
ttgcttgtttaagaacctgc

SEQ ID NO: 71319 - DNA, 20 bp, Artificial Sequence
  Description of Artificial Sequence: Synthetic oligonucleotide
  Target: SCN9A; (-) strand; PAM type: YTN; PAM sequence: TTC
cccttttgcttgtttaagaa

SEQ ID NO: 71320 - DNA, 20 bp, Artificial Sequence
  Description of Artificial Sequence: Synthetic oligonucleotide
  Target: SCN9A; (-) strand; PAM type: YTN; PAM sequence: TTT
ccccttttgcttgtttaaga

SEQ ID NO: 71321 - DNA, 20 bp, Artificial Sequence
  Description of Artificial Sequence: Synthetic oligonucleotide
  Target: SCN9A; (-) strand; PAM type: YTN; PAM sequence: CTA
tgggtatatttccccttttg

SEQ ID NO: 71322 - DNA, 20 bp, Artificial Sequence
  Description of Artificial Sequence: Synthetic oligonucleotide
  Target: SCN9A; (-) strand; PAM type: YTN; PAM sequence: TTC
aggggctatgggtatatttc

SEQ ID NO: 71323 - DNA, 20 bp, Artificial Sequence
  Description of Artificial Sequence: Synthetic oligonucleotide
  Target: SCN9A; (-) strand; PAM type: YTN; PAM sequence: TTA
ttcaggggctatgggtatat

SEQ ID NO: 71324 - DNA, 20 bp, Artificial Sequence
  Description of Artificial Sequence: Synthetic oligonucleotide
  Target: SCN9A; (-) strand; PAM type: YTN; PAM sequence: TTT
attcaggggctatgggtata

SEQ ID NO: 71325 - DNA, 20 bp, Artificial Sequence
  Description of Artificial Sequence: Synthetic oligonucleotide
  Target: SCN9A; (-) strand; PAM type: YTN; PAM sequence: CTT
tattcaggggctatgggtat

SEQ ID NO: 71326 - DNA, 20 bp, Artificial Sequence
  Description of Artificial Sequence: Synthetic oligonucleotide
  Target: SCN9A; (-) strand; PAM type: YTN; PAM sequence: TTC
tttattcaggggctatgggt

SEQ ID NO: 71327 - DNA, 20 bp, Artificial Sequence
  Description of Artificial Sequence: Synthetic oligonucleotide
  Target: SCN9A; (-) strand; PAM type: YTN; PAM sequence: TTT
ctttattcaggggctatggg

SEQ ID NO: 71328 - DNA, 20 bp, Artificial Sequence
  Description of Artificial Sequence: Synthetic oligonucleotide
  Target: SCN9A; (-) strand; PAM type: YTN; PAM sequence: TTT
tctttattcaggggctatgg

SEQ ID NO: 71329 - DNA, 20 bp, Artificial Sequence
  Description of Artificial Sequence: Synthetic oligonucleotide
  Target: SCN9A; (-) strand; PAM type: YTN; PAM sequence: TTA
ttttctttattcaggggcta

SEQ ID NO: 71330 - DNA, 20 bp, Artificial Sequence
  Description of Artificial Sequence: Synthetic oligonucleotide
  Target: SCN9A; (-) strand; PAM type: YTN; PAM sequence: CTG
agatattattttctttattc

SEQ ID NO: 71331 - DNA, 20 bp, Artificial Sequence
  Description of Artificial Sequence: Synthetic oligonucleotide
  Target: SCN9A; (-) strand; PAM type: YTN; PAM sequence: TTC
tgagatattattttctttat

SEQ ID NO: 71332 - DNA, 20 bp, Artificial Sequence
  Description of Artificial Sequence: Synthetic oligonucleotide
  Target: SCN9A; (-) strand; PAM type: YTN; PAM sequence: TTT
ctgagatattattttcttta

SEQ ID NO: 71333 - DNA, 20 bp, Artificial Sequence
  Description of Artificial Sequence: Synthetic oligonucleotide
  Target: SCN9A; (-) strand; PAM type: YTN; PAM sequence: TTC
aggtttctgagatattattt

SEQ ID NO: 71334 - DNA, 20 bp, Artificial Sequence
  Description of Artificial Sequence: Synthetic oligonucleotide
  Target: SCN9A; (-) strand; PAM type: YTN; PAM sequence: TTG
gattcaggtttctgagatat

SEQ ID NO: 71335 - DNA, 20 bp, Artificial Sequence
  Description of Artificial Sequence: Synthetic oligonucleotide
  Target: SCN9A; (-) strand; PAM type: YTN; PAM sequence: CTT
ggattcaggtttctgagata

SEQ ID NO: 71336 - DNA, 20 bp, Artificial Sequence
  Description of Artificial Sequence: Synthetic oligonucleotide
  Target: SCN9A; (-) strand; PAM type: YTN; PAM sequence: TTA
cttggattcaggtttctgag

SEQ ID NO: 71337 - DNA, 20 bp, Artificial Sequence
  Description of Artificial Sequence: Synthetic oligonucleotide
  Target: SCN9A; (-) strand; PAM type: YTN; PAM sequence: CTT
acttggattcaggtttctga

SEQ ID NO: 71338 - DNA, 20 bp, Artificial Sequence
  Description of Artificial Sequence: Synthetic oligonucleotide
  Target: SCN9A; (-) strand; PAM type: YTN; PAM sequence: CTA
gcttacttggattcaggttt

SEQ ID NO: 71339 - DNA, 20 bp, Artificial Sequence
  Description of Artificial Sequence: Synthetic oligonucleotide
  Target: SCN9A; (-) strand; PAM type: YTN; PAM sequence: TTA
atccctagcttacttggatt

SEQ ID NO: 71340 - DNA, 20 bp, Artificial Sequence
  Description of Artificial Sequence: Synthetic oligonucleotide
  Target: SCN9A; (-) strand; PAM type: YTN; PAM sequence: CTT
aatccctagcttacttggat

SEQ ID NO: 71341 - DNA, 20 bp, Artificial Sequence
  Description of Artificial Sequence: Synthetic oligonucleotide
  Target: SCN9A; (-) strand; PAM type: YTN; PAM sequence: TTA
aaataaatgatgccaactta

SEQ ID NO: 71342 - DNA, 20 bp, Artificial Sequence
  Description of Artificial Sequence: Synthetic oligonucleotide
  Target: SCN9A; (-) strand; PAM type: YTN; PAM sequence: TTT
aaaataaatgatgccaactt

SEQ ID NO: 71343 - DNA, 20 bp, Artificial Sequence
  Description of Artificial Sequence: Synthetic oligonucleotide
  Target: SCN9A; (-) strand; PAM type: YTN; PAM sequence: TTT
taaaataaatgatgccaact

SEQ ID NO: 71344 - DNA, 20 bp, Artificial Sequence
  Description of Artificial Sequence: Synthetic oligonucleotide
  Target: SCN9A; (-) strand; PAM type: YTN; PAM sequence: TTT
ttaaaataaatgatgccaac

SEQ ID NO: 71345 - DNA, 20 bp, Artificial Sequence
  Description of Artificial Sequence: Synthetic oligonucleotide
  Target: SCN9A; (-) strand; PAM type: YTN; PAM sequence: TTA
tgtgtcaataatttttaaaa

SEQ ID NO: 71346 - DNA, 20 bp, Artificial Sequence
  Description of Artificial Sequence: Synthetic oligonucleotide
  Target: SCN9A; (-) strand; PAM type: YTN; PAM sequence: TTA
ttatgtgtcaataattttta

SEQ ID NO: 71347 - DNA, 20 bp, Artificial Sequence
  Description of Artificial Sequence: Synthetic oligonucleotide
  Target: SCN9A; (-) strand; PAM type: YTN; PAM sequence: CTA
tcacatgtaccccataaata

SEQ ID NO: 71348 - DNA, 20 bp, Artificial Sequence
  Description of Artificial Sequence: Synthetic oligonucleotide
  Target: SCN9A; (-) strand; PAM type: YTN; PAM sequence: TTA
tataatgtatacatgtatca

SEQ ID NO: 71349 - DNA, 20 bp, Artificial Sequence
  Description of Artificial Sequence: Synthetic oligonucleotide
  Target: SCN9A; (-) strand; PAM type: YTN; PAM sequence: TTG
ataattatataatgtataca

SEQ ID NO: 71350 - DNA, 20 bp, Artificial Sequence
  Description of Artificial Sequence: Synthetic oligonucleotide
  Target: SCN9A; (-) strand; PAM type: YTN; PAM sequence: TTT
gataattatataatgtatac

SEQ ID NO: 71351 - DNA, 20 bp, Artificial Sequence
  Description of Artificial Sequence: Synthetic oligonucleotide
  Target: SCN9A; (-) strand; PAM type: YTN; PAM sequence: CTA
tttgataattatataatgta

SEQ ID NO: 71352 - DNA, 20 bp, Artificial Sequence
  Description of Artificial Sequence: Synthetic oligonucleotide
  Target: SCN9A; (-) strand; PAM type: YTN; PAM sequence: TTA
ccctatttgataattatata

SEQ ID NO: 71353 - DNA, 20 bp, Artificial Sequence
  Description of Artificial Sequence: Synthetic oligonucleotide
  Target: SCN9A; (-) strand; PAM type: YTN; PAM sequence: CTA
gttaccctatttgataatta

SEQ ID NO: 71354 - DNA, 20 bp, Artificial Sequence
  Description of Artificial Sequence: Synthetic oligonucleotide
  Target: SCN9A; (-) strand; PAM type: YTN; PAM sequence: CTG
ctagttaccctatttgataa

SEQ ID NO: 71355 - DNA, 20 bp, Artificial Sequence
  Description of Artificial Sequence: Synthetic oligonucleotide
  Target: SCN9A; (-) strand; PAM type: YTN; PAM sequence: CTA
tggatctgctagttacccta

SEQ ID NO: 71356 - DNA, 20 bp, Artificial Sequence
  Description of Artificial Sequence: Synthetic oligonucleotide
  Target: SCN9A; (-) strand; PAM type: YTN; PAM sequence: TTC
aaagctatggatctgctagt

SEQ ID NO: 71357 - DNA, 20 bp, Artificial Sequence
  Description of Artificial Sequence: Synthetic oligonucleotide
  Target: SCN9A; (-) strand; PAM type: YTN; PAM sequence: CTC
acaaagaaatggtaaatgtt

SEQ ID NO: 71358 - DNA, 20 bp, Artificial Sequence
  Description of Artificial Sequence: Synthetic oligonucleotide
  Target: SCN9A; (-) strand; PAM type: YTN; PAM sequence: CTC
ctcacaaagaaatggtaaat

SEQ ID NO: 71359 - DNA, 20 bp, Artificial Sequence
  Description of Artificial Sequence: Synthetic oligonucleotide
  Target: SCN9A; (-) strand; PAM type: YTN; PAM sequence: TTA
aatggtctcctcacaaagaa

SEQ ID NO: 71360 - DNA, 20 bp, Artificial Sequence
  Description of Artificial Sequence: Synthetic oligonucleotide
  Target: SCN9A; (-) strand; PAM type: YTN; PAM sequence: TTT
aaatggtctcctcacaaaga

SEQ ID NO: 71361 - DNA, 20 bp, Artificial Sequence
  Description of Artificial Sequence: Synthetic oligonucleotide
  Target: SCN9A; (-) strand; PAM type: YTN; PAM sequence: TTT
taaatggtctcctcacaaag

SEQ ID NO: 71362 - DNA, 20 bp, Artificial Sequence
  Description of Artificial Sequence: Synthetic oligonucleotide
  Target: SCN9A; (-) strand; PAM type: YTN; PAM sequence: TTT
ttaaatggtctcctcacaaa

SEQ ID NO: 71363 - DNA, 20 bp, Artificial Sequence
  Description of Artificial Sequence: Synthetic oligonucleotide
  Target: SCN9A; (-) strand; PAM type: YTN; PAM sequence: CTA
gaagtttttaaatggtctcc

SEQ ID NO: 71364 - DNA, 20 bp, Artificial Sequence
  Description of Artificial Sequence: Synthetic oligonucleotide
  Target: SCN9A; (-) strand; PAM type: YTN; PAM sequence: TTC
aaaatagctagaagttttta

SEQ ID NO: 71365 - DNA, 20 bp, Artificial Sequence
  Description of Artificial Sequence: Synthetic oligonucleotide
  Target: SCN9A; (-) strand; PAM type: YTN; PAM sequence: TTT
caaaatagctagaagttttt

SEQ ID NO: 71366 - DNA, 20 bp, Artificial Sequence
  Description of Artificial Sequence: Synthetic oligonucleotide
  Target: SCN9A; (-) strand; PAM type: YTN; PAM sequence: TTG
tatatttcaaaatagctaga

SEQ ID NO: 71367 - DNA, 20 bp, Artificial Sequence
  Description of Artificial Sequence: Synthetic oligonucleotide
  Target: SCN9A; (-) strand; PAM type: YTN; PAM sequence: TTA
accataatgtgttgtatatt

SEQ ID NO: 71368 - DNA, 20 bp, Artificial Sequence
  Description of Artificial Sequence: Synthetic oligonucleotide
  Target: SCN9A; (-) strand; PAM type: YTN; PAM sequence: CTA
gagttaaccataatgtgttg

SEQ ID NO: 71369 - DNA, 20 bp, Artificial Sequence
  Description of Artificial Sequence: Synthetic oligonucleotide
  Target: SCN9A; (-) strand; PAM type: YTN; PAM sequence: TTG
gatgactagagttaaccata

SEQ ID NO: 71370 - DNA, 20 bp, Artificial Sequence
  Description of Artificial Sequence: Synthetic oligonucleotide
  Target: SCN9A; (-) strand; PAM type: YTN; PAM sequence: TTG
aatcgttggatgactagagt

SEQ ID NO: 71371 - DNA, 20 bp, Artificial Sequence
  Description of Artificial Sequence: Synthetic oligonucleotide
  Target: SCN9A; (-) strand; PAM type: YTN; PAM sequence: CTA
ttgaatcgttggatgactag

SEQ ID NO: 71372 - DNA, 20 bp, Artificial Sequence
  Description of Artificial Sequence: Synthetic oligonucleotide
  Target: SCN9A; (-) strand; PAM type: YTN; PAM sequence: TTC
tattgaatcgttggatgact

SEQ ID NO: 71373 - DNA, 20 bp, Artificial Sequence
  Description of Artificial Sequence: Synthetic oligonucleotide
  Target: SCN9A; (-) strand; PAM type: YTN; PAM sequence: CTG
gtgttctattgaatcgttgg

SEQ ID NO: 71374 - DNA, 20 bp, Artificial Sequence
  Description of Artificial Sequence: Synthetic oligonucleotide
  Target: SCN9A; (-) strand; PAM type: YTN; PAM sequence: TTC
tggtgttctattgaatcgtt

SEQ ID NO: 71375 - DNA, 20 bp, Artificial Sequence
  Description of Artificial Sequence: Synthetic oligonucleotide
  Target: SCN9A; (-) strand; PAM type: YTN; PAM sequence: CTA
cagtgagatagaaagaataa

SEQ ID NO: 71376 - DNA, 20 bp, Artificial Sequence
  Description of Artificial Sequence: Synthetic oligonucleotide
  Target: SCN9A; (-) strand; PAM type: YTN; PAM sequence: TTG
gtcaacaggtacaaagctac

SEQ ID NO: 71377 - DNA, 20 bp, Artificial Sequence
  Description of Artificial Sequence: Synthetic oligonucleotide
  Target: SCN9A; (-) strand; PAM type: YTN; PAM sequence: TTG
gaggagcgaggtgtggggaa

SEQ ID NO: 71378 - DNA, 20 bp, Artificial Sequence
  Description of Artificial Sequence: Synthetic oligonucleotide
  Target: SCN9A; (-) strand; PAM type: YTN; PAM sequence: CTT
ggaggagcgaggtgtgggga

SEQ ID NO: 71379 - DNA, 20 bp, Artificial Sequence
  Description of Artificial Sequence: Synthetic oligonucleotide
  Target: SCN9A; (-) strand; PAM type: YTN; PAM sequence: TTA
tcggaggatgggaggcttgg

SEQ ID NO: 71380 - DNA, 20 bp, Artificial Sequence
  Description of Artificial Sequence: Synthetic oligonucleotide
  Target: SCN9A; (-) strand; PAM type: YTN; PAM sequence: TTG
tcatagaagtagatagtaga

SEQ ID NO: 71381 - DNA, 20 bp, Artificial Sequence
  Description of Artificial Sequence: Synthetic oligonucleotide
  Target: SCN9A; (-) strand; PAM type: YTN; PAM sequence: CTA
aagggttgtcatagaagtag

SEQ ID NO: 71382 - DNA, 20 bp, Artificial Sequence
  Description of Artificial Sequence: Synthetic oligonucleotide
  Target: SCN9A; (-) strand; PAM type: YTN; PAM sequence: CTC
acacatatgtggaatctaaa

SEQ ID NO: 71383 - DNA, 20 bp, Artificial Sequence
  Description of Artificial Sequence: Synthetic oligonucleotide
  Target: SCN9A; (-) strand; PAM type: YTN; PAM sequence: TTA
agtgaaatcagccaggcaca

SEQ ID NO: 71384 - DNA, 20 bp, Artificial Sequence
  Description of Artificial Sequence: Synthetic oligonucleotide
  Target: SCN9A; (-) strand; PAM type: YTN; PAM sequence: TTA
tgttaagtgaaatcagccag

SEQ ID NO: 71385 - DNA, 20 bp, Artificial Sequence
  Description of Artificial Sequence: Synthetic oligonucleotide
  Target: SCN9A; (-) strand; PAM type: YTN; PAM sequence: CTG
gaggacattatgttaagtga

SEQ ID NO: 71386 - DNA, 20 bp, Artificial Sequence
  Description of Artificial Sequence: Synthetic oligonucleotide
  Target: SCN9A; (-) strand; PAM type: YTN; PAM sequence: TTG
tggcaacatgaatgaacctg

SEQ ID NO: 71387 - DNA, 20 bp, Artificial Sequence
  Description of Artificial Sequence: Synthetic oligonucleotide
  Target: SCN9A; (-) strand; PAM type: YTN; PAM sequence: TTT
gtggcaacatgaatgaacct

SEQ ID NO: 71388 - DNA, 20 bp, Artificial Sequence
  Description of Artificial Sequence: Synthetic oligonucleotide
  Target: SCN9A; (-) strand; PAM type: YTN; PAM sequence: TTA
tttgtggcaacatgaatgaa

SEQ ID NO: 71389 - DNA, 20 bp, Artificial Sequence
  Description of Artificial Sequence: Synthetic oligonucleotide
  Target: SCN9A; (-) strand; PAM type: YTN; PAM sequence: CTG
ttatttgtggcaacatgaat

SEQ ID NO: 71390 - DNA, 20 bp, Artificial Sequence
  Description of Artificial Sequence: Synthetic oligonucleotide
  Target: SCN9A; (-) strand; PAM type: YTN; PAM sequence: TTC
agccataagaaataatgaaa

SEQ ID NO: 71391 - DNA, 20 bp, Artificial Sequence
  Description of Artificial Sequence: Synthetic oligonucleotide
  Target: SCN9A; (-) strand; PAM type: YTN; PAM sequence: TTG
aacgccattcagccataaga

SEQ ID NO: 71392 - DNA, 20 bp, Artificial Sequence
  Description of Artificial Sequence: Synthetic oligonucleotide
  Target: SCN9A; (-) strand; PAM type: YTN; PAM sequence: CTA
aatgatcgtaaataaataaa

SEQ ID NO: 71393 - DNA, 20 bp, Artificial Sequence
  Description of Artificial Sequence: Synthetic oligonucleotide
  Target: SCN9A; (-) strand; PAM type: YTN; PAM sequence: TTA
acctaaatgatcgtaaataa

SEQ ID NO: 71394 - DNA, 20 bp, Artificial Sequence
  Description of Artificial Sequence: Synthetic oligonucleotide
  Target: SCN9A; (-) strand; PAM type: YTN; PAM sequence: TTA
tcatattaacctaaatgatc

SEQ ID NO: 71395 - DNA, 20 bp, Artificial Sequence
  Description of Artificial Sequence: Synthetic oligonucleotide
  Target: SCN9A; (-) strand; PAM type: YTN; PAM sequence: TTC
acaatagccaagttatcata

SEQ ID NO: 71396 - DNA, 20 bp, Artificial Sequence
  Description of Artificial Sequence: Synthetic oligonucleotide
  Target: SCN9A; (-) strand; PAM type: YTN; PAM sequence: CTG
ttcacaatagccaagttatc

SEQ ID NO: 71397 - DNA, 20 bp, Artificial Sequence
  Description of Artificial Sequence: Synthetic oligonucleotide
  Target: SCN9A; (-) strand; PAM type: YTN; PAM sequence: CTG
cactgttcacaatagccaag

SEQ ID NO: 71398 - DNA, 20 bp, Artificial Sequence
  Description of Artificial Sequence: Synthetic oligonucleotide
  Target: SCN9A; (-) strand; PAM type: YTN; PAM sequence: TTG
ctgcactgttcacaatagcc

SEQ ID NO: 71399 - DNA, 20 bp, Artificial Sequence
  Description of Artificial Sequence: Synthetic oligonucleotide
  Target: SCN9A; (-) strand; PAM type: YTN; PAM sequence: TTA
ttgctgcactgttcacaata

SEQ ID NO: 71400 - DNA, 20 bp, Artificial Sequence
  Description of Artificial Sequence: Synthetic oligonucleotide
  Target: SCN9A; (-) strand; PAM type: YTN; PAM sequence: TTT
attgctgcactgttcacaat

SEQ ID NO: 71401 - DNA, 20 bp, Artificial Sequence
  Description of Artificial Sequence: Synthetic oligonucleotide
  Target: SCN9A; (-) strand; PAM type: YTN; PAM sequence: CTA
tatgtttattgctgcactgt

SEQ ID NO: 71402 - DNA, 20 bp, Artificial Sequence
  Description of Artificial Sequence: Synthetic oligonucleotide
  Target: SCN9A; (-) strand; PAM type: YTN; PAM sequence: CTC
ctatatgtttattgctgcac

SEQ ID NO: 71403 - DNA, 20 bp, Artificial Sequence
  Description of Artificial Sequence: Synthetic oligonucleotide
  Target: SCN9A; (-) strand; PAM type: YTN; PAM sequence: CTG
tactcctatatgtttattgc

SEQ ID NO: 71404 - DNA, 20 bp, Artificial Sequence
  Description of Artificial Sequence: Synthetic oligonucleotide
  Target: SCN9A; (-) strand; PAM type: YTN; PAM sequence: TTG
aagagatacagtaaacatag

SEQ ID NO: 71405 - DNA, 20 bp, Artificial Sequence
  Description of Artificial Sequence: Synthetic oligonucleotide
  Target: SCN9A; (-) strand; PAM type: YTN; PAM sequence: CTA
agtaaatatccagatgaaat

SEQ ID NO: 71406 - DNA, 20 bp, Artificial Sequence
  Description of Artificial Sequence: Synthetic oligonucleotide
  Target: SCN9A; (-) strand; PAM type: YTN; PAM sequence: TTC
atatgatccagcagtcccaa

SEQ ID NO: 71407 - DNA, 20 bp, Artificial Sequence
  Description of Artificial Sequence: Synthetic oligonucleotide
  Target: SCN9A; (-) strand; PAM type: YTN; PAM sequence: TTT
catatgatccagcagtccca

SEQ ID NO: 71408 - DNA, 20 bp, Artificial Sequence
  Description of Artificial Sequence: Synthetic oligonucleotide
  Target: SCN9A; (-) strand; PAM type: YTN; PAM sequence: TTT
tcatatgatccagcagtccc

SEQ ID NO: 71409 - DNA, 20 bp, Artificial Sequence
  Description of Artificial Sequence: Synthetic oligonucleotide
  Target: SCN9A; (-) strand; PAM type: YTN; PAM sequence: TTA
aaaatagaattttcatatga

SEQ ID NO: 71410 - DNA, 20 bp, Artificial Sequence
  Description of Artificial Sequence: Synthetic oligonucleotide
  Target: SCN9A; (-) strand; PAM type: YTN; PAM sequence: TTA
aaaaattaaaaatagaattt

SEQ ID NO: 71411 - DNA, 20 bp, Artificial Sequence
  Description of Artificial Sequence: Synthetic oligonucleotide
  Target: SCN9A; (-) strand; PAM type: YTN; PAM sequence: TTT
aaaaaattaaaaatagaatt

SEQ ID NO: 71412 - DNA, 20 bp, Artificial Sequence
  Description of Artificial Sequence: Synthetic oligonucleotide
  Target: SCN9A; (-) strand; PAM type: YTN; PAM sequence: CTT
taaaaaattaaaaatagaat

SEQ ID NO: 71413 - DNA, 20 bp, Artificial Sequence
  Description of Artificial Sequence: Synthetic oligonucleotide
  Target: SCN9A; (-) strand; PAM type: YTN; PAM sequence: TTC
tttaaaaaattaaaaataga

SEQ ID NO: 71414 - DNA, 20 bp, Artificial Sequence
  Description of Artificial Sequence: Synthetic oligonucleotide
  Target: SCN9A; (-) strand; PAM type: YTN; PAM sequence: TTA
tggaaagtaatatgggggtt

SEQ ID NO: 71415 - DNA, 20 bp, Artificial Sequence
  Description of Artificial Sequence: Synthetic oligonucleotide
  Target: SCN9A; (-) strand; PAM type: YTN; PAM sequence: TTA
gtaccaccattatggaaagt

SEQ ID NO: 71416 - DNA, 20 bp, Artificial Sequence
  Description of Artificial Sequence: Synthetic oligonucleotide
  Target: SCN9A; (-) strand; PAM type: YTN; PAM sequence: TTG
tgagaatgtaaattagtacc

SEQ ID NO: 71417 - DNA, 20 bp, Artificial Sequence
  Description of Artificial Sequence: Synthetic oligonucleotide
  Target: SCN9A; (-) strand; PAM type: YTN; PAM sequence: CTG
attgtgagaatgtaaattag

SEQ ID NO: 71418 - DNA, 20 bp, Artificial Sequence
  Description of Artificial Sequence: Synthetic oligonucleotide
  Target: SCN9A; (-) strand; PAM type: YTN; PAM sequence: TTA
cacactgattgtgagaatgt

SEQ ID NO: 71419 - DNA, 20 bp, Artificial Sequence
  Description of Artificial Sequence: Synthetic oligonucleotide
  Target: SCN9A; (-) strand; PAM type: YTN; PAM sequence: CTT
acacactgattgtgagaatg

SEQ ID NO: 71420 - DNA, 20 bp, Artificial Sequence
  Description of Artificial Sequence: Synthetic oligonucleotide
  Target: SCN9A; (-) strand; PAM type: YTN; PAM sequence: TTA
aaggatatggagaaaaggga

SEQ ID NO: 71421 - DNA, 20 bp, Artificial Sequence
  Description of Artificial Sequence: Synthetic oligonucleotide
  Target: SCN9A; (-) strand; PAM type: YTN; PAM sequence: TTT
aaaggatatggagaaaaggg

SEQ ID NO: 71422 - DNA, 20 bp, Artificial Sequence
  Description of Artificial Sequence: Synthetic oligonucleotide
  Target: SCN9A; (-) strand; PAM type: YTN; PAM sequence: CTA
ccatcaaaaaatcaaaagat

SEQ ID NO: 71423 - DNA, 20 bp, Artificial Sequence
  Description of Artificial Sequence: Synthetic oligonucleotide
  Target: SCN9A; (-) strand; PAM type: YTN; PAM sequence: TTA
aaatggctaccatcaaaaaa

SEQ ID NO: 71424 - DNA, 20 bp, Artificial Sequence
  Description of Artificial Sequence: Synthetic oligonucleotide
  Target: SCN9A; (-) strand; PAM type: YTN; PAM sequence: CTA
gttaaaatggctaccatcaa

SEQ ID NO: 71425 - DNA, 20 bp, Artificial Sequence
  Description of Artificial Sequence: Synthetic oligonucleotide
  Target: SCN9A; (-) strand; PAM type: YTN; PAM sequence: CTC
accctagttaaaatggctac

SEQ ID NO: 71426 - DNA, 20 bp, Artificial Sequence
  Description of Artificial Sequence: Synthetic oligonucleotide
  Target: SCN9A; (-) strand; PAM type: YTN; PAM sequence: CTC
ctcaccctagttaaaatggc

SEQ ID NO: 71427 - DNA, 20 bp, Artificial Sequence
  Description of Artificial Sequence: Synthetic oligonucleotide
  Target: SCN9A; (-) strand; PAM type: YTN; PAM sequence: TTG
aggtatctcctcaccctagt

SEQ ID NO: 71428 - DNA, 20 bp, Artificial Sequence
  Description of Artificial Sequence: Synthetic oligonucleotide
  Target: SCN9A; (-) strand; PAM type: YTN; PAM sequence: CTT
gaggtatctcctcaccctag

SEQ ID NO: 71429 - DNA, 20 bp, Artificial Sequence
  Description of Artificial Sequence: Synthetic oligonucleotide
  Target: SCN9A; (-) strand; PAM type: YTN; PAM sequence: CTA
tcttgaggtatctcctcacc

SEQ ID NO: 71430 - DNA, 20 bp, Artificial Sequence
  Description of Artificial Sequence: Synthetic oligonucleotide
  Target: SCN9A; (-) strand; PAM type: YTN; PAM sequence: CTA
atcaccagggaaatgcaaat

SEQ ID NO: 71431 - DNA, 20 bp, Artificial Sequence
  Description of Artificial Sequence: Synthetic oligonucleotide
  Target: SCN9A; (-) strand; PAM type: YTN; PAM sequence: CTC
aacatcactaatcaccaggg

SEQ ID NO: 71432 - DNA, 20 bp, Artificial Sequence
  Description of Artificial Sequence: Synthetic oligonucleotide
  Target: SCN9A; (-) strand; PAM type: YTN; PAM sequence: CTC
aaaagaagacaaagaaatgc

SEQ ID NO: 71433 - DNA, 20 bp, Artificial Sequence
  Description of Artificial Sequence: Synthetic oligonucleotide
  Target: SCN9A; (-) strand; PAM type: YTN; PAM sequence: TTC
tcaaaagaagacaaagaaat

SEQ ID NO: 71434 - DNA, 20 bp, Artificial Sequence
  Description of Artificial Sequence: Synthetic oligonucleotide
  Target: SCN9A; (-) strand; PAM type: YTN; PAM sequence: TTT
ctcaaaagaagacaaagaaa

SEQ ID NO: 71435 - DNA, 20 bp, Artificial Sequence
  Description of Artificial Sequence: Synthetic oligonucleotide
  Target: SCN9A; (-) strand; PAM type: YTN; PAM sequence: CTG
aatagatatttctcaaaaga

SEQ ID NO: 71436 - DNA, 20 bp, Artificial Sequence
  Description of Artificial Sequence: Synthetic oligonucleotide
  Target: SCN9A; (-) strand; PAM type: YTN; PAM sequence: TTC
aaaaatggacaaaagacctg

SEQ ID NO: 71437 - DNA, 20 bp, Artificial Sequence
  Description of Artificial Sequence: Synthetic oligonucleotide
  Target: SCN9A; (-) strand; PAM type: YTN; PAM sequence: CTC
aacaacgacaaaaaaaacaa

SEQ ID NO: 71438 - DNA, 20 bp, Artificial Sequence
  Description of Artificial Sequence: Synthetic oligonucleotide
  Target: SCN9A; (-) strand; PAM type: YTN; PAM sequence: CTC
aaacaactcaacaacgacaa

SEQ ID NO: 71439 - DNA, 20 bp, Artificial Sequence
  Description of Artificial Sequence: Synthetic oligonucleotide
  Target: SCN9A; (-) strand; PAM type: YTN; PAM sequence: CTA
aaacatacaaggaactcaaa

SEQ ID NO: 71440 - DNA, 20 bp, Artificial Sequence
  Description of Artificial Sequence: Synthetic oligonucleotide
  Target: SCN9A; (-) strand; PAM type: YTN; PAM sequence: TTA
atatctaaaacatacaagga

SEQ ID NO: 71441 - DNA, 20 bp, Artificial Sequence
  Description of Artificial Sequence: Synthetic oligonucleotide
  Target: SCN9A; (-) strand; PAM type: YTN; PAM sequence: CTG
ataatgggttaatatctaaa

SEQ ID NO: 71442 - DNA, 20 bp, Artificial Sequence
  Description of Artificial Sequence: Synthetic oligonucleotide
  Target: SCN9A; (-) strand; PAM type: YTN; PAM sequence: CTA
tgcatctgataatgggttaa

SEQ ID NO: 71443 - DNA, 20 bp, Artificial Sequence
  Description of Artificial Sequence: Synthetic oligonucleotide
  Target: SCN9A; (-) strand; PAM type: YTN; PAM sequence: TTG
taaactatgcatctgataat

SEQ ID NO: 71444 - DNA, 20 bp, Artificial Sequence
  Description of Artificial Sequence: Synthetic oligonucleotide
  Target: SCN9A; (-) strand; PAM type: YTN; PAM sequence: TTT
gtaaactatgcatctgataa

SEQ ID NO: 71445 - DNA, 20 bp, Artificial Sequence
  Description of Artificial Sequence: Synthetic oligonucleotide
  Target: SCN9A; (-) strand; PAM type: YTN; PAM sequence: CTA
cagaatgggaaaataaattt

SEQ ID NO: 71446 - DNA, 20 bp, Artificial Sequence
  Description of Artificial Sequence: Synthetic oligonucleotide
  Target: SCN9A; (-) strand; PAM type: YTN; PAM sequence: CTG
cacagcaaggcaaacaatca

SEQ ID NO: 71447 - DNA, 20 bp, Artificial Sequence
  Description of Artificial Sequence: Synthetic oligonucleotide
  Target: SCN9A; (-) strand; PAM type: YTN; PAM sequence: TTC
tgcacagcaaggcaaacaat

SEQ ID NO: 71448 - DNA, 20 bp, Artificial Sequence
  Description of Artificial Sequence: Synthetic oligonucleotide
  Target: SCN9A; (-) strand; PAM type: YTN; PAM sequence: CTT
ctgcacagcaaggcaaacaa

SEQ ID NO: 71449 - DNA, 20 bp, Artificial Sequence
  Description of Artificial Sequence: Synthetic oligonucleotide
  Target: SCN9A; (-) strand; PAM type: YTN; PAM sequence: CTA
aaaagcttctgcacagcaag

SEQ ID NO: 71450 - DNA, 20 bp, Artificial Sequence
  Description of Artificial Sequence: Synthetic oligonucleotide
  Target: SCN9A; (-) strand; PAM type: YTN; PAM sequence: TTA
aactaaaaagcttctgcaca

SEQ ID NO: 71451 - DNA, 20 bp, Artificial Sequence
  Description of Artificial Sequence: Synthetic oligonucleotide
  Target: SCN9A; (-) strand; PAM type: YTN; PAM sequence: TTA
tattaaactaaaaagcttct

SEQ ID NO: 71452 - DNA, 20 bp, Artificial Sequence
  Description of Artificial Sequence: Synthetic oligonucleotide
  Target: SCN9A; (-) strand; PAM type: YTN; PAM sequence: TTG
gattatattaaactaaaaag

SEQ ID NO: 71453 - DNA, 20 bp, Artificial Sequence
  Description of Artificial Sequence: Synthetic oligonucleotide
  Target: SCN9A; (-) strand; PAM type: YTN; PAM sequence: CTA
aaaagcacaggcaacaaaag

SEQ ID NO: 71454 - DNA, 20 bp, Artificial Sequence
  Description of Artificial Sequence: Synthetic oligonucleotide
  Target: SCN9A; (-) strand; PAM type: YTN; PAM sequence: TTG
gataaaacctaaaaagcaca

SEQ ID NO: 71455 - DNA, 20 bp, Artificial Sequence
  Description of Artificial Sequence: Synthetic oligonucleotide
  Target: SCN9A; (-) strand; PAM type: YTN; PAM sequence: TTT
ggataaaacctaaaaagcac

SEQ ID NO: 71456 - DNA, 20 bp, Artificial Sequence
  Description of Artificial Sequence: Synthetic oligonucleotide
  Target: SCN9A; (-) strand; PAM type: YTN; PAM sequence: TTT
tggataaaacctaaaaagca

SEQ ID NO: 71457 - DNA, 20 bp, Artificial Sequence
  Description of Artificial Sequence: Synthetic oligonucleotide
  Target: SCN9A; (-) strand; PAM type: YTN; PAM sequence: TTT
ttggataaaacctaaaaagc

SEQ ID NO: 71458 - DNA, 20 bp, Artificial Sequence
  Description of Artificial Sequence: Synthetic oligonucleotide
  Target: SCN9A; (-) strand; PAM type: YTN; PAM sequence: TTT
tttggataaaacctaaaaag

SEQ ID NO: 71459 - DNA, 20 bp, Artificial Sequence
  Description of Artificial Sequence: Synthetic oligonucleotide
  Target: SCN9A; (-) strand; PAM type: YTN; PAM sequence: TTT
ttttggataaaacctaaaaa

SEQ ID NO: 71460 - DNA, 20 bp, Artificial Sequence
  Description of Artificial Sequence: Synthetic oligonucleotide
  Target: SCN9A; (-) strand; PAM type: YTN; PAM sequence: CTA
ggcaaggatttttttggata

SEQ ID NO: 71461 - DNA, 20 bp, Artificial Sequence
  Description of Artificial Sequence: Synthetic oligonucleotide
  Target: SCN9A; (-) strand; PAM type: YTN; PAM sequence: TTC
taggcaaggatttttttgga

SEQ ID NO: 71462 - DNA, 20 bp, Artificial Sequence
  Description of Artificial Sequence: Synthetic oligonucleotide
  Target: SCN9A; (-) strand; PAM type: YTN; PAM sequence: TTG
ttctaggcaaggattttttt

SEQ ID NO: 71463 - DNA, 20 bp, Artificial Sequence
  Description of Artificial Sequence: Synthetic oligonucleotide
  Target: SCN9A; (-) strand; PAM type: YTN; PAM sequence: TTC
atgatgttgttctaggcaag

SEQ ID NO: 71464 - DNA, 20 bp, Artificial Sequence
  Description of Artificial Sequence: Synthetic oligonucleotide
  Target: SCN9A; (-) strand; PAM type: YTN; PAM sequence: CTT
catgatgttgttctaggcaa

SEQ ID NO: 71465 - DNA, 20 bp, Artificial Sequence
  Description of Artificial Sequence: Synthetic oligonucleotide
  Target: SCN9A; (-) strand; PAM type: YTN; PAM sequence: TTA
gagaagaaaaaaaacagggg

SEQ ID NO: 71466 - DNA, 20 bp, Artificial Sequence
  Description of Artificial Sequence: Synthetic oligonucleotide
  Target: SCN9A; (-) strand; PAM type: YTN; PAM sequence: CTA
ttagagaagaaaaaaaacag

SEQ ID NO: 71467 - DNA, 20 bp, Artificial Sequence
  Description of Artificial Sequence: Synthetic oligonucleotide
  Target: SCN9A; (-) strand; PAM type: YTN; PAM sequence: CTA
cacaactattagagaagaaa

SEQ ID NO: 71468 - DNA, 20 bp, Artificial Sequence
  Description of Artificial Sequence: Synthetic oligonucleotide
  Target: SCN9A; (-) strand; PAM type: YTN; PAM sequence: CTG
aaaactacacaactattaga

SEQ ID NO: 71469 - DNA, 20 bp, Artificial Sequence
  Description of Artificial Sequence: Synthetic oligonucleotide
  Target: SCN9A; (-) strand; PAM type: YTN; PAM sequence: TTA
aatgtaagactgaaaactac

SEQ ID NO: 71470 - DNA, 20 bp, Artificial Sequence
  Description of Artificial Sequence: Synthetic oligonucleotide
  Target: SCN9A; (-) strand; PAM type: YTN; PAM sequence: CTT
aaatgtaagactgaaaacta

SEQ ID NO: 71471 - DNA, 20 bp, Artificial Sequence
  Description of Artificial Sequence: Synthetic oligonucleotide
  Target: SCN9A; (-) strand; PAM type: YTN; PAM sequence: CTA
cttaaatgtaagactgaaaa

SEQ ID NO: 71472 - DNA, 20 bp, Artificial Sequence
  Description of Artificial Sequence: Synthetic oligonucleotide
  Target: SCN9A; (-) strand; PAM type: YTN; PAM sequence: CTC
aaaatagactacttaaatgt

SEQ ID NO: 71473 - DNA, 20 bp, Artificial Sequence
  Description of Artificial Sequence: Synthetic oligonucleotide
  Target: SCN9A; (-) strand; PAM type: YTN; PAM sequence: TTA
tacacaagtcaactcaaaat

SEQ ID NO: 71474 - DNA, 20 bp, Artificial Sequence
  Description of Artificial Sequence: Synthetic oligonucleotide
  Target: SCN9A; (-) strand; PAM type: YTN; PAM sequence: TTT
atacacaagtcaactcaaaa

SEQ ID NO: 71475 - DNA, 20 bp, Artificial Sequence
  Description of Artificial Sequence: Synthetic oligonucleotide
  Target: SCN9A; (-) strand; PAM type: YTN; PAM sequence: CTT
tatacacaagtcaactcaaa

SEQ ID NO: 71476 - DNA, 20 bp, Artificial Sequence
  Description of Artificial Sequence: Synthetic oligonucleotide
  Target: SCN9A; (-) strand; PAM type: YTN; PAM sequence: TTA
ctttatacacaagtcaactc

SEQ ID NO: 71477 - DNA, 20 bp, Artificial Sequence
  Description of Artificial Sequence: Synthetic oligonucleotide
  Target: SCN9A; (-) strand; PAM type: YTN; PAM sequence: CTT
actttatacacaagtcaact

SEQ ID NO: 71478 - DNA, 20 bp, Artificial Sequence
  Description of Artificial Sequence: Synthetic oligonucleotide
  Target: SCN9A; (-) strand; PAM type: YTN; PAM sequence: CTC
ttactttatacacaagtcaa

SEQ ID NO: 71479 - DNA, 20 bp, Artificial Sequence
  Description of Artificial Sequence: Synthetic oligonucleotide
  Target: SCN9A; (-) strand; PAM type: YTN; PAM sequence: TTA
tctcttactttatacacaag

SEQ ID NO: 71480 - DNA, 20 bp, Artificial Sequence
  Description of Artificial Sequence: Synthetic oligonucleotide
  Target: SCN9A; (-) strand; PAM type: YTN; PAM sequence: TTT
atctcttactttatacacaa

SEQ ID NO: 71481 - DNA, 20 bp, Artificial Sequence
  Description of Artificial Sequence: Synthetic oligonucleotide
  Target: SCN9A; (-) strand; PAM type: YTN; PAM sequence: CTT
tatctcttactttatacaca

SEQ ID NO: 71482 - DNA, 20 bp, Artificial Sequence
  Description of Artificial Sequence: Synthetic oligonucleotide
  Target: SCN9A; (-) strand; PAM type: YTN; PAM sequence: TTA
gacctttatctcttacttta

SEQ ID NO: 71483 - DNA, 20 bp, Artificial Sequence
  Description of Artificial Sequence: Synthetic oligonucleotide
  Target: SCN9A; (-) strand; PAM type: YTN; PAM sequence: CTG
aatagccacatgcaaaagaa

SEQ ID NO: 71484 - DNA, 20 bp, Artificial Sequence
  Description of Artificial Sequence: Synthetic oligonucleotide
  Target: SCN9A; (-) strand; PAM type: YTN; PAM sequence: CTG
ggcaaactgaatagccacat

SEQ ID NO: 71485 - DNA, 20 bp, Artificial Sequence
  Description of Artificial Sequence: Synthetic oligonucleotide
  Target: SCN9A; (-) strand; PAM type: YTN; PAM sequence: TTC
tgggcaaactgaatagccac

SEQ ID NO: 71486 - DNA, 20 bp, Artificial Sequence
  Description of Artificial Sequence: Synthetic oligonucleotide
  Target: SCN9A; (-) strand; PAM type: YTN; PAM sequence: TTA
gtaaatggttctgggcaaac

SEQ ID NO: 71487 - DNA, 20 bp, Artificial Sequence
  Description of Artificial Sequence: Synthetic oligonucleotide
  Target: SCN9A; (-) strand; PAM type: YTN; PAM sequence: TTT
agtaaatggttctgggcaaa

SEQ ID NO: 71488 - DNA, 20 bp, Artificial Sequence
  Description of Artificial Sequence: Synthetic oligonucleotide
  Target: SCN9A; (-) strand; PAM type: YTN; PAM sequence: CTT
tagtaaatggttctgggcaa

SEQ ID NO: 71489 - DNA, 20 bp, Artificial Sequence
  Description of Artificial Sequence: Synthetic oligonucleotide
  Target: SCN9A; (-) strand; PAM type: YTN; PAM sequence: CTC
tttagtaaatggttctgggc

SEQ ID NO: 71490 - DNA, 20 bp, Artificial Sequence
  Description of Artificial Sequence: Synthetic oligonucleotide
  Target: SCN9A; (-) strand; PAM type: YTN; PAM sequence: CTA
taatagagaaaggacagcct

SEQ ID NO: 71491 - DNA, 20 bp, Artificial Sequence
  Description of Artificial Sequence: Synthetic oligonucleotide
  Target: SCN9A; (-) strand; PAM type: YTN; PAM sequence: TTC
caagtacctataatagagaa

SEQ ID NO: 71492 - DNA, 20 bp, Artificial Sequence
  Description of Artificial Sequence: Synthetic oligonucleotide
  Target: SCN9A; (-) strand; PAM type: YTN; PAM sequence: TTG
acaaggttccaagtacctat

SEQ ID NO: 71493 - DNA, 20 bp, Artificial Sequence
  Description of Artificial Sequence: Synthetic oligonucleotide
  Target: SCN9A; (-) strand; PAM type: YTN; PAM sequence: TTT
gacaaggttccaagtaccta

SEQ ID NO: 71494 - DNA, 20 bp, Artificial Sequence
  Description of Artificial Sequence: Synthetic oligonucleotide
  Target: SCN9A; (-) strand; PAM type: YTN; PAM sequence: TTT
tgacaaggttccaagtacct

SEQ ID NO: 71495 - DNA, 20 bp, Artificial Sequence
  Description of Artificial Sequence: Synthetic oligonucleotide
  Target: SCN9A; (-) strand; PAM type: YTN; PAM sequence: CTG
agttttgacaaggttccaag

SEQ ID NO: 71496 - DNA, 20 bp, Artificial Sequence
  Description of Artificial Sequence: Synthetic oligonucleotide
  Target: SCN9A; (-) strand; PAM type: YTN; PAM sequence: CTA
cacatatacagtcaactgag

SEQ ID NO: 71497 - DNA, 20 bp, Artificial Sequence
  Description of Artificial Sequence: Synthetic oligonucleotide
  Target: SCN9A; (-) strand; PAM type: YTN; PAM sequence: CTG
acataaaacagacacacaga

SEQ ID NO: 71498 - DNA, 20 bp, Artificial Sequence
  Description of Artificial Sequence: Synthetic oligonucleotide
  Target: SCN9A; (-) strand; PAM type: YTN; PAM sequence: CTA
tagtaaccaaacagaatgat

SEQ ID NO: 71499 - DNA, 20 bp, Artificial Sequence
  Description of Artificial Sequence: Synthetic oligonucleotide
  Target: SCN9A; (-) strand; PAM type: YTN; PAM sequence: CTA
taaagctatagtaaccaaac

SEQ ID NO: 71500 - DNA, 20 bp, Artificial Sequence
  Description of Artificial Sequence: Synthetic oligonucleotide
  Target: SCN9A; (-) strand; PAM type: YTN; PAM sequence: TTC
aaaacatactataaagctat

SEQ ID NO: 71501 - DNA, 20 bp, Artificial Sequence
  Description of Artificial Sequence: Synthetic oligonucleotide
  Target: SCN9A; (-) strand; PAM type: YTN; PAM sequence: CTT
caaaacatactataaagcta

SEQ ID NO: 71502 - DNA, 20 bp, Artificial Sequence
  Description of Artificial Sequence: Synthetic oligonucleotide
  Target: SCN9A; (-) strand; PAM type: YTN; PAM sequence: CTG
acttcaaaacatactataaa

SEQ ID NO: 71503 - DNA, 20 bp, Artificial Sequence
  Description of Artificial Sequence: Synthetic oligonucleotide
  Target: SCN9A; (-) strand; PAM type: YTN; PAM sequence: CTA
actgacttcaaaacatacta

SEQ ID NO: 71504 - DNA, 20 bp, Artificial Sequence
  Description of Artificial Sequence: Synthetic oligonucleotide
  Target: SCN9A; (-) strand; PAM type: YTN; PAM sequence: TTC
acactaactgacttcaaaac

SEQ ID NO: 71505 - DNA, 20 bp, Artificial Sequence
  Description of Artificial Sequence: Synthetic oligonucleotide
  Target: SCN9A; (-) strand; PAM type: YTN; PAM sequence: CTT
cacactaactgacttcaaaa

SEQ ID NO: 71506 - DNA, 20 bp, Artificial Sequence
  Description of Artificial Sequence: Synthetic oligonucleotide
  Target: SCN9A; (-) strand; PAM type: YTN; PAM sequence: CTG
atggcttcacactaactgac

SEQ ID NO: 71507 - DNA, 20 bp, Artificial Sequence
  Description of Artificial Sequence: Synthetic oligonucleotide
  Target: SCN9A; (-) strand; PAM type: YTN; PAM sequence: CTG
gaacaaaaagaacaaagctg

SEQ ID NO: 71508 - DNA, 20 bp, Artificial Sequence
  Description of Artificial Sequence: Synthetic oligonucleotide
  Target: SCN9A; (-) strand; PAM type: YTN; PAM sequence: CTA
aatagcccaagtaacctgga

SEQ ID NO: 71509 - DNA, 20 bp, Artificial Sequence
  Description of Artificial Sequence: Synthetic oligonucleotide
  Target: SCN9A; (-) strand; PAM type: YTN; PAM sequence: TTG
tatgaaaccacaaaagaccc

SEQ ID NO: 71510 - DNA, 20 bp, Artificial Sequence
  Description of Artificial Sequence: Synthetic oligonucleotide
  Target: SCN9A; (-) strand; PAM type: YTN; PAM sequence: TTT
gtatgaaaccacaaaagacc

SEQ ID NO: 71511 - DNA, 20 bp, Artificial Sequence
  Description of Artificial Sequence: Synthetic oligonucleotide
  Target: SCN9A; (-) strand; PAM type: YTN; PAM sequence: CTA
acatttgtatgaaaccacaa

SEQ ID NO: 71512 - DNA, 20 bp, Artificial Sequence
  Description of Artificial Sequence: Synthetic oligonucleotide
  Target: SCN9A; (-) strand; PAM type: YTN; PAM sequence: TTA
cagaaaaaaaaaaaaaaagt

SEQ ID NO: 71513 - DNA, 20 bp, Artificial Sequence
  Description of Artificial Sequence: Synthetic oligonucleotide
  Target: SCN9A; (-) strand; PAM type: YTN; PAM sequence: TTT
acagaaaaaaaaaaaaaaag

SEQ ID NO: 71514 - DNA, 20 bp, Artificial Sequence
  Description of Artificial Sequence: Synthetic oligonucleotide
  Target: SCN9A; (-) strand; PAM type: YTN; PAM sequence: CTT
tacagaaaaaaaaaaaaaaa

SEQ ID NO: 71515 - DNA, 20 bp, Artificial Sequence
  Description of Artificial Sequence: Synthetic oligonucleotide
  Target: SCN9A; (-) strand; PAM type: YTN; PAM sequence: TTC
tttacagaaaaaaaaaaaaa

SEQ ID NO: 71516 - DNA, 20 bp, Artificial Sequence
  Description of Artificial Sequence: Synthetic oligonucleotide
  Target: SCN9A; (-) strand; PAM type: YTN; PAM sequence: CTA
tcaaaataccagtgacattc

SEQ ID NO: 71517 - DNA, 20 bp, Artificial Sequence
  Description of Artificial Sequence: Synthetic oligonucleotide
  Target: SCN9A; (-) strand; PAM type: YTN; PAM sequence: TTA
atgcaatccctatcaaaata

SEQ ID NO: 71518 - DNA, 20 bp, Artificial Sequence
  Description of Artificial Sequence: Synthetic oligonucleotide
  Target: SCN9A; (-) strand; PAM type: YTN; PAM sequence: TTT
aatgcaatccctatcaaaat

SEQ ID NO: 71519 - DNA, 20 bp, Artificial Sequence
  Description of Artificial Sequence: Synthetic oligonucleotide
  Target: SCN9A; (-) strand; PAM type: YTN; PAM sequence: CTA
caggtttaatgcaatcccta

SEQ ID NO: 71520 - DNA, 20 bp, Artificial Sequence
  Description of Artificial Sequence: Synthetic oligonucleotide
  Target: SCN9A; (-) strand; PAM type: YTN; PAM sequence: TTA
cccaaagcaatctacaggtt

SEQ ID NO: 71521 - DNA, 20 bp, Artificial Sequence
  Description of Artificial Sequence: Synthetic oligonucleotide
  Target: SCN9A; (-) strand; PAM type: YTN; PAM sequence: TTA
aaatgtccatattacccaaa

SEQ ID NO: 71522 - DNA, 20 bp, Artificial Sequence
  Description of Artificial Sequence: Synthetic oligonucleotide
  Target: SCN9A; (-) strand; PAM type: YTN; PAM sequence: TTT
aaaatgtccatattacccaa

SEQ ID NO: 71523 - DNA, 20 bp, Artificial Sequence
  Description of Artificial Sequence: Synthetic oligonucleotide
  Target: SCN9A; (-) strand; PAM type: YTN; PAM sequence: TTT
taaaatgtccatattaccca

SEQ ID NO: 71524 - DNA, 20 bp, Artificial Sequence
  Description of Artificial Sequence: Synthetic oligonucleotide
  Target: SCN9A; (-) strand; PAM type: YTN; PAM sequence: TTT
ttaaaatgtccatattaccc

SEQ ID NO: 71525 - DNA, 20 bp, Artificial Sequence
  Description of Artificial Sequence: Synthetic oligonucleotide
  Target: SCN9A; (-) strand; PAM type: YTN; PAM sequence: TTA
tttttaaaatgtccatatta

SEQ ID NO: 71526 - DNA, 20 bp, Artificial Sequence
  Description of Artificial Sequence: Synthetic oligonucleotide
  Target: SCN9A; (-) strand; PAM type: YTN; PAM sequence: TTA
ttatttttaaaatgtccata

SEQ ID NO: 71527 - DNA, 20 bp, Artificial Sequence
  Description of Artificial Sequence: Synthetic oligonucleotide
  Target: SCN9A; (-) strand; PAM type: YTN; PAM sequence: TTA
gaataattattatttttaaa

SEQ ID NO: 71528 - DNA, 20 bp, Artificial Sequence
  Description of Artificial Sequence: Synthetic oligonucleotide
  Target: SCN9A; (-) strand; PAM type: YTN; PAM sequence: TTC
atggattagaataattatta

SEQ ID NO: 71529 - DNA, 20 bp, Artificial Sequence
  Description of Artificial Sequence: Synthetic oligonucleotide
  Target: SCN9A; (-) strand; PAM type: YTN; PAM sequence: TTC
catgttcatggattagaata

SEQ ID NO: 71530 - DNA, 20 bp, Artificial Sequence
  Description of Artificial Sequence: Synthetic oligonucleotide
  Target: SCN9A; (-) strand; PAM type: YTN; PAM sequence: TTG
aagaggacacaaaaagggaa

SEQ ID NO: 71531 - DNA, 20 bp, Artificial Sequence
  Description of Artificial Sequence: Synthetic oligonucleotide
  Target: SCN9A; (-) strand; PAM type: YTN; PAM sequence: TTG
gtgagagaaattgaagagga

SEQ ID NO: 71532 - DNA, 20 bp, Artificial Sequence
  Description of Artificial Sequence: Synthetic oligonucleotide
  Target: SCN9A; (-) strand; PAM type: YTN; PAM sequence: CTA
taaaatattggtgagagaaa

SEQ ID NO: 71533 - DNA, 20 bp, Artificial Sequence
  Description of Artificial Sequence: Synthetic oligonucleotide
  Target: SCN9A; (-) strand; PAM type: YTN; PAM sequence: TTA
caatgaaaactataaaatat

SEQ ID NO: 71534 - DNA, 20 bp, Artificial Sequence
  Description of Artificial Sequence: Synthetic oligonucleotide
  Target: SCN9A; (-) strand; PAM type: YTN; PAM sequence: TTT
acaatgaaaactataaaata

SEQ ID NO: 71535 - DNA, 20 bp, Artificial Sequence
  Description of Artificial Sequence: Synthetic oligonucleotide
  Target: SCN9A; (-) strand; PAM type: YTN; PAM sequence: TTA
aacaaggaggtgaaatatat

SEQ ID NO: 71536 - DNA, 20 bp, Artificial Sequence
  Description of Artificial Sequence: Synthetic oligonucleotide
  Target: SCN9A; (-) strand; PAM type: YTN; PAM sequence: TTT
aaacaaggaggtgaaatata

SEQ ID NO: 71537 - DNA, 20 bp, Artificial Sequence
  Description of Artificial Sequence: Synthetic oligonucleotide
  Target: SCN9A; (-) strand; PAM type: YTN; PAM sequence: CTA
gaaataaatttaaacaagga

SEQ ID NO: 71538 - DNA, 20 bp, Artificial Sequence
  Description of Artificial Sequence: Synthetic oligonucleotide
  Target: SCN9A; (-) strand; PAM type: YTN; PAM sequence: CTA
caaaaaataaaatacctaga

SEQ ID NO: 71539 - DNA, 20 bp, Artificial Sequence
  Description of Artificial Sequence: Synthetic oligonucleotide
  Target: SCN9A; (-) strand; PAM type: YTN; PAM sequence: TTA
caatagctacaaaaaataaa

SEQ ID NO: 71540 - DNA, 20 bp, Artificial Sequence
  Description of Artificial Sequence: Synthetic oligonucleotide
  Target: SCN9A; (-) strand; PAM type: YTN; PAM sequence: TTT
acaatagctacaaaaaataa

SEQ ID NO: 71541 - DNA, 20 bp, Artificial Sequence
  Description of Artificial Sequence: Synthetic oligonucleotide
  Target: SCN9A; (-) strand; PAM type: YTN; PAM sequence: CTG
aaaataagaaagcaatccca

SEQ ID NO: 71542 - DNA, 20 bp, Artificial Sequence
  Description of Artificial Sequence: Synthetic oligonucleotide
  Target: SCN9A; (-) strand; PAM type: YTN; PAM sequence: TTA
acaacaaataatctgaaaat

SEQ ID NO: 71543 - DNA, 20 bp, Artificial Sequence
  Description of Artificial Sequence: Synthetic oligonucleotide
  Target: SCN9A; (-) strand; PAM type: YTN; PAM sequence: CTA
tatgttaacaacaaataatc

SEQ ID NO: 71544 - DNA, 20 bp, Artificial Sequence
  Description of Artificial Sequence: Synthetic oligonucleotide
  Target: SCN9A; (-) strand; PAM type: YTN; PAM sequence: TTC
tatatgttaacaacaaataa

SEQ ID NO: 71545 - DNA, 20 bp, Artificial Sequence
  Description of Artificial Sequence: Synthetic oligonucleotide
  Target: SCN9A; (-) strand; PAM type: YTN; PAM sequence: TTT
ctatatgttaacaacaaata

SEQ ID NO: 71546 - DNA, 20 bp, Artificial Sequence
  Description of Artificial Sequence: Synthetic oligonucleotide
  Target: SCN9A; (-) strand; PAM type: YTN; PAM sequence: TTA
tttctatatgttaacaacaa

SEQ ID NO: 71547 - DNA, 20 bp, Artificial Sequence
  Description of Artificial Sequence: Synthetic oligonucleotide
  Target: SCN9A; (-) strand; PAM type: YTN; PAM sequence: TTG
gaggacacaaaatcaacatg

SEQ ID NO: 71548 - DNA, 20 bp, Artificial Sequence
  Description of Artificial Sequence: Synthetic oligonucleotide
  Target: SCN9A; (-) strand; PAM type: YTN; PAM sequence: TTC
agtaatgttggaggacacaa

SEQ ID NO: 71549 - DNA, 20 bp, Artificial Sequence
  Description of Artificial Sequence: Synthetic oligonucleotide
  Target: SCN9A; (-) strand; PAM type: YTN; PAM sequence: TTC
ataaatgaattcagtaatgt

SEQ ID NO: 71550 - DNA, 20 bp, Artificial Sequence
  Description of Artificial Sequence: Synthetic oligonucleotide
  Target: SCN9A; (-) strand; PAM type: YTN; PAM sequence: TTT
cataaatgaattcagtaatg

SEQ ID NO: 71551 - DNA, 20 bp, Artificial Sequence
  Description of Artificial Sequence: Synthetic oligonucleotide
  Target: SCN9A; (-) strand; PAM type: YTN; PAM sequence: CTA
atgaccccatgaaaaaaagt

SEQ ID NO: 71552 - DNA, 20 bp, Artificial Sequence
  Description of Artificial Sequence: Synthetic oligonucleotide
  Target: SCN9A; (-) strand; PAM type: YTN; PAM sequence: TTC
taatgaccccatgaaaaaaa

SEQ ID NO: 71553 - DNA, 20 bp, Artificial Sequence
  Description of Artificial Sequence: Synthetic oligonucleotide
  Target: SCN9A; (-) strand; PAM type: YTN; PAM sequence: TTA
gatatagagagttctaatga

SEQ ID NO: 71554 - DNA, 20 bp, Artificial Sequence
  Description of Artificial Sequence: Synthetic oligonucleotide
  Target: SCN9A; (-) strand; PAM type: YTN; PAM sequence: CTT
agatatagagagttctaatg

SEQ ID NO: 71555 - DNA, 20 bp, Artificial Sequence
  Description of Artificial Sequence: Synthetic oligonucleotide
  Target: SCN9A; (-) strand; PAM type: YTN; PAM sequence: CTG
atcttagatatagagagttc

SEQ ID NO: 71556 - DNA, 20 bp, Artificial Sequence
  Description of Artificial Sequence: Synthetic oligonucleotide
  Target: SCN9A; (-) strand; PAM type: YTN; PAM sequence: TTA
tatgatctgatcttagatat

SEQ ID NO: 71557 - DNA, 20 bp, Artificial Sequence
  Description of Artificial Sequence: Synthetic oligonucleotide
  Target: SCN9A; (-) strand; PAM type: YTN; PAM sequence: TTT
atatgatctgatcttagata

SEQ ID NO: 71558 - DNA, 20 bp, Artificial Sequence
  Description of Artificial Sequence: Synthetic oligonucleotide
  Target: SCN9A; (-) strand; PAM type: YTN; PAM sequence: TTT
tatatgatctgatcttagat

SEQ ID NO: 71559 - DNA, 20 bp, Artificial Sequence
  Description of Artificial Sequence: Synthetic oligonucleotide
  Target: SCN9A; (-) strand; PAM type: YTN; PAM sequence: TTT
ttatatgatctgatcttaga

SEQ ID NO: 71560 - DNA, 20 bp, Artificial Sequence
  Description of Artificial Sequence: Synthetic oligonucleotide
  Target: SCN9A; (-) strand; PAM type: YTN; PAM sequence: TTG
tttttatatgatctgatctt

SEQ ID NO: 71561 - DNA, 20 bp, Artificial Sequence
  Description of Artificial Sequence: Synthetic oligonucleotide
  Target: SCN9A; (-) strand; PAM type: YTN; PAM sequence: TTT
gtttttatatgatctgatct

SEQ ID NO: 71562 - DNA, 20 bp, Artificial Sequence
  Description of Artificial Sequence: Synthetic oligonucleotide
  Target: SCN9A; (-) strand; PAM type: YTN; PAM sequence: CTT
tgtttttatatgatctgatc

SEQ ID NO: 71563 - DNA, 20 bp, Artificial Sequence
  Description of Artificial Sequence: Synthetic oligonucleotide
  Target: SCN9A; (-) strand; PAM type: YTN; PAM sequence: CTC
tttgtttttatatgatctga

SEQ ID NO: 71564 - DNA, 20 bp, Artificial Sequence
  Description of Artificial Sequence: Synthetic oligonucleotide
  Target: SCN9A; (-) strand; PAM type: YTN; PAM sequence: TTC
tctttgtttttatatgatct

SEQ ID NO: 71565 - DNA, 20 bp, Artificial Sequence
  Description of Artificial Sequence: Synthetic oligonucleotide
  Target: SCN9A; (-) strand; PAM type: YTN; PAM sequence: TTG
gaaagaaggaagtcaaattc

SEQ ID NO: 71566 - DNA, 20 bp, Artificial Sequence
  Description of Artificial Sequence: Synthetic oligonucleotide
  Target: SCN9A; (-) strand; PAM type: YTN; PAM sequence: TTA
aattggaaagaaggaagtca

SEQ ID NO: 71567 - DNA, 20 bp, Artificial Sequence
  Description of Artificial Sequence: Synthetic oligonucleotide
  Target: SCN9A; (-) strand; PAM type: YTN; PAM sequence: TTT
aaattggaaagaaggaagtc

SEQ ID NO: 71568 - DNA, 20 bp, Artificial Sequence
  Description of Artificial Sequence: Synthetic oligonucleotide
  Target: SCN9A; (-) strand; PAM type: YTN; PAM sequence: CTA
gccagagcaatcaggcaaga

SEQ ID NO: 71569 - DNA, 20 bp, Artificial Sequence
  Description of Artificial Sequence: Synthetic oligonucleotide
  Target: SCN9A; (-) strand; PAM type: YTN; PAM sequence: TTC
tagccagagcaatcaggcaa

SEQ ID NO: 71570 - DNA, 20 bp, Artificial Sequence
  Description of Artificial Sequence: Synthetic oligonucleotide
  Target: SCN9A; (-) strand; PAM type: YTN; PAM sequence: TTC
aacatagtaatgaagttcta

SEQ ID NO: 71571 - DNA, 20 bp, Artificial Sequence
  Description of Artificial Sequence: Synthetic oligonucleotide
  Target: SCN9A; (-) strand; PAM type: YTN; PAM sequence: TTA
ttcaacatagtaatgaagtt

SEQ ID NO: 71572 - DNA, 20 bp, Artificial Sequence
  Description of Artificial Sequence: Synthetic oligonucleotide
  Target: SCN9A; (-) strand; PAM type: YTN; PAM sequence: TTT
attcaacatagtaatgaagt

SEQ ID NO: 71573 - DNA, 20 bp, Artificial Sequence
  Description of Artificial Sequence: Synthetic oligonucleotide
  Target: SCN9A; (-) strand; PAM type: YTN; PAM sequence: TTT
tattcaacatagtaatgaag

SEQ ID NO: 71574 - DNA, 20 bp, Artificial Sequence
  Description of Artificial Sequence: Synthetic oligonucleotide
  Target: SCN9A; (-) strand; PAM type: YTN; PAM sequence: CTT
ttattcaacatagtaatgaa

SEQ ID NO: 71575 - DNA, 20 bp, Artificial Sequence
  Description of Artificial Sequence: Synthetic oligonucleotide
  Target: SCN9A; (-) strand; PAM type: YTN; PAM sequence: CTA
cttttattcaacatagtaat

SEQ ID NO: 71576 - DNA, 20 bp, Artificial Sequence
  Description of Artificial Sequence: Synthetic oligonucleotide
  Target: SCN9A; (-) strand; PAM type: YTN; PAM sequence: TTC
actacttttattcaacatag

SEQ ID NO: 71577 - DNA, 20 bp, Artificial Sequence
  Description of Artificial Sequence: Synthetic oligonucleotide
  Target: SCN9A; (-) strand; PAM type: YTN; PAM sequence: TTT
cactacttttattcaacata

SEQ ID NO: 71578 - DNA, 20 bp, Artificial Sequence
  Description of Artificial Sequence: Synthetic oligonucleotide
  Target: SCN9A; (-) strand; PAM type: YTN; PAM sequence: CTT
tcactacttttattcaacat

SEQ ID NO: 71579 - DNA, 20 bp, Artificial Sequence
  Description of Artificial Sequence: Synthetic oligonucleotide
  Target: SCN9A; (-) strand; PAM type: YTN; PAM sequence: CTG
gaacaagataaggatgccca

SEQ ID NO: 71580 - DNA, 20 bp, Artificial Sequence
  Description of Artificial Sequence: Synthetic oligonucleotide
  Target: SCN9A; (-) strand; PAM type: YTN; PAM sequence: CTC
caagatctggaacaagataa

SEQ ID NO: 71581 - DNA, 20 bp, Artificial Sequence
  Description of Artificial Sequence: Synthetic oligonucleotide
  Target: SCN9A; (-) strand; PAM type: YTN; PAM sequence: CTC
tccaagatctggaacaagat

SEQ ID NO: 71582 - DNA, 20 bp, Artificial Sequence
  Description of Artificial Sequence: Synthetic oligonucleotide
  Target: SCN9A; (-) strand; PAM type: YTN; PAM sequence: TTC
tctccaagatctggaacaag

SEQ ID NO: 71583 - DNA, 20 bp, Artificial Sequence
  Description of Artificial Sequence: Synthetic oligonucleotide
  Target: SCN9A; (-) strand; PAM type: YTN; PAM sequence: TTT
ctctccaagatctggaacaa

SEQ ID NO: 71584 - DNA, 20 bp, Artificial Sequence
  Description of Artificial Sequence: Synthetic oligonucleotide
  Target: SCN9A; (-) strand; PAM type: YTN; PAM sequence: CTT
tctctccaagatctggaaca

SEQ ID NO: 71585 - DNA, 20 bp, Artificial Sequence
  Description of Artificial Sequence: Synthetic oligonucleotide
  Target: SCN9A; (-) strand; PAM type: YTN; PAM sequence: CTG
aaagctttctctccaagatc

SEQ ID NO: 71586 - DNA, 20 bp, Artificial Sequence
  Description of Artificial Sequence: Synthetic oligonucleotide
  Target: SCN9A; (-) strand; PAM type: YTN; PAM sequence: CTA
accagggaagagctgaaagc

SEQ ID NO: 71587 - DNA, 20 bp, Artificial Sequence
  Description of Artificial Sequence: Synthetic oligonucleotide
  Target: SCN9A; (-) strand; PAM type: YTN; PAM sequence: CTA
acatgatactaaccagggaa

SEQ ID NO: 71588 - DNA, 20 bp, Artificial Sequence
  Description of Artificial Sequence: Synthetic oligonucleotide
  Target: SCN9A; (-) strand; PAM type: YTN; PAM sequence: TTA
atgtaatgaaggccatatgt

SEQ ID NO: 71589 - DNA, 20 bp, Artificial Sequence
  Description of Artificial Sequence: Synthetic oligonucleotide
  Target: SCN9A; (-) strand; PAM type: YTN; PAM sequence: CTT
aatgtaatgaaggccatatg

SEQ ID NO: 71590 - DNA, 20 bp, Artificial Sequence
  Description of Artificial Sequence: Synthetic oligonucleotide
  Target: SCN9A; (-) strand; PAM type: YTN; PAM sequence: TTA
agtatagaagaaacatacct

SEQ ID NO: 71591 - DNA, 20 bp, Artificial Sequence
  Description of Artificial Sequence: Synthetic oligonucleotide
  Target: SCN9A; (-) strand; PAM type: YTN; PAM sequence: TTA
tcaacaaattaagtatagaa

SEQ ID NO: 71592 - DNA, 20 bp, Artificial Sequence
  Description of Artificial Sequence: Synthetic oligonucleotide
  Target: SCN9A; (-) strand; PAM type: YTN; PAM sequence: TTG
ataaaaattatcaacaaatt

SEQ ID NO: 71593 - DNA, 20 bp, Artificial Sequence
  Description of Artificial Sequence: Synthetic oligonucleotide
  Target: SCN9A; (-) strand; PAM type: YTN; PAM sequence: TTT
gataaaaattatcaacaaat

SEQ ID NO: 71594 - DNA, 20 bp, Artificial Sequence
  Description of Artificial Sequence: Synthetic oligonucleotide
  Target: SCN9A; (-) strand; PAM type: YTN; PAM sequence: TTA
tttgataaaaattatcaaca

SEQ ID NO: 71595 - DNA, 20 bp, Artificial Sequence
  Description of Artificial Sequence: Synthetic oligonucleotide
  Target: SCN9A; (-) strand; PAM type: YTN; PAM sequence: TTT
atttgataaaaattatcaac

SEQ ID NO: 71596 - DNA, 20 bp, Artificial Sequence
  Description of Artificial Sequence: Synthetic oligonucleotide
  Target: SCN9A; (-) strand; PAM type: YTN; PAM sequence: CTT
tatttgataaaaattatcaa

SEQ ID NO: 71597 - DNA, 20 bp, Artificial Sequence
  Description of Artificial Sequence: Synthetic oligonucleotide
  Target: SCN9A; (-) strand; PAM type: YTN; PAM sequence: TTA
taaaatccagtatcctttat

SEQ ID NO: 71598 - DNA, 20 bp, Artificial Sequence
  Description of Artificial Sequence: Synthetic oligonucleotide
  Target: SCN9A; (-) strand; PAM type: YTN; PAM sequence: TTT
ataaaatccagtatccttta

SEQ ID NO: 71599 - DNA, 20 bp, Artificial Sequence
  Description of Artificial Sequence: Synthetic oligonucleotide
  Target: SCN9A; (-) strand; PAM type: YTN; PAM sequence: TTT
tataaaatccagtatccttt

SEQ ID NO: 71600 - DNA, 20 bp, Artificial Sequence
  Description of Artificial Sequence: Synthetic oligonucleotide
  Target: SCN9A; (-) strand; PAM type: YTN; PAM sequence: CTC
aatagacagagaaaaagcat

SEQ ID NO: 71601 - DNA, 20 bp, Artificial Sequence
  Description of Artificial Sequence: Synthetic oligonucleotide
  Target: SCN9A; (-) strand; PAM type: YTN; PAM sequence: TTA
tatcaacagaatgaaacata

SEQ ID NO: 71602 - DNA, 20 bp, Artificial Sequence
  Description of Artificial Sequence: Synthetic oligonucleotide
  Target: SCN9A; (-) strand; PAM type: YTN; PAM sequence: CTA
tattatatcaacagaatgaa

SEQ ID NO: 71603 - DNA, 20 bp, Artificial Sequence
  Description of Artificial Sequence: Synthetic oligonucleotide
  Target: SCN9A; (-) strand; PAM type: YTN; PAM sequence: TTC
tatattatatcaacagaatg

SEQ ID NO: 71604 - DNA, 20 bp, Artificial Sequence
  Description of Artificial Sequence: Synthetic oligonucleotide
  Target: SCN9A; (-) strand; PAM type: YTN; PAM sequence: TTT
ctatattatatcaacagaat

SEQ ID NO: 71605 - DNA, 20 bp, Artificial Sequence
  Description of Artificial Sequence: Synthetic oligonucleotide
  Target: SCN9A; (-) strand; PAM type: YTN; PAM sequence: CTT
tctatattatatcaacagaa

SEQ ID NO: 71606 - DNA, 20 bp, Artificial Sequence
  Description of Artificial Sequence: Synthetic oligonucleotide
  Target: SCN9A; (-) strand; PAM type: YTN; PAM sequence: TTG
cagaacaataaactttctat

SEQ ID NO: 71607 - DNA, 20 bp, Artificial Sequence
  Description of Artificial Sequence: Synthetic oligonucleotide
  Target: SCN9A; (-) strand; PAM type: YTN; PAM sequence: TTT
gcagaacaataaactttcta

SEQ ID NO: 71608 - DNA, 20 bp, Artificial Sequence
  Description of Artificial Sequence: Synthetic oligonucleotide
  Target: SCN9A; (-) strand; PAM type: YTN; PAM sequence: TTC
aacatttgcagaacaataaa

SEQ ID NO: 71609 - DNA, 20 bp, Artificial Sequence
  Description of Artificial Sequence: Synthetic oligonucleotide
  Target: SCN9A; (-) strand; PAM type: YTN; PAM sequence: TTT
caacatttgcagaacaataa

SEQ ID NO: 71610 - DNA, 20 bp, Artificial Sequence
  Description of Artificial Sequence: Synthetic oligonucleotide
  Target: SCN9A; (-) strand; PAM type: YTN; PAM sequence: CTG
gaaatcgtcccagggatgca

SEQ ID NO: 71611 - DNA, 20 bp, Artificial Sequence
  Description of Artificial Sequence: Synthetic oligonucleotide
  Target: SCN9A; (-) strand; PAM type: YTN; PAM sequence: CTC
aactggaaatcgtcccaggg

SEQ ID NO: 71612 - DNA, 20 bp, Artificial Sequence
  Description of Artificial Sequence: Synthetic oligonucleotide
  Target: SCN9A; (-) strand; PAM type: YTN; PAM sequence: TTC
accatgctcaactggaaatc

SEQ ID NO: 71613 - DNA, 20 bp, Artificial Sequence
  Description of Artificial Sequence: Synthetic oligonucleotide
  Target: SCN9A; (-) strand; PAM type: YTN; PAM sequence: TTA
ttcaccatgctcaactggaa

SEQ ID NO: 71614 - DNA, 20 bp, Artificial Sequence
  Description of Artificial Sequence: Synthetic oligonucleotide
  Target: SCN9A; (-) strand; PAM type: YTN; PAM sequence: CTA
tcaaaaagattattcaccat

SEQ ID NO: 71615 - DNA, 20 bp, Artificial Sequence
  Description of Artificial Sequence: Synthetic oligonucleotide
  Target: SCN9A; (-) strand; PAM type: YTN; PAM sequence: CTC
aaatccaacagcctatcaaa

SEQ ID NO: 71616 - DNA, 20 bp, Artificial Sequence
  Description of Artificial Sequence: Synthetic oligonucleotide
  Target: SCN9A; (-) strand; PAM type: YTN; PAM sequence: CTA
gcaactcaaatccaacagcc

SEQ ID NO: 71617 - DNA, 20 bp, Artificial Sequence
  Description of Artificial Sequence: Synthetic oligonucleotide
  Target: SCN9A; (-) strand; PAM type: YTN; PAM sequence: CTG
atgaacacagatgcaaaatg

SEQ ID NO: 71618 - DNA, 20 bp, Artificial Sequence
  Description of Artificial Sequence: Synthetic oligonucleotide
  Target: SCN9A; (-) strand; PAM type: YTN; PAM sequence: CTA
tccctgatgaacacagatgc

SEQ ID NO: 71619 - DNA, 20 bp, Artificial Sequence
  Description of Artificial Sequence: Synthetic oligonucleotide
  Target: SCN9A; (-) strand; PAM type: YTN; PAM sequence: CTG
aaggccactatccctgatga

SEQ ID NO: 71620 - DNA, 20 bp, Artificial Sequence
  Description of Artificial Sequence: Synthetic oligonucleotide
  Target: SCN9A; (-) strand; PAM type: YTN; PAM sequence: TTA
ccccaataccagaacaagac

SEQ ID NO: 71621 - DNA, 20 bp, Artificial Sequence
  Description of Artificial Sequence: Synthetic oligonucleotide
  Target: SCN9A; (-) strand; PAM type: YTN; PAM sequence: CTA
caaggccaatattaccccaa

SEQ ID NO: 71622 - DNA, 20 bp, Artificial Sequence
  Description of Artificial Sequence: Synthetic oligonucleotide
  Target: SCN9A; (-) strand; PAM type: YTN; PAM sequence: TTC
tacaaggccaatattacccc

SEQ ID NO: 71623 - DNA, 20 bp, Artificial Sequence
  Description of Artificial Sequence: Synthetic oligonucleotide
  Target: SCN9A; (-) strand; PAM type: YTN; PAM sequence: TTC
attctacaaggccaatatta

SEQ ID NO: 71624 - DNA, 20 bp, Artificial Sequence
  Description of Artificial Sequence: Synthetic oligonucleotide
  Target: SCN9A; (-) strand; PAM type: YTN; PAM sequence: CTA
aattcattctacaaggccaa

SEQ ID NO: 71625 - DNA, 20 bp, Artificial Sequence
  Description of Artificial Sequence: Synthetic oligonucleotide
  Target: SCN9A; (-) strand; PAM type: YTN; PAM sequence: TTC
taaattcattctacaaggcc

SEQ ID NO: 71626 - DNA, 20 bp, Artificial Sequence
  Description of Artificial Sequence: Synthetic oligonucleotide
  Target: SCN9A; (-) strand; PAM type: YTN; PAM sequence: CTT
ctaaattcattctacaaggc

SEQ ID NO: 71627 - DNA, 20 bp, Artificial Sequence
  Description of Artificial Sequence: Synthetic oligonucleotide
  Target: SCN9A; (-) strand; PAM type: YTN; PAM sequence: TTC
ttctaaattcattctacaag

SEQ ID NO: 71628 - DNA, 20 bp, Artificial Sequence
  Description of Artificial Sequence: Synthetic oligonucleotide
  Target: SCN9A; (-) strand; PAM type: YTN; PAM sequence: TTC
caaaaaaatcaaaaggaaag

SEQ ID NO: 71629 - DNA, 20 bp, Artificial Sequence
  Description of Artificial Sequence: Synthetic oligonucleotide
  Target: SCN9A; (-) strand; PAM type: YTN; PAM sequence: TTA
ttccaaaaaaatcaaaagga

SEQ ID NO: 71630 - DNA, 20 bp, Artificial Sequence
  Description of Artificial Sequence: Synthetic oligonucleotide
  Target: SCN9A; (-) strand; PAM type: YTN; PAM sequence: TTA
aattattccaaaaaaatcaa

SEQ ID NO: 71631 - DNA, 20 bp, Artificial Sequence
  Description of Artificial Sequence: Synthetic oligonucleotide
  Target: SCN9A; (-) strand; PAM type: YTN; PAM sequence: CTT
aaattattccaaaaaaatca

SEQ ID NO: 71632 - DNA, 20 bp, Artificial Sequence
  Description of Artificial Sequence: Synthetic oligonucleotide
  Target: SCN9A; (-) strand; PAM type: YTN; PAM sequence: TTC
ttaaattattccaaaaaaat

SEQ ID NO: 71633 - DNA, 20 bp, Artificial Sequence
  Description of Artificial Sequence: Synthetic oligonucleotide
  Target: SCN9A; (-) strand; PAM type: YTN; PAM sequence: CTT
cttaaattattccaaaaaaa

SEQ ID NO: 71634 - DNA, 20 bp, Artificial Sequence
  Description of Artificial Sequence: Synthetic oligonucleotide
  Target: SCN9A; (-) strand; PAM type: YTN; PAM sequence: TTC
ttcttaaattattccaaaaa

SEQ ID NO: 71635 - DNA, 20 bp, Artificial Sequence
  Description of Artificial Sequence: Synthetic oligonucleotide
  Target: SCN9A; (-) strand; PAM type: YTN; PAM sequence: CTA
attcttcttaaattattcca

SEQ ID NO: 71636 - DNA, 20 bp, Artificial Sequence
  Description of Artificial Sequence: Synthetic oligonucleotide
  Target: SCN9A; (-) strand; PAM type: YTN; PAM sequence: CTA
atactaattcttcttaaatt

SEQ ID NO: 71637 - DNA, 20 bp, Artificial Sequence
  Description of Artificial Sequence: Synthetic oligonucleotide
  Target: SCN9A; (-) strand; PAM type: YTN; PAM sequence: TTA
aagaagaactaatactaatt

SEQ ID NO: 71638 - DNA, 20 bp, Artificial Sequence
  Description of Artificial Sequence: Synthetic oligonucleotide
  Target: SCN9A; (-) strand; PAM type: YTN; PAM sequence: TTT
aaagaagaactaatactaat

SEQ ID NO: 71639 - DNA, 20 bp, Artificial Sequence
  Description of Artificial Sequence: Synthetic oligonucleotide
  Target: SCN9A; (-) strand; PAM type: YTN; PAM sequence: CTA
ccaaacatttaaagaagaac

SEQ ID NO: 71640 - DNA, 20 bp, Artificial Sequence
  Description of Artificial Sequence: Synthetic oligonucleotide
  Target: SCN9A; (-) strand; PAM type: YTN; PAM sequence: TTC
taccaaacatttaaagaaga

SEQ ID NO: 71641 - DNA, 20 bp, Artificial Sequence
  Description of Artificial Sequence: Synthetic oligonucleotide
  Target: SCN9A; (-) strand; PAM type: YTN; PAM sequence: CTG
atgaattctaccaaacattt

SEQ ID NO: 71642 - DNA, 20 bp, Artificial Sequence
  Description of Artificial Sequence: Synthetic oligonucleotide
  Target: SCN9A; (-) strand; PAM type: YTN; PAM sequence: TTC
actgatgaattctaccaaac

SEQ ID NO: 71643 - DNA, 20 bp, Artificial Sequence
  Description of Artificial Sequence: Synthetic oligonucleotide
  Target: SCN9A; (-) strand; PAM type: YTN; PAM sequence: CTT
cactgatgaattctaccaaa

SEQ ID NO: 71644 - DNA, 20 bp, Artificial Sequence
  Description of Artificial Sequence: Synthetic oligonucleotide
  Target: SCN9A; (-) strand; PAM type: YTN; PAM sequence: CTA
gcaaagaaaagtccaggacc

SEQ ID NO: 71645 - DNA, 20 bp, Artificial Sequence
  Description of Artificial Sequence: Synthetic oligonucleotide
  Target: SCN9A; (-) strand; PAM type: YTN; PAM sequence: CTC
ctagcaaagaaaagtccagg

SEQ ID NO: 71646 - DNA, 20 bp, Artificial Sequence
  Description of Artificial Sequence: Synthetic oligonucleotide
  Target: SCN9A; (-) strand; PAM type: YTN; PAM sequence: CTC
tcctagcaaagaaaagtcca

SEQ ID NO: 71647 - DNA, 20 bp, Artificial Sequence
  Description of Artificial Sequence: Synthetic oligonucleotide
  Target: SCN9A; (-) strand; PAM type: YTN; PAM sequence: TTG
aatcagtaataaaatctctc

SEQ ID NO: 71648 - DNA, 20 bp, Artificial Sequence
  Description of Artificial Sequence: Synthetic oligonucleotide
  Target: SCN9A; (-) strand; PAM type: YTN; PAM sequence: CTC
aaacagaccaataatgagta

SEQ ID NO: 71649 - DNA, 20 bp, Artificial Sequence
  Description of Artificial Sequence: Synthetic oligonucleotide
  Target: SCN9A; (-) strand; PAM type: YTN; PAM sequence: CTG
tatcatgaagaaatggaaaa

SEQ ID NO: 71650 - DNA, 20 bp, Artificial Sequence
  Description of Artificial Sequence: Synthetic oligonucleotide
  Target: SCN9A; (-) strand; PAM type: YTN; PAM sequence: TTG
ccaagactgtatcatgaaga

SEQ ID NO: 71651 - DNA, 20 bp, Artificial Sequence
  Description of Artificial Sequence: Synthetic oligonucleotide
  Target: SCN9A; (-) strand; PAM type: YTN; PAM sequence: CTT
gccaagactgtatcatgaag

SEQ ID NO: 71652 - DNA, 20 bp, Artificial Sequence
  Description of Artificial Sequence: Synthetic oligonucleotide
  Target: SCN9A; (-) strand; PAM type: YTN; PAM sequence: CTC
aacacatacaacttgccaag

SEQ ID NO: 71653 - DNA, 20 bp, Artificial Sequence
  Description of Artificial Sequence: Synthetic oligonucleotide
  Target: SCN9A; (-) strand; PAM type: YTN; PAM sequence: TTA
ctcaacacatacaacttgcc

SEQ ID NO: 71654 - DNA, 20 bp, Artificial Sequence
  Description of Artificial Sequence: Synthetic oligonucleotide
  Target: SCN9A; (-) strand; PAM type: YTN; PAM sequence: TTG
ataaattactcaacacatac

SEQ ID NO: 71655 - DNA, 20 bp, Artificial Sequence
  Description of Artificial Sequence: Synthetic oligonucleotide
  Target: SCN9A; (-) strand; PAM type: YTN; PAM sequence: CTA
atggaaattgataaattact

SEQ ID NO: 71656 - DNA, 20 bp, Artificial Sequence
  Description of Artificial Sequence: Synthetic oligonucleotide
  Target: SCN9A; (-) strand; PAM type: YTN; PAM sequence: TTG
gaaaacctaatggaaattga

SEQ ID NO: 71657 - DNA, 20 bp, Artificial Sequence
  Description of Artificial Sequence: Synthetic oligonucleotide
  Target: SCN9A; (-) strand; PAM type: YTN; PAM sequence: CTC
caacaaattggaaaacctaa

SEQ ID NO: 71658 - DNA, 20 bp, Artificial Sequence
  Description of Artificial Sequence: Synthetic oligonucleotide
  Target: SCN9A; (-) strand; PAM type: YTN; PAM sequence: CTA
tgaacaatcatactccaaca

SEQ ID NO: 71659 - DNA, 20 bp, Artificial Sequence
  Description of Artificial Sequence: Synthetic oligonucleotide
  Target: SCN9A; (-) strand; PAM type: YTN; PAM sequence: CTA
ctatgaacaatcatactcca

SEQ ID NO: 71660 - DNA, 20 bp, Artificial Sequence
  Description of Artificial Sequence: Synthetic oligonucleotide
  Target: SCN9A; (-) strand; PAM type: YTN; PAM sequence: CTG
atcaatagagactactatga

SEQ ID NO: 71661 - DNA, 20 bp, Artificial Sequence
  Description of Artificial Sequence: Synthetic oligonucleotide
  Target: SCN9A; (-) strand; PAM type: YTN; PAM sequence: CTA
ctgatcaatagagactacta

SEQ ID NO: 71662 - DNA, 20 bp, Artificial Sequence
  Description of Artificial Sequence: Synthetic oligonucleotide
  Target: SCN9A; (-) strand; PAM type: YTN; PAM sequence: TTG
cagcagctactgatcaatag

SEQ ID NO: 71663 - DNA, 20 bp, Artificial Sequence
  Description of Artificial Sequence: Synthetic oligonucleotide
  Target: SCN9A; (-) strand; PAM type: YTN; PAM sequence: TTT
gcagcagctactgatcaata

SEQ ID NO: 71664 - DNA, 20 bp, Artificial Sequence
  Description of Artificial Sequence: Synthetic oligonucleotide
  Target: SCN9A; (-) strand; PAM type: YTN; PAM sequence: TTA
acaacgtttgcagcagctac

SEQ ID NO: 71665 - DNA, 20 bp, Artificial Sequence
  Description of Artificial Sequence: Synthetic oligonucleotide
  Target: SCN9A; (-) strand; PAM type: YTN; PAM sequence: TTC
agaatcattaacaacgtttg

SEQ ID NO: 71666 - DNA, 20 bp, Artificial Sequence
  Description of Artificial Sequence: Synthetic oligonucleotide
  Target: SCN9A; (-) strand; PAM type: YTN; PAM sequence: CTT
cagaatcattaacaacgttt

SEQ ID NO: 71667 - DNA, 20 bp, Artificial Sequence
  Description of Artificial Sequence: Synthetic oligonucleotide
  Target: SCN9A; (-) strand; PAM type: YTN; PAM sequence: TTG
gatgcaacttcagaatcatt

SEQ ID NO: 71668 - DNA, 20 bp, Artificial Sequence
  Description of Artificial Sequence: Synthetic oligonucleotide
  Target: SCN9A; (-) strand; PAM type: YTN; PAM sequence: TTT
ggatgcaacttcagaatcat

SEQ ID NO: 71669 - DNA, 20 bp, Artificial Sequence
  Description of Artificial Sequence: Synthetic oligonucleotide
  Target: SCN9A; (-) strand; PAM type: YTN; PAM sequence: CTA
aatttggatgcaacttcaga

SEQ ID NO: 71670 - DNA, 20 bp, Artificial Sequence
  Description of Artificial Sequence: Synthetic oligonucleotide
  Target: SCN9A; (-) strand; PAM type: YTN; PAM sequence: TTG
cctaaatttggatgcaactt

SEQ ID NO: 71671 - DNA, 20 bp, Artificial Sequence
  Description of Artificial Sequence: Synthetic oligonucleotide
  Target: SCN9A; (-) strand; PAM type: YTN; PAM sequence: TTT
gcctaaatttggatgcaact

SEQ ID NO: 71672 - DNA, 20 bp, Artificial Sequence
  Description of Artificial Sequence: Synthetic oligonucleotide
  Target: SCN9A; (-) strand; PAM type: YTN; PAM sequence: TTG
tttgcctaaatttggatgca

SEQ ID NO: 71673 - DNA, 20 bp, Artificial Sequence
  Description of Artificial Sequence: Synthetic oligonucleotide
  Target: SCN9A; (-) strand; PAM type: YTN; PAM sequence: TTG
aattgtttgcctaaatttgg

SEQ ID NO: 71674 - DNA, 20 bp, Artificial Sequence
  Description of Artificial Sequence: Synthetic oligonucleotide
  Target: SCN9A; (-) strand; PAM type: YTN; PAM sequence: TTT
gaattgtttgcctaaatttg

SEQ ID NO: 71675 - DNA, 20 bp, Artificial Sequence
  Description of Artificial Sequence: Synthetic oligonucleotide
  Target: SCN9A; (-) strand; PAM type: YTN; PAM sequence: CTT
tgaattgtttgcctaaattt

SEQ ID NO: 71676 - DNA, 20 bp, Artificial Sequence
  Description of Artificial Sequence: Synthetic oligonucleotide
  Target: SCN9A; (-) strand; PAM type: YTN; PAM sequence: CTG
gatcatatcctttgaattgt

SEQ ID NO: 71677 - DNA, 20 bp, Artificial Sequence
  Description of Artificial Sequence: Synthetic oligonucleotide
  Target: SCN9A; (-) strand; PAM type: YTN; PAM sequence: TTC
tggatcatatcctttgaatt

SEQ ID NO: 71678 - DNA, 20 bp, Artificial Sequence
  Description of Artificial Sequence: Synthetic oligonucleotide
  Target: SCN9A; (-) strand; PAM type: YTN; PAM sequence: CTG
ttctggatcatatcctttga

SEQ ID NO: 71679 - DNA, 20 bp, Artificial Sequence
  Description of Artificial Sequence: Synthetic oligonucleotide
  Target: SCN9A; (-) strand; PAM type: YTN; PAM sequence: TTA
caaatgcctgttctggatca

SEQ ID NO: 71680 - DNA, 20 bp, Artificial Sequence
  Description of Artificial Sequence: Synthetic oligonucleotide
  Target: SCN9A; (-) strand; PAM type: YTN; PAM sequence: TTA
ttacaaatgcctgttctgga

SEQ ID NO: 71681 - DNA, 20 bp, Artificial Sequence
  Description of Artificial Sequence: Synthetic oligonucleotide
  Target: SCN9A; (-) strand; PAM type: YTN; PAM sequence: TTT
attacaaatgcctgttctgg

SEQ ID NO: 71682 - DNA, 20 bp, Artificial Sequence
  Description of Artificial Sequence: Synthetic oligonucleotide
  Target: SCN9A; (-) strand; PAM type: YTN; PAM sequence: CTT
tattacaaatgcctgttctg

SEQ ID NO: 71683 - DNA, 20 bp, Artificial Sequence
  Description of Artificial Sequence: Synthetic oligonucleotide
  Target: SCN9A; (-) strand; PAM type: YTN; PAM sequence: TTG
gggactttattacaaatgcc

SEQ ID NO: 71684 - DNA, 20 bp, Artificial Sequence
  Description of Artificial Sequence: Synthetic oligonucleotide
  Target: SCN9A; (-) strand; PAM type: YTN; PAM sequence: CTT
ggggactttattacaaatgc

SEQ ID NO: 71685 - DNA, 20 bp, Artificial Sequence
  Description of Artificial Sequence: Synthetic oligonucleotide
  Target: SCN9A; (-) strand; PAM type: YTN; PAM sequence: TTA
gtgtgtgaaagacatacttg

SEQ ID NO: 71686 - DNA, 20 bp, Artificial Sequence
  Description of Artificial Sequence: Synthetic oligonucleotide
  Target: SCN9A; (-) strand; PAM type: YTN; PAM sequence: TTT
agtgtgtgaaagacatactt

SEQ ID NO: 71687 - DNA, 20 bp, Artificial Sequence
  Description of Artificial Sequence: Synthetic oligonucleotide
  Target: SCN9A; (-) strand; PAM type: YTN; PAM sequence: TTT
tagtgtgtgaaagacatact

SEQ ID NO: 71688 - DNA, 20 bp, Artificial Sequence
  Description of Artificial Sequence: Synthetic oligonucleotide
  Target: SCN9A; (-) strand; PAM type: YTN; PAM sequence: TTC
agaattttagtgtgtgaaag

SEQ ID NO: 71689 - DNA, 20 bp, Artificial Sequence
  Description of Artificial Sequence: Synthetic oligonucleotide
  Target: SCN9A; (-) strand; PAM type: YTN; PAM sequence: CTT
cagaattttagtgtgtgaaa

SEQ ID NO: 71690 - DNA, 20 bp, Artificial Sequence
  Description of Artificial Sequence: Synthetic oligonucleotide
  Target: SCN9A; (-) strand; PAM type: YTN; PAM sequence: TTA
aaagagatagcgtgatgaag

SEQ ID NO: 71691 - DNA, 20 bp, Artificial Sequence
  Description of Artificial Sequence: Synthetic oligonucleotide
  Target: SCN9A; (-) strand; PAM type: YTN; PAM sequence: TTT
aaaagagatagcgtgatgaa

SEQ ID NO: 71692 - DNA, 20 bp, Artificial Sequence
  Description of Artificial Sequence: Synthetic oligonucleotide
  Target: SCN9A; (-) strand; PAM type: YTN; PAM sequence: TTG
aatttaaaagagatagcgtg

SEQ ID NO: 71693 - DNA, 20 bp, Artificial Sequence
  Description of Artificial Sequence: Synthetic oligonucleotide
  Target: SCN9A; (-) strand; PAM type: YTN; PAM sequence: TTA
cagattgaatttaaaagaga

SEQ ID NO: 71694 - DNA, 20 bp, Artificial Sequence
  Description of Artificial Sequence: Synthetic oligonucleotide
  Target: SCN9A; (-) strand; PAM type: YTN; PAM sequence: TTG
gttacagattgaatttaaaa

SEQ ID NO: 71695 - DNA, 20 bp, Artificial Sequence
  Description of Artificial Sequence: Synthetic oligonucleotide
  Target: SCN9A; (-) strand; PAM type: YTN; PAM sequence: CTA
ttggttacagattgaattta

SEQ ID NO: 71696 - DNA, 20 bp, Artificial Sequence
  Description of Artificial Sequence: Synthetic oligonucleotide
  Target: SCN9A; (-) strand; PAM type: YTN; PAM sequence: CTG
taagtagctattggttacag

SEQ ID NO: 71697 - DNA, 20 bp, Artificial Sequence
  Description of Artificial Sequence: Synthetic oligonucleotide
  Target: SCN9A; (-) strand; PAM type: YTN; PAM sequence: TTA
tatacacactgtaagtagct

SEQ ID NO: 71698 - DNA, 20 bp, Artificial Sequence
  Description of Artificial Sequence: Synthetic oligonucleotide
  Target: SCN9A; (-) strand; PAM type: YTN; PAM sequence: CTT
atatacacactgtaagtagc

SEQ ID NO: 71699 - DNA, 20 bp, Artificial Sequence
  Description of Artificial Sequence: Synthetic oligonucleotide
  Target: SCN9A; (-) strand; PAM type: YTN; PAM sequence: TTG
agtgcttatatacacactgt

SEQ ID NO: 71700 - DNA, 20 bp, Artificial Sequence
  Description of Artificial Sequence: Synthetic oligonucleotide
  Target: SCN9A; (-) strand; PAM type: YTN; PAM sequence: TTA
taagtatggaattgagtgct

SEQ ID NO: 71701 - DNA, 20 bp, Artificial Sequence
  Description of Artificial Sequence: Synthetic oligonucleotide
  Target: SCN9A; (-) strand; PAM type: YTN; PAM sequence: TTA
ttataagtatggaattgagt

SEQ ID NO: 71702 - DNA, 20 bp, Artificial Sequence
  Description of Artificial Sequence: Synthetic oligonucleotide
  Target: SCN9A; (-) strand; PAM type: YTN; PAM sequence: CTC
aatgtacaattattataagt

SEQ ID NO: 71703 - DNA, 20 bp, Artificial Sequence
  Description of Artificial Sequence: Synthetic oligonucleotide
  Target: SCN9A; (-) strand; PAM type: YTN; PAM sequence: TTG
aaaagtgctcaatgtacaat

SEQ ID NO: 71704 - DNA, 20 bp, Artificial Sequence
  Description of Artificial Sequence: Synthetic oligonucleotide
  Target: SCN9A; (-) strand; PAM type: YTN; PAM sequence: TTA
ttgaaaagtgctcaatgtac

SEQ ID NO: 71705 - DNA, 20 bp, Artificial Sequence
  Description of Artificial Sequence: Synthetic oligonucleotide
  Target: SCN9A; (-) strand; PAM type: YTN; PAM sequence: CTT
attgaaaagtgctcaatgta

SEQ ID NO: 71706 - DNA, 20 bp, Artificial Sequence
  Description of Artificial Sequence: Synthetic oligonucleotide
  Target: SCN9A; (-) strand; PAM type: YTN; PAM sequence: TTA
gacaaatgcttattgaaaag

SEQ ID NO: 71707 - DNA, 20 bp, Artificial Sequence
  Description of Artificial Sequence: Synthetic oligonucleotide
  Target: SCN9A; (-) strand; PAM type: YTN; PAM sequence: CTC
ataaataattagacaaatgc

SEQ ID NO: 71708 - DNA, 20 bp, Artificial Sequence
  Description of Artificial Sequence: Synthetic oligonucleotide
  Target: SCN9A; (-) strand; PAM type: YTN; PAM sequence: TTC
tcataaataattagacaaat

SEQ ID NO: 71709 - DNA, 20 bp, Artificial Sequence
  Description of Artificial Sequence: Synthetic oligonucleotide
  Target: SCN9A; (-) strand; PAM type: YTN; PAM sequence: TTA
tatgattctcataaataatt

SEQ ID NO: 71710 - DNA, 20 bp, Artificial Sequence
  Description of Artificial Sequence: Synthetic oligonucleotide
  Target: SCN9A; (-) strand; PAM type: YTN; PAM sequence: TTG
taataaagattatatgattc

SEQ ID NO: 71711 - DNA, 20 bp, Artificial Sequence
  Description of Artificial Sequence: Synthetic oligonucleotide
  Target: SCN9A; (-) strand; PAM type: YTN; PAM sequence: TTA
tgtgtaaaatagattgtaat

SEQ ID NO: 71712 - DNA, 20 bp, Artificial Sequence
  Description of Artificial Sequence: Synthetic oligonucleotide
  Target: SCN9A; (-) strand; PAM type: YTN; PAM sequence: TTT
atgtgtaaaatagattgtaa

SEQ ID NO: 71713 - DNA, 20 bp, Artificial Sequence
  Description of Artificial Sequence: Synthetic oligonucleotide
  Target: SCN9A; (-) strand; PAM type: YTN; PAM sequence: TTA
tttatgtgtaaaatagattg

SEQ ID NO: 71714 - DNA, 20 bp, Artificial Sequence
  Description of Artificial Sequence: Synthetic oligonucleotide
  Target: SCN9A; (-) strand; PAM type: YTN; PAM sequence: TTT
atttatgtgtaaaatagatt

SEQ ID NO: 71715 - DNA, 20 bp, Artificial Sequence
  Description of Artificial Sequence: Synthetic oligonucleotide
  Target: SCN9A; (-) strand; PAM type: YTN; PAM sequence: TTC
agtttatttatgtgtaaaat

SEQ ID NO: 71716 - DNA, 20 bp, Artificial Sequence
  Description of Artificial Sequence: Synthetic oligonucleotide
  Target: SCN9A; (-) strand; PAM type: YTN; PAM sequence: TTT
cagtttatttatgtgtaaaa

SEQ ID NO: 71717 - DNA, 20 bp, Artificial Sequence
  Description of Artificial Sequence: Synthetic oligonucleotide
  Target: SCN9A; (-) strand; PAM type: YTN; PAM sequence: TTT
tcagtttatttatgtgtaaa

SEQ ID NO: 71718 - DNA, 20 bp, Artificial Sequence
  Description of Artificial Sequence: Synthetic oligonucleotide
  Target: SCN9A; (-) strand; PAM type: YTN; PAM sequence: TTT
ttcagtttatttatgtgtaa

SEQ ID NO: 71719 - DNA, 20 bp, Artificial Sequence
  Description of Artificial Sequence: Synthetic oligonucleotide
  Target: SCN9A; (-) strand; PAM type: YTN; PAM sequence: TTT
tttcagtttatttatgtgta

SEQ ID NO: 71720 - DNA, 20 bp, Artificial Sequence
  Description of Artificial Sequence: Synthetic oligonucleotide
  Target: SCN9A; (-) strand; PAM type: YTN; PAM sequence: TTT
ttttcagtttatttatgtgt

SEQ ID NO: 71721 - DNA, 20 bp, Artificial Sequence
  Description of Artificial Sequence: Synthetic oligonucleotide
  Target: SCN9A; (-) strand; PAM type: YTN; PAM sequence: TTA
caaaaacatttttttcagtt

SEQ ID NO: 71722 - DNA, 20 bp, Artificial Sequence
  Description of Artificial Sequence: Synthetic oligonucleotide
  Target: SCN9A; (-) strand; PAM type: YTN; PAM sequence: TTT
acaaaaacatttttttcagt

SEQ ID NO: 71723 - DNA, 20 bp, Artificial Sequence
  Description of Artificial Sequence: Synthetic oligonucleotide
  Target: SCN9A; (-) strand; PAM type: YTN; PAM sequence: TTG
agcaatttacaaaaacattt

SEQ ID NO: 71724 - DNA, 20 bp, Artificial Sequence
  Description of Artificial Sequence: Synthetic oligonucleotide
  Target: SCN9A; (-) strand; PAM type: YTN; PAM sequence: CTT
gagcaatttacaaaaacatt

SEQ ID NO: 71725 - DNA, 20 bp, Artificial Sequence
  Description of Artificial Sequence: Synthetic oligonucleotide
  Target: SCN9A; (-) strand; PAM type: YTN; PAM sequence: TTG
ataagaccttgagcaattta

SEQ ID NO: 71726 - DNA, 20 bp, Artificial Sequence
  Description of Artificial Sequence: Synthetic oligonucleotide
  Target: SCN9A; (-) strand; PAM type: YTN; PAM sequence: TTT
gataagaccttgagcaattt

SEQ ID NO: 71727 - DNA, 20 bp, Artificial Sequence
  Description of Artificial Sequence: Synthetic oligonucleotide
  Target: SCN9A; (-) strand; PAM type: YTN; PAM sequence: TTT
tgataagaccttgagcaatt

SEQ ID NO: 71728 - DNA, 20 bp, Artificial Sequence
  Description of Artificial Sequence: Synthetic oligonucleotide
  Target: SCN9A; (-) strand; PAM type: YTN; PAM sequence: CTT
ttgataagaccttgagcaat

SEQ ID NO: 71729 - DNA, 20 bp, Artificial Sequence
  Description of Artificial Sequence: Synthetic oligonucleotide
  Target: SCN9A; (-) strand; PAM type: YTN; PAM sequence: TTA
gcttttgataagaccttgag

SEQ ID NO: 71730 - DNA, 20 bp, Artificial Sequence
  Description of Artificial Sequence: Synthetic oligonucleotide
  Target: SCN9A; (-) strand; PAM type: YTN; PAM sequence: CTT
agcttttgataagaccttga

SEQ ID NO: 71731 - DNA, 20 bp, Artificial Sequence
  Description of Artificial Sequence: Synthetic oligonucleotide
  Target: SCN9A; (-) strand; PAM type: YTN; PAM sequence: CTC
aaatcttagcttttgataag

SEQ ID NO: 71732 - DNA, 20 bp, Artificial Sequence
  Description of Artificial Sequence: Synthetic oligonucleotide
  Target: SCN9A; (-) strand; PAM type: YTN; PAM sequence: TTG
cctcaaatcttagcttttga

SEQ ID NO: 71733 - DNA, 20 bp, Artificial Sequence
  Description of Artificial Sequence: Synthetic oligonucleotide
  Target: SCN9A; (-) strand; PAM type: YTN; PAM sequence: TTT
gcctcaaatcttagcttttg

SEQ ID NO: 71734 - DNA, 20 bp, Artificial Sequence
  Description of Artificial Sequence: Synthetic oligonucleotide
  Target: SCN9A; (-) strand; PAM type: YTN; PAM sequence: TTA
agatagaatatttgcctcaa

SEQ ID NO: 71735 - DNA, 20 bp, Artificial Sequence
  Description of Artificial Sequence: Synthetic oligonucleotide
  Target: SCN9A; (-) strand; PAM type: YTN; PAM sequence: TTT
aagatagaatatttgcctca

SEQ ID NO: 71736 - DNA, 20 bp, Artificial Sequence
  Description of Artificial Sequence: Synthetic oligonucleotide
  Target: SCN9A; (-) strand; PAM type: YTN; PAM sequence: TTT
taagatagaatatttgcctc

SEQ ID NO: 71737 - DNA, 20 bp, Artificial Sequence
  Description of Artificial Sequence: Synthetic oligonucleotide
  Target: SCN9A; (-) strand; PAM type: YTN; PAM sequence: TTT
ttaagatagaatatttgcct

SEQ ID NO: 71738 - DNA, 20 bp, Artificial Sequence
  Description of Artificial Sequence: Synthetic oligonucleotide
  Target: SCN9A; (-) strand; PAM type: YTN; PAM sequence: CTT
tttaagatagaatatttgcc

SEQ ID NO: 71739 - DNA, 20 bp, Artificial Sequence
  Description of Artificial Sequence: Synthetic oligonucleotide
  Target: SCN9A; (-) strand; PAM type: YTN; PAM sequence: TTA
agaatgccactttttaagat

SEQ ID NO: 71740 - DNA, 20 bp, Artificial Sequence
  Description of Artificial Sequence: Synthetic oligonucleotide
  Target: SCN9A; (-) strand; PAM type: YTN; PAM sequence: TTG
ggatatagttaagaatgcca

SEQ ID NO: 71741 - DNA, 20 bp, Artificial Sequence
  Description of Artificial Sequence: Synthetic oligonucleotide
  Target: SCN9A; (-) strand; PAM type: YTN; PAM sequence: CTT
gggatatagttaagaatgcc

SEQ ID NO: 71742 - DNA, 20 bp, Artificial Sequence
  Description of Artificial Sequence: Synthetic oligonucleotide
  Target: SCN9A; (-) strand; PAM type: YTN; PAM sequence: CTA
ccttgggatatagttaagaa

SEQ ID NO: 71743 - DNA, 20 bp, Artificial Sequence
  Description of Artificial Sequence: Synthetic oligonucleotide
  Target: SCN9A; (-) strand; PAM type: YTN; PAM sequence: TTA
gccactaccttgggatatag

SEQ ID NO: 71744 - DNA, 20 bp, Artificial Sequence
  Description of Artificial Sequence: Synthetic oligonucleotide
  Target: SCN9A; (-) strand; PAM type: YTN; PAM sequence: CTT
agccactaccttgggatata

SEQ ID NO: 71745 - DNA, 20 bp, Artificial Sequence
  Description of Artificial Sequence: Synthetic oligonucleotide
  Target: SCN9A; (-) strand; PAM type: YTN; PAM sequence: TTA
agtcttagccactaccttgg

SEQ ID NO: 71746 - DNA, 20 bp, Artificial Sequence
  Description of Artificial Sequence: Synthetic oligonucleotide
  Target: SCN9A; (-) strand; PAM type: YTN; PAM sequence: TTA
tgtcattaagtcttagccac

SEQ ID NO: 71747 - DNA, 20 bp, Artificial Sequence
  Description of Artificial Sequence: Synthetic oligonucleotide
  Target: SCN9A; (-) strand; PAM type: YTN; PAM sequence: TTT
atgtcattaagtcttagcca

SEQ ID NO: 71748 - DNA, 20 bp, Artificial Sequence
  Description of Artificial Sequence: Synthetic oligonucleotide
  Target: SCN9A; (-) strand; PAM type: YTN; PAM sequence: TTA
tatatttatgtcattaagtc

SEQ ID NO: 71749 - DNA, 20 bp, Artificial Sequence
  Description of Artificial Sequence: Synthetic oligonucleotide
  Target: SCN9A; (-) strand; PAM type: YTN; PAM sequence: TTT
atatatttatgtcattaagt

SEQ ID NO: 71750 - DNA, 20 bp, Artificial Sequence
  Description of Artificial Sequence: Synthetic oligonucleotide
  Target: SCN9A; (-) strand; PAM type: YTN; PAM sequence: CTA
atttatatatttatgtcatt

SEQ ID NO: 71751 - DNA, 20 bp, Artificial Sequence
  Description of Artificial Sequence: Synthetic oligonucleotide
  Target: SCN9A; (-) strand; PAM type: YTN; PAM sequence: CTC
ctaatttatatatttatgtc

SEQ ID NO: 71752 - DNA, 20 bp, Artificial Sequence
  Description of Artificial Sequence: Synthetic oligonucleotide
  Target: SCN9A; (-) strand; PAM type: YTN; PAM sequence: TTA
cccaatagaaagtaactcct

SEQ ID NO: 71753 - DNA, 20 bp, Artificial Sequence
  Description of Artificial Sequence: Synthetic oligonucleotide
  Target: SCN9A; (-) strand; PAM type: YTN; PAM sequence: TTG
aattacccaatagaaagtaa

SEQ ID NO: 71754 - DNA, 20 bp, Artificial Sequence
  Description of Artificial Sequence: Synthetic oligonucleotide
  Target: SCN9A; (-) strand; PAM type: YTN; PAM sequence: CTG
gatgagccaaagaggcaaat

SEQ ID NO: 71755 - DNA, 20 bp, Artificial Sequence
  Description of Artificial Sequence: Synthetic oligonucleotide
  Target: SCN9A; (-) strand; PAM type: YTN; PAM sequence: TTG
tgatgagcctggatgagcca

SEQ ID NO: 71756 - DNA, 20 bp, Artificial Sequence
  Description of Artificial Sequence: Synthetic oligonucleotide
  Target: SCN9A; (-) strand; PAM type: YTN; PAM sequence: TTT
gtgatgagcctggatgagcc

SEQ ID NO: 71757 - DNA, 20 bp, Artificial Sequence
  Description of Artificial Sequence: Synthetic oligonucleotide
  Target: SCN9A; (-) strand; PAM type: YTN; PAM sequence: TTG
tgtttgtgatgagcctggat

SEQ ID NO: 71758 - DNA, 20 bp, Artificial Sequence
  Description of Artificial Sequence: Synthetic oligonucleotide
  Target: SCN9A; (-) strand; PAM type: YTN; PAM sequence: TTG
aaatagtgatggttgtgttt

SEQ ID NO: 71759 - DNA, 20 bp, Artificial Sequence
  Description of Artificial Sequence: Synthetic oligonucleotide
  Target: SCN9A; (-) strand; PAM type: YTN; PAM sequence: TTT
gaaatagtgatggttgtgtt

SEQ ID NO: 71760 - DNA, 20 bp, Artificial Sequence
  Description of Artificial Sequence: Synthetic oligonucleotide
  Target: SCN9A; (-) strand; PAM type: YTN; PAM sequence: CTT
tgaaatagtgatggttgtgt

SEQ ID NO: 71761 - DNA, 20 bp, Artificial Sequence
  Description of Artificial Sequence: Synthetic oligonucleotide
  Target: SCN9A; (-) strand; PAM type: YTN; PAM sequence: CTG
agatgcctttgaaatagtga

SEQ ID NO: 71762 - DNA, 20 bp, Artificial Sequence
  Description of Artificial Sequence: Synthetic oligonucleotide
  Target: SCN9A; (-) strand; PAM type: YTN; PAM sequence: TTC
gtatctgagatgcctttgaa

SEQ ID NO: 71763 - DNA, 20 bp, Artificial Sequence
  Description of Artificial Sequence: Synthetic oligonucleotide
  Target: SCN9A; (-) strand; PAM type: YTN; PAM sequence: TTT
cgtatctgagatgcctttga

SEQ ID NO: 71764 - DNA, 20 bp, Artificial Sequence
  Description of Artificial Sequence: Synthetic oligonucleotide
  Target: SCN9A; (-) strand; PAM type: YTN; PAM sequence: TTT
tcgtatctgagatgcctttg

SEQ ID NO: 71765 - DNA, 20 bp, Artificial Sequence
  Description of Artificial Sequence: Synthetic oligonucleotide
  Target: SCN9A; (-) strand; PAM type: YTN; PAM sequence: TTT
ttcgtatctgagatgccttt

SEQ ID NO: 71766 - DNA, 20 bp, Artificial Sequence
  Description of Artificial Sequence: Synthetic oligonucleotide
  Target: SCN9A; (-) strand; PAM type: YTN; PAM sequence: TTT
tttcgtatctgagatgcctt

SEQ ID NO: 71767 - DNA, 20 bp, Artificial Sequence
  Description of Artificial Sequence: Synthetic oligonucleotide
  Target: SCN9A; (-) strand; PAM type: YTN; PAM sequence: TTT
ttttcgtatctgagatgcct

SEQ ID NO: 71768 - DNA, 20 bp, Artificial Sequence
  Description of Artificial Sequence: Synthetic oligonucleotide
  Target: SCN9A; (-) strand; PAM type: YTN; PAM sequence: TTA
tttttttcgtatctgagatg

SEQ ID NO: 71769 - DNA, 20 bp, Artificial Sequence
  Description of Artificial Sequence: Synthetic oligonucleotide
  Target: SCN9A; (-) strand; PAM type: YTN; PAM sequence: TTT
atttttttcgtatctgagat

SEQ ID NO: 71770 - DNA, 20 bp, Artificial Sequence
  Description of Artificial Sequence: Synthetic oligonucleotide
  Target: SCN9A; (-) strand; PAM type: YTN; PAM sequence: TTT
tatttttttcgtatctgaga

SEQ ID NO: 71771 - DNA, 20 bp, Artificial Sequence
  Description of Artificial Sequence: Synthetic oligonucleotide
  Target: SCN9A; (-) strand; PAM type: YTN; PAM sequence: CTT
ttatttttttcgtatctgag

SEQ ID NO: 71772 - DNA, 20 bp, Artificial Sequence
  Description of Artificial Sequence: Synthetic oligonucleotide
  Target: SCN9A; (-) strand; PAM type: YTN; PAM sequence: TTG
caacttttatttttttcgta

SEQ ID NO: 71773 - DNA, 20 bp, Artificial Sequence
  Description of Artificial Sequence: Synthetic oligonucleotide
  Target: SCN9A; (-) strand; PAM type: YTN; PAM sequence: TTT
gcaacttttatttttttcgt

SEQ ID NO: 71774 - DNA, 20 bp, Artificial Sequence
  Description of Artificial Sequence: Synthetic oligonucleotide
  Target: SCN9A; (-) strand; PAM type: YTN; PAM sequence: TTT
tgcaacttttatttttttcg

SEQ ID NO: 71775 - DNA, 20 bp, Artificial Sequence
  Description of Artificial Sequence: Synthetic oligonucleotide
  Target: SCN9A; (-) strand; PAM type: YTN; PAM sequence: CTT
ttgcaacttttatttttttc

SEQ ID NO: 71776 - DNA, 20 bp, Artificial Sequence
  Description of Artificial Sequence: Synthetic oligonucleotide
  Target: SCN9A; (-) strand; PAM type: YTN; PAM sequence: CTC
ttttgcaacttttatttttt

SEQ ID NO: 71777 - DNA, 20 bp, Artificial Sequence
  Description of Artificial Sequence: Synthetic oligonucleotide
  Target: SCN9A; (-) strand; PAM type: YTN; PAM sequence: TTC
cctcttttgcaacttttatt

SEQ ID NO: 71778 - DNA, 20 bp, Artificial Sequence
  Description of Artificial Sequence: Synthetic oligonucleotide
  Target: SCN9A; (-) strand; PAM type: YTN; PAM sequence: CTG
tgaattccctcttttgcaac

SEQ ID NO: 71779 - DNA, 20 bp, Artificial Sequence
  Description of Artificial Sequence: Synthetic oligonucleotide
  Target: SCN9A; (-) strand; PAM type: YTN; PAM sequence: TTG
aactgtgaattccctctttt

SEQ ID NO: 71780 - DNA, 20 bp, Artificial Sequence
  Description of Artificial Sequence: Synthetic oligonucleotide
  Target: SCN9A; (-) strand; PAM type: YTN; PAM sequence: CTT
gaactgtgaattccctcttt

SEQ ID NO: 71781 - DNA, 20 bp, Artificial Sequence
  Description of Artificial Sequence: Synthetic oligonucleotide
  Target: SCN9A; (-) strand; PAM type: YTN; PAM sequence: TTC
ccagagtcttgaactgtgaa

SEQ ID NO: 71782 - DNA, 20 bp, Artificial Sequence
  Description of Artificial Sequence: Synthetic oligonucleotide
  Target: SCN9A; (-) strand; PAM type: YTN; PAM sequence: TTG
agttcccagagtcttgaact

SEQ ID NO: 71783 - DNA, 20 bp, Artificial Sequence
  Description of Artificial Sequence: Synthetic oligonucleotide
  Target: SCN9A; (-) strand; PAM type: YTN; PAM sequence: CTT
gagttcccagagtcttgaac

SEQ ID NO: 71784 - DNA, 20 bp, Artificial Sequence
  Description of Artificial Sequence: Synthetic oligonucleotide
  Target: SCN9A; (-) strand; PAM type: YTN; PAM sequence: CTC
ccacttgagttcccagagtc

SEQ ID NO: 71785 - DNA, 20 bp, Artificial Sequence
  Description of Artificial Sequence: Synthetic oligonucleotide
  Target: SCN9A; (-) strand; PAM type: YTN; PAM sequence: TTC
atctcccacttgagttccca

SEQ ID NO: 71786 - DNA, 20 bp, Artificial Sequence
  Description of Artificial Sequence: Synthetic oligonucleotide
  Target: SCN9A; (-) strand; PAM type: YTN; PAM sequence: CTT
catctcccacttgagttccc

SEQ ID NO: 71787 - DNA, 20 bp, Artificial Sequence
  Description of Artificial Sequence: Synthetic oligonucleotide
  Target: SCN9A; (-) strand; PAM type: YTN; PAM sequence: CTC
ataatcttcatctcccactt

SEQ ID NO: 71788 - DNA, 20 bp, Artificial Sequence
  Description of Artificial Sequence: Synthetic oligonucleotide
  Target: SCN9A; (-) strand; PAM type: YTN; PAM sequence: TTC
tcataatcttcatctcccac

SEQ ID NO: 71789 - DNA, 20 bp, Artificial Sequence
  Description of Artificial Sequence: Synthetic oligonucleotide
  Target: SCN9A; (-) strand; PAM type: YTN; PAM sequence: CTA
attctcataatcttcatctc

SEQ ID NO: 71790 - DNA, 20 bp, Artificial Sequence
  Description of Artificial Sequence: Synthetic oligonucleotide
  Target: SCN9A; (-) strand; PAM type: YTN; PAM sequence: CTC
taattctcataatcttcatc

SEQ ID NO: 71791 - DNA, 20 bp, Artificial Sequence
  Description of Artificial Sequence: Synthetic oligonucleotide
  Target: SCN9A; (-) strand; PAM type: YTN; PAM sequence: CTG
ctctaattctcataatcttc

SEQ ID NO: 71792 - DNA, 20 bp, Artificial Sequence
  Description of Artificial Sequence: Synthetic oligonucleotide
  Target: SCN9A; (-) strand; PAM type: YTN; PAM sequence: TTC
ctgctctaattctcataatc

SEQ ID NO: 71793 - DNA, 20 bp, Artificial Sequence
  Description of Artificial Sequence: Synthetic oligonucleotide
  Target: SCN9A; (-) strand; PAM type: YTN; PAM sequence: TTT
cctgctctaattctcataat

SEQ ID NO: 71794 - DNA, 20 bp, Artificial Sequence
  Description of Artificial Sequence: Synthetic oligonucleotide
  Target: SCN9A; (-) strand; PAM type: YTN; PAM sequence: TTT
tcctgctctaattctcataa

SEQ ID NO: 71795 - DNA, 20 bp, Artificial Sequence
  Description of Artificial Sequence: Synthetic oligonucleotide
  Target: SCN9A; (-) strand; PAM type: YTN; PAM sequence: CTT
ttcctgctctaattctcata

SEQ ID NO: 71796 - DNA, 20 bp, Artificial Sequence
  Description of Artificial Sequence: Synthetic oligonucleotide
  Target: SCN9A; (-) strand; PAM type: YTN; PAM sequence: CTA
acttttcctgctctaattct

SEQ ID NO: 71797 - DNA, 20 bp, Artificial Sequence
  Description of Artificial Sequence: Synthetic oligonucleotide
  Target: SCN9A; (-) strand; PAM type: YTN; PAM sequence: CTA
tgctaacttttcctgctcta

SEQ ID NO: 71798 - DNA, 20 bp, Artificial Sequence
  Description of Artificial Sequence: Synthetic oligonucleotide
  Target: SCN9A; (-) strand; PAM type: YTN; PAM sequence: CTC
ctatgctaacttttcctgct

SEQ ID NO: 71799 - DNA, 20 bp, Artificial Sequence
  Description of Artificial Sequence: Synthetic oligonucleotide
  Target: SCN9A; (-) strand; PAM type: YTN; PAM sequence: TTA
atcctcctatgctaactttt

SEQ ID NO: 71800 - DNA, 20 bp, Artificial Sequence
  Description of Artificial Sequence: Synthetic oligonucleotide
  Target: SCN9A; (-) strand; PAM type: YTN; PAM sequence: TTT
aatcctcctatgctaacttt

SEQ ID NO: 71801 - DNA, 20 bp, Artificial Sequence
  Description of Artificial Sequence: Synthetic oligonucleotide
  Target: SCN9A; (-) strand; PAM type: YTN; PAM sequence: CTT
taatcctcctatgctaactt

SEQ ID NO: 71802 - DNA, 20 bp, Artificial Sequence
  Description of Artificial Sequence: Synthetic oligonucleotide
  Target: SCN9A; (-) strand; PAM type: YTN; PAM sequence: CTA
aaatgtctttaatcctccta

SEQ ID NO: 71803 - DNA, 20 bp, Artificial Sequence
  Description of Artificial Sequence: Synthetic oligonucleotide
  Target: SCN9A; (-) strand; PAM type: YTN; PAM sequence: TTG
tctaaaatgtctttaatcct

SEQ ID NO: 71804 - DNA, 20 bp, Artificial Sequence
  Description of Artificial Sequence: Synthetic oligonucleotide
  Target: SCN9A; (-) strand; PAM type: YTN; PAM sequence: TTT
gtctaaaatgtctttaatcc

SEQ ID NO: 71805 - DNA, 20 bp, Artificial Sequence
  Description of Artificial Sequence: Synthetic oligonucleotide
  Target: SCN9A; (-) strand; PAM type: YTN; PAM sequence: TTA
tttgtctaaaatgtctttaa

SEQ ID NO: 71806 - DNA, 20 bp, Artificial Sequence
  Description of Artificial Sequence: Synthetic oligonucleotide
  Target: SCN9A; (-) strand; PAM type: YTN; PAM sequence: TTT
atttgtctaaaatgtcttta

SEQ ID NO: 71807 - DNA, 20 bp, Artificial Sequence
  Description of Artificial Sequence: Synthetic oligonucleotide
  Target: SCN9A; (-) strand; PAM type: YTN; PAM sequence: TTA
tttatttgtctaaaatgtct

SEQ ID NO: 71808 - DNA, 20 bp, Artificial Sequence
  Description of Artificial Sequence: Synthetic oligonucleotide
  Target: SCN9A; (-) strand; PAM type: YTN; PAM sequence: TTT
atttatttgtctaaaatgtc

SEQ ID NO: 71809 - DNA, 20 bp, Artificial Sequence
  Description of Artificial Sequence: Synthetic oligonucleotide
  Target: SCN9A; (-) strand; PAM type: YTN; PAM sequence: TTT
tatttatttgtctaaaatgt

SEQ ID NO: 71810 - DNA, 20 bp, Artificial Sequence
  Description of Artificial Sequence: Synthetic oligonucleotide
  Target: SCN9A; (-) strand; PAM type: YTN; PAM sequence: CTA
aaatagtgtacattttattt

SEQ ID NO: 71811 - DNA, 20 bp, Artificial Sequence
  Description of Artificial Sequence: Synthetic oligonucleotide
  Target: SCN9A; (-) strand; PAM type: YTN; PAM sequence: TTC
agatcactaaaatagtgtac

SEQ ID NO: 71812 - DNA, 20 bp, Artificial Sequence
  Description of Artificial Sequence: Synthetic oligonucleotide
  Target: SCN9A; (-) strand; PAM type: YTN; PAM sequence: TTC
ccattcagatcactaaaata

SEQ ID NO: 71813 - DNA, 20 bp, Artificial Sequence
  Description of Artificial Sequence: Synthetic oligonucleotide
  Target: SCN9A; (-) strand; PAM type: YTN; PAM sequence: TTT
cccattcagatcactaaaat

SEQ ID NO: 71814 - DNA, 20 bp, Artificial Sequence
  Description of Artificial Sequence: Synthetic oligonucleotide
  Target: SCN9A; (-) strand; PAM type: YTN; PAM sequence: TTT
tcccattcagatcactaaaa

SEQ ID NO: 71815 - DNA, 20 bp, Artificial Sequence
  Description of Artificial Sequence: Synthetic oligonucleotide
  Target: SCN9A; (-) strand; PAM type: YTN; PAM sequence: TTG
ttttcccattcagatcacta

SEQ ID NO: 71816 - DNA, 20 bp, Artificial Sequence
  Description of Artificial Sequence: Synthetic oligonucleotide
  Target: SCN9A; (-) strand; PAM type: YTN; PAM sequence: TTT
gttttcccattcagatcact

SEQ ID NO: 71817 - DNA, 20 bp, Artificial Sequence
  Description of Artificial Sequence: Synthetic oligonucleotide
  Target: SCN9A; (-) strand; PAM type: YTN; PAM sequence: TTT
tgttttcccattcagatcac

SEQ ID NO: 71818 - DNA, 20 bp, Artificial Sequence
  Description of Artificial Sequence: Synthetic oligonucleotide
  Target: SCN9A; (-) strand; PAM type: YTN; PAM sequence: TTG
ttttgttttcccattcagat

SEQ ID NO: 71819 - DNA, 20 bp, Artificial Sequence
  Description of Artificial Sequence: Synthetic oligonucleotide
  Target: SCN9A; (-) strand; PAM type: YTN; PAM sequence: TTT
gttttgttttcccattcaga

SEQ ID NO: 71820 - DNA, 20 bp, Artificial Sequence
  Description of Artificial Sequence: Synthetic oligonucleotide
  Target: SCN9A; (-) strand; PAM type: YTN; PAM sequence: TTT
tgttttgttttcccattcag

SEQ ID NO: 71821 - DNA, 20 bp, Artificial Sequence
  Description of Artificial Sequence: Synthetic oligonucleotide
  Target: SCN9A; (-) strand; PAM type: YTN; PAM sequence: TTG
ttttgttttgttttcccatt

SEQ ID NO: 71822 - DNA, 20 bp, Artificial Sequence
  Description of Artificial Sequence: Synthetic oligonucleotide
  Target: SCN9A; (-) strand; PAM type: YTN; PAM sequence: TTT
gttttgttttgttttcccat

SEQ ID NO: 71823 - DNA, 20 bp, Artificial Sequence
  Description of Artificial Sequence: Synthetic oligonucleotide
  Target: SCN9A; (-) strand; PAM type: YTN; PAM sequence: TTT
tgttttgttttgttttccca

SEQ ID NO: 71824 - DNA, 20 bp, Artificial Sequence
  Description of Artificial Sequence: Synthetic oligonucleotide
  Target: SCN9A; (-) strand; PAM type: YTN; PAM sequence: TTT
ttgttttgttttgttttccc

SEQ ID NO: 71825 - DNA, 20 bp, Artificial Sequence
  Description of Artificial Sequence: Synthetic oligonucleotide
  Target: SCN9A; (-) strand; PAM type: YTN; PAM sequence: CTG
tcatttttgttttgttttgt

SEQ ID NO: 71826 - DNA, 20 bp, Artificial Sequence
  Description of Artificial Sequence: Synthetic oligonucleotide
  Target: SCN9A; (-) strand; PAM type: YTN; PAM sequence: TTC
tgtcatttttgttttgtttt

SEQ ID NO: 71827 - DNA, 20 bp, Artificial Sequence
  Description of Artificial Sequence: Synthetic oligonucleotide
  Target: SCN9A; (-) strand; PAM type: YTN; PAM sequence: TTA
aattctgtcatttttgtttt

SEQ ID NO: 71828 - DNA, 20 bp, Artificial Sequence
  Description of Artificial Sequence: Synthetic oligonucleotide
  Target: SCN9A; (-) strand; PAM type: YTN; PAM sequence: TTT
aaattctgtcatttttgttt

SEQ ID NO: 71829 - DNA, 20 bp, Artificial Sequence
  Description of Artificial Sequence: Synthetic oligonucleotide
  Target: SCN9A; (-) strand; PAM type: YTN; PAM sequence: TTC
cagtttaaattctgtcattt

SEQ ID NO: 71830 - DNA, 20 bp, Artificial Sequence
  Description of Artificial Sequence: Synthetic oligonucleotide
  Target: SCN9A; (-) strand; PAM type: YTN; PAM sequence: TTT
ccagtttaaattctgtcatt

SEQ ID NO: 71831 - DNA, 20 bp, Artificial Sequence
  Description of Artificial Sequence: Synthetic oligonucleotide
  Target: SCN9A; (-) strand; PAM type: YTN; PAM sequence: TTA
aaatgtttccagtttaaatt

SEQ ID NO: 71832 - DNA, 20 bp, Artificial Sequence
  Description of Artificial Sequence: Synthetic oligonucleotide
  Target: SCN9A; (-) strand; PAM type: YTN; PAM sequence: TTC
agattaaaatgtttccagtt

SEQ ID NO: 71833 - DNA, 20 bp, Artificial Sequence
  Description of Artificial Sequence: Synthetic oligonucleotide
  Target: SCN9A; (-) strand; PAM type: YTN; PAM sequence: CTT
cagattaaaatgtttccagt

SEQ ID NO: 71834 - DNA, 20 bp, Artificial Sequence
  Description of Artificial Sequence: Synthetic oligonucleotide
  Target: SCN9A; (-) strand; PAM type: YTN; PAM sequence: CTC
ttcagattaaaatgtttcca

SEQ ID NO: 71835 - DNA, 20 bp, Artificial Sequence
  Description of Artificial Sequence: Synthetic oligonucleotide
  Target: SCN9A; (-) strand; PAM type: YTN; PAM sequence: TTC
cagcctcttcagattaaaat

SEQ ID NO: 71836 - DNA, 20 bp, Artificial Sequence
  Description of Artificial Sequence: Synthetic oligonucleotide
  Target: SCN9A; (-) strand; PAM type: YTN; PAM sequence: TTT
ccagcctcttcagattaaaa

SEQ ID NO: 71837 - DNA, 20 bp, Artificial Sequence
  Description of Artificial Sequence: Synthetic oligonucleotide
  Target: SCN9A; (-) strand; PAM type: YTN; PAM sequence: CTT
tccagcctcttcagattaaa

SEQ ID NO: 71838 - DNA, 20 bp, Artificial Sequence
  Description of Artificial Sequence: Synthetic oligonucleotide
  Target: SCN9A; (-) strand; PAM type: YTN; PAM sequence: TTC
tttccagcctcttcagatta

SEQ ID NO: 71839 - DNA, 20 bp, Artificial Sequence
  Description of Artificial Sequence: Synthetic oligonucleotide
  Target: SCN9A; (-) strand; PAM type: YTN; PAM sequence: TTT
ctttccagcctcttcagatt

SEQ ID NO: 71840 - DNA, 20 bp, Artificial Sequence
  Description of Artificial Sequence: Synthetic oligonucleotide
  Target: SCN9A; (-) strand; PAM type: YTN; PAM sequence: CTT
tctttccagcctcttcagat

SEQ ID NO: 71841 - DNA, 20 bp, Artificial Sequence
  Description of Artificial Sequence: Synthetic oligonucleotide
  Target: SCN9A; (-) strand; PAM type: YTN; PAM sequence: CTA
aggtctttctttccagcctc

SEQ ID NO: 71842 - DNA, 20 bp, Artificial Sequence
  Description of Artificial Sequence: Synthetic oligonucleotide
  Target: SCN9A; (-) strand; PAM type: YTN; PAM sequence: TTA
catctaaggtctttctttcc

SEQ ID NO: 71843 - DNA, 20 bp, Artificial Sequence
  Description of Artificial Sequence: Synthetic oligonucleotide
  Target: SCN9A; (-) strand; PAM type: YTN; PAM sequence: CTT
acatctaaggtctttctttc

SEQ ID NO: 71844 - DNA, 20 bp, Artificial Sequence
  Description of Artificial Sequence: Synthetic oligonucleotide
  Target: SCN9A; (-) strand; PAM type: YTN; PAM sequence: CTA
taaaaaccttacatctaagg

SEQ ID NO: 71845 - DNA, 20 bp, Artificial Sequence
  Description of Artificial Sequence: Synthetic oligonucleotide
  Target: SCN9A; (-) strand; PAM type: YTN; PAM sequence: CTG
tggtcaactataaaaacctt

SEQ ID NO: 71846 - DNA, 20 bp, Artificial Sequence
  Description of Artificial Sequence: Synthetic oligonucleotide
  Target: SCN9A; (-) strand; PAM type: YTN; PAM sequence: TTA
agctgtggtcaactataaaa

SEQ ID NO: 71847 - DNA, 20 bp, Artificial Sequence
  Description of Artificial Sequence: Synthetic oligonucleotide
  Target: SCN9A; (-) strand; PAM type: YTN; PAM sequence: TTG
ataagatattaagctgtggt

SEQ ID NO: 71848 - DNA, 20 bp, Artificial Sequence
  Description of Artificial Sequence: Synthetic oligonucleotide
  Target: SCN9A; (-) strand; PAM type: YTN; PAM sequence: TTT
gataagatattaagctgtgg

SEQ ID NO: 71849 - DNA, 20 bp, Artificial Sequence
  Description of Artificial Sequence: Synthetic oligonucleotide
  Target: SCN9A; (-) strand; PAM type: YTN; PAM sequence: TTG
tttgataagatattaagctg

SEQ ID NO: 71850 - DNA, 20 bp, Artificial Sequence
  Description of Artificial Sequence: Synthetic oligonucleotide
  Target: SCN9A; (-) strand; PAM type: YTN; PAM sequence: TTT
gtttgataagatattaagct

SEQ ID NO: 71851 - DNA, 20 bp, Artificial Sequence
  Description of Artificial Sequence: Synthetic oligonucleotide
  Target: SCN9A; (-) strand; PAM type: YTN; PAM sequence: CTA
gaggaaatttgtttgataag

SEQ ID NO: 71852 - DNA, 20 bp, Artificial Sequence
  Description of Artificial Sequence: Synthetic oligonucleotide
  Target: SCN9A; (-) strand; PAM type: YTN; PAM sequence: TTC
aagatctagaggaaatttgt

SEQ ID NO: 71853 - DNA, 20 bp, Artificial Sequence
  Description of Artificial Sequence: Synthetic oligonucleotide
  Target: SCN9A; (-) strand; PAM type: YTN; PAM sequence: TTG
agaaataatgaaggttcaag

SEQ ID NO: 71854 - DNA, 20 bp, Artificial Sequence
  Description of Artificial Sequence: Synthetic oligonucleotide
  Target: SCN9A; (-) strand; PAM type: YTN; PAM sequence: CTG
aaaatataagaattgagaaa

SEQ ID NO: 71855 - DNA, 20 bp, Artificial Sequence
  Description of Artificial Sequence: Synthetic oligonucleotide
  Target: SCN9A; (-) strand; PAM type: YTN; PAM sequence: CTA
cctgaaaatataagaattga

SEQ ID NO: 71856 - DNA, 20 bp, Artificial Sequence
  Description of Artificial Sequence: Synthetic oligonucleotide
  Target: SCN9A; (-) strand; PAM type: YTN; PAM sequence: TTA
agtatagacaaacctacctg

SEQ ID NO: 71857 - DNA, 20 bp, Artificial Sequence
  Description of Artificial Sequence: Synthetic oligonucleotide
  Target: SCN9A; (-) strand; PAM type: YTN; PAM sequence: CTC
aaagtatgtcatattaagta

SEQ ID NO: 71858 - DNA, 20 bp, Artificial Sequence
  Description of Artificial Sequence: Synthetic oligonucleotide
  Target: SCN9A; (-) strand; PAM type: YTN; PAM sequence: TTC
catgacgtatctcaaagtat

SEQ ID NO: 71859 - DNA, 20 bp, Artificial Sequence
  Description of Artificial Sequence: Synthetic oligonucleotide
  Target: SCN9A; (-) strand; PAM type: YTN; PAM sequence: TTT
ccatgacgtatctcaaagta

SEQ ID NO: 71860 - DNA, 20 bp, Artificial Sequence
  Description of Artificial Sequence: Synthetic oligonucleotide
  Target: SCN9A; (-) strand; PAM type: YTN; PAM sequence: TTT
tccatgacgtatctcaaagt

SEQ ID NO: 71861 - DNA, 20 bp, Artificial Sequence
  Description of Artificial Sequence: Synthetic oligonucleotide
  Target: SCN9A; (-) strand; PAM type: YTN; PAM sequence: TTC
ataaaaaattttccatgacg

SEQ ID NO: 71862 - DNA, 20 bp, Artificial Sequence
  Description of Artificial Sequence: Synthetic oligonucleotide
  Target: SCN9A; (-) strand; PAM type: YTN; PAM sequence: CTT
cataaaaaattttccatgac

SEQ ID NO: 71863 - DNA, 20 bp, Artificial Sequence
  Description of Artificial Sequence: Synthetic oligonucleotide
  Target: SCN9A; (-) strand; PAM type: YTN; PAM sequence: TTC
ttcataaaaaattttccatg

SEQ ID NO: 71864 - DNA, 20 bp, Artificial Sequence
  Description of Artificial Sequence: Synthetic oligonucleotide
  Target: SCN9A; (-) strand; PAM type: YTN; PAM sequence: CTT
cttcataaaaaattttccat

SEQ ID NO: 71865 - DNA, 20 bp, Artificial Sequence
  Description of Artificial Sequence: Synthetic oligonucleotide
  Target: SCN9A; (-) strand; PAM type: YTN; PAM sequence: TTA
cccttcttcataaaaaattt

SEQ ID NO: 71866 - DNA, 20 bp, Artificial Sequence
  Description of Artificial Sequence: Synthetic oligonucleotide
  Target: SCN9A; (-) strand; PAM type: YTN; PAM sequence: TTT
acccttcttcataaaaaatt

SEQ ID NO: 71867 - DNA, 20 bp, Artificial Sequence
  Description of Artificial Sequence: Synthetic oligonucleotide
  Target: SCN9A; (-) strand; PAM type: YTN; PAM sequence: TTG
aaagtttacccttcttcata

SEQ ID NO: 71868 - DNA, 20 bp, Artificial Sequence
  Description of Artificial Sequence: Synthetic oligonucleotide
  Target: SCN9A; (-) strand; PAM type: YTN; PAM sequence: TTT
gaaagtttacccttcttcat

SEQ ID NO: 71869 - DNA, 20 bp, Artificial Sequence
  Description of Artificial Sequence: Synthetic oligonucleotide
  Target: SCN9A; (-) strand; PAM type: YTN; PAM sequence: CTT
tgaaagtttacccttcttca

SEQ ID NO: 71870 - DNA, 20 bp, Artificial Sequence
  Description of Artificial Sequence: Synthetic oligonucleotide
  Target: SCN9A; (-) strand; PAM type: YTN; PAM sequence: TTA
tgaactttgaaagtttaccc

SEQ ID NO: 71871 - DNA, 20 bp, Artificial Sequence
  Description of Artificial Sequence: Synthetic oligonucleotide
  Target: SCN9A; (-) strand; PAM type: YTN; PAM sequence: CTA
attatgaactttgaaagttt

SEQ ID NO: 71872 - DNA, 20 bp, Artificial Sequence
  Description of Artificial Sequence: Synthetic oligonucleotide
  Target: SCN9A; (-) strand; PAM type: YTN; PAM sequence: TTC
taattatgaactttgaaagt

SEQ ID NO: 71873 - DNA, 20 bp, Artificial Sequence
  Description of Artificial Sequence: Synthetic oligonucleotide
  Target: SCN9A; (-) strand; PAM type: YTN; PAM sequence: CTT
ctaattatgaactttgaaag

SEQ ID NO: 71874 - DNA, 20 bp, Artificial Sequence
  Description of Artificial Sequence: Synthetic oligonucleotide
  Target: SCN9A; (-) strand; PAM type: YTN; PAM sequence: CTG
acttctaattatgaactttg

SEQ ID NO: 71875 - DNA, 20 bp, Artificial Sequence
  Description of Artificial Sequence: Synthetic oligonucleotide
  Target: SCN9A; (-) strand; PAM type: YTN; PAM sequence: CTA
ctgacttctaattatgaact

SEQ ID NO: 71876 - DNA, 20 bp, Artificial Sequence
  Description of Artificial Sequence: Synthetic oligonucleotide
  Target: SCN9A; (-) strand; PAM type: YTN; PAM sequence: TTA
gtgctactgacttctaatta

SEQ ID NO: 71877 - DNA, 20 bp, Artificial Sequence
  Description of Artificial Sequence: Synthetic oligonucleotide
  Target: SCN9A; (-) strand; PAM type: YTN; PAM sequence: CTT
agtgctactgacttctaatt

SEQ ID NO: 71878 - DNA, 20 bp, Artificial Sequence
  Description of Artificial Sequence: Synthetic oligonucleotide
  Target: SCN9A; (-) strand; PAM type: YTN; PAM sequence: TTC
ttagtgctactgacttctaa

SEQ ID NO: 71879 - DNA, 20 bp, Artificial Sequence
  Description of Artificial Sequence: Synthetic oligonucleotide
  Target: SCN9A; (-) strand; PAM type: YTN; PAM sequence: CTC
aggttcttagtgctactgac

SEQ ID NO: 71880 - DNA, 20 bp, Artificial Sequence
  Description of Artificial Sequence: Synthetic oligonucleotide
  Target: SCN9A; (-) strand; PAM type: YTN; PAM sequence: TTA
agaactcaggttcttagtgc

SEQ ID NO: 71881 - DNA, 20 bp, Artificial Sequence
  Description of Artificial Sequence: Synthetic oligonucleotide
  Target: SCN9A; (-) strand; PAM type: YTN; PAM sequence: CTT
aagaactcaggttcttagtg

SEQ ID NO: 71882 - DNA, 20 bp, Artificial Sequence
  Description of Artificial Sequence: Synthetic oligonucleotide
  Target: SCN9A; (-) strand; PAM type: YTN; PAM sequence: TTA
cttaagaactcaggttctta

SEQ ID NO: 71883 - DNA, 20 bp, Artificial Sequence
  Description of Artificial Sequence: Synthetic oligonucleotide
  Target: SCN9A; (-) strand; PAM type: YTN; PAM sequence: TTA
ttacttaagaactcaggttc

SEQ ID NO: 71884 - DNA, 20 bp, Artificial Sequence
  Description of Artificial Sequence: Synthetic oligonucleotide
  Target: SCN9A; (-) strand; PAM type: YTN; PAM sequence: TTA
ttattacttaagaactcagg

SEQ ID NO: 71885 - DNA, 20 bp, Artificial Sequence
  Description of Artificial Sequence: Synthetic oligonucleotide
  Target: SCN9A; (-) strand; PAM type: YTN; PAM sequence: CTG
catcattattattacttaag

SEQ ID NO: 71886 - DNA, 20 bp, Artificial Sequence
  Description of Artificial Sequence: Synthetic oligonucleotide
  Target: SCN9A; (-) strand; PAM type: YTN; PAM sequence: TTC
tgcatcattattattactta

SEQ ID NO: 71887 - DNA, 20 bp, Artificial Sequence
  Description of Artificial Sequence: Synthetic oligonucleotide
  Target: SCN9A; (-) strand; PAM type: YTN; PAM sequence: TTT
ctgcatcattattattactt

SEQ ID NO: 71888 - DNA, 20 bp, Artificial Sequence
  Description of Artificial Sequence: Synthetic oligonucleotide
  Target: SCN9A; (-) strand; PAM type: YTN; PAM sequence: TTG
tcatcgatttctgcatcatt

SEQ ID NO: 71889 - DNA, 20 bp, Artificial Sequence
  Description of Artificial Sequence: Synthetic oligonucleotide
  Target: SCN9A; (-) strand; PAM type: YTN; PAM sequence: TTG
ttgtcatcgatttctgcatc

SEQ ID NO: 71890 - DNA, 20 bp, Artificial Sequence
  Description of Artificial Sequence: Synthetic oligonucleotide
  Target: SCN9A; (-) strand; PAM type: YTN; PAM sequence: TTT
gttgtcatcgatttctgcat

SEQ ID NO: 71891 - DNA, 20 bp, Artificial Sequence
  Description of Artificial Sequence: Synthetic oligonucleotide
  Target: SCN9A; (-) strand; PAM type: YTN; PAM sequence: TTA
aaaaaagtgtttgttgtcat

SEQ ID NO: 71892 - DNA, 20 bp, Artificial Sequence
  Description of Artificial Sequence: Synthetic oligonucleotide
  Target: SCN9A; (-) strand; PAM type: YTN; PAM sequence: TTT
aaaaaaagtgtttgttgtca

SEQ ID NO: 71893 - DNA, 20 bp, Artificial Sequence
  Description of Artificial Sequence: Synthetic oligonucleotide
  Target: SCN9A; (-) strand; PAM type: YTN; PAM sequence: TTT
taaaaaaagtgtttgttgtc

SEQ ID NO: 71894 - DNA, 20 bp, Artificial Sequence
  Description of Artificial Sequence: Synthetic oligonucleotide
  Target: SCN9A; (-) strand; PAM type: YTN; PAM sequence: TTA
gcaagccattttaaaaaaag

SEQ ID NO: 71895 - DNA, 20 bp, Artificial Sequence
  Description of Artificial Sequence: Synthetic oligonucleotide
  Target: SCN9A; (-) strand; PAM type: YTN; PAM sequence: TTG
aattagcaagccattttaaa

SEQ ID NO: 71896 - DNA, 20 bp, Artificial Sequence
  Description of Artificial Sequence: Synthetic oligonucleotide
  Target: SCN9A; (-) strand; PAM type: YTN; PAM sequence: TTT
gaattagcaagccattttaa

SEQ ID NO: 71897 - DNA, 20 bp, Artificial Sequence
  Description of Artificial Sequence: Synthetic oligonucleotide
  Target: SCN9A; (-) strand; PAM type: YTN; PAM sequence: TTA
agtcatgtagcatagtgttt

SEQ ID NO: 71898 - DNA, 20 bp, Artificial Sequence
  Description of Artificial Sequence: Synthetic oligonucleotide
  Target: SCN9A; (-) strand; PAM type: YTN; PAM sequence: TTT
aagtcatgtagcatagtgtt

SEQ ID NO: 71899 - DNA, 20 bp, Artificial Sequence
  Description of Artificial Sequence: Synthetic oligonucleotide
  Target: SCN9A; (-) strand; PAM type: YTN; PAM sequence: TTT
taagtcatgtagcatagtgt

SEQ ID NO: 71900 - DNA, 20 bp, Artificial Sequence
  Description of Artificial Sequence: Synthetic oligonucleotide
  Target: SCN9A; (-) strand; PAM type: YTN; PAM sequence: TTT
ttaagtcatgtagcatagtg

SEQ ID NO: 71901 - DNA, 20 bp, Artificial Sequence
  Description of Artificial Sequence: Synthetic oligonucleotide
  Target: SCN9A; (-) strand; PAM type: YTN; PAM sequence: CTA
gtatttttaagtcatgtagc

SEQ ID NO: 71902 - DNA, 20 bp, Artificial Sequence
  Description of Artificial Sequence: Synthetic oligonucleotide
  Target: SCN9A; (-) strand; PAM type: YTN; PAM sequence: TTG
tagtaacagatacacaagct

SEQ ID NO: 71903 - DNA, 20 bp, Artificial Sequence
  Description of Artificial Sequence: Synthetic oligonucleotide
  Target: SCN9A; (-) strand; PAM type: YTN; PAM sequence: TTA
gaggttgtagtaacagatac

SEQ ID NO: 71904 - DNA, 20 bp, Artificial Sequence
  Description of Artificial Sequence: Synthetic oligonucleotide
  Target: SCN9A; (-) strand; PAM type: YTN; PAM sequence: CTT
agaggttgtagtaacagata

SEQ ID NO: 71905 - DNA, 20 bp, Artificial Sequence
  Description of Artificial Sequence: Synthetic oligonucleotide
  Target: SCN9A; (-) strand; PAM type: YTN; PAM sequence: CTA
ccttagaggttgtagtaaca

SEQ ID NO: 71906 - DNA, 20 bp, Artificial Sequence
  Description of Artificial Sequence: Synthetic oligonucleotide
  Target: SCN9A; (-) strand; PAM type: YTN; PAM sequence: TTG
tggctaccttagaggttgta

SEQ ID NO: 71907 - DNA, 20 bp, Artificial Sequence
  Description of Artificial Sequence: Synthetic oligonucleotide
  Target: SCN9A; (-) strand; PAM type: YTN; PAM sequence: TTT
gtggctaccttagaggttgt

SEQ ID NO: 71908 - DNA, 20 bp, Artificial Sequence
  Description of Artificial Sequence: Synthetic oligonucleotide
  Target: SCN9A; (-) strand; PAM type: YTN; PAM sequence: TTA
aatatacaggagtttgtggc

SEQ ID NO: 71909 - DNA, 20 bp, Artificial Sequence
  Description of Artificial Sequence: Synthetic oligonucleotide
  Target: SCN9A; (-) strand; PAM type: YTN; PAM sequence: TTC
catggtatgcacaattaaat

SEQ ID NO: 71910 - DNA, 20 bp, Artificial Sequence
  Description of Artificial Sequence: Synthetic oligonucleotide
  Target: SCN9A; (-) strand; PAM type: YTN; PAM sequence: TTT
ccatggtatgcacaattaaa

SEQ ID NO: 71911 - DNA, 20 bp, Artificial Sequence
  Description of Artificial Sequence: Synthetic oligonucleotide
  Target: SCN9A; (-) strand; PAM type: YTN; PAM sequence: TTA
catttccatggtatgcacaa

SEQ ID NO: 71912 - DNA, 20 bp, Artificial Sequence
  Description of Artificial Sequence: Synthetic oligonucleotide
  Target: SCN9A; (-) strand; PAM type: YTN; PAM sequence: CTA
ttacatttccatggtatgca

SEQ ID NO: 71913 - DNA, 20 bp, Artificial Sequence
  Description of Artificial Sequence: Synthetic oligonucleotide
  Target: SCN9A; (-) strand; PAM type: YTN; PAM sequence: CTC
tattacatttccatggtatg

SEQ ID NO: 71914 - DNA, 20 bp, Artificial Sequence
  Description of Artificial Sequence: Synthetic oligonucleotide
  Target: SCN9A; (-) strand; PAM type: YTN; PAM sequence: TTA
ctctattacatttccatggt

SEQ ID NO: 71915 - DNA, 20 bp, Artificial Sequence
  Description of Artificial Sequence: Synthetic oligonucleotide
  Target: SCN9A; (-) strand; PAM type: YTN; PAM sequence: CTT
actctattacatttccatgg

SEQ ID NO: 71916 - DNA, 20 bp, Artificial Sequence
  Description of Artificial Sequence: Synthetic oligonucleotide
  Target: SCN9A; (-) strand; PAM type: YTN; PAM sequence: TTC
ttactctattacatttccat

SEQ ID NO: 71917 - DNA, 20 bp, Artificial Sequence
  Description of Artificial Sequence: Synthetic oligonucleotide
  Target: SCN9A; (-) strand; PAM type: YTN; PAM sequence: CTA
tatgataaaagagtgtacat

SEQ ID NO: 71918 - DNA, 20 bp, Artificial Sequence
  Description of Artificial Sequence: Synthetic oligonucleotide
  Target: SCN9A; (-) strand; PAM type: YTN; PAM sequence: TTA
tatctatatgataaaagagt

SEQ ID NO: 71919 - DNA, 20 bp, Artificial Sequence
  Description of Artificial Sequence: Synthetic oligonucleotide
  Target: SCN9A; (-) strand; PAM type: YTN; PAM sequence: TTA
cataatggttatatctatat

SEQ ID NO: 71920 - DNA, 20 bp, Artificial Sequence
  Description of Artificial Sequence: Synthetic oligonucleotide
  Target: SCN9A; (-) strand; PAM type: YTN; PAM sequence: CTC
attacataatggttatatct

SEQ ID NO: 71921 - DNA, 20 bp, Artificial Sequence
  Description of Artificial Sequence: Synthetic oligonucleotide
  Target: SCN9A; (-) strand; PAM type: YTN; PAM sequence: TTC
tcattacataatggttatat

SEQ ID NO: 71922 - DNA, 20 bp, Artificial Sequence
  Description of Artificial Sequence: Synthetic oligonucleotide
  Target: SCN9A; (-) strand; PAM type: YTN; PAM sequence: TTT
ctcattacataatggttata

SEQ ID NO: 71923 - DNA, 20 bp, Artificial Sequence
  Description of Artificial Sequence: Synthetic oligonucleotide
  Target: SCN9A; (-) strand; PAM type: YTN; PAM sequence: TTT
tctcattacataatggttat

SEQ ID NO: 71924 - DNA, 20 bp, Artificial Sequence
  Description of Artificial Sequence: Synthetic oligonucleotide
  Target: SCN9A; (-) strand; PAM type: YTN; PAM sequence: TTT
ttctcattacataatggtta

SEQ ID NO: 71925 - DNA, 20 bp, Artificial Sequence
  Description of Artificial Sequence: Synthetic oligonucleotide
  Target: SCN9A; (-) strand; PAM type: YTN; PAM sequence: TTT
tttctcattacataatggtt

SEQ ID NO: 71926 - DNA, 20 bp, Artificial Sequence
  Description of Artificial Sequence: Synthetic oligonucleotide
  Target: SCN9A; (-) strand; PAM type: YTN; PAM sequence: TTT
ttttctcattacataatggt

SEQ ID NO: 71927 - DNA, 20 bp, Artificial Sequence
  Description of Artificial Sequence: Synthetic oligonucleotide
  Target: SCN9A; (-) strand; PAM type: YTN; PAM sequence: CTA
atttttttctcattacataa

SEQ ID NO: 71928 - DNA, 20 bp, Artificial Sequence
  Description of Artificial Sequence: Synthetic oligonucleotide
  Target: SCN9A; (-) strand; PAM type: YTN; PAM sequence: TTC
actaatttttttctcattac

SEQ ID NO: 71929 - DNA, 20 bp, Artificial Sequence
  Description of Artificial Sequence: Synthetic oligonucleotide
  Target: SCN9A; (-) strand; PAM type: YTN; PAM sequence: TTT
cactaatttttttctcatta

SEQ ID NO: 71930 - DNA, 20 bp, Artificial Sequence
  Description of Artificial Sequence: Synthetic oligonucleotide
  Target: SCN9A; (-) strand; PAM type: YTN; PAM sequence: TTT
tcactaatttttttctcatt

SEQ ID NO: 71931 - DNA, 20 bp, Artificial Sequence
  Description of Artificial Sequence: Synthetic oligonucleotide
  Target: SCN9A; (-) strand; PAM type: YTN; PAM sequence: TTG
attttcactaatttttttct

SEQ ID NO: 71932 - DNA, 20 bp, Artificial Sequence
  Description of Artificial Sequence: Synthetic oligonucleotide
  Target: SCN9A; (-) strand; PAM type: YTN; PAM sequence: CTT
gattttcactaatttttttc

SEQ ID NO: 71933 - DNA, 20 bp, Artificial Sequence
  Description of Artificial Sequence: Synthetic oligonucleotide
  Target: SCN9A; (-) strand; PAM type: YTN; PAM sequence: TTC
ttgattttcactaatttttt

SEQ ID NO: 71934 - DNA, 20 bp, Artificial Sequence
  Description of Artificial Sequence: Synthetic oligonucleotide
  Target: SCN9A; (-) strand; PAM type: YTN; PAM sequence: CTA
atattcttgattttcactaa

SEQ ID NO: 71935 - DNA, 20 bp, Artificial Sequence
  Description of Artificial Sequence: Synthetic oligonucleotide
  Target: SCN9A; (-) strand; PAM type: YTN; PAM sequence: TTC
taatattcttgattttcact

SEQ ID NO: 71936 - DNA, 20 bp, Artificial Sequence
  Description of Artificial Sequence: Synthetic oligonucleotide
  Target: SCN9A; (-) strand; PAM type: YTN; PAM sequence: TTA
atattctaatattcttgatt

SEQ ID NO: 71937 - DNA, 20 bp, Artificial Sequence
  Description of Artificial Sequence: Synthetic oligonucleotide
  Target: SCN9A; (-) strand; PAM type: YTN; PAM sequence: TTG
atgttaatattctaatattc

SEQ ID NO: 71938 - DNA, 20 bp, Artificial Sequence
  Description of Artificial Sequence: Synthetic oligonucleotide
  Target: SCN9A; (-) strand; PAM type: YTN; PAM sequence: TTT
gatgttaatattctaatatt

SEQ ID NO: 71939 - DNA, 20 bp, Artificial Sequence
  Description of Artificial Sequence: Synthetic oligonucleotide
  Target: SCN9A; (-) strand; PAM type: YTN; PAM sequence: CTA
aaaatcatttgatgttaata

SEQ ID NO: 71940 - DNA, 20 bp, Artificial Sequence
  Description of Artificial Sequence: Synthetic oligonucleotide
  Target: SCN9A; (-) strand; PAM type: YTN; PAM sequence: TTG
tctaaaaatcatttgatgtt

SEQ ID NO: 71941 - DNA, 20 bp, Artificial Sequence
  Description of Artificial Sequence: Synthetic oligonucleotide
  Target: SCN9A; (-) strand; PAM type: YTN; PAM sequence: CTG
agttgtctaaaaatcatttg

SEQ ID NO: 71942 - DNA, 20 bp, Artificial Sequence
  Description of Artificial Sequence: Synthetic oligonucleotide
  Target: SCN9A; (-) strand; PAM type: YTN; PAM sequence: CTA
taaactgagttgtctaaaaa

SEQ ID NO: 71943 - DNA, 20 bp, Artificial Sequence
  Description of Artificial Sequence: Synthetic oligonucleotide
  Target: SCN9A; (-) strand; PAM type: YTN; PAM sequence: CTA
gtgccctataaactgagttg

SEQ ID NO: 71944 - DNA, 20 bp, Artificial Sequence
  Description of Artificial Sequence: Synthetic oligonucleotide
  Target: SCN9A; (-) strand; PAM type: YTN; PAM sequence: TTC
cgaaagcgtatgaaatctag

SEQ ID NO: 71945 - DNA, 20 bp, Artificial Sequence
  Description of Artificial Sequence: Synthetic oligonucleotide
  Target: SCN9A; (-) strand; PAM type: YTN; PAM sequence: CTT
ccgaaagcgtatgaaatcta

SEQ ID NO: 71946 - DNA, 20 bp, Artificial Sequence
  Description of Artificial Sequence: Synthetic oligonucleotide
  Target: SCN9A; (-) strand; PAM type: YTN; PAM sequence: TTC
catgagcccttccgaaagcg

SEQ ID NO: 71947 - DNA, 20 bp, Artificial Sequence
  Description of Artificial Sequence: Synthetic oligonucleotide
  Target: SCN9A; (-) strand; PAM type: YTN; PAM sequence: TTA
ttccatgagcccttccgaaa

SEQ ID NO: 71948 - DNA, 20 bp, Artificial Sequence
  Description of Artificial Sequence: Synthetic oligonucleotide
  Target: SCN9A; (-) strand; PAM type: YTN; PAM sequence: CTT
attccatgagcccttccgaa

SEQ ID NO: 71949 - DNA, 20 bp, Artificial Sequence
  Description of Artificial Sequence: Synthetic oligonucleotide
  Target: SCN9A; (-) strand; PAM type: YTN; PAM sequence: CTG
tcacttattccatgagccct

SEQ ID NO: 71950 - DNA, 20 bp, Artificial Sequence
  Description of Artificial Sequence: Synthetic oligonucleotide
  Target: SCN9A; (-) strand; PAM type: YTN; PAM sequence: CTC
tgtcacttattccatgagcc

SEQ ID NO: 71951 - DNA, 20 bp, Artificial Sequence
  Description of Artificial Sequence: Synthetic oligonucleotide
  Target: SCN9A; (-) strand; PAM type: YTN; PAM sequence: TTA
ctctgtcacttattccatga

SEQ ID NO: 71952 - DNA, 20 bp, Artificial Sequence
  Description of Artificial Sequence: Synthetic oligonucleotide
  Target: SCN9A; (-) strand; PAM type: YTN; PAM sequence: TTC
ataaaattactctgtcactt

SEQ ID NO: 71953 - DNA, 20 bp, Artificial Sequence
  Description of Artificial Sequence: Synthetic oligonucleotide
  Target: SCN9A; (-) strand; PAM type: YTN; PAM sequence: TTA
accattcataaaattactct

SEQ ID NO: 71954 - DNA, 20 bp, Artificial Sequence
  Description of Artificial Sequence: Synthetic oligonucleotide
  Target: SCN9A; (-) strand; PAM type: YTN; PAM sequence: TTT
aaccattcataaaattactc

SEQ ID NO: 71955 - DNA, 20 bp, Artificial Sequence
  Description of Artificial Sequence: Synthetic oligonucleotide
  Target: SCN9A; (-) strand; PAM type: YTN; PAM sequence: TTT
taaccattcataaaattact

SEQ ID NO: 71956 - DNA, 20 bp, Artificial Sequence
  Description of Artificial Sequence: Synthetic oligonucleotide
  Target: SCN9A; (-) strand; PAM type: YTN; PAM sequence: TTA
ttttaaccattcataaaatt

SEQ ID NO: 71957 - DNA, 20 bp, Artificial Sequence
  Description of Artificial Sequence: Synthetic oligonucleotide
  Target: SCN9A; (-) strand; PAM type: YTN; PAM sequence: CTG
aaatagattattttaaccat

SEQ ID NO: 71958 - DNA, 20 bp, Artificial Sequence
  Description of Artificial Sequence: Synthetic oligonucleotide
  Target: SCN9A; (-) strand; PAM type: YTN; PAM sequence: TTA
taactgaaatagattatttt

SEQ ID NO: 71959 - DNA, 20 bp, Artificial Sequence
  Description of Artificial Sequence: Synthetic oligonucleotide
  Target: SCN9A; (-) strand; PAM type: YTN; PAM sequence: TTT
ataactgaaatagattattt

SEQ ID NO: 71960 - DNA, 20 bp, Artificial Sequence
  Description of Artificial Sequence: Synthetic oligonucleotide
  Target: SCN9A; (-) strand; PAM type: YTN; PAM sequence: TTT
tataactgaaatagattatt

SEQ ID NO: 71961 - DNA, 20 bp, Artificial Sequence
  Description of Artificial Sequence: Synthetic oligonucleotide
  Target: SCN9A; (-) strand; PAM type: YTN; PAM sequence: TTG
tattttataactgaaataga

SEQ ID NO: 71962 - DNA, 20 bp, Artificial Sequence
  Description of Artificial Sequence: Synthetic oligonucleotide
  Target: SCN9A; (-) strand; PAM type: YTN; PAM sequence: TTT
gtattttataactgaaatag

SEQ ID NO: 71963 - DNA, 20 bp, Artificial Sequence
  Description of Artificial Sequence: Synthetic oligonucleotide
  Target: SCN9A; (-) strand; PAM type: YTN; PAM sequence: TTA
tttgtattttataactgaaa

SEQ ID NO: 71964 - DNA, 20 bp, Artificial Sequence
  Description of Artificial Sequence: Synthetic oligonucleotide
  Target: SCN9A; (-) strand; PAM type: YTN; PAM sequence: TTT
atttgtattttataactgaa

SEQ ID NO: 71965 - DNA, 20 bp, Artificial Sequence
  Description of Artificial Sequence: Synthetic oligonucleotide
  Target: SCN9A; (-) strand; PAM type: YTN; PAM sequence: TTT
tatttgtattttataactga

SEQ ID NO: 71966 - DNA, 20 bp, Artificial Sequence
  Description of Artificial Sequence: Synthetic oligonucleotide
  Target: SCN9A; (-) strand; PAM type: YTN; PAM sequence: CTA
gtgattttatttgtatttta

SEQ ID NO: 71967 - DNA, 20 bp, Artificial Sequence
  Description of Artificial Sequence: Synthetic oligonucleotide
  Target: SCN9A; (-) strand; PAM type: YTN; PAM sequence: TTA
taactagtgattttatttgt

SEQ ID NO: 71968 - DNA, 20 bp, Artificial Sequence
  Description of Artificial Sequence: Synthetic oligonucleotide
  Target: SCN9A; (-) strand; PAM type: YTN; PAM sequence: TTT
ataactagtgattttatttg

SEQ ID NO: 71969 - DNA, 20 bp, Artificial Sequence
  Description of Artificial Sequence: Synthetic oligonucleotide
  Target: SCN9A; (-) strand; PAM type: YTN; PAM sequence: TTT
tataactagtgattttattt

SEQ ID NO: 71970 - DNA, 20 bp, Artificial Sequence
  Description of Artificial Sequence: Synthetic oligonucleotide
  Target: SCN9A; (-) strand; PAM type: YTN; PAM sequence: CTT
ttataactagtgattttatt

SEQ ID NO: 71971 - DNA, 20 bp, Artificial Sequence
  Description of Artificial Sequence: Synthetic oligonucleotide
  Target: SCN9A; (-) strand; PAM type: YTN; PAM sequence: CTA
tcttttataactagtgattt

SEQ ID NO: 71972 - DNA, 20 bp, Artificial Sequence
  Description of Artificial Sequence: Synthetic oligonucleotide
  Target: SCN9A; (-) strand; PAM type: YTN; PAM sequence: TTA
gctatcttttataactagtg

SEQ ID NO: 71973 - DNA, 20 bp, Artificial Sequence
  Description of Artificial Sequence: Synthetic oligonucleotide
  Target: SCN9A; (-) strand; PAM type: YTN; PAM sequence: TTG
tcataatggttagctatctt

SEQ ID NO: 71974 - DNA, 20 bp, Artificial Sequence
  Description of Artificial Sequence: Synthetic oligonucleotide
  Target: SCN9A; (-) strand; PAM type: YTN; PAM sequence: CTG
tggcatgcagatgaaggtgt

SEQ ID NO: 71975 - DNA, 20 bp, Artificial Sequence
  Description of Artificial Sequence: Synthetic oligonucleotide
  Target: SCN9A; (-) strand; PAM type: YTN; PAM sequence: TTA
tatatctgtggcatgcagat

SEQ ID NO: 71976 - DNA, 20 bp, Artificial Sequence
  Description of Artificial Sequence: Synthetic oligonucleotide
  Target: SCN9A; (-) strand; PAM type: YTN; PAM sequence: TTT
atatatctgtggcatgcaga

SEQ ID NO: 71977 - DNA, 20 bp, Artificial Sequence
  Description of Artificial Sequence: Synthetic oligonucleotide
  Target: SCN9A; (-) strand; PAM type: YTN; PAM sequence: CTA
tagaatttatatatctgtgg

SEQ ID NO: 71978 - DNA, 20 bp, Artificial Sequence
  Description of Artificial Sequence: Synthetic oligonucleotide
  Target: SCN9A; (-) strand; PAM type: YTN; PAM sequence: CTG
gggtataaagccatgcagct

SEQ ID NO: 71979 - DNA, 20 bp, Artificial Sequence
  Description of Artificial Sequence: Synthetic oligonucleotide
  Target: SCN9A; (-) strand; PAM type: YTN; PAM sequence: CTC
ccctggggtataaagccatg

SEQ ID NO: 71980 - DNA, 20 bp, Artificial Sequence
  Description of Artificial Sequence: Synthetic oligonucleotide
  Target: SCN9A; (-) strand; PAM type: YTN; PAM sequence: TTG
tctcccctggggtataaagc

SEQ ID NO: 71981 - DNA, 20 bp, Artificial Sequence
  Description of Artificial Sequence: Synthetic oligonucleotide
  Target: SCN9A; (-) strand; PAM type: YTN; PAM sequence: TTT
gtctcccctggggtataaag

SEQ ID NO: 71982 - DNA, 20 bp, Artificial Sequence
  Description of Artificial Sequence: Synthetic oligonucleotide
  Target: SCN9A; (-) strand; PAM type: YTN; PAM sequence: TTA
ataatttgtctcccctgggg

SEQ ID NO: 71983 - DNA, 20 bp, Artificial Sequence
  Description of Artificial Sequence: Synthetic oligonucleotide
  Target: SCN9A; (-) strand; PAM type: YTN; PAM sequence: CTT
aataatttgtctcccctggg

SEQ ID NO: 71984 - DNA, 20 bp, Artificial Sequence
  Description of Artificial Sequence: Synthetic oligonucleotide
  Target: SCN9A; (-) strand; PAM type: YTN; PAM sequence: TTG
gacttaataatttgtctccc

SEQ ID NO: 71985 - DNA, 20 bp, Artificial Sequence
  Description of Artificial Sequence: Synthetic oligonucleotide
  Target: SCN9A; (-) strand; PAM type: YTN; PAM sequence: CTA
ttggacttaataatttgtct

SEQ ID NO: 71986 - DNA, 20 bp, Artificial Sequence
  Description of Artificial Sequence: Synthetic oligonucleotide
  Target: SCN9A; (-) strand; PAM type: YTN; PAM sequence: TTC
ctattggacttaataatttg

SEQ ID NO: 71987 - DNA, 20 bp, Artificial Sequence
  Description of Artificial Sequence: Synthetic oligonucleotide
  Target: SCN9A; (-) strand; PAM type: YTN; PAM sequence: TTG
aaacacaaaacaaacattcc

SEQ ID NO: 71988 - DNA, 20 bp, Artificial Sequence
  Description of Artificial Sequence: Synthetic oligonucleotide
  Target: SCN9A; (-) strand; PAM type: YTN; PAM sequence: TTT
gaaacacaaaacaaacattc

SEQ ID NO: 71989 - DNA, 20 bp, Artificial Sequence
  Description of Artificial Sequence: Synthetic oligonucleotide
  Target: SCN9A; (-) strand; PAM type: YTN; PAM sequence: TTG
tccatttgaaacacaaaaca

SEQ ID NO: 71990 - DNA, 20 bp, Artificial Sequence
  Description of Artificial Sequence: Synthetic oligonucleotide
  Target: SCN9A; (-) strand; PAM type: YTN; PAM sequence: TTT
gtccatttgaaacacaaaac

SEQ ID NO: 71991 - DNA, 20 bp, Artificial Sequence
  Description of Artificial Sequence: Synthetic oligonucleotide
  Target: SCN9A; (-) strand; PAM type: YTN; PAM sequence: CTT
tgtccatttgaaacacaaaa

SEQ ID NO: 71992 - DNA, 20 bp, Artificial Sequence
  Description of Artificial Sequence: Synthetic oligonucleotide
  Target: SCN9A; (-) strand; PAM type: YTN; PAM sequence: CTC
tttgtccatttgaaacacaa

SEQ ID NO: 71993 - DNA, 20 bp, Artificial Sequence
  Description of Artificial Sequence: Synthetic oligonucleotide
  Target: SCN9A; (-) strand; PAM type: YTN; PAM sequence: CTC
tctttgtccatttgaaacac

SEQ ID NO: 71994 - DNA, 20 bp, Artificial Sequence
  Description of Artificial Sequence: Synthetic oligonucleotide
  Target: SCN9A; (-) strand; PAM type: YTN; PAM sequence: TTG
tcctctctttgtccatttga

SEQ ID NO: 71995 - DNA, 20 bp, Artificial Sequence
  Description of Artificial Sequence: Synthetic oligonucleotide
  Target: SCN9A; (-) strand; PAM type: YTN; PAM sequence: CTT
gtcctctctttgtccatttg

SEQ ID NO: 71996 - DNA, 20 bp, Artificial Sequence
  Description of Artificial Sequence: Synthetic oligonucleotide
  Target: SCN9A; (-) strand; PAM type: YTN; PAM sequence: CTC
ttgtcctctctttgtccatt

SEQ ID NO: 71997 - DNA, 20 bp, Artificial Sequence
  Description of Artificial Sequence: Synthetic oligonucleotide
  Target: SCN9A; (-) strand; PAM type: YTN; PAM sequence: CTC
tcttgtcctctctttgtcca

SEQ ID NO: 71998 - DNA, 20 bp, Artificial Sequence
  Description of Artificial Sequence: Synthetic oligonucleotide
  Target: SCN9A; (-) strand; PAM type: YTN; PAM sequence: CTA
cctctcttgtcctctctttg

SEQ ID NO: 71999 - DNA, 20 bp, Artificial Sequence
  Description of Artificial Sequence: Synthetic oligonucleotide
  Target: SCN9A; (-) strand; PAM type: YTN; PAM sequence: TTC
tacctctcttgtcctctctt

SEQ ID NO: 72000 - DNA, 20 bp, Artificial Sequence
  Description of Artificial Sequence: Synthetic oligonucleotide
  Target: SCN9A; (-) strand; PAM type: YTN; PAM sequence: TTT
ctacctctcttgtcctctct

SEQ ID NO: 72001 - DNA, 20 bp, Artificial Sequence
  Description of Artificial Sequence: Synthetic oligonucleotide
  Target: SCN9A; (-) strand; PAM type: YTN; PAM sequence: CTC
aatggaatttctacctctct

SEQ ID NO: 72002 - DNA, 20 bp, Artificial Sequence
  Description of Artificial Sequence: Synthetic oligonucleotide
  Target: SCN9A; (-) strand; PAM type: YTN; PAM sequence: TTA
tagctcaatggaatttctac

SEQ ID NO: 72003 - DNA, 20 bp, Artificial Sequence
  Description of Artificial Sequence: Synthetic oligonucleotide
  Target: SCN9A; (-) strand; PAM type: YTN; PAM sequence: CTT
atagctcaatggaatttcta

SEQ ID NO: 72004 - DNA, 20 bp, Artificial Sequence
  Description of Artificial Sequence: Synthetic oligonucleotide
  Target: SCN9A; (-) strand; PAM type: YTN; PAM sequence: TTG
tgacttatagctcaatggaa

SEQ ID NO: 72005 - DNA, 20 bp, Artificial Sequence
  Description of Artificial Sequence: Synthetic oligonucleotide
  Target: SCN9A; (-) strand; PAM type: YTN; PAM sequence: CTT
gtgacttatagctcaatgga

SEQ ID NO: 72006 - DNA, 20 bp, Artificial Sequence
  Description of Artificial Sequence: Synthetic oligonucleotide
  Target: SCN9A; (-) strand; PAM type: YTN; PAM sequence: CTA
ggcttgtgacttatagctca

SEQ ID NO: 72007 - DNA, 20 bp, Artificial Sequence
  Description of Artificial Sequence: Synthetic oligonucleotide
  Target: SCN9A; (-) strand; PAM type: YTN; PAM sequence: TTA
taaaggcagagccatgtcaa

SEQ ID NO: 72008 - DNA, 20 bp, Artificial Sequence
  Description of Artificial Sequence: Synthetic oligonucleotide
  Target: SCN9A; (-) strand; PAM type: YTN; PAM sequence: TTA
tacagttataaaggcagagc

SEQ ID NO: 72009 - DNA, 20 bp, Artificial Sequence
  Description of Artificial Sequence: Synthetic oligonucleotide
  Target: SCN9A; (-) strand; PAM type: YTN; PAM sequence: TTA
tagagttatacagttataaa

SEQ ID NO: 72010 - DNA, 20 bp, Artificial Sequence
  Description of Artificial Sequence: Synthetic oligonucleotide
  Target: SCN9A; (-) strand; PAM type: YTN; PAM sequence: CTA
gagttatagagttatacagt

SEQ ID NO: 72011 - DNA, 20 bp, Artificial Sequence
  Description of Artificial Sequence: Synthetic oligonucleotide
  Target: SCN9A; (-) strand; PAM type: YTN; PAM sequence: TTA
taaatctagagttatagagt

SEQ ID NO: 72012 - DNA, 20 bp, Artificial Sequence
  Description of Artificial Sequence: Synthetic oligonucleotide
  Target: SCN9A; (-) strand; PAM type: YTN; PAM sequence: TTA
tacagttataaatctagagt

SEQ ID NO: 72013 - DNA, 20 bp, Artificial Sequence
  Description of Artificial Sequence: Synthetic oligonucleotide
  Target: SCN9A; (-) strand; PAM type: YTN; PAM sequence: CTA
gagttatacagttataaatc

SEQ ID NO: 72014 - DNA, 20 bp, Artificial Sequence
  Description of Artificial Sequence: Synthetic oligonucleotide
  Target: SCN9A; (-) strand; PAM type: YTN; PAM sequence: TTA
taaagctagagttatacagt

SEQ ID NO: 72015 - DNA, 20 bp, Artificial Sequence
  Description of Artificial Sequence: Synthetic oligonucleotide
  Target: SCN9A; (-) strand; PAM type: YTN; PAM sequence: TTC
acagttataaagctagagtt

SEQ ID NO: 72016 - DNA, 20 bp, Artificial Sequence
  Description of Artificial Sequence: Synthetic oligonucleotide
  Target: SCN9A; (-) strand; PAM type: YTN; PAM sequence: TTA
ttcacagttataaagctaga

SEQ ID NO: 72017 - DNA, 20 bp, Artificial Sequence
  Description of Artificial Sequence: Synthetic oligonucleotide
  Target: SCN9A; (-) strand; PAM type: YTN; PAM sequence: TTT
attcacagttataaagctag

SEQ ID NO: 72018 - DNA, 20 bp, Artificial Sequence
  Description of Artificial Sequence: Synthetic oligonucleotide
  Target: SCN9A; (-) strand; PAM type: YTN; PAM sequence: TTT
tattcacagttataaagcta

SEQ ID NO: 72019 - DNA, 20 bp, Artificial Sequence
  Description of Artificial Sequence: Synthetic oligonucleotide
  Target: SCN9A; (-) strand; PAM type: YTN; PAM sequence: TTA
aaaggaagtgattttattca

SEQ ID NO: 72020 - DNA, 20 bp, Artificial Sequence
  Description of Artificial Sequence: Synthetic oligonucleotide
  Target: SCN9A; (-) strand; PAM type: YTN; PAM sequence: CTC
attaaaaggaagtgatttta

SEQ ID NO: 72021 - DNA, 20 bp, Artificial Sequence
  Description of Artificial Sequence: Synthetic oligonucleotide
  Target: SCN9A; (-) strand; PAM type: YTN; PAM sequence: CTG
aaaaagcagactcattaaaa

SEQ ID NO: 72022 - DNA, 20 bp, Artificial Sequence
  Description of Artificial Sequence: Synthetic oligonucleotide
  Target: SCN9A; (-) strand; PAM type: YTN; PAM sequence: CTA
actgaaaaagcagactcatt

SEQ ID NO: 72023 - DNA, 20 bp, Artificial Sequence
  Description of Artificial Sequence: Synthetic oligonucleotide
  Target: SCN9A; (-) strand; PAM type: YTN; PAM sequence: TTC
taactgaaaaagcagactca

SEQ ID NO: 72024 - DNA, 20 bp, Artificial Sequence
  Description of Artificial Sequence: Synthetic oligonucleotide
  Target: SCN9A; (-) strand; PAM type: YTN; PAM sequence: TTT
ctaactgaaaaagcagactc

SEQ ID NO: 72025 - DNA, 20 bp, Artificial Sequence
  Description of Artificial Sequence: Synthetic oligonucleotide
  Target: SCN9A; (-) strand; PAM type: YTN; PAM sequence: TTT
tctaactgaaaaagcagact

SEQ ID NO: 72026 - DNA, 20 bp, Artificial Sequence
  Description of Artificial Sequence: Synthetic oligonucleotide
  Target: SCN9A; (-) strand; PAM type: YTN; PAM sequence: TTC
attttctaactgaaaaagca

SEQ ID NO: 72027 - DNA, 20 bp, Artificial Sequence
  Description of Artificial Sequence: Synthetic oligonucleotide
  Target: SCN9A; (-) strand; PAM type: YTN; PAM sequence: CTT
cattttctaactgaaaaagc

SEQ ID NO: 72028 - DNA, 20 bp, Artificial Sequence
  Description of Artificial Sequence: Synthetic oligonucleotide
  Target: SCN9A; (-) strand; PAM type: YTN; PAM sequence: TTA
gcacttcattttctaactga

SEQ ID NO: 72029 - DNA, 20 bp, Artificial Sequence
  Description of Artificial Sequence: Synthetic oligonucleotide
  Target: SCN9A; (-) strand; PAM type: YTN; PAM sequence: TTT
agcacttcattttctaactg

SEQ ID NO: 72030 - DNA, 20 bp, Artificial Sequence
  Description of Artificial Sequence: Synthetic oligonucleotide
  Target: SCN9A; (-) strand; PAM type: YTN; PAM sequence: TTC
catttagcacttcattttct

SEQ ID NO: 72031 - DNA, 20 bp, Artificial Sequence
  Description of Artificial Sequence: Synthetic oligonucleotide
  Target: SCN9A; (-) strand; PAM type: YTN; PAM sequence: TTT
ccatttagcacttcattttc

SEQ ID NO: 72032 - DNA, 20 bp, Artificial Sequence
  Description of Artificial Sequence: Synthetic oligonucleotide
  Target: SCN9A; (-) strand; PAM type: YTN; PAM sequence: CTT
tccatttagcacttcatttt

SEQ ID NO: 72033 - DNA, 20 bp, Artificial Sequence
  Description of Artificial Sequence: Synthetic oligonucleotide
  Target: SCN9A; (-) strand; PAM type: YTN; PAM sequence: TTA
tagaactttccatttagcac

SEQ ID NO: 72034 - DNA, 20 bp, Artificial Sequence
  Description of Artificial Sequence: Synthetic oligonucleotide
  Target: SCN9A; (-) strand; PAM type: YTN; PAM sequence: CTT
atagaactttccatttagca

SEQ ID NO: 72035 - DNA, 20 bp, Artificial Sequence
  Description of Artificial Sequence: Synthetic oligonucleotide
  Target: SCN9A; (-) strand; PAM type: YTN; PAM sequence: TTA
agggaaccttatagaacttt

SEQ ID NO: 72036 - DNA, 20 bp, Artificial Sequence
  Description of Artificial Sequence: Synthetic oligonucleotide
  Target: SCN9A; (-) strand; PAM type: YTN; PAM sequence: TTT
aagggaaccttatagaactt

SEQ ID NO: 72037 - DNA, 20 bp, Artificial Sequence
  Description of Artificial Sequence: Synthetic oligonucleotide
  Target: SCN9A; (-) strand; PAM type: YTN; PAM sequence: TTT
taagggaaccttatagaact

SEQ ID NO: 72038 - DNA, 20 bp, Artificial Sequence
  Description of Artificial Sequence: Synthetic oligonucleotide
  Target: SCN9A; (-) strand; PAM type: YTN; PAM sequence: TTT
ttaagggaaccttatagaac

SEQ ID NO: 72039 - DNA, 20 bp, Artificial Sequence
  Description of Artificial Sequence: Synthetic oligonucleotide
  Target: SCN9A; (-) strand; PAM type: YTN; PAM sequence: TTG
caacatttttaagggaacct

SEQ ID NO: 72040 - DNA, 20 bp, Artificial Sequence
  Description of Artificial Sequence: Synthetic oligonucleotide
  Target: SCN9A; (-) strand; PAM type: YTN; PAM sequence: TTG
agttgcaacatttttaaggg

SEQ ID NO: 72041 - DNA, 20 bp, Artificial Sequence
  Description of Artificial Sequence: Synthetic oligonucleotide
  Target: SCN9A; (-) strand; PAM type: YTN; PAM sequence: TTA
gtatgttgagttgcaacatt

SEQ ID NO: 72042 - DNA, 20 bp, Artificial Sequence
  Description of Artificial Sequence: Synthetic oligonucleotide
  Target: SCN9A; (-) strand; PAM type: YTN; PAM sequence: CTT
agtatgttgagttgcaacat

SEQ ID NO: 72043 - DNA, 20 bp, Artificial Sequence
  Description of Artificial Sequence: Synthetic oligonucleotide
  Target: SCN9A; (-) strand; PAM type: YTN; PAM sequence: TTC
ttagtatgttgagttgcaac

SEQ ID NO: 72044 - DNA, 20 bp, Artificial Sequence
  Description of Artificial Sequence: Synthetic oligonucleotide
  Target: SCN9A; (-) strand; PAM type: YTN; PAM sequence: TTA
ttcttagtatgttgagttgc

SEQ ID NO: 72045 - DNA, 20 bp, Artificial Sequence
  Description of Artificial Sequence: Synthetic oligonucleotide
  Target: SCN9A; (-) strand; PAM type: YTN; PAM sequence: CTT
attcttagtatgttgagttg

SEQ ID NO: 72046 - DNA, 20 bp, Artificial Sequence
  Description of Artificial Sequence: Synthetic oligonucleotide
  Target: SCN9A; (-) strand; PAM type: YTN; PAM sequence: TTC
ttattcttagtatgttgagt

SEQ ID NO: 72047 - DNA, 20 bp, Artificial Sequence
  Description of Artificial Sequence: Synthetic oligonucleotide
  Target: SCN9A; (-) strand; PAM type: YTN; PAM sequence: CTG
acaaaattcttattcttagt

SEQ ID NO: 72048 - DNA, 20 bp, Artificial Sequence
  Description of Artificial Sequence: Synthetic oligonucleotide
  Target: SCN9A; (-) strand; PAM type: YTN; PAM sequence: CTG
ctgacaaaattcttattctt

SEQ ID NO: 72049 - DNA, 20 bp, Artificial Sequence
  Description of Artificial Sequence: Synthetic oligonucleotide
  Target: SCN9A; (-) strand; PAM type: YTN; PAM sequence: TTA
gctgctgacaaaattcttat

SEQ ID NO: 72050 - DNA, 20 bp, Artificial Sequence
  Description of Artificial Sequence: Synthetic oligonucleotide
  Target: SCN9A; (-) strand; PAM type: YTN; PAM sequence: CTT
agctgctgacaaaattctta

SEQ ID NO: 72051 - DNA, 20 bp, Artificial Sequence
  Description of Artificial Sequence: Synthetic oligonucleotide
  Target: SCN9A; (-) strand; PAM type: YTN; PAM sequence: CTC
cttagctgctgacaaaattc

SEQ ID NO: 72052 - DNA, 20 bp, Artificial Sequence
  Description of Artificial Sequence: Synthetic oligonucleotide
  Target: SCN9A; (-) strand; PAM type: YTN; PAM sequence: TTC
atggatctccttagctgctg

SEQ ID NO: 72053 - DNA, 20 bp, Artificial Sequence
  Description of Artificial Sequence: Synthetic oligonucleotide
  Target: SCN9A; (-) strand; PAM type: YTN; PAM sequence: TTT
catggatctccttagctgct

SEQ ID NO: 72054 - DNA, 20 bp, Artificial Sequence
  Description of Artificial Sequence: Synthetic oligonucleotide
  Target: SCN9A; (-) strand; PAM type: YTN; PAM sequence: CTT
tcatggatctccttagctgc

SEQ ID NO: 72055 - DNA, 20 bp, Artificial Sequence
  Description of Artificial Sequence: Synthetic oligonucleotide
  Target: SCN9A; (-) strand; PAM type: YTN; PAM sequence: CTG
acctttcatggatctcctta

SEQ ID NO: 72056 - DNA, 20 bp, Artificial Sequence
  Description of Artificial Sequence: Synthetic oligonucleotide
  Target: SCN9A; (-) strand; PAM type: YTN; PAM sequence: TTA
aagtcaatggctgacctttc

SEQ ID NO: 72057 - DNA, 20 bp, Artificial Sequence
  Description of Artificial Sequence: Synthetic oligonucleotide
  Target: SCN9A; (-) strand; PAM type: YTN; PAM sequence: TTT
aaagtcaatggctgaccttt

SEQ ID NO: 72058 - DNA, 20 bp, Artificial Sequence
  Description of Artificial Sequence: Synthetic oligonucleotide
  Target: SCN9A; (-) strand; PAM type: YTN; PAM sequence: TTC
atttaaagtcaatggctgac

SEQ ID NO: 72059 - DNA, 20 bp, Artificial Sequence
  Description of Artificial Sequence: Synthetic oligonucleotide
  Target: SCN9A; (-) strand; PAM type: YTN; PAM sequence: TTT
catttaaagtcaatggctga

SEQ ID NO: 72060 - DNA, 20 bp, Artificial Sequence
  Description of Artificial Sequence: Synthetic oligonucleotide
  Target: SCN9A; (-) strand; PAM type: YTN; PAM sequence: CTT
tcatttaaagtcaatggctg

SEQ ID NO: 72061 - DNA, 20 bp, Artificial Sequence
  Description of Artificial Sequence: Synthetic oligonucleotide
  Target: SCN9A; (-) strand; PAM type: YTN; PAM sequence: TTC
tttcatttaaagtcaatggc

SEQ ID NO: 72062 - DNA, 20 bp, Artificial Sequence
  Description of Artificial Sequence: Synthetic oligonucleotide
  Target: SCN9A; (-) strand; PAM type: YTN; PAM sequence: TTT
ctttcatttaaagtcaatgg

SEQ ID NO: 72063 - DNA, 20 bp, Artificial Sequence
  Description of Artificial Sequence: Synthetic oligonucleotide
  Target: SCN9A; (-) strand; PAM type: YTN; PAM sequence: TTT
tctttcatttaaagtcaatg

SEQ ID NO: 72064 - DNA, 20 bp, Artificial Sequence
  Description of Artificial Sequence: Synthetic oligonucleotide
  Target: SCN9A; (-) strand; PAM type: YTN; PAM sequence: TTT
ttctttcatttaaagtcaat

SEQ ID NO: 72065 - DNA, 20 bp, Artificial Sequence
  Description of Artificial Sequence: Synthetic oligonucleotide
  Target: SCN9A; (-) strand; PAM type: YTN; PAM sequence: TTC
atttttctttcatttaaagt

SEQ ID NO: 72066 - DNA, 20 bp, Artificial Sequence
  Description of Artificial Sequence: Synthetic oligonucleotide
  Target: SCN9A; (-) strand; PAM type: YTN; PAM sequence: CTG
ttcatttttctttcatttaa

SEQ ID NO: 72067 - DNA, 20 bp, Artificial Sequence
  Description of Artificial Sequence: Synthetic oligonucleotide
  Target: SCN9A; (-) strand; PAM type: YTN; PAM sequence: TTA
cctgttcatttttctttcat

SEQ ID NO: 72068 - DNA, 20 bp, Artificial Sequence
  Description of Artificial Sequence: Synthetic oligonucleotide
  Target: SCN9A; (-) strand; PAM type: YTN; PAM sequence: CTT
acctgttcatttttctttca

SEQ ID NO: 72069 - DNA, 20 bp, Artificial Sequence
  Description of Artificial Sequence: Synthetic oligonucleotide
  Target: SCN9A; (-) strand; PAM type: YTN; PAM sequence: TTC
ttacctgttcatttttcttt

SEQ ID NO: 72070 - DNA, 20 bp, Artificial Sequence
  Description of Artificial Sequence: Synthetic oligonucleotide
  Target: SCN9A; (-) strand; PAM type: YTN; PAM sequence: TTT
cttacctgttcatttttctt

SEQ ID NO: 72071 - DNA, 20 bp, Artificial Sequence
  Description of Artificial Sequence: Synthetic oligonucleotide
  Target: SCN9A; (-) strand; PAM type: YTN; PAM sequence: TTA
tttcttacctgttcattttt

SEQ ID NO: 72072 - DNA, 20 bp, Artificial Sequence
  Description of Artificial Sequence: Synthetic oligonucleotide
  Target: SCN9A; (-) strand; PAM type: YTN; PAM sequence: TTA
tgaggaattatttcttacct

SEQ ID NO: 72073 - DNA, 20 bp, Artificial Sequence
  Description of Artificial Sequence: Synthetic oligonucleotide
  Target: SCN9A; (-) strand; PAM type: YTN; PAM sequence: TTT
atgaggaattatttcttacc

SEQ ID NO: 72074 - DNA, 20 bp, Artificial Sequence
  Description of Artificial Sequence: Synthetic oligonucleotide
  Target: SCN9A; (-) strand; PAM type: YTN; PAM sequence: TTA
acatttatgaggaattattt

SEQ ID NO: 72075 - DNA, 20 bp, Artificial Sequence
  Description of Artificial Sequence: Synthetic oligonucleotide
  Target: SCN9A; (-) strand; PAM type: YTN; PAM sequence: CTT
aacatttatgaggaattatt

SEQ ID NO: 72076 - DNA, 20 bp, Artificial Sequence
  Description of Artificial Sequence: Synthetic oligonucleotide
  Target: SCN9A; (-) strand; PAM type: YTN; PAM sequence: TTC
ttaacatttatgaggaatta

SEQ ID NO: 72077 - DNA, 20 bp, Artificial Sequence
  Description of Artificial Sequence: Synthetic oligonucleotide
  Target: SCN9A; (-) strand; PAM type: YTN; PAM sequence: TTT
cttaacatttatgaggaatt

SEQ ID NO: 72078 - DNA, 20 bp, Artificial Sequence
  Description of Artificial Sequence: Synthetic oligonucleotide
  Target: SCN9A; (-) strand; PAM type: YTN; PAM sequence: TTA
tttcttaacatttatgagga

SEQ ID NO: 72079 - DNA, 20 bp, Artificial Sequence
  Description of Artificial Sequence: Synthetic oligonucleotide
  Target: SCN9A; (-) strand; PAM type: YTN; PAM sequence: CTG
aaattatttcttaacattta

SEQ ID NO: 72080 - DNA, 20 bp, Artificial Sequence
  Description of Artificial Sequence: Synthetic oligonucleotide
  Target: SCN9A; (-) strand; PAM type: YTN; PAM sequence: TTC
tgaaattatttcttaacatt

SEQ ID NO: 72081 - DNA, 20 bp, Artificial Sequence
  Description of Artificial Sequence: Synthetic oligonucleotide
  Target: SCN9A; (-) strand; PAM type: YTN; PAM sequence: CTT
ctgaaattatttcttaacat

SEQ ID NO: 72082 - DNA, 20 bp, Artificial Sequence
  Description of Artificial Sequence: Synthetic oligonucleotide
  Target: SCN9A; (-) strand; PAM type: YTN; PAM sequence: CTG
gggaaagtcaaccaaagact

SEQ ID NO: 72083 - DNA, 20 bp, Artificial Sequence
  Description of Artificial Sequence: Synthetic oligonucleotide
  Target: SCN9A; (-) strand; PAM type: YTN; PAM sequence: TTC
aggagctggggaaagtcaac

SEQ ID NO: 72084 - DNA, 20 bp, Artificial Sequence
  Description of Artificial Sequence: Synthetic oligonucleotide
  Target: SCN9A; (-) strand; PAM type: YTN; PAM sequence: CTT
caggagctggggaaagtcaa

SEQ ID NO: 72085 - DNA, 20 bp, Artificial Sequence
  Description of Artificial Sequence: Synthetic oligonucleotide
  Target: SCN9A; (-) strand; PAM type: YTN; PAM sequence: TTA
aagcacttcaggagctgggg

SEQ ID NO: 72086 - DNA, 20 bp, Artificial Sequence
  Description of Artificial Sequence: Synthetic oligonucleotide
  Target: SCN9A; (-) strand; PAM type: YTN; PAM sequence: CTA
ggtgttaaagcacttcagga

SEQ ID NO: 72087 - DNA, 20 bp, Artificial Sequence
  Description of Artificial Sequence: Synthetic oligonucleotide
  Target: SCN9A; (-) strand; PAM type: YTN; PAM sequence: TTC
taggtgttaaagcacttcag

SEQ ID NO: 72088 - DNA, 20 bp, Artificial Sequence
  Description of Artificial Sequence: Synthetic oligonucleotide
  Target: SCN9A; (-) strand; PAM type: YTN; PAM sequence: TTG
gattctaggtgttaaagcac

SEQ ID NO: 72089 - DNA, 20 bp, Artificial Sequence
  Description of Artificial Sequence: Synthetic oligonucleotide
  Target: SCN9A; (-) strand; PAM type: YTN; PAM sequence: CTT
ggattctaggtgttaaagca

SEQ ID NO: 72090 - DNA, 20 bp, Artificial Sequence
  Description of Artificial Sequence: Synthetic oligonucleotide
  Target: SCN9A; (-) strand; PAM type: YTN; PAM sequence: CTC
agaataaaacttggattcta

SEQ ID NO: 72091 - DNA, 20 bp, Artificial Sequence
  Description of Artificial Sequence: Synthetic oligonucleotide
  Target: SCN9A; (-) strand; PAM type: YTN; PAM sequence: CTC
tcagaataaaacttggattc

SEQ ID NO: 72092 - DNA, 20 bp, Artificial Sequence
  Description of Artificial Sequence: Synthetic oligonucleotide
  Target: SCN9A; (-) strand; PAM type: YTN; PAM sequence: TTG
ctctcagaataaaacttgga

SEQ ID NO: 72093 - DNA, 20 bp, Artificial Sequence
  Description of Artificial Sequence: Synthetic oligonucleotide
  Target: SCN9A; (-) strand; PAM type: YTN; PAM sequence: CTG
gcagacagttgctctcagaa

SEQ ID NO: 72094 - DNA, 20 bp, Artificial Sequence
  Description of Artificial Sequence: Synthetic oligonucleotide
  Target: SCN9A; (-) strand; PAM type: YTN; PAM sequence: TTG
cctggcagacagttgctctc

SEQ ID NO: 72095 - DNA, 20 bp, Artificial Sequence
  Description of Artificial Sequence: Synthetic oligonucleotide
  Target: SCN9A; (-) strand; PAM type: YTN; PAM sequence: CTC
caattgcctggcagacagtt

SEQ ID NO: 72096 - DNA, 20 bp, Artificial Sequence
  Description of Artificial Sequence: Synthetic oligonucleotide
  Target: SCN9A; (-) strand; PAM type: YTN; PAM sequence: TTA
taaactccaattgcctggca

SEQ ID NO: 72097 - DNA, 20 bp, Artificial Sequence
  Description of Artificial Sequence: Synthetic oligonucleotide
  Target: SCN9A; (-) strand; PAM type: YTN; PAM sequence: TTA
aaattataaactccaattgc

SEQ ID NO: 72098 - DNA, 20 bp, Artificial Sequence
  Description of Artificial Sequence: Synthetic oligonucleotide
  Target: SCN9A; (-) strand; PAM type: YTN; PAM sequence: TTA
aagaagattaaaattataaa

SEQ ID NO: 72099 - DNA, 20 bp, Artificial Sequence
  Description of Artificial Sequence: Synthetic oligonucleotide
  Target: SCN9A; (-) strand; PAM type: YTN; PAM sequence: TTT
aaagaagattaaaattataa

SEQ ID NO: 72100 - DNA, 20 bp, Artificial Sequence
  Description of Artificial Sequence: Synthetic oligonucleotide
  Target: SCN9A; (-) strand; PAM type: YTN; PAM sequence: CTG
tcacccatttaaagaagatt

SEQ ID NO: 72101 - DNA, 20 bp, Artificial Sequence
  Description of Artificial Sequence: Synthetic oligonucleotide
  Target: SCN9A; (-) strand; PAM type: YTN; PAM sequence: CTC
tgtcacccatttaaagaaga

SEQ ID NO: 72102 - DNA, 20 bp, Artificial Sequence
  Description of Artificial Sequence: Synthetic oligonucleotide
  Target: SCN9A; (-) strand; PAM type: YTN; PAM sequence: CTA
actctgtcacccatttaaag

SEQ ID NO: 72103 - DNA, 20 bp, Artificial Sequence
  Description of Artificial Sequence: Synthetic oligonucleotide
  Target: SCN9A; (-) strand; PAM type: YTN; PAM sequence: CTA
actaactctgtcacccattt

SEQ ID NO: 72104 - DNA, 20 bp, Artificial Sequence
  Description of Artificial Sequence: Synthetic oligonucleotide
  Target: SCN9A; (-) strand; PAM type: YTN; PAM sequence: TTC
taactaactctgtcacccat

SEQ ID NO: 72105 - DNA, 20 bp, Artificial Sequence
  Description of Artificial Sequence: Synthetic oligonucleotide
  Target: SCN9A; (-) strand; PAM type: YTN; PAM sequence: TTT
ctaactaactctgtcaccca

SEQ ID NO: 72106 - DNA, 20 bp, Artificial Sequence
  Description of Artificial Sequence: Synthetic oligonucleotide
  Target: SCN9A; (-) strand; PAM type: YTN; PAM sequence: TTT
tctaactaactctgtcaccc

SEQ ID NO: 72107 - DNA, 20 bp, Artificial Sequence
  Description of Artificial Sequence: Synthetic oligonucleotide
  Target: SCN9A; (-) strand; PAM type: YTN; PAM sequence: TTT
ttctaactaactctgtcacc

SEQ ID NO: 72108 - DNA, 20 bp, Artificial Sequence
  Description of Artificial Sequence: Synthetic oligonucleotide
  Target: SCN9A; (-) strand; PAM type: YTN; PAM sequence: TTT
tttctaactaactctgtcac

SEQ ID NO: 72109 - DNA, 20 bp, Artificial Sequence
  Description of Artificial Sequence: Synthetic oligonucleotide
  Target: SCN9A; (-) strand; PAM type: YTN; PAM sequence: TTT
ttttctaactaactctgtca

SEQ ID NO: 72110 - DNA, 20 bp, Artificial Sequence
  Description of Artificial Sequence: Synthetic oligonucleotide
  Target: SCN9A; (-) strand; PAM type: YTN; PAM sequence: CTA
tttttttctaactaactctg

SEQ ID NO: 72111 - DNA, 20 bp, Artificial Sequence
  Description of Artificial Sequence: Synthetic oligonucleotide
  Target: SCN9A; (-) strand; PAM type: YTN; PAM sequence: CTC
agtcacctatttttttctaa

SEQ ID NO: 72112 - DNA, 20 bp, Artificial Sequence
  Description of Artificial Sequence: Synthetic oligonucleotide
  Target: SCN9A; (-) strand; PAM type: YTN; PAM sequence: CTA
actcagtcacctattttttt

SEQ ID NO: 72113 - DNA, 20 bp, Artificial Sequence
  Description of Artificial Sequence: Synthetic oligonucleotide
  Target: SCN9A; (-) strand; PAM type: YTN; PAM sequence: TTA
gtatcatatggaaagggaaa

SEQ ID NO: 72114 - DNA, 20 bp, Artificial Sequence
  Description of Artificial Sequence: Synthetic oligonucleotide
  Target: SCN9A; (-) strand; PAM type: YTN; PAM sequence: TTT
agtatcatatggaaagggaa

SEQ ID NO: 72115 - DNA, 20 bp, Artificial Sequence
  Description of Artificial Sequence: Synthetic oligonucleotide
  Target: SCN9A; (-) strand; PAM type: YTN; PAM sequence: CTA
ggtttagtatcatatggaaa

SEQ ID NO: 72116 - DNA, 20 bp, Artificial Sequence
  Description of Artificial Sequence: Synthetic oligonucleotide
  Target: SCN9A; (-) strand; PAM type: YTN; PAM sequence: TTA
aggagcaggcatctaggttt

SEQ ID NO: 72117 - DNA, 20 bp, Artificial Sequence
  Description of Artificial Sequence: Synthetic oligonucleotide
  Target: SCN9A; (-) strand; PAM type: YTN; PAM sequence: TTT
aaggagcaggcatctaggtt

SEQ ID NO: 72118 - DNA, 20 bp, Artificial Sequence
  Description of Artificial Sequence: Synthetic oligonucleotide
  Target: SCN9A; (-) strand; PAM type: YTN; PAM sequence: TTT
taaggagcaggcatctaggt

SEQ ID NO: 72119 - DNA, 20 bp, Artificial Sequence
  Description of Artificial Sequence: Synthetic oligonucleotide
  Target: SCN9A; (-) strand; PAM type: YTN; PAM sequence: CTT
ttaaggagcaggcatctagg

SEQ ID NO: 72120 - DNA, 20 bp, Artificial Sequence
  Description of Artificial Sequence: Synthetic oligonucleotide
  Target: SCN9A; (-) strand; PAM type: YTN; PAM sequence: TTC
cacgtatgccttttaaggag

SEQ ID NO: 72121 - DNA, 20 bp, Artificial Sequence
  Description of Artificial Sequence: Synthetic oligonucleotide
  Target: SCN9A; (-) strand; PAM type: YTN; PAM sequence: TTA
gaaaatcagattccacgtat

SEQ ID NO: 72122 - DNA, 20 bp, Artificial Sequence
  Description of Artificial Sequence: Synthetic oligonucleotide
  Target: SCN9A; (-) strand; PAM type: YTN; PAM sequence: TTA
aagttagaaaatcagattcc

SEQ ID NO: 72123 - DNA, 20 bp, Artificial Sequence
  Description of Artificial Sequence: Synthetic oligonucleotide
  Target: SCN9A; (-) strand; PAM type: YTN; PAM sequence: CTT
aaagttagaaaatcagattc

SEQ ID NO: 72124 - DNA, 20 bp, Artificial Sequence
  Description of Artificial Sequence: Synthetic oligonucleotide
  Target: SCN9A; (-) strand; PAM type: YTN; PAM sequence: TTC
agcttaaagttagaaaatca

SEQ ID NO: 72125 - DNA, 20 bp, Artificial Sequence
  Description of Artificial Sequence: Synthetic oligonucleotide
  Target: SCN9A; (-) strand; PAM type: YTN; PAM sequence: TTT
cagcttaaagttagaaaatc

SEQ ID NO: 72126 - DNA, 20 bp, Artificial Sequence
  Description of Artificial Sequence: Synthetic oligonucleotide
  Target: SCN9A; (-) strand; PAM type: YTN; PAM sequence: TTC
atttcagcttaaagttagaa

SEQ ID NO: 72127 - DNA, 20 bp, Artificial Sequence
  Description of Artificial Sequence: Synthetic oligonucleotide
  Target: SCN9A; (-) strand; PAM type: YTN; PAM sequence: TTA
aaaccgtgttcatttcagct

SEQ ID NO: 72128 - DNA, 20 bp, Artificial Sequence
  Description of Artificial Sequence: Synthetic oligonucleotide
  Target: SCN9A; (-) strand; PAM type: YTN; PAM sequence: TTT
aaaaccgtgttcatttcagc

SEQ ID NO: 72129 - DNA, 20 bp, Artificial Sequence
  Description of Artificial Sequence: Synthetic oligonucleotide
  Target: SCN9A; (-) strand; PAM type: YTN; PAM sequence: TTT
taaaaccgtgttcatttcag

SEQ ID NO: 72130 - DNA, 20 bp, Artificial Sequence
  Description of Artificial Sequence: Synthetic oligonucleotide
  Target: SCN9A; (-) strand; PAM type: YTN; PAM sequence: CTC
ccaaaattttaaaaccgtgt

SEQ ID NO: 72131 - DNA, 20 bp, Artificial Sequence
  Description of Artificial Sequence: Synthetic oligonucleotide
  Target: SCN9A; (-) strand; PAM type: YTN; PAM sequence: CTA
catggaagaagtaatactcc

SEQ ID NO: 72132 - DNA, 20 bp, Artificial Sequence
  Description of Artificial Sequence: Synthetic oligonucleotide
  Target: SCN9A; (-) strand; PAM type: YTN; PAM sequence: TTC
tacatggaagaagtaatact

SEQ ID NO: 72133 - DNA, 20 bp, Artificial Sequence
  Description of Artificial Sequence: Synthetic oligonucleotide
  Target: SCN9A; (-) strand; PAM type: YTN; PAM sequence: TTA
aaatgttctacatggaagaa

SEQ ID NO: 72134 - DNA, 20 bp, Artificial Sequence
  Description of Artificial Sequence: Synthetic oligonucleotide
  Target: SCN9A; (-) strand; PAM type: YTN; PAM sequence: TTT
aaaatgttctacatggaaga

SEQ ID NO: 72135 - DNA, 20 bp, Artificial Sequence
  Description of Artificial Sequence: Synthetic oligonucleotide
  Target: SCN9A; (-) strand; PAM type: YTN; PAM sequence: TTT
taaaatgttctacatggaag

SEQ ID NO: 72136 - DNA, 20 bp, Artificial Sequence
  Description of Artificial Sequence: Synthetic oligonucleotide
  Target: SCN9A; (-) strand; PAM type: YTN; PAM sequence: TTG
tatattttaaaatgttctac

SEQ ID NO: 72137 - DNA, 20 bp, Artificial Sequence
  Description of Artificial Sequence: Synthetic oligonucleotide
  Target: SCN9A; (-) strand; PAM type: YTN; PAM sequence: TTT
gtatattttaaaatgttcta

SEQ ID NO: 72138 - DNA, 20 bp, Artificial Sequence
  Description of Artificial Sequence: Synthetic oligonucleotide
  Target: SCN9A; (-) strand; PAM type: YTN; PAM sequence: TTA
tttgtatattttaaaatgtt

SEQ ID NO: 72139 - DNA, 20 bp, Artificial Sequence
  Description of Artificial Sequence: Synthetic oligonucleotide
  Target: SCN9A; (-) strand; PAM type: YTN; PAM sequence: TTT
atttgtatattttaaaatgt

SEQ ID NO: 72140 - DNA, 20 bp, Artificial Sequence
  Description of Artificial Sequence: Synthetic oligonucleotide
  Target: SCN9A; (-) strand; PAM type: YTN; PAM sequence: TTT
tatttgtatattttaaaatg

SEQ ID NO: 72141 - DNA, 20 bp, Artificial Sequence
  Description of Artificial Sequence: Synthetic oligonucleotide
  Target: SCN9A; (-) strand; PAM type: YTN; PAM sequence: CTG
tattttatttgtatatttta

SEQ ID NO: 72142 - DNA, 20 bp, Artificial Sequence
  Description of Artificial Sequence: Synthetic oligonucleotide
  Target: SCN9A; (-) strand; PAM type: YTN; PAM sequence: CTA
cagatgtgggacccagggat

SEQ ID NO: 72143 - DNA, 20 bp, Artificial Sequence
  Description of Artificial Sequence: Synthetic oligonucleotide
  Target: SCN9A; (-) strand; PAM type: YTN; PAM sequence: CTC
tacagatgtgggacccaggg

SEQ ID NO: 72144 - DNA, 20 bp, Artificial Sequence
  Description of Artificial Sequence: Synthetic oligonucleotide
  Target: SCN9A; (-) strand; PAM type: YTN; PAM sequence: TTG
actctacagatgtgggaccc

SEQ ID NO: 72145 - DNA, 20 bp, Artificial Sequence
  Description of Artificial Sequence: Synthetic oligonucleotide
  Target: SCN9A; (-) strand; PAM type: YTN; PAM sequence: TTG
gttgactctacagatgtggg

SEQ ID NO: 72146 - DNA, 20 bp, Artificial Sequence
  Description of Artificial Sequence: Synthetic oligonucleotide
  Target: SCN9A; (-) strand; PAM type: YTN; PAM sequence: CTG
tagttggttgactctacaga

SEQ ID NO: 72147 - DNA, 20 bp, Artificial Sequence
  Description of Artificial Sequence: Synthetic oligonucleotide
  Target: SCN9A; (-) strand; PAM type: YTN; PAM sequence: TTC
catctgtagttggttgactc

SEQ ID NO: 72148 - DNA, 20 bp, Artificial Sequence
  Description of Artificial Sequence: Synthetic oligonucleotide
  Target: SCN9A; (-) strand; PAM type: YTN; PAM sequence: TTT
ccatctgtagttggttgact

SEQ ID NO: 72149 - DNA, 20 bp, Artificial Sequence
  Description of Artificial Sequence: Synthetic oligonucleotide
  Target: SCN9A; (-) strand; PAM type: YTN; PAM sequence: TTT
tccatctgtagttggttgac

SEQ ID NO: 72150 - DNA, 20 bp, Artificial Sequence
  Description of Artificial Sequence: Synthetic oligonucleotide
  Target: SCN9A; (-) strand; PAM type: YTN; PAM sequence: TTA
ttttccatctgtagttggtt

SEQ ID NO: 72151 - DNA, 20 bp, Artificial Sequence
  Description of Artificial Sequence: Synthetic oligonucleotide
  Target: SCN9A; (-) strand; PAM type: YTN; PAM sequence: TTC
caattattttccatctgtag

SEQ ID NO: 72152 - DNA, 20 bp, Artificial Sequence
  Description of Artificial Sequence: Synthetic oligonucleotide
  Target: SCN9A; (-) strand; PAM type: YTN; PAM sequence: TTT
ccaattattttccatctgta

SEQ ID NO: 72153 - DNA, 20 bp, Artificial Sequence
  Description of Artificial Sequence: Synthetic oligonucleotide
  Target: SCN9A; (-) strand; PAM type: YTN; PAM sequence: TTT
tccaattattttccatctgt

SEQ ID NO: 72154 - DNA, 20 bp, Artificial Sequence
  Description of Artificial Sequence: Synthetic oligonucleotide
  Target: SCN9A; (-) strand; PAM type: YTN; PAM sequence: TTT
ttccaattattttccatctg

SEQ ID NO: 72155 - DNA, 20 bp, Artificial Sequence
  Description of Artificial Sequence: Synthetic oligonucleotide
  Target: SCN9A; (-) strand; PAM type: YTN; PAM sequence: TTT
tttccaattattttccatct

SEQ ID NO: 72156 - DNA, 20 bp, Artificial Sequence
  Description of Artificial Sequence: Synthetic oligonucleotide
  Target: SCN9A; (-) strand; PAM type: YTN; PAM sequence: TTA
ttttttccaattattttcca

SEQ ID NO: 72157 - DNA, 20 bp, Artificial Sequence
  Description of Artificial Sequence: Synthetic oligonucleotide
  Target: SCN9A; (-) strand; PAM type: YTN; PAM sequence: TTT
attttttccaattattttcc

SEQ ID NO: 72158 - DNA, 20 bp, Artificial Sequence
  Description of Artificial Sequence: Synthetic oligonucleotide
  Target: SCN9A; (-) strand; PAM type: YTN; PAM sequence: TTA
tatttattttttccaattat

SEQ ID NO: 72159 - DNA, 20 bp, Artificial Sequence
  Description of Artificial Sequence: Synthetic oligonucleotide
  Target: SCN9A; (-) strand; PAM type: YTN; PAM sequence: TTT
atatttattttttccaatta

SEQ ID NO: 72160 - DNA, 20 bp, Artificial Sequence
  Description of Artificial Sequence: Synthetic oligonucleotide
  Target: SCN9A; (-) strand; PAM type: YTN; PAM sequence: TTT
tatatttattttttccaatt

SEQ ID NO: 72161 - DNA, 20 bp, Artificial Sequence
  Description of Artificial Sequence: Synthetic oligonucleotide
  Target: SCN9A; (-) strand; PAM type: YTN; PAM sequence: TTT
ttatatttattttttccaat

SEQ ID NO: 72162 - DNA, 20 bp, Artificial Sequence
  Description of Artificial Sequence: Synthetic oligonucleotide
  Target: SCN9A; (-) strand; PAM type: YTN; PAM sequence: TTG
tatttttatatttatttttt

SEQ ID NO: 72163 - DNA, 20 bp, Artificial Sequence
  Description of Artificial Sequence: Synthetic oligonucleotide
  Target: SCN9A; (-) strand; PAM type: YTN; PAM sequence: TTG
ttgtatttttatatttattt

SEQ ID NO: 72164 - DNA, 20 bp, Artificial Sequence
  Description of Artificial Sequence: Synthetic oligonucleotide
  Target: SCN9A; (-) strand; PAM type: YTN; PAM sequence: TTA
ttgttgtatttttatattta

SEQ ID NO: 72165 - DNA, 20 bp, Artificial Sequence
  Description of Artificial Sequence: Synthetic oligonucleotide
  Target: SCN9A; (-) strand; PAM type: YTN; PAM sequence: TTT
attgttgtatttttatattt

SEQ ID NO: 72166 - DNA, 20 bp, Artificial Sequence
  Description of Artificial Sequence: Synthetic oligonucleotide
  Target: SCN9A; (-) strand; PAM type: YTN; PAM sequence: TTT
tattgttgtatttttatatt

SEQ ID NO: 72167 - DNA, 20 bp, Artificial Sequence
  Description of Artificial Sequence: Synthetic oligonucleotide
  Target: SCN9A; (-) strand; PAM type: YTN; PAM sequence: TTT
ttattgttgtatttttatat

SEQ ID NO: 72168 - DNA, 20 bp, Artificial Sequence
  Description of Artificial Sequence: Synthetic oligonucleotide
  Target: SCN9A; (-) strand; PAM type: YTN; PAM sequence: CTA
tttttattgttgtattttta

SEQ ID NO: 72169 - DNA, 20 bp, Artificial Sequence
  Description of Artificial Sequence: Synthetic oligonucleotide
  Target: SCN9A; (-) strand; PAM type: YTN; PAM sequence: TTG
tactatttttattgttgtat

SEQ ID NO: 72170 - DNA, 20 bp, Artificial Sequence
  Description of Artificial Sequence: Synthetic oligonucleotide
  Target: SCN9A; (-) strand; PAM type: YTN; PAM sequence: TTT
gtactatttttattgttgta

SEQ ID NO: 72171 - DNA, 20 bp, Artificial Sequence
  Description of Artificial Sequence: Synthetic oligonucleotide
  Target: SCN9A; (-) strand; PAM type: YTN; PAM sequence: TTA
tttgtactatttttattgtt

SEQ ID NO: 72172 - DNA, 20 bp, Artificial Sequence
  Description of Artificial Sequence: Synthetic oligonucleotide
  Target: SCN9A; (-) strand; PAM type: YTN; PAM sequence: TTT
atttgtactatttttattgt

SEQ ID NO: 72173 - DNA, 20 bp, Artificial Sequence
  Description of Artificial Sequence: Synthetic oligonucleotide
  Target: SCN9A; (-) strand; PAM type: YTN; PAM sequence: TTT
tatttgtactatttttattg

SEQ ID NO: 72174 - DNA, 20 bp, Artificial Sequence
  Description of Artificial Sequence: Synthetic oligonucleotide
  Target: SCN9A; (-) strand; PAM type: YTN; PAM sequence: TTT
ttatttgtactatttttatt

SEQ ID NO: 72175 - DNA, 20 bp, Artificial Sequence
  Description of Artificial Sequence: Synthetic oligonucleotide
  Target: SCN9A; (-) strand; PAM type: YTN; PAM sequence: TTT
tttatttgtactatttttat

SEQ ID NO: 72176 - DNA, 20 bp, Artificial Sequence
  Description of Artificial Sequence: Synthetic oligonucleotide
  Target: SCN9A; (-) strand; PAM type: YTN; PAM sequence: CTA
tattttttatttgtactatt

SEQ ID NO: 72177 - DNA, 20 bp, Artificial Sequence
  Description of Artificial Sequence: Synthetic oligonucleotide
  Target: SCN9A; (-) strand; PAM type: YTN; PAM sequence: TTA
ctatattttttatttgtact

SEQ ID NO: 72178 - DNA, 20 bp, Artificial Sequence
  Description of Artificial Sequence: Synthetic oligonucleotide
  Target: SCN9A; (-) strand; PAM type: YTN; PAM sequence: TTT
actatattttttatttgtac

SEQ ID NO: 72179 - DNA, 20 bp, Artificial Sequence
  Description of Artificial Sequence: Synthetic oligonucleotide
  Target: SCN9A; (-) strand; PAM type: YTN; PAM sequence: TTT
tactatattttttatttgta

SEQ ID NO: 72180 - DNA, 20 bp, Artificial Sequence
  Description of Artificial Sequence: Synthetic oligonucleotide
  Target: SCN9A; (-) strand; PAM type: YTN; PAM sequence: TTG
ttttactatattttttattt

SEQ ID NO: 72181 - DNA, 20 bp, Artificial Sequence
  Description of Artificial Sequence: Synthetic oligonucleotide
  Target: SCN9A; (-) strand; PAM type: YTN; PAM sequence: TTT
gttttactatattttttatt

SEQ ID NO: 72182 - DNA, 20 bp, Artificial Sequence
  Description of Artificial Sequence: Synthetic oligonucleotide
  Target: SCN9A; (-) strand; PAM type: YTN; PAM sequence: CTG
acacaatgtaaatatttgtt

SEQ ID NO: 72183 - DNA, 20 bp, Artificial Sequence
  Description of Artificial Sequence: Synthetic oligonucleotide
  Target: SCN9A; (-) strand; PAM type: YTN; PAM sequence: TTA
taatgtaaaagtaaatcact

SEQ ID NO: 72184 - DNA, 20 bp, Artificial Sequence
  Description of Artificial Sequence: Synthetic oligonucleotide
  Target: SCN9A; (-) strand; PAM type: YTN; PAM sequence: CTT
ataatgtaaaagtaaatcac

SEQ ID NO: 72185 - DNA, 20 bp, Artificial Sequence
  Description of Artificial Sequence: Synthetic oligonucleotide
  Target: SCN9A; (-) strand; PAM type: YTN; PAM sequence: TTA
cttataatgtaaaagtaaat

SEQ ID NO: 72186 - DNA, 20 bp, Artificial Sequence
  Description of Artificial Sequence: Synthetic oligonucleotide
  Target: SCN9A; (-) strand; PAM type: YTN; PAM sequence: TTC
agattacttataatgtaaaa

SEQ ID NO: 72187 - DNA, 20 bp, Artificial Sequence
  Description of Artificial Sequence: Synthetic oligonucleotide
  Target: SCN9A; (-) strand; PAM type: YTN; PAM sequence: CTT
cagattacttataatgtaaa

SEQ ID NO: 72188 - DNA, 20 bp, Artificial Sequence
  Description of Artificial Sequence: Synthetic oligonucleotide
  Target: SCN9A; (-) strand; PAM type: YTN; PAM sequence: TTA
tcttcagattacttataatg

SEQ ID NO: 72189 - DNA, 20 bp, Artificial Sequence
  Description of Artificial Sequence: Synthetic oligonucleotide
  Target: SCN9A; (-) strand; PAM type: YTN; PAM sequence: TTA
aattatcttcagattactta

SEQ ID NO: 72190 - DNA, 20 bp, Artificial Sequence
  Description of Artificial Sequence: Synthetic oligonucleotide
  Target: SCN9A; (-) strand; PAM type: YTN; PAM sequence: TTT
aaattatcttcagattactt

SEQ ID NO: 72191 - DNA, 20 bp, Artificial Sequence
  Description of Artificial Sequence: Synthetic oligonucleotide
  Target: SCN9A; (-) strand; PAM type: YTN; PAM sequence: CTT
taaattatcttcagattact

SEQ ID NO: 72192 - DNA, 20 bp, Artificial Sequence
  Description of Artificial Sequence: Synthetic oligonucleotide
  Target: SCN9A; (-) strand; PAM type: YTN; PAM sequence: CTC
atatgtacactttaaattat

SEQ ID NO: 72193 - DNA, 20 bp, Artificial Sequence
  Description of Artificial Sequence: Synthetic oligonucleotide
  Target: SCN9A; (-) strand; PAM type: YTN; PAM sequence: CTC
tcatatgtacactttaaatt

SEQ ID NO: 72194 - DNA, 20 bp, Artificial Sequence
  Description of Artificial Sequence: Synthetic oligonucleotide
  Target: SCN9A; (-) strand; PAM type: YTN; PAM sequence: CTA
cacacatcctctcatatgta

SEQ ID NO: 72195 - DNA, 20 bp, Artificial Sequence
  Description of Artificial Sequence: Synthetic oligonucleotide
  Target: SCN9A; (-) strand; PAM type: YTN; PAM sequence: TTA
ccataaaacctacacacatc

SEQ ID NO: 72196 - DNA, 20 bp, Artificial Sequence
  Description of Artificial Sequence: Synthetic oligonucleotide
  Target: SCN9A; (-) strand; PAM type: YTN; PAM sequence: TTT
accataaaacctacacacat

SEQ ID NO: 72197 - DNA, 20 bp, Artificial Sequence
  Description of Artificial Sequence: Synthetic oligonucleotide
  Target: SCN9A; (-) strand; PAM type: YTN; PAM sequence: TTA
tataaaatggcacaatgttt

SEQ ID NO: 72198 - DNA, 20 bp, Artificial Sequence
  Description of Artificial Sequence: Synthetic oligonucleotide
  Target: SCN9A; (-) strand; PAM type: YTN; PAM sequence: TTT
atataaaatggcacaatgtt

SEQ ID NO: 72199 - DNA, 20 bp, Artificial Sequence
  Description of Artificial Sequence: Synthetic oligonucleotide
  Target: SCN9A; (-) strand; PAM type: YTN; PAM sequence: CTT
tatataaaatggcacaatgt

SEQ ID NO: 72200 - DNA, 20 bp, Artificial Sequence
  Description of Artificial Sequence: Synthetic oligonucleotide
  Target: SCN9A; (-) strand; PAM type: YTN; PAM sequence: TTC
ctttatataaaatggcacaa

SEQ ID NO: 72201 - DNA, 20 bp, Artificial Sequence
  Description of Artificial Sequence: Synthetic oligonucleotide
  Target: SCN9A; (-) strand; PAM type: YTN; PAM sequence: CTC
aattcctttatataaaatgg

SEQ ID NO: 72202 - DNA, 20 bp, Artificial Sequence
  Description of Artificial Sequence: Synthetic oligonucleotide
  Target: SCN9A; (-) strand; PAM type: YTN; PAM sequence: CTG
cagatgctcaattcctttat

SEQ ID NO: 72203 - DNA, 20 bp, Artificial Sequence
  Description of Artificial Sequence: Synthetic oligonucleotide
  Target: SCN9A; (-) strand; PAM type: YTN; PAM sequence: CTA
aaatctgcagatgctcaatt

SEQ ID NO: 72204 - DNA, 20 bp, Artificial Sequence
  Description of Artificial Sequence: Synthetic oligonucleotide
  Target: SCN9A; (-) strand; PAM type: YTN; PAM sequence: TTG
aaggccccccacagagacta

SEQ ID NO: 72205 - DNA, 20 bp, Artificial Sequence
  Description of Artificial Sequence: Synthetic oligonucleotide
  Target: SCN9A; (-) strand; PAM type: YTN; PAM sequence: TTT
gaaggccccccacagagact

SEQ ID NO: 72206 - DNA, 20 bp, Artificial Sequence
  Description of Artificial Sequence: Synthetic oligonucleotide
  Target: SCN9A; (-) strand; PAM type: YTN; PAM sequence: CTA
tgggcgagtagtttgaaggc

SEQ ID NO: 72207 - DNA, 20 bp, Artificial Sequence
  Description of Artificial Sequence: Synthetic oligonucleotide
  Target: SCN9A; (-) strand; PAM type: YTN; PAM sequence: CTC
gatatctatgggcgagtagt

SEQ ID NO: 72208 - DNA, 20 bp, Artificial Sequence
  Description of Artificial Sequence: Synthetic oligonucleotide
  Target: SCN9A; (-) strand; PAM type: YTN; PAM sequence: CTA
gtcatccctcgatatctatg

SEQ ID NO: 72209 - DNA, 20 bp, Artificial Sequence
  Description of Artificial Sequence: Synthetic oligonucleotide
  Target: SCN9A; (-) strand; PAM type: YTN; PAM sequence: TTC
caagacggtaaagtaaggaa

SEQ ID NO: 72210 - DNA, 20 bp, Artificial Sequence
  Description of Artificial Sequence: Synthetic oligonucleotide
  Target: SCN9A; (-) strand; PAM type: YTN; PAM sequence: TTT
ccaagacggtaaagtaagga

SEQ ID NO: 72211 - DNA, 20 bp, Artificial Sequence
  Description of Artificial Sequence: Synthetic oligonucleotide
  Target: SCN9A; (-) strand; PAM type: YTN; PAM sequence: TTT
tccaagacggtaaagtaagg

SEQ ID NO: 72212 - DNA, 20 bp, Artificial Sequence
  Description of Artificial Sequence: Synthetic oligonucleotide
  Target: SCN9A; (-) strand; PAM type: YTN; PAM sequence: TTT
ttccaagacggtaaagtaag

SEQ ID NO: 72213 - DNA, 20 bp, Artificial Sequence
  Description of Artificial Sequence: Synthetic oligonucleotide
  Target: SCN9A; (-) strand; PAM type: YTN; PAM sequence: TTT
tttccaagacggtaaagtaa

SEQ ID NO: 72214 - DNA, 20 bp, Artificial Sequence
  Description of Artificial Sequence: Synthetic oligonucleotide
  Target: SCN9A; (-) strand; PAM type: YTN; PAM sequence: CTA
tgtagccaaggacatttttt

SEQ ID NO: 72215 - DNA, 20 bp, Artificial Sequence
  Description of Artificial Sequence: Synthetic oligonucleotide
  Target: SCN9A; (-) strand; PAM type: YTN; PAM sequence: TTC
tatgtagccaaggacatttt

SEQ ID NO: 72216 - DNA, 20 bp, Artificial Sequence
  Description of Artificial Sequence: Synthetic oligonucleotide
  Target: SCN9A; (-) strand; PAM type: YTN; PAM sequence: TTT
ctatgtagccaaggacattt

SEQ ID NO: 72217 - DNA, 20 bp, Artificial Sequence
  Description of Artificial Sequence: Synthetic oligonucleotide
  Target: SCN9A; (-) strand; PAM type: YTN; PAM sequence: TTA
aataaataaatcatgatata

SEQ ID NO: 72218 - DNA, 20 bp, Artificial Sequence
  Description of Artificial Sequence: Synthetic oligonucleotide
  Target: SCN9A; (-) strand; PAM type: YTN; PAM sequence: TTG
agtgaataaatgattaaata

SEQ ID NO: 72219 - DNA, 20 bp, Artificial Sequence
  Description of Artificial Sequence: Synthetic oligonucleotide
  Target: SCN9A; (-) strand; PAM type: YTN; PAM sequence: TTA
attgagtgaataaatgatta

SEQ ID NO: 72220 - DNA, 20 bp, Artificial Sequence
  Description of Artificial Sequence: Synthetic oligonucleotide
  Target: SCN9A; (-) strand; PAM type: YTN; PAM sequence: TTT
aattgagtgaataaatgatt

SEQ ID NO: 72221 - DNA, 20 bp, Artificial Sequence
  Description of Artificial Sequence: Synthetic oligonucleotide
  Target: SCN9A; (-) strand; PAM type: YTN; PAM sequence: CTA
tatttaattgagtgaataaa

SEQ ID NO: 72222 - DNA, 20 bp, Artificial Sequence
  Description of Artificial Sequence: Synthetic oligonucleotide
  Target: SCN9A; (-) strand; PAM type: YTN; PAM sequence: CTC
tatatttaattgagtgaata

SEQ ID NO: 72223 - DNA, 20 bp, Artificial Sequence
  Description of Artificial Sequence: Synthetic oligonucleotide
  Target: SCN9A; (-) strand; PAM type: YTN; PAM sequence: TTA
aaacaaaataaaataaaatg

SEQ ID NO: 72224 - DNA, 20 bp, Artificial Sequence
  Description of Artificial Sequence: Synthetic oligonucleotide
  Target: SCN9A; (-) strand; PAM type: YTN; PAM sequence: TTA
aattaaaacaaaataaaata

SEQ ID NO: 72225 - DNA, 20 bp, Artificial Sequence
  Description of Artificial Sequence: Synthetic oligonucleotide
  Target: SCN9A; (-) strand; PAM type: YTN; PAM sequence: TTA
aattaaattaaaacaaaata

SEQ ID NO: 72226 - DNA, 20 bp, Artificial Sequence
  Description of Artificial Sequence: Synthetic oligonucleotide
  Target: SCN9A; (-) strand; PAM type: YTN; PAM sequence: TTA
aatacataagattaaattaa

SEQ ID NO: 72227 - DNA, 20 bp, Artificial Sequence
  Description of Artificial Sequence: Synthetic oligonucleotide
  Target: SCN9A; (-) strand; PAM type: YTN; PAM sequence: TTA
aattaaatacataagattaa

SEQ ID NO: 72228 - DNA, 20 bp, Artificial Sequence
  Description of Artificial Sequence: Synthetic oligonucleotide
  Target: SCN9A; (-) strand; PAM type: YTN; PAM sequence: CTC
aaaaaaaatcaatacataag

SEQ ID NO: 72229 - DNA, 20 bp, Artificial Sequence
  Description of Artificial Sequence: Synthetic oligonucleotide
  Target: SCN9A; (-) strand; PAM type: YTN; PAM sequence: CTG
tctcaaaaaaaatcaataca

SEQ ID NO: 72230 - DNA, 20 bp, Artificial Sequence
  Description of Artificial Sequence: Synthetic oligonucleotide
  Target: SCN9A; (-) strand; PAM type: YTN; PAM sequence: CTC
tgtctcaaaaaaaatcaata

SEQ ID NO: 72231 - DNA, 20 bp, Artificial Sequence
  Description of Artificial Sequence: Synthetic oligonucleotide
  Target: SCN9A; (-) strand; PAM type: YTN; PAM sequence: CTA
cagagtgagactctgtctca

SEQ ID NO: 72232 - DNA, 20 bp, Artificial Sequence
  Description of Artificial Sequence: Synthetic oligonucleotide
  Target: SCN9A; (-) strand; PAM type: YTN; PAM sequence: TTG
gactacagagtgagactctg

SEQ ID NO: 72233 - DNA, 20 bp, Artificial Sequence
  Description of Artificial Sequence: Synthetic oligonucleotide
  Target: SCN9A; (-) strand; PAM type: YTN; PAM sequence: CTT
ggactacagagtgagactct

SEQ ID NO: 72234 - DNA, 20 bp, Artificial Sequence
  Description of Artificial Sequence: Synthetic oligonucleotide
  Target: SCN9A; (-) strand; PAM type: YTN; PAM sequence: CTC
cagcttggactacagagtga

SEQ ID NO: 72235 - DNA, 20 bp, Artificial Sequence
  Description of Artificial Sequence: Synthetic oligonucleotide
  Target: SCN9A; (-) strand; PAM type: YTN; PAM sequence: CTG
cactccagcttggactacag

SEQ ID NO: 72236 - DNA, 20 bp, Artificial Sequence
  Description of Artificial Sequence: Synthetic oligonucleotide
  Target: SCN9A; (-) strand; PAM type: YTN; PAM sequence: TTG
cagtaagccaagatcgcacc

SEQ ID NO: 72237 - DNA, 20 bp, Artificial Sequence
  Description of Artificial Sequence: Synthetic oligonucleotide
  Target: SCN9A; (-) strand; PAM type: YTN; PAM sequence: CTC
cagaggcggaggttgcagta

SEQ ID NO: 72238 - DNA, 20 bp, Artificial Sequence
  Description of Artificial Sequence: Synthetic oligonucleotide
  Target: SCN9A; (-) strand; PAM type: YTN; PAM sequence: TTG
agctccagaggcggaggttg

SEQ ID NO: 72239 - DNA, 20 bp, Artificial Sequence
  Description of Artificial Sequence: Synthetic oligonucleotide
  Target: SCN9A; (-) strand; PAM type: YTN; PAM sequence: CTT
gagctccagaggcggaggtt

SEQ ID NO: 72240 - DNA, 20 bp, Artificial Sequence
  Description of Artificial Sequence: Synthetic oligonucleotide
  Target: SCN9A; (-) strand; PAM type: YTN; PAM sequence: CTG
aggcatgagaatcacttgag

SEQ ID NO: 72241 - DNA, 20 bp, Artificial Sequence
  Description of Artificial Sequence: Synthetic oligonucleotide
  Target: SCN9A; (-) strand; PAM type: YTN; PAM sequence: CTC
aggaggctgaggcatgagaa

SEQ ID NO: 72242 - DNA, 20 bp, Artificial Sequence
  Description of Artificial Sequence: Synthetic oligonucleotide
  Target: SCN9A; (-) strand; PAM type: YTN; PAM sequence: CTG
atatatatatatatatatat

SEQ ID NO: 72243 - DNA, 20 bp, Artificial Sequence
  Description of Artificial Sequence: Synthetic oligonucleotide
  Target: SCN9A; (-) strand; PAM type: YTN; PAM sequence: TTA
tatggaataatcatgactga

SEQ ID NO: 72244 - DNA, 20 bp, Artificial Sequence
  Description of Artificial Sequence: Synthetic oligonucleotide
  Target: SCN9A; (-) strand; PAM type: YTN; PAM sequence: TTG
gaaaacgagattatatggaa

SEQ ID NO: 72245 - DNA, 20 bp, Artificial Sequence
  Description of Artificial Sequence: Synthetic oligonucleotide
  Target: SCN9A; (-) strand; PAM type: YTN; PAM sequence: CTT
ggaaaacgagattatatgga

SEQ ID NO: 72246 - DNA, 20 bp, Artificial Sequence
  Description of Artificial Sequence: Synthetic oligonucleotide
  Target: SCN9A; (-) strand; PAM type: YTN; PAM sequence: TTA
tagtggacttggaaaacgag

SEQ ID NO: 72247 - DNA, 20 bp, Artificial Sequence
  Description of Artificial Sequence: Synthetic oligonucleotide
  Target: SCN9A; (-) strand; PAM type: YTN; PAM sequence: TTT
atagtggacttggaaaacga

SEQ ID NO: 72248 - DNA, 20 bp, Artificial Sequence
  Description of Artificial Sequence: Synthetic oligonucleotide
  Target: SCN9A; (-) strand; PAM type: YTN; PAM sequence: CTC
catgaatttatagtggactt

SEQ ID NO: 72249 - DNA, 20 bp, Artificial Sequence
  Description of Artificial Sequence: Synthetic oligonucleotide
  Target: SCN9A; (-) strand; PAM type: YTN; PAM sequence: CTC
caccctccatgaatttatag

SEQ ID NO: 72250 - DNA, 20 bp, Artificial Sequence
  Description of Artificial Sequence: Synthetic oligonucleotide
  Target: SCN9A; (-) strand; PAM type: YTN; PAM sequence: CTA
agactccaccctccatgaat

SEQ ID NO: 72251 - DNA, 20 bp, Artificial Sequence
  Description of Artificial Sequence: Synthetic oligonucleotide
  Target: SCN9A; (-) strand; PAM type: YTN; PAM sequence: TTA
ctaagactccaccctccatg

SEQ ID NO: 72252 - DNA, 20 bp, Artificial Sequence
  Description of Artificial Sequence: Synthetic oligonucleotide
  Target: SCN9A; (-) strand; PAM type: YTN; PAM sequence: CTT
actaagactccaccctccat

SEQ ID NO: 72253 - DNA, 20 bp, Artificial Sequence
  Description of Artificial Sequence: Synthetic oligonucleotide
  Target: SCN9A; (-) strand; PAM type: YTN; PAM sequence: TTA
acttactaagactccaccct

SEQ ID NO: 72254 - DNA, 20 bp, Artificial Sequence
  Description of Artificial Sequence: Synthetic oligonucleotide
  Target: SCN9A; (-) strand; PAM type: YTN; PAM sequence: CTT
aacttactaagactccaccc

SEQ ID NO: 72255 - DNA, 20 bp, Artificial Sequence
  Description of Artificial Sequence: Synthetic oligonucleotide
  Target: SCN9A; (-) strand; PAM type: YTN; PAM sequence: CTC
cttaacttactaagactcca

SEQ ID NO: 72256 - DNA, 20 bp, Artificial Sequence
  Description of Artificial Sequence: Synthetic oligonucleotide
  Target: SCN9A; (-) strand; PAM type: YTN; PAM sequence: CTA
tctccttaacttactaagac

SEQ ID NO: 72257 - DNA, 20 bp, Artificial Sequence
  Description of Artificial Sequence: Synthetic oligonucleotide
  Target: SCN9A; (-) strand; PAM type: YTN; PAM sequence: TTC
tatctccttaacttactaag

SEQ ID NO: 72258 - DNA, 20 bp, Artificial Sequence
  Description of Artificial Sequence: Synthetic oligonucleotide
  Target: SCN9A; (-) strand; PAM type: YTN; PAM sequence: CTT
ctatctccttaacttactaa

SEQ ID NO: 72259 - DNA, 20 bp, Artificial Sequence
  Description of Artificial Sequence: Synthetic oligonucleotide
  Target: SCN9A; (-) strand; PAM type: YTN; PAM sequence: TTA
ccaaatatcttctatctcct

SEQ ID NO: 72260 - DNA, 20 bp, Artificial Sequence
  Description of Artificial Sequence: Synthetic oligonucleotide
  Target: SCN9A; (-) strand; PAM type: YTN; PAM sequence: TTT
accaaatatcttctatctcc

SEQ ID NO: 72261 - DNA, 20 bp, Artificial Sequence
  Description of Artificial Sequence: Synthetic oligonucleotide
  Target: SCN9A; (-) strand; PAM type: YTN; PAM sequence: TTG
acagatatttaccaaatatc

SEQ ID NO: 72262 - DNA, 20 bp, Artificial Sequence
  Description of Artificial Sequence: Synthetic oligonucleotide
  Target: SCN9A; (-) strand; PAM type: YTN; PAM sequence: TTT
gacagatatttaccaaatat

SEQ ID NO: 72263 - DNA, 20 bp, Artificial Sequence
  Description of Artificial Sequence: Synthetic oligonucleotide
  Target: SCN9A; (-) strand; PAM type: YTN; PAM sequence: TTA
gaaagtatttgacagatatt

SEQ ID NO: 72264 - DNA, 20 bp, Artificial Sequence
  Description of Artificial Sequence: Synthetic oligonucleotide
  Target: SCN9A; (-) strand; PAM type: YTN; PAM sequence: CTC
atgttagaaagtatttgaca

SEQ ID NO: 72265 - DNA, 20 bp, Artificial Sequence
  Description of Artificial Sequence: Synthetic oligonucleotide
  Target: SCN9A; (-) strand; PAM type: YTN; PAM sequence: CTA
gctcatgttagaaagtattt

SEQ ID NO: 72266 - DNA, 20 bp, Artificial Sequence
  Description of Artificial Sequence: Synthetic oligonucleotide
  Target: SCN9A; (-) strand; PAM type: YTN; PAM sequence: CTC
tagctcatgttagaaagtat

SEQ ID NO: 72267 - DNA, 20 bp, Artificial Sequence
  Description of Artificial Sequence: Synthetic oligonucleotide
  Target: SCN9A; (-) strand; PAM type: YTN; PAM sequence: TTC
tctagctcatgttagaaagt

SEQ ID NO: 72268 - DNA, 20 bp, Artificial Sequence
  Description of Artificial Sequence: Synthetic oligonucleotide
  Target: SCN9A; (-) strand; PAM type: YTN; PAM sequence: TTT
ctctagctcatgttagaaag

SEQ ID NO: 72269 - DNA, 20 bp, Artificial Sequence
  Description of Artificial Sequence: Synthetic oligonucleotide
  Target: SCN9A; (-) strand; PAM type: YTN; PAM sequence: TTT
tctctagctcatgttagaaa

SEQ ID NO: 72270 - DNA, 20 bp, Artificial Sequence
  Description of Artificial Sequence: Synthetic oligonucleotide
  Target: SCN9A; (-) strand; PAM type: YTN; PAM sequence: TTG
ttttctctagctcatgttag

SEQ ID NO: 72271 - DNA, 20 bp, Artificial Sequence
  Description of Artificial Sequence: Synthetic oligonucleotide
  Target: SCN9A; (-) strand; PAM type: YTN; PAM sequence: TTT
gttttctctagctcatgtta

SEQ ID NO: 72272 - DNA, 20 bp, Artificial Sequence
  Description of Artificial Sequence: Synthetic oligonucleotide
  Target: SCN9A; (-) strand; PAM type: YTN; PAM sequence: TTT
tgttttctctagctcatgtt

SEQ ID NO: 72273 - DNA, 20 bp, Artificial Sequence
  Description of Artificial Sequence: Synthetic oligonucleotide
  Target: SCN9A; (-) strand; PAM type: YTN; PAM sequence: CTT
ttgttttctctagctcatgt

SEQ ID NO: 72274 - DNA, 20 bp, Artificial Sequence
  Description of Artificial Sequence: Synthetic oligonucleotide
  Target: SCN9A; (-) strand; PAM type: YTN; PAM sequence: TTA
aaaataatcttttgttttct

SEQ ID NO: 72275 - DNA, 20 bp, Artificial Sequence
  Description of Artificial Sequence: Synthetic oligonucleotide
  Target: SCN9A; (-) strand; PAM type: YTN; PAM sequence: TTT
aaaaataatcttttgttttc

SEQ ID NO: 72276 - DNA, 20 bp, Artificial Sequence
  Description of Artificial Sequence: Synthetic oligonucleotide
  Target: SCN9A; (-) strand; PAM type: YTN; PAM sequence: TTA
aggcatcatttaaaaataat

SEQ ID NO: 72277 - DNA, 20 bp, Artificial Sequence
  Description of Artificial Sequence: Synthetic oligonucleotide
  Target: SCN9A; (-) strand; PAM type: YTN; PAM sequence: CTT
aaggcatcatttaaaaataa

SEQ ID NO: 72278 - DNA, 20 bp, Artificial Sequence
  Description of Artificial Sequence: Synthetic oligonucleotide
  Target: SCN9A; (-) strand; PAM type: YTN; PAM sequence: TTC
aagtcttaaggcatcattta

SEQ ID NO: 72279 - DNA, 20 bp, Artificial Sequence
  Description of Artificial Sequence: Synthetic oligonucleotide
  Target: SCN9A; (-) strand; PAM type: YTN; PAM sequence: TTT
caagtcttaaggcatcattt

SEQ ID NO: 72280 - DNA, 20 bp, Artificial Sequence
  Description of Artificial Sequence: Synthetic oligonucleotide
  Target: SCN9A; (-) strand; PAM type: YTN; PAM sequence: CTT
tcaagtcttaaggcatcatt

SEQ ID NO: 72281 - DNA, 20 bp, Artificial Sequence
  Description of Artificial Sequence: Synthetic oligonucleotide
  Target: SCN9A; (-) strand; PAM type: YTN; PAM sequence: TTG
ctttcaagtcttaaggcatc

SEQ ID NO: 72282 - DNA, 20 bp, Artificial Sequence
  Description of Artificial Sequence: Synthetic oligonucleotide
  Target: SCN9A; (-) strand; PAM type: YTN; PAM sequence: TTA
tgagattgctttcaagtctt

SEQ ID NO: 72283 - DNA, 20 bp, Artificial Sequence
  Description of Artificial Sequence: Synthetic oligonucleotide
  Target: SCN9A; (-) strand; PAM type: YTN; PAM sequence: TTT
atgagattgctttcaagtct

SEQ ID NO: 72284 - DNA, 20 bp, Artificial Sequence
  Description of Artificial Sequence: Synthetic oligonucleotide
  Target: SCN9A; (-) strand; PAM type: YTN; PAM sequence: TTT
tatgagattgctttcaagtc

SEQ ID NO: 72285 - DNA, 20 bp, Artificial Sequence
  Description of Artificial Sequence: Synthetic oligonucleotide
  Target: SCN9A; (-) strand; PAM type: YTN; PAM sequence: CTT
ttatgagattgctttcaagt

SEQ ID NO: 72286 - DNA, 20 bp, Artificial Sequence
  Description of Artificial Sequence: Synthetic oligonucleotide
  Target: SCN9A; (-) strand; PAM type: YTN; PAM sequence: TTA
cttttatgagattgctttca

SEQ ID NO: 72287 - DNA, 20 bp, Artificial Sequence
  Description of Artificial Sequence: Synthetic oligonucleotide
  Target: SCN9A; (-) strand; PAM type: YTN; PAM sequence: TTA
caaattacttttatgagatt

SEQ ID NO: 72288 - DNA, 20 bp, Artificial Sequence
  Description of Artificial Sequence: Synthetic oligonucleotide
  Target: SCN9A; (-) strand; PAM type: YTN; PAM sequence: TTG
tgaaatataacaaccgtatt

SEQ ID NO: 72289 - DNA, 20 bp, Artificial Sequence
  Description of Artificial Sequence: Synthetic oligonucleotide
  Target: SCN9A; (-) strand; PAM type: YTN; PAM sequence: TTA
ttgtgaaatataacaaccgt

SEQ ID NO: 72290 - DNA, 20 bp, Artificial Sequence
  Description of Artificial Sequence: Synthetic oligonucleotide
  Target: SCN9A; (-) strand; PAM type: YTN; PAM sequence: TTT
attgtgaaatataacaaccg

SEQ ID NO: 72291 - DNA, 20 bp, Artificial Sequence
  Description of Artificial Sequence: Synthetic oligonucleotide
  Target: SCN9A; (-) strand; PAM type: YTN; PAM sequence: TTT
tattgtgaaatataacaacc

SEQ ID NO: 72292 - DNA, 20 bp, Artificial Sequence
  Description of Artificial Sequence: Synthetic oligonucleotide
  Target: SCN9A; (-) strand; PAM type: YTN; PAM sequence: TTT
ttattgtgaaatataacaac

SEQ ID NO: 72293 - DNA, 20 bp, Artificial Sequence
  Description of Artificial Sequence: Synthetic oligonucleotide
  Target: SCN9A; (-) strand; PAM type: YTN; PAM sequence: TTA
tttttattgtgaaatataac

SEQ ID NO: 72294 - DNA, 20 bp, Artificial Sequence
  Description of Artificial Sequence: Synthetic oligonucleotide
  Target: SCN9A; (-) strand; PAM type: YTN; PAM sequence: TTT
atttttattgtgaaatataa

SEQ ID NO: 72295 - DNA, 20 bp, Artificial Sequence
  Description of Artificial Sequence: Synthetic oligonucleotide
  Target: SCN9A; (-) strand; PAM type: YTN; PAM sequence: TTT
tatttttattgtgaaatata

SEQ ID NO: 72296 - DNA, 20 bp, Artificial Sequence
  Description of Artificial Sequence: Synthetic oligonucleotide
  Target: SCN9A; (-) strand; PAM type: YTN; PAM sequence: TTG
agttttatttttattgtgaa

SEQ ID NO: 72297 - DNA, 20 bp, Artificial Sequence
  Description of Artificial Sequence: Synthetic oligonucleotide
  Target: SCN9A; (-) strand; PAM type: YTN; PAM sequence: CTA
gtgagtcaaggtatgtattg

SEQ ID NO: 72298 - DNA, 20 bp, Artificial Sequence
  Description of Artificial Sequence: Synthetic oligonucleotide
  Target: SCN9A; (-) strand; PAM type: YTN; PAM sequence: TTC
tagtgagtcaaggtatgtat

SEQ ID NO: 72299 - DNA, 20 bp, Artificial Sequence
  Description of Artificial Sequence: Synthetic oligonucleotide
  Target: SCN9A; (-) strand; PAM type: YTN; PAM sequence: TTT
ctagtgagtcaaggtatgta

SEQ ID NO: 72300 - DNA, 20 bp, Artificial Sequence
  Description of Artificial Sequence: Synthetic oligonucleotide
  Target: SCN9A; (-) strand; PAM type: YTN; PAM sequence: CTG
catatttctagtgagtcaag

SEQ ID NO: 72301 - DNA, 20 bp, Artificial Sequence
  Description of Artificial Sequence: Synthetic oligonucleotide
  Target: SCN9A; (-) strand; PAM type: YTN; PAM sequence: TTA
cctgcatatttctagtgagt

SEQ ID NO: 72302 - DNA, 20 bp, Artificial Sequence
  Description of Artificial Sequence: Synthetic oligonucleotide
  Target: SCN9A; (-) strand; PAM type: YTN; PAM sequence: CTT
acctgcatatttctagtgag

SEQ ID NO: 72303 - DNA, 20 bp, Artificial Sequence
  Description of Artificial Sequence: Synthetic oligonucleotide
  Target: SCN9A; (-) strand; PAM type: YTN; PAM sequence: CTC
ccacccttacctgcatattt

SEQ ID NO: 72304 - DNA, 20 bp, Artificial Sequence
  Description of Artificial Sequence: Synthetic oligonucleotide
  Target: SCN9A; (-) strand; PAM type: YTN; PAM sequence: CTC
tcccacccttacctgcatat

SEQ ID NO: 72305 - DNA, 20 bp, Artificial Sequence
  Description of Artificial Sequence: Synthetic oligonucleotide
  Target: SCN9A; (-) strand; PAM type: YTN; PAM sequence: CTC
ctctcccacccttacctgca

SEQ ID NO: 72306 - DNA, 20 bp, Artificial Sequence
  Description of Artificial Sequence: Synthetic oligonucleotide
  Target: SCN9A; (-) strand; PAM type: YTN; PAM sequence: TTG
tgccctcctctcccaccctt

SEQ ID NO: 72307 - DNA, 20 bp, Artificial Sequence
  Description of Artificial Sequence: Synthetic oligonucleotide
  Target: SCN9A; (-) strand; PAM type: YTN; PAM sequence: TTT
gtgccctcctctcccaccct

SEQ ID NO: 72308 - DNA, 20 bp, Artificial Sequence
  Description of Artificial Sequence: Synthetic oligonucleotide
  Target: SCN9A; (-) strand; PAM type: YTN; PAM sequence: TTT
tgtgccctcctctcccaccc

SEQ ID NO: 72309 - DNA, 20 bp, Artificial Sequence
  Description of Artificial Sequence: Synthetic oligonucleotide
  Target: SCN9A; (-) strand; PAM type: YTN; PAM sequence: TTT
ttgtgccctcctctcccacc

SEQ ID NO: 72310 - DNA, 20 bp, Artificial Sequence
  Description of Artificial Sequence: Synthetic oligonucleotide
  Target: SCN9A; (-) strand; PAM type: YTN; PAM sequence: TTT
tttgtgccctcctctcccac

SEQ ID NO: 72311 - DNA, 20 bp, Artificial Sequence
  Description of Artificial Sequence: Synthetic oligonucleotide
  Target: SCN9A; (-) strand; PAM type: YTN; PAM sequence: TTT
ttttgtgccctcctctccca

SEQ ID NO: 72312 - DNA, 20 bp, Artificial Sequence
  Description of Artificial Sequence: Synthetic oligonucleotide
  Target: SCN9A; (-) strand; PAM type: YTN; PAM sequence: CTT
tttttgtgccctcctctccc

SEQ ID NO: 72313 - DNA, 20 bp, Artificial Sequence
  Description of Artificial Sequence: Synthetic oligonucleotide
  Target: SCN9A; (-) strand; PAM type: YTN; PAM sequence: TTA
aaacctttttttgtgccctc

SEQ ID NO: 72314 - DNA, 20 bp, Artificial Sequence
  Description of Artificial Sequence: Synthetic oligonucleotide
  Target: SCN9A; (-) strand; PAM type: YTN; PAM sequence: TTT
aaaacctttttttgtgccct

SEQ ID NO: 72315 - DNA, 20 bp, Artificial Sequence
  Description of Artificial Sequence: Synthetic oligonucleotide
  Target: SCN9A; (-) strand; PAM type: YTN; PAM sequence: CTT
taaaacctttttttgtgccc

SEQ ID NO: 72316 - DNA, 20 bp, Artificial Sequence
  Description of Artificial Sequence: Synthetic oligonucleotide
  Target: SCN9A; (-) strand; PAM type: YTN; PAM sequence: CTC
tttaaaacctttttttgtgc

SEQ ID NO: 72317 - DNA, 20 bp, Artificial Sequence
  Description of Artificial Sequence: Synthetic oligonucleotide
  Target: SCN9A; (-) strand; PAM type: YTN; PAM sequence: TTG
agaacaggaactctttaaaa

SEQ ID NO: 72318 - DNA, 20 bp, Artificial Sequence
  Description of Artificial Sequence: Synthetic oligonucleotide
  Target: SCN9A; (-) strand; PAM type: YTN; PAM sequence: TTC
attgagaacaggaactcttt

SEQ ID NO: 72319 - DNA, 20 bp, Artificial Sequence
  Description of Artificial Sequence: Synthetic oligonucleotide
  Target: SCN9A; (-) strand; PAM type: YTN; PAM sequence: CTG
taaattcattgagaacagga

SEQ ID NO: 72320 - DNA, 20 bp, Artificial Sequence
  Description of Artificial Sequence: Synthetic oligonucleotide
  Target: SCN9A; (-) strand; PAM type: YTN; PAM sequence: TTA
tggtatgcatcaaatagtac

SEQ ID NO: 72321 - DNA, 20 bp, Artificial Sequence
  Description of Artificial Sequence: Synthetic oligonucleotide
  Target: SCN9A; (-) strand; PAM type: YTN; PAM sequence: TTG
agaaattatggtatgcatca

SEQ ID NO: 72322 - DNA, 20 bp, Artificial Sequence
  Description of Artificial Sequence: Synthetic oligonucleotide
  Target: SCN9A; (-) strand; PAM type: YTN; PAM sequence: TTT
gagaaattatggtatgcatc

SEQ ID NO: 72323 - DNA, 20 bp, Artificial Sequence
  Description of Artificial Sequence: Synthetic oligonucleotide
  Target: SCN9A; (-) strand; PAM type: YTN; PAM sequence: TTT
tgagaaattatggtatgcat

SEQ ID NO: 72324 - DNA, 20 bp, Artificial Sequence
  Description of Artificial Sequence: Synthetic oligonucleotide
  Target: SCN9A; (-) strand; PAM type: YTN; PAM sequence: TTT
ttgagaaattatggtatgca

SEQ ID NO: 72325 - DNA, 20 bp, Artificial Sequence
  Description of Artificial Sequence: Synthetic oligonucleotide
  Target: SCN9A; (-) strand; PAM type: YTN; PAM sequence: TTT
tttgagaaattatggtatgc

SEQ ID NO: 72326 - DNA, 20 bp, Artificial Sequence
  Description of Artificial Sequence: Synthetic oligonucleotide
  Target: SCN9A; (-) strand; PAM type: YTN; PAM sequence: TTA
attttttgagaaattatggt

SEQ ID NO: 72327 - DNA, 20 bp, Artificial Sequence
  Description of Artificial Sequence: Synthetic oligonucleotide
  Target: SCN9A; (-) strand; PAM type: YTN; PAM sequence: TTT
aattttttgagaaattatgg

SEQ ID NO: 72328 - DNA, 20 bp, Artificial Sequence
  Description of Artificial Sequence: Synthetic oligonucleotide
  Target: SCN9A; (-) strand; PAM type: YTN; PAM sequence: TTT
taattttttgagaaattatg

SEQ ID NO: 72329 - DNA, 20 bp, Artificial Sequence
  Description of Artificial Sequence: Synthetic oligonucleotide
  Target: SCN9A; (-) strand; PAM type: YTN; PAM sequence: TTA
aattttaattttttgagaaa

SEQ ID NO: 72330 - DNA, 20 bp, Artificial Sequence
  Description of Artificial Sequence: Synthetic oligonucleotide
  Target: SCN9A; (-) strand; PAM type: YTN; PAM sequence: CTT
aaattttaattttttgagaa

SEQ ID NO: 72331 - DNA, 20 bp, Artificial Sequence
  Description of Artificial Sequence: Synthetic oligonucleotide
  Target: SCN9A; (-) strand; PAM type: YTN; PAM sequence: TTC
agtaatcttaaattttaatt

SEQ ID NO: 72332 - DNA, 20 bp, Artificial Sequence
  Description of Artificial Sequence: Synthetic oligonucleotide
  Target: SCN9A; (-) strand; PAM type: YTN; PAM sequence: CTG
gattcagtaatcttaaattt

SEQ ID NO: 72333 - DNA, 20 bp, Artificial Sequence
  Description of Artificial Sequence: Synthetic oligonucleotide
  Target: SCN9A; (-) strand; PAM type: YTN; PAM sequence: TTC
ctggattcagtaatcttaaa

SEQ ID NO: 72334 - DNA, 20 bp, Artificial Sequence
  Description of Artificial Sequence: Synthetic oligonucleotide
  Target: SCN9A; (-) strand; PAM type: YTN; PAM sequence: CTT
cctggattcagtaatcttaa

SEQ ID NO: 72335 - DNA, 20 bp, Artificial Sequence
  Description of Artificial Sequence: Synthetic oligonucleotide
  Target: SCN9A; (-) strand; PAM type: YTN; PAM sequence: TTC
ttcctggattcagtaatctt

SEQ ID NO: 72336 - DNA, 20 bp, Artificial Sequence
  Description of Artificial Sequence: Synthetic oligonucleotide
  Target: SCN9A; (-) strand; PAM type: YTN; PAM sequence: CTT
cttcctggattcagtaatct

SEQ ID NO: 72337 - DNA, 20 bp, Artificial Sequence
  Description of Artificial Sequence: Synthetic oligonucleotide
  Target: SCN9A; (-) strand; PAM type: YTN; PAM sequence: TTA
tacttcttcctggattcagt

SEQ ID NO: 72338 - DNA, 20 bp, Artificial Sequence
  Description of Artificial Sequence: Synthetic oligonucleotide
  Target: SCN9A; (-) strand; PAM type: YTN; PAM sequence: TTT
atacttcttcctggattcag

SEQ ID NO: 72339 - DNA, 20 bp, Artificial Sequence
  Description of Artificial Sequence: Synthetic oligonucleotide
  Target: SCN9A; (-) strand; PAM type: YTN; PAM sequence: TTT
tatacttcttcctggattca

SEQ ID NO: 72340 - DNA, 20 bp, Artificial Sequence
  Description of Artificial Sequence: Synthetic oligonucleotide
  Target: SCN9A; (-) strand; PAM type: YTN; PAM sequence: TTG
aaccgcaaacaattttatac

SEQ ID NO: 72341 - DNA, 20 bp, Artificial Sequence
  Description of Artificial Sequence: Synthetic oligonucleotide
  Target: SCN9A; (-) strand; PAM type: YTN; PAM sequence: TTT
gaaccgcaaacaattttata

SEQ ID NO: 72342 - DNA, 20 bp, Artificial Sequence
  Description of Artificial Sequence: Synthetic oligonucleotide
  Target: SCN9A; (-) strand; PAM type: YTN; PAM sequence: TTT
tgaaccgcaaacaattttat

SEQ ID NO: 72343 - DNA, 20 bp, Artificial Sequence
  Description of Artificial Sequence: Synthetic oligonucleotide
  Target: SCN9A; (-) strand; PAM type: YTN; PAM sequence: TTT
ttgaaccgcaaacaatttta

SEQ ID NO: 72344 - DNA, 20 bp, Artificial Sequence
  Description of Artificial Sequence: Synthetic oligonucleotide
  Target: SCN9A; (-) strand; PAM type: YTN; PAM sequence: CTC
atttttgaaccgcaaacaat

SEQ ID NO: 72345 - DNA, 20 bp, Artificial Sequence
  Description of Artificial Sequence: Synthetic oligonucleotide
  Target: SCN9A; (-) strand; PAM type: YTN; PAM sequence: TTC
tcatttttgaaccgcaaaca

SEQ ID NO: 72346 - DNA, 20 bp, Artificial Sequence
  Description of Artificial Sequence: Synthetic oligonucleotide
  Target: SCN9A; (-) strand; PAM type: YTN; PAM sequence: CTT
ctcatttttgaaccgcaaac

SEQ ID NO: 72347 - DNA, 20 bp, Artificial Sequence
  Description of Artificial Sequence: Synthetic oligonucleotide
  Target: SCN9A; (-) strand; PAM type: YTN; PAM sequence: CTC
cccaaatggatgtagtccct

SEQ ID NO: 72348 - DNA, 20 bp, Artificial Sequence
  Description of Artificial Sequence: Synthetic oligonucleotide
  Target: SCN9A; (-) strand; PAM type: YTN; PAM sequence: TTC
tccccaaatggatgtagtcc

SEQ ID NO: 72349 - DNA, 20 bp, Artificial Sequence
  Description of Artificial Sequence: Synthetic oligonucleotide
  Target: SCN9A; (-) strand; PAM type: YTN; PAM sequence: TTT
ctccccaaatggatgtagtc

SEQ ID NO: 72350 - DNA, 20 bp, Artificial Sequence
  Description of Artificial Sequence: Synthetic oligonucleotide
  Target: SCN9A; (-) strand; PAM type: YTN; PAM sequence: CTA
atttctccccaaatggatgt

SEQ ID NO: 72351 - DNA, 20 bp, Artificial Sequence
  Description of Artificial Sequence: Synthetic oligonucleotide
  Target: SCN9A; (-) strand; PAM type: YTN; PAM sequence: CTC
ctaatttctccccaaatgga

SEQ ID NO: 72352 - DNA, 20 bp, Artificial Sequence
  Description of Artificial Sequence: Synthetic oligonucleotide
  Target: SCN9A; (-) strand; PAM type: YTN; PAM sequence: TTC
atccctcctaatttctcccc

SEQ ID NO: 72353 - DNA, 20 bp, Artificial Sequence
  Description of Artificial Sequence: Synthetic oligonucleotide
  Target: SCN9A; (-) strand; PAM type: YTN; PAM sequence: TTT
catccctcctaatttctccc

SEQ ID NO: 72354 - DNA, 20 bp, Artificial Sequence
  Description of Artificial Sequence: Synthetic oligonucleotide
  Target: SCN9A; (-) strand; PAM type: YTN; PAM sequence: TTA
tttcatccctcctaatttct

SEQ ID NO: 72355 - DNA, 20 bp, Artificial Sequence
  Description of Artificial Sequence: Synthetic oligonucleotide
  Target: SCN9A; (-) strand; PAM type: YTN; PAM sequence: TTT
atttcatccctcctaatttc

SEQ ID NO: 72356 - DNA, 20 bp, Artificial Sequence
  Description of Artificial Sequence: Synthetic oligonucleotide
  Target: SCN9A; (-) strand; PAM type: YTN; PAM sequence: TTA
tttatttcatccctcctaat

SEQ ID NO: 72357 - DNA, 20 bp, Artificial Sequence
  Description of Artificial Sequence: Synthetic oligonucleotide
  Target: SCN9A; (-) strand; PAM type: YTN; PAM sequence: CTC
aaaatgttatttatttcatc

SEQ ID NO: 72358 - DNA, 20 bp, Artificial Sequence
  Description of Artificial Sequence: Synthetic oligonucleotide
  Target: SCN9A; (-) strand; PAM type: YTN; PAM sequence: TTC
tcaaaatgttatttatttca

SEQ ID NO: 72359 - DNA, 20 bp, Artificial Sequence
  Description of Artificial Sequence: Synthetic oligonucleotide
  Target: SCN9A; (-) strand; PAM type: YTN; PAM sequence: CTC
aatgttctcaaaatgttatt

SEQ ID NO: 72360 - DNA, 20 bp, Artificial Sequence
  Description of Artificial Sequence: Synthetic oligonucleotide
  Target: SCN9A; (-) strand; PAM type: YTN; PAM sequence: TTA
gaaccatactcaatgttctc

SEQ ID NO: 72361 - DNA, 20 bp, Artificial Sequence
  Description of Artificial Sequence: Synthetic oligonucleotide
  Target: SCN9A; (-) strand; PAM type: YTN; PAM sequence: TTT
agaaccatactcaatgttct

SEQ ID NO: 72362 - DNA, 20 bp, Artificial Sequence
  Description of Artificial Sequence: Synthetic oligonucleotide
  Target: SCN9A; (-) strand; PAM type: YTN; PAM sequence: TTA
atacatgtaaaatgtttaga

SEQ ID NO: 72363 - DNA, 20 bp, Artificial Sequence
  Description of Artificial Sequence: Synthetic oligonucleotide
  Target: SCN9A; (-) strand; PAM type: YTN; PAM sequence: TTA
acacgttaatacatgtaaaa

SEQ ID NO: 72364 - DNA, 20 bp, Artificial Sequence
  Description of Artificial Sequence: Synthetic oligonucleotide
  Target: SCN9A; (-) strand; PAM type: YTN; PAM sequence: TTA
aatgaattaacacgttaata

SEQ ID NO: 72365 - DNA, 20 bp, Artificial Sequence
  Description of Artificial Sequence: Synthetic oligonucleotide
  Target: SCN9A; (-) strand; PAM type: YTN; PAM sequence: TTG
ggtcagggttaaatgaatta

SEQ ID NO: 72366 - DNA, 20 bp, Artificial Sequence
  Description of Artificial Sequence: Synthetic oligonucleotide
  Target: SCN9A; (-) strand; PAM type: YTN; PAM sequence: TTA
aatcgcagttgggtcagggt

SEQ ID NO: 72367 - DNA, 20 bp, Artificial Sequence
  Description of Artificial Sequence: Synthetic oligonucleotide
  Target: SCN9A; (-) strand; PAM type: YTN; PAM sequence: CTT
aaatcgcagttgggtcaggg

SEQ ID NO: 72368 - DNA, 20 bp, Artificial Sequence
  Description of Artificial Sequence: Synthetic oligonucleotide
  Target: SCN9A; (-) strand; PAM type: YTN; PAM sequence: TTA
atacttaaatcgcagttggg

SEQ ID NO: 72369 - DNA, 20 bp, Artificial Sequence
  Description of Artificial Sequence: Synthetic oligonucleotide
  Target: SCN9A; (-) strand; PAM type: YTN; PAM sequence: TTG
ttaatacttaaatcgcagtt

SEQ ID NO: 72370 - DNA, 20 bp, Artificial Sequence
  Description of Artificial Sequence: Synthetic oligonucleotide
  Target: SCN9A; (-) strand; PAM type: YTN; PAM sequence: TTA
aattgttaatacttaaatcg

SEQ ID NO: 72371 - DNA, 20 bp, Artificial Sequence
  Description of Artificial Sequence: Synthetic oligonucleotide
  Target: SCN9A; (-) strand; PAM type: YTN; PAM sequence: CTA
ttaaattgttaatacttaaa

SEQ ID NO: 72372 - DNA, 20 bp, Artificial Sequence
  Description of Artificial Sequence: Synthetic oligonucleotide
  Target: SCN9A; (-) strand; PAM type: YTN; PAM sequence: TTA
tcatctattaaattgttaat

SEQ ID NO: 72373 - DNA, 20 bp, Artificial Sequence
  Description of Artificial Sequence: Synthetic oligonucleotide
  Target: SCN9A; (-) strand; PAM type: YTN; PAM sequence: TTT
atcatctattaaattgttaa

SEQ ID NO: 72374 - DNA, 20 bp, Artificial Sequence
  Description of Artificial Sequence: Synthetic oligonucleotide
  Target: SCN9A; (-) strand; PAM type: YTN; PAM sequence: TTG
tatttatcatctattaaatt

SEQ ID NO: 72375 - DNA, 20 bp, Artificial Sequence
  Description of Artificial Sequence: Synthetic oligonucleotide
  Target: SCN9A; (-) strand; PAM type: YTN; PAM sequence: CTT
gtatttatcatctattaaat

SEQ ID NO: 72376 - DNA, 20 bp, Artificial Sequence
  Description of Artificial Sequence: Synthetic oligonucleotide
  Target: SCN9A; (-) strand; PAM type: YTN; PAM sequence: TTC
aaggcatcacccttgtattt

SEQ ID NO: 72377 - DNA, 20 bp, Artificial Sequence
  Description of Artificial Sequence: Synthetic oligonucleotide
  Target: SCN9A; (-) strand; PAM type: YTN; PAM sequence: CTT
caaggcatcacccttgtatt

SEQ ID NO: 72378 - DNA, 20 bp, Artificial Sequence
  Description of Artificial Sequence: Synthetic oligonucleotide
  Target: SCN9A; (-) strand; PAM type: YTN; PAM sequence: CTC
cagtcaaaatccttcaaggc

SEQ ID NO: 72379 - DNA, 20 bp, Artificial Sequence
  Description of Artificial Sequence: Synthetic oligonucleotide
  Target: SCN9A; (-) strand; PAM type: YTN; PAM sequence: TTC
tccagtcaaaatccttcaag

SEQ ID NO: 72380 - DNA, 20 bp, Artificial Sequence
  Description of Artificial Sequence: Synthetic oligonucleotide
  Target: SCN9A; (-) strand; PAM type: YTN; PAM sequence: CTT
ctccagtcaaaatccttcaa

SEQ ID NO: 72381 - DNA, 20 bp, Artificial Sequence
  Description of Artificial Sequence: Synthetic oligonucleotide
  Target: SCN9A; (-) strand; PAM type: YTN; PAM sequence: TTC
cttctccagtcaaaatcctt

SEQ ID NO: 72382 - DNA, 20 bp, Artificial Sequence
  Description of Artificial Sequence: Synthetic oligonucleotide
  Target: SCN9A; (-) strand; PAM type: YTN; PAM sequence: TTT
ccttctccagtcaaaatcct

SEQ ID NO: 72383 - DNA, 20 bp, Artificial Sequence
  Description of Artificial Sequence: Synthetic oligonucleotide
  Target: SCN9A; (-) strand; PAM type: YTN; PAM sequence: TTG
ggatttccttctccagtcaa

SEQ ID NO: 72384 - DNA, 20 bp, Artificial Sequence
  Description of Artificial Sequence: Synthetic oligonucleotide
  Target: SCN9A; (-) strand; PAM type: YTN; PAM sequence: CTT
gggatttccttctccagtca

SEQ ID NO: 72385 - DNA, 20 bp, Artificial Sequence
  Description of Artificial Sequence: Synthetic oligonucleotide
  Target: SCN9A; (-) strand; PAM type: YTN; PAM sequence: TTG
cttgggatttccttctccag

SEQ ID NO: 72386 - DNA, 20 bp, Artificial Sequence
  Description of Artificial Sequence: Synthetic oligonucleotide
  Target: SCN9A; (-) strand; PAM type: YTN; PAM sequence: TTT
gcttgggatttccttctcca

SEQ ID NO: 72387 - DNA, 20 bp, Artificial Sequence
  Description of Artificial Sequence: Synthetic oligonucleotide
  Target: SCN9A; (-) strand; PAM type: YTN; PAM sequence: CTT
tgcttgggatttccttctcc

SEQ ID NO: 72388 - DNA, 20 bp, Artificial Sequence
  Description of Artificial Sequence: Synthetic oligonucleotide
  Target: SCN9A; (-) strand; PAM type: YTN; PAM sequence: CTC
cacactttgcttgggatttc

SEQ ID NO: 72389 - DNA, 20 bp, Artificial Sequence
  Description of Artificial Sequence: Synthetic oligonucleotide
  Target: SCN9A; (-) strand; PAM type: YTN; PAM sequence: CTC
tccacactttgcttgggatt

SEQ ID NO: 72390 - DNA, 20 bp, Artificial Sequence
  Description of Artificial Sequence: Synthetic oligonucleotide
  Target: SCN9A; (-) strand; PAM type: YTN; PAM sequence: TTA
ggtcataaacactctccaca

SEQ ID NO: 72391 - DNA, 20 bp, Artificial Sequence
  Description of Artificial Sequence: Synthetic oligonucleotide
  Target: SCN9A; (-) strand; PAM type: YTN; PAM sequence: TTT
aggtcataaacactctccac

SEQ ID NO: 72392 - DNA, 20 bp, Artificial Sequence
  Description of Artificial Sequence: Synthetic oligonucleotide
  Target: SCN9A; (-) strand; PAM type: YTN; PAM sequence: TTT
taggtcataaacactctcca

SEQ ID NO: 72393 - DNA, 20 bp, Artificial Sequence
  Description of Artificial Sequence: Synthetic oligonucleotide
  Target: SCN9A; (-) strand; PAM type: YTN; PAM sequence: CTT
ttaggtcataaacactctcc

SEQ ID NO: 72394 - DNA, 20 bp, Artificial Sequence
  Description of Artificial Sequence: Synthetic oligonucleotide
  Target: SCN9A; (-) strand; PAM type: YTN; PAM sequence: TTC
cttttaggtcataaacactc

SEQ ID NO: 72395 - DNA, 20 bp, Artificial Sequence
  Description of Artificial Sequence: Synthetic oligonucleotide
  Target: SCN9A; (-) strand; PAM type: YTN; PAM sequence: TTT
ccttttaggtcataaacact

SEQ ID NO: 72396 - DNA, 20 bp, Artificial Sequence
  Description of Artificial Sequence: Synthetic oligonucleotide
  Target: SCN9A; (-) strand; PAM type: YTN; PAM sequence: CTG
taccaaaccaatttcctttt

SEQ ID NO: 72397 - DNA, 20 bp, Artificial Sequence
  Description of Artificial Sequence: Synthetic oligonucleotide
  Target: SCN9A; (-) strand; PAM type: YTN; PAM sequence: TTA
cctgtaccaaaccaatttcc

SEQ ID NO: 72398 - DNA, 20 bp, Artificial Sequence
  Description of Artificial Sequence: Synthetic oligonucleotide
  Target: SCN9A; (-) strand; PAM type: YTN; PAM sequence: TTT
acctgtaccaaaccaatttc

SEQ ID NO: 72399 - DNA, 20 bp, Artificial Sequence
  Description of Artificial Sequence: Synthetic oligonucleotide
  Target: SCN9A; (-) strand; PAM type: YTN; PAM sequence: TTT
tacctgtaccaaaccaattt

SEQ ID NO: 72400 - DNA, 20 bp, Artificial Sequence
  Description of Artificial Sequence: Synthetic oligonucleotide
  Target: SCN9A; (-) strand; PAM type: YTN; PAM sequence: TTT
ttacctgtaccaaaccaatt

SEQ ID NO: 72401 - DNA, 20 bp, Artificial Sequence
  Description of Artificial Sequence: Synthetic oligonucleotide
  Target: SCN9A; (-) strand; PAM type: YTN; PAM sequence: CTC
acccatagatttttacctgt

SEQ ID NO: 72402 - DNA, 20 bp, Artificial Sequence
  Description of Artificial Sequence: Synthetic oligonucleotide
  Target: SCN9A; (-) strand; PAM type: YTN; PAM sequence: CTA
gtgctcacccatagattttt

SEQ ID NO: 72403 - DNA, 20 bp, Artificial Sequence
  Description of Artificial Sequence: Synthetic oligonucleotide
  Target: SCN9A; (-) strand; PAM type: YTN; PAM sequence: CTC
ctagtgctcacccatagatt

SEQ ID NO: 72404 - DNA, 20 bp, Artificial Sequence
  Description of Artificial Sequence: Synthetic oligonucleotide
  Target: SCN9A; (-) strand; PAM type: YTN; PAM sequence: CTA
tctcctagtgctcacccata

SEQ ID NO: 72405 - DNA, 20 bp, Artificial Sequence
  Description of Artificial Sequence: Synthetic oligonucleotide
  Target: SCN9A; (-) strand; PAM type: YTN; PAM sequence: CTC
tatctcctagtgctcaccca

SEQ ID NO: 72406 - DNA, 20 bp, Artificial Sequence
  Description of Artificial Sequence: Synthetic oligonucleotide
  Target: SCN9A; (-) strand; PAM type: YTN; PAM sequence: TTG
accagctctatctcctagtg

SEQ ID NO: 72407 - DNA, 20 bp, Artificial Sequence
  Description of Artificial Sequence: Synthetic oligonucleotide
  Target: SCN9A; (-) strand; PAM type: YTN; PAM sequence: TTT
gaccagctctatctcctagt

SEQ ID NO: 72408 - DNA, 20 bp, Artificial Sequence
  Description of Artificial Sequence: Synthetic oligonucleotide
  Target: SCN9A; (-) strand; PAM type: YTN; PAM sequence: CTT
tgaccagctctatctcctag

SEQ ID NO: 72409 - DNA, 20 bp, Artificial Sequence
  Description of Artificial Sequence: Synthetic oligonucleotide
  Target: SCN9A; (-) strand; PAM type: YTN; PAM sequence: CTA
accagctttgaccagctcta

SEQ ID NO: 72410 - DNA, 20 bp, Artificial Sequence
  Description of Artificial Sequence: Synthetic oligonucleotide
  Target: SCN9A; (-) strand; PAM type: YTN; PAM sequence: CTA
tggccctaaccagctttgac

SEQ ID NO: 72411 - DNA, 20 bp, Artificial Sequence
  Description of Artificial Sequence: Synthetic oligonucleotide
  Target: SCN9A; (-) strand; PAM type: YTN; PAM sequence: TTC
acactatggccctaaccagc

SEQ ID NO: 72412 - DNA, 20 bp, Artificial Sequence
  Description of Artificial Sequence: Synthetic oligonucleotide
  Target: SCN9A; (-) strand; PAM type: YTN; PAM sequence: CTT
cacactatggccctaaccag

SEQ ID NO: 72413 - DNA, 20 bp, Artificial Sequence
  Description of Artificial Sequence: Synthetic oligonucleotide
  Target: SCN9A; (-) strand; PAM type: YTN; PAM sequence: CTG
tgcacaaagccttcacacta

SEQ ID NO: 72414 - DNA, 20 bp, Artificial Sequence
  Description of Artificial Sequence: Synthetic oligonucleotide
  Target: SCN9A; (-) strand; PAM type: YTN; PAM sequence: TTA
tgtactgtgcacaaagcctt

SEQ ID NO: 72415 - DNA, 20 bp, Artificial Sequence
  Description of Artificial Sequence: Synthetic oligonucleotide
  Target: SCN9A; (-) strand; PAM type: YTN; PAM sequence: CTC
gaattatgtactgtgcacaa

SEQ ID NO: 72416 - DNA, 20 bp, Artificial Sequence
  Description of Artificial Sequence: Synthetic oligonucleotide
  Target: SCN9A; (-) strand; PAM type: YTN; PAM sequence: CTG
gccatccccaaagtctcgaa

SEQ ID NO: 72417 - DNA, 20 bp, Artificial Sequence
  Description of Artificial Sequence: Synthetic oligonucleotide
  Target: SCN9A; (-) strand; PAM type: YTN; PAM sequence: TTA
caggagtgagccaccacgcc

SEQ ID NO: 72418 - DNA, 20 bp, Artificial Sequence
  Description of Artificial Sequence: Synthetic oligonucleotide
  Target: SCN9A; (-) strand; PAM type: YTN; PAM sequence: CTG
agattacaggagtgagccac

SEQ ID NO: 72419 - DNA, 20 bp, Artificial Sequence
  Description of Artificial Sequence: Synthetic oligonucleotide
  Target: SCN9A; (-) strand; PAM type: YTN; PAM sequence: TTG
ctgagattacaggagtgagc

SEQ ID NO: 72420 - DNA, 20 bp, Artificial Sequence
  Description of Artificial Sequence: Synthetic oligonucleotide
  Target: SCN9A; (-) strand; PAM type: YTN; PAM sequence: TTC
cccagttgctgagattacag

SEQ ID NO: 72421 - DNA, 20 bp, Artificial Sequence
  Description of Artificial Sequence: Synthetic oligonucleotide
  Target: SCN9A; (-) strand; PAM type: YTN; PAM sequence: TTT
ccccagttgctgagattaca

SEQ ID NO: 72422 - DNA, 20 bp, Artificial Sequence
  Description of Artificial Sequence: Synthetic oligonucleotide
  Target: SCN9A; (-) strand; PAM type: YTN; PAM sequence: TTT
tccccagttgctgagattac

SEQ ID NO: 72423 - DNA, 20 bp, Artificial Sequence
  Description of Artificial Sequence: Synthetic oligonucleotide
  Target: SCN9A; (-) strand; PAM type: YTN; PAM sequence: TTT
ttccccagttgctgagatta

SEQ ID NO: 72424 - DNA, 20 bp, Artificial Sequence
  Description of Artificial Sequence: Synthetic oligonucleotide
  Target: SCN9A; (-) strand; PAM type: YTN; PAM sequence: CTT
tttccccagttgctgagatt

SEQ ID NO: 72425 - DNA, 20 bp, Artificial Sequence
  Description of Artificial Sequence: Synthetic oligonucleotide
  Target: SCN9A; (-) strand; PAM type: YTN; PAM sequence: TTC
aaactttttccccagttgct

SEQ ID NO: 72426 - DNA, 20 bp, Artificial Sequence
  Description of Artificial Sequence: Synthetic oligonucleotide
  Target: SCN9A; (-) strand; PAM type: YTN; PAM sequence: CTT
caaactttttccccagttgc

SEQ ID NO: 72427 - DNA, 20 bp, Artificial Sequence
  Description of Artificial Sequence: Synthetic oligonucleotide
  Target: SCN9A; (-) strand; PAM type: YTN; PAM sequence: TTC
ttcaaactttttccccagtt

SEQ ID NO: 72428 - DNA, 20 bp, Artificial Sequence
  Description of Artificial Sequence: Synthetic oligonucleotide
  Target: SCN9A; (-) strand; PAM type: YTN; PAM sequence: CTC
aggcaattcttcaaactttt

SEQ ID NO: 72429 - DNA, 20 bp, Artificial Sequence
  Description of Artificial Sequence: Synthetic oligonucleotide
  Target: SCN9A; (-) strand; PAM type: YTN; PAM sequence: CTG
gactcaggcaattcttcaaa

SEQ ID NO: 72430 - DNA, 20 bp, Artificial Sequence
  Description of Artificial Sequence: Synthetic oligonucleotide
  Target: SCN9A; (-) strand; PAM type: YTN; PAM sequence: CTA
ctggactcaggcaattcttc

SEQ ID NO: 72431 - DNA, 20 bp, Artificial Sequence
  Description of Artificial Sequence: Synthetic oligonucleotide
  Target: SCN9A; (-) strand; PAM type: YTN; PAM sequence: CTC
aaactactggactcaggcaa

SEQ ID NO: 72432 - DNA, 20 bp, Artificial Sequence
  Description of Artificial Sequence: Synthetic oligonucleotide
  Target: SCN9A; (-) strand; PAM type: YTN; PAM sequence: CTG
gtctcaaactactggactca

SEQ ID NO: 72433 - DNA, 20 bp, Artificial Sequence
  Description of Artificial Sequence: Synthetic oligonucleotide
  Target: SCN9A; (-) strand; PAM type: YTN; PAM sequence: TTC
ccaggctggtctcaaactac

SEQ ID NO: 72434 - DNA, 20 bp, Artificial Sequence
  Description of Artificial Sequence: Synthetic oligonucleotide
  Target: SCN9A; (-) strand; PAM type: YTN; PAM sequence: TTT
cccaggctggtctcaaacta

SEQ ID NO: 72435 - DNA, 20 bp, Artificial Sequence
  Description of Artificial Sequence: Synthetic oligonucleotide
  Target: SCN9A; (-) strand; PAM type: YTN; PAM sequence: CTA
tgtttcccaggctggtctca

SEQ ID NO: 72436 - DNA, 20 bp, Artificial Sequence
  Description of Artificial Sequence: Synthetic oligonucleotide
  Target: SCN9A; (-) strand; PAM type: YTN; PAM sequence: TTC
actatgtttcccaggctggt

SEQ ID NO: 72437 - DNA, 20 bp, Artificial Sequence
  Description of Artificial Sequence: Synthetic oligonucleotide
  Target: SCN9A; (-) strand; PAM type: YTN; PAM sequence: TTT
cactatgtttcccaggctgg

SEQ ID NO: 72438 - DNA, 20 bp, Artificial Sequence
  Description of Artificial Sequence: Synthetic oligonucleotide
  Target: SCN9A; (-) strand; PAM type: YTN; PAM sequence: TTG
tagagacaaggtttcactat

SEQ ID NO: 72439 - DNA, 20 bp, Artificial Sequence
  Description of Artificial Sequence: Synthetic oligonucleotide
  Target: SCN9A; (-) strand; PAM type: YTN; PAM sequence: TTT
gtagagacaaggtttcacta

SEQ ID NO: 72440 - DNA, 20 bp, Artificial Sequence
  Description of Artificial Sequence: Synthetic oligonucleotide
  Target: SCN9A; (-) strand; PAM type: YTN; PAM sequence: TTA
aaaaagtttgtagagacaag

SEQ ID NO: 72441 - DNA, 20 bp, Artificial Sequence
  Description of Artificial Sequence: Synthetic oligonucleotide
  Target: SCN9A; (-) strand; PAM type: YTN; PAM sequence: TTT
aaaaaagtttgtagagacaa

SEQ ID NO: 72442 - DNA, 20 bp, Artificial Sequence
  Description of Artificial Sequence: Synthetic oligonucleotide
  Target: SCN9A; (-) strand; PAM type: YTN; PAM sequence: TTT
taaaaaagtttgtagagaca

SEQ ID NO: 72443 - DNA, 20 bp, Artificial Sequence
  Description of Artificial Sequence: Synthetic oligonucleotide
  Target: SCN9A; (-) strand; PAM type: YTN; PAM sequence: TTT
ttaaaaaagtttgtagagac

SEQ ID NO: 72444 - DNA, 20 bp, Artificial Sequence
  Description of Artificial Sequence: Synthetic oligonucleotide
  Target: SCN9A; (-) strand; PAM type: YTN; PAM sequence: TTT
tttaaaaaagtttgtagaga

SEQ ID NO: 72445 - DNA, 20 bp, Artificial Sequence
  Description of Artificial Sequence: Synthetic oligonucleotide
  Target: SCN9A; (-) strand; PAM type: YTN; PAM sequence: TTT
ttttaaaaaagtttgtagag

SEQ ID NO: 72446 - DNA, 20 bp, Artificial Sequence
  Description of Artificial Sequence: Synthetic oligonucleotide
  Target: SCN9A; (-) strand; PAM type: YTN; PAM sequence: CTA
atttttttaaaaaagtttgt

SEQ ID NO: 72447 - DNA, 20 bp, Artificial Sequence
  Description of Artificial Sequence: Synthetic oligonucleotide
  Target: SCN9A; (-) strand; PAM type: YTN; PAM sequence: CTA
cacacccatgccacaacacc

SEQ ID NO: 72448 - DNA, 20 bp, Artificial Sequence
  Description of Artificial Sequence: Synthetic oligonucleotide
  Target: SCN9A; (-) strand; PAM type: YTN; PAM sequence: CTG
ggactacacacccatgccac

SEQ ID NO: 72449 - DNA, 20 bp, Artificial Sequence
  Description of Artificial Sequence: Synthetic oligonucleotide
  Target: SCN9A; (-) strand; PAM type: YTN; PAM sequence: TTG
ctgggactacacacccatgc

SEQ ID NO: 72450 - DNA, 20 bp, Artificial Sequence
  Description of Artificial Sequence: Synthetic oligonucleotide
  Target: SCN9A; (-) strand; PAM type: YTN; PAM sequence: CTG
agttgctgggactacacacc

SEQ ID NO: 72451 - DNA, 20 bp, Artificial Sequence
  Description of Artificial Sequence: Synthetic oligonucleotide
  Target: SCN9A; (-) strand; PAM type: YTN; PAM sequence: CTC
ctgagttgctgggactacac

SEQ ID NO: 72452 - DNA, 20 bp, Artificial Sequence
  Description of Artificial Sequence: Synthetic oligonucleotide
  Target: SCN9A; (-) strand; PAM type: YTN; PAM sequence: CTC
cacctcctgagttgctggga

SEQ ID NO: 72453 - DNA, 20 bp, Artificial Sequence
  Description of Artificial Sequence: Synthetic oligonucleotide
  Target: SCN9A; (-) strand; PAM type: YTN; PAM sequence: CTG
cctccacctcctgagttgct

SEQ ID NO: 72454 - DNA, 20 bp, Artificial Sequence
  Description of Artificial Sequence: Synthetic oligonucleotide
  Target: SCN9A; (-) strand; PAM type: YTN; PAM sequence: CTC
ctgcctccacctcctgagtt

SEQ ID NO: 72455 - DNA, 20 bp, Artificial Sequence
  Description of Artificial Sequence: Synthetic oligonucleotide
  Target: SCN9A; (-) strand; PAM type: YTN; PAM sequence: CTC
aagtgatcctcctgcctcca

SEQ ID NO: 72456 - DNA, 20 bp, Artificial Sequence
  Description of Artificial Sequence: Synthetic oligonucleotide
  Target: SCN9A; (-) strand; PAM type: YTN; PAM sequence: CTG
ggctcaagtgatcctcctgc

SEQ ID NO: 72457 - DNA, 20 bp, Artificial Sequence
  Description of Artificial Sequence: Synthetic oligonucleotide
  Target: SCN9A; (-) strand; PAM type: YTN; PAM sequence: CTC
ctgggctcaagtgatcctcc

SEQ ID NO: 72458 - DNA, 20 bp, Artificial Sequence
  Description of Artificial Sequence: Synthetic oligonucleotide
  Target: SCN9A; (-) strand; PAM type: YTN; PAM sequence: TTG
aactcctgggctcaagtgat

SEQ ID NO: 72459 - DNA, 20 bp, Artificial Sequence
  Description of Artificial Sequence: Synthetic oligonucleotide
  Target: SCN9A; (-) strand; PAM type: YTN; PAM sequence: CTT
gaactcctgggctcaagtga

SEQ ID NO: 72460 - DNA, 20 bp, Artificial Sequence
  Description of Artificial Sequence: Synthetic oligonucleotide
  Target: SCN9A; (-) strand; PAM type: YTN; PAM sequence: CTG
caaccttgaactcctgggct

SEQ ID NO: 72461 - DNA, 20 bp, Artificial Sequence
  Description of Artificial Sequence: Synthetic oligonucleotide
  Target: SCN9A; (-) strand; PAM type: YTN; PAM sequence: TTA
ctgcaaccttgaactcctgg

SEQ ID NO: 72462 - DNA, 20 bp, Artificial Sequence
  Description of Artificial Sequence: Synthetic oligonucleotide
  Target: SCN9A; (-) strand; PAM type: YTN; PAM sequence: CTT
actgcaaccttgaactcctg

SEQ ID NO: 72463 - DNA, 20 bp, Artificial Sequence
  Description of Artificial Sequence: Synthetic oligonucleotide
  Target: SCN9A; (-) strand; PAM type: YTN; PAM sequence: CTA
tcatagcttactgcaacctt

SEQ ID NO: 72464 - DNA, 20 bp, Artificial Sequence
  Description of Artificial Sequence: Synthetic oligonucleotide
  Target: SCN9A; (-) strand; PAM type: YTN; PAM sequence: CTG
gagtacagtggtgctatcat

SEQ ID NO: 72465 - DNA, 20 bp, Artificial Sequence
  Description of Artificial Sequence: Synthetic oligonucleotide
  Target: SCN9A; (-) strand; PAM type: YTN; PAM sequence: TTG
cccagtctggagtacagtgg

SEQ ID NO: 72466 - DNA, 20 bp, Artificial Sequence
  Description of Artificial Sequence: Synthetic oligonucleotide
  Target: SCN9A; (-) strand; PAM type: YTN; PAM sequence: CTG
ttgcccagtctggagtacag

SEQ ID NO: 72467 - DNA, 20 bp, Artificial Sequence
  Description of Artificial Sequence: Synthetic oligonucleotide
  Target: SCN9A; (-) strand; PAM type: YTN; PAM sequence: CTC
tgttgcccagtctggagtac

SEQ ID NO: 72468 - DNA, 20 bp, Artificial Sequence
  Description of Artificial Sequence: Synthetic oligonucleotide
  Target: SCN9A; (-) strand; PAM type: YTN; PAM sequence: CTC
actctgttgcccagtctgga

SEQ ID NO: 72469 - DNA, 20 bp, Artificial Sequence
  Description of Artificial Sequence: Synthetic oligonucleotide
  Target: SCN9A; (-) strand; PAM type: YTN; PAM sequence: TTA
aaaaacggagacaggtctca

SEQ ID NO: 72470 - DNA, 20 bp, Artificial Sequence
  Description of Artificial Sequence: Synthetic oligonucleotide
  Target: SCN9A; (-) strand; PAM type: YTN; PAM sequence: TTT
aaaaaacggagacaggtctc

SEQ ID NO: 72471 - DNA, 20 bp, Artificial Sequence
  Description of Artificial Sequence: Synthetic oligonucleotide
  Target: SCN9A; (-) strand; PAM type: YTN; PAM sequence: TTT
taaaaaacggagacaggtct

SEQ ID NO: 72472 - DNA, 20 bp, Artificial Sequence
  Description of Artificial Sequence: Synthetic oligonucleotide
  Target: SCN9A; (-) strand; PAM type: YTN; PAM sequence: TTT
ttaaaaaacggagacaggtc

SEQ ID NO: 72473 - DNA, 20 bp, Artificial Sequence
  Description of Artificial Sequence: Synthetic oligonucleotide
  Target: SCN9A; (-) strand; PAM type: YTN; PAM sequence: TTT
tttaaaaaacggagacaggt

SEQ ID NO: 72474 - DNA, 20 bp, Artificial Sequence
  Description of Artificial Sequence: Synthetic oligonucleotide
  Target: SCN9A; (-) strand; PAM type: YTN; PAM sequence: TTT
ttttaaaaaacggagacagg

SEQ ID NO: 72475 - DNA, 20 bp, Artificial Sequence
  Description of Artificial Sequence: Synthetic oligonucleotide
  Target: SCN9A; (-) strand; PAM type: YTN; PAM sequence: TTT
tttttaaaaaacggagacag

SEQ ID NO: 72476 - DNA, 20 bp, Artificial Sequence
  Description of Artificial Sequence: Synthetic oligonucleotide
  Target: SCN9A; (-) strand; PAM type: YTN; PAM sequence: CTT
ttttttaaaaaacggagaca

SEQ ID NO: 72477 - DNA, 20 bp, Artificial Sequence
  Description of Artificial Sequence: Synthetic oligonucleotide
  Target: SCN9A; (-) strand; PAM type: YTN; PAM sequence: TTC
ttttttttaaaaaacggaga

SEQ ID NO: 72478 - DNA, 20 bp, Artificial Sequence
  Description of Artificial Sequence: Synthetic oligonucleotide
  Target: SCN9A; (-) strand; PAM type: YTN; PAM sequence: CTT
cttttttttaaaaaacggag

SEQ ID NO: 72479 - DNA, 20 bp, Artificial Sequence
  Description of Artificial Sequence: Synthetic oligonucleotide
  Target: SCN9A; (-) strand; PAM type: YTN; PAM sequence: CTC
ttcttttttttaaaaaacgg

SEQ ID NO: 72480 - DNA, 20 bp, Artificial Sequence
  Description of Artificial Sequence: Synthetic oligonucleotide
  Target: SCN9A; (-) strand; PAM type: YTN; PAM sequence: CTC
tcttcttttttttaaaaaac

SEQ ID NO: 72481 - DNA, 20 bp, Artificial Sequence
  Description of Artificial Sequence: Synthetic oligonucleotide
  Target: SCN9A; (-) strand; PAM type: YTN; PAM sequence: CTC
tctcttcttttttttaaaaa

SEQ ID NO: 72482 - DNA, 20 bp, Artificial Sequence
  Description of Artificial Sequence: Synthetic oligonucleotide
  Target: SCN9A; (-) strand; PAM type: YTN; PAM sequence: CTC
tctctcttcttttttttaaa

SEQ ID NO: 72483 - DNA, 20 bp, Artificial Sequence
  Description of Artificial Sequence: Synthetic oligonucleotide
  Target: SCN9A; (-) strand; PAM type: YTN; PAM sequence: CTC
tctctctcttctttttttta

SEQ ID NO: 72484 - DNA, 20 bp, Artificial Sequence
  Description of Artificial Sequence: Synthetic oligonucleotide
  Target: SCN9A; (-) strand; PAM type: YTN; PAM sequence: CTC
tctctctctcttcttttttt

SEQ ID NO: 72485 - DNA, 20 bp, Artificial Sequence
  Description of Artificial Sequence: Synthetic oligonucleotide
  Target: SCN9A; (-) strand; PAM type: YTN; PAM sequence: CTC
tctctctctctcttcttttt

SEQ ID NO: 72486 - DNA, 20 bp, Artificial Sequence
  Description of Artificial Sequence: Synthetic oligonucleotide
  Target: SCN9A; (-) strand; PAM type: YTN; PAM sequence: CTC
tctctctctctctcttcttt

SEQ ID NO: 72487 - DNA, 20 bp, Artificial Sequence
  Description of Artificial Sequence: Synthetic oligonucleotide
  Target: SCN9A; (-) strand; PAM type: YTN; PAM sequence: CTC
atgatgtatccatgatccgc

SEQ ID NO: 72488 - DNA, 20 bp, Artificial Sequence
  Description of Artificial Sequence: Synthetic oligonucleotide
  Target: SCN9A; (-) strand; PAM type: YTN; PAM sequence: CTC
tcatgatgtatccatgatcc

SEQ ID NO: 72489 - DNA, 20 bp, Artificial Sequence
  Description of Artificial Sequence: Synthetic oligonucleotide
  Target: SCN9A; (-) strand; PAM type: YTN; PAM sequence: TTC
actctcatgatgtatccatg

SEQ ID NO: 72490 - DNA, 20 bp, Artificial Sequence
  Description of Artificial Sequence: Synthetic oligonucleotide
  Target: SCN9A; (-) strand; PAM type: YTN; PAM sequence: TTT
cactctcatgatgtatccat

SEQ ID NO: 72491 - DNA, 20 bp, Artificial Sequence
  Description of Artificial Sequence: Synthetic oligonucleotide
  Target: SCN9A; (-) strand; PAM type: YTN; PAM sequence: CTA
atcatttcactctcatgatg

SEQ ID NO: 72492 - DNA, 20 bp, Artificial Sequence
  Description of Artificial Sequence: Synthetic oligonucleotide
  Target: SCN9A; (-) strand; PAM type: YTN; PAM sequence: TTC
agtcctaatcatttcactct

SEQ ID NO: 72493 - DNA, 20 bp, Artificial Sequence
  Description of Artificial Sequence: Synthetic oligonucleotide
  Target: SCN9A; (-) strand; PAM type: YTN; PAM sequence: CTC
atgcagattcagtcctaatc

SEQ ID NO: 72494 - DNA, 20 bp, Artificial Sequence
  Description of Artificial Sequence: Synthetic oligonucleotide
  Target: SCN9A; (-) strand; PAM type: YTN; PAM sequence: TTC
gctcatgcagattcagtcct

SEQ ID NO: 72495 - DNA, 20 bp, Artificial Sequence
  Description of Artificial Sequence: Synthetic oligonucleotide
  Target: SCN9A; (-) strand; PAM type: YTN; PAM sequence: TTT
cgctcatgcagattcagtcc

SEQ ID NO: 72496 - DNA, 20 bp, Artificial Sequence
  Description of Artificial Sequence: Synthetic oligonucleotide
  Target: SCN9A; (-) strand; PAM type: YTN; PAM sequence: TTT
tcgctcatgcagattcagtc

SEQ ID NO: 72497 - DNA, 20 bp, Artificial Sequence
  Description of Artificial Sequence: Synthetic oligonucleotide
  Target: SCN9A; (-) strand; PAM type: YTN; PAM sequence: TTA
ttttcgctcatgcagattca

SEQ ID NO: 72498 - DNA, 20 bp, Artificial Sequence
  Description of Artificial Sequence: Synthetic oligonucleotide
  Target: SCN9A; (-) strand; PAM type: YTN; PAM sequence: TTG
attattttcgctcatgcaga

SEQ ID NO: 72499 - DNA, 20 bp, Artificial Sequence
  Description of Artificial Sequence: Synthetic oligonucleotide
  Target: SCN9A; (-) strand; PAM type: YTN; PAM sequence: TTT
gattattttcgctcatgcag

SEQ ID NO: 72500 - DNA, 20 bp, Artificial Sequence
  Description of Artificial Sequence: Synthetic oligonucleotide
  Target: SCN9A; (-) strand; PAM type: YTN; PAM sequence: TTA
tttgattattttcgctcatg

SEQ ID NO: 72501 - DNA, 20 bp, Artificial Sequence
  Description of Artificial Sequence: Synthetic oligonucleotide
  Target: SCN9A; (-) strand; PAM type: YTN; PAM sequence: CTT
atttgattattttcgctcat

SEQ ID NO: 72502 - DNA, 20 bp, Artificial Sequence
  Description of Artificial Sequence: Synthetic oligonucleotide
  Target: SCN9A; (-) strand; PAM type: YTN; PAM sequence: TTA
cttatttgattattttcgct

SEQ ID NO: 72503 - DNA, 20 bp, Artificial Sequence
  Description of Artificial Sequence: Synthetic oligonucleotide
  Target: SCN9A; (-) strand; PAM type: YTN; PAM sequence: TTT
acttatttgattattttcgc

SEQ ID NO: 72504 - DNA, 20 bp, Artificial Sequence
  Description of Artificial Sequence: Synthetic oligonucleotide
  Target: SCN9A; (-) strand; PAM type: YTN; PAM sequence: CTA
gtttacttatttgattattt

SEQ ID NO: 72505 - DNA, 20 bp, Artificial Sequence
  Description of Artificial Sequence: Synthetic oligonucleotide
  Target: SCN9A; (-) strand; PAM type: YTN; PAM sequence: CTC
tagtttacttatttgattat

SEQ ID NO: 72506 - DNA, 20 bp, Artificial Sequence
  Description of Artificial Sequence: Synthetic oligonucleotide
  Target: SCN9A; (-) strand; PAM type: YTN; PAM sequence: TTA
ctctagtttacttatttgat

SEQ ID NO: 72507 - DNA, 20 bp, Artificial Sequence
  Description of Artificial Sequence: Synthetic oligonucleotide
  Target: SCN9A; (-) strand; PAM type: YTN; PAM sequence: TTT
actctagtttacttatttga

SEQ ID NO: 72508 - DNA, 20 bp, Artificial Sequence
  Description of Artificial Sequence: Synthetic oligonucleotide
  Target: SCN9A; (-) strand; PAM type: YTN; PAM sequence: TTG
catttactctagtttactta

SEQ ID NO: 72509 - DNA, 20 bp, Artificial Sequence
  Description of Artificial Sequence: Synthetic oligonucleotide
  Target: SCN9A; (-) strand; PAM type: YTN; PAM sequence: TTT
gcatttactctagtttactt

SEQ ID NO: 72510 - DNA, 20 bp, Artificial Sequence
  Description of Artificial Sequence: Synthetic oligonucleotide
  Target: SCN9A; (-) strand; PAM type: YTN; PAM sequence: TTT
tgcatttactctagtttact

SEQ ID NO: 72511 - DNA, 20 bp, Artificial Sequence
  Description of Artificial Sequence: Synthetic oligonucleotide
  Target: SCN9A; (-) strand; PAM type: YTN; PAM sequence: TTC
cattttgcatttactctagt

SEQ ID NO: 72512 - DNA, 20 bp, Artificial Sequence
  Description of Artificial Sequence: Synthetic oligonucleotide
  Target: SCN9A; (-) strand; PAM type: YTN; PAM sequence: CTT
ccattttgcatttactctag

SEQ ID NO: 72513 - DNA, 20 bp, Artificial Sequence
  Description of Artificial Sequence: Synthetic oligonucleotide
  Target: SCN9A; (-) strand; PAM type: YTN; PAM sequence: CTG
cttccattttgcatttactc

SEQ ID NO: 72514 - DNA, 20 bp, Artificial Sequence
  Description of Artificial Sequence: Synthetic oligonucleotide
  Target: SCN9A; (-) strand; PAM type: YTN; PAM sequence: CTC
tgcttccattttgcatttac

SEQ ID NO: 72515 - DNA, 20 bp, Artificial Sequence
  Description of Artificial Sequence: Synthetic oligonucleotide
  Target: SCN9A; (-) strand; PAM type: YTN; PAM sequence: CTG
atgcctctgcttccattttg

SEQ ID NO: 72516 - DNA, 20 bp, Artificial Sequence
  Description of Artificial Sequence: Synthetic oligonucleotide
  Target: SCN9A; (-) strand; PAM type: YTN; PAM sequence: CTC
aactgatgcctctgcttcca

SEQ ID NO: 72517 - DNA, 20 bp, Artificial Sequence
  Description of Artificial Sequence: Synthetic oligonucleotide
  Target: SCN9A; (-) strand; PAM type: YTN; PAM sequence: TTC
aagcagagtctcaactgatg

SEQ ID NO: 72518 - DNA, 20 bp, Artificial Sequence
  Description of Artificial Sequence: Synthetic oligonucleotide
  Target: SCN9A; (-) strand; PAM type: YTN; PAM sequence: TTT
caagcagagtctcaactgat

SEQ ID NO: 72519 - DNA, 20 bp, Artificial Sequence
  Description of Artificial Sequence: Synthetic oligonucleotide
  Target: SCN9A; (-) strand; PAM type: YTN; PAM sequence: CTA
aaccatttcaagcagagtct

SEQ ID NO: 72520 - DNA, 20 bp, Artificial Sequence
  Description of Artificial Sequence: Synthetic oligonucleotide
  Target: SCN9A; (-) strand; PAM type: YTN; PAM sequence: TTG
cctaaaccatttcaagcaga

SEQ ID NO: 72521 - DNA, 20 bp, Artificial Sequence
  Description of Artificial Sequence: Synthetic oligonucleotide
  Target: SCN9A; (-) strand; PAM type: YTN; PAM sequence: TTT
gcctaaaccatttcaagcag

SEQ ID NO: 72522 - DNA, 20 bp, Artificial Sequence
  Description of Artificial Sequence: Synthetic oligonucleotide
  Target: SCN9A; (-) strand; PAM type: YTN; PAM sequence: TTT
tgcctaaaccatttcaagca

SEQ ID NO: 72523 - DNA, 20 bp, Artificial Sequence
  Description of Artificial Sequence: Synthetic oligonucleotide
  Target: SCN9A; (-) strand; PAM type: YTN; PAM sequence: TTT
ttgcctaaaccatttcaagc

SEQ ID NO: 72524 - DNA, 20 bp, Artificial Sequence
  Description of Artificial Sequence: Synthetic oligonucleotide
  Target: SCN9A; (-) strand; PAM type: YTN; PAM sequence: CTT
tttgcctaaaccatttcaag

SEQ ID NO: 72525 - DNA, 20 bp, Artificial Sequence
  Description of Artificial Sequence: Synthetic oligonucleotide
  Target: SCN9A; (-) strand; PAM type: YTN; PAM sequence: CTA
ctttttgcctaaaccatttc

SEQ ID NO: 72526 - DNA, 20 bp, Artificial Sequence
  Description of Artificial Sequence: Synthetic oligonucleotide
  Target: SCN9A; (-) strand; PAM type: YTN; PAM sequence: CTC
actactttttgcctaaacca

SEQ ID NO: 72527 - DNA, 20 bp, Artificial Sequence
  Description of Artificial Sequence: Synthetic oligonucleotide
  Target: SCN9A; (-) strand; PAM type: YTN; PAM sequence: TTG
tactcactactttttgccta

SEQ ID NO: 72528 - DNA, 20 bp, Artificial Sequence
  Description of Artificial Sequence: Synthetic oligonucleotide
  Target: SCN9A; (-) strand; PAM type: YTN; PAM sequence: TTT
gtactcactactttttgcct

SEQ ID NO: 72529 - DNA, 20 bp, Artificial Sequence
  Description of Artificial Sequence: Synthetic oligonucleotide
  Target: SCN9A; (-) strand; PAM type: YTN; PAM sequence: CTT
tgtactcactactttttgcc

SEQ ID NO: 72530 - DNA, 20 bp, Artificial Sequence
  Description of Artificial Sequence: Synthetic oligonucleotide
  Target: SCN9A; (-) strand; PAM type: YTN; PAM sequence: TTC
ctttgtactcactacttttt

SEQ ID NO: 72531 - DNA, 20 bp, Artificial Sequence
  Description of Artificial Sequence: Synthetic oligonucleotide
  Target: SCN9A; (-) strand; PAM type: YTN; PAM sequence: TTT
cctttgtactcactactttt

SEQ ID NO: 72532 - DNA, 20 bp, Artificial Sequence
  Description of Artificial Sequence: Synthetic oligonucleotide
  Target: SCN9A; (-) strand; PAM type: YTN; PAM sequence: CTT
tcctttgtactcactacttt

SEQ ID NO: 72533 - DNA, 20 bp, Artificial Sequence
  Description of Artificial Sequence: Synthetic oligonucleotide
  Target: SCN9A; (-) strand; PAM type: YTN; PAM sequence: TTC
atcacctttcctttgtactc

SEQ ID NO: 72534 - DNA, 20 bp, Artificial Sequence
  Description of Artificial Sequence: Synthetic oligonucleotide
  Target: SCN9A; (-) strand; PAM type: YTN; PAM sequence: TTT
catcacctttcctttgtact

SEQ ID NO: 72535 - DNA, 20 bp, Artificial Sequence
  Description of Artificial Sequence: Synthetic oligonucleotide
  Target: SCN9A; (-) strand; PAM type: YTN; PAM sequence: TTT
tcatcacctttcctttgtac

SEQ ID NO: 72536 - DNA, 20 bp, Artificial Sequence
  Description of Artificial Sequence: Synthetic oligonucleotide
  Target: SCN9A; (-) strand; PAM type: YTN; PAM sequence: CTT
ttcatcacctttcctttgta

SEQ ID NO: 72537 - DNA, 20 bp, Artificial Sequence
  Description of Artificial Sequence: Synthetic oligonucleotide
  Target: SCN9A; (-) strand; PAM type: YTN; PAM sequence: CTC
cttttcatcacctttccttt

SEQ ID NO: 72538 - DNA, 20 bp, Artificial Sequence
  Description of Artificial Sequence: Synthetic oligonucleotide
  Target: SCN9A; (-) strand; PAM type: YTN; PAM sequence: CTC
tccttttcatcacctttcct

SEQ ID NO: 72539 - DNA, 20 bp, Artificial Sequence
  Description of Artificial Sequence: Synthetic oligonucleotide
  Target: SCN9A; (-) strand; PAM type: YTN; PAM sequence: TTG
aatccacctctccttttcat

SEQ ID NO: 72540 - DNA, 20 bp, Artificial Sequence
  Description of Artificial Sequence: Synthetic oligonucleotide
  Target: SCN9A; (-) strand; PAM type: YTN; PAM sequence: TTT
gaatccacctctccttttca

SEQ ID NO: 72541 - DNA, 20 bp, Artificial Sequence
  Description of Artificial Sequence: Synthetic oligonucleotide
  Target: SCN9A; (-) strand; PAM type: YTN; PAM sequence: CTG
tttgaatccacctctccttt

SEQ ID NO: 72542 - DNA, 20 bp, Artificial Sequence
  Description of Artificial Sequence: Synthetic oligonucleotide
  Target: SCN9A; (-) strand; PAM type: YTN; PAM sequence: CTC
cacagtgcctgtttgaatcc

SEQ ID NO: 72543 - DNA, 20 bp, Artificial Sequence
  Description of Artificial Sequence: Synthetic oligonucleotide
  Target: SCN9A; (-) strand; PAM type: YTN; PAM sequence: CTC
cctccacagtgcctgtttga

SEQ ID NO: 72544 - DNA, 20 bp, Artificial Sequence
  Description of Artificial Sequence: Synthetic oligonucleotide
  Target: SCN9A; (-) strand; PAM type: YTN; PAM sequence: TTA
cacagtctccctccacagtg

SEQ ID NO: 72545 - DNA, 20 bp, Artificial Sequence
  Description of Artificial Sequence: Synthetic oligonucleotide
  Target: SCN9A; (-) strand; PAM type: YTN; PAM sequence: TTG
aaaagttacacagtctccct

SEQ ID NO: 72546 - DNA, 20 bp, Artificial Sequence
  Description of Artificial Sequence: Synthetic oligonucleotide
  Target: SCN9A; (-) strand; PAM type: YTN; PAM sequence: CTG
tcagttgaaaagttacacag

SEQ ID NO: 72547 - DNA, 20 bp, Artificial Sequence
  Description of Artificial Sequence: Synthetic oligonucleotide
  Target: SCN9A; (-) strand; PAM type: YTN; PAM sequence: TTC
ctgtcagttgaaaagttaca

SEQ ID NO: 72548 - DNA, 20 bp, Artificial Sequence
  Description of Artificial Sequence: Synthetic oligonucleotide
  Target: SCN9A; (-) strand; PAM type: YTN; PAM sequence: TTT
cctgtcagttgaaaagttac

SEQ ID NO: 72549 - DNA, 20 bp, Artificial Sequence
  Description of Artificial Sequence: Synthetic oligonucleotide
  Target: SCN9A; (-) strand; PAM type: YTN; PAM sequence: TTC
atcccatgtttcctgtcagt

SEQ ID NO: 72550 - DNA, 20 bp, Artificial Sequence
  Description of Artificial Sequence: Synthetic oligonucleotide
  Target: SCN9A; (-) strand; PAM type: YTN; PAM sequence: CTT
catcccatgtttcctgtcag

SEQ ID NO: 72551 - DNA, 20 bp, Artificial Sequence
  Description of Artificial Sequence: Synthetic oligonucleotide
  Target: SCN9A; (-) strand; PAM type: YTN; PAM sequence: TTC
ccatgcttcatcccatgttt

SEQ ID NO: 72552 - DNA, 20 bp, Artificial Sequence
  Description of Artificial Sequence: Synthetic oligonucleotide
  Target: SCN9A; (-) strand; PAM type: YTN; PAM sequence: CTT
cccatgcttcatcccatgtt

SEQ ID NO: 72553 - DNA, 20 bp, Artificial Sequence
  Description of Artificial Sequence: Synthetic oligonucleotide
  Target: SCN9A; (-) strand; PAM type: YTN; PAM sequence: TTG
agccttcccatgcttcatcc

SEQ ID NO: 72554 - DNA, 20 bp, Artificial Sequence
  Description of Artificial Sequence: Synthetic oligonucleotide
  Target: SCN9A; (-) strand; PAM type: YTN; PAM sequence: TTT
gagccttcccatgcttcatc

SEQ ID NO: 72555 - DNA, 20 bp, Artificial Sequence
  Description of Artificial Sequence: Synthetic oligonucleotide
  Target: SCN9A; (-) strand; PAM type: YTN; PAM sequence: CTT
tgagccttcccatgcttcat

SEQ ID NO: 72556 - DNA, 20 bp, Artificial Sequence
  Description of Artificial Sequence: Synthetic oligonucleotide
  Target: SCN9A; (-) strand; PAM type: YTN; PAM sequence: CTC
aaaggtatctttgagccttc

SEQ ID NO: 72557 - DNA, 20 bp, Artificial Sequence
  Description of Artificial Sequence: Synthetic oligonucleotide
  Target: SCN9A; (-) strand; PAM type: YTN; PAM sequence: CTG
tatgagaaagctcaaaggta

SEQ ID NO: 72558 - DNA, 20 bp, Artificial Sequence
  Description of Artificial Sequence: Synthetic oligonucleotide
  Target: SCN9A; (-) strand; PAM type: YTN; PAM sequence: TTA
gctgtatgagaaagctcaaa

SEQ ID NO: 72559 - DNA, 20 bp, Artificial Sequence
  Description of Artificial Sequence: Synthetic oligonucleotide
  Target: SCN9A; (-) strand; PAM type: YTN; PAM sequence: CTT
agctgtatgagaaagctcaa

SEQ ID NO: 72560 - DNA, 20 bp, Artificial Sequence
  Description of Artificial Sequence: Synthetic oligonucleotide
  Target: SCN9A; (-) strand; PAM type: YTN; PAM sequence: TTA
cttagctgtatgagaaagct

SEQ ID NO: 72561 - DNA, 20 bp, Artificial Sequence
  Description of Artificial Sequence: Synthetic oligonucleotide
  Target: SCN9A; (-) strand; PAM type: YTN; PAM sequence: CTT
acttagctgtatgagaaagc

SEQ ID NO: 72562 - DNA, 20 bp, Artificial Sequence
  Description of Artificial Sequence: Synthetic oligonucleotide
  Target: SCN9A; (-) strand; PAM type: YTN; PAM sequence: TTA
atcttacttagctgtatgag

SEQ ID NO: 72563 - DNA, 20 bp, Artificial Sequence
  Description of Artificial Sequence: Synthetic oligonucleotide
  Target: SCN9A; (-) strand; PAM type: YTN; PAM sequence: TTT
aatcttacttagctgtatga

SEQ ID NO: 72564 - DNA, 20 bp, Artificial Sequence
  Description of Artificial Sequence: Synthetic oligonucleotide
  Target: SCN9A; (-) strand; PAM type: YTN; PAM sequence: TTG
atttaatcttacttagctgt

SEQ ID NO: 72565 - DNA, 20 bp, Artificial Sequence
  Description of Artificial Sequence: Synthetic oligonucleotide
  Target: SCN9A; (-) strand; PAM type: YTN; PAM sequence: TTA
ataattgatttaatcttact

SEQ ID NO: 72566 - DNA, 20 bp, Artificial Sequence
  Description of Artificial Sequence: Synthetic oligonucleotide
  Target: SCN9A; (-) strand; PAM type: YTN; PAM sequence: CTT
aataattgatttaatcttac

SEQ ID NO: 72567 - DNA, 20 bp, Artificial Sequence
  Description of Artificial Sequence: Synthetic oligonucleotide
  Target: SCN9A; (-) strand; PAM type: YTN; PAM sequence: TTC
ttaataattgatttaatctt

SEQ ID NO: 72568 - DNA, 20 bp, Artificial Sequence
  Description of Artificial Sequence: Synthetic oligonucleotide
  Target: SCN9A; (-) strand; PAM type: YTN; PAM sequence: CTA
gttcttaataattgatttaa

SEQ ID NO: 72569 - DNA, 20 bp, Artificial Sequence
  Description of Artificial Sequence: Synthetic oligonucleotide
  Target: SCN9A; (-) strand; PAM type: YTN; PAM sequence: TTA
ctagttcttaataattgatt

SEQ ID NO: 72570 - DNA, 20 bp, Artificial Sequence
  Description of Artificial Sequence: Synthetic oligonucleotide
  Target: SCN9A; (-) strand; PAM type: YTN; PAM sequence: CTT
actagttcttaataattgat

SEQ ID NO: 72571 - DNA, 20 bp, Artificial Sequence
  Description of Artificial Sequence: Synthetic oligonucleotide
  Target: SCN9A; (-) strand; PAM type: YTN; PAM sequence: TTC
ttactagttcttaataattg

SEQ ID NO: 72572 - DNA, 20 bp, Artificial Sequence
  Description of Artificial Sequence: Synthetic oligonucleotide
  Target: SCN9A; (-) strand; PAM type: YTN; PAM sequence: TTT
cttactagttcttaataatt

SEQ ID NO: 72573 - DNA, 20 bp, Artificial Sequence
  Description of Artificial Sequence: Synthetic oligonucleotide
  Target: SCN9A; (-) strand; PAM type: YTN; PAM sequence: TTT
tcttactagttcttaataat

SEQ ID NO: 72574 - DNA, 20 bp, Artificial Sequence
  Description of Artificial Sequence: Synthetic oligonucleotide
  Target: SCN9A; (-) strand; PAM type: YTN; PAM sequence: CTG
gtaaagttttcttactagtt

SEQ ID NO: 72575 - DNA, 20 bp, Artificial Sequence
  Description of Artificial Sequence: Synthetic oligonucleotide
  Target: SCN9A; (-) strand; PAM type: YTN; PAM sequence: TTC
atctggtaaagttttcttac

SEQ ID NO: 72576 - DNA, 20 bp, Artificial Sequence
  Description of Artificial Sequence: Synthetic oligonucleotide
  Target: SCN9A; (-) strand; PAM type: YTN; PAM sequence: CTG
aagattcatctggtaaagtt

SEQ ID NO: 72577 - DNA, 20 bp, Artificial Sequence
  Description of Artificial Sequence: Synthetic oligonucleotide
  Target: SCN9A; (-) strand; PAM type: YTN; PAM sequence: TTC
ctgaagattcatctggtaaa

SEQ ID NO: 72578 - DNA, 20 bp, Artificial Sequence
  Description of Artificial Sequence: Synthetic oligonucleotide
  Target: SCN9A; (-) strand; PAM type: YTN; PAM sequence: CTT
cctgaagattcatctggtaa

SEQ ID NO: 72579 - DNA, 20 bp, Artificial Sequence
  Description of Artificial Sequence: Synthetic oligonucleotide
  Target: SCN9A; (-) strand; PAM type: YTN; PAM sequence: TTA
cacaacagcttcctgaagat

SEQ ID NO: 72580 - DNA, 20 bp, Artificial Sequence
  Description of Artificial Sequence: Synthetic oligonucleotide
  Target: SCN9A; (-) strand; PAM type: YTN; PAM sequence: TTT
acacaacagcttcctgaaga

SEQ ID NO: 72581 - DNA, 20 bp, Artificial Sequence
  Description of Artificial Sequence: Synthetic oligonucleotide
  Target: SCN9A; (-) strand; PAM type: YTN; PAM sequence: CTT
tacacaacagcttcctgaag

SEQ ID NO: 72582 - DNA, 20 bp, Artificial Sequence
  Description of Artificial Sequence: Synthetic oligonucleotide
  Target: SCN9A; (-) strand; PAM type: YTN; PAM sequence: TTG
tgcgtgactttacacaacag

SEQ ID NO: 72583 - DNA, 20 bp, Artificial Sequence
  Description of Artificial Sequence: Synthetic oligonucleotide
  Target: SCN9A; (-) strand; PAM type: YTN; PAM sequence: TTT
gtgcgtgactttacacaaca

SEQ ID NO: 72584 - DNA, 20 bp, Artificial Sequence
  Description of Artificial Sequence: Synthetic oligonucleotide
  Target: SCN9A; (-) strand; PAM type: YTN; PAM sequence: TTT
tgtgcgtgactttacacaac

SEQ ID NO: 72585 - DNA, 20 bp, Artificial Sequence
  Description of Artificial Sequence: Synthetic oligonucleotide
  Target: SCN9A; (-) strand; PAM type: YTN; PAM sequence: TTT
ttgtgcgtgactttacacaa

SEQ ID NO: 72586 - DNA, 20 bp, Artificial Sequence
  Description of Artificial Sequence: Synthetic oligonucleotide
  Target: SCN9A; (-) strand; PAM type: YTN; PAM sequence: TTG
catgtagtgatggatagttt

SEQ ID NO: 72587 - DNA, 20 bp, Artificial Sequence
  Description of Artificial Sequence: Synthetic oligonucleotide
  Target: SCN9A; (-) strand; PAM type: YTN; PAM sequence: TTA
acattgcatgtagtgatgga

SEQ ID NO: 72588 - DNA, 20 bp, Artificial Sequence
  Description of Artificial Sequence: Synthetic oligonucleotide
  Target: SCN9A; (-) strand; PAM type: YTN; PAM sequence: CTT
aacattgcatgtagtgatgg

SEQ ID NO: 72589 - DNA, 20 bp, Artificial Sequence
  Description of Artificial Sequence: Synthetic oligonucleotide
  Target: SCN9A; (-) strand; PAM type: YTN; PAM sequence: TTC
ttaacattgcatgtagtgat

SEQ ID NO: 72590 - DNA, 20 bp, Artificial Sequence
  Description of Artificial Sequence: Synthetic oligonucleotide
  Target: SCN9A; (-) strand; PAM type: YTN; PAM sequence: CTT
cttaacattgcatgtagtga

SEQ ID NO: 72591 - DNA, 20 bp, Artificial Sequence
  Description of Artificial Sequence: Synthetic oligonucleotide
  Target: SCN9A; (-) strand; PAM type: YTN; PAM sequence: TTC
ttcttaacattgcatgtagt

SEQ ID NO: 72592 - DNA, 20 bp, Artificial Sequence
  Description of Artificial Sequence: Synthetic oligonucleotide
  Target: SCN9A; (-) strand; PAM type: YTN; PAM sequence: TTG
tcataagttcttcttaacat

SEQ ID NO: 72593 - DNA, 20 bp, Artificial Sequence
  Description of Artificial Sequence: Synthetic oligonucleotide
  Target: SCN9A; (-) strand; PAM type: YTN; PAM sequence: CTA
ttgtcataagttcttcttaa

SEQ ID NO: 72594 - DNA, 20 bp, Artificial Sequence
  Description of Artificial Sequence: Synthetic oligonucleotide
  Target: SCN9A; (-) strand; PAM type: YTN; PAM sequence: TTC
tattgtcataagttcttctt

SEQ ID NO: 72595 - DNA, 20 bp, Artificial Sequence
  Description of Artificial Sequence: Synthetic oligonucleotide
  Target: SCN9A; (-) strand; PAM type: YTN; PAM sequence: TTT
ctattgtcataagttcttct

SEQ ID NO: 72596 - DNA, 20 bp, Artificial Sequence
  Description of Artificial Sequence: Synthetic oligonucleotide
  Target: SCN9A; (-) strand; PAM type: YTN; PAM sequence: TTC
atatttctattgtcataagt

SEQ ID NO: 72597 - DNA, 20 bp, Artificial Sequence
  Description of Artificial Sequence: Synthetic oligonucleotide
  Target: SCN9A; (-) strand; PAM type: YTN; PAM sequence: TTT
catatttctattgtcataag

SEQ ID NO: 72598 - DNA, 20 bp, Artificial Sequence
  Description of Artificial Sequence: Synthetic oligonucleotide
  Target: SCN9A; (-) strand; PAM type: YTN; PAM sequence: TTA
gtatgaaatgaatgaaaatt

SEQ ID NO: 72599 - DNA, 20 bp, Artificial Sequence
  Description of Artificial Sequence: Synthetic oligonucleotide
  Target: SCN9A; (-) strand; PAM type: YTN; PAM sequence: TTA
acaattagtatgaaatgaat

SEQ ID NO: 72600 - DNA, 20 bp, Artificial Sequence
  Description of Artificial Sequence: Synthetic oligonucleotide
  Target: SCN9A; (-) strand; PAM type: YTN; PAM sequence: TTC
atattaacaattagtatgaa

SEQ ID NO: 72601 - DNA, 20 bp, Artificial Sequence
  Description of Artificial Sequence: Synthetic oligonucleotide
  Target: SCN9A; (-) strand; PAM type: YTN; PAM sequence: TTT
catattaacaattagtatga

SEQ ID NO: 72602 - DNA, 20 bp, Artificial Sequence
  Description of Artificial Sequence: Synthetic oligonucleotide
  Target: SCN9A; (-) strand; PAM type: YTN; PAM sequence: TTG
tgtttcatattaacaattag

SEQ ID NO: 72603 - DNA, 20 bp, Artificial Sequence
  Description of Artificial Sequence: Synthetic oligonucleotide
  Target: SCN9A; (-) strand; PAM type: YTN; PAM sequence: TTT
gtgtttcatattaacaatta

SEQ ID NO: 72604 - DNA, 20 bp, Artificial Sequence
  Description of Artificial Sequence: Synthetic oligonucleotide
  Target: SCN9A; (-) strand; PAM type: YTN; PAM sequence: CTT
tgtgtttcatattaacaatt

SEQ ID NO: 72605 - DNA, 20 bp, Artificial Sequence
  Description of Artificial Sequence: Synthetic oligonucleotide
  Target: SCN9A; (-) strand; PAM type: YTN; PAM sequence: TTC
atatactttgtgtttcatat

SEQ ID NO: 72606 - DNA, 20 bp, Artificial Sequence
  Description of Artificial Sequence: Synthetic oligonucleotide
  Target: SCN9A; (-) strand; PAM type: YTN; PAM sequence: CTT
catatactttgtgtttcata

SEQ ID NO: 72607 - DNA, 20 bp, Artificial Sequence
  Description of Artificial Sequence: Synthetic oligonucleotide
  Target: SCN9A; (-) strand; PAM type: YTN; PAM sequence: TTC
ggatagtgaatacagcaaag

SEQ ID NO: 72608 - DNA, 20 bp, Artificial Sequence
  Description of Artificial Sequence: Synthetic oligonucleotide
  Target: SCN9A; (-) strand; PAM type: YTN; PAM sequence: TTA
gcagtgattcggatagtgaa

SEQ ID NO: 72609 - DNA, 20 bp, Artificial Sequence
  Description of Artificial Sequence: Synthetic oligonucleotide
  Target: SCN9A; (-) strand; PAM type: YTN; PAM sequence: CTT
agcagtgattcggatagtga

SEQ ID NO: 72610 - DNA, 20 bp, Artificial Sequence
  Description of Artificial Sequence: Synthetic oligonucleotide
  Target: SCN9A; (-) strand; PAM type: YTN; PAM sequence: CTG
aggaacttagcagtgattcg

SEQ ID NO: 72611 - DNA, 20 bp, Artificial Sequence
  Description of Artificial Sequence: Synthetic oligonucleotide
  Target: SCN9A; (-) strand; PAM type: YTN; PAM sequence: TTG
gaaaatatgaatgctgagga

SEQ ID NO: 72612 - DNA, 20 bp, Artificial Sequence
  Description of Artificial Sequence: Synthetic oligonucleotide
  Target: SCN9A; (-) strand; PAM type: YTN; PAM sequence: TTT
ggaaaatatgaatgctgagg

SEQ ID NO: 72613 - DNA, 20 bp, Artificial Sequence
  Description of Artificial Sequence: Synthetic oligonucleotide
  Target: SCN9A; (-) strand; PAM type: YTN; PAM sequence: CTG
gggaatccgatttggaaaat

SEQ ID NO: 72614 - DNA, 20 bp, Artificial Sequence
  Description of Artificial Sequence: Synthetic oligonucleotide
  Target: SCN9A; (-) strand; PAM type: YTN; PAM sequence: TTG
cacctggggaatccgatttg

SEQ ID NO: 72615 - DNA, 20 bp, Artificial Sequence
  Description of Artificial Sequence: Synthetic oligonucleotide
  Target: SCN9A; (-) strand; PAM type: YTN; PAM sequence: CTC
acagtgacagtgccaattgc

SEQ ID NO: 72616 - DNA, 20 bp, Artificial Sequence
  Description of Artificial Sequence: Synthetic oligonucleotide
  Target: SCN9A; (-) strand; PAM type: YTN; PAM sequence: TTC
acaatcccagcctcacagtg

SEQ ID NO: 72617 - DNA, 20 bp, Artificial Sequence
  Description of Artificial Sequence: Synthetic oligonucleotide
  Target: SCN9A; (-) strand; PAM type: YTN; PAM sequence: TTA
ttcacaatcccagcctcaca

SEQ ID NO: 72618 - DNA, 20 bp, Artificial Sequence
  Description of Artificial Sequence: Synthetic oligonucleotide
  Target: SCN9A; (-) strand; PAM type: YTN; PAM sequence: TTT
attcacaatcccagcctcac

SEQ ID NO: 72619 - DNA, 20 bp, Artificial Sequence
  Description of Artificial Sequence: Synthetic oligonucleotide
  Target: SCN9A; (-) strand; PAM type: YTN; PAM sequence: TTG
atggaagacagtgatggtca

SEQ ID NO: 72620 - DNA, 20 bp, Artificial Sequence
  Description of Artificial Sequence: Synthetic oligonucleotide
  Target: SCN9A; (-) strand; PAM type: YTN; PAM sequence: CTT
gatggaagacagtgatggtc

SEQ ID NO: 72621 - DNA, 20 bp, Artificial Sequence
  Description of Artificial Sequence: Synthetic oligonucleotide
  Target: SCN9A; (-) strand; PAM type: YTN; PAM sequence: TTG
gaagcagcgtggacaaacac

SEQ ID NO: 72622 - DNA, 20 bp, Artificial Sequence
  Description of Artificial Sequence: Synthetic oligonucleotide
  Target: SCN9A; (-) strand; PAM type: YTN; PAM sequence: TTT
ggaagcagcgtggacaaaca

SEQ ID NO: 72623 - DNA, 20 bp, Artificial Sequence
  Description of Artificial Sequence: Synthetic oligonucleotide
  Target: SCN9A; (-) strand; PAM type: YTN; PAM sequence: TTT
tggaagcagcgtggacaaac

SEQ ID NO: 72624 - DNA, 20 bp, Artificial Sequence
  Description of Artificial Sequence: Synthetic oligonucleotide
  Target: SCN9A; (-) strand; PAM type: YTN; PAM sequence: CTC
aaggaaaaagataaaatcag

SEQ ID NO: 72625 - DNA, 20 bp, Artificial Sequence
  Description of Artificial Sequence: Synthetic oligonucleotide
  Target: SCN9A; (-) strand; PAM type: YTN; PAM sequence: TTC
ctcaaggaaaaagataaaat

SEQ ID NO: 72626 - DNA, 20 bp, Artificial Sequence
  Description of Artificial Sequence: Synthetic oligonucleotide
  Target: SCN9A; (-) strand; PAM type: YTN; PAM sequence: TTT
cctcaaggaaaaagataaaa

SEQ ID NO: 72627 - DNA, 20 bp, Artificial Sequence
  Description of Artificial Sequence: Synthetic oligonucleotide
  Target: SCN9A; (-) strand; PAM type: YTN; PAM sequence: CTG
aaatgagcaaaggtcacaat

SEQ ID NO: 72628 - DNA, 20 bp, Artificial Sequence
  Description of Artificial Sequence: Synthetic oligonucleotide
  Target: SCN9A; (-) strand; PAM type: YTN; PAM sequence: TTG
ctgaaatgagcaaaggtcac

SEQ ID NO: 72629 - DNA, 20 bp, Artificial Sequence
  Description of Artificial Sequence: Synthetic oligonucleotide
  Target: SCN9A; (-) strand; PAM type: YTN; PAM sequence: CTT
gctgaaatgagcaaaggtca

SEQ ID NO: 72630 - DNA, 20 bp, Artificial Sequence
  Description of Artificial Sequence: Synthetic oligonucleotide
  Target: SCN9A; (-) strand; PAM type: YTN; PAM sequence: CTA
accatacacttgctgaaatg

SEQ ID NO: 72631 - DNA, 20 bp, Artificial Sequence
  Description of Artificial Sequence: Synthetic oligonucleotide
  Target: SCN9A; (-) strand; PAM type: YTN; PAM sequence: TTC
taaccatacacttgctgaaa

SEQ ID NO: 72632 - DNA, 20 bp, Artificial Sequence
  Description of Artificial Sequence: Synthetic oligonucleotide
  Target: SCN9A; (-) strand; PAM type: YTN; PAM sequence: TTT
ctaaccatacacttgctgaa

SEQ ID NO: 72633 - DNA, 20 bp, Artificial Sequence
  Description of Artificial Sequence: Synthetic oligonucleotide
  Target: SCN9A; (-) strand; PAM type: YTN; PAM sequence: CTA
tatttctaaccatacacttg

SEQ ID NO: 72634 - DNA, 20 bp, Artificial Sequence
  Description of Artificial Sequence: Synthetic oligonucleotide
  Target: SCN9A; (-) strand; PAM type: YTN; PAM sequence: CTA
agaaggaaaactatatttct

SEQ ID NO: 72635 - DNA, 20 bp, Artificial Sequence
  Description of Artificial Sequence: Synthetic oligonucleotide
  Target: SCN9A; (-) strand; PAM type: YTN; PAM sequence: CTG
aatactaagaaggaaaacta

SEQ ID NO: 72636 - DNA, 20 bp, Artificial Sequence
  Description of Artificial Sequence: Synthetic oligonucleotide
  Target: SCN9A; (-) strand; PAM type: YTN; PAM sequence: TTC
cagggagataagacaagcag

SEQ ID NO: 72637 - DNA, 20 bp, Artificial Sequence
  Description of Artificial Sequence: Synthetic oligonucleotide
  Target: SCN9A; (-) strand; PAM type: YTN; PAM sequence: TTT
ccagggagataagacaagca

SEQ ID NO: 72638 - DNA, 20 bp, Artificial Sequence
  Description of Artificial Sequence: Synthetic oligonucleotide
  Target: SCN9A; (-) strand; PAM type: YTN; PAM sequence: TTC
caaaaagccaaagatttcca

SEQ ID NO: 72639 - DNA, 20 bp, Artificial Sequence
  Description of Artificial Sequence: Synthetic oligonucleotide
  Target: SCN9A; (-) strand; PAM type: YTN; PAM sequence: TTT
ccaaaaagccaaagatttcc

SEQ ID NO: 72640 - DNA, 20 bp, Artificial Sequence
  Description of Artificial Sequence: Synthetic oligonucleotide
  Target: SCN9A; (-) strand; PAM type: YTN; PAM sequence: TTT
tccaaaaagccaaagatttc

SEQ ID NO: 72641 - DNA, 20 bp, Artificial Sequence
  Description of Artificial Sequence: Synthetic oligonucleotide
  Target: SCN9A; (-) strand; PAM type: YTN; PAM sequence: CTA
aaagcattttccaaaaagcc

SEQ ID NO: 72642 - DNA, 20 bp, Artificial Sequence
  Description of Artificial Sequence: Synthetic oligonucleotide
  Target: SCN9A; (-) strand; PAM type: YTN; PAM sequence: TTC
taaaagcattttccaaaaag

SEQ ID NO: 72643 - DNA, 20 bp, Artificial Sequence
  Description of Artificial Sequence: Synthetic oligonucleotide
  Target: SCN9A; (-) strand; PAM type: YTN; PAM sequence: TTA
ttctaaaagcattttccaaa

SEQ ID NO: 72644 - DNA, 20 bp, Artificial Sequence
  Description of Artificial Sequence: Synthetic oligonucleotide
  Target: SCN9A; (-) strand; PAM type: YTN; PAM sequence: TTT
attctaaaagcattttccaa

SEQ ID NO: 72645 - DNA, 20 bp, Artificial Sequence
  Description of Artificial Sequence: Synthetic oligonucleotide
  Target: SCN9A; (-) strand; PAM type: YTN; PAM sequence: TTA
cgtgaatttattctaaaagc

SEQ ID NO: 72646 - DNA, 20 bp, Artificial Sequence
  Description of Artificial Sequence: Synthetic oligonucleotide
  Target: SCN9A; (-) strand; PAM type: YTN; PAM sequence: CTT
acgtgaatttattctaaaag

SEQ ID NO: 72647 - DNA, 20 bp, Artificial Sequence
  Description of Artificial Sequence: Synthetic oligonucleotide
  Target: SCN9A; (-) strand; PAM type: YTN; PAM sequence: TTA
tgtgaaacaaaccttacgtg

SEQ ID NO: 72648 - DNA, 20 bp, Artificial Sequence
  Description of Artificial Sequence: Synthetic oligonucleotide
  Target: SCN9A; (-) strand; PAM type: YTN; PAM sequence: TTA
aaaagggaataaattatgtg

SEQ ID NO: 72649 - DNA, 20 bp, Artificial Sequence
  Description of Artificial Sequence: Synthetic oligonucleotide
  Target: SCN9A; (-) strand; PAM type: YTN; PAM sequence: CTA
gaattaaaaagggaataaat

SEQ ID NO: 72650 - DNA, 20 bp, Artificial Sequence
  Description of Artificial Sequence: Synthetic oligonucleotide
  Target: SCN9A; (-) strand; PAM type: YTN; PAM sequence: TTG
cagtgactagaattaaaaag

SEQ ID NO: 72651 - DNA, 20 bp, Artificial Sequence
  Description of Artificial Sequence: Synthetic oligonucleotide
  Target: SCN9A; (-) strand; PAM type: YTN; PAM sequence: CTC
cagattgcagtgactagaat

SEQ ID NO: 72652 - DNA, 20 bp, Artificial Sequence
  Description of Artificial Sequence: Synthetic oligonucleotide
  Target: SCN9A; (-) strand; PAM type: YTN; PAM sequence: CTG
atgcaaacaacctccagatt

SEQ ID NO: 72653 - DNA, 20 bp, Artificial Sequence
  Description of Artificial Sequence: Synthetic oligonucleotide
  Target: SCN9A; (-) strand; PAM type: YTN; PAM sequence: TTG
aagaagaccctgatgcaaac

SEQ ID NO: 72654 - DNA, 20 bp, Artificial Sequence
  Description of Artificial Sequence: Synthetic oligonucleotide
  Target: SCN9A; (-) strand; PAM type: YTN; PAM sequence: TTA
cagcaattgaagaagaccct

SEQ ID NO: 72655 - DNA, 20 bp, Artificial Sequence
  Description of Artificial Sequence: Synthetic oligonucleotide
  Target: SCN9A; (-) strand; PAM type: YTN; PAM sequence: CTT
acagcaattgaagaagaccc

SEQ ID NO: 72656 - DNA, 20 bp, Artificial Sequence
  Description of Artificial Sequence: Synthetic oligonucleotide
  Target: SCN9A; (-) strand; PAM type: YTN; PAM sequence: TTC
agacaatcttacagcaattg

SEQ ID NO: 72657 - DNA, 20 bp, Artificial Sequence
  Description of Artificial Sequence: Synthetic oligonucleotide
  Target: SCN9A; (-) strand; PAM type: YTN; PAM sequence: TTA
gttcagacaatcttacagca

SEQ ID NO: 72658 - DNA, 20 bp, Artificial Sequence
  Description of Artificial Sequence: Synthetic oligonucleotide
  Target: SCN9A; (-) strand; PAM type: YTN; PAM sequence: TTT
agttcagacaatcttacagc

SEQ ID NO: 72659 - DNA, 20 bp, Artificial Sequence
  Description of Artificial Sequence: Synthetic oligonucleotide
  Target: SCN9A; (-) strand; PAM type: YTN; PAM sequence: CTC
atttagttcagacaatctta

SEQ ID NO: 72660 - DNA, 20 bp, Artificial Sequence
  Description of Artificial Sequence: Synthetic oligonucleotide
  Target: SCN9A; (-) strand; PAM type: YTN; PAM sequence: TTG
agctcatttagttcagacaa

SEQ ID NO: 72661 - DNA, 20 bp, Artificial Sequence
  Description of Artificial Sequence: Synthetic oligonucleotide
  Target: SCN9A; (-) strand; PAM type: YTN; PAM sequence: TTA
ttgagctcatttagttcaga

SEQ ID NO: 72662 - DNA, 20 bp, Artificial Sequence
  Description of Artificial Sequence: Synthetic oligonucleotide
  Target: SCN9A; (-) strand; PAM type: YTN; PAM sequence: TTA
ttattgagctcatttagttc

SEQ ID NO: 72663 - DNA, 20 bp, Artificial Sequence
  Description of Artificial Sequence: Synthetic oligonucleotide
  Target: SCN9A; (-) strand; PAM type: YTN; PAM sequence: CTT
attattgagctcatttagtt

SEQ ID NO: 72664 - DNA, 20 bp, Artificial Sequence
  Description of Artificial Sequence: Synthetic oligonucleotide
  Target: SCN9A; (-) strand; PAM type: YTN; PAM sequence: CTG
gccttattattgagctcatt

SEQ ID NO: 72665 - DNA, 20 bp, Artificial Sequence
  Description of Artificial Sequence: Synthetic oligonucleotide
  Target: SCN9A; (-) strand; PAM type: YTN; PAM sequence: TTC
tggccttattattgagctca

SEQ ID NO: 72666 - DNA, 20 bp, Artificial Sequence
  Description of Artificial Sequence: Synthetic oligonucleotide
  Target: SCN9A; (-) strand; PAM type: YTN; PAM sequence: TTT
ctggccttattattgagctc

SEQ ID NO: 72667 - DNA, 20 bp, Artificial Sequence
  Description of Artificial Sequence: Synthetic oligonucleotide
  Target: SCN9A; (-) strand; PAM type: YTN; PAM sequence: CTA
tttctggccttattattgag

SEQ ID NO: 72668 - DNA, 20 bp, Artificial Sequence
  Description of Artificial Sequence: Synthetic oligonucleotide
  Target: SCN9A; (-) strand; PAM type: YTN; PAM sequence: CTA
aacctatttctggccttatt

SEQ ID NO: 72669 - DNA, 20 bp, Artificial Sequence
  Description of Artificial Sequence: Synthetic oligonucleotide
  Target: SCN9A; (-) strand; PAM type: YTN; PAM sequence: CTG
atataggtcctaaacctatt

SEQ ID NO: 72670 - DNA, 20 bp, Artificial Sequence
  Description of Artificial Sequence: Synthetic oligonucleotide
  Target: SCN9A; (-) strand; PAM type: YTN; PAM sequence: CTC
cccaccctgatataggtcct

SEQ ID NO: 72671 - DNA, 20 bp, Artificial Sequence
  Description of Artificial Sequence: Synthetic oligonucleotide
  Target: SCN9A; (-) strand; PAM type: YTN; PAM sequence: CTC
tccccaccctgatataggtc

SEQ ID NO: 72672 - DNA, 20 bp, Artificial Sequence
  Description of Artificial Sequence: Synthetic oligonucleotide
  Target: SCN9A; (-) strand; PAM type: YTN; PAM sequence: CTA
ccccctctccccaccctgat

SEQ ID NO: 72673 - DNA, 20 bp, Artificial Sequence
  Description of Artificial Sequence: Synthetic oligonucleotide
  Target: SCN9A; (-) strand; PAM type: YTN; PAM sequence: CTC
taccccctctccccaccctg

SEQ ID NO: 72674 - DNA, 20 bp, Artificial Sequence
  Description of Artificial Sequence: Synthetic oligonucleotide
  Target: SCN9A; (-) strand; PAM type: YTN; PAM sequence: TTC
tctaccccctctccccaccc

SEQ ID NO: 72675 - DNA, 20 bp, Artificial Sequence
  Description of Artificial Sequence: Synthetic oligonucleotide
  Target: SCN9A; (-) strand; PAM type: YTN; PAM sequence: TTT
ctctaccccctctccccacc

SEQ ID NO: 72676 - DNA, 20 bp, Artificial Sequence
  Description of Artificial Sequence: Synthetic oligonucleotide
  Target: SCN9A; (-) strand; PAM type: YTN; PAM sequence: CTA
tttctctaccccctctcccc

SEQ ID NO: 72677 - DNA, 20 bp, Artificial Sequence
  Description of Artificial Sequence: Synthetic oligonucleotide
  Target: SCN9A; (-) strand; PAM type: YTN; PAM sequence: CTC
cctatttctctaccccctct

SEQ ID NO: 72678 - DNA, 20 bp, Artificial Sequence
  Description of Artificial Sequence: Synthetic oligonucleotide
  Target: SCN9A; (-) strand; PAM type: YTN; PAM sequence: CTG
tctccctatttctctacccc

SEQ ID NO: 72679 - DNA, 20 bp, Artificial Sequence
  Description of Artificial Sequence: Synthetic oligonucleotide
  Target: SCN9A; (-) strand; PAM type: YTN; PAM sequence: TTC
ctgtctccctatttctctac

SEQ ID NO: 72680 - DNA, 20 bp, Artificial Sequence
  Description of Artificial Sequence: Synthetic oligonucleotide
  Target: SCN9A; (-) strand; PAM type: YTN; PAM sequence: TTT
cctgtctccctatttctcta

SEQ ID NO: 72681 - DNA, 20 bp, Artificial Sequence
  Description of Artificial Sequence: Synthetic oligonucleotide
  Target: SCN9A; (-) strand; PAM type: YTN; PAM sequence: TTA
tatttcctgtctccctattt

SEQ ID NO: 72682 - DNA, 20 bp, Artificial Sequence
  Description of Artificial Sequence: Synthetic oligonucleotide
  Target: SCN9A; (-) strand; PAM type: YTN; PAM sequence: TTT
atatttcctgtctccctatt

SEQ ID NO: 72683 - DNA, 20 bp, Artificial Sequence
  Description of Artificial Sequence: Synthetic oligonucleotide
  Target: SCN9A; (-) strand; PAM type: YTN; PAM sequence: TTT
tatatttcctgtctccctat

SEQ ID NO: 72684 - DNA, 20 bp, Artificial Sequence
  Description of Artificial Sequence: Synthetic oligonucleotide
  Target: SCN9A; (-) strand; PAM type: YTN; PAM sequence: TTT
ttatatttcctgtctcccta

SEQ ID NO: 72685 - DNA, 20 bp, Artificial Sequence
  Description of Artificial Sequence: Synthetic oligonucleotide
  Target: SCN9A; (-) strand; PAM type: YTN; PAM sequence: TTT
tttatatttcctgtctccct

SEQ ID NO: 72686 - DNA, 20 bp, Artificial Sequence
  Description of Artificial Sequence: Synthetic oligonucleotide
  Target: SCN9A; (-) strand; PAM type: YTN; PAM sequence: TTA
ttttttatatttcctgtctc

SEQ ID NO: 72687 - DNA, 20 bp, Artificial Sequence
  Description of Artificial Sequence: Synthetic oligonucleotide
  Target: SCN9A; (-) strand; PAM type: YTN; PAM sequence: TTT
attttttatatttcctgtct

SEQ ID NO: 72688 - DNA, 20 bp, Artificial Sequence
  Description of Artificial Sequence: Synthetic oligonucleotide
  Target: SCN9A; (-) strand; PAM type: YTN; PAM sequence: TTT
tattttttatatttcctgtc

SEQ ID NO: 72689 - DNA, 20 bp, Artificial Sequence
  Description of Artificial Sequence: Synthetic oligonucleotide
  Target: SCN9A; (-) strand; PAM type: YTN; PAM sequence: TTA
ttttattttttatatttcct

SEQ ID NO: 72690 - DNA, 20 bp, Artificial Sequence
  Description of Artificial Sequence: Synthetic oligonucleotide
  Target: SCN9A; (-) strand; PAM type: YTN; PAM sequence: TTT
attttattttttatatttcc

SEQ ID NO: 72691 - DNA, 20 bp, Artificial Sequence
  Description of Artificial Sequence: Synthetic oligonucleotide
  Target: SCN9A; (-) strand; PAM type: YTN; PAM sequence: TTT
tattttattttttatatttc

SEQ ID NO: 72692 - DNA, 20 bp, Artificial Sequence
  Description of Artificial Sequence: Synthetic oligonucleotide
  Target: SCN9A; (-) strand; PAM type: YTN; PAM sequence: TTA
ttttattttattttttatat

SEQ ID NO: 72693 - DNA, 20 bp, Artificial Sequence
  Description of Artificial Sequence: Synthetic oligonucleotide
  Target: SCN9A; (-) strand; PAM type: YTN; PAM sequence: CTT
attttattttattttttata

SEQ ID NO: 72694 - DNA, 20 bp, Artificial Sequence
  Description of Artificial Sequence: Synthetic oligonucleotide
  Target: SCN9A; (-) strand; PAM type: YTN; PAM sequence: TTC
ggaaaagtgtacttatttta

SEQ ID NO: 72695 - DNA, 20 bp, Artificial Sequence
  Description of Artificial Sequence: Synthetic oligonucleotide
  Target: SCN9A; (-) strand; PAM type: YTN; PAM sequence: CTA
tattcggaaaagtgtactta

SEQ ID NO: 72696 - DNA, 20 bp, Artificial Sequence
  Description of Artificial Sequence: Synthetic oligonucleotide
  Target: SCN9A; (-) strand; PAM type: YTN; PAM sequence: TTG
tggcctatattcggaaaagt

SEQ ID NO: 72697 - DNA, 20 bp, Artificial Sequence
  Description of Artificial Sequence: Synthetic oligonucleotide
  Target: SCN9A; (-) strand; PAM type: YTN; PAM sequence: TTG
tattgtggcctatattcgga

SEQ ID NO: 72698 - DNA, 20 bp, Artificial Sequence
  Description of Artificial Sequence: Synthetic oligonucleotide
  Target: SCN9A; (-) strand; PAM type: YTN; PAM sequence: TTT
gtattgtggcctatattcgg

SEQ ID NO: 72699 - DNA, 20 bp, Artificial Sequence
  Description of Artificial Sequence: Synthetic oligonucleotide
  Target: SCN9A; (-) strand; PAM type: YTN; PAM sequence: CTG
gtttgtattgtggcctatat

SEQ ID NO: 72700 - DNA, 20 bp, Artificial Sequence
  Description of Artificial Sequence: Synthetic oligonucleotide
  Target: SCN9A; (-) strand; PAM type: YTN; PAM sequence: TTG
ctggtttgtattgtggccta

SEQ ID NO: 72701 - DNA, 20 bp, Artificial Sequence
  Description of Artificial Sequence: Synthetic oligonucleotide
  Target: SCN9A; (-) strand; PAM type: YTN; PAM sequence: TTC
gttgctggtttgtattgtgg

SEQ ID NO: 72702 - DNA, 20 bp, Artificial Sequence
  Description of Artificial Sequence: Synthetic oligonucleotide
  Target: SCN9A; (-) strand; PAM type: YTN; PAM sequence: CTT
cgttgctggtttgtattgtg

SEQ ID NO: 72703 - DNA, 20 bp, Artificial Sequence
  Description of Artificial Sequence: Synthetic oligonucleotide
  Target: SCN9A; (-) strand; PAM type: YTN; PAM sequence: TTA
tccgtgtgtgaaaaggtgca

SEQ ID NO: 72704 - DNA, 20 bp, Artificial Sequence
  Description of Artificial Sequence: Synthetic oligonucleotide
  Target: SCN9A; (-) strand; PAM type: YTN; PAM sequence: CTT
atccgtgtgtgaaaaggtgc

SEQ ID NO: 72705 - DNA, 20 bp, Artificial Sequence
  Description of Artificial Sequence: Synthetic oligonucleotide
  Target: SCN9A; (-) strand; PAM type: YTN; PAM sequence: CTC
atgtggtcttatccgtgtgt

SEQ ID NO: 72706 - DNA, 20 bp, Artificial Sequence
  Description of Artificial Sequence: Synthetic oligonucleotide
  Target: SCN9A; (-) strand; PAM type: YTN; PAM sequence: CTC
tcatgtggtcttatccgtgt

SEQ ID NO: 72707 - DNA, 20 bp, Artificial Sequence
  Description of Artificial Sequence: Synthetic oligonucleotide
  Target: SCN9A; (-) strand; PAM type: YTN; PAM sequence: CTC
tctcatgtggtcttatccgt

SEQ ID NO: 72708 - DNA, 20 bp, Artificial Sequence
  Description of Artificial Sequence: Synthetic oligonucleotide
  Target: SCN9A; (-) strand; PAM type: YTN; PAM sequence: CTG
tctctctcatgtggtcttat

SEQ ID NO: 72709 - DNA, 20 bp, Artificial Sequence
  Description of Artificial Sequence: Synthetic oligonucleotide
  Target: SCN9A; (-) strand; PAM type: YTN; PAM sequence: CTC
tgtctctctcatgtggtctt

SEQ ID NO: 72710 - DNA, 20 bp, Artificial Sequence
  Description of Artificial Sequence: Synthetic oligonucleotide
  Target: SCN9A; (-) strand; PAM type: YTN; PAM sequence: CTC
gcctctgtctctctcatgtg

SEQ ID NO: 72711 - DNA, 20 bp, Artificial Sequence
  Description of Artificial Sequence: Synthetic oligonucleotide
  Target: SCN9A; (-) strand; PAM type: YTN; PAM sequence: CTA
ccctcgcctctgtctctctc

SEQ ID NO: 72712 - DNA, 20 bp, Artificial Sequence
  Description of Artificial Sequence: Synthetic oligonucleotide
  Target: SCN9A; (-) strand; PAM type: YTN; PAM sequence: CTA
gggatacagtgatgaggagt

SEQ ID NO: 72713 - DNA, 20 bp, Artificial Sequence
  Description of Artificial Sequence: Synthetic oligonucleotide
  Target: SCN9A; (-) strand; PAM type: YTN; PAM sequence: CTA
gtctagggatacagtgatga

SEQ ID NO: 72714 - DNA, 20 bp, Artificial Sequence
  Description of Artificial Sequence: Synthetic oligonucleotide
  Target: SCN9A; (-) strand; PAM type: YTN; PAM sequence: CTG
caggggctagtctagggata

SEQ ID NO: 72715 - DNA, 20 bp, Artificial Sequence
  Description of Artificial Sequence: Synthetic oligonucleotide
  Target: SCN9A; (-) strand; PAM type: YTN; PAM sequence: CTG
agtctgcaggggctagtcta

SEQ ID NO: 72716 - DNA, 20 bp, Artificial Sequence
  Description of Artificial Sequence: Synthetic oligonucleotide
  Target: SCN9A; (-) strand; PAM type: YTN; PAM sequence: CTG
ctgagtctgcaggggctagt

SEQ ID NO: 72717 - DNA, 20 bp, Artificial Sequence
  Description of Artificial Sequence: Synthetic oligonucleotide
  Target: SCN9A; (-) strand; PAM type: YTN; PAM sequence: CTG
ctgctgagtctgcaggggct

SEQ ID NO: 72718 - DNA, 20 bp, Artificial Sequence
  Description of Artificial Sequence: Synthetic oligonucleotide
  Target: SCN9A; (-) strand; PAM type: YTN; PAM sequence: CTC
tgctgctgagtctgcagggg

SEQ ID NO: 72719 - DNA, 20 bp, Artificial Sequence
  Description of Artificial Sequence: Synthetic oligonucleotide
  Target: SCN9A; (-) strand; PAM type: YTN; PAM sequence: CTG
accctctgctgctgagtctg

SEQ ID NO: 72720 - DNA, 20 bp, Artificial Sequence
  Description of Artificial Sequence: Synthetic oligonucleotide
  Target: SCN9A; (-) strand; PAM type: YTN; PAM sequence: CTG
ggtatggctgaccctctgct

SEQ ID NO: 72721 - DNA, 20 bp, Artificial Sequence
  Description of Artificial Sequence: Synthetic oligonucleotide
  Target: SCN9A; (-) strand; PAM type: YTN; PAM sequence: TTC
ctgggtatggctgaccctct

SEQ ID NO: 72722 - DNA, 20 bp, Artificial Sequence
  Description of Artificial Sequence: Synthetic oligonucleotide
  Target: SCN9A; (-) strand; PAM type: YTN; PAM sequence: CTT
cctgggtatggctgaccctc

SEQ ID NO: 72723 - DNA, 20 bp, Artificial Sequence
  Description of Artificial Sequence: Synthetic oligonucleotide
  Target: SCN9A; (-) strand; PAM type: YTN; PAM sequence: TTC
ttcctgggtatggctgaccc

SEQ ID NO: 72724 - DNA, 20 bp, Artificial Sequence
  Description of Artificial Sequence: Synthetic oligonucleotide
  Target: SCN9A; (-) strand; PAM type: YTN; PAM sequence: CTC
cccatggtaattcttcctgg

SEQ ID NO: 72725 - DNA, 20 bp, Artificial Sequence
  Description of Artificial Sequence: Synthetic oligonucleotide
  Target: SCN9A; (-) strand; PAM type: YTN; PAM sequence: CTG
ctccccatggtaattcttcc

SEQ ID NO: 72726 - DNA, 20 bp, Artificial Sequence
  Description of Artificial Sequence: Synthetic oligonucleotide
  Target: SCN9A; (-) strand; PAM type: YTN; PAM sequence: CTC
tgctccccatggtaattctt

SEQ ID NO: 72727 - DNA, 20 bp, Artificial Sequence
  Description of Artificial Sequence: Synthetic oligonucleotide
  Target: SCN9A; (-) strand; PAM type: YTN; PAM sequence: CTC
tctgctccccatggtaattc

SEQ ID NO: 72728 - DNA, 20 bp, Artificial Sequence
  Description of Artificial Sequence: Synthetic oligonucleotide
  Target: SCN9A; (-) strand; PAM type: YTN; PAM sequence: TTC
tctctgctccccatggtaat

SEQ ID NO: 72729 - DNA, 20 bp, Artificial Sequence
  Description of Artificial Sequence: Synthetic oligonucleotide
  Target: SCN9A; (-) strand; PAM type: YTN; PAM sequence: TTA
gaaatgatgtaatgataatg

SEQ ID NO: 72730 - DNA, 20 bp, Artificial Sequence
  Description of Artificial Sequence: Synthetic oligonucleotide
  Target: SCN9A; (-) strand; PAM type: YTN; PAM sequence: CTT
agaaatgatgtaatgataat

SEQ ID NO: 72731 - DNA, 20 bp, Artificial Sequence
  Description of Artificial Sequence: Synthetic oligonucleotide
  Target: SCN9A; (-) strand; PAM type: YTN; PAM sequence: CTA
cagaaatgaacttagaaatg

SEQ ID NO: 72732 - DNA, 20 bp, Artificial Sequence
  Description of Artificial Sequence: Synthetic oligonucleotide
  Target: SCN9A; (-) strand; PAM type: YTN; PAM sequence: CTG
ctacagaaatgaacttagaa

SEQ ID NO: 72733 - DNA, 20 bp, Artificial Sequence
  Description of Artificial Sequence: Synthetic oligonucleotide
  Target: SCN9A; (-) strand; PAM type: YTN; PAM sequence: CTA
ctgctacagaaatgaactta

SEQ ID NO: 72734 - DNA, 20 bp, Artificial Sequence
  Description of Artificial Sequence: Synthetic oligonucleotide
  Target: SCN9A; (-) strand; PAM type: YTN; PAM sequence: TTA
aggcactactgctacagaaa

SEQ ID NO: 72735 - DNA, 20 bp, Artificial Sequence
  Description of Artificial Sequence: Synthetic oligonucleotide
  Target: SCN9A; (-) strand; PAM type: YTN; PAM sequence: TTG
attaaggcactactgctaca

SEQ ID NO: 72736 - DNA, 20 bp, Artificial Sequence
  Description of Artificial Sequence: Synthetic oligonucleotide
  Target: SCN9A; (-) strand; PAM type: YTN; PAM sequence: CTT
gattaaggcactactgctac

SEQ ID NO: 72737 - DNA, 20 bp, Artificial Sequence
  Description of Artificial Sequence: Synthetic oligonucleotide
  Target: SCN9A; (-) strand; PAM type: YTN; PAM sequence: TTC
ataaaagagaacttgattaa

SEQ ID NO: 72738 - DNA, 20 bp, Artificial Sequence
  Description of Artificial Sequence: Synthetic oligonucleotide
  Target: SCN9A; (-) strand; PAM type: YTN; PAM sequence: TTG
ggttcataaaagagaacttg

SEQ ID NO: 72739 - DNA, 20 bp, Artificial Sequence
  Description of Artificial Sequence: Synthetic oligonucleotide
  Target: SCN9A; (-) strand; PAM type: YTN; PAM sequence: TTT
gggttcataaaagagaactt

SEQ ID NO: 72740 - DNA, 20 bp, Artificial Sequence
  Description of Artificial Sequence: Synthetic oligonucleotide
  Target: SCN9A; (-) strand; PAM type: YTN; PAM sequence: TTT
tgggttcataaaagagaact

SEQ ID NO: 72741 - DNA, 20 bp, Artificial Sequence
  Description of Artificial Sequence: Synthetic oligonucleotide
  Target: SCN9A; (-) strand; PAM type: YTN; PAM sequence: TTT
ttgggttcataaaagagaac

SEQ ID NO: 72742 - DNA, 20 bp, Artificial Sequence
  Description of Artificial Sequence: Synthetic oligonucleotide
  Target: SCN9A; (-) strand; PAM type: YTN; PAM sequence: TTT
tttgggttcataaaagagaa

SEQ ID NO: 72743 - DNA, 20 bp, Artificial Sequence
  Description of Artificial Sequence: Synthetic oligonucleotide
  Target: SCN9A; (-) strand; PAM type: YTN; PAM sequence: CTA
ggagagttttttgggttcat

SEQ ID NO: 72744 - DNA, 20 bp, Artificial Sequence
  Description of Artificial Sequence: Synthetic oligonucleotide
  Target: SCN9A; (-) strand; PAM type: YTN; PAM sequence: CTC
acaggtaataaagagtaatg

SEQ ID NO: 72745 - DNA, 20 bp, Artificial Sequence
  Description of Artificial Sequence: Synthetic oligonucleotide
  Target: SCN9A; (-) strand; PAM type: YTN; PAM sequence: TTC
tcacaggtaataaagagtaa

SEQ ID NO: 72746 - DNA, 20 bp, Artificial Sequence
  Description of Artificial Sequence: Synthetic oligonucleotide
  Target: SCN9A; (-) strand; PAM type: YTN; PAM sequence: TTT
ctcacaggtaataaagagta

SEQ ID NO: 72747 - DNA, 20 bp, Artificial Sequence
  Description of Artificial Sequence: Synthetic oligonucleotide
  Target: SCN9A; (-) strand; PAM type: YTN; PAM sequence: CTG
tttctcacaggtaataaaga

SEQ ID NO: 72748 - DNA, 20 bp, Artificial Sequence
  Description of Artificial Sequence: Synthetic oligonucleotide
  Target: SCN9A; (-) strand; PAM type: YTN; PAM sequence: CTA
cctgtttctcacaggtaata

SEQ ID NO: 72749 - DNA, 20 bp, Artificial Sequence
  Description of Artificial Sequence: Synthetic oligonucleotide
  Target: SCN9A; (-) strand; PAM type: YTN; PAM sequence: TTC
tacctgtttctcacaggtaa

SEQ ID NO: 72750 - DNA, 20 bp, Artificial Sequence
  Description of Artificial Sequence: Synthetic oligonucleotide
  Target: SCN9A; (-) strand; PAM type: YTN; PAM sequence: TTG
ttctacctgtttctcacagg

SEQ ID NO: 72751 - DNA, 20 bp, Artificial Sequence
  Description of Artificial Sequence: Synthetic oligonucleotide
  Target: SCN9A; (-) strand; PAM type: YTN; PAM sequence: TTT
gttctacctgtttctcacag

SEQ ID NO: 72752 - DNA, 20 bp, Artificial Sequence
  Description of Artificial Sequence: Synthetic oligonucleotide
  Target: SCN9A; (-) strand; PAM type: YTN; PAM sequence: TTT
tgttctacctgtttctcaca

SEQ ID NO: 72753 - DNA, 20 bp, Artificial Sequence
  Description of Artificial Sequence: Synthetic oligonucleotide
  Target: SCN9A; (-) strand; PAM type: YTN; PAM sequence: TTG
ttttgttctacctgtttctc

SEQ ID NO: 72754 - DNA, 20 bp, Artificial Sequence
  Description of Artificial Sequence: Synthetic oligonucleotide
  Target: SCN9A; (-) strand; PAM type: YTN; PAM sequence: TTA
gcacaatagaaaatagtcac

SEQ ID NO: 72755 - DNA, 20 bp, Artificial Sequence
  Description of Artificial Sequence: Synthetic oligonucleotide
  Target: SCN9A; (-) strand; PAM type: YTN; PAM sequence: TTT
agcacaatagaaaatagtca

SEQ ID NO: 72756 - DNA, 20 bp, Artificial Sequence
  Description of Artificial Sequence: Synthetic oligonucleotide
  Target: SCN9A; (-) strand; PAM type: YTN; PAM sequence: CTT
tagcacaatagaaaatagtc

SEQ ID NO: 72757 - DNA, 20 bp, Artificial Sequence
  Description of Artificial Sequence: Synthetic oligonucleotide
  Target: SCN9A; (-) strand; PAM type: YTN; PAM sequence: CTG
gtaaagtgaacaaagatctt

SEQ ID NO: 72758 - DNA, 20 bp, Artificial Sequence
  Description of Artificial Sequence: Synthetic oligonucleotide
  Target: SCN9A; (-) strand; PAM type: YTN; PAM sequence: TTC
tggtaaagtgaacaaagatc

SEQ ID NO: 72759 - DNA, 20 bp, Artificial Sequence
  Description of Artificial Sequence: Synthetic oligonucleotide
  Target: SCN9A; (-) strand; PAM type: YTN; PAM sequence: CTT
ctggtaaagtgaacaaagat

SEQ ID NO: 72760 - DNA, 20 bp, Artificial Sequence
  Description of Artificial Sequence: Synthetic oligonucleotide
  Target: SCN9A; (-) strand; PAM type: YTN; PAM sequence: TTA
tcttctggtaaagtgaacaa

SEQ ID NO: 72761 - DNA, 20 bp, Artificial Sequence
  Description of Artificial Sequence: Synthetic oligonucleotide
  Target: SCN9A; (-) strand; PAM type: YTN; PAM sequence: TTT
atcttctggtaaagtgaaca

SEQ ID NO: 72762 - DNA, 20 bp, Artificial Sequence
  Description of Artificial Sequence: Synthetic oligonucleotide
  Target: SCN9A; (-) strand; PAM type: YTN; PAM sequence: TTA
gaacaagtgacatttatctt

SEQ ID NO: 72763 - DNA, 20 bp, Artificial Sequence
  Description of Artificial Sequence: Synthetic oligonucleotide
  Target: SCN9A; (-) strand; PAM type: YTN; PAM sequence: TTG
ttagaacaagtgacatttat

SEQ ID NO: 72764 - DNA, 20 bp, Artificial Sequence
  Description of Artificial Sequence: Synthetic oligonucleotide
  Target: SCN9A; (-) strand; PAM type: YTN; PAM sequence: TTT
gttagaacaagtgacattta

SEQ ID NO: 72765 - DNA, 20 bp, Artificial Sequence
  Description of Artificial Sequence: Synthetic oligonucleotide
  Target: SCN9A; (-) strand; PAM type: YTN; PAM sequence: TTC
catttgttagaacaagtgac

SEQ ID NO: 72766 - DNA, 20 bp, Artificial Sequence
  Description of Artificial Sequence: Synthetic oligonucleotide
  Target: SCN9A; (-) strand; PAM type: YTN; PAM sequence: TTA
tgtgttccatttgttagaac

SEQ ID NO: 72767 - DNA, 20 bp, Artificial Sequence
  Description of Artificial Sequence: Synthetic oligonucleotide
  Target: SCN9A; (-) strand; PAM type: YTN; PAM sequence: TTG
taagtattatgtgttccatt

SEQ ID NO: 72768 - DNA, 20 bp, Artificial Sequence
  Description of Artificial Sequence: Synthetic oligonucleotide
  Target: SCN9A; (-) strand; PAM type: YTN; PAM sequence: TTT
gtaagtattatgtgttccat

SEQ ID NO: 72769 - DNA, 20 bp, Artificial Sequence
  Description of Artificial Sequence: Synthetic oligonucleotide
  Target: SCN9A; (-) strand; PAM type: YTN; PAM sequence: CTT
tgtaagtattatgtgttcca

SEQ ID NO: 72770 - DNA, 20 bp, Artificial Sequence
  Description of Artificial Sequence: Synthetic oligonucleotide
  Target: SCN9A; (-) strand; PAM type: YTN; PAM sequence: TTA
caggaactttgtaagtatta

SEQ ID NO: 72771 - DNA, 20 bp, Artificial Sequence
  Description of Artificial Sequence: Synthetic oligonucleotide
  Target: SCN9A; (-) strand; PAM type: YTN; PAM sequence: TTA
ttacaggaactttgtaagta

SEQ ID NO: 72772 - DNA, 20 bp, Artificial Sequence
  Description of Artificial Sequence: Synthetic oligonucleotide
  Target: SCN9A; (-) strand; PAM type: YTN; PAM sequence: TTT
attacaggaactttgtaagt

SEQ ID NO: 72773 - DNA, 20 bp, Artificial Sequence
  Description of Artificial Sequence: Synthetic oligonucleotide
  Target: SCN9A; (-) strand; PAM type: YTN; PAM sequence: TTT
tattacaggaactttgtaag

SEQ ID NO: 72774 - DNA, 20 bp, Artificial Sequence
  Description of Artificial Sequence: Synthetic oligonucleotide
  Target: SCN9A; (-) strand; PAM type: YTN; PAM sequence: TTG
gacagaatattttattacag

SEQ ID NO: 72775 - DNA, 20 bp, Artificial Sequence
  Description of Artificial Sequence: Synthetic oligonucleotide
  Target: SCN9A; (-) strand; PAM type: YTN; PAM sequence: CTT
ggacagaatattttattaca

SEQ ID NO: 72776 - DNA, 20 bp, Artificial Sequence
  Description of Artificial Sequence: Synthetic oligonucleotide
  Target: SCN9A; (-) strand; PAM type: YTN; PAM sequence: TTC
ttggacagaatattttatta

SEQ ID NO: 72777 - DNA, 20 bp, Artificial Sequence
  Description of Artificial Sequence: Synthetic oligonucleotide
  Target: SCN9A; (-) strand; PAM type: YTN; PAM sequence: CTT
cttggacagaatattttatt

SEQ ID NO: 72778 - DNA, 20 bp, Artificial Sequence
  Description of Artificial Sequence: Synthetic oligonucleotide
  Target: SCN9A; (-) strand; PAM type: YTN; PAM sequence: CTA
gcacgcttcttggacagaat

SEQ ID NO: 72779 - DNA, 20 bp, Artificial Sequence
  Description of Artificial Sequence: Synthetic oligonucleotide
  Target: SCN9A; (-) strand; PAM type: YTN; PAM sequence: TTC
tagcacgcttcttggacaga

SEQ ID NO: 72780 - DNA, 20 bp, Artificial Sequence
  Description of Artificial Sequence: Synthetic oligonucleotide
  Target: SCN9A; (-) strand; PAM type: YTN; PAM sequence: TTA
agcagtattctagcacgctt

SEQ ID NO: 72781 - DNA, 20 bp, Artificial Sequence
  Description of Artificial Sequence: Synthetic oligonucleotide
  Target: SCN9A; (-) strand; PAM type: YTN; PAM sequence: TTA
aaagtcacattaagcagtat

SEQ ID NO: 72782 - DNA, 20 bp, Artificial Sequence
  Description of Artificial Sequence: Synthetic oligonucleotide
  Target: SCN9A; (-) strand; PAM type: YTN; PAM sequence: TTT
aaaagtcacattaagcagta

SEQ ID NO: 72783 - DNA, 20 bp, Artificial Sequence
  Description of Artificial Sequence: Synthetic oligonucleotide
  Target: SCN9A; (-) strand; PAM type: YTN; PAM sequence: CTT
taaaagtcacattaagcagt

SEQ ID NO: 72784 - DNA, 20 bp, Artificial Sequence
  Description of Artificial Sequence: Synthetic oligonucleotide
  Target: SCN9A; (-) strand; PAM type: YTN; PAM sequence: CTG
tgctttaaaagtcacattaa

SEQ ID NO: 72785 - DNA, 20 bp, Artificial Sequence
  Description of Artificial Sequence: Synthetic oligonucleotide
  Target: SCN9A; (-) strand; PAM type: YTN; PAM sequence: TTC
tgtgctttaaaagtcacatt

SEQ ID NO: 72786 - DNA, 20 bp, Artificial Sequence
  Description of Artificial Sequence: Synthetic oligonucleotide
  Target: SCN9A; (-) strand; PAM type: YTN; PAM sequence: TTT
ctgtgctttaaaagtcacat

SEQ ID NO: 72787 - DNA, 20 bp, Artificial Sequence
  Description of Artificial Sequence: Synthetic oligonucleotide
  Target: SCN9A; (-) strand; PAM type: YTN; PAM sequence: TTT
tctgtgctttaaaagtcaca

SEQ ID NO: 72788 - DNA, 20 bp, Artificial Sequence
  Description of Artificial Sequence: Synthetic oligonucleotide
  Target: SCN9A; (-) strand; PAM type: YTN; PAM sequence: CTT
ttctgtgctttaaaagtcac

SEQ ID NO: 72789 - DNA, 20 bp, Artificial Sequence
  Description of Artificial Sequence: Synthetic oligonucleotide
  Target: SCN9A; (-) strand; PAM type: YTN; PAM sequence: TTC
aaggggcaggtccttttctg

SEQ ID NO: 72790 - DNA, 20 bp, Artificial Sequence
  Description of Artificial Sequence: Synthetic oligonucleotide
  Target: SCN9A; (-) strand; PAM type: YTN; PAM sequence: TTG
catgtgaatcaggttcaagg

SEQ ID NO: 72791 - DNA, 20 bp, Artificial Sequence
  Description of Artificial Sequence: Synthetic oligonucleotide
  Target: SCN9A; (-) strand; PAM type: YTN; PAM sequence: TTA
ttgcatgtgaatcaggttca

SEQ ID NO: 72792 - DNA, 20 bp, Artificial Sequence
  Description of Artificial Sequence: Synthetic oligonucleotide
  Target: SCN9A; (-) strand; PAM type: YTN; PAM sequence: CTA
gggcaaacataataggcaat

SEQ ID NO: 72793 - DNA, 20 bp, Artificial Sequence
  Description of Artificial Sequence: Synthetic oligonucleotide
  Target: SCN9A; (-) strand; PAM type: YTN; PAM sequence: TTC
tagggcaaacataataggca

SEQ ID NO: 72794 - DNA, 20 bp, Artificial Sequence
  Description of Artificial Sequence: Synthetic oligonucleotide
  Target: SCN9A; (-) strand; PAM type: YTN; PAM sequence: CTT
ctagggcaaacataataggc

SEQ ID NO: 72795 - DNA, 20 bp, Artificial Sequence
  Description of Artificial Sequence: Synthetic oligonucleotide
  Target: SCN9A; (-) strand; PAM type: YTN; PAM sequence: CTC
ttctagggcaaacataatag

SEQ ID NO: 72796 - DNA, 20 bp, Artificial Sequence
  Description of Artificial Sequence: Synthetic oligonucleotide
  Target: SCN9A; (-) strand; PAM type: YTN; PAM sequence: TTG
taatctcttctagggcaaac

SEQ ID NO: 72797 - DNA, 20 bp, Artificial Sequence
  Description of Artificial Sequence: Synthetic oligonucleotide
  Target: SCN9A; (-) strand; PAM type: YTN; PAM sequence: TTT
gtaatctcttctagggcaaa

SEQ ID NO: 72798 - DNA, 20 bp, Artificial Sequence
  Description of Artificial Sequence: Synthetic oligonucleotide
  Target: SCN9A; (-) strand; PAM type: YTN; PAM sequence: TTT
tgtaatctcttctagggcaa

SEQ ID NO: 72799 - DNA, 20 bp, Artificial Sequence
  Description of Artificial Sequence: Synthetic oligonucleotide
  Target: SCN9A; (-) strand; PAM type: YTN; PAM sequence: TTT
ttgtaatctcttctagggca

SEQ ID NO: 72800 - DNA, 20 bp, Artificial Sequence
  Description of Artificial Sequence: Synthetic oligonucleotide
  Target: SCN9A; (-) strand; PAM type: YTN; PAM sequence: TTT
tttgtaatctcttctagggc

SEQ ID NO: 72801 - DNA, 20 bp, Artificial Sequence
  Description of Artificial Sequence: Synthetic oligonucleotide
  Target: SCN9A; (-) strand; PAM type: YTN; PAM sequence: CTT
ttttgtaatctcttctaggg

SEQ ID NO: 72802 - DNA, 20 bp, Artificial Sequence
  Description of Artificial Sequence: Synthetic oligonucleotide
  Target: SCN9A; (-) strand; PAM type: YTN; PAM sequence: CTG
accttttttgtaatctcttc

SEQ ID NO: 72803 - DNA, 20 bp, Artificial Sequence
  Description of Artificial Sequence: Synthetic oligonucleotide
  Target: SCN9A; (-) strand; PAM type: YTN; PAM sequence: TTG
tcctgaccttttttgtaatc

SEQ ID NO: 72804 - DNA, 20 bp, Artificial Sequence
  Description of Artificial Sequence: Synthetic oligonucleotide
  Target: SCN9A; (-) strand; PAM type: YTN; PAM sequence: TTC
aagagaatagaaattgtcct

SEQ ID NO: 72805 - DNA, 20 bp, Artificial Sequence
  Description of Artificial Sequence: Synthetic oligonucleotide
  Target: SCN9A; (-) strand; PAM type: YTN; PAM sequence: CTT
caagagaatagaaattgtcc

SEQ ID NO: 72806 - DNA, 20 bp, Artificial Sequence
  Description of Artificial Sequence: Synthetic oligonucleotide
  Target: SCN9A; (-) strand; PAM type: YTN; PAM sequence: TTG
cttcaagagaatagaaattg

SEQ ID NO: 72807 - DNA, 20 bp, Artificial Sequence
  Description of Artificial Sequence: Synthetic oligonucleotide
  Target: SCN9A; (-) strand; PAM type: YTN; PAM sequence: TTT
gcttcaagagaatagaaatt

SEQ ID NO: 72808 - DNA, 20 bp, Artificial Sequence
  Description of Artificial Sequence: Synthetic oligonucleotide
  Target: SCN9A; (-) strand; PAM type: YTN; PAM sequence: CTT
tgcttcaagagaatagaaat

SEQ ID NO: 72809 - DNA, 20 bp, Artificial Sequence
  Description of Artificial Sequence: Synthetic oligonucleotide
  Target: SCN9A; (-) strand; PAM type: YTN; PAM sequence: CTC
agaaataaaactttgcttca

SEQ ID NO: 72810 - DNA, 20 bp, Artificial Sequence
  Description of Artificial Sequence: Synthetic oligonucleotide
  Target: SCN9A; (-) strand; PAM type: YTN; PAM sequence: TTA
actcagaaataaaactttgc

SEQ ID NO: 72811 - DNA, 20 bp, Artificial Sequence
  Description of Artificial Sequence: Synthetic oligonucleotide
  Target: SCN9A; (-) strand; PAM type: YTN; PAM sequence: TTC
agtgagaaaaaaaaataatt

SEQ ID NO: 72812 - DNA, 20 bp, Artificial Sequence
  Description of Artificial Sequence: Synthetic oligonucleotide
  Target: SCN9A; (-) strand; PAM type: YTN; PAM sequence: CTT
cagtgagaaaaaaaaataat

SEQ ID NO: 72813 - DNA, 20 bp, Artificial Sequence
  Description of Artificial Sequence: Synthetic oligonucleotide
  Target: SCN9A; (-) strand; PAM type: YTN; PAM sequence: CTA
cttcagtgagaaaaaaaaat

SEQ ID NO: 72814 - DNA, 20 bp, Artificial Sequence
  Description of Artificial Sequence: Synthetic oligonucleotide
  Target: SCN9A; (-) strand; PAM type: YTN; PAM sequence: TTC
tacttcagtgagaaaaaaaa

SEQ ID NO: 72815 - DNA, 20 bp, Artificial Sequence
  Description of Artificial Sequence: Synthetic oligonucleotide
  Target: SCN9A; (-) strand; PAM type: YTN; PAM sequence: CTT
ctacttcagtgagaaaaaaa

SEQ ID NO: 72816 - DNA, 20 bp, Artificial Sequence
  Description of Artificial Sequence: Synthetic oligonucleotide
  Target: SCN9A; (-) strand; PAM type: YTN; PAM sequence: CTG
cacttctacttcagtgagaa

SEQ ID NO: 72817 - DNA, 20 bp, Artificial Sequence
  Description of Artificial Sequence: Synthetic oligonucleotide
  Target: SCN9A; (-) strand; PAM type: YTN; PAM sequence: TTG
acctgcacttctacttcagt

SEQ ID NO: 72818 - DNA, 20 bp, Artificial Sequence
  Description of Artificial Sequence: Synthetic oligonucleotide
  Target: SCN9A; (-) strand; PAM type: YTN; PAM sequence: TTA
caatgtggagttgacctgca

SEQ ID NO: 72819 - DNA, 20 bp, Artificial Sequence
  Description of Artificial Sequence: Synthetic oligonucleotide
  Target: SCN9A; (-) strand; PAM type: YTN; PAM sequence: TTT
acaatgtggagttgacctgc

SEQ ID NO: 72820 - DNA, 20 bp, Artificial Sequence
  Description of Artificial Sequence: Synthetic oligonucleotide
  Target: SCN9A; (-) strand; PAM type: YTN; PAM sequence: TTT
tacaatgtggagttgacctg

SEQ ID NO: 72821 - DNA, 20 bp, Artificial Sequence
  Description of Artificial Sequence: Synthetic oligonucleotide
  Target: SCN9A; (-) strand; PAM type: YTN; PAM sequence: TTT
ttacaatgtggagttgacct

SEQ ID NO: 72822 - DNA, 20 bp, Artificial Sequence
  Description of Artificial Sequence: Synthetic oligonucleotide
  Target: SCN9A; (-) strand; PAM type: YTN; PAM sequence: TTT
tttacaatgtggagttgacc

SEQ ID NO: 72823 - DNA, 20 bp, Artificial Sequence
  Description of Artificial Sequence: Synthetic oligonucleotide
  Target: SCN9A; (-) strand; PAM type: YTN; PAM sequence: TTT
ttttacaatgtggagttgac

SEQ ID NO: 72824 - DNA, 20 bp, Artificial Sequence
  Description of Artificial Sequence: Synthetic oligonucleotide
  Target: SCN9A; (-) strand; PAM type: YTN; PAM sequence: TTT
tttttacaatgtggagttga

SEQ ID NO: 72825 - DNA, 20 bp, Artificial Sequence
  Description of Artificial Sequence: Synthetic oligonucleotide
  Target: SCN9A; (-) strand; PAM type: YTN; PAM sequence: TTT
ttttttacaatgtggagttg

SEQ ID NO: 72826 - DNA, 20 bp, Artificial Sequence
  Description of Artificial Sequence: Synthetic oligonucleotide
  Target: SCN9A; (-) strand; PAM type: YTN; PAM sequence: TTT
tttttttacaatgtggagtt

SEQ ID NO: 72827 - DNA, 20 bp, Artificial Sequence
  Description of Artificial Sequence: Synthetic oligonucleotide
  Target: SCN9A; (-) strand; PAM type: YTN; PAM sequence: TTT
ttttttttacaatgtggagt

SEQ ID NO: 72828 - DNA, 20 bp, Artificial Sequence
  Description of Artificial Sequence: Synthetic oligonucleotide
  Target: SCN9A; (-) strand; PAM type: YTN; PAM sequence: TTT
tttttttttacaatgtggag

SEQ ID NO: 72829 - DNA, 20 bp, Artificial Sequence
  Description of Artificial Sequence: Synthetic oligonucleotide
  Target: SCN9A; (-) strand; PAM type: YTN; PAM sequence: CTG
tgaacattttttttttttac

SEQ ID NO: 72830 - DNA, 20 bp, Artificial Sequence
  Description of Artificial Sequence: Synthetic oligonucleotide
  Target: SCN9A; (-) strand; PAM type: YTN; PAM sequence: CTC
tgtgaacatttttttttttt

SEQ ID NO: 72831 - DNA, 20 bp, Artificial Sequence
  Description of Artificial Sequence: Synthetic oligonucleotide
  Target: SCN9A; (-) strand; PAM type: YTN; PAM sequence: CTG
ccctctgtgaacattttttt

SEQ ID NO: 72832 - DNA, 20 bp, Artificial Sequence
  Description of Artificial Sequence: Synthetic oligonucleotide
  Target: SCN9A; (-) strand; PAM type: YTN; PAM sequence: TTC
ctgccctctgtgaacatttt

SEQ ID NO: 72833 - DNA, 20 bp, Artificial Sequence
  Description of Artificial Sequence: Synthetic oligonucleotide
  Target: SCN9A; (-) strand; PAM type: YTN; PAM sequence: TTT
cctgccctctgtgaacattt

SEQ ID NO: 72834 - DNA, 20 bp, Artificial Sequence
  Description of Artificial Sequence: Synthetic oligonucleotide
  Target: SCN9A; (-) strand; PAM type: YTN; PAM sequence: TTA
catgtttcctgccctctgtg

SEQ ID NO: 72835 - DNA, 20 bp, Artificial Sequence
  Description of Artificial Sequence: Synthetic oligonucleotide
  Target: SCN9A; (-) strand; PAM type: YTN; PAM sequence: TTT
acatgtttcctgccctctgt

SEQ ID NO: 72836 - DNA, 20 bp, Artificial Sequence
  Description of Artificial Sequence: Synthetic oligonucleotide
  Target: SCN9A; (-) strand; PAM type: YTN; PAM sequence: TTA
caatttacatgtttcctgcc

SEQ ID NO: 72837 - DNA, 20 bp, Artificial Sequence
  Description of Artificial Sequence: Synthetic oligonucleotide
  Target: SCN9A; (-) strand; PAM type: YTN; PAM sequence: TTT
acaatttacatgtttcctgc

SEQ ID NO: 72838 - DNA, 20 bp, Artificial Sequence
  Description of Artificial Sequence: Synthetic oligonucleotide
  Target: SCN9A; (-) strand; PAM type: YTN; PAM sequence: TTA
aatataatttacaatttaca

SEQ ID NO: 72839 - DNA, 20 bp, Artificial Sequence
  Description of Artificial Sequence: Synthetic oligonucleotide
  Target: SCN9A; (-) strand; PAM type: YTN; PAM sequence: TTT
aaatataatttacaatttac

SEQ ID NO: 72840 - DNA, 20 bp, Artificial Sequence
  Description of Artificial Sequence: Synthetic oligonucleotide
  Target: SCN9A; (-) strand; PAM type: YTN; PAM sequence: CTG
gataaaacaatgtttaaata

SEQ ID NO: 72841 - DNA, 20 bp, Artificial Sequence
  Description of Artificial Sequence: Synthetic oligonucleotide
  Target: SCN9A; (-) strand; PAM type: YTN; PAM sequence: TTC
ctggataaaacaatgtttaa

SEQ ID NO: 72842 - DNA, 20 bp, Artificial Sequence
  Description of Artificial Sequence: Synthetic oligonucleotide
  Target: SCN9A; (-) strand; PAM type: YTN; PAM sequence: TTT
cctggataaaacaatgttta

SEQ ID NO: 72843 - DNA, 20 bp, Artificial Sequence
  Description of Artificial Sequence: Synthetic oligonucleotide
  Target: SCN9A; (-) strand; PAM type: YTN; PAM sequence: TTG
tttcctggataaaacaatgt

SEQ ID NO: 72844 - DNA, 20 bp, Artificial Sequence
  Description of Artificial Sequence: Synthetic oligonucleotide
  Target: SCN9A; (-) strand; PAM type: YTN; PAM sequence: TTT
gtttcctggataaaacaatg

SEQ ID NO: 72845 - DNA, 20 bp, Artificial Sequence
  Description of Artificial Sequence: Synthetic oligonucleotide
  Target: SCN9A; (-) strand; PAM type: YTN; PAM sequence: TTT
tgtttcctggataaaacaat

SEQ ID NO: 72846 - DNA, 20 bp, Artificial Sequence
  Description of Artificial Sequence: Synthetic oligonucleotide
  Target: SCN9A; (-) strand; PAM type: YTN; PAM sequence: TTT
ttgtttcctggataaaacaa

SEQ ID NO: 72847 - DNA, 20 bp, Artificial Sequence
  Description of Artificial Sequence: Synthetic oligonucleotide
  Target: SCN9A; (-) strand; PAM type: YTN; PAM sequence: TTT
tttgtttcctggataaaaca

SEQ ID NO: 72848 - DNA, 20 bp, Artificial Sequence
  Description of Artificial Sequence: Synthetic oligonucleotide
  Target: SCN9A; (-) strand; PAM type: YTN; PAM sequence: CTT
ttttgtttcctggataaaac

SEQ ID NO: 72849 - DNA, 20 bp, Artificial Sequence
  Description of Artificial Sequence: Synthetic oligonucleotide
  Target: SCN9A; (-) strand; PAM type: YTN; PAM sequence: TTC
cttttttgtttcctggataa

SEQ ID NO: 72850 - DNA, 20 bp, Artificial Sequence
  Description of Artificial Sequence: Synthetic oligonucleotide
  Target: SCN9A; (-) strand; PAM type: YTN; PAM sequence: TTT
ccttttttgtttcctggata

SEQ ID NO: 72851 - DNA, 20 bp, Artificial Sequence
  Description of Artificial Sequence: Synthetic oligonucleotide
  Target: SCN9A; (-) strand; PAM type: YTN; PAM sequence: TTC
aatttccttttttgtttcct

SEQ ID NO: 72852 - DNA, 20 bp, Artificial Sequence
  Description of Artificial Sequence: Synthetic oligonucleotide
  Target: SCN9A; (-) strand; PAM type: YTN; PAM sequence: TTA
catcaaatgccaattcaatt

SEQ ID NO: 72853 - DNA, 20 bp, Artificial Sequence
  Description of Artificial Sequence: Synthetic oligonucleotide
  Target: SCN9A; (-) strand; PAM type: YTN; PAM sequence: CTT
acatcaaatgccaattcaat

SEQ ID NO: 72854 - DNA, 20 bp, Artificial Sequence
  Description of Artificial Sequence: Synthetic oligonucleotide
  Target: SCN9A; (-) strand; PAM type: YTN; PAM sequence: TTG
ggccatgaaaagacttacat

SEQ ID NO: 72855 - DNA, 20 bp, Artificial Sequence
  Description of Artificial Sequence: Synthetic oligonucleotide
  Target: SCN9A; (-) strand; PAM type: YTN; PAM sequence: TTT
gggccatgaaaagacttaca

SEQ ID NO: 72856 - DNA, 20 bp, Artificial Sequence
  Description of Artificial Sequence: Synthetic oligonucleotide
  Target: SCN9A; (-) strand; PAM type: YTN; PAM sequence: TTA
aaacatgaggtagatgattt

SEQ ID NO: 72857 - DNA, 20 bp, Artificial Sequence
  Description of Artificial Sequence: Synthetic oligonucleotide
  Target: SCN9A; (-) strand; PAM type: YTN; PAM sequence: TTT
aaaacatgaggtagatgatt

SEQ ID NO: 72858 - DNA, 20 bp, Artificial Sequence
  Description of Artificial Sequence: Synthetic oligonucleotide
  Target: SCN9A; (-) strand; PAM type: YTN; PAM sequence: TTT
taaaacatgaggtagatgat

SEQ ID NO: 72859 - DNA, 20 bp, Artificial Sequence
  Description of Artificial Sequence: Synthetic oligonucleotide
  Target: SCN9A; (-) strand; PAM type: YTN; PAM sequence: TTT
ttaaaacatgaggtagatga

SEQ ID NO: 72860 - DNA, 20 bp, Artificial Sequence
  Description of Artificial Sequence: Synthetic oligonucleotide
  Target: SCN9A; (-) strand; PAM type: YTN; PAM sequence: TTC
gatttttaaaacatgaggta

SEQ ID NO: 72861 - DNA, 20 bp, Artificial Sequence
  Description of Artificial Sequence: Synthetic oligonucleotide
  Target: SCN9A; (-) strand; PAM type: YTN; PAM sequence: CTT
cgatttttaaaacatgaggt

SEQ ID NO: 72862 - DNA, 20 bp, Artificial Sequence
  Description of Artificial Sequence: Synthetic oligonucleotide
  Target: SCN9A; (-) strand; PAM type: YTN; PAM sequence: TTA
cttcgatttttaaaacatga

SEQ ID NO: 72863 - DNA, 20 bp, Artificial Sequence
  Description of Artificial Sequence: Synthetic oligonucleotide
  Target: SCN9A; (-) strand; PAM type: YTN; PAM sequence: CTT
acttcgatttttaaaacatg

SEQ ID NO: 72864 - DNA, 20 bp, Artificial Sequence
  Description of Artificial Sequence: Synthetic oligonucleotide
  Target: SCN9A; (-) strand; PAM type: YTN; PAM sequence: TTA
ggtcttacttcgatttttaa

SEQ ID NO: 72865 - DNA, 20 bp, Artificial Sequence
  Description of Artificial Sequence: Synthetic oligonucleotide
  Target: SCN9A; (-) strand; PAM type: YTN; PAM sequence: TTC
agttaggtcttacttcgatt

SEQ ID NO: 72866 - DNA, 20 bp, Artificial Sequence
  Description of Artificial Sequence: Synthetic oligonucleotide
  Target: SCN9A; (-) strand; PAM type: YTN; PAM sequence: CTT
cagttaggtcttacttcgat

SEQ ID NO: 72867 - DNA, 20 bp, Artificial Sequence
  Description of Artificial Sequence: Synthetic oligonucleotide
  Target: SCN9A; (-) strand; PAM type: YTN; PAM sequence: CTC
ttcagttaggtcttacttcg

SEQ ID NO: 72868 - DNA, 20 bp, Artificial Sequence
  Description of Artificial Sequence: Synthetic oligonucleotide
  Target: SCN9A; (-) strand; PAM type: YTN; PAM sequence: TTC
tcttcagttaggtcttactt

SEQ ID NO: 72869 - DNA, 20 bp, Artificial Sequence
  Description of Artificial Sequence: Synthetic oligonucleotide
  Target: SCN9A; (-) strand; PAM type: YTN; PAM sequence: CTT
ctcttcagttaggtcttact

SEQ ID NO: 72870 - DNA, 20 bp, Artificial Sequence
  Description of Artificial Sequence: Synthetic oligonucleotide
  Target: SCN9A; (-) strand; PAM type: YTN; PAM sequence: TTA
ggtatgaccaaaatgaggga

SEQ ID NO: 72871 - DNA, 20 bp, Artificial Sequence
  Description of Artificial Sequence: Synthetic oligonucleotide
  Target: SCN9A; (-) strand; PAM type: YTN; PAM sequence: TTT
aggtatgaccaaaatgaggg

SEQ ID NO: 72872 - DNA, 20 bp, Artificial Sequence
  Description of Artificial Sequence: Synthetic oligonucleotide
  Target: SCN9A; (-) strand; PAM type: YTN; PAM sequence: TTT
taggtatgaccaaaatgagg

SEQ ID NO: 72873 - DNA, 20 bp, Artificial Sequence
  Description of Artificial Sequence: Synthetic oligonucleotide
  Target: SCN9A; (-) strand; PAM type: YTN; PAM sequence: TTG
ttttaggtatgaccaaaatg

SEQ ID NO: 72874 - DNA, 20 bp, Artificial Sequence
  Description of Artificial Sequence: Synthetic oligonucleotide
  Target: SCN9A; (-) strand; PAM type: YTN; PAM sequence: CTC
agagaaattgttttaggtat

SEQ ID NO: 72875 - DNA, 20 bp, Artificial Sequence
  Description of Artificial Sequence: Synthetic oligonucleotide
  Target: SCN9A; (-) strand; PAM type: YTN; PAM sequence: TTA
catctcagagaaattgtttt

SEQ ID NO: 72876 - DNA, 20 bp, Artificial Sequence
  Description of Artificial Sequence: Synthetic oligonucleotide
  Target: SCN9A; (-) strand; PAM type: YTN; PAM sequence: CTT
acatctcagagaaattgttt

SEQ ID NO: 72877 - DNA, 20 bp, Artificial Sequence
  Description of Artificial Sequence: Synthetic oligonucleotide
  Target: SCN9A; (-) strand; PAM type: YTN; PAM sequence: TTA
cttacatctcagagaaattg

SEQ ID NO: 72878 - DNA, 20 bp, Artificial Sequence
  Description of Artificial Sequence: Synthetic oligonucleotide
  Target: SCN9A; (-) strand; PAM type: YTN; PAM sequence: TTT
acttacatctcagagaaatt

SEQ ID NO: 72879 - DNA, 20 bp, Artificial Sequence
  Description of Artificial Sequence: Synthetic oligonucleotide
  Target: SCN9A; (-) strand; PAM type: YTN; PAM sequence: CTT
tacttacatctcagagaaat

SEQ ID NO: 72880 - DNA, 20 bp, Artificial Sequence
  Description of Artificial Sequence: Synthetic oligonucleotide
  Target: SCN9A; (-) strand; PAM type: YTN; PAM sequence: CTG
tctttacttacatctcagag

SEQ ID NO: 72881 - DNA, 20 bp, Artificial Sequence
  Description of Artificial Sequence: Synthetic oligonucleotide
  Target: SCN9A; (-) strand; PAM type: YTN; PAM sequence: CTG
ctgtctttacttacatctca

SEQ ID NO: 72882 - DNA, 20 bp, Artificial Sequence
  Description of Artificial Sequence: Synthetic oligonucleotide
  Target: SCN9A; (-) strand; PAM type: YTN; PAM sequence: TTA
gcctgctgtctttacttaca

SEQ ID NO: 72883 - DNA, 20 bp, Artificial Sequence
  Description of Artificial Sequence: Synthetic oligonucleotide
  Target: SCN9A; (-) strand; PAM type: YTN; PAM sequence: TTT
agcctgctgtctttacttac

SEQ ID NO: 72884 - DNA, 20 bp, Artificial Sequence
  Description of Artificial Sequence: Synthetic oligonucleotide
  Target: SCN9A; (-) strand; PAM type: YTN; PAM sequence: TTT
tagcctgctgtctttactta

SEQ ID NO: 72885 - DNA, 20 bp, Artificial Sequence
  Description of Artificial Sequence: Synthetic oligonucleotide
  Target: SCN9A; (-) strand; PAM type: YTN; PAM sequence: TTG
agacacacaattttagcctg

SEQ ID NO: 72886 - DNA, 20 bp, Artificial Sequence
  Description of Artificial Sequence: Synthetic oligonucleotide
  Target: SCN9A; (-) strand; PAM type: YTN; PAM sequence: TTA
ttgagacacacaattttagc

SEQ ID NO: 72887 - DNA, 20 bp, Artificial Sequence
  Description of Artificial Sequence: Synthetic oligonucleotide
  Target: SCN9A; (-) strand; PAM type: YTN; PAM sequence: CTT
attgagacacacaattttag

SEQ ID NO: 72888 - DNA, 20 bp, Artificial Sequence
  Description of Artificial Sequence: Synthetic oligonucleotide
  Target: SCN9A; (-) strand; PAM type: YTN; PAM sequence: CTA
aatcagacttattgagacac

SEQ ID NO: 72889 - DNA, 20 bp, Artificial Sequence
  Description of Artificial Sequence: Synthetic oligonucleotide
  Target: SCN9A; (-) strand; PAM type: YTN; PAM sequence: CTC
ctaaatcagacttattgaga

SEQ ID NO: 72890 - DNA, 20 bp, Artificial Sequence
  Description of Artificial Sequence: Synthetic oligonucleotide
  Target: SCN9A; (-) strand; PAM type: YTN; PAM sequence: TTC
tcctaaatcagacttattga

SEQ ID NO: 72891 - DNA, 20 bp, Artificial Sequence
  Description of Artificial Sequence: Synthetic oligonucleotide
  Target: SCN9A; (-) strand; PAM type: YTN; PAM sequence: TTT
ctcctaaatcagacttattg

SEQ ID NO: 72892 - DNA, 20 bp, Artificial Sequence
  Description of Artificial Sequence: Synthetic oligonucleotide
  Target: SCN9A; (-) strand; PAM type: YTN; PAM sequence: TTT
tctcctaaatcagacttatt

SEQ ID NO: 72893 - DNA, 20 bp, Artificial Sequence
  Description of Artificial Sequence: Synthetic oligonucleotide
  Target: SCN9A; (-) strand; PAM type: YTN; PAM sequence: CTC
cagaattttctcctaaatca

SEQ ID NO: 72894 - DNA, 20 bp, Artificial Sequence
  Description of Artificial Sequence: Synthetic oligonucleotide
  Target: SCN9A; (-) strand; PAM type: YTN; PAM sequence: CTC
cgacctccagaattttctcc

SEQ ID NO: 72895 - DNA, 20 bp, Artificial Sequence
  Description of Artificial Sequence: Synthetic oligonucleotide
  Target: SCN9A; (-) strand; PAM type: YTN; PAM sequence: TTC
ccagacctccgacctccaga

SEQ ID NO: 72896 - DNA, 20 bp, Artificial Sequence
  Description of Artificial Sequence: Synthetic oligonucleotide
  Target: SCN9A; (-) strand; PAM type: YTN; PAM sequence: CTA
tgattcccagacctccgacc

SEQ ID NO: 72897 - DNA, 20 bp, Artificial Sequence
  Description of Artificial Sequence: Synthetic oligonucleotide
  Target: SCN9A; (-) strand; PAM type: YTN; PAM sequence: TTC
actatgattcccagacctcc

SEQ ID NO: 72898 - DNA, 20 bp, Artificial Sequence
  Description of Artificial Sequence: Synthetic oligonucleotide
  Target: SCN9A; (-) strand; PAM type: YTN; PAM sequence: TTG
ttcactatgattcccagacc

SEQ ID NO: 72899 - DNA, 20 bp, Artificial Sequence
  Description of Artificial Sequence: Synthetic oligonucleotide
  Target: SCN9A; (-) strand; PAM type: YTN; PAM sequence: TTA
tcaaaattgttcactatgat

SEQ ID NO: 72900 - DNA, 20 bp, Artificial Sequence
  Description of Artificial Sequence: Synthetic oligonucleotide
  Target: SCN9A; (-) strand; PAM type: YTN; PAM sequence: TTA
gcaattatcaaaattgttca

SEQ ID NO: 72901 - DNA, 20 bp, Artificial Sequence
  Description of Artificial Sequence: Synthetic oligonucleotide
  Target: SCN9A; (-) strand; PAM type: YTN; PAM sequence: TTT
agcaattatcaaaattgttc

SEQ ID NO: 72902 - DNA, 20 bp, Artificial Sequence
  Description of Artificial Sequence: Synthetic oligonucleotide
  Target: SCN9A; (-) strand; PAM type: YTN; PAM sequence: TTT
tagcaattatcaaaattgtt

SEQ ID NO: 72903 - DNA, 20 bp, Artificial Sequence
  Description of Artificial Sequence: Synthetic oligonucleotide
  Target: SCN9A; (-) strand; PAM type: YTN; PAM sequence: TTT
ttagcaattatcaaaattgt

SEQ ID NO: 72904 - DNA, 20 bp, Artificial Sequence
  Description of Artificial Sequence: Synthetic oligonucleotide
  Target: SCN9A; (-) strand; PAM type: YTN; PAM sequence: TTC
agggatttttagcaattatc

SEQ ID NO: 72905 - DNA, 20 bp, Artificial Sequence
  Description of Artificial Sequence: Synthetic oligonucleotide
  Target: SCN9A; (-) strand; PAM type: YTN; PAM sequence: TTT
cagggatttttagcaattat

SEQ ID NO: 72906 - DNA, 20 bp, Artificial Sequence
  Description of Artificial Sequence: Synthetic oligonucleotide
  Target: SCN9A; (-) strand; PAM type: YTN; PAM sequence: TTA
aaccatttcagggattttta

SEQ ID NO: 72907 - DNA, 20 bp, Artificial Sequence
  Description of Artificial Sequence: Synthetic oligonucleotide
  Target: SCN9A; (-) strand; PAM type: YTN; PAM sequence: CTA
ttaaaccatttcagggattt

SEQ ID NO: 72908 - DNA, 20 bp, Artificial Sequence
  Description of Artificial Sequence: Synthetic oligonucleotide
  Target: SCN9A; (-) strand; PAM type: YTN; PAM sequence: TTG
acaactattaaaccatttca

SEQ ID NO: 72909 - DNA, 20 bp, Artificial Sequence
  Description of Artificial Sequence: Synthetic oligonucleotide
  Target: SCN9A; (-) strand; PAM type: YTN; PAM sequence: TTC
attgacaactattaaaccat

SEQ ID NO: 72910 - DNA, 20 bp, Artificial Sequence
  Description of Artificial Sequence: Synthetic oligonucleotide
  Target: SCN9A; (-) strand; PAM type: YTN; PAM sequence: TTT
cattgacaactattaaacca

SEQ ID NO: 72911 - DNA, 20 bp, Artificial Sequence
  Description of Artificial Sequence: Synthetic oligonucleotide
  Target: SCN9A; (-) strand; PAM type: YTN; PAM sequence: TTT
tcattgacaactattaaacc

SEQ ID NO: 72912 - DNA, 20 bp, Artificial Sequence
  Description of Artificial Sequence: Synthetic oligonucleotide
  Target: SCN9A; (-) strand; PAM type: YTN; PAM sequence: TTT
ttcattgacaactattaaac

SEQ ID NO: 72913 - DNA, 20 bp, Artificial Sequence
  Description of Artificial Sequence: Synthetic oligonucleotide
  Target: SCN9A; (-) strand; PAM type: YTN; PAM sequence: CTT
tttcattgacaactattaaa

SEQ ID NO: 72914 - DNA, 20 bp, Artificial Sequence
  Description of Artificial Sequence: Synthetic oligonucleotide
  Target: SCN9A; (-) strand; PAM type: YTN; PAM sequence: TTC
atagtgaaatatactttttc

SEQ ID NO: 72915 - DNA, 20 bp, Artificial Sequence
  Description of Artificial Sequence: Synthetic oligonucleotide
  Target: SCN9A; (-) strand; PAM type: YTN; PAM sequence: TTT
catagtgaaatatacttttt

SEQ ID NO: 72916 - DNA, 20 bp, Artificial Sequence
  Description of Artificial Sequence: Synthetic oligonucleotide
  Target: SCN9A; (-) strand; PAM type: YTN; PAM sequence: TTA
aaacaaatatacacaaacat

SEQ ID NO: 72917 - DNA, 20 bp, Artificial Sequence
  Description of Artificial Sequence: Synthetic oligonucleotide
  Target: SCN9A; (-) strand; PAM type: YTN; PAM sequence: CTA
ttaaaacaaatatacacaaa

SEQ ID NO: 72918 - DNA, 20 bp, Artificial Sequence
  Description of Artificial Sequence: Synthetic oligonucleotide
  Target: SCN9A; (-) strand; PAM type: YTN; PAM sequence: TTC
ctattaaaacaaatatacac

SEQ ID NO: 72919 - DNA, 20 bp, Artificial Sequence
  Description of Artificial Sequence: Synthetic oligonucleotide
  Target: SCN9A; (-) strand; PAM type: YTN; PAM sequence: TTC
accaatattcctattaaaac

SEQ ID NO: 72920 - DNA, 20 bp, Artificial Sequence
  Description of Artificial Sequence: Synthetic oligonucleotide
  Target: SCN9A; (-) strand; PAM type: YTN; PAM sequence: CTT
caccaatattcctattaaaa

SEQ ID NO: 72921 - DNA, 20 bp, Artificial Sequence
  Description of Artificial Sequence: Synthetic oligonucleotide
  Target: SCN9A; (-) strand; PAM type: YTN; PAM sequence: CTC
agatcttcaccaatattcct

SEQ ID NO: 72922 - DNA, 20 bp, Artificial Sequence
  Description of Artificial Sequence: Synthetic oligonucleotide
  Target: SCN9A; (-) strand; PAM type: YTN; PAM sequence: CTA
aagcagtaaaatggaccctc

SEQ ID NO: 72923 - DNA, 20 bp, Artificial Sequence
  Description of Artificial Sequence: Synthetic oligonucleotide
  Target: SCN9A; (-) strand; PAM type: YTN; PAM sequence: TTA
aggagactaaagcagtaaaa

SEQ ID NO: 72924 - DNA, 20 bp, Artificial Sequence
  Description of Artificial Sequence: Synthetic oligonucleotide
  Target: SCN9A; (-) strand; PAM type: YTN; PAM sequence: TTG
aacagattaaggagactaaa

SEQ ID NO: 72925 - DNA, 20 bp, Artificial Sequence
  Description of Artificial Sequence: Synthetic oligonucleotide
  Target: SCN9A; (-) strand; PAM type: YTN; PAM sequence: CTT
gaacagattaaggagactaa

SEQ ID NO: 72926 - DNA, 20 bp, Artificial Sequence
  Description of Artificial Sequence: Synthetic oligonucleotide
  Target: SCN9A; (-) strand; PAM type: YTN; PAM sequence: TTA
acgcttgaacagattaagga

SEQ ID NO: 72927 - DNA, 20 bp, Artificial Sequence
  Description of Artificial Sequence: Synthetic oligonucleotide
  Target: SCN9A; (-) strand; PAM type: YTN; PAM sequence: TTT
aacgcttgaacagattaagg

SEQ ID NO: 72928 - DNA, 20 bp, Artificial Sequence
  Description of Artificial Sequence: Synthetic oligonucleotide
  Target: SCN9A; (-) strand; PAM type: YTN; PAM sequence: TTA
aaatggtttaacgcttgaac

SEQ ID NO: 72929 - DNA, 20 bp, Artificial Sequence
  Description of Artificial Sequence: Synthetic oligonucleotide
  Target: SCN9A; (-) strand; PAM type: YTN; PAM sequence: CTG
ttaaaatggtttaacgcttg

SEQ ID NO: 72930 - DNA, 20 bp, Artificial Sequence
  Description of Artificial Sequence: Synthetic oligonucleotide
  Target: SCN9A; (-) strand; PAM type: YTN; PAM sequence: CTG
caccctgttaaaatggttta

SEQ ID NO: 72931 - DNA, 20 bp, Artificial Sequence
  Description of Artificial Sequence: Synthetic oligonucleotide
  Target: SCN9A; (-) strand; PAM type: YTN; PAM sequence: CTC
aacgaagtgagaaccgcatg

SEQ ID NO: 72932 - DNA, 20 bp, Artificial Sequence
  Description of Artificial Sequence: Synthetic oligonucleotide
  Target: SCN9A; (-) strand; PAM type: YTN; PAM sequence: TTC
tcaacgaagtgagaaccgca

SEQ ID NO: 72933 - DNA, 20 bp, Artificial Sequence
  Description of Artificial Sequence: Synthetic oligonucleotide
  Target: SCN9A; (-) strand; PAM type: YTN; PAM sequence: CTG
ttctcaacgaagtgagaacc

SEQ ID NO: 72934 - DNA, 20 bp, Artificial Sequence
  Description of Artificial Sequence: Synthetic oligonucleotide
  Target: SCN9A; (-) strand; PAM type: YTN; PAM sequence: TTG
tcacagcagctgttctcaac

SEQ ID NO: 72935 - DNA, 20 bp, Artificial Sequence
  Description of Artificial Sequence: Synthetic oligonucleotide
  Target: SCN9A; (-) strand; PAM type: YTN; PAM sequence: TTG
aaggaaagaaagttgtcaca

SEQ ID NO: 72936 - DNA, 20 bp, Artificial Sequence
  Description of Artificial Sequence: Synthetic oligonucleotide
  Target: SCN9A; (-) strand; PAM type: YTN; PAM sequence: TTT
gaaggaaagaaagttgtcac

SEQ ID NO: 72937 - DNA, 20 bp, Artificial Sequence
  Description of Artificial Sequence: Synthetic oligonucleotide
  Target: SCN9A; (-) strand; PAM type: YTN; PAM sequence: TTT
tgaaggaaagaaagttgtca

SEQ ID NO: 72938 - DNA, 20 bp, Artificial Sequence
  Description of Artificial Sequence: Synthetic oligonucleotide
  Target: SCN9A; (-) strand; PAM type: YTN; PAM sequence: TTT
ttgaaggaaagaaagttgtc

SEQ ID NO: 72939 - DNA, 20 bp, Artificial Sequence
  Description of Artificial Sequence: Synthetic oligonucleotide
  Target: SCN9A; (-) strand; PAM type: YTN; PAM sequence: TTA
tgatttttgaaggaaagaaa

SEQ ID NO: 72940 - DNA, 20 bp, Artificial Sequence
  Description of Artificial Sequence: Synthetic oligonucleotide
  Target: SCN9A; (-) strand; PAM type: YTN; PAM sequence: CTT
atgatttttgaaggaaagaa

SEQ ID NO: 72941 - DNA, 20 bp, Artificial Sequence
  Description of Artificial Sequence: Synthetic oligonucleotide
  Target: SCN9A; (-) strand; PAM type: YTN; PAM sequence: TTA
gagacttatgatttttgaag

SEQ ID NO: 72942 - DNA, 20 bp, Artificial Sequence
  Description of Artificial Sequence: Synthetic oligonucleotide
  Target: SCN9A; (-) strand; PAM type: YTN; PAM sequence: TTA
tagaaatattagagacttat

SEQ ID NO: 72943 - DNA, 20 bp, Artificial Sequence
  Description of Artificial Sequence: Synthetic oligonucleotide
  Target: SCN9A; (-) strand; PAM type: YTN; PAM sequence: CTA
ggttatagaaatattagaga

SEQ ID NO: 72944 - DNA, 20 bp, Artificial Sequence
  Description of Artificial Sequence: Synthetic oligonucleotide
  Target: SCN9A; (-) strand; PAM type: YTN; PAM sequence: TTG
tgatacccactaggttatag

SEQ ID NO: 72945 - DNA, 20 bp, Artificial Sequence
  Description of Artificial Sequence: Synthetic oligonucleotide
  Target: SCN9A; (-) strand; PAM type: YTN; PAM sequence: TTT
gtgatacccactaggttata

SEQ ID NO: 72946 - DNA, 20 bp, Artificial Sequence
  Description of Artificial Sequence: Synthetic oligonucleotide
  Target: SCN9A; (-) strand; PAM type: YTN; PAM sequence: TTG
atttgtgatacccactaggt

SEQ ID NO: 72947 - DNA, 20 bp, Artificial Sequence
  Description of Artificial Sequence: Synthetic oligonucleotide
  Target: SCN9A; (-) strand; PAM type: YTN; PAM sequence: TTT
gatttgtgatacccactagg

SEQ ID NO: 72948 - DNA, 20 bp, Artificial Sequence
  Description of Artificial Sequence: Synthetic oligonucleotide
  Target: SCN9A; (-) strand; PAM type: YTN; PAM sequence: TTT
tgatttgtgatacccactag

SEQ ID NO: 72949 - DNA, 20 bp, Artificial Sequence
  Description of Artificial Sequence: Synthetic oligonucleotide
  Target: SCN9A; (-) strand; PAM type: YTN; PAM sequence: TTA
ttttgatttgtgatacccac

SEQ ID NO: 72950 - DNA, 20 bp, Artificial Sequence
  Description of Artificial Sequence: Synthetic oligonucleotide
  Target: SCN9A; (-) strand; PAM type: YTN; PAM sequence: TTT
attttgatttgtgataccca

SEQ ID NO: 72951 - DNA, 20 bp, Artificial Sequence
  Description of Artificial Sequence: Synthetic oligonucleotide
  Target: SCN9A; (-) strand; PAM type: YTN; PAM sequence: CTT
tattttgatttgtgataccc

SEQ ID NO: 72952 - DNA, 20 bp, Artificial Sequence
  Description of Artificial Sequence: Synthetic oligonucleotide
  Target: SCN9A; (-) strand; PAM type: YTN; PAM sequence: TTA
acatgataatacaaagatga

SEQ ID NO: 72953 - DNA, 20 bp, Artificial Sequence
  Description of Artificial Sequence: Synthetic oligonucleotide
  Target: SCN9A; (-) strand; PAM type: YTN; PAM sequence: TTT
aacatgataatacaaagatg

SEQ ID NO: 72954 - DNA, 20 bp, Artificial Sequence
  Description of Artificial Sequence: Synthetic oligonucleotide
  Target: SCN9A; (-) strand; PAM type: YTN; PAM sequence: TTG
tttaacatgataatacaaag

SEQ ID NO: 72955 - DNA, 20 bp, Artificial Sequence
  Description of Artificial Sequence: Synthetic oligonucleotide
  Target: SCN9A; (-) strand; PAM type: YTN; PAM sequence: CTT
gtttaacatgataatacaaa

SEQ ID NO: 72956 - DNA, 20 bp, Artificial Sequence
  Description of Artificial Sequence: Synthetic oligonucleotide
  Target: SCN9A; (-) strand; PAM type: YTN; PAM sequence: CTC
ttgtttaacatgataataca

SEQ ID NO: 72957 - DNA, 20 bp, Artificial Sequence
  Description of Artificial Sequence: Synthetic oligonucleotide
  Target: SCN9A; (-) strand; PAM type: YTN; PAM sequence: TTC
tcttgtttaacatgataata

SEQ ID NO: 72958 - DNA, 20 bp, Artificial Sequence
  Description of Artificial Sequence: Synthetic oligonucleotide
  Target: SCN9A; (-) strand; PAM type: YTN; PAM sequence: CTT
ctcttgtttaacatgataat

SEQ ID NO: 72959 - DNA, 20 bp, Artificial Sequence
  Description of Artificial Sequence: Synthetic oligonucleotide
  Target: SCN9A; (-) strand; PAM type: YTN; PAM sequence: TTC
ttctcttgtttaacatgata

SEQ ID NO: 72960 - DNA, 20 bp, Artificial Sequence
  Description of Artificial Sequence: Synthetic oligonucleotide
  Target: SCN9A; (-) strand; PAM type: YTN; PAM sequence: TTT
cttctcttgtttaacatgat

SEQ ID NO: 72961 - DNA, 20 bp, Artificial Sequence
  Description of Artificial Sequence: Synthetic oligonucleotide
  Target: SCN9A; (-) strand; PAM type: YTN; PAM sequence: TTA
atatttcttctcttgtttaa

SEQ ID NO: 72962 - DNA, 20 bp, Artificial Sequence
  Description of Artificial Sequence: Synthetic oligonucleotide
  Target: SCN9A; (-) strand; PAM type: YTN; PAM sequence: TTA
ttaatatttcttctcttgtt

SEQ ID NO: 72963 - DNA, 20 bp, Artificial Sequence
  Description of Artificial Sequence: Synthetic oligonucleotide
  Target: SCN9A; (-) strand; PAM type: YTN; PAM sequence: TTT
attaatatttcttctcttgt

SEQ ID NO: 72964 - DNA, 20 bp, Artificial Sequence
  Description of Artificial Sequence: Synthetic oligonucleotide
  Target: SCN9A; (-) strand; PAM type: YTN; PAM sequence: TTT
tattaatatttcttctcttg

SEQ ID NO: 72965 - DNA, 20 bp, Artificial Sequence
  Description of Artificial Sequence: Synthetic oligonucleotide
  Target: SCN9A; (-) strand; PAM type: YTN; PAM sequence: TTG
aatcaagtatacattttatt

SEQ ID NO: 72966 - DNA, 20 bp, Artificial Sequence
  Description of Artificial Sequence: Synthetic oligonucleotide
  Target: SCN9A; (-) strand; PAM type: YTN; PAM sequence: TTT
gaatcaagtatacattttat

SEQ ID NO: 72967 - DNA, 20 bp, Artificial Sequence
  Description of Artificial Sequence: Synthetic oligonucleotide
  Target: SCN9A; (-) strand; PAM type: YTN; PAM sequence: CTT
tgaatcaagtatacatttta

SEQ ID NO: 72968 - DNA, 20 bp, Artificial Sequence
  Description of Artificial Sequence: Synthetic oligonucleotide
  Target: SCN9A; (-) strand; PAM type: YTN; PAM sequence: TTA
atcaaaatgagactttgaat

SEQ ID NO: 72969 - DNA, 20 bp, Artificial Sequence
  Description of Artificial Sequence: Synthetic oligonucleotide
  Target: SCN9A; (-) strand; PAM type: YTN; PAM sequence: TTG
cgaagaccattaatcaaaat

SEQ ID NO: 72970 - DNA, 20 bp, Artificial Sequence
  Description of Artificial Sequence: Synthetic oligonucleotide
  Target: SCN9A; (-) strand; PAM type: YTN; PAM sequence: CTT
gcgaagaccattaatcaaaa

SEQ ID NO: 72971 - DNA, 20 bp, Artificial Sequence
  Description of Artificial Sequence: Synthetic oligonucleotide
  Target: SCN9A; (-) strand; PAM type: YTN; PAM sequence: CTA
tatcaggaaacttgcgaaga

SEQ ID NO: 72972 - DNA, 20 bp, Artificial Sequence
  Description of Artificial Sequence: Synthetic oligonucleotide
  Target: SCN9A; (-) strand; PAM type: YTN; PAM sequence: CTC
gggtctatatcaggaaactt

SEQ ID NO: 72973 - DNA, 20 bp, Artificial Sequence
  Description of Artificial Sequence: Synthetic oligonucleotide
  Target: SCN9A; (-) strand; PAM type: YTN; PAM sequence: TTA
gtcagctcgggtctatatca

SEQ ID NO: 72974 - DNA, 20 bp, Artificial Sequence
  Description of Artificial Sequence: Synthetic oligonucleotide
  Target: SCN9A; (-) strand; PAM type: YTN; PAM sequence: TTT
agtcagctcgggtctatatc

SEQ ID NO: 72975 - DNA, 20 bp, Artificial Sequence
  Description of Artificial Sequence: Synthetic oligonucleotide
  Target: SCN9A; (-) strand; PAM type: YTN; PAM sequence: TTT
tagtcagctcgggtctatat

SEQ ID NO: 72976 - DNA, 20 bp, Artificial Sequence
  Description of Artificial Sequence: Synthetic oligonucleotide
  Target: SCN9A; (-) strand; PAM type: YTN; PAM sequence: TTG
gaaaaataagttttagtcag

SEQ ID NO: 72977 - DNA, 20 bp, Artificial Sequence
  Description of Artificial Sequence: Synthetic oligonucleotide
  Target: SCN9A; (-) strand; PAM type: YTN; PAM sequence: TTT
ggaaaaataagttttagtca

SEQ ID NO: 72978 - DNA, 20 bp, Artificial Sequence
  Description of Artificial Sequence: Synthetic oligonucleotide
  Target: SCN9A; (-) strand; PAM type: YTN; PAM sequence: TTA
ggaaaacatttggaaaaata

SEQ ID NO: 72979 - DNA, 20 bp, Artificial Sequence
  Description of Artificial Sequence: Synthetic oligonucleotide
  Target: SCN9A; (-) strand; PAM type: YTN; PAM sequence: TTT
aggaaaacatttggaaaaat

SEQ ID NO: 72980 - DNA, 20 bp, Artificial Sequence
  Description of Artificial Sequence: Synthetic oligonucleotide
  Target: SCN9A; (-) strand; PAM type: YTN; PAM sequence: TTA
aggaccataggtttaggaaa

SEQ ID NO: 72981 - DNA, 20 bp, Artificial Sequence
  Description of Artificial Sequence: Synthetic oligonucleotide
  Target: SCN9A; (-) strand; PAM type: YTN; PAM sequence: TTG
aaatggttaaggaccatagg

SEQ ID NO: 72982 - DNA, 20 bp, Artificial Sequence
  Description of Artificial Sequence: Synthetic oligonucleotide
  Target: SCN9A; (-) strand; PAM type: YTN; PAM sequence: TTA
attgaaatggttaaggacca

SEQ ID NO: 72983 - DNA, 20 bp, Artificial Sequence
  Description of Artificial Sequence: Synthetic oligonucleotide
  Target: SCN9A; (-) strand; PAM type: YTN; PAM sequence: TTG
ccagttaattgaaatggtta

SEQ ID NO: 72984 - DNA, 20 bp, Artificial Sequence
  Description of Artificial Sequence: Synthetic oligonucleotide
  Target: SCN9A; (-) strand; PAM type: YTN; PAM sequence: TTA
ttgccagttaattgaaatgg

SEQ ID NO: 72985 - DNA, 20 bp, Artificial Sequence
  Description of Artificial Sequence: Synthetic oligonucleotide
  Target: SCN9A; (-) strand; PAM type: YTN; PAM sequence: TTT
attgccagttaattgaaatg

SEQ ID NO: 72986 - DNA, 20 bp, Artificial Sequence
  Description of Artificial Sequence: Synthetic oligonucleotide
  Target: SCN9A; (-) strand; PAM type: YTN; PAM sequence: TTT
tattgccagttaattgaaat

SEQ ID NO: 72987 - DNA, 20 bp, Artificial Sequence
  Description of Artificial Sequence: Synthetic oligonucleotide
  Target: SCN9A; (-) strand; PAM type: YTN; PAM sequence: TTG
atcattttattgccagttaa

SEQ ID NO: 72988 - DNA, 20 bp, Artificial Sequence
  Description of Artificial Sequence: Synthetic oligonucleotide
  Target: SCN9A; (-) strand; PAM type: YTN; PAM sequence: TTT
gatcattttattgccagtta

SEQ ID NO: 72989 - DNA, 20 bp, Artificial Sequence
  Description of Artificial Sequence: Synthetic oligonucleotide
  Target: SCN9A; (-) strand; PAM type: YTN; PAM sequence: TTT
tgatcattttattgccagtt

SEQ ID NO: 72990 - DNA, 20 bp, Artificial Sequence
  Description of Artificial Sequence: Synthetic oligonucleotide
  Target: SCN9A; (-) strand; PAM type: YTN; PAM sequence: CTT
ttgatcattttattgccagt

SEQ ID NO: 72991 - DNA, 20 bp, Artificial Sequence
  Description of Artificial Sequence: Synthetic oligonucleotide
  Target: SCN9A; (-) strand; PAM type: YTN; PAM sequence: TTC
ttttgatcattttattgcca

SEQ ID NO: 72992 - DNA, 20 bp, Artificial Sequence
  Description of Artificial Sequence: Synthetic oligonucleotide
  Target: SCN9A; (-) strand; PAM type: YTN; PAM sequence: TTA
ttcttttgatcattttattg

SEQ ID NO: 72993 - DNA, 20 bp, Artificial Sequence
  Description of Artificial Sequence: Synthetic oligonucleotide
  Target: SCN9A; (-) strand; PAM type: YTN; PAM sequence: TTT
attcttttgatcattttatt

SEQ ID NO: 72994 - DNA, 20 bp, Artificial Sequence
  Description of Artificial Sequence: Synthetic oligonucleotide
  Target: SCN9A; (-) strand; PAM type: YTN; PAM sequence: CTA
atttattcttttgatcattt

SEQ ID NO: 72995 - DNA, 20 bp, Artificial Sequence
  Description of Artificial Sequence: Synthetic oligonucleotide
  Target: SCN9A; (-) strand; PAM type: YTN; PAM sequence: CTC
taatttattcttttgatcat

SEQ ID NO: 72996 - DNA, 20 bp, Artificial Sequence
  Description of Artificial Sequence: Synthetic oligonucleotide
  Target: SCN9A; (-) strand; PAM type: YTN; PAM sequence: TTC
tctaatttattcttttgatc

SEQ ID NO: 72997 - DNA, 20 bp, Artificial Sequence
  Description of Artificial Sequence: Synthetic oligonucleotide
  Target: SCN9A; (-) strand; PAM type: YTN; PAM sequence: TTT
ctctaatttattcttttgat

SEQ ID NO: 72998 - DNA, 20 bp, Artificial Sequence
  Description of Artificial Sequence: Synthetic oligonucleotide
  Target: SCN9A; (-) strand; PAM type: YTN; PAM sequence: TTA
tatttctctaatttattctt

SEQ ID NO: 72999 - DNA, 20 bp, Artificial Sequence
  Description of Artificial Sequence: Synthetic oligonucleotide
  Target: SCN9A; (-) strand; PAM type: YTN; PAM sequence: TTT
atatttctctaatttattct

SEQ ID NO: 73000 - DNA, 20 bp, Artificial Sequence
  Description of Artificial Sequence: Synthetic oligonucleotide
  Target: SCN9A; (-) strand; PAM type: YTN; PAM sequence: TTT
tatatttctctaatttattc

SEQ ID NO: 73001 - DNA, 20 bp, Artificial Sequence
  Description of Artificial Sequence: Synthetic oligonucleotide
  Target: SCN9A; (-) strand; PAM type: YTN; PAM sequence: TTT
ttatatttctctaatttatt

SEQ ID NO: 73002 - DNA, 20 bp, Artificial Sequence
  Description of Artificial Sequence: Synthetic oligonucleotide
  Target: SCN9A; (-) strand; PAM type: YTN; PAM sequence: TTT
tttatatttctctaatttat

SEQ ID NO: 73003 - DNA, 20 bp, Artificial Sequence
  Description of Artificial Sequence: Synthetic oligonucleotide
  Target: SCN9A; (-) strand; PAM type: YTN; PAM sequence: TTT
ttttatatttctctaattta

SEQ ID NO: 73004 - DNA, 20 bp, Artificial Sequence
  Description of Artificial Sequence: Synthetic oligonucleotide
  Target: SCN9A; (-) strand; PAM type: YTN; PAM sequence: CTT
tttttatatttctctaattt

SEQ ID NO: 73005 - DNA, 20 bp, Artificial Sequence
  Description of Artificial Sequence: Synthetic oligonucleotide
  Target: SCN9A; (-) strand; PAM type: YTN; PAM sequence: CTC
tttttttatatttctctaat

SEQ ID NO: 73006 - DNA, 20 bp, Artificial Sequence
  Description of Artificial Sequence: Synthetic oligonucleotide
  Target: SCN9A; (-) strand; PAM type: YTN; PAM sequence: TTC
tctttttttatatttctcta

SEQ ID NO: 73007 - DNA, 20 bp, Artificial Sequence
  Description of Artificial Sequence: Synthetic oligonucleotide
  Target: SCN9A; (-) strand; PAM type: YTN; PAM sequence: CTT
ctctttttttatatttctct

SEQ ID NO: 73008 - DNA, 20 bp, Artificial Sequence
  Description of Artificial Sequence: Synthetic oligonucleotide
  Target: SCN9A; (-) strand; PAM type: YTN; PAM sequence: CTG
gcttctctttttttatattt

SEQ ID NO: 73009 - DNA, 20 bp, Artificial Sequence
  Description of Artificial Sequence: Synthetic oligonucleotide
  Target: SCN9A; (-) strand; PAM type: YTN; PAM sequence: CTA
aactggcttctcttttttta

SEQ ID NO: 73010 - DNA, 20 bp, Artificial Sequence
  Description of Artificial Sequence: Synthetic oligonucleotide
  Target: SCN9A; (-) strand; PAM type: YTN; PAM sequence: TTA
tatgctaaactggcttctct

SEQ ID NO: 73011 - DNA, 20 bp, Artificial Sequence
  Description of Artificial Sequence: Synthetic oligonucleotide
  Target: SCN9A; (-) strand; PAM type: YTN; PAM sequence: TTA
gagttatatgctaaactggc

SEQ ID NO: 73012 - DNA, 20 bp, Artificial Sequence
  Description of Artificial Sequence: Synthetic oligonucleotide
  Target: SCN9A; (-) strand; PAM type: YTN; PAM sequence: TTC
cacattagagttatatgcta

SEQ ID NO: 73013 - DNA, 20 bp, Artificial Sequence
  Description of Artificial Sequence: Synthetic oligonucleotide
  Target: SCN9A; (-) strand; PAM type: YTN; PAM sequence: CTT
ccacattagagttatatgct

SEQ ID NO: 73014 - DNA, 20 bp, Artificial Sequence
  Description of Artificial Sequence: Synthetic oligonucleotide
  Target: SCN9A; (-) strand; PAM type: YTN; PAM sequence: CTG
atatagccttccacattaga

SEQ ID NO: 73015 - DNA, 20 bp, Artificial Sequence
  Description of Artificial Sequence: Synthetic oligonucleotide
  Target: SCN9A; (-) strand; PAM type: YTN; PAM sequence: TTC
ctgatatagccttccacatt

SEQ ID NO: 73016 - DNA, 20 bp, Artificial Sequence
  Description of Artificial Sequence: Synthetic oligonucleotide
  Target: SCN9A; (-) strand; PAM type: YTN; PAM sequence: TTA
aggaaaaaaatatattcctg

SEQ ID NO: 73017 - DNA, 20 bp, Artificial Sequence
  Description of Artificial Sequence: Synthetic oligonucleotide
  Target: SCN9A; (-) strand; PAM type: YTN; PAM sequence: TTT
aaggaaaaaaatatattcct

SEQ ID NO: 73018 - DNA, 20 bp, Artificial Sequence
  Description of Artificial Sequence: Synthetic oligonucleotide
  Target: SCN9A; (-) strand; PAM type: YTN; PAM sequence: TTA
aaatttaaggaaaaaaatat

SEQ ID NO: 73019 - DNA, 20 bp, Artificial Sequence
  Description of Artificial Sequence: Synthetic oligonucleotide
  Target: SCN9A; (-) strand; PAM type: YTN; PAM sequence: CTA
ccaatatcatagaattaaaa

SEQ ID NO: 73020 - DNA, 20 bp, Artificial Sequence
  Description of Artificial Sequence: Synthetic oligonucleotide
  Target: SCN9A; (-) strand; PAM type: YTN; PAM sequence: CTA
atggaggaactaccaatatc

SEQ ID NO: 73021 - DNA, 20 bp, Artificial Sequence
  Description of Artificial Sequence: Synthetic oligonucleotide
  Target: SCN9A; (-) strand; PAM type: YTN; PAM sequence: TTG
actaatggaggaactaccaa

SEQ ID NO: 73022 - DNA, 20 bp, Artificial Sequence
  Description of Artificial Sequence: Synthetic oligonucleotide
  Target: SCN9A; (-) strand; PAM type: YTN; PAM sequence: CTT
gactaatggaggaactacca

SEQ ID NO: 73023 - DNA, 20 bp, Artificial Sequence
  Description of Artificial Sequence: Synthetic oligonucleotide
  Target: SCN9A; (-) strand; PAM type: YTN; PAM sequence: CTC
ttgactaatggaggaactac

SEQ ID NO: 73024 - DNA, 20 bp, Artificial Sequence
  Description of Artificial Sequence: Synthetic oligonucleotide
  Target: SCN9A; (-) strand; PAM type: YTN; PAM sequence: TTG
ataaccaactcttgactaat

SEQ ID NO: 73025 - DNA, 20 bp, Artificial Sequence
  Description of Artificial Sequence: Synthetic oligonucleotide
  Target: SCN9A; (-) strand; PAM type: YTN; PAM sequence: TTC
ataaagttgataaccaactc

SEQ ID NO: 73026 - DNA, 20 bp, Artificial Sequence
  Description of Artificial Sequence: Synthetic oligonucleotide
  Target: SCN9A; (-) strand; PAM type: YTN; PAM sequence: TTG
gcaaagaaagtatacagaag

SEQ ID NO: 73027 - DNA, 20 bp, Artificial Sequence
  Description of Artificial Sequence: Synthetic oligonucleotide
  Target: SCN9A; (-) strand; PAM type: YTN; PAM sequence: CTT
ggcaaagaaagtatacagaa

SEQ ID NO: 73028 - DNA, 20 bp, Artificial Sequence
  Description of Artificial Sequence: Synthetic oligonucleotide
  Target: SCN9A; (-) strand; PAM type: YTN; PAM sequence: TTC
ttggcaaagaaagtatacag

SEQ ID NO: 73029 - DNA, 20 bp, Artificial Sequence
  Description of Artificial Sequence: Synthetic oligonucleotide
  Target: SCN9A; (-) strand; PAM type: YTN; PAM sequence: TTA
attcttggcaaagaaagtat

SEQ ID NO: 73030 - DNA, 20 bp, Artificial Sequence
  Description of Artificial Sequence: Synthetic oligonucleotide
  Target: SCN9A; (-) strand; PAM type: YTN; PAM sequence: TTA
ttaattcttggcaaagaaag

SEQ ID NO: 73031 - DNA, 20 bp, Artificial Sequence
  Description of Artificial Sequence: Synthetic oligonucleotide
  Target: SCN9A; (-) strand; PAM type: YTN; PAM sequence: TTA
attattaattcttggcaaag

SEQ ID NO: 73032 - DNA, 20 bp, Artificial Sequence
  Description of Artificial Sequence: Synthetic oligonucleotide
  Target: SCN9A; (-) strand; PAM type: YTN; PAM sequence: TTT
aattattaattcttggcaaa

SEQ ID NO: 73033 - DNA, 20 bp, Artificial Sequence
  Description of Artificial Sequence: Synthetic oligonucleotide
  Target: SCN9A; (-) strand; PAM type: YTN; PAM sequence: CTT
taattattaattcttggcaa

SEQ ID NO: 73034 - DNA, 20 bp, Artificial Sequence
  Description of Artificial Sequence: Synthetic oligonucleotide
  Target: SCN9A; (-) strand; PAM type: YTN; PAM sequence: TTC
tttaattattaattcttggc

SEQ ID NO: 73035 - DNA, 20 bp, Artificial Sequence
  Description of Artificial Sequence: Synthetic oligonucleotide
  Target: SCN9A; (-) strand; PAM type: YTN; PAM sequence: TTA
ttctttaattattaattctt

SEQ ID NO: 73036 - DNA, 20 bp, Artificial Sequence
  Description of Artificial Sequence: Synthetic oligonucleotide
  Target: SCN9A; (-) strand; PAM type: YTN; PAM sequence: TTA
ttattctttaattattaatt

SEQ ID NO: 73037 - DNA, 20 bp, Artificial Sequence
  Description of Artificial Sequence: Synthetic oligonucleotide
  Target: SCN9A; (-) strand; PAM type: YTN; PAM sequence: CTC
atattattattctttaatta

SEQ ID NO: 73038 - DNA, 20 bp, Artificial Sequence
  Description of Artificial Sequence: Synthetic oligonucleotide
  Target: SCN9A; (-) strand; PAM type: YTN; PAM sequence: CTA
actcatattattattcttta

SEQ ID NO: 73039 - DNA, 20 bp, Artificial Sequence
  Description of Artificial Sequence: Synthetic oligonucleotide
  Target: SCN9A; (-) strand; PAM type: YTN; PAM sequence: TTA
actaactcatattattattc

SEQ ID NO: 73040 - DNA, 20 bp, Artificial Sequence
  Description of Artificial Sequence: Synthetic oligonucleotide
  Target: SCN9A; (-) strand; PAM type: YTN; PAM sequence: TTA
gtgttaactaactcatatta

SEQ ID NO: 73041 - DNA, 20 bp, Artificial Sequence
  Description of Artificial Sequence: Synthetic oligonucleotide
  Target: SCN9A; (-) strand; PAM type: YTN; PAM sequence: TTC
gtgtagaattagtgttaact

SEQ ID NO: 73042 - DNA, 20 bp, Artificial Sequence
  Description of Artificial Sequence: Synthetic oligonucleotide
  Target: SCN9A; (-) strand; PAM type: YTN; PAM sequence: TTC
attcgtgtagaattagtgtt

SEQ ID NO: 73043 - DNA, 20 bp, Artificial Sequence
  Description of Artificial Sequence: Synthetic oligonucleotide
  Target: SCN9A; (-) strand; PAM type: YTN; PAM sequence: TTT
cattcgtgtagaattagtgt

SEQ ID NO: 73044 - DNA, 20 bp, Artificial Sequence
  Description of Artificial Sequence: Synthetic oligonucleotide
  Target: SCN9A; (-) strand; PAM type: YTN; PAM sequence: TTG
gtgagtgtttcattcgtgta

SEQ ID NO: 73045 - DNA, 20 bp, Artificial Sequence
  Description of Artificial Sequence: Synthetic oligonucleotide
  Target: SCN9A; (-) strand; PAM type: YTN; PAM sequence: TTA
tagtaaaaaacagaggggat

SEQ ID NO: 73046 - DNA, 20 bp, Artificial Sequence
  Description of Artificial Sequence: Synthetic oligonucleotide
  Target: SCN9A; (-) strand; PAM type: YTN; PAM sequence: TTT
atagtaaaaaacagagggga

SEQ ID NO: 73047 - DNA, 20 bp, Artificial Sequence
  Description of Artificial Sequence: Synthetic oligonucleotide
  Target: SCN9A; (-) strand; PAM type: YTN; PAM sequence: TTG
aaaggcaatatagatttata

SEQ ID NO: 73048 - DNA, 20 bp, Artificial Sequence
  Description of Artificial Sequence: Synthetic oligonucleotide
  Target: SCN9A; (-) strand; PAM type: YTN; PAM sequence: TTT
gaaaggcaatatagatttat

SEQ ID NO: 73049 - DNA, 20 bp, Artificial Sequence
  Description of Artificial Sequence: Synthetic oligonucleotide
  Target: SCN9A; (-) strand; PAM type: YTN; PAM sequence: CTT
tgaaaggcaatatagattta

SEQ ID NO: 73050 - DNA, 20 bp, Artificial Sequence
  Description of Artificial Sequence: Synthetic oligonucleotide
  Target: SCN9A; (-) strand; PAM type: YTN; PAM sequence: TTC
ctttgaaaggcaatatagat

SEQ ID NO: 73051 - DNA, 20 bp, Artificial Sequence
  Description of Artificial Sequence: Synthetic oligonucleotide
  Target: SCN9A; (-) strand; PAM type: YTN; PAM sequence: TTT
cctttgaaaggcaatataga

SEQ ID NO: 73052 - DNA, 20 bp, Artificial Sequence
  Description of Artificial Sequence: Synthetic oligonucleotide
  Target: SCN9A; (-) strand; PAM type: YTN; PAM sequence: TTT
tcctttgaaaggcaatatag

SEQ ID NO: 73053 - DNA, 20 bp, Artificial Sequence
  Description of Artificial Sequence: Synthetic oligonucleotide
  Target: SCN9A; (-) strand; PAM type: YTN; PAM sequence: TTA
tgttttcctttgaaaggcaa

SEQ ID NO: 73054 - DNA, 20 bp, Artificial Sequence
  Description of Artificial Sequence: Synthetic oligonucleotide
  Target: SCN9A; (-) strand; PAM type: YTN; PAM sequence: CTG
gtgtgagagttatgttttcc

SEQ ID NO: 73055 - DNA, 20 bp, Artificial Sequence
  Description of Artificial Sequence: Synthetic oligonucleotide
  Target: SCN9A; (-) strand; PAM type: YTN; PAM sequence: TTG
atcatggacactggtgtgag

SEQ ID NO: 73056 - DNA, 20 bp, Artificial Sequence
  Description of Artificial Sequence: Synthetic oligonucleotide
  Target: SCN9A; (-) strand; PAM type: YTN; PAM sequence: TTT
gatcatggacactggtgtga

SEQ ID NO: 73057 - DNA, 20 bp, Artificial Sequence
  Description of Artificial Sequence: Synthetic oligonucleotide
  Target: SCN9A; (-) strand; PAM type: YTN; PAM sequence: TTG
aacaatggataatataatat

SEQ ID NO: 73058 - DNA, 20 bp, Artificial Sequence
  Description of Artificial Sequence: Synthetic oligonucleotide
  Target: SCN9A; (-) strand; PAM type: YTN; PAM sequence: TTT
gaacaatggataatataata

SEQ ID NO: 73059 - DNA, 20 bp, Artificial Sequence
  Description of Artificial Sequence: Synthetic oligonucleotide
  Target: SCN9A; (-) strand; PAM type: YTN; PAM sequence: CTT
tgaacaatggataatataat

SEQ ID NO: 73060 - DNA, 20 bp, Artificial Sequence
  Description of Artificial Sequence: Synthetic oligonucleotide
  Target: SCN9A; (-) strand; PAM type: YTN; PAM sequence: TTG
aagtgggcctttgaacaatg

SEQ ID NO: 73061 - DNA, 20 bp, Artificial Sequence
  Description of Artificial Sequence: Synthetic oligonucleotide
  Target: SCN9A; (-) strand; PAM type: YTN; PAM sequence: TTT
gaagtgggcctttgaacaat

SEQ ID NO: 73062 - DNA, 20 bp, Artificial Sequence
  Description of Artificial Sequence: Synthetic oligonucleotide
  Target: SCN9A; (-) strand; PAM type: YTN; PAM sequence: TTT
tgaagtgggcctttgaacaa

SEQ ID NO: 73063 - DNA, 20 bp, Artificial Sequence
  Description of Artificial Sequence: Synthetic oligonucleotide
  Target: SCN9A; (-) strand; PAM type: YTN; PAM sequence: TTT
ttgaagtgggcctttgaaca

SEQ ID NO: 73064 - DNA, 20 bp, Artificial Sequence
  Description of Artificial Sequence: Synthetic oligonucleotide
  Target: SCN9A; (-) strand; PAM type: YTN; PAM sequence: TTA
agggaggtttttgaagtggg

SEQ ID NO: 73065 - DNA, 20 bp, Artificial Sequence
  Description of Artificial Sequence: Synthetic oligonucleotide
  Target: SCN9A; (-) strand; PAM type: YTN; PAM sequence: CTT
aagggaggtttttgaagtgg

SEQ ID NO: 73066 - DNA, 20 bp, Artificial Sequence
  Description of Artificial Sequence: Synthetic oligonucleotide
  Target: SCN9A; (-) strand; PAM type: YTN; PAM sequence: TTG
agacttaagggaggtttttg

SEQ ID NO: 73067 - DNA, 20 bp, Artificial Sequence
  Description of Artificial Sequence: Synthetic oligonucleotide
  Target: SCN9A; (-) strand; PAM type: YTN; PAM sequence: CTA
gattgagacttaagggaggt

SEQ ID NO: 73068 - DNA, 20 bp, Artificial Sequence
  Description of Artificial Sequence: Synthetic oligonucleotide
  Target: SCN9A; (-) strand; PAM type: YTN; PAM sequence: TTC
tagattgagacttaagggag

SEQ ID NO: 73069 - DNA, 20 bp, Artificial Sequence
  Description of Artificial Sequence: Synthetic oligonucleotide
  Target: SCN9A; (-) strand; PAM type: YTN; PAM sequence: TTA
aagaaagagttctagattga

SEQ ID NO: 73070 - DNA, 20 bp, Artificial Sequence
  Description of Artificial Sequence: Synthetic oligonucleotide
  Target: SCN9A; (-) strand; PAM type: YTN; PAM sequence: CTT
aaagaaagagttctagattg

SEQ ID NO: 73071 - DNA, 20 bp, Artificial Sequence
  Description of Artificial Sequence: Synthetic oligonucleotide
  Target: SCN9A; (-) strand; PAM type: YTN; PAM sequence: CTG
acacttaaagaaagagttct

SEQ ID NO: 73072 - DNA, 20 bp, Artificial Sequence
  Description of Artificial Sequence: Synthetic oligonucleotide
  Target: SCN9A; (-) strand; PAM type: YTN; PAM sequence: TTC
tgacacttaaagaaagagtt

SEQ ID NO: 73073 - DNA, 20 bp, Artificial Sequence
  Description of Artificial Sequence: Synthetic oligonucleotide
  Target: SCN9A; (-) strand; PAM type: YTN; PAM sequence: CTT
ctgacacttaaagaaagagt

SEQ ID NO: 73074 - DNA, 20 bp, Artificial Sequence
  Description of Artificial Sequence: Synthetic oligonucleotide
  Target: SCN9A; (-) strand; PAM type: YTN; PAM sequence: TTA
aataaaatgcttctgacact

SEQ ID NO: 73075 - DNA, 20 bp, Artificial Sequence
  Description of Artificial Sequence: Synthetic oligonucleotide
  Target: SCN9A; (-) strand; PAM type: YTN; PAM sequence: CTA
ccaataaggttaaataaaat

SEQ ID NO: 73076 - DNA, 20 bp, Artificial Sequence
  Description of Artificial Sequence: Synthetic oligonucleotide
  Target: SCN9A; (-) strand; PAM type: YTN; PAM sequence: TTC
taccaataaggttaaataaa

SEQ ID NO: 73077 - DNA, 20 bp, Artificial Sequence
  Description of Artificial Sequence: Synthetic oligonucleotide
  Target: SCN9A; (-) strand; PAM type: YTN; PAM sequence: TTA
tcagacaaggaagaagtgat

SEQ ID NO: 73078 - DNA, 20 bp, Artificial Sequence
  Description of Artificial Sequence: Synthetic oligonucleotide
  Target: SCN9A; (-) strand; PAM type: YTN; PAM sequence: TTA
gggcacagaaaagtggaaca

SEQ ID NO: 73079 - DNA, 20 bp, Artificial Sequence
  Description of Artificial Sequence: Synthetic oligonucleotide
  Target: SCN9A; (-) strand; PAM type: YTN; PAM sequence: TTA
ttagggcacagaaaagtgga

SEQ ID NO: 73080 - DNA, 20 bp, Artificial Sequence
  Description of Artificial Sequence: Synthetic oligonucleotide
  Target: SCN9A; (-) strand; PAM type: YTN; PAM sequence: CTT
attagggcacagaaaagtgg

SEQ ID NO: 73081 - DNA, 20 bp, Artificial Sequence
  Description of Artificial Sequence: Synthetic oligonucleotide
  Target: SCN9A; (-) strand; PAM type: YTN; PAM sequence: TTA
agatgcttattagggcacag

SEQ ID NO: 73082 - DNA, 20 bp, Artificial Sequence
  Description of Artificial Sequence: Synthetic oligonucleotide
  Target: SCN9A; (-) strand; PAM type: YTN; PAM sequence: TTT
aagatgcttattagggcaca

SEQ ID NO: 73083 - DNA, 20 bp, Artificial Sequence
  Description of Artificial Sequence: Synthetic oligonucleotide
  Target: SCN9A; (-) strand; PAM type: YTN; PAM sequence: TTT
taagatgcttattagggcac

SEQ ID NO: 73084 - DNA, 20 bp, Artificial Sequence
  Description of Artificial Sequence: Synthetic oligonucleotide
  Target: SCN9A; (-) strand; PAM type: YTN; PAM sequence: TTT
ttaagatgcttattagggca

SEQ ID NO: 73085 - DNA, 20 bp, Artificial Sequence
  Description of Artificial Sequence: Synthetic oligonucleotide
  Target: SCN9A; (-) strand; PAM type: YTN; PAM sequence: TTG
tttttaagatgcttattagg

SEQ ID NO: 73086 - DNA, 20 bp, Artificial Sequence
  Description of Artificial Sequence: Synthetic oligonucleotide
  Target: SCN9A; (-) strand; PAM type: YTN; PAM sequence: CTT
gtttttaagatgcttattag

SEQ ID NO: 73087 - DNA, 20 bp, Artificial Sequence
  Description of Artificial Sequence: Synthetic oligonucleotide
  Target: SCN9A; (-) strand; PAM type: YTN; PAM sequence: CTA
atccttgtttttaagatgct

SEQ ID NO: 73088 - DNA, 20 bp, Artificial Sequence
  Description of Artificial Sequence: Synthetic oligonucleotide
  Target: SCN9A; (-) strand; PAM type: YTN; PAM sequence: TTA
cccatggtctaatccttgtt

SEQ ID NO: 73089 - DNA, 20 bp, Artificial Sequence
  Description of Artificial Sequence: Synthetic oligonucleotide
  Target: SCN9A; (-) strand; PAM type: YTN; PAM sequence: TTA
gggtggaagaccaaaaccaa

SEQ ID NO: 73090 - DNA, 20 bp, Artificial Sequence
  Description of Artificial Sequence: Synthetic oligonucleotide
  Target: SCN9A; (-) strand; PAM type: YTN; PAM sequence: TTT
agggtggaagaccaaaacca

SEQ ID NO: 73091 - DNA, 20 bp, Artificial Sequence
  Description of Artificial Sequence: Synthetic oligonucleotide
  Target: SCN9A; (-) strand; PAM type: YTN; PAM sequence: TTA
tttagggtggaagaccaaaa

SEQ ID NO: 73092 - DNA, 20 bp, Artificial Sequence
  Description of Artificial Sequence: Synthetic oligonucleotide
  Target: SCN9A; (-) strand; PAM type: YTN; PAM sequence: TTA
ggtattatttagggtggaag

SEQ ID NO: 73093 - DNA, 20 bp, Artificial Sequence
  Description of Artificial Sequence: Synthetic oligonucleotide
  Target: SCN9A; (-) strand; PAM type: YTN; PAM sequence: TTT
aggtattatttagggtggaa

SEQ ID NO: 73094 - DNA, 20 bp, Artificial Sequence
  Description of Artificial Sequence: Synthetic oligonucleotide
  Target: SCN9A; (-) strand; PAM type: YTN; PAM sequence: TTG
tttaggtattatttagggtg

SEQ ID NO: 73095 - DNA, 20 bp, Artificial Sequence
  Description of Artificial Sequence: Synthetic oligonucleotide
  Target: SCN9A; (-) strand; PAM type: YTN; PAM sequence: TTA
gataggaaggcattgtttag

SEQ ID NO: 73096 - DNA, 20 bp, Artificial Sequence
  Description of Artificial Sequence: Synthetic oligonucleotide
  Target: SCN9A; (-) strand; PAM type: YTN; PAM sequence: TTT
agataggaaggcattgttta

SEQ ID NO: 73097 - DNA, 20 bp, Artificial Sequence
  Description of Artificial Sequence: Synthetic oligonucleotide
  Target: SCN9A; (-) strand; PAM type: YTN; PAM sequence: TTG
tttagataggaaggcattgt

SEQ ID NO: 73098 - DNA, 20 bp, Artificial Sequence
  Description of Artificial Sequence: Synthetic oligonucleotide
  Target: SCN9A; (-) strand; PAM type: YTN; PAM sequence: TTA
ggtattgtttagataggaag

SEQ ID NO: 73099 - DNA, 20 bp, Artificial Sequence
  Description of Artificial Sequence: Synthetic oligonucleotide
  Target: SCN9A; (-) strand; PAM type: YTN; PAM sequence: TTT
aggtattgtttagataggaa

SEQ ID NO: 73100 - DNA, 20 bp, Artificial Sequence
  Description of Artificial Sequence: Synthetic oligonucleotide
  Target: SCN9A; (-) strand; PAM type: YTN; PAM sequence: CTG
tgaaaagaaaggtatttagg

SEQ ID NO: 73101 - DNA, 20 bp, Artificial Sequence
  Description of Artificial Sequence: Synthetic oligonucleotide
  Target: SCN9A; (-) strand; PAM type: YTN; PAM sequence: CTC
tgtgaaaagaaaggtattta

SEQ ID NO: 73102 - DNA, 20 bp, Artificial Sequence
  Description of Artificial Sequence: Synthetic oligonucleotide
  Target: SCN9A; (-) strand; PAM type: YTN; PAM sequence: TTC
tctgtgaaaagaaaggtatt

SEQ ID NO: 73103 - DNA, 20 bp, Artificial Sequence
  Description of Artificial Sequence: Synthetic oligonucleotide
  Target: SCN9A; (-) strand; PAM type: YTN; PAM sequence: CTT
ctctgtgaaaagaaaggtat

SEQ ID NO: 73104 - DNA, 20 bp, Artificial Sequence
  Description of Artificial Sequence: Synthetic oligonucleotide
  Target: SCN9A; (-) strand; PAM type: YTN; PAM sequence: TTA
gtatcttctctgtgaaaaga

SEQ ID NO: 73105 - DNA, 20 bp, Artificial Sequence
  Description of Artificial Sequence: Synthetic oligonucleotide
  Target: SCN9A; (-) strand; PAM type: YTN; PAM sequence: TTT
agtatcttctctgtgaaaag

SEQ ID NO: 73106 - DNA, 20 bp, Artificial Sequence
  Description of Artificial Sequence: Synthetic oligonucleotide
  Target: SCN9A; (-) strand; PAM type: YTN; PAM sequence: TTT
tagtatcttctctgtgaaaa

SEQ ID NO: 73107 - DNA, 20 bp, Artificial Sequence
  Description of Artificial Sequence: Synthetic oligonucleotide
  Target: SCN9A; (-) strand; PAM type: YTN; PAM sequence: TTT
ttagtatcttctctgtgaaa

SEQ ID NO: 73108 - DNA, 20 bp, Artificial Sequence
  Description of Artificial Sequence: Synthetic oligonucleotide
  Target: SCN9A; (-) strand; PAM type: YTN; PAM sequence: TTT
tttagtatcttctctgtgaa

SEQ ID NO: 73109 - DNA, 20 bp, Artificial Sequence
  Description of Artificial Sequence: Synthetic oligonucleotide
  Target: SCN9A; (-) strand; PAM type: YTN; PAM sequence: CTC
aatattttttagtatcttct

SEQ ID NO: 73110 - DNA, 20 bp, Artificial Sequence
  Description of Artificial Sequence: Synthetic oligonucleotide
  Target: SCN9A; (-) strand; PAM type: YTN; PAM sequence: TTC
cactcaatattttttagtat

SEQ ID NO: 73111 - DNA, 20 bp, Artificial Sequence
  Description of Artificial Sequence: Synthetic oligonucleotide
  Target: SCN9A; (-) strand; PAM type: YTN; PAM sequence: TTT
ccactcaatattttttagta

SEQ ID NO: 73112 - DNA, 20 bp, Artificial Sequence
  Description of Artificial Sequence: Synthetic oligonucleotide
  Target: SCN9A; (-) strand; PAM type: YTN; PAM sequence: TTT
tccactcaatattttttagt

SEQ ID NO: 73113 - DNA, 20 bp, Artificial Sequence
  Description of Artificial Sequence: Synthetic oligonucleotide
  Target: SCN9A; (-) strand; PAM type: YTN; PAM sequence: CTC
accacattttccactcaata

SEQ ID NO: 73114 - DNA, 20 bp, Artificial Sequence
  Description of Artificial Sequence: Synthetic oligonucleotide
  Target: SCN9A; (-) strand; PAM type: YTN; PAM sequence: CTC
tcaccacattttccactcaa

SEQ ID NO: 73115 - DNA, 20 bp, Artificial Sequence
  Description of Artificial Sequence: Synthetic oligonucleotide
  Target: SCN9A; (-) strand; PAM type: YTN; PAM sequence: TTG
gctctcaccacattttccac

SEQ ID NO: 73116 - DNA, 20 bp, Artificial Sequence
  Description of Artificial Sequence: Synthetic oligonucleotide
  Target: SCN9A; (-) strand; PAM type: YTN; PAM sequence: CTT
ggctctcaccacattttcca

SEQ ID NO: 73117 - DNA, 20 bp, Artificial Sequence
  Description of Artificial Sequence: Synthetic oligonucleotide
  Target: SCN9A; (-) strand; PAM type: YTN; PAM sequence: TTC
ccttggctctcaccacattt

SEQ ID NO: 73118 - DNA, 20 bp, Artificial Sequence
  Description of Artificial Sequence: Synthetic oligonucleotide
  Target: SCN9A; (-) strand; PAM type: YTN; PAM sequence: TTC
aaagggaaaggcattccctt

SEQ ID NO: 73119 - DNA, 20 bp, Artificial Sequence
  Description of Artificial Sequence: Synthetic oligonucleotide
  Target: SCN9A; (-) strand; PAM type: YTN; PAM sequence: TTC
aggcaaattcaaagggaaag

SEQ ID NO: 73120 - DNA, 20 bp, Artificial Sequence
  Description of Artificial Sequence: Synthetic oligonucleotide
  Target: SCN9A; (-) strand; PAM type: YTN; PAM sequence: TTA
ttcaggcaaattcaaaggga

SEQ ID NO: 73121 - DNA, 20 bp, Artificial Sequence
  Description of Artificial Sequence: Synthetic oligonucleotide
  Target: SCN9A; (-) strand; PAM type: YTN; PAM sequence: TTT
attcaggcaaattcaaaggg

SEQ ID NO: 73122 - DNA, 20 bp, Artificial Sequence
  Description of Artificial Sequence: Synthetic oligonucleotide
  Target: SCN9A; (-) strand; PAM type: YTN; PAM sequence: TTA
tttattcaggcaaattcaaa

SEQ ID NO: 73123 - DNA, 20 bp, Artificial Sequence
  Description of Artificial Sequence: Synthetic oligonucleotide
  Target: SCN9A; (-) strand; PAM type: YTN; PAM sequence: TTA
ttatttattcaggcaaattc

SEQ ID NO: 73124 - DNA, 20 bp, Artificial Sequence
  Description of Artificial Sequence: Synthetic oligonucleotide
  Target: SCN9A; (-) strand; PAM type: YTN; PAM sequence: TTT
attatttattcaggcaaatt

SEQ ID NO: 73125 - DNA, 20 bp, Artificial Sequence
  Description of Artificial Sequence: Synthetic oligonucleotide
  Target: SCN9A; (-) strand; PAM type: YTN; PAM sequence: TTA
aatgtttattatttattcag

SEQ ID NO: 73126 - DNA, 20 bp, Artificial Sequence
  Description of Artificial Sequence: Synthetic oligonucleotide
  Target: SCN9A; (-) strand; PAM type: YTN; PAM sequence: TTT
aaatgtttattatttattca

SEQ ID NO: 73127 - DNA, 20 bp, Artificial Sequence
  Description of Artificial Sequence: Synthetic oligonucleotide
  Target: SCN9A; (-) strand; PAM type: YTN; PAM sequence: TTG
tgaaaacatgccacatcaaa

SEQ ID NO: 73128 - DNA, 20 bp, Artificial Sequence
  Description of Artificial Sequence: Synthetic oligonucleotide
  Target: SCN9A; (-) strand; PAM type: YTN; PAM sequence: CTT
gtgaaaacatgccacatcaa

SEQ ID NO: 73129 - DNA, 20 bp, Artificial Sequence
  Description of Artificial Sequence: Synthetic oligonucleotide
  Target: SCN9A; (-) strand; PAM type: YTN; PAM sequence: TTG
ggaaaggtataacttgtgaa

SEQ ID NO: 73130 - DNA, 20 bp, Artificial Sequence
  Description of Artificial Sequence: Synthetic oligonucleotide
  Target: SCN9A; (-) strand; PAM type: YTN; PAM sequence: TTG
acataaaatcgtgaaattgg

SEQ ID NO: 73131 - DNA, 20 bp, Artificial Sequence
  Description of Artificial Sequence: Synthetic oligonucleotide
  Target: SCN9A; (-) strand; PAM type: YTN; PAM sequence: TTT
gacataaaatcgtgaaattg

SEQ ID NO: 73132 - DNA, 20 bp, Artificial Sequence
  Description of Artificial Sequence: Synthetic oligonucleotide
  Target: SCN9A; (-) strand; PAM type: YTN; PAM sequence: TTT
tgacataaaatcgtgaaatt

SEQ ID NO: 73133 - DNA, 20 bp, Artificial Sequence
  Description of Artificial Sequence: Synthetic oligonucleotide
  Target: SCN9A; (-) strand; PAM type: YTN; PAM sequence: TTA
caaaattttgacataaaatc

SEQ ID NO: 73134 - DNA, 20 bp, Artificial Sequence
  Description of Artificial Sequence: Synthetic oligonucleotide
  Target: SCN9A; (-) strand; PAM type: YTN; PAM sequence: CTT
acaaaattttgacataaaat

SEQ ID NO: 73135 - DNA, 20 bp, Artificial Sequence
  Description of Artificial Sequence: Synthetic oligonucleotide
  Target: SCN9A; (-) strand; PAM type: YTN; PAM sequence: TTC
ttacaaaattttgacataaa

SEQ ID NO: 73136 - DNA, 20 bp, Artificial Sequence
  Description of Artificial Sequence: Synthetic oligonucleotide
  Target: SCN9A; (-) strand; PAM type: YTN; PAM sequence: CTT
cttacaaaattttgacataa

SEQ ID NO: 73137 - DNA, 20 bp, Artificial Sequence
  Description of Artificial Sequence: Synthetic oligonucleotide
  Target: SCN9A; (-) strand; PAM type: YTN; PAM sequence: TTC
ttcttacaaaattttgacat

SEQ ID NO: 73138 - DNA, 20 bp, Artificial Sequence
  Description of Artificial Sequence: Synthetic oligonucleotide
  Target: SCN9A; (-) strand; PAM type: YTN; PAM sequence: TTT
cttcttacaaaattttgaca

SEQ ID NO: 73139 - DNA, 20 bp, Artificial Sequence
  Description of Artificial Sequence: Synthetic oligonucleotide
  Target: SCN9A; (-) strand; PAM type: YTN; PAM sequence: CTG
tgcatttcttcttacaaaat

SEQ ID NO: 73140 - DNA, 20 bp, Artificial Sequence
  Description of Artificial Sequence: Synthetic oligonucleotide
  Target: SCN9A; (-) strand; PAM type: YTN; PAM sequence: CTG
cgcccagctgtgcatttctt

SEQ ID NO: 73141 - DNA, 20 bp, Artificial Sequence
  Description of Artificial Sequence: Synthetic oligonucleotide
  Target: SCN9A; (-) strand; PAM type: YTN; PAM sequence: CTA
ctgcgcccagctgtgcattt

SEQ ID NO: 73142 - DNA, 20 bp, Artificial Sequence
  Description of Artificial Sequence: Synthetic oligonucleotide
  Target: SCN9A; (-) strand; PAM type: YTN; PAM sequence: TTA
caggcgtgagctactgcgcc

SEQ ID NO: 73143 - DNA, 20 bp, Artificial Sequence
  Description of Artificial Sequence: Synthetic oligonucleotide
  Target: SCN9A; (-) strand; PAM type: YTN; PAM sequence: CTA
gaattacaggcgtgagctac

SEQ ID NO: 73144 - DNA, 20 bp, Artificial Sequence
  Description of Artificial Sequence: Synthetic oligonucleotide
  Target: SCN9A; (-) strand; PAM type: YTN; PAM sequence: CTC
ccaaagtgctagaattacag

SEQ ID NO: 73145 - DNA, 20 bp, Artificial Sequence
  Description of Artificial Sequence: Synthetic oligonucleotide
  Target: SCN9A; (-) strand; PAM type: YTN; PAM sequence: CTC
cgtcgcctcccaaagtgcta

SEQ ID NO: 73146 - DNA, 20 bp, Artificial Sequence
  Description of Artificial Sequence: Synthetic oligonucleotide
  Target: SCN9A; (-) strand; PAM type: YTN; PAM sequence: CTC
aggtgatccagcctccgtcg

SEQ ID NO: 73147 - DNA, 20 bp, Artificial Sequence
  Description of Artificial Sequence: Synthetic oligonucleotide
  Target: SCN9A; (-) strand; PAM type: YTN; PAM sequence: CTG
acctcaggtgatccagcctc

SEQ ID NO: 73148 - DNA, 20 bp, Artificial Sequence
  Description of Artificial Sequence: Synthetic oligonucleotide
  Target: SCN9A; (-) strand; PAM type: YTN; PAM sequence: CTC
ctgacctcaggtgatccagc

SEQ ID NO: 73149 - DNA, 20 bp, Artificial Sequence
  Description of Artificial Sequence: Synthetic oligonucleotide
  Target: SCN9A; (-) strand; PAM type: YTN; PAM sequence: CTC
gaactcctgacctcaggtga

SEQ ID NO: 73150 - DNA, 20 bp, Artificial Sequence
  Description of Artificial Sequence: Synthetic oligonucleotide
  Target: SCN9A; (-) strand; PAM type: YTN; PAM sequence: CTG
gtctcgaactcctgacctca

SEQ ID NO: 73151 - DNA, 20 bp, Artificial Sequence
  Description of Artificial Sequence: Synthetic oligonucleotide
  Target: SCN9A; (-) strand; PAM type: YTN; PAM sequence: TTG
gccaggctggtctcgaactc

SEQ ID NO: 73152 - DNA, 20 bp, Artificial Sequence
  Description of Artificial Sequence: Synthetic oligonucleotide
  Target: SCN9A; (-) strand; PAM type: YTN; PAM sequence: TTC
gtcatgttggccaggctggt

SEQ ID NO: 73153 - DNA, 20 bp, Artificial Sequence
  Description of Artificial Sequence: Synthetic oligonucleotide
  Target: SCN9A; (-) strand; PAM type: YTN; PAM sequence: TTT
cgtcatgttggccaggctgg

SEQ ID NO: 73154 - DNA, 20 bp, Artificial Sequence
  Description of Artificial Sequence: Synthetic oligonucleotide
  Target: SCN9A; (-) strand; PAM type: YTN; PAM sequence: TTT
tcgtcatgttggccaggctg

SEQ ID NO: 73155 - DNA, 20 bp, Artificial Sequence
  Description of Artificial Sequence: Synthetic oligonucleotide
  Target: SCN9A; (-) strand; PAM type: YTN; PAM sequence: TTA
gtagagacaggttttcgtca

SEQ ID NO: 73156 - DNA, 20 bp, Artificial Sequence
  Description of Artificial Sequence: Synthetic oligonucleotide
  Target: SCN9A; (-) strand; PAM type: YTN; PAM sequence: TTT
agtagagacaggttttcgtc

SEQ ID NO: 73157 - DNA, 20 bp, Artificial Sequence
  Description of Artificial Sequence: Synthetic oligonucleotide
  Target: SCN9A; (-) strand; PAM type: YTN; PAM sequence: TTT
tagtagagacaggttttcgt

SEQ ID NO: 73158 - DNA, 20 bp, Artificial Sequence
  Description of Artificial Sequence: Synthetic oligonucleotide
  Target: SCN9A; (-) strand; PAM type: YTN; PAM sequence: TTT
ttagtagagacaggttttcg

SEQ ID NO: 73159 - DNA, 20 bp, Artificial Sequence
  Description of Artificial Sequence: Synthetic oligonucleotide
  Target: SCN9A; (-) strand; PAM type: YTN; PAM sequence: TTG
tatttttagtagagacaggt

SEQ ID NO: 73160 - DNA, 20 bp, Artificial Sequence
  Description of Artificial Sequence: Synthetic oligonucleotide
  Target: SCN9A; (-) strand; PAM type: YTN; PAM sequence: TTT
gtatttttagtagagacagg

SEQ ID NO: 73161 - DNA, 20 bp, Artificial Sequence
  Description of Artificial Sequence: Synthetic oligonucleotide
  Target: SCN9A; (-) strand; PAM type: YTN; PAM sequence: TTT
tgtatttttagtagagacag

SEQ ID NO: 73162 - DNA, 20 bp, Artificial Sequence
  Description of Artificial Sequence: Synthetic oligonucleotide
  Target: SCN9A; (-) strand; PAM type: YTN; PAM sequence: TTT
ttgtatttttagtagagaca

SEQ ID NO: 73163 - DNA, 20 bp, Artificial Sequence
  Description of Artificial Sequence: Synthetic oligonucleotide
  Target: SCN9A; (-) strand; PAM type: YTN; PAM sequence: CTA
atttttgtatttttagtaga

SEQ ID NO: 73164 - DNA, 20 bp, Artificial Sequence
  Description of Artificial Sequence: Synthetic oligonucleotide
  Target: SCN9A; (-) strand; PAM type: YTN; PAM sequence: CTA
ccgtgccagctaatttttgt

SEQ ID NO: 73165 - DNA, 20 bp, Artificial Sequence
  Description of Artificial Sequence: Synthetic oligonucleotide
  Target: SCN9A; (-) strand; PAM type: YTN; PAM sequence: TTA
caggtgcatgctaccgtgcc

SEQ ID NO: 73166 - DNA, 20 bp, Artificial Sequence
  Description of Artificial Sequence: Synthetic oligonucleotide
  Target: SCN9A; (-) strand; PAM type: YTN; PAM sequence: CTG
agattacaggtgcatgctac

SEQ ID NO: 73167 - DNA, 20 bp, Artificial Sequence
  Description of Artificial Sequence: Synthetic oligonucleotide
  Target: SCN9A; (-) strand; PAM type: YTN; PAM sequence: CTG
agtagctgagattacaggtg

SEQ ID NO: 73168 - DNA, 20 bp, Artificial Sequence
  Description of Artificial Sequence: Synthetic oligonucleotide
  Target: SCN9A; (-) strand; PAM type: YTN; PAM sequence: CTC
ctgagtagctgagattacag

SEQ ID NO: 73169 - DNA, 20 bp, Artificial Sequence
  Description of Artificial Sequence: Synthetic oligonucleotide
  Target: SCN9A; (-) strand; PAM type: YTN; PAM sequence: CTC
agcctcctgagtagctgaga

SEQ ID NO: 73170 - DNA, 20 bp, Artificial Sequence
  Description of Artificial Sequence: Synthetic oligonucleotide
  Target: SCN9A; (-) strand; PAM type: YTN; PAM sequence: CTG
cctcagcctcctgagtagct

SEQ ID NO: 73171 - DNA, 20 bp, Artificial Sequence
  Description of Artificial Sequence: Synthetic oligonucleotide
  Target: SCN9A; (-) strand; PAM type: YTN; PAM sequence: TTC
tgcctcagcctcctgagtag

SEQ ID NO: 73172 - DNA, 20 bp, Artificial Sequence
  Description of Artificial Sequence: Synthetic oligonucleotide
  Target: SCN9A; (-) strand; PAM type: YTN; PAM sequence: CTT
ctgcctcagcctcctgagta

SEQ ID NO: 73173 - DNA, 20 bp, Artificial Sequence
  Description of Artificial Sequence: Synthetic oligonucleotide
  Target: SCN9A; (-) strand; PAM type: YTN; PAM sequence: TTC
ttctgcctcagcctcctgag

SEQ ID NO: 73174 - DNA, 20 bp, Artificial Sequence
  Description of Artificial Sequence: Synthetic oligonucleotide
  Target: SCN9A; (-) strand; PAM type: YTN; PAM sequence: TTC
aagcaattcttctgcctcag

SEQ ID NO: 73175 - DNA, 20 bp, Artificial Sequence
  Description of Artificial Sequence: Synthetic oligonucleotide
  Target: SCN9A; (-) strand; PAM type: YTN; PAM sequence: CTC
ccaggttcaagcaattcttc

SEQ ID NO: 73176 - DNA, 20 bp, Artificial Sequence
  Description of Artificial Sequence: Synthetic oligonucleotide
  Target: SCN9A; (-) strand; PAM type: YTN; PAM sequence: CTC
cacctcccaggttcaagcaa

SEQ ID NO: 73177 - DNA, 20 bp, Artificial Sequence
  Description of Artificial Sequence: Synthetic oligonucleotide
  Target: SCN9A; (-) strand; PAM type: YTN; PAM sequence: CTC
accccaacctccacctccca

SEQ ID NO: 73178 - DNA, 20 bp, Artificial Sequence
  Description of Artificial Sequence: Synthetic oligonucleotide
  Target: SCN9A; (-) strand; PAM type: YTN; PAM sequence: CTC
ggctcaccccaacctccacc

SEQ ID NO: 73179 - DNA, 20 bp, Artificial Sequence
  Description of Artificial Sequence: Synthetic oligonucleotide
  Target: SCN9A; (-) strand; PAM type: YTN; PAM sequence: CTG
gagtgcaatgatgtgatctc

SEQ ID NO: 73180 - DNA, 20 bp, Artificial Sequence
  Description of Artificial Sequence: Synthetic oligonucleotide
  Target: SCN9A; (-) strand; PAM type: YTN; PAM sequence: TTG
cccaggctggagtgcaatga

SEQ ID NO: 73181 - DNA, 20 bp, Artificial Sequence
  Description of Artificial Sequence: Synthetic oligonucleotide
  Target: SCN9A; (-) strand; PAM type: YTN; PAM sequence: TTG
ttgcccaggctggagtgcaa

SEQ ID NO: 73182 - DNA, 20 bp, Artificial Sequence
  Description of Artificial Sequence: Synthetic oligonucleotide
  Target: SCN9A; (-) strand; PAM type: YTN; PAM sequence: TTT
gttgcccaggctggagtgca

SEQ ID NO: 73183 - DNA, 20 bp, Artificial Sequence
  Description of Artificial Sequence: Synthetic oligonucleotide
  Target: SCN9A; (-) strand; PAM type: YTN; PAM sequence: CTT
tgttgcccaggctggagtgc

SEQ ID NO: 73184 - DNA, 20 bp, Artificial Sequence
  Description of Artificial Sequence: Synthetic oligonucleotide
  Target: SCN9A; (-) strand; PAM type: YTN; PAM sequence: CTC
gctttgttgcccaggctgga

SEQ ID NO: 73185 - DNA, 20 bp, Artificial Sequence
  Description of Artificial Sequence: Synthetic oligonucleotide
  Target: SCN9A; (-) strand; PAM type: YTN; PAM sequence: TTG
agatggaatctcgctttgtt

SEQ ID NO: 73186 - DNA, 20 bp, Artificial Sequence
  Description of Artificial Sequence: Synthetic oligonucleotide
  Target: SCN9A; (-) strand; PAM type: YTN; PAM sequence: TTT
gagatggaatctcgctttgt

SEQ ID NO: 73187 - DNA, 20 bp, Artificial Sequence
  Description of Artificial Sequence: Synthetic oligonucleotide
  Target: SCN9A; (-) strand; PAM type: YTN; PAM sequence: TTT
tgagatggaatctcgctttg

SEQ ID NO: 73188 - DNA, 20 bp, Artificial Sequence
  Description of Artificial Sequence: Synthetic oligonucleotide
  Target: SCN9A; (-) strand; PAM type: YTN; PAM sequence: TTT
ttgagatggaatctcgcttt

SEQ ID NO: 73189 - DNA, 20 bp, Artificial Sequence
  Description of Artificial Sequence: Synthetic oligonucleotide
  Target: SCN9A; (-) strand; PAM type: YTN; PAM sequence: TTT
tttgagatggaatctcgctt

SEQ ID NO: 73190 - DNA, 20 bp, Artificial Sequence
  Description of Artificial Sequence: Synthetic oligonucleotide
  Target: SCN9A; (-) strand; PAM type: YTN; PAM sequence: TTT
ttttgagatggaatctcgct

SEQ ID NO: 73191 - DNA, 20 bp, Artificial Sequence
  Description of Artificial Sequence: Synthetic oligonucleotide
  Target: SCN9A; (-) strand; PAM type: YTN; PAM sequence: TTT
tttttgagatggaatctcgc

SEQ ID NO: 73192 - DNA, 20 bp, Artificial Sequence
  Description of Artificial Sequence: Synthetic oligonucleotide
  Target: SCN9A; (-) strand; PAM type: YTN; PAM sequence: TTT
ttttttgagatggaatctcg

SEQ ID NO: 73193 - DNA, 20 bp, Artificial Sequence
  Description of Artificial Sequence: Synthetic oligonucleotide
  Target: SCN9A; (-) strand; PAM type: YTN; PAM sequence: TTT
tttttttgagatggaatctc

SEQ ID NO: 73194 - DNA, 20 bp, Artificial Sequence
  Description of Artificial Sequence: Synthetic oligonucleotide
  Target: SCN9A; (-) strand; PAM type: YTN; PAM sequence: TTT
ttttttttgagatggaatct

SEQ ID NO: 73195 - DNA, 20 bp, Artificial Sequence
  Description of Artificial Sequence: Synthetic oligonucleotide
  Target: SCN9A; (-) strand; PAM type: YTN; PAM sequence: TTT
tttttttttgagatggaatc

SEQ ID NO: 73196 - DNA, 20 bp, Artificial Sequence
  Description of Artificial Sequence: Synthetic oligonucleotide
  Target: SCN9A; (-) strand; PAM type: YTN; PAM sequence: TTT
ttttttttttgagatggaat

SEQ ID NO: 73197 - DNA, 20 bp, Artificial Sequence
  Description of Artificial Sequence: Synthetic oligonucleotide
  Target: SCN9A; (-) strand; PAM type: YTN; PAM sequence: TTT
tttttttttttgagatggaa

SEQ ID NO: 73198 - DNA, 20 bp, Artificial Sequence
  Description of Artificial Sequence: Synthetic oligonucleotide
  Target: SCN9A; (-) strand; PAM type: YTN; PAM sequence: TTG
tgtattttttttttttttga

SEQ ID NO: 73199 - DNA, 20 bp, Artificial Sequence
  Description of Artificial Sequence: Synthetic oligonucleotide
  Target: SCN9A; (-) strand; PAM type: YTN; PAM sequence: CTT
gtgtattttttttttttttg

SEQ ID NO: 73200 - DNA, 20 bp, Artificial Sequence
  Description of Artificial Sequence: Synthetic oligonucleotide
  Target: SCN9A; (-) strand; PAM type: YTN; PAM sequence: TTG
cttgtgtatttttttttttt

SEQ ID NO: 73201 - DNA, 20 bp, Artificial Sequence
  Description of Artificial Sequence: Synthetic oligonucleotide
  Target: SCN9A; (-) strand; PAM type: YTN; PAM sequence: TTT
gcttgtgtattttttttttt

SEQ ID NO: 73202 - DNA, 20 bp, Artificial Sequence
  Description of Artificial Sequence: Synthetic oligonucleotide
  Target: SCN9A; (-) strand; PAM type: YTN; PAM sequence: CTA
tagcaggatttgcttgtgta

SEQ ID NO: 73203 - DNA, 20 bp, Artificial Sequence
  Description of Artificial Sequence: Synthetic oligonucleotide
  Target: SCN9A; (-) strand; PAM type: YTN; PAM sequence: CTC
ctatagcaggatttgcttgt

SEQ ID NO: 73204 - DNA, 20 bp, Artificial Sequence
  Description of Artificial Sequence: Synthetic oligonucleotide
  Target: SCN9A; (-) strand; PAM type: YTN; PAM sequence: TTA
taagctcctatagcaggatt

SEQ ID NO: 73205 - DNA, 20 bp, Artificial Sequence
  Description of Artificial Sequence: Synthetic oligonucleotide
  Target: SCN9A; (-) strand; PAM type: YTN; PAM sequence: TTT
ataagctcctatagcaggat

SEQ ID NO: 73206 - DNA, 20 bp, Artificial Sequence
  Description of Artificial Sequence: Synthetic oligonucleotide
  Target: SCN9A; (-) strand; PAM type: YTN; PAM sequence: TTG
tatttataagctcctatagc

SEQ ID NO: 73207 - DNA, 20 bp, Artificial Sequence
  Description of Artificial Sequence: Synthetic oligonucleotide
  Target: SCN9A; (-) strand; PAM type: YTN; PAM sequence: TTT
gtatttataagctcctatag

SEQ ID NO: 73208 - DNA, 20 bp, Artificial Sequence
  Description of Artificial Sequence: Synthetic oligonucleotide
  Target: SCN9A; (-) strand; PAM type: YTN; PAM sequence: TTT
tgtatttataagctcctata

SEQ ID NO: 73209 - DNA, 20 bp, Artificial Sequence
  Description of Artificial Sequence: Synthetic oligonucleotide
  Target: SCN9A; (-) strand; PAM type: YTN; PAM sequence: CTG
ttttgtatttataagctcct

SEQ ID NO: 73210 - DNA, 20 bp, Artificial Sequence
  Description of Artificial Sequence: Synthetic oligonucleotide
  Target: SCN9A; (-) strand; PAM type: YTN; PAM sequence: CTC
tgttttgtatttataagctc

SEQ ID NO: 73211 - DNA, 20 bp, Artificial Sequence
  Description of Artificial Sequence: Synthetic oligonucleotide
  Target: SCN9A; (-) strand; PAM type: YTN; PAM sequence: TTC
tctgttttgtatttataagc

SEQ ID NO: 73212 - DNA, 20 bp, Artificial Sequence
  Description of Artificial Sequence: Synthetic oligonucleotide
  Target: SCN9A; (-) strand; PAM type: YTN; PAM sequence: CTT
ctctgttttgtatttataag

SEQ ID NO: 73213 - DNA, 20 bp, Artificial Sequence
  Description of Artificial Sequence: Synthetic oligonucleotide
  Target: SCN9A; (-) strand; PAM type: YTN; PAM sequence: TTC
ttctctgttttgtatttata

SEQ ID NO: 73214 - DNA, 20 bp, Artificial Sequence
  Description of Artificial Sequence: Synthetic oligonucleotide
  Target: SCN9A; (-) strand; PAM type: YTN; PAM sequence: CTT
cttctctgttttgtatttat

SEQ ID NO: 73215 - DNA, 20 bp, Artificial Sequence
  Description of Artificial Sequence: Synthetic oligonucleotide
  Target: SCN9A; (-) strand; PAM type: YTN; PAM sequence: TTC
ttcttctctgttttgtattt

SEQ ID NO: 73216 - DNA, 20 bp, Artificial Sequence
  Description of Artificial Sequence: Synthetic oligonucleotide
  Target: SCN9A; (-) strand; PAM type: YTN; PAM sequence: TTT
cttcttctctgttttgtatt

SEQ ID NO: 73217 - DNA, 20 bp, Artificial Sequence
  Description of Artificial Sequence: Synthetic oligonucleotide
  Target: SCN9A; (-) strand; PAM type: YTN; PAM sequence: TTG
tttcttcttctctgttttgt

SEQ ID NO: 73218 - DNA, 20 bp, Artificial Sequence
  Description of Artificial Sequence: Synthetic oligonucleotide
  Target: SCN9A; (-) strand; PAM type: YTN; PAM sequence: TTT
gtttcttcttctctgttttg

SEQ ID NO: 73219 - DNA, 20 bp, Artificial Sequence
  Description of Artificial Sequence: Synthetic oligonucleotide
  Target: SCN9A; (-) strand; PAM type: YTN; PAM sequence: CTT
tgtttcttcttctctgtttt

SEQ ID NO: 73220 - DNA, 20 bp, Artificial Sequence
  Description of Artificial Sequence: Synthetic oligonucleotide
  Target: SCN9A; (-) strand; PAM type: YTN; PAM sequence: CTC
tttgtttcttcttctctgtt

SEQ ID NO: 73221 - DNA, 20 bp, Artificial Sequence
  Description of Artificial Sequence: Synthetic oligonucleotide
  Target: SCN9A; (-) strand; PAM type: YTN; PAM sequence: TTC
tctttgtttcttcttctctg

SEQ ID NO: 73222 - DNA, 20 bp, Artificial Sequence
  Description of Artificial Sequence: Synthetic oligonucleotide
  Target: SCN9A; (-) strand; PAM type: YTN; PAM sequence: TTC
caatatggaatgaaatgcac

SEQ ID NO: 73223 - DNA, 20 bp, Artificial Sequence
  Description of Artificial Sequence: Synthetic oligonucleotide
  Target: SCN9A; (-) strand; PAM type: YTN; PAM sequence: CTT
ccaatatggaatgaaatgca

SEQ ID NO: 73224 - DNA, 20 bp, Artificial Sequence
  Description of Artificial Sequence: Synthetic oligonucleotide
  Target: SCN9A; (-) strand; PAM type: YTN; PAM sequence: TTC
cttccaatatggaatgaaat

SEQ ID NO: 73225 - DNA, 20 bp, Artificial Sequence
  Description of Artificial Sequence: Synthetic oligonucleotide
  Target: SCN9A; (-) strand; PAM type: YTN; PAM sequence: TTA
caaattccttccaatatgga

SEQ ID NO: 73226 - DNA, 20 bp, Artificial Sequence
  Description of Artificial Sequence: Synthetic oligonucleotide
  Target: SCN9A; (-) strand; PAM type: YTN; PAM sequence: CTT
acaaattccttccaatatgg

SEQ ID NO: 73227 - DNA, 20 bp, Artificial Sequence
  Description of Artificial Sequence: Synthetic oligonucleotide
  Target: SCN9A; (-) strand; PAM type: YTN; PAM sequence: TTA
tatagccttacaaattcctt

SEQ ID NO: 73228 - DNA, 20 bp, Artificial Sequence
  Description of Artificial Sequence: Synthetic oligonucleotide
  Target: SCN9A; (-) strand; PAM type: YTN; PAM sequence: TTT
atatagccttacaaattcct

SEQ ID NO: 73229 - DNA, 20 bp, Artificial Sequence
  Description of Artificial Sequence: Synthetic oligonucleotide
  Target: SCN9A; (-) strand; PAM type: YTN; PAM sequence: TTT
tatatagccttacaaattcc

SEQ ID NO: 73230 - DNA, 20 bp, Artificial Sequence
  Description of Artificial Sequence: Synthetic oligonucleotide
  Target: SCN9A; (-) strand; PAM type: YTN; PAM sequence: CTA
gttttatatagccttacaaa

SEQ ID NO: 73231 - DNA, 20 bp, Artificial Sequence
  Description of Artificial Sequence: Synthetic oligonucleotide
  Target: SCN9A; (-) strand; PAM type: YTN; PAM sequence: TTC
ctagttttatatagccttac

SEQ ID NO: 73232 - DNA, 20 bp, Artificial Sequence
  Description of Artificial Sequence: Synthetic oligonucleotide
  Target: SCN9A; (-) strand; PAM type: YTN; PAM sequence: CTT
cctagttttatatagcctta

SEQ ID NO: 73233 - DNA, 20 bp, Artificial Sequence
  Description of Artificial Sequence: Synthetic oligonucleotide
  Target: SCN9A; (-) strand; PAM type: YTN; PAM sequence: TTG
tagtaataaataagcttcct

SEQ ID NO: 73234 - DNA, 20 bp, Artificial Sequence
  Description of Artificial Sequence: Synthetic oligonucleotide
  Target: SCN9A; (-) strand; PAM type: YTN; PAM sequence: CTC
aagttgtagtaataaataag

SEQ ID NO: 73235 - DNA, 20 bp, Artificial Sequence
  Description of Artificial Sequence: Synthetic oligonucleotide
  Target: SCN9A; (-) strand; PAM type: YTN; PAM sequence: TTG
atcaccctcaagttgtagta

SEQ ID NO: 73236 - DNA, 20 bp, Artificial Sequence
  Description of Artificial Sequence: Synthetic oligonucleotide
  Target: SCN9A; (-) strand; PAM type: YTN; PAM sequence: TTG
ttgatcaccctcaagttgta

SEQ ID NO: 73237 - DNA, 20 bp, Artificial Sequence
  Description of Artificial Sequence: Synthetic oligonucleotide
  Target: SCN9A; (-) strand; PAM type: YTN; PAM sequence: CTA
taattgttgatcaccctcaa

SEQ ID NO: 73238 - DNA, 20 bp, Artificial Sequence
  Description of Artificial Sequence: Synthetic oligonucleotide
  Target: SCN9A; (-) strand; PAM type: YTN; PAM sequence: TTC
tataattgttgatcaccctc

SEQ ID NO: 73239 - DNA, 20 bp, Artificial Sequence
  Description of Artificial Sequence: Synthetic oligonucleotide
  Target: SCN9A; (-) strand; PAM type: YTN; PAM sequence: TTA
ccattctataattgttgatc

SEQ ID NO: 73240 - DNA, 20 bp, Artificial Sequence
  Description of Artificial Sequence: Synthetic oligonucleotide
  Target: SCN9A; (-) strand; PAM type: YTN; PAM sequence: CTG
gattaccattctataattgt

SEQ ID NO: 73241 - DNA, 20 bp, Artificial Sequence
  Description of Artificial Sequence: Synthetic oligonucleotide
  Target: SCN9A; (-) strand; PAM type: YTN; PAM sequence: CTG
cacaaaaaatatacatcctg

SEQ ID NO: 73242 - DNA, 20 bp, Artificial Sequence
  Description of Artificial Sequence: Synthetic oligonucleotide
  Target: SCN9A; (-) strand; PAM type: YTN; PAM sequence: TTA
ctgcacaaaaaatatacatc

SEQ ID NO: 73243 - DNA, 20 bp, Artificial Sequence
  Description of Artificial Sequence: Synthetic oligonucleotide
  Target: SCN9A; (-) strand; PAM type: YTN; PAM sequence: TTT
actgcacaaaaaatatacat

SEQ ID NO: 73244 - DNA, 20 bp, Artificial Sequence
  Description of Artificial Sequence: Synthetic oligonucleotide
  Target: SCN9A; (-) strand; PAM type: YTN; PAM sequence: TTT
tactgcacaaaaaatataca

SEQ ID NO: 73245 - DNA, 20 bp, Artificial Sequence
  Description of Artificial Sequence: Synthetic oligonucleotide
  Target: SCN9A; (-) strand; PAM type: YTN; PAM sequence: TTT
ttactgcacaaaaaatatac

SEQ ID NO: 73246 - DNA, 20 bp, Artificial Sequence
  Description of Artificial Sequence: Synthetic oligonucleotide
  Target: SCN9A; (-) strand; PAM type: YTN; PAM sequence: CTA
gatttttactgcacaaaaaa

SEQ ID NO: 73247 - DNA, 20 bp, Artificial Sequence
  Description of Artificial Sequence: Synthetic oligonucleotide
  Target: SCN9A; (-) strand; PAM type: YTN; PAM sequence: TTC
tagatttttactgcacaaaa

SEQ ID NO: 73248 - DNA, 20 bp, Artificial Sequence
  Description of Artificial Sequence: Synthetic oligonucleotide
  Target: SCN9A; (-) strand; PAM type: YTN; PAM sequence: TTA
tgcagcacaaattctagatt

SEQ ID NO: 73249 - DNA, 20 bp, Artificial Sequence
  Description of Artificial Sequence: Synthetic oligonucleotide
  Target: SCN9A; (-) strand; PAM type: YTN; PAM sequence: TTT
atgcagcacaaattctagat

SEQ ID NO: 73250 - DNA, 20 bp, Artificial Sequence
  Description of Artificial Sequence: Synthetic oligonucleotide
  Target: SCN9A; (-) strand; PAM type: YTN; PAM sequence: CTG
tgccagacatacacaaaggc

SEQ ID NO: 73251 - DNA, 20 bp, Artificial Sequence
  Description of Artificial Sequence: Synthetic oligonucleotide
  Target: SCN9A; (-) strand; PAM type: YTN; PAM sequence: CTA
aatgatactgtgccagacat

SEQ ID NO: 73252 - DNA, 20 bp, Artificial Sequence
  Description of Artificial Sequence: Synthetic oligonucleotide
  Target: SCN9A; (-) strand; PAM type: YTN; PAM sequence: TTC
atccagtcacacactaaatg

SEQ ID NO: 73253 - DNA, 20 bp, Artificial Sequence
  Description of Artificial Sequence: Synthetic oligonucleotide
  Target: SCN9A; (-) strand; PAM type: YTN; PAM sequence: TTA
cattcatccagtcacacact

SEQ ID NO: 73254 - DNA, 20 bp, Artificial Sequence
  Description of Artificial Sequence: Synthetic oligonucleotide
  Target: SCN9A; (-) strand; PAM type: YTN; PAM sequence: CTT
acattcatccagtcacacac

SEQ ID NO: 73255 - DNA, 20 bp, Artificial Sequence
  Description of Artificial Sequence: Synthetic oligonucleotide
  Target: SCN9A; (-) strand; PAM type: YTN; PAM sequence: TTC
agaagtcaggacagaaactt

SEQ ID NO: 73256 - DNA, 20 bp, Artificial Sequence
  Description of Artificial Sequence: Synthetic oligonucleotide
  Target: SCN9A; (-) strand; PAM type: YTN; PAM sequence: TTG
taaccaccataaaaagagga

SEQ ID NO: 73257 - DNA, 20 bp, Artificial Sequence
  Description of Artificial Sequence: Synthetic oligonucleotide
  Target: SCN9A; (-) strand; PAM type: YTN; PAM sequence: CTT
gtaaccaccataaaaagagg

SEQ ID NO: 73258 - DNA, 20 bp, Artificial Sequence
  Description of Artificial Sequence: Synthetic oligonucleotide
  Target: SCN9A; (-) strand; PAM type: YTN; PAM sequence: TTG
tccttgtaaccaccataaaa

SEQ ID NO: 73259 - DNA, 20 bp, Artificial Sequence
  Description of Artificial Sequence: Synthetic oligonucleotide
  Target: SCN9A; (-) strand; PAM type: YTN; PAM sequence: TTG
ttgtccttgtaaccaccata

SEQ ID NO: 73260 - DNA, 20 bp, Artificial Sequence
  Description of Artificial Sequence: Synthetic oligonucleotide
  Target: SCN9A; (-) strand; PAM type: YTN; PAM sequence: CTA
aaatattgttgtccttgtaa

SEQ ID NO: 73261 - DNA, 20 bp, Artificial Sequence
  Description of Artificial Sequence: Synthetic oligonucleotide
  Target: SCN9A; (-) strand; PAM type: YTN; PAM sequence: TTA
ctaaaatattgttgtccttg

SEQ ID NO: 73262 - DNA, 20 bp, Artificial Sequence
  Description of Artificial Sequence: Synthetic oligonucleotide
  Target: SCN9A; (-) strand; PAM type: YTN; PAM sequence: TTG
aaaaaaattactaaaatatt

SEQ ID NO: 73263 - DNA, 20 bp, Artificial Sequence
  Description of Artificial Sequence: Synthetic oligonucleotide
  Target: SCN9A; (-) strand; PAM type: YTN; PAM sequence: CTG
agttgaaaaaaattactaaa

SEQ ID NO: 73264 - DNA, 20 bp, Artificial Sequence
  Description of Artificial Sequence: Synthetic oligonucleotide
  Target: SCN9A; (-) strand; PAM type: YTN; PAM sequence: TTC
ccactgagttgaaaaaaatt

SEQ ID NO: 73265 - DNA, 20 bp, Artificial Sequence
  Description of Artificial Sequence: Synthetic oligonucleotide
  Target: SCN9A; (-) strand; PAM type: YTN; PAM sequence: CTT
cccactgagttgaaaaaaat

SEQ ID NO: 73266 - DNA, 20 bp, Artificial Sequence
  Description of Artificial Sequence: Synthetic oligonucleotide
  Target: SCN9A; (-) strand; PAM type: YTN; PAM sequence: TTC
acttcccactgagttgaaaa

SEQ ID NO: 73267 - DNA, 20 bp, Artificial Sequence
  Description of Artificial Sequence: Synthetic oligonucleotide
  Target: SCN9A; (-) strand; PAM type: YTN; PAM sequence: CTT
cacttcccactgagttgaaa

SEQ ID NO: 73268 - DNA, 20 bp, Artificial Sequence
  Description of Artificial Sequence: Synthetic oligonucleotide
  Target: SCN9A; (-) strand; PAM type: YTN; PAM sequence: CTC
atcaggtatccagaaggtgg

SEQ ID NO: 73269 - DNA, 20 bp, Artificial Sequence
  Description of Artificial Sequence: Synthetic oligonucleotide
  Target: SCN9A; (-) strand; PAM type: YTN; PAM sequence: CTC
tcatcaggtatccagaaggt

SEQ ID NO: 73270 - DNA, 20 bp, Artificial Sequence
  Description of Artificial Sequence: Synthetic oligonucleotide
  Target: SCN9A; (-) strand; PAM type: YTN; PAM sequence: TTG
acatcaaatctctcatcagg

SEQ ID NO: 73271 - DNA, 20 bp, Artificial Sequence
  Description of Artificial Sequence: Synthetic oligonucleotide
  Target: SCN9A; (-) strand; PAM type: YTN; PAM sequence: CTT
gacatcaaatctctcatcag

SEQ ID NO: 73272 - DNA, 20 bp, Artificial Sequence
  Description of Artificial Sequence: Synthetic oligonucleotide
  Target: SCN9A; (-) strand; PAM type: YTN; PAM sequence: TTG
gtcagcttgacatcaaatct

SEQ ID NO: 73273 - DNA, 20 bp, Artificial Sequence
  Description of Artificial Sequence: Synthetic oligonucleotide
  Target: SCN9A; (-) strand; PAM type: YTN; PAM sequence: TTG
tcacagttggtcagcttgac

SEQ ID NO: 73274 - DNA, 20 bp, Artificial Sequence
  Description of Artificial Sequence: Synthetic oligonucleotide
  Target: SCN9A; (-) strand; PAM type: YTN; PAM sequence: CTT
gtcacagttggtcagcttga

SEQ ID NO: 73275 - DNA, 20 bp, Artificial Sequence
  Description of Artificial Sequence: Synthetic oligonucleotide
  Target: SCN9A; (-) strand; PAM type: YTN; PAM sequence: TTG
acttgtcacagttggtcagc

SEQ ID NO: 73276 - DNA, 20 bp, Artificial Sequence
  Description of Artificial Sequence: Synthetic oligonucleotide
  Target: SCN9A; (-) strand; PAM type: YTN; PAM sequence: CTG
ccacgttgacttgtcacagt

SEQ ID NO: 73277 - DNA, 20 bp, Artificial Sequence
  Description of Artificial Sequence: Synthetic oligonucleotide
  Target: SCN9A; (-) strand; PAM type: YTN; PAM sequence: CTC
aaatctgccacgttgacttg

SEQ ID NO: 73278 - DNA, 20 bp, Artificial Sequence
  Description of Artificial Sequence: Synthetic oligonucleotide
  Target: SCN9A; (-) strand; PAM type: YTN; PAM sequence: TTC
tcaaatctgccacgttgact

SEQ ID NO: 73279 - DNA, 20 bp, Artificial Sequence
  Description of Artificial Sequence: Synthetic oligonucleotide
  Target: SCN9A; (-) strand; PAM type: YTN; PAM sequence: CTC
aattctcaaatctgccacgt

SEQ ID NO: 73280 - DNA, 20 bp, Artificial Sequence
  Description of Artificial Sequence: Synthetic oligonucleotide
  Target: SCN9A; (-) strand; PAM type: YTN; PAM sequence: CTC
atctcaattctcaaatctgc

SEQ ID NO: 73281 - DNA, 20 bp, Artificial Sequence
  Description of Artificial Sequence: Synthetic oligonucleotide
  Target: SCN9A; (-) strand; PAM type: YTN; PAM sequence: CTA
tgagccactcatctcaattc

SEQ ID NO: 73282 - DNA, 20 bp, Artificial Sequence
  Description of Artificial Sequence: Synthetic oligonucleotide
  Target: SCN9A; (-) strand; PAM type: YTN; PAM sequence: TTC
tatgagccactcatctcaat

SEQ ID NO: 73283 - DNA, 20 bp, Artificial Sequence
  Description of Artificial Sequence: Synthetic oligonucleotide
  Target: SCN9A; (-) strand; PAM type: YTN; PAM sequence: CTT
ctatgagccactcatctcaa

SEQ ID NO: 73284 - DNA, 20 bp, Artificial Sequence
  Description of Artificial Sequence: Synthetic oligonucleotide
  Target: SCN9A; (-) strand; PAM type: YTN; PAM sequence: CTC
ttctatgagccactcatctc

SEQ ID NO: 73285 - DNA, 20 bp, Artificial Sequence
  Description of Artificial Sequence: Synthetic oligonucleotide
  Target: SCN9A; (-) strand; PAM type: YTN; PAM sequence: TTG
ggataaaatgctcttctatg

SEQ ID NO: 73286 - DNA, 20 bp, Artificial Sequence
  Description of Artificial Sequence: Synthetic oligonucleotide
  Target: SCN9A; (-) strand; PAM type: YTN; PAM sequence: TTA
caagcaggagaaaattggga

SEQ ID NO: 73287 - DNA, 20 bp, Artificial Sequence
  Description of Artificial Sequence: Synthetic oligonucleotide
  Target: SCN9A; (-) strand; PAM type: YTN; PAM sequence: CTT
acaagcaggagaaaattggg

SEQ ID NO: 73288 - DNA, 20 bp, Artificial Sequence
  Description of Artificial Sequence: Synthetic oligonucleotide
  Target: SCN9A; (-) strand; PAM type: YTN; PAM sequence: TTC
aagcttacaagcaggagaaa

SEQ ID NO: 73289 - DNA, 20 bp, Artificial Sequence
  Description of Artificial Sequence: Synthetic oligonucleotide
  Target: SCN9A; (-) strand; PAM type: YTN; PAM sequence: TTT
caagcttacaagcaggagaa

SEQ ID NO: 73290 - DNA, 20 bp, Artificial Sequence
  Description of Artificial Sequence: Synthetic oligonucleotide
  Target: SCN9A; (-) strand; PAM type: YTN; PAM sequence: CTT
tcaagcttacaagcaggaga

SEQ ID NO: 73291 - DNA, 20 bp, Artificial Sequence
  Description of Artificial Sequence: Synthetic oligonucleotide
  Target: SCN9A; (-) strand; PAM type: YTN; PAM sequence: TTA
gtgaaaactttcaagcttac

SEQ ID NO: 73292 - DNA, 20 bp, Artificial Sequence
  Description of Artificial Sequence: Synthetic oligonucleotide
  Target: SCN9A; (-) strand; PAM type: YTN; PAM sequence: CTG
attagtgaaaactttcaagc

SEQ ID NO: 73293 - DNA, 20 bp, Artificial Sequence
  Description of Artificial Sequence: Synthetic oligonucleotide
  Target: SCN9A; (-) strand; PAM type: YTN; PAM sequence: TTA
tactgattagtgaaaacttt

SEQ ID NO: 73294 - DNA, 20 bp, Artificial Sequence
  Description of Artificial Sequence: Synthetic oligonucleotide
  Target: SCN9A; (-) strand; PAM type: YTN; PAM sequence: CTT
atactgattagtgaaaactt

SEQ ID NO: 73295 - DNA, 20 bp, Artificial Sequence
  Description of Artificial Sequence: Synthetic oligonucleotide
  Target: SCN9A; (-) strand; PAM type: YTN; PAM sequence: TTC
cttatactgattagtgaaaa

SEQ ID NO: 73296 - DNA, 20 bp, Artificial Sequence
  Description of Artificial Sequence: Synthetic oligonucleotide
  Target: SCN9A; (-) strand; PAM type: YTN; PAM sequence: CTT
ccttatactgattagtgaaa

SEQ ID NO: 73297 - DNA, 20 bp, Artificial Sequence
  Description of Artificial Sequence: Synthetic oligonucleotide
  Target: SCN9A; (-) strand; PAM type: YTN; PAM sequence: TTC
ttccttatactgattagtga

SEQ ID NO: 73298 - DNA, 20 bp, Artificial Sequence
  Description of Artificial Sequence: Synthetic oligonucleotide
  Target: SCN9A; (-) strand; PAM type: YTN; PAM sequence: TTT
cttccttatactgattagtg

SEQ ID NO: 73299 - DNA, 20 bp, Artificial Sequence
  Description of Artificial Sequence: Synthetic oligonucleotide
  Target: SCN9A; (-) strand; PAM type: YTN; PAM sequence: TTT
tcttccttatactgattagt

SEQ ID NO: 73300 - DNA, 20 bp, Artificial Sequence
  Description of Artificial Sequence: Synthetic oligonucleotide
  Target: SCN9A; (-) strand; PAM type: YTN; PAM sequence: TTT
ttcttccttatactgattag

SEQ ID NO: 73301 - DNA, 20 bp, Artificial Sequence
  Description of Artificial Sequence: Synthetic oligonucleotide
  Target: SCN9A; (-) strand; PAM type: YTN; PAM sequence: TTT
tttcttccttatactgatta

SEQ ID NO: 73302 - DNA, 20 bp, Artificial Sequence
  Description of Artificial Sequence: Synthetic oligonucleotide
  Target: SCN9A; (-) strand; PAM type: YTN; PAM sequence: TTT
ttttcttccttatactgatt

SEQ ID NO: 73303 - DNA, 20 bp, Artificial Sequence
  Description of Artificial Sequence: Synthetic oligonucleotide
  Target: SCN9A; (-) strand; PAM type: YTN; PAM sequence: TTT
tttttcttccttatactgat

SEQ ID NO: 73304 - DNA, 20 bp, Artificial Sequence
  Description of Artificial Sequence: Synthetic oligonucleotide
  Target: SCN9A; (-) strand; PAM type: YTN; PAM sequence: TTA
ttttttttcttccttatact

SEQ ID NO: 73305 - DNA, 20 bp, Artificial Sequence
  Description of Artificial Sequence: Synthetic oligonucleotide
  Target: SCN9A; (-) strand; PAM type: YTN; PAM sequence: TTT
attttttttcttccttatac

SEQ ID NO: 73306 - DNA, 20 bp, Artificial Sequence
  Description of Artificial Sequence: Synthetic oligonucleotide
  Target: SCN9A; (-) strand; PAM type: YTN; PAM sequence: TTT
tattttttttcttccttata

SEQ ID NO: 73307 - DNA, 20 bp, Artificial Sequence
  Description of Artificial Sequence: Synthetic oligonucleotide
  Target: SCN9A; (-) strand; PAM type: YTN; PAM sequence: TTT
ttattttttttcttccttat

SEQ ID NO: 73308 - DNA, 20 bp, Artificial Sequence
  Description of Artificial Sequence: Synthetic oligonucleotide
  Target: SCN9A; (-) strand; PAM type: YTN; PAM sequence: TTT
tttattttttttcttcctta

SEQ ID NO: 73309 - DNA, 20 bp, Artificial Sequence
  Description of Artificial Sequence: Synthetic oligonucleotide
  Target: SCN9A; (-) strand; PAM type: YTN; PAM sequence: TTT
ttttattttttttcttcctt

SEQ ID NO: 73310 - DNA, 20 bp, Artificial Sequence
  Description of Artificial Sequence: Synthetic oligonucleotide
  Target: SCN9A; (-) strand; PAM type: YTN; PAM sequence: TTT
tttttattttttttcttcct

SEQ ID NO: 73311 - DNA, 20 bp, Artificial Sequence
  Description of Artificial Sequence: Synthetic oligonucleotide
  Target: SCN9A; (-) strand; PAM type: YTN; PAM sequence: TTT
ttttttattttttttcttcc

SEQ ID NO: 73312 - DNA, 20 bp, Artificial Sequence
  Description of Artificial Sequence: Synthetic oligonucleotide
  Target: SCN9A; (-) strand; PAM type: YTN; PAM sequence: CTT
tttttttattttttttcttc

SEQ ID NO: 73313 - DNA, 20 bp, Artificial Sequence
  Description of Artificial Sequence: Synthetic oligonucleotide
  Target: SCN9A; (-) strand; PAM type: YTN; PAM sequence: TTG
tactttttttttattttttt

SEQ ID NO: 73314 - DNA, 20 bp, Artificial Sequence
  Description of Artificial Sequence: Synthetic oligonucleotide
  Target: SCN9A; (-) strand; PAM type: YTN; PAM sequence: CTT
gtactttttttttatttttt

SEQ ID NO: 73315 - DNA, 20 bp, Artificial Sequence
  Description of Artificial Sequence: Synthetic oligonucleotide
  Target: SCN9A; (-) strand; PAM type: YTN; PAM sequence: TTG
gcttgtactttttttttatt

SEQ ID NO: 73316 - DNA, 20 bp, Artificial Sequence
  Description of Artificial Sequence: Synthetic oligonucleotide
  Target: SCN9A; (-) strand; PAM type: YTN; PAM sequence: CTT
ggcttgtactttttttttat

SEQ ID NO: 73317 - DNA, 20 bp, Artificial Sequence
  Description of Artificial Sequence: Synthetic oligonucleotide
  Target: SCN9A; (-) strand; PAM type: YTN; PAM sequence: TTC
ttggcttgtacttttttttt

SEQ ID NO: 73318 - DNA, 20 bp, Artificial Sequence
  Description of Artificial Sequence: Synthetic oligonucleotide
  Target: SCN9A; (-) strand; PAM type: YTN; PAM sequence: TTT
cttggcttgtactttttttt

SEQ ID NO: 73319 - DNA, 20 bp, Artificial Sequence
  Description of Artificial Sequence: Synthetic oligonucleotide
  Target: SCN9A; (-) strand; PAM type: YTN; PAM sequence: TTT
tcttggcttgtacttttttt

SEQ ID NO: 73320 - DNA, 20 bp, Artificial Sequence
  Description of Artificial Sequence: Synthetic oligonucleotide
  Target: SCN9A; (-) strand; PAM type: YTN; PAM sequence: TTA
gtgttttcttggcttgtact

SEQ ID NO: 73321 - DNA, 20 bp, Artificial Sequence
  Description of Artificial Sequence: Synthetic oligonucleotide
  Target: SCN9A; (-) strand; PAM type: YTN; PAM sequence: TTG
aattagtgttttcttggctt

SEQ ID NO: 73322 - DNA, 20 bp, Artificial Sequence
  Description of Artificial Sequence: Synthetic oligonucleotide
  Target: SCN9A; (-) strand; PAM type: YTN; PAM sequence: TTT
gaattagtgttttcttggct

SEQ ID NO: 73323 - DNA, 20 bp, Artificial Sequence
  Description of Artificial Sequence: Synthetic oligonucleotide
  Target: SCN9A; (-) strand; PAM type: YTN; PAM sequence: TTT
tgaattagtgttttcttggc

SEQ ID NO: 73324 - DNA, 20 bp, Artificial Sequence
  Description of Artificial Sequence: Synthetic oligonucleotide
  Target: SCN9A; (-) strand; PAM type: YTN; PAM sequence: TTT
ttgaattagtgttttcttgg

SEQ ID NO: 73325 - DNA, 20 bp, Artificial Sequence
  Description of Artificial Sequence: Synthetic oligonucleotide
  Target: SCN9A; (-) strand; PAM type: YTN; PAM sequence: CTT
tttgaattagtgttttcttg

SEQ ID NO: 73326 - DNA, 20 bp, Artificial Sequence
  Description of Artificial Sequence: Synthetic oligonucleotide
  Target: SCN9A; (-) strand; PAM type: YTN; PAM sequence: CTA
ctttttgaattagtgttttc

SEQ ID NO: 73327 - DNA, 20 bp, Artificial Sequence
  Description of Artificial Sequence: Synthetic oligonucleotide
  Target: SCN9A; (-) strand; PAM type: YTN; PAM sequence: CTG
cctactttttgaattagtgt

SEQ ID NO: 73328 - DNA, 20 bp, Artificial Sequence
  Description of Artificial Sequence: Synthetic oligonucleotide
  Target: SCN9A; (-) strand; PAM type: YTN; PAM sequence: CTA
tagcatcgcgtggacatagc

SEQ ID NO: 73329 - DNA, 20 bp, Artificial Sequence
  Description of Artificial Sequence: Synthetic oligonucleotide
  Target: SCN9A; (-) strand; PAM type: YTN; PAM sequence: CTG
gcctatagcatcgcgtggac

SEQ ID NO: 73330 - DNA, 20 bp, Artificial Sequence
  Description of Artificial Sequence: Synthetic oligonucleotide
  Target: SCN9A; (-) strand; PAM type: YTN; PAM sequence: TTC
cagccactggcctatagcat

SEQ ID NO: 73331 - DNA, 20 bp, Artificial Sequence
  Description of Artificial Sequence: Synthetic oligonucleotide
  Target: SCN9A; (-) strand; PAM type: YTN; PAM sequence: TTT
ccagccactggcctatagca

SEQ ID NO: 73332 - DNA, 20 bp, Artificial Sequence
  Description of Artificial Sequence: Synthetic oligonucleotide
  Target: SCN9A; (-) strand; PAM type: YTN; PAM sequence: TTT
tccagccactggcctatagc

SEQ ID NO: 73333 - DNA, 20 bp, Artificial Sequence
  Description of Artificial Sequence: Synthetic oligonucleotide
  Target: SCN9A; (-) strand; PAM type: YTN; PAM sequence: TTA
cgaaaaagttttccagccac

SEQ ID NO: 73334 - DNA, 20 bp, Artificial Sequence
  Description of Artificial Sequence: Synthetic oligonucleotide
  Target: SCN9A; (-) strand; PAM type: YTN; PAM sequence: TTT
acgaaaaagttttccagcca

SEQ ID NO: 73335 - DNA, 20 bp, Artificial Sequence
  Description of Artificial Sequence: Synthetic oligonucleotide
  Target: SCN9A; (-) strand; PAM type: YTN; PAM sequence: CTT
tacgaaaaagttttccagcc

SEQ ID NO: 73336 - DNA, 20 bp, Artificial Sequence
  Description of Artificial Sequence: Synthetic oligonucleotide
  Target: SCN9A; (-) strand; PAM type: YTN; PAM sequence: TTG
gccctttacgaaaaagtttt

SEQ ID NO: 73337 - DNA, 20 bp, Artificial Sequence
  Description of Artificial Sequence: Synthetic oligonucleotide
  Target: SCN9A; (-) strand; PAM type: YTN; PAM sequence: TTT
ggccctttacgaaaaagttt

SEQ ID NO: 73338 - DNA, 20 bp, Artificial Sequence
  Description of Artificial Sequence: Synthetic oligonucleotide
  Target: SCN9A; (-) strand; PAM type: YTN; PAM sequence: TTA
tcatttggccctttacgaaa

SEQ ID NO: 73339 - DNA, 20 bp, Artificial Sequence
  Description of Artificial Sequence: Synthetic oligonucleotide
  Target: SCN9A; (-) strand; PAM type: YTN; PAM sequence: TTT
atcatttggccctttacgaa

SEQ ID NO: 73340 - DNA, 20 bp, Artificial Sequence
  Description of Artificial Sequence: Synthetic oligonucleotide
  Target: SCN9A; (-) strand; PAM type: YTN; PAM sequence: CTA
aaatatttatcatttggccc

SEQ ID NO: 73341 - DNA, 20 bp, Artificial Sequence
  Description of Artificial Sequence: Synthetic oligonucleotide
  Target: SCN9A; (-) strand; PAM type: YTN; PAM sequence: CTG
ccatagaaatcgtatgccca

SEQ ID NO: 73342 - DNA, 20 bp, Artificial Sequence
  Description of Artificial Sequence: Synthetic oligonucleotide
  Target: SCN9A; (-) strand; PAM type: YTN; PAM sequence: TTA
cagtggcagaggtgaatagc

SEQ ID NO: 73343 - DNA, 20 bp, Artificial Sequence
  Description of Artificial Sequence: Synthetic oligonucleotide
  Target: SCN9A; (-) strand; PAM type: YTN; PAM sequence: TTA
cattacagtggcagaggtga

SEQ ID NO: 73344 - DNA, 20 bp, Artificial Sequence
  Description of Artificial Sequence: Synthetic oligonucleotide
  Target: SCN9A; (-) strand; PAM type: YTN; PAM sequence: TTT
acattacagtggcagaggtg

SEQ ID NO: 73345 - DNA, 20 bp, Artificial Sequence
  Description of Artificial Sequence: Synthetic oligonucleotide
  Target: SCN9A; (-) strand; PAM type: YTN; PAM sequence: TTT
tacattacagtggcagaggt

SEQ ID NO: 73346 - DNA, 20 bp, Artificial Sequence
  Description of Artificial Sequence: Synthetic oligonucleotide
  Target: SCN9A; (-) strand; PAM type: YTN; PAM sequence: CTT
ttacattacagtggcagagg

SEQ ID NO: 73347 - DNA, 20 bp, Artificial Sequence
  Description of Artificial Sequence: Synthetic oligonucleotide
  Target: SCN9A; (-) strand; PAM type: YTN; PAM sequence: CTG
cttttacattacagtggcag

SEQ ID NO: 73348 - DNA, 20 bp, Artificial Sequence
  Description of Artificial Sequence: Synthetic oligonucleotide
  Target: SCN9A; (-) strand; PAM type: YTN; PAM sequence: CTA
tgactgcttttacattacag

SEQ ID NO: 73349 - DNA, 20 bp, Artificial Sequence
  Description of Artificial Sequence: Synthetic oligonucleotide
  Target: SCN9A; (-) strand; PAM type: YTN; PAM sequence: TTC
tatgactgcttttacattac

SEQ ID NO: 73350 - DNA, 20 bp, Artificial Sequence
  Description of Artificial Sequence: Synthetic oligonucleotide
  Target: SCN9A; (-) strand; PAM type: YTN; PAM sequence: CTT
ctatgactgcttttacatta

SEQ ID NO: 73351 - DNA, 20 bp, Artificial Sequence
  Description of Artificial Sequence: Synthetic oligonucleotide
  Target: SCN9A; (-) strand; PAM type: YTN; PAM sequence: TTA
cgtatcttctatgactgctt

SEQ ID NO: 73352 - DNA, 20 bp, Artificial Sequence
  Description of Artificial Sequence: Synthetic oligonucleotide
  Target: SCN9A; (-) strand; PAM type: YTN; PAM sequence: TTT
acgtatcttctatgactgct

SEQ ID NO: 73353 - DNA, 20 bp, Artificial Sequence
  Description of Artificial Sequence: Synthetic oligonucleotide
  Target: SCN9A; (-) strand; PAM type: YTN; PAM sequence: TTC
atttacgtatcttctatgac

SEQ ID NO: 73354 - DNA, 20 bp, Artificial Sequence
  Description of Artificial Sequence: Synthetic oligonucleotide
  Target: SCN9A; (-) strand; PAM type: YTN; PAM sequence: TTC
aaacataggaatgtcaattc

SEQ ID NO: 73355 - DNA, 20 bp, Artificial Sequence
  Description of Artificial Sequence: Synthetic oligonucleotide
  Target: SCN9A; (-) strand; PAM type: YTN; PAM sequence: TTA
ttcaaacataggaatgtcaa

SEQ ID NO: 73356 - DNA, 20 bp, Artificial Sequence
  Description of Artificial Sequence: Synthetic oligonucleotide
  Target: SCN9A; (-) strand; PAM type: YTN; PAM sequence: TTT
attcaaacataggaatgtca

SEQ ID NO: 73357 - DNA, 20 bp, Artificial Sequence
  Description of Artificial Sequence: Synthetic oligonucleotide
  Target: SCN9A; (-) strand; PAM type: YTN; PAM sequence: CTT
tattcaaacataggaatgtc

SEQ ID NO: 73358 - DNA, 20 bp, Artificial Sequence
  Description of Artificial Sequence: Synthetic oligonucleotide
  Target: SCN9A; (-) strand; PAM type: YTN; PAM sequence: TTC
ataaactttattcaaacata

SEQ ID NO: 73359 - DNA, 20 bp, Artificial Sequence
  Description of Artificial Sequence: Synthetic oligonucleotide
  Target: SCN9A; (-) strand; PAM type: YTN; PAM sequence: TTA
gtgttcataaactttattca

SEQ ID NO: 73360 - DNA, 20 bp, Artificial Sequence
  Description of Artificial Sequence: Synthetic oligonucleotide
  Target: SCN9A; (-) strand; PAM type: YTN; PAM sequence: TTT
agtgttcataaactttattc

SEQ ID NO: 73361 - DNA, 20 bp, Artificial Sequence
  Description of Artificial Sequence: Synthetic oligonucleotide
  Target: SCN9A; (-) strand; PAM type: YTN; PAM sequence: TTT
tagtgttcataaactttatt

SEQ ID NO: 73362 - DNA, 20 bp, Artificial Sequence
  Description of Artificial Sequence: Synthetic oligonucleotide
  Target: SCN9A; (-) strand; PAM type: YTN; PAM sequence: TTA
tatgaaatgcaaattttagt

SEQ ID NO: 73363 - DNA, 20 bp, Artificial Sequence
  Description of Artificial Sequence: Synthetic oligonucleotide
  Target: SCN9A; (-) strand; PAM type: YTN; PAM sequence: TTA
aaataatcaaaagaagaata

SEQ ID NO: 73364 - DNA, 20 bp, Artificial Sequence
  Description of Artificial Sequence: Synthetic oligonucleotide
  Target: SCN9A; (-) strand; PAM type: YTN; PAM sequence: TTA
agtggttaaaataatcaaaa

SEQ ID NO: 73365 - DNA, 20 bp, Artificial Sequence
  Description of Artificial Sequence: Synthetic oligonucleotide
  Target: SCN9A; (-) strand; PAM type: YTN; PAM sequence: TTT
aagtggttaaaataatcaaa

SEQ ID NO: 73366 - DNA, 20 bp, Artificial Sequence
  Description of Artificial Sequence: Synthetic oligonucleotide
  Target: SCN9A; (-) strand; PAM type: YTN; PAM sequence: TTT
taagtggttaaaataatcaa

SEQ ID NO: 73367 - DNA, 20 bp, Artificial Sequence
  Description of Artificial Sequence: Synthetic oligonucleotide
  Target: SCN9A; (-) strand; PAM type: YTN; PAM sequence: TTT
ttaagtggttaaaataatca

SEQ ID NO: 73368 - DNA, 20 bp, Artificial Sequence
  Description of Artificial Sequence: Synthetic oligonucleotide
  Target: SCN9A; (-) strand; PAM type: YTN; PAM sequence: TTA
catttttaagtggttaaaat

SEQ ID NO: 73369 - DNA, 20 bp, Artificial Sequence
  Description of Artificial Sequence: Synthetic oligonucleotide
  Target: SCN9A; (-) strand; PAM type: YTN; PAM sequence: TTT
acatttttaagtggttaaaa

SEQ ID NO: 73370 - DNA, 20 bp, Artificial Sequence
  Description of Artificial Sequence: Synthetic oligonucleotide
  Target: SCN9A; (-) strand; PAM type: YTN; PAM sequence: TTT
tacatttttaagtggttaaa

SEQ ID NO: 73371 - DNA, 20 bp, Artificial Sequence
  Description of Artificial Sequence: Synthetic oligonucleotide
  Target: SCN9A; (-) strand; PAM type: YTN; PAM sequence: TTT
ttacatttttaagtggttaa

SEQ ID NO: 73372 - DNA, 20 bp, Artificial Sequence
  Description of Artificial Sequence: Synthetic oligonucleotide
  Target: SCN9A; (-) strand; PAM type: YTN; PAM sequence: CTA
agaatgatttttacattttt

SEQ ID NO: 73373 - DNA, 20 bp, Artificial Sequence
  Description of Artificial Sequence: Synthetic oligonucleotide
  Target: SCN9A; (-) strand; PAM type: YTN; PAM sequence: CTG
ggagctaagaatgattttta

SEQ ID NO: 73374 - DNA, 20 bp, Artificial Sequence
  Description of Artificial Sequence: Synthetic oligonucleotide
  Target: SCN9A; (-) strand; PAM type: YTN; PAM sequence: TTG
tgtggccctgggagctaaga

SEQ ID NO: 73375 - DNA, 20 bp, Artificial Sequence
  Description of Artificial Sequence: Synthetic oligonucleotide
  Target: SCN9A; (-) strand; PAM type: YTN; PAM sequence: TTA
ttgtgtggccctgggagcta

SEQ ID NO: 73376 - DNA, 20 bp, Artificial Sequence
  Description of Artificial Sequence: Synthetic oligonucleotide
  Target: SCN9A; (-) strand; PAM type: YTN; PAM sequence: CTG
ttattgtgtggccctgggag

SEQ ID NO: 73377 - DNA, 20 bp, Artificial Sequence
  Description of Artificial Sequence: Synthetic oligonucleotide
  Target: SCN9A; (-) strand; PAM type: YTN; PAM sequence: CTA
tgccccacagaccaaagcca

SEQ ID NO: 73378 - DNA, 20 bp, Artificial Sequence
  Description of Artificial Sequence: Synthetic oligonucleotide
  Target: SCN9A; (-) strand; PAM type: YTN; PAM sequence: CTA
tagcaaggatcagcacctat

SEQ ID NO: 73379 - DNA, 20 bp, Artificial Sequence
  Description of Artificial Sequence: Synthetic oligonucleotide
  Target: SCN9A; (-) strand; PAM type: YTN; PAM sequence: CTC
tatagcaaggatcagcacct

SEQ ID NO: 73380 - DNA, 20 bp, Artificial Sequence
  Description of Artificial Sequence: Synthetic oligonucleotide
  Target: SCN9A; (-) strand; PAM type: YTN; PAM sequence: CTA
gcctctatagcaaggatcag

SEQ ID NO: 73381 - DNA, 20 bp, Artificial Sequence
  Description of Artificial Sequence: Synthetic oligonucleotide
  Target: SCN9A; (-) strand; PAM type: YTN; PAM sequence: TTA
tagccatgtgtaagactagc

SEQ ID NO: 73382 - DNA, 20 bp, Artificial Sequence
  Description of Artificial Sequence: Synthetic oligonucleotide
  Target: SCN9A; (-) strand; PAM type: YTN; PAM sequence: CTT
atagccatgtgtaagactag

SEQ ID NO: 73383 - DNA, 20 bp, Artificial Sequence
  Description of Artificial Sequence: Synthetic oligonucleotide
  Target: SCN9A; (-) strand; PAM type: YTN; PAM sequence: CTG
gtcccgcaccttatagccat

SEQ ID NO: 73384 - DNA, 20 bp, Artificial Sequence
  Description of Artificial Sequence: Synthetic oligonucleotide
  Target: SCN9A; (-) strand; PAM type: YTN; PAM sequence: TTA
ataatggaccaaggcaaatg

SEQ ID NO: 73385 - DNA, 20 bp, Artificial Sequence
  Description of Artificial Sequence: Synthetic oligonucleotide
  Target: SCN9A; (-) strand; PAM type: YTN; PAM sequence: TTA
ataataacaaaaatgaagtt

SEQ ID NO: 73386 - DNA, 20 bp, Artificial Sequence
  Description of Artificial Sequence: Synthetic oligonucleotide
  Target: SCN9A; (-) strand; PAM type: YTN; PAM sequence: TTA
agttaataataacaaaaatg

SEQ ID NO: 73387 - DNA, 20 bp, Artificial Sequence
  Description of Artificial Sequence: Synthetic oligonucleotide
  Target: SCN9A; (-) strand; PAM type: YTN; PAM sequence: CTA
gtaaataaaatataattaag

SEQ ID NO: 73388 - DNA, 20 bp, Artificial Sequence
  Description of Artificial Sequence: Synthetic oligonucleotide
  Target: SCN9A; (-) strand; PAM type: YTN; PAM sequence: CTA
tactagtaaataaaatataa

SEQ ID NO: 73389 - DNA, 20 bp, Artificial Sequence
  Description of Artificial Sequence: Synthetic oligonucleotide
  Target: SCN9A; (-) strand; PAM type: YTN; PAM sequence: TTG
aagctatactagtaaataaa

SEQ ID NO: 73390 - DNA, 20 bp, Artificial Sequence
  Description of Artificial Sequence: Synthetic oligonucleotide
  Target: SCN9A; (-) strand; PAM type: YTN; PAM sequence: CTT
gaagctatactagtaaataa

SEQ ID NO: 73391 - DNA, 20 bp, Artificial Sequence
  Description of Artificial Sequence: Synthetic oligonucleotide
  Target: SCN9A; (-) strand; PAM type: YTN; PAM sequence: CTC
ttgaagctatactagtaaat

SEQ ID NO: 73392 - DNA, 20 bp, Artificial Sequence
  Description of Artificial Sequence: Synthetic oligonucleotide
  Target: SCN9A; (-) strand; PAM type: YTN; PAM sequence: CTC
tcttgaagctatactagtaa

SEQ ID NO: 73393 - DNA, 20 bp, Artificial Sequence
  Description of Artificial Sequence: Synthetic oligonucleotide
  Target: SCN9A; (-) strand; PAM type: YTN; PAM sequence: TTG
aaagtgatggcatatgctct

SEQ ID NO: 73394 - DNA, 20 bp, Artificial Sequence
  Description of Artificial Sequence: Synthetic oligonucleotide
  Target: SCN9A; (-) strand; PAM type: YTN; PAM sequence: TTT
gaaagtgatggcatatgctc

SEQ ID NO: 73395 - DNA, 20 bp, Artificial Sequence
  Description of Artificial Sequence: Synthetic oligonucleotide
  Target: SCN9A; (-) strand; PAM type: YTN; PAM sequence: TTT
tgaaagtgatggcatatgct

SEQ ID NO: 73396 - DNA, 20 bp, Artificial Sequence
  Description of Artificial Sequence: Synthetic oligonucleotide
  Target: SCN9A; (-) strand; PAM type: YTN; PAM sequence: CTA
attttgaaagtgatggcata

SEQ ID NO: 73397 - DNA, 20 bp, Artificial Sequence
  Description of Artificial Sequence: Synthetic oligonucleotide
  Target: SCN9A; (-) strand; PAM type: YTN; PAM sequence: CTC
taattttgaaagtgatggca

SEQ ID NO: 73398 - DNA, 20 bp, Artificial Sequence
  Description of Artificial Sequence: Synthetic oligonucleotide
  Target: SCN9A; (-) strand; PAM type: YTN; PAM sequence: TTC
tctaattttgaaagtgatgg

SEQ ID NO: 73399 - DNA, 20 bp, Artificial Sequence
  Description of Artificial Sequence: Synthetic oligonucleotide
  Target: SCN9A; (-) strand; PAM type: YTN; PAM sequence: TTT
ctctaattttgaaagtgatg

SEQ ID NO: 73400 - DNA, 20 bp, Artificial Sequence
  Description of Artificial Sequence: Synthetic oligonucleotide
  Target: SCN9A; (-) strand; PAM type: YTN; PAM sequence: TTT
tctctaattttgaaagtgat

SEQ ID NO: 73401 - DNA, 20 bp, Artificial Sequence
  Description of Artificial Sequence: Synthetic oligonucleotide
  Target: SCN9A; (-) strand; PAM type: YTN; PAM sequence: TTT
ttctctaattttgaaagtga

SEQ ID NO: 73402 - DNA, 20 bp, Artificial Sequence
  Description of Artificial Sequence: Synthetic oligonucleotide
  Target: SCN9A; (-) strand; PAM type: YTN; PAM sequence: CTT
tttctctaattttgaaagtg

SEQ ID NO: 73403 - DNA, 20 bp, Artificial Sequence
  Description of Artificial Sequence: Synthetic oligonucleotide
  Target: SCN9A; (-) strand; PAM type: YTN; PAM sequence: CTA
tctttttctctaattttgaa

SEQ ID NO: 73404 - DNA, 20 bp, Artificial Sequence
  Description of Artificial Sequence: Synthetic oligonucleotide
  Target: SCN9A; (-) strand; PAM type: YTN; PAM sequence: TTC
tatctttttctctaattttg

SEQ ID NO: 73405 - DNA, 20 bp, Artificial Sequence
  Description of Artificial Sequence: Synthetic oligonucleotide
  Target: SCN9A; (-) strand; PAM type: YTN; PAM sequence: TTT
ctatctttttctctaatttt

SEQ ID NO: 73406 - DNA, 20 bp, Artificial Sequence
  Description of Artificial Sequence: Synthetic oligonucleotide
  Target: SCN9A; (-) strand; PAM type: YTN; PAM sequence: TTA
aggcaaaggtttctatcttt

SEQ ID NO: 73407 - DNA, 20 bp, Artificial Sequence
  Description of Artificial Sequence: Synthetic oligonucleotide
  Target: SCN9A; (-) strand; PAM type: YTN; PAM sequence: TTT
aaggcaaaggtttctatctt

SEQ ID NO: 73408 - DNA, 20 bp, Artificial Sequence
  Description of Artificial Sequence: Synthetic oligonucleotide
  Target: SCN9A; (-) strand; PAM type: YTN; PAM sequence: TTT
taaggcaaaggtttctatct

SEQ ID NO: 73409 - DNA, 20 bp, Artificial Sequence
  Description of Artificial Sequence: Synthetic oligonucleotide
  Target: SCN9A; (-) strand; PAM type: YTN; PAM sequence: TTC
attttaaggcaaaggtttct

SEQ ID NO: 73410 - DNA, 20 bp, Artificial Sequence
  Description of Artificial Sequence: Synthetic oligonucleotide
  Target: SCN9A; (-) strand; PAM type: YTN; PAM sequence: CTA
ttcattttaaggcaaaggtt

SEQ ID NO: 73411 - DNA, 20 bp, Artificial Sequence
  Description of Artificial Sequence: Synthetic oligonucleotide
  Target: SCN9A; (-) strand; PAM type: YTN; PAM sequence: CTG
cctattcattttaaggcaaa

SEQ ID NO: 73412 - DNA, 20 bp, Artificial Sequence
  Description of Artificial Sequence: Synthetic oligonucleotide
  Target: SCN9A; (-) strand; PAM type: YTN; PAM sequence: TTC
aaaatcactgcctattcatt

SEQ ID NO: 73413 - DNA, 20 bp, Artificial Sequence
  Description of Artificial Sequence: Synthetic oligonucleotide
  Target: SCN9A; (-) strand; PAM type: YTN; PAM sequence: TTT
caaaatcactgcctattcat

SEQ ID NO: 73414 - DNA, 20 bp, Artificial Sequence
  Description of Artificial Sequence: Synthetic oligonucleotide
  Target: SCN9A; (-) strand; PAM type: YTN; PAM sequence: TTT
tcaaaatcactgcctattca

SEQ ID NO: 73415 - DNA, 20 bp, Artificial Sequence
  Description of Artificial Sequence: Synthetic oligonucleotide
  Target: SCN9A; (-) strand; PAM type: YTN; PAM sequence: TTT
ttcaaaatcactgcctattc

SEQ ID NO: 73416 - DNA, 20 bp, Artificial Sequence
  Description of Artificial Sequence: Synthetic oligonucleotide
  Target: SCN9A; (-) strand; PAM type: YTN; PAM sequence: TTA
tatttttcaaaatcactgcc

SEQ ID NO: 73417 - DNA, 20 bp, Artificial Sequence
  Description of Artificial Sequence: Synthetic oligonucleotide
  Target: SCN9A; (-) strand; PAM type: YTN; PAM sequence: TTT
atatttttcaaaatcactgc

SEQ ID NO: 73418 - DNA, 20 bp, Artificial Sequence
  Description of Artificial Sequence: Synthetic oligonucleotide
  Target: SCN9A; (-) strand; PAM type: YTN; PAM sequence: CTA
gccaaataacccatatttat

SEQ ID NO: 73419 - DNA, 20 bp, Artificial Sequence
  Description of Artificial Sequence: Synthetic oligonucleotide
  Target: SCN9A; (-) strand; PAM type: YTN; PAM sequence: TTC
ctagccaaataacccatatt

SEQ ID NO: 73420 - DNA, 20 bp, Artificial Sequence
  Description of Artificial Sequence: Synthetic oligonucleotide
  Target: SCN9A; (-) strand; PAM type: YTN; PAM sequence: TTT
cctagccaaataacccatat

SEQ ID NO: 73421 - DNA, 20 bp, Artificial Sequence
  Description of Artificial Sequence: Synthetic oligonucleotide
  Target: SCN9A; (-) strand; PAM type: YTN; PAM sequence: TTT
tcctagccaaataacccata

SEQ ID NO: 73422 - DNA, 20 bp, Artificial Sequence
  Description of Artificial Sequence: Synthetic oligonucleotide
  Target: SCN9A; (-) strand; PAM type: YTN; PAM sequence: TTA
gttttcctagccaaataacc

SEQ ID NO: 73423 - DNA, 20 bp, Artificial Sequence
  Description of Artificial Sequence: Synthetic oligonucleotide
  Target: SCN9A; (-) strand; PAM type: YTN; PAM sequence: TTG
tattagttttcctagccaaa

SEQ ID NO: 73424 - DNA, 20 bp, Artificial Sequence
  Description of Artificial Sequence: Synthetic oligonucleotide
  Target: SCN9A; (-) strand; PAM type: YTN; PAM sequence: TTT
gtattagttttcctagccaa

SEQ ID NO: 73425 - DNA, 20 bp, Artificial Sequence
  Description of Artificial Sequence: Synthetic oligonucleotide
  Target: SCN9A; (-) strand; PAM type: YTN; PAM sequence: TTT
tgtattagttttcctagcca

SEQ ID NO: 73426 - DNA, 20 bp, Artificial Sequence
  Description of Artificial Sequence: Synthetic oligonucleotide
  Target: SCN9A; (-) strand; PAM type: YTN; PAM sequence: TTA
atacaagaaagaacaggaaa

SEQ ID NO: 73427 - DNA, 20 bp, Artificial Sequence
  Description of Artificial Sequence: Synthetic oligonucleotide
  Target: SCN9A; (-) strand; PAM type: YTN; PAM sequence: TTT
aatacaagaaagaacaggaa

SEQ ID NO: 73428 - DNA, 20 bp, Artificial Sequence
  Description of Artificial Sequence: Synthetic oligonucleotide
  Target: SCN9A; (-) strand; PAM type: YTN; PAM sequence: TTT
taatacaagaaagaacagga

SEQ ID NO: 73429 - DNA, 20 bp, Artificial Sequence
  Description of Artificial Sequence: Synthetic oligonucleotide
  Target: SCN9A; (-) strand; PAM type: YTN; PAM sequence: TTG
caaaagaatagtgataattt

SEQ ID NO: 73430 - DNA, 20 bp, Artificial Sequence
  Description of Artificial Sequence: Synthetic oligonucleotide
  Target: SCN9A; (-) strand; PAM type: YTN; PAM sequence: TTA
attgcaaaagaatagtgata

SEQ ID NO: 73431 - DNA, 20 bp, Artificial Sequence
  Description of Artificial Sequence: Synthetic oligonucleotide
  Target: SCN9A; (-) strand; PAM type: YTN; PAM sequence: TTA
ttaattgcaaaagaatagtg

SEQ ID NO: 73432 - DNA, 20 bp, Artificial Sequence
  Description of Artificial Sequence: Synthetic oligonucleotide
  Target: SCN9A; (-) strand; PAM type: YTN; PAM sequence: CTA
caattattaattgcaaaaga

SEQ ID NO: 73433 - DNA, 20 bp, Artificial Sequence
  Description of Artificial Sequence: Synthetic oligonucleotide
  Target: SCN9A; (-) strand; PAM type: YTN; PAM sequence: TTA
tatctacaattattaattgc

SEQ ID NO: 73434 - DNA, 20 bp, Artificial Sequence
  Description of Artificial Sequence: Synthetic oligonucleotide
  Target: SCN9A; (-) strand; PAM type: YTN; PAM sequence: TTA
attatatctacaattattaa

SEQ ID NO: 73435 - DNA, 20 bp, Artificial Sequence
  Description of Artificial Sequence: Synthetic oligonucleotide
  Target: SCN9A; (-) strand; PAM type: YTN; PAM sequence: TTA
taattaattatatctacaat

SEQ ID NO: 73436 - DNA, 20 bp, Artificial Sequence
  Description of Artificial Sequence: Synthetic oligonucleotide
  Target: SCN9A; (-) strand; PAM type: YTN; PAM sequence: TTT
ataattaattatatctacaa

SEQ ID NO: 73437 - DNA, 20 bp, Artificial Sequence
  Description of Artificial Sequence: Synthetic oligonucleotide
  Target: SCN9A; (-) strand; PAM type: YTN; PAM sequence: TTT
tataattaattatatctaca

SEQ ID NO: 73438 - DNA, 20 bp, Artificial Sequence
  Description of Artificial Sequence: Synthetic oligonucleotide
  Target: SCN9A; (-) strand; PAM type: YTN; PAM sequence: TTA
taattttataattaattata

SEQ ID NO: 73439 - DNA, 20 bp, Artificial Sequence
  Description of Artificial Sequence: Synthetic oligonucleotide
  Target: SCN9A; (-) strand; PAM type: YTN; PAM sequence: TTT
ataattttataattaattat

SEQ ID NO: 73440 - DNA, 20 bp, Artificial Sequence
  Description of Artificial Sequence: Synthetic oligonucleotide
  Target: SCN9A; (-) strand; PAM type: YTN; PAM sequence: TTT
tataattttataattaatta

SEQ ID NO: 73441 - DNA, 20 bp, Artificial Sequence
  Description of Artificial Sequence: Synthetic oligonucleotide
  Target: SCN9A; (-) strand; PAM type: YTN; PAM sequence: TTT
ttataattttataattaatt

SEQ ID NO: 73442 - DNA, 20 bp, Artificial Sequence
  Description of Artificial Sequence: Synthetic oligonucleotide
  Target: SCN9A; (-) strand; PAM type: YTN; PAM sequence: TTA
tttttataattttataatta

SEQ ID NO: 73443 - DNA, 20 bp, Artificial Sequence
  Description of Artificial Sequence: Synthetic oligonucleotide
  Target: SCN9A; (-) strand; PAM type: YTN; PAM sequence: CTA
ttatttttataattttataa

SEQ ID NO: 73444 - DNA, 20 bp, Artificial Sequence
  Description of Artificial Sequence: Synthetic oligonucleotide
  Target: SCN9A; (-) strand; PAM type: YTN; PAM sequence: TTG
tgatgatgtgatctattatt

SEQ ID NO: 73445 - DNA, 20 bp, Artificial Sequence
  Description of Artificial Sequence: Synthetic oligonucleotide
  Target: SCN9A; (-) strand; PAM type: YTN; PAM sequence: TTT
gtgatgatgtgatctattat

SEQ ID NO: 73446 - DNA, 20 bp, Artificial Sequence
  Description of Artificial Sequence: Synthetic oligonucleotide
  Target: SCN9A; (-) strand; PAM type: YTN; PAM sequence: TTT
tgtgatgatgtgatctatta

SEQ ID NO: 73447 - DNA, 20 bp, Artificial Sequence
  Description of Artificial Sequence: Synthetic oligonucleotide
  Target: SCN9A; (-) strand; PAM type: YTN; PAM sequence: TTA
ttttgtgatgatgtgatcta

SEQ ID NO: 73448 - DNA, 20 bp, Artificial Sequence
  Description of Artificial Sequence: Synthetic oligonucleotide
  Target: SCN9A; (-) strand; PAM type: YTN; PAM sequence: CTG
tggaaattattttgtgatga

SEQ ID NO: 73449 - DNA, 20 bp, Artificial Sequence
  Description of Artificial Sequence: Synthetic oligonucleotide
  Target: SCN9A; (-) strand; PAM type: YTN; PAM sequence: CTC
tgtggaaattattttgtgat

SEQ ID NO: 73450 - DNA, 20 bp, Artificial Sequence
  Description of Artificial Sequence: Synthetic oligonucleotide
  Target: SCN9A; (-) strand; PAM type: YTN; PAM sequence: TTC
tctgtggaaattattttgtg

SEQ ID NO: 73451 - DNA, 20 bp, Artificial Sequence
  Description of Artificial Sequence: Synthetic oligonucleotide
  Target: SCN9A; (-) strand; PAM type: YTN; PAM sequence: TTT
ctctgtggaaattattttgt

SEQ ID NO: 73452 - DNA, 20 bp, Artificial Sequence
  Description of Artificial Sequence: Synthetic oligonucleotide
  Target: SCN9A; (-) strand; PAM type: YTN; PAM sequence: TTA
atttctctgtggaaattatt

SEQ ID NO: 73453 - DNA, 20 bp, Artificial Sequence
  Description of Artificial Sequence: Synthetic oligonucleotide
  Target: SCN9A; (-) strand; PAM type: YTN; PAM sequence: TTT
aatttctctgtggaaattat

SEQ ID NO: 73454 - DNA, 20 bp, Artificial Sequence
  Description of Artificial Sequence: Synthetic oligonucleotide
  Target: SCN9A; (-) strand; PAM type: YTN; PAM sequence: TTT
taatttctctgtggaaatta

SEQ ID NO: 73455 - DNA, 20 bp, Artificial Sequence
  Description of Artificial Sequence: Synthetic oligonucleotide
  Target: SCN9A; (-) strand; PAM type: YTN; PAM sequence: TTC
atgcattttaatttctctgt

SEQ ID NO: 73456 - DNA, 20 bp, Artificial Sequence
  Description of Artificial Sequence: Synthetic oligonucleotide
  Target: SCN9A; (-) strand; PAM type: YTN; PAM sequence: CTG
gtggtatgtaaccagatgtt

SEQ ID NO: 73457 - DNA, 20 bp, Artificial Sequence
  Description of Artificial Sequence: Synthetic oligonucleotide
  Target: SCN9A; (-) strand; PAM type: YTN; PAM sequence: TTG
gaaacctggtggtatgtaac

SEQ ID NO: 73458 - DNA, 20 bp, Artificial Sequence
  Description of Artificial Sequence: Synthetic oligonucleotide
  Target: SCN9A; (-) strand; PAM type: YTN; PAM sequence: TTA
catgatggtcatggtcattg

SEQ ID NO: 73459 - DNA, 20 bp, Artificial Sequence
  Description of Artificial Sequence: Synthetic oligonucleotide
  Target: SCN9A; (-) strand; PAM type: YTN; PAM sequence: TTT
acatgatggtcatggtcatt

SEQ ID NO: 73460 - DNA, 20 bp, Artificial Sequence
  Description of Artificial Sequence: Synthetic oligonucleotide
  Target: SCN9A; (-) strand; PAM type: YTN; PAM sequence: TTG
tttacatgatggtcatggtc

SEQ ID NO: 73461 - DNA, 20 bp, Artificial Sequence
  Description of Artificial Sequence: Synthetic oligonucleotide
  Target: SCN9A; (-) strand; PAM type: YTN; PAM sequence: TTA
ttgtttacatgatggtcatg

SEQ ID NO: 73462 - DNA, 20 bp, Artificial Sequence
  Description of Artificial Sequence: Synthetic oligonucleotide
  Target: SCN9A; (-) strand; PAM type: YTN; PAM sequence: CTT
attgtttacatgatggtcat

SEQ ID NO: 73463 - DNA, 20 bp, Artificial Sequence
  Description of Artificial Sequence: Synthetic oligonucleotide
  Target: SCN9A; (-) strand; PAM type: YTN; PAM sequence: CTA
tgtgccttattgtttacatg

SEQ ID NO: 73464 - DNA, 20 bp, Artificial Sequence
  Description of Artificial Sequence: Synthetic oligonucleotide
  Target: SCN9A; (-) strand; PAM type: YTN; PAM sequence: CTG
gtcaagctatgtgccttatt

SEQ ID NO: 73465 - DNA, 20 bp, Artificial Sequence
  Description of Artificial Sequence: Synthetic oligonucleotide
  Target: SCN9A; (-) strand; PAM type: YTN; PAM sequence: CTG
tatggaggtcgctggtcaag

SEQ ID NO: 73466 - DNA, 20 bp, Artificial Sequence
  Description of Artificial Sequence: Synthetic oligonucleotide
  Target: SCN9A; (-) strand; PAM type: YTN; PAM sequence: CTG
tgtggagagtggatagagac

SEQ ID NO: 73467 - DNA, 20 bp, Artificial Sequence
  Description of Artificial Sequence: Synthetic oligonucleotide
  Target: SCN9A; (-) strand; PAM type: YTN; PAM sequence: TTC
cgcgtgctgtgtggagagtg

SEQ ID NO: 73468 - DNA, 20 bp, Artificial Sequence
  Description of Artificial Sequence: Synthetic oligonucleotide
  Target: SCN9A; (-) strand; PAM type: YTN; PAM sequence: TTG
tgttccgcgtgctgtgtgga

SEQ ID NO: 73469 - DNA, 20 bp, Artificial Sequence
  Description of Artificial Sequence: Synthetic oligonucleotide
  Target: SCN9A; (-) strand; PAM type: YTN; PAM sequence: CTG
attgtgttccgcgtgctgtg

SEQ ID NO: 73470 - DNA, 20 bp, Artificial Sequence
  Description of Artificial Sequence: Synthetic oligonucleotide
  Target: SCN9A; (-) strand; PAM type: YTN; PAM sequence: TTC
ctgattgtgttccgcgtgct

SEQ ID NO: 73471 - DNA, 20 bp, Artificial Sequence
  Description of Artificial Sequence: Synthetic oligonucleotide
  Target: SCN9A; (-) strand; PAM type: YTN; PAM sequence: CTT
cctgattgtgttccgcgtgc

SEQ ID NO: 73472 - DNA, 20 bp, Artificial Sequence
  Description of Artificial Sequence: Synthetic oligonucleotide
  Target: SCN9A; (-) strand; PAM type: YTN; PAM sequence: CTC
cttcctgattgtgttccgcg

SEQ ID NO: 73473 - DNA, 20 bp, Artificial Sequence
  Description of Artificial Sequence: Synthetic oligonucleotide
  Target: SCN9A; (-) strand; PAM type: YTN; PAM sequence: TTC
cactccttcctgattgtgtt

SEQ ID NO: 73474 - DNA, 20 bp, Artificial Sequence
  Description of Artificial Sequence: Synthetic oligonucleotide
  Target: SCN9A; (-) strand; PAM type: YTN; PAM sequence: CTT
ccactccttcctgattgtgt

SEQ ID NO: 73475 - DNA, 20 bp, Artificial Sequence
  Description of Artificial Sequence: Synthetic oligonucleotide
  Target: SCN9A; (-) strand; PAM type: YTN; PAM sequence: TTC
ttccactccttcctgattgt

SEQ ID NO: 73476 - DNA, 20 bp, Artificial Sequence
  Description of Artificial Sequence: Synthetic oligonucleotide
  Target: SCN9A; (-) strand; PAM type: YTN; PAM sequence: CTT
cttccactccttcctgattg

SEQ ID NO: 73477 - DNA, 20 bp, Artificial Sequence
  Description of Artificial Sequence: Synthetic oligonucleotide
  Target: SCN9A; (-) strand; PAM type: YTN; PAM sequence: CTC
ccacggtggcacatgaacga

SEQ ID NO: 73478 - DNA, 20 bp, Artificial Sequence
  Description of Artificial Sequence: Synthetic oligonucleotide
  Target: SCN9A; (-) strand; PAM type: YTN; PAM sequence: CTG
tacgctcccacggtggcaca

SEQ ID NO: 73479 - DNA, 20 bp, Artificial Sequence
  Description of Artificial Sequence: Synthetic oligonucleotide
  Target: SCN9A; (-) strand; PAM type: YTN; PAM sequence: CTG
caagatcaatgatgactgta

SEQ ID NO: 73480 - DNA, 20 bp, Artificial Sequence
  Description of Artificial Sequence: Synthetic oligonucleotide
  Target: SCN9A; (-) strand; PAM type: YTN; PAM sequence: CTA
caaagaatgtgtctgcaaga

SEQ ID NO: 73481 - DNA, 20 bp, Artificial Sequence
  Description of Artificial Sequence: Synthetic oligonucleotide
  Target: SCN9A; (-) strand; PAM type: YTN; PAM sequence: TTG
gtaagagctacaaagaatgt

SEQ ID NO: 73482 - DNA, 20 bp, Artificial Sequence
  Description of Artificial Sequence: Synthetic oligonucleotide
  Target: SCN9A; (-) strand; PAM type: YTN; PAM sequence: TTT
ggtaagagctacaaagaatg

SEQ ID NO: 73483 - DNA, 20 bp, Artificial Sequence
  Description of Artificial Sequence: Synthetic oligonucleotide
  Target: SCN9A; (-) strand; PAM type: YTN; PAM sequence: CTT
tggtaagagctacaaagaat

SEQ ID NO: 73484 - DNA, 20 bp, Artificial Sequence
  Description of Artificial Sequence: Synthetic oligonucleotide
  Target: SCN9A; (-) strand; PAM type: YTN; PAM sequence: CTC
tttggtaagagctacaaaga

SEQ ID NO: 73485 - DNA, 20 bp, Artificial Sequence
  Description of Artificial Sequence: Synthetic oligonucleotide
  Target: SCN9A; (-) strand; PAM type: YTN; PAM sequence: CTG
tggtcggcatgcagctcttt

SEQ ID NO: 73486 - DNA, 20 bp, Artificial Sequence
  Description of Artificial Sequence: Synthetic oligonucleotide
  Target: SCN9A; (-) strand; PAM type: YTN; PAM sequence: TTG
ctgtggtcggcatgcagctc

SEQ ID NO: 73487 - DNA, 20 bp, Artificial Sequence
  Description of Artificial Sequence: Synthetic oligonucleotide
  Target: SCN9A; (-) strand; PAM type: YTN; PAM sequence: TTT
gctgtggtcggcatgcagct

SEQ ID NO: 73488 - DNA, 20 bp, Artificial Sequence
  Description of Artificial Sequence: Synthetic oligonucleotide
  Target: SCN9A; (-) strand; PAM type: YTN; PAM sequence: TTT
tgctgtggtcggcatgcagc

SEQ ID NO: 73489 - DNA, 20 bp, Artificial Sequence
  Description of Artificial Sequence: Synthetic oligonucleotide
  Target: SCN9A; (-) strand; PAM type: YTN; PAM sequence: TTT
ttgctgtggtcggcatgcag

SEQ ID NO: 73490 - DNA, 20 bp, Artificial Sequence
  Description of Artificial Sequence: Synthetic oligonucleotide
  Target: SCN9A; (-) strand; PAM type: YTN; PAM sequence: TTC
atttttgctgtggtcggcat

SEQ ID NO: 73491 - DNA, 20 bp, Artificial Sequence
  Description of Artificial Sequence: Synthetic oligonucleotide
  Target: SCN9A; (-) strand; PAM type: YTN; PAM sequence: CTT
catttttgctgtggtcggca

SEQ ID NO: 73492 - DNA, 20 bp, Artificial Sequence
  Description of Artificial Sequence: Synthetic oligonucleotide
  Target: SCN9A; (-) strand; PAM type: YTN; PAM sequence: TTG
gccatcatcgtcttcatttt

SEQ ID NO: 73493 - DNA, 20 bp, Artificial Sequence
  Description of Artificial Sequence: Synthetic oligonucleotide
  Target: SCN9A; (-) strand; PAM type: YTN; PAM sequence: TTA
gtgttggccatcatcgtctt

SEQ ID NO: 73494 - DNA, 20 bp, Artificial Sequence
  Description of Artificial Sequence: Synthetic oligonucleotide
  Target: SCN9A; (-) strand; PAM type: YTN; PAM sequence: CTT
agtgttggccatcatcgtct

SEQ ID NO: 73495 - DNA, 20 bp, Artificial Sequence
  Description of Artificial Sequence: Synthetic oligonucleotide
  Target: SCN9A; (-) strand; PAM type: YTN; PAM sequence: CTC
accttagtgttggccatcat

SEQ ID NO: 73496 - DNA, 20 bp, Artificial Sequence
  Description of Artificial Sequence: Synthetic oligonucleotide
  Target: SCN9A; (-) strand; PAM type: YTN; PAM sequence: CTA
ggtaacctcaccttagtgtt

SEQ ID NO: 73497 - DNA, 20 bp, Artificial Sequence
  Description of Artificial Sequence: Synthetic oligonucleotide
  Target: SCN9A; (-) strand; PAM type: YTN; PAM sequence: CTC
taggtaacctcaccttagtg

SEQ ID NO: 73498 - DNA, 20 bp, Artificial Sequence
  Description of Artificial Sequence: Synthetic oligonucleotide
  Target: SCN9A; (-) strand; PAM type: YTN; PAM sequence: CTC
agtaggggctctaggtaacc

SEQ ID NO: 73499 - DNA, 20 bp, Artificial Sequence
  Description of Artificial Sequence: Synthetic oligonucleotide
  Target: SCN9A; (-) strand; PAM type: YTN; PAM sequence: TTG
gtaactcagtaggggctcta

SEQ ID NO: 73500 - DNA, 20 bp, Artificial Sequence
  Description of Artificial Sequence: Synthetic oligonucleotide
  Target: SCN9A; (-) strand; PAM type: YTN; PAM sequence: TTA
agatcattggtaactcagta

SEQ ID NO: 73501 - DNA, 20 bp, Artificial Sequence
  Description of Artificial Sequence: Synthetic oligonucleotide
  Target: SCN9A; (-) strand; PAM type: YTN; PAM sequence: CTG
attaagatcattggtaactc

SEQ ID NO: 73502 - DNA, 20 bp, Artificial Sequence
  Description of Artificial Sequence: Synthetic oligonucleotide
  Target: SCN9A; (-) strand; PAM type: YTN; PAM sequence: TTG
aacatgctgattaagatcat

SEQ ID NO: 73503 - DNA, 20 bp, Artificial Sequence
  Description of Artificial Sequence: Synthetic oligonucleotide
  Target: SCN9A; (-) strand; PAM type: YTN; PAM sequence: CTG
gccaacattgaacatgctga

SEQ ID NO: 73504 - DNA, 20 bp, Artificial Sequence
  Description of Artificial Sequence: Synthetic oligonucleotide
  Target: SCN9A; (-) strand; PAM type: YTN; PAM sequence: TTG
gcaaaatcctggccaacatt

SEQ ID NO: 73505 - DNA, 20 bp, Artificial Sequence
  Description of Artificial Sequence: Synthetic oligonucleotide
  Target: SCN9A; (-) strand; PAM type: YTN; PAM sequence: TTC
aagttggcaaaatcctggcc

SEQ ID NO: 73506 - DNA, 20 bp, Artificial Sequence
  Description of Artificial Sequence: Synthetic oligonucleotide
  Target: SCN9A; (-) strand; PAM type: YTN; PAM sequence: CTT
caagttggcaaaatcctggc

SEQ ID NO: 73507 - DNA, 20 bp, Artificial Sequence
  Description of Artificial Sequence: Synthetic oligonucleotide
  Target: SCN9A; (-) strand; PAM type: YTN; PAM sequence: CTC
cgagtcttcaagttggcaaa

SEQ ID NO: 73508 - DNA, 20 bp, Artificial Sequence
  Description of Artificial Sequence: Synthetic oligonucleotide
  Target: SCN9A; (-) strand; PAM type: YTN; PAM sequence: TTA
gctccgagtcttcaagttgg

SEQ ID NO: 73509 - DNA, 20 bp, Artificial Sequence
  Description of Artificial Sequence: Synthetic oligonucleotide
  Target: SCN9A; (-) strand; PAM type: YTN; PAM sequence: TTT
agctccgagtcttcaagttg

SEQ ID NO: 73510 - DNA, 20 bp, Artificial Sequence
  Description of Artificial Sequence: Synthetic oligonucleotide
  Target: SCN9A; (-) strand; PAM type: YTN; PAM sequence: TTT
tagctccgagtcttcaagtt

SEQ ID NO: 73511 - DNA, 20 bp, Artificial Sequence
  Description of Artificial Sequence: Synthetic oligonucleotide
  Target: SCN9A; (-) strand; PAM type: YTN; PAM sequence: CTT
ttagctccgagtcttcaagt

SEQ ID NO: 73512 - DNA, 20 bp, Artificial Sequence
  Description of Artificial Sequence: Synthetic oligonucleotide
  Target: SCN9A; (-) strand; PAM type: YTN; PAM sequence: TTG
cttttagctccgagtcttca

SEQ ID NO: 73513 - DNA, 20 bp, Artificial Sequence
  Description of Artificial Sequence: Synthetic oligonucleotide
  Target: SCN9A; (-) strand; PAM type: YTN; PAM sequence: TTT
gcttttagctccgagtcttc

SEQ ID NO: 73514 - DNA, 20 bp, Artificial Sequence
  Description of Artificial Sequence: Synthetic oligonucleotide
  Target: SCN9A; (-) strand; PAM type: YTN; PAM sequence: TTA
tatttgcttttagctccgag

SEQ ID NO: 73515 - DNA, 20 bp, Artificial Sequence
  Description of Artificial Sequence: Synthetic oligonucleotide
  Target: SCN9A; (-) strand; PAM type: YTN; PAM sequence: TTT
atatttgcttttagctccga

SEQ ID NO: 73516 - DNA, 20 bp, Artificial Sequence
  Description of Artificial Sequence: Synthetic oligonucleotide
  Target: SCN9A; (-) strand; PAM type: YTN; PAM sequence: CTT
tatatttgcttttagctccg

SEQ ID NO: 73517 - DNA, 20 bp, Artificial Sequence
  Description of Artificial Sequence: Synthetic oligonucleotide
  Target: SCN9A; (-) strand; PAM type: YTN; PAM sequence: TTA
aactttatatttgcttttag

SEQ ID NO: 73518 - DNA, 20 bp, Artificial Sequence
  Description of Artificial Sequence: Synthetic oligonucleotide
  Target: SCN9A; (-) strand; PAM type: YTN; PAM sequence: TTA
acattaaactttatatttgc

SEQ ID NO: 73519 - DNA, 20 bp, Artificial Sequence
  Description of Artificial Sequence: Synthetic oligonucleotide
  Target: SCN9A; (-) strand; PAM type: YTN; PAM sequence: TTC
atagtgattaacattaaact

SEQ ID NO: 73520 - DNA, 20 bp, Artificial Sequence
  Description of Artificial Sequence: Synthetic oligonucleotide
  Target: SCN9A; (-) strand; PAM type: YTN; PAM sequence: TTT
catagtgattaacattaaac

SEQ ID NO: 73521 - DNA, 20 bp, Artificial Sequence
  Description of Artificial Sequence: Synthetic oligonucleotide
  Target: SCN9A; (-) strand; PAM type: YTN; PAM sequence: TTT
tcatagtgattaacattaaa

SEQ ID NO: 73522 - DNA, 20 bp, Artificial Sequence
  Description of Artificial Sequence: Synthetic oligonucleotide
  Target: SCN9A; (-) strand; PAM type: YTN; PAM sequence: TTG
aaaagattttcatagtgatt

SEQ ID NO: 73523 - DNA, 20 bp, Artificial Sequence
  Description of Artificial Sequence: Synthetic oligonucleotide
  Target: SCN9A; (-) strand; PAM type: YTN; PAM sequence: TTG
gaaacattgaaaagattttc

SEQ ID NO: 73524 - DNA, 20 bp, Artificial Sequence
  Description of Artificial Sequence: Synthetic oligonucleotide
  Target: SCN9A; (-) strand; PAM type: YTN; PAM sequence: TTG
aacaaaaatcaagattggaa

SEQ ID NO: 73525 - DNA, 20 bp, Artificial Sequence
  Description of Artificial Sequence: Synthetic oligonucleotide
  Target: SCN9A; (-) strand; PAM type: YTN; PAM sequence: TTT
gaacaaaaatcaagattgga

SEQ ID NO: 73526 - DNA, 20 bp, Artificial Sequence
  Description of Artificial Sequence: Synthetic oligonucleotide
  Target: SCN9A; (-) strand; PAM type: YTN; PAM sequence: CTT
tgaacaaaaatcaagattgg

SEQ ID NO: 73527 - DNA, 20 bp, Artificial Sequence
  Description of Artificial Sequence: Synthetic oligonucleotide
  Target: SCN9A; (-) strand; PAM type: YTN; PAM sequence: TTA
ccctttgaacaaaaatcaag

SEQ ID NO: 73528 - DNA, 20 bp, Artificial Sequence
  Description of Artificial Sequence: Synthetic oligonucleotide
  Target: SCN9A; (-) strand; PAM type: YTN; PAM sequence: TTT
accctttgaacaaaaatcaa

SEQ ID NO: 73529 - DNA, 20 bp, Artificial Sequence
  Description of Artificial Sequence: Synthetic oligonucleotide
  Target: SCN9A; (-) strand; PAM type: YTN; PAM sequence: CTT
taccctttgaacaaaaatca

SEQ ID NO: 73530 - DNA, 20 bp, Artificial Sequence
  Description of Artificial Sequence: Synthetic oligonucleotide
  Target: SCN9A; (-) strand; PAM type: YTN; PAM sequence: CTG
ctttaccctttgaacaaaaa

SEQ ID NO: 73531 - DNA, 20 bp, Artificial Sequence
  Description of Artificial Sequence: Synthetic oligonucleotide
  Target: SCN9A; (-) strand; PAM type: YTN; PAM sequence: TTA
aagtctgctttaccctttga

SEQ ID NO: 73532 - DNA, 20 bp, Artificial Sequence
  Description of Artificial Sequence: Synthetic oligonucleotide
  Target: SCN9A; (-) strand; PAM type: YTN; PAM sequence: CTT
aaagtctgctttaccctttg

SEQ ID NO: 73533 - DNA, 20 bp, Artificial Sequence
  Description of Artificial Sequence: Synthetic oligonucleotide
  Target: SCN9A; (-) strand; PAM type: YTN; PAM sequence: TTA
taggacttaaagtctgcttt

SEQ ID NO: 73534 - DNA, 20 bp, Artificial Sequence
  Description of Artificial Sequence: Synthetic oligonucleotide
  Target: SCN9A; (-) strand; PAM type: YTN; PAM sequence: CTG
gataataatgacaatattat

SEQ ID NO: 73535 - DNA, 20 bp, Artificial Sequence
  Description of Artificial Sequence: Synthetic oligonucleotide
  Target: SCN9A; (-) strand; PAM type: YTN; PAM sequence: TTA
gctggataataatgacaata

SEQ ID NO: 73536 - DNA, 20 bp, Artificial Sequence
  Description of Artificial Sequence: Synthetic oligonucleotide
  Target: SCN9A; (-) strand; PAM type: YTN; PAM sequence: TTT
agctggataataatgacaat

SEQ ID NO: 73537 - DNA, 20 bp, Artificial Sequence
  Description of Artificial Sequence: Synthetic oligonucleotide
  Target: SCN9A; (-) strand; PAM type: YTN; PAM sequence: TTT
tagctggataataatgacaa

SEQ ID NO: 73538 - DNA, 20 bp, Artificial Sequence
  Description of Artificial Sequence: Synthetic oligonucleotide
  Target: SCN9A; (-) strand; PAM type: YTN; PAM sequence: TTG
atgaaaatgaaaaataagaa

SEQ ID NO: 73539 - DNA, 20 bp, Artificial Sequence
  Description of Artificial Sequence: Synthetic oligonucleotide
  Target: SCN9A; (-) strand; PAM type: YTN; PAM sequence: TTG
aaaattgatgaaaatgaaaa

SEQ ID NO: 73540 - DNA, 20 bp, Artificial Sequence
  Description of Artificial Sequence: Synthetic oligonucleotide
  Target: SCN9A; (-) strand; PAM type: YTN; PAM sequence: TTG
tggcaagtggaacaaaataa

SEQ ID NO: 73541 - DNA, 20 bp, Artificial Sequence
  Description of Artificial Sequence: Synthetic oligonucleotide
  Target: SCN9A; (-) strand; PAM type: YTN; PAM sequence: TTT
gtggcaagtggaacaaaata

SEQ ID NO: 73542 - DNA, 20 bp, Artificial Sequence
  Description of Artificial Sequence: Synthetic oligonucleotide
  Target: SCN9A; (-) strand; PAM type: YTN; PAM sequence: TTT
tgtggcaagtggaacaaaat

SEQ ID NO: 73543 - DNA, 20 bp, Artificial Sequence
  Description of Artificial Sequence: Synthetic oligonucleotide
  Target: SCN9A; (-) strand; PAM type: YTN; PAM sequence: TTT
ttgtggcaagtggaacaaaa

SEQ ID NO: 73544 - DNA, 20 bp, Artificial Sequence
  Description of Artificial Sequence: Synthetic oligonucleotide
  Target: SCN9A; (-) strand; PAM type: YTN; PAM sequence: TTT
tttgtggcaagtggaacaaa

SEQ ID NO: 73545 - DNA, 20 bp, Artificial Sequence
  Description of Artificial Sequence: Synthetic oligonucleotide
  Target: SCN9A; (-) strand; PAM type: YTN; PAM sequence: TTG
taattttttgtggcaagtgg

SEQ ID NO: 73546 - DNA, 20 bp, Artificial Sequence
  Description of Artificial Sequence: Synthetic oligonucleotide
  Target: SCN9A; (-) strand; PAM type: YTN; PAM sequence: TTC
ataatatgtgttgtaatttt

SEQ ID NO: 73547 - DNA, 20 bp, Artificial Sequence
  Description of Artificial Sequence: Synthetic oligonucleotide
  Target: SCN9A; (-) strand; PAM type: YTN; PAM sequence: CTT
cataatatgtgttgtaattt

SEQ ID NO: 73548 - DNA, 20 bp, Artificial Sequence
  Description of Artificial Sequence: Synthetic oligonucleotide
  Target: SCN9A; (-) strand; PAM type: YTN; PAM sequence: TTC
ttcataatatgtgttgtaat

SEQ ID NO: 73549 - DNA, 20 bp, Artificial Sequence
  Description of Artificial Sequence: Synthetic oligonucleotide
  Target: SCN9A; (-) strand; PAM type: YTN; PAM sequence: TTT
cttcataatatgtgttgtaa

SEQ ID NO: 73550 - DNA, 20 bp, Artificial Sequence
  Description of Artificial Sequence: Synthetic oligonucleotide
  Target: SCN9A; (-) strand; PAM type: YTN; PAM sequence: CTA
aaagtacatagtttcttcat

SEQ ID NO: 73551 - DNA, 20 bp, Artificial Sequence
  Description of Artificial Sequence: Synthetic oligonucleotide
  Target: SCN9A; (-) strand; PAM type: YTN; PAM sequence: CTG
aactaaaagtacatagtttc

SEQ ID NO: 73552 - DNA, 20 bp, Artificial Sequence
  Description of Artificial Sequence: Synthetic oligonucleotide
  Target: SCN9A; (-) strand; PAM type: YTN; PAM sequence: CTA
tagcaatcctgaactaaaag

SEQ ID NO: 73553 - DNA, 20 bp, Artificial Sequence
  Description of Artificial Sequence: Synthetic oligonucleotide
  Target: SCN9A; (-) strand; PAM type: YTN; PAM sequence: TTC
tatagcaatcctgaactaaa

SEQ ID NO: 73554 - DNA, 20 bp, Artificial Sequence
  Description of Artificial Sequence: Synthetic oligonucleotide
  Target: SCN9A; (-) strand; PAM type: YTN; PAM sequence: TTT
ctatagcaatcctgaactaa

SEQ ID NO: 73555 - DNA, 20 bp, Artificial Sequence
  Description of Artificial Sequence: Synthetic oligonucleotide
  Target: SCN9A; (-) strand; PAM type: YTN; PAM sequence: TTA
tgataagaggtttctatagc

SEQ ID NO: 73556 - DNA, 20 bp, Artificial Sequence
  Description of Artificial Sequence: Synthetic oligonucleotide
  Target: SCN9A; (-) strand; PAM type: YTN; PAM sequence: CTA
aaagaaaaatatcacaaatt

SEQ ID NO: 73557 - DNA, 20 bp, Artificial Sequence
  Description of Artificial Sequence: Synthetic oligonucleotide
  Target: SCN9A; (-) strand; PAM type: YTN; PAM sequence: TTC
taaaagaaaaatatcacaaa

SEQ ID NO: 73558 - DNA, 20 bp, Artificial Sequence
  Description of Artificial Sequence: Synthetic oligonucleotide
  Target: SCN9A; (-) strand; PAM type: YTN; PAM sequence: TTA
tcaattctaaaagaaaaata

SEQ ID NO: 73559 - DNA, 20 bp, Artificial Sequence
  Description of Artificial Sequence: Synthetic oligonucleotide
  Target: SCN9A; (-) strand; PAM type: YTN; PAM sequence: TTA
aggataaattatcaattcta

SEQ ID NO: 73560 - DNA, 20 bp, Artificial Sequence
  Description of Artificial Sequence: Synthetic oligonucleotide
  Target: SCN9A; (-) strand; PAM type: YTN; PAM sequence: TTA
gaaagtagaattaaggataa

SEQ ID NO: 73561 - DNA, 20 bp, Artificial Sequence
  Description of Artificial Sequence: Synthetic oligonucleotide
  Target: SCN9A; (-) strand; PAM type: YTN; PAM sequence: CTA
agtgtcggcatgagaaaatg

SEQ ID NO: 73562 - DNA, 20 bp, Artificial Sequence
  Description of Artificial Sequence: Synthetic oligonucleotide
  Target: SCN9A; (-) strand; PAM type: YTN; PAM sequence: TTA
tctaagtgtcggcatgagaa

SEQ ID NO: 73563 - DNA, 20 bp, Artificial Sequence
  Description of Artificial Sequence: Synthetic oligonucleotide
  Target: SCN9A; (-) strand; PAM type: YTN; PAM sequence: TTT
atctaagtgtcggcatgaga

SEQ ID NO: 73564 - DNA, 20 bp, Artificial Sequence
  Description of Artificial Sequence: Synthetic oligonucleotide
  Target: SCN9A; (-) strand; PAM type: YTN; PAM sequence: TTT
tatctaagtgtcggcatgag

SEQ ID NO: 73565 - DNA, 20 bp, Artificial Sequence
  Description of Artificial Sequence: Synthetic oligonucleotide
  Target: SCN9A; (-) strand; PAM type: YTN; PAM sequence: CTA
gattttatctaagtgtcggc

SEQ ID NO: 73566 - DNA, 20 bp, Artificial Sequence
  Description of Artificial Sequence: Synthetic oligonucleotide
  Target: SCN9A; (-) strand; PAM type: YTN; PAM sequence: CTA
atatgctagattttatctaa

SEQ ID NO: 73567 - DNA, 20 bp, Artificial Sequence
  Description of Artificial Sequence: Synthetic oligonucleotide
  Target: SCN9A; (-) strand; PAM type: YTN; PAM sequence: CTC
taatatgctagattttatct

SEQ ID NO: 73568 - DNA, 20 bp, Artificial Sequence
  Description of Artificial Sequence: Synthetic oligonucleotide
  Target: SCN9A; (-) strand; PAM type: YTN; PAM sequence: TTC
ctctaatatgctagatttta

SEQ ID NO: 73569 - DNA, 20 bp, Artificial Sequence
  Description of Artificial Sequence: Synthetic oligonucleotide
  Target: SCN9A; (-) strand; PAM type: YTN; PAM sequence: TTA
aagcacattcctctaatatg

SEQ ID NO: 73570 - DNA, 20 bp, Artificial Sequence
  Description of Artificial Sequence: Synthetic oligonucleotide
  Target: SCN9A; (-) strand; PAM type: YTN; PAM sequence: TTT
aaagcacattcctctaatat

SEQ ID NO: 73571 - DNA, 20 bp, Artificial Sequence
  Description of Artificial Sequence: Synthetic oligonucleotide
  Target: SCN9A; (-) strand; PAM type: YTN; PAM sequence: TTT
taaagcacattcctctaata

SEQ ID NO: 73572 - DNA, 20 bp, Artificial Sequence
  Description of Artificial Sequence: Synthetic oligonucleotide
  Target: SCN9A; (-) strand; PAM type: YTN; PAM sequence: TTT
ttaaagcacattcctctaat

SEQ ID NO: 73573 - DNA, 20 bp, Artificial Sequence
  Description of Artificial Sequence: Synthetic oligonucleotide
  Target: SCN9A; (-) strand; PAM type: YTN; PAM sequence: CTT
tttaaagcacattcctctaa

SEQ ID NO: 73574 - DNA, 20 bp, Artificial Sequence
  Description of Artificial Sequence: Synthetic oligonucleotide
  Target: SCN9A; (-) strand; PAM type: YTN; PAM sequence: TTA
acaatataaaaacaaataaa

SEQ ID NO: 73575 - DNA, 20 bp, Artificial Sequence
  Description of Artificial Sequence: Synthetic oligonucleotide
  Target: SCN9A; (-) strand; PAM type: YTN; PAM sequence: CTT
aacaatataaaaacaaataa

SEQ ID NO: 73576 - DNA, 20 bp, Artificial Sequence
  Description of Artificial Sequence: Synthetic oligonucleotide
  Target: SCN9A; (-) strand; PAM type: YTN; PAM sequence: CTG
atcttaacaatataaaaaca

SEQ ID NO: 73577 - DNA, 20 bp, Artificial Sequence
  Description of Artificial Sequence: Synthetic oligonucleotide
  Target: SCN9A; (-) strand; PAM type: YTN; PAM sequence: TTG
tctgatcttaacaatataaa

SEQ ID NO: 73578 - DNA, 20 bp, Artificial Sequence
  Description of Artificial Sequence: Synthetic oligonucleotide
  Target: SCN9A; (-) strand; PAM type: YTN; PAM sequence: TTG
ttgtctgatcttaacaatat

SEQ ID NO: 73579 - DNA, 20 bp, Artificial Sequence
  Description of Artificial Sequence: Synthetic oligonucleotide
  Target: SCN9A; (-) strand; PAM type: YTN; PAM sequence: TTA
tcccccaaaacaattgttgt

SEQ ID NO: 73580 - DNA, 20 bp, Artificial Sequence
  Description of Artificial Sequence: Synthetic oligonucleotide
  Target: SCN9A; (-) strand; PAM type: YTN; PAM sequence: TTG
ttatcccccaaaacaattgt

SEQ ID NO: 73581 - DNA, 20 bp, Artificial Sequence
  Description of Artificial Sequence: Synthetic oligonucleotide
  Target: SCN9A; (-) strand; PAM type: YTN; PAM sequence: TTA
aagatcaaattgttatcccc

SEQ ID NO: 73582 - DNA, 20 bp, Artificial Sequence
  Description of Artificial Sequence: Synthetic oligonucleotide
  Target: SCN9A; (-) strand; PAM type: YTN; PAM sequence: TTG
gtaattaaagatcaaattgt

SEQ ID NO: 73583 - DNA, 20 bp, Artificial Sequence
  Description of Artificial Sequence: Synthetic oligonucleotide
  Target: SCN9A; (-) strand; PAM type: YTN; PAM sequence: TTT
ggtaattaaagatcaaattg

SEQ ID NO: 73584 - DNA, 20 bp, Artificial Sequence
  Description of Artificial Sequence: Synthetic oligonucleotide
  Target: SCN9A; (-) strand; PAM type: YTN; PAM sequence: TTA
tgaatttggtaattaaagat

SEQ ID NO: 73585 - DNA, 20 bp, Artificial Sequence
  Description of Artificial Sequence: Synthetic oligonucleotide
  Target: SCN9A; (-) strand; PAM type: YTN; PAM sequence: TTT
atgaatttggtaattaaaga

SEQ ID NO: 73586 - DNA, 20 bp, Artificial Sequence
  Description of Artificial Sequence: Synthetic oligonucleotide
  Target: SCN9A; (-) strand; PAM type: YTN; PAM sequence: CTT
tatgaatttggtaattaaag

SEQ ID NO: 73587 - DNA, 20 bp, Artificial Sequence
  Description of Artificial Sequence: Synthetic oligonucleotide
  Target: SCN9A; (-) strand; PAM type: YTN; PAM sequence: TTC
ataactttatgaatttggta

SEQ ID NO: 73588 - DNA, 20 bp, Artificial Sequence
  Description of Artificial Sequence: Synthetic oligonucleotide
  Target: SCN9A; (-) strand; PAM type: YTN; PAM sequence: TTA
tatgttcataactttatgaa

SEQ ID NO: 73589 - DNA, 20 bp, Artificial Sequence
  Description of Artificial Sequence: Synthetic oligonucleotide
  Target: SCN9A; (-) strand; PAM type: YTN; PAM sequence: TTC
aatgattatatgttcataac

SEQ ID NO: 73590 - DNA, 20 bp, Artificial Sequence
  Description of Artificial Sequence: Synthetic oligonucleotide
  Target: SCN9A; (-) strand; PAM type: YTN; PAM sequence: TTT
caatgattatatgttcataa

SEQ ID NO: 73591 - DNA, 20 bp, Artificial Sequence
  Description of Artificial Sequence: Synthetic oligonucleotide
  Target: SCN9A; (-) strand; PAM type: YTN; PAM sequence: TTA
cagaatttcaatgattatat

SEQ ID NO: 73592 - DNA, 20 bp, Artificial Sequence
  Description of Artificial Sequence: Synthetic oligonucleotide
  Target: SCN9A; (-) strand; PAM type: YTN; PAM sequence: CTT
acagaatttcaatgattata

SEQ ID NO: 73593 - DNA, 20 bp, Artificial Sequence
  Description of Artificial Sequence: Synthetic oligonucleotide
  Target: SCN9A; (-) strand; PAM type: YTN; PAM sequence: TTG
tggcttacagaatttcaatg

SEQ ID NO: 73594 - DNA, 20 bp, Artificial Sequence
  Description of Artificial Sequence: Synthetic oligonucleotide
  Target: SCN9A; (-) strand; PAM type: YTN; PAM sequence: CTT
gtggcttacagaatttcaat

SEQ ID NO: 73595 - DNA, 20 bp, Artificial Sequence
  Description of Artificial Sequence: Synthetic oligonucleotide
  Target: SCN9A; (-) strand; PAM type: YTN; PAM sequence: TTC
agagtaagaagcttgtggct

SEQ ID NO: 73596 - DNA, 20 bp, Artificial Sequence
  Description of Artificial Sequence: Synthetic oligonucleotide
  Target: SCN9A; (-) strand; PAM type: YTN; PAM sequence: TTT
cagagtaagaagcttgtggc

SEQ ID NO: 73597 - DNA, 20 bp, Artificial Sequence
  Description of Artificial Sequence: Synthetic oligonucleotide
  Target: SCN9A; (-) strand; PAM type: YTN; PAM sequence: TTA
tttcagagtaagaagcttgt

SEQ ID NO: 73598 - DNA, 20 bp, Artificial Sequence
  Description of Artificial Sequence: Synthetic oligonucleotide
  Target: SCN9A; (-) strand; PAM type: YTN; PAM sequence: TTT
atttcagagtaagaagcttg

SEQ ID NO: 73599 - DNA, 20 bp, Artificial Sequence
  Description of Artificial Sequence: Synthetic oligonucleotide
  Target: SCN9A; (-) strand; PAM type: YTN; PAM sequence: TTA
atatagtacaataatttatt

SEQ ID NO: 73600 - DNA, 20 bp, Artificial Sequence
  Description of Artificial Sequence: Synthetic oligonucleotide
  Target: SCN9A; (-) strand; PAM type: YTN; PAM sequence: CTA
ttaatatagtacaataattt

SEQ ID NO: 73601 - DNA, 20 bp, Artificial Sequence
  Description of Artificial Sequence: Synthetic oligonucleotide
  Target: SCN9A; (-) strand; PAM type: YTN; PAM sequence: TTC
tattaatatagtacaataat

SEQ ID NO: 73602 - DNA, 20 bp, Artificial Sequence
  Description of Artificial Sequence: Synthetic oligonucleotide
  Target: SCN9A; (-) strand; PAM type: YTN; PAM sequence: TTT
ctattaatatagtacaataa

SEQ ID NO: 73603 - DNA, 20 bp, Artificial Sequence
  Description of Artificial Sequence: Synthetic oligonucleotide
  Target: SCN9A; (-) strand; PAM type: YTN; PAM sequence: TTT
tctattaatatagtacaata

SEQ ID NO: 73604 - DNA, 20 bp, Artificial Sequence
  Description of Artificial Sequence: Synthetic oligonucleotide
  Target: SCN9A; (-) strand; PAM type: YTN; PAM sequence: CTA
atataatataaatattttct

SEQ ID NO: 73605 - DNA, 20 bp, Artificial Sequence
  Description of Artificial Sequence: Synthetic oligonucleotide
  Target: SCN9A; (-) strand; PAM type: YTN; PAM sequence: TTG
aagtacacgctaatataata

SEQ ID NO: 73606 - DNA, 20 bp, Artificial Sequence
  Description of Artificial Sequence: Synthetic oligonucleotide
  Target: SCN9A; (-) strand; PAM type: YTN; PAM sequence: TTT
gaagtacacgctaatataat

SEQ ID NO: 73607 - DNA, 20 bp, Artificial Sequence
  Description of Artificial Sequence: Synthetic oligonucleotide
  Target: SCN9A; (-) strand; PAM type: YTN; PAM sequence: CTA
atttgaagtacacgctaata

SEQ ID NO: 73608 - DNA, 20 bp, Artificial Sequence
  Description of Artificial Sequence: Synthetic oligonucleotide
  Target: SCN9A; (-) strand; PAM type: YTN; PAM sequence: TTC
taatttgaagtacacgctaa

SEQ ID NO: 73609 - DNA, 20 bp, Artificial Sequence
  Description of Artificial Sequence: Synthetic oligonucleotide
  Target: SCN9A; (-) strand; PAM type: YTN; PAM sequence: CTC
aattctaatttgaagtacac

SEQ ID NO: 73610 - DNA, 20 bp, Artificial Sequence
  Description of Artificial Sequence: Synthetic oligonucleotide
  Target: SCN9A; (-) strand; PAM type: YTN; PAM sequence: TTG
aagacatgctcaattctaat

SEQ ID NO: 73611 - DNA, 20 bp, Artificial Sequence
  Description of Artificial Sequence: Synthetic oligonucleotide
  Target: SCN9A; (-) strand; PAM type: YTN; PAM sequence: TTT
gaagacatgctcaattctaa

SEQ ID NO: 73612 - DNA, 20 bp, Artificial Sequence
  Description of Artificial Sequence: Synthetic oligonucleotide
  Target: SCN9A; (-) strand; PAM type: YTN; PAM sequence: TTT
tgaagacatgctcaattcta

SEQ ID NO: 73613 - DNA, 20 bp, Artificial Sequence
  Description of Artificial Sequence: Synthetic oligonucleotide
  Target: SCN9A; (-) strand; PAM type: YTN; PAM sequence: TTT
ttgaagacatgctcaattct

SEQ ID NO: 73614 - DNA, 20 bp, Artificial Sequence
  Description of Artificial Sequence: Synthetic oligonucleotide
  Target: SCN9A; (-) strand; PAM type: YTN; PAM sequence: TTA
caatttttgaagacatgctc

SEQ ID NO: 73615 - DNA, 20 bp, Artificial Sequence
  Description of Artificial Sequence: Synthetic oligonucleotide
  Target: SCN9A; (-) strand; PAM type: YTN; PAM sequence: TTT
acaatttttgaagacatgct

SEQ ID NO: 73616 - DNA, 20 bp, Artificial Sequence
  Description of Artificial Sequence: Synthetic oligonucleotide
  Target: SCN9A; (-) strand; PAM type: YTN; PAM sequence: TTT
tacaatttttgaagacatgc

SEQ ID NO: 73617 - DNA, 20 bp, Artificial Sequence
  Description of Artificial Sequence: Synthetic oligonucleotide
  Target: SCN9A; (-) strand; PAM type: YTN; PAM sequence: TTT
ttacaatttttgaagacatg

SEQ ID NO: 73618 - DNA, 20 bp, Artificial Sequence
  Description of Artificial Sequence: Synthetic oligonucleotide
  Target: SCN9A; (-) strand; PAM type: YTN; PAM sequence: CTA
aaaccacatgaatattttta

SEQ ID NO: 73619 - DNA, 20 bp, Artificial Sequence
  Description of Artificial Sequence: Synthetic oligonucleotide
  Target: SCN9A; (-) strand; PAM type: YTN; PAM sequence: TTA
aagaactaaaaccacatgaa

SEQ ID NO: 73620 - DNA, 20 bp, Artificial Sequence
  Description of Artificial Sequence: Synthetic oligonucleotide
  Target: SCN9A; (-) strand; PAM type: YTN; PAM sequence: CTT
aaagaactaaaaccacatga

SEQ ID NO: 73621 - DNA, 20 bp, Artificial Sequence
  Description of Artificial Sequence: Synthetic oligonucleotide
  Target: SCN9A; (-) strand; PAM type: YTN; PAM sequence: TTG
acaaatgcacttaaagaact

SEQ ID NO: 73622 - DNA, 20 bp, Artificial Sequence
  Description of Artificial Sequence: Synthetic oligonucleotide
  Target: SCN9A; (-) strand; PAM type: YTN; PAM sequence: TTC
attgacaaatgcacttaaag

SEQ ID NO: 73623 - DNA, 20 bp, Artificial Sequence
  Description of Artificial Sequence: Synthetic oligonucleotide
  Target: SCN9A; (-) strand; PAM type: YTN; PAM sequence: CTA
gtaaaataaaatccattcat

SEQ ID NO: 73624 - DNA, 20 bp, Artificial Sequence
  Description of Artificial Sequence: Synthetic oligonucleotide
  Target: SCN9A; (-) strand; PAM type: YTN; PAM sequence: TTG
atatctagtaaaataaaatc

SEQ ID NO: 73625 - DNA, 20 bp, Artificial Sequence
  Description of Artificial Sequence: Synthetic oligonucleotide
  Target: SCN9A; (-) strand; PAM type: YTN; PAM sequence: CTT
gatatctagtaaaataaaat

SEQ ID NO: 73626 - DNA, 20 bp, Artificial Sequence
  Description of Artificial Sequence: Synthetic oligonucleotide
  Target: SCN9A; (-) strand; PAM type: YTN; PAM sequence: TTA
tatcttgatatctagtaaaa

SEQ ID NO: 73627 - DNA, 20 bp, Artificial Sequence
  Description of Artificial Sequence: Synthetic oligonucleotide
  Target: SCN9A; (-) strand; PAM type: YTN; PAM sequence: TTG
aatcaaaaggcaagattata

SEQ ID NO: 73628 - DNA, 20 bp, Artificial Sequence
  Description of Artificial Sequence: Synthetic oligonucleotide
  Target: SCN9A; (-) strand; PAM type: YTN; PAM sequence: TTT
gaatcaaaaggcaagattat

SEQ ID NO: 73629 - DNA, 20 bp, Artificial Sequence
  Description of Artificial Sequence: Synthetic oligonucleotide
  Target: SCN9A; (-) strand; PAM type: YTN; PAM sequence: TTG
ggaatttgaatcaaaaggca

SEQ ID NO: 73630 - DNA, 20 bp, Artificial Sequence
  Description of Artificial Sequence: Synthetic oligonucleotide
  Target: SCN9A; (-) strand; PAM type: YTN; PAM sequence: TTT
gggaatttgaatcaaaaggc

SEQ ID NO: 73631 - DNA, 20 bp, Artificial Sequence
  Description of Artificial Sequence: Synthetic oligonucleotide
  Target: SCN9A; (-) strand; PAM type: YTN; PAM sequence: TTT
tgggaatttgaatcaaaagg

SEQ ID NO: 73632 - DNA, 20 bp, Artificial Sequence
  Description of Artificial Sequence: Synthetic oligonucleotide
  Target: SCN9A; (-) strand; PAM type: YTN; PAM sequence: CTT
ttgggaatttgaatcaaaag

SEQ ID NO: 73633 - DNA, 20 bp, Artificial Sequence
  Description of Artificial Sequence: Synthetic oligonucleotide
  Target: SCN9A; (-) strand; PAM type: YTN; PAM sequence: TTA
aaaacttttgggaatttgaa

SEQ ID NO: 73634 - DNA, 20 bp, Artificial Sequence
  Description of Artificial Sequence: Synthetic oligonucleotide
  Target: SCN9A; (-) strand; PAM type: YTN; PAM sequence: TTT
aaaaacttttgggaatttga

SEQ ID NO: 73635 - DNA, 20 bp, Artificial Sequence
  Description of Artificial Sequence: Synthetic oligonucleotide
  Target: SCN9A; (-) strand; PAM type: YTN; PAM sequence: TTT
taaaaacttttgggaatttg

SEQ ID NO: 73636 - DNA, 20 bp, Artificial Sequence
  Description of Artificial Sequence: Synthetic oligonucleotide
  Target: SCN9A; (-) strand; PAM type: YTN; PAM sequence: TTT
ttaaaaacttttgggaattt

SEQ ID NO: 73637 - DNA, 20 bp, Artificial Sequence
  Description of Artificial Sequence: Synthetic oligonucleotide
  Target: SCN9A; (-) strand; PAM type: YTN; PAM sequence: TTA
tttttaaaaacttttgggaa

SEQ ID NO: 73638 - DNA, 20 bp, Artificial Sequence
  Description of Artificial Sequence: Synthetic oligonucleotide
  Target: SCN9A; (-) strand; PAM type: YTN; PAM sequence: TTG
cattatttttaaaaactttt

SEQ ID NO: 73639 - DNA, 20 bp, Artificial Sequence
  Description of Artificial Sequence: Synthetic oligonucleotide
  Target: SCN9A; (-) strand; PAM type: YTN; PAM sequence: TTT
gcattatttttaaaaacttt

SEQ ID NO: 73640 - DNA, 20 bp, Artificial Sequence
  Description of Artificial Sequence: Synthetic oligonucleotide
  Target: SCN9A; (-) strand; PAM type: YTN; PAM sequence: TTT
tgcattatttttaaaaactt

SEQ ID NO: 73641 - DNA, 20 bp, Artificial Sequence
  Description of Artificial Sequence: Synthetic oligonucleotide
  Target: SCN9A; (-) strand; PAM type: YTN; PAM sequence: TTG
gttttgcattatttttaaaa

SEQ ID NO: 73642 - DNA, 20 bp, Artificial Sequence
  Description of Artificial Sequence: Synthetic oligonucleotide
  Target: SCN9A; (-) strand; PAM type: YTN; PAM sequence: TTT
ggttttgcattatttttaaa

SEQ ID NO: 73643 - DNA, 20 bp, Artificial Sequence
  Description of Artificial Sequence: Synthetic oligonucleotide
  Target: SCN9A; (-) strand; PAM type: YTN; PAM sequence: CTT
tggttttgcattatttttaa

SEQ ID NO: 73644 - DNA, 20 bp, Artificial Sequence
  Description of Artificial Sequence: Synthetic oligonucleotide
  Target: SCN9A; (-) strand; PAM type: YTN; PAM sequence: TTC
tttggttttgcattattttt

SEQ ID NO: 73645 - DNA, 20 bp, Artificial Sequence
  Description of Artificial Sequence: Synthetic oligonucleotide
  Target: SCN9A; (-) strand; PAM type: YTN; PAM sequence: TTT
ctttggttttgcattatttt

SEQ ID NO: 73646 - DNA, 20 bp, Artificial Sequence
  Description of Artificial Sequence: Synthetic oligonucleotide
  Target: SCN9A; (-) strand; PAM type: YTN; PAM sequence: CTA
taataaaggggtatttcttt

SEQ ID NO: 73647 - DNA, 20 bp, Artificial Sequence
  Description of Artificial Sequence: Synthetic oligonucleotide
  Target: SCN9A; (-) strand; PAM type: YTN; PAM sequence: TTC
tataataaaggggtatttct

SEQ ID NO: 73648 - DNA, 20 bp, Artificial Sequence
  Description of Artificial Sequence: Synthetic oligonucleotide
  Target: SCN9A; (-) strand; PAM type: YTN; PAM sequence: TTA
tattctataataaaggggta

SEQ ID NO: 73649 - DNA, 20 bp, Artificial Sequence
  Description of Artificial Sequence: Synthetic oligonucleotide
  Target: SCN9A; (-) strand; PAM type: YTN; PAM sequence: TTG
ccattatattctataataaa

SEQ ID NO: 73650 - DNA, 20 bp, Artificial Sequence
  Description of Artificial Sequence: Synthetic oligonucleotide
  Target: SCN9A; (-) strand; PAM type: YTN; PAM sequence: CTA
aggttgccattatattctat

SEQ ID NO: 73651 - DNA, 20 bp, Artificial Sequence
  Description of Artificial Sequence: Synthetic oligonucleotide
  Target: SCN9A; (-) strand; PAM type: YTN; PAM sequence: CTG
gtaaacataaactaaggttg

SEQ ID NO: 73652 - DNA, 20 bp, Artificial Sequence
  Description of Artificial Sequence: Synthetic oligonucleotide
  Target: SCN9A; (-) strand; PAM type: YTN; PAM sequence: TTC
agactggtaaacataaacta

SEQ ID NO: 73653 - DNA, 20 bp, Artificial Sequence
  Description of Artificial Sequence: Synthetic oligonucleotide
  Target: SCN9A; (-) strand; PAM type: YTN; PAM sequence: CTG
cgatcattcagactggtaaa

SEQ ID NO: 73654 - DNA, 20 bp, Artificial Sequence
  Description of Artificial Sequence: Synthetic oligonucleotide
  Target: SCN9A; (-) strand; PAM type: YTN; PAM sequence: TTC
tgcgatcattcagactggta

SEQ ID NO: 73655 - DNA, 20 bp, Artificial Sequence
  Description of Artificial Sequence: Synthetic oligonucleotide
  Target: SCN9A; (-) strand; PAM type: YTN; PAM sequence: TTG
tcagttctgcgatcattcag

SEQ ID NO: 73656 - DNA, 20 bp, Artificial Sequence
  Description of Artificial Sequence: Synthetic oligonucleotide
  Target: SCN9A; (-) strand; PAM type: YTN; PAM sequence: CTA
gcagatgtggaaggattgtc

SEQ ID NO: 73657 - DNA, 20 bp, Artificial Sequence
  Description of Artificial Sequence: Synthetic oligonucleotide
  Target: SCN9A; (-) strand; PAM type: YTN; PAM sequence: TTC
tagcagatgtggaaggattg

SEQ ID NO: 73658 - DNA, 20 bp, Artificial Sequence
  Description of Artificial Sequence: Synthetic oligonucleotide
  Target: SCN9A; (-) strand; PAM type: YTN; PAM sequence: TTT
ctagcagatgtggaaggatt

SEQ ID NO: 73659 - DNA, 20 bp, Artificial Sequence
  Description of Artificial Sequence: Synthetic oligonucleotide
  Target: SCN9A; (-) strand; PAM type: YTN; PAM sequence: CTT
tctagcagatgtggaaggat

SEQ ID NO: 73660 - DNA, 20 bp, Artificial Sequence
  Description of Artificial Sequence: Synthetic oligonucleotide
  Target: SCN9A; (-) strand; PAM type: YTN; PAM sequence: CTC
tttctagcagatgtggaagg

SEQ ID NO: 73661 - DNA, 20 bp, Artificial Sequence
  Description of Artificial Sequence: Synthetic oligonucleotide
  Target: SCN9A; (-) strand; PAM type: YTN; PAM sequence: TTA
gtggagctctttctagcaga

SEQ ID NO: 73662 - DNA, 20 bp, Artificial Sequence
  Description of Artificial Sequence: Synthetic oligonucleotide
  Target: SCN9A; (-) strand; PAM type: YTN; PAM sequence: TTT
agtggagctctttctagcag

SEQ ID NO: 73663 - DNA, 20 bp, Artificial Sequence
  Description of Artificial Sequence: Synthetic oligonucleotide
  Target: SCN9A; (-) strand; PAM type: YTN; PAM sequence: TTA
agtttagtggagctctttct

SEQ ID NO: 73664 - DNA, 20 bp, Artificial Sequence
  Description of Artificial Sequence: Synthetic oligonucleotide
  Target: SCN9A; (-) strand; PAM type: YTN; PAM sequence: TTT
aagtttagtggagctctttc

SEQ ID NO: 73665 - DNA, 20 bp, Artificial Sequence
  Description of Artificial Sequence: Synthetic oligonucleotide
  Target: SCN9A; (-) strand; PAM type: YTN; PAM sequence: CTT
taagtttagtggagctcttt

SEQ ID NO: 73666 - DNA, 20 bp, Artificial Sequence
  Description of Artificial Sequence: Synthetic oligonucleotide
  Target: SCN9A; (-) strand; PAM type: YTN; PAM sequence: TTG
tgactttaagtttagtggag

SEQ ID NO: 73667 - DNA, 20 bp, Artificial Sequence
  Description of Artificial Sequence: Synthetic oligonucleotide
  Target: SCN9A; (-) strand; PAM type: YTN; PAM sequence: TTA
ttgtgactttaagtttagtg

SEQ ID NO: 73668 - DNA, 20 bp, Artificial Sequence
  Description of Artificial Sequence: Synthetic oligonucleotide
  Target: SCN9A; (-) strand; PAM type: YTN; PAM sequence: CTT
attgtgactttaagtttagt

SEQ ID NO: 73669 - DNA, 20 bp, Artificial Sequence
  Description of Artificial Sequence: Synthetic oligonucleotide
  Target: SCN9A; (-) strand; PAM type: YTN; PAM sequence: TTG
acagccttattgtgacttta

SEQ ID NO: 73670 - DNA, 20 bp, Artificial Sequence
  Description of Artificial Sequence: Synthetic oligonucleotide
  Target: SCN9A; (-) strand; PAM type: YTN; PAM sequence: TTT
gacagccttattgtgacttt

SEQ ID NO: 73671 - DNA, 20 bp, Artificial Sequence
  Description of Artificial Sequence: Synthetic oligonucleotide
  Target: SCN9A; (-) strand; PAM type: YTN; PAM sequence: TTT
tgacagccttattgtgactt

SEQ ID NO: 73672 - DNA, 20 bp, Artificial Sequence
  Description of Artificial Sequence: Synthetic oligonucleotide
  Target: SCN9A; (-) strand; PAM type: YTN; PAM sequence: TTT
ttgacagccttattgtgact

SEQ ID NO: 73673 - DNA, 20 bp, Artificial Sequence
  Description of Artificial Sequence: Synthetic oligonucleotide
  Target: SCN9A; (-) strand; PAM type: YTN; PAM sequence: CTG
gaatatttttgacagcctta

SEQ ID NO: 73674 - DNA, 20 bp, Artificial Sequence
  Description of Artificial Sequence: Synthetic oligonucleotide
  Target: SCN9A; (-) strand; PAM type: YTN; PAM sequence: TTC
caagtaggctggaatatttt

SEQ ID NO: 73675 - DNA, 20 bp, Artificial Sequence
  Description of Artificial Sequence: Synthetic oligonucleotide
  Target: SCN9A; (-) strand; PAM type: YTN; PAM sequence: TTT
ccaagtaggctggaatattt

SEQ ID NO: 73676 - DNA, 20 bp, Artificial Sequence
  Description of Artificial Sequence: Synthetic oligonucleotide
  Target: SCN9A; (-) strand; PAM type: YTN; PAM sequence: TTG
ccatggatccatatgagtat

SEQ ID NO: 73677 - DNA, 20 bp, Artificial Sequence
  Description of Artificial Sequence: Synthetic oligonucleotide
  Target: SCN9A; (-) strand; PAM type: YTN; PAM sequence: CTG
attgccatggatccatatga

SEQ ID NO: 73678 - DNA, 20 bp, Artificial Sequence
  Description of Artificial Sequence: Synthetic oligonucleotide
  Target: SCN9A; (-) strand; PAM type: YTN; PAM sequence: TTA
aaactgattgccatggatcc

SEQ ID NO: 73679 - DNA, 20 bp, Artificial Sequence
  Description of Artificial Sequence: Synthetic oligonucleotide
  Target: SCN9A; (-) strand; PAM type: YTN; PAM sequence: CTG
aaatggtattaaaactgatt

SEQ ID NO: 73680 - DNA, 20 bp, Artificial Sequence
  Description of Artificial Sequence: Synthetic oligonucleotide
  Target: SCN9A; (-) strand; PAM type: YTN; PAM sequence: TTG
cagctgaaatggtattaaaa

SEQ ID NO: 73681 - DNA, 20 bp, Artificial Sequence
  Description of Artificial Sequence: Synthetic oligonucleotide
  Target: SCN9A; (-) strand; PAM type: YTN; PAM sequence: TTT
gcagctgaaatggtattaaa

SEQ ID NO: 73682 - DNA, 20 bp, Artificial Sequence
  Description of Artificial Sequence: Synthetic oligonucleotide
  Target: SCN9A; (-) strand; PAM type: YTN; PAM sequence: CTT
tgcagctgaaatggtattaa

SEQ ID NO: 73683 - DNA, 20 bp, Artificial Sequence
  Description of Artificial Sequence: Synthetic oligonucleotide
  Target: SCN9A; (-) strand; PAM type: YTN; PAM sequence: CTG
gaatctttgcagctgaaatg

SEQ ID NO: 73684 - DNA, 20 bp, Artificial Sequence
  Description of Artificial Sequence: Synthetic oligonucleotide
  Target: SCN9A; (-) strand; PAM type: YTN; PAM sequence: TTA
ctggaatctttgcagctgaa

SEQ ID NO: 73685 - DNA, 20 bp, Artificial Sequence
  Description of Artificial Sequence: Synthetic oligonucleotide
  Target: SCN9A; (-) strand; PAM type: YTN; PAM sequence: TTT
actggaatctttgcagctga

SEQ ID NO: 73686 - DNA, 20 bp, Artificial Sequence
  Description of Artificial Sequence: Synthetic oligonucleotide
  Target: SCN9A; (-) strand; PAM type: YTN; PAM sequence: CTT
tactggaatctttgcagctg

SEQ ID NO: 73687 - DNA, 20 bp, Artificial Sequence
  Description of Artificial Sequence: Synthetic oligonucleotide
  Target: SCN9A; (-) strand; PAM type: YTN; PAM sequence: TTA
ggtctttactggaatctttg

SEQ ID NO: 73688 - DNA, 20 bp, Artificial Sequence
  Description of Artificial Sequence: Synthetic oligonucleotide
  Target: SCN9A; (-) strand; PAM type: YTN; PAM sequence: CTT
aggtctttactggaatcttt

SEQ ID NO: 73689 - DNA, 20 bp, Artificial Sequence
  Description of Artificial Sequence: Synthetic oligonucleotide
  Target: SCN9A; (-) strand; PAM type: YTN; PAM sequence: CTC
acttaggtctttactggaat

SEQ ID NO: 73690 - DNA, 20 bp, Artificial Sequence
  Description of Artificial Sequence: Synthetic oligonucleotide
  Target: SCN9A; (-) strand; PAM type: YTN; PAM sequence: TTC
tcacttaggtctttactgga

SEQ ID NO: 73691 - DNA, 20 bp, Artificial Sequence
  Description of Artificial Sequence: Synthetic oligonucleotide
  Target: SCN9A; (-) strand; PAM type: YTN; PAM sequence: TTT
ctcacttaggtctttactgg

SEQ ID NO: 73692 - DNA, 20 bp, Artificial Sequence
  Description of Artificial Sequence: Synthetic oligonucleotide
  Target: SCN9A; (-) strand; PAM type: YTN; PAM sequence: TTT
tctcacttaggtctttactg

SEQ ID NO: 73693 - DNA, 20 bp, Artificial Sequence
  Description of Artificial Sequence: Synthetic oligonucleotide
  Target: SCN9A; (-) strand; PAM type: YTN; PAM sequence: TTT
ttctcacttaggtctttact

SEQ ID NO: 73694 - DNA, 20 bp, Artificial Sequence
  Description of Artificial Sequence: Synthetic oligonucleotide
  Target: SCN9A; (-) strand; PAM type: YTN; PAM sequence: TTA
tttttctcacttaggtcttt

SEQ ID NO: 73695 - DNA, 20 bp, Artificial Sequence
  Description of Artificial Sequence: Synthetic oligonucleotide
  Target: SCN9A; (-) strand; PAM type: YTN; PAM sequence: TTA
acagaaaaacattatttttc

SEQ ID NO: 73696 - DNA, 20 bp, Artificial Sequence
  Description of Artificial Sequence: Synthetic oligonucleotide
  Target: SCN9A; (-) strand; PAM type: YTN; PAM sequence: CTA
atattaacagaaaaacatta

SEQ ID NO: 73697 - DNA, 20 bp, Artificial Sequence
  Description of Artificial Sequence: Synthetic oligonucleotide
  Target: SCN9A; (-) strand; PAM type: YTN; PAM sequence: TTC
taatattaacagaaaaacat

SEQ ID NO: 73698 - DNA, 20 bp, Artificial Sequence
  Description of Artificial Sequence: Synthetic oligonucleotide
  Target: SCN9A; (-) strand; PAM type: YTN; PAM sequence: TTT
ctaatattaacagaaaaaca

SEQ ID NO: 73699 - DNA, 20 bp, Artificial Sequence
  Description of Artificial Sequence: Synthetic oligonucleotide
  Target: SCN9A; (-) strand; PAM type: YTN; PAM sequence: TTT
tctaatattaacagaaaaac

SEQ ID NO: 73700 - DNA, 20 bp, Artificial Sequence
  Description of Artificial Sequence: Synthetic oligonucleotide
  Target: SCN9A; (-) strand; PAM type: YTN; PAM sequence: CTG
ttttctaatattaacagaaa

SEQ ID NO: 73701 - DNA, 20 bp, Artificial Sequence
  Description of Artificial Sequence: Synthetic oligonucleotide
  Target: SCN9A; (-) strand; PAM type: YTN; PAM sequence: TTC
ctgttttctaatattaacag

SEQ ID NO: 73702 - DNA, 20 bp, Artificial Sequence
  Description of Artificial Sequence: Synthetic oligonucleotide
  Target: SCN9A; (-) strand; PAM type: YTN; PAM sequence: TTT
cctgttttctaatattaaca

SEQ ID NO: 73703 - DNA, 20 bp, Artificial Sequence
  Description of Artificial Sequence: Synthetic oligonucleotide
  Target: SCN9A; (-) strand; PAM type: YTN; PAM sequence: TTG
atttcctgttttctaatatt

SEQ ID NO: 73704 - DNA, 20 bp, Artificial Sequence
  Description of Artificial Sequence: Synthetic oligonucleotide
  Target: SCN9A; (-) strand; PAM type: YTN; PAM sequence: TTG
tgttgatttcctgttttcta

SEQ ID NO: 73705 - DNA, 20 bp, Artificial Sequence
  Description of Artificial Sequence: Synthetic oligonucleotide
  Target: SCN9A; (-) strand; PAM type: YTN; PAM sequence: TTA
tcattgtgttgatttcctgt

SEQ ID NO: 73706 - DNA, 20 bp, Artificial Sequence
  Description of Artificial Sequence: Synthetic oligonucleotide
  Target: SCN9A; (-) strand; PAM type: YTN; PAM sequence: TTA
ttatcattgtgttgatttcc

SEQ ID NO: 73707 - DNA, 20 bp, Artificial Sequence
  Description of Artificial Sequence: Synthetic oligonucleotide
  Target: SCN9A; (-) strand; PAM type: YTN; PAM sequence: CTA
agcaaacagtgattattatc

SEQ ID NO: 73708 - DNA, 20 bp, Artificial Sequence
  Description of Artificial Sequence: Synthetic oligonucleotide
  Target: SCN9A; (-) strand; PAM type: YTN; PAM sequence: CTG
gaacacagtaaatgctaagc

SEQ ID NO: 73709 - DNA, 20 bp, Artificial Sequence
  Description of Artificial Sequence: Synthetic oligonucleotide
  Target: SCN9A; (-) strand; PAM type: YTN; PAM sequence: CTG
tctggaacacagtaaatgct

SEQ ID NO: 73710 - DNA, 20 bp, Artificial Sequence
  Description of Artificial Sequence: Synthetic oligonucleotide
  Target: SCN9A; (-) strand; PAM type: YTN; PAM sequence: TTA
gcaaactgtctggaacacag

SEQ ID NO: 73711 - DNA, 20 bp, Artificial Sequence
  Description of Artificial Sequence: Synthetic oligonucleotide
  Target: SCN9A; (-) strand; PAM type: YTN; PAM sequence: TTT
agcaaactgtctggaacaca

SEQ ID NO: 73712 - DNA, 20 bp, Artificial Sequence
  Description of Artificial Sequence: Synthetic oligonucleotide
  Target: SCN9A; (-) strand; PAM type: YTN; PAM sequence: TTA
taaagtatttagcaaactgt

SEQ ID NO: 73713 - DNA, 20 bp, Artificial Sequence
  Description of Artificial Sequence: Synthetic oligonucleotide
  Target: SCN9A; (-) strand; PAM type: YTN; PAM sequence: TTT
ataaagtatttagcaaactg

SEQ ID NO: 73714 - DNA, 20 bp, Artificial Sequence
  Description of Artificial Sequence: Synthetic oligonucleotide
  Target: SCN9A; (-) strand; PAM type: YTN; PAM sequence: TTA
gataagaatatccatttata

SEQ ID NO: 73715 - DNA, 20 bp, Artificial Sequence
  Description of Artificial Sequence: Synthetic oligonucleotide
  Target: SCN9A; (-) strand; PAM type: YTN; PAM sequence: CTA
agttagataagaatatccat

SEQ ID NO: 73716 - DNA, 20 bp, Artificial Sequence
  Description of Artificial Sequence: Synthetic oligonucleotide
  Target: SCN9A; (-) strand; PAM type: YTN; PAM sequence: TTA
caggactaagttagataaga

SEQ ID NO: 73717 - DNA, 20 bp, Artificial Sequence
  Description of Artificial Sequence: Synthetic oligonucleotide
  Target: SCN9A; (-) strand; PAM type: YTN; PAM sequence: TTT
acaggactaagttagataag

SEQ ID NO: 73718 - DNA, 20 bp, Artificial Sequence
  Description of Artificial Sequence: Synthetic oligonucleotide
  Target: SCN9A; (-) strand; PAM type: YTN; PAM sequence: CTA
atttacaggactaagttaga

SEQ ID NO: 73719 - DNA, 20 bp, Artificial Sequence
  Description of Artificial Sequence: Synthetic oligonucleotide
  Target: SCN9A; (-) strand; PAM type: YTN; PAM sequence: CTG
atatgggagccagggaagag

SEQ ID NO: 73720 - DNA, 20 bp, Artificial Sequence
  Description of Artificial Sequence: Synthetic oligonucleotide
  Target: SCN9A; (-) strand; PAM type: YTN; PAM sequence: TTG
atgctgatatgggagccagg

SEQ ID NO: 73721 - DNA, 20 bp, Artificial Sequence
  Description of Artificial Sequence: Synthetic oligonucleotide
  Target: SCN9A; (-) strand; PAM type: YTN; PAM sequence: TTT
gatgctgatatgggagccag

SEQ ID NO: 73722 - DNA, 20 bp, Artificial Sequence
  Description of Artificial Sequence: Synthetic oligonucleotide
  Target: SCN9A; (-) strand; PAM type: YTN; PAM sequence: TTT
tgatgctgatatgggagcca

SEQ ID NO: 73723 - DNA, 20 bp, Artificial Sequence
  Description of Artificial Sequence: Synthetic oligonucleotide
  Target: SCN9A; (-) strand; PAM type: YTN; PAM sequence: CTT
ttgatgctgatatgggagcc

SEQ ID NO: 73724 - DNA, 20 bp, Artificial Sequence
  Description of Artificial Sequence: Synthetic oligonucleotide
  Target: SCN9A; (-) strand; PAM type: YTN; PAM sequence: TTC
aaccttttgatgctgatatg

SEQ ID NO: 73725 - DNA, 20 bp, Artificial Sequence
  Description of Artificial Sequence: Synthetic oligonucleotide
  Target: SCN9A; (-) strand; PAM type: YTN; PAM sequence: TTT
caaccttttgatgctgatat

SEQ ID NO: 73726 - DNA, 20 bp, Artificial Sequence
  Description of Artificial Sequence: Synthetic oligonucleotide
  Target: SCN9A; (-) strand; PAM type: YTN; PAM sequence: TTT
tcaaccttttgatgctgata

SEQ ID NO: 73727 - DNA, 20 bp, Artificial Sequence
  Description of Artificial Sequence: Synthetic oligonucleotide
  Target: SCN9A; (-) strand; PAM type: YTN; PAM sequence: CTT
ttcaaccttttgatgctgat

SEQ ID NO: 73728 - DNA, 20 bp, Artificial Sequence
  Description of Artificial Sequence: Synthetic oligonucleotide
  Target: SCN9A; (-) strand; PAM type: YTN; PAM sequence: TTA
gagcttttcaaccttttgat

SEQ ID NO: 73729 - DNA, 20 bp, Artificial Sequence
  Description of Artificial Sequence: Synthetic oligonucleotide
  Target: SCN9A; (-) strand; PAM type: YTN; PAM sequence: CTG
acaggacagttagagctttt

SEQ ID NO: 73730 - DNA, 20 bp, Artificial Sequence
  Description of Artificial Sequence: Synthetic oligonucleotide
  Target: SCN9A; (-) strand; PAM type: YTN; PAM sequence: CTA
aaaatgatgagcactgacag

SEQ ID NO: 73731 - DNA, 20 bp, Artificial Sequence
  Description of Artificial Sequence: Synthetic oligonucleotide
  Target: SCN9A; (-) strand; PAM type: YTN; PAM sequence: CTG
tctaaaaatgatgagcactg

SEQ ID NO: 73732 - DNA, 20 bp, Artificial Sequence
  Description of Artificial Sequence: Synthetic oligonucleotide
  Target: SCN9A; (-) strand; PAM type: YTN; PAM sequence: CTA
aaatgctgtctaaaaatgat

SEQ ID NO: 73733 - DNA, 20 bp, Artificial Sequence
  Description of Artificial Sequence: Synthetic oligonucleotide
  Target: SCN9A; (-) strand; PAM type: YTN; PAM sequence: TTC
taaaatgctgtctaaaaatg

SEQ ID NO: 73734 - DNA, 20 bp, Artificial Sequence
  Description of Artificial Sequence: Synthetic oligonucleotide
  Target: SCN9A; (-) strand; PAM type: YTN; PAM sequence: CTA
ttctaaaatgctgtctaaaa

SEQ ID NO: 73735 - DNA, 20 bp, Artificial Sequence
  Description of Artificial Sequence: Synthetic oligonucleotide
  Target: SCN9A; (-) strand; PAM type: YTN; PAM sequence: TTA
atatgctattctaaaatgct

SEQ ID NO: 73736 - DNA, 20 bp, Artificial Sequence
  Description of Artificial Sequence: Synthetic oligonucleotide
  Target: SCN9A; (-) strand; PAM type: YTN; PAM sequence: TTT
aatatgctattctaaaatgc

SEQ ID NO: 73737 - DNA, 20 bp, Artificial Sequence
  Description of Artificial Sequence: Synthetic oligonucleotide
  Target: SCN9A; (-) strand; PAM type: YTN; PAM sequence: TTT
taatatgctattctaaaatg

SEQ ID NO: 73738 - DNA, 20 bp, Artificial Sequence
  Description of Artificial Sequence: Synthetic oligonucleotide
  Target: SCN9A; (-) strand; PAM type: YTN; PAM sequence: CTG
aaattttaatatgctattct

SEQ ID NO: 73739 - DNA, 20 bp, Artificial Sequence
  Description of Artificial Sequence: Synthetic oligonucleotide
  Target: SCN9A; (-) strand; PAM type: YTN; PAM sequence: TTC
tgaaattttaatatgctatt

SEQ ID NO: 73740 - DNA, 20 bp, Artificial Sequence
  Description of Artificial Sequence: Synthetic oligonucleotide
  Target: SCN9A; (-) strand; PAM type: YTN; PAM sequence: CTT
ctgaaattttaatatgctat

SEQ ID NO: 73741 - DNA, 20 bp, Artificial Sequence
  Description of Artificial Sequence: Synthetic oligonucleotide
  Target: SCN9A; (-) strand; PAM type: YTN; PAM sequence: CTC
ttctgaaattttaatatgct

SEQ ID NO: 73742 - DNA, 20 bp, Artificial Sequence
  Description of Artificial Sequence: Synthetic oligonucleotide
  Target: SCN9A; (-) strand; PAM type: YTN; PAM sequence: TTA
ctcttctgaaattttaatat

SEQ ID NO: 73743 - DNA, 20 bp, Artificial Sequence
  Description of Artificial Sequence: Synthetic oligonucleotide
  Target: SCN9A; (-) strand; PAM type: YTN; PAM sequence: TTT
actcttctgaaattttaata

SEQ ID NO: 73744 - DNA, 20 bp, Artificial Sequence
  Description of Artificial Sequence: Synthetic oligonucleotide
  Target: SCN9A; (-) strand; PAM type: YTN; PAM sequence: TTT
tactcttctgaaattttaat

SEQ ID NO: 73745 - DNA, 20 bp, Artificial Sequence
  Description of Artificial Sequence: Synthetic oligonucleotide
  Target: SCN9A; (-) strand; PAM type: YTN; PAM sequence: TTA
ccaaatgttttactcttctg

SEQ ID NO: 73746 - DNA, 20 bp, Artificial Sequence
  Description of Artificial Sequence: Synthetic oligonucleotide
  Target: SCN9A; (-) strand; PAM type: YTN; PAM sequence: CTG
tgtcaattaccaaatgtttt

SEQ ID NO: 73747 - DNA, 20 bp, Artificial Sequence
  Description of Artificial Sequence: Synthetic oligonucleotide
  Target: SCN9A; (-) strand; PAM type: YTN; PAM sequence: TTG
aaaatagtgactgtgtcaat

SEQ ID NO: 73748 - DNA, 20 bp, Artificial Sequence
  Description of Artificial Sequence: Synthetic oligonucleotide
  Target: SCN9A; (-) strand; PAM type: YTN; PAM sequence: TTT
gaaaatagtgactgtgtcaa

SEQ ID NO: 73749 - DNA, 20 bp, Artificial Sequence
  Description of Artificial Sequence: Synthetic oligonucleotide
  Target: SCN9A; (-) strand; PAM type: YTN; PAM sequence: CTT
tgaaaatagtgactgtgtca

SEQ ID NO: 73750 - DNA, 20 bp, Artificial Sequence
  Description of Artificial Sequence: Synthetic oligonucleotide
  Target: SCN9A; (-) strand; PAM type: YTN; PAM sequence: TTC
tttgaaaatagtgactgtgt

SEQ ID NO: 73751 - DNA, 20 bp, Artificial Sequence
  Description of Artificial Sequence: Synthetic oligonucleotide
  Target: SCN9A; (-) strand; PAM type: YTN; PAM sequence: TTG
acccacataaattctttgaa

SEQ ID NO: 73752 - DNA, 20 bp, Artificial Sequence
  Description of Artificial Sequence: Synthetic oligonucleotide
  Target: SCN9A; (-) strand; PAM type: YTN; PAM sequence: TTT
gacccacataaattctttga

SEQ ID NO: 73753 - DNA, 20 bp, Artificial Sequence
  Description of Artificial Sequence: Synthetic oligonucleotide
  Target: SCN9A; (-) strand; PAM type: YTN; PAM sequence: TTT
tgacccacataaattctttg

SEQ ID NO: 73754 - DNA, 20 bp, Artificial Sequence
  Description of Artificial Sequence: Synthetic oligonucleotide
  Target: SCN9A; (-) strand; PAM type: YTN; PAM sequence: TTT
ttgacccacataaattcttt

SEQ ID NO: 73755 - DNA, 20 bp, Artificial Sequence
  Description of Artificial Sequence: Synthetic oligonucleotide
  Target: SCN9A; (-) strand; PAM type: YTN; PAM sequence: CTT
tttgacccacataaattctt

SEQ ID NO: 73756 - DNA, 20 bp, Artificial Sequence
  Description of Artificial Sequence: Synthetic oligonucleotide
  Target: SCN9A; (-) strand; PAM type: YTN; PAM sequence: TTC
cagaacaactttttgaccca

SEQ ID NO: 73757 - DNA, 20 bp, Artificial Sequence
  Description of Artificial Sequence: Synthetic oligonucleotide
  Target: SCN9A; (-) strand; PAM type: YTN; PAM sequence: CTT
ccagaacaactttttgaccc

SEQ ID NO: 73758 - DNA, 20 bp, Artificial Sequence
  Description of Artificial Sequence: Synthetic oligonucleotide
  Target: SCN9A; (-) strand; PAM type: YTN; PAM sequence: TTC
ttccagaacaactttttgac

SEQ ID NO: 73759 - DNA, 20 bp, Artificial Sequence
  Description of Artificial Sequence: Synthetic oligonucleotide
  Target: SCN9A; (-) strand; PAM type: YTN; PAM sequence: CTT
cttccagaacaactttttga

SEQ ID NO: 73760 - DNA, 20 bp, Artificial Sequence
  Description of Artificial Sequence: Synthetic oligonucleotide
  Target: SCN9A; (-) strand; PAM type: YTN; PAM sequence: TTA
tcttcttccagaacaacttt

SEQ ID NO: 73761 - DNA, 20 bp, Artificial Sequence
  Description of Artificial Sequence: Synthetic oligonucleotide
  Target: SCN9A; (-) strand; PAM type: YTN; PAM sequence: TTT
atcttcttccagaacaactt

SEQ ID NO: 73762 - DNA, 20 bp, Artificial Sequence
  Description of Artificial Sequence: Synthetic oligonucleotide
  Target: SCN9A; (-) strand; PAM type: YTN; PAM sequence: TTT
tatcttcttccagaacaact

SEQ ID NO: 73763 - DNA, 20 bp, Artificial Sequence
  Description of Artificial Sequence: Synthetic oligonucleotide
  Target: SCN9A; (-) strand; PAM type: YTN; PAM sequence: TTT
ttatcttcttccagaacaac

SEQ ID NO: 73764 - DNA, 20 bp, Artificial Sequence
  Description of Artificial Sequence: Synthetic oligonucleotide
  Target: SCN9A; (-) strand; PAM type: YTN; PAM sequence: CTT
tttatcttcttccagaacaa

SEQ ID NO: 73765 - DNA, 20 bp, Artificial Sequence
  Description of Artificial Sequence: Synthetic oligonucleotide
  Target: SCN9A; (-) strand; PAM type: YTN; PAM sequence: TTC
tttttatcttcttccagaac

SEQ ID NO: 73766 - DNA, 20 bp, Artificial Sequence
  Description of Artificial Sequence: Synthetic oligonucleotide
  Target: SCN9A; (-) strand; PAM type: YTN; PAM sequence: TTT
ctttttatcttcttccagaa

SEQ ID NO: 73767 - DNA, 20 bp, Artificial Sequence
  Description of Artificial Sequence: Synthetic oligonucleotide
  Target: SCN9A; (-) strand; PAM type: YTN; PAM sequence: TTT
tctttttatcttcttccaga

SEQ ID NO: 73768 - DNA, 20 bp, Artificial Sequence
  Description of Artificial Sequence: Synthetic oligonucleotide
  Target: SCN9A; (-) strand; PAM type: YTN; PAM sequence: TTA
tgttttctttttatcttctt

SEQ ID NO: 73769 - DNA, 20 bp, Artificial Sequence
  Description of Artificial Sequence: Synthetic oligonucleotide
  Target: SCN9A; (-) strand; PAM type: YTN; PAM sequence: CTT
atgttttctttttatcttct

SEQ ID NO: 73770 - DNA, 20 bp, Artificial Sequence
  Description of Artificial Sequence: Synthetic oligonucleotide
  Target: SCN9A; (-) strand; PAM type: YTN; PAM sequence: TTC
agtatcaacttatgttttct

SEQ ID NO: 73771 - DNA, 20 bp, Artificial Sequence
  Description of Artificial Sequence: Synthetic oligonucleotide
  Target: SCN9A; (-) strand; PAM type: YTN; PAM sequence: TTT
cagtatcaacttatgttttc

SEQ ID NO: 73772 - DNA, 20 bp, Artificial Sequence
  Description of Artificial Sequence: Synthetic oligonucleotide
  Target: SCN9A; (-) strand; PAM type: YTN; PAM sequence: CTC
aaaatttcagtatcaactta

SEQ ID NO: 73773 - DNA, 20 bp, Artificial Sequence
  Description of Artificial Sequence: Synthetic oligonucleotide
  Target: SCN9A; (-) strand; PAM type: YTN; PAM sequence: CTG
gctcaaaatttcagtatcaa

SEQ ID NO: 73774 - DNA, 20 bp, Artificial Sequence
  Description of Artificial Sequence: Synthetic oligonucleotide
  Target: SCN9A; (-) strand; PAM type: YTN; PAM sequence: CTA
acagtagtcagatcagaaaa

SEQ ID NO: 73775 - DNA, 20 bp, Artificial Sequence
  Description of Artificial Sequence: Synthetic oligonucleotide
  Target: SCN9A; (-) strand; PAM type: YTN; PAM sequence: CTC
taacagtagtcagatcagaa

SEQ ID NO: 73776 - DNA, 20 bp, Artificial Sequence
  Description of Artificial Sequence: Synthetic oligonucleotide
  Target: SCN9A; (-) strand; PAM type: YTN; PAM sequence: TTA
ctctaacagtagtcagatca

SEQ ID NO: 73777 - DNA, 20 bp, Artificial Sequence
  Description of Artificial Sequence: Synthetic oligonucleotide
  Target: SCN9A; (-) strand; PAM type: YTN; PAM sequence: TTA
ttactctaacagtagtcaga

SEQ ID NO: 73778 - DNA, 20 bp, Artificial Sequence
  Description of Artificial Sequence: Synthetic oligonucleotide
  Target: SCN9A; (-) strand; PAM type: YTN; PAM sequence: TTT
attactctaacagtagtcag

SEQ ID NO: 73779 - DNA, 20 bp, Artificial Sequence
  Description of Artificial Sequence: Synthetic oligonucleotide
  Target: SCN9A; (-) strand; PAM type: YTN; PAM sequence: CTT
tattactctaacagtagtca

SEQ ID NO: 73780 - DNA, 20 bp, Artificial Sequence
  Description of Artificial Sequence: Synthetic oligonucleotide
  Target: SCN9A; (-) strand; PAM type: YTN; PAM sequence: TTC
tttattactctaacagtagt

SEQ ID NO: 73781 - DNA, 20 bp, Artificial Sequence
  Description of Artificial Sequence: Synthetic oligonucleotide
  Target: SCN9A; (-) strand; PAM type: YTN; PAM sequence: TTA
aagagtgagtcaacatgttc

SEQ ID NO: 73782 - DNA, 20 bp, Artificial Sequence
  Description of Artificial Sequence: Synthetic oligonucleotide
  Target: SCN9A; (-) strand; PAM type: YTN; PAM sequence: TTT
aaagagtgagtcaacatgtt

SEQ ID NO: 73783 - DNA, 20 bp, Artificial Sequence
  Description of Artificial Sequence: Synthetic oligonucleotide
  Target: SCN9A; (-) strand; PAM type: YTN; PAM sequence: CTT
taaagagtgagtcaacatgt

SEQ ID NO: 73784 - DNA, 20 bp, Artificial Sequence
  Description of Artificial Sequence: Synthetic oligonucleotide
  Target: SCN9A; (-) strand; PAM type: YTN; PAM sequence: CTG
ataaatctttaaagagtgag

SEQ ID NO: 73785 - DNA, 20 bp, Artificial Sequence
  Description of Artificial Sequence: Synthetic oligonucleotide
  Target: SCN9A; (-) strand; PAM type: YTN; PAM sequence: CTG
ctgataaatctttaaagagt

SEQ ID NO: 73786 - DNA, 20 bp, Artificial Sequence
  Description of Artificial Sequence: Synthetic oligonucleotide
  Target: SCN9A; (-) strand; PAM type: YTN; PAM sequence: TTC
tgctgataaatctttaaaga

SEQ ID NO: 73787 - DNA, 20 bp, Artificial Sequence
  Description of Artificial Sequence: Synthetic oligonucleotide
  Target: SCN9A; (-) strand; PAM type: YTN; PAM sequence: CTT
ctgctgataaatctttaaag

SEQ ID NO: 73788 - DNA, 20 bp, Artificial Sequence
  Description of Artificial Sequence: Synthetic oligonucleotide
  Target: SCN9A; (-) strand; PAM type: YTN; PAM sequence: CTC
ttctgctgataaatctttaa

SEQ ID NO: 73789 - DNA, 20 bp, Artificial Sequence
  Description of Artificial Sequence: Synthetic oligonucleotide
  Target: SCN9A; (-) strand; PAM type: YTN; PAM sequence: TTC
tcttctgctgataaatcttt

SEQ ID NO: 73790 - DNA, 20 bp, Artificial Sequence
  Description of Artificial Sequence: Synthetic oligonucleotide
  Target: SCN9A; (-) strand; PAM type: YTN; PAM sequence: TTT
ctcttctgctgataaatctt

SEQ ID NO: 73791 - DNA, 20 bp, Artificial Sequence
  Description of Artificial Sequence: Synthetic oligonucleotide
  Target: SCN9A; (-) strand; PAM type: YTN; PAM sequence: TTT
tctcttctgctgataaatct

SEQ ID NO: 73792 - DNA, 20 bp, Artificial Sequence
  Description of Artificial Sequence: Synthetic oligonucleotide
  Target: SCN9A; (-) strand; PAM type: YTN; PAM sequence: TTT
ttctcttctgctgataaatc

SEQ ID NO: 73793 - DNA, 20 bp, Artificial Sequence
  Description of Artificial Sequence: Synthetic oligonucleotide
  Target: SCN9A; (-) strand; PAM type: YTN; PAM sequence: TTT
tttctcttctgctgataaat

SEQ ID NO: 73794 - DNA, 20 bp, Artificial Sequence
  Description of Artificial Sequence: Synthetic oligonucleotide
  Target: SCN9A; (-) strand; PAM type: YTN; PAM sequence: CTT
ttttctcttctgctgataaa

SEQ ID NO: 73795 - DNA, 20 bp, Artificial Sequence
  Description of Artificial Sequence: Synthetic oligonucleotide
  Target: SCN9A; (-) strand; PAM type: YTN; PAM sequence: TTA
aatacttttttctcttctgc

SEQ ID NO: 73796 - DNA, 20 bp, Artificial Sequence
  Description of Artificial Sequence: Synthetic oligonucleotide
  Target: SCN9A; (-) strand; PAM type: YTN; PAM sequence: TTG
tcaattaaatacttttttct

SEQ ID NO: 73797 - DNA, 20 bp, Artificial Sequence
  Description of Artificial Sequence: Synthetic oligonucleotide
  Target: SCN9A; (-) strand; PAM type: YTN; PAM sequence: CTG
ccacattgtcaattaaatac

SEQ ID NO: 73798 - DNA, 20 bp, Artificial Sequence
  Description of Artificial Sequence: Synthetic oligonucleotide
  Target: SCN9A; (-) strand; PAM type: YTN; PAM sequence: TTA
gctgccacattgtcaattaa

SEQ ID NO: 73799 - DNA, 20 bp, Artificial Sequence
  Description of Artificial Sequence: Synthetic oligonucleotide
  Target: SCN9A; (-) strand; PAM type: YTN; PAM sequence: TTT
agctgccacattgtcaatta

SEQ ID NO: 73800 - DNA, 20 bp, Artificial Sequence
  Description of Artificial Sequence: Synthetic oligonucleotide
  Target: SCN9A; (-) strand; PAM type: YTN; PAM sequence: CTT
tagctgccacattgtcaatt

SEQ ID NO: 73801 - DNA, 20 bp, Artificial Sequence
  Description of Artificial Sequence: Synthetic oligonucleotide
  Target: SCN9A; (-) strand; PAM type: YTN; PAM sequence: TTA
ctttagctgccacattgtca

SEQ ID NO: 73802 - DNA, 20 bp, Artificial Sequence
  Description of Artificial Sequence: Synthetic oligonucleotide
  Target: SCN9A; (-) strand; PAM type: YTN; PAM sequence: TTA
gaagtattactttagctgcc

SEQ ID NO: 73803 - DNA, 20 bp, Artificial Sequence
  Description of Artificial Sequence: Synthetic oligonucleotide
  Target: SCN9A; (-) strand; PAM type: YTN; PAM sequence: TTT
agaagtattactttagctgc

SEQ ID NO: 73804 - DNA, 20 bp, Artificial Sequence
  Description of Artificial Sequence: Synthetic oligonucleotide
  Target: SCN9A; (-) strand; PAM type: YTN; PAM sequence: CTT
tagaagtattactttagctg

SEQ ID NO: 73805 - DNA, 20 bp, Artificial Sequence
  Description of Artificial Sequence: Synthetic oligonucleotide
  Target: SCN9A; (-) strand; PAM type: YTN; PAM sequence: TTG
tgtcaaagctttagaagtat

SEQ ID NO: 73806 - DNA, 20 bp, Artificial Sequence
  Description of Artificial Sequence: Synthetic oligonucleotide
  Target: SCN9A; (-) strand; PAM type: YTN; PAM sequence: TTT
gtgtcaaagctttagaagta

SEQ ID NO: 73807 - DNA, 20 bp, Artificial Sequence
  Description of Artificial Sequence: Synthetic oligonucleotide
  Target: SCN9A; (-) strand; PAM type: YTN; PAM sequence: TTT
tgtgtcaaagctttagaagt

SEQ ID NO: 73808 - DNA, 20 bp, Artificial Sequence
  Description of Artificial Sequence: Synthetic oligonucleotide
  Target: SCN9A; (-) strand; PAM type: YTN; PAM sequence: CTT
ttgtgtcaaagctttagaag

SEQ ID NO: 73809 - DNA, 20 bp, Artificial Sequence
  Description of Artificial Sequence: Synthetic oligonucleotide
  Target: SCN9A; (-) strand; PAM type: YTN; PAM sequence: TTG
caatgcacttttgtgtcaaa

SEQ ID NO: 73810 - DNA, 20 bp, Artificial Sequence
  Description of Artificial Sequence: Synthetic oligonucleotide
  Target: SCN9A; (-) strand; PAM type: YTN; PAM sequence: TTT
gcaatgcacttttgtgtcaa

SEQ ID NO: 73811 - DNA, 20 bp, Artificial Sequence
  Description of Artificial Sequence: Synthetic oligonucleotide
  Target: SCN9A; (-) strand; PAM type: YTN; PAM sequence: TTT
tgcaatgcacttttgtgtca

SEQ ID NO: 73812 - DNA, 20 bp, Artificial Sequence
  Description of Artificial Sequence: Synthetic oligonucleotide
  Target: SCN9A; (-) strand; PAM type: YTN; PAM sequence: TTA
atgatattttgcaatgcact

SEQ ID NO: 73813 - DNA, 20 bp, Artificial Sequence
  Description of Artificial Sequence: Synthetic oligonucleotide
  Target: SCN9A; (-) strand; PAM type: YTN; PAM sequence: TTG
ataccagtatcatgaattaa

SEQ ID NO: 73814 - DNA, 20 bp, Artificial Sequence
  Description of Artificial Sequence: Synthetic oligonucleotide
  Target: SCN9A; (-) strand; PAM type: YTN; PAM sequence: TTT
gataccagtatcatgaatta

SEQ ID NO: 73815 - DNA, 20 bp, Artificial Sequence
  Description of Artificial Sequence: Synthetic oligonucleotide
  Target: SCN9A; (-) strand; PAM type: YTN; PAM sequence: CTT
tgataccagtatcatgaatt

SEQ ID NO: 73816 - DNA, 20 bp, Artificial Sequence
  Description of Artificial Sequence: Synthetic oligonucleotide
  Target: SCN9A; (-) strand; PAM type: YTN; PAM sequence: TTA
agtgagtcctttgataccag

SEQ ID NO: 73817 - DNA, 20 bp, Artificial Sequence
  Description of Artificial Sequence: Synthetic oligonucleotide
  Target: SCN9A; (-) strand; PAM type: YTN; PAM sequence: TTT
aagtgagtcctttgatacca

SEQ ID NO: 73818 - DNA, 20 bp, Artificial Sequence
  Description of Artificial Sequence: Synthetic oligonucleotide
  Target: SCN9A; (-) strand; PAM type: YTN; PAM sequence: TTT
taagtgagtcctttgatacc

SEQ ID NO: 73819 - DNA, 20 bp, Artificial Sequence
  Description of Artificial Sequence: Synthetic oligonucleotide
  Target: SCN9A; (-) strand; PAM type: YTN; PAM sequence: TTT
ttaagtgagtcctttgatac

SEQ ID NO: 73820 - DNA, 20 bp, Artificial Sequence
  Description of Artificial Sequence: Synthetic oligonucleotide
  Target: SCN9A; (-) strand; PAM type: YTN; PAM sequence: CTT
tttaagtgagtcctttgata

SEQ ID NO: 73821 - DNA, 20 bp, Artificial Sequence
  Description of Artificial Sequence: Synthetic oligonucleotide
  Target: SCN9A; (-) strand; PAM type: YTN; PAM sequence: TTG
cctttttaagtgagtccttt

SEQ ID NO: 73822 - DNA, 20 bp, Artificial Sequence
  Description of Artificial Sequence: Synthetic oligonucleotide
  Target: SCN9A; (-) strand; PAM type: YTN; PAM sequence: TTC
ggtgttgcctttttaagtga

SEQ ID NO: 73823 - DNA, 20 bp, Artificial Sequence
  Description of Artificial Sequence: Synthetic oligonucleotide
  Target: SCN9A; (-) strand; PAM type: YTN; PAM sequence: TTT
cggtgttgcctttttaagtg

SEQ ID NO: 73824 - DNA, 20 bp, Artificial Sequence
  Description of Artificial Sequence: Synthetic oligonucleotide
  Target: SCN9A; (-) strand; PAM type: YTN; PAM sequence: TTC
atttcggtgttgccttttta

SEQ ID NO: 73825 - DNA, 20 bp, Artificial Sequence
  Description of Artificial Sequence: Synthetic oligonucleotide
  Target: SCN9A; (-) strand; PAM type: YTN; PAM sequence: TTG
agtcaaagtgtacccaaagg

SEQ ID NO: 73826 - DNA, 20 bp, Artificial Sequence
  Description of Artificial Sequence: Synthetic oligonucleotide
  Target: SCN9A; (-) strand; PAM type: YTN; PAM sequence: CTT
gagtcaaagtgtacccaaag

SEQ ID NO: 73827 - DNA, 20 bp, Artificial Sequence
  Description of Artificial Sequence: Synthetic oligonucleotide
  Target: SCN9A; (-) strand; PAM type: YTN; PAM sequence: TTC
cttgagtcaaagtgtaccca

SEQ ID NO: 73828 - DNA, 20 bp, Artificial Sequence
  Description of Artificial Sequence: Synthetic oligonucleotide
  Target: SCN9A; (-) strand; PAM type: YTN; PAM sequence: TTG
gtcagattccttgagtcaaa

SEQ ID NO: 73829 - DNA, 20 bp, Artificial Sequence
  Description of Artificial Sequence: Synthetic oligonucleotide
  Target: SCN9A; (-) strand; PAM type: YTN; PAM sequence: TTT
ggtcagattccttgagtcaa

SEQ ID NO: 73830 - DNA, 20 bp, Artificial Sequence
  Description of Artificial Sequence: Synthetic oligonucleotide
  Target: SCN9A; (-) strand; PAM type: YTN; PAM sequence: CTT
tggtcagattccttgagtca

SEQ ID NO: 73831 - DNA, 20 bp, Artificial Sequence
  Description of Artificial Sequence: Synthetic oligonucleotide
  Target: SCN9A; (-) strand; PAM type: YTN; PAM sequence: TTC
tttggtcagattccttgagt

SEQ ID NO: 73832 - DNA, 20 bp, Artificial Sequence
  Description of Artificial Sequence: Synthetic oligonucleotide
  Target: SCN9A; (-) strand; PAM type: YTN; PAM sequence: CTT
ctttggtcagattccttgag

SEQ ID NO: 73833 - DNA, 20 bp, Artificial Sequence
  Description of Artificial Sequence: Synthetic oligonucleotide
  Target: SCN9A; (-) strand; PAM type: YTN; PAM sequence: TTA
gaatcttctttggtcagatt

SEQ ID NO: 73834 - DNA, 20 bp, Artificial Sequence
  Description of Artificial Sequence: Synthetic oligonucleotide
  Target: SCN9A; (-) strand; PAM type: YTN; PAM sequence: CTT
agaatcttctttggtcagat

SEQ ID NO: 73835 - DNA, 20 bp, Artificial Sequence
  Description of Artificial Sequence: Synthetic oligonucleotide
  Target: SCN9A; (-) strand; PAM type: YTN; PAM sequence: TTC
ccttagaatcttctttggtc

SEQ ID NO: 73836 - DNA, 20 bp, Artificial Sequence
  Description of Artificial Sequence: Synthetic oligonucleotide
  Target: SCN9A; (-) strand; PAM type: YTN; PAM sequence: TTT
cccttagaatcttctttggt

SEQ ID NO: 73837 - DNA, 20 bp, Artificial Sequence
  Description of Artificial Sequence: Synthetic oligonucleotide
  Target: SCN9A; (-) strand; PAM type: YTN; PAM sequence: CTA
aacatttcccttagaatctt

SEQ ID NO: 73838 - DNA, 20 bp, Artificial Sequence
  Description of Artificial Sequence: Synthetic oligonucleotide
  Target: SCN9A; (-) strand; PAM type: YTN; PAM sequence: TTA
tagacctaaacatttccctt

SEQ ID NO: 73839 - DNA, 20 bp, Artificial Sequence
  Description of Artificial Sequence: Synthetic oligonucleotide
  Target: SCN9A; (-) strand; PAM type: YTN; PAM sequence: CTG
cagttatagacctaaacatt

SEQ ID NO: 73840 - DNA, 20 bp, Artificial Sequence
  Description of Artificial Sequence: Synthetic oligonucleotide
  Target: SCN9A; (-) strand; PAM type: YTN; PAM sequence: CTC
ctgcagttatagacctaaac

SEQ ID NO: 73841 - DNA, 20 bp, Artificial Sequence
  Description of Artificial Sequence: Synthetic oligonucleotide
  Target: SCN9A; (-) strand; PAM type: YTN; PAM sequence: TTG
actcctgcagttatagacct

SEQ ID NO: 73842 - DNA, 20 bp, Artificial Sequence
  Description of Artificial Sequence: Synthetic oligonucleotide
  Target: SCN9A; (-) strand; PAM type: YTN; PAM sequence: TTG
aaaattgactcctgcagtta

SEQ ID NO: 73843 - DNA, 20 bp, Artificial Sequence
  Description of Artificial Sequence: Synthetic oligonucleotide
  Target: SCN9A; (-) strand; PAM type: YTN; PAM sequence: TTT
gaaaattgactcctgcagtt

SEQ ID NO: 73844 - DNA, 20 bp, Artificial Sequence
  Description of Artificial Sequence: Synthetic oligonucleotide
  Target: SCN9A; (-) strand; PAM type: YTN; PAM sequence: TTA
tttgaaaattgactcctgca

SEQ ID NO: 73845 - DNA, 20 bp, Artificial Sequence
  Description of Artificial Sequence: Synthetic oligonucleotide
  Target: SCN9A; (-) strand; PAM type: YTN; PAM sequence: CTG
cattatttgaaaattgactc

SEQ ID NO: 73846 - DNA, 20 bp, Artificial Sequence
  Description of Artificial Sequence: Synthetic oligonucleotide
  Target: SCN9A; (-) strand; PAM type: YTN; PAM sequence: TTG
atcctgcattatttgaaaat

SEQ ID NO: 73847 - DNA, 20 bp, Artificial Sequence
  Description of Artificial Sequence: Synthetic oligonucleotide
  Target: SCN9A; (-) strand; PAM type: YTN; PAM sequence: CTT
gatcctgcattatttgaaaa

SEQ ID NO: 73848 - DNA, 20 bp, Artificial Sequence
  Description of Artificial Sequence: Synthetic oligonucleotide
  Target: SCN9A; (-) strand; PAM type: YTN; PAM sequence: TTC
ttgatcctgcattatttgaa

SEQ ID NO: 73849 - DNA, 20 bp, Artificial Sequence
  Description of Artificial Sequence: Synthetic oligonucleotide
  Target: SCN9A; (-) strand; PAM type: YTN; PAM sequence: CTT
cttgatcctgcattatttga

SEQ ID NO: 73850 - DNA, 20 bp, Artificial Sequence
  Description of Artificial Sequence: Synthetic oligonucleotide
  Target: SCN9A; (-) strand; PAM type: YTN; PAM sequence: CTG
ccaatcttcttgatcctgca

SEQ ID NO: 73851 - DNA, 20 bp, Artificial Sequence
  Description of Artificial Sequence: Synthetic oligonucleotide
  Target: SCN9A; (-) strand; PAM type: YTN; PAM sequence: CTC
cctgccaatcttcttgatcc

SEQ ID NO: 73852 - DNA, 20 bp, Artificial Sequence
  Description of Artificial Sequence: Synthetic oligonucleotide
  Target: SCN9A; (-) strand; PAM type: YTN; PAM sequence: CTG
ctccctgccaatcttcttga

SEQ ID NO: 73853 - DNA, 20 bp, Artificial Sequence
  Description of Artificial Sequence: Synthetic oligonucleotide
  Target: SCN9A; (-) strand; PAM type: YTN; PAM sequence: CTC
aagtccagctgctccctgcc

SEQ ID NO: 73854 - DNA, 20 bp, Artificial Sequence
  Description of Artificial Sequence: Synthetic oligonucleotide
  Target: SCN9A; (-) strand; PAM type: YTN; PAM sequence: TTA
ccacaacctcaagtccagct

SEQ ID NO: 73855 - DNA, 20 bp, Artificial Sequence
  Description of Artificial Sequence: Synthetic oligonucleotide
  Target: SCN9A; (-) strand; PAM type: YTN; PAM sequence: CTA
ttaccacaacctcaagtcca

SEQ ID NO: 73856 - DNA, 20 bp, Artificial Sequence
  Description of Artificial Sequence: Synthetic oligonucleotide
  Target: SCN9A; (-) strand; PAM type: YTN; PAM sequence: CTG
gtcacagctattaccacaac

SEQ ID NO: 73857 - DNA, 20 bp, Artificial Sequence
  Description of Artificial Sequence: Synthetic oligonucleotide
  Target: SCN9A; (-) strand; PAM type: YTN; PAM sequence: TTA
cctggtcacagctattacca

SEQ ID NO: 73858 - DNA, 20 bp, Artificial Sequence
  Description of Artificial Sequence: Synthetic oligonucleotide
  Target: SCN9A; (-) strand; PAM type: YTN; PAM sequence: TTT
acctggtcacagctattacc

SEQ ID NO: 73859 - DNA, 20 bp, Artificial Sequence
  Description of Artificial Sequence: Synthetic oligonucleotide
  Target: SCN9A; (-) strand; PAM type: YTN; PAM sequence: CTC
agaaaggatttacctggtca

SEQ ID NO: 73860 - DNA, 20 bp, Artificial Sequence
  Description of Artificial Sequence: Synthetic oligonucleotide
  Target: SCN9A; (-) strand; PAM type: YTN; PAM sequence: CTG
tgaactcagaaaggatttac

SEQ ID NO: 73861 - DNA, 20 bp, Artificial Sequence
  Description of Artificial Sequence: Synthetic oligonucleotide
  Target: SCN9A; (-) strand; PAM type: YTN; PAM sequence: CTG
catccctgtgaactcagaaa

SEQ ID NO: 73862 - DNA, 20 bp, Artificial Sequence
  Description of Artificial Sequence: Synthetic oligonucleotide
  Target: SCN9A; (-) strand; PAM type: YTN; PAM sequence: CTG
agacgactgcatccctgtga

SEQ ID NO: 73863 - DNA, 20 bp, Artificial Sequence
  Description of Artificial Sequence: Synthetic oligonucleotide
  Target: SCN9A; (-) strand; PAM type: YTN; PAM sequence: CTC
actgagacgactgcatccct

SEQ ID NO: 73864 - DNA, 20 bp, Artificial Sequence
  Description of Artificial Sequence: Synthetic oligonucleotide
  Target: SCN9A; (-) strand; PAM type: YTN; PAM sequence: TTC
tcactgagacgactgcatcc

SEQ ID NO: 73865 - DNA, 20 bp, Artificial Sequence
  Description of Artificial Sequence: Synthetic oligonucleotide
  Target: SCN9A; (-) strand; PAM type: YTN; PAM sequence: CTT
ctcactgagacgactgcatc

SEQ ID NO: 73866 - DNA, 20 bp, Artificial Sequence
  Description of Artificial Sequence: Synthetic oligonucleotide
  Target: SCN9A; (-) strand; PAM type: YTN; PAM sequence: TTG
caaataagtaccttctcact

SEQ ID NO: 73867 - DNA, 20 bp, Artificial Sequence
  Description of Artificial Sequence: Synthetic oligonucleotide
  Target: SCN9A; (-) strand; PAM type: YTN; PAM sequence: CTT
gcaaataagtaccttctcac

SEQ ID NO: 73868 - DNA, 20 bp, Artificial Sequence
  Description of Artificial Sequence: Synthetic oligonucleotide
  Target: SCN9A; (-) strand; PAM type: YTN; PAM sequence: TTG
gtggagatccggatcttgca

SEQ ID NO: 73869 - DNA, 20 bp, Artificial Sequence
  Description of Artificial Sequence: Synthetic oligonucleotide
  Target: SCN9A; (-) strand; PAM type: YTN; PAM sequence: TTG
ttggtggagatccggatctt

SEQ ID NO: 73870 - DNA, 20 bp, Artificial Sequence
  Description of Artificial Sequence: Synthetic oligonucleotide
  Target: SCN9A; (-) strand; PAM type: YTN; PAM sequence: CTA
attgttggtggagatccgga

SEQ ID NO: 73871 - DNA, 20 bp, Artificial Sequence
  Description of Artificial Sequence: Synthetic oligonucleotide
  Target: SCN9A; (-) strand; PAM type: YTN; PAM sequence: TTC
taattgttggtggagatccg

SEQ ID NO: 73872 - DNA, 20 bp, Artificial Sequence
  Description of Artificial Sequence: Synthetic oligonucleotide
  Target: SCN9A; (-) strand; PAM type: YTN; PAM sequence: TTT
ctaattgttggtggagatcc

SEQ ID NO: 73873 - DNA, 20 bp, Artificial Sequence
  Description of Artificial Sequence: Synthetic oligonucleotide
  Target: SCN9A; (-) strand; PAM type: YTN; PAM sequence: CTA
gtttctaattgttggtggag

SEQ ID NO: 73874 - DNA, 20 bp, Artificial Sequence
  Description of Artificial Sequence: Synthetic oligonucleotide
  Target: SCN9A; (-) strand; PAM type: YTN; PAM sequence: TTG
gaaaaaggcaggaatatcta

SEQ ID NO: 73875 - DNA, 20 bp, Artificial Sequence
  Description of Artificial Sequence: Synthetic oligonucleotide
  Target: SCN9A; (-) strand; PAM type: YTN; PAM sequence: TTT
ggaaaaaggcaggaatatct

SEQ ID NO: 73876 - DNA, 20 bp, Artificial Sequence
  Description of Artificial Sequence: Synthetic oligonucleotide
  Target: SCN9A; (-) strand; PAM type: YTN; PAM sequence: CTT
tggaaaaaggcaggaatatc

SEQ ID NO: 73877 - DNA, 20 bp, Artificial Sequence
  Description of Artificial Sequence: Synthetic oligonucleotide
  Target: SCN9A; (-) strand; PAM type: YTN; PAM sequence: TTA
tctttggaaaaaggcaggaa

SEQ ID NO: 73878 - DNA, 20 bp, Artificial Sequence
  Description of Artificial Sequence: Synthetic oligonucleotide
  Target: SCN9A; (-) strand; PAM type: YTN; PAM sequence: TTT
atctttggaaaaaggcagga

SEQ ID NO: 73879 - DNA, 20 bp, Artificial Sequence
  Description of Artificial Sequence: Synthetic oligonucleotide
  Target: SCN9A; (-) strand; PAM type: YTN; PAM sequence: CTA
tttatctttggaaaaaggca

SEQ ID NO: 73880 - DNA, 20 bp, Artificial Sequence
  Description of Artificial Sequence: Synthetic oligonucleotide
  Target: SCN9A; (-) strand; PAM type: YTN; PAM sequence: TTC
tatttatctttggaaaaagg

SEQ ID NO: 73881 - DNA, 20 bp, Artificial Sequence
  Description of Artificial Sequence: Synthetic oligonucleotide
  Target: SCN9A; (-) strand; PAM type: YTN; PAM sequence: CTT
ctatttatctttggaaaaag

SEQ ID NO: 73882 - DNA, 20 bp, Artificial Sequence
  Description of Artificial Sequence: Synthetic oligonucleotide
  Target: SCN9A; (-) strand; PAM type: YTN; PAM sequence: TTC
ccttctatttatctttggaa

SEQ ID NO: 73883 - DNA, 20 bp, Artificial Sequence
  Description of Artificial Sequence: Synthetic oligonucleotide
  Target: SCN9A; (-) strand; PAM type: YTN; PAM sequence: CTT
cccttctatttatctttgga

SEQ ID NO: 73884 - DNA, 20 bp, Artificial Sequence
  Description of Artificial Sequence: Synthetic oligonucleotide
  Target: SCN9A; (-) strand; PAM type: YTN; PAM sequence: TTC
ttcccttctatttatctttg

SEQ ID NO: 73885 - DNA, 20 bp, Artificial Sequence
  Description of Artificial Sequence: Synthetic oligonucleotide
  Target: SCN9A; (-) strand; PAM type: YTN; PAM sequence: CTT
cttcccttctatttatcttt

SEQ ID NO: 73886 - DNA, 20 bp, Artificial Sequence
  Description of Artificial Sequence: Synthetic oligonucleotide
  Target: SCN9A; (-) strand; PAM type: YTN; PAM sequence: TTC
ttcttcccttctatttatct

SEQ ID NO: 73887 - DNA, 20 bp, Artificial Sequence
  Description of Artificial Sequence: Synthetic oligonucleotide
  Target: SCN9A; (-) strand; PAM type: YTN; PAM sequence: TTA
gcattcttcttcccttctat

SEQ ID NO: 73888 - DNA, 20 bp, Artificial Sequence
  Description of Artificial Sequence: Synthetic oligonucleotide
  Target: SCN9A; (-) strand; PAM type: YTN; PAM sequence: CTG
agttagcattcttcttccct

SEQ ID NO: 73889 - DNA, 20 bp, Artificial Sequence
  Description of Artificial Sequence: Synthetic oligonucleotide
  Target: SCN9A; (-) strand; PAM type: YTN; PAM sequence: CTC
gctgagttagcattcttctt

SEQ ID NO: 73890 - DNA, 20 bp, Artificial Sequence
  Description of Artificial Sequence: Synthetic oligonucleotide
  Target: SCN9A; (-) strand; PAM type: YTN; PAM sequence: TTC
cccatgtgctcgctgagtta

SEQ ID NO: 73891 - DNA, 20 bp, Artificial Sequence
  Description of Artificial Sequence: Synthetic oligonucleotide
  Target: SCN9A; (-) strand; PAM type: YTN; PAM sequence: TTT
ccccatgtgctcgctgagtt

SEQ ID NO: 73892 - DNA, 20 bp, Artificial Sequence
  Description of Artificial Sequence: Synthetic oligonucleotide
  Target: SCN9A; (-) strand; PAM type: YTN; PAM sequence: TTT
tccccatgtgctcgctgagt

SEQ ID NO: 73893 - DNA, 20 bp, Artificial Sequence
  Description of Artificial Sequence: Synthetic oligonucleotide
  Target: SCN9A; (-) strand; PAM type: YTN; PAM sequence: TTT
ttccccatgtgctcgctgag

SEQ ID NO: 73894 - DNA, 20 bp, Artificial Sequence
  Description of Artificial Sequence: Synthetic oligonucleotide
  Target: SCN9A; (-) strand; PAM type: YTN; PAM sequence: TTC
ccaatgtttttccccatgtg

SEQ ID NO: 73895 - DNA, 20 bp, Artificial Sequence
  Description of Artificial Sequence: Synthetic oligonucleotide
  Target: SCN9A; (-) strand; PAM type: YTN; PAM sequence: CTA
caaatattcccaatgttttt

SEQ ID NO: 73896 - DNA, 20 bp, Artificial Sequence
  Description of Artificial Sequence: Synthetic oligonucleotide
  Target: SCN9A; (-) strand; PAM type: YTN; PAM sequence: TTG
tctacaaatattcccaatgt

SEQ ID NO: 73897 - DNA, 20 bp, Artificial Sequence
  Description of Artificial Sequence: Synthetic oligonucleotide
  Target: SCN9A; (-) strand; PAM type: YTN; PAM sequence: CTA
aattgtctacaaatattccc

SEQ ID NO: 73898 - DNA, 20 bp, Artificial Sequence
  Description of Artificial Sequence: Synthetic oligonucleotide
  Target: SCN9A; (-) strand; PAM type: YTN; PAM sequence: TTC
taaattgtctacaaatattc

SEQ ID NO: 73899 - DNA, 20 bp, Artificial Sequence
  Description of Artificial Sequence: Synthetic oligonucleotide
  Target: SCN9A; (-) strand; PAM type: YTN; PAM sequence: CTT
ctaaattgtctacaaatatt

SEQ ID NO: 73900 - DNA, 20 bp, Artificial Sequence
  Description of Artificial Sequence: Synthetic oligonucleotide
  Target: SCN9A; (-) strand; PAM type: YTN; PAM sequence: TTC
ttctaaattgtctacaaata

SEQ ID NO: 73901 - DNA, 20 bp, Artificial Sequence
  Description of Artificial Sequence: Synthetic oligonucleotide
  Target: SCN9A; (-) strand; PAM type: YTN; PAM sequence: TTT
cttctaaattgtctacaaat

SEQ ID NO: 73902 - DNA, 20 bp, Artificial Sequence
  Description of Artificial Sequence: Synthetic oligonucleotide
  Target: SCN9A; (-) strand; PAM type: YTN; PAM sequence: TTT
tcttctaaattgtctacaaa

SEQ ID NO: 73903 - DNA, 20 bp, Artificial Sequence
  Description of Artificial Sequence: Synthetic oligonucleotide
  Target: SCN9A; (-) strand; PAM type: YTN; PAM sequence: CTT
ttcttctaaattgtctacaa

SEQ ID NO: 73904 - DNA, 20 bp, Artificial Sequence
  Description of Artificial Sequence: Synthetic oligonucleotide
  Target: SCN9A; (-) strand; PAM type: YTN; PAM sequence: CTG
tcttttcttctaaattgtct

SEQ ID NO: 73905 - DNA, 20 bp, Artificial Sequence
  Description of Artificial Sequence: Synthetic oligonucleotide
  Target: SCN9A; (-) strand; PAM type: YTN; PAM sequence: CTG
agtctgtcttttcttctaaa

SEQ ID NO: 73906 - DNA, 20 bp, Artificial Sequence
  Description of Artificial Sequence: Synthetic oligonucleotide
  Target: SCN9A; (-) strand; PAM type: YTN; PAM sequence: TTC
tgagtctgtcttttcttcta

SEQ ID NO: 73907 - DNA, 20 bp, Artificial Sequence
  Description of Artificial Sequence: Synthetic oligonucleotide
  Target: SCN9A; (-) strand; PAM type: YTN; PAM sequence: TTT
ctgagtctgtcttttcttct

SEQ ID NO: 73908 - DNA, 20 bp, Artificial Sequence
  Description of Artificial Sequence: Synthetic oligonucleotide
  Target: SCN9A; (-) strand; PAM type: YTN; PAM sequence: TTT
tctgagtctgtcttttcttc

SEQ ID NO: 73909 - DNA, 20 bp, Artificial Sequence
  Description of Artificial Sequence: Synthetic oligonucleotide
  Target: SCN9A; (-) strand; PAM type: YTN; PAM sequence: CTT
ttctgagtctgtcttttctt

SEQ ID NO: 73910 - DNA, 20 bp, Artificial Sequence
  Description of Artificial Sequence: Synthetic oligonucleotide
  Target: SCN9A; (-) strand; PAM type: YTN; PAM sequence: TTC
ttttctgagtctgtcttttc

SEQ ID NO: 73911 - DNA, 20 bp, Artificial Sequence
  Description of Artificial Sequence: Synthetic oligonucleotide
  Target: SCN9A; (-) strand; PAM type: YTN; PAM sequence: TTG
aagaccagaagttcttttct

SEQ ID NO: 73912 - DNA, 20 bp, Artificial Sequence
  Description of Artificial Sequence: Synthetic oligonucleotide
  Target: SCN9A; (-) strand; PAM type: YTN; PAM sequence: TTT
gaagaccagaagttcttttc

SEQ ID NO: 73913 - DNA, 20 bp, Artificial Sequence
  Description of Artificial Sequence: Synthetic oligonucleotide
  Target: SCN9A; (-) strand; PAM type: YTN; PAM sequence: TTG
acatttgaagaccagaagtt

SEQ ID NO: 73914 - DNA, 20 bp, Artificial Sequence
  Description of Artificial Sequence: Synthetic oligonucleotide
  Target: SCN9A; (-) strand; PAM type: YTN; PAM sequence: CTG
tggtcccaaacaaattgaca

SEQ ID NO: 73915 - DNA, 20 bp, Artificial Sequence
  Description of Artificial Sequence: Synthetic oligonucleotide
  Target: SCN9A; (-) strand; PAM type: YTN; PAM sequence: TTG
ctgtggtcccaaacaaattg

SEQ ID NO: 73916 - DNA, 20 bp, Artificial Sequence
  Description of Artificial Sequence: Synthetic oligonucleotide
  Target: SCN9A; (-) strand; PAM type: YTN; PAM sequence: TTT
gctgtggtcccaaacaaatt

SEQ ID NO: 73917 - DNA, 20 bp, Artificial Sequence
  Description of Artificial Sequence: Synthetic oligonucleotide
  Target: SCN9A; (-) strand; PAM type: YTN; PAM sequence: TTT
tgctgtggtcccaaacaaat

SEQ ID NO: 73918 - DNA, 20 bp, Artificial Sequence
  Description of Artificial Sequence: Synthetic oligonucleotide
  Target: SCN9A; (-) strand; PAM type: YTN; PAM sequence: CTT
ttgctgtggtcccaaacaaa

SEQ ID NO: 73919 - DNA, 20 bp, Artificial Sequence
  Description of Artificial Sequence: Synthetic oligonucleotide
  Target: SCN9A; (-) strand; PAM type: YTN; PAM sequence: TTG
cttttgctgtggtcccaaac

SEQ ID NO: 73920 - DNA, 20 bp, Artificial Sequence
  Description of Artificial Sequence: Synthetic oligonucleotide
  Target: SCN9A; (-) strand; PAM type: YTN; PAM sequence: TTT
gcttttgctgtggtcccaaa

SEQ ID NO: 73921 - DNA, 20 bp, Artificial Sequence
  Description of Artificial Sequence: Synthetic oligonucleotide
  Target: SCN9A; (-) strand; PAM type: YTN; PAM sequence: TTT
tgcttttgctgtggtcccaa

SEQ ID NO: 73922 - DNA, 20 bp, Artificial Sequence
  Description of Artificial Sequence: Synthetic oligonucleotide
  Target: SCN9A; (-) strand; PAM type: YTN; PAM sequence: CTA
tataagataattttgctttt

SEQ ID NO: 73923 - DNA, 20 bp, Artificial Sequence
  Description of Artificial Sequence: Synthetic oligonucleotide
  Target: SCN9A; (-) strand; PAM type: YTN; PAM sequence: TTG
tcaatgtctatataagataa

SEQ ID NO: 73924 - DNA, 20 bp, Artificial Sequence
  Description of Artificial Sequence: Synthetic oligonucleotide
  Target: SCN9A; (-) strand; PAM type: YTN; PAM sequence: TTT
gtcaatgtctatataagata

SEQ ID NO: 73925 - DNA, 20 bp, Artificial Sequence
  Description of Artificial Sequence: Synthetic oligonucleotide
  Target: SCN9A; (-) strand; PAM type: YTN; PAM sequence: CTT
tgtcaatgtctatataagat

SEQ ID NO: 73926 - DNA, 20 bp, Artificial Sequence
  Description of Artificial Sequence: Synthetic oligonucleotide
  Target: SCN9A; (-) strand; PAM type: YTN; PAM sequence: TTG
ggtatctttgtcaatgtcta

SEQ ID NO: 73927 - DNA, 20 bp, Artificial Sequence
  Description of Artificial Sequence: Synthetic oligonucleotide
  Target: SCN9A; (-) strand; PAM type: YTN; PAM sequence: TTT
gggtatctttgtcaatgtct

SEQ ID NO: 73928 - DNA, 20 bp, Artificial Sequence
  Description of Artificial Sequence: Synthetic oligonucleotide
  Target: SCN9A; (-) strand; PAM type: YTN; PAM sequence: CTT
tgggtatctttgtcaatgtc

SEQ ID NO: 73929 - DNA, 20 bp, Artificial Sequence
  Description of Artificial Sequence: Synthetic oligonucleotide
  Target: SCN9A; (-) strand; PAM type: YTN; PAM sequence: TTC
ataaaccatgaataactttg

SEQ ID NO: 73930 - DNA, 20 bp, Artificial Sequence
  Description of Artificial Sequence: Synthetic oligonucleotide
  Target: SCN9A; (-) strand; PAM type: YTN; PAM sequence: CTT
cataaaccatgaataacttt

SEQ ID NO: 73931 - DNA, 20 bp, Artificial Sequence
  Description of Artificial Sequence: Synthetic oligonucleotide
  Target: SCN9A; (-) strand; PAM type: YTN; PAM sequence: CTC
ttcataaaccatgaataact

SEQ ID NO: 73932 - DNA, 20 bp, Artificial Sequence
  Description of Artificial Sequence: Synthetic oligonucleotide
  Target: SCN9A; (-) strand; PAM type: YTN; PAM sequence: TTA
tgactcttcataaaccatga

SEQ ID NO: 73933 - DNA, 20 bp, Artificial Sequence
  Description of Artificial Sequence: Synthetic oligonucleotide
  Target: SCN9A; (-) strand; PAM type: YTN; PAM sequence: CTT
atgactcttcataaaccatg

SEQ ID NO: 73934 - DNA, 20 bp, Artificial Sequence
  Description of Artificial Sequence: Synthetic oligonucleotide
  Target: SCN9A; (-) strand; PAM type: YTN; PAM sequence: CTC
agcttatgactcttcataaa

SEQ ID NO: 73935 - DNA, 20 bp, Artificial Sequence
  Description of Artificial Sequence: Synthetic oligonucleotide
  Target: SCN9A; (-) strand; PAM type: YTN; PAM sequence: TTA
gggccagagaatctcagctt

SEQ ID NO: 73936 - DNA, 20 bp, Artificial Sequence
  Description of Artificial Sequence: Synthetic oligonucleotide
  Target: SCN9A; (-) strand; PAM type: YTN; PAM sequence: TTT
agggccagagaatctcagct

SEQ ID NO: 73937 - DNA, 20 bp, Artificial Sequence
  Description of Artificial Sequence: Synthetic oligonucleotide
  Target: SCN9A; (-) strand; PAM type: YTN; PAM sequence: TTT
tagggccagagaatctcagc

SEQ ID NO: 73938 - DNA, 20 bp, Artificial Sequence
  Description of Artificial Sequence: Synthetic oligonucleotide
  Target: SCN9A; (-) strand; PAM type: YTN; PAM sequence: TTT
ttagggccagagaatctcag

SEQ ID NO: 73939 - DNA, 20 bp, Artificial Sequence
  Description of Artificial Sequence: Synthetic oligonucleotide
  Target: SCN9A; (-) strand; PAM type: YTN; PAM sequence: TTC
atttttagggccagagaatc

SEQ ID NO: 73940 - DNA, 20 bp, Artificial Sequence
  Description of Artificial Sequence: Synthetic oligonucleotide
  Target: SCN9A; (-) strand; PAM type: YTN; PAM sequence: CTA
tggatgtgaggcaggcacca

SEQ ID NO: 73941 - DNA, 20 bp, Artificial Sequence
  Description of Artificial Sequence: Synthetic oligonucleotide
  Target: SCN9A; (-) strand; PAM type: YTN; PAM sequence: TTG
actatggatgtgaggcaggc

SEQ ID NO: 73942 - DNA, 20 bp, Artificial Sequence
  Description of Artificial Sequence: Synthetic oligonucleotide
  Target: SCN9A; (-) strand; PAM type: YTN; PAM sequence: TTT
gactatggatgtgaggcagg

SEQ ID NO: 73943 - DNA, 20 bp, Artificial Sequence
  Description of Artificial Sequence: Synthetic oligonucleotide
  Target: SCN9A; (-) strand; PAM type: YTN; PAM sequence: TTT
tgactatggatgtgaggcag

SEQ ID NO: 73944 - DNA, 20 bp, Artificial Sequence
  Description of Artificial Sequence: Synthetic oligonucleotide
  Target: SCN9A; (-) strand; PAM type: YTN; PAM sequence: TTT
ttgactatggatgtgaggca

SEQ ID NO: 73945 - DNA, 20 bp, Artificial Sequence
  Description of Artificial Sequence: Synthetic oligonucleotide
  Target: SCN9A; (-) strand; PAM type: YTN; PAM sequence: CTC
agggtaaacaaaatgccagt

SEQ ID NO: 73946 - DNA, 20 bp, Artificial Sequence
  Description of Artificial Sequence: Synthetic oligonucleotide
  Target: SCN9A; (-) strand; PAM type: YTN; PAM sequence: CTA
actcagggtaaacaaaatgc

SEQ ID NO: 73947 - DNA, 20 bp, Artificial Sequence
  Description of Artificial Sequence: Synthetic oligonucleotide
  Target: SCN9A; (-) strand; PAM type: YTN; PAM sequence: CTG
gtcacactaactcagggtaa

SEQ ID NO: 73948 - DNA, 20 bp, Artificial Sequence
  Description of Artificial Sequence: Synthetic oligonucleotide
  Target: SCN9A; (-) strand; PAM type: YTN; PAM sequence: CTA
aaatgtacagtgctggtcac

SEQ ID NO: 73949 - DNA, 20 bp, Artificial Sequence
  Description of Artificial Sequence: Synthetic oligonucleotide
  Target: SCN9A; (-) strand; PAM type: YTN; PAM sequence: CTC
taaaatgtacagtgctggtc

SEQ ID NO: 73950 - DNA, 20 bp, Artificial Sequence
  Description of Artificial Sequence: Synthetic oligonucleotide
  Target: SCN9A; (-) strand; PAM type: YTN; PAM sequence: TTG
atgccagagtgatctctaaa

SEQ ID NO: 73951 - DNA, 20 bp, Artificial Sequence
  Description of Artificial Sequence: Synthetic oligonucleotide
  Target: SCN9A; (-) strand; PAM type: YTN; PAM sequence: TTA
gtaaaattgatgccagagtg

SEQ ID NO: 73952 - DNA, 20 bp, Artificial Sequence
  Description of Artificial Sequence: Synthetic oligonucleotide
  Target: SCN9A; (-) strand; PAM type: YTN; PAM sequence: CTG
gaagatataagatccaatta

SEQ ID NO: 73953 - DNA, 20 bp, Artificial Sequence
  Description of Artificial Sequence: Synthetic oligonucleotide
  Target: SCN9A; (-) strand; PAM type: YTN; PAM sequence: TTC
tggaagatataagatccaat

SEQ ID NO: 73954 - DNA, 20 bp, Artificial Sequence
  Description of Artificial Sequence: Synthetic oligonucleotide
  Target: SCN9A; (-) strand; PAM type: YTN; PAM sequence: CTT
ctggaagatataagatccaa

SEQ ID NO: 73955 - DNA, 20 bp, Artificial Sequence
  Description of Artificial Sequence: Synthetic oligonucleotide
  Target: SCN9A; (-) strand; PAM type: YTN; PAM sequence: CTC
aaggataggcaagaaggtga

SEQ ID NO: 73956 - DNA, 20 bp, Artificial Sequence
  Description of Artificial Sequence: Synthetic oligonucleotide
  Target: SCN9A; (-) strand; PAM type: YTN; PAM sequence: CTG
gacatagaagactcaaggat

SEQ ID NO: 73957 - DNA, 20 bp, Artificial Sequence
  Description of Artificial Sequence: Synthetic oligonucleotide
  Target: SCN9A; (-) strand; PAM type: YTN; PAM sequence: TTG
aactggacatagaagactca

SEQ ID NO: 73958 - DNA, 20 bp, Artificial Sequence
  Description of Artificial Sequence: Synthetic oligonucleotide
  Target: SCN9A; (-) strand; PAM type: YTN; PAM sequence: TTG
agaaaccaaaatggttgaac

SEQ ID NO: 73959 - DNA, 20 bp, Artificial Sequence
  Description of Artificial Sequence: Synthetic oligonucleotide
  Target: SCN9A; (-) strand; PAM type: YTN; PAM sequence: TTT
gagaaaccaaaatggttgaa

SEQ ID NO: 73960 - DNA, 20 bp, Artificial Sequence
  Description of Artificial Sequence: Synthetic oligonucleotide
  Target: SCN9A; (-) strand; PAM type: YTN; PAM sequence: TTT
tgagaaaccaaaatggttga

SEQ ID NO: 73961 - DNA, 20 bp, Artificial Sequence
  Description of Artificial Sequence: Synthetic oligonucleotide
  Target: SCN9A; (-) strand; PAM type: YTN; PAM sequence: CTA
ttttgagaaaccaaaatggt

SEQ ID NO: 73962 - DNA, 20 bp, Artificial Sequence
  Description of Artificial Sequence: Synthetic oligonucleotide
  Target: SCN9A; (-) strand; PAM type: YTN; PAM sequence: TTA
aaaacaactattttgagaaa

SEQ ID NO: 73963 - DNA, 20 bp, Artificial Sequence
  Description of Artificial Sequence: Synthetic oligonucleotide
  Target: SCN9A; (-) strand; PAM type: YTN; PAM sequence: TTT
aaaaacaactattttgagaa

SEQ ID NO: 73964 - DNA, 20 bp, Artificial Sequence
  Description of Artificial Sequence: Synthetic oligonucleotide
  Target: SCN9A; (-) strand; PAM type: YTN; PAM sequence: CTT
taaaaacaactattttgaga

SEQ ID NO: 73965 - DNA, 20 bp, Artificial Sequence
  Description of Artificial Sequence: Synthetic oligonucleotide
  Target: SCN9A; (-) strand; PAM type: YTN; PAM sequence: TTA
atgaaacaagctttaaaaac

SEQ ID NO: 73966 - DNA, 20 bp, Artificial Sequence
  Description of Artificial Sequence: Synthetic oligonucleotide
  Target: SCN9A; (-) strand; PAM type: YTN; PAM sequence: CTT
aatgaaacaagctttaaaaa

SEQ ID NO: 73967 - DNA, 20 bp, Artificial Sequence
  Description of Artificial Sequence: Synthetic oligonucleotide
  Target: SCN9A; (-) strand; PAM type: YTN; PAM sequence: TTC
aaagacttaatgaaacaagc

SEQ ID NO: 73968 - DNA, 20 bp, Artificial Sequence
  Description of Artificial Sequence: Synthetic oligonucleotide
  Target: SCN9A; (-) strand; PAM type: YTN; PAM sequence: CTT
caaagacttaatgaaacaag

SEQ ID NO: 73969 - DNA, 20 bp, Artificial Sequence
  Description of Artificial Sequence: Synthetic oligonucleotide
  Target: SCN9A; (-) strand; PAM type: YTN; PAM sequence: TTG
tcatcaaaacttcaaagact

SEQ ID NO: 73970 - DNA, 20 bp, Artificial Sequence
  Description of Artificial Sequence: Synthetic oligonucleotide
  Target: SCN9A; (-) strand; PAM type: YTN; PAM sequence: CTA
tcatcatcatcaacatcatt

SEQ ID NO: 73971 - DNA, 20 bp, Artificial Sequence
  Description of Artificial Sequence: Synthetic oligonucleotide
  Target: SCN9A; (-) strand; PAM type: YTN; PAM sequence: TTA
aagctatcatcatcatcaac

SEQ ID NO: 73972 - DNA, 20 bp, Artificial Sequence
  Description of Artificial Sequence: Synthetic oligonucleotide
  Target: SCN9A; (-) strand; PAM type: YTN; PAM sequence: CTG
gcatatagtaaatacacaat

SEQ ID NO: 73973 - DNA, 20 bp, Artificial Sequence
  Description of Artificial Sequence: Synthetic oligonucleotide
  Target: SCN9A; (-) strand; PAM type: YTN; PAM sequence: TTA
gcctggcatatagtaaatac

SEQ ID NO: 73974 - DNA, 20 bp, Artificial Sequence
  Description of Artificial Sequence: Synthetic oligonucleotide
  Target: SCN9A; (-) strand; PAM type: YTN; PAM sequence: TTA
ttagcctggcatatagtaaa

SEQ ID NO: 73975 - DNA, 20 bp, Artificial Sequence
  Description of Artificial Sequence: Synthetic oligonucleotide
  Target: SCN9A; (-) strand; PAM type: YTN; PAM sequence: CTT
attagcctggcatatagtaa

SEQ ID NO: 73976 - DNA, 20 bp, Artificial Sequence
  Description of Artificial Sequence: Synthetic oligonucleotide
  Target: SCN9A; (-) strand; PAM type: YTN; PAM sequence: CTG
cttattagcctggcatatag

SEQ ID NO: 73977 - DNA, 20 bp, Artificial Sequence
  Description of Artificial Sequence: Synthetic oligonucleotide
  Target: SCN9A; (-) strand; PAM type: YTN; PAM sequence: TTC
tgcttattagcctggcatat

SEQ ID NO: 73978 - DNA, 20 bp, Artificial Sequence
  Description of Artificial Sequence: Synthetic oligonucleotide
  Target: SCN9A; (-) strand; PAM type: YTN; PAM sequence: TTT
ctgcttattagcctggcata

SEQ ID NO: 73979 - DNA, 20 bp, Artificial Sequence
  Description of Artificial Sequence: Synthetic oligonucleotide
  Target: SCN9A; (-) strand; PAM type: YTN; PAM sequence: CTT
tctgcttattagcctggcat

SEQ ID NO: 73980 - DNA, 20 bp, Artificial Sequence
  Description of Artificial Sequence: Synthetic oligonucleotide
  Target: SCN9A; (-) strand; PAM type: YTN; PAM sequence: TTA
aatgctttctgcttattagc

SEQ ID NO: 73981 - DNA, 20 bp, Artificial Sequence
  Description of Artificial Sequence: Synthetic oligonucleotide
  Target: SCN9A; (-) strand; PAM type: YTN; PAM sequence: TTG
ggaggattaaatgctttctg

SEQ ID NO: 73982 - DNA, 20 bp, Artificial Sequence
  Description of Artificial Sequence: Synthetic oligonucleotide
  Target: SCN9A; (-) strand; PAM type: YTN; PAM sequence: CTT
gggaggattaaatgctttct

SEQ ID NO: 73983 - DNA, 20 bp, Artificial Sequence
  Description of Artificial Sequence: Synthetic oligonucleotide
  Target: SCN9A; (-) strand; PAM type: YTN; PAM sequence: TTC
ttgggaggattaaatgcttt

SEQ ID NO: 73984 - DNA, 20 bp, Artificial Sequence
  Description of Artificial Sequence: Synthetic oligonucleotide
  Target: SCN9A; (-) strand; PAM type: YTN; PAM sequence: TTA
tcatattcttgggaggatta

SEQ ID NO: 73985 - DNA, 20 bp, Artificial Sequence
  Description of Artificial Sequence: Synthetic oligonucleotide
  Target: SCN9A; (-) strand; PAM type: YTN; PAM sequence: TTT
atcatattcttgggaggatt

SEQ ID NO: 73986 - DNA, 20 bp, Artificial Sequence
  Description of Artificial Sequence: Synthetic oligonucleotide
  Target: SCN9A; (-) strand; PAM type: YTN; PAM sequence: TTC
atttatcatattcttgggag

SEQ ID NO: 73987 - DNA, 20 bp, Artificial Sequence
  Description of Artificial Sequence: Synthetic oligonucleotide
  Target: SCN9A; (-) strand; PAM type: YTN; PAM sequence: TTT
catttatcatattcttggga

SEQ ID NO: 73988 - DNA, 20 bp, Artificial Sequence
  Description of Artificial Sequence: Synthetic oligonucleotide
  Target: SCN9A; (-) strand; PAM type: YTN; PAM sequence: CTG
tatttcatttatcatattct

SEQ ID NO: 73989 - DNA, 20 bp, Artificial Sequence
  Description of Artificial Sequence: Synthetic oligonucleotide
  Target: SCN9A; (-) strand; PAM type: YTN; PAM sequence: TTG
taactgtatttcatttatca

SEQ ID NO: 73990 - DNA, 20 bp, Artificial Sequence
  Description of Artificial Sequence: Synthetic oligonucleotide
  Target: SCN9A; (-) strand; PAM type: YTN; PAM sequence: TTA
taatataattgtaactgtat

SEQ ID NO: 73991 - DNA, 20 bp, Artificial Sequence
  Description of Artificial Sequence: Synthetic oligonucleotide
  Target: SCN9A; (-) strand; PAM type: YTN; PAM sequence: TTT
ataatataattgtaactgta

SEQ ID NO: 73992 - DNA, 20 bp, Artificial Sequence
  Description of Artificial Sequence: Synthetic oligonucleotide
  Target: SCN9A; (-) strand; PAM type: YTN; PAM sequence: TTA
tttataatataattgtaact

SEQ ID NO: 73993 - DNA, 20 bp, Artificial Sequence
  Description of Artificial Sequence: Synthetic oligonucleotide
  Target: SCN9A; (-) strand; PAM type: YTN; PAM sequence: TTA
taaaataattatttataata

SEQ ID NO: 73994 - DNA, 20 bp, Artificial Sequence
  Description of Artificial Sequence: Synthetic oligonucleotide
  Target: SCN9A; (-) strand; PAM type: YTN; PAM sequence: TTC
attataaaataattatttat

SEQ ID NO: 73995 - DNA, 20 bp, Artificial Sequence
  Description of Artificial Sequence: Synthetic oligonucleotide
  Target: SCN9A; (-) strand; PAM type: YTN; PAM sequence: CTT
cattataaaataattattta

SEQ ID NO: 73996 - DNA, 20 bp, Artificial Sequence
  Description of Artificial Sequence: Synthetic oligonucleotide
  Target: SCN9A; (-) strand; PAM type: YTN; PAM sequence: TTA
taaaataatacttcattata

SEQ ID NO: 73997 - DNA, 20 bp, Artificial Sequence
  Description of Artificial Sequence: Synthetic oligonucleotide
  Target: SCN9A; (-) strand; PAM type: YTN; PAM sequence: TTT
ataaaataatacttcattat

SEQ ID NO: 73998 - DNA, 20 bp, Artificial Sequence
  Description of Artificial Sequence: Synthetic oligonucleotide
  Target: SCN9A; (-) strand; PAM type: YTN; PAM sequence: TTA
tcatttataaaataatactt

SEQ ID NO: 73999 - DNA, 20 bp, Artificial Sequence
  Description of Artificial Sequence: Synthetic oligonucleotide
  Target: SCN9A; (-) strand; PAM type: YTN; PAM sequence: TTT
atcatttataaaataatact

SEQ ID NO: 74000 - DNA, 20 bp, Artificial Sequence
  Description of Artificial Sequence: Synthetic oligonucleotide
  Target: SCN9A; (-) strand; PAM type: YTN; PAM sequence: TTT
tatcatttataaaataatac

SEQ ID NO: 74001 - DNA, 20 bp, Artificial Sequence
  Description of Artificial Sequence: Synthetic oligonucleotide
  Target: SCN9A; (-) strand; PAM type: YTN; PAM sequence: TTA
attttatcatttataaaata

SEQ ID NO: 74002 - DNA, 20 bp, Artificial Sequence
  Description of Artificial Sequence: Synthetic oligonucleotide
  Target: SCN9A; (-) strand; PAM type: YTN; PAM sequence: TTT
aattttatcatttataaaat

SEQ ID NO: 74003 - DNA, 20 bp, Artificial Sequence
  Description of Artificial Sequence: Synthetic oligonucleotide
  Target: SCN9A; (-) strand; PAM type: YTN; PAM sequence: CTG
tagtatttaattttatcatt

SEQ ID NO: 74004 - DNA, 20 bp, Artificial Sequence
  Description of Artificial Sequence: Synthetic oligonucleotide
  Target: SCN9A; (-) strand; PAM type: YTN; PAM sequence: CTC
tgtagtatttaattttatca

SEQ ID NO: 74005 - DNA, 20 bp, Artificial Sequence
  Description of Artificial Sequence: Synthetic oligonucleotide
  Target: SCN9A; (-) strand; PAM type: YTN; PAM sequence: TTA
actctgtagtatttaatttt

SEQ ID NO: 74006 - DNA, 20 bp, Artificial Sequence
  Description of Artificial Sequence: Synthetic oligonucleotide
  Target: SCN9A; (-) strand; PAM type: YTN; PAM sequence: TTT
aactctgtagtatttaattt

SEQ ID NO: 74007 - DNA, 20 bp, Artificial Sequence
  Description of Artificial Sequence: Synthetic oligonucleotide
  Target: SCN9A; (-) strand; PAM type: YTN; PAM sequence: TTT
taactctgtagtatttaatt

SEQ ID NO: 74008 - DNA, 20 bp, Artificial Sequence
  Description of Artificial Sequence: Synthetic oligonucleotide
  Target: SCN9A; (-) strand; PAM type: YTN; PAM sequence: TTG
gacaaatattttaactctgt

SEQ ID NO: 74009 - DNA, 20 bp, Artificial Sequence
  Description of Artificial Sequence: Synthetic oligonucleotide
  Target: SCN9A; (-) strand; PAM type: YTN; PAM sequence: CTT
ggacaaatattttaactctg

SEQ ID NO: 74010 - DNA, 20 bp, Artificial Sequence
  Description of Artificial Sequence: Synthetic oligonucleotide
  Target: SCN9A; (-) strand; PAM type: YTN; PAM sequence: TTA
tatgagtgatatgcccttgg

SEQ ID NO: 74011 - DNA, 20 bp, Artificial Sequence
  Description of Artificial Sequence: Synthetic oligonucleotide
  Target: SCN9A; (-) strand; PAM type: YTN; PAM sequence: CTG
cattatatgagtgatatgcc

SEQ ID NO: 74012 - DNA, 20 bp, Artificial Sequence
  Description of Artificial Sequence: Synthetic oligonucleotide
  Target: SCN9A; (-) strand; PAM type: YTN; PAM sequence: TTC
tgcattatatgagtgatatg

SEQ ID NO: 74013 - DNA, 20 bp, Artificial Sequence
  Description of Artificial Sequence: Synthetic oligonucleotide
  Target: SCN9A; (-) strand; PAM type: YTN; PAM sequence: CTG
attctgcattatatgagtga

SEQ ID NO: 74014 - DNA, 20 bp, Artificial Sequence
  Description of Artificial Sequence: Synthetic oligonucleotide
  Target: SCN9A; (-) strand; PAM type: YTN; PAM sequence: TTG
aatgctgattctgcattata

SEQ ID NO: 74015 - DNA, 20 bp, Artificial Sequence
  Description of Artificial Sequence: Synthetic oligonucleotide
  Target: SCN9A; (-) strand; PAM type: YTN; PAM sequence: TTT
gaatgctgattctgcattat

SEQ ID NO: 74016 - DNA, 20 bp, Artificial Sequence
  Description of Artificial Sequence: Synthetic oligonucleotide
  Target: SCN9A; (-) strand; PAM type: YTN; PAM sequence: CTG
ggtttgaatgctgattctgc

SEQ ID NO: 74017 - DNA, 20 bp, Artificial Sequence
  Description of Artificial Sequence: Synthetic oligonucleotide
  Target: SCN9A; (-) strand; PAM type: YTN; PAM sequence: CTC
agagtcccaaagtcctgggt

SEQ ID NO: 74018 - DNA, 20 bp, Artificial Sequence
  Description of Artificial Sequence: Synthetic oligonucleotide
  Target: SCN9A; (-) strand; PAM type: YTN; PAM sequence: TTG
ggtcctcagagtcccaaagt

SEQ ID NO: 74019 - DNA, 20 bp, Artificial Sequence
  Description of Artificial Sequence: Synthetic oligonucleotide
  Target: SCN9A; (-) strand; PAM type: YTN; PAM sequence: TTT
gggtcctcagagtcccaaag

SEQ ID NO: 74020 - DNA, 20 bp, Artificial Sequence
  Description of Artificial Sequence: Synthetic oligonucleotide
  Target: SCN9A; (-) strand; PAM type: YTN; PAM sequence: TTG
acataatagtagtgaagtgt

SEQ ID NO: 74021 - DNA, 20 bp, Artificial Sequence
  Description of Artificial Sequence: Synthetic oligonucleotide
  Target: SCN9A; (-) strand; PAM type: YTN; PAM sequence: TTT
gacataatagtagtgaagtg

SEQ ID NO: 74022 - DNA, 20 bp, Artificial Sequence
  Description of Artificial Sequence: Synthetic oligonucleotide
  Target: SCN9A; (-) strand; PAM type: YTN; PAM sequence: CTT
tgacataatagtagtgaagt

SEQ ID NO: 74023 - DNA, 20 bp, Artificial Sequence
  Description of Artificial Sequence: Synthetic oligonucleotide
  Target: SCN9A; (-) strand; PAM type: YTN; PAM sequence: TTG
ctttgacataatagtagtga

SEQ ID NO: 74024 - DNA, 20 bp, Artificial Sequence
  Description of Artificial Sequence: Synthetic oligonucleotide
  Target: SCN9A; (-) strand; PAM type: YTN; PAM sequence: CTA
tggatgtattgctttgacat

SEQ ID NO: 74025 - DNA, 20 bp, Artificial Sequence
  Description of Artificial Sequence: Synthetic oligonucleotide
  Target: SCN9A; (-) strand; PAM type: YTN; PAM sequence: TTC
agaaaacctatggatgtatt

SEQ ID NO: 74026 - DNA, 20 bp, Artificial Sequence
  Description of Artificial Sequence: Synthetic oligonucleotide
  Target: SCN9A; (-) strand; PAM type: YTN; PAM sequence: TTT
cagaaaacctatggatgtat

SEQ ID NO: 74027 - DNA, 20 bp, Artificial Sequence
  Description of Artificial Sequence: Synthetic oligonucleotide
  Target: SCN9A; (-) strand; PAM type: YTN; PAM sequence: TTT
tcagaaaacctatggatgta

SEQ ID NO: 74028 - DNA, 20 bp, Artificial Sequence
  Description of Artificial Sequence: Synthetic oligonucleotide
  Target: SCN9A; (-) strand; PAM type: YTN; PAM sequence: CTC
acatattttcagaaaaccta

SEQ ID NO: 74029 - DNA, 20 bp, Artificial Sequence
  Description of Artificial Sequence: Synthetic oligonucleotide
  Target: SCN9A; (-) strand; PAM type: YTN; PAM sequence: TTG
taagtacacacctcacatat

SEQ ID NO: 74030 - DNA, 20 bp, Artificial Sequence
  Description of Artificial Sequence: Synthetic oligonucleotide
  Target: SCN9A; (-) strand; PAM type: YTN; PAM sequence: CTT
gtaagtacacacctcacata

SEQ ID NO: 74031 - DNA, 20 bp, Artificial Sequence
  Description of Artificial Sequence: Synthetic oligonucleotide
  Target: SCN9A; (-) strand; PAM type: YTN; PAM sequence: TTC
ttgtaagtacacacctcaca

SEQ ID NO: 74032 - DNA, 20 bp, Artificial Sequence
  Description of Artificial Sequence: Synthetic oligonucleotide
  Target: SCN9A; (-) strand; PAM type: YTN; PAM sequence: TTT
cttgtaagtacacacctcac

SEQ ID NO: 74033 - DNA, 20 bp, Artificial Sequence
  Description of Artificial Sequence: Synthetic oligonucleotide
  Target: SCN9A; (-) strand; PAM type: YTN; PAM sequence: CTT
tcttgtaagtacacacctca

SEQ ID NO: 74034 - DNA, 20 bp, Artificial Sequence
  Description of Artificial Sequence: Synthetic oligonucleotide
  Target: SCN9A; (-) strand; PAM type: YTN; PAM sequence: CTG
ctttcttgtaagtacacacc

SEQ ID NO: 74035 - DNA, 20 bp, Artificial Sequence
  Description of Artificial Sequence: Synthetic oligonucleotide
  Target: SCN9A; (-) strand; PAM type: YTN; PAM sequence: TTG
ctgctttcttgtaagtacac

SEQ ID NO: 74036 - DNA, 20 bp, Artificial Sequence
  Description of Artificial Sequence: Synthetic oligonucleotide
  Target: SCN9A; (-) strand; PAM type: YTN; PAM sequence: TTA
cattgctgctttcttgtaag

SEQ ID NO: 74037 - DNA, 20 bp, Artificial Sequence
  Description of Artificial Sequence: Synthetic oligonucleotide
  Target: SCN9A; (-) strand; PAM type: YTN; PAM sequence: CTA
attacattgctgctttcttg

SEQ ID NO: 74038 - DNA, 20 bp, Artificial Sequence
  Description of Artificial Sequence: Synthetic oligonucleotide
  Target: SCN9A; (-) strand; PAM type: YTN; PAM sequence: TTC
ctaattacattgctgctttc

SEQ ID NO: 74039 - DNA, 20 bp, Artificial Sequence
  Description of Artificial Sequence: Synthetic oligonucleotide
  Target: SCN9A; (-) strand; PAM type: YTN; PAM sequence: CTT
cctaattacattgctgcttt

SEQ ID NO: 74040 - DNA, 20 bp, Artificial Sequence
  Description of Artificial Sequence: Synthetic oligonucleotide
  Target: SCN9A; (-) strand; PAM type: YTN; PAM sequence: CTC
acaccttcctaattacattg

SEQ ID NO: 74041 - DNA, 20 bp, Artificial Sequence
  Description of Artificial Sequence: Synthetic oligonucleotide
  Target: SCN9A; (-) strand; PAM type: YTN; PAM sequence: TTC
tcacaccttcctaattacat

SEQ ID NO: 74042 - DNA, 20 bp, Artificial Sequence
  Description of Artificial Sequence: Synthetic oligonucleotide
  Target: SCN9A; (-) strand; PAM type: YTN; PAM sequence: TTT
ctcacaccttcctaattaca

SEQ ID NO: 74043 - DNA, 20 bp, Artificial Sequence
  Description of Artificial Sequence: Synthetic oligonucleotide
  Target: SCN9A; (-) strand; PAM type: YTN; PAM sequence: CTT
tctcacaccttcctaattac

SEQ ID NO: 74044 - DNA, 20 bp, Artificial Sequence
  Description of Artificial Sequence: Synthetic oligonucleotide
  Target: SCN9A; (-) strand; PAM type: YTN; PAM sequence: TTC
tttctcacaccttcctaatt

SEQ ID NO: 74045 - DNA, 20 bp, Artificial Sequence
  Description of Artificial Sequence: Synthetic oligonucleotide
  Target: SCN9A; (-) strand; PAM type: YTN; PAM sequence: TTG
gttctttctcacaccttcct

SEQ ID NO: 74046 - DNA, 20 bp, Artificial Sequence
  Description of Artificial Sequence: Synthetic oligonucleotide
  Target: SCN9A; (-) strand; PAM type: YTN; PAM sequence: TTT
ggttctttctcacaccttcc

SEQ ID NO: 74047 - DNA, 20 bp, Artificial Sequence
  Description of Artificial Sequence: Synthetic oligonucleotide
  Target: SCN9A; (-) strand; PAM type: YTN; PAM sequence: TTT
tggttctttctcacaccttc

SEQ ID NO: 74048 - DNA, 20 bp, Artificial Sequence
  Description of Artificial Sequence: Synthetic oligonucleotide
  Target: SCN9A; (-) strand; PAM type: YTN; PAM sequence: TTT
ttggttctttctcacacctt

SEQ ID NO: 74049 - DNA, 20 bp, Artificial Sequence
  Description of Artificial Sequence: Synthetic oligonucleotide
  Target: SCN9A; (-) strand; PAM type: YTN; PAM sequence: TTA
acatttttggttctttctca

SEQ ID NO: 74050 - DNA, 20 bp, Artificial Sequence
  Description of Artificial Sequence: Synthetic oligonucleotide
  Target: SCN9A; (-) strand; PAM type: YTN; PAM sequence: CTT
aacatttttggttctttctc

SEQ ID NO: 74051 - DNA, 20 bp, Artificial Sequence
  Description of Artificial Sequence: Synthetic oligonucleotide
  Target: SCN9A; (-) strand; PAM type: YTN; PAM sequence: TTG
ggagcaacacttaacatttt

SEQ ID NO: 74052 - DNA, 20 bp, Artificial Sequence
  Description of Artificial Sequence: Synthetic oligonucleotide
  Target: SCN9A; (-) strand; PAM type: YTN; PAM sequence: CTT
gggagcaacacttaacattt

SEQ ID NO: 74053 - DNA, 20 bp, Artificial Sequence
  Description of Artificial Sequence: Synthetic oligonucleotide
  Target: SCN9A; (-) strand; PAM type: YTN; PAM sequence: TTC
ttgggagcaacacttaacat

SEQ ID NO: 74054 - DNA, 20 bp, Artificial Sequence
  Description of Artificial Sequence: Synthetic oligonucleotide
  Target: SCN9A; (-) strand; PAM type: YTN; PAM sequence: TTT
cttgggagcaacacttaaca

SEQ ID NO: 74055 - DNA, 20 bp, Artificial Sequence
  Description of Artificial Sequence: Synthetic oligonucleotide
  Target: SCN9A; (-) strand; PAM type: YTN; PAM sequence: CTG
ccagcatatttcttgggagc

SEQ ID NO: 74056 - DNA, 20 bp, Artificial Sequence
  Description of Artificial Sequence: Synthetic oligonucleotide
  Target: SCN9A; (-) strand; PAM type: YTN; PAM sequence: TTC
tgccagcatatttcttggga

SEQ ID NO: 74057 - DNA, 20 bp, Artificial Sequence
  Description of Artificial Sequence: Synthetic oligonucleotide
  Target: SCN9A; (-) strand; PAM type: YTN; PAM sequence: TTT
ctgccagcatatttcttggg

SEQ ID NO: 74058 - DNA, 20 bp, Artificial Sequence
  Description of Artificial Sequence: Synthetic oligonucleotide
  Target: SCN9A; (-) strand; PAM type: YTN; PAM sequence: TTT
tctgccagcatatttcttgg

SEQ ID NO: 74059 - DNA, 20 bp, Artificial Sequence
  Description of Artificial Sequence: Synthetic oligonucleotide
  Target: SCN9A; (-) strand; PAM type: YTN; PAM sequence: TTT
ttctgccagcatatttcttg

SEQ ID NO: 74060 - DNA, 20 bp, Artificial Sequence
  Description of Artificial Sequence: Synthetic oligonucleotide
  Target: SCN9A; (-) strand; PAM type: YTN; PAM sequence: TTT
tttctgccagcatatttctt

SEQ ID NO: 74061 - DNA, 20 bp, Artificial Sequence
  Description of Artificial Sequence: Synthetic oligonucleotide
  Target: SCN9A; (-) strand; PAM type: YTN; PAM sequence: TTG
ataatgattttttctgccag

SEQ ID NO: 74062 - DNA, 20 bp, Artificial Sequence
  Description of Artificial Sequence: Synthetic oligonucleotide
  Target: SCN9A; (-) strand; PAM type: YTN; PAM sequence: TTG
ggagttgataatgatttttt

SEQ ID NO: 74063 - DNA, 20 bp, Artificial Sequence
  Description of Artificial Sequence: Synthetic oligonucleotide
  Target: SCN9A; (-) strand; PAM type: YTN; PAM sequence: CTT
gggagttgataatgattttt

SEQ ID NO: 74064 - DNA, 20 bp, Artificial Sequence
  Description of Artificial Sequence: Synthetic oligonucleotide
  Target: SCN9A; (-) strand; PAM type: YTN; PAM sequence: TTA
ccatcttgggagttgataat

SEQ ID NO: 74065 - DNA, 20 bp, Artificial Sequence
  Description of Artificial Sequence: Synthetic oligonucleotide
  Target: SCN9A; (-) strand; PAM type: YTN; PAM sequence: CTA
taaaaggttaccatcttggg

SEQ ID NO: 74066 - DNA, 20 bp, Artificial Sequence
  Description of Artificial Sequence: Synthetic oligonucleotide
  Target: SCN9A; (-) strand; PAM type: YTN; PAM sequence: TTC
tataaaaggttaccatcttg

SEQ ID NO: 74067 - DNA, 20 bp, Artificial Sequence
  Description of Artificial Sequence: Synthetic oligonucleotide
  Target: SCN9A; (-) strand; PAM type: YTN; PAM sequence: TTT
ctataaaaggttaccatctt

SEQ ID NO: 74068 - DNA, 20 bp, Artificial Sequence
  Description of Artificial Sequence: Synthetic oligonucleotide
  Target: SCN9A; (-) strand; PAM type: YTN; PAM sequence: CTA
tttctataaaaggttaccat

SEQ ID NO: 74069 - DNA, 20 bp, Artificial Sequence
  Description of Artificial Sequence: Synthetic oligonucleotide
  Target: SCN9A; (-) strand; PAM type: YTN; PAM sequence: CTA
caaataacaatactatttct

SEQ ID NO: 74070 - DNA, 20 bp, Artificial Sequence
  Description of Artificial Sequence: Synthetic oligonucleotide
  Target: SCN9A; (-) strand; PAM type: YTN; PAM sequence: TTG
aggtctacaaataacaatac

SEQ ID NO: 74071 - DNA, 20 bp, Artificial Sequence
  Description of Artificial Sequence: Synthetic oligonucleotide
  Target: SCN9A; (-) strand; PAM type: YTN; PAM sequence: CTG
ttgaggtctacaaataacaa

SEQ ID NO: 74072 - DNA, 20 bp, Artificial Sequence
  Description of Artificial Sequence: Synthetic oligonucleotide
  Target: SCN9A; (-) strand; PAM type: YTN; PAM sequence: TTG
tgcagtactgttgaggtcta

SEQ ID NO: 74073 - DNA, 20 bp, Artificial Sequence
  Description of Artificial Sequence: Synthetic oligonucleotide
  Target: SCN9A; (-) strand; PAM type: YTN; PAM sequence: TTA
aaataattgtgcagtactgt

SEQ ID NO: 74074 - DNA, 20 bp, Artificial Sequence
  Description of Artificial Sequence: Synthetic oligonucleotide
  Target: SCN9A; (-) strand; PAM type: YTN; PAM sequence: TTT
aaaataattgtgcagtactg

SEQ ID NO: 74075 - DNA, 20 bp, Artificial Sequence
  Description of Artificial Sequence: Synthetic oligonucleotide
  Target: SCN9A; (-) strand; PAM type: YTN; PAM sequence: TTT
taaaataattgtgcagtact

SEQ ID NO: 74076 - DNA, 20 bp, Artificial Sequence
  Description of Artificial Sequence: Synthetic oligonucleotide
  Target: SCN9A; (-) strand; PAM type: YTN; PAM sequence: CTT
ttaaaataattgtgcagtac

SEQ ID NO: 74077 - DNA, 20 bp, Artificial Sequence
  Description of Artificial Sequence: Synthetic oligonucleotide
  Target: SCN9A; (-) strand; PAM type: YTN; PAM sequence: TTA
tgtcttttaaaataattgtg

SEQ ID NO: 74078 - DNA, 20 bp, Artificial Sequence
  Description of Artificial Sequence: Synthetic oligonucleotide
  Target: SCN9A; (-) strand; PAM type: YTN; PAM sequence: CTG
gttatgtcttttaaaataat

SEQ ID NO: 74079 - DNA, 20 bp, Artificial Sequence
  Description of Artificial Sequence: Synthetic oligonucleotide
  Target: SCN9A; (-) strand; PAM type: YTN; PAM sequence: TTC
tggttatgtcttttaaaata

SEQ ID NO: 74080 - DNA, 20 bp, Artificial Sequence
  Description of Artificial Sequence: Synthetic oligonucleotide
  Target: SCN9A; (-) strand; PAM type: YTN; PAM sequence: TTT
ctggttatgtcttttaaaat

SEQ ID NO: 74081 - DNA, 20 bp, Artificial Sequence
  Description of Artificial Sequence: Synthetic oligonucleotide
  Target: SCN9A; (-) strand; PAM type: YTN; PAM sequence: TTC
catatgaatggatgtgtaga

SEQ ID NO: 74082 - DNA, 20 bp, Artificial Sequence
  Description of Artificial Sequence: Synthetic oligonucleotide
  Target: SCN9A; (-) strand; PAM type: YTN; PAM sequence: TTT
ccatatgaatggatgtgtag

SEQ ID NO: 74083 - DNA, 20 bp, Artificial Sequence
  Description of Artificial Sequence: Synthetic oligonucleotide
  Target: SCN9A; (-) strand; PAM type: YTN; PAM sequence: CTT
tccatatgaatggatgtgta

SEQ ID NO: 74084 - DNA, 20 bp, Artificial Sequence
  Description of Artificial Sequence: Synthetic oligonucleotide
  Target: SCN9A; (-) strand; PAM type: YTN; PAM sequence: TTA
tgcatatccagaactttcca

SEQ ID NO: 74085 - DNA, 20 bp, Artificial Sequence
  Description of Artificial Sequence: Synthetic oligonucleotide
  Target: SCN9A; (-) strand; PAM type: YTN; PAM sequence: CTC
agaattatgcatatccagaa

SEQ ID NO: 74086 - DNA, 20 bp, Artificial Sequence
  Description of Artificial Sequence: Synthetic oligonucleotide
  Target: SCN9A; (-) strand; PAM type: YTN; PAM sequence: CTG
cagcctcagaattatgcata

SEQ ID NO: 74087 - DNA, 20 bp, Artificial Sequence
  Description of Artificial Sequence: Synthetic oligonucleotide
  Target: SCN9A; (-) strand; PAM type: YTN; PAM sequence: TTA
tgtcagatgaatctgcagcc

SEQ ID NO: 74088 - DNA, 20 bp, Artificial Sequence
  Description of Artificial Sequence: Synthetic oligonucleotide
  Target: SCN9A; (-) strand; PAM type: YTN; PAM sequence: TTT
atgtcagatgaatctgcagc

SEQ ID NO: 74089 - DNA, 20 bp, Artificial Sequence
  Description of Artificial Sequence: Synthetic oligonucleotide
  Target: SCN9A; (-) strand; PAM type: YTN; PAM sequence: TTT
tatgtcagatgaatctgcag

SEQ ID NO: 74090 - DNA, 20 bp, Artificial Sequence
  Description of Artificial Sequence: Synthetic oligonucleotide
  Target: SCN9A; (-) strand; PAM type: YTN; PAM sequence: TTT
ttatgtcagatgaatctgca

SEQ ID NO: 74091 - DNA, 20 bp, Artificial Sequence
  Description of Artificial Sequence: Synthetic oligonucleotide
  Target: SCN9A; (-) strand; PAM type: YTN; PAM sequence: TTT
tttatgtcagatgaatctgc

SEQ ID NO: 74092 - DNA, 20 bp, Artificial Sequence
  Description of Artificial Sequence: Synthetic oligonucleotide
  Target: SCN9A; (-) strand; PAM type: YTN; PAM sequence: TTC
atattttttatgtcagatga

SEQ ID NO: 74093 - DNA, 20 bp, Artificial Sequence
  Description of Artificial Sequence: Synthetic oligonucleotide
  Target: SCN9A; (-) strand; PAM type: YTN; PAM sequence: TTT
catattttttatgtcagatg

SEQ ID NO: 74094 - DNA, 20 bp, Artificial Sequence
  Description of Artificial Sequence: Synthetic oligonucleotide
  Target: SCN9A; (-) strand; PAM type: YTN; PAM sequence: TTG
tcatttcatattttttatgt

SEQ ID NO: 74095 - DNA, 20 bp, Artificial Sequence
  Description of Artificial Sequence: Synthetic oligonucleotide
  Target: SCN9A; (-) strand; PAM type: YTN; PAM sequence: TTG
tcatcattgtcatttcatat

SEQ ID NO: 74096 - DNA, 20 bp, Artificial Sequence
  Description of Artificial Sequence: Synthetic oligonucleotide
  Target: SCN9A; (-) strand; PAM type: YTN; PAM sequence: TTA
gttgtcatcattgtcatttc

SEQ ID NO: 74097 - DNA, 20 bp, Artificial Sequence
  Description of Artificial Sequence: Synthetic oligonucleotide
  Target: SCN9A; (-) strand; PAM type: YTN; PAM sequence: TTT
agttgtcatcattgtcattt

SEQ ID NO: 74098 - DNA, 20 bp, Artificial Sequence
  Description of Artificial Sequence: Synthetic oligonucleotide
  Target: SCN9A; (-) strand; PAM type: YTN; PAM sequence: TTT
tagttgtcatcattgtcatt

SEQ ID NO: 74099 - DNA, 20 bp, Artificial Sequence
  Description of Artificial Sequence: Synthetic oligonucleotide
  Target: SCN9A; (-) strand; PAM type: YTN; PAM sequence: TTT
ttagttgtcatcattgtcat

SEQ ID NO: 74100 - DNA, 20 bp, Artificial Sequence
  Description of Artificial Sequence: Synthetic oligonucleotide
  Target: SCN9A; (-) strand; PAM type: YTN; PAM sequence: CTT
tttagttgtcatcattgtca

SEQ ID NO: 74101 - DNA, 20 bp, Artificial Sequence
  Description of Artificial Sequence: Synthetic oligonucleotide
  Target: SCN9A; (-) strand; PAM type: YTN; PAM sequence: CTC
tttttagttgtcatcattgt

SEQ ID NO: 74102 - DNA, 20 bp, Artificial Sequence
  Description of Artificial Sequence: Synthetic oligonucleotide
  Target: SCN9A; (-) strand; PAM type: YTN; PAM sequence: TTC
tctttttagttgtcatcatt

SEQ ID NO: 74103 - DNA, 20 bp, Artificial Sequence
  Description of Artificial Sequence: Synthetic oligonucleotide
  Target: SCN9A; (-) strand; PAM type: YTN; PAM sequence: TTT
ctctttttagttgtcatcat

SEQ ID NO: 74104 - DNA, 20 bp, Artificial Sequence
  Description of Artificial Sequence: Synthetic oligonucleotide
  Target: SCN9A; (-) strand; PAM type: YTN; PAM sequence: CTC
atagtttctctttttagttg

SEQ ID NO: 74105 - DNA, 20 bp, Artificial Sequence
  Description of Artificial Sequence: Synthetic oligonucleotide
  Target: SCN9A; (-) strand; PAM type: YTN; PAM sequence: TTA
tgtactcatagtttctcttt

SEQ ID NO: 74106 - DNA, 20 bp, Artificial Sequence
  Description of Artificial Sequence: Synthetic oligonucleotide
  Target: SCN9A; (-) strand; PAM type: YTN; PAM sequence: TTG
tgtgttatgtactcatagtt

SEQ ID NO: 74107 - DNA, 20 bp, Artificial Sequence
  Description of Artificial Sequence: Synthetic oligonucleotide
  Target: SCN9A; (-) strand; PAM type: YTN; PAM sequence: TTA
ttgtgtgttatgtactcata

SEQ ID NO: 74108 - DNA, 20 bp, Artificial Sequence
  Description of Artificial Sequence: Synthetic oligonucleotide
  Target: SCN9A; (-) strand; PAM type: YTN; PAM sequence: CTT
attgtgtgttatgtactcat

SEQ ID NO: 74109 - DNA, 20 bp, Artificial Sequence
  Description of Artificial Sequence: Synthetic oligonucleotide
  Target: SCN9A; (-) strand; PAM type: YTN; PAM sequence: CTC
ttattgtgtgttatgtactc

SEQ ID NO: 74110 - DNA, 20 bp, Artificial Sequence
  Description of Artificial Sequence: Synthetic oligonucleotide
  Target: SCN9A; (-) strand; PAM type: YTN; PAM sequence: TTG
gtaagtctcttattgtgtgt

SEQ ID NO: 74111 - DNA, 20 bp, Artificial Sequence
  Description of Artificial Sequence: Synthetic oligonucleotide
  Target: SCN9A; (-) strand; PAM type: YTN; PAM sequence: TTT
ggtaagtctcttattgtgtg

SEQ ID NO: 74112 - DNA, 20 bp, Artificial Sequence
  Description of Artificial Sequence: Synthetic oligonucleotide
  Target: SCN9A; (-) strand; PAM type: YTN; PAM sequence: CTA
taggaaatttggtaagtctc

SEQ ID NO: 74113 - DNA, 20 bp, Artificial Sequence
  Description of Artificial Sequence: Synthetic oligonucleotide
  Target: SCN9A; (-) strand; PAM type: YTN; PAM sequence: TTG
ctataggaaatttggtaagt

SEQ ID NO: 74114 - DNA, 20 bp, Artificial Sequence
  Description of Artificial Sequence: Synthetic oligonucleotide
  Target: SCN9A; (-) strand; PAM type: YTN; PAM sequence: CTT
gctataggaaatttggtaag

SEQ ID NO: 74115 - DNA, 20 bp, Artificial Sequence
  Description of Artificial Sequence: Synthetic oligonucleotide
  Target: SCN9A; (-) strand; PAM type: YTN; PAM sequence: TTC
aaaaatgtacttgctatagg

SEQ ID NO: 74116 - DNA, 20 bp, Artificial Sequence
  Description of Artificial Sequence: Synthetic oligonucleotide
  Target: SCN9A; (-) strand; PAM type: YTN; PAM sequence: CTG
aggaattcaaaaatgtactt

SEQ ID NO: 74117 - DNA, 20 bp, Artificial Sequence
  Description of Artificial Sequence: Synthetic oligonucleotide
  Target: SCN9A; (-) strand; PAM type: YTN; PAM sequence: CTA
tggaacaccacccaatgact

SEQ ID NO: 74118 - DNA, 20 bp, Artificial Sequence
  Description of Artificial Sequence: Synthetic oligonucleotide
  Target: SCN9A; (-) strand; PAM type: YTN; PAM sequence: TTA
tggctatggaacaccaccca

SEQ ID NO: 74119 - DNA, 20 bp, Artificial Sequence
  Description of Artificial Sequence: Synthetic oligonucleotide
  Target: SCN9A; (-) strand; PAM type: YTN; PAM sequence: TTT
atggctatggaacaccaccc

SEQ ID NO: 74120 - DNA, 20 bp, Artificial Sequence
  Description of Artificial Sequence: Synthetic oligonucleotide
  Target: SCN9A; (-) strand; PAM type: YTN; PAM sequence: TTA
tttatggctatggaacacca

SEQ ID NO: 74121 - DNA, 20 bp, Artificial Sequence
  Description of Artificial Sequence: Synthetic oligonucleotide
  Target: SCN9A; (-) strand; PAM type: YTN; PAM sequence: TTA
aacacattatttatggctat

SEQ ID NO: 74122 - DNA, 20 bp, Artificial Sequence
  Description of Artificial Sequence: Synthetic oligonucleotide
  Target: SCN9A; (-) strand; PAM type: YTN; PAM sequence: TTT
aaacacattatttatggcta

SEQ ID NO: 74123 - DNA, 20 bp, Artificial Sequence
  Description of Artificial Sequence: Synthetic oligonucleotide
  Target: SCN9A; (-) strand; PAM type: YTN; PAM sequence: TTT
taaacacattatttatggct

SEQ ID NO: 74124 - DNA, 20 bp, Artificial Sequence
  Description of Artificial Sequence: Synthetic oligonucleotide
  Target: SCN9A; (-) strand; PAM type: YTN; PAM sequence: TTG
catagttttaaacacattat

SEQ ID NO: 74125 - DNA, 20 bp, Artificial Sequence
  Description of Artificial Sequence: Synthetic oligonucleotide
  Target: SCN9A; (-) strand; PAM type: YTN; PAM sequence: TTT
gcatagttttaaacacatta

SEQ ID NO: 74126 - DNA, 20 bp, Artificial Sequence
  Description of Artificial Sequence: Synthetic oligonucleotide
  Target: SCN9A; (-) strand; PAM type: YTN; PAM sequence: TTA
ccatttgcatagttttaaac

SEQ ID NO: 74127 - DNA, 20 bp, Artificial Sequence
  Description of Artificial Sequence: Synthetic oligonucleotide
  Target: SCN9A; (-) strand; PAM type: YTN; PAM sequence: TTG
caattaccatttgcatagtt

SEQ ID NO: 74128 - DNA, 20 bp, Artificial Sequence
  Description of Artificial Sequence: Synthetic oligonucleotide
  Target: SCN9A; (-) strand; PAM type: YTN; PAM sequence: CTT
gcaattaccatttgcatagt

SEQ ID NO: 74129 - DNA, 20 bp, Artificial Sequence
  Description of Artificial Sequence: Synthetic oligonucleotide
  Target: SCN9A; (-) strand; PAM type: YTN; PAM sequence: TTG
tagatcttgcaattaccatt

SEQ ID NO: 74130 - DNA, 20 bp, Artificial Sequence
  Description of Artificial Sequence: Synthetic oligonucleotide
  Target: SCN9A; (-) strand; PAM type: YTN; PAM sequence: TTT
gtagatcttgcaattaccat

SEQ ID NO: 74131 - DNA, 20 bp, Artificial Sequence
  Description of Artificial Sequence: Synthetic oligonucleotide
  Target: SCN9A; (-) strand; PAM type: YTN; PAM sequence: TTT
tgtagatcttgcaattacca

SEQ ID NO: 74132 - DNA, 20 bp, Artificial Sequence
  Description of Artificial Sequence: Synthetic oligonucleotide
  Target: SCN9A; (-) strand; PAM type: YTN; PAM sequence: CTT
ttgtagatcttgcaattacc

SEQ ID NO: 74133 - DNA, 20 bp, Artificial Sequence
  Description of Artificial Sequence: Synthetic oligonucleotide
  Target: SCN9A; (-) strand; PAM type: YTN; PAM sequence: TTG
taatggatccttttgtagat

SEQ ID NO: 74134 - DNA, 20 bp, Artificial Sequence
  Description of Artificial Sequence: Synthetic oligonucleotide
  Target: SCN9A; (-) strand; PAM type: YTN; PAM sequence: TTA
ttgtaatggatccttttgta

SEQ ID NO: 74135 - DNA, 20 bp, Artificial Sequence
  Description of Artificial Sequence: Synthetic oligonucleotide
  Target: SCN9A; (-) strand; PAM type: YTN; PAM sequence: TTT
attgtaatggatccttttgt

SEQ ID NO: 74136 - DNA, 20 bp, Artificial Sequence
  Description of Artificial Sequence: Synthetic oligonucleotide
  Target: SCN9A; (-) strand; PAM type: YTN; PAM sequence: TTT
tattgtaatggatccttttg

SEQ ID NO: 74137 - DNA, 20 bp, Artificial Sequence
  Description of Artificial Sequence: Synthetic oligonucleotide
  Target: SCN9A; (-) strand; PAM type: YTN; PAM sequence: CTA
ttttattgtaatggatcctt

SEQ ID NO: 74138 - DNA, 20 bp, Artificial Sequence
  Description of Artificial Sequence: Synthetic oligonucleotide
  Target: SCN9A; (-) strand; PAM type: YTN; PAM sequence: TTC
aaaaagtgtatctattttat

SEQ ID NO: 74139 - DNA, 20 bp, Artificial Sequence
  Description of Artificial Sequence: Synthetic oligonucleotide
  Target: SCN9A; (-) strand; PAM type: YTN; PAM sequence: TTG
gataaaattcaaaaagtgta

SEQ ID NO: 74140 - DNA, 20 bp, Artificial Sequence
  Description of Artificial Sequence: Synthetic oligonucleotide
  Target: SCN9A; (-) strand; PAM type: YTN; PAM sequence: CTC
catattggataaaattcaaa

SEQ ID NO: 74141 - DNA, 20 bp, Artificial Sequence
  Description of Artificial Sequence: Synthetic oligonucleotide
  Target: SCN9A; (-) strand; PAM type: YTN; PAM sequence: CTC
tccatattggataaaattca

SEQ ID NO: 74142 - DNA, 20 bp, Artificial Sequence
  Description of Artificial Sequence: Synthetic oligonucleotide
  Target: SCN9A; (-) strand; PAM type: YTN; PAM sequence: TTG
ctctccatattggataaaat

SEQ ID NO: 74143 - DNA, 20 bp, Artificial Sequence
  Description of Artificial Sequence: Synthetic oligonucleotide
  Target: SCN9A; (-) strand; PAM type: YTN; PAM sequence: CTG
gaattgctctccatattgga

SEQ ID NO: 74144 - DNA, 20 bp, Artificial Sequence
  Description of Artificial Sequence: Synthetic oligonucleotide
  Target: SCN9A; (-) strand; PAM type: YTN; PAM sequence: TTG
atctggaattgctctccata

SEQ ID NO: 74145 - DNA, 20 bp, Artificial Sequence
  Description of Artificial Sequence: Synthetic oligonucleotide
  Target: SCN9A; (-) strand; PAM type: YTN; PAM sequence: CTT
gatctggaattgctctccat

SEQ ID NO: 74146 - DNA, 20 bp, Artificial Sequence
  Description of Artificial Sequence: Synthetic oligonucleotide
  Target: SCN9A; (-) strand; PAM type: YTN; PAM sequence: TTC
ttgatctggaattgctctcc

SEQ ID NO: 74147 - DNA, 20 bp, Artificial Sequence
  Description of Artificial Sequence: Synthetic oligonucleotide
  Target: SCN9A; (-) strand; PAM type: YTN; PAM sequence: TTG
cacacaaattcttgatctgg

SEQ ID NO: 74148 - DNA, 20 bp, Artificial Sequence
  Description of Artificial Sequence: Synthetic oligonucleotide
  Target: SCN9A; (-) strand; PAM type: YTN; PAM sequence: TTT
gcacacaaattcttgatctg

SEQ ID NO: 74149 - DNA, 20 bp, Artificial Sequence
  Description of Artificial Sequence: Synthetic oligonucleotide
  Target: SCN9A; (-) strand; PAM type: YTN; PAM sequence: TTG
gtggtacagatttgcacaca

SEQ ID NO: 74150 - DNA, 20 bp, Artificial Sequence
  Description of Artificial Sequence: Synthetic oligonucleotide
  Target: SCN9A; (-) strand; PAM type: YTN; PAM sequence: CTT
ggtggtacagatttgcacac

SEQ ID NO: 74151 - DNA, 20 bp, Artificial Sequence
  Description of Artificial Sequence: Synthetic oligonucleotide
  Target: SCN9A; (-) strand; PAM type: YTN; PAM sequence: TTG
aagagtccagacaaaaatgt

SEQ ID NO: 74152 - DNA, 20 bp, Artificial Sequence
  Description of Artificial Sequence: Synthetic oligonucleotide
  Target: SCN9A; (-) strand; PAM type: YTN; PAM sequence: CTT
gaagagtccagacaaaaatg

SEQ ID NO: 74153 - DNA, 20 bp, Artificial Sequence
  Description of Artificial Sequence: Synthetic oligonucleotide
  Target: SCN9A; (-) strand; PAM type: YTN; PAM sequence: CTC
ccagaacttgaagagtccag

SEQ ID NO: 74154 - DNA, 20 bp, Artificial Sequence
  Description of Artificial Sequence: Synthetic oligonucleotide
  Target: SCN9A; (-) strand; PAM type: YTN; PAM sequence: TTC
tcccagaacttgaagagtcc

SEQ ID NO: 74155 - DNA, 20 bp, Artificial Sequence
  Description of Artificial Sequence: Synthetic oligonucleotide
  Target: SCN9A; (-) strand; PAM type: YTN; PAM sequence: TTT
ctcccagaacttgaagagtc

SEQ ID NO: 74156 - DNA, 20 bp, Artificial Sequence
  Description of Artificial Sequence: Synthetic oligonucleotide
  Target: SCN9A; (-) strand; PAM type: YTN; PAM sequence: TTT
tctcccagaacttgaagagt

SEQ ID NO: 74157 - DNA, 20 bp, Artificial Sequence
  Description of Artificial Sequence: Synthetic oligonucleotide
  Target: SCN9A; (-) strand; PAM type: YTN; PAM sequence: TTT
ttctcccagaacttgaagag

SEQ ID NO: 74158 - DNA, 20 bp, Artificial Sequence
  Description of Artificial Sequence: Synthetic oligonucleotide
  Target: SCN9A; (-) strand; PAM type: YTN; PAM sequence: TTT
tttctcccagaacttgaaga

SEQ ID NO: 74159 - DNA, 20 bp, Artificial Sequence
  Description of Artificial Sequence: Synthetic oligonucleotide
  Target: SCN9A; (-) strand; PAM type: YTN; PAM sequence: CTT
ttttctcccagaacttgaag

SEQ ID NO: 74160 - DNA, 20 bp, Artificial Sequence
  Description of Artificial Sequence: Synthetic oligonucleotide
  Target: SCN9A; (-) strand; PAM type: YTN; PAM sequence: CTG
cttttttctcccagaacttg

SEQ ID NO: 74161 - DNA, 20 bp, Artificial Sequence
  Description of Artificial Sequence: Synthetic oligonucleotide
  Target: SCN9A; (-) strand; PAM type: YTN; PAM sequence: CTC
tgcttttttctcccagaact

SEQ ID NO: 74162 - DNA, 20 bp, Artificial Sequence
  Description of Artificial Sequence: Synthetic oligonucleotide
  Target: SCN9A; (-) strand; PAM type: YTN; PAM sequence: TTC
tctgcttttttctcccagaa

SEQ ID NO: 74163 - DNA, 20 bp, Artificial Sequence
  Description of Artificial Sequence: Synthetic oligonucleotide
  Target: SCN9A; (-) strand; PAM type: YTN; PAM sequence: CTC
catgttctctgcttttttct

SEQ ID NO: 74164 - DNA, 20 bp, Artificial Sequence
  Description of Artificial Sequence: Synthetic oligonucleotide
  Target: SCN9A; (-) strand; PAM type: YTN; PAM sequence: CTG
actccatgttctctgctttt

SEQ ID NO: 74165 - DNA, 20 bp, Artificial Sequence
  Description of Artificial Sequence: Synthetic oligonucleotide
  Target: SCN9A; (-) strand; PAM type: YTN; PAM sequence: TTA
ggagtgaaacagacaaatgg

SEQ ID NO: 74166 - DNA, 20 bp, Artificial Sequence
  Description of Artificial Sequence: Synthetic oligonucleotide
  Target: SCN9A; (-) strand; PAM type: YTN; PAM sequence: CTG
gttaggagtgaaacagacaa

SEQ ID NO: 74167 - DNA, 20 bp, Artificial Sequence
  Description of Artificial Sequence: Synthetic oligonucleotide
  Target: SCN9A; (-) strand; PAM type: YTN; PAM sequence: TTG
tatctggttaggagtgaaac

SEQ ID NO: 74168 - DNA, 20 bp, Artificial Sequence
  Description of Artificial Sequence: Synthetic oligonucleotide
  Target: SCN9A; (-) strand; PAM type: YTN; PAM sequence: TTT
gtatctggttaggagtgaaa

SEQ ID NO: 74169 - DNA, 20 bp, Artificial Sequence
  Description of Artificial Sequence: Synthetic oligonucleotide
  Target: SCN9A; (-) strand; PAM type: YTN; PAM sequence: CTG
atttgtatctggttaggagt

SEQ ID NO: 74170 - DNA, 20 bp, Artificial Sequence
  Description of Artificial Sequence: Synthetic oligonucleotide
  Target: SCN9A; (-) strand; PAM type: YTN; PAM sequence: CTG
actgatttgtatctggttag

SEQ ID NO: 74171 - DNA, 20 bp, Artificial Sequence
  Description of Artificial Sequence: Synthetic oligonucleotide
  Target: SCN9A; (-) strand; PAM type: YTN; PAM sequence: TTA
gaatgcctgactgatttgta

SEQ ID NO: 74172 - DNA, 20 bp, Artificial Sequence
  Description of Artificial Sequence: Synthetic oligonucleotide
  Target: SCN9A; (-) strand; PAM type: YTN; PAM sequence: TTC
aatattagaatgcctgactg

SEQ ID NO: 74173 - DNA, 20 bp, Artificial Sequence
  Description of Artificial Sequence: Synthetic oligonucleotide
  Target: SCN9A; (-) strand; PAM type: YTN; PAM sequence: TTT
caatattagaatgcctgact

SEQ ID NO: 74174 - DNA, 20 bp, Artificial Sequence
  Description of Artificial Sequence: Synthetic oligonucleotide
  Target: SCN9A; (-) strand; PAM type: YTN; PAM sequence: TTG
tttcaatattagaatgcctg

SEQ ID NO: 74175 - DNA, 20 bp, Artificial Sequence
  Description of Artificial Sequence: Synthetic oligonucleotide
  Target: SCN9A; (-) strand; PAM type: YTN; PAM sequence: CTT
gtttcaatattagaatgcct

SEQ ID NO: 74176 - DNA, 20 bp, Artificial Sequence
  Description of Artificial Sequence: Synthetic oligonucleotide
  Target: SCN9A; (-) strand; PAM type: YTN; PAM sequence: CTA
taaaccttgtttcaatatta

SEQ ID NO: 74177 - DNA, 20 bp, Artificial Sequence
  Description of Artificial Sequence: Synthetic oligonucleotide
  Target: SCN9A; (-) strand; PAM type: YTN; PAM sequence: CTA
aactataaaccttgtttcaa

SEQ ID NO: 74178 - DNA, 20 bp, Artificial Sequence
  Description of Artificial Sequence: Synthetic oligonucleotide
  Target: SCN9A; (-) strand; PAM type: YTN; PAM sequence: TTC
aaaatctaaactataaacct

SEQ ID NO: 74179 - DNA, 20 bp, Artificial Sequence
  Description of Artificial Sequence: Synthetic oligonucleotide
  Target: SCN9A; (-) strand; PAM type: YTN; PAM sequence: TTT
caaaatctaaactataaacc

SEQ ID NO: 74180 - DNA, 20 bp, Artificial Sequence
  Description of Artificial Sequence: Synthetic oligonucleotide
  Target: SCN9A; (-) strand; PAM type: YTN; PAM sequence: TTT
tcaaaatctaaactataaac

SEQ ID NO: 74181 - DNA, 20 bp, Artificial Sequence
  Description of Artificial Sequence: Synthetic oligonucleotide
  Target: SCN9A; (-) strand; PAM type: YTN; PAM sequence: TTA
aattttcaaaatctaaacta

SEQ ID NO: 74182 - DNA, 20 bp, Artificial Sequence
  Description of Artificial Sequence: Synthetic oligonucleotide
  Target: SCN9A; (-) strand; PAM type: YTN; PAM sequence: CTG
ttaaattttcaaaatctaaa

SEQ ID NO: 74183 - DNA, 20 bp, Artificial Sequence
  Description of Artificial Sequence: Synthetic oligonucleotide
  Target: SCN9A; (-) strand; PAM type: YTN; PAM sequence: TTG
aaatagtactgttaaatttt

SEQ ID NO: 74184 - DNA, 20 bp, Artificial Sequence
  Description of Artificial Sequence: Synthetic oligonucleotide
  Target: SCN9A; (-) strand; PAM type: YTN; PAM sequence: TTC
attgaaatagtactgttaaa

SEQ ID NO: 74185 - DNA, 20 bp, Artificial Sequence
  Description of Artificial Sequence: Synthetic oligonucleotide
  Target: SCN9A; (-) strand; PAM type: YTN; PAM sequence: TTT
cattgaaatagtactgttaa

SEQ ID NO: 74186 - DNA, 20 bp, Artificial Sequence
  Description of Artificial Sequence: Synthetic oligonucleotide
  Target: SCN9A; (-) strand; PAM type: YTN; PAM sequence: CTT
tcattgaaatagtactgtta

SEQ ID NO: 74187 - DNA, 20 bp, Artificial Sequence
  Description of Artificial Sequence: Synthetic oligonucleotide
  Target: SCN9A; (-) strand; PAM type: YTN; PAM sequence: CTA
tgctttcattgaaatagtac

SEQ ID NO: 74188 - DNA, 20 bp, Artificial Sequence
  Description of Artificial Sequence: Synthetic oligonucleotide
  Target: SCN9A; (-) strand; PAM type: YTN; PAM sequence: TTA
cataagaggctatgctttca

SEQ ID NO: 74189 - DNA, 20 bp, Artificial Sequence
  Description of Artificial Sequence: Synthetic oligonucleotide
  Target: SCN9A; (-) strand; PAM type: YTN; PAM sequence: CTT
acataagaggctatgctttc

SEQ ID NO: 74190 - DNA, 20 bp, Artificial Sequence
  Description of Artificial Sequence: Synthetic oligonucleotide
  Target: SCN9A; (-) strand; PAM type: YTN; PAM sequence: CTA
ggcaacgaacatgtcataat

SEQ ID NO: 74191 - DNA, 20 bp, Artificial Sequence
  Description of Artificial Sequence: Synthetic oligonucleotide
  Target: SCN9A; (-) strand; PAM type: YTN; PAM sequence: TTC
atctaggcaacgaacatgtc

SEQ ID NO: 74192 - DNA, 20 bp, Artificial Sequence
  Description of Artificial Sequence: Synthetic oligonucleotide
  Target: SCN9A; (-) strand; PAM type: YTN; PAM sequence: CTT
catctaggcaacgaacatgt

SEQ ID NO: 74193 - DNA, 20 bp, Artificial Sequence
  Description of Artificial Sequence: Synthetic oligonucleotide
  Target: SCN9A; (-) strand; PAM type: YTN; PAM sequence: TTA
tgcttcatctaggcaacgaa

SEQ ID NO: 74194 - DNA, 20 bp, Artificial Sequence
  Description of Artificial Sequence: Synthetic oligonucleotide
  Target: SCN9A; (-) strand; PAM type: YTN; PAM sequence: CTT
atgcttcatctaggcaacga

SEQ ID NO: 74195 - DNA, 20 bp, Artificial Sequence
  Description of Artificial Sequence: Synthetic oligonucleotide
  Target: SCN9A; (-) strand; PAM type: YTN; PAM sequence: CTC
ttatgcttcatctaggcaac

SEQ ID NO: 74196 - DNA, 20 bp, Artificial Sequence
  Description of Artificial Sequence: Synthetic oligonucleotide
  Target: SCN9A; (-) strand; PAM type: YTN; PAM sequence: CTC
tcttatgcttcatctaggca

SEQ ID NO: 74197 - DNA, 20 bp, Artificial Sequence
  Description of Artificial Sequence: Synthetic oligonucleotide
  Target: SCN9A; (-) strand; PAM type: YTN; PAM sequence: TTA
ccctctcttatgcttcatct

SEQ ID NO: 74198 - DNA, 20 bp, Artificial Sequence
  Description of Artificial Sequence: Synthetic oligonucleotide
  Target: SCN9A; (-) strand; PAM type: YTN; PAM sequence: CTT
accctctcttatgcttcatc

SEQ ID NO: 74199 - DNA, 20 bp, Artificial Sequence
  Description of Artificial Sequence: Synthetic oligonucleotide
  Target: SCN9A; (-) strand; PAM type: YTN; PAM sequence: TTC
cttaccctctcttatgcttc

SEQ ID NO: 74200 - DNA, 20 bp, Artificial Sequence
  Description of Artificial Sequence: Synthetic oligonucleotide
  Target: SCN9A; (-) strand; PAM type: YTN; PAM sequence: CTT
ccttaccctctcttatgctt

SEQ ID NO: 74201 - DNA, 20 bp, Artificial Sequence
  Description of Artificial Sequence: Synthetic oligonucleotide
  Target: SCN9A; (-) strand; PAM type: YTN; PAM sequence: TTC
acttccttaccctctcttat

SEQ ID NO: 74202 - DNA, 20 bp, Artificial Sequence
  Description of Artificial Sequence: Synthetic oligonucleotide
  Target: SCN9A; (-) strand; PAM type: YTN; PAM sequence: TTT
cacttccttaccctctctta

SEQ ID NO: 74203 - DNA, 20 bp, Artificial Sequence
  Description of Artificial Sequence: Synthetic oligonucleotide
  Target: SCN9A; (-) strand; PAM type: YTN; PAM sequence: TTG
cagtcataaatttcacttcc

SEQ ID NO: 74204 - DNA, 20 bp, Artificial Sequence
  Description of Artificial Sequence: Synthetic oligonucleotide
  Target: SCN9A; (-) strand; PAM type: YTN; PAM sequence: CTT
gcagtcataaatttcacttc

SEQ ID NO: 74205 - DNA, 20 bp, Artificial Sequence
  Description of Artificial Sequence: Synthetic oligonucleotide
  Target: SCN9A; (-) strand; PAM type: YTN; PAM sequence: CTG
aaagatgcccacatatgtgc

SEQ ID NO: 74206 - DNA, 20 bp, Artificial Sequence
  Description of Artificial Sequence: Synthetic oligonucleotide
  Target: SCN9A; (-) strand; PAM type: YTN; PAM sequence: CTC
tgaaagatgcccacatatgt

SEQ ID NO: 74207 - DNA, 20 bp, Artificial Sequence
  Description of Artificial Sequence: Synthetic oligonucleotide
  Target: SCN9A; (-) strand; PAM type: YTN; PAM sequence: TTC
tctgaaagatgcccacatat

SEQ ID NO: 74208 - DNA, 20 bp, Artificial Sequence
  Description of Artificial Sequence: Synthetic oligonucleotide
  Target: SCN9A; (-) strand; PAM type: YTN; PAM sequence: TTT
ctctgaaagatgcccacata

SEQ ID NO: 74209 - DNA, 20 bp, Artificial Sequence
  Description of Artificial Sequence: Synthetic oligonucleotide
  Target: SCN9A; (-) strand; PAM type: YTN; PAM sequence: TTT
tctctgaaagatgcccacat

SEQ ID NO: 74210 - DNA, 20 bp, Artificial Sequence
  Description of Artificial Sequence: Synthetic oligonucleotide
  Target: SCN9A; (-) strand; PAM type: YTN; PAM sequence: TTT
ttctctgaaagatgcccaca

SEQ ID NO: 74211 - DNA, 20 bp, Artificial Sequence
  Description of Artificial Sequence: Synthetic oligonucleotide
  Target: SCN9A; (-) strand; PAM type: YTN; PAM sequence: TTA
ggtgcatttttctctgaaag

SEQ ID NO: 74212 - DNA, 20 bp, Artificial Sequence
  Description of Artificial Sequence: Synthetic oligonucleotide
  Target: SCN9A; (-) strand; PAM type: YTN; PAM sequence: TTA
ccatcacatgttaggtgcat

SEQ ID NO: 74213 - DNA, 20 bp, Artificial Sequence
  Description of Artificial Sequence: Synthetic oligonucleotide
  Target: SCN9A; (-) strand; PAM type: YTN; PAM sequence: TTT
accatcacatgttaggtgca

SEQ ID NO: 74214 - DNA, 20 bp, Artificial Sequence
  Description of Artificial Sequence: Synthetic oligonucleotide
  Target: SCN9A; (-) strand; PAM type: YTN; PAM sequence: CTG
tttaccatcacatgttaggt

SEQ ID NO: 74215 - DNA, 20 bp, Artificial Sequence
  Description of Artificial Sequence: Synthetic oligonucleotide
  Target: SCN9A; (-) strand; PAM type: YTN; PAM sequence: CTC
ctgtttaccatcacatgtta

SEQ ID NO: 74216 - DNA, 20 bp, Artificial Sequence
  Description of Artificial Sequence: Synthetic oligonucleotide
  Target: SCN9A; (-) strand; PAM type: YTN; PAM sequence: TTC
tcctgtttaccatcacatgt

SEQ ID NO: 74217 - DNA, 20 bp, Artificial Sequence
  Description of Artificial Sequence: Synthetic oligonucleotide
  Target: SCN9A; (-) strand; PAM type: YTN; PAM sequence: TTA
aggaaacatagttctcctgt

SEQ ID NO: 74218 - DNA, 20 bp, Artificial Sequence
  Description of Artificial Sequence: Synthetic oligonucleotide
  Target: SCN9A; (-) strand; PAM type: YTN; PAM sequence: CTG
ttaaggaaacatagttctcc

SEQ ID NO: 74219 - DNA, 20 bp, Artificial Sequence
  Description of Artificial Sequence: Synthetic oligonucleotide
  Target: SCN9A; (-) strand; PAM type: YTN; PAM sequence: CTC
tgttaaggaaacatagttct

SEQ ID NO: 74220 - DNA, 20 bp, Artificial Sequence
  Description of Artificial Sequence: Synthetic oligonucleotide
  Target: SCN9A; (-) strand; PAM type: YTN; PAM sequence: TTC
tctgttaaggaaacatagtt

SEQ ID NO: 74221 - DNA, 20 bp, Artificial Sequence
  Description of Artificial Sequence: Synthetic oligonucleotide
  Target: SCN9A; (-) strand; PAM type: YTN; PAM sequence: TTT
ctctgttaaggaaacatagt

SEQ ID NO: 74222 - DNA, 20 bp, Artificial Sequence
  Description of Artificial Sequence: Synthetic oligonucleotide
  Target: SCN9A; (-) strand; PAM type: YTN; PAM sequence: TTG
gtggaaaacatacatttctc

SEQ ID NO: 74223 - DNA, 20 bp, Artificial Sequence
  Description of Artificial Sequence: Synthetic oligonucleotide
  Target: SCN9A; (-) strand; PAM type: YTN; PAM sequence: CTA
aaaacacaggtgaaaaatat

SEQ ID NO: 74224 - DNA, 20 bp, Artificial Sequence
  Description of Artificial Sequence: Synthetic oligonucleotide
  Target: SCN9A; (-) strand; PAM type: YTN; PAM sequence: TTG
tcatgggactaaaaacacag

SEQ ID NO: 74225 - DNA, 20 bp, Artificial Sequence
  Description of Artificial Sequence: Synthetic oligonucleotide
  Target: SCN9A; (-) strand; PAM type: YTN; PAM sequence: TTG
ttgtcatgggactaaaaaca

SEQ ID NO: 74226 - DNA, 20 bp, Artificial Sequence
  Description of Artificial Sequence: Synthetic oligonucleotide
  Target: SCN9A; (-) strand; PAM type: YTN; PAM sequence: TTA
ttgttgtcatgggactaaaa

SEQ ID NO: 74227 - DNA, 20 bp, Artificial Sequence
  Description of Artificial Sequence: Synthetic oligonucleotide
  Target: SCN9A; (-) strand; PAM type: YTN; PAM sequence: CTT
attgttgtcatgggactaaa

SEQ ID NO: 74228 - DNA, 20 bp, Artificial Sequence
  Description of Artificial Sequence: Synthetic oligonucleotide
  Target: SCN9A; (-) strand; PAM type: YTN; PAM sequence: CTC
atcttattgttgtcatggga

SEQ ID NO: 74229 - DNA, 20 bp, Artificial Sequence
  Description of Artificial Sequence: Synthetic oligonucleotide
  Target: SCN9A; (-) strand; PAM type: YTN; PAM sequence: CTG
gacagaatagtctcatctta

SEQ ID NO: 74230 - DNA, 20 bp, Artificial Sequence
  Description of Artificial Sequence: Synthetic oligonucleotide
  Target: SCN9A; (-) strand; PAM type: YTN; PAM sequence: TTC
tggacagaatagtctcatct

SEQ ID NO: 74231 - DNA, 20 bp, Artificial Sequence
  Description of Artificial Sequence: Synthetic oligonucleotide
  Target: SCN9A; (-) strand; PAM type: YTN; PAM sequence: TTT
ctggacagaatagtctcatc

SEQ ID NO: 74232 - DNA, 20 bp, Artificial Sequence
  Description of Artificial Sequence: Synthetic oligonucleotide
  Target: SCN9A; (-) strand; PAM type: YTN; PAM sequence: TTT
tctggacagaatagtctcat

SEQ ID NO: 74233 - DNA, 20 bp, Artificial Sequence
  Description of Artificial Sequence: Synthetic oligonucleotide
  Target: SCN9A; (-) strand; PAM type: YTN; PAM sequence: TTT
ttctggacagaatagtctca

SEQ ID NO: 74234 - DNA, 20 bp, Artificial Sequence
  Description of Artificial Sequence: Synthetic oligonucleotide
  Target: SCN9A; (-) strand; PAM type: YTN; PAM sequence: TTT
tttctggacagaatagtctc

SEQ ID NO: 74235 - DNA, 20 bp, Artificial Sequence
  Description of Artificial Sequence: Synthetic oligonucleotide
  Target: SCN9A; (-) strand; PAM type: YTN; PAM sequence: TTA
cagcaagagttttttctgga

SEQ ID NO: 74236 - DNA, 20 bp, Artificial Sequence
  Description of Artificial Sequence: Synthetic oligonucleotide
  Target: SCN9A; (-) strand; PAM type: YTN; PAM sequence: CTA
ttacagcaagagttttttct

SEQ ID NO: 74237 - DNA, 20 bp, Artificial Sequence
  Description of Artificial Sequence: Synthetic oligonucleotide
  Target: SCN9A; (-) strand; PAM type: YTN; PAM sequence: CTG
tgaactattacagcaagagt

SEQ ID NO: 74238 - DNA, 20 bp, Artificial Sequence
  Description of Artificial Sequence: Synthetic oligonucleotide
  Target: SCN9A; (-) strand; PAM type: YTN; PAM sequence: TTC
acctgtgaactattacagca

SEQ ID NO: 74239 - DNA, 20 bp, Artificial Sequence
  Description of Artificial Sequence: Synthetic oligonucleotide
  Target: SCN9A; (-) strand; PAM type: YTN; PAM sequence: TTT
cacctgtgaactattacagc

SEQ ID NO: 74240 - DNA, 20 bp, Artificial Sequence
  Description of Artificial Sequence: Synthetic oligonucleotide
  Target: SCN9A; (-) strand; PAM type: YTN; PAM sequence: TTT
tcacctgtgaactattacag

SEQ ID NO: 74241 - DNA, 20 bp, Artificial Sequence
  Description of Artificial Sequence: Synthetic oligonucleotide
  Target: SCN9A; (-) strand; PAM type: YTN; PAM sequence: TTG
ttttcacctgtgaactatta

SEQ ID NO: 74242 - DNA, 20 bp, Artificial Sequence
  Description of Artificial Sequence: Synthetic oligonucleotide
  Target: SCN9A; (-) strand; PAM type: YTN; PAM sequence: CTA
ggattgttttcacctgtgaa

SEQ ID NO: 74243 - DNA, 20 bp, Artificial Sequence
  Description of Artificial Sequence: Synthetic oligonucleotide
  Target: SCN9A; (-) strand; PAM type: YTN; PAM sequence: TTC
taggattgttttcacctgtg

SEQ ID NO: 74244 - DNA, 20 bp, Artificial Sequence
  Description of Artificial Sequence: Synthetic oligonucleotide
  Target: SCN9A; (-) strand; PAM type: YTN; PAM sequence: TTG
gttctaggattgttttcacc

SEQ ID NO: 74245 - DNA, 20 bp, Artificial Sequence
  Description of Artificial Sequence: Synthetic oligonucleotide
  Target: SCN9A; (-) strand; PAM type: YTN; PAM sequence: CTT
ggttctaggattgttttcac

SEQ ID NO: 74246 - DNA, 20 bp, Artificial Sequence
  Description of Artificial Sequence: Synthetic oligonucleotide
  Target: SCN9A; (-) strand; PAM type: YTN; PAM sequence: TTG
cttggttctaggattgtttt

SEQ ID NO: 74247 - DNA, 20 bp, Artificial Sequence
  Description of Artificial Sequence: Synthetic oligonucleotide
  Target: SCN9A; (-) strand; PAM type: YTN; PAM sequence: CTA
gttgcttggttctaggattg

SEQ ID NO: 74248 - DNA, 20 bp, Artificial Sequence
  Description of Artificial Sequence: Synthetic oligonucleotide
  Target: SCN9A; (-) strand; PAM type: YTN; PAM sequence: TTC
tagttgcttggttctaggat

SEQ ID NO: 74249 - DNA, 20 bp, Artificial Sequence
  Description of Artificial Sequence: Synthetic oligonucleotide
  Target: SCN9A; (-) strand; PAM type: YTN; PAM sequence: TTT
ctagttgcttggttctagga

SEQ ID NO: 74250 - DNA, 20 bp, Artificial Sequence
  Description of Artificial Sequence: Synthetic oligonucleotide
  Target: SCN9A; (-) strand; PAM type: YTN; PAM sequence: TTA
tttctagttgcttggttcta

SEQ ID NO: 74251 - DNA, 20 bp, Artificial Sequence
  Description of Artificial Sequence: Synthetic oligonucleotide
  Target: SCN9A; (-) strand; PAM type: YTN; PAM sequence: CTC
cataaattatttctagttgc

SEQ ID NO: 74252 - DNA, 20 bp, Artificial Sequence
  Description of Artificial Sequence: Synthetic oligonucleotide
  Target: SCN9A; (-) strand; PAM type: YTN; PAM sequence: TTC
atgagtcctccataaattat

SEQ ID NO: 74253 - DNA, 20 bp, Artificial Sequence
  Description of Artificial Sequence: Synthetic oligonucleotide
  Target: SCN9A; (-) strand; PAM type: YTN; PAM sequence: TTT
catgagtcctccataaatta

SEQ ID NO: 74254 - DNA, 20 bp, Artificial Sequence
  Description of Artificial Sequence: Synthetic oligonucleotide
  Target: SCN9A; (-) strand; PAM type: YTN; PAM sequence: CTA
tttcatgagtcctccataaa

SEQ ID NO: 74255 - DNA, 20 bp, Artificial Sequence
  Description of Artificial Sequence: Synthetic oligonucleotide
  Target: SCN9A; (-) strand; PAM type: YTN; PAM sequence: CTA
atggtgtgaaatgtctattt

SEQ ID NO: 74256 - DNA, 20 bp, Artificial Sequence
  Description of Artificial Sequence: Synthetic oligonucleotide
  Target: SCN9A; (-) strand; PAM type: YTN; PAM sequence: CTA
aataaatggtgagaagtaaa

SEQ ID NO: 74257 - DNA, 20 bp, Artificial Sequence
  Description of Artificial Sequence: Synthetic oligonucleotide
  Target: SCN9A; (-) strand; PAM type: YTN; PAM sequence: CTC
ctaaataaatggtgagaagt

SEQ ID NO: 74258 - DNA, 20 bp, Artificial Sequence
  Description of Artificial Sequence: Synthetic oligonucleotide
  Target: SCN9A; (-) strand; PAM type: YTN; PAM sequence: CTC
atctcctaaataaatggtga

SEQ ID NO: 74259 - DNA, 20 bp, Artificial Sequence
  Description of Artificial Sequence: Synthetic oligonucleotide
  Target: SCN9A; (-) strand; PAM type: YTN; PAM sequence: CTA
ctcatctcctaaataaatgg

SEQ ID NO: 74260 - DNA, 20 bp, Artificial Sequence
  Description of Artificial Sequence: Synthetic oligonucleotide
  Target: SCN9A; (-) strand; PAM type: YTN; PAM sequence: TTG
tgggggcaaagtgtctactc

SEQ ID NO: 74261 - DNA, 20 bp, Artificial Sequence
  Description of Artificial Sequence: Synthetic oligonucleotide
  Target: SCN9A; (-) strand; PAM type: YTN; PAM sequence: TTC
ccattgtgggggcaaagtgt

SEQ ID NO: 74262 - DNA, 20 bp, Artificial Sequence
  Description of Artificial Sequence: Synthetic oligonucleotide
  Target: SCN9A; (-) strand; PAM type: YTN; PAM sequence: TTC
accccccacattcccattgt

SEQ ID NO: 74263 - DNA, 20 bp, Artificial Sequence
  Description of Artificial Sequence: Synthetic oligonucleotide
  Target: SCN9A; (-) strand; PAM type: YTN; PAM sequence: CTT
caccccccacattcccattg

SEQ ID NO: 74264 - DNA, 20 bp, Artificial Sequence
  Description of Artificial Sequence: Synthetic oligonucleotide
  Target: SCN9A; (-) strand; PAM type: YTN; PAM sequence: CTA
acacttcaccccccacattc

SEQ ID NO: 74265 - DNA, 20 bp, Artificial Sequence
  Description of Artificial Sequence: Synthetic oligonucleotide
  Target: SCN9A; (-) strand; PAM type: YTN; PAM sequence: CTG
ggtctaacacttcacccccc

SEQ ID NO: 74266 - DNA, 20 bp, Artificial Sequence
  Description of Artificial Sequence: Synthetic oligonucleotide
  Target: SCN9A; (-) strand; PAM type: YTN; PAM sequence: CTG
gtccctgggtctaacacttc

SEQ ID NO: 74267 - DNA, 20 bp, Artificial Sequence
  Description of Artificial Sequence: Synthetic oligonucleotide
  Target: SCN9A; (-) strand; PAM type: YTN; PAM sequence: CTG
acaatatgccccaggtccca

SEQ ID NO: 74268 - DNA, 20 bp, Artificial Sequence
  Description of Artificial Sequence: Synthetic oligonucleotide
  Target: SCN9A; (-) strand; PAM type: YTN; PAM sequence: CTC
ccctgacaatatgccccagg

SEQ ID NO: 74269 - DNA, 20 bp, Artificial Sequence
  Description of Artificial Sequence: Synthetic oligonucleotide
  Target: SCN9A; (-) strand; PAM type: YTN; PAM sequence: CTC
tcccctgacaatatgcccca

SEQ ID NO: 74270 - DNA, 20 bp, Artificial Sequence
  Description of Artificial Sequence: Synthetic oligonucleotide
  Target: SCN9A; (-) strand; PAM type: YTN; PAM sequence: CTA
ccctctcccctgacaatatg

SEQ ID NO: 74271 - DNA, 20 bp, Artificial Sequence
  Description of Artificial Sequence: Synthetic oligonucleotide
  Target: SCN9A; (-) strand; PAM type: YTN; PAM sequence: TTC
taccctctcccctgacaata

SEQ ID NO: 74272 - DNA, 20 bp, Artificial Sequence
  Description of Artificial Sequence: Synthetic oligonucleotide
  Target: SCN9A; (-) strand; PAM type: YTN; PAM sequence: CTT
ctaccctctcccctgacaat

SEQ ID NO: 74273 - DNA, 20 bp, Artificial Sequence
  Description of Artificial Sequence: Synthetic oligonucleotide
  Target: SCN9A; (-) strand; PAM type: YTN; PAM sequence: CTG
gcttctaccctctcccctga

SEQ ID NO: 74274 - DNA, 20 bp, Artificial Sequence
  Description of Artificial Sequence: Synthetic oligonucleotide
  Target: SCN9A; (-) strand; PAM type: YTN; PAM sequence: CTG
tgctggcttctaccctctcc

SEQ ID NO: 74275 - DNA, 20 bp, Artificial Sequence
  Description of Artificial Sequence: Synthetic oligonucleotide
  Target: SCN9A; (-) strand; PAM type: YTN; PAM sequence: TTA
caaactgtgctggcttctac

SEQ ID NO: 74276 - DNA, 20 bp, Artificial Sequence
  Description of Artificial Sequence: Synthetic oligonucleotide
  Target: SCN9A; (-) strand; PAM type: YTN; PAM sequence: TTT
acaaactgtgctggcttcta

SEQ ID NO: 74277 - DNA, 20 bp, Artificial Sequence
  Description of Artificial Sequence: Synthetic oligonucleotide
  Target: SCN9A; (-) strand; PAM type: YTN; PAM sequence: CTT
tacaaactgtgctggcttct

SEQ ID NO: 74278 - DNA, 20 bp, Artificial Sequence
  Description of Artificial Sequence: Synthetic oligonucleotide
  Target: SCN9A; (-) strand; PAM type: YTN; PAM sequence: CTA
ataagcaaagatagtcaaag

SEQ ID NO: 74279 - DNA, 20 bp, Artificial Sequence
  Description of Artificial Sequence: Synthetic oligonucleotide
  Target: SCN9A; (-) strand; PAM type: YTN; PAM sequence: TTC
taataagcaaagatagtcaa

SEQ ID NO: 74280 - DNA, 20 bp, Artificial Sequence
  Description of Artificial Sequence: Synthetic oligonucleotide
  Target: SCN9A; (-) strand; PAM type: YTN; PAM sequence: CTT
ctaataagcaaagatagtca

SEQ ID NO: 74281 - DNA, 20 bp, Artificial Sequence
  Description of Artificial Sequence: Synthetic oligonucleotide
  Target: SCN9A; (-) strand; PAM type: YTN; PAM sequence: CTC
ttctaataagcaaagatagt

SEQ ID NO: 74282 - DNA, 20 bp, Artificial Sequence
  Description of Artificial Sequence: Synthetic oligonucleotide
  Target: SCN9A; (-) strand; PAM type: YTN; PAM sequence: TTG
tctcttctaataagcaaaga

SEQ ID NO: 74283 - DNA, 20 bp, Artificial Sequence
  Description of Artificial Sequence: Synthetic oligonucleotide
  Target: SCN9A; (-) strand; PAM type: YTN; PAM sequence: CTC
aaaaattgtctcttctaata

SEQ ID NO: 74284 - DNA, 20 bp, Artificial Sequence
  Description of Artificial Sequence: Synthetic oligonucleotide
  Target: SCN9A; (-) strand; PAM type: YTN; PAM sequence: TTC
gctcaaaaattgtctcttct

SEQ ID NO: 74285 - DNA, 20 bp, Artificial Sequence
  Description of Artificial Sequence: Synthetic oligonucleotide
  Target: SCN9A; (-) strand; PAM type: YTN; PAM sequence: TTA
catattcgctcaaaaattgt

SEQ ID NO: 74286 - DNA, 20 bp, Artificial Sequence
  Description of Artificial Sequence: Synthetic oligonucleotide
  Target: SCN9A; (-) strand; PAM type: YTN; PAM sequence: TTA
caaattacatattcgctcaa

SEQ ID NO: 74287 - DNA, 20 bp, Artificial Sequence
  Description of Artificial Sequence: Synthetic oligonucleotide
  Target: SCN9A; (-) strand; PAM type: YTN; PAM sequence: CTT
acaaattacatattcgctca

SEQ ID NO: 74288 - DNA, 20 bp, Artificial Sequence
  Description of Artificial Sequence: Synthetic oligonucleotide
  Target: SCN9A; (-) strand; PAM type: YTN; PAM sequence: CTA
tataatcttacaaattacat

SEQ ID NO: 74289 - DNA, 20 bp, Artificial Sequence
  Description of Artificial Sequence: Synthetic oligonucleotide
  Target: SCN9A; (-) strand; PAM type: YTN; PAM sequence: CTG
tcactatataatcttacaaa

SEQ ID NO: 74290 - DNA, 20 bp, Artificial Sequence
  Description of Artificial Sequence: Synthetic oligonucleotide
  Target: SCN9A; (-) strand; PAM type: YTN; PAM sequence: TTC
tgtcactatataatcttaca

SEQ ID NO: 74291 - DNA, 20 bp, Artificial Sequence
  Description of Artificial Sequence: Synthetic oligonucleotide
  Target: SCN9A; (-) strand; PAM type: YTN; PAM sequence: CTA
cgtgattctgtcactatata

SEQ ID NO: 74292 - DNA, 20 bp, Artificial Sequence
  Description of Artificial Sequence: Synthetic oligonucleotide
  Target: SCN9A; (-) strand; PAM type: YTN; PAM sequence: TTA
acccagagctacgtgattct

SEQ ID NO: 74293 - DNA, 20 bp, Artificial Sequence
  Description of Artificial Sequence: Synthetic oligonucleotide
  Target: SCN9A; (-) strand; PAM type: YTN; PAM sequence: TTG
atgcagaaaacaaggttaac

SEQ ID NO: 74294 - DNA, 20 bp, Artificial Sequence
  Description of Artificial Sequence: Synthetic oligonucleotide
  Target: SCN9A; (-) strand; PAM type: YTN; PAM sequence: TTA
atagtaattgatgcagaaaa

SEQ ID NO: 74295 - DNA, 20 bp, Artificial Sequence
  Description of Artificial Sequence: Synthetic oligonucleotide
  Target: SCN9A; (-) strand; PAM type: YTN; PAM sequence: TTT
aatagtaattgatgcagaaa

SEQ ID NO: 74296 - DNA, 20 bp, Artificial Sequence
  Description of Artificial Sequence: Synthetic oligonucleotide
  Target: SCN9A; (-) strand; PAM type: YTN; PAM sequence: TTC
aaagataagtgatttaatag

SEQ ID NO: 74297 - DNA, 20 bp, Artificial Sequence
  Description of Artificial Sequence: Synthetic oligonucleotide
  Target: SCN9A; (-) strand; PAM type: YTN; PAM sequence: TTT
caaagataagtgatttaata

SEQ ID NO: 74298 - DNA, 20 bp, Artificial Sequence
  Description of Artificial Sequence: Synthetic oligonucleotide
  Target: SCN9A; (-) strand; PAM type: YTN; PAM sequence: CTT
tcaaagataagtgatttaat

SEQ ID NO: 74299 - DNA, 20 bp, Artificial Sequence
  Description of Artificial Sequence: Synthetic oligonucleotide
  Target: SCN9A; (-) strand; PAM type: YTN; PAM sequence: CTG
acctttcaaagataagtgat

SEQ ID NO: 74300 - DNA, 20 bp, Artificial Sequence
  Description of Artificial Sequence: Synthetic oligonucleotide
  Target: SCN9A; (-) strand; PAM type: YTN; PAM sequence: TTG
ggtgatctgacctttcaaag

SEQ ID NO: 74301 - DNA, 20 bp, Artificial Sequence
  Description of Artificial Sequence: Synthetic oligonucleotide
  Target: SCN9A; (-) strand; PAM type: YTN; PAM sequence: TTG
caaaatgaaaaaaagaaaac

SEQ ID NO: 74302 - DNA, 20 bp, Artificial Sequence
  Description of Artificial Sequence: Synthetic oligonucleotide
  Target: SCN9A; (-) strand; PAM type: YTN; PAM sequence: TTT
gcaaaatgaaaaaaagaaaa

SEQ ID NO: 74303 - DNA, 20 bp, Artificial Sequence
  Description of Artificial Sequence: Synthetic oligonucleotide
  Target: SCN9A; (-) strand; PAM type: YTN; PAM sequence: CTT
tgcaaaatgaaaaaaagaaa

SEQ ID NO: 74304 - DNA, 20 bp, Artificial Sequence
  Description of Artificial Sequence: Synthetic oligonucleotide
  Target: SCN9A; (-) strand; PAM type: YTN; PAM sequence: TTG
ataacatggcaaaaatgact

SEQ ID NO: 74305 - DNA, 20 bp, Artificial Sequence
  Description of Artificial Sequence: Synthetic oligonucleotide
  Target: SCN9A; (-) strand; PAM type: YTN; PAM sequence: TTA
aacacagacattgataacat

SEQ ID NO: 74306 - DNA, 20 bp, Artificial Sequence
  Description of Artificial Sequence: Synthetic oligonucleotide
  Target: SCN9A; (-) strand; PAM type: YTN; PAM sequence: CTA
ttaaacacagacattgataa

SEQ ID NO: 74307 - DNA, 20 bp, Artificial Sequence
  Description of Artificial Sequence: Synthetic oligonucleotide
  Target: SCN9A; (-) strand; PAM type: YTN; PAM sequence: TTG
ctattaaacacagacattga

SEQ ID NO: 74308 - DNA, 20 bp, Artificial Sequence
  Description of Artificial Sequence: Synthetic oligonucleotide
  Target: SCN9A; (-) strand; PAM type: YTN; PAM sequence: TTT
gctattaaacacagacattg

SEQ ID NO: 74309 - DNA, 20 bp, Artificial Sequence
  Description of Artificial Sequence: Synthetic oligonucleotide
  Target: SCN9A; (-) strand; PAM type: YTN; PAM sequence: TTA
tttgctattaaacacagaca

SEQ ID NO: 74310 - DNA, 20 bp, Artificial Sequence
  Description of Artificial Sequence: Synthetic oligonucleotide
  Target: SCN9A; (-) strand; PAM type: YTN; PAM sequence: TTA
aaaatggataaaattatttg

SEQ ID NO: 74311 - DNA, 20 bp, Artificial Sequence
  Description of Artificial Sequence: Synthetic oligonucleotide
  Target: SCN9A; (-) strand; PAM type: YTN; PAM sequence: CTT
aaaaatggataaaattattt

SEQ ID NO: 74312 - DNA, 20 bp, Artificial Sequence
  Description of Artificial Sequence: Synthetic oligonucleotide
  Target: SCN9A; (-) strand; PAM type: YTN; PAM sequence: TTA
tgtgcttaaaaatggataaa

SEQ ID NO: 74313 - DNA, 20 bp, Artificial Sequence
  Description of Artificial Sequence: Synthetic oligonucleotide
  Target: SCN9A; (-) strand; PAM type: YTN; PAM sequence: TTT
atgtgcttaaaaatggataa

SEQ ID NO: 74314 - DNA, 20 bp, Artificial Sequence
  Description of Artificial Sequence: Synthetic oligonucleotide
  Target: SCN9A; (-) strand; PAM type: YTN; PAM sequence: TTT
tatgtgcttaaaaatggata

SEQ ID NO: 74315 - DNA, 20 bp, Artificial Sequence
  Description of Artificial Sequence: Synthetic oligonucleotide
  Target: SCN9A; (-) strand; PAM type: YTN; PAM sequence: TTT
ttatgtgcttaaaaatggat

SEQ ID NO: 74316 - DNA, 20 bp, Artificial Sequence
  Description of Artificial Sequence: Synthetic oligonucleotide
  Target: SCN9A; (-) strand; PAM type: YTN; PAM sequence: TTG
tttttatgtgcttaaaaatg

SEQ ID NO: 74317 - DNA, 20 bp, Artificial Sequence
  Description of Artificial Sequence: Synthetic oligonucleotide
  Target: SCN9A; (-) strand; PAM type: YTN; PAM sequence: CTG
atggaattgtttttatgtgc

SEQ ID NO: 74318 - DNA, 20 bp, Artificial Sequence
  Description of Artificial Sequence: Synthetic oligonucleotide
  Target: SCN9A; (-) strand; PAM type: YTN; PAM sequence: TTA
aatgatggtaaagataacca

SEQ ID NO: 74319 - DNA, 20 bp, Artificial Sequence
  Description of Artificial Sequence: Synthetic oligonucleotide
  Target: SCN9A; (-) strand; PAM type: YTN; PAM sequence: TTT
aaatgatggtaaagataacc

SEQ ID NO: 74320 - DNA, 20 bp, Artificial Sequence
  Description of Artificial Sequence: Synthetic oligonucleotide
  Target: SCN9A; (-) strand; PAM type: YTN; PAM sequence: TTT
taaatgatggtaaagataac

SEQ ID NO: 74321 - DNA, 20 bp, Artificial Sequence
  Description of Artificial Sequence: Synthetic oligonucleotide
  Target: SCN9A; (-) strand; PAM type: YTN; PAM sequence: TTC
agagaccataaaatggtttt

SEQ ID NO: 74322 - DNA, 20 bp, Artificial Sequence
  Description of Artificial Sequence: Synthetic oligonucleotide
  Target: SCN9A; (-) strand; PAM type: YTN; PAM sequence: TTA
ggaagaattcagagaccata

SEQ ID NO: 74323 - DNA, 20 bp, Artificial Sequence
  Description of Artificial Sequence: Synthetic oligonucleotide
  Target: SCN9A; (-) strand; PAM type: YTN; PAM sequence: CTT
aggaagaattcagagaccat

SEQ ID NO: 74324 - DNA, 20 bp, Artificial Sequence
  Description of Artificial Sequence: Synthetic oligonucleotide
  Target: SCN9A; (-) strand; PAM type: YTN; PAM sequence: TTC
ttaggaagaattcagagacc

SEQ ID NO: 74325 - DNA, 20 bp, Artificial Sequence
  Description of Artificial Sequence: Synthetic oligonucleotide
  Target: SCN9A; (-) strand; PAM type: YTN; PAM sequence: TTA
aataggcacatgaaattctt

SEQ ID NO: 74326 - DNA, 20 bp, Artificial Sequence
  Description of Artificial Sequence: Synthetic oligonucleotide
  Target: SCN9A; (-) strand; PAM type: YTN; PAM sequence: CTT
aaataggcacatgaaattct

SEQ ID NO: 74327 - DNA, 20 bp, Artificial Sequence
  Description of Artificial Sequence: Synthetic oligonucleotide
  Target: SCN9A; (-) strand; PAM type: YTN; PAM sequence: CTG
gtcaaccttaaataggcaca

SEQ ID NO: 74328 - DNA, 20 bp, Artificial Sequence
  Description of Artificial Sequence: Synthetic oligonucleotide
  Target: SCN9A; (-) strand; PAM type: YTN; PAM sequence: TTA
acataaatctggtcaacctt

SEQ ID NO: 74329 - DNA, 20 bp, Artificial Sequence
  Description of Artificial Sequence: Synthetic oligonucleotide
  Target: SCN9A; (-) strand; PAM type: YTN; PAM sequence: TTA
aataaaattaacataaatct

SEQ ID NO: 74330 - DNA, 20 bp, Artificial Sequence
  Description of Artificial Sequence: Synthetic oligonucleotide
  Target: SCN9A; (-) strand; PAM type: YTN; PAM sequence: CTT
aaataaaattaacataaatc

SEQ ID NO: 74331 - DNA, 20 bp, Artificial Sequence
  Description of Artificial Sequence: Synthetic oligonucleotide
  Target: SCN9A; (-) strand; PAM type: YTN; PAM sequence: TTC
ttaaataaaattaacataaa

SEQ ID NO: 74332 - DNA, 20 bp, Artificial Sequence
  Description of Artificial Sequence: Synthetic oligonucleotide
  Target: SCN9A; (-) strand; PAM type: YTN; PAM sequence: CTG
tacagattcttaaataaaat

SEQ ID NO: 74333 - DNA, 20 bp, Artificial Sequence
  Description of Artificial Sequence: Synthetic oligonucleotide
  Target: SCN9A; (-) strand; PAM type: YTN; PAM sequence: TTA
ctgtacagattcttaaataa

SEQ ID NO: 74334 - DNA, 20 bp, Artificial Sequence
  Description of Artificial Sequence: Synthetic oligonucleotide
  Target: SCN9A; (-) strand; PAM type: YTN; PAM sequence: TTT
actgtacagattcttaaata

SEQ ID NO: 74335 - DNA, 20 bp, Artificial Sequence
  Description of Artificial Sequence: Synthetic oligonucleotide
  Target: SCN9A; (-) strand; PAM type: YTN; PAM sequence: TTT
tactgtacagattcttaaat

SEQ ID NO: 74336 - DNA, 20 bp, Artificial Sequence
  Description of Artificial Sequence: Synthetic oligonucleotide
  Target: SCN9A; (-) strand; PAM type: YTN; PAM sequence: CTT
ttactgtacagattcttaaa

SEQ ID NO: 74337 - DNA, 20 bp, Artificial Sequence
  Description of Artificial Sequence: Synthetic oligonucleotide
  Target: SCN9A; (-) strand; PAM type: YTN; PAM sequence: TTC
ttttactgtacagattctta

SEQ ID NO: 74338 - DNA, 20 bp, Artificial Sequence
  Description of Artificial Sequence: Synthetic oligonucleotide
  Target: SCN9A; (-) strand; PAM type: YTN; PAM sequence: CTT
cttttactgtacagattctt

SEQ ID NO: 74339 - DNA, 20 bp, Artificial Sequence
  Description of Artificial Sequence: Synthetic oligonucleotide
  Target: SCN9A; (-) strand; PAM type: YTN; PAM sequence: CTG
tggaaggtatgtaataatct

SEQ ID NO: 74340 - DNA, 20 bp, Artificial Sequence
  Description of Artificial Sequence: Synthetic oligonucleotide
  Target: SCN9A; (-) strand; PAM type: YTN; PAM sequence: TTA
acaaacactgtggaaggtat

SEQ ID NO: 74341 - DNA, 20 bp, Artificial Sequence
  Description of Artificial Sequence: Synthetic oligonucleotide
  Target: SCN9A; (-) strand; PAM type: YTN; PAM sequence: CTC
agacagagagcaatgagtag

SEQ ID NO: 74342 - DNA, 20 bp, Artificial Sequence
  Description of Artificial Sequence: Synthetic oligonucleotide
  Target: SCN9A; (-) strand; PAM type: YTN; PAM sequence: CTG
aatgatcccaacctcagaca

SEQ ID NO: 74343 - DNA, 20 bp, Artificial Sequence
  Description of Artificial Sequence: Synthetic oligonucleotide
  Target: SCN9A; (-) strand; PAM type: YTN; PAM sequence: TTC
agaggatatgctgaatgatc

SEQ ID NO: 74344 - DNA, 20 bp, Artificial Sequence
  Description of Artificial Sequence: Synthetic oligonucleotide
  Target: SCN9A; (-) strand; PAM type: YTN; PAM sequence: TTT
cagaggatatgctgaatgat

SEQ ID NO: 74345 - DNA, 20 bp, Artificial Sequence
  Description of Artificial Sequence: Synthetic oligonucleotide
  Target: SCN9A; (-) strand; PAM type: YTN; PAM sequence: CTT
tcagaggatatgctgaatga

SEQ ID NO: 74346 - DNA, 20 bp, Artificial Sequence
  Description of Artificial Sequence: Synthetic oligonucleotide
  Target: SCN9A; (-) strand; PAM type: YTN; PAM sequence: CTC
ctttcagaggatatgctgaa

SEQ ID NO: 74347 - DNA, 20 bp, Artificial Sequence
  Description of Artificial Sequence: Synthetic oligonucleotide
  Target: SCN9A; (-) strand; PAM type: YTN; PAM sequence: CTA
tctcctttcagaggatatgc

SEQ ID NO: 74348 - DNA, 20 bp, Artificial Sequence
  Description of Artificial Sequence: Synthetic oligonucleotide
  Target: SCN9A; (-) strand; PAM type: YTN; PAM sequence: TTC
ctatctcctttcagaggata

SEQ ID NO: 74349 - DNA, 20 bp, Artificial Sequence
  Description of Artificial Sequence: Synthetic oligonucleotide
  Target: SCN9A; (-) strand; PAM type: YTN; PAM sequence: TTG
tagttcctatctcctttcag

SEQ ID NO: 74350 - DNA, 20 bp, Artificial Sequence
  Description of Artificial Sequence: Synthetic oligonucleotide
  Target: SCN9A; (-) strand; PAM type: YTN; PAM sequence: TTA
gggcacgaccaatcaaatac

SEQ ID NO: 74351 - DNA, 20 bp, Artificial Sequence
  Description of Artificial Sequence: Synthetic oligonucleotide
  Target: SCN9A; (-) strand; PAM type: YTN; PAM sequence: TTT
agggcacgaccaatcaaata

SEQ ID NO: 74352 - DNA, 20 bp, Artificial Sequence
  Description of Artificial Sequence: Synthetic oligonucleotide
  Target: SCN9A; (-) strand; PAM type: YTN; PAM sequence: TTT
tagggcacgaccaatcaaat

SEQ ID NO: 74353 - DNA, 20 bp, Artificial Sequence
  Description of Artificial Sequence: Synthetic oligonucleotide
  Target: SCN9A; (-) strand; PAM type: YTN; PAM sequence: TTT
ttagggcacgaccaatcaaa

SEQ ID NO: 74354 - DNA, 20 bp, Artificial Sequence
  Description of Artificial Sequence: Synthetic oligonucleotide
  Target: SCN9A; (-) strand; PAM type: YTN; PAM sequence: TTT
tttagggcacgaccaatcaa

SEQ ID NO: 74355 - DNA, 20 bp, Artificial Sequence
  Description of Artificial Sequence: Synthetic oligonucleotide
  Target: SCN9A; (-) strand; PAM type: YTN; PAM sequence: TTT
ttttagggcacgaccaatca

SEQ ID NO: 74356 - DNA, 20 bp, Artificial Sequence
  Description of Artificial Sequence: Synthetic oligonucleotide
  Target: SCN9A; (-) strand; PAM type: YTN; PAM sequence: TTT
tttttagggcacgaccaatc

SEQ ID NO: 74357 - DNA, 20 bp, Artificial Sequence
  Description of Artificial Sequence: Synthetic oligonucleotide
  Target: SCN9A; (-) strand; PAM type: YTN; PAM sequence: TTT
ttttttagggcacgaccaat

SEQ ID NO: 74358 - DNA, 20 bp, Artificial Sequence
  Description of Artificial Sequence: Synthetic oligonucleotide
  Target: SCN9A; (-) strand; PAM type: YTN; PAM sequence: TTT
tttttttagggcacgaccaa

SEQ ID NO: 74359 - DNA, 20 bp, Artificial Sequence
  Description of Artificial Sequence: Synthetic oligonucleotide
  Target: SCN9A; (-) strand; PAM type: YTN; PAM sequence: TTG
attttttttttagggcacga

SEQ ID NO: 74360 - DNA, 20 bp, Artificial Sequence
  Description of Artificial Sequence: Synthetic oligonucleotide
  Target: SCN9A; (-) strand; PAM type: YTN; PAM sequence: TTA
attgattttttttttagggc

SEQ ID NO: 74361 - DNA, 20 bp, Artificial Sequence
  Description of Artificial Sequence: Synthetic oligonucleotide
  Target: SCN9A; (-) strand; PAM type: YTN; PAM sequence: TTA
agacattaattgattttttt

SEQ ID NO: 74362 - DNA, 20 bp, Artificial Sequence
  Description of Artificial Sequence: Synthetic oligonucleotide
  Target: SCN9A; (-) strand; PAM type: YTN; PAM sequence: CTT
aagacattaattgatttttt

SEQ ID NO: 74363 - DNA, 20 bp, Artificial Sequence
  Description of Artificial Sequence: Synthetic oligonucleotide
  Target: SCN9A; (-) strand; PAM type: YTN; PAM sequence: TTC
ttaagacattaattgatttt

SEQ ID NO: 74364 - DNA, 20 bp, Artificial Sequence
  Description of Artificial Sequence: Synthetic oligonucleotide
  Target: SCN9A; (-) strand; PAM type: YTN; PAM sequence: CTG
ttcttaagacattaattgat

SEQ ID NO: 74365 - DNA, 20 bp, Artificial Sequence
  Description of Artificial Sequence: Synthetic oligonucleotide
  Target: SCN9A; (-) strand; PAM type: YTN; PAM sequence: TTC
tgttcttaagacattaattg

SEQ ID NO: 74366 - DNA, 20 bp, Artificial Sequence
  Description of Artificial Sequence: Synthetic oligonucleotide
  Target: SCN9A; (-) strand; PAM type: YTN; PAM sequence: TTA
ggattctgttcttaagacat

SEQ ID NO: 74367 - DNA, 20 bp, Artificial Sequence
  Description of Artificial Sequence: Synthetic oligonucleotide
  Target: SCN9A; (-) strand; PAM type: YTN; PAM sequence: TTA
ttaggattctgttcttaaga

SEQ ID NO: 74368 - DNA, 20 bp, Artificial Sequence
  Description of Artificial Sequence: Synthetic oligonucleotide
  Target: SCN9A; (-) strand; PAM type: YTN; PAM sequence: TTT
attaggattctgttcttaag

SEQ ID NO: 74369 - DNA, 20 bp, Artificial Sequence
  Description of Artificial Sequence: Synthetic oligonucleotide
  Target: SCN9A; (-) strand; PAM type: YTN; PAM sequence: CTA
caatttattaggattctgtt

SEQ ID NO: 74370 - DNA, 20 bp, Artificial Sequence
  Description of Artificial Sequence: Synthetic oligonucleotide
  Target: SCN9A; (-) strand; PAM type: YTN; PAM sequence: TTA
tacctacaatttattaggat

SEQ ID NO: 74371 - DNA, 20 bp, Artificial Sequence
  Description of Artificial Sequence: Synthetic oligonucleotide
  Target: SCN9A; (-) strand; PAM type: YTN; PAM sequence: CTT
atacctacaatttattagga

SEQ ID NO: 74372 - DNA, 20 bp, Artificial Sequence
  Description of Artificial Sequence: Synthetic oligonucleotide
  Target: SCN9A; (-) strand; PAM type: YTN; PAM sequence: TTA
tcttatacctacaatttatt

SEQ ID NO: 74373 - DNA, 20 bp, Artificial Sequence
  Description of Artificial Sequence: Synthetic oligonucleotide
  Target: SCN9A; (-) strand; PAM type: YTN; PAM sequence: TTT
atcttatacctacaatttat

SEQ ID NO: 74374 - DNA, 20 bp, Artificial Sequence
  Description of Artificial Sequence: Synthetic oligonucleotide
  Target: SCN9A; (-) strand; PAM type: YTN; PAM sequence: TTT
tatcttatacctacaattta

SEQ ID NO: 74375 - DNA, 20 bp, Artificial Sequence
  Description of Artificial Sequence: Synthetic oligonucleotide
  Target: SCN9A; (-) strand; PAM type: YTN; PAM sequence: CTA
tataagcaagattttatctt

SEQ ID NO: 74376 - DNA, 20 bp, Artificial Sequence
  Description of Artificial Sequence: Synthetic oligonucleotide
  Target: SCN9A; (-) strand; PAM type: YTN; PAM sequence: CTA
cagctatataagcaagattt

SEQ ID NO: 74377 - DNA, 20 bp, Artificial Sequence
  Description of Artificial Sequence: Synthetic oligonucleotide
  Target: SCN9A; (-) strand; PAM type: YTN; PAM sequence: CTC
actacagctatataagcaag

SEQ ID NO: 74378 - DNA, 20 bp, Artificial Sequence
  Description of Artificial Sequence: Synthetic oligonucleotide
  Target: SCN9A; (-) strand; PAM type: YTN; PAM sequence: TTA
ctcactacagctatataagc

SEQ ID NO: 74379 - DNA, 20 bp, Artificial Sequence
  Description of Artificial Sequence: Synthetic oligonucleotide
  Target: SCN9A; (-) strand; PAM type: YTN; PAM sequence: TTA
attactcactacagctatat

SEQ ID NO: 74380 - DNA, 20 bp, Artificial Sequence
  Description of Artificial Sequence: Synthetic oligonucleotide
  Target: SCN9A; (-) strand; PAM type: YTN; PAM sequence: TTT
aattactcactacagctata

SEQ ID NO: 74381 - DNA, 20 bp, Artificial Sequence
  Description of Artificial Sequence: Synthetic oligonucleotide
  Target: SCN9A; (-) strand; PAM type: YTN; PAM sequence: TTT
taattactcactacagctat

SEQ ID NO: 74382 - DNA, 20 bp, Artificial Sequence
  Description of Artificial Sequence: Synthetic oligonucleotide
  Target: SCN9A; (-) strand; PAM type: YTN; PAM sequence: CTT
ttaattactcactacagcta

SEQ ID NO: 74383 - DNA, 20 bp, Artificial Sequence
  Description of Artificial Sequence: Synthetic oligonucleotide
  Target: SCN9A; (-) strand; PAM type: YTN; PAM sequence: CTA
cttttaattactcactacag

SEQ ID NO: 74384 - DNA, 20 bp, Artificial Sequence
  Description of Artificial Sequence: Synthetic oligonucleotide
  Target: SCN9A; (-) strand; PAM type: YTN; PAM sequence: CTC
tacttttaattactcactac

SEQ ID NO: 74385 - DNA, 20 bp, Artificial Sequence
  Description of Artificial Sequence: Synthetic oligonucleotide
  Target: SCN9A; (-) strand; PAM type: YTN; PAM sequence: CTA
ggctctacttttaattactc

SEQ ID NO: 74386 - DNA, 20 bp, Artificial Sequence
  Description of Artificial Sequence: Synthetic oligonucleotide
  Target: SCN9A; (-) strand; PAM type: YTN; PAM sequence: TTG
aacccagcaatctaggctct

SEQ ID NO: 74387 - DNA, 20 bp, Artificial Sequence
  Description of Artificial Sequence: Synthetic oligonucleotide
  Target: SCN9A; (-) strand; PAM type: YTN; PAM sequence: TTT
gaacccagcaatctaggctc

SEQ ID NO: 74388 - DNA, 20 bp, Artificial Sequence
  Description of Artificial Sequence: Synthetic oligonucleotide
  Target: SCN9A; (-) strand; PAM type: YTN; PAM sequence: CTA
tgatatacagccagtaagta

SEQ ID NO: 74389 - DNA, 20 bp, Artificial Sequence
  Description of Artificial Sequence: Synthetic oligonucleotide
  Target: SCN9A; (-) strand; PAM type: YTN; PAM sequence: CTC
ctatgatatacagccagtaa

SEQ ID NO: 74390 - DNA, 20 bp, Artificial Sequence
  Description of Artificial Sequence: Synthetic oligonucleotide
  Target: SCN9A; (-) strand; PAM type: YTN; PAM sequence: CTC
tcctatgatatacagccagt

SEQ ID NO: 74391 - DNA, 20 bp, Artificial Sequence
  Description of Artificial Sequence: Synthetic oligonucleotide
  Target: SCN9A; (-) strand; PAM type: YTN; PAM sequence: TTA
agtagctctcctatgatata

SEQ ID NO: 74392 - DNA, 20 bp, Artificial Sequence
  Description of Artificial Sequence: Synthetic oligonucleotide
  Target: SCN9A; (-) strand; PAM type: YTN; PAM sequence: CTG
agacagttaagtagctctcc

SEQ ID NO: 74393 - DNA, 20 bp, Artificial Sequence
  Description of Artificial Sequence: Synthetic oligonucleotide
  Target: SCN9A; (-) strand; PAM type: YTN; PAM sequence: TTA
ccaatataaaactgagacag

SEQ ID NO: 74394 - DNA, 20 bp, Artificial Sequence
  Description of Artificial Sequence: Synthetic oligonucleotide
  Target: SCN9A; (-) strand; PAM type: YTN; PAM sequence: TTT
accaatataaaactgagaca

SEQ ID NO: 74395 - DNA, 20 bp, Artificial Sequence
  Description of Artificial Sequence: Synthetic oligonucleotide
  Target: SCN9A; (-) strand; PAM type: YTN; PAM sequence: TTT
taccaatataaaactgagac

SEQ ID NO: 74396 - DNA, 20 bp, Artificial Sequence
  Description of Artificial Sequence: Synthetic oligonucleotide
  Target: SCN9A; (-) strand; PAM type: YTN; PAM sequence: TTA
tccccattttaccaatataa

SEQ ID NO: 74397 - DNA, 20 bp, Artificial Sequence
  Description of Artificial Sequence: Synthetic oligonucleotide
  Target: SCN9A; (-) strand; PAM type: YTN; PAM sequence: CTA
tgattatccccattttacca

SEQ ID NO: 74398 - DNA, 20 bp, Artificial Sequence
  Description of Artificial Sequence: Synthetic oligonucleotide
  Target: SCN9A; (-) strand; PAM type: YTN; PAM sequence: CTC
acaagaatatgaagcaagca

SEQ ID NO: 74399 - DNA, 20 bp, Artificial Sequence
  Description of Artificial Sequence: Synthetic oligonucleotide
  Target: SCN9A; (-) strand; PAM type: YTN; PAM sequence: TTA
atcctcacaagaatatgaag

SEQ ID NO: 74400 - DNA, 20 bp, Artificial Sequence
  Description of Artificial Sequence: Synthetic oligonucleotide
  Target: SCN9A; (-) strand; PAM type: YTN; PAM sequence: TTT
aatcctcacaagaatatgaa

SEQ ID NO: 74401 - DNA, 20 bp, Artificial Sequence
  Description of Artificial Sequence: Synthetic oligonucleotide
  Target: SCN9A; (-) strand; PAM type: YTN; PAM sequence: CTT
taatcctcacaagaatatga

SEQ ID NO: 74402 - DNA, 20 bp, Artificial Sequence
  Description of Artificial Sequence: Synthetic oligonucleotide
  Target: SCN9A; (-) strand; PAM type: YTN; PAM sequence: TTC
ctttaatcctcacaagaata

SEQ ID NO: 74403 - DNA, 20 bp, Artificial Sequence
  Description of Artificial Sequence: Synthetic oligonucleotide
  Target: SCN9A; (-) strand; PAM type: YTN; PAM sequence: TTA
attcctttaatcctcacaag

SEQ ID NO: 74404 - DNA, 20 bp, Artificial Sequence
  Description of Artificial Sequence: Synthetic oligonucleotide
  Target: SCN9A; (-) strand; PAM type: YTN; PAM sequence: CTC
ataaatattaattcctttaa

SEQ ID NO: 74405 - DNA, 20 bp, Artificial Sequence
  Description of Artificial Sequence: Synthetic oligonucleotide
  Target: SCN9A; (-) strand; PAM type: YTN; PAM sequence: TTA
tctcataaatattaattcct

SEQ ID NO: 74406 - DNA, 20 bp, Artificial Sequence
  Description of Artificial Sequence: Synthetic oligonucleotide
  Target: SCN9A; (-) strand; PAM type: YTN; PAM sequence: TTT
atctcataaatattaattcc

SEQ ID NO: 74407 - DNA, 20 bp, Artificial Sequence
  Description of Artificial Sequence: Synthetic oligonucleotide
  Target: SCN9A; (-) strand; PAM type: YTN; PAM sequence: TTT
tatctcataaatattaattc

SEQ ID NO: 74408 - DNA, 20 bp, Artificial Sequence
  Description of Artificial Sequence: Synthetic oligonucleotide
  Target: SCN9A; (-) strand; PAM type: YTN; PAM sequence: TTT
ttatctcataaatattaatt

SEQ ID NO: 74409 - DNA, 20 bp, Artificial Sequence
  Description of Artificial Sequence: Synthetic oligonucleotide
  Target: SCN9A; (-) strand; PAM type: YTN; PAM sequence: TTT
tttatctcataaatattaat

SEQ ID NO: 74410 - DNA, 20 bp, Artificial Sequence
  Description of Artificial Sequence: Synthetic oligonucleotide
  Target: SCN9A; (-) strand; PAM type: YTN; PAM sequence: TTA
ttttttatctcataaatatt

SEQ ID NO: 74411 - DNA, 20 bp, Artificial Sequence
  Description of Artificial Sequence: Synthetic oligonucleotide
  Target: SCN9A; (-) strand; PAM type: YTN; PAM sequence: TTT
attttttatctcataaatat

SEQ ID NO: 74412 - DNA, 20 bp, Artificial Sequence
  Description of Artificial Sequence: Synthetic oligonucleotide
  Target: SCN9A; (-) strand; PAM type: YTN; PAM sequence: CTT
tattttttatctcataaata

SEQ ID NO: 74413 - DNA, 20 bp, Artificial Sequence
  Description of Artificial Sequence: Synthetic oligonucleotide
  Target: SCN9A; (-) strand; PAM type: YTN; PAM sequence: CTA
gctttattttttatctcata

SEQ ID NO: 74414 - DNA, 20 bp, Artificial Sequence
  Description of Artificial Sequence: Synthetic oligonucleotide
  Target: SCN9A; (-) strand; PAM type: YTN; PAM sequence: CTC
agaaaggcagagaggtgatg

SEQ ID NO: 74415 - DNA, 20 bp, Artificial Sequence
  Description of Artificial Sequence: Synthetic oligonucleotide
  Target: SCN9A; (-) strand; PAM type: YTN; PAM sequence: TTG
aacactcagaaaggcagaga

SEQ ID NO: 74416 - DNA, 20 bp, Artificial Sequence
  Description of Artificial Sequence: Synthetic oligonucleotide
  Target: SCN9A; (-) strand; PAM type: YTN; PAM sequence: CTG
aataaattgaacactcagaa

SEQ ID NO: 74417 - DNA, 20 bp, Artificial Sequence
  Description of Artificial Sequence: Synthetic oligonucleotide
  Target: SCN9A; (-) strand; PAM type: YTN; PAM sequence: CTA
tctgaataaattgaacactc

SEQ ID NO: 74418 - DNA, 20 bp, Artificial Sequence
  Description of Artificial Sequence: Synthetic oligonucleotide
  Target: SCN9A; (-) strand; PAM type: YTN; PAM sequence: CTG
tcacatgacaaactatctga

SEQ ID NO: 74419 - DNA, 20 bp, Artificial Sequence
  Description of Artificial Sequence: Synthetic oligonucleotide
  Target: SCN9A; (-) strand; PAM type: YTN; PAM sequence: TTC
atgtaggactgtcacatgac

SEQ ID NO: 74420 - DNA, 20 bp, Artificial Sequence
  Description of Artificial Sequence: Synthetic oligonucleotide
  Target: SCN9A; (-) strand; PAM type: YTN; PAM sequence: TTT
catgtaggactgtcacatga

SEQ ID NO: 74421 - DNA, 20 bp, Artificial Sequence
  Description of Artificial Sequence: Synthetic oligonucleotide
  Target: SCN9A; (-) strand; PAM type: YTN; PAM sequence: TTT
tcatgtaggactgtcacatg

SEQ ID NO: 74422 - DNA, 20 bp, Artificial Sequence
  Description of Artificial Sequence: Synthetic oligonucleotide
  Target: SCN9A; (-) strand; PAM type: YTN; PAM sequence: CTG
ttttcatgtaggactgtcac

SEQ ID NO: 74423 - DNA, 20 bp, Artificial Sequence
  Description of Artificial Sequence: Synthetic oligonucleotide
  Target: SCN9A; (-) strand; PAM type: YTN; PAM sequence: TTC
actgttttcatgtaggactg

SEQ ID NO: 74424 - DNA, 20 bp, Artificial Sequence
  Description of Artificial Sequence: Synthetic oligonucleotide
  Target: SCN9A; (-) strand; PAM type: YTN; PAM sequence: TTT
cactgttttcatgtaggact

SEQ ID NO: 74425 - DNA, 20 bp, Artificial Sequence
  Description of Artificial Sequence: Synthetic oligonucleotide
  Target: SCN9A; (-) strand; PAM type: YTN; PAM sequence: CTT
tcactgttttcatgtaggac

SEQ ID NO: 74426 - DNA, 20 bp, Artificial Sequence
  Description of Artificial Sequence: Synthetic oligonucleotide
  Target: SCN9A; (-) strand; PAM type: YTN; PAM sequence: CTA
cagcactttcactgttttca

SEQ ID NO: 74427 - DNA, 20 bp, Artificial Sequence
  Description of Artificial Sequence: Synthetic oligonucleotide
  Target: SCN9A; (-) strand; PAM type: YTN; PAM sequence: TTA
gatacacagcactacagcac

SEQ ID NO: 74428 - DNA, 20 bp, Artificial Sequence
  Description of Artificial Sequence: Synthetic oligonucleotide
  Target: SCN9A; (-) strand; PAM type: YTN; PAM sequence: TTT
agatacacagcactacagca

SEQ ID NO: 74429 - DNA, 20 bp, Artificial Sequence
  Description of Artificial Sequence: Synthetic oligonucleotide
  Target: SCN9A; (-) strand; PAM type: YTN; PAM sequence: CTT
tagatacacagcactacagc

SEQ ID NO: 74430 - DNA, 20 bp, Artificial Sequence
  Description of Artificial Sequence: Synthetic oligonucleotide
  Target: SCN9A; (-) strand; PAM type: YTN; PAM sequence: CTA
cccctttagatacacagcac

SEQ ID NO: 74431 - DNA, 20 bp, Artificial Sequence
  Description of Artificial Sequence: Synthetic oligonucleotide
  Target: SCN9A; (-) strand; PAM type: YTN; PAM sequence: TTC
tacccctttagatacacagc

SEQ ID NO: 74432 - DNA, 20 bp, Artificial Sequence
  Description of Artificial Sequence: Synthetic oligonucleotide
  Target: SCN9A; (-) strand; PAM type: YTN; PAM sequence: CTG
agattctacccctttagata

SEQ ID NO: 74433 - DNA, 20 bp, Artificial Sequence
  Description of Artificial Sequence: Synthetic oligonucleotide
  Target: SCN9A; (-) strand; PAM type: YTN; PAM sequence: TTA
tcagagaatactgagattct

SEQ ID NO: 74434 - DNA, 20 bp, Artificial Sequence
  Description of Artificial Sequence: Synthetic oligonucleotide
  Target: SCN9A; (-) strand; PAM type: YTN; PAM sequence: TTT
atcagagaatactgagattc

SEQ ID NO: 74435 - DNA, 20 bp, Artificial Sequence
  Description of Artificial Sequence: Synthetic oligonucleotide
  Target: SCN9A; (-) strand; PAM type: YTN; PAM sequence: TTC
cagaaatttatcagagaata

SEQ ID NO: 74436 - DNA, 20 bp, Artificial Sequence
  Description of Artificial Sequence: Synthetic oligonucleotide
  Target: SCN9A; (-) strand; PAM type: YTN; PAM sequence: CTC
aataaaaagtaattccagaa

SEQ ID NO: 74437 - DNA, 20 bp, Artificial Sequence
  Description of Artificial Sequence: Synthetic oligonucleotide
  Target: SCN9A; (-) strand; PAM type: YTN; PAM sequence: TTC
cctcaataaaaagtaattcc

SEQ ID NO: 74438 - DNA, 20 bp, Artificial Sequence
  Description of Artificial Sequence: Synthetic oligonucleotide
  Target: SCN9A; (-) strand; PAM type: YTN; PAM sequence: TTG
ttccctcaataaaaagtaat

SEQ ID NO: 74439 - DNA, 20 bp, Artificial Sequence
  Description of Artificial Sequence: Synthetic oligonucleotide
  Target: SCN9A; (-) strand; PAM type: YTN; PAM sequence: TTA
atgttgttccctcaataaaa

SEQ ID NO: 74440 - DNA, 20 bp, Artificial Sequence
  Description of Artificial Sequence: Synthetic oligonucleotide
  Target: SCN9A; (-) strand; PAM type: YTN; PAM sequence: TTC
attaatgttgttccctcaat

SEQ ID NO: 74441 - DNA, 20 bp, Artificial Sequence
  Description of Artificial Sequence: Synthetic oligonucleotide
  Target: SCN9A; (-) strand; PAM type: YTN; PAM sequence: CTT
cattaatgttgttccctcaa

SEQ ID NO: 74442 - DNA, 20 bp, Artificial Sequence
  Description of Artificial Sequence: Synthetic oligonucleotide
  Target: SCN9A; (-) strand; PAM type: YTN; PAM sequence: TTA
caggagcttcattaatgttg

SEQ ID NO: 74443 - DNA, 20 bp, Artificial Sequence
  Description of Artificial Sequence: Synthetic oligonucleotide
  Target: SCN9A; (-) strand; PAM type: YTN; PAM sequence: TTG
gcagtaagagacaaccatta

SEQ ID NO: 74444 - DNA, 20 bp, Artificial Sequence
  Description of Artificial Sequence: Synthetic oligonucleotide
  Target: SCN9A; (-) strand; PAM type: YTN; PAM sequence: CTT
ggcagtaagagacaaccatt

SEQ ID NO: 74445 - DNA, 20 bp, Artificial Sequence
  Description of Artificial Sequence: Synthetic oligonucleotide
  Target: SCN9A; (-) strand; PAM type: YTN; PAM sequence: TTC
cttggcagtaagagacaacc

SEQ ID NO: 74446 - DNA, 20 bp, Artificial Sequence
  Description of Artificial Sequence: Synthetic oligonucleotide
  Target: SCN9A; (-) strand; PAM type: YTN; PAM sequence: CTT
ccttggcagtaagagacaac

SEQ ID NO: 74447 - DNA, 20 bp, Artificial Sequence
  Description of Artificial Sequence: Synthetic oligonucleotide
  Target: SCN9A; (-) strand; PAM type: YTN; PAM sequence: TTC
atgaggtcttccttggcagt

SEQ ID NO: 74448 - DNA, 20 bp, Artificial Sequence
  Description of Artificial Sequence: Synthetic oligonucleotide
  Target: SCN9A; (-) strand; PAM type: YTN; PAM sequence: CTC
agttcatgaggtcttccttg

SEQ ID NO: 74449 - DNA, 20 bp, Artificial Sequence
  Description of Artificial Sequence: Synthetic oligonucleotide
  Target: SCN9A; (-) strand; PAM type: YTN; PAM sequence: CTG
ctcagttcatgaggtcttcc

SEQ ID NO: 74450 - DNA, 20 bp, Artificial Sequence
  Description of Artificial Sequence: Synthetic oligonucleotide
  Target: SCN9A; (-) strand; PAM type: YTN; PAM sequence: CTC
tgctcagttcatgaggtctt

SEQ ID NO: 74451 - DNA, 20 bp, Artificial Sequence
  Description of Artificial Sequence: Synthetic oligonucleotide
  Target: SCN9A; (-) strand; PAM type: YTN; PAM sequence: TTA
tcatcatatgctctgctcag

SEQ ID NO: 74452 - DNA, 20 bp, Artificial Sequence
  Description of Artificial Sequence: Synthetic oligonucleotide
  Target: SCN9A; (-) strand; PAM type: YTN; PAM sequence: TTT
atcatcatatgctctgctca

SEQ ID NO: 74453 - DNA, 20 bp, Artificial Sequence
  Description of Artificial Sequence: Synthetic oligonucleotide
  Target: SCN9A; (-) strand; PAM type: YTN; PAM sequence: CTG
agtcatttatcatcatatgc

SEQ ID NO: 74454 - DNA, 20 bp, Artificial Sequence
  Description of Artificial Sequence: Synthetic oligonucleotide
  Target: SCN9A; (-) strand; PAM type: YTN; PAM sequence: TTC
aaactgagtcatttatcatc

SEQ ID NO: 74455 - DNA, 20 bp, Artificial Sequence
  Description of Artificial Sequence: Synthetic oligonucleotide
  Target: SCN9A; (-) strand; PAM type: YTN; PAM sequence: TTT
caaactgagtcatttatcat

SEQ ID NO: 74456 - DNA, 20 bp, Artificial Sequence
  Description of Artificial Sequence: Synthetic oligonucleotide
  Target: SCN9A; (-) strand; PAM type: YTN; PAM sequence: CTT
tcaaactgagtcatttatca

SEQ ID NO: 74457 - DNA, 20 bp, Artificial Sequence
  Description of Artificial Sequence: Synthetic oligonucleotide
  Target: SCN9A; (-) strand; PAM type: YTN; PAM sequence: TTC
ctttcaaactgagtcattta

SEQ ID NO: 74458 - DNA, 20 bp, Artificial Sequence
  Description of Artificial Sequence: Synthetic oligonucleotide
  Target: SCN9A; (-) strand; PAM type: YTN; PAM sequence: TTG
ttcctttcaaactgagtcat

SEQ ID NO: 74459 - DNA, 20 bp, Artificial Sequence
  Description of Artificial Sequence: Synthetic oligonucleotide
  Target: SCN9A; (-) strand; PAM type: YTN; PAM sequence: CTA
attgttcctttcaaactgag

SEQ ID NO: 74460 - DNA, 20 bp, Artificial Sequence
  Description of Artificial Sequence: Synthetic oligonucleotide
  Target: SCN9A; (-) strand; PAM type: YTN; PAM sequence: TTC
actaattgttcctttcaaac

SEQ ID NO: 74461 - DNA, 20 bp, Artificial Sequence
  Description of Artificial Sequence: Synthetic oligonucleotide
  Target: SCN9A; (-) strand; PAM type: YTN; PAM sequence: TTT
cactaattgttcctttcaaa

SEQ ID NO: 74462 - DNA, 20 bp, Artificial Sequence
  Description of Artificial Sequence: Synthetic oligonucleotide
  Target: SCN9A; (-) strand; PAM type: YTN; PAM sequence: CTC
catttcactaattgttcctt

SEQ ID NO: 74463 - DNA, 20 bp, Artificial Sequence
  Description of Artificial Sequence: Synthetic oligonucleotide
  Target: SCN9A; (-) strand; PAM type: YTN; PAM sequence: TTC
tccatttcactaattgttcc

SEQ ID NO: 74464 - DNA, 20 bp, Artificial Sequence
  Description of Artificial Sequence: Synthetic oligonucleotide
  Target: SCN9A; (-) strand; PAM type: YTN; PAM sequence: TTG
cattctccatttcactaatt

SEQ ID NO: 74465 - DNA, 20 bp, Artificial Sequence
  Description of Artificial Sequence: Synthetic oligonucleotide
  Target: SCN9A; (-) strand; PAM type: YTN; PAM sequence: CTT
gcattctccatttcactaat

SEQ ID NO: 74466 - DNA, 20 bp, Artificial Sequence
  Description of Artificial Sequence: Synthetic oligonucleotide
  Target: SCN9A; (-) strand; PAM type: YTN; PAM sequence: TTC
agatgtagcttgcattctcc

SEQ ID NO: 74467 - DNA, 20 bp, Artificial Sequence
  Description of Artificial Sequence: Synthetic oligonucleotide
  Target: SCN9A; (-) strand; PAM type: YTN; PAM sequence: TTT
cagatgtagcttgcattctc

SEQ ID NO: 74468 - DNA, 20 bp, Artificial Sequence
  Description of Artificial Sequence: Synthetic oligonucleotide
  Target: SCN9A; (-) strand; PAM type: YTN; PAM sequence: CTT
tcagatgtagcttgcattct

SEQ ID NO: 74469 - DNA, 20 bp, Artificial Sequence
  Description of Artificial Sequence: Synthetic oligonucleotide
  Target: SCN9A; (-) strand; PAM type: YTN; PAM sequence: CTC
tttcagatgtagcttgcatt

SEQ ID NO: 74470 - DNA, 20 bp, Artificial Sequence
  Description of Artificial Sequence: Synthetic oligonucleotide
  Target: SCN9A; (-) strand; PAM type: YTN; PAM sequence: CTG
aagagaggtcacctctttca

SEQ ID NO: 74471 - DNA, 20 bp, Artificial Sequence
  Description of Artificial Sequence: Synthetic oligonucleotide
  Target: SCN9A; (-) strand; PAM type: YTN; PAM sequence: CTA
gagctgaagagaggtcacct

SEQ ID NO: 74472 - DNA, 20 bp, Artificial Sequence
  Description of Artificial Sequence: Synthetic oligonucleotide
  Target: SCN9A; (-) strand; PAM type: YTN; PAM sequence: TTC
tagagctgaagagaggtcac

SEQ ID NO: 74473 - DNA, 20 bp, Artificial Sequence
  Description of Artificial Sequence: Synthetic oligonucleotide
  Target: SCN9A; (-) strand; PAM type: YTN; PAM sequence: TTT
ctagagctgaagagaggtca

SEQ ID NO: 74474 - DNA, 20 bp, Artificial Sequence
  Description of Artificial Sequence: Synthetic oligonucleotide
  Target: SCN9A; (-) strand; PAM type: YTN; PAM sequence: TTG
catggcaacaatttctagag

SEQ ID NO: 74475 - DNA, 20 bp, Artificial Sequence
  Description of Artificial Sequence: Synthetic oligonucleotide
  Target: SCN9A; (-) strand; PAM type: YTN; PAM sequence: TTT
gcatggcaacaatttctaga

SEQ ID NO: 74476 - DNA, 20 bp, Artificial Sequence
  Description of Artificial Sequence: Synthetic oligonucleotide
  Target: SCN9A; (-) strand; PAM type: YTN; PAM sequence: TTT
tgcatggcaacaatttctag

SEQ ID NO: 74477 - DNA, 20 bp, Artificial Sequence
  Description of Artificial Sequence: Synthetic oligonucleotide
  Target: SCN9A; (-) strand; PAM type: YTN; PAM sequence: TTT
ttgcatggcaacaatttcta

SEQ ID NO: 74478 - DNA, 20 bp, Artificial Sequence
  Description of Artificial Sequence: Synthetic oligonucleotide
  Target: SCN9A; (-) strand; PAM type: YTN; PAM sequence: TTC
atgtttttgcatggcaacaa

SEQ ID NO: 74479 - DNA, 20 bp, Artificial Sequence
  Description of Artificial Sequence: Synthetic oligonucleotide
  Target: SCN9A; (-) strand; PAM type: YTN; PAM sequence: TTA
tgcatgagttcatgtttttg

SEQ ID NO: 74480 - DNA, 20 bp, Artificial Sequence
  Description of Artificial Sequence: Synthetic oligonucleotide
  Target: SCN9A; (-) strand; PAM type: YTN; PAM sequence: TTG
ttatgcatgagttcatgttt

SEQ ID NO: 74481 - DNA, 20 bp, Artificial Sequence
  Description of Artificial Sequence: Synthetic oligonucleotide
  Target: SCN9A; (-) strand; PAM type: YTN; PAM sequence: CTT
gttatgcatgagttcatgtt

SEQ ID NO: 74482 - DNA, 20 bp, Artificial Sequence
  Description of Artificial Sequence: Synthetic oligonucleotide
  Target: SCN9A; (-) strand; PAM type: YTN; PAM sequence: CTC
acaaaaataaatacacttgt

SEQ ID NO: 74483 - DNA, 20 bp, Artificial Sequence
  Description of Artificial Sequence: Synthetic oligonucleotide
  Target: SCN9A; (-) strand; PAM type: YTN; PAM sequence: TTC
tcacaaaaataaatacactt

SEQ ID NO: 74484 - DNA, 20 bp, Artificial Sequence
  Description of Artificial Sequence: Synthetic oligonucleotide
  Target: SCN9A; (-) strand; PAM type: YTN; PAM sequence: TTT
ctcacaaaaataaatacact

SEQ ID NO: 74485 - DNA, 20 bp, Artificial Sequence
  Description of Artificial Sequence: Synthetic oligonucleotide
  Target: SCN9A; (-) strand; PAM type: YTN; PAM sequence: TTT
tctcacaaaaataaatacac

SEQ ID NO: 74486 - DNA, 20 bp, Artificial Sequence
  Description of Artificial Sequence: Synthetic oligonucleotide
  Target: SCN9A; (-) strand; PAM type: YTN; PAM sequence: TTA
aaaataagacattttctcac

SEQ ID NO: 74487 - DNA, 20 bp, Artificial Sequence
  Description of Artificial Sequence: Synthetic oligonucleotide
  Target: SCN9A; (-) strand; PAM type: YTN; PAM sequence: TTT
aaaaataagacattttctca

SEQ ID NO: 74488 - DNA, 20 bp, Artificial Sequence
  Description of Artificial Sequence: Synthetic oligonucleotide
  Target: SCN9A; (-) strand; PAM type: YTN; PAM sequence: TTT
taaaaataagacattttctc

SEQ ID NO: 74489 - DNA, 20 bp, Artificial Sequence
  Description of Artificial Sequence: Synthetic oligonucleotide
  Target: SCN9A; (-) strand; PAM type: YTN; PAM sequence: TTC
caagttttaaaaataagaca

SEQ ID NO: 74490 - DNA, 20 bp, Artificial Sequence
  Description of Artificial Sequence: Synthetic oligonucleotide
  Target: SCN9A; (-) strand; PAM type: YTN; PAM sequence: TTT
ccaagttttaaaaataagac

SEQ ID NO: 74491 - DNA, 20 bp, Artificial Sequence
  Description of Artificial Sequence: Synthetic oligonucleotide
  Target: SCN9A; (-) strand; PAM type: YTN; PAM sequence: TTA
gtttccaagttttaaaaata

SEQ ID NO: 74492 - DNA, 20 bp, Artificial Sequence
  Description of Artificial Sequence: Synthetic oligonucleotide
  Target: SCN9A; (-) strand; PAM type: YTN; PAM sequence: TTG
aattagtttccaagttttaa

SEQ ID NO: 74493 - DNA, 20 bp, Artificial Sequence
  Description of Artificial Sequence: Synthetic oligonucleotide
  Target: SCN9A; (-) strand; PAM type: YTN; PAM sequence: TTT
gaattagtttccaagtttta

SEQ ID NO: 74494 - DNA, 20 bp, Artificial Sequence
  Description of Artificial Sequence: Synthetic oligonucleotide
  Target: SCN9A; (-) strand; PAM type: YTN; PAM sequence: TTA
aatttgaattagtttccaag

SEQ ID NO: 74495 - DNA, 20 bp, Artificial Sequence
  Description of Artificial Sequence: Synthetic oligonucleotide
  Target: SCN9A; (-) strand; PAM type: YTN; PAM sequence: TTT
aaatttgaattagtttccaa

SEQ ID NO: 74496 - DNA, 20 bp, Artificial Sequence
  Description of Artificial Sequence: Synthetic oligonucleotide
  Target: SCN9A; (-) strand; PAM type: YTN; PAM sequence: TTT
taaatttgaattagtttcca

SEQ ID NO: 74497 - DNA, 20 bp, Artificial Sequence
  Description of Artificial Sequence: Synthetic oligonucleotide
  Target: SCN9A; (-) strand; PAM type: YTN; PAM sequence: CTG
catggaaccaacatagtgtt

SEQ ID NO: 74498 - DNA, 20 bp, Artificial Sequence
  Description of Artificial Sequence: Synthetic oligonucleotide
  Target: SCN9A; (-) strand; PAM type: YTN; PAM sequence: CTG
gcctgcatggaaccaacata

SEQ ID NO: 74499 - DNA, 20 bp, Artificial Sequence
  Description of Artificial Sequence: Synthetic oligonucleotide
  Target: SCN9A; (-) strand; PAM type: YTN; PAM sequence: TTC
tggcctgcatggaaccaaca

SEQ ID NO: 74500 - DNA, 20 bp, Artificial Sequence
  Description of Artificial Sequence: Synthetic oligonucleotide
  Target: SCN9A; (-) strand; PAM type: YTN; PAM sequence: TTT
ctggcctgcatggaaccaac

SEQ ID NO: 74501 - DNA, 20 bp, Artificial Sequence
  Description of Artificial Sequence: Synthetic oligonucleotide
  Target: SCN9A; (-) strand; PAM type: YTN; PAM sequence: TTG
tgtatatatgtgtgtgtgag

SEQ ID NO: 74502 - DNA, 20 bp, Artificial Sequence
  Description of Artificial Sequence: Synthetic oligonucleotide
  Target: SCN9A; (-) strand; PAM type: YTN; PAM sequence: TTT
gtgtatatatgtgtgtgtga

SEQ ID NO: 74503 - DNA, 20 bp, Artificial Sequence
  Description of Artificial Sequence: Synthetic oligonucleotide
  Target: SCN9A; (-) strand; PAM type: YTN; PAM sequence: TTG
tttgtgtatatatgtgtgtg

SEQ ID NO: 74504 - DNA, 20 bp, Artificial Sequence
  Description of Artificial Sequence: Synthetic oligonucleotide
  Target: SCN9A; (-) strand; PAM type: YTN; PAM sequence: TTG
tatagttgtttgtgtatata

SEQ ID NO: 74505 - DNA, 20 bp, Artificial Sequence
  Description of Artificial Sequence: Synthetic oligonucleotide
  Target: SCN9A; (-) strand; PAM type: YTN; PAM sequence: CTA
gagttgtatagttgtttgtg

SEQ ID NO: 74506 - DNA, 20 bp, Artificial Sequence
  Description of Artificial Sequence: Synthetic oligonucleotide
  Target: SCN9A; (-) strand; PAM type: YTN; PAM sequence: TTA
aaatatataccacataccac

SEQ ID NO: 74507 - DNA, 20 bp, Artificial Sequence
  Description of Artificial Sequence: Synthetic oligonucleotide
  Target: SCN9A; (-) strand; PAM type: YTN; PAM sequence: TTT
aaaatatataccacatacca

SEQ ID NO: 74508 - DNA, 20 bp, Artificial Sequence
  Description of Artificial Sequence: Synthetic oligonucleotide
  Target: SCN9A; (-) strand; PAM type: YTN; PAM sequence: CTA
gaaatatatatttaaaatat

SEQ ID NO: 74509 - DNA, 20 bp, Artificial Sequence
  Description of Artificial Sequence: Synthetic oligonucleotide
  Target: SCN9A; (-) strand; PAM type: YTN; PAM sequence: TTA
caaatctagaaatatatatt

SEQ ID NO: 74510 - DNA, 20 bp, Artificial Sequence
  Description of Artificial Sequence: Synthetic oligonucleotide
  Target: SCN9A; (-) strand; PAM type: YTN; PAM sequence: TTT
acaaatctagaaatatatat

SEQ ID NO: 74511 - DNA, 20 bp, Artificial Sequence
  Description of Artificial Sequence: Synthetic oligonucleotide
  Target: SCN9A; (-) strand; PAM type: YTN; PAM sequence: CTT
tacaaatctagaaatatata

SEQ ID NO: 74512 - DNA, 20 bp, Artificial Sequence
  Description of Artificial Sequence: Synthetic oligonucleotide
  Target: SCN9A; (-) strand; PAM type: YTN; PAM sequence: CTA
tacaactttacaaatctaga

SEQ ID NO: 74513 - DNA, 20 bp, Artificial Sequence
  Description of Artificial Sequence: Synthetic oligonucleotide
  Target: SCN9A; (-) strand; PAM type: YTN; PAM sequence: CTA
tacaactatacaactttaca

SEQ ID NO: 74514 - DNA, 20 bp, Artificial Sequence
  Description of Artificial Sequence: Synthetic oligonucleotide
  Target: SCN9A; (-) strand; PAM type: YTN; PAM sequence: CTA
tacctatacaactatacaac

SEQ ID NO: 74515 - DNA, 20 bp, Artificial Sequence
  Description of Artificial Sequence: Synthetic oligonucleotide
  Target: SCN9A; (-) strand; PAM type: YTN; PAM sequence: TTG
atacacatacatgcatgact

SEQ ID NO: 74516 - DNA, 20 bp, Artificial Sequence
  Description of Artificial Sequence: Synthetic oligonucleotide
  Target: SCN9A; (-) strand; PAM type: YTN; PAM sequence: TTT
gatacacatacatgcatgac

SEQ ID NO: 74517 - DNA, 20 bp, Artificial Sequence
  Description of Artificial Sequence: Synthetic oligonucleotide
  Target: SCN9A; (-) strand; PAM type: YTN; PAM sequence: TTT
tgatacacatacatgcatga

SEQ ID NO: 74518 - DNA, 20 bp, Artificial Sequence
  Description of Artificial Sequence: Synthetic oligonucleotide
  Target: SCN9A; (-) strand; PAM type: YTN; PAM sequence: CTG
tgttttgatacacatacatg

SEQ ID NO: 74519 - DNA, 20 bp, Artificial Sequence
  Description of Artificial Sequence: Synthetic oligonucleotide
  Target: SCN9A; (-) strand; PAM type: YTN; PAM sequence: CTG
tatgtctgtgttttgataca

SEQ ID NO: 74520 - DNA, 20 bp, Artificial Sequence
  Description of Artificial Sequence: Synthetic oligonucleotide
  Target: SCN9A; (-) strand; PAM type: YTN; PAM sequence: CTA
tgcctgtatgtctgtgtttt

SEQ ID NO: 74521 - DNA, 20 bp, Artificial Sequence
  Description of Artificial Sequence: Synthetic oligonucleotide
  Target: SCN9A; (-) strand; PAM type: YTN; PAM sequence: TTC
acatacacatagatgcataa

SEQ ID NO: 74522 - DNA, 20 bp, Artificial Sequence
  Description of Artificial Sequence: Synthetic oligonucleotide
  Target: SCN9A; (-) strand; PAM type: YTN; PAM sequence: CTG
ttcacatacacatagatgca

SEQ ID NO: 74523 - DNA, 20 bp, Artificial Sequence
  Description of Artificial Sequence: Synthetic oligonucleotide
  Target: SCN9A; (-) strand; PAM type: YTN; PAM sequence: CTC
aaatgggtgtgtctgttcac

SEQ ID NO: 74524 - DNA, 20 bp, Artificial Sequence
  Description of Artificial Sequence: Synthetic oligonucleotide
  Target: SCN9A; (-) strand; PAM type: YTN; PAM sequence: CTC
tcaaatgggtgtgtctgttc

SEQ ID NO: 74525 - DNA, 20 bp, Artificial Sequence
  Description of Artificial Sequence: Synthetic oligonucleotide
  Target: SCN9A; (-) strand; PAM type: YTN; PAM sequence: TTA
cagagatctctcaaatgggt

SEQ ID NO: 74526 - DNA, 20 bp, Artificial Sequence
  Description of Artificial Sequence: Synthetic oligonucleotide
  Target: SCN9A; (-) strand; PAM type: YTN; PAM sequence: TTT
acagagatctctcaaatggg

SEQ ID NO: 74527 - DNA, 20 bp, Artificial Sequence
  Description of Artificial Sequence: Synthetic oligonucleotide
  Target: SCN9A; (-) strand; PAM type: YTN; PAM sequence: TTT
tacagagatctctcaaatgg

SEQ ID NO: 74528 - DNA, 20 bp, Artificial Sequence
  Description of Artificial Sequence: Synthetic oligonucleotide
  Target: SCN9A; (-) strand; PAM type: YTN; PAM sequence: TTT
ttacagagatctctcaaatg

SEQ ID NO: 74529 - DNA, 20 bp, Artificial Sequence
  Description of Artificial Sequence: Synthetic oligonucleotide
  Target: SCN9A; (-) strand; PAM type: YTN; PAM sequence: CTT
tttacagagatctctcaaat

SEQ ID NO: 74530 - DNA, 20 bp, Artificial Sequence
  Description of Artificial Sequence: Synthetic oligonucleotide
  Target: SCN9A; (-) strand; PAM type: YTN; PAM sequence: TTG
actttttacagagatctctc

SEQ ID NO: 74531 - DNA, 20 bp, Artificial Sequence
  Description of Artificial Sequence: Synthetic oligonucleotide
  Target: SCN9A; (-) strand; PAM type: YTN; PAM sequence: TTC
aaaaagttgactttttacag

SEQ ID NO: 74532 - DNA, 20 bp, Artificial Sequence
  Description of Artificial Sequence: Synthetic oligonucleotide
  Target: SCN9A; (-) strand; PAM type: YTN; PAM sequence: TTT
caaaaagttgactttttaca

SEQ ID NO: 74533 - DNA, 20 bp, Artificial Sequence
  Description of Artificial Sequence: Synthetic oligonucleotide
  Target: SCN9A; (-) strand; PAM type: YTN; PAM sequence: TTT
tcaaaaagttgactttttac

SEQ ID NO: 74534 - DNA, 20 bp, Artificial Sequence
  Description of Artificial Sequence: Synthetic oligonucleotide
  Target: SCN9A; (-) strand; PAM type: YTN; PAM sequence: CTT
ttcaaaaagttgacttttta

SEQ ID NO: 74535 - DNA, 20 bp, Artificial Sequence
  Description of Artificial Sequence: Synthetic oligonucleotide
  Target: SCN9A; (-) strand; PAM type: YTN; PAM sequence: TTC
gagacttttcaaaaagttga

SEQ ID NO: 74536 - DNA, 20 bp, Artificial Sequence
  Description of Artificial Sequence: Synthetic oligonucleotide
  Target: SCN9A; (-) strand; PAM type: YTN; PAM sequence: TTT
cgagacttttcaaaaagttg

SEQ ID NO: 74537 - DNA, 20 bp, Artificial Sequence
  Description of Artificial Sequence: Synthetic oligonucleotide
  Target: SCN9A; (-) strand; PAM type: YTN; PAM sequence: TTT
tcgagacttttcaaaaagtt

SEQ ID NO: 74538 - DNA, 20 bp, Artificial Sequence
  Description of Artificial Sequence: Synthetic oligonucleotide
  Target: SCN9A; (-) strand; PAM type: YTN; PAM sequence: CTG
gttttcgagacttttcaaaa

SEQ ID NO: 74539 - DNA, 20 bp, Artificial Sequence
  Description of Artificial Sequence: Synthetic oligonucleotide
  Target: SCN9A; (-) strand; PAM type: YTN; PAM sequence: CTA
tagcacagaaaacctggttt

SEQ ID NO: 74540 - DNA, 20 bp, Artificial Sequence
  Description of Artificial Sequence: Synthetic oligonucleotide
  Target: SCN9A; (-) strand; PAM type: YTN; PAM sequence: TTG
acagactatagcacagaaaa

SEQ ID NO: 74541 - DNA, 20 bp, Artificial Sequence
  Description of Artificial Sequence: Synthetic oligonucleotide
  Target: SCN9A; (-) strand; PAM type: YTN; PAM sequence: TTT
gacagactatagcacagaaa

SEQ ID NO: 74542 - DNA, 20 bp, Artificial Sequence
  Description of Artificial Sequence: Synthetic oligonucleotide
  Target: SCN9A; (-) strand; PAM type: YTN; PAM sequence: TTG
tttgacagactatagcacag

SEQ ID NO: 74543 - DNA, 20 bp, Artificial Sequence
  Description of Artificial Sequence: Synthetic oligonucleotide
  Target: SCN9A; (-) strand; PAM type: YTN; PAM sequence: CTT
gtttgacagactatagcaca

SEQ ID NO: 74544 - DNA, 20 bp, Artificial Sequence
  Description of Artificial Sequence: Synthetic oligonucleotide
  Target: SCN9A; (-) strand; PAM type: YTN; PAM sequence: TTC
ttgtttgacagactatagca

SEQ ID NO: 74545 - DNA, 20 bp, Artificial Sequence
  Description of Artificial Sequence: Synthetic oligonucleotide
  Target: SCN9A; (-) strand; PAM type: YTN; PAM sequence: CTG
acaaattcttgtttgacaga

SEQ ID NO: 74546 - DNA, 20 bp, Artificial Sequence
  Description of Artificial Sequence: Synthetic oligonucleotide
  Target: SCN9A; (-) strand; PAM type: YTN; PAM sequence: TTA
atctgacaaattcttgtttg

SEQ ID NO: 74547 - DNA, 20 bp, Artificial Sequence
  Description of Artificial Sequence: Synthetic oligonucleotide
  Target: SCN9A; (-) strand; PAM type: YTN; PAM sequence: TTT
aatctgacaaattcttgttt

SEQ ID NO: 74548 - DNA, 20 bp, Artificial Sequence
  Description of Artificial Sequence: Synthetic oligonucleotide
  Target: SCN9A; (-) strand; PAM type: YTN; PAM sequence: TTG
tttaatctgacaaattcttg

SEQ ID NO: 74549 - DNA, 20 bp, Artificial Sequence
  Description of Artificial Sequence: Synthetic oligonucleotide
  Target: SCN9A; (-) strand; PAM type: YTN; PAM sequence: TTT
gtttaatctgacaaattctt

SEQ ID NO: 74550 - DNA, 20 bp, Artificial Sequence
  Description of Artificial Sequence: Synthetic oligonucleotide
  Target: SCN9A; (-) strand; PAM type: YTN; PAM sequence: CTA
catggaaaataatttgttta

SEQ ID NO: 74551 - DNA, 20 bp, Artificial Sequence
  Description of Artificial Sequence: Synthetic oligonucleotide
  Target: SCN9A; (-) strand; PAM type: YTN; PAM sequence: CTG
aaacatgtctacatggaaaa

SEQ ID NO: 74552 - DNA, 20 bp, Artificial Sequence
  Description of Artificial Sequence: Synthetic oligonucleotide
  Target: SCN9A; (-) strand; PAM type: YTN; PAM sequence: CTA
tacctgaaacatgtctacat

SEQ ID NO: 74553 - DNA, 20 bp, Artificial Sequence
  Description of Artificial Sequence: Synthetic oligonucleotide
  Target: SCN9A; (-) strand; PAM type: YTN; PAM sequence: CTC
tatacctgaaacatgtctac

SEQ ID NO: 74554 - DNA, 20 bp, Artificial Sequence
  Description of Artificial Sequence: Synthetic oligonucleotide
  Target: SCN9A; (-) strand; PAM type: YTN; PAM sequence: CTA
ataacgtcatctctatacct

SEQ ID NO: 74555 - DNA, 20 bp, Artificial Sequence
  Description of Artificial Sequence: Synthetic oligonucleotide
  Target: SCN9A; (-) strand; PAM type: YTN; PAM sequence: CTG
cataactaataacgtcatct

SEQ ID NO: 74556 - DNA, 20 bp, Artificial Sequence
  Description of Artificial Sequence: Synthetic oligonucleotide
  Target: SCN9A; (-) strand; PAM type: YTN; PAM sequence: TTA
tatgaaaacactgcataact

SEQ ID NO: 74557 - DNA, 20 bp, Artificial Sequence
  Description of Artificial Sequence: Synthetic oligonucleotide
  Target: SCN9A; (-) strand; PAM type: YTN; PAM sequence: TTT
atatgaaaacactgcataac

SEQ ID NO: 74558 - DNA, 20 bp, Artificial Sequence
  Description of Artificial Sequence: Synthetic oligonucleotide
  Target: SCN9A; (-) strand; PAM type: YTN; PAM sequence: TTG
tggcacaatatatggtttat

SEQ ID NO: 74559 - DNA, 20 bp, Artificial Sequence
  Description of Artificial Sequence: Synthetic oligonucleotide
  Target: SCN9A; (-) strand; PAM type: YTN; PAM sequence: TTA
taagatacaatggaaataca

SEQ ID NO: 74560 - DNA, 20 bp, Artificial Sequence
  Description of Artificial Sequence: Synthetic oligonucleotide
  Target: SCN9A; (-) strand; PAM type: YTN; PAM sequence: CTT
ataagatacaatggaaatac

SEQ ID NO: 74561 - DNA, 20 bp, Artificial Sequence
  Description of Artificial Sequence: Synthetic oligonucleotide
  Target: SCN9A; (-) strand; PAM type: YTN; PAM sequence: TTA
gtggatacttataagataca

SEQ ID NO: 74562 - DNA, 20 bp, Artificial Sequence
  Description of Artificial Sequence: Synthetic oligonucleotide
  Target: SCN9A; (-) strand; PAM type: YTN; PAM sequence: CTA
gaggaattagtggatactta

SEQ ID NO: 74563 - DNA, 20 bp, Artificial Sequence
  Description of Artificial Sequence: Synthetic oligonucleotide
  Target: SCN9A; (-) strand; PAM type: YTN; PAM sequence: CTA
caaaactagaggaattagtg

SEQ ID NO: 74564 - DNA, 20 bp, Artificial Sequence
  Description of Artificial Sequence: Synthetic oligonucleotide
  Target: SCN9A; (-) strand; PAM type: YTN; PAM sequence: CTA
aagtgaaaactacaaaacta

SEQ ID NO: 74565 - DNA, 20 bp, Artificial Sequence
  Description of Artificial Sequence: Synthetic oligonucleotide
  Target: SCN9A; (-) strand; PAM type: YTN; PAM sequence: TTC
accatagaaaaatcagtatc

SEQ ID NO: 74566 - DNA, 20 bp, Artificial Sequence
  Description of Artificial Sequence: Synthetic oligonucleotide
  Target: SCN9A; (-) strand; PAM type: YTN; PAM sequence: TTT
caccatagaaaaatcagtat

SEQ ID NO: 74567 - DNA, 20 bp, Artificial Sequence
  Description of Artificial Sequence: Synthetic oligonucleotide
  Target: SCN9A; (-) strand; PAM type: YTN; PAM sequence: TTT
tcaccatagaaaaatcagta

SEQ ID NO: 74568 - DNA, 20 bp, Artificial Sequence
  Description of Artificial Sequence: Synthetic oligonucleotide
  Target: SCN9A; (-) strand; PAM type: YTN; PAM sequence: TTT
ttcaccatagaaaaatcagt

SEQ ID NO: 74569 - DNA, 20 bp, Artificial Sequence
  Description of Artificial Sequence: Synthetic oligonucleotide
  Target: SCN9A; (-) strand; PAM type: YTN; PAM sequence: TTT
tttcaccatagaaaaatcag

SEQ ID NO: 74570 - DNA, 20 bp, Artificial Sequence
  Description of Artificial Sequence: Synthetic oligonucleotide
  Target: SCN9A; (-) strand; PAM type: YTN; PAM sequence: TTA
agagttttttcaccatagaa

SEQ ID NO: 74571 - DNA, 20 bp, Artificial Sequence
  Description of Artificial Sequence: Synthetic oligonucleotide
  Target: SCN9A; (-) strand; PAM type: YTN; PAM sequence: TTT
aagagttttttcaccataga

SEQ ID NO: 74572 - DNA, 20 bp, Artificial Sequence
  Description of Artificial Sequence: Synthetic oligonucleotide
  Target: SCN9A; (-) strand; PAM type: YTN; PAM sequence: TTC
atttaagagttttttcacca

SEQ ID NO: 74573 - DNA, 20 bp, Artificial Sequence
  Description of Artificial Sequence: Synthetic oligonucleotide
  Target: SCN9A; (-) strand; PAM type: YTN; PAM sequence: CTT
catttaagagttttttcacc

SEQ ID NO: 74574 - DNA, 20 bp, Artificial Sequence
  Description of Artificial Sequence: Synthetic oligonucleotide
  Target: SCN9A; (-) strand; PAM type: YTN; PAM sequence: TTC
ttcatttaagagttttttca

SEQ ID NO: 74575 - DNA, 20 bp, Artificial Sequence
  Description of Artificial Sequence: Synthetic oligonucleotide
  Target: SCN9A; (-) strand; PAM type: YTN; PAM sequence: TTT
cttcatttaagagttttttc

SEQ ID NO: 74576 - DNA, 20 bp, Artificial Sequence
  Description of Artificial Sequence: Synthetic oligonucleotide
  Target: SCN9A; (-) strand; PAM type: YTN; PAM sequence: TTA
atgaagtttcttcatttaag

SEQ ID NO: 74577 - DNA, 20 bp, Artificial Sequence
  Description of Artificial Sequence: Synthetic oligonucleotide
  Target: SCN9A; (-) strand; PAM type: YTN; PAM sequence: TTT
aatgaagtttcttcatttaa

SEQ ID NO: 74578 - DNA, 20 bp, Artificial Sequence
  Description of Artificial Sequence: Synthetic oligonucleotide
  Target: SCN9A; (-) strand; PAM type: YTN; PAM sequence: TTT
taatgaagtttcttcattta

SEQ ID NO: 74579 - DNA, 20 bp, Artificial Sequence
  Description of Artificial Sequence: Synthetic oligonucleotide
  Target: SCN9A; (-) strand; PAM type: YTN; PAM sequence: TTT
ttaatgaagtttcttcattt

SEQ ID NO: 74580 - DNA, 20 bp, Artificial Sequence
  Description of Artificial Sequence: Synthetic oligonucleotide
  Target: SCN9A; (-) strand; PAM type: YTN; PAM sequence: TTC
atatttttaatgaagtttct

SEQ ID NO: 74581 - DNA, 20 bp, Artificial Sequence
  Description of Artificial Sequence: Synthetic oligonucleotide
  Target: SCN9A; (-) strand; PAM type: YTN; PAM sequence: TTT
catatttttaatgaagtttc

SEQ ID NO: 74582 - DNA, 20 bp, Artificial Sequence
  Description of Artificial Sequence: Synthetic oligonucleotide
  Target: SCN9A; (-) strand; PAM type: YTN; PAM sequence: TTA
tttcatatttttaatgaagt

SEQ ID NO: 74583 - DNA, 20 bp, Artificial Sequence
  Description of Artificial Sequence: Synthetic oligonucleotide
  Target: SCN9A; (-) strand; PAM type: YTN; PAM sequence: TTA
ggagattatttcatattttt

SEQ ID NO: 74584 - DNA, 20 bp, Artificial Sequence
  Description of Artificial Sequence: Synthetic oligonucleotide
  Target: SCN9A; (-) strand; PAM type: YTN; PAM sequence: TTA
tatcagattaggagattatt

SEQ ID NO: 74585 - DNA, 20 bp, Artificial Sequence
  Description of Artificial Sequence: Synthetic oligonucleotide
  Target: SCN9A; (-) strand; PAM type: YTN; PAM sequence: TTT
atatcagattaggagattat

SEQ ID NO: 74586 - DNA, 20 bp, Artificial Sequence
  Description of Artificial Sequence: Synthetic oligonucleotide
  Target: SCN9A; (-) strand; PAM type: YTN; PAM sequence: CTA
tataatttatatcagattag

SEQ ID NO: 74587 - DNA, 20 bp, Artificial Sequence
  Description of Artificial Sequence: Synthetic oligonucleotide
  Target: SCN9A; (-) strand; PAM type: YTN; PAM sequence: TTA
tgtgtgtaatatgtaaaata

SEQ ID NO: 74588 - DNA, 20 bp, Artificial Sequence
  Description of Artificial Sequence: Synthetic oligonucleotide
  Target: SCN9A; (-) strand; PAM type: YTN; PAM sequence: TTG
caattatgtgtgtaatatgt

SEQ ID NO: 74589 - DNA, 20 bp, Artificial Sequence
  Description of Artificial Sequence: Synthetic oligonucleotide
  Target: SCN9A; (-) strand; PAM type: YTN; PAM sequence: TTT
gcaattatgtgtgtaatatg

SEQ ID NO: 74590 - DNA, 20 bp, Artificial Sequence
  Description of Artificial Sequence: Synthetic oligonucleotide
  Target: SCN9A; (-) strand; PAM type: YTN; PAM sequence: TTT
tgcaattatgtgtgtaatat

SEQ ID NO: 74591 - DNA, 20 bp, Artificial Sequence
  Description of Artificial Sequence: Synthetic oligonucleotide
  Target: SCN9A; (-) strand; PAM type: YTN; PAM sequence: TTG
ttttgcaattatgtgtgtaa

SEQ ID NO: 74592 - DNA, 20 bp, Artificial Sequence
  Description of Artificial Sequence: Synthetic oligonucleotide
  Target: SCN9A; (-) strand; PAM type: YTN; PAM sequence: TTT
gttttgcaattatgtgtgta

SEQ ID NO: 74593 - DNA, 20 bp, Artificial Sequence
  Description of Artificial Sequence: Synthetic oligonucleotide
  Target: SCN9A; (-) strand; PAM type: YTN; PAM sequence: TTT
tgttttgcaattatgtgtgt

SEQ ID NO: 74594 - DNA, 20 bp, Artificial Sequence
  Description of Artificial Sequence: Synthetic oligonucleotide
  Target: SCN9A; (-) strand; PAM type: YTN; PAM sequence: TTG
cattttgttttgcaattatg

SEQ ID NO: 74595 - DNA, 20 bp, Artificial Sequence
  Description of Artificial Sequence: Synthetic oligonucleotide
  Target: SCN9A; (-) strand; PAM type: YTN; PAM sequence: CTT
gcattttgttttgcaattat

SEQ ID NO: 74596 - DNA, 20 bp, Artificial Sequence
  Description of Artificial Sequence: Synthetic oligonucleotide
  Target: SCN9A; (-) strand; PAM type: YTN; PAM sequence: TTG
cttgcattttgttttgcaat

SEQ ID NO: 74597 - DNA, 20 bp, Artificial Sequence
  Description of Artificial Sequence: Synthetic oligonucleotide
  Target: SCN9A; (-) strand; PAM type: YTN; PAM sequence: TTT
gcttgcattttgttttgcaa

SEQ ID NO: 74598 - DNA, 20 bp, Artificial Sequence
  Description of Artificial Sequence: Synthetic oligonucleotide
  Target: SCN9A; (-) strand; PAM type: YTN; PAM sequence: CTT
tgcttgcattttgttttgca

SEQ ID NO: 74599 - DNA, 20 bp, Artificial Sequence
  Description of Artificial Sequence: Synthetic oligonucleotide
  Target: SCN9A; (-) strand; PAM type: YTN; PAM sequence: CTG
tggaatcaaactttgcttgc

SEQ ID NO: 74600 - DNA, 20 bp, Artificial Sequence
  Description of Artificial Sequence: Synthetic oligonucleotide
  Target: SCN9A; (-) strand; PAM type: YTN; PAM sequence: TTC
tgtggaatcaaactttgctt

SEQ ID NO: 74601 - DNA, 20 bp, Artificial Sequence
  Description of Artificial Sequence: Synthetic oligonucleotide
  Target: SCN9A; (-) strand; PAM type: YTN; PAM sequence: TTT
ctgtggaatcaaactttgct

SEQ ID NO: 74602 - DNA, 20 bp, Artificial Sequence
  Description of Artificial Sequence: Synthetic oligonucleotide
  Target: SCN9A; (-) strand; PAM type: YTN; PAM sequence: TTA
aatttctgtggaatcaaact

SEQ ID NO: 74603 - DNA, 20 bp, Artificial Sequence
  Description of Artificial Sequence: Synthetic oligonucleotide
  Target: SCN9A; (-) strand; PAM type: YTN; PAM sequence: TTG
aatgagcatgttaaatttct

SEQ ID NO: 74604 - DNA, 20 bp, Artificial Sequence
  Description of Artificial Sequence: Synthetic oligonucleotide
  Target: SCN9A; (-) strand; PAM type: YTN; PAM sequence: TTA
ttgaatgagcatgttaaatt

SEQ ID NO: 74605 - DNA, 20 bp, Artificial Sequence
  Description of Artificial Sequence: Synthetic oligonucleotide
  Target: SCN9A; (-) strand; PAM type: YTN; PAM sequence: TTC
attattgaatgagcatgtta

SEQ ID NO: 74606 - DNA, 20 bp, Artificial Sequence
  Description of Artificial Sequence: Synthetic oligonucleotide
  Target: SCN9A; (-) strand; PAM type: YTN; PAM sequence: TTT
cattattgaatgagcatgtt

SEQ ID NO: 74607 - DNA, 20 bp, Artificial Sequence
  Description of Artificial Sequence: Synthetic oligonucleotide
  Target: SCN9A; (-) strand; PAM type: YTN; PAM sequence: TTT
tcattattgaatgagcatgt

SEQ ID NO: 74608 - DNA, 20 bp, Artificial Sequence
  Description of Artificial Sequence: Synthetic oligonucleotide
  Target: SCN9A; (-) strand; PAM type: YTN; PAM sequence: TTT
ttcattattgaatgagcatg

SEQ ID NO: 74609 - DNA, 20 bp, Artificial Sequence
  Description of Artificial Sequence: Synthetic oligonucleotide
  Target: SCN9A; (-) strand; PAM type: YTN; PAM sequence: CTG
caaggtatttttcattattg

SEQ ID NO: 74610 - DNA, 20 bp, Artificial Sequence
  Description of Artificial Sequence: Synthetic oligonucleotide
  Target: SCN9A; (-) strand; PAM type: YTN; PAM sequence: TTC
tgcaaggtatttttcattat

SEQ ID NO: 74611 - DNA, 20 bp, Artificial Sequence
  Description of Artificial Sequence: Synthetic oligonucleotide
  Target: SCN9A; (-) strand; PAM type: YTN; PAM sequence: CTT
ctgcaaggtatttttcatta

SEQ ID NO: 74612 - DNA, 20 bp, Artificial Sequence
  Description of Artificial Sequence: Synthetic oligonucleotide
  Target: SCN9A; (-) strand; PAM type: YTN; PAM sequence: TTA
agcccttctgcaaggtattt

SEQ ID NO: 74613 - DNA, 20 bp, Artificial Sequence
  Description of Artificial Sequence: Synthetic oligonucleotide
  Target: SCN9A; (-) strand; PAM type: YTN; PAM sequence: CTT
aagcccttctgcaaggtatt

SEQ ID NO: 74614 - DNA, 20 bp, Artificial Sequence
  Description of Artificial Sequence: Synthetic oligonucleotide
  Target: SCN9A; (-) strand; PAM type: YTN; PAM sequence: CTA
tgtgtgcatgatacagctta

SEQ ID NO: 74615 - DNA, 20 bp, Artificial Sequence
  Description of Artificial Sequence: Synthetic oligonucleotide
  Target: SCN9A; (-) strand; PAM type: YTN; PAM sequence: CTC
tatgtgtgcatgatacagct

SEQ ID NO: 74616 - DNA, 20 bp, Artificial Sequence
  Description of Artificial Sequence: Synthetic oligonucleotide
  Target: SCN9A; (-) strand; PAM type: YTN; PAM sequence: TTA
ggtaacatgtgacctctatg

SEQ ID NO: 74617 - DNA, 20 bp, Artificial Sequence
  Description of Artificial Sequence: Synthetic oligonucleotide
  Target: SCN9A; (-) strand; PAM type: YTN; PAM sequence: TTT
aggtaacatgtgacctctat

SEQ ID NO: 74618 - DNA, 20 bp, Artificial Sequence
  Description of Artificial Sequence: Synthetic oligonucleotide
  Target: SCN9A; (-) strand; PAM type: YTN; PAM sequence: TTT
taggtaacatgtgacctcta

SEQ ID NO: 74619 - DNA, 20 bp, Artificial Sequence
  Description of Artificial Sequence: Synthetic oligonucleotide
  Target: SCN9A; (-) strand; PAM type: YTN; PAM sequence: CTT
ttaggtaacatgtgacctct

SEQ ID NO: 74620 - DNA, 20 bp, Artificial Sequence
  Description of Artificial Sequence: Synthetic oligonucleotide
  Target: SCN9A; (-) strand; PAM type: YTN; PAM sequence: TTG
aataaatgcatgtgctttta

SEQ ID NO: 74621 - DNA, 20 bp, Artificial Sequence
  Description of Artificial Sequence: Synthetic oligonucleotide
  Target: SCN9A; (-) strand; PAM type: YTN; PAM sequence: TTT
gaataaatgcatgtgctttt

SEQ ID NO: 74622 - DNA, 20 bp, Artificial Sequence
  Description of Artificial Sequence: Synthetic oligonucleotide
  Target: SCN9A; (-) strand; PAM type: YTN; PAM sequence: TTC
aatttgaataaatgcatgtg

SEQ ID NO: 74623 - DNA, 20 bp, Artificial Sequence
  Description of Artificial Sequence: Synthetic oligonucleotide
  Target: SCN9A; (-) strand; PAM type: YTN; PAM sequence: TTT
caatttgaataaatgcatgt

SEQ ID NO: 74624 - DNA, 20 bp, Artificial Sequence
  Description of Artificial Sequence: Synthetic oligonucleotide
  Target: SCN9A; (-) strand; PAM type: YTN; PAM sequence: TTC
catcaaatccatggccacac

SEQ ID NO: 74625 - DNA, 20 bp, Artificial Sequence
  Description of Artificial Sequence: Synthetic oligonucleotide
  Target: SCN9A; (-) strand; PAM type: YTN; PAM sequence: TTC
aagtgagagtaaagttccat

SEQ ID NO: 74626 - DNA, 20 bp, Artificial Sequence
  Description of Artificial Sequence: Synthetic oligonucleotide
  Target: SCN9A; (-) strand; PAM type: YTN; PAM sequence: TTT
caagtgagagtaaagttcca

SEQ ID NO: 74627 - DNA, 20 bp, Artificial Sequence
  Description of Artificial Sequence: Synthetic oligonucleotide
  Target: SCN9A; (-) strand; PAM type: YTN; PAM sequence: TTG
cagacaatgtagtatttcaa

SEQ ID NO: 74628 - DNA, 20 bp, Artificial Sequence
  Description of Artificial Sequence: Synthetic oligonucleotide
  Target: SCN9A; (-) strand; PAM type: YTN; PAM sequence: TTT
gcagacaatgtagtatttca

SEQ ID NO: 74629 - DNA, 20 bp, Artificial Sequence
  Description of Artificial Sequence: Synthetic oligonucleotide
  Target: SCN9A; (-) strand; PAM type: YTN; PAM sequence: TTA
tatttgcagacaatgtagta

SEQ ID NO: 74630 - DNA, 20 bp, Artificial Sequence
  Description of Artificial Sequence: Synthetic oligonucleotide
  Target: SCN9A; (-) strand; PAM type: YTN; PAM sequence: TTT
atatttgcagacaatgtagt

SEQ ID NO: 74631 - DNA, 20 bp, Artificial Sequence
  Description of Artificial Sequence: Synthetic oligonucleotide
  Target: SCN9A; (-) strand; PAM type: YTN; PAM sequence: TTA
tatatttatatttgcagaca

SEQ ID NO: 74632 - DNA, 20 bp, Artificial Sequence
  Description of Artificial Sequence: Synthetic oligonucleotide
  Target: SCN9A; (-) strand; PAM type: YTN; PAM sequence: CTT
atatatttatatttgcagac

SEQ ID NO: 74633 - DNA, 20 bp, Artificial Sequence
  Description of Artificial Sequence: Synthetic oligonucleotide
  Target: SCN9A; (-) strand; PAM type: YTN; PAM sequence: CTA
catgcttatatatttatatt

SEQ ID NO: 74634 - DNA, 20 bp, Artificial Sequence
  Description of Artificial Sequence: Synthetic oligonucleotide
  Target: SCN9A; (-) strand; PAM type: YTN; PAM sequence: TTC
aaacatatgctacatgctta

SEQ ID NO: 74635 - DNA, 20 bp, Artificial Sequence
  Description of Artificial Sequence: Synthetic oligonucleotide
  Target: SCN9A; (-) strand; PAM type: YTN; PAM sequence: CTT
caaacatatgctacatgctt

SEQ ID NO: 74636 - DNA, 20 bp, Artificial Sequence
  Description of Artificial Sequence: Synthetic oligonucleotide
  Target: SCN9A; (-) strand; PAM type: YTN; PAM sequence: CTA
acccaataagcttcaaacat

SEQ ID NO: 74637 - DNA, 20 bp, Artificial Sequence
  Description of Artificial Sequence: Synthetic oligonucleotide
  Target: SCN9A; (-) strand; PAM type: YTN; PAM sequence: TTG
actaacccaataagcttcaa

SEQ ID NO: 74638 - DNA, 20 bp, Artificial Sequence
  Description of Artificial Sequence: Synthetic oligonucleotide
  Target: SCN9A; (-) strand; PAM type: YTN; PAM sequence: TTT
gactaacccaataagcttca

SEQ ID NO: 74639 - DNA, 20 bp, Artificial Sequence
  Description of Artificial Sequence: Synthetic oligonucleotide
  Target: SCN9A; (-) strand; PAM type: YTN; PAM sequence: CTT
tgactaacccaataagcttc

SEQ ID NO: 74640 - DNA, 20 bp, Artificial Sequence
  Description of Artificial Sequence: Synthetic oligonucleotide
  Target: SCN9A; (-) strand; PAM type: YTN; PAM sequence: TTA
ccaatatcagcaagggcttt

SEQ ID NO: 74641 - DNA, 20 bp, Artificial Sequence
  Description of Artificial Sequence: Synthetic oligonucleotide
  Target: SCN9A; (-) strand; PAM type: YTN; PAM sequence: CTG
cattaccaatatcagcaagg

SEQ ID NO: 74642 - DNA, 20 bp, Artificial Sequence
  Description of Artificial Sequence: Synthetic oligonucleotide
  Target: SCN9A; (-) strand; PAM type: YTN; PAM sequence: CTA
tgctgcattaccaatatcag

SEQ ID NO: 74643 - DNA, 20 bp, Artificial Sequence
  Description of Artificial Sequence: Synthetic oligonucleotide
  Target: SCN9A; (-) strand; PAM type: YTN; PAM sequence: CTA
tgctatgctgcattaccaat

SEQ ID NO: 74644 - DNA, 20 bp, Artificial Sequence
  Description of Artificial Sequence: Synthetic oligonucleotide
  Target: SCN9A; (-) strand; PAM type: YTN; PAM sequence: CTC
actatgctatgctgcattac

SEQ ID NO: 74645 - DNA, 20 bp, Artificial Sequence
  Description of Artificial Sequence: Synthetic oligonucleotide
  Target: SCN9A; (-) strand; PAM type: YTN; PAM sequence: TTA
gcccactcactatgctatgc

SEQ ID NO: 74646 - DNA, 20 bp, Artificial Sequence
  Description of Artificial Sequence: Synthetic oligonucleotide
  Target: SCN9A; (-) strand; PAM type: YTN; PAM sequence: TTT
agcccactcactatgctatg

SEQ ID NO: 74647 - DNA, 20 bp, Artificial Sequence
  Description of Artificial Sequence: Synthetic oligonucleotide
  Target: SCN9A; (-) strand; PAM type: YTN; PAM sequence: CTT
tagcccactcactatgctat

SEQ ID NO: 74648 - DNA, 20 bp, Artificial Sequence
  Description of Artificial Sequence: Synthetic oligonucleotide
  Target: SCN9A; (-) strand; PAM type: YTN; PAM sequence: CTC
tttagcccactcactatgct

SEQ ID NO: 74649 - DNA, 20 bp, Artificial Sequence
  Description of Artificial Sequence: Synthetic oligonucleotide
  Target: SCN9A; (-) strand; PAM type: YTN; PAM sequence: TTC
caggatatctctttagccca

SEQ ID NO: 74650 - DNA, 20 bp, Artificial Sequence
  Description of Artificial Sequence: Synthetic oligonucleotide
  Target: SCN9A; (-) strand; PAM type: YTN; PAM sequence: TTT
ccaggatatctctttagccc

SEQ ID NO: 74651 - DNA, 20 bp, Artificial Sequence
  Description of Artificial Sequence: Synthetic oligonucleotide
  Target: SCN9A; (-) strand; PAM type: YTN; PAM sequence: CTG
gagtttccaggatatctctt

SEQ ID NO: 74652 - DNA, 20 bp, Artificial Sequence
  Description of Artificial Sequence: Synthetic oligonucleotide
  Target: SCN9A; (-) strand; PAM type: YTN; PAM sequence: TTC
ctggagtttccaggatatct

SEQ ID NO: 74653 - DNA, 20 bp, Artificial Sequence
  Description of Artificial Sequence: Synthetic oligonucleotide
  Target: SCN9A; (-) strand; PAM type: YTN; PAM sequence: CTC
attcctggagtttccaggat

SEQ ID NO: 74654 - DNA, 20 bp, Artificial Sequence
  Description of Artificial Sequence: Synthetic oligonucleotide
  Target: SCN9A; (-) strand; PAM type: YTN; PAM sequence: TTC
tcattcctggagtttccagg

SEQ ID NO: 74655 - DNA, 20 bp, Artificial Sequence
  Description of Artificial Sequence: Synthetic oligonucleotide
  Target: SCN9A; (-) strand; PAM type: YTN; PAM sequence: TTT
ctcattcctggagtttccag

SEQ ID NO: 74656 - DNA, 20 bp, Artificial Sequence
  Description of Artificial Sequence: Synthetic oligonucleotide
  Target: SCN9A; (-) strand; PAM type: YTN; PAM sequence: CTT
tctcattcctggagtttcca

SEQ ID NO: 74657 - DNA, 20 bp, Artificial Sequence
  Description of Artificial Sequence: Synthetic oligonucleotide
  Target: SCN9A; (-) strand; PAM type: YTN; PAM sequence: TTG
aaagtgagatctttctcatt

SEQ ID NO: 74658 - DNA, 20 bp, Artificial Sequence
  Description of Artificial Sequence: Synthetic oligonucleotide
  Target: SCN9A; (-) strand; PAM type: YTN; PAM sequence: CTT
gaaagtgagatctttctcat

SEQ ID NO: 74659 - DNA, 20 bp, Artificial Sequence
  Description of Artificial Sequence: Synthetic oligonucleotide
  Target: SCN9A; (-) strand; PAM type: YTN; PAM sequence: TTA
ggcttgaaagtgagatcttt

SEQ ID NO: 74660 - DNA, 20 bp, Artificial Sequence
  Description of Artificial Sequence: Synthetic oligonucleotide
  Target: SCN9A; (-) strand; PAM type: YTN; PAM sequence: CTG
attaggcttgaaagtgagat

SEQ ID NO: 74661 - DNA, 20 bp, Artificial Sequence
  Description of Artificial Sequence: Synthetic oligonucleotide
  Target: SCN9A; (-) strand; PAM type: YTN; PAM sequence: TTA
gagaaaggtgtctgattagg

SEQ ID NO: 74662 - DNA, 20 bp, Artificial Sequence
  Description of Artificial Sequence: Synthetic oligonucleotide
  Target: SCN9A; (-) strand; PAM type: YTN; PAM sequence: CTA
agtggttagagaaaggtgtc

SEQ ID NO: 74663 - DNA, 20 bp, Artificial Sequence
  Description of Artificial Sequence: Synthetic oligonucleotide
  Target: SCN9A; (-) strand; PAM type: YTN; PAM sequence: CTA
cgagtcactaagtggttaga

SEQ ID NO: 74664 - DNA, 20 bp, Artificial Sequence
  Description of Artificial Sequence: Synthetic oligonucleotide
  Target: SCN9A; (-) strand; PAM type: YTN; PAM sequence: TTC
caaaggtctacgagtcacta

SEQ ID NO: 74665 - DNA, 20 bp, Artificial Sequence
  Description of Artificial Sequence: Synthetic oligonucleotide
  Target: SCN9A; (-) strand; PAM type: YTN; PAM sequence: TTA
cagcagttccaaaggtctac

SEQ ID NO: 74666 - DNA, 20 bp, Artificial Sequence
  Description of Artificial Sequence: Synthetic oligonucleotide
  Target: SCN9A; (-) strand; PAM type: YTN; PAM sequence: TTT
acagcagttccaaaggtcta

SEQ ID NO: 74667 - DNA, 20 bp, Artificial Sequence
  Description of Artificial Sequence: Synthetic oligonucleotide
  Target: SCN9A; (-) strand; PAM type: YTN; PAM sequence: TTT
tacagcagttccaaaggtct

SEQ ID NO: 74668 - DNA, 20 bp, Artificial Sequence
  Description of Artificial Sequence: Synthetic oligonucleotide
  Target: SCN9A; (-) strand; PAM type: YTN; PAM sequence: TTG
acacaaacaaacataaaagc

SEQ ID NO: 74669 - DNA, 20 bp, Artificial Sequence
  Description of Artificial Sequence: Synthetic oligonucleotide
  Target: SCN9A; (-) strand; PAM type: YTN; PAM sequence: CTG
aaatgcaagcattgacacaa

SEQ ID NO: 74670 - DNA, 20 bp, Artificial Sequence
  Description of Artificial Sequence: Synthetic oligonucleotide
  Target: SCN9A; (-) strand; PAM type: YTN; PAM sequence: CTA
tgaatcaaaacaaaatatct

SEQ ID NO: 74671 - DNA, 20 bp, Artificial Sequence
  Description of Artificial Sequence: Synthetic oligonucleotide
  Target: SCN9A; (-) strand; PAM type: YTN; PAM sequence: CTG
gagtctatgaatcaaaacaa

SEQ ID NO: 74672 - DNA, 20 bp, Artificial Sequence
  Description of Artificial Sequence: Synthetic oligonucleotide
  Target: SCN9A; (-) strand; PAM type: YTN; PAM sequence: TTC
atctggagtctatgaatcaa

SEQ ID NO: 74673 - DNA, 20 bp, Artificial Sequence
  Description of Artificial Sequence: Synthetic oligonucleotide
  Target: SCN9A; (-) strand; PAM type: YTN; PAM sequence: TTT
catctggagtctatgaatca

SEQ ID NO: 74674 - DNA, 20 bp, Artificial Sequence
  Description of Artificial Sequence: Synthetic oligonucleotide
  Target: SCN9A; (-) strand; PAM type: YTN; PAM sequence: TTA
aaaaatatttcatctggagt

SEQ ID NO: 74675 - DNA, 20 bp, Artificial Sequence
  Description of Artificial Sequence: Synthetic oligonucleotide
  Target: SCN9A; (-) strand; PAM type: YTN; PAM sequence: TTT
aaaaaatatttcatctggag

SEQ ID NO: 74676 - DNA, 20 bp, Artificial Sequence
  Description of Artificial Sequence: Synthetic oligonucleotide
  Target: SCN9A; (-) strand; PAM type: YTN; PAM sequence: TTT
taaaaaatatttcatctgga

SEQ ID NO: 74677 - DNA, 20 bp, Artificial Sequence
  Description of Artificial Sequence: Synthetic oligonucleotide
  Target: SCN9A; (-) strand; PAM type: YTN; PAM sequence: TTT
ttaaaaaatatttcatctgg

SEQ ID NO: 74678 - DNA, 20 bp, Artificial Sequence
  Description of Artificial Sequence: Synthetic oligonucleotide
  Target: SCN9A; (-) strand; PAM type: YTN; PAM sequence: TTC
atttttaaaaaatatttcat

SEQ ID NO: 74679 - DNA, 20 bp, Artificial Sequence
  Description of Artificial Sequence: Synthetic oligonucleotide
  Target: SCN9A; (-) strand; PAM type: YTN; PAM sequence: TTT
catttttaaaaaatatttca

SEQ ID NO: 74680 - DNA, 20 bp, Artificial Sequence
  Description of Artificial Sequence: Synthetic oligonucleotide
  Target: SCN9A; (-) strand; PAM type: YTN; PAM sequence: TTT
tcatttttaaaaaatatttc

SEQ ID NO: 74681 - DNA, 20 bp, Artificial Sequence
  Description of Artificial Sequence: Synthetic oligonucleotide
  Target: SCN9A; (-) strand; PAM type: YTN; PAM sequence: CTG
ttttcatttttaaaaaatat

SEQ ID NO: 74682 - DNA, 20 bp, Artificial Sequence
  Description of Artificial Sequence: Synthetic oligonucleotide
  Target: SCN9A; (-) strand; PAM type: YTN; PAM sequence: CTC
catataaatgaaacataact

SEQ ID NO: 74683 - DNA, 20 bp, Artificial Sequence
  Description of Artificial Sequence: Synthetic oligonucleotide
  Target: SCN9A; (-) strand; PAM type: YTN; PAM sequence: TTA
ggtcctccatataaatgaaa

SEQ ID NO: 74684 - DNA, 20 bp, Artificial Sequence
  Description of Artificial Sequence: Synthetic oligonucleotide
  Target: SCN9A; (-) strand; PAM type: YTN; PAM sequence: CTA
tgtattaggtcctccatata

SEQ ID NO: 74685 - DNA, 20 bp, Artificial Sequence
  Description of Artificial Sequence: Synthetic oligonucleotide
  Target: SCN9A; (-) strand; PAM type: YTN; PAM sequence: TTA
gaatggctatgtattaggtc

SEQ ID NO: 74686 - DNA, 20 bp, Artificial Sequence
  Description of Artificial Sequence: Synthetic oligonucleotide
  Target: SCN9A; (-) strand; PAM type: YTN; PAM sequence: TTT
agaatggctatgtattaggt

SEQ ID NO: 74687 - DNA, 20 bp, Artificial Sequence
  Description of Artificial Sequence: Synthetic oligonucleotide
  Target: SCN9A; (-) strand; PAM type: YTN; PAM sequence: TTG
aaaaaatttagaatggctat

SEQ ID NO: 74688 - DNA, 20 bp, Artificial Sequence
  Description of Artificial Sequence: Synthetic oligonucleotide
  Target: SCN9A; (-) strand; PAM type: YTN; PAM sequence: CTT
gaaaaaatttagaatggcta

SEQ ID NO: 74689 - DNA, 20 bp, Artificial Sequence
  Description of Artificial Sequence: Synthetic oligonucleotide
  Target: SCN9A; (-) strand; PAM type: YTN; PAM sequence: TTA
tcttgaaaaaatttagaatg

SEQ ID NO: 74690 - DNA, 20 bp, Artificial Sequence
  Description of Artificial Sequence: Synthetic oligonucleotide
  Target: SCN9A; (-) strand; PAM type: YTN; PAM sequence: CTT
atcttgaaaaaatttagaat

SEQ ID NO: 74691 - DNA, 20 bp, Artificial Sequence
  Description of Artificial Sequence: Synthetic oligonucleotide
  Target: SCN9A; (-) strand; PAM type: YTN; PAM sequence: TTC
ttatcttgaaaaaatttaga

SEQ ID NO: 74692 - DNA, 20 bp, Artificial Sequence
  Description of Artificial Sequence: Synthetic oligonucleotide
  Target: SCN9A; (-) strand; PAM type: YTN; PAM sequence: CTT
cttatcttgaaaaaatttag

SEQ ID NO: 74693 - DNA, 20 bp, Artificial Sequence
  Description of Artificial Sequence: Synthetic oligonucleotide
  Target: SCN9A; (-) strand; PAM type: YTN; PAM sequence: CTC
caatgtgcagtaggcttctt

SEQ ID NO: 74694 - DNA, 20 bp, Artificial Sequence
  Description of Artificial Sequence: Synthetic oligonucleotide
  Target: SCN9A; (-) strand; PAM type: YTN; PAM sequence: CTC
tccaatgtgcagtaggcttc

SEQ ID NO: 74695 - DNA, 20 bp, Artificial Sequence
  Description of Artificial Sequence: Synthetic oligonucleotide
  Target: SCN9A; (-) strand; PAM type: YTN; PAM sequence: CTA
tctctccaatgtgcagtagg

SEQ ID NO: 74696 - DNA, 20 bp, Artificial Sequence
  Description of Artificial Sequence: Synthetic oligonucleotide
  Target: SCN9A; (-) strand; PAM type: YTN; PAM sequence: CTG
ctatctctccaatgtgcagt

SEQ ID NO: 74697 - DNA, 20 bp, Artificial Sequence
  Description of Artificial Sequence: Synthetic oligonucleotide
  Target: SCN9A; (-) strand; PAM type: YTN; PAM sequence: CTC
tgctatctctccaatgtgca

SEQ ID NO: 74698 - DNA, 20 bp, Artificial Sequence
  Description of Artificial Sequence: Synthetic oligonucleotide
  Target: SCN9A; (-) strand; PAM type: YTN; PAM sequence: CTC
actctgctatctctccaatg

SEQ ID NO: 74699 - DNA, 20 bp, Artificial Sequence
  Description of Artificial Sequence: Synthetic oligonucleotide
  Target: SCN9A; (-) strand; PAM type: YTN; PAM sequence: TTA
accactcactctgctatctc

SEQ ID NO: 74700 - DNA, 20 bp, Artificial Sequence
  Description of Artificial Sequence: Synthetic oligonucleotide
  Target: SCN9A; (-) strand; PAM type: YTN; PAM sequence: CTT
aaccactcactctgctatct

SEQ ID NO: 74701 - DNA, 20 bp, Artificial Sequence
  Description of Artificial Sequence: Synthetic oligonucleotide
  Target: SCN9A; (-) strand; PAM type: YTN; PAM sequence: CTC
ttaaccactcactctgctat

SEQ ID NO: 74702 - DNA, 20 bp, Artificial Sequence
  Description of Artificial Sequence: Synthetic oligonucleotide
  Target: SCN9A; (-) strand; PAM type: YTN; PAM sequence: TTG
tgctcttaaccactcactct

SEQ ID NO: 74703 - DNA, 20 bp, Artificial Sequence
  Description of Artificial Sequence: Synthetic oligonucleotide
  Target: SCN9A; (-) strand; PAM type: YTN; PAM sequence: CTT
gtgctcttaaccactcactc

SEQ ID NO: 74704 - DNA, 20 bp, Artificial Sequence
  Description of Artificial Sequence: Synthetic oligonucleotide
  Target: SCN9A; (-) strand; PAM type: YTN; PAM sequence: TTC
agatcttgtgctcttaacca

SEQ ID NO: 74705 - DNA, 20 bp, Artificial Sequence
  Description of Artificial Sequence: Synthetic oligonucleotide
  Target: SCN9A; (-) strand; PAM type: YTN; PAM sequence: TTT
cagatcttgtgctcttaacc

SEQ ID NO: 74706 - DNA, 20 bp, Artificial Sequence
  Description of Artificial Sequence: Synthetic oligonucleotide
  Target: SCN9A; (-) strand; PAM type: YTN; PAM sequence: CTG
tttcagatcttgtgctctta

SEQ ID NO: 74707 - DNA, 20 bp, Artificial Sequence
  Description of Artificial Sequence: Synthetic oligonucleotide
  Target: SCN9A; (-) strand; PAM type: YTN; PAM sequence: CTG
tctgtttcagatcttgtgct

SEQ ID NO: 74708 - DNA, 20 bp, Artificial Sequence
  Description of Artificial Sequence: Synthetic oligonucleotide
  Target: SCN9A; (-) strand; PAM type: YTN; PAM sequence: TTG
aaacggaggctgtctgtttc

SEQ ID NO: 74709 - DNA, 20 bp, Artificial Sequence
  Description of Artificial Sequence: Synthetic oligonucleotide
  Target: SCN9A; (-) strand; PAM type: YTN; PAM sequence: CTA
agttgaaacggaggctgtct

SEQ ID NO: 74710 - DNA, 20 bp, Artificial Sequence
  Description of Artificial Sequence: Synthetic oligonucleotide
  Target: SCN9A; (-) strand; PAM type: YTN; PAM sequence: CTC
ctaagttgaaacggaggctg

SEQ ID NO: 74711 - DNA, 20 bp, Artificial Sequence
  Description of Artificial Sequence: Synthetic oligonucleotide
  Target: SCN9A; (-) strand; PAM type: YTN; PAM sequence: CTA
ataaatggtagctcctaagt

SEQ ID NO: 74712 - DNA, 20 bp, Artificial Sequence
  Description of Artificial Sequence: Synthetic oligonucleotide
  Target: SCN9A; (-) strand; PAM type: YTN; PAM sequence: CTC
agctaataaatggtagctcc

SEQ ID NO: 74713 - DNA, 20 bp, Artificial Sequence
  Description of Artificial Sequence: Synthetic oligonucleotide
  Target: SCN9A; (-) strand; PAM type: YTN; PAM sequence: TTA
ctcagctaataaatggtagc

SEQ ID NO: 74714 - DNA, 20 bp, Artificial Sequence
  Description of Artificial Sequence: Synthetic oligonucleotide
  Target: SCN9A; (-) strand; PAM type: YTN; PAM sequence: TTT
actcagctaataaatggtag

SEQ ID NO: 74715 - DNA, 20 bp, Artificial Sequence
  Description of Artificial Sequence: Synthetic oligonucleotide
  Target: SCN9A; (-) strand; PAM type: YTN; PAM sequence: TTG
ccccaatttactcagctaat

SEQ ID NO: 74716 - DNA, 20 bp, Artificial Sequence
  Description of Artificial Sequence: Synthetic oligonucleotide
  Target: SCN9A; (-) strand; PAM type: YTN; PAM sequence: CTT
gccccaatttactcagctaa

SEQ ID NO: 74717 - DNA, 20 bp, Artificial Sequence
  Description of Artificial Sequence: Synthetic oligonucleotide
  Target: SCN9A; (-) strand; PAM type: YTN; PAM sequence: TTG
aggcatggggaaatgaagca

SEQ ID NO: 74718 - DNA, 20 bp, Artificial Sequence
  Description of Artificial Sequence: Synthetic oligonucleotide
  Target: SCN9A; (-) strand; PAM type: YTN; PAM sequence: TTA
caaatgggaaaattgaggca

SEQ ID NO: 74719 - DNA, 20 bp, Artificial Sequence
  Description of Artificial Sequence: Synthetic oligonucleotide
  Target: SCN9A; (-) strand; PAM type: YTN; PAM sequence: TTT
acaaatgggaaaattgaggc

SEQ ID NO: 74720 - DNA, 20 bp, Artificial Sequence
  Description of Artificial Sequence: Synthetic oligonucleotide
  Target: SCN9A; (-) strand; PAM type: YTN; PAM sequence: TTT
tacaaatgggaaaattgagg

SEQ ID NO: 74721 - DNA, 20 bp, Artificial Sequence
  Description of Artificial Sequence: Synthetic oligonucleotide
  Target: SCN9A; (-) strand; PAM type: YTN; PAM sequence: CTG
ttttacaaatgggaaaattg

SEQ ID NO: 74722 - DNA, 20 bp, Artificial Sequence
  Description of Artificial Sequence: Synthetic oligonucleotide
  Target: SCN9A; (-) strand; PAM type: YTN; PAM sequence: CTC
tgttttacaaatgggaaaat

SEQ ID NO: 74723 - DNA, 20 bp, Artificial Sequence
  Description of Artificial Sequence: Synthetic oligonucleotide
  Target: SCN9A; (-) strand; PAM type: YTN; PAM sequence: TTA
tctctgttttacaaatggga

SEQ ID NO: 74724 - DNA, 20 bp, Artificial Sequence
  Description of Artificial Sequence: Synthetic oligonucleotide
  Target: SCN9A; (-) strand; PAM type: YTN; PAM sequence: TTA
ttatctctgttttacaaatg

SEQ ID NO: 74725 - DNA, 20 bp, Artificial Sequence
  Description of Artificial Sequence: Synthetic oligonucleotide
  Target: SCN9A; (-) strand; PAM type: YTN; PAM sequence: TTA
tgacaaccccatgagatgat

SEQ ID NO: 74726 - DNA, 20 bp, Artificial Sequence
  Description of Artificial Sequence: Synthetic oligonucleotide
  Target: SCN9A; (-) strand; PAM type: YTN; PAM sequence: TTT
atgacaaccccatgagatga

SEQ ID NO: 74727 - DNA, 20 bp, Artificial Sequence
  Description of Artificial Sequence: Synthetic oligonucleotide
  Target: SCN9A; (-) strand; PAM type: YTN; PAM sequence: TTA
gtatttatgacaaccccatg

SEQ ID NO: 74728 - DNA, 20 bp, Artificial Sequence
  Description of Artificial Sequence: Synthetic oligonucleotide
  Target: SCN9A; (-) strand; PAM type: YTN; PAM sequence: TTT
agtatttatgacaaccccat

SEQ ID NO: 74729 - DNA, 20 bp, Artificial Sequence
  Description of Artificial Sequence: Synthetic oligonucleotide
  Target: SCN9A; (-) strand; PAM type: YTN; PAM sequence: TTA
ataacagcaaacacatattt

SEQ ID NO: 74730 - DNA, 20 bp, Artificial Sequence
  Description of Artificial Sequence: Synthetic oligonucleotide
  Target: SCN9A; (-) strand; PAM type: YTN; PAM sequence: TTG
ttaataacagcaaacacata

SEQ ID NO: 74731 - DNA, 20 bp, Artificial Sequence
  Description of Artificial Sequence: Synthetic oligonucleotide
  Target: SCN9A; (-) strand; PAM type: YTN; PAM sequence: TTG
agttgttaataacagcaaac

SEQ ID NO: 74732 - DNA, 20 bp, Artificial Sequence
  Description of Artificial Sequence: Synthetic oligonucleotide
  Target: SCN9A; (-) strand; PAM type: YTN; PAM sequence: TTT
gagttgttaataacagcaaa

SEQ ID NO: 74733 - DNA, 20 bp, Artificial Sequence
  Description of Artificial Sequence: Synthetic oligonucleotide
  Target: SCN9A; (-) strand; PAM type: YTN; PAM sequence: TTA
tttgagttgttaataacagc

SEQ ID NO: 74734 - DNA, 20 bp, Artificial Sequence
  Description of Artificial Sequence: Synthetic oligonucleotide
  Target: SCN9A; (-) strand; PAM type: YTN; PAM sequence: CTT
atttgagttgttaataacag

SEQ ID NO: 74735 - DNA, 20 bp, Artificial Sequence
  Description of Artificial Sequence: Synthetic oligonucleotide
  Target: SCN9A; (-) strand; PAM type: YTN; PAM sequence: TTC
caaggaatcttatttgagtt

SEQ ID NO: 74736 - DNA, 20 bp, Artificial Sequence
  Description of Artificial Sequence: Synthetic oligonucleotide
  Target: SCN9A; (-) strand; PAM type: YTN; PAM sequence: CTA
ttccaaggaatcttatttga

SEQ ID NO: 74737 - DNA, 20 bp, Artificial Sequence
  Description of Artificial Sequence: Synthetic oligonucleotide
  Target: SCN9A; (-) strand; PAM type: YTN; PAM sequence: TTA
atatgtacctattccaagga

SEQ ID NO: 74738 - DNA, 20 bp, Artificial Sequence
  Description of Artificial Sequence: Synthetic oligonucleotide
  Target: SCN9A; (-) strand; PAM type: YTN; PAM sequence: CTT
aatatgtacctattccaagg

SEQ ID NO: 74739 - DNA, 20 bp, Artificial Sequence
  Description of Artificial Sequence: Synthetic oligonucleotide
  Target: SCN9A; (-) strand; PAM type: YTN; PAM sequence: TTC
aggtcacagcttaatatgta

SEQ ID NO: 74740 - DNA, 20 bp, Artificial Sequence
  Description of Artificial Sequence: Synthetic oligonucleotide
  Target: SCN9A; (-) strand; PAM type: YTN; PAM sequence: TTT
caggtcacagcttaatatgt

SEQ ID NO: 74741 - DNA, 20 bp, Artificial Sequence
  Description of Artificial Sequence: Synthetic oligonucleotide
  Target: SCN9A; (-) strand; PAM type: YTN; PAM sequence: TTT
tcaggtcacagcttaatatg

SEQ ID NO: 74742 - DNA, 20 bp, Artificial Sequence
  Description of Artificial Sequence: Synthetic oligonucleotide
  Target: SCN9A; (-) strand; PAM type: YTN; PAM sequence: TTT
ttcaggtcacagcttaatat

SEQ ID NO: 74743 - DNA, 20 bp, Artificial Sequence
  Description of Artificial Sequence: Synthetic oligonucleotide
  Target: SCN9A; (-) strand; PAM type: YTN; PAM sequence: CTT
tttcaggtcacagcttaata

SEQ ID NO: 74744 - DNA, 20 bp, Artificial Sequence
  Description of Artificial Sequence: Synthetic oligonucleotide
  Target: SCN9A; (-) strand; PAM type: YTN; PAM sequence: CTA
tctttttcaggtcacagctt

SEQ ID NO: 74745 - DNA, 20 bp, Artificial Sequence
  Description of Artificial Sequence: Synthetic oligonucleotide
  Target: SCN9A; (-) strand; PAM type: YTN; PAM sequence: CTG
ctatctttttcaggtcacag

SEQ ID NO: 74746 - DNA, 20 bp, Artificial Sequence
  Description of Artificial Sequence: Synthetic oligonucleotide
  Target: SCN9A; (-) strand; PAM type: YTN; PAM sequence: CTA
ctgctatctttttcaggtca

SEQ ID NO: 74747 - DNA, 20 bp, Artificial Sequence
  Description of Artificial Sequence: Synthetic oligonucleotide
  Target: SCN9A; (-) strand; PAM type: YTN; PAM sequence: TTG
ccagctactgctatcttttt

SEQ ID NO: 74748 - DNA, 20 bp, Artificial Sequence
  Description of Artificial Sequence: Synthetic oligonucleotide
  Target: SCN9A; (-) strand; PAM type: YTN; PAM sequence: CTT
gccagctactgctatctttt

SEQ ID NO: 74749 - DNA, 20 bp, Artificial Sequence
  Description of Artificial Sequence: Synthetic oligonucleotide
  Target: SCN9A; (-) strand; PAM type: YTN; PAM sequence: TTA
cttgccagctactgctatct

SEQ ID NO: 74750 - DNA, 20 bp, Artificial Sequence
  Description of Artificial Sequence: Synthetic oligonucleotide
  Target: SCN9A; (-) strand; PAM type: YTN; PAM sequence: TTG
gattacttgccagctactgc

SEQ ID NO: 74751 - DNA, 20 bp, Artificial Sequence
  Description of Artificial Sequence: Synthetic oligonucleotide
  Target: SCN9A; (-) strand; PAM type: YTN; PAM sequence: TTT
ggattacttgccagctactg

SEQ ID NO: 74752 - DNA, 20 bp, Artificial Sequence
  Description of Artificial Sequence: Synthetic oligonucleotide
  Target: SCN9A; (-) strand; PAM type: YTN; PAM sequence: CTA
tgaagaaatttggattactt

SEQ ID NO: 74753 - DNA, 20 bp, Artificial Sequence
  Description of Artificial Sequence: Synthetic oligonucleotide
  Target: SCN9A; (-) strand; PAM type: YTN; PAM sequence: TTC
tatgaagaaatttggattac

SEQ ID NO: 74754 - DNA, 20 bp, Artificial Sequence
  Description of Artificial Sequence: Synthetic oligonucleotide
  Target: SCN9A; (-) strand; PAM type: YTN; PAM sequence: TTT
ctatgaagaaatttggatta

SEQ ID NO: 74755 - DNA, 20 bp, Artificial Sequence
  Description of Artificial Sequence: Synthetic oligonucleotide
  Target: SCN9A; (-) strand; PAM type: YTN; PAM sequence: TTA
ataatagatcccatttctat

SEQ ID NO: 74756 - DNA, 20 bp, Artificial Sequence
  Description of Artificial Sequence: Synthetic oligonucleotide
  Target: SCN9A; (-) strand; PAM type: YTN; PAM sequence: TTA
gttaataatagatcccattt

SEQ ID NO: 74757 - DNA, 20 bp, Artificial Sequence
  Description of Artificial Sequence: Synthetic oligonucleotide
  Target: SCN9A; (-) strand; PAM type: YTN; PAM sequence: CTG
atattagttaataatagatc

SEQ ID NO: 74758 - DNA, 20 bp, Artificial Sequence
  Description of Artificial Sequence: Synthetic oligonucleotide
  Target: SCN9A; (-) strand; PAM type: YTN; PAM sequence: TTA
tgacggatacatatatagat

SEQ ID NO: 74759 - DNA, 20 bp, Artificial Sequence
  Description of Artificial Sequence: Synthetic oligonucleotide
  Target: SCN9A; (-) strand; PAM type: YTN; PAM sequence: TTT
atgacggatacatatataga

SEQ ID NO: 74760 - DNA, 20 bp, Artificial Sequence
  Description of Artificial Sequence: Synthetic oligonucleotide
  Target: SCN9A; (-) strand; PAM type: YTN; PAM sequence: TTA
gagaacaatttatgacggat

SEQ ID NO: 74761 - DNA, 20 bp, Artificial Sequence
  Description of Artificial Sequence: Synthetic oligonucleotide
  Target: SCN9A; (-) strand; PAM type: YTN; PAM sequence: TTT
agagaacaatttatgacgga

SEQ ID NO: 74762 - DNA, 20 bp, Artificial Sequence
  Description of Artificial Sequence: Synthetic oligonucleotide
  Target: SCN9A; (-) strand; PAM type: YTN; PAM sequence: CTT
tagagaacaatttatgacgg

SEQ ID NO: 74763 - DNA, 20 bp, Artificial Sequence
  Description of Artificial Sequence: Synthetic oligonucleotide
  Target: SCN9A; (-) strand; PAM type: YTN; PAM sequence: CTC
tttagagaacaatttatgac

SEQ ID NO: 74764 - DNA, 20 bp, Artificial Sequence
  Description of Artificial Sequence: Synthetic oligonucleotide
  Target: SCN9A; (-) strand; PAM type: YTN; PAM sequence: TTA
taaataatctctttagagaa

SEQ ID NO: 74765 - DNA, 20 bp, Artificial Sequence
  Description of Artificial Sequence: Synthetic oligonucleotide
  Target: SCN9A; (-) strand; PAM type: YTN; PAM sequence: TTG
aagattataaataatctctt

SEQ ID NO: 74766 - DNA, 20 bp, Artificial Sequence
  Description of Artificial Sequence: Synthetic oligonucleotide
  Target: SCN9A; (-) strand; PAM type: YTN; PAM sequence: TTA
taattgaagattataaataa

SEQ ID NO: 74767 - DNA, 20 bp, Artificial Sequence
  Description of Artificial Sequence: Synthetic oligonucleotide
  Target: SCN9A; (-) strand; PAM type: YTN; PAM sequence: TTT
ataattgaagattataaata

SEQ ID NO: 74768 - DNA, 20 bp, Artificial Sequence
  Description of Artificial Sequence: Synthetic oligonucleotide
  Target: SCN9A; (-) strand; PAM type: YTN; PAM sequence: TTT
tataattgaagattataaat

SEQ ID NO: 74769 - DNA, 20 bp, Artificial Sequence
  Description of Artificial Sequence: Synthetic oligonucleotide
  Target: SCN9A; (-) strand; PAM type: YTN; PAM sequence: TTA
attttataattgaagattat

SEQ ID NO: 74770 - DNA, 20 bp, Artificial Sequence
  Description of Artificial Sequence: Synthetic oligonucleotide
  Target: SCN9A; (-) strand; PAM type: YTN; PAM sequence: CTA
ttaattttataattgaagat

SEQ ID NO: 74771 - DNA, 20 bp, Artificial Sequence
  Description of Artificial Sequence: Synthetic oligonucleotide
  Target: SCN9A; (-) strand; PAM type: YTN; PAM sequence: TTG
tctattaattttataattga

SEQ ID NO: 74772 - DNA, 20 bp, Artificial Sequence
  Description of Artificial Sequence: Synthetic oligonucleotide
  Target: SCN9A; (-) strand; PAM type: YTN; PAM sequence: CTT
gtctattaattttataattg

SEQ ID NO: 74773 - DNA, 20 bp, Artificial Sequence
  Description of Artificial Sequence: Synthetic oligonucleotide
  Target: SCN9A; (-) strand; PAM type: YTN; PAM sequence: TTG
taaaaaggtacttgtctatt

SEQ ID NO: 74774 - DNA, 20 bp, Artificial Sequence
  Description of Artificial Sequence: Synthetic oligonucleotide
  Target: SCN9A; (-) strand; PAM type: YTN; PAM sequence: TTT
gtaaaaaggtacttgtctat

SEQ ID NO: 74775 - DNA, 20 bp, Artificial Sequence
  Description of Artificial Sequence: Synthetic oligonucleotide
  Target: SCN9A; (-) strand; PAM type: YTN; PAM sequence: TTT
tgtaaaaaggtacttgtcta

SEQ ID NO: 74776 - DNA, 20 bp, Artificial Sequence
  Description of Artificial Sequence: Synthetic oligonucleotide
  Target: SCN9A; (-) strand; PAM type: YTN; PAM sequence: TTT
ttgtaaaaaggtacttgtct

SEQ ID NO: 74777 - DNA, 20 bp, Artificial Sequence
  Description of Artificial Sequence: Synthetic oligonucleotide
  Target: SCN9A; (-) strand; PAM type: YTN; PAM sequence: CTC
aaagataaaatcccattttt

SEQ ID NO: 74778 - DNA, 20 bp, Artificial Sequence
  Description of Artificial Sequence: Synthetic oligonucleotide
  Target: SCN9A; (-) strand; PAM type: YTN; PAM sequence: CTA
actcaaagataaaatcccat

SEQ ID NO: 74779 - DNA, 20 bp, Artificial Sequence
  Description of Artificial Sequence: Synthetic oligonucleotide
  Target: SCN9A; (-) strand; PAM type: YTN; PAM sequence: TTG
taggcatctaactcaaagat

SEQ ID NO: 74780 - DNA, 20 bp, Artificial Sequence
  Description of Artificial Sequence: Synthetic oligonucleotide
  Target: SCN9A; (-) strand; PAM type: YTN; PAM sequence: CTA
tgtgttgtaggcatctaact

SEQ ID NO: 74781 - DNA, 20 bp, Artificial Sequence
  Description of Artificial Sequence: Synthetic oligonucleotide
  Target: SCN9A; (-) strand; PAM type: YTN; PAM sequence: TTC
tatgtgttgtaggcatctaa

SEQ ID NO: 74782 - DNA, 20 bp, Artificial Sequence
  Description of Artificial Sequence: Synthetic oligonucleotide
  Target: SCN9A; (-) strand; PAM type: YTN; PAM sequence: CTC
attctatgtgttgtaggcat

SEQ ID NO: 74783 - DNA, 20 bp, Artificial Sequence
  Description of Artificial Sequence: Synthetic oligonucleotide
  Target: SCN9A; (-) strand; PAM type: YTN; PAM sequence: CTA
atcctcattctatgtgttgt

SEQ ID NO: 74784 - DNA, 20 bp, Artificial Sequence
  Description of Artificial Sequence: Synthetic oligonucleotide
  Target: SCN9A; (-) strand; PAM type: YTN; PAM sequence: TTA
gcctaatcctcattctatgt

SEQ ID NO: 74785 - DNA, 20 bp, Artificial Sequence
  Description of Artificial Sequence: Synthetic oligonucleotide
  Target: SCN9A; (-) strand; PAM type: YTN; PAM sequence: TTC
attagcctaatcctcattct

SEQ ID NO: 74786 - DNA, 20 bp, Artificial Sequence
  Description of Artificial Sequence: Synthetic oligonucleotide
  Target: SCN9A; (-) strand; PAM type: YTN; PAM sequence: TTG
attcattagcctaatcctca

SEQ ID NO: 74787 - DNA, 20 bp, Artificial Sequence
  Description of Artificial Sequence: Synthetic oligonucleotide
  Target: SCN9A; (-) strand; PAM type: YTN; PAM sequence: TTT
gattcattagcctaatcctc

SEQ ID NO: 74788 - DNA, 20 bp, Artificial Sequence
  Description of Artificial Sequence: Synthetic oligonucleotide
  Target: SCN9A; (-) strand; PAM type: YTN; PAM sequence: CTT
tgattcattagcctaatcct

SEQ ID NO: 74789 - DNA, 20 bp, Artificial Sequence
  Description of Artificial Sequence: Synthetic oligonucleotide
  Target: SCN9A; (-) strand; PAM type: YTN; PAM sequence: CTA
taggaacacacctttgattc

SEQ ID NO: 74790 - DNA, 20 bp, Artificial Sequence
  Description of Artificial Sequence: Synthetic oligonucleotide
  Target: SCN9A; (-) strand; PAM type: YTN; PAM sequence: TTC
tataggaacacacctttgat

SEQ ID NO: 74791 - DNA, 20 bp, Artificial Sequence
  Description of Artificial Sequence: Synthetic oligonucleotide
  Target: SCN9A; (-) strand; PAM type: YTN; PAM sequence: TTT
ctataggaacacacctttga

SEQ ID NO: 74792 - DNA, 20 bp, Artificial Sequence
  Description of Artificial Sequence: Synthetic oligonucleotide
  Target: SCN9A; (-) strand; PAM type: YTN; PAM sequence: TTT
tctataggaacacacctttg

SEQ ID NO: 74793 - DNA, 20 bp, Artificial Sequence
  Description of Artificial Sequence: Synthetic oligonucleotide
  Target: SCN9A; (-) strand; PAM type: YTN; PAM sequence: TTT
ttctataggaacacaccttt

SEQ ID NO: 74794 - DNA, 20 bp, Artificial Sequence
  Description of Artificial Sequence: Synthetic oligonucleotide
  Target: SCN9A; (-) strand; PAM type: YTN; PAM sequence: CTT
tttctataggaacacacctt

SEQ ID NO: 74795 - DNA, 20 bp, Artificial Sequence
  Description of Artificial Sequence: Synthetic oligonucleotide
  Target: SCN9A; (-) strand; PAM type: YTN; PAM sequence: TTG
caatactttttctataggaa

SEQ ID NO: 74796 - DNA, 20 bp, Artificial Sequence
  Description of Artificial Sequence: Synthetic oligonucleotide
  Target: SCN9A; (-) strand; PAM type: YTN; PAM sequence: TTT
gcaatactttttctatagga

SEQ ID NO: 74797 - DNA, 20 bp, Artificial Sequence
  Description of Artificial Sequence: Synthetic oligonucleotide
  Target: SCN9A; (-) strand; PAM type: YTN; PAM sequence: TTT
tgcaatactttttctatagg

SEQ ID NO: 74798 - DNA, 20 bp, Artificial Sequence
  Description of Artificial Sequence: Synthetic oligonucleotide
  Target: SCN9A; (-) strand; PAM type: YTN; PAM sequence: CTG
cattttgcaatactttttct

SEQ ID NO: 74799 - DNA, 20 bp, Artificial Sequence
  Description of Artificial Sequence: Synthetic oligonucleotide
  Target: SCN9A; (-) strand; PAM type: YTN; PAM sequence: CTC
tgcattttgcaatacttttt

SEQ ID NO: 74800 - DNA, 20 bp, Artificial Sequence
  Description of Artificial Sequence: Synthetic oligonucleotide
  Target: SCN9A; (-) strand; PAM type: YTN; PAM sequence: TTG
tgaatggctctgcattttgc

SEQ ID NO: 74801 - DNA, 20 bp, Artificial Sequence
  Description of Artificial Sequence: Synthetic oligonucleotide
  Target: SCN9A; (-) strand; PAM type: YTN; PAM sequence: CTT
gtgaatggctctgcattttg

SEQ ID NO: 74802 - DNA, 20 bp, Artificial Sequence
  Description of Artificial Sequence: Synthetic oligonucleotide
  Target: SCN9A; (-) strand; PAM type: YTN; PAM sequence: CTG
gtcttgtgaatggctctgca

SEQ ID NO: 74803 - DNA, 20 bp, Artificial Sequence
  Description of Artificial Sequence: Synthetic oligonucleotide
  Target: SCN9A; (-) strand; PAM type: YTN; PAM sequence: CTC
tggtcttgtgaatggctctg

SEQ ID NO: 74804 - DNA, 20 bp, Artificial Sequence
  Description of Artificial Sequence: Synthetic oligonucleotide
  Target: SCN9A; (-) strand; PAM type: YTN; PAM sequence: TTC
tctggtcttgtgaatggctc

SEQ ID NO: 74805 - DNA, 20 bp, Artificial Sequence
  Description of Artificial Sequence: Synthetic oligonucleotide
  Target: SCN9A; (-) strand; PAM type: YTN; PAM sequence: CTT
ctctggtcttgtgaatggct

SEQ ID NO: 74806 - DNA, 20 bp, Artificial Sequence
  Description of Artificial Sequence: Synthetic oligonucleotide
  Target: SCN9A; (-) strand; PAM type: YTN; PAM sequence: CTG
aagggccttctctggtcttg

SEQ ID NO: 74807 - DNA, 20 bp, Artificial Sequence
  Description of Artificial Sequence: Synthetic oligonucleotide
  Target: SCN9A; (-) strand; PAM type: YTN; PAM sequence: CTG
ctgaagggccttctctggtc

SEQ ID NO: 74808 - DNA, 20 bp, Artificial Sequence
  Description of Artificial Sequence: Synthetic oligonucleotide
  Target: SCN9A; (-) strand; PAM type: YTN; PAM sequence: CTC
tgctgaagggccttctctgg

SEQ ID NO: 74809 - DNA, 20 bp, Artificial Sequence
  Description of Artificial Sequence: Synthetic oligonucleotide
  Target: SCN9A; (-) strand; PAM type: YTN; PAM sequence: CTC
tctgctgaagggccttctct

SEQ ID NO: 74810 - DNA, 20 bp, Artificial Sequence
  Description of Artificial Sequence: Synthetic oligonucleotide
  Target: SCN9A; (-) strand; PAM type: YTN; PAM sequence: CTG
catcagtcagtctctctgct

SEQ ID NO: 74811 - DNA, 20 bp, Artificial Sequence
  Description of Artificial Sequence: Synthetic oligonucleotide
  Target: SCN9A; (-) strand; PAM type: YTN; PAM sequence: TTC
ctgcatcagtcagtctctct

SEQ ID NO: 74812 - DNA, 20 bp, Artificial Sequence
  Description of Artificial Sequence: Synthetic oligonucleotide
  Target: SCN9A; (-) strand; PAM type: YTN; PAM sequence: TTG
ttcctgcatcagtcagtctc

SEQ ID NO: 74813 - DNA, 20 bp, Artificial Sequence
  Description of Artificial Sequence: Synthetic oligonucleotide
  Target: SCN9A; (-) strand; PAM type: YTN; PAM sequence: CTT
gttcctgcatcagtcagtct

SEQ ID NO: 74814 - DNA, 20 bp, Artificial Sequence
  Description of Artificial Sequence: Synthetic oligonucleotide
  Target: SCN9A; (-) strand; PAM type: YTN; PAM sequence: CTG
ggcccttgttcctgcatcag

SEQ ID NO: 74815 - DNA, 20 bp, Artificial Sequence
  Description of Artificial Sequence: Synthetic oligonucleotide
  Target: SCN9A; (-) strand; PAM type: YTN; PAM sequence: CTC
aggcatggctgggcccttgt

SEQ ID NO: 74816 - DNA, 20 bp, Artificial Sequence
  Description of Artificial Sequence: Synthetic oligonucleotide
  Target: SCN9A; (-) strand; PAM type: YTN; PAM sequence: TTA
catagctcaggcatggctgg

SEQ ID NO: 74817 - DNA, 20 bp, Artificial Sequence
  Description of Artificial Sequence: Synthetic oligonucleotide
  Target: SCN9A; (-) strand; PAM type: YTN; PAM sequence: TTT
acatagctcaggcatggctg

SEQ ID NO: 74818 - DNA, 20 bp, Artificial Sequence
  Description of Artificial Sequence: Synthetic oligonucleotide
  Target: SCN9A; (-) strand; PAM type: YTN; PAM sequence: TTT
tacatagctcaggcatggct

SEQ ID NO: 74819 - DNA, 20 bp, Artificial Sequence
  Description of Artificial Sequence: Synthetic oligonucleotide
  Target: SCN9A; (-) strand; PAM type: YTN; PAM sequence: CTG
atgacagcgtaaggacgttt

SEQ ID NO: 74820 - DNA, 20 bp, Artificial Sequence
  Description of Artificial Sequence: Synthetic oligonucleotide
  Target: SCN9A; (-) strand; PAM type: YTN; PAM sequence: TTC
tgatgacagcgtaaggacgt

SEQ ID NO: 74821 - DNA, 20 bp, Artificial Sequence
  Description of Artificial Sequence: Synthetic oligonucleotide
  Target: SCN9A; (-) strand; PAM type: YTN; PAM sequence: CTT
ctgatgacagcgtaaggacg

SEQ ID NO: 74822 - DNA, 20 bp, Artificial Sequence
  Description of Artificial Sequence: Synthetic oligonucleotide
  Target: SCN9A; (-) strand; PAM type: YTN; PAM sequence: CTG
ccagaggtgataatagataa

SEQ ID NO: 74823 - DNA, 20 bp, Artificial Sequence
  Description of Artificial Sequence: Synthetic oligonucleotide
  Target: SCN9A; (-) strand; PAM type: YTN; PAM sequence: TTC
tgccagaggtgataatagat

SEQ ID NO: 74824 - DNA, 20 bp, Artificial Sequence
  Description of Artificial Sequence: Synthetic oligonucleotide
  Target: SCN9A; (-) strand; PAM type: YTN; PAM sequence: CTT
ctgccagaggtgataataga

SEQ ID NO: 74825 - DNA, 20 bp, Artificial Sequence
  Description of Artificial Sequence: Synthetic oligonucleotide
  Target: SCN9A; (-) strand; PAM type: YTN; PAM sequence: CTC
cccaatggacagcttctgcc

SEQ ID NO: 74826 - DNA, 20 bp, Artificial Sequence
  Description of Artificial Sequence: Synthetic oligonucleotide
  Target: SCN9A; (-) strand; PAM type: YTN; PAM sequence: CTC
atgctccccaatggacagct

SEQ ID NO: 74827 - DNA, 20 bp, Artificial Sequence
  Description of Artificial Sequence: Synthetic oligonucleotide
  Target: SCN9A; (-) strand; PAM type: YTN; PAM sequence: CTC
agccctcatgctccccaatg

SEQ ID NO: 74828 - DNA, 20 bp, Artificial Sequence
  Description of Artificial Sequence: Synthetic oligonucleotide
  Target: SCN9A; (-) strand; PAM type: YTN; PAM sequence: TTG
atggacgctcagccctcatg

SEQ ID NO: 74829 - DNA, 20 bp, Artificial Sequence
  Description of Artificial Sequence: Synthetic oligonucleotide
  Target: SCN9A; (-) strand; PAM type: YTN; PAM sequence: CTG
gttgatggacgctcagccct

SEQ ID NO: 74830 - DNA, 20 bp, Artificial Sequence
  Description of Artificial Sequence: Synthetic oligonucleotide
  Target: SCN9A; (-) strand; PAM type: YTN; PAM sequence: CTC
cctggttgatggacgctcag

SEQ ID NO: 74831 - DNA, 20 bp, Artificial Sequence
  Description of Artificial Sequence: Synthetic oligonucleotide
  Target: SCN9A; (-) strand; PAM type: YTN; PAM sequence: CTG
caacggtgtggtctccctgg

SEQ ID NO: 74832 - DNA, 20 bp, Artificial Sequence
  Description of Artificial Sequence: Synthetic oligonucleotide
  Target: SCN9A; (-) strand; PAM type: YTN; PAM sequence: CTG
tggactgcaacggtgtggtc

SEQ ID NO: 74833 - DNA, 20 bp, Artificial Sequence
  Description of Artificial Sequence: Synthetic oligonucleotide
  Target: SCN9A; (-) strand; PAM type: YTN; PAM sequence: CTG
ccggtgaacgggaaaatgca

SEQ ID NO: 74834 - DNA, 20 bp, Artificial Sequence
  Description of Artificial Sequence: Synthetic oligonucleotide
  Target: SCN9A; (-) strand; PAM type: YTN; PAM sequence: TTG
tgccccacagaccccaggag

SEQ ID NO: 74835 - DNA, 20 bp, Artificial Sequence
  Description of Artificial Sequence: Synthetic oligonucleotide
  Target: SCN9A; (-) strand; PAM type: YTN; PAM sequence: TTT
gtgccccacagaccccagga

SEQ ID NO: 74836 - DNA, 20 bp, Artificial Sequence
  Description of Artificial Sequence: Synthetic oligonucleotide
  Target: SCN9A; (-) strand; PAM type: YTN; PAM sequence: CTG
tttgtgccccacagacccca

SEQ ID NO: 74837 - DNA, 20 bp, Artificial Sequence
  Description of Artificial Sequence: Synthetic oligonucleotide
  Target: SCN9A; (-) strand; PAM type: YTN; PAM sequence: CTC
actgtttgtgccccacagac

SEQ ID NO: 74838 - DNA, 20 bp, Artificial Sequence
  Description of Artificial Sequence: Synthetic oligonucleotide
  Target: SCN9A; (-) strand; PAM type: YTN; PAM sequence: TTG
gagacaatgagagcagaagg

SEQ ID NO: 74839 - DNA, 20 bp, Artificial Sequence
  Description of Artificial Sequence: Synthetic oligonucleotide
  Target: SCN9A; (-) strand; PAM type: YTN; PAM sequence: TTT
ggagacaatgagagcagaag

SEQ ID NO: 74840 - DNA, 20 bp, Artificial Sequence
  Description of Artificial Sequence: Synthetic oligonucleotide
  Target: SCN9A; (-) strand; PAM type: YTN; PAM sequence: TTT
tggagacaatgagagcagaa

SEQ ID NO: 74841 - DNA, 20 bp, Artificial Sequence
  Description of Artificial Sequence: Synthetic oligonucleotide
  Target: SCN9A; (-) strand; PAM type: YTN; PAM sequence: TTT
ttggagacaatgagagcaga

SEQ ID NO: 74842 - DNA, 20 bp, Artificial Sequence
  Description of Artificial Sequence: Synthetic oligonucleotide
  Target: SCN9A; (-) strand; PAM type: YTN; PAM sequence: TTG
ccgatgatgagcacagcatt

SEQ ID NO: 74843 - DNA, 20 bp, Artificial Sequence
  Description of Artificial Sequence: Synthetic oligonucleotide
  Target: SCN9A; (-) strand; PAM type: YTN; PAM sequence: TTT
gccgatgatgagcacagcat

SEQ ID NO: 74844 - DNA, 20 bp, Artificial Sequence
  Description of Artificial Sequence: Synthetic oligonucleotide
  Target: SCN9A; (-) strand; PAM type: YTN; PAM sequence: CTG
aatttgccgatgatgagcac

SEQ ID NO: 74845 - DNA, 20 bp, Artificial Sequence
  Description of Artificial Sequence: Synthetic oligonucleotide
  Target: SCN9A; (-) strand; PAM type: YTN; PAM sequence: CTG
agactgaatttgccgatgat

SEQ ID NO: 74846 - DNA, 20 bp, Artificial Sequence
  Description of Artificial Sequence: Synthetic oligonucleotide
  Target: SCN9A; (-) strand; PAM type: YTN; PAM sequence: TTC
aaaggcagaggaagagatat

SEQ ID NO: 74847 - DNA, 20 bp, Artificial Sequence
  Description of Artificial Sequence: Synthetic oligonucleotide
  Target: SCN9A; (-) strand; PAM type: YTN; PAM sequence: TTT
caaaggcagaggaagagata

SEQ ID NO: 74848 - DNA, 20 bp, Artificial Sequence
  Description of Artificial Sequence: Synthetic oligonucleotide
  Target: SCN9A; (-) strand; PAM type: YTN; PAM sequence: TTA
gtttcaaaggcagaggaaga

SEQ ID NO: 74849 - DNA, 20 bp, Artificial Sequence
  Description of Artificial Sequence: Synthetic oligonucleotide
  Target: SCN9A; (-) strand; PAM type: YTN; PAM sequence: TTT
agtttcaaaggcagaggaag

SEQ ID NO: 74850 - DNA, 20 bp, Artificial Sequence
  Description of Artificial Sequence: Synthetic oligonucleotide
  Target: SCN9A; (-) strand; PAM type: YTN; PAM sequence: TTT
tagtttcaaaggcagaggaa

SEQ ID NO: 74851 - DNA, 20 bp, Artificial Sequence
  Description of Artificial Sequence: Synthetic oligonucleotide
  Target: SCN9A; (-) strand; PAM type: YTN; PAM sequence: TTT
ttagtttcaaaggcagagga

SEQ ID NO: 74852 - DNA, 20 bp, Artificial Sequence
  Description of Artificial Sequence: Synthetic oligonucleotide
  Target: SCN9A; (-) strand; PAM type: YTN; PAM sequence: CTT
tttagtttcaaaggcagagg

SEQ ID NO: 74853 - DNA, 20 bp, Artificial Sequence
  Description of Artificial Sequence: Synthetic oligonucleotide
  Target: SCN9A; (-) strand; PAM type: YTN; PAM sequence: CTG
caaggcgaagcagcagaaca

SEQ ID NO: 74854 - DNA, 20 bp, Artificial Sequence
  Description of Artificial Sequence: Synthetic oligonucleotide
  Target: SCN9A; (-) strand; PAM type: YTN; PAM sequence: TTC
tgcaaggcgaagcagcagaa

SEQ ID NO: 74855 - DNA, 20 bp, Artificial Sequence
  Description of Artificial Sequence: Synthetic oligonucleotide
  Target: SCN9A; (-) strand; PAM type: YTN; PAM sequence: TTT
ctgcaaggcgaagcagcaga

SEQ ID NO: 74856 - DNA, 20 bp, Artificial Sequence
  Description of Artificial Sequence: Synthetic oligonucleotide
  Target: SCN9A; (-) strand; PAM type: YTN; PAM sequence: TTT
tctgcaaggcgaagcagcag

SEQ ID NO: 74857 - DNA, 20 bp, Artificial Sequence
  Description of Artificial Sequence: Synthetic oligonucleotide
  Target: SCN9A; (-) strand; PAM type: YTN; PAM sequence: TTG
ttttctgcaaggcgaagcag

SEQ ID NO: 74858 - DNA, 20 bp, Artificial Sequence
  Description of Artificial Sequence: Synthetic oligonucleotide
  Target: SCN9A; (-) strand; PAM type: YTN; PAM sequence: CTT
gttttctgcaaggcgaagca

SEQ ID NO: 74859 - DNA, 20 bp, Artificial Sequence
  Description of Artificial Sequence: Synthetic oligonucleotide
  Target: SCN9A; (-) strand; PAM type: YTN; PAM sequence: CTC
cttgttttctgcaaggcgaa

SEQ ID NO: 74860 - DNA, 20 bp, Artificial Sequence
  Description of Artificial Sequence: Synthetic oligonucleotide
  Target: SCN9A; (-) strand; PAM type: YTN; PAM sequence: TTC
gtggctccttgttttctgca

SEQ ID NO: 74861 - DNA, 20 bp, Artificial Sequence
  Description of Artificial Sequence: Synthetic oligonucleotide
  Target: SCN9A; (-) strand; PAM type: YTN; PAM sequence: CTC
agcattcgtggctccttgtt

SEQ ID NO: 74862 - DNA, 20 bp, Artificial Sequence
  Description of Artificial Sequence: Synthetic oligonucleotide
  Target: SCN9A; (-) strand; PAM type: YTN; PAM sequence: CTG
cagtcaccactcagcattcg

SEQ ID NO: 74863 - DNA, 20 bp, Artificial Sequence
  Description of Artificial Sequence: Synthetic oligonucleotide
  Target: SCN9A; (-) strand; PAM type: YTN; PAM sequence: TTC
tgcagtcaccactcagcatt

SEQ ID NO: 74864 - DNA, 20 bp, Artificial Sequence
  Description of Artificial Sequence: Synthetic oligonucleotide
  Target: SCN9A; (-) strand; PAM type: YTN; PAM sequence: TTT
ctgcagtcaccactcagcat

SEQ ID NO: 74865 - DNA, 20 bp, Artificial Sequence
  Description of Artificial Sequence: Synthetic oligonucleotide
  Target: SCN9A; (-) strand; PAM type: YTN; PAM sequence: TTT
tctgcagtcaccactcagca

SEQ ID NO: 74866 - DNA, 20 bp, Artificial Sequence
  Description of Artificial Sequence: Synthetic oligonucleotide
  Target: SCN9A; (-) strand; PAM type: YTN; PAM sequence: TTT
ttctgcagtcaccactcagc

SEQ ID NO: 74867 - DNA, 20 bp, Artificial Sequence
  Description of Artificial Sequence: Synthetic oligonucleotide
  Target: SCN9A; (-) strand; PAM type: YTN; PAM sequence: TTA
atttttctgcagtcaccact

SEQ ID NO: 74868 - DNA, 20 bp, Artificial Sequence
  Description of Artificial Sequence: Synthetic oligonucleotide
  Target: SCN9A; (-) strand; PAM type: YTN; PAM sequence: TTT
aatttttctgcagtcaccac

SEQ ID NO: 74869 - DNA, 20 bp, Artificial Sequence
  Description of Artificial Sequence: Synthetic oligonucleotide
  Target: SCN9A; (-) strand; PAM type: YTN; PAM sequence: TTT
taatttttctgcagtcacca

SEQ ID NO: 74870 - DNA, 20 bp, Artificial Sequence
  Description of Artificial Sequence: Synthetic oligonucleotide
  Target: SCN9A; (-) strand; PAM type: YTN; PAM sequence: TTT
ttaatttttctgcagtcacc

SEQ ID NO: 74871 - DNA, 20 bp, Artificial Sequence
  Description of Artificial Sequence: Synthetic oligonucleotide
  Target: SCN9A; (-) strand; PAM type: YTN; PAM sequence: TTT
tttaatttttctgcagtcac

SEQ ID NO: 74872 - DNA, 20 bp, Artificial Sequence
  Description of Artificial Sequence: Synthetic oligonucleotide
  Target: SCN9A; (-) strand; PAM type: YTN; PAM sequence: TTT
ttttaatttttctgcagtca

SEQ ID NO: 74873 - DNA, 20 bp, Artificial Sequence
  Description of Artificial Sequence: Synthetic oligonucleotide
  Target: SCN9A; (-) strand; PAM type: YTN; PAM sequence: TTT
tttttaatttttctgcagtc

SEQ ID NO: 74874 - DNA, 20 bp, Artificial Sequence
  Description of Artificial Sequence: Synthetic oligonucleotide
  Target: SCN9A; (-) strand; PAM type: YTN; PAM sequence: TTC
agcaaccacgttttttttaa

SEQ ID NO: 74875 - DNA, 20 bp, Artificial Sequence
  Description of Artificial Sequence: Synthetic oligonucleotide
  Target: SCN9A; (-) strand; PAM type: YTN; PAM sequence: CTT
cagcaaccacgtttttttta

SEQ ID NO: 74876 - DNA, 20 bp, Artificial Sequence
  Description of Artificial Sequence: Synthetic oligonucleotide
  Target: SCN9A; (-) strand; PAM type: YTN; PAM sequence: CTA
tcagtaggtgcttcagcaac

SEQ ID NO: 74877 - DNA, 20 bp, Artificial Sequence
  Description of Artificial Sequence: Synthetic oligonucleotide
  Target: SCN9A; (-) strand; PAM type: YTN; PAM sequence: TTC
tatcagtaggtgcttcagca

SEQ ID NO: 74878 - DNA, 20 bp, Artificial Sequence
  Description of Artificial Sequence: Synthetic oligonucleotide
  Target: SCN9A; (-) strand; PAM type: YTN; PAM sequence: CTT
ctatcagtaggtgcttcagc

SEQ ID NO: 74879 - DNA, 20 bp, Artificial Sequence
  Description of Artificial Sequence: Synthetic oligonucleotide
  Target: SCN9A; (-) strand; PAM type: YTN; PAM sequence: TTA
tatgaagtgtacttctatca

SEQ ID NO: 74880 - DNA, 20 bp, Artificial Sequence
  Description of Artificial Sequence: Synthetic oligonucleotide
  Target: SCN9A; (-) strand; PAM type: YTN; PAM sequence: TTT
atatgaagtgtacttctatc

SEQ ID NO: 74881 - DNA, 20 bp, Artificial Sequence
  Description of Artificial Sequence: Synthetic oligonucleotide
  Target: SCN9A; (-) strand; PAM type: YTN; PAM sequence: TTC
agtggtatttatatgaagtg

SEQ ID NO: 74882 - DNA, 20 bp, Artificial Sequence
  Description of Artificial Sequence: Synthetic oligonucleotide
  Target: SCN9A; (-) strand; PAM type: YTN; PAM sequence: CTC
aggccagtgggttcagtggt

SEQ ID NO: 74883 - DNA, 20 bp, Artificial Sequence
  Description of Artificial Sequence: Synthetic oligonucleotide
  Target: SCN9A; (-) strand; PAM type: YTN; PAM sequence: CTG
ccctcaggccagtgggttca

SEQ ID NO: 74884 - DNA, 20 bp, Artificial Sequence
  Description of Artificial Sequence: Synthetic oligonucleotide
  Target: SCN9A; (-) strand; PAM type: YTN; PAM sequence: TTA
agtcagtacagagccacctg

SEQ ID NO: 74885 - DNA, 20 bp, Artificial Sequence
  Description of Artificial Sequence: Synthetic oligonucleotide
  Target: SCN9A; (-) strand; PAM type: YTN; PAM sequence: TTT
aagtcagtacagagccacct

SEQ ID NO: 74886 - DNA, 20 bp, Artificial Sequence
  Description of Artificial Sequence: Synthetic oligonucleotide
  Target: SCN9A; (-) strand; PAM type: YTN; PAM sequence: TTT
taagtcagtacagagccacc

SEQ ID NO: 74887 - DNA, 20 bp, Artificial Sequence
  Description of Artificial Sequence: Synthetic oligonucleotide
  Target: SCN9A; (-) strand; PAM type: YTN; PAM sequence: CTT
ttaagtcagtacagagccac

SEQ ID NO: 74888 - DNA, 20 bp, Artificial Sequence
  Description of Artificial Sequence: Synthetic oligonucleotide
  Target: SCN9A; (-) strand; PAM type: YTN; PAM sequence: TTC
ttttaagtcagtacagagcc

SEQ ID NO: 74889 - DNA, 20 bp, Artificial Sequence
  Description of Artificial Sequence: Synthetic oligonucleotide
  Target: SCN9A; (-) strand; PAM type: YTN; PAM sequence: TTT
cttttaagtcagtacagagc

SEQ ID NO: 74890 - DNA, 20 bp, Artificial Sequence
  Description of Artificial Sequence: Synthetic oligonucleotide
  Target: SCN9A; (-) strand; PAM type: YTN; PAM sequence: TTA
agtatgtttcttttaagtca

SEQ ID NO: 74891 - DNA, 20 bp, Artificial Sequence
  Description of Artificial Sequence: Synthetic oligonucleotide
  Target: SCN9A; (-) strand; PAM type: YTN; PAM sequence: TTT
aagtatgtttcttttaagtc

SEQ ID NO: 74892 - DNA, 20 bp, Artificial Sequence
  Description of Artificial Sequence: Synthetic oligonucleotide
  Target: SCN9A; (-) strand; PAM type: YTN; PAM sequence: TTT
taagtatgtttcttttaagt

SEQ ID NO: 74893 - DNA, 20 bp, Artificial Sequence
  Description of Artificial Sequence: Synthetic oligonucleotide
  Target: SCN9A; (-) strand; PAM type: YTN; PAM sequence: TTT
ttaagtatgtttcttttaag

SEQ ID NO: 74894 - DNA, 20 bp, Artificial Sequence
  Description of Artificial Sequence: Synthetic oligonucleotide
  Target: SCN9A; (-) strand; PAM type: YTN; PAM sequence: TTC
gtttttaagtatgtttcttt

SEQ ID NO: 74895 - DNA, 20 bp, Artificial Sequence
  Description of Artificial Sequence: Synthetic oligonucleotide
  Target: SCN9A; (-) strand; PAM type: YTN; PAM sequence: CTT
cgtttttaagtatgtttctt

SEQ ID NO: 74896 - DNA, 20 bp, Artificial Sequence
  Description of Artificial Sequence: Synthetic oligonucleotide
  Target: SCN9A; (-) strand; PAM type: YTN; PAM sequence: TTG
cttcgtttttaagtatgttt

SEQ ID NO: 74897 - DNA, 20 bp, Artificial Sequence
  Description of Artificial Sequence: Synthetic oligonucleotide
  Target: SCN9A; (-) strand; PAM type: YTN; PAM sequence: CTG
aattgcttcgtttttaagta

SEQ ID NO: 74898 - DNA, 20 bp, Artificial Sequence
  Description of Artificial Sequence: Synthetic oligonucleotide
  Target: SCN9A; (-) strand; PAM type: YTN; PAM sequence: CTC
actgaattgcttcgttttta

SEQ ID NO: 74899 - DNA, 20 bp, Artificial Sequence
  Description of Artificial Sequence: Synthetic oligonucleotide
  Target: SCN9A; (-) strand; PAM type: YTN; PAM sequence: TTC
tcactgaattgcttcgtttt

SEQ ID NO: 74900 - DNA, 20 bp, Artificial Sequence
  Description of Artificial Sequence: Synthetic oligonucleotide
  Target: SCN9A; (-) strand; PAM type: YTN; PAM sequence: CTT
ctcactgaattgcttcgttt

SEQ ID NO: 74901 - DNA, 20 bp, Artificial Sequence
  Description of Artificial Sequence: Synthetic oligonucleotide
  Target: SCN9A; (-) strand; PAM type: YTN; PAM sequence: TTC
ttctcactgaattgcttcgt

SEQ ID NO: 74902 - DNA, 20 bp, Artificial Sequence
  Description of Artificial Sequence: Synthetic oligonucleotide
  Target: SCN9A; (-) strand; PAM type: YTN; PAM sequence: TTT
cttctcactgaattgcttcg

SEQ ID NO: 74903 - DNA, 20 bp, Artificial Sequence
  Description of Artificial Sequence: Synthetic oligonucleotide
  Target: SCN9A; (-) strand; PAM type: YTN; PAM sequence: TTT
tcttctcactgaattgcttc

SEQ ID NO: 74904 - DNA, 20 bp, Artificial Sequence
  Description of Artificial Sequence: Synthetic oligonucleotide
  Target: SCN9A; (-) strand; PAM type: YTN; PAM sequence: TTA
agtggaagaagttttcttct

SEQ ID NO: 74905 - DNA, 20 bp, Artificial Sequence
  Description of Artificial Sequence: Synthetic oligonucleotide
  Target: SCN9A; (-) strand; PAM type: YTN; PAM sequence: CTT
aagtggaagaagttttcttc

SEQ ID NO: 74906 - DNA, 20 bp, Artificial Sequence
  Description of Artificial Sequence: Synthetic oligonucleotide
  Target: SCN9A; (-) strand; PAM type: YTN; PAM sequence: TTC
atcccttaagtggaagaagt

SEQ ID NO: 74907 - DNA, 20 bp, Artificial Sequence
  Description of Artificial Sequence: Synthetic oligonucleotide
  Target: SCN9A; (-) strand; PAM type: YTN; PAM sequence: TTT
catcccttaagtggaagaag

SEQ ID NO: 74908 - DNA, 20 bp, Artificial Sequence
  Description of Artificial Sequence: Synthetic oligonucleotide
  Target: SCN9A; (-) strand; PAM type: YTN; PAM sequence: TTG
tttcatcccttaagtggaag

SEQ ID NO: 74909 - DNA, 20 bp, Artificial Sequence
  Description of Artificial Sequence: Synthetic oligonucleotide
  Target: SCN9A; (-) strand; PAM type: YTN; PAM sequence: CTA
caaattgtttcatcccttaa

SEQ ID NO: 74910 - DNA, 20 bp, Artificial Sequence
  Description of Artificial Sequence: Synthetic oligonucleotide
  Target: SCN9A; (-) strand; PAM type: YTN; PAM sequence: TTC
tacaaattgtttcatccctt

SEQ ID NO: 74911 - DNA, 20 bp, Artificial Sequence
  Description of Artificial Sequence: Synthetic oligonucleotide
  Target: SCN9A; (-) strand; PAM type: YTN; PAM sequence: CTG
aaaggatgaattctacaaat

SEQ ID NO: 74912 - DNA, 20 bp, Artificial Sequence
  Description of Artificial Sequence: Synthetic oligonucleotide
  Target: SCN9A; (-) strand; PAM type: YTN; PAM sequence: CTG
gtcctgaaaggatgaattct

SEQ ID NO: 74913 - DNA, 20 bp, Artificial Sequence
  Description of Artificial Sequence: Synthetic oligonucleotide
  Target: SCN9A; (-) strand; PAM type: YTN; PAM sequence: TTA
cctggtcctgaaaggatgaa

SEQ ID NO: 74914 - DNA, 20 bp, Artificial Sequence
  Description of Artificial Sequence: Synthetic oligonucleotide
  Target: SCN9A; (-) strand; PAM type: YTN; PAM sequence: TTT
acctggtcctgaaaggatga

SEQ ID NO: 74915 - DNA, 20 bp, Artificial Sequence
  Description of Artificial Sequence: Synthetic oligonucleotide
  Target: SCN9A; (-) strand; PAM type: YTN; PAM sequence: CTG
tatagcaacaaataatttac

SEQ ID NO: 74916 - DNA, 20 bp, Artificial Sequence
  Description of Artificial Sequence: Synthetic oligonucleotide
  Target: SCN9A; (-) strand; PAM type: YTN; PAM sequence: TTA
gagagctgtatagcaacaaa

SEQ ID NO: 74917 - DNA, 20 bp, Artificial Sequence
  Description of Artificial Sequence: Synthetic oligonucleotide
  Target: SCN9A; (-) strand; PAM type: YTN; PAM sequence: CTA
ggccagaatattagagagct

SEQ ID NO: 74918 - DNA, 20 bp, Artificial Sequence
  Description of Artificial Sequence: Synthetic oligonucleotide
  Target: SCN9A; (-) strand; PAM type: YTN; PAM sequence: CTC
taggccagaatattagagag

SEQ ID NO: 74919 - DNA, 20 bp, Artificial Sequence
  Description of Artificial Sequence: Synthetic oligonucleotide
  Target: SCN9A; (-) strand; PAM type: YTN; PAM sequence: TTA
aaagaatggagcagtaactc

SEQ ID NO: 74920 - DNA, 20 bp, Artificial Sequence
  Description of Artificial Sequence: Synthetic oligonucleotide
  Target: SCN9A; (-) strand; PAM type: YTN; PAM sequence: CTG
tgcagcaaaatgaatggcat

SEQ ID NO: 74921 - DNA, 20 bp, Artificial Sequence
  Description of Artificial Sequence: Synthetic oligonucleotide
  Target: SCN9A; (-) strand; PAM type: YTN; PAM sequence: TTC
tgtgcagcaaaatgaatggc

SEQ ID NO: 74922 - DNA, 20 bp, Artificial Sequence
  Description of Artificial Sequence: Synthetic oligonucleotide
  Target: SCN9A; (-) strand; PAM type: YTN; PAM sequence: TTA
taagttctgtgcagcaaaat

SEQ ID NO: 74923 - DNA, 20 bp, Artificial Sequence
  Description of Artificial Sequence: Synthetic oligonucleotide
  Target: SCN9A; (-) strand; PAM type: YTN; PAM sequence: TTA
agttataagttctgtgcagc

SEQ ID NO: 74924 - DNA, 20 bp, Artificial Sequence
  Description of Artificial Sequence: Synthetic oligonucleotide
  Target: SCN9A; (-) strand; PAM type: YTN; PAM sequence: TTT
aagttataagttctgtgcag

SEQ ID NO: 74925 - DNA, 20 bp, Artificial Sequence
  Description of Artificial Sequence: Synthetic oligonucleotide
  Target: SCN9A; (-) strand; PAM type: YTN; PAM sequence: TTT
taagttataagttctgtgca

SEQ ID NO: 74926 - DNA, 20 bp, Artificial Sequence
  Description of Artificial Sequence: Synthetic oligonucleotide
  Target: SCN9A; (-) strand; PAM type: YTN; PAM sequence: TTT
ttaagttataagttctgtgc

SEQ ID NO: 74927 - DNA, 20 bp, Artificial Sequence
  Description of Artificial Sequence: Synthetic oligonucleotide
  Target: SCN9A; (-) strand; PAM type: YTN; PAM sequence: TTT
tttaagttataagttctgtg

SEQ ID NO: 74928 - DNA, 20 bp, Artificial Sequence
  Description of Artificial Sequence: Synthetic oligonucleotide
  Target: SCN9A; (-) strand; PAM type: YTN; PAM sequence: TTT
ttttaagttataagttctgt

SEQ ID NO: 74929 - DNA, 20 bp, Artificial Sequence
  Description of Artificial Sequence: Synthetic oligonucleotide
  Target: SCN9A; (-) strand; PAM type: YTN; PAM sequence: CTT
tttttaagttataagttctg

SEQ ID NO: 74930 - DNA, 20 bp, Artificial Sequence
  Description of Artificial Sequence: Synthetic oligonucleotide
  Target: SCN9A; (-) strand; PAM type: YTN; PAM sequence: TTC
tttttttaagttataagttc

SEQ ID NO: 74931 - DNA, 20 bp, Artificial Sequence
  Description of Artificial Sequence: Synthetic oligonucleotide
  Target: SCN9A; (-) strand; PAM type: YTN; PAM sequence: CTA
agttctttttttaagttata

SEQ ID NO: 74932 - DNA, 20 bp, Artificial Sequence
  Description of Artificial Sequence: Synthetic oligonucleotide
  Target: SCN9A; (-) strand; PAM type: YTN; PAM sequence: TTG
aatgaccagtagcaatacta

SEQ ID NO: 74933 - DNA, 20 bp, Artificial Sequence
  Description of Artificial Sequence: Synthetic oligonucleotide
  Target: SCN9A; (-) strand; PAM type: YTN; PAM sequence: TTG
atatataaaaagttgaatga

SEQ ID NO: 74934 - DNA, 20 bp, Artificial Sequence
  Description of Artificial Sequence: Synthetic oligonucleotide
  Target: SCN9A; (-) strand; PAM type: YTN; PAM sequence: CTG
gggattgatatataaaaagt

SEQ ID NO: 74935 - DNA, 20 bp, Artificial Sequence
  Description of Artificial Sequence: Synthetic oligonucleotide
  Target: SCN9A; (-) strand; PAM type: YTN; PAM sequence: TTG
tgaagcctggggattgatat

SEQ ID NO: 74936 - DNA, 20 bp, Artificial Sequence
  Description of Artificial Sequence: Synthetic oligonucleotide
  Target: SCN9A; (-) strand; PAM type: YTN; PAM sequence: TTT
gtgaagcctggggattgata

SEQ ID NO: 74937 - DNA, 20 bp, Artificial Sequence
  Description of Artificial Sequence: Synthetic oligonucleotide
  Target: SCN9A; (-) strand; PAM type: YTN; PAM sequence: TTT
tgtgaagcctggggattgat

SEQ ID NO: 74938 - DNA, 20 bp, Artificial Sequence
  Description of Artificial Sequence: Synthetic oligonucleotide
  Target: SCN9A; (-) strand; PAM type: YTN; PAM sequence: TTT
ttgtgaagcctggggattga

SEQ ID NO: 74939 - DNA, 20 bp, Artificial Sequence
  Description of Artificial Sequence: Synthetic oligonucleotide
  Target: SCN9A; (-) strand; PAM type: YTN; PAM sequence: TTT
tttgtgaagcctggggattg

SEQ ID NO: 74940 - DNA, 20 bp, Artificial Sequence
  Description of Artificial Sequence: Synthetic oligonucleotide
  Target: SCN9A; (-) strand; PAM type: YTN; PAM sequence: TTT
ttttgtgaagcctggggatt

SEQ ID NO: 74941 - DNA, 20 bp, Artificial Sequence
  Description of Artificial Sequence: Synthetic oligonucleotide
  Target: SCN9A; (-) strand; PAM type: YTN; PAM sequence: TTC
caatttttttgtgaagcctg

SEQ ID NO: 74942 - DNA, 20 bp, Artificial Sequence
  Description of Artificial Sequence: Synthetic oligonucleotide
  Target: SCN9A; (-) strand; PAM type: YTN; PAM sequence: TTT
ccaatttttttgtgaagcct

SEQ ID NO: 74943 - DNA, 20 bp, Artificial Sequence
  Description of Artificial Sequence: Synthetic oligonucleotide
  Target: SCN9A; (-) strand; PAM type: YTN; PAM sequence: TTC
aatgcaaagaaccatacagc

SEQ ID NO: 74944 - DNA, 20 bp, Artificial Sequence
  Description of Artificial Sequence: Synthetic oligonucleotide
  Target: SCN9A; (-) strand; PAM type: YTN; PAM sequence: TTT
caatgcaaagaaccatacag

SEQ ID NO: 74945 - DNA, 20 bp, Artificial Sequence
  Description of Artificial Sequence: Synthetic oligonucleotide
  Target: SCN9A; (-) strand; PAM type: YTN; PAM sequence: TTT
tcaatgcaaagaaccataca

SEQ ID NO: 74946 - DNA, 20 bp, Artificial Sequence
  Description of Artificial Sequence: Synthetic oligonucleotide
  Target: SCN9A; (-) strand; PAM type: YTN; PAM sequence: TTA
gtatgtaaggtggattttca

SEQ ID NO: 74947 - DNA, 20 bp, Artificial Sequence
  Description of Artificial Sequence: Synthetic oligonucleotide
  Target: SCN9A; (-) strand; PAM type: YTN; PAM sequence: CTT
agtatgtaaggtggattttc

SEQ ID NO: 74948 - DNA, 20 bp, Artificial Sequence
  Description of Artificial Sequence: Synthetic oligonucleotide
  Target: SCN9A; (-) strand; PAM type: YTN; PAM sequence: CTC
ttagtatgtaaggtggattt

SEQ ID NO: 74949 - DNA, 20 bp, Artificial Sequence
  Description of Artificial Sequence: Synthetic oligonucleotide
  Target: SCN9A; (-) strand; PAM type: YTN; PAM sequence: CTG
agctcttagtatgtaaggtg

SEQ ID NO: 74950 - DNA, 20 bp, Artificial Sequence
  Description of Artificial Sequence: Synthetic oligonucleotide
  Target: SCN9A; (-) strand; PAM type: YTN; PAM sequence: TTA
actgagctcttagtatgtaa

SEQ ID NO: 74951 - DNA, 20 bp, Artificial Sequence
  Description of Artificial Sequence: Synthetic oligonucleotide
  Target: SCN9A; (-) strand; PAM type: YTN; PAM sequence: TTT
aactgagctcttagtatgta

SEQ ID NO: 74952 - DNA, 20 bp, Artificial Sequence
  Description of Artificial Sequence: Synthetic oligonucleotide
  Target: SCN9A; (-) strand; PAM type: YTN; PAM sequence: CTT
taactgagctcttagtatgt

SEQ ID NO: 74953 - DNA, 20 bp, Artificial Sequence
  Description of Artificial Sequence: Synthetic oligonucleotide
  Target: SCN9A; (-) strand; PAM type: YTN; PAM sequence: TTA
aatacactttaactgagctc

SEQ ID NO: 74954 - DNA, 20 bp, Artificial Sequence
  Description of Artificial Sequence: Synthetic oligonucleotide
  Target: SCN9A; (-) strand; PAM type: YTN; PAM sequence: TTT
aaatacactttaactgagct

SEQ ID NO: 74955 - DNA, 20 bp, Artificial Sequence
  Description of Artificial Sequence: Synthetic oligonucleotide
  Target: SCN9A; (-) strand; PAM type: YTN; PAM sequence: CTT
taaatacactttaactgagc

SEQ ID NO: 74956 - DNA, 20 bp, Artificial Sequence
  Description of Artificial Sequence: Synthetic oligonucleotide
  Target: SCN9A; (-) strand; PAM type: YTN; PAM sequence: CTC
tttaaatacactttaactga

SEQ ID NO: 74957 - DNA, 20 bp, Artificial Sequence
  Description of Artificial Sequence: Synthetic oligonucleotide
  Target: SCN9A; (-) strand; PAM type: YTN; PAM sequence: CTC
tctttaaatacactttaact

SEQ ID NO: 74958 - DNA, 20 bp, Artificial Sequence
  Description of Artificial Sequence: Synthetic oligonucleotide
  Target: SCN9A; (-) strand; PAM type: YTN; PAM sequence: CTA
aaagctctctttaaatacac

SEQ ID NO: 74959 - DNA, 20 bp, Artificial Sequence
  Description of Artificial Sequence: Synthetic oligonucleotide
  Target: SCN9A; (-) strand; PAM type: YTN; PAM sequence: CTG
gtgctaaaagctctctttaa

SEQ ID NO: 74960 - DNA, 20 bp, Artificial Sequence
  Description of Artificial Sequence: Synthetic oligonucleotide
  Target: SCN9A; (-) strand; PAM type: YTN; PAM sequence: TTA
actggtgctaaaagctctct

SEQ ID NO: 74961 - DNA, 20 bp, Artificial Sequence
  Description of Artificial Sequence: Synthetic oligonucleotide
  Target: SCN9A; (-) strand; PAM type: YTN; PAM sequence: TTA
taaattaactggtgctaaaa

SEQ ID NO: 74962 - DNA, 20 bp, Artificial Sequence
  Description of Artificial Sequence: Synthetic oligonucleotide
  Target: SCN9A; (-) strand; PAM type: YTN; PAM sequence: TTT
ataaattaactggtgctaaa

SEQ ID NO: 74963 - DNA, 20 bp, Artificial Sequence
  Description of Artificial Sequence: Synthetic oligonucleotide
  Target: SCN9A; (-) strand; PAM type: YTN; PAM sequence: CTT
tataaattaactggtgctaa

SEQ ID NO: 74964 - DNA, 20 bp, Artificial Sequence
  Description of Artificial Sequence: Synthetic oligonucleotide
  Target: SCN9A; (-) strand; PAM type: YTN; PAM sequence: TTA
atgactttataaattaactg

SEQ ID NO: 74965 - DNA, 20 bp, Artificial Sequence
  Description of Artificial Sequence: Synthetic oligonucleotide
  Target: SCN9A; (-) strand; PAM type: YTN; PAM sequence: TTT
aatgactttataaattaact

SEQ ID NO: 74966 - DNA, 20 bp, Artificial Sequence
  Description of Artificial Sequence: Synthetic oligonucleotide
  Target: SCN9A; (-) strand; PAM type: YTN; PAM sequence: TTA
aatatttaatgactttataa

SEQ ID NO: 74967 - DNA, 20 bp, Artificial Sequence
  Description of Artificial Sequence: Synthetic oligonucleotide
  Target: SCN9A; (-) strand; PAM type: YTN; PAM sequence: TTT
aaatatttaatgactttata

SEQ ID NO: 74968 - DNA, 20 bp, Artificial Sequence
  Description of Artificial Sequence: Synthetic oligonucleotide
  Target: SCN9A; (-) strand; PAM type: YTN; PAM sequence: TTT
taaatatttaatgactttat

SEQ ID NO: 74969 - DNA, 20 bp, Artificial Sequence
  Description of Artificial Sequence: Synthetic oligonucleotide
  Target: SCN9A; (-) strand; PAM type: YTN; PAM sequence: TTT
ttaaatatttaatgacttta

SEQ ID NO: 74970 - DNA, 20 bp, Artificial Sequence
  Description of Artificial Sequence: Synthetic oligonucleotide
  Target: SCN9A; (-) strand; PAM type: YTN; PAM sequence: CTT
tttaaatatttaatgacttt

SEQ ID NO: 74971 - DNA, 20 bp, Artificial Sequence
  Description of Artificial Sequence: Synthetic oligonucleotide
  Target: SCN9A; (-) strand; PAM type: YTN; PAM sequence: TTC
tttttaaatatttaatgact

SEQ ID NO: 74972 - DNA, 20 bp, Artificial Sequence
  Description of Artificial Sequence: Synthetic oligonucleotide
  Target: SCN9A; (-) strand; PAM type: YTN; PAM sequence: CTT
ctttttaaatatttaatgac

SEQ ID NO: 74973 - DNA, 20 bp, Artificial Sequence
  Description of Artificial Sequence: Synthetic oligonucleotide
  Target: SCN9A; (-) strand; PAM type: YTN; PAM sequence: TTG
ggcaacttctttttaaatat

SEQ ID NO: 74974 - DNA, 20 bp, Artificial Sequence
  Description of Artificial Sequence: Synthetic oligonucleotide
  Target: SCN9A; (-) strand; PAM type: YTN; PAM sequence: TTG
gtattgggcaacttcttttt

SEQ ID NO: 74975 - DNA, 20 bp, Artificial Sequence
  Description of Artificial Sequence: Synthetic oligonucleotide
  Target: SCN9A; (-) strand; PAM type: YTN; PAM sequence: TTT
ggtattgggcaacttctttt

SEQ ID NO: 74976 - DNA, 20 bp, Artificial Sequence
  Description of Artificial Sequence: Synthetic oligonucleotide
  Target: SCN9A; (-) strand; PAM type: YTN; PAM sequence: CTT
tggtattgggcaacttcttt

SEQ ID NO: 74977 - DNA, 20 bp, Artificial Sequence
  Description of Artificial Sequence: Synthetic oligonucleotide
  Target: SCN9A; (-) strand; PAM type: YTN; PAM sequence: CTC
tttggtattgggcaacttct

SEQ ID NO: 74978 - DNA, 20 bp, Artificial Sequence
  Description of Artificial Sequence: Synthetic oligonucleotide
  Target: SCN9A; (-) strand; PAM type: YTN; PAM sequence: CTC
ctctttggtattgggcaact

SEQ ID NO: 74979 - DNA, 20 bp, Artificial Sequence
  Description of Artificial Sequence: Synthetic oligonucleotide
  Target: SCN9A; (-) strand; PAM type: YTN; PAM sequence: TTC
ctcctctttggtattgggca

SEQ ID NO: 74980 - DNA, 20 bp, Artificial Sequence
  Description of Artificial Sequence: Synthetic oligonucleotide
  Target: SCN9A; (-) strand; PAM type: YTN; PAM sequence: TTT
cctcctctttggtattgggc

SEQ ID NO: 74981 - DNA, 20 bp, Artificial Sequence
  Description of Artificial Sequence: Synthetic oligonucleotide
  Target: SCN9A; (-) strand; PAM type: YTN; PAM sequence: TTT
tcctcctctttggtattggg

SEQ ID NO: 74982 - DNA, 20 bp, Artificial Sequence
  Description of Artificial Sequence: Synthetic oligonucleotide
  Target: SCN9A; (-) strand; PAM type: YTN; PAM sequence: TTT
ttcctcctctttggtattgg

SEQ ID NO: 74983 - DNA, 20 bp, Artificial Sequence
  Description of Artificial Sequence: Synthetic oligonucleotide
  Target: SCN9A; (-) strand; PAM type: YTN; PAM sequence: TTG
aatttttcctcctctttggt

SEQ ID NO: 74984 - DNA, 20 bp, Artificial Sequence
  Description of Artificial Sequence: Synthetic oligonucleotide
  Target: SCN9A; (-) strand; PAM type: YTN; PAM sequence: CTG
gacatgagtcatataagcat

SEQ ID NO: 74985 - DNA, 20 bp, Artificial Sequence
  Description of Artificial Sequence: Synthetic oligonucleotide
  Target: SCN9A; (-) strand; PAM type: YTN; PAM sequence: TTA
caccctggacatgagtcata

SEQ ID NO: 74986 - DNA, 20 bp, Artificial Sequence
  Description of Artificial Sequence: Synthetic oligonucleotide
  Target: SCN9A; (-) strand; PAM type: YTN; PAM sequence: TTT
acaccctggacatgagtcat

SEQ ID NO: 74987 - DNA, 20 bp, Artificial Sequence
  Description of Artificial Sequence: Synthetic oligonucleotide
  Target: SCN9A; (-) strand; PAM type: YTN; PAM sequence: TTC
caaaggatttacaccctgga

SEQ ID NO: 74988 - DNA, 20 bp, Artificial Sequence
  Description of Artificial Sequence: Synthetic oligonucleotide
  Target: SCN9A; (-) strand; PAM type: YTN; PAM sequence: CTT
ccaaaggatttacaccctgg

SEQ ID NO: 74989 - DNA, 20 bp, Artificial Sequence
  Description of Artificial Sequence: Synthetic oligonucleotide
  Target: SCN9A; (-) strand; PAM type: YTN; PAM sequence: CTA
gatccttccaaaggatttac

SEQ ID NO: 74990 - DNA, 20 bp, Artificial Sequence
  Description of Artificial Sequence: Synthetic oligonucleotide
  Target: SCN9A; (-) strand; PAM type: YTN; PAM sequence: TTG
aactagatccttccaaagga

SEQ ID NO: 74991 - DNA, 20 bp, Artificial Sequence
  Description of Artificial Sequence: Synthetic oligonucleotide
  Target: SCN9A; (-) strand; PAM type: YTN; PAM sequence: CTA
ttgaactagatccttccaaa

SEQ ID NO: 74992 - DNA, 20 bp, Artificial Sequence
  Description of Artificial Sequence: Synthetic oligonucleotide
  Target: SCN9A; (-) strand; PAM type: YTN; PAM sequence: CTA
atgtctattgaactagatcc

SEQ ID NO: 74993 - DNA, 20 bp, Artificial Sequence
  Description of Artificial Sequence: Synthetic oligonucleotide
  Target: SCN9A; (-) strand; PAM type: YTN; PAM sequence: TTA
catagtaagcactaatgtct

SEQ ID NO: 74994 - DNA, 20 bp, Artificial Sequence
  Description of Artificial Sequence: Synthetic oligonucleotide
  Target: SCN9A; (-) strand; PAM type: YTN; PAM sequence: TTT
acatagtaagcactaatgtc

SEQ ID NO: 74995 - DNA, 20 bp, Artificial Sequence
  Description of Artificial Sequence: Synthetic oligonucleotide
  Target: SCN9A; (-) strand; PAM type: YTN; PAM sequence: CTT
tacatagtaagcactaatgt

SEQ ID NO: 74996 - DNA, 20 bp, Artificial Sequence
  Description of Artificial Sequence: Synthetic oligonucleotide
  Target: SCN9A; (-) strand; PAM type: YTN; PAM sequence: TTC
tttacatagtaagcactaat

SEQ ID NO: 74997 - DNA, 20 bp, Artificial Sequence
  Description of Artificial Sequence: Synthetic oligonucleotide
  Target: SCN9A; (-) strand; PAM type: YTN; PAM sequence: TTG
ttctttacatagtaagcact

SEQ ID NO: 74998 - DNA, 20 bp, Artificial Sequence
  Description of Artificial Sequence: Synthetic oligonucleotide
  Target: SCN9A; (-) strand; PAM type: YTN; PAM sequence: TTT
gttctttacatagtaagcac

SEQ ID NO: 74999 - DNA, 20 bp, Artificial Sequence
  Description of Artificial Sequence: Synthetic oligonucleotide
  Target: SCN9A; (-) strand; PAM type: YTN; PAM sequence: CTT
tgttctttacatagtaagca

SEQ ID NO: 75000 - DNA, 20 bp, Artificial Sequence
  Description of Artificial Sequence: Synthetic oligonucleotide
  Target: SCN9A; (-) strand; PAM type: YTN; PAM sequence: TTG
ccactttgttctttacatag

SEQ ID NO: 75001 - DNA, 20 bp, Artificial Sequence
  Description of Artificial Sequence: Synthetic oligonucleotide
  Target: SCN9A; (-) strand; PAM type: YTN; PAM sequence: TTC
acaatagttgccactttgtt

SEQ ID NO: 75002 - DNA, 20 bp, Artificial Sequence
  Description of Artificial Sequence: Synthetic oligonucleotide
  Target: SCN9A; (-) strand; PAM type: YTN; PAM sequence: TTG
ttcacaatagttgccacttt

SEQ ID NO: 75003 - DNA, 20 bp, Artificial Sequence
  Description of Artificial Sequence: Synthetic oligonucleotide
  Target: SCN9A; (-) strand; PAM type: YTN; PAM sequence: TTC
cattgttcacaatagttgcc

SEQ ID NO: 75004 - DNA, 20 bp, Artificial Sequence
  Description of Artificial Sequence: Synthetic oligonucleotide
  Target: SCN9A; (-) strand; PAM type: YTN; PAM sequence: TTT
ccattgttcacaatagttgc

SEQ ID NO: 75005 - DNA, 20 bp, Artificial Sequence
  Description of Artificial Sequence: Synthetic oligonucleotide
  Target: SCN9A; (-) strand; PAM type: YTN; PAM sequence: TTT
tccattgttcacaatagttg

SEQ ID NO: 75006 - DNA, 20 bp, Artificial Sequence
  Description of Artificial Sequence: Synthetic oligonucleotide
  Target: SCN9A; (-) strand; PAM type: YTN; PAM sequence: TTT
ttccattgttcacaatagtt

SEQ ID NO: 75007 - DNA, 20 bp, Artificial Sequence
  Description of Artificial Sequence: Synthetic oligonucleotide
  Target: SCN9A; (-) strand; PAM type: YTN; PAM sequence: CTT
tttccattgttcacaatagt

SEQ ID NO: 75008 - DNA, 20 bp, Artificial Sequence
  Description of Artificial Sequence: Synthetic oligonucleotide
  Target: SCN9A; (-) strand; PAM type: YTN; PAM sequence: TTA
ccatactttttccattgttc

SEQ ID NO: 75009 - DNA, 20 bp, Artificial Sequence
  Description of Artificial Sequence: Synthetic oligonucleotide
  Target: SCN9A; (-) strand; PAM type: YTN; PAM sequence: CTT
accatactttttccattgtt

SEQ ID NO: 75010 - DNA, 20 bp, Artificial Sequence
  Description of Artificial Sequence: Synthetic oligonucleotide
  Target: SCN9A; (-) strand; PAM type: YTN; PAM sequence: TTG
aggcaaagaccttaccatac

SEQ ID NO: 75011 - DNA, 20 bp, Artificial Sequence
  Description of Artificial Sequence: Synthetic oligonucleotide
  Target: SCN9A; (-) strand; PAM type: YTN; PAM sequence: TTT
gaggcaaagaccttaccata

SEQ ID NO: 75012 - DNA, 20 bp, Artificial Sequence
  Description of Artificial Sequence: Synthetic oligonucleotide
  Target: SCN9A; (-) strand; PAM type: YTN; PAM sequence: TTT
tgaggcaaagaccttaccat

SEQ ID NO: 75013 - DNA, 20 bp, Artificial Sequence
  Description of Artificial Sequence: Synthetic oligonucleotide
  Target: SCN9A; (-) strand; PAM type: YTN; PAM sequence: CTG
gttttgaggcaaagacctta

SEQ ID NO: 75014 - DNA, 20 bp, Artificial Sequence
  Description of Artificial Sequence: Synthetic oligonucleotide
  Target: SCN9A; (-) strand; PAM type: YTN; PAM sequence: TTG
gacacatatatcaataaaaa

SEQ ID NO: 75015 - DNA, 20 bp, Artificial Sequence
  Description of Artificial Sequence: Synthetic oligonucleotide
  Target: SCN9A; (-) strand; PAM type: YTN; PAM sequence: CTT
ggacacatatatcaataaaa

SEQ ID NO: 75016 - DNA, 20 bp, Artificial Sequence
  Description of Artificial Sequence: Synthetic oligonucleotide
  Target: SCN9A; (-) strand; PAM type: YTN; PAM sequence: CTA
ggtgatgatacagaacttgg

SEQ ID NO: 75017 - DNA, 20 bp, Artificial Sequence
  Description of Artificial Sequence: Synthetic oligonucleotide
  Target: SCN9A; (-) strand; PAM type: YTN; PAM sequence: TTG
aacctaggtgatgatacaga

SEQ ID NO: 75018 - DNA, 20 bp, Artificial Sequence
  Description of Artificial Sequence: Synthetic oligonucleotide
  Target: SCN9A; (-) strand; PAM type: YTN; PAM sequence: CTT
gaacctaggtgatgatacag

SEQ ID NO: 75019 - DNA, 20 bp, Artificial Sequence
  Description of Artificial Sequence: Synthetic oligonucleotide
  Target: SCN9A; (-) strand; PAM type: YTN; PAM sequence: TTC
acttgaacctaggtgatgat

SEQ ID NO: 75020 - DNA, 20 bp, Artificial Sequence
  Description of Artificial Sequence: Synthetic oligonucleotide
  Target: SCN9A; (-) strand; PAM type: YTN; PAM sequence: TTT
cacttgaacctaggtgatga

SEQ ID NO: 75021 - DNA, 20 bp, Artificial Sequence
  Description of Artificial Sequence: Synthetic oligonucleotide
  Target: SCN9A; (-) strand; PAM type: YTN; PAM sequence: TTC
aaaatttcacttgaacctag

SEQ ID NO: 75022 - DNA, 20 bp, Artificial Sequence
  Description of Artificial Sequence: Synthetic oligonucleotide
  Target: SCN9A; (-) strand; PAM type: YTN; PAM sequence: CTT
caaaatttcacttgaaccta

SEQ ID NO: 75023 - DNA, 20 bp, Artificial Sequence
  Description of Artificial Sequence: Synthetic oligonucleotide
  Target: SCN9A; (-) strand; PAM type: YTN; PAM sequence: CTG
ccttcaaaatttcacttgaa

SEQ ID NO: 75024 - DNA, 20 bp, Artificial Sequence
  Description of Artificial Sequence: Synthetic oligonucleotide
  Target: SCN9A; (-) strand; PAM type: YTN; PAM sequence: CTG
atatacacagtaaaaaaaga

SEQ ID NO: 75025 - DNA, 20 bp, Artificial Sequence
  Description of Artificial Sequence: Synthetic oligonucleotide
  Target: SCN9A; (-) strand; PAM type: YTN; PAM sequence: CTC
ctgatatacacagtaaaaaa

SEQ ID NO: 75026 - DNA, 20 bp, Artificial Sequence
  Description of Artificial Sequence: Synthetic oligonucleotide
  Target: SCN9A; (-) strand; PAM type: YTN; PAM sequence: TTC
tcctgatatacacagtaaaa

SEQ ID NO: 75027 - DNA, 20 bp, Artificial Sequence
  Description of Artificial Sequence: Synthetic oligonucleotide
  Target: SCN9A; (-) strand; PAM type: YTN; PAM sequence: CTA
caagattctcctgatataca

SEQ ID NO: 75028 - DNA, 20 bp, Artificial Sequence
  Description of Artificial Sequence: Synthetic oligonucleotide
  Target: SCN9A; (-) strand; PAM type: YTN; PAM sequence: TTA
aaaatctacaagattctcct

SEQ ID NO: 75029 - DNA, 20 bp, Artificial Sequence
  Description of Artificial Sequence: Synthetic oligonucleotide
  Target: SCN9A; (-) strand; PAM type: YTN; PAM sequence: CTA
gttaaaaatctacaagattc

SEQ ID NO: 75030 - DNA, 20 bp, Artificial Sequence
  Description of Artificial Sequence: Synthetic oligonucleotide
  Target: SCN9A; (-) strand; PAM type: YTN; PAM sequence: CTA
aaaatctagttaaaaatcta

SEQ ID NO: 75031 - DNA, 20 bp, Artificial Sequence
  Description of Artificial Sequence: Synthetic oligonucleotide
  Target: SCN9A; (-) strand; PAM type: YTN; PAM sequence: CTA
aactaaaaatctagttaaaa

SEQ ID NO: 75032 - DNA, 20 bp, Artificial Sequence
  Description of Artificial Sequence: Synthetic oligonucleotide
  Target: SCN9A; (-) strand; PAM type: YTN; PAM sequence: TTC
taaactaaaaatctagttaa

SEQ ID NO: 75033 - DNA, 20 bp, Artificial Sequence
  Description of Artificial Sequence: Synthetic oligonucleotide
  Target: SCN9A; (-) strand; PAM type: YTN; PAM sequence: TTT
ctaaactaaaaatctagtta

SEQ ID NO: 75034 - DNA, 20 bp, Artificial Sequence
  Description of Artificial Sequence: Synthetic oligonucleotide
  Target: SCN9A; (-) strand; PAM type: YTN; PAM sequence: TTT
tctaaactaaaaatctagtt

SEQ ID NO: 75035 - DNA, 20 bp, Artificial Sequence
  Description of Artificial Sequence: Synthetic oligonucleotide
  Target: SCN9A; (-) strand; PAM type: YTN; PAM sequence: CTT
ttctaaactaaaaatctagt

SEQ ID NO: 75036 - DNA, 20 bp, Artificial Sequence
  Description of Artificial Sequence: Synthetic oligonucleotide
  Target: SCN9A; (-) strand; PAM type: YTN; PAM sequence: TTC
catcacacaaccccacaaat

SEQ ID NO: 75037 - DNA, 20 bp, Artificial Sequence
  Description of Artificial Sequence: Synthetic oligonucleotide
  Target: SCN9A; (-) strand; PAM type: YTN; PAM sequence: TTT
ccatcacacaaccccacaaa

SEQ ID NO: 75038 - DNA, 20 bp, Artificial Sequence
  Description of Artificial Sequence: Synthetic oligonucleotide
  Target: SCN9A; (-) strand; PAM type: YTN; PAM sequence: TTT
tccatcacacaaccccacaa

SEQ ID NO: 75039 - DNA, 20 bp, Artificial Sequence
  Description of Artificial Sequence: Synthetic oligonucleotide
  Target: SCN9A; (-) strand; PAM type: YTN; PAM sequence: CTG
ttttccatcacacaacccca

SEQ ID NO: 75040 - DNA, 20 bp, Artificial Sequence
  Description of Artificial Sequence: Synthetic oligonucleotide
  Target: SCN9A; (-) strand; PAM type: YTN; PAM sequence: TTC
cctgttttccatcacacaac

SEQ ID NO: 75041 - DNA, 20 bp, Artificial Sequence
  Description of Artificial Sequence: Synthetic oligonucleotide
  Target: SCN9A; (-) strand; PAM type: YTN; PAM sequence: CTT
ccctgttttccatcacacaa

SEQ ID NO: 75042 - DNA, 20 bp, Artificial Sequence
  Description of Artificial Sequence: Synthetic oligonucleotide
  Target: SCN9A; (-) strand; PAM type: YTN; PAM sequence: TTA
ggtcttccctgttttccatc

SEQ ID NO: 75043 - DNA, 20 bp, Artificial Sequence
  Description of Artificial Sequence: Synthetic oligonucleotide
  Target: SCN9A; (-) strand; PAM type: YTN; PAM sequence: CTT
aggtcttccctgttttccat

SEQ ID NO: 75044 - DNA, 20 bp, Artificial Sequence
  Description of Artificial Sequence: Synthetic oligonucleotide
  Target: SCN9A; (-) strand; PAM type: YTN; PAM sequence: TTC
cttaggtcttccctgttttc

SEQ ID NO: 75045 - DNA, 20 bp, Artificial Sequence
  Description of Artificial Sequence: Synthetic oligonucleotide
  Target: SCN9A; (-) strand; PAM type: YTN; PAM sequence: TTT
ccttaggtcttccctgtttt

SEQ ID NO: 75046 - DNA, 20 bp, Artificial Sequence
  Description of Artificial Sequence: Synthetic oligonucleotide
  Target: SCN9A; (-) strand; PAM type: YTN; PAM sequence: TTT
tccttaggtcttccctgttt

SEQ ID NO: 75047 - DNA, 20 bp, Artificial Sequence
  Description of Artificial Sequence: Synthetic oligonucleotide
  Target: SCN9A; (-) strand; PAM type: YTN; PAM sequence: CTG
ttttccttaggtcttccctg

SEQ ID NO: 75048 - DNA, 20 bp, Artificial Sequence
  Description of Artificial Sequence: Synthetic oligonucleotide
  Target: SCN9A; (-) strand; PAM type: YTN; PAM sequence: TTC
tgttttccttaggtcttccc

SEQ ID NO: 75049 - DNA, 20 bp, Artificial Sequence
  Description of Artificial Sequence: Synthetic oligonucleotide
  Target: SCN9A; (-) strand; PAM type: YTN; PAM sequence: CTT
ctgttttccttaggtcttcc

SEQ ID NO: 75050 - DNA, 20 bp, Artificial Sequence
  Description of Artificial Sequence: Synthetic oligonucleotide
  Target: SCN9A; (-) strand; PAM type: YTN; PAM sequence: TTG
cttctgttttccttaggtct

SEQ ID NO: 75051 - DNA, 20 bp, Artificial Sequence
  Description of Artificial Sequence: Synthetic oligonucleotide
  Target: SCN9A; (-) strand; PAM type: YTN; PAM sequence: CTG
cacaaatccccaagatgaac

SEQ ID NO: 75052 - DNA, 20 bp, Artificial Sequence
  Description of Artificial Sequence: Synthetic oligonucleotide
  Target: SCN9A; (-) strand; PAM type: YTN; PAM sequence: TTC
tgcacaaatccccaagatga

SEQ ID NO: 75053 - DNA, 20 bp, Artificial Sequence
  Description of Artificial Sequence: Synthetic oligonucleotide
  Target: SCN9A; (-) strand; PAM type: YTN; PAM sequence: TTA
taattctgcacaaatcccca

SEQ ID NO: 75054 - DNA, 20 bp, Artificial Sequence
  Description of Artificial Sequence: Synthetic oligonucleotide
  Target: SCN9A; (-) strand; PAM type: YTN; PAM sequence: CTT
ataattctgcacaaatcccc

SEQ ID NO: 75055 - DNA, 20 bp, Artificial Sequence
  Description of Artificial Sequence: Synthetic oligonucleotide
  Target: SCN9A; (-) strand; PAM type: YTN; PAM sequence: CTG
cttataattctgcacaaatc

SEQ ID NO: 75056 - DNA, 20 bp, Artificial Sequence
  Description of Artificial Sequence: Synthetic oligonucleotide
  Target: SCN9A; (-) strand; PAM type: YTN; PAM sequence: CTC
cctgcttataattctgcaca

SEQ ID NO: 75057 - DNA, 20 bp, Artificial Sequence
  Description of Artificial Sequence: Synthetic oligonucleotide
  Target: SCN9A; (-) strand; PAM type: YTN; PAM sequence: CTC
aggcctccctgcttataatt

SEQ ID NO: 75058 - DNA, 20 bp, Artificial Sequence
  Description of Artificial Sequence: Synthetic oligonucleotide
  Target: SCN9A; (-) strand; PAM type: YTN; PAM sequence: CTC
tcaggcctccctgcttataa

SEQ ID NO: 75059 - DNA, 20 bp, Artificial Sequence
  Description of Artificial Sequence: Synthetic oligonucleotide
  Target: SCN9A; (-) strand; PAM type: YTN; PAM sequence: TTC
atctctcaggcctccctgct

SEQ ID NO: 75060 - DNA, 20 bp, Artificial Sequence
  Description of Artificial Sequence: Synthetic oligonucleotide
  Target: SCN9A; (-) strand; PAM type: YTN; PAM sequence: CTT
catctctcaggcctccctgc

SEQ ID NO: 75061 - DNA, 20 bp, Artificial Sequence
  Description of Artificial Sequence: Synthetic oligonucleotide
  Target: SCN9A; (-) strand; PAM type: YTN; PAM sequence: CTG
aaaccttcatctctcaggcc

SEQ ID NO: 75062 - DNA, 20 bp, Artificial Sequence
  Description of Artificial Sequence: Synthetic oligonucleotide
  Target: SCN9A; (-) strand; PAM type: YTN; PAM sequence: TTC
actgaaaccttcatctctca

SEQ ID NO: 75063 - DNA, 20 bp, Artificial Sequence
  Description of Artificial Sequence: Synthetic oligonucleotide
  Target: SCN9A; (-) strand; PAM type: YTN; PAM sequence: TTT
cactgaaaccttcatctctc

SEQ ID NO: 75064 - DNA, 20 bp, Artificial Sequence
  Description of Artificial Sequence: Synthetic oligonucleotide
  Target: SCN9A; (-) strand; PAM type: YTN; PAM sequence: TTT
tcactgaaaccttcatctct

SEQ ID NO: 75065 - DNA, 20 bp, Artificial Sequence
  Description of Artificial Sequence: Synthetic oligonucleotide
  Target: SCN9A; (-) strand; PAM type: YTN; PAM sequence: CTT
ttcactgaaaccttcatctc

SEQ ID NO: 75066 - DNA, 20 bp, Artificial Sequence
  Description of Artificial Sequence: Synthetic oligonucleotide
  Target: SCN9A; (-) strand; PAM type: YTN; PAM sequence: CTC
ttttcactgaaaccttcatc

SEQ ID NO: 75067 - DNA, 20 bp, Artificial Sequence
  Description of Artificial Sequence: Synthetic oligonucleotide
  Target: SCN9A; (-) strand; PAM type: YTN; PAM sequence: TTC
tcttttcactgaaaccttca

SEQ ID NO: 75068 - DNA, 20 bp, Artificial Sequence
  Description of Artificial Sequence: Synthetic oligonucleotide
  Target: SCN9A; (-) strand; PAM type: YTN; PAM sequence: TTT
ctcttttcactgaaaccttc

SEQ ID NO: 75069 - DNA, 20 bp, Artificial Sequence
  Description of Artificial Sequence: Synthetic oligonucleotide
  Target: SCN9A; (-) strand; PAM type: YTN; PAM sequence: CTT
tctcttttcactgaaacctt

SEQ ID NO: 75070 - DNA, 20 bp, Artificial Sequence
  Description of Artificial Sequence: Synthetic oligonucleotide
  Target: SCN9A; (-) strand; PAM type: YTN; PAM sequence: TTC
cctttctcttttcactgaaa

SEQ ID NO: 75071 - DNA, 20 bp, Artificial Sequence
  Description of Artificial Sequence: Synthetic oligonucleotide
  Target: SCN9A; (-) strand; PAM type: YTN; PAM sequence: TTT
ccctttctcttttcactgaa

SEQ ID NO: 75072 - DNA, 20 bp, Artificial Sequence
  Description of Artificial Sequence: Synthetic oligonucleotide
  Target: SCN9A; (-) strand; PAM type: YTN; PAM sequence: CTT
tccctttctcttttcactga

SEQ ID NO: 75073 - DNA, 20 bp, Artificial Sequence
  Description of Artificial Sequence: Synthetic oligonucleotide
  Target: SCN9A; (-) strand; PAM type: YTN; PAM sequence: CTC
tttccctttctcttttcact

SEQ ID NO: 75074 - DNA, 20 bp, Artificial Sequence
  Description of Artificial Sequence: Synthetic oligonucleotide
  Target: SCN9A; (-) strand; PAM type: YTN; PAM sequence: TTC
tctttccctttctcttttca

SEQ ID NO: 75075 - DNA, 20 bp, Artificial Sequence
  Description of Artificial Sequence: Synthetic oligonucleotide
  Target: SCN9A; (-) strand; PAM type: YTN; PAM sequence: TTA
tgtggaagttctctttccct

SEQ ID NO: 75076 - DNA, 20 bp, Artificial Sequence
  Description of Artificial Sequence: Synthetic oligonucleotide
  Target: SCN9A; (-) strand; PAM type: YTN; PAM sequence: TTT
atgtggaagttctctttccc

SEQ ID NO: 75077 - DNA, 20 bp, Artificial Sequence
  Description of Artificial Sequence: Synthetic oligonucleotide
  Target: SCN9A; (-) strand; PAM type: YTN; PAM sequence: CTG
tttatgtggaagttctcttt

SEQ ID NO: 75078 - DNA, 20 bp, Artificial Sequence
  Description of Artificial Sequence: Synthetic oligonucleotide
  Target: SCN9A; (-) strand; PAM type: YTN; PAM sequence: TTC
tgtttatgtggaagttctct

SEQ ID NO: 75079 - DNA, 20 bp, Artificial Sequence
  Description of Artificial Sequence: Synthetic oligonucleotide
  Target: SCN9A; (-) strand; PAM type: YTN; PAM sequence: TTA
attctgtttatgtggaagtt

SEQ ID NO: 75080 - DNA, 20 bp, Artificial Sequence
  Description of Artificial Sequence: Synthetic oligonucleotide
  Target: SCN9A; (-) strand; PAM type: YTN; PAM sequence: CTG
ttaattctgtttatgtggaa

SEQ ID NO: 75081 - DNA, 20 bp, Artificial Sequence
  Description of Artificial Sequence: Synthetic oligonucleotide
  Target: SCN9A; (-) strand; PAM type: YTN; PAM sequence: CTA
atatgtagtgccatagtctg

SEQ ID NO: 75082 - DNA, 20 bp, Artificial Sequence
  Description of Artificial Sequence: Synthetic oligonucleotide
  Target: SCN9A; (-) strand; PAM type: YTN; PAM sequence: CTA
ctaatatgtagtgccatagt

SEQ ID NO: 75083 - DNA, 20 bp, Artificial Sequence
  Description of Artificial Sequence: Synthetic oligonucleotide
  Target: SCN9A; (-) strand; PAM type: YTN; PAM sequence: CTC
cacccccaaccacatcaact

SEQ ID NO: 75084 - DNA, 20 bp, Artificial Sequence
  Description of Artificial Sequence: Synthetic oligonucleotide
  Target: SCN9A; (-) strand; PAM type: YTN; PAM sequence: TTG
atatcctccacccccaacca

SEQ ID NO: 75085 - DNA, 20 bp, Artificial Sequence
  Description of Artificial Sequence: Synthetic oligonucleotide
  Target: SCN9A; (-) strand; PAM type: YTN; PAM sequence: TTT
gatatcctccacccccaacc

SEQ ID NO: 75086 - DNA, 20 bp, Artificial Sequence
  Description of Artificial Sequence: Synthetic oligonucleotide
  Target: SCN9A; (-) strand; PAM type: YTN; PAM sequence: CTT
tgatatcctccacccccaac

SEQ ID NO: 75087 - DNA, 20 bp, Artificial Sequence
  Description of Artificial Sequence: Synthetic oligonucleotide
  Target: SCN9A; (-) strand; PAM type: YTN; PAM sequence: TTG
gagaagcctttgatatcctc

SEQ ID NO: 75088 - DNA, 20 bp, Artificial Sequence
  Description of Artificial Sequence: Synthetic oligonucleotide
  Target: SCN9A; (-) strand; PAM type: YTN; PAM sequence: TTT
ggagaagcctttgatatcct

SEQ ID NO: 75089 - DNA, 20 bp, Artificial Sequence
  Description of Artificial Sequence: Synthetic oligonucleotide
  Target: SCN9A; (-) strand; PAM type: YTN; PAM sequence: CTT
tggagaagcctttgatatcc

SEQ ID NO: 75090 - DNA, 20 bp, Artificial Sequence
  Description of Artificial Sequence: Synthetic oligonucleotide
  Target: SCN9A; (-) strand; PAM type: YTN; PAM sequence: TTG
gaactttggagaagcctttg

SEQ ID NO: 75091 - DNA, 20 bp, Artificial Sequence
  Description of Artificial Sequence: Synthetic oligonucleotide
  Target: SCN9A; (-) strand; PAM type: YTN; PAM sequence: TTT
ggaactttggagaagccttt

SEQ ID NO: 75092 - DNA, 20 bp, Artificial Sequence
  Description of Artificial Sequence: Synthetic oligonucleotide
  Target: SCN9A; (-) strand; PAM type: YTN; PAM sequence: CTC
acccatttggaactttggag

SEQ ID NO: 75093 - DNA, 20 bp, Artificial Sequence
  Description of Artificial Sequence: Synthetic oligonucleotide
  Target: SCN9A; (-) strand; PAM type: YTN; PAM sequence: TTA
aacagtataggtaatagtat

SEQ ID NO: 75094 - DNA, 20 bp, Artificial Sequence
  Description of Artificial Sequence: Synthetic oligonucleotide
  Target: SCN9A; (-) strand; PAM type: YTN; PAM sequence: CTT
aaacagtataggtaatagta

SEQ ID NO: 75095 - DNA, 20 bp, Artificial Sequence
  Description of Artificial Sequence: Synthetic oligonucleotide
  Target: SCN9A; (-) strand; PAM type: YTN; PAM sequence: TTC
ttaaacagtataggtaatag

SEQ ID NO: 75096 - DNA, 20 bp, Artificial Sequence
  Description of Artificial Sequence: Synthetic oligonucleotide
  Target: SCN9A; (-) strand; PAM type: YTN; PAM sequence: TTT
cttaaacagtataggtaata

SEQ ID NO: 75097 - DNA, 20 bp, Artificial Sequence
  Description of Artificial Sequence: Synthetic oligonucleotide
  Target: SCN9A; (-) strand; PAM type: YTN; PAM sequence: CTT
tcttaaacagtataggtaat

SEQ ID NO: 75098 - DNA, 20 bp, Artificial Sequence
  Description of Artificial Sequence: Synthetic oligonucleotide
  Target: SCN9A; (-) strand; PAM type: YTN; PAM sequence: TTC
tttcttaaacagtataggta

SEQ ID NO: 75099 - DNA, 20 bp, Artificial Sequence
  Description of Artificial Sequence: Synthetic oligonucleotide
  Target: SCN9A; (-) strand; PAM type: YTN; PAM sequence: CTT
ctttcttaaacagtataggt

SEQ ID NO: 75100 - DNA, 20 bp, Artificial Sequence
  Description of Artificial Sequence: Synthetic oligonucleotide
  Target: SCN9A; (-) strand; PAM type: YTN; PAM sequence: CTC
ttctttcttaaacagtatag

SEQ ID NO: 75101 - DNA, 20 bp, Artificial Sequence
  Description of Artificial Sequence: Synthetic oligonucleotide
  Target: SCN9A; (-) strand; PAM type: YTN; PAM sequence: TTC
tcttctttcttaaacagtat

SEQ ID NO: 75102 - DNA, 20 bp, Artificial Sequence
  Description of Artificial Sequence: Synthetic oligonucleotide
  Target: SCN9A; (-) strand; PAM type: YTN; PAM sequence: TTT
ctcttctttcttaaacagta

SEQ ID NO: 75103 - DNA, 20 bp, Artificial Sequence
  Description of Artificial Sequence: Synthetic oligonucleotide
  Target: SCN9A; (-) strand; PAM type: YTN; PAM sequence: CTA
gtttctcttctttcttaaac

SEQ ID NO: 75104 - DNA, 20 bp, Artificial Sequence
  Description of Artificial Sequence: Synthetic oligonucleotide
  Target: SCN9A; (-) strand; PAM type: YTN; PAM sequence: TTA
gactagtttctcttctttct

SEQ ID NO: 75105 - DNA, 20 bp, Artificial Sequence
  Description of Artificial Sequence: Synthetic oligonucleotide
  Target: SCN9A; (-) strand; PAM type: YTN; PAM sequence: CTT
agactagtttctcttctttc

SEQ ID NO: 75106 - DNA, 20 bp, Artificial Sequence
  Description of Artificial Sequence: Synthetic oligonucleotide
  Target: SCN9A; (-) strand; PAM type: YTN; PAM sequence: CTA
atcttagactagtttctctt

SEQ ID NO: 75107 - DNA, 20 bp, Artificial Sequence
  Description of Artificial Sequence: Synthetic oligonucleotide
  Target: SCN9A; (-) strand; PAM type: YTN; PAM sequence: TTA
aaaactaatcttagactagt

SEQ ID NO: 75108 - DNA, 20 bp, Artificial Sequence
  Description of Artificial Sequence: Synthetic oligonucleotide
  Target: SCN9A; (-) strand; PAM type: YTN; PAM sequence: TTG
gttaaaaactaatcttagac

SEQ ID NO: 75109 - DNA, 20 bp, Artificial Sequence
  Description of Artificial Sequence: Synthetic oligonucleotide
  Target: SCN9A; (-) strand; PAM type: YTN; PAM sequence: TTC
attggttaaaaactaatctt

SEQ ID NO: 75110 - DNA, 20 bp, Artificial Sequence
  Description of Artificial Sequence: Synthetic oligonucleotide
  Target: SCN9A; (-) strand; PAM type: YTN; PAM sequence: CTT
cattggttaaaaactaatct

SEQ ID NO: 75111 - DNA, 20 bp, Artificial Sequence
  Description of Artificial Sequence: Synthetic oligonucleotide
  Target: SCN9A; (-) strand; PAM type: YTN; PAM sequence: TTG
taatgcttcattggttaaaa

SEQ ID NO: 75112 - DNA, 20 bp, Artificial Sequence
  Description of Artificial Sequence: Synthetic oligonucleotide
  Target: SCN9A; (-) strand; PAM type: YTN; PAM sequence: TTT
gtaatgcttcattggttaaa

SEQ ID NO: 75113 - DNA, 20 bp, Artificial Sequence
  Description of Artificial Sequence: Synthetic oligonucleotide
  Target: SCN9A; (-) strand; PAM type: YTN; PAM sequence: TTT
tgtaatgcttcattggttaa

SEQ ID NO: 75114 - DNA, 20 bp, Artificial Sequence
  Description of Artificial Sequence: Synthetic oligonucleotide
  Target: SCN9A; (-) strand; PAM type: YTN; PAM sequence: CTG
tgttttgtaatgcttcattg

SEQ ID NO: 75115 - DNA, 20 bp, Artificial Sequence
  Description of Artificial Sequence: Synthetic oligonucleotide
  Target: SCN9A; (-) strand; PAM type: YTN; PAM sequence: TTA
gtctgtgttttgtaatgctt

SEQ ID NO: 75116 - DNA, 20 bp, Artificial Sequence
  Description of Artificial Sequence: Synthetic oligonucleotide
  Target: SCN9A; (-) strand; PAM type: YTN; PAM sequence: TTT
agtctgtgttttgtaatgct

SEQ ID NO: 75117 - DNA, 20 bp, Artificial Sequence
  Description of Artificial Sequence: Synthetic oligonucleotide
  Target: SCN9A; (-) strand; PAM type: YTN; PAM sequence: TTG
tatttagtctgtgttttgta

SEQ ID NO: 75118 - DNA, 20 bp, Artificial Sequence
  Description of Artificial Sequence: Synthetic oligonucleotide
  Target: SCN9A; (-) strand; PAM type: YTN; PAM sequence: TTT
gtatttagtctgtgttttgt

SEQ ID NO: 75119 - DNA, 20 bp, Artificial Sequence
  Description of Artificial Sequence: Synthetic oligonucleotide
  Target: SCN9A; (-) strand; PAM type: YTN; PAM sequence: TTA
tatttgtatttagtctgtgt

SEQ ID NO: 75120 - DNA, 20 bp, Artificial Sequence
  Description of Artificial Sequence: Synthetic oligonucleotide
  Target: SCN9A; (-) strand; PAM type: YTN; PAM sequence: TTT
atatttgtatttagtctgtg

SEQ ID NO: 75121 - DNA, 20 bp, Artificial Sequence
  Description of Artificial Sequence: Synthetic oligonucleotide
  Target: SCN9A; (-) strand; PAM type: YTN; PAM sequence: TTT
tatatttgtatttagtctgt

SEQ ID NO: 75122 - DNA, 20 bp, Artificial Sequence
  Description of Artificial Sequence: Synthetic oligonucleotide
  Target: SCN9A; (-) strand; PAM type: YTN; PAM sequence: CTT
ttatatttgtatttagtctg

SEQ ID NO: 75123 - DNA, 20 bp, Artificial Sequence
  Description of Artificial Sequence: Synthetic oligonucleotide
  Target: SCN9A; (-) strand; PAM type: YTN; PAM sequence: CTA
tagaataacttttatatttg

SEQ ID NO: 75124 - DNA, 20 bp, Artificial Sequence
  Description of Artificial Sequence: Synthetic oligonucleotide
  Target: SCN9A; (-) strand; PAM type: YTN; PAM sequence: TTC
acactatagaataactttta

SEQ ID NO: 75125 - DNA, 20 bp, Artificial Sequence
  Description of Artificial Sequence: Synthetic oligonucleotide
  Target: SCN9A; (-) strand; PAM type: YTN; PAM sequence: TTG
tagaaataaagagaccattc

SEQ ID NO: 75126 - DNA, 20 bp, Artificial Sequence
  Description of Artificial Sequence: Synthetic oligonucleotide
  Target: SCN9A; (-) strand; PAM type: YTN; PAM sequence: CTG
agaaccattgtagaaataaa

SEQ ID NO: 75127 - DNA, 20 bp, Artificial Sequence
  Description of Artificial Sequence: Synthetic oligonucleotide
  Target: SCN9A; (-) strand; PAM type: YTN; PAM sequence: TTC
ctgagaaccattgtagaaat

SEQ ID NO: 75128 - DNA, 20 bp, Artificial Sequence
  Description of Artificial Sequence: Synthetic oligonucleotide
  Target: SCN9A; (-) strand; PAM type: YTN; PAM sequence: TTC
agaagcaaaatgttcctgag

SEQ ID NO: 75129 - DNA, 20 bp, Artificial Sequence
  Description of Artificial Sequence: Synthetic oligonucleotide
  Target: SCN9A; (-) strand; PAM type: YTN; PAM sequence: TTT
cagaagcaaaatgttcctga

SEQ ID NO: 75130 - DNA, 20 bp, Artificial Sequence
  Description of Artificial Sequence: Synthetic oligonucleotide
  Target: SCN9A; (-) strand; PAM type: YTN; PAM sequence: TTT
tcagaagcaaaatgttcctg

SEQ ID NO: 75131 - DNA, 20 bp, Artificial Sequence
  Description of Artificial Sequence: Synthetic oligonucleotide
  Target: SCN9A; (-) strand; PAM type: YTN; PAM sequence: CTA
attttcagaagcaaaatgtt

SEQ ID NO: 75132 - DNA, 20 bp, Artificial Sequence
  Description of Artificial Sequence: Synthetic oligonucleotide
  Target: SCN9A; (-) strand; PAM type: YTN; PAM sequence: CTA
ataaactaattttcagaagc

SEQ ID NO: 75133 - DNA, 20 bp, Artificial Sequence
  Description of Artificial Sequence: Synthetic oligonucleotide
  Target: SCN9A; (-) strand; PAM type: YTN; PAM sequence: CTC
taataaactaattttcagaa

SEQ ID NO: 75134 - DNA, 20 bp, Artificial Sequence
  Description of Artificial Sequence: Synthetic oligonucleotide
  Target: SCN9A; (-) strand; PAM type: YTN; PAM sequence: TTC
tctaataaactaattttcag

SEQ ID NO: 75135 - DNA, 20 bp, Artificial Sequence
  Description of Artificial Sequence: Synthetic oligonucleotide
  Target: SCN9A; (-) strand; PAM type: YTN; PAM sequence: TTG
tcaatatattctctaataaa

SEQ ID NO: 75136 - DNA, 20 bp, Artificial Sequence
  Description of Artificial Sequence: Synthetic oligonucleotide
  Target: SCN9A; (-) strand; PAM type: YTN; PAM sequence: TTC
agaattgtcaatatattctc

SEQ ID NO: 75137 - DNA, 20 bp, Artificial Sequence
  Description of Artificial Sequence: Synthetic oligonucleotide
  Target: SCN9A; (-) strand; PAM type: YTN; PAM sequence: TTT
cagaattgtcaatatattct

SEQ ID NO: 75138 - DNA, 20 bp, Artificial Sequence
  Description of Artificial Sequence: Synthetic oligonucleotide
  Target: SCN9A; (-) strand; PAM type: YTN; PAM sequence: TTA
tagtttcagaattgtcaata

SEQ ID NO: 75139 - DNA, 20 bp, Artificial Sequence
  Description of Artificial Sequence: Synthetic oligonucleotide
  Target: SCN9A; (-) strand; PAM type: YTN; PAM sequence: CTT
atagtttcagaattgtcaat

SEQ ID NO: 75140 - DNA, 20 bp, Artificial Sequence
  Description of Artificial Sequence: Synthetic oligonucleotide
  Target: SCN9A; (-) strand; PAM type: YTN; PAM sequence: TTG
aaagaccttatagtttcaga

SEQ ID NO: 75141 - DNA, 20 bp, Artificial Sequence
  Description of Artificial Sequence: Synthetic oligonucleotide
  Target: SCN9A; (-) strand; PAM type: YTN; PAM sequence: TTT
gaaagaccttatagtttcag

SEQ ID NO: 75142 - DNA, 20 bp, Artificial Sequence
  Description of Artificial Sequence: Synthetic oligonucleotide
  Target: SCN9A; (-) strand; PAM type: YTN; PAM sequence: TTT
tgaaagaccttatagtttca

SEQ ID NO: 75143 - DNA, 20 bp, Artificial Sequence
  Description of Artificial Sequence: Synthetic oligonucleotide
  Target: SCN9A; (-) strand; PAM type: YTN; PAM sequence: TTT
ttgaaagaccttatagtttc

SEQ ID NO: 75144 - DNA, 20 bp, Artificial Sequence
  Description of Artificial Sequence: Synthetic oligonucleotide
  Target: SCN9A; (-) strand; PAM type: YTN; PAM sequence: TTC
aatcatttttgaaagacctt

SEQ ID NO: 75145 - DNA, 20 bp, Artificial Sequence
  Description of Artificial Sequence: Synthetic oligonucleotide
  Target: SCN9A; (-) strand; PAM type: YTN; PAM sequence: TTG
ggttcaatcatttttgaaag

SEQ ID NO: 75146 - DNA, 20 bp, Artificial Sequence
  Description of Artificial Sequence: Synthetic oligonucleotide
  Target: SCN9A; (-) strand; PAM type: YTN; PAM sequence: TTT
gggttcaatcatttttgaaa

SEQ ID NO: 75147 - DNA, 20 bp, Artificial Sequence
  Description of Artificial Sequence: Synthetic oligonucleotide
  Target: SCN9A; (-) strand; PAM type: YTN; PAM sequence: TTC
catttgggttcaatcatttt

SEQ ID NO: 75148 - DNA, 20 bp, Artificial Sequence
  Description of Artificial Sequence: Synthetic oligonucleotide
  Target: SCN9A; (-) strand; PAM type: YTN; PAM sequence: TTT
ccatttgggttcaatcattt

SEQ ID NO: 75149 - DNA, 20 bp, Artificial Sequence
  Description of Artificial Sequence: Synthetic oligonucleotide
  Target: SCN9A; (-) strand; PAM type: YTN; PAM sequence: TTA
tggaaagatgtacacaggtt

SEQ ID NO: 75150 - DNA, 20 bp, Artificial Sequence
  Description of Artificial Sequence: Synthetic oligonucleotide
  Target: SCN9A; (-) strand; PAM type: YTN; PAM sequence: TTT
atggaaagatgtacacaggt

SEQ ID NO: 75151 - DNA, 20 bp, Artificial Sequence
  Description of Artificial Sequence: Synthetic oligonucleotide
  Target: SCN9A; (-) strand; PAM type: YTN; PAM sequence: CTA
ggcatttatggaaagatgta

SEQ ID NO: 75152 - DNA, 20 bp, Artificial Sequence
  Description of Artificial Sequence: Synthetic oligonucleotide
  Target: SCN9A; (-) strand; PAM type: YTN; PAM sequence: CTA
gtatcgctaggcatttatgg

SEQ ID NO: 75153 - DNA, 20 bp, Artificial Sequence
  Description of Artificial Sequence: Synthetic oligonucleotide
  Target: SCN9A; (-) strand; PAM type: YTN; PAM sequence: TTA
ggtaaaaacctagtatcgct

SEQ ID NO: 75154 - DNA, 20 bp, Artificial Sequence
  Description of Artificial Sequence: Synthetic oligonucleotide
  Target: SCN9A; (-) strand; PAM type: YTN; PAM sequence: TTT
aggtaaaaacctagtatcgc

SEQ ID NO: 75155 - DNA, 20 bp, Artificial Sequence
  Description of Artificial Sequence: Synthetic oligonucleotide
  Target: SCN9A; (-) strand; PAM type: YTN; PAM sequence: TTT
taggtaaaaacctagtatcg

SEQ ID NO: 75156 - DNA, 20 bp, Artificial Sequence
  Description of Artificial Sequence: Synthetic oligonucleotide
  Target: SCN9A; (-) strand; PAM type: YTN; PAM sequence: TTG
gtatgattttaggtaaaaac

SEQ ID NO: 75157 - DNA, 20 bp, Artificial Sequence
  Description of Artificial Sequence: Synthetic oligonucleotide
  Target: SCN9A; (-) strand; PAM type: YTN; PAM sequence: TTC
attggtatgattttaggtaa

SEQ ID NO: 75158 - DNA, 20 bp, Artificial Sequence
  Description of Artificial Sequence: Synthetic oligonucleotide
  Target: SCN9A; (-) strand; PAM type: YTN; PAM sequence: TTT
cattggtatgattttaggta

SEQ ID NO: 75159 - DNA, 20 bp, Artificial Sequence
  Description of Artificial Sequence: Synthetic oligonucleotide
  Target: SCN9A; (-) strand; PAM type: YTN; PAM sequence: CTC
gggagaggatagtgagtgat

SEQ ID NO: 75160 - DNA, 20 bp, Artificial Sequence
  Description of Artificial Sequence: Synthetic oligonucleotide
  Target: SCN9A; (-) strand; PAM type: YTN; PAM sequence: TTA
gggtaagagaactcgggaga

SEQ ID NO: 75161 - DNA, 20 bp, Artificial Sequence
  Description of Artificial Sequence: Synthetic oligonucleotide
  Target: SCN9A; (-) strand; PAM type: YTN; PAM sequence: TTT
agggtaagagaactcgggag

SEQ ID NO: 75162 - DNA, 20 bp, Artificial Sequence
  Description of Artificial Sequence: Synthetic oligonucleotide
  Target: SCN9A; (-) strand; PAM type: YTN; PAM sequence: TTT
tagggtaagagaactcggga

SEQ ID NO: 75163 - DNA, 20 bp, Artificial Sequence
  Description of Artificial Sequence: Synthetic oligonucleotide
  Target: SCN9A; (-) strand; PAM type: YTN; PAM sequence: TTA
ttttagggtaagagaactcg

SEQ ID NO: 75164 - DNA, 20 bp, Artificial Sequence
  Description of Artificial Sequence: Synthetic oligonucleotide
  Target: SCN9A; (-) strand; PAM type: YTN; PAM sequence: CTT
attttagggtaagagaactc

SEQ ID NO: 75165 - DNA, 20 bp, Artificial Sequence
  Description of Artificial Sequence: Synthetic oligonucleotide
  Target: SCN9A; (-) strand; PAM type: YTN; PAM sequence: CTA
gagaaaaatgtcttatttta

SEQ ID NO: 75166 - DNA, 20 bp, Artificial Sequence
  Description of Artificial Sequence: Synthetic oligonucleotide
  Target: SCN9A; (-) strand; PAM type: YTN; PAM sequence: CTA
aatgtgtatcacccgaggca

SEQ ID NO: 75167 - DNA, 20 bp, Artificial Sequence
  Description of Artificial Sequence: Synthetic oligonucleotide
  Target: SCN9A; (-) strand; PAM type: YTN; PAM sequence: TTG
ctaaatgtgtatcacccgag

SEQ ID NO: 75168 - DNA, 20 bp, Artificial Sequence
  Description of Artificial Sequence: Synthetic oligonucleotide
  Target: SCN9A; (-) strand; PAM type: YTN; PAM sequence: CTA
cccccaatcaggtaccaccc

SEQ ID NO: 75169 - DNA, 20 bp, Artificial Sequence
  Description of Artificial Sequence: Synthetic oligonucleotide
  Target: SCN9A; (-) strand; PAM type: YTN; PAM sequence: TTG
tctacccccaatcaggtacc

SEQ ID NO: 75170 - DNA, 20 bp, Artificial Sequence
  Description of Artificial Sequence: Synthetic oligonucleotide
  Target: SCN9A; (-) strand; PAM type: YTN; PAM sequence: TTG
gtgtcgaagggcataggcga

SEQ ID NO: 75171 - DNA, 20 bp, Artificial Sequence
  Description of Artificial Sequence: Synthetic oligonucleotide
  Target: SCN9A; (-) strand; PAM type: YTN; PAM sequence: CTT
ggtgtcgaagggcataggcg

SEQ ID NO: 75172 - DNA, 20 bp, Artificial Sequence
  Description of Artificial Sequence: Synthetic oligonucleotide
  Target: SCN9A; (-) strand; PAM type: YTN; PAM sequence: TTC
caccttggtgtcgaagggca

SEQ ID NO: 75173 - DNA, 20 bp, Artificial Sequence
  Description of Artificial Sequence: Synthetic oligonucleotide
  Target: SCN9A; (-) strand; PAM type: YTN; PAM sequence: TTT
ccaccttggtgtcgaagggc

SEQ ID NO: 75174 - DNA, 20 bp, Artificial Sequence
  Description of Artificial Sequence: Synthetic oligonucleotide
  Target: SCN9A; (-) strand; PAM type: YTN; PAM sequence: TTG
tcgaaatcagaatcagagga

SEQ ID NO: 75175 - DNA, 20 bp, Artificial Sequence
  Description of Artificial Sequence: Synthetic oligonucleotide
  Target: SCN9A; (-) strand; PAM type: YTN; PAM sequence: CTG
agaaattgtcgaaatcagaa

SEQ ID NO: 75176 - DNA, 20 bp, Artificial Sequence
  Description of Artificial Sequence: Synthetic oligonucleotide
  Target: SCN9A; (-) strand; PAM type: YTN; PAM sequence: CTC
cagtggagaggaaaagggag

SEQ ID NO: 75177 - DNA, 20 bp, Artificial Sequence
  Description of Artificial Sequence: Synthetic oligonucleotide
  Target: SCN9A; (-) strand; PAM type: YTN; PAM sequence: CTC
tccagtggagaggaaaaggg

SEQ ID NO: 75178 - DNA, 20 bp, Artificial Sequence
  Description of Artificial Sequence: Synthetic oligonucleotide
  Target: SCN9A; (-) strand; PAM type: YTN; PAM sequence: CTA
aagaaagaagaaacagaaga

SEQ ID NO: 75179 - DNA, 20 bp, Artificial Sequence
  Description of Artificial Sequence: Synthetic oligonucleotide
  Target: SCN9A; (-) strand; PAM type: YTN; PAM sequence: CTA
aaagtgctaaagaaagaaga

SEQ ID NO: 75180 - DNA, 20 bp, Artificial Sequence
  Description of Artificial Sequence: Synthetic oligonucleotide
  Target: SCN9A; (-) strand; PAM type: YTN; PAM sequence: CTC
taaaagtgctaaagaaagaa

SEQ ID NO: 75181 - DNA, 20 bp, Artificial Sequence
  Description of Artificial Sequence: Synthetic oligonucleotide
  Target: SCN9A; (-) strand; PAM type: YTN; PAM sequence: CTG
agctctaaaagtgctaaaga

SEQ ID NO: 75182 - DNA, 20 bp, Artificial Sequence
  Description of Artificial Sequence: Synthetic oligonucleotide
  Target: SCN9A; (-) strand; PAM type: YTN; PAM sequence: CTG
aaacatccaaactgagctct

SEQ ID NO: 75183 - DNA, 20 bp, Artificial Sequence
  Description of Artificial Sequence: Synthetic oligonucleotide
  Target: SCN9A; (-) strand; PAM type: YTN; PAM sequence: TTC
tgaaacatccaaactgagct

SEQ ID NO: 75184 - DNA, 20 bp, Artificial Sequence
  Description of Artificial Sequence: Synthetic oligonucleotide
  Target: SCN9A; (-) strand; PAM type: YTN; PAM sequence: CTT
ctgaaacatccaaactgagc

SEQ ID NO: 75185 - DNA, 20 bp, Artificial Sequence
  Description of Artificial Sequence: Synthetic oligonucleotide
  Target: SCN9A; (-) strand; PAM type: YTN; PAM sequence: TTC
ttctgaaacatccaaactga

SEQ ID NO: 75186 - DNA, 20 bp, Artificial Sequence
  Description of Artificial Sequence: Synthetic oligonucleotide
  Target: SCN9A; (-) strand; PAM type: YTN; PAM sequence: CTC
agagagttcttctgaaacat

SEQ ID NO: 75187 - DNA, 20 bp, Artificial Sequence
  Description of Artificial Sequence: Synthetic oligonucleotide
  Target: SCN9A; (-) strand; PAM type: YTN; PAM sequence: CTC
tcagagagttcttctgaaac

SEQ ID NO: 75188 - DNA, 20 bp, Artificial Sequence
  Description of Artificial Sequence: Synthetic oligonucleotide
  Target: SCN9A; (-) strand; PAM type: YTN; PAM sequence: TTA
tgggcctctcagagagttct

SEQ ID NO: 75189 - DNA, 20 bp, Artificial Sequence
  Description of Artificial Sequence: Synthetic oligonucleotide
  Target: SCN9A; (-) strand; PAM type: YTN; PAM sequence: TTA
ggagaagcagaattatgggc

SEQ ID NO: 75190 - DNA, 20 bp, Artificial Sequence
  Description of Artificial Sequence: Synthetic oligonucleotide
  Target: SCN9A; (-) strand; PAM type: YTN; PAM sequence: CTG
aatatacaagtattaggaga

SEQ ID NO: 75191 - DNA, 20 bp, Artificial Sequence
  Description of Artificial Sequence: Synthetic oligonucleotide
  Target: SCN9A; (-) strand; PAM type: YTN; PAM sequence: TTG
cagcggcagcggctgaatat

SEQ ID NO: 75192 - DNA, 20 bp, Artificial Sequence
  Description of Artificial Sequence: Synthetic oligonucleotide
  Target: SCN9A; (-) strand; PAM type: YTN; PAM sequence: TTG
gcccaaccaggcaattgcag

SEQ ID NO: 75193 - DNA, 20 bp, Artificial Sequence
  Description of Artificial Sequence: Synthetic oligonucleotide
  Target: SCN9A; (-) strand; PAM type: YTN; PAM sequence: CTT
ggcccaaccaggcaattgca

SEQ ID NO: 75194 - DNA, 20 bp, Artificial Sequence
  Description of Artificial Sequence: Synthetic oligonucleotide
  Target: SCN9A; (-) strand; PAM type: YTN; PAM sequence: TTA
acgtcttggcccaaccaggc

SEQ ID NO: 75195 - DNA, 20 bp, Artificial Sequence
  Description of Artificial Sequence: Synthetic oligonucleotide
  Target: SCN9A; (-) strand; PAM type: YTN; PAM sequence: TTA
agtgttaacgtcttggccca

SEQ ID NO: 75196 - DNA, 20 bp, Artificial Sequence
  Description of Artificial Sequence: Synthetic oligonucleotide
  Target: SCN9A; (-) strand; PAM type: YTN; PAM sequence: TTT
aagtgttaacgtcttggccc

SEQ ID NO: 75197 - DNA, 20 bp, Artificial Sequence
  Description of Artificial Sequence: Synthetic oligonucleotide
  Target: SCN9A; (-) strand; PAM type: YTN; PAM sequence: CTC
atttaagtgttaacgtcttg

SEQ ID NO: 75198 - DNA, 20 bp, Artificial Sequence
  Description of Artificial Sequence: Synthetic oligonucleotide
  Target: SCN9A; (-) strand; PAM type: YTN; PAM sequence: TTG
gaaatgactcatttaagtgt

SEQ ID NO: 75199 - DNA, 20 bp, Artificial Sequence
  Description of Artificial Sequence: Synthetic oligonucleotide
  Target: SCN9A; (-) strand; PAM type: YTN; PAM sequence: TTT
ggaaatgactcatttaagtg

SEQ ID NO: 75200 - DNA, 20 bp, Artificial Sequence
  Description of Artificial Sequence: Synthetic oligonucleotide
  Target: SCN9A; (-) strand; PAM type: YTN; PAM sequence: CTA
ggatttggaaatgactcatt

SEQ ID NO: 75201 - DNA, 20 bp, Artificial Sequence
  Description of Artificial Sequence: Synthetic oligonucleotide
  Target: SCN9A; (-) strand; PAM type: YTN; PAM sequence: TTC
ctaggatttggaaatgactc

SEQ ID NO: 75202 - DNA, 20 bp, Artificial Sequence
  Description of Artificial Sequence: Synthetic oligonucleotide
  Target: SCN9A; (-) strand; PAM type: YTN; PAM sequence: TTT
cctaggatttggaaatgact

SEQ ID NO: 75203 - DNA, 20 bp, Artificial Sequence
  Description of Artificial Sequence: Synthetic oligonucleotide
  Target: SCN9A; (-) strand; PAM type: YTN; PAM sequence: CTA
gggtttcctaggatttggaa

SEQ ID NO: 75204 - DNA, 20 bp, Artificial Sequence
  Description of Artificial Sequence: Synthetic oligonucleotide
  Target: SCN9A; (-) strand; PAM type: YTN; PAM sequence: CTG
tcctagggtttcctaggatt

SEQ ID NO: 75205 - DNA, 20 bp, Artificial Sequence
  Description of Artificial Sequence: Synthetic oligonucleotide
  Target: SCN9A; (-) strand; PAM type: YTN; PAM sequence: CTA
ataggtgaaagatgtcctgt

SEQ ID NO: 75206 - DNA, 20 bp, Artificial Sequence
  Description of Artificial Sequence: Synthetic oligonucleotide
  Target: SCN9A; (-) strand; PAM type: YTN; PAM sequence: TTA
tgctaataggtgaaagatgt

SEQ ID NO: 75207 - DNA, 20 bp, Artificial Sequence
  Description of Artificial Sequence: Synthetic oligonucleotide
  Target: SCN9A; (-) strand; PAM type: YTN; PAM sequence: TTG
ttatgctaataggtgaaaga

SEQ ID NO: 75208 - DNA, 20 bp, Artificial Sequence
  Description of Artificial Sequence: Synthetic oligonucleotide
  Target: SCN9A; (-) strand; PAM type: YTN; PAM sequence: TTA
tatgcaccatgttgttatgc

SEQ ID NO: 75209 - DNA, 20 bp, Artificial Sequence
  Description of Artificial Sequence: Synthetic oligonucleotide
  Target: SCN9A; (-) strand; PAM type: YTN; PAM sequence: TTA
aaggacatgattatatgcac

SEQ ID NO: 75210 - DNA, 20 bp, Artificial Sequence
  Description of Artificial Sequence: Synthetic oligonucleotide
  Target: SCN9A; (-) strand; PAM type: YTN; PAM sequence: TTT
aaaggacatgattatatgca

SEQ ID NO: 75211 - DNA, 20 bp, Artificial Sequence
  Description of Artificial Sequence: Synthetic oligonucleotide
  Target: SCN9A; (-) strand; PAM type: YTN; PAM sequence: TTC
atgtttaaaggacatgatta

SEQ ID NO: 75212 - DNA, 20 bp, Artificial Sequence
  Description of Artificial Sequence: Synthetic oligonucleotide
  Target: SCN9A; (-) strand; PAM type: YTN; PAM sequence: TTT
catgtttaaaggacatgatt

SEQ ID NO: 75213 - DNA, 20 bp, Artificial Sequence
  Description of Artificial Sequence: Synthetic oligonucleotide
  Target: SCN9A; (-) strand; PAM type: YTN; PAM sequence: TTG
tgtaaagaaaacgatcattt

SEQ ID NO: 75214 - DNA, 20 bp, Artificial Sequence
  Description of Artificial Sequence: Synthetic oligonucleotide
  Target: SCN9A; (-) strand; PAM type: YTN; PAM sequence: CTG
atcattgtgtaaagaaaacg

SEQ ID NO: 75215 - DNA, 20 bp, Artificial Sequence
  Description of Artificial Sequence: Synthetic oligonucleotide
  Target: SCN9A; (-) strand; PAM type: YTN; PAM sequence: TTC
tgatcattgtgtaaagaaaa

SEQ ID NO: 75216 - DNA, 20 bp, Artificial Sequence
  Description of Artificial Sequence: Synthetic oligonucleotide
  Target: SCN9A; (-) strand; PAM type: YTN; PAM sequence: TTG
taagcattctgatcattgtg

SEQ ID NO: 75217 - DNA, 20 bp, Artificial Sequence
  Description of Artificial Sequence: Synthetic oligonucleotide
  Target: SCN9A; (-) strand; PAM type: YTN; PAM sequence: TTT
gtaagcattctgatcattgt

SEQ ID NO: 75218 - DNA, 20 bp, Artificial Sequence
  Description of Artificial Sequence: Synthetic oligonucleotide
  Target: SCN9A; (-) strand; PAM type: YTN; PAM sequence: CTT
tgtaagcattctgatcattg

SEQ ID NO: 75219 - DNA, 20 bp, Artificial Sequence
  Description of Artificial Sequence: Synthetic oligonucleotide
  Target: SCN9A; (-) strand; PAM type: YTN; PAM sequence: CTG
agacaaaaaccaaatatata

SEQ ID NO: 75220 - DNA, 20 bp, Artificial Sequence
  Description of Artificial Sequence: Synthetic oligonucleotide
  Target: SCN9A; (-) strand; PAM type: YTN; PAM sequence: TTC
aacctgagacaaaaaccaaa

SEQ ID NO: 75221 - DNA, 20 bp, Artificial Sequence
  Description of Artificial Sequence: Synthetic oligonucleotide
  Target: SCN9A; (-) strand; PAM type: YTN; PAM sequence: TTT
caacctgagacaaaaaccaa

SEQ ID NO: 75222 - DNA, 20 bp, Artificial Sequence
  Description of Artificial Sequence: Synthetic oligonucleotide
  Target: SCN9A; (-) strand; PAM type: YTN; PAM sequence: TTA
tttcaacctgagacaaaaac

SEQ ID NO: 75223 - DNA, 20 bp, Artificial Sequence
  Description of Artificial Sequence: Synthetic oligonucleotide
  Target: SCN9A; (-) strand; PAM type: YTN; PAM sequence: TTT
atttcaacctgagacaaaaa

SEQ ID NO: 75224 - DNA, 20 bp, Artificial Sequence
  Description of Artificial Sequence: Synthetic oligonucleotide
  Target: SCN9A; (-) strand; PAM type: YTN; PAM sequence: CTT
tatttcaacctgagacaaaa

SEQ ID NO: 75225 - DNA, 20 bp, Artificial Sequence
  Description of Artificial Sequence: Synthetic oligonucleotide
  Target: SCN9A; (-) strand; PAM type: YTN; PAM sequence: CTA
aaatacaatagagctttatt

SEQ ID NO: 75226 - DNA, 20 bp, Artificial Sequence
  Description of Artificial Sequence: Synthetic oligonucleotide
  Target: SCN9A; (-) strand; PAM type: YTN; PAM sequence: TTC
taaaatacaatagagcttta

SEQ ID NO: 75227 - DNA, 20 bp, Artificial Sequence
  Description of Artificial Sequence: Synthetic oligonucleotide
  Target: SCN9A; (-) strand; PAM type: YTN; PAM sequence: TTA
attctaaaatacaatagagc

SEQ ID NO: 75228 - DNA, 20 bp, Artificial Sequence
  Description of Artificial Sequence: Synthetic oligonucleotide
  Target: SCN9A; (-) strand; PAM type: YTN; PAM sequence: TTT
aattctaaaatacaatagag

SEQ ID NO: 75229 - DNA, 20 bp, Artificial Sequence
  Description of Artificial Sequence: Synthetic oligonucleotide
  Target: SCN9A; (-) strand; PAM type: YTN; PAM sequence: TTA
ataacatgtaatagtttaat

SEQ ID NO: 75230 - DNA, 20 bp, Artificial Sequence
  Description of Artificial Sequence: Synthetic oligonucleotide
  Target: SCN9A; (-) strand; PAM type: YTN; PAM sequence: CTG
taagcaaattaataacatgt

SEQ ID NO: 75231 - DNA, 20 bp, Artificial Sequence
  Description of Artificial Sequence: Synthetic oligonucleotide
  Target: SCN9A; (-) strand; PAM type: YTN; PAM sequence: TTA
ctgtaagcaaattaataaca

SEQ ID NO: 75232 - DNA, 20 bp, Artificial Sequence
  Description of Artificial Sequence: Synthetic oligonucleotide
  Target: SCN9A; (-) strand; PAM type: YTN; PAM sequence: TTT
actgtaagcaaattaataac

SEQ ID NO: 75233 - DNA, 20 bp, Artificial Sequence
  Description of Artificial Sequence: Synthetic oligonucleotide
  Target: SCN9A; (-) strand; PAM type: YTN; PAM sequence: CTT
tactgtaagcaaattaataa

SEQ ID NO: 75234 - DNA, 20 bp, Artificial Sequence
  Description of Artificial Sequence: Synthetic oligonucleotide
  Target: SCN9A; (-) strand; PAM type: YTN; PAM sequence: TTG
tctttactgtaagcaaatta

SEQ ID NO: 75235 - DNA, 20 bp, Artificial Sequence
  Description of Artificial Sequence: Synthetic oligonucleotide
  Target: SCN9A; (-) strand; PAM type: YTN; PAM sequence: TTT
gtctttactgtaagcaaatt

SEQ ID NO: 75236 - DNA, 20 bp, Artificial Sequence
  Description of Artificial Sequence: Synthetic oligonucleotide
  Target: SCN9A; (-) strand; PAM type: YTN; PAM sequence: TTA
atttgtctttactgtaagca

SEQ ID NO: 75237 - DNA, 20 bp, Artificial Sequence
  Description of Artificial Sequence: Synthetic oligonucleotide
  Target: SCN9A; (-) strand; PAM type: YTN; PAM sequence: TTT
aatttgtctttactgtaagc

SEQ ID NO: 75238 - DNA, 20 bp, Artificial Sequence
  Description of Artificial Sequence: Synthetic oligonucleotide
  Target: SCN9A; (-) strand; PAM type: YTN; PAM sequence: TTA
acatataatatttaatttgt

SEQ ID NO: 75239 - DNA, 20 bp, Artificial Sequence
  Description of Artificial Sequence: Synthetic oligonucleotide
  Target: SCN9A; (-) strand; PAM type: YTN; PAM sequence: TTT
aacatataatatttaatttg

SEQ ID NO: 75240 - DNA, 20 bp, Artificial Sequence
  Description of Artificial Sequence: Synthetic oligonucleotide
  Target: SCN9A; (-) strand; PAM type: YTN; PAM sequence: CTT
taacatataatatttaattt

SEQ ID NO: 75241 - DNA, 20 bp, Artificial Sequence
  Description of Artificial Sequence: Synthetic oligonucleotide
  Target: SCN9A; (-) strand; PAM type: YTN; PAM sequence: TTG
taaaactttaacatataata

SEQ ID NO: 75242 - DNA, 20 bp, Artificial Sequence
  Description of Artificial Sequence: Synthetic oligonucleotide
  Target: SCN9A; (-) strand; PAM type: YTN; PAM sequence: CTT
gtaaaactttaacatataat

SEQ ID NO: 75243 - DNA, 20 bp, Artificial Sequence
  Description of Artificial Sequence: Synthetic oligonucleotide
  Target: SCN9A; (-) strand; PAM type: YTN; PAM sequence: TTA
ccttgtaaaactttaacata

SEQ ID NO: 75244 - DNA, 20 bp, Artificial Sequence
  Description of Artificial Sequence: Synthetic oligonucleotide
  Target: SCN9A; (-) strand; PAM type: YTN; PAM sequence: TTC
caaaattaccttgtaaaact

SEQ ID NO: 75245 - DNA, 20 bp, Artificial Sequence
  Description of Artificial Sequence: Synthetic oligonucleotide
  Target: SCN9A; (-) strand; PAM type: YTN; PAM sequence: TTA
cattccaaaattaccttgta

SEQ ID NO: 75246 - DNA, 20 bp, Artificial Sequence
  Description of Artificial Sequence: Synthetic oligonucleotide
  Target: SCN9A; (-) strand; PAM type: YTN; PAM sequence: TTT
acattccaaaattaccttgt

SEQ ID NO: 75247 - DNA, 20 bp, Artificial Sequence
  Description of Artificial Sequence: Synthetic oligonucleotide
  Target: SCN9A; (-) strand; PAM type: YTN; PAM sequence: TTT
tacattccaaaattaccttg

SEQ ID NO: 75248 - DNA, 20 bp, Artificial Sequence
  Description of Artificial Sequence: Synthetic oligonucleotide
  Target: SCN9A; (-) strand; PAM type: YTN; PAM sequence: TTA
tgcgagttttacattccaaa

SEQ ID NO: 75249 - DNA, 20 bp, Artificial Sequence
  Description of Artificial Sequence: Synthetic oligonucleotide
  Target: SCN9A; (-) strand; PAM type: YTN; PAM sequence: TTT
atgcgagttttacattccaa

SEQ ID NO: 75250 - DNA, 20 bp, Artificial Sequence
  Description of Artificial Sequence: Synthetic oligonucleotide
  Target: SCN9A; (-) strand; PAM type: YTN; PAM sequence: TTG
catggtttatgcgagtttta

SEQ ID NO: 75251 - DNA, 20 bp, Artificial Sequence
  Description of Artificial Sequence: Synthetic oligonucleotide
  Target: SCN9A; (-) strand; PAM type: YTN; PAM sequence: TTA
ttgcatggtttatgcgagtt

SEQ ID NO: 75252 - DNA, 20 bp, Artificial Sequence
  Description of Artificial Sequence: Synthetic oligonucleotide
  Target: SCN9A; (-) strand; PAM type: YTN; PAM sequence: CTT
attgcatggtttatgcgagt

SEQ ID NO: 75253 - DNA, 20 bp, Artificial Sequence
  Description of Artificial Sequence: Synthetic oligonucleotide
  Target: SCN9A; (-) strand; PAM type: YTN; PAM sequence: CTG
tcttattgcatggtttatgc

SEQ ID NO: 75254 - DNA, 20 bp, Artificial Sequence
  Description of Artificial Sequence: Synthetic oligonucleotide
  Target: SCN9A; (-) strand; PAM type: YTN; PAM sequence: TTG
tctgtcttattgcatggttt

SEQ ID NO: 75255 - DNA, 20 bp, Artificial Sequence
  Description of Artificial Sequence: Synthetic oligonucleotide
  Target: SCN9A; (-) strand; PAM type: YTN; PAM sequence: CTG
ataatcaaattgtctgtctt

SEQ ID NO: 75256 - DNA, 20 bp, Artificial Sequence
  Description of Artificial Sequence: Synthetic oligonucleotide
  Target: SCN9A; (-) strand; PAM type: YTN; PAM sequence: TTG
cctgataatcaaattgtctg

SEQ ID NO: 75257 - DNA, 20 bp, Artificial Sequence
  Description of Artificial Sequence: Synthetic oligonucleotide
  Target: SCN9A; (-) strand; PAM type: YTN; PAM sequence: TTA
attgcctgataatcaaattg

SEQ ID NO: 75258 - DNA, 20 bp, Artificial Sequence
  Description of Artificial Sequence: Synthetic oligonucleotide
  Target: SCN9A; (-) strand; PAM type: YTN; PAM sequence: TTG
atgatatggagttaattgcc

SEQ ID NO: 75259 - DNA, 20 bp, Artificial Sequence
  Description of Artificial Sequence: Synthetic oligonucleotide
  Target: SCN9A; (-) strand; PAM type: YTN; PAM sequence: CTA
ttgatgatatggagttaatt

SEQ ID NO: 75260 - DNA, 20 bp, Artificial Sequence
  Description of Artificial Sequence: Synthetic oligonucleotide
  Target: SCN9A; (-) strand; PAM type: YTN; PAM sequence: TTC
tattgatgatatggagttaa

SEQ ID NO: 75261 - DNA, 20 bp, Artificial Sequence
  Description of Artificial Sequence: Synthetic oligonucleotide
  Target: SCN9A; (-) strand; PAM type: YTN; PAM sequence: CTG
attctattgatgatatggag

SEQ ID NO: 75262 - DNA, 20 bp, Artificial Sequence
  Description of Artificial Sequence: Synthetic oligonucleotide
  Target: SCN9A; (-) strand; PAM type: YTN; PAM sequence: TTA
aaccatagagtgcctgattc

SEQ ID NO: 75263 - DNA, 20 bp, Artificial Sequence
  Description of Artificial Sequence: Synthetic oligonucleotide
  Target: SCN9A; (-) strand; PAM type: YTN; PAM sequence: TTA
ttaaaccatagagtgcctga

SEQ ID NO: 75264 - DNA, 20 bp, Artificial Sequence
  Description of Artificial Sequence: Synthetic oligonucleotide
  Target: SCN9A; (-) strand; PAM type: YTN; PAM sequence: TTT
attaaaccatagagtgcctg

SEQ ID NO: 75265 - DNA, 20 bp, Artificial Sequence
  Description of Artificial Sequence: Synthetic oligonucleotide
  Target: SCN9A; (-) strand; PAM type: YTN; PAM sequence: CTT
tattaaaccatagagtgcct

SEQ ID NO: 75266 - DNA, 20 bp, Artificial Sequence
  Description of Artificial Sequence: Synthetic oligonucleotide
  Target: SCN9A; (-) strand; PAM type: YTN; PAM sequence: CTC
aatctttattaaaccataga

SEQ ID NO: 75267 - DNA, 20 bp, Artificial Sequence
  Description of Artificial Sequence: Synthetic oligonucleotide
  Target: SCN9A; (-) strand; PAM type: YTN; PAM sequence: TTC
aaataactcaatctttatta

SEQ ID NO: 75268 - DNA, 20 bp, Artificial Sequence
  Description of Artificial Sequence: Synthetic oligonucleotide
  Target: SCN9A; (-) strand; PAM type: YTN; PAM sequence: TTT
caaataactcaatctttatt

SEQ ID NO: 75269 - DNA, 20 bp, Artificial Sequence
  Description of Artificial Sequence: Synthetic oligonucleotide
  Target: SCN9A; (-) strand; PAM type: YTN; PAM sequence: TTT
tcaaataactcaatctttat

SEQ ID NO: 75270 - DNA, 20 bp, Artificial Sequence
  Description of Artificial Sequence: Synthetic oligonucleotide
  Target: SCN9A; (-) strand; PAM type: YTN; PAM sequence: TTT
ttcaaataactcaatcttta

SEQ ID NO: 75271 - DNA, 20 bp, Artificial Sequence
  Description of Artificial Sequence: Synthetic oligonucleotide
  Target: SCN9A; (-) strand; PAM type: YTN; PAM sequence: TTA
tttttcaaataactcaatct

SEQ ID NO: 75272 - DNA, 20 bp, Artificial Sequence
  Description of Artificial Sequence: Synthetic oligonucleotide
  Target: SCN9A; (-) strand; PAM type: YTN; PAM sequence: TTT
atttttcaaataactcaatc

SEQ ID NO: 75273 - DNA, 20 bp, Artificial Sequence
  Description of Artificial Sequence: Synthetic oligonucleotide
  Target: SCN9A; (-) strand; PAM type: YTN; PAM sequence: TTC
atttatttttcaaataactc

SEQ ID NO: 75274 - DNA, 20 bp, Artificial Sequence
  Description of Artificial Sequence: Synthetic oligonucleotide
  Target: SCN9A; (-) strand; PAM type: YTN; PAM sequence: TTA
ataattcatttatttttcaa

SEQ ID NO: 75275 - DNA, 20 bp, Artificial Sequence
  Description of Artificial Sequence: Synthetic oligonucleotide
  Target: SCN9A; (-) strand; PAM type: YTN; PAM sequence: TTT
aataattcatttatttttca

SEQ ID NO: 75276 - DNA, 20 bp, Artificial Sequence
  Description of Artificial Sequence: Synthetic oligonucleotide
  Target: SCN9A; (-) strand; PAM type: YTN; PAM sequence: CTT
taataattcatttatttttc

SEQ ID NO: 75277 - DNA, 20 bp, Artificial Sequence
  Description of Artificial Sequence: Synthetic oligonucleotide
  Target: SCN9A; (-) strand; PAM type: YTN; PAM sequence: TTA
tgctttaataattcatttat

SEQ ID NO: 75278 - DNA, 20 bp, Artificial Sequence
  Description of Artificial Sequence: Synthetic oligonucleotide
  Target: SCN9A; (-) strand; PAM type: YTN; PAM sequence: TTA
caatattatgctttaataat

SEQ ID NO: 75279 - DNA, 20 bp, Artificial Sequence
  Description of Artificial Sequence: Synthetic oligonucleotide
  Target: SCN9A; (-) strand; PAM type: YTN; PAM sequence: CTT
acaatattatgctttaataa

SEQ ID NO: 75280 - DNA, 20 bp, Artificial Sequence
  Description of Artificial Sequence: Synthetic oligonucleotide
  Target: SCN9A; (-) strand; PAM type: YTN; PAM sequence: TTC
ttacaatattatgctttaat

SEQ ID NO: 75281 - DNA, 20 bp, Artificial Sequence
  Description of Artificial Sequence: Synthetic oligonucleotide
  Target: SCN9A; (-) strand; PAM type: YTN; PAM sequence: TTT
cttacaatattatgctttaa

SEQ ID NO: 75282 - DNA, 20 bp, Artificial Sequence
  Description of Artificial Sequence: Synthetic oligonucleotide
  Target: SCN9A; (-) strand; PAM type: YTN; PAM sequence: CTT
tcttacaatattatgcttta

SEQ ID NO: 75283 - DNA, 20 bp, Artificial Sequence
  Description of Artificial Sequence: Synthetic oligonucleotide
  Target: SCN9A; (-) strand; PAM type: YTN; PAM sequence: TTA
ccactttcttacaatattat

SEQ ID NO: 75284 - DNA, 20 bp, Artificial Sequence
  Description of Artificial Sequence: Synthetic oligonucleotide
  Target: SCN9A; (-) strand; PAM type: YTN; PAM sequence: CTT
accactttcttacaatatta

SEQ ID NO: 75285 - DNA, 20 bp, Artificial Sequence
  Description of Artificial Sequence: Synthetic oligonucleotide
  Target: SCN9A; (-) strand; PAM type: YTN; PAM sequence: TTG
accttaccactttcttacaa

SEQ ID NO: 75286 - DNA, 20 bp, Artificial Sequence
  Description of Artificial Sequence: Synthetic oligonucleotide
  Target: SCN9A; (-) strand; PAM type: YTN; PAM sequence: TTA
ggccaatagtcattgacctt

SEQ ID NO: 75287 - DNA, 20 bp, Artificial Sequence
  Description of Artificial Sequence: Synthetic oligonucleotide
  Target: SCN9A; (-) strand; PAM type: YTN; PAM sequence: TTT
aggccaatagtcattgacct

SEQ ID NO: 75288 - DNA, 20 bp, Artificial Sequence
  Description of Artificial Sequence: Synthetic oligonucleotide
  Target: SCN9A; (-) strand; PAM type: YTN; PAM sequence: TTC
atttaggccaatagtcattg

SEQ ID NO: 75289 - DNA, 20 bp, Artificial Sequence
  Description of Artificial Sequence: Synthetic oligonucleotide
  Target: SCN9A; (-) strand; PAM type: YTN; PAM sequence: TTT
catttaggccaatagtcatt

SEQ ID NO: 75290 - DNA, 20 bp, Artificial Sequence
  Description of Artificial Sequence: Synthetic oligonucleotide
  Target: SCN9A; (-) strand; PAM type: YTN; PAM sequence: TTC
ccagaagtttcatttaggcc

SEQ ID NO: 75291 - DNA, 20 bp, Artificial Sequence
  Description of Artificial Sequence: Synthetic oligonucleotide
  Target: SCN9A; (-) strand; PAM type: YTN; PAM sequence: CTA
gggaattcccagaagtttca

SEQ ID NO: 75292 - DNA, 20 bp, Artificial Sequence
  Description of Artificial Sequence: Synthetic oligonucleotide
  Target: SCN9A; (-) strand; PAM type: YTN; PAM sequence: CTA
cctagggaattcccagaagt

SEQ ID NO: 75293 - DNA, 20 bp, Artificial Sequence
  Description of Artificial Sequence: Synthetic oligonucleotide
  Target: SCN9A; (-) strand; PAM type: YTN; PAM sequence: TTA
tcccaggtactacctaggga

SEQ ID NO: 75294 - DNA, 20 bp, Artificial Sequence
  Description of Artificial Sequence: Synthetic oligonucleotide
  Target: SCN9A; (-) strand; PAM type: YTN; PAM sequence: CTA
ggttatcccaggtactacct

SEQ ID NO: 75295 - DNA, 20 bp, Artificial Sequence
  Description of Artificial Sequence: Synthetic oligonucleotide
  Target: SCN9A; (-) strand; PAM type: YTN; PAM sequence: TTG
taaagggatagtactaggtt

SEQ ID NO: 75296 - DNA, 20 bp, Artificial Sequence
  Description of Artificial Sequence: Synthetic oligonucleotide
  Target: SCN9A; (-) strand; PAM type: YTN; PAM sequence: TTT
gtaaagggatagtactaggt

SEQ ID NO: 75297 - DNA, 20 bp, Artificial Sequence
  Description of Artificial Sequence: Synthetic oligonucleotide
  Target: SCN9A; (-) strand; PAM type: YTN; PAM sequence: TTT
tgtaaagggatagtactagg

SEQ ID NO: 75298 - DNA, 20 bp, Artificial Sequence
  Description of Artificial Sequence: Synthetic oligonucleotide
  Target: SCN9A; (-) strand; PAM type: YTN; PAM sequence: TTA
taaacaaaacattttgtaaa

SEQ ID NO: 75299 - DNA, 20 bp, Artificial Sequence
  Description of Artificial Sequence: Synthetic oligonucleotide
  Target: SCN9A; (-) strand; PAM type: YTN; PAM sequence: TTT
ataaacaaaacattttgtaa

SEQ ID NO: 75300 - DNA, 20 bp, Artificial Sequence
  Description of Artificial Sequence: Synthetic oligonucleotide
  Target: SCN9A; (-) strand; PAM type: YTN; PAM sequence: TTA
gtgtttataaacaaaacatt

SEQ ID NO: 75301 - DNA, 20 bp, Artificial Sequence
  Description of Artificial Sequence: Synthetic oligonucleotide
  Target: SCN9A; (-) strand; PAM type: YTN; PAM sequence: TTT
agtgtttataaacaaaacat

SEQ ID NO: 75302 - DNA, 20 bp, Artificial Sequence
  Description of Artificial Sequence: Synthetic oligonucleotide
  Target: SCN9A; (-) strand; PAM type: YTN; PAM sequence: TTT
tagtgtttataaacaaaaca

SEQ ID NO: 75303 - DNA, 20 bp, Artificial Sequence
  Description of Artificial Sequence: Synthetic oligonucleotide
  Target: SCN9A; (-) strand; PAM type: YTN; PAM sequence: TTT
ttagtgtttataaacaaaac

SEQ ID NO: 75304 - DNA, 20 bp, Artificial Sequence
  Description of Artificial Sequence: Synthetic oligonucleotide
  Target: SCN9A; (-) strand; PAM type: YTN; PAM sequence: TTT
tttagtgtttataaacaaaa

SEQ ID NO: 75305 - DNA, 20 bp, Artificial Sequence
  Description of Artificial Sequence: Synthetic oligonucleotide
  Target: SCN9A; (-) strand; PAM type: YTN; PAM sequence: TTA
caagaattttttagtgttta

SEQ ID NO: 75306 - DNA, 20 bp, Artificial Sequence
  Description of Artificial Sequence: Synthetic oligonucleotide
  Target: SCN9A; (-) strand; PAM type: YTN; PAM sequence: TTT
acaagaattttttagtgttt

SEQ ID NO: 75307 - DNA, 20 bp, Artificial Sequence
  Description of Artificial Sequence: Synthetic oligonucleotide
  Target: SCN9A; (-) strand; PAM type: YTN; PAM sequence: TTT
tacaagaattttttagtgtt

SEQ ID NO: 75308 - DNA, 20 bp, Artificial Sequence
  Description of Artificial Sequence: Synthetic oligonucleotide
  Target: SCN9A; (-) strand; PAM type: YTN; PAM sequence: TTT
ttacaagaattttttagtgt

SEQ ID NO: 75309 - DNA, 20 bp, Artificial Sequence
  Description of Artificial Sequence: Synthetic oligonucleotide
  Target: SCN9A; (-) strand; PAM type: YTN; PAM sequence: TTC
ccatgtttttacaagaattt

SEQ ID NO: 75310 - DNA, 20 bp, Artificial Sequence
  Description of Artificial Sequence: Synthetic oligonucleotide
  Target: SCN9A; (-) strand; PAM type: YTN; PAM sequence: TTT
cccatgtttttacaagaatt

SEQ ID NO: 75311 - DNA, 20 bp, Artificial Sequence
  Description of Artificial Sequence: Synthetic oligonucleotide
  Target: SCN9A; (-) strand; PAM type: YTN; PAM sequence: TTA
tttcccatgtttttacaaga

SEQ ID NO: 75312 - DNA, 20 bp, Artificial Sequence
  Description of Artificial Sequence: Synthetic oligonucleotide
  Target: SCN9A; (-) strand; PAM type: YTN; PAM sequence: TTT
atttcccatgtttttacaag

SEQ ID NO: 75313 - DNA, 20 bp, Artificial Sequence
  Description of Artificial Sequence: Synthetic oligonucleotide
  Target: SCN9A; (-) strand; PAM type: YTN; PAM sequence: CTT
tatttcccatgtttttacaa

SEQ ID NO: 75314 - DNA, 20 bp, Artificial Sequence
  Description of Artificial Sequence: Synthetic oligonucleotide
  Target: SCN9A; (-) strand; PAM type: YTN; PAM sequence: TTA
tatctttatttcccatgttt

SEQ ID NO: 75315 - DNA, 20 bp, Artificial Sequence
  Description of Artificial Sequence: Synthetic oligonucleotide
  Target: SCN9A; (-) strand; PAM type: YTN; PAM sequence: TTT
atatctttatttcccatgtt

SEQ ID NO: 75316 - DNA, 20 bp, Artificial Sequence
  Description of Artificial Sequence: Synthetic oligonucleotide
  Target: SCN9A; (-) strand; PAM type: YTN; PAM sequence: TTC
atttatatctttatttccca

SEQ ID NO: 75317 - DNA, 20 bp, Artificial Sequence
  Description of Artificial Sequence: Synthetic oligonucleotide
  Target: SCN9A; (-) strand; PAM type: YTN; PAM sequence: TTT
catttatatctttatttccc

SEQ ID NO: 75318 - DNA, 20 bp, Artificial Sequence
  Description of Artificial Sequence: Synthetic oligonucleotide
  Target: SCN9A; (-) strand; PAM type: YTN; PAM sequence: TTT
tcatttatatctttatttcc

SEQ ID NO: 75319 - DNA, 20 bp, Artificial Sequence
  Description of Artificial Sequence: Synthetic oligonucleotide
  Target: SCN9A; (-) strand; PAM type: YTN; PAM sequence: TTT
ttcatttatatctttatttc

SEQ ID NO: 75320 - DNA, 20 bp, Artificial Sequence
  Description of Artificial Sequence: Synthetic oligonucleotide
  Target: SCN9A; (-) strand; PAM type: YTN; PAM sequence: CTG
tttttcatttatatctttat

SEQ ID NO: 75321 - DNA, 20 bp, Artificial Sequence
  Description of Artificial Sequence: Synthetic oligonucleotide
  Target: SCN9A; (-) strand; PAM type: YTN; PAM sequence: TTC
tgtttttcatttatatcttt

SEQ ID NO: 75322 - DNA, 20 bp, Artificial Sequence
  Description of Artificial Sequence: Synthetic oligonucleotide
  Target: SCN9A; (-) strand; PAM type: YTN; PAM sequence: TTT
ctgtttttcatttatatctt

SEQ ID NO: 75323 - DNA, 20 bp, Artificial Sequence
  Description of Artificial Sequence: Synthetic oligonucleotide
  Target: SCN9A; (-) strand; PAM type: YTN; PAM sequence: TTT
tctgtttttcatttatatct

SEQ ID NO: 75324 - DNA, 20 bp, Artificial Sequence
  Description of Artificial Sequence: Synthetic oligonucleotide
  Target: SCN9A; (-) strand; PAM type: YTN; PAM sequence: TTT
ttctgtttttcatttatatc

SEQ ID NO: 75325 - DNA, 20 bp, Artificial Sequence
  Description of Artificial Sequence: Synthetic oligonucleotide
  Target: SCN9A; (-) strand; PAM type: YTN; PAM sequence: TTT
tttctgtttttcatttatat

SEQ ID NO: 75326 - DNA, 20 bp, Artificial Sequence
  Description of Artificial Sequence: Synthetic oligonucleotide
  Target: SCN9A; (-) strand; PAM type: YTN; PAM sequence: TTT
ttttctgtttttcatttata

SEQ ID NO: 75327 - DNA, 20 bp, Artificial Sequence
  Description of Artificial Sequence: Synthetic oligonucleotide
  Target: SCN9A; (-) strand; PAM type: YTN; PAM sequence: CTT
tttttctgtttttcatttat

SEQ ID NO: 75328 - DNA, 20 bp, Artificial Sequence
  Description of Artificial Sequence: Synthetic oligonucleotide
  Target: SCN9A; (-) strand; PAM type: YTN; PAM sequence: CTG
ggaggtaagatgactttttt

SEQ ID NO: 75329 - DNA, 20 bp, Artificial Sequence
  Description of Artificial Sequence: Synthetic oligonucleotide
  Target: SCN9A; (-) strand; PAM type: YTN; PAM sequence: TTC
tgggaggtaagatgactttt

SEQ ID NO: 75330 - DNA, 20 bp, Artificial Sequence
  Description of Artificial Sequence: Synthetic oligonucleotide
  Target: SCN9A; (-) strand; PAM type: YTN; PAM sequence: TTT
ctgggaggtaagatgacttt

SEQ ID NO: 75331 - DNA, 20 bp, Artificial Sequence
  Description of Artificial Sequence: Synthetic oligonucleotide
  Target: SCN9A; (-) strand; PAM type: YTN; PAM sequence: TTA
tttctgggaggtaagatgac

SEQ ID NO: 75332 - DNA, 20 bp, Artificial Sequence
  Description of Artificial Sequence: Synthetic oligonucleotide
  Target: SCN9A; (-) strand; PAM type: YTN; PAM sequence: TTA
gcaccaattatttctgggag

SEQ ID NO: 75333 - DNA, 20 bp, Artificial Sequence
  Description of Artificial Sequence: Synthetic oligonucleotide
  Target: SCN9A; (-) strand; PAM type: YTN; PAM sequence: TTA
tacatacatataaaaagaat

SEQ ID NO: 75334 - DNA, 20 bp, Artificial Sequence
  Description of Artificial Sequence: Synthetic oligonucleotide
  Target: SCN9A; (-) strand; PAM type: YTN; PAM sequence: TTA
aaattatacatacatataaa

SEQ ID NO: 75335 - DNA, 20 bp, Artificial Sequence
  Description of Artificial Sequence: Synthetic oligonucleotide
  Target: SCN9A; (-) strand; PAM type: YTN; PAM sequence: TTT
aaaattatacatacatataa

SEQ ID NO: 75336 - DNA, 20 bp, Artificial Sequence
  Description of Artificial Sequence: Synthetic oligonucleotide
  Target: SCN9A; (-) strand; PAM type: YTN; PAM sequence: TTT
taaaattatacatacatata

SEQ ID NO: 75337 - DNA, 20 bp, Artificial Sequence
  Description of Artificial Sequence: Synthetic oligonucleotide
  Target: SCN9A; (-) strand; PAM type: YTN; PAM sequence: CTC
aattttaaaattatacatac

SEQ ID NO: 75338 - DNA, 20 bp, Artificial Sequence
  Description of Artificial Sequence: Synthetic oligonucleotide
  Target: SCN9A; (-) strand; PAM type: YTN; PAM sequence: TTA
aataatatagtccgatacaa

SEQ ID NO: 75339 - DNA, 20 bp, Artificial Sequence
  Description of Artificial Sequence: Synthetic oligonucleotide
  Target: SCN9A; (-) strand; PAM type: YTN; PAM sequence: TTA
gaataatgatggattaaata

SEQ ID NO: 75340 - DNA, 20 bp, Artificial Sequence
  Description of Artificial Sequence: Synthetic oligonucleotide
  Target: SCN9A; (-) strand; PAM type: YTN; PAM sequence: TTT
agaataatgatggattaaat

SEQ ID NO: 75341 - DNA, 20 bp, Artificial Sequence
  Description of Artificial Sequence: Synthetic oligonucleotide
  Target: SCN9A; (-) strand; PAM type: YTN; PAM sequence: TTT
tagaataatgatggattaaa

SEQ ID NO: 75342 - DNA, 20 bp, Artificial Sequence
  Description of Artificial Sequence: Synthetic oligonucleotide
  Target: SCN9A; (-) strand; PAM type: YTN; PAM sequence: CTT
ttagaataatgatggattaa

SEQ ID NO: 75343 - DNA, 20 bp, Artificial Sequence
  Description of Artificial Sequence: Synthetic oligonucleotide
  Target: SCN9A; (-) strand; PAM type: YTN; PAM sequence: TTA
tcatgaggaaaaatctttta

SEQ ID NO: 75344 - DNA, 20 bp, Artificial Sequence
  Description of Artificial Sequence: Synthetic oligonucleotide
  Target: SCN9A; (-) strand; PAM type: YTN; PAM sequence: TTT
atcatgaggaaaaatctttt

SEQ ID NO: 75345 - DNA, 20 bp, Artificial Sequence
  Description of Artificial Sequence: Synthetic oligonucleotide
  Target: SCN9A; (-) strand; PAM type: YTN; PAM sequence: TTT
tatcatgaggaaaaatcttt

SEQ ID NO: 75346 - DNA, 20 bp, Artificial Sequence
  Description of Artificial Sequence: Synthetic oligonucleotide
  Target: SCN9A; (-) strand; PAM type: YTN; PAM sequence: TTA
ttttatcatgaggaaaaatc

SEQ ID NO: 75347 - DNA, 20 bp, Artificial Sequence
  Description of Artificial Sequence: Synthetic oligonucleotide
  Target: SCN9A; (-) strand; PAM type: YTN; PAM sequence: TTA
aaattattttatcatgagga

SEQ ID NO: 75348 - DNA, 20 bp, Artificial Sequence
  Description of Artificial Sequence: Synthetic oligonucleotide
  Target: SCN9A; (-) strand; PAM type: YTN; PAM sequence: TTT
aaaattattttatcatgagg

SEQ ID NO: 75349 - DNA, 20 bp, Artificial Sequence
  Description of Artificial Sequence: Synthetic oligonucleotide
  Target: SCN9A; (-) strand; PAM type: YTN; PAM sequence: TTT
taaaattattttatcatgag

SEQ ID NO: 75350 - DNA, 20 bp, Artificial Sequence
  Description of Artificial Sequence: Synthetic oligonucleotide
  Target: SCN9A; (-) strand; PAM type: YTN; PAM sequence: TTT
ttaaaattattttatcatga

SEQ ID NO: 75351 - DNA, 20 bp, Artificial Sequence
  Description of Artificial Sequence: Synthetic oligonucleotide
  Target: SCN9A; (-) strand; PAM type: YTN; PAM sequence: TTT
tttaaaattattttatcatg

SEQ ID NO: 75352 - DNA, 20 bp, Artificial Sequence
  Description of Artificial Sequence: Synthetic oligonucleotide
  Target: SCN9A; (-) strand; PAM type: YTN; PAM sequence: TTT
ttttaaaattattttatcat

SEQ ID NO: 75353 - DNA, 20 bp, Artificial Sequence
  Description of Artificial Sequence: Synthetic oligonucleotide
  Target: SCN9A; (-) strand; PAM type: YTN; PAM sequence: CTA
tgtgtttttttaaaattatt

SEQ ID NO: 75354 - DNA, 20 bp, Artificial Sequence
  Description of Artificial Sequence: Synthetic oligonucleotide
  Target: SCN9A; (-) strand; PAM type: YTN; PAM sequence: TTG
ccatagaactatgtgttttt

SEQ ID NO: 75355 - DNA, 20 bp, Artificial Sequence
  Description of Artificial Sequence: Synthetic oligonucleotide
  Target: SCN9A; (-) strand; PAM type: YTN; PAM sequence: TTT
gccatagaactatgtgtttt

SEQ ID NO: 75356 - DNA, 20 bp, Artificial Sequence
  Description of Artificial Sequence: Synthetic oligonucleotide
  Target: SCN9A; (-) strand; PAM type: YTN; PAM sequence: TTT
tgccatagaactatgtgttt

SEQ ID NO: 75357 - DNA, 20 bp, Artificial Sequence
  Description of Artificial Sequence: Synthetic oligonucleotide
  Target: SCN9A; (-) strand; PAM type: YTN; PAM sequence: TTA
ttttgccatagaactatgtg

SEQ ID NO: 75358 - DNA, 20 bp, Artificial Sequence
  Description of Artificial Sequence: Synthetic oligonucleotide
  Target: SCN9A; (-) strand; PAM type: YTN; PAM sequence: TTA
aagtattattttgccataga

SEQ ID NO: 75359 - DNA, 20 bp, Artificial Sequence
  Description of Artificial Sequence: Synthetic oligonucleotide
  Target: SCN9A; (-) strand; PAM type: YTN; PAM sequence: CTT
aaagtattattttgccatag

SEQ ID NO: 75360 - DNA, 20 bp, Artificial Sequence
  Description of Artificial Sequence: Synthetic oligonucleotide
  Target: SCN9A; (-) strand; PAM type: YTN; PAM sequence: TTG
tatatcttaaagtattattt

SEQ ID NO: 75361 - DNA, 20 bp, Artificial Sequence
  Description of Artificial Sequence: Synthetic oligonucleotide
  Target: SCN9A; (-) strand; PAM type: YTN; PAM sequence: TTA
tgaaaattgtatatcttaaa

SEQ ID NO: 75362 - DNA, 20 bp, Artificial Sequence
  Description of Artificial Sequence: Synthetic oligonucleotide
  Target: SCN9A; (-) strand; PAM type: YTN; PAM sequence: CTA
agaaaattatgaaaattgta

SEQ ID NO: 75363 - DNA, 20 bp, Artificial Sequence
  Description of Artificial Sequence: Synthetic oligonucleotide
  Target: SCN9A; (-) strand; PAM type: YTN; PAM sequence: TTA
gaaaataactaagaaaatta

SEQ ID NO: 75364 - DNA, 20 bp, Artificial Sequence
  Description of Artificial Sequence: Synthetic oligonucleotide
  Target: SCN9A; (-) strand; PAM type: YTN; PAM sequence: TTG
gaaaattagaaaataactaa

SEQ ID NO: 75365 - DNA, 20 bp, Artificial Sequence
  Description of Artificial Sequence: Synthetic oligonucleotide
  Target: SCN9A; (-) strand; PAM type: YTN; PAM sequence: TTT
ggaaaattagaaaataacta

SEQ ID NO: 75366 - DNA, 20 bp, Artificial Sequence
  Description of Artificial Sequence: Synthetic oligonucleotide
  Target: SCN9A; (-) strand; PAM type: YTN; PAM sequence: TTT
tggaaaattagaaaataact

SEQ ID NO: 75367 - DNA, 20 bp, Artificial Sequence
  Description of Artificial Sequence: Synthetic oligonucleotide
  Target: SCN9A; (-) strand; PAM type: YTN; PAM sequence: TTA
aattttggaaaattagaaaa

SEQ ID NO: 75368 - DNA, 20 bp, Artificial Sequence
  Description of Artificial Sequence: Synthetic oligonucleotide
  Target: SCN9A; (-) strand; PAM type: YTN; PAM sequence: TTT
aaattttggaaaattagaaa

SEQ ID NO: 75369 - DNA, 20 bp, Artificial Sequence
  Description of Artificial Sequence: Synthetic oligonucleotide
  Target: SCN9A; (-) strand; PAM type: YTN; PAM sequence: TTA
ataatggtaaaaatcagaaa

SEQ ID NO: 75370 - DNA, 20 bp, Artificial Sequence
  Description of Artificial Sequence: Synthetic oligonucleotide
  Target: SCN9A; (-) strand; PAM type: YTN; PAM sequence: TTT
aataatggtaaaaatcagaa

SEQ ID NO: 75371 - DNA, 20 bp, Artificial Sequence
  Description of Artificial Sequence: Synthetic oligonucleotide
  Target: SCN9A; (-) strand; PAM type: YTN; PAM sequence: TTT
taataatggtaaaaatcaga

SEQ ID NO: 75372 - DNA, 20 bp, Artificial Sequence
  Description of Artificial Sequence: Synthetic oligonucleotide
  Target: SCN9A; (-) strand; PAM type: YTN; PAM sequence: TTC
agtgcagcattttaataatg

SEQ ID NO: 75373 - DNA, 20 bp, Artificial Sequence
  Description of Artificial Sequence: Synthetic oligonucleotide
  Target: SCN9A; (-) strand; PAM type: YTN; PAM sequence: CTG
atgcacaaatattcagtgca

SEQ ID NO: 75374 - DNA, 20 bp, Artificial Sequence
  Description of Artificial Sequence: Synthetic oligonucleotide
  Target: SCN9A; (-) strand; PAM type: YTN; PAM sequence: TTC
tgatgcacaaatattcagtg

SEQ ID NO: 75375 - DNA, 20 bp, Artificial Sequence
  Description of Artificial Sequence: Synthetic oligonucleotide
  Target: SCN9A; (-) strand; PAM type: YTN; PAM sequence: CTG
caatgcagataaattctgat

SEQ ID NO: 75376 - DNA, 20 bp, Artificial Sequence
  Description of Artificial Sequence: Synthetic oligonucleotide
  Target: SCN9A; (-) strand; PAM type: YTN; PAM sequence: TTA
ggggagggcaatcatctgca

SEQ ID NO: 75377 - DNA, 20 bp, Artificial Sequence
  Description of Artificial Sequence: Synthetic oligonucleotide
  Target: SCN9A; (-) strand; PAM type: YTN; PAM sequence: CTA
atgtattaggggagggcaat

SEQ ID NO: 75378 - DNA, 20 bp, Artificial Sequence
  Description of Artificial Sequence: Synthetic oligonucleotide
  Target: SCN9A; (-) strand; PAM type: YTN; PAM sequence: TTC
aaggagtctaatgtattagg

SEQ ID NO: 75379 - DNA, 20 bp, Artificial Sequence
  Description of Artificial Sequence: Synthetic oligonucleotide
  Target: SCN9A; (-) strand; PAM type: YTN; PAM sequence: CTT
caaggagtctaatgtattag

SEQ ID NO: 75380 - DNA, 20 bp, Artificial Sequence
  Description of Artificial Sequence: Synthetic oligonucleotide
  Target: SCN9A; (-) strand; PAM type: YTN; PAM sequence: CTC
ttcaaggagtctaatgtatt

SEQ ID NO: 75381 - DNA, 20 bp, Artificial Sequence
  Description of Artificial Sequence: Synthetic oligonucleotide
  Target: SCN9A; (-) strand; PAM type: YTN; PAM sequence: TTA
aatctcttcaaggagtctaa

SEQ ID NO: 75382 - DNA, 20 bp, Artificial Sequence
  Description of Artificial Sequence: Synthetic oligonucleotide
  Target: SCN9A; (-) strand; PAM type: YTN; PAM sequence: CTA
gttaaatctcttcaaggagt

SEQ ID NO: 75383 - DNA, 20 bp, Artificial Sequence
  Description of Artificial Sequence: Synthetic oligonucleotide
  Target: SCN9A; (-) strand; PAM type: YTN; PAM sequence: TTC
acctagttaaatctcttcaa

SEQ ID NO: 75384 - DNA, 20 bp, Artificial Sequence
  Description of Artificial Sequence: Synthetic oligonucleotide
  Target: SCN9A; (-) strand; PAM type: YTN; PAM sequence: TTT
cacctagttaaatctcttca

SEQ ID NO: 75385 - DNA, 20 bp, Artificial Sequence
  Description of Artificial Sequence: Synthetic oligonucleotide
  Target: SCN9A; (-) strand; PAM type: YTN; PAM sequence: CTG
aaggtttcacctagttaaat

SEQ ID NO: 75386 - DNA, 20 bp, Artificial Sequence
  Description of Artificial Sequence: Synthetic oligonucleotide
  Target: SCN9A; (-) strand; PAM type: YTN; PAM sequence: TTG
tctgaaggtttcacctagtt

SEQ ID NO: 75387 - DNA, 20 bp, Artificial Sequence
  Description of Artificial Sequence: Synthetic oligonucleotide
  Target: SCN9A; (-) strand; PAM type: YTN; PAM sequence: TTT
gtctgaaggtttcacctagt

SEQ ID NO: 75388 - DNA, 20 bp, Artificial Sequence
  Description of Artificial Sequence: Synthetic oligonucleotide
  Target: SCN9A; (-) strand; PAM type: YTN; PAM sequence: TTA
acatttgtctgaaggtttca

SEQ ID NO: 75389 - DNA, 20 bp, Artificial Sequence
  Description of Artificial Sequence: Synthetic oligonucleotide
  Target: SCN9A; (-) strand; PAM type: YTN; PAM sequence: CTT
aacatttgtctgaaggtttc

SEQ ID NO: 75390 - DNA, 20 bp, Artificial Sequence
  Description of Artificial Sequence: Synthetic oligonucleotide
  Target: SCN9A; (-) strand; PAM type: YTN; PAM sequence: TTG
ccttaacatttgtctgaagg

SEQ ID NO: 75391 - DNA, 20 bp, Artificial Sequence
  Description of Artificial Sequence: Synthetic oligonucleotide
  Target: SCN9A; (-) strand; PAM type: YTN; PAM sequence: CTG
cagttgccttaacatttgtc

SEQ ID NO: 75392 - DNA, 20 bp, Artificial Sequence
  Description of Artificial Sequence: Synthetic oligonucleotide
  Target: SCN9A; (-) strand; PAM type: YTN; PAM sequence: TTC
aaatgtactgcagttgcctt

SEQ ID NO: 75393 - DNA, 20 bp, Artificial Sequence
  Description of Artificial Sequence: Synthetic oligonucleotide
  Target: SCN9A; (-) strand; PAM type: YTN; PAM sequence: TTT
caaatgtactgcagttgcct

SEQ ID NO: 75394 - DNA, 20 bp, Artificial Sequence
  Description of Artificial Sequence: Synthetic oligonucleotide
  Target: SCN9A; (-) strand; PAM type: YTN; PAM sequence: CTA
agagaaacataatttcaaat

SEQ ID NO: 75395 - DNA, 20 bp, Artificial Sequence
  Description of Artificial Sequence: Synthetic oligonucleotide
  Target: SCN9A; (-) strand; PAM type: YTN; PAM sequence: TTG
tactaagagaaacataattt

SEQ ID NO: 75396 - DNA, 20 bp, Artificial Sequence
  Description of Artificial Sequence: Synthetic oligonucleotide
  Target: SCN9A; (-) strand; PAM type: YTN; PAM sequence: CTT
gtactaagagaaacataatt

SEQ ID NO: 75397 - DNA, 20 bp, Artificial Sequence
  Description of Artificial Sequence: Synthetic oligonucleotide
  Target: SCN9A; (-) strand; PAM type: YTN; PAM sequence: TTG
agaaggcttgtactaagaga

SEQ ID NO: 75398 - DNA, 20 bp, Artificial Sequence
  Description of Artificial Sequence: Synthetic oligonucleotide
  Target: SCN9A; (-) strand; PAM type: YTN; PAM sequence: TTT
gagaaggcttgtactaagag

SEQ ID NO: 75399 - DNA, 20 bp, Artificial Sequence
  Description of Artificial Sequence: Synthetic oligonucleotide
  Target: SCN9A; (-) strand; PAM type: YTN; PAM sequence: TTC
agtgtaaatgtttgagaagg

SEQ ID NO: 75400 - DNA, 20 bp, Artificial Sequence
  Description of Artificial Sequence: Synthetic oligonucleotide
  Target: SCN9A; (-) strand; PAM type: YTN; PAM sequence: CTT
cagtgtaaatgtttgagaag

SEQ ID NO: 75401 - DNA, 20 bp, Artificial Sequence
  Description of Artificial Sequence: Synthetic oligonucleotide
  Target: SCN9A; (-) strand; PAM type: YTN; PAM sequence: TTC
ttcagtgtaaatgtttgaga

SEQ ID NO: 75402 - DNA, 20 bp, Artificial Sequence
  Description of Artificial Sequence: Synthetic oligonucleotide
  Target: SCN9A; (-) strand; PAM type: YTN; PAM sequence: TTC
cagagagattcttcagtgta

SEQ ID NO: 75403 - DNA, 20 bp, Artificial Sequence
  Description of Artificial Sequence: Synthetic oligonucleotide
  Target: SCN9A; (-) strand; PAM type: YTN; PAM sequence: TTT
ccagagagattcttcagtgt

SEQ ID NO: 75404 - DNA, 20 bp, Artificial Sequence
  Description of Artificial Sequence: Synthetic oligonucleotide
  Target: SCN9A; (-) strand; PAM type: YTN; PAM sequence: CTT
tccagagagattcttcagtg

SEQ ID NO: 75405 - DNA, 20 bp, Artificial Sequence
  Description of Artificial Sequence: Synthetic oligonucleotide
  Target: SCN9A; (-) strand; PAM type: YTN; PAM sequence: CTC
tttccagagagattcttcag

SEQ ID NO: 75406 - DNA, 20 bp, Artificial Sequence
  Description of Artificial Sequence: Synthetic oligonucleotide
  Target: SCN9A; (-) strand; PAM type: YTN; PAM sequence: TTA
atcctctttccagagagatt

SEQ ID NO: 75407 - DNA, 20 bp, Artificial Sequence
  Description of Artificial Sequence: Synthetic oligonucleotide
  Target: SCN9A; (-) strand; PAM type: YTN; PAM sequence: CTT
aatcctctttccagagagat

SEQ ID NO: 75408 - DNA, 20 bp, Artificial Sequence
  Description of Artificial Sequence: Synthetic oligonucleotide
  Target: SCN9A; (-) strand; PAM type: YTN; PAM sequence: CTC
cttaatcctctttccagaga

SEQ ID NO: 75409 - DNA, 20 bp, Artificial Sequence
  Description of Artificial Sequence: Synthetic oligonucleotide
  Target: SCN9A; (-) strand; PAM type: YTN; PAM sequence: TTC
ctccttaatcctctttccag

SEQ ID NO: 75410 - DNA, 20 bp, Artificial Sequence
  Description of Artificial Sequence: Synthetic oligonucleotide
  Target: SCN9A; (-) strand; PAM type: YTN; PAM sequence: TTT
cctccttaatcctctttcca

SEQ ID NO: 75411 - DNA, 20 bp, Artificial Sequence
  Description of Artificial Sequence: Synthetic oligonucleotide
  Target: SCN9A; (-) strand; PAM type: YTN; PAM sequence: CTC
gaaagtttcctccttaatcc

SEQ ID NO: 75412 - DNA, 20 bp, Artificial Sequence
  Description of Artificial Sequence: Synthetic oligonucleotide
  Target: SCN9A; (-) strand; PAM type: YTN; PAM sequence: TTC
tcgaaagtttcctccttaat

SEQ ID NO: 75413 - DNA, 20 bp, Artificial Sequence
  Description of Artificial Sequence: Synthetic oligonucleotide
  Target: SCN9A; (-) strand; PAM type: YTN; PAM sequence: TTG
tcatagattctcgaaagttt

SEQ ID NO: 75414 - DNA, 20 bp, Artificial Sequence
  Description of Artificial Sequence: Synthetic oligonucleotide
  Target: SCN9A; (-) strand; PAM type: YTN; PAM sequence: TTA
ggttgtcatagattctcgaa

SEQ ID NO: 75415 - DNA, 20 bp, Artificial Sequence
  Description of Artificial Sequence: Synthetic oligonucleotide
  Target: SCN9A; (-) strand; PAM type: YTN; PAM sequence: TTT
aggttgtcatagattctcga

SEQ ID NO: 75416 - DNA, 20 bp, Artificial Sequence
  Description of Artificial Sequence: Synthetic oligonucleotide
  Target: SCN9A; (-) strand; PAM type: YTN; PAM sequence: CTA
atttaggttgtcatagattc

SEQ ID NO: 75417 - DNA, 20 bp, Artificial Sequence
  Description of Artificial Sequence: Synthetic oligonucleotide
  Target: SCN9A; (-) strand; PAM type: YTN; PAM sequence: TTG
gtgtggctaatttaggttgt

SEQ ID NO: 75418 - DNA, 20 bp, Artificial Sequence
  Description of Artificial Sequence: Synthetic oligonucleotide
  Target: SCN9A; (-) strand; PAM type: YTN; PAM sequence: TTT
ggtgtggctaatttaggttg

SEQ ID NO: 75419 - DNA, 20 bp, Artificial Sequence
  Description of Artificial Sequence: Synthetic oligonucleotide
  Target: SCN9A; (-) strand; PAM type: YTN; PAM sequence: TTT
tggtgtggctaatttaggtt

SEQ ID NO: 75420 - DNA, 20 bp, Artificial Sequence
  Description of Artificial Sequence: Synthetic oligonucleotide
  Target: SCN9A; (-) strand; PAM type: YTN; PAM sequence: TTA
agaaaataattttggtgtgg

SEQ ID NO: 75421 - DNA, 20 bp, Artificial Sequence
  Description of Artificial Sequence: Synthetic oligonucleotide
  Target: SCN9A; (-) strand; PAM type: YTN; PAM sequence: TTA
agataaaacatgagatatta

SEQ ID NO: 75422 - DNA, 20 bp, Artificial Sequence
  Description of Artificial Sequence: Synthetic oligonucleotide
  Target: SCN9A; (-) strand; PAM type: YTN; PAM sequence: TTT
aagataaaacatgagatatt

SEQ ID NO: 75423 - DNA, 20 bp, Artificial Sequence
  Description of Artificial Sequence: Synthetic oligonucleotide
  Target: SCN9A; (-) strand; PAM type: YTN; PAM sequence: TTT
taagataaaacatgagatat

SEQ ID NO: 75424 - DNA, 20 bp, Artificial Sequence
  Description of Artificial Sequence: Synthetic oligonucleotide
  Target: SCN9A; (-) strand; PAM type: YTN; PAM sequence: TTT
ttaagataaaacatgagata

SEQ ID NO: 75425 - DNA, 20 bp, Artificial Sequence
  Description of Artificial Sequence: Synthetic oligonucleotide
  Target: SCN9A; (-) strand; PAM type: YTN; PAM sequence: TTA
atgtcacaaggatttttaag

SEQ ID NO: 75426 - DNA, 20 bp, Artificial Sequence
  Description of Artificial Sequence: Synthetic oligonucleotide
  Target: SCN9A; (-) strand; PAM type: YTN; PAM sequence: TTG
ttaatgtcacaaggattttt

SEQ ID NO: 75427 - DNA, 20 bp, Artificial Sequence
  Description of Artificial Sequence: Synthetic oligonucleotide
  Target: SCN9A; (-) strand; PAM type: YTN; PAM sequence: TTT
gttaatgtcacaaggatttt

SEQ ID NO: 75428 - DNA, 20 bp, Artificial Sequence
  Description of Artificial Sequence: Synthetic oligonucleotide
  Target: SCN9A; (-) strand; PAM type: YTN; PAM sequence: TTT
tgttaatgtcacaaggattt

SEQ ID NO: 75429 - DNA, 20 bp, Artificial Sequence
  Description of Artificial Sequence: Synthetic oligonucleotide
  Target: SCN9A; (-) strand; PAM type: YTN; PAM sequence: CTA
aaacagtgcatcatgttttg

SEQ ID NO: 75430 - DNA, 20 bp, Artificial Sequence
  Description of Artificial Sequence: Synthetic oligonucleotide
  Target: SCN9A; (-) strand; PAM type: YTN; PAM sequence: CTA
tggggtatgactaaaacagt

SEQ ID NO: 75431 - DNA, 20 bp, Artificial Sequence
  Description of Artificial Sequence: Synthetic oligonucleotide
  Target: SCN9A; (-) strand; PAM type: YTN; PAM sequence: TTC
tatggggtatgactaaaaca

SEQ ID NO: 75432 - DNA, 20 bp, Artificial Sequence
  Description of Artificial Sequence: Synthetic oligonucleotide
  Target: SCN9A; (-) strand; PAM type: YTN; PAM sequence: CTT
ctatggggtatgactaaaac

SEQ ID NO: 75433 - DNA, 20 bp, Artificial Sequence
  Description of Artificial Sequence: Synthetic oligonucleotide
  Target: SCN9A; (-) strand; PAM type: YTN; PAM sequence: CTC
ttctatggggtatgactaaa

SEQ ID NO: 75434 - DNA, 20 bp, Artificial Sequence
  Description of Artificial Sequence: Synthetic oligonucleotide
  Target: SCN9A; (-) strand; PAM type: YTN; PAM sequence: TTA
acagatactcttctatgggg

SEQ ID NO: 75435 - DNA, 20 bp, Artificial Sequence
  Description of Artificial Sequence: Synthetic oligonucleotide
  Target: SCN9A; (-) strand; PAM type: YTN; PAM sequence: TTA
aaattaacagatactcttct

SEQ ID NO: 75436 - DNA, 20 bp, Artificial Sequence
  Description of Artificial Sequence: Synthetic oligonucleotide
  Target: SCN9A; (-) strand; PAM type: YTN; PAM sequence: TTA
acgttaaaattaacagatac

SEQ ID NO: 75437 - DNA, 20 bp, Artificial Sequence
  Description of Artificial Sequence: Synthetic oligonucleotide
  Target: SCN9A; (-) strand; PAM type: YTN; PAM sequence: TTT
aacgttaaaattaacagata

SEQ ID NO: 75438 - DNA, 20 bp, Artificial Sequence
  Description of Artificial Sequence: Synthetic oligonucleotide
  Target: SCN9A; (-) strand; PAM type: YTN; PAM sequence: TTT
taacgttaaaattaacagat

SEQ ID NO: 75439 - DNA, 20 bp, Artificial Sequence
  Description of Artificial Sequence: Synthetic oligonucleotide
  Target: SCN9A; (-) strand; PAM type: YTN; PAM sequence: TTA
ttttaacgttaaaattaaca

SEQ ID NO: 75440 - DNA, 20 bp, Artificial Sequence
  Description of Artificial Sequence: Synthetic oligonucleotide
  Target: SCN9A; (-) strand; PAM type: YTN; PAM sequence: TTC
atgaaaattattttaacgtt

SEQ ID NO: 75441 - DNA, 20 bp, Artificial Sequence
  Description of Artificial Sequence: Synthetic oligonucleotide
  Target: SCN9A; (-) strand; PAM type: YTN; PAM sequence: TTT
catgaaaattattttaacgt

SEQ ID NO: 75442 - DNA, 20 bp, Artificial Sequence
  Description of Artificial Sequence: Synthetic oligonucleotide
  Target: SCN9A; (-) strand; PAM type: YTN; PAM sequence: TTG
tatacagtggtttcatgaaa

SEQ ID NO: 75443 - DNA, 20 bp, Artificial Sequence
  Description of Artificial Sequence: Synthetic oligonucleotide
  Target: SCN9A; (-) strand; PAM type: YTN; PAM sequence: TTC
cccagagtaccaattgtata

SEQ ID NO: 75444 - DNA, 20 bp, Artificial Sequence
  Description of Artificial Sequence: Synthetic oligonucleotide
  Target: SCN9A; (-) strand; PAM type: YTN; PAM sequence: TTT
ccccagagtaccaattgtat

SEQ ID NO: 75445 - DNA, 20 bp, Artificial Sequence
  Description of Artificial Sequence: Synthetic oligonucleotide
  Target: SCN9A; (-) strand; PAM type: YTN; PAM sequence: TTA
tatatatatacaatatatat

SEQ ID NO: 75446 - DNA, 20 bp, Artificial Sequence
  Description of Artificial Sequence: Synthetic oligonucleotide
  Target: SCN9A; (-) strand; PAM type: YTN; PAM sequence: TTT
atatatatatacaatatata

SEQ ID NO: 75447 - DNA, 20 bp, Artificial Sequence
  Description of Artificial Sequence: Synthetic oligonucleotide
  Target: SCN9A; (-) strand; PAM type: YTN; PAM sequence: CTC
aatttatatatatatacaat

SEQ ID NO: 75448 - DNA, 20 bp, Artificial Sequence
  Description of Artificial Sequence: Synthetic oligonucleotide
  Target: SCN9A; (-) strand; PAM type: YTN; PAM sequence: TTA
aataatatagtcagatatat

SEQ ID NO: 75449 - DNA, 20 bp, Artificial Sequence
  Description of Artificial Sequence: Synthetic oligonucleotide
  Target: SCN9A; (-) strand; PAM type: YTN; PAM sequence: TTG
attaaataatatagtcagat

SEQ ID NO: 75450 - DNA, 20 bp, Artificial Sequence
  Description of Artificial Sequence: Synthetic oligonucleotide
  Target: SCN9A; (-) strand; PAM type: YTN; PAM sequence: TTA
gaataattgattaaataata

SEQ ID NO: 75451 - DNA, 20 bp, Artificial Sequence
  Description of Artificial Sequence: Synthetic oligonucleotide
  Target: SCN9A; (-) strand; PAM type: YTN; PAM sequence: TTT
agaataattgattaaataat

SEQ ID NO: 75452 - DNA, 20 bp, Artificial Sequence
  Description of Artificial Sequence: Synthetic oligonucleotide
  Target: SCN9A; (-) strand; PAM type: YTN; PAM sequence: TTT
tagaataattgattaaataa

SEQ ID NO: 75453 - DNA, 20 bp, Artificial Sequence
  Description of Artificial Sequence: Synthetic oligonucleotide
  Target: SCN9A; (-) strand; PAM type: YTN; PAM sequence: CTT
ttagaataattgattaaata

SEQ ID NO: 75454 - DNA, 20 bp, Artificial Sequence
  Description of Artificial Sequence: Synthetic oligonucleotide
  Target: SCN9A; (-) strand; PAM type: YTN; PAM sequence: TTA
tatcatgaggaaaaatcttt

SEQ ID NO: 75455 - DNA, 20 bp, Artificial Sequence
  Description of Artificial Sequence: Synthetic oligonucleotide
  Target: SCN9A; (-) strand; PAM type: YTN; PAM sequence: TTA
ttatatcatgaggaaaaatc

SEQ ID NO: 75456 - DNA, 20 bp, Artificial Sequence
  Description of Artificial Sequence: Synthetic oligonucleotide
  Target: SCN9A; (-) strand; PAM type: YTN; PAM sequence: TTA
aattattatatcatgaggaa

SEQ ID NO: 75457 - DNA, 20 bp, Artificial Sequence
  Description of Artificial Sequence: Synthetic oligonucleotide
  Target: SCN9A; (-) strand; PAM type: YTN; PAM sequence: TTT
aaattattatatcatgagga
